United States Patent 12,545,960 (METHODS FOR SIMULTANEOUS AMPLIFICATION OF TARGET LOCI) - sequence listing, part 2

SEQ ID NO: 16821 - DNA, 25 bp, synthetic construct
  misc_feature 1..25: note = Synthetic Construct
  source 1..25: mol_type = other DNA
cccttcctttttctaccttgtgtgt

SEQ ID NO: 16822 - DNA, 23 bp, synthetic construct
  misc_feature 1..23: note = Synthetic Construct
  source 1..23: mol_type = other DNA
cccacctctcccagagtatgtca

SEQ ID NO: 16823 - DNA, 21 bp, synthetic construct
  misc_feature 1..21: note = Synthetic Construct
  source 1..21: mol_type = other DNA
gcctcagtcagcttcctccaa

SEQ ID NO: 16824 - DNA, 21 bp, synthetic construct
  misc_feature 1..21: note = Synthetic Construct
  source 1..21: mol_type = other DNA
atggggaaggaggcccaggaa

SEQ ID NO: 16825 - DNA, 23 bp, synthetic construct
  misc_feature 1..23: note = Synthetic Construct
  source 1..23: mol_type = other DNA
cagccaaacttctgcatgactct

SEQ ID NO: 16826 - DNA, 20 bp, synthetic construct
  misc_feature 1..20: note = Synthetic Construct
  source 1..20: mol_type = other DNA
aggctgaacagctgcagaga

SEQ ID NO: 16827 - DNA, 20 bp, synthetic construct
  misc_feature 1..20: note = Synthetic Construct
  source 1..20: mol_type = other DNA
gccgctgacatgcttccaaa

SEQ ID NO: 16828 - DNA, 21 bp, synthetic construct
  misc_feature 1..21: note = Synthetic Construct
  source 1..21: mol_type = other DNA
tgggcggagtgccaagtaatg

SEQ ID NO: 16829 - DNA, 26 bp, synthetic construct
  misc_feature 1..26: note = Synthetic Construct
  source 1..26: mol_type = other DNA
catgaccttcgtgattacttgcatga

SEQ ID NO: 16830 - DNA, 23 bp, synthetic construct
  misc_feature 1..23: note = Synthetic Construct
  source 1..23: mol_type = other DNA
gccaattggtgcaagagatcaca

SEQ ID NO: 16831 - DNA, 22 bp, synthetic construct
  misc_feature 1..22: note = Synthetic Construct
  source 1..22: mol_type = other DNA
aggtgtgaagtgaccacaaagt

SEQ ID NO: 16832 - DNA, 20 bp, synthetic construct
  misc_feature 1..20: note = Synthetic Construct
  source 1..20: mol_type = other DNA
acccctcattctgcgcactt

SEQ ID NO: 16833 - DNA, 23 bp, synthetic construct
  misc_feature 1..23: note = Synthetic Construct
  source 1..23: mol_type = other DNA
tcctctgtacctgtcccctcttc

SEQ ID NO: 16834 - DNA, 21 bp, synthetic construct
  misc_feature 1..21: note = Synthetic Construct
  source 1..21: mol_type = other DNA
caagcaacactcccacctttg

SEQ ID NO: 16835 - DNA, 19 bp, synthetic construct
  misc_feature 1..19: note = Synthetic Construct
  source 1..19: mol_type = other DNA
agggccgaccgtggttttc

SEQ ID NO: 16836 - DNA, 24 bp, synthetic construct
  misc_feature 1..24: note = Synthetic Construct
  source 1..24: mol_type = other DNA
ctccatccagtgcttaaagctgat

SEQ ID NO: 16837 - DNA, 27 bp, synthetic construct
  misc_feature 1..27: note = Synthetic Construct
  source 1..27: mol_type = other DNA
gaggaagaggctaaatgtctagagaag

SEQ ID NO: 16838 - DNA, 24 bp, synthetic construct
  misc_feature 1..24: note = Synthetic Construct
  source 1..24: mol_type = other DNA
gcactaggactccccagtactctt

SEQ ID NO: 16839 - DNA, 24 bp, synthetic construct
  misc_feature 1..24: note = Synthetic Construct
  source 1..24: mol_type = other DNA
cacataggcagcacagtcatggat

SEQ ID NO: 16840 - DNA, 21 bp, synthetic construct
  misc_feature 1..21: note = Synthetic Construct
  source 1..21: mol_type = other DNA
gtgcctgccaagagaacatct

SEQ ID NO: 16841 - DNA, 22 bp, synthetic construct
  misc_feature 1..22: note = Synthetic Construct
  source 1..22: mol_type = other DNA
tccctttggacaacagggtagt

SEQ ID NO: 16842 - DNA, 18 bp, synthetic construct
  misc_feature 1..18: note = Synthetic Construct
  source 1..18: mol_type = other DNA
acactcgcaggccactga

SEQ ID NO: 16843 - DNA, 23 bp, synthetic construct
  misc_feature 1..23: note = Synthetic Construct
  source 1..23: mol_type = other DNA
ggccccaggaagactagtcagat

SEQ ID NO: 16844 - DNA, 23 bp, synthetic construct
  misc_feature 1..23: note = Synthetic Construct
  source 1..23: mol_type = other DNA
gccacctctcactctcttgatct

SEQ ID NO: 16845 - DNA, 24 bp, synthetic construct
  misc_feature 1..24: note = Synthetic Construct
  source 1..24: mol_type = other DNA
gaacaaccttccaagttggtctca

SEQ ID NO: 16846 - DNA, 27 bp, synthetic construct
  misc_feature 1..27: note = Synthetic Construct
  source 1..27: mol_type = other DNA
gatgatgtcattaaggtggggaatttg

SEQ ID NO: 16847 - DNA, 23 bp, synthetic construct
  misc_feature 1..23: note = Synthetic Construct
  source 1..23: mol_type = other DNA
gcctagaagatgctgccccttag

SEQ ID NO: 16848 - DNA, 22 bp, synthetic construct
  misc_feature 1..22: note = Synthetic Construct
  source 1..22: mol_type = other DNA
tgggcagagatgaggaccaaca

SEQ ID NO: 16849 - DNA, 23 bp, synthetic construct
  misc_feature 1..23: note = Synthetic Construct
  source 1..23: mol_type = other DNA
ggaaaggggcagcaagaatgaga

SEQ ID NO: 16850 - DNA, 22 bp, synthetic construct
  misc_feature 1..22: note = Synthetic Construct
  source 1..22: mol_type = other DNA
gctcttccgccatgggataatg

SEQ ID NO: 16851 - DNA, 23 bp, synthetic construct
  misc_feature 1..23: note = Synthetic Construct
  source 1..23: mol_type = other DNA
ccaacccactgcaacaactgcta

SEQ ID NO: 16852 - DNA, 20 bp, synthetic construct
  misc_feature 1..20: note = Synthetic Construct
  source 1..20: mol_type = other DNA
tcctggccagcaaaggcaat

SEQ ID NO: 16853 - DNA, 20 bp, synthetic construct
  misc_feature 1..20: note = Synthetic Construct
  source 1..20: mol_type = other DNA
tccagctcagtccctcttgt

SEQ ID NO: 16854 - DNA, 22 bp, synthetic construct
  misc_feature 1..22: note = Synthetic Construct
  source 1..22: mol_type = other DNA
ggttaatggctgccctcctact

SEQ ID NO: 16855 - DNA, 20 bp, synthetic construct
  misc_feature 1..20: note = Synthetic Construct
  source 1..20: mol_type = other DNA
tcagctgtgccccactaaca

SEQ ID NO: 16856 - DNA, 22 bp, synthetic construct
  misc_feature 1..22: note = Synthetic Construct
  source 1..22: mol_type = other DNA
caggtgtgtcatctccctggtt

SEQ ID NO: 16857 - DNA, 26 bp, synthetic construct
  misc_feature 1..26: note = Synthetic Construct
  source 1..26: mol_type = other DNA
cttctcgaaggctatcctaactgttt

SEQ ID NO: 16858 - DNA, 19 bp, synthetic construct
  misc_feature 1..19: note = Synthetic Construct
  source 1..19: mol_type = other DNA
tggagggagcggctgattg

SEQ ID NO: 16859 - DNA, 22 bp, synthetic construct
  misc_feature 1..22: note = Synthetic Construct
  source 1..22: mol_type = other DNA
agtagtggggcaatggggagaa

SEQ ID NO: 16860 - DNA, 22 bp, synthetic construct
  misc_feature 1..22: note = Synthetic Construct
  source 1..22: mol_type = other DNA
agcccatagccctgtggttact

SEQ ID NO: 16861 - DNA, 22 bp, synthetic construct
  misc_feature 1..22: note = Synthetic Construct
  source 1..22: mol_type = other DNA
gctgtgcctgttgtcagcaatg

SEQ ID NO: 16862 - DNA, 22 bp, synthetic construct
  misc_feature 1..22: note = Synthetic Construct
  source 1..22: mol_type = other DNA
catgaagtggccaccctgtttg

SEQ ID NO: 16863 - DNA, 20 bp, synthetic construct
  misc_feature 1..20: note = Synthetic Construct
  source 1..20: mol_type = other DNA
gccctcagcttcctgagcta

SEQ ID NO: 16864 - DNA, 21 bp, synthetic construct
  misc_feature 1..21: note = Synthetic Construct
  source 1..21: mol_type = other DNA
ctctgcttgctctctgtgctt

SEQ ID NO: 16865 - DNA, 24 bp, synthetic construct
  misc_feature 1..24: note = Synthetic Construct
  source 1..24: mol_type = other DNA
tggtgaagaggtcccctaaattct

SEQ ID NO: 16866 - DNA, 24 bp, synthetic construct
  misc_feature 1..24: note = Synthetic Construct
  source 1..24: mol_type = other DNA
tggctgtcctccaaattggttatc

SEQ ID NO: 16867 - DNA, 21 bp, synthetic construct
  misc_feature 1..21: note = Synthetic Construct
  source 1..21: mol_type = other DNA
actggaggcagcacctggatt

SEQ ID NO: 16868 - DNA, 27 bp, synthetic construct
  misc_feature 1..27: note = Synthetic Construct
  source 1..27: mol_type = other DNA
ctggagagcttttctctactggagcta

SEQ ID NO: 16869 - DNA, 22 bp, synthetic construct
  misc_feature 1..22: note = Synthetic Construct
  source 1..22: mol_type = other DNA
ccttggcctcttacccttcctt

SEQ ID NO: 16870 - DNA, 20 bp, synthetic construct
  misc_feature 1..20: note = Synthetic Construct
  source 1..20: mol_type = other DNA
ccttctcagcgctcctcctt

SEQ ID NO: 16871 - DNA, 20 bp, synthetic construct
  misc_feature 1..20: note = Synthetic Construct
  source 1..20: mol_type = other DNA
gctccttgcactcccatctt

SEQ ID NO: 16872 - DNA, 19 bp, synthetic construct
  misc_feature 1..19: note = Synthetic Construct
  source 1..19: mol_type = other DNA
gagcccaaagcggccaatg

SEQ ID NO: 16873 - DNA, 22 bp, synthetic construct
  misc_feature 1..22: note = Synthetic Construct
  source 1..22: mol_type = other DNA
gaccaacccaactctccccatt

SEQ ID NO: 16874 - DNA, 20 bp, synthetic construct
  misc_feature 1..20: note = Synthetic Construct
  source 1..20: mol_type = other DNA
tcgcgcagaggccacaatta

SEQ ID NO: 16875 - DNA, 22 bp, synthetic construct
  misc_feature 1..22: note = Synthetic Construct
  source 1..22: mol_type = other DNA
gatgcaggagtgcctgtggaat

SEQ ID NO: 16876 - DNA, 20 bp, synthetic construct
  misc_feature 1..20: note = Synthetic Construct
  source 1..20: mol_type = other DNA
acggtggctgcttctccttt

SEQ ID NO: 16877 - DNA, 18 bp, synthetic construct
  misc_feature 1..18: note = Synthetic Construct
  source 1..18: mol_type = other DNA
aggctcggggacactcaa

SEQ ID NO: 16878 - DNA, 22 bp, synthetic construct
  misc_feature 1..22: note = Synthetic Construct
  source 1..22: mol_type = other DNA
cctctgagagttgcctgcacaa

SEQ ID NO: 16879 - DNA, 20 bp, synthetic construct
  misc_feature 1..20: note = Synthetic Construct
  source 1..20: mol_type = other DNA
tgcccacctccccgctttct

SEQ ID NO: 16880 - DNA, 25 bp, synthetic construct
  misc_feature 1..25: note = Synthetic Construct
  source 1..25: mol_type = other DNA
ccaagccagagggaatttgtctatc

SEQ ID NO: 16881 - DNA, 20 bp, synthetic construct
  misc_feature 1..20: note = Synthetic Construct
  source 1..20: mol_type = other DNA
tcgttgaccctgccatgagt

SEQ ID NO: 16882 - DNA, 23 bp, synthetic construct
  misc_feature 1..23: note = Synthetic Construct
  source 1..23: mol_type = other DNA
aggggaggacacagagtatttca

SEQ ID NO: 16883 - DNA, 24 bp, synthetic construct
  misc_feature 1..24: note = Synthetic Construct
  source 1..24: mol_type = other DNA
gggagacaccagttaagtggctaa

SEQ ID NO: 16884 - DNA, 22 bp, synthetic construct
  misc_feature 1..22: note = Synthetic Construct
  source 1..22: mol_type = other DNA
gacacctagcggtgacttctga

SEQ ID NO: 16885 - DNA, 20 bp, synthetic construct
  misc_feature 1..20: note = Synthetic Construct
  source 1..20: mol_type = other DNA
caaagcaggcagccatctca

SEQ ID NO: 16886 - DNA, 21 bp, synthetic construct
  misc_feature 1..21: note = Synthetic Construct
  source 1..21: mol_type = other DNA
tggacagagtgccccacagat

SEQ ID NO: 16887 - DNA, 24 bp, synthetic construct
  misc_feature 1..24: note = Synthetic Construct
  source 1..24: mol_type = other DNA
gagctcccatgttctttcttggat

SEQ ID NO: 16888 - DNA, 22 bp, synthetic construct
  misc_feature 1..22: note = Synthetic Construct
  source 1..22: mol_type = other DNA
tctgccctgtgaggaggatgaa

SEQ ID NO: 16889 - DNA, 19 bp, synthetic construct
  misc_feature 1..19: note = Synthetic Construct
  source 1..19: mol_type = other DNA
agagctgggagggcagtga

SEQ ID NO: 16890 - DNA, 20 bp, synthetic construct
  misc_feature 1..20: note = Synthetic Construct
  source 1..20: mol_type = other DNA
gcacaggaaggaggtgcaaa

SEQ ID NO: 16891 - DNA, 20 bp, synthetic construct
  misc_feature 1..20: note = Synthetic Construct
  source 1..20: mol_type = other DNA
gcccaaatgggcccctctac

SEQ ID NO: 16892 - DNA, 24 bp, synthetic construct
  misc_feature 1..24: note = Synthetic Construct
  source 1..24: mol_type = other DNA
atctgtgcatgtatggcttcaaac

SEQ ID NO: 16893 - DNA, 22 bp, synthetic construct
  misc_feature 1..22: note = Synthetic Construct
  source 1..22: mol_type = other DNA
acaaagacactgccgttactca

SEQ ID NO: 16894 - DNA, 25 bp, synthetic construct
  misc_feature 1..25: note = Synthetic Construct
  source 1..25: mol_type = other DNA
gcctacatgtatgggaagggagcta

SEQ ID NO: 16895 - DNA, 23 bp, synthetic construct
  misc_feature 1..23: note = Synthetic Construct
  source 1..23: mol_type = other DNA
gggtggatagaaaccaaggcata

SEQ ID NO: 16896 - DNA, 26 bp, synthetic construct
  misc_feature 1..26: note = Synthetic Construct
  source 1..26: mol_type = other DNA
gtgtcataaacccttactggggagaa

SEQ ID NO: 16897 - DNA, 20 bp, synthetic construct
  misc_feature 1..20: note = Synthetic Construct
  source 1..20: mol_type = other DNA
tcccagggagctctgctttg

SEQ ID NO: 16898 - DNA, 21 bp, synthetic construct
  misc_feature 1..21: note = Synthetic Construct
  source 1..21: mol_type = other DNA
cagtgtcccaggcccttgtag

SEQ ID NO: 16899 - DNA, 24 bp, synthetic construct
  misc_feature 1..24: note = Synthetic Construct
  source 1..24: mol_type = other DNA
cctggagcctgagattgtgggatt

SEQ ID NO: 16900 - DNA, 25 bp, synthetic construct
  misc_feature 1..25: note = Synthetic Construct
  source 1..25: mol_type = other DNA
ggcttacgggtaagaacaggacaaa

SEQ ID NO: 16901 - DNA, 22 bp, synthetic construct
  misc_feature 1..22: note = Synthetic Construct
  source 1..22: mol_type = other DNA
gtgagtgcagcttcagcggatt

SEQ ID NO: 16902 - DNA, 21 bp, synthetic construct
  misc_feature 1..21: note = Synthetic Construct
  source 1..21: mol_type = other DNA
ccaccattgccctggttcaga

SEQ ID NO: 16903 - DNA, 24 bp, synthetic construct
  misc_feature 1..24: note = Synthetic Construct
  source 1..24: mol_type = other DNA
gcttccctccagttccagtaagaa

SEQ ID NO: 16904 - DNA, 26 bp, synthetic construct
  misc_feature 1..26: note = Synthetic Construct
  source 1..26: mol_type = other DNA
ccagataaccctcacaataggtttct

SEQ ID NO: 16905 - DNA, 26 bp, synthetic construct
  misc_feature 1..26: note = Synthetic Construct
  source 1..26: mol_type = other DNA
gaagcctatcaggagctttgtgagtt

SEQ ID NO: 16906 - DNA, 23 bp, synthetic construct
  misc_feature 1..23: note = Synthetic Construct
  source 1..23: mol_type = other DNA
gcccctactcaagggtgcactaa

SEQ ID NO: 16907 - DNA, 20 bp, synthetic construct
  misc_feature 1..20: note = Synthetic Construct
  source 1..20: mol_type = other DNA
ggcctgagacgagagcatgt

SEQ ID NO: 16908 - DNA, 22 bp, synthetic construct
  misc_feature 1..22: note = Synthetic Construct
  source 1..22: mol_type = other DNA
ccaaagtggtttggggcatttc

SEQ ID NO: 16909 - DNA, 21 bp, synthetic construct
  misc_feature 1..21: note = Synthetic Construct
  source 1..21: mol_type = other DNA
caggacccctttcgtctccat

SEQ ID NO: 16910 - DNA, 23 bp, synthetic construct
  misc_feature 1..23: note = Synthetic Construct
  source 1..23: mol_type = other DNA
aaaagaggccctgaagggattac

SEQ ID NO: 16911 - DNA, 24 bp, synthetic construct
  misc_feature 1..24: note = Synthetic Construct
  source 1..24: mol_type = other DNA
caccaacatggaccactcagctat

SEQ ID NO: 16912 - DNA, 22 bp, synthetic construct
  misc_feature 1..22: note = Synthetic Construct
  source 1..22: mol_type = other DNA
ggctctagcctcagctcaaagt

SEQ ID NO: 16913 - DNA, 20 bp, synthetic construct
  misc_feature 1..20: note = Synthetic Construct
  source 1..20: mol_type = other DNA
aagccctggatgtggagtca

SEQ ID NO: 16914 - DNA, 19 bp, synthetic construct
  misc_feature 1..19: note = Synthetic Construct
  source 1..19: mol_type = other DNA
gagccccacactggacact

SEQ ID NO: 16915 - DNA, 26 bp, synthetic construct
  misc_feature 1..26: note = Synthetic Construct
  source 1..26: mol_type = other DNA
gcaggtagcaatacaaatccagttca

SEQ ID NO: 16916 - DNA, 22 bp, synthetic construct
  misc_feature 1..22: note = Synthetic Construct
  source 1..22: mol_type = other DNA
ggccattatgtgctggggattg

SEQ ID NO: 16917 - DNA, 20 bp, synthetic construct
  misc_feature 1..20: note = Synthetic Construct
  source 1..20: mol_type = other DNA
ttcagccggtggtcctgaca

SEQ ID NO: 16918 - DNA, 20 bp, synthetic construct
  misc_feature 1..20: note = Synthetic Construct
  source 1..20: mol_type = other DNA
tcaggcgaccatcaggtgaa

SEQ ID NO: 16919 - DNA, 20 bp, synthetic construct
  misc_feature 1..20: note = Synthetic Construct
  source 1..20: mol_type = other DNA
taatggcccacggcgggata

SEQ ID NO: 16920 - DNA, 20 bp, synthetic construct
  misc_feature 1..20: note = Synthetic Construct
  source 1..20: mol_type = other DNA
ctggccaaatcccacccaaa

SEQ ID NO: 16921 - DNA, 23 bp, synthetic construct
  misc_feature 1..23: note = Synthetic Construct
  source 1..23: mol_type = other DNA
ggttttgggaagggcagtggaat

SEQ ID NO: 16922 - DNA, 21 bp, synthetic construct
  misc_feature 1..21: note = Synthetic Construct
  source 1..21: mol_type = other DNA
cgaaggcaccatgccagtgtt

SEQ ID NO: 16923 - DNA, 22 bp, synthetic construct
  misc_feature 1..22: note = Synthetic Construct
  source 1..22: mol_type = other DNA
cctgggaaagacgctaccttgt

SEQ ID NO: 16924 - DNA, 20 bp, synthetic construct
  misc_feature 1..20: note = Synthetic Construct
  source 1..20: mol_type = other DNA
atgggcttgtggtcctctct

SEQ ID NO: 16925 - DNA, 22 bp, synthetic construct
  misc_feature 1..22: note = Synthetic Construct
  source 1..22: mol_type = other DNA
cgagctgtcaacgccgtaattc

SEQ ID NO: 16926 - DNA, 24 bp, synthetic construct
  misc_feature 1..24: note = Synthetic Construct
  source 1..24: mol_type = other DNA
cctcaaatgcaggtctgagcacat

SEQ ID NO: 16927 - DNA, 20 bp, synthetic construct
  misc_feature 1..20: note = Synthetic Construct
  source 1..20: mol_type = other DNA
ggcaagaccgtgccagaaag

SEQ ID NO: 16928 - DNA, 27 bp, synthetic construct
  misc_feature 1..27: note = Synthetic Construct
  source 1..27: mol_type = other DNA
cctccttttgcagtagaagttgacaat

SEQ ID NO: 16929 - DNA, 22 bp, synthetic construct
  misc_feature 1..22: note = Synthetic Construct
  source 1..22: mol_type = other DNA
gaggccatagtgagctgtcatc

SEQ ID NO: 16930 - DNA, 21 bp, synthetic construct
  misc_feature 1..21: note = Synthetic Construct
  source 1..21: mol_type = other DNA
cagagtgagtgtgggcacgtt

SEQ ID NO: 16931 - DNA, 23 bp, synthetic construct
  misc_feature 1..23: note = Synthetic Construct
  source 1..23: mol_type = other DNA
ctccaggaaagggctctggtaag

SEQ ID NO: 16932 - DNA, 24 bp, synthetic construct
  misc_feature 1..24: note = Synthetic Construct
  source 1..24: mol_type = other DNA
ggctcaaacaatccttgtgtctca

SEQ ID NO: 16933 - DNA, 24 bp, synthetic construct
  misc_feature 1..24: note = Synthetic Construct
  source 1..24: mol_type = other DNA
gtgttcccataggtaaggcattca

SEQ ID NO: 16934 - DNA, 24 bp, synthetic construct
  misc_feature 1..24: note = Synthetic Construct
  source 1..24: mol_type = other DNA
cctttatgtctgcaggtgtcaatc

SEQ ID NO: 16935 - DNA, 20 bp, synthetic construct
  misc_feature 1..20: note = Synthetic Construct
  source 1..20: mol_type = other DNA
gtgccttacccgtgtctgaa

SEQ ID NO: 16936 - DNA, 23 bp, synthetic construct
  misc_feature 1..23: note = Synthetic Construct
  source 1..23: mol_type = other DNA
gttggagtgcactgagcttcttg

SEQ ID NO: 16937 - DNA, 26 bp, synthetic construct
  misc_feature 1..26: note = Synthetic Construct
  source 1..26: mol_type = other DNA
ggaaccactacaccaaagttgtccta

SEQ ID NO: 16938 - DNA, 24 bp, synthetic construct
  misc_feature 1..24: note = Synthetic Construct
  source 1..24: mol_type = other DNA
ccaggagtaatgcttccagccaaa

SEQ ID NO: 16939 - DNA, 25 bp, synthetic construct
  misc_feature 1..25: note = Synthetic Construct
  source 1..25: mol_type = other DNA
ttccaaagcaaagagacacctctaa

SEQ ID NO: 16940 - DNA, 25 bp, synthetic construct
  misc_feature 1..25: note = Synthetic Construct
  source 1..25: mol_type = other DNA
gctctgtcaagtacgactccaggtt

SEQ ID NO: 16941 - DNA, 24 bp, synthetic construct
  misc_feature 1..24: note = Synthetic Construct
  source 1..24: mol_type = other DNA
gaccatcacaccagattgctttgt

SEQ ID NO: 16942 - DNA, 27 bp, synthetic construct
  misc_feature 1..27: note = Synthetic Construct
  source 1..27: mol_type = other DNA
gcccagagaagccttttagcatttaca

SEQ ID NO: 16943 - DNA, 24 bp, synthetic construct
  misc_feature 1..24: note = Synthetic Construct
  source 1..24: mol_type = other DNA
cagctttgggccctaatgatcaca

SEQ ID NO: 16944 - DNA, 22 bp, synthetic construct
  misc_feature 1..22: note = Synthetic Construct
  source 1..22: mol_type = other DNA
ctggcaggatgagtgttgttgt

SEQ ID NO: 16945 - DNA, 20 bp, synthetic construct
  misc_feature 1..20: note = Synthetic Construct
  source 1..20: mol_type = other DNA
tgacgcggaatggcttactt

SEQ ID NO: 16946 - DNA, 21 bp, synthetic construct
  misc_feature 1..21: note = Synthetic Construct
  source 1..21: mol_type = other DNA
cagcttttgccaggagctcaa

SEQ ID NO: 16947 - DNA, 23 bp, synthetic construct
  misc_feature 1..23: note = Synthetic Construct
  source 1..23: mol_type = other DNA
gctgtaaggactgtgccatgaga

SEQ ID NO: 16948 - DNA, 23 bp, synthetic construct
  misc_feature 1..23: note = Synthetic Construct
  source 1..23: mol_type = other DNA
gaagacagccccaagaagcattt

SEQ ID NO: 16949 - DNA, 22 bp, synthetic construct
  misc_feature 1..22: note = Synthetic Construct
  source 1..22: mol_type = other DNA
ctgctcttccccatcattcact

SEQ ID NO: 16950 - DNA, 22 bp, synthetic construct
  misc_feature 1..22: note = Synthetic Construct
  source 1..22: mol_type = other DNA
cctgctgcaaacctgtgtgaga

SEQ ID NO: 16951 - DNA, 20 bp, synthetic construct
  misc_feature 1..20: note = Synthetic Construct
  source 1..20: mol_type = other DNA
ttttgggaggcgggttctgt

SEQ ID NO: 16952 - DNA, 20 bp, synthetic construct
  misc_feature 1..20: note = Synthetic Construct
  source 1..20: mol_type = other DNA
actctggacagcagcacaag

SEQ ID NO: 16953 - DNA, 22 bp, synthetic construct
  misc_feature 1..22: note = Synthetic Construct
  source 1..22: mol_type = other DNA
cagggagccagaatctctgaag

SEQ ID NO: 16954 - DNA, 20 bp, synthetic construct
  misc_feature 1..20: note = Synthetic Construct
  source 1..20: mol_type = other DNA
gctgaacggaaggacagaca

SEQ ID NO: 16955 - DNA, 21 bp, synthetic construct
  misc_feature 1..21: note = Synthetic Construct
  source 1..21: mol_type = other DNA
ggaatcccgggactggagagt

SEQ ID NO: 16956 - DNA, 20 bp, synthetic construct
  misc_feature 1..20: note = Synthetic Construct
  source 1..20: mol_type = other DNA
agggcccttctgcccagtga

SEQ ID NO: 16957 - DNA, 24 bp, synthetic construct
  misc_feature 1..24: note = Synthetic Construct
  source 1..24: mol_type = other DNA
gccactttcacttccacaccttga

SEQ ID NO: 16958 - DNA, 22 bp, synthetic construct
  misc_feature 1..22: note = Synthetic Construct
  source 1..22: mol_type = other DNA
ggcaccccagaaaagtctagtt

SEQ ID NO: 16959 - DNA, 25 bp, synthetic construct
  misc_feature 1..25: note = Synthetic Construct
  source 1..25: mol_type = other DNA
ccgcctttttgatggtgtcatattt

SEQ ID NO: 16960 - DNA, 20 bp, synthetic construct
  misc_feature 1..20: note = Synthetic Construct
  source 1..20: mol_type = other DNA
ccagtttctccctcgctgtt

SEQ ID NO: 16961 - DNA, 21 bp, synthetic construct
  misc_feature 1..21: note = Synthetic Construct
  source 1..21: mol_type = other DNA
gtgatgctgggctgtgtttac

SEQ ID NO: 16962 - DNA, 21 bp, synthetic construct
  misc_feature 1..21: note = Synthetic Construct
  source 1..21: mol_type = other DNA
ggcttcttcaggcgtgagatt

SEQ ID NO: 16963 - DNA, 20 bp, synthetic construct
  misc_feature 1..20: note = Synthetic Construct
  source 1..20: mol_type = other DNA
ttcgctgctgctcctggaaa

SEQ ID NO: 16964 - DNA, 26 bp, synthetic construct
  misc_feature 1..26: note = Synthetic Construct
  source 1..26: mol_type = other DNA
gacagttgaagtagaaccttccacaa

SEQ ID NO: 16965 - DNA, 23 bp, synthetic construct
  misc_feature 1..23: note = Synthetic Construct
  source 1..23: mol_type = other DNA
gcccaaaatcatgcgttcagcta

SEQ ID NO: 16966 - DNA, 23 bp, synthetic construct
  misc_feature 1..23: note = Synthetic Construct
  source 1..23: mol_type = other DNA
cagtgatctgaggcaatgtctgt

SEQ ID NO: 16967 - DNA, 21 bp, synthetic construct
  misc_feature 1..21: note = Synthetic Construct
  source 1..21: mol_type = other DNA
ggccagtcgcaatcatgtaga

SEQ ID NO: 16968 - DNA, 21 bp, synthetic construct
  misc_feature 1..21: note = Synthetic Construct
  source 1..21: mol_type = other DNA
cctggtcgggtctgtgttact

SEQ ID NO: 16969 - DNA, 25 bp, synthetic construct
  misc_feature 1..25: note = Synthetic Construct
  source 1..25: mol_type = other DNA
cctgcctaacagctgattgaagtct

SEQ ID NO: 16970 - DNA, 23 bp, synthetic construct
  misc_feature 1..23: note = Synthetic Construct
  source 1..23: mol_type = other DNA
gttcagccacttcatgccatttt

SEQ ID NO: 16971 - DNA, 22 bp, synthetic construct
  misc_feature 1..22: note = Synthetic Construct
  source 1..22: mol_type = other DNA
agaggagtttgcagagccaatc

SEQ ID NO: 16972 - DNA, 23 bp, synthetic construct
  misc_feature 1..23: note = Synthetic Construct
  source 1..23: mol_type = other DNA
gaccaataagggctgtggactca

SEQ ID NO: 16973 - DNA, 23 bp, synthetic construct
  misc_feature 1..23: note = Synthetic Construct
  source 1..23: mol_type = other DNA
ggcaagtcagtcaagtgggaagt

SEQ ID NO: 16974 - DNA, 23 bp, synthetic construct
  misc_feature 1..23: note = Synthetic Construct
  source 1..23: mol_type = other DNA
cacagaacccactgcttgcttgt

SEQ ID NO: 16975 - DNA, 24 bp, synthetic construct
  misc_feature 1..24: note = Synthetic Construct
  source 1..24: mol_type = other DNA
ccacagaaatgaggcagtttgtct

SEQ ID NO: 16976 - DNA, 20 bp, synthetic construct
  misc_feature 1..20: note = Synthetic Construct
  source 1..20: mol_type = other DNA
cgccatttgggtgcttgttg

SEQ ID NO: 16977 - DNA, 26 bp, synthetic construct
  misc_feature 1..26: note = Synthetic Construct
  source 1..26: mol_type = other DNA
ggaagagaagcaggtcactgaagtct

SEQ ID NO: 16978 - DNA, 20 bp, synthetic construct
  misc_feature 1..20: note = Synthetic Construct
  source 1..20: mol_type = other DNA
gctgacacaccctcagcaat

SEQ ID NO: 16979 - DNA, 23 bp, synthetic construct
  misc_feature 1..23: note = Synthetic Construct
  source 1..23: mol_type = other DNA
ccaactctgcctccacaggtaac

SEQ ID NO: 16980 - DNA, 22 bp, synthetic construct
  misc_feature 1..22: note = Synthetic Construct
  source 1..22: mol_type = other DNA
agaggaagccgaaggccagtaa

SEQ ID NO: 16981 - DNA, 25 bp, synthetic construct
  misc_feature 1..25: note = Synthetic Construct
  source 1..25: mol_type = other DNA
ggagaagtgtgaactgctaagacta

SEQ ID NO: 16982 - DNA, 28 bp, synthetic construct
  misc_feature 1..28: note = Synthetic Construct
  source 1..28: mol_type = other DNA
ggagtgtagggtatgaggtagggatcat

SEQ ID NO: 16983 - DNA, 22 bp, synthetic construct
  misc_feature 1..22: note = Synthetic Construct
  source 1..22: mol_type = other DNA
cagccatagttgcaccatcaag

SEQ ID NO: 16984 - DNA, 22 bp, synthetic construct
  misc_feature 1..22: note = Synthetic Construct
  source 1..22: mol_type = other DNA
cagaagctgccacgaattcaga

SEQ ID NO: 16985 - DNA, 22 bp, synthetic construct
  misc_feature 1..22: note = Synthetic Construct
  source 1..22: mol_type = other DNA
gggccattcactctcctctact

SEQ ID NO: 16986 - DNA, 25 bp, synthetic construct
  misc_feature 1..25: note = Synthetic Construct
  source 1..25: mol_type = other DNA
gagtagccctcttccaaaactgaag

SEQ ID NO: 16987 - DNA, 25 bp, synthetic construct
  misc_feature 1..25: note = Synthetic Construct
  source 1..25: mol_type = other DNA
ctggctgtgaacttcttaggagcta

SEQ ID NO: 16988 - DNA, 20 bp, synthetic construct
  misc_feature 1..20: note = Synthetic Construct
  source 1..20: mol_type = other DNA
tgtcagctgtcgcacccata

SEQ ID NO: 16989 - DNA, 25 bp, synthetic construct
  misc_feature 1..25: note = Synthetic Construct
  source 1..25: mol_type = other DNA
ccaagggatcggtgtagtagctttc

SEQ ID NO: 16990 - DNA, 23 bp, synthetic construct
  misc_feature 1..23: note = Synthetic Construct
  source 1..23: mol_type = other DNA
gttctggagagggctgtcttcta

SEQ ID NO: 16991 - DNA, 21 bp, synthetic construct
  misc_feature 1..21: note = Synthetic Construct
  source 1..21: mol_type = other DNA
catggatggggagtgggatgt

SEQ ID NO: 16992 - DNA, 20 bp, synthetic construct
  misc_feature 1..20: note = Synthetic Construct
  source 1..20: mol_type = other DNA
gccacattgctggccacttt

SEQ ID NO: 16993 - DNA, 22 bp, synthetic construct
  misc_feature 1..22: note = Synthetic Construct
  source 1..22: mol_type = other DNA
gcccaagcaactttcgaaacaa

SEQ ID NO: 16994 - DNA, 21 bp, synthetic construct
  misc_feature 1..21: note = Synthetic Construct
  source 1..21: mol_type = other DNA
cacagccaagcatacctctgt

SEQ ID NO: 16995 - DNA, 24 bp, synthetic construct
  misc_feature 1..24: note = Synthetic Construct
  source 1..24: mol_type = other DNA
gaagtcagaactgagagtgtccat

SEQ ID NO: 16996 - DNA, 21 bp, synthetic construct
  misc_feature 1..21: note = Synthetic Construct
  source 1..21: mol_type = other DNA
catcccatcggtcccttccaa

SEQ ID NO: 16997 - DNA, 24 bp, synthetic construct
  misc_feature 1..24: note = Synthetic Construct
  source 1..24: mol_type = other DNA
ccatgagctcacatcactgtcaag

SEQ ID NO: 16998 - DNA, 22 bp, synthetic construct
  misc_feature 1..22: note = Synthetic Construct
  source 1..22: mol_type = other DNA
gggtcttgtgggagagacattc

SEQ ID NO: 16999 - DNA, 24 bp, synthetic construct
  misc_feature 1..24: note = Synthetic Construct
  source 1..24: mol_type = other DNA
acaagggtacctgatagtccaaac

SEQ ID NO: 17000 - DNA, 19 bp, synthetic construct
  misc_feature 1..19: note = Synthetic Construct
  source 1..19: mol_type = other DNA
gccgacacattgcggtttt

SEQ ID NO: 17001 - DNA, 26 bp, synthetic construct
  misc_feature 1..26: note = Synthetic Construct
  source 1..26: mol_type = other DNA
gaagagtcattccagtctgtgcttag

SEQ ID NO: 17002 - DNA, 19 bp, synthetic construct
  misc_feature 1..19: note = Synthetic Construct
  source 1..19: mol_type = other DNA
tgggcagtagccccactca

SEQ ID NO: 17003 - DNA, 22 bp, synthetic construct
  misc_feature 1..22: note = Synthetic Construct
  source 1..22: mol_type = other DNA
ctcagcaccggtctcttctttg

SEQ ID NO: 17004 - DNA, 20 bp, synthetic construct
  misc_feature 1..20: note = Synthetic Construct
  source 1..20: mol_type = other DNA
gcagggttcatgggtccaaa

SEQ ID NO: 17005 - DNA, 24 bp, synthetic construct
  misc_feature 1..24: note = Synthetic Construct
  source 1..24: mol_type = other DNA
cagagaacagcaatgtcccagatg

SEQ ID NO: 17006 - DNA, 22 bp, synthetic construct
  misc_feature 1..22: note = Synthetic Construct
  source 1..22: mol_type = other DNA
cgcccctcaatgggagtagtta

SEQ ID NO: 17007 - DNA, 23 bp, synthetic construct
  misc_feature 1..23: note = Synthetic Construct
  source 1..23: mol_type = other DNA
cgccttacagtccctacttcttc

SEQ ID NO: 17008 - DNA, 21 bp, synthetic construct
  misc_feature 1..21: note = Synthetic Construct
  source 1..21: mol_type = other DNA
agctgagctcttcgccaggta

SEQ ID NO: 17009 - DNA, 24 bp, synthetic construct
  misc_feature 1..24: note = Synthetic Construct
  source 1..24: mol_type = other DNA
gcctcaatgggctcatctttgaga

SEQ ID NO: 17010 - DNA, 21 bp, synthetic construct
  misc_feature 1..21: note = Synthetic Construct
  source 1..21: mol_type = other DNA
gaccaaggcaaggagacaaga

SEQ ID NO: 17011 - DNA, 20 bp, synthetic construct
  misc_feature 1..20: note = Synthetic Construct
  source 1..20: mol_type = other DNA
cctgagggctcagcatttgt

SEQ ID NO: 17012 - DNA, 22 bp, synthetic construct
  misc_feature 1..22: note = Synthetic Construct
  source 1..22: mol_type = other DNA
ccccagcccttctccagttaat

SEQ ID NO: 17013 - DNA, 23 bp, synthetic construct
  misc_feature 1..23: note = Synthetic Construct
  source 1..23: mol_type = other DNA
ggggagtgtagacagcacctgat

SEQ ID NO: 17014 - DNA, 23 bp, synthetic construct
  misc_feature 1..23: note = Synthetic Construct
  source 1..23: mol_type = other DNA
ccatgacaaccaaagagccttct

SEQ ID NO: 17015 - DNA, 22 bp, synthetic construct
  misc_feature 1..22: note = Synthetic Construct
  source 1..22: mol_type = other DNA
gcagccctggattgagttgaca

SEQ ID NO: 17016 - DNA, 22 bp, synthetic construct
  misc_feature 1..22: note = Synthetic Construct
  source 1..22: mol_type = other DNA
acaaatctcagcccagggacta

SEQ ID NO: 17017 - DNA, 22 bp, synthetic construct
  misc_feature 1..22: note = Synthetic Construct
  source 1..22: mol_type = other DNA
ggaagatgaccgtagcggcttt

SEQ ID NO: 17018 - DNA, 23 bp, synthetic construct
  misc_feature 1..23: note = Synthetic Construct
  source 1..23: mol_type = other DNA
gggctgcctgtttgaagttggaa

SEQ ID NO: 17019 - DNA, 22 bp, synthetic construct
  misc_feature 1..22: note = Synthetic Construct
  source 1..22: mol_type = other DNA
cttaaggcagcaggatggtcaa

SEQ ID NO: 17020 - DNA, 24 bp, synthetic construct
  misc_feature 1..24: note = Synthetic Construct
  source 1..24: mol_type = other DNA
gtgaagaagcccttgtgtgactga

SEQ ID NO: 17021 - DNA, 23 bp, synthetic construct
  misc_feature 1..23: note = Synthetic Construct
  source 1..23: mol_type = other DNA
cccggaggcagattaaggaaaag

SEQ ID NO: 17022 - DNA, 20 bp, synthetic construct
  misc_feature 1..20: note = Synthetic Construct
  source 1..20: mol_type = other DNA
ggccaggacaaggtgtgtca

SEQ ID NO: 17023 - DNA, 20 bp, synthetic construct
  misc_feature 1..20: note = Synthetic Construct
  source 1..20: mol_type = other DNA
tgggaggcatcggtgacaag

SEQ ID NO: 17024 - DNA, 19 bp, synthetic construct
  misc_feature 1..19: note = Synthetic Construct
  source 1..19: mol_type = other DNA
ggctcagccaggcttggaa

SEQ ID NO: 17025 - DNA, 22 bp, synthetic construct
  misc_feature 1..22: note = Synthetic Construct
  source 1..22: mol_type = other DNA
ggccaccatctcctgttctaag

SEQ ID NO: 17026 - DNA, 20 bp, synthetic construct
  misc_feature 1..20: note = Synthetic Construct
  source 1..20: mol_type = other DNA
gcaaagcggcagtgtcaact

SEQ ID NO: 17027 - DNA, 21 bp, synthetic construct
  misc_feature 1..21: note = Synthetic Construct
  source 1..21: mol_type = other DNA
agagggtccttccaggcacat

SEQ ID NO: 17028 - DNA, 22 bp, synthetic construct
  misc_feature 1..22: note = Synthetic Construct
  source 1..22: mol_type = other DNA
cttcccatggttccaccagaaa

SEQ ID NO: 17029 - DNA, 22 bp, synthetic construct
  misc_feature 1..22: note = Synthetic Construct
  source 1..22: mol_type = other DNA
accgcccctgaacacttcctat

SEQ ID NO: 17030 - DNA, 22 bp, synthetic construct
  misc_feature 1..22: note = Synthetic Construct
  source 1..22: mol_type = other DNA
cgttccttaccctggccttcaa

SEQ ID NO: 17031 - DNA, 22 bp, synthetic construct
  misc_feature 1..22: note = Synthetic Construct
  source 1..22: mol_type = other DNA
ccctctcctccctatcagcatt

SEQ ID NO: 17032 - DNA, 23 bp, synthetic construct
  misc_feature 1..23: note = Synthetic Construct
  source 1..23: mol_type = other DNA
acaacctgttcagttgtctgtct

SEQ ID NO: 17033 - DNA, 21 bp, synthetic construct
  misc_feature 1..21: note = Synthetic Construct
  source 1..21: mol_type = other DNA
tgctccctctacagcacaaag

SEQ ID NO: 17034 - DNA, 24 bp, synthetic construct
  misc_feature 1..24: note = Synthetic Construct
  source 1..24: mol_type = other DNA
ctgactctttgcattgttgtgcta

SEQ ID NO: 17035 - DNA, 19 bp, synthetic construct
  misc_feature 1..19: note = Synthetic Construct
  source 1..19: mol_type = other DNA
tgtcctgtgccgaggaaga

SEQ ID NO: 17036 - DNA, 24 bp, synthetic construct
  misc_feature 1..24: note = Synthetic Construct
  source 1..24: mol_type = other DNA
gtccttaaccacgttcttgctgtt

SEQ ID NO: 17037 - DNA, 22 bp, synthetic construct
  misc_feature 1..22: note = Synthetic Construct
  source 1..22: mol_type = other DNA
ggccagtcctgccattcttctt

SEQ ID NO: 17038 - DNA, 23 bp, synthetic construct
  misc_feature 1..23: note = Synthetic Construct
  source 1..23: mol_type = other DNA
tcatggagcccctcactctcatc

SEQ ID NO: 17039 - DNA, 27 bp, synthetic construct
  misc_feature 1..27: note = Synthetic Construct
  source 1..27: mol_type = other DNA
cgtgtacttactgaagaaaccaaccta

SEQ ID NO: 17040 - DNA, 26 bp, synthetic construct
  misc_feature 1..26: note = Synthetic Construct
  source 1..26: mol_type = other DNA
gtaggcaggtagaaatgtttggattc

SEQ ID NO: 17041 - DNA, 25 bp, synthetic construct
  misc_feature 1..25: note = Synthetic Construct
  source 1..25: mol_type = other DNA
ggaacttatgggtcagatctggaaa

SEQ ID NO: 17042 - DNA, 23 bp, synthetic construct
  misc_feature 1..23: note = Synthetic Construct
  source 1..23: mol_type = other DNA
acacaaaagacacgcatgtcaac

SEQ ID NO: 17043 - DNA, 22 bp, synthetic construct
  misc_feature 1..22: note = Synthetic Construct
  source 1..22: mol_type = other DNA
catccacctagaccagggatca

SEQ ID NO: 17044 - DNA, 25 bp, synthetic construct
  misc_feature 1..25: note = Synthetic Construct
  source 1..25: mol_type = other DNA
catatacccactgactccctgaaaa

SEQ ID NO: 17045 - DNA, 23 bp, synthetic construct
  misc_feature 1..23: note = Synthetic Construct
  source 1..23: mol_type = other DNA
acccttctcctgtcttgacaatc

SEQ ID NO: 17046 - DNA, 20 bp, synthetic construct
  misc_feature 1..20: note = Synthetic Construct
  source 1..20: mol_type = other DNA
acagaagggacgcctctaca

SEQ ID NO: 17047 - DNA, 23 bp, synthetic construct
  misc_feature 1..23: note = Synthetic Construct
  source 1..23: mol_type = other DNA
ggagggcaccatttaagcagtag

SEQ ID NO: 17048 - DNA, 25 bp, synthetic construct
  misc_feature 1..25: note = Synthetic Construct
  source 1..25: mol_type = other DNA
gggcacctcattcgtaactctttct

SEQ ID NO: 17049 - DNA, 25 bp, synthetic construct
  misc_feature 1..25: note = Synthetic Construct
  source 1..25: mol_type = other DNA
cagggtgttcttgctacaaaccaaa

SEQ ID NO: 17050 - DNA, 19 bp, synthetic construct
  misc_feature 1..19: note = Synthetic Construct
  source 1..19: mol_type = other DNA
aggcctgccttgggtcaca

SEQ ID NO: 17051 - DNA, 21 bp, synthetic construct
  misc_feature 1..21: note = Synthetic Construct
  source 1..21: mol_type = other DNA
gaacaaaccgtgtggggcaat

SEQ ID NO: 17052 - DNA, 20 bp, synthetic construct
  misc_feature 1..20: note = Synthetic Construct
  source 1..20: mol_type = other DNA
aggcaggggaaacgagagaa

SEQ ID NO: 17053 - DNA, 22 bp, synthetic construct
  misc_feature 1..22: note = Synthetic Construct
  source 1..22: mol_type = other DNA
cagccttacaggtgagcctttc

SEQ ID NO: 17054 - DNA, 22 bp, synthetic construct
  misc_feature 1..22: note = Synthetic Construct
  source 1..22: mol_type = other DNA
agctgctaatgtccagtgtcaa

SEQ ID NO: 17055 - DNA, 20 bp, synthetic construct
  misc_feature 1..20: note = Synthetic Construct
  source 1..20: mol_type = other DNA
cgagttaggccaccaagcaa

SEQ ID NO: 17056 - DNA, 25 bp, synthetic construct
  misc_feature 1..25: note = Synthetic Construct
  source 1..25: mol_type = other DNA
ctcagtgactaggtttgggtctgta

SEQ ID NO: 17057 - DNA, 20 bp, synthetic construct
  misc_feature 1..20: note = Synthetic Construct
  source 1..20: mol_type = other DNA
tgggagaggaaggtgcaaga

SEQ ID NO: 17058 - DNA, 22 bp, synthetic construct
  misc_feature 1..22: note = Synthetic Construct
  source 1..22: mol_type = other DNA
agactaactgccacccttgaga

SEQ ID NO: 17059 - DNA, 24 bp, synthetic construct
  misc_feature 1..24: note = Synthetic Construct
  source 1..24: mol_type = other DNA
ggagccatgaaagggaactcaaag

SEQ ID NO: 17060 - DNA, 25 bp, synthetic construct
  misc_feature 1..25: note = Synthetic Construct
  source 1..25: mol_type = other DNA
caccatagctcccttaaatccagaa

SEQ ID NO: 17061 - DNA, 22 bp, synthetic construct
  misc_feature 1..22: note = Synthetic Construct
  source 1..22: mol_type = other DNA
gtgagggaggtagggtttcaag

SEQ ID NO: 17062 - DNA, 23 bp, synthetic construct
  misc_feature 1..23: note = Synthetic Construct
  source 1..23: mol_type = other DNA
ctgactttcttagccaccgtaca

SEQ ID NO: 17063 - DNA, 22 bp, synthetic construct
  misc_feature 1..22: note = Synthetic Construct
  source 1..22: mol_type = other DNA
tcactcccggaggaagacaaag

SEQ ID NO: 17064 - DNA, 24 bp, synthetic construct
  misc_feature 1..24: note = Synthetic Construct
  source 1..24: mol_type = other DNA
ggtgagtggcaagaaggaatcgaa

SEQ ID NO: 17065 - DNA, 20 bp, synthetic construct
  misc_feature 1..20: note = Synthetic Construct
  source 1..20: mol_type = other DNA
actcccctccttcccagctt

SEQ ID NO: 17066 - DNA, 24 bp, synthetic construct
  misc_feature 1..24: note = Synthetic Construct
  source 1..24: mol_type = other DNA
ggtgaggaaagagtggtccctgaa

SEQ ID NO: 17067 - DNA, 21 bp, synthetic construct
  misc_feature 1..21: note = Synthetic Construct
  source 1..21: mol_type = other DNA
ggaatggctgcagagttgtga

SEQ ID NO: 17068 - DNA, 27 bp, synthetic construct
  misc_feature 1..27: note = Synthetic Construct
  source 1..27: mol_type = other DNA
ctcttcaccaggaccatgtacctagaa

SEQ ID NO: 17069 - DNA, 25 bp, synthetic construct
  misc_feature 1..25: note = Synthetic Construct
  source 1..25: mol_type = other DNA
ccagttagtgttcaggcttttgaca

SEQ ID NO: 17070 - DNA, 18 bp, synthetic construct
  misc_feature 1..18: note = Synthetic Construct
  source 1..18: mol_type = other DNA
tcctcccatcggccatca

SEQ ID NO: 17071 - DNA, 22 bp, synthetic construct
  misc_feature 1..22: note = Synthetic Construct
  source 1..22: mol_type = other DNA
tggggatagcatgtccttgact

SEQ ID NO: 17072 - DNA, 23 bp, synthetic construct
  misc_feature 1..23: note = Synthetic Construct
  source 1..23: mol_type = other DNA
cagagctcgtgagtgatgtgctt

SEQ ID NO: 17073 - DNA, 21 bp, synthetic construct
  misc_feature 1..21: note = Synthetic Construct
  source 1..21: mol_type = other DNA
gtgcaaatggccagagacaag

SEQ ID NO: 17074 - DNA, 19 bp, synthetic construct
  misc_feature 1..19: note = Synthetic Construct
  source 1..19: mol_type = other DNA
tcgggccccataggcaaca

SEQ ID NO: 17075 - DNA, 24 bp, synthetic construct
  misc_feature 1..24: note = Synthetic Construct
  source 1..24: mol_type = other DNA
tctgagttcagtaggagacagtga

SEQ ID NO: 17076 - DNA, 22 bp, synthetic construct
  misc_feature 1..22: note = Synthetic Construct
  source 1..22: mol_type = other DNA
gtctcaaaagcctgaggtctga

SEQ ID NO: 17077 - DNA, 22 bp, synthetic construct
  misc_feature 1..22: note = Synthetic Construct
  source 1..22: mol_type = other DNA
gccaagtcttactggcttgaca

SEQ ID NO: 17078 - DNA, 26 bp, synthetic construct
  misc_feature 1..26: note = Synthetic Construct
  source 1..26: mol_type = other DNA
gcattgtcaagaccctgcaattcttc

SEQ ID NO: 17079 - DNA, 24 bp, synthetic construct
  misc_feature 1..24: note = Synthetic Construct
  source 1..24: mol_type = other DNA
ccacagccttagttccacccttgt

SEQ ID NO: 17080 - DNA, 24 bp, synthetic construct
  misc_feature 1..24: note = Synthetic Construct
  source 1..24: mol_type = other DNA
atgagacagccacctctctaattg

SEQ ID NO: 17081 - DNA, 20 bp, synthetic construct
  misc_feature 1..20: note = Synthetic Construct
  source 1..20: mol_type = other DNA
accagcccatccagttcaga

SEQ ID NO: 17082 - DNA, 21 bp, synthetic construct
  misc_feature 1..21: note = Synthetic Construct
  source 1..21: mol_type = other DNA
tctatctgcccctccctcaag

SEQ ID NO: 17083 - DNA, 20 bp, synthetic construct
  misc_feature 1..20: note = Synthetic Construct
  source 1..20: mol_type = other DNA
gctttgcacaggggtaggat

SEQ ID NO: 17084 - DNA, 23 bp, synthetic construct
  misc_feature 1..23: note = Synthetic Construct
  source 1..23: mol_type = other DNA
tggccatccatatttacctgcaa

SEQ ID NO: 17085 - DNA, 22 bp, synthetic construct
  misc_feature 1..22: note = Synthetic Construct
  source 1..22: mol_type = other DNA
gcctccgcctatgctggaatta

SEQ ID NO: 17086 - DNA, 20 bp, synthetic construct
  misc_feature 1..20: note = Synthetic Construct
  source 1..20: mol_type = other DNA
accaacccggaagccctgta

SEQ ID NO: 17087 - DNA, 25 bp, synthetic construct
  misc_feature 1..25: note = Synthetic Construct
  source 1..25: mol_type = other DNA
gaggatgaaaagaaagccaagttgt

SEQ ID NO: 17088 - DNA, 22 bp, synthetic construct
  misc_feature 1..22: note = Synthetic Construct
  source 1..22: mol_type = other DNA
gagatgccttgtgggaagaagt

SEQ ID NO: 17089 - DNA, 20 bp, synthetic construct
  misc_feature 1..20: note = Synthetic Construct
  source 1..20: mol_type = other DNA
tgccccttgtgggacagtga

SEQ ID NO: 17090 - DNA, 20 bp, synthetic construct
  misc_feature 1..20: note = Synthetic Construct
  source 1..20: mol_type = other DNA
gggtgtgagagcgaggtttt

SEQ ID NO: 17091 - DNA, 20 bp, synthetic construct
  misc_feature 1..20: note = Synthetic Construct
  source 1..20: mol_type = other DNA
tcccggggcactttccactt

SEQ ID NO: 17092 - DNA, 24 bp, synthetic construct
  misc_feature 1..24: note = Synthetic Construct
  source 1..24: mol_type = other DNA
ccttggggattatgagcttccatt

SEQ ID NO: 17093 - DNA, 24 bp, synthetic construct
  misc_feature 1..24: note = Synthetic Construct
  source 1..24: mol_type = other DNA
tccctcatctgaaattgtgcatgt

SEQ ID NO: 17094 - DNA, 25 bp, synthetic construct
  misc_feature 1..25: note = Synthetic Construct
  source 1..25: mol_type = other DNA
gaggatgtttcattggccacagtct

SEQ ID NO: 17095 - DNA, 19 bp, synthetic construct
  misc_feature 1..19: note = Synthetic Construct
  source 1..19: mol_type = other DNA
tgcacagcacggtgtggtt

SEQ ID NO: 17096 - DNA, 22 bp, synthetic construct
  misc_feature 1..22: note = Synthetic Construct
  source 1..22: mol_type = other DNA
gcttgtagccccatgtagttca

SEQ ID NO: 17097 - DNA, 22 bp, synthetic construct
  misc_feature 1..22: note = Synthetic Construct
  source 1..22: mol_type = other DNA
aggccgctccttccagatatga

SEQ ID NO: 17098 - DNA, 20 bp, synthetic construct
  misc_feature 1..20: note = Synthetic Construct
  source 1..20: mol_type = other DNA
gaggcagcagtgctttggtt

SEQ ID NO: 17099 - DNA, 24 bp, synthetic construct
  misc_feature 1..24: note = Synthetic Construct
  source 1..24: mol_type = other DNA
ggttcctactggcgagtggataga

SEQ ID NO: 17100 - DNA, 22 bp, synthetic construct
  misc_feature 1..22: note = Synthetic Construct
  source 1..22: mol_type = other DNA
gctgatgggcatgggagatgaa

SEQ ID NO: 17101 - DNA, 19 bp, synthetic construct
  misc_feature 1..19: note = Synthetic Construct
  source 1..19: mol_type = other DNA
tcccaaggagccaggaaca

SEQ ID NO: 17102 - DNA, 26 bp, synthetic construct
  misc_feature 1..26: note = Synthetic Construct
  source 1..26: mol_type = other DNA
ccaagatactgatcgttgtctgaact

SEQ ID NO: 17103 - DNA, 24 bp, synthetic construct
  misc_feature 1..24: note = Synthetic Construct
  source 1..24: mol_type = other DNA
gtaaaaagctgcagggagtacagt

SEQ ID NO: 17104 - DNA, 24 bp, synthetic construct
  misc_feature 1..24: note = Synthetic Construct
  source 1..24: mol_type = other DNA
acacctggcattatcaagacgtaa

SEQ ID NO: 17105 - DNA, 23 bp, synthetic construct
  misc_feature 1..23: note = Synthetic Construct
  source 1..23: mol_type = other DNA
caggtttggttagcggaggactt

SEQ ID NO: 17106 - DNA, 22 bp, synthetic construct
  misc_feature 1..22: note = Synthetic Construct
  source 1..22: mol_type = other DNA
gtgacagtagggcctgaaggat

SEQ ID NO: 17107 - DNA, 20 bp, synthetic construct
  misc_feature 1..20: note = Synthetic Construct
  source 1..20: mol_type = other DNA
tggtgtgggacagtccactt

SEQ ID NO: 17108 - DNA, 21 bp, synthetic construct
  misc_feature 1..21: note = Synthetic Construct
  source 1..21: mol_type = other DNA
tgggacctaggtgctggtgtt

SEQ ID NO: 17109 - DNA, 19 bp, synthetic construct
  misc_feature 1..19: note = Synthetic Construct
  source 1..19: mol_type = other DNA
ccccatctgaggccctgaa

SEQ ID NO: 17110 - DNA, 22 bp, synthetic construct
  misc_feature 1..22: note = Synthetic Construct
  source 1..22: mol_type = other DNA
tctgggcctctacggcttgtta

SEQ ID NO: 17111 - DNA, 22 bp, synthetic construct
  misc_feature 1..22: note = Synthetic Construct
  source 1..22: mol_type = other DNA
gatcgggaaagagggtctgaag

SEQ ID NO: 17112 - DNA, 23 bp, synthetic construct
  misc_feature 1..23: note = Synthetic Construct
  source 1..23: mol_type = other DNA
tgtcaatggtgatcggaggtttc

SEQ ID NO: 17113 - DNA, 22 bp, synthetic construct
  misc_feature 1..22: note = Synthetic Construct
  source 1..22: mol_type = other DNA
cctgccacttgcatccatctct

SEQ ID NO: 17114 - DNA, 24 bp, synthetic construct
  misc_feature 1..24: note = Synthetic Construct
  source 1..24: mol_type = other DNA
cagtgggaatatactctggcatgt

SEQ ID NO: 17115 - DNA, 27 bp, synthetic construct
  misc_feature 1..27: note = Synthetic Construct
  source 1..27: mol_type = other DNA
gtcctgtagtgaaatagccagattcta

SEQ ID NO: 17116 - DNA, 22 bp, synthetic construct
  misc_feature 1..22: note = Synthetic Construct
  source 1..22: mol_type = other DNA
tcaacctgagaggtcccgagat

SEQ ID NO: 17117 - DNA, 24 bp, synthetic construct
  misc_feature 1..24: note = Synthetic Construct
  source 1..24: mol_type = other DNA
gggctgatctgctgatttccttga

SEQ ID NO: 17118 - DNA, 22 bp, synthetic construct
  misc_feature 1..22: note = Synthetic Construct
  source 1..22: mol_type = other DNA
ggagaaggcagcctctacacta

SEQ ID NO: 17119 - DNA, 19 bp, synthetic construct
  misc_feature 1..19: note = Synthetic Construct
  source 1..19: mol_type = other DNA
tggccaggggtctgtcact

SEQ ID NO: 17120 - DNA, 21 bp, synthetic construct
  misc_feature 1..21: note = Synthetic Construct
  source 1..21: mol_type = other DNA
aggcctctgtgccactctttg

SEQ ID NO: 17121 - DNA, 23 bp, synthetic construct
  misc_feature 1..23: note = Synthetic Construct
  source 1..23: mol_type = other DNA
gtctgcccttgacacctcaaaga

SEQ ID NO: 17122 - DNA, 22 bp, synthetic construct
  misc_feature 1..22: note = Synthetic Construct
  source 1..22: mol_type = other DNA
gaaggagaagtggggactggtt

SEQ ID NO: 17123 - DNA, 23 bp, synthetic construct
  misc_feature 1..23: note = Synthetic Construct
  source 1..23: mol_type = other DNA
cacagccagcactagagacaatc

SEQ ID NO: 17124 - DNA, 23 bp, synthetic construct
  misc_feature 1..23: note = Synthetic Construct
  source 1..23: mol_type = other DNA
tccagcctttgagtctttgtcat

SEQ ID NO: 17125 - DNA, 22 bp, synthetic construct
  misc_feature 1..22: note = Synthetic Construct
  source 1..22: mol_type = other DNA
caggcacactgagatgcccata

SEQ ID NO: 17126 - DNA, 25 bp, synthetic construct
  misc_feature 1..25: note = Synthetic Construct
  source 1..25: mol_type = other DNA
ccactttcacatccaagaaaactgt

SEQ ID NO: 17127 - DNA, 21 bp, synthetic construct
  misc_feature 1..21: note = Synthetic Construct
  source 1..21: mol_type = other DNA
gcttcccagcacacactaaga

SEQ ID NO: 17128 - DNA, 27 bp, synthetic construct
  misc_feature 1..27: note = Synthetic Construct
  source 1..27: mol_type = other DNA
catgtggcctttaaatgtctggataag

SEQ ID NO: 17129 - DNA, 22 bp, synthetic construct
  misc_feature 1..22: note = Synthetic Construct
  source 1..22: mol_type = other DNA
ggaaaggctgtgcaatggatac

SEQ ID NO: 17130 - DNA, 21 bp, synthetic construct
  misc_feature 1..21: note = Synthetic Construct
  source 1..21: mol_type = other DNA
gacctcaccaatgcgaaggaa

SEQ ID NO: 17131 - DNA, 21 bp, synthetic construct
  misc_feature 1..21: note = Synthetic Construct
  source 1..21: mol_type = other DNA
cgagcaggctgagggaagtct

SEQ ID NO: 17132 - DNA, 22 bp, synthetic construct
  misc_feature 1..22: note = Synthetic Construct
  source 1..22: mol_type = other DNA
gtgcgaggacataaacccaagt

SEQ ID NO: 17133 - DNA, 26 bp, synthetic construct
  misc_feature 1..26: note = Synthetic Construct
  source 1..26: mol_type = other DNA
cattcacgtttgctagttctctcttc

SEQ ID NO: 17134 - DNA, 24 bp, synthetic construct
  misc_feature 1..24: note = Synthetic Construct
  source 1..24: mol_type = other DNA
gacttccaacctggacttagacat

SEQ ID NO: 17135 - DNA, 25 bp, synthetic construct
  misc_feature 1..25: note = Synthetic Construct
  source 1..25: mol_type = other DNA
ctcgcaaaatcctcagatcctttgt

SEQ ID NO: 17136 - DNA, 23 bp, synthetic construct
  misc_feature 1..23: note = Synthetic Construct
  source 1..23: mol_type = other DNA
gcagaccatggggctctacttac

SEQ ID NO: 17137 - DNA, 23 bp, synthetic construct
  misc_feature 1..23: note = Synthetic Construct
  source 1..23: mol_type = other DNA
ctcccaccacataagcaaagact

SEQ ID NO: 17138 - DNA, 21 bp, synthetic construct
  misc_feature 1..21: note = Synthetic Construct
  source 1..21: mol_type = other DNA
cacttgcagccgactttggta

SEQ ID NO: 17139 - DNA, 25 bp, synthetic construct
  misc_feature 1..25: note = Synthetic Construct
  source 1..25: mol_type = other DNA
acctccctatgtagtgagctgttag

SEQ ID NO: 17140 - DNA, 24 bp, synthetic construct
  misc_feature 1..24: note = Synthetic Construct
  source 1..24: mol_type = other DNA
gcaaaggtcttcatgggcaagtct

SEQ ID NO: 17141 - DNA, 23 bp, synthetic construct
  misc_feature 1..23: note = Synthetic Construct
  source 1..23: mol_type = other DNA
gaccagagctggcaaattctaca

SEQ ID NO: 17142 - DNA, 25 bp, synthetic construct
  misc_feature 1..25: note = Synthetic Construct
  source 1..25: mol_type = other DNA
gcctggaatgtgatccatcaatgtt

SEQ ID NO: 17143 - DNA, 26 bp, synthetic construct
  misc_feature 1..26: note = Synthetic Construct
  source 1..26: mol_type = other DNA
ggggaagagaggttaaggaagtgttt

SEQ ID NO: 17144 - DNA, 23 bp, synthetic construct
  misc_feature 1..23: note = Synthetic Construct
  source 1..23: mol_type = other DNA
ggctactcctcccagtctgttgt

SEQ ID NO: 17145 - DNA, 26 bp, synthetic construct
  misc_feature 1..26: note = Synthetic Construct
  source 1..26: mol_type = other DNA
ccaccctgttggatttactttcttca

SEQ ID NO: 17146 - DNA, 22 bp, synthetic construct
  misc_feature 1..22: note = Synthetic Construct
  source 1..22: mol_type = other DNA
ggaatcatgtggggtggaatct

SEQ ID NO: 17147 - DNA, 21 bp, synthetic construct
  misc_feature 1..21: note = Synthetic Construct
  source 1..21: mol_type = other DNA
agtgagggccttacacagtga

SEQ ID NO: 17148 - DNA, 24 bp, synthetic construct
  misc_feature 1..24: note = Synthetic Construct
  source 1..24: mol_type = other DNA
gaggagagacagcagtgtttgtaa

SEQ ID NO: 17149 - DNA, 21 bp, synthetic construct
  misc_feature 1..21: note = Synthetic Construct
  source 1..21: mol_type = other DNA
gctgctgtgattggggagttg

SEQ ID NO: 17150 - DNA, 23 bp, synthetic construct
  misc_feature 1..23: note = Synthetic Construct
  source 1..23: mol_type = other DNA
ctcccctggtactctggaattga

SEQ ID NO: 17151 - DNA, 26 bp, synthetic construct
  misc_feature 1..26: note = Synthetic Construct
  source 1..26: mol_type = other DNA
gtgcaggtagaagaactgatttctca

SEQ ID NO: 17152 - DNA, 21 bp, synthetic construct
  misc_feature 1..21: note = Synthetic Construct
  source 1..21: mol_type = other DNA
ccgctgtgttgcttgctttct

SEQ ID NO: 17153 - DNA, 20 bp, synthetic construct
  misc_feature 1..20: note = Synthetic Construct
  source 1..20: mol_type = other DNA
actgtcaaacggctgtgctt

SEQ ID NO: 17154 - DNA, 22 bp, synthetic construct
  misc_feature 1..22: note = Synthetic Construct
  source 1..22: mol_type = other DNA
agtcaagcaggaggacttggat

SEQ ID NO: 17155 - DNA, 24 bp, synthetic construct
  misc_feature 1..24: note = Synthetic Construct
  source 1..24: mol_type = other DNA
ggacaagaagcccattttaagcat

SEQ ID NO: 17156 - DNA, 21 bp, synthetic construct
  misc_feature 1..21: note = Synthetic Construct
  source 1..21: mol_type = other DNA
actccgaccaacccagaccaa

SEQ ID NO: 17157 - DNA, 24 bp, synthetic construct
  misc_feature 1..24: note = Synthetic Construct
  source 1..24: mol_type = other DNA
ctccaatgccattagctccagaac

SEQ ID NO: 17158 - DNA, 23 bp, synthetic construct
  misc_feature 1..23: note = Synthetic Construct
  source 1..23: mol_type = other DNA
gctatgtgcctctttggggttac

SEQ ID NO: 17159 - DNA, 23 bp, synthetic construct
  misc_feature 1..23: note = Synthetic Construct
  source 1..23: mol_type = other DNA
agacagtgctgactctgtgagta

SEQ ID NO: 17160 - DNA, 24 bp, synthetic construct
  misc_feature 1..24: note = Synthetic Construct
  source 1..24: mol_type = other DNA
ggtctgctgactcctcatctcttc

SEQ ID NO: 17161 - DNA, 24 bp, synthetic construct
  misc_feature 1..24: note = Synthetic Construct
  source 1..24: mol_type = other DNA
actcgaaatcatggctgattctgt

SEQ ID NO: 17162 - DNA, 22 bp, synthetic construct
  misc_feature 1..22: note = Synthetic Construct
  source 1..22: mol_type = other DNA
caccagcaactacaatggcaaa

SEQ ID NO: 17163 - DNA, 23 bp, synthetic construct
  misc_feature 1..23: note = Synthetic Construct
  source 1..23: mol_type = other DNA
gccctgactcaacttccttctgt

SEQ ID NO: 17164 - DNA, 23 bp, synthetic construct
  misc_feature 1..23: note = Synthetic Construct
  source 1..23: mol_type = other DNA
gccatgggctgtgatctcactta

SEQ ID NO: 17165 - DNA, 23 bp, synthetic construct
  misc_feature 1..23: note = Synthetic Construct
  source 1..23: mol_type = other DNA
cagtgcaggcaggatgtatgtgt

SEQ ID NO: 17166 - DNA, 22 bp, synthetic construct
  misc_feature 1..22: note = Synthetic Construct
  source 1..22: mol_type = other DNA
ctctcctgcctcatggagttgt

SEQ ID NO: 17167 - DNA, 21 bp, synthetic construct
  misc_feature 1..21: note = Synthetic Construct
  source 1..21: mol_type = other DNA
tcctatcagcacccgccagaa

SEQ ID NO: 17168 - DNA, 24 bp, synthetic construct
  misc_feature 1..24: note = Synthetic Construct
  source 1..24: mol_type = other DNA
ggttggaataaaggggcacagctt

SEQ ID NO: 17169 - DNA, 24 bp, synthetic construct
  misc_feature 1..24: note = Synthetic Construct
  source 1..24: mol_type = other DNA
ccctcccacttggtgtgttataga

SEQ ID NO: 17170 - DNA, 25 bp, synthetic construct
  misc_feature 1..25: note = Synthetic Construct
  source 1..25: mol_type = other DNA
ggagattgaacagtccatcgaaaca

SEQ ID NO: 17171 - DNA, 24 bp, synthetic construct
  misc_feature 1..24: note = Synthetic Construct
  source 1..24: mol_type = other DNA
ggggcgttaacatttactgagcat

SEQ ID NO: 17172 - DNA, 25 bp, synthetic construct
  misc_feature 1..25: note = Synthetic Construct
  source 1..25: mol_type = other DNA
gaagtccagtggatattccctcatt

SEQ ID NO: 17173 - DNA, 21 bp, synthetic construct
  misc_feature 1..21: note = Synthetic Construct
  source 1..21: mol_type = other DNA
actcgccagtcccttcctaat

SEQ ID NO: 17174 - DNA, 22 bp, synthetic construct
  misc_feature 1..22: note = Synthetic Construct
  source 1..22: mol_type = other DNA
accacatttgactcagggtgtt

SEQ ID NO: 17175 - DNA, 22 bp, synthetic construct
  misc_feature 1..22: note = Synthetic Construct
  source 1..22: mol_type = other DNA
ggcccagtgatttcctttgaca

SEQ ID NO: 17176 - DNA, 21 bp, synthetic construct
  misc_feature 1..21: note = Synthetic Construct
  source 1..21: mol_type = other DNA
gaaggtccaacgcacatcttg

SEQ ID NO: 17177 - DNA, 20 bp, synthetic construct
  misc_feature 1..20: note = Synthetic Construct
  source 1..20: mol_type = other DNA
agcgccccttcctgtttcta

SEQ ID NO: 17178 - DNA, 24 bp, synthetic construct
  misc_feature 1..24: note = Synthetic Construct
  source 1..24: mol_type = other DNA
ccactccctgtgggtttggttatc

SEQ ID NO: 17179 - DNA, 22 bp, synthetic construct
  misc_feature 1..22: note = Synthetic Construct
  source 1..22: mol_type = other DNA
aggctggtggctggaatcatct

SEQ ID NO: 17180 - DNA, 21 bp, synthetic construct
  misc_feature 1..21: note = Synthetic Construct
  source 1..21: mol_type = other DNA
gtgttgcctctggcccttatc

SEQ ID NO: 17181 - DNA, 21 bp, synthetic construct
  misc_feature 1..21: note = Synthetic Construct
  source 1..21: mol_type = other DNA
caacttgccctttgggtccta

SEQ ID NO: 17182 - DNA, 23 bp, synthetic construct
  misc_feature 1..23: note = Synthetic Construct
  source 1..23: mol_type = other DNA
tggtagcacagcaaaaactgcta

SEQ ID NO: 17183 - DNA, 24 bp, synthetic construct
  misc_feature 1..24: note = Synthetic Construct
  source 1..24: mol_type = other DNA
gtaatccttacagccctccggata

SEQ ID NO: 17184 - DNA, 22 bp, synthetic construct
  misc_feature 1..22: note = Synthetic Construct
  source 1..22: mol_type = other DNA
cctgatggcccaagaggtatga

SEQ ID NO: 17185 - DNA, 21 bp, synthetic construct
  misc_feature 1..21: note = Synthetic Construct
  source 1..21: mol_type = other DNA
ttccccataacccggccacat

SEQ ID NO: 17186 - DNA, 25 bp, synthetic construct
  misc_feature 1..25: note = Synthetic Construct
  source 1..25: mol_type = other DNA
gtctgtcttagtgacccaggtattc

SEQ ID NO: 17187 - DNA, 22 bp, synthetic construct
  misc_feature 1..22: note = Synthetic Construct
  source 1..22: mol_type = other DNA
ctgcccaatgtggaactcttct

SEQ ID NO: 17188 - DNA, 25 bp, synthetic construct
  misc_feature 1..25: note = Synthetic Construct
  source 1..25: mol_type = other DNA
ggctaaaggcttactggcataggat

SEQ ID NO: 17189 - DNA, 22 bp, synthetic construct
  misc_feature 1..22: note = Synthetic Construct
  source 1..22: mol_type = other DNA
ggctgcttcaaggcaattggaa

SEQ ID NO: 17190 - DNA, 21 bp, synthetic construct
  misc_feature 1..21: note = Synthetic Construct
  source 1..21: mol_type = other DNA
tctccagggcagacacagttg

SEQ ID NO: 17191 - DNA, 21 bp, synthetic construct
  misc_feature 1..21: note = Synthetic Construct
  source 1..21: mol_type = other DNA
ggagcggcttgatgacataga

SEQ ID NO: 17192 - DNA, 27 bp, synthetic construct
  misc_feature 1..27: note = Synthetic Construct
  source 1..27: mol_type = other DNA
cccaactgtgatattaaaccaccttct

SEQ ID NO: 17193 - DNA, 20 bp, synthetic construct
  misc_feature 1..20: note = Synthetic Construct
  source 1..20: mol_type = other DNA
ttctctggcatcgcctgtgt

SEQ ID NO: 17194 - DNA, 26 bp, synthetic construct
  misc_feature 1..26: note = Synthetic Construct
  source 1..26: mol_type = other DNA
actgaccagctgcctatttatgtaag

SEQ ID NO: 17195 - DNA, 20 bp, synthetic construct
  misc_feature 1..20: note = Synthetic Construct
  source 1..20: mol_type = other DNA
ccaaggcggcatcaaccaaa

SEQ ID NO: 17196 - DNA, 22 bp, synthetic construct
  misc_feature 1..22: note = Synthetic Construct
  source 1..22: mol_type = other DNA
ctgaggctggagcgaagaaaag

SEQ ID NO: 17197 - DNA, 22 bp, synthetic construct
  misc_feature 1..22: note = Synthetic Construct
  source 1..22: mol_type = other DNA
tcactgggacacagacatggta

SEQ ID NO: 17198 - DNA, 23 bp, synthetic construct
  misc_feature 1..23: note = Synthetic Construct
  source 1..23: mol_type = other DNA
tgcttgaaccccatcctttatgt

SEQ ID NO: 17199 - DNA, 22 bp, synthetic construct
  misc_feature 1..22: note = Synthetic Construct
  source 1..22: mol_type = other DNA
acctcattgtccctccatcagt

SEQ ID NO: 17200 - DNA, 26 bp, synthetic construct
  misc_feature 1..26: note = Synthetic Construct
  source 1..26: mol_type = other DNA
gctgaggagtttaaacctgccagtaa

SEQ ID NO: 17201 - DNA, 24 bp, synthetic construct
  misc_feature 1..24: note = Synthetic Construct
  source 1..24: mol_type = other DNA
tgggaggttcctctcactaataca

SEQ ID NO: 17202 - DNA, 20 bp, synthetic construct
  misc_feature 1..20: note = Synthetic Construct
  source 1..20: mol_type = other DNA
tgcacctagcccagtgtgtt

SEQ ID NO: 17203 - DNA, 22 bp, synthetic construct
  misc_feature 1..22: note = Synthetic Construct
  source 1..22: mol_type = other DNA
gtctccatgtccaggctgttgt

SEQ ID NO: 17204 - DNA, 25 bp, synthetic construct
  misc_feature 1..25: note = Synthetic Construct
  source 1..25: mol_type = other DNA
cctcaggggtttgcaatctaataca

SEQ ID NO: 17205 - DNA, 26 bp, synthetic construct
  misc_feature 1..26: note = Synthetic Construct
  source 1..26: mol_type = other DNA
gctttgggagaacaaactctcattac

SEQ ID NO: 17206 - DNA, 21 bp, synthetic construct
  misc_feature 1..21: note = Synthetic Construct
  source 1..21: mol_type = other DNA
tgggaaccaatgggctttcat

SEQ ID NO: 17207 - DNA, 23 bp, synthetic construct
  misc_feature 1..23: note = Synthetic Construct
  source 1..23: mol_type = other DNA
cacctgaagggttgctctcacaa

SEQ ID NO: 17208 - DNA, 21 bp, synthetic construct
  misc_feature 1..21: note = Synthetic Construct
  source 1..21: mol_type = other DNA
ggaactggcagcttggttttc

SEQ ID NO: 17209 - DNA, 24 bp, synthetic construct
  misc_feature 1..24: note = Synthetic Construct
  source 1..24: mol_type = other DNA
cacctaacaagagtccgaggatac

SEQ ID NO: 17210 - DNA, 22 bp, synthetic construct
  misc_feature 1..22: note = Synthetic Construct
  source 1..22: mol_type = other DNA
cagagccaaagggaccatgaag

SEQ ID NO: 17211 - DNA, 22 bp, synthetic construct
  misc_feature 1..22: note = Synthetic Construct
  source 1..22: mol_type = other DNA
gcttggaaaccagggtgggaat

SEQ ID NO: 17212 - DNA, 22 bp, synthetic construct
  misc_feature 1..22: note = Synthetic Construct
  source 1..22: mol_type = other DNA
gcattgtactcagggtggagaa

SEQ ID NO: 17213 - DNA, 21 bp, synthetic construct
  misc_feature 1..21: note = Synthetic Construct
  source 1..21: mol_type = other DNA
cgattcccaccccaggaatga

SEQ ID NO: 17214 - DNA, 24 bp, synthetic construct
  misc_feature 1..24: note = Synthetic Construct
  source 1..24: mol_type = other DNA
cacaggagccacctacttctgtga

SEQ ID NO: 17215 - DNA, 25 bp, synthetic construct
  misc_feature 1..25: note = Synthetic Construct
  source 1..25: mol_type = other DNA
gtcggcagaattggtacttaacctt

SEQ ID NO: 17216 - DNA, 24 bp, synthetic construct
  misc_feature 1..24: note = Synthetic Construct
  source 1..24: mol_type = other DNA
ggtggggatgatagcatgaaggaa

SEQ ID NO: 17217 - DNA, 25 bp, synthetic construct
  misc_feature 1..25: note = Synthetic Construct
  source 1..25: mol_type = other DNA
cctgagcagtgatccctttagtaag

SEQ ID NO: 17218 - DNA, 22 bp, synthetic construct
  misc_feature 1..22: note = Synthetic Construct
  source 1..22: mol_type = other DNA
ctccatgctgcctctctgaaac

SEQ ID NO: 17219 - DNA, 21 bp, synthetic construct
  misc_feature 1..21: note = Synthetic Construct
  source 1..21: mol_type = other DNA
ggcaggatgactgctgtccaa

SEQ ID NO: 17220 - DNA, 24 bp, synthetic construct
  misc_feature 1..24: note = Synthetic Construct
  source 1..24: mol_type = other DNA
gagtgatgccacagctcaaacaac

SEQ ID NO: 17221 - DNA, 19 bp, synthetic construct
  misc_feature 1..19: note = Synthetic Construct
  source 1..19: mol_type = other DNA
ccctggctgcttccacagt

SEQ ID NO: 17222 - DNA, 20 bp, synthetic construct
  misc_feature 1..20: note = Synthetic Construct
  source 1..20: mol_type = other DNA
tcagcgtgctcagtgaaaca

SEQ ID NO: 17223 - DNA, 21 bp, synthetic construct
  misc_feature 1..21: note = Synthetic Construct
  source 1..21: mol_type = other DNA
cacatccttgggcatcactgt

SEQ ID NO: 17224 - DNA, 22 bp, synthetic construct
  misc_feature 1..22: note = Synthetic Construct
  source 1..22: mol_type = other DNA
tctgtaggctgtgtggtcaatg

SEQ ID NO: 17225 - DNA, 25 bp, synthetic construct
  misc_feature 1..25: note = Synthetic Construct
  source 1..25: mol_type = other DNA
ccacagccctatactccaagcatct

SEQ ID NO: 17226 - DNA, 22 bp, synthetic construct
  misc_feature 1..22: note = Synthetic Construct
  source 1..22: mol_type = other DNA
agtgtggctctgcttaaaggtt

SEQ ID NO: 17227 - DNA, 22 bp, synthetic construct
  misc_feature 1..22: note = Synthetic Construct
  source 1..22: mol_type = other DNA
caggcaggtctttcccctcttt

SEQ ID NO: 17228 - DNA, 25 bp, synthetic construct
  misc_feature 1..25: note = Synthetic Construct
  source 1..25: mol_type = other DNA
accagatgcttttaatccctgtgaa

SEQ ID NO: 17229 - DNA, 25 bp, synthetic construct
  misc_feature 1..25: note = Synthetic Construct
  source 1..25: mol_type = other DNA
ccacccaagggttttcactccttct

SEQ ID NO: 17230 - DNA, 27 bp, synthetic construct
  misc_feature 1..27: note = Synthetic Construct
  source 1..27: mol_type = other DNA
ggcatgaggataaaactactgctgctt

SEQ ID NO: 17231 - DNA, 19 bp, synthetic construct
  misc_feature 1..19: note = Synthetic Construct
  source 1..19: mol_type = other DNA
agcactggcaagggagcaa

SEQ ID NO: 17232 - DNA, 21 bp, synthetic construct
  misc_feature 1..21: note = Synthetic Construct
  source 1..21: mol_type = other DNA
tgcttcagccctctgcctaca

SEQ ID NO: 17233 - DNA, 24 bp, synthetic construct
  misc_feature 1..24: note = Synthetic Construct
  source 1..24: mol_type = other DNA
cagcctccttcttacccgttcata

SEQ ID NO: 17234 - DNA, 21 bp, synthetic construct
  misc_feature 1..21: note = Synthetic Construct
  source 1..21: mol_type = other DNA
ccagagccccaagtggatgta

SEQ ID NO: 17235 - DNA, 23 bp, synthetic construct
  misc_feature 1..23: note = Synthetic Construct
  source 1..23: mol_type = other DNA
agggccaaattgtccttcagaaa

SEQ ID NO: 17236 - DNA, 21 bp, synthetic construct
  misc_feature 1..21: note = Synthetic Construct
  source 1..21: mol_type = other DNA
ggcgactcgatgggaaaattg

SEQ ID NO: 17237 - DNA, 25 bp, synthetic construct
  misc_feature 1..25: note = Synthetic Construct
  source 1..25: mol_type = other DNA
ggagcagctaagagaagtagaaaca

SEQ ID NO: 17238 - DNA, 23 bp, synthetic construct
  misc_feature 1..23: note = Synthetic Construct
  source 1..23: mol_type = other DNA
gcactgtgtaggacactggcaat

SEQ ID NO: 17239 - DNA, 22 bp, synthetic construct
  misc_feature 1..22: note = Synthetic Construct
  source 1..22: mol_type = other DNA
ggcccattccttcccgagaaaa

SEQ ID NO: 17240 - DNA, 23 bp, synthetic construct
  misc_feature 1..23: note = Synthetic Construct
  source 1..23: mol_type = other DNA
ggcattggtgagagtgccatttg

SEQ ID NO: 17241 - DNA, 22 bp, synthetic construct
  misc_feature 1..22: note = Synthetic Construct
  source 1..22: mol_type = other DNA
tctggcctgcctgtcaacaaac

SEQ ID NO: 17242 - DNA, 21 bp, synthetic construct
  misc_feature 1..21: note = Synthetic Construct
  source 1..21: mol_type = other DNA
tccttgccctcccaagcgtat

SEQ ID NO: 17243 - DNA, 25 bp, synthetic construct
  misc_feature 1..25: note = Synthetic Construct
  source 1..25: mol_type = other DNA
gcagctactaacatgtgacacacaa

SEQ ID NO: 17244 - DNA, 28 bp, synthetic construct
  misc_feature 1..28: note = Synthetic Construct
  source 1..28: mol_type = other DNA
gctataacctttggtttcctgtcagttc

SEQ ID NO: 17245 - DNA, 26 bp, synthetic construct
  misc_feature 1..26: note = Synthetic Construct
  source 1..26: mol_type = other DNA
gttcctaaggagtgatgtgtggatca

SEQ ID NO: 17246 - DNA, 24 bp, synthetic construct
  misc_feature 1..24: note = Synthetic Construct
  source 1..24: mol_type = other DNA
tccaagcaggagacaaaattcact

SEQ ID NO: 17247 - DNA, 20 bp, synthetic construct
  misc_feature 1..20: note = Synthetic Construct
  source 1..20: mol_type = other DNA
ggcgaagagcccagtcatca

SEQ ID NO: 17248 - DNA, 24 bp, synthetic construct
  misc_feature 1..24: note = Synthetic Construct
  source 1..24: mol_type = other DNA
ggtgcttggagcatccttcagaaa

SEQ ID NO: 17249 - DNA, 23 bp, synthetic construct
  misc_feature 1..23: note = Synthetic Construct
  source 1..23: mol_type = other DNA
gcaccagaagccctgaaatcaac

SEQ ID NO: 17250 - DNA, 23 bp, synthetic construct
  misc_feature 1..23: note = Synthetic Construct
  source 1..23: mol_type = other DNA
ggaatttccagctgtcctgatct

SEQ ID NO: 17251 - DNA, 24 bp, synthetic construct
  misc_feature 1..24: note = Synthetic Construct
  source 1..24: mol_type = other DNA
cagcattcatcccctctaaacgat

SEQ ID NO: 17252 - DNA, 24 bp, synthetic construct
  misc_feature 1..24: note = Synthetic Construct
  source 1..24: mol_type = other DNA
ctccaaatccaataccccatggaa

SEQ ID NO: 17253 - DNA, 27 bp, synthetic construct
  misc_feature 1..27: note = Synthetic Construct
  source 1..27: mol_type = other DNA
gctcagacagcatgagagtaatacagt

SEQ ID NO: 17254 - DNA, 23 bp, synthetic construct
  misc_feature 1..23: note = Synthetic Construct
  source 1..23: mol_type = other DNA
gccctttcctcttttggcagtag

SEQ ID NO: 17255 - DNA, 25 bp, synthetic construct
  misc_feature 1..25: note = Synthetic Construct
  source 1..25: mol_type = other DNA
cccctcacacatggaaagagatttg

SEQ ID NO: 17256 - DNA, 24 bp, synthetic construct
  misc_feature 1..24: note = Synthetic Construct
  source 1..24: mol_type = other DNA
caaatgcaaaggttctgaggcaaa

SEQ ID NO: 17257 - DNA, 22 bp, synthetic construct
  misc_feature 1..22: note = Synthetic Construct
  source 1..22: mol_type = other DNA
gcacaaccccggaactgaaaga

SEQ ID NO: 17258 - DNA, 23 bp, synthetic construct
  misc_feature 1..23: note = Synthetic Construct
  source 1..23: mol_type = other DNA
ccctgaaaccccacacattgcat

SEQ ID NO: 17259 - DNA, 22 bp, synthetic construct
  misc_feature 1..22: note = Synthetic Construct
  source 1..22: mol_type = other DNA
gggagacaaggaggcaacacaa

SEQ ID NO: 17260 - DNA, 25 bp, synthetic construct
  misc_feature 1..25: note = Synthetic Construct
  source 1..25: mol_type = other DNA
gggaacaaaatgtttcccagtcaag

SEQ ID NO: 17261 - DNA, 25 bp, synthetic construct
  misc_feature 1..25: note = Synthetic Construct
  source 1..25: mol_type = other DNA
cagcctaaaagcaaagccaagtaag

SEQ ID NO: 17262 - DNA, 20 bp, synthetic construct
  misc_feature 1..20: note = Synthetic Construct
  source 1..20: mol_type = other DNA
gccacctacccacccactca

SEQ ID NO: 17263 - DNA, 23 bp, synthetic construct
  misc_feature 1..23: note = Synthetic Construct
  source 1..23: mol_type = other DNA
ggcaatgcgaatgagttcctaca

SEQ ID NO: 17264 - DNA, 26 bp, synthetic construct
  misc_feature 1..26: note = Synthetic Construct
  source 1..26: mol_type = other DNA
caccaccaaaaggctgataaagtgaa

SEQ ID NO: 17265 - DNA, 26 bp, synthetic construct
  misc_feature 1..26: note = Synthetic Construct
  source 1..26: mol_type = other DNA
cctgaggctccatgcttttaataact

SEQ ID NO: 17266 - DNA, 26 bp, synthetic construct
  misc_feature 1..26: note = Synthetic Construct
  source 1..26: mol_type = other DNA
cactttgatctccttatgctgctagt

SEQ ID NO: 17267 - DNA, 30 bp, synthetic construct
  misc_feature 1..30: note = Synthetic Construct
  source 1..30: mol_type = other DNA
cctttggaaacttatagtagccagagtttg

SEQ ID NO: 17268 - DNA, 26 bp, synthetic construct
  misc_feature 1..26: note = Synthetic Construct
  source 1..26: mol_type = other DNA
cttcccactctggtttatagggaaga

SEQ ID NO: 17269 - DNA, 26 bp, synthetic construct
  misc_feature 1..26: note = Synthetic Construct
  source 1..26: mol_type = other DNA
cctgggtaataactgagatggagtca

SEQ ID NO: 17270 - DNA, 24 bp, synthetic construct
  misc_feature 1..24: note = Synthetic Construct
  source 1..24: mol_type = other DNA
cccttcataagtagcgtcactcaa

SEQ ID NO: 17271 - DNA, 24 bp, synthetic construct
  misc_feature 1..24: note = Synthetic Construct
  source 1..24: mol_type = other DNA
ggaggttattcacagggcttcaga

SEQ ID NO: 17272 - DNA, 24 bp, synthetic construct
  misc_feature 1..24: note = Synthetic Construct
  source 1..24: mol_type = other DNA
tcagaccctagctgtttcactact

SEQ ID NO: 17273 - DNA, 26 bp, synthetic construct
  misc_feature 1..26: note = Synthetic Construct
  source 1..26: mol_type = other DNA
ctcacctgtactttctactcttgcat

SEQ ID NO: 17274 - DNA, 28 bp, synthetic construct
  misc_feature 1..28: note = Synthetic Construct
  source 1..28: mol_type = other DNA
gctgctcaagtctaagttgcgaatttct

SEQ ID NO: 17275 - DNA, 23 bp, synthetic construct
  misc_feature 1..23: note = Synthetic Construct
  source 1..23: mol_type = other DNA
atgcactaggattgccttctgtt

SEQ ID NO: 17276 - DNA, 27 bp, synthetic construct
  misc_feature 1..27: note = Synthetic Construct
  source 1..27: mol_type = other DNA
ccacagttaggatcctttaagcttttc

SEQ ID NO: 17277 - DNA, 24 bp, synthetic construct
  misc_feature 1..24: note = Synthetic Construct
  source 1..24: mol_type = other DNA
ccctgtctcactgaagagctgtag

SEQ ID NO: 17278 - DNA, 22 bp, synthetic construct
  misc_feature 1..22: note = Synthetic Construct
  source 1..22: mol_type = other DNA
cccggctcatcagtttgtgcta

SEQ ID NO: 17279 - DNA, 24 bp, synthetic construct
  misc_feature 1..24: note = Synthetic Construct
  source 1..24: mol_type = other DNA
gggccacttactcaaagcttcttg

SEQ ID NO: 17280 - DNA, 26 bp, synthetic construct
  misc_feature 1..26: note = Synthetic Construct
  source 1..26: mol_type = other DNA
cctgttcacatagatcccaggtcaag

SEQ ID NO: 17281 - DNA, 24 bp, synthetic construct
  misc_feature 1..24: note = Synthetic Construct
  source 1..24: mol_type = other DNA
agggtaaaaagtccaagtgtgagt

SEQ ID NO: 17282 - DNA, 21 bp, synthetic construct
  misc_feature 1..21: note = Synthetic Construct
  source 1..21: mol_type = other DNA
gcccttagacgaggtgagttc

SEQ ID NO: 17283 - DNA, 26 bp, synthetic construct
  misc_feature 1..26: note = Synthetic Construct
  source 1..26: mol_type = other DNA
gttgcactacaaggtagattgggtta

SEQ ID NO: 17284 - DNA, 23 bp, synthetic construct
  misc_feature 1..23: note = Synthetic Construct
  source 1..23: mol_type = other DNA
agcacaggaaggggatttctttg

SEQ ID NO: 17285 - DNA, 25 bp, synthetic construct
  misc_feature 1..25: note = Synthetic Construct
  source 1..25: mol_type = other DNA
ggctaacctgacaattacctcaatg

SEQ ID NO: 17286 - DNA, 24 bp, synthetic construct
  misc_feature 1..24: note = Synthetic Construct
  source 1..24: mol_type = other DNA
ccttagcggggaaccataattttc

SEQ ID NO: 17287 - DNA, 22 bp, synthetic construct
  misc_feature 1..22: note = Synthetic Construct
  source 1..22: mol_type = other DNA
ctgcctgctatttcccaactgt

SEQ ID NO: 17288 - DNA, 21 bp, synthetic construct
  misc_feature 1..21: note = Synthetic Construct
  source 1..21: mol_type = other DNA
cctggccacatgtgtctgaac

SEQ ID NO: 17289 - DNA, 23 bp, synthetic construct
  misc_feature 1..23: note = Synthetic Construct
  source 1..23: mol_type = other DNA
cccgtcctacctctaaacacaga

SEQ ID NO: 17290 - DNA, 25 bp, synthetic construct
  misc_feature 1..25: note = Synthetic Construct
  source 1..25: mol_type = other DNA
ccttctgcttttccaccatgttaag

SEQ ID NO: 17291 - DNA, 22 bp, synthetic construct
  misc_feature 1..22: note = Synthetic Construct
  source 1..22: mol_type = other DNA
ctctgtagtgctccccacattg

SEQ ID NO: 17292 - DNA, 22 bp, synthetic construct
  misc_feature 1..22: note = Synthetic Construct
  source 1..22: mol_type = other DNA
acgccccgtgatactgttccta

SEQ ID NO: 17293 - DNA, 21 bp, synthetic construct
  misc_feature 1..21: note = Synthetic Construct
  source 1..21: mol_type = other DNA
tctgcgagcacttgaggtttc

SEQ ID NO: 17294 - DNA, 20 bp, synthetic construct
  misc_feature 1..20: note = Synthetic Construct
  source 1..20: mol_type = other DNA
ggctgggttgagaagcatga

SEQ ID NO: 17295 - DNA, 21 bp, synthetic construct
  misc_feature 1..21: note = Synthetic Construct
  source 1..21: mol_type = other DNA
catggctgaagaggaccatgt

SEQ ID NO: 17296 - DNA, 22 bp, synthetic construct
  misc_feature 1..22: note = Synthetic Construct
  source 1..22: mol_type = other DNA
gggcacaacactgaagctctga

SEQ ID NO: 17297 - DNA, 25 bp, synthetic construct
  misc_feature 1..25: note = Synthetic Construct
  source 1..25: mol_type = other DNA
gggtagattcagaaagcagctatga

SEQ ID NO: 17298 - DNA, 23 bp, synthetic construct
  misc_feature 1..23: note = Synthetic Construct
  source 1..23: mol_type = other DNA
gcaggtgagtgtactgtgagcta

SEQ ID NO: 17299 - DNA, 22 bp, synthetic construct
  misc_feature 1..22: note = Synthetic Construct
  source 1..22: mol_type = other DNA
caggcaagatgtacgccttcaa

SEQ ID NO: 17300 - DNA, 25 bp, synthetic construct
  misc_feature 1..25: note = Synthetic Construct
  source 1..25: mol_type = other DNA
gcaacaggaaccatgaagagcagaa

SEQ ID NO: 17301 - DNA, 22 bp, synthetic construct
  misc_feature 1..22: note = Synthetic Construct
  source 1..22: mol_type = other DNA
gggacatgctgacaaggactgt

SEQ ID NO: 17302 - DNA, 24 bp, synthetic construct
  misc_feature 1..24: note = Synthetic Construct
  source 1..24: mol_type = other DNA
gggccctgtaaaggagagaaattg

SEQ ID NO: 17303 - DNA, 20 bp, synthetic construct
  misc_feature 1..20: note = Synthetic Construct
  source 1..20: mol_type = other DNA
gtggccgaatcccaccaaaa

SEQ ID NO: 17304 - DNA, 20 bp, synthetic construct
  misc_feature 1..20: note = Synthetic Construct
  source 1..20: mol_type = other DNA
atacacagagccgcccatca

SEQ ID NO: 17305 - DNA, 23 bp, synthetic construct
  misc_feature 1..23: note = Synthetic Construct
  source 1..23: mol_type = other DNA
gccatacctgaaaccacgtttac

SEQ ID NO: 17306 - DNA, 19 bp, synthetic construct
  misc_feature 1..19: note = Synthetic Construct
  source 1..19: mol_type = other DNA
aggtgtagctccggtcgaa

SEQ ID NO: 17307 - DNA, 23 bp, synthetic construct
  misc_feature 1..23: note = Synthetic Construct
  source 1..23: mol_type = other DNA
cctgcctcccaaactccagtaga

SEQ ID NO: 17308 - DNA, 24 bp, synthetic construct
  misc_feature 1..24: note = Synthetic Construct
  source 1..24: mol_type = other DNA
cttaaggcctggatgtctgtttga

SEQ ID NO: 17309 - DNA, 23 bp, synthetic construct
  misc_feature 1..23: note = Synthetic Construct
  source 1..23: mol_type = other DNA
cccattgtccaacagggcttttc

SEQ ID NO: 17310 - DNA, 24 bp, synthetic construct
  misc_feature 1..24: note = Synthetic Construct
  source 1..24: mol_type = other DNA
caaggcttccttttcagtcctagt

SEQ ID NO: 17311 - DNA, 22 bp, synthetic construct
  misc_feature 1..22: note = Synthetic Construct
  source 1..22: mol_type = other DNA
ccgtctcactgctgtcttctgt

SEQ ID NO: 17312 - DNA, 23 bp, synthetic construct
  misc_feature 1..23: note = Synthetic Construct
  source 1..23: mol_type = other DNA
aagccgaacgaaataggaaggaa

SEQ ID NO: 17313 - DNA, 21 bp, synthetic construct
  misc_feature 1..21: note = Synthetic Construct
  source 1..21: mol_type = other DNA
gggcagcagcaaagaaacttg

SEQ ID NO: 17314 - DNA, 28 bp, synthetic construct
  misc_feature 1..28: note = Synthetic Construct
  source 1..28: mol_type = other DNA
gcctaatgagatttaaggcagggactca

SEQ ID NO: 17315 - DNA, 23 bp, synthetic construct
  misc_feature 1..23: note = Synthetic Construct
  source 1..23: mol_type = other DNA
ggggatatcctgtgtgtggttga

SEQ ID NO: 17316 - DNA, 23 bp, synthetic construct
  misc_feature 1..23: note = Synthetic Construct
  source 1..23: mol_type = other DNA
gtgggataacacctttccccaaa

SEQ ID NO: 17317 - DNA, 19 bp, synthetic construct
  misc_feature 1..19: note = Synthetic Construct
  source 1..19: mol_type = other DNA
gcccatggatggcagcaaa

SEQ ID NO: 17318 - DNA, 21 bp, synthetic construct
  misc_feature 1..21: note = Synthetic Construct
  source 1..21: mol_type = other DNA
gcaagattcatgccgcagaca

SEQ ID NO: 17319 - DNA, 23 bp, synthetic construct
  misc_feature 1..23: note = Synthetic Construct
  source 1..23: mol_type = other DNA
gtcgttgctgtctctgctttagt

SEQ ID NO: 17320 - DNA, 24 bp, synthetic construct
  misc_feature 1..24: note = Synthetic Construct
  source 1..24: mol_type = other DNA
gcagtgattctcacaccctactgt

SEQ ID NO: 17321 - DNA, 27 bp, synthetic construct
  misc_feature 1..27: note = Synthetic Construct
  source 1..27: mol_type = other DNA
ggaaacgtaggaagttctctagtgtga

SEQ ID NO: 17322 - DNA, 22 bp, synthetic construct
  misc_feature 1..22: note = Synthetic Construct
  source 1..22: mol_type = other DNA
cccatcactgcctcatgtgttc

SEQ ID NO: 17323 - DNA, 24 bp, synthetic construct
  misc_feature 1..24: note = Synthetic Construct
  source 1..24: mol_type = other DNA
gccattccaatttatgggcagtca

SEQ ID NO: 17324 - DNA, 23 bp, synthetic construct
  misc_feature 1..23: note = Synthetic Construct
  source 1..23: mol_type = other DNA
aggagctggcataaagttgaaca

SEQ ID NO: 17325 - DNA, 26 bp, synthetic construct
  misc_feature 1..26: note = Synthetic Construct
  source 1..26: mol_type = other DNA
gcgagggaggatgagaaataggttgt

SEQ ID NO: 17326 - DNA, 22 bp, synthetic construct
  misc_feature 1..22: note = Synthetic Construct
  source 1..22: mol_type = other DNA
ggtcagcctgtgttcaggatct

SEQ ID NO: 17327 - DNA, 25 bp, synthetic construct
  misc_feature 1..25: note = Synthetic Construct
  source 1..25: mol_type = other DNA
gtgggtgccagacatgtagatcaag

SEQ ID NO: 17328 - DNA, 23 bp, synthetic construct
  misc_feature 1..23: note = Synthetic Construct
  source 1..23: mol_type = other DNA
gcaaacttcaggggaagatcact

SEQ ID NO: 17329 - DNA, 24 bp, synthetic construct
  misc_feature 1..24: note = Synthetic Construct
  source 1..24: mol_type = other DNA
ctggtacttaccctgtgccagaag

SEQ ID NO: 17330 - DNA, 27 bp, synthetic construct
  misc_feature 1..27: note = Synthetic Construct
  source 1..27: mol_type = other DNA
ctgtaacacctgggaaacctgatgtat

SEQ ID NO: 17331 - DNA, 26 bp, synthetic construct
  misc_feature 1..26: note = Synthetic Construct
  source 1..26: mol_type = other DNA
agtgctttctcagtatctcccaaaag

SEQ ID NO: 17332 - DNA, 22 bp, synthetic construct
  misc_feature 1..22: note = Synthetic Construct
  source 1..22: mol_type = other DNA
ccccatttgtaagccgggaaca

SEQ ID NO: 17333 - DNA, 22 bp, synthetic construct
  misc_feature 1..22: note = Synthetic Construct
  source 1..22: mol_type = other DNA
gaagtcagaacgctgcttgttc

SEQ ID NO: 17334 - DNA, 21 bp, synthetic construct
  misc_feature 1..21: note = Synthetic Construct
  source 1..21: mol_type = other DNA
acctgtctttgagctgtgcat

SEQ ID NO: 17335 - DNA, 23 bp, synthetic construct
  misc_feature 1..23: note = Synthetic Construct
  source 1..23: mol_type = other DNA
gtctgctttgaaccgagtctttg

SEQ ID NO: 17336 - DNA, 25 bp, synthetic construct
  misc_feature 1..25: note = Synthetic Construct
  source 1..25: mol_type = other DNA
ggctcaaacaatcccactgccttac

SEQ ID NO: 17337 - DNA, 24 bp, synthetic construct
  misc_feature 1..24: note = Synthetic Construct
  source 1..24: mol_type = other DNA
gcttgaatctcccactgacatcaa

SEQ ID NO: 17338 - DNA, 22 bp, synthetic construct
  misc_feature 1..22: note = Synthetic Construct
  source 1..22: mol_type = other DNA
ctccccgcatgtgcatgactaa

SEQ ID NO: 17339 - DNA, 22 bp, synthetic construct
  misc_feature 1..22: note = Synthetic Construct
  source 1..22: mol_type = other DNA
cacactgacccttgcttcttca

SEQ ID NO: 17340 - DNA, 25 bp, synthetic construct
  misc_feature 1..25: note = Synthetic Construct
  source 1..25: mol_type = other DNA
gtcaccatgtaatttcccaatggtt

SEQ ID NO: 17341 - DNA, 24 bp, synthetic construct
  misc_feature 1..24: note = Synthetic Construct
  source 1..24: mol_type = other DNA
gcagcacaggcttatttcttgaca

SEQ ID NO: 17342 - DNA, 23 bp, synthetic construct
  misc_feature 1..23: note = Synthetic Construct
  source 1..23: mol_type = other DNA
gagtggatgaacccagcaagttc

SEQ ID NO: 17343 - DNA, 25 bp, synthetic construct
  misc_feature 1..25: note = Synthetic Construct
  source 1..25: mol_type = other DNA
gaaaagctctcactttccctgatct

SEQ ID NO: 17344 - DNA, 25 bp, synthetic construct
  misc_feature 1..25: note = Synthetic Construct
  source 1..25: mol_type = other DNA
gctgatgcctgatcttgagccctaa

SEQ ID NO: 17345 - DNA, 23 bp, synthetic construct
  misc_feature 1..23: note = Synthetic Construct
  source 1..23: mol_type = other DNA
gttgtgtgatgctcacagactga

SEQ ID NO: 17346 - DNA, 22 bp, synthetic construct
  misc_feature 1..22: note = Synthetic Construct
  source 1..22: mol_type = other DNA
tggggaaagaaccacccaaaag

SEQ ID NO: 17347 - DNA, 24 bp, synthetic construct
  misc_feature 1..24: note = Synthetic Construct
  source 1..24: mol_type = other DNA
cctttatgggcaccaactgatttc

SEQ ID NO: 17348 - DNA, 27 bp, synthetic construct
  misc_feature 1..27: note = Synthetic Construct
  source 1..27: mol_type = other DNA
ctgaggttctatgcctaaagaaaccaa

SEQ ID NO: 17349 - DNA, 24 bp, synthetic construct
  misc_feature 1..24: note = Synthetic Construct
  source 1..24: mol_type = other DNA
gctaccaaaatggggctaggaaga

SEQ ID NO: 17350 - DNA, 24 bp, synthetic construct
  misc_feature 1..24: note = Synthetic Construct
  source 1..24: mol_type = other DNA
gcaactgtgaactcaggagcaagt

SEQ ID NO: 17351 - DNA, 24 bp, synthetic construct
  misc_feature 1..24: note = Synthetic Construct
  source 1..24: mol_type = other DNA
ggggattgctgattggttggattg

SEQ ID NO: 17352 - DNA, 25 bp, synthetic construct
  misc_feature 1..25: note = Synthetic Construct
  source 1..25: mol_type = other DNA
cagccagcactaaacgtagagaaag

SEQ ID NO: 17353 - DNA, 30 bp, synthetic construct
  misc_feature 1..30: note = Synthetic Construct
  source 1..30: mol_type = other DNA
ggaaagagaaataatggggaagcatgtgat

SEQ ID NO: 17354 - DNA, 22 bp, synthetic construct
  misc_feature 1..22: note = Synthetic Construct
  source 1..22: mol_type = other DNA
agggaagcgtactgagtgctat

SEQ ID NO: 17355 - DNA, 23 bp, synthetic construct
  misc_feature 1..23: note = Synthetic Construct
  source 1..23: mol_type = other DNA
tggaaacagaggcagctaaatca

SEQ ID NO: 17356 - DNA, 20 bp, synthetic construct
  misc_feature 1..20: note = Synthetic Construct
  source 1..20: mol_type = other DNA
cctctctcccctcggctcta

SEQ ID NO: 17357 - DNA, 24 bp, synthetic construct
  misc_feature 1..24: note = Synthetic Construct
  source 1..24: mol_type = other DNA
gctcgtagtgtgaacttgggaact

SEQ ID NO: 17358 - DNA, 25 bp, synthetic construct
  misc_feature 1..25: note = Synthetic Construct
  source 1..25: mol_type = other DNA
caggcttggactagaagtacaccat

SEQ ID NO: 17359 - DNA, 20 bp, synthetic construct
  misc_feature 1..20: note = Synthetic Construct
  source 1..20: mol_type = other DNA
gcaggttgcttgggttgaca

SEQ ID NO: 17360 - DNA, 29 bp, synthetic construct
  misc_feature 1..29: note = Synthetic Construct
  source 1..29: mol_type = other DNA
ctgagttttcaaaggctacacgttacttc

SEQ ID NO: 17361 - DNA, 24 bp, synthetic construct
  misc_feature 1..24: note = Synthetic Construct
  source 1..24: mol_type = other DNA
gctgtccccatactagtgactcat

SEQ ID NO: 17362 - DNA, 21 bp, synthetic construct
  misc_feature 1..21: note = Synthetic Construct
  source 1..21: mol_type = other DNA
agctacgtggaccccactgtt

SEQ ID NO: 17363 - DNA, 22 bp, synthetic construct
  misc_feature 1..22: note = Synthetic Construct
  source 1..22: mol_type = other DNA
gcctttctcggcctttggaatc

SEQ ID NO: 17364 - DNA, 28 bp, synthetic construct
  misc_feature 1..28: note = Synthetic Construct
  source 1..28: mol_type = other DNA
ccatggactaaagggttatagggttcta

SEQ ID NO: 17365 - DNA, 26 bp, synthetic construct
  misc_feature 1..26: note = Synthetic Construct
  source 1..26: mol_type = other DNA
ctggtaacctactaaggcttgttttg

SEQ ID NO: 17366 - DNA, 19 bp, synthetic construct
  misc_feature 1..19: note = Synthetic Construct
  source 1..19: mol_type = other DNA
ccctgcacaccctctcagt

SEQ ID NO: 17367 - DNA, 20 bp, synthetic construct
  misc_feature 1..20: note = Synthetic Construct
  source 1..20: mol_type = other DNA
tcccttaagtcccggagcat

SEQ ID NO: 17368 - DNA, 22 bp, synthetic construct
  misc_feature 1..22: note = Synthetic Construct
  source 1..22: mol_type = other DNA
ttgctactgggctctggtgaga

SEQ ID NO: 17369 - DNA, 24 bp, synthetic construct
  misc_feature 1..24: note = Synthetic Construct
  source 1..24: mol_type = other DNA
tgatgtccagacagagtgttcaga

SEQ ID NO: 17370 - DNA, 26 bp, synthetic construct
  misc_feature 1..26: note = Synthetic Construct
  source 1..26: mol_type = other DNA
ccctgtgtttttggaagacaccatgt

SEQ ID NO: 17371 - DNA, 25 bp, synthetic construct
  misc_feature 1..25: note = Synthetic Construct
  source 1..25: mol_type = other DNA
ggcctgagttctagctttggtgttg

SEQ ID NO: 17372 - DNA, 24 bp, synthetic construct
  misc_feature 1..24: note = Synthetic Construct
  source 1..24: mol_type = other DNA
ggtgggatggaggattctctttgt

SEQ ID NO: 17373 - DNA, 20 bp, synthetic construct
  misc_feature 1..20: note = Synthetic Construct
  source 1..20: mol_type = other DNA
gtgtcccagaacgagcactt

SEQ ID NO: 17374 - DNA, 30 bp, synthetic construct
  misc_feature 1..30: note = Synthetic Construct
  source 1..30: mol_type = other DNA
cgggaccagtagtcttgttttaatcacata

SEQ ID NO: 17375 - DNA, 23 bp, synthetic construct
  misc_feature 1..23: note = Synthetic Construct
  source 1..23: mol_type = other DNA
gctctccctagacatggcgacta

SEQ ID NO: 17376 - DNA, 23 bp, synthetic construct
  misc_feature 1..23: note = Synthetic Construct
  source 1..23: mol_type = other DNA
ggggatgtagggtggaaagaaac

SEQ ID NO: 17377 - DNA, 28 bp, synthetic construct
  misc_feature 1..28: note = Synthetic Construct
  source 1..28: mol_type = other DNA
ctgtgctggtaagagaattagctggaat

SEQ ID NO: 17378 - DNA, 21 bp, synthetic construct
  misc_feature 1..21: note = Synthetic Construct
  source 1..21: mol_type = other DNA
gttgcctcctttgaccctgaa

SEQ ID NO: 17379 - DNA, 21 bp, synthetic construct
  misc_feature 1..21: note = Synthetic Construct
  source 1..21: mol_type = other DNA
tctgggccattcggtaacatc

SEQ ID NO: 17380 - DNA, 25 bp, synthetic construct
  misc_feature 1..25: note = Synthetic Construct
  source 1..25: mol_type = other DNA
gcataattgggcctagtgggttatg

SEQ ID NO: 17381 - DNA, 25 bp, synthetic construct
  misc_feature 1..25: note = Synthetic Construct
  source 1..25: mol_type = other DNA
cctgaggaaagaatccctgagcttt

SEQ ID NO: 17382 - DNA, 21 bp, synthetic construct
  misc_feature 1..21: note = Synthetic Construct
  source 1..21: mol_type = other DNA
gagggagatgacctccactga

SEQ ID NO: 17383 - DNA, 25 bp, synthetic construct
  misc_feature 1..25: note = Synthetic Construct
  source 1..25: mol_type = other DNA
gcagttttgcaccaacctaatgctt

SEQ ID NO: 17384 - DNA, 24 bp, synthetic construct
  misc_feature 1..24: note = Synthetic Construct
  source 1..24: mol_type = other DNA
ctggctctgcagtttggagaaaag

SEQ ID NO: 17385 - DNA, 22 bp, synthetic construct
  misc_feature 1..22: note = Synthetic Construct
  source 1..22: mol_type = other DNA
ccagatgggctgacacagtcat

SEQ ID NO: 17386 - DNA, 26 bp, synthetic construct
  misc_feature 1..26: note = Synthetic Construct
  source 1..26: mol_type = other DNA
cactgtggagtttttcctggttgtaa

SEQ ID NO: 17387 - DNA, 21 bp, synthetic construct
  misc_feature 1..21: note = Synthetic Construct
  source 1..21: mol_type = other DNA
tgggaagtcctggcatgtaac

SEQ ID NO: 17388 - DNA, 23 bp, synthetic construct
  misc_feature 1..23: note = Synthetic Construct
  source 1..23: mol_type = other DNA
gcagcgacaatgaaacccagttc

SEQ ID NO: 17389 - DNA, 24 bp, synthetic construct
  misc_feature 1..24: note = Synthetic Construct
  source 1..24: mol_type = other DNA
tgcagtgttgatgtcacatgctat

SEQ ID NO: 17390 - DNA, 23 bp, synthetic construct
  misc_feature 1..23: note = Synthetic Construct
  source 1..23: mol_type = other DNA
cagggttctgcaatgtaccacaa

SEQ ID NO: 17391 - DNA, 20 bp, synthetic construct
  misc_feature 1..20: note = Synthetic Construct
  source 1..20: mol_type = other DNA
tccacttccactggctgaca

SEQ ID NO: 17392 - DNA, 26 bp, synthetic construct
  misc_feature 1..26: note = Synthetic Construct
  source 1..26: mol_type = other DNA
cactgcattcccactcatatgcttct

SEQ ID NO: 17393 - DNA, 24 bp, synthetic construct
  misc_feature 1..24: note = Synthetic Construct
  source 1..24: mol_type = other DNA
tgtggggaaatttgcctatacact

SEQ ID NO: 17394 - DNA, 25 bp, synthetic construct
  misc_feature 1..25: note = Synthetic Construct
  source 1..25: mol_type = other DNA
gggtaaacaaggctaagaagcaaag

SEQ ID NO: 17395 - DNA, 21 bp, synthetic construct
  misc_feature 1..21: note = Synthetic Construct
  source 1..21: mol_type = other DNA
ggaaacacctcaacccgcatt

SEQ ID NO: 17396 - DNA, 23 bp, synthetic construct
  misc_feature 1..23: note = Synthetic Construct
  source 1..23: mol_type = other DNA
catcctcagactgggacttctgt

SEQ ID NO: 17397 - DNA, 24 bp, synthetic construct
  misc_feature 1..24: note = Synthetic Construct
  source 1..24: mol_type = other DNA
tggtgcttaagagtaggctgattc

SEQ ID NO: 17398 - DNA, 24 bp, synthetic construct
  misc_feature 1..24: note = Synthetic Construct
  source 1..24: mol_type = other DNA
tggttctgagcaaattgtggtact

SEQ ID NO: 17399 - DNA, 24 bp, synthetic construct
  misc_feature 1..24: note = Synthetic Construct
  source 1..24: mol_type = other DNA
gctagagtgctaagctttctgtca

SEQ ID NO: 17400 - DNA, 27 bp, synthetic construct
  misc_feature 1..27: note = Synthetic Construct
  source 1..27: mol_type = other DNA
ggcattaccagctactgagattttaga

SEQ ID NO: 17401 - DNA, 28 bp, synthetic construct
  misc_feature 1..28: note = Synthetic Construct
  source 1..28: mol_type = other DNA
ccacaccaagaatggttatcagtgtgaa

SEQ ID NO: 17402 - DNA, 24 bp, synthetic construct
  misc_feature 1..24: note = Synthetic Construct
  source 1..24: mol_type = other DNA
aacccagcatatgagtcgaatgaa

SEQ ID NO: 17403 - DNA, 20 bp, synthetic construct
  misc_feature 1..20: note = Synthetic Construct
  source 1..20: mol_type = other DNA
aggggatgaccaaccctgat

SEQ ID NO: 17404 - DNA, 26 bp, synthetic construct
  misc_feature 1..26: note = Synthetic Construct
  source 1..26: mol_type = other DNA
ggctgttcttcaacaagaagtgaatg

SEQ ID NO: 17405 - DNA, 26 bp, synthetic construct
  misc_feature 1..26: note = Synthetic Construct
  source 1..26: mol_type = other DNA
ccaggattagaaagttcaacccaagt

SEQ ID NO: 17406 - DNA, 22 bp, synthetic construct
  misc_feature 1..22: note = Synthetic Construct
  source 1..22: mol_type = other DNA
ccgccaagtcagttcagacaga

SEQ ID NO: 17407 - DNA, 22 bp, synthetic construct
  misc_feature 1..22: note = Synthetic Construct
  source 1..22: mol_type = other DNA
gctcctctctttgtgaggcaaa

SEQ ID NO: 17408 - DNA, 21 bp, synthetic construct
  misc_feature 1..21: note = Synthetic Construct
  source 1..21: mol_type = other DNA
cgtgtctgcattctcccttca

SEQ ID NO: 17409 - DNA, 22 bp, synthetic construct
  misc_feature 1..22: note = Synthetic Construct
  source 1..22: mol_type = other DNA
cccacatgcaacccagttcttc

SEQ ID NO: 17410 - DNA, 24 bp, synthetic construct
  misc_feature 1..24: note = Synthetic Construct
  source 1..24: mol_type = other DNA
gcctttctgacaaactcccagata

SEQ ID NO: 17411 - DNA, 26 bp, synthetic construct
  misc_feature 1..26: note = Synthetic Construct
  source 1..26: mol_type = other DNA
agagataccgatactctgtccatcaa

SEQ ID NO: 17412 - DNA, 22 bp, synthetic construct
  misc_feature 1..22: note = Synthetic Construct
  source 1..22: mol_type = other DNA
tctgtgttgctcactactgctt

SEQ ID NO: 17413 - DNA, 24 bp, synthetic construct
  misc_feature 1..24: note = Synthetic Construct
  source 1..24: mol_type = other DNA
ctcttcagctcaaccctccctttt

SEQ ID NO: 17414 - DNA, 28 bp, synthetic construct
  misc_feature 1..28: note = Synthetic Construct
  source 1..28: mol_type = other DNA
ccaaagtgaacctaaagccttactccaa

SEQ ID NO: 17415 - DNA, 23 bp, synthetic construct
  misc_feature 1..23: note = Synthetic Construct
  source 1..23: mol_type = other DNA
ggcccttcctttagagcttttca

SEQ ID NO: 17416 - DNA, 23 bp, synthetic construct
  misc_feature 1..23: note = Synthetic Construct
  source 1..23: mol_type = other DNA
ggctgcagcataactggcttttg

SEQ ID NO: 17417 - DNA, 25 bp, synthetic construct
  misc_feature 1..25: note = Synthetic Construct
  source 1..25: mol_type = other DNA
ggctgaggtcattaagagctagtgt

SEQ ID NO: 17418 - DNA, 22 bp, synthetic construct
  misc_feature 1..22: note = Synthetic Construct
  source 1..22: mol_type = other DNA
cggagataggagcacactcttg

SEQ ID NO: 17419 - DNA, 26 bp, synthetic construct
  misc_feature 1..26: note = Synthetic Construct
  source 1..26: mol_type = other DNA
ccctctcttcttcatcagcactcttt

SEQ ID NO: 17420 - DNA, 24 bp, synthetic construct
  misc_feature 1..24: note = Synthetic Construct
  source 1..24: mol_type = other DNA
cagagaactctgaagctggctagt

SEQ ID NO: 17421 - DNA, 23 bp, synthetic construct
  misc_feature 1..23: note = Synthetic Construct
  source 1..23: mol_type = other DNA
tccaggtcttctcaaggcatcta

SEQ ID NO: 17422 - DNA, 19 bp, synthetic construct
  misc_feature 1..19: note = Synthetic Construct
  source 1..19: mol_type = other DNA
gccaagtcggtggcgagaa

SEQ ID NO: 17423 - DNA, 23 bp, synthetic construct
  misc_feature 1..23: note = Synthetic Construct
  source 1..23: mol_type = other DNA
gtgtgtgggcttcgctacagaaa

SEQ ID NO: 17424 - DNA, 23 bp, synthetic construct
  misc_feature 1..23: note = Synthetic Construct
  source 1..23: mol_type = other DNA
cctctgtttgcgcagagatcaca

SEQ ID NO: 17425 - DNA, 27 bp, synthetic construct
  misc_feature 1..27: note = Synthetic Construct
  source 1..27: mol_type = other DNA
gacaggagtgttaaaggttccaaatag

SEQ ID NO: 17426 - DNA, 26 bp, synthetic construct
  misc_feature 1..26: note = Synthetic Construct
  source 1..26: mol_type = other DNA
cactggctctctgagactcttaaatc

SEQ ID NO: 17427 - DNA, 23 bp, synthetic construct
  misc_feature 1..23: note = Synthetic Construct
  source 1..23: mol_type = other DNA
gtggctctcaaaccagagaccaa

SEQ ID NO: 17428 - DNA, 23 bp, synthetic construct
  misc_feature 1..23: note = Synthetic Construct
  source 1..23: mol_type = other DNA
ctgcctactccccacatctttac

SEQ ID NO: 17429 - DNA, 21 bp, synthetic construct
  misc_feature 1..21: note = Synthetic Construct
  source 1..21: mol_type = other DNA
gcttgttccactcccgtcaca

SEQ ID NO: 17430 - DNA, 24 bp, synthetic construct
  misc_feature 1..24: note = Synthetic Construct
  source 1..24: mol_type = other DNA
cattgcaaagagttccagtgaaca

SEQ ID NO: 17431 - DNA, 22 bp, synthetic construct
  misc_feature 1..22: note = Synthetic Construct
  source 1..22: mol_type = other DNA
ggcatgggacttcactctgaca

SEQ ID NO: 17432 - DNA, 26 bp, synthetic construct
  misc_feature 1..26: note = Synthetic Construct
  source 1..26: mol_type = other DNA
gctcttccaaaacattgccacatatc

SEQ ID NO: 17433 - DNA, 23 bp, synthetic construct
  misc_feature 1..23: note = Synthetic Construct
  source 1..23: mol_type = other DNA
ggactgcaggatacctgttgctt

SEQ ID NO: 17434 - DNA, 26 bp, synthetic construct
  misc_feature 1..26: note = Synthetic Construct
  source 1..26: mol_type = other DNA
ccactagaaattggattgacccaaca

SEQ ID NO: 17435 - DNA, 24 bp, synthetic construct
  misc_feature 1..24: note = Synthetic Construct
  source 1..24: mol_type = other DNA
tcgatgccaactctatccatgaaa

SEQ ID NO: 17436 - DNA, 25 bp, synthetic construct
  misc_feature 1..25: note = Synthetic Construct
  source 1..25: mol_type = other DNA
ggactggctacaaagactgcctaat

SEQ ID NO: 17437 - DNA, 30 bp, synthetic construct
  misc_feature 1..30: note = Synthetic Construct
  source 1..30: mol_type = other DNA
gagatggatggattctacccctaaagtaag

SEQ ID NO: 17438 - DNA, 22 bp, synthetic construct
  misc_feature 1..22: note = Synthetic Construct
  source 1..22: mol_type = other DNA
gcctctagactcactggtccaa

SEQ ID NO: 17439 - DNA, 26 bp, synthetic construct
  misc_feature 1..26: note = Synthetic Construct
  source 1..26: mol_type = other DNA
ccggacttgatgtcagattcaagcta

SEQ ID NO: 17440 - DNA, 24 bp, synthetic construct
  misc_feature 1..24: note = Synthetic Construct
  source 1..24: mol_type = other DNA
gacttcgcacaagttttccttcat

SEQ ID NO: 17441 - DNA, 27 bp, synthetic construct
  misc_feature 1..27: note = Synthetic Construct
  source 1..27: mol_type = other DNA
gcacagaggaaatgggtataggactta

SEQ ID NO: 17442 - DNA, 23 bp, synthetic construct
  misc_feature 1..23: note = Synthetic Construct
  source 1..23: mol_type = other DNA
gccagtgggaacaatctggagaa

SEQ ID NO: 17443 - DNA, 24 bp, synthetic construct
  misc_feature 1..24: note = Synthetic Construct
  source 1..24: mol_type = other DNA
ggctggagcatgttccttcaatct

SEQ ID NO: 17444 - DNA, 26 bp, synthetic construct
  misc_feature 1..26: note = Synthetic Construct
  source 1..26: mol_type = other DNA
cacccaacttttgtttggagagcatt

SEQ ID NO: 17445 - DNA, 22 bp, synthetic construct
  misc_feature 1..22: note = Synthetic Construct
  source 1..22: mol_type = other DNA
ctgtccaccgtacaggatcgtt

SEQ ID NO: 17446 - DNA, 22 bp, synthetic construct
  misc_feature 1..22: note = Synthetic Construct
  source 1..22: mol_type = other DNA
gtgctagtgagagtgctggttt

SEQ ID NO: 17447 - DNA, 23 bp, synthetic construct
  misc_feature 1..23: note = Synthetic Construct
  source 1..23: mol_type = other DNA
cctggcccaaggtgagaatgtag

SEQ ID NO: 17448 - DNA, 24 bp, synthetic construct
  misc_feature 1..24: note = Synthetic Construct
  source 1..24: mol_type = other DNA
ctggggctttagtcttttgccata

SEQ ID NO: 17449 - DNA, 30 bp, synthetic construct
  misc_feature 1..30: note = Synthetic Construct
  source 1..30: mol_type = other DNA
cccaaacacctacagaaaaagaatcgaact

SEQ ID NO: 17450 - DNA, 20 bp, synthetic construct
  misc_feature 1..20: note = Synthetic Construct
  source 1..20: mol_type = other DNA
agctgctagagtgccgatgt

SEQ ID NO: 17451 - DNA, 23 bp, synthetic construct
  misc_feature 1..23: note = Synthetic Construct
  source 1..23: mol_type = other DNA
accataccccagcaaaagaaaca

SEQ ID NO: 17452 - DNA, 26 bp, synthetic construct
  misc_feature 1..26: note = Synthetic Construct
  source 1..26: mol_type = other DNA
ctcggcccacttaattctagatgttc

SEQ ID NO: 17453 - DNA, 27 bp, synthetic construct
  misc_feature 1..27: note = Synthetic Construct
  source 1..27: mol_type = other DNA
gggaatttctactcctccttcagcaaa

SEQ ID NO: 17454 - DNA, 23 bp, synthetic construct
  misc_feature 1..23: note = Synthetic Construct
  source 1..23: mol_type = other DNA
tggggattccacaaactttggtt

SEQ ID NO: 17455 - DNA, 24 bp, synthetic construct
  misc_feature 1..24: note = Synthetic Construct
  source 1..24: mol_type = other DNA
acaccatctcctggaagtaacagt

SEQ ID NO: 17456 - DNA, 20 bp, synthetic construct
  misc_feature 1..20: note = Synthetic Construct
  source 1..20: mol_type = other DNA
gccctttgctggctgacaca

SEQ ID NO: 17457 - DNA, 25 bp, synthetic construct
  misc_feature 1..25: note = Synthetic Construct
  source 1..25: mol_type = other DNA
ctgcttttgtggattcagggtgact

SEQ ID NO: 17458 - DNA, 27 bp, synthetic construct
  misc_feature 1..27: note = Synthetic Construct
  source 1..27: mol_type = other DNA
gccatctgccatatctcagagagtcaa

SEQ ID NO: 17459 - DNA, 25 bp, synthetic construct
  misc_feature 1..25: note = Synthetic Construct
  source 1..25: mol_type = other DNA
aagggaattcctagatgccaaactt

SEQ ID NO: 17460 - DNA, 26 bp, synthetic construct
  misc_feature 1..26: note = Synthetic Construct
  source 1..26: mol_type = other DNA
cgccgagtgatcttaaaagcagacaa

SEQ ID NO: 17461 - DNA, 26 bp, synthetic construct
  misc_feature 1..26: note = Synthetic Construct
  source 1..26: mol_type = other DNA
agaatcctggggtatgttagtgattg

SEQ ID NO: 17462 - DNA, 25 bp, synthetic construct
  misc_feature 1..25: note = Synthetic Construct
  source 1..25: mol_type = other DNA
cgaggctaaccaaggtcagataata

SEQ ID NO: 17463 - DNA, 23 bp, synthetic construct
  misc_feature 1..23: note = Synthetic Construct
  source 1..23: mol_type = other DNA
ccagcttgcatcaagaggactga

SEQ ID NO: 17464 - DNA, 23 bp, synthetic construct
  misc_feature 1..23: note = Synthetic Construct
  source 1..23: mol_type = other DNA
cctgatgatggcagagtctgaag

SEQ ID NO: 17465 - DNA, 29 bp, synthetic construct
  misc_feature 1..29: note = Synthetic Construct
  source 1..29: mol_type = other DNA
ccatcctctactttagggtgactttaaca

SEQ ID NO: 17466 - DNA, 21 bp, synthetic construct
  misc_feature 1..21: note = Synthetic Construct
  source 1..21: mol_type = other DNA
gaactgctctctggcttcctt

SEQ ID NO: 17467 - DNA, 26 bp, synthetic construct
  misc_feature 1..26: note = Synthetic Construct
  source 1..26: mol_type = other DNA
gaagcagttctggtctcaagatgata

SEQ ID NO: 17468 - DNA, 24 bp, synthetic construct
  misc_feature 1..24: note = Synthetic Construct
  source 1..24: mol_type = other DNA
cggcgaagcactaaaaatgcacta

SEQ ID NO: 17469 - DNA, 29 bp, synthetic construct
  misc_feature 1..29: note = Synthetic Construct
  source 1..29: mol_type = other DNA
ccttagcttagatattacgctccagcatt

SEQ ID NO: 17470 - DNA, 23 bp, synthetic construct
  misc_feature 1..23: note = Synthetic Construct
  source 1..23: mol_type = other DNA
cacagagtcctgaaaagcaggaa

SEQ ID NO: 17471 - DNA, 23 bp, synthetic construct
  misc_feature 1..23: note = Synthetic Construct
  source 1..23: mol_type = other DNA
gagtccaagcagatcatgtgtgt

SEQ ID NO: 17472 - DNA, 23 bp, synthetic construct
  misc_feature 1..23: note = Synthetic Construct
  source 1..23: mol_type = other DNA
gcgagaacgaccattcaaaatca

SEQ ID NO: 17473 - DNA, 26 bp, synthetic construct
  misc_feature 1..26: note = Synthetic Construct
  source 1..26: mol_type = other DNA
gcctatgtcacttctctcccttgaac

SEQ ID NO: 17474 - DNA, 23 bp, synthetic construct
  misc_feature 1..23: note = Synthetic Construct
  source 1..23: mol_type = other DNA
ggccagaaatggtcttgcagctt

SEQ ID NO: 17475 - DNA, 23 bp, synthetic construct
  misc_feature 1..23: note = Synthetic Construct
  source 1..23: mol_type = other DNA
gcattagagttgctaccgctttc

SEQ ID NO: 17476 - DNA, 21 bp, synthetic construct
  misc_feature 1..21: note = Synthetic Construct
  source 1..21: mol_type = other DNA
ggcaatagggcactcacaaac

SEQ ID NO: 17477 - DNA, 20 bp, synthetic construct
  misc_feature 1..20: note = Synthetic Construct
  source 1..20: mol_type = other DNA
tgtcacttgcccacaaggtt

SEQ ID NO: 17478 - DNA, 23 bp, synthetic construct
  misc_feature 1..23: note = Synthetic Construct
  source 1..23: mol_type = other DNA
cagtgtgctggttctggttgagt

SEQ ID NO: 17479 - DNA, 23 bp, synthetic construct
  misc_feature 1..23: note = Synthetic Construct
  source 1..23: mol_type = other DNA
gcaaacacagcttgtctcaggat

SEQ ID NO: 17480 - DNA, 29 bp, synthetic construct
  misc_feature 1..29: note = Synthetic Construct
  source 1..29: mol_type = other DNA
gtgtgaagtcagtgttctaggaagtattg

SEQ ID NO: 17481 - DNA, 24 bp, synthetic construct
  misc_feature 1..24: note = Synthetic Construct
  source 1..24: mol_type = other DNA
acagggacctctctaaaactcaga

SEQ ID NO: 17482 - DNA, 30 bp, synthetic construct
  misc_feature 1..30: note = Synthetic Construct
  source 1..30: mol_type = other DNA
gccagatcctgcttatagtttagatgttac

SEQ ID NO: 17483 - DNA, 22 bp, synthetic construct
  misc_feature 1..22: note = Synthetic Construct
  source 1..22: mol_type = other DNA
ccccaggcttcatggttcatca

SEQ ID NO: 17484 - DNA, 20 bp, synthetic construct
  misc_feature 1..20: note = Synthetic Construct
  source 1..20: mol_type = other DNA
ggttcccaccatgagccttt

SEQ ID NO: 17485 - DNA, 23 bp, synthetic construct
  misc_feature 1..23: note = Synthetic Construct
  source 1..23: mol_type = other DNA
gccttagtccaagtgctccaatg

SEQ ID NO: 17486 - DNA, 26 bp, synthetic construct
  misc_feature 1..26: note = Synthetic Construct
  source 1..26: mol_type = other DNA
gcaggtagcgaatctaagacaaaaag

SEQ ID NO: 17487 - DNA, 24 bp, synthetic construct
  misc_feature 1..24: note = Synthetic Construct
  source 1..24: mol_type = other DNA
gtccctttgggcctaattttcctt

SEQ ID NO: 17488 - DNA, 24 bp, synthetic construct
  misc_feature 1..24: note = Synthetic Construct
  source 1..24: mol_type = other DNA
cccacagcaacactaactcttcat

SEQ ID NO: 17489 - DNA, 22 bp, synthetic construct
  misc_feature 1..22: note = Synthetic Construct
  source 1..22: mol_type = other DNA
ccacccaacactgcacatcaag

SEQ ID NO: 17490 - DNA, 22 bp, synthetic construct
  misc_feature 1..22: note = Synthetic Construct
  source 1..22: mol_type = other DNA
cttgccttctttgcctgtcgaa

SEQ ID NO: 17491 - DNA, 23 bp, synthetic construct
  misc_feature 1..23: note = Synthetic Construct
  source 1..23: mol_type = other DNA
tgtgtcagacagataagcgtgtt

SEQ ID NO: 17492 - DNA, 22 bp, synthetic construct
  misc_feature 1..22: note = Synthetic Construct
  source 1..22: mol_type = other DNA
gggcgggactaatagagcttac

SEQ ID NO: 17493 - DNA, 20 bp, synthetic construct
  misc_feature 1..20: note = Synthetic Construct
  source 1..20: mol_type = other DNA
cgcgttttccaccacggtaa

SEQ ID NO: 17494 - DNA, 26 bp, synthetic construct
  misc_feature 1..26: note = Synthetic Construct
  source 1..26: mol_type = other DNA
cgacattccttaacattccacagttg

SEQ ID NO: 17495 - DNA, 27 bp, synthetic construct
  misc_feature 1..27: note = Synthetic Construct
  source 1..27: mol_type = other DNA
gaactgtccattacagagctagaaaag

SEQ ID NO: 17496 - DNA, 27 bp, synthetic construct
  misc_feature 1..27: note = Synthetic Construct
  source 1..27: mol_type = other DNA
gtgtcttacttatccctctgacctcat

SEQ ID NO: 17497 - DNA, 24 bp, synthetic construct
  misc_feature 1..24: note = Synthetic Construct
  source 1..24: mol_type = other DNA
acctagagagaaagtggaggaact

SEQ ID NO: 17498 - DNA, 21 bp, synthetic construct
  misc_feature 1..21: note = Synthetic Construct
  source 1..21: mol_type = other DNA
gagagcaactcagctcgcatt

SEQ ID NO: 17499 - DNA, 22 bp, synthetic construct
  misc_feature 1..22: note = Synthetic Construct
  source 1..22: mol_type = other DNA
agcggttgccatggactaatac

SEQ ID NO: 17500 - DNA, 26 bp, synthetic construct
  misc_feature 1..26: note = Synthetic Construct
  source 1..26: mol_type = other DNA
catctgatttgcaaccactacccttt

SEQ ID NO: 17501 - DNA, 24 bp, synthetic construct
  misc_feature 1..24: note = Synthetic Construct
  source 1..24: mol_type = other DNA
cagttgcctctttcagtcactgtt

SEQ ID NO: 17502 - DNA, 21 bp, synthetic construct
  misc_feature 1..21: note = Synthetic Construct
  source 1..21: mol_type = other DNA
cctgacaatgcagcacactct

SEQ ID NO: 17503 - DNA, 21 bp, synthetic construct
  misc_feature 1..21: note = Synthetic Construct
  source 1..21: mol_type = other DNA
aggggacacagtccacaaaac

SEQ ID NO: 17504 - DNA, 23 bp, synthetic construct
  misc_feature 1..23: note = Synthetic Construct
  source 1..23: mol_type = other DNA
cctccatttctgccaagctcgtt

SEQ ID NO: 17505 - DNA, 29 bp, synthetic construct
  misc_feature 1..29: note = Synthetic Construct
  source 1..29: mol_type = other DNA
gctaagtccctaagagaaaagctttgtga

SEQ ID NO: 17506 - DNA, 24 bp, synthetic construct
  misc_feature 1..24: note = Synthetic Construct
  source 1..24: mol_type = other DNA
gtgttcactccagggcctcttatc

SEQ ID NO: 17507 - DNA, 23 bp, synthetic construct
  misc_feature 1..23: note = Synthetic Construct
  source 1..23: mol_type = other DNA
gctggccctggatttacttcaca

SEQ ID NO: 17508 - DNA, 26 bp, synthetic construct
  misc_feature 1..26: note = Synthetic Construct
  source 1..26: mol_type = other DNA
gctcagttgtatggtttggaacaaga

SEQ ID NO: 17509 - DNA, 25 bp, synthetic construct
  misc_feature 1..25: note = Synthetic Construct
  source 1..25: mol_type = other DNA
tttctcacattgcctgagacagata

SEQ ID NO: 17510 - DNA, 23 bp, synthetic construct
  misc_feature 1..23: note = Synthetic Construct
  source 1..23: mol_type = other DNA
ggcctataactgccactcagtca

SEQ ID NO: 17511 - DNA, 25 bp, synthetic construct
  misc_feature 1..25: note = Synthetic Construct
  source 1..25: mol_type = other DNA
ctgccttttgaagcaacatgctttt

SEQ ID NO: 17512 - DNA, 22 bp, synthetic construct
  misc_feature 1..22: note = Synthetic Construct
  source 1..22: mol_type = other DNA
gtggctgccatcagaagctaag

SEQ ID NO: 17513 - DNA, 24 bp, synthetic construct
  misc_feature 1..24: note = Synthetic Construct
  source 1..24: mol_type = other DNA
ctctgccgatcaacacatgatttc

SEQ ID NO: 17514 - DNA, 24 bp, synthetic construct
  misc_feature 1..24: note = Synthetic Construct
  source 1..24: mol_type = other DNA
ggacatgttacacctgggccaaat

SEQ ID NO: 17515 - DNA, 24 bp, synthetic construct
  misc_feature 1..24: note = Synthetic Construct
  source 1..24: mol_type = other DNA
gggtacaccatgaaccaggacctt

SEQ ID NO: 17516 - DNA, 25 bp, synthetic construct
  misc_feature 1..25: note = Synthetic Construct
  source 1..25: mol_type = other DNA
ggctgattccagagtcagaacttca

SEQ ID NO: 17517 - DNA, 23 bp, synthetic construct
  misc_feature 1..23: note = Synthetic Construct
  source 1..23: mol_type = other DNA
ggtgacagcaatgtcaggtgcta

SEQ ID NO: 17518 - DNA, 28 bp, synthetic construct
  misc_feature 1..28: note = Synthetic Construct
  source 1..28: mol_type = other DNA
ccaccgtagaccatattgacttcatttc

SEQ ID NO: 17519 - DNA, 27 bp, synthetic construct
  misc_feature 1..27: note = Synthetic Construct
  source 1..27: mol_type = other DNA
ggatggggtcatttagggacttaaaac

SEQ ID NO: 17520 - DNA, 25 bp, synthetic construct
  misc_feature 1..25: note = Synthetic Construct
  source 1..25: mol_type = other DNA
acatgtagtttccagaggcaaagaa

SEQ ID NO: 17521 - DNA, 22 bp, synthetic construct
  misc_feature 1..22: note = Synthetic Construct
  source 1..22: mol_type = other DNA
gactaaggggaggccatgaaag

SEQ ID NO: 17522 - DNA, 23 bp, synthetic construct
  misc_feature 1..23: note = Synthetic Construct
  source 1..23: mol_type = other DNA
tccctggtttcatgagtgacaag

SEQ ID NO: 17523 - DNA, 25 bp, synthetic construct
  misc_feature 1..25: note = Synthetic Construct
  source 1..25: mol_type = other DNA
tcttactgattctttgccgtcagta

SEQ ID NO: 17524 - DNA, 21 bp, synthetic construct
  misc_feature 1..21: note = Synthetic Construct
  source 1..21: mol_type = other DNA
gcgatgccttctgcctgagta

SEQ ID NO: 17525 - DNA, 22 bp, synthetic construct
  misc_feature 1..22: note = Synthetic Construct
  source 1..22: mol_type = other DNA
aggggaaagccacagaaaatgt

SEQ ID NO: 17526 - DNA, 25 bp, synthetic construct
  misc_feature 1..25: note = Synthetic Construct
  source 1..25: mol_type = other DNA
cagcttgtgtcagcttctagccata

SEQ ID NO: 17527 - DNA, 24 bp, synthetic construct
  misc_feature 1..24: note = Synthetic Construct
  source 1..24: mol_type = other DNA
agaaactccagctgtcttgacttc

SEQ ID NO: 17528 - DNA, 24 bp, synthetic construct
  misc_feature 1..24: note = Synthetic Construct
  source 1..24: mol_type = other DNA
gtctctgggaaccaagtccatatc

SEQ ID NO: 17529 - DNA, 21 bp, synthetic construct
  misc_feature 1..21: note = Synthetic Construct
  source 1..21: mol_type = other DNA
agtcagtcccggatctctgaa

SEQ ID NO: 17530 - DNA, 24 bp, synthetic construct
  misc_feature 1..24: note = Synthetic Construct
  source 1..24: mol_type = other DNA
cgcttagtcaatcctcacccattc

SEQ ID NO: 17531 - DNA, 26 bp, synthetic construct
  misc_feature 1..26: note = Synthetic Construct
  source 1..26: mol_type = other DNA
gcccctcttatagcaagccgtaaatc

SEQ ID NO: 17532 - DNA, 23 bp, synthetic construct
  misc_feature 1..23: note = Synthetic Construct
  source 1..23: mol_type = other DNA
ggtcaatctggaaacagggtgat

SEQ ID NO: 17533 - DNA, 24 bp, synthetic construct
  misc_feature 1..24: note = Synthetic Construct
  source 1..24: mol_type = other DNA
gctcgtgttctgtcagtgacttat

SEQ ID NO: 17534 - DNA, 25 bp, synthetic construct
  misc_feature 1..25: note = Synthetic Construct
  source 1..25: mol_type = other DNA
cccaagcaaggaggatgattactgt

SEQ ID NO: 17535 - DNA, 22 bp, synthetic construct
  misc_feature 1..22: note = Synthetic Construct
  source 1..22: mol_type = other DNA
caccccaaagtgcaaaggattc

SEQ ID NO: 17536 - DNA, 24 bp, synthetic construct
  misc_feature 1..24: note = Synthetic Construct
  source 1..24: mol_type = other DNA
gagtacacagtcatgggctagagt

SEQ ID NO: 17537 - DNA, 25 bp, synthetic construct
  misc_feature 1..25: note = Synthetic Construct
  source 1..25: mol_type = other DNA
gagaaggcttttcaagcagaagatt

SEQ ID NO: 17538 - DNA, 25 bp, synthetic construct
  misc_feature 1..25: note = Synthetic Construct
  source 1..25: mol_type = other DNA
ccctttaggttgctggactcatttg

SEQ ID NO: 17539 - DNA, 25 bp, synthetic construct
  misc_feature 1..25: note = Synthetic Construct
  source 1..25: mol_type = other DNA
gttctttctctgtcttccagaccaa

SEQ ID NO: 17540 - DNA, 27 bp, synthetic construct
  misc_feature 1..27: note = Synthetic Construct
  source 1..27: mol_type = other DNA
ccgcaattatcatagcagttcccatct

SEQ ID NO: 17541 - DNA, 26 bp, synthetic construct
  misc_feature 1..26: note = Synthetic Construct
  source 1..26: mol_type = other DNA
gagatgcatggattggactagaggaa

SEQ ID NO: 17542 - DNA, 23 bp, synthetic construct
  misc_feature 1..23: note = Synthetic Construct
  source 1..23: mol_type = other DNA
ggacacactccctacacatttga

SEQ ID NO: 17543 - DNA, 26 bp, synthetic construct
  misc_feature 1..26: note = Synthetic Construct
  source 1..26: mol_type = other DNA
gcacaatagaacaagctaagcctaca

SEQ ID NO: 17544 - DNA, 23 bp, synthetic construct
  misc_feature 1..23: note = Synthetic Construct
  source 1..23: mol_type = other DNA
ccttactgtcccgagaagcaatc

SEQ ID NO: 17545 - DNA, 22 bp, synthetic construct
  misc_feature 1..22: note = Synthetic Construct
  source 1..22: mol_type = other DNA
cagagccatggaaccacagaca

SEQ ID NO: 17546 - DNA, 25 bp, synthetic construct
  misc_feature 1..25: note = Synthetic Construct
  source 1..25: mol_type = other DNA
gcacgtttatgcatgacatctctgt

SEQ ID NO: 17547 - DNA, 26 bp, synthetic construct
  misc_feature 1..26: note = Synthetic Construct
  source 1..26: mol_type = other DNA
cctctgttggaaccactccactctac

SEQ ID NO: 17548 - DNA, 25 bp, synthetic construct
  misc_feature 1..25: note = Synthetic Construct
  source 1..25: mol_type = other DNA
ccctcacatgaatagcctacactct

SEQ ID NO: 17549 - DNA, 23 bp, synthetic construct
  misc_feature 1..23: note = Synthetic Construct
  source 1..23: mol_type = other DNA
ggaacgctgtcagtcgagaattt

SEQ ID NO: 17550 - DNA, 26 bp, synthetic construct
  misc_feature 1..26: note = Synthetic Construct
  source 1..26: mol_type = other DNA
cagagacttgatgagactcaggtttg

SEQ ID NO: 17551 - DNA, 28 bp, synthetic construct
  misc_feature 1..28: note = Synthetic Construct
  source 1..28: mol_type = other DNA
ggcggattagtggctgtctacattattc

SEQ ID NO: 17552 - DNA, 23 bp, synthetic construct
  misc_feature 1..23: note = Synthetic Construct
  source 1..23: mol_type = other DNA
gcaagtcaacagagccgttcatc

SEQ ID NO: 17553 - DNA, 23 bp, synthetic construct
  misc_feature 1..23: note = Synthetic Construct
  source 1..23: mol_type = other DNA
gcatcagcttctgagttgccttt

SEQ ID NO: 17554 - DNA, 23 bp, synthetic construct
  misc_feature 1..23: note = Synthetic Construct
  source 1..23: mol_type = other DNA
gacttgtcattgctccgttcttc

SEQ ID NO: 17555 - DNA, 21 bp, synthetic construct
  misc_feature 1..21: note = Synthetic Construct
  source 1..21: mol_type = other DNA
ccagttgtggatgtggcattg

SEQ ID NO: 17556 - DNA, 19 bp, synthetic construct
  misc_feature 1..19: note = Synthetic Construct
  source 1..19: mol_type = other DNA
gcagacgtctcggctgtgt

SEQ ID NO: 17557 - DNA, 23 bp, synthetic construct
  misc_feature 1..23: note = Synthetic Construct
  source 1..23: mol_type = other DNA
gtgggtctaactggcttgatctt

SEQ ID NO: 17558 - DNA, 24 bp, synthetic construct
  misc_feature 1..24: note = Synthetic Construct
  source 1..24: mol_type = other DNA
agaccactgagcaatgacacaaat

SEQ ID NO: 17559 - DNA, 25 bp, synthetic construct
  misc_feature 1..25: note = Synthetic Construct
  source 1..25: mol_type = other DNA
actccagagtgtatttggttcactt

SEQ ID NO: 17560 - DNA, 26 bp, synthetic construct
  misc_feature 1..26: note = Synthetic Construct
  source 1..26: mol_type = other DNA
ggctctcaggagactttatggtcaga

SEQ ID NO: 17561 - DNA, 23 bp, synthetic construct
  misc_feature 1..23: note = Synthetic Construct
  source 1..23: mol_type = other DNA
tggggcttagggcaagttttaat

SEQ ID NO: 17562 - DNA, 26 bp, synthetic construct
  misc_feature 1..26: note = Synthetic Construct
  source 1..26: mol_type = other DNA
ccacacctggttcctagctctatttg

SEQ ID NO: 17563 - DNA, 24 bp, synthetic construct
  misc_feature 1..24: note = Synthetic Construct
  source 1..24: mol_type = other DNA
atgctgggaatatgacttgtgact

SEQ ID NO: 17564 - DNA, 24 bp, synthetic construct
  misc_feature 1..24: note = Synthetic Construct
  source 1..24: mol_type = other DNA
gaggaaaggttcattccctcttca

SEQ ID NO: 17565 - DNA, 23 bp, synthetic construct
  misc_feature 1..23: note = Synthetic Construct
  source 1..23: mol_type = other DNA
ccagaacgctaaagtaggcagaa

SEQ ID NO: 17566 - DNA, 25 bp, synthetic construct
  misc_feature 1..25: note = Synthetic Construct
  source 1..25: mol_type = other DNA
cccctctactggaagagctaagttg

SEQ ID NO: 17567 - DNA, 19 bp, synthetic construct
  misc_feature 1..19: note = Synthetic Construct
  source 1..19: mol_type = other DNA
tccgcaaaaacccctgtgt

SEQ ID NO: 17568 - DNA, 22 bp, synthetic construct
  misc_feature 1..22: note = Synthetic Construct
  source 1..22: mol_type = other DNA
tgctaagaggggagtctgttct

SEQ ID NO: 17569 - DNA, 23 bp, synthetic construct
  misc_feature 1..23: note = Synthetic Construct
  source 1..23: mol_type = other DNA
acaacacactaggtctccacaga

SEQ ID NO: 17570 - DNA, 25 bp, synthetic construct
  misc_feature 1..25: note = Synthetic Construct
  source 1..25: mol_type = other DNA
ccctctggacctcagtctcatcttt

SEQ ID NO: 17571 - DNA, 20 bp, synthetic construct
  misc_feature 1..20: note = Synthetic Construct
  source 1..20: mol_type = other DNA
aggggaaagacctgccttgt

SEQ ID NO: 17572 - DNA, 25 bp, synthetic construct
  misc_feature 1..25: note = Synthetic Construct
  source 1..25: mol_type = other DNA
tggatacctctgagaagctgatgat

SEQ ID NO: 17573 - DNA, 23 bp, synthetic construct
  misc_feature 1..23: note = Synthetic Construct
  source 1..23: mol_type = other DNA
caggactggaagtgagggtattc

SEQ ID NO: 17574 - DNA, 23 bp, synthetic construct
  misc_feature 1..23: note = Synthetic Construct
  source 1..23: mol_type = other DNA
ggggcgtgtcaaggtattagttg

SEQ ID NO: 17575 - DNA, 24 bp, synthetic construct
  misc_feature 1..24: note = Synthetic Construct
  source 1..24: mol_type = other DNA
ccagtaggtcacagcagaagaaaa

SEQ ID NO: 17576 - DNA, 24 bp, synthetic construct
  misc_feature 1..24: note = Synthetic Construct
  source 1..24: mol_type = other DNA
gtgggtatgtcaccttaggcaaga

SEQ ID NO: 17577 - DNA, 19 bp, synthetic construct
  misc_feature 1..19: note = Synthetic Construct
  source 1..19: mol_type = other DNA
acatgcccgatgccaggta

SEQ ID NO: 17578 - DNA, 26 bp, synthetic construct
  misc_feature 1..26: note = Synthetic Construct
  source 1..26: mol_type = other DNA
gctacaattaggcactggatctggtt

SEQ ID NO: 17579 - DNA, 30 bp, synthetic construct
  misc_feature 1..30: note = Synthetic Construct
  source 1..30: mol_type = other DNA
ccttaccatcagttcagtagaagcatagat

SEQ ID NO: 17580 - DNA, 21 bp, synthetic construct
  misc_feature 1..21: note = Synthetic Construct
  source 1..21: mol_type = other DNA
ggcgggaggaaatgtggaatg

SEQ ID NO: 17581 - DNA, 29 bp, synthetic construct
  misc_feature 1..29: note = Synthetic Construct
  source 1..29: mol_type = other DNA
gagccctagtttaaaaatgtccctgtaag

SEQ ID NO: 17582 - DNA, 29 bp, synthetic construct
  misc_feature 1..29: note = Synthetic Construct
  source 1..29: mol_type = other DNA
ctgagcccagaagacttattttccagttt

SEQ ID NO: 17583 - DNA, 30 bp, synthetic construct
  misc_feature 1..30: note = Synthetic Construct
  source 1..30: mol_type = other DNA
gggtcttcatattaggctgtgagatagtgt

SEQ ID NO: 17584 - DNA, 24 bp, synthetic construct
  misc_feature 1..24: note = Synthetic Construct
  source 1..24: mol_type = other DNA
ggcttaaacctccgtttcttgttc

SEQ ID NO: 17585 - DNA, 28 bp, synthetic construct
  misc_feature 1..28: note = Synthetic Construct
  source 1..28: mol_type = other DNA
ctgaaagcctggatctttcatgggatag

SEQ ID NO: 17586 - DNA, 24 bp, synthetic construct
  misc_feature 1..24: note = Synthetic Construct
  source 1..24: mol_type = other DNA
ccgtgcaggttgatatggttcctt

SEQ ID NO: 17587 - DNA, 24 bp, synthetic construct
  misc_feature 1..24: note = Synthetic Construct
  source 1..24: mol_type = other DNA
ccagccagaagtgttagtgagaag

SEQ ID NO: 17588 - DNA, 22 bp, synthetic construct
  misc_feature 1..22: note = Synthetic Construct
  source 1..22: mol_type = other DNA
cggcatttggttgagcacaaag

SEQ ID NO: 17589 - DNA, 23 bp, synthetic construct
  misc_feature 1..23: note = Synthetic Construct
  source 1..23: mol_type = other DNA
gcagaacctatggcagctaaaac

SEQ ID NO: 17590 - DNA, 25 bp, synthetic construct
  misc_feature 1..25: note = Synthetic Construct
  source 1..25: mol_type = other DNA
ggatcagagagaaccagactcactt

SEQ ID NO: 17591 - DNA, 25 bp, synthetic construct
  misc_feature 1..25: note = Synthetic Construct
  source 1..25: mol_type = other DNA
ctgagttatgtacagggcagagatg

SEQ ID NO: 17592 - DNA, 24 bp, synthetic construct
  misc_feature 1..24: note = Synthetic Construct
  source 1..24: mol_type = other DNA
aggagggcacctgtagattaaaac

SEQ ID NO: 17593 - DNA, 30 bp, synthetic construct
  misc_feature 1..30: note = Synthetic Construct
  source 1..30: mol_type = other DNA
ggcaaaaacattatcattgagcctggattc

SEQ ID NO: 17594 - DNA, 25 bp, synthetic construct
  misc_feature 1..25: note = Synthetic Construct
  source 1..25: mol_type = other DNA
actgtagactccatccaccattaca

SEQ ID NO: 17595 - DNA, 21 bp, synthetic construct
  misc_feature 1..21: note = Synthetic Construct
  source 1..21: mol_type = other DNA
ttgttgggttgatggctgtct

SEQ ID NO: 17596 - DNA, 25 bp, synthetic construct
  misc_feature 1..25: note = Synthetic Construct
  source 1..25: mol_type = other DNA
ggtgtggcttggtttctttttgaag

SEQ ID NO: 17597 - DNA, 25 bp, synthetic construct
  misc_feature 1..25: note = Synthetic Construct
  source 1..25: mol_type = other DNA
ccatgggctaagaaccaggtgaaag

SEQ ID NO: 17598 - DNA, 24 bp, synthetic construct
  misc_feature 1..24: note = Synthetic Construct
  source 1..24: mol_type = other DNA
aaaactgctgctgtaacctgaatc

SEQ ID NO: 17599 - DNA, 25 bp, synthetic construct
  misc_feature 1..25: note = Synthetic Construct
  source 1..25: mol_type = other DNA
ccccagcaatctaactcacccagaa

SEQ ID NO: 17600 - DNA, 24 bp, synthetic construct
  misc_feature 1..24: note = Synthetic Construct
  source 1..24: mol_type = other DNA
gagccgtgtaagaaggaaggatct

SEQ ID NO: 17601 - DNA, 22 bp, synthetic construct
  misc_feature 1..22: note = Synthetic Construct
  source 1..22: mol_type = other DNA
gtggggcttaacagccagtaga

SEQ ID NO: 17602 - DNA, 24 bp, synthetic construct
  misc_feature 1..24: note = Synthetic Construct
  source 1..24: mol_type = other DNA
ggaaccagagatcccagttagctt

SEQ ID NO: 17603 - DNA, 25 bp, synthetic construct
  misc_feature 1..25: note = Synthetic Construct
  source 1..25: mol_type = other DNA
cagtaagatgtgtgcctttggatct

SEQ ID NO: 17604 - DNA, 23 bp, synthetic construct
  misc_feature 1..23: note = Synthetic Construct
  source 1..23: mol_type = other DNA
tgtgtctgttgtccctaggttga

SEQ ID NO: 17605 - DNA, 23 bp, synthetic construct
  misc_feature 1..23: note = Synthetic Construct
  source 1..23: mol_type = other DNA
cctcctgccactaggctttgaac

SEQ ID NO: 17606 - DNA, 26 bp, synthetic construct
  misc_feature 1..26: note = Synthetic Construct
  source 1..26: mol_type = other DNA
ggctgacaagatgtaaaaagctcaac

SEQ ID NO: 17607 - DNA, 23 bp, synthetic construct
  misc_feature 1..23: note = Synthetic Construct
  source 1..23: mol_type = other DNA
gcaagggagtctgacctacatga

SEQ ID NO: 17608 - DNA, 24 bp, synthetic construct
  misc_feature 1..24: note = Synthetic Construct
  source 1..24: mol_type = other DNA
ggttccttcttaccttggagtgaa

SEQ ID NO: 17609 - DNA, 22 bp, synthetic construct
  misc_feature 1..22: note = Synthetic Construct
  source 1..22: mol_type = other DNA
cagcctgcttaagatggtgaga

SEQ ID NO: 17610 - DNA, 29 bp, synthetic construct
  misc_feature 1..29: note = Synthetic Construct
  source 1..29: mol_type = other DNA
ctccaacatcaactcctacaattctcttc

SEQ ID NO: 17611 - DNA, 24 bp, synthetic construct
  misc_feature 1..24: note = Synthetic Construct
  source 1..24: mol_type = other DNA
cccaccagctacacaaggagattc

SEQ ID NO: 17612 - DNA, 22 bp, synthetic construct
  misc_feature 1..22: note = Synthetic Construct
  source 1..22: mol_type = other DNA
cagcagctctttcccctctttc

SEQ ID NO: 17613 - DNA, 25 bp, synthetic construct
  misc_feature 1..25: note = Synthetic Construct
  source 1..25: mol_type = other DNA
gcagaaaatcaaaactggctaccaa

SEQ ID NO: 17614 - DNA, 25 bp, synthetic construct
  misc_feature 1..25: note = Synthetic Construct
  source 1..25: mol_type = other DNA
cagctaaaaagaggctgggaaagaa

SEQ ID NO: 17615 - DNA, 24 bp, synthetic construct
  misc_feature 1..24: note = Synthetic Construct
  source 1..24: mol_type = other DNA
ggaaacagggaatgagggtagaag

SEQ ID NO: 17616 - DNA, 25 bp, synthetic construct
  misc_feature 1..25: note = Synthetic Construct
  source 1..25: mol_type = other DNA
gctaaatggcaagtgaatccctaga

SEQ ID NO: 17617 - DNA, 26 bp, synthetic construct
  misc_feature 1..26: note = Synthetic Construct
  source 1..26: mol_type = other DNA
ggggaagagtgcacttatctgtgttt

SEQ ID NO: 17618 - DNA, 25 bp, synthetic construct
  misc_feature 1..25: note = Synthetic Construct
  source 1..25: mol_type = other DNA
gggtgaagctgggaatatcataagt

SEQ ID NO: 17619 - DNA, 24 bp, synthetic construct
  misc_feature 1..24: note = Synthetic Construct
  source 1..24: mol_type = other DNA
cccgtcttgtgggtaaactgtcat

SEQ ID NO: 17620 - DNA, 24 bp, synthetic construct
  misc_feature 1..24: note = Synthetic Construct
  source 1..24: mol_type = other DNA
caacatggagagacactgttccta

SEQ ID NO: 17621 - DNA, 26 bp, synthetic construct
  misc_feature 1..26: note = Synthetic Construct
  source 1..26: mol_type = other DNA
ccagttgtgtggtctcagggacataa

SEQ ID NO: 17622 - DNA, 25 bp, synthetic construct
  misc_feature 1..25: note = Synthetic Construct
  source 1..25: mol_type = other DNA
ggggaacttgaactaccagcgaaag

SEQ ID NO: 17623 - DNA, 25 bp, synthetic construct
  misc_feature 1..25: note = Synthetic Construct
  source 1..25: mol_type = other DNA
catcagccatatgtatgacgactgt

SEQ ID NO: 17624 - DNA, 25 bp, synthetic construct
  misc_feature 1..25: note = Synthetic Construct
  source 1..25: mol_type = other DNA
ctgtccacttcatctcctttctgtt

SEQ ID NO: 17625 - DNA, 24 bp, synthetic construct
  misc_feature 1..24: note = Synthetic Construct
  source 1..24: mol_type = other DNA
ggatgggaccagatatgcctgaga

SEQ ID NO: 17626 - DNA, 22 bp, synthetic construct
  misc_feature 1..22: note = Synthetic Construct
  source 1..22: mol_type = other DNA
actgcccttgtgactgaaaaca

SEQ ID NO: 17627 - DNA, 24 bp, synthetic construct
  misc_feature 1..24: note = Synthetic Construct
  source 1..24: mol_type = other DNA
ggactgtctcctctctggatgtag

SEQ ID NO: 17628 - DNA, 24 bp, synthetic construct
  misc_feature 1..24: note = Synthetic Construct
  source 1..24: mol_type = other DNA
tctcttctttccaccaaagtgaca

SEQ ID NO: 17629 - DNA, 22 bp, synthetic construct
  misc_feature 1..22: note = Synthetic Construct
  source 1..22: mol_type = other DNA
ctgctccttcctttgggtctga

SEQ ID NO: 17630 - DNA, 22 bp, synthetic construct
  misc_feature 1..22: note = Synthetic Construct
  source 1..22: mol_type = other DNA
aggggaggagtgagcaagaagt

SEQ ID NO: 17631 - DNA, 22 bp, synthetic construct
  misc_feature 1..22: note = Synthetic Construct
  source 1..22: mol_type = other DNA
gtccaaacagagccctggaaaa

SEQ ID NO: 17632 - DNA, 21 bp, synthetic construct
  misc_feature 1..21: note = Synthetic Construct
  source 1..21: mol_type = other DNA
ccctcaatccccttcctgctt

SEQ ID NO: 17633 - DNA, 25 bp, synthetic construct
  misc_feature 1..25: note = Synthetic Construct
  source 1..25: mol_type = other DNA
cccctgaaccaaattctgagatact

SEQ ID NO: 17634 - DNA, 23 bp, synthetic construct
  misc_feature 1..23: note = Synthetic Construct
  source 1..23: mol_type = other DNA
cccaatgaagaagatgccagtca

SEQ ID NO: 17635 - DNA, 23 bp, synthetic construct
  misc_feature 1..23: note = Synthetic Construct
  source 1..23: mol_type = other DNA
cgtgctttgtgagaatggtggaa

SEQ ID NO: 17636 - DNA, 23 bp, synthetic construct
  misc_feature 1..23: note = Synthetic Construct
  source 1..23: mol_type = other DNA
agggtatcacacagtggagacat

SEQ ID NO: 17637 - DNA, 24 bp, synthetic construct
  misc_feature 1..24: note = Synthetic Construct
  source 1..24: mol_type = other DNA
gtcggggaaagtgaaaagaagttg

SEQ ID NO: 17638 - DNA, 23 bp, synthetic construct
  misc_feature 1..23: note = Synthetic Construct
  source 1..23: mol_type = other DNA
ggctccaataaaaccccaacagt

SEQ ID NO: 17639 - DNA, 22 bp, synthetic construct
  misc_feature 1..22: note = Synthetic Construct
  source 1..22: mol_type = other DNA
atggtgaaagctgacccttgaa

SEQ ID NO: 17640 - DNA, 24 bp, synthetic construct
  misc_feature 1..24: note = Synthetic Construct
  source 1..24: mol_type = other DNA
gctgtttgtcttgcccacttccta

SEQ ID NO: 17641 - DNA, 25 bp, synthetic construct
  misc_feature 1..25: note = Synthetic Construct
  source 1..25: mol_type = other DNA
tgtatcgtagttccccattgttcat

SEQ ID NO: 17642 - DNA, 22 bp, synthetic construct
  misc_feature 1..22: note = Synthetic Construct
  source 1..22: mol_type = other DNA
ggccattcaggccagtcataca

SEQ ID NO: 17643 - DNA, 26 bp, synthetic construct
  misc_feature 1..26: note = Synthetic Construct
  source 1..26: mol_type = other DNA
cctcttctagatacaagccccaatca

SEQ ID NO: 17644 - DNA, 21 bp, synthetic construct
  misc_feature 1..21: note = Synthetic Construct
  source 1..21: mol_type = other DNA
aagtgggtgtctggtctctct

SEQ ID NO: 17645 - DNA, 24 bp, synthetic construct
  misc_feature 1..24: note = Synthetic Construct
  source 1..24: mol_type = other DNA
gcaaggggtgaagatactcactgt

SEQ ID NO: 17646 - DNA, 25 bp, synthetic construct
  misc_feature 1..25: note = Synthetic Construct
  source 1..25: mol_type = other DNA
ggggtgagaagggagtatgtagtag

SEQ ID NO: 17647 - DNA, 25 bp, synthetic construct
  misc_feature 1..25: note = Synthetic Construct
  source 1..25: mol_type = other DNA
tctcaatcttccagcttctcattgt

SEQ ID NO: 17648 - DNA, 22 bp, synthetic construct
  misc_feature 1..22: note = Synthetic Construct
  source 1..22: mol_type = other DNA
ccaaccccaaagccagttcagt

SEQ ID NO: 17649 - DNA, 27 bp, synthetic construct
  misc_feature 1..27: note = Synthetic Construct
  source 1..27: mol_type = other DNA
ctgcattctgtctcaaggaagaaatag

SEQ ID NO: 17650 - DNA, 24 bp, synthetic construct
  misc_feature 1..24: note = Synthetic Construct
  source 1..24: mol_type = other DNA
agtgggtacttggatactccatca

SEQ ID NO: 17651 - DNA, 24 bp, synthetic construct
  misc_feature 1..24: note = Synthetic Construct
  source 1..24: mol_type = other DNA
gccactgtttctggtccaatgaag

SEQ ID NO: 17652 - DNA, 30 bp, synthetic construct
  misc_feature 1..30: note = Synthetic Construct
  source 1..30: mol_type = other DNA
gtcagtagttcctctgaagggattatttgt

SEQ ID NO: 17653 - DNA, 25 bp, synthetic construct
  misc_feature 1..25: note = Synthetic Construct
  source 1..25: mol_type = other DNA
tgagtgaaagatggcactgatctac

SEQ ID NO: 17654 - DNA, 22 bp, synthetic construct
  misc_feature 1..22: note = Synthetic Construct
  source 1..22: mol_type = other DNA
ccacctaagcagtcctgcatgt

SEQ ID NO: 17655 - DNA, 21 bp, synthetic construct
  misc_feature 1..21: note = Synthetic Construct
  source 1..21: mol_type = other DNA
ttctgtggggctcagttttgt

SEQ ID NO: 17656 - DNA, 29 bp, synthetic construct
  misc_feature 1..29: note = Synthetic Construct
  source 1..29: mol_type = other DNA
gcaaagctaggcaaatgtctaatggattg

SEQ ID NO: 17657 - DNA, 22 bp, synthetic construct
  misc_feature 1..22: note = Synthetic Construct
  source 1..22: mol_type = other DNA
gcaccgtgagtctaccagaaac

SEQ ID NO: 17658 - DNA, 23 bp, synthetic construct
  misc_feature 1..23: note = Synthetic Construct
  source 1..23: mol_type = other DNA
tgaacatggggtcatcacacttg

SEQ ID NO: 17659 - DNA, 24 bp, synthetic construct
  misc_feature 1..24: note = Synthetic Construct
  source 1..24: mol_type = other DNA
cttcaaggcagtattctggcaagt

SEQ ID NO: 17660 - DNA, 22 bp, synthetic construct
  misc_feature 1..22: note = Synthetic Construct
  source 1..22: mol_type = other DNA
gcaactagctaactggccacaa

SEQ ID NO: 17661 - DNA, 23 bp, synthetic construct
  misc_feature 1..23: note = Synthetic Construct
  source 1..23: mol_type = other DNA
caactccaatcagggtggtctct

SEQ ID NO: 17662 - DNA, 23 bp, synthetic construct
  misc_feature 1..23: note = Synthetic Construct
  source 1..23: mol_type = other DNA
ccactgtaatcaccaaccacgtt

SEQ ID NO: 17663 - DNA, 25 bp, synthetic construct
  misc_feature 1..25: note = Synthetic Construct
  source 1..25: mol_type = other DNA
gcttcttaagcacattctggcaaac

SEQ ID NO: 17664 - DNA, 30 bp, synthetic construct
  misc_feature 1..30: note = Synthetic Construct
  source 1..30: mol_type = other DNA
cagtaggtaaaagaagggatttgtggatag

SEQ ID NO: 17665 - DNA, 24 bp, synthetic construct
  misc_feature 1..24: note = Synthetic Construct
  source 1..24: mol_type = other DNA
gcttttgcagtgttggtgctaaaa

SEQ ID NO: 17666 - DNA, 22 bp, synthetic construct
  misc_feature 1..22: note = Synthetic Construct
  source 1..22: mol_type = other DNA
gggagttgatctgtgtggacaa

SEQ ID NO: 17667 - DNA, 21 bp, synthetic construct
  misc_feature 1..21: note = Synthetic Construct
  source 1..21: mol_type = other DNA
cccaggcagttctgaggtaca

SEQ ID NO: 17668 - DNA, 23 bp, synthetic construct
  misc_feature 1..23: note = Synthetic Construct
  source 1..23: mol_type = other DNA
gcaatgtctaagcctcagtggtt

SEQ ID NO: 17669 - DNA, 23 bp, synthetic construct
  misc_feature 1..23: note = Synthetic Construct
  source 1..23: mol_type = other DNA
accacaactggcttgatttcctt

SEQ ID NO: 17670 - DNA, 25 bp, synthetic construct
  misc_feature 1..25: note = Synthetic Construct
  source 1..25: mol_type = other DNA
agaaactgtagaaggaggagagtca

SEQ ID NO: 17671 - DNA, 24 bp, synthetic construct
  misc_feature 1..24: note = Synthetic Construct
  source 1..24: mol_type = other DNA
gggtgtgattctgacctccctaag

SEQ ID NO: 17672 - DNA, 24 bp, synthetic construct
  misc_feature 1..24: note = Synthetic Construct
  source 1..24: mol_type = other DNA
ggagtgtcttataggggcaagaag

SEQ ID NO: 17673 - DNA, 27 bp, synthetic construct
  misc_feature 1..27: note = Synthetic Construct
  source 1..27: mol_type = other DNA
ccaccagtaagcagagaaatacagtct

SEQ ID NO: 17674 - DNA, 26 bp, synthetic construct
  misc_feature 1..26: note = Synthetic Construct
  source 1..26: mol_type = other DNA
gcctctcttccctgattcttcctttc

SEQ ID NO: 17675 - DNA, 22 bp, synthetic construct
  misc_feature 1..22: note = Synthetic Construct
  source 1..22: mol_type = other DNA
agcatcagacactcggtgttac

SEQ ID NO: 17676 - DNA, 24 bp, synthetic construct
  misc_feature 1..24: note = Synthetic Construct
  source 1..24: mol_type = other DNA
gtcccttcctccatcatgaactgt

SEQ ID NO: 17677 - DNA, 26 bp, synthetic construct
  misc_feature 1..26: note = Synthetic Construct
  source 1..26: mol_type = other DNA
ggagtttgtgttagaagcaggtaaga

SEQ ID NO: 17678 - DNA, 25 bp, synthetic construct
  misc_feature 1..25: note = Synthetic Construct
  source 1..25: mol_type = other DNA
gtggatgcttttgaaggtttggttt

SEQ ID NO: 17679 - DNA, 26 bp, synthetic construct
  misc_feature 1..26: note = Synthetic Construct
  source 1..26: mol_type = other DNA
cacagagttctcatcctcagtgttag

SEQ ID NO: 17680 - DNA, 24 bp, synthetic construct
  misc_feature 1..24: note = Synthetic Construct
  source 1..24: mol_type = other DNA
ctgcatgatcgtattggagtggtt

SEQ ID NO: 17681 - DNA, 27 bp, synthetic construct
  misc_feature 1..27: note = Synthetic Construct
  source 1..27: mol_type = other DNA
gctcagaatccaaacaccatagctttc

SEQ ID NO: 17682 - DNA, 22 bp, synthetic construct
  misc_feature 1..22: note = Synthetic Construct
  source 1..22: mol_type = other DNA
ctgactgcctaactgggtctca

SEQ ID NO: 17683 - DNA, 24 bp, synthetic construct
  misc_feature 1..24: note = Synthetic Construct
  source 1..24: mol_type = other DNA
ggggctgacttaccagtgactcta

SEQ ID NO: 17684 - DNA, 26 bp, synthetic construct
  misc_feature 1..26: note = Synthetic Construct
  source 1..26: mol_type = other DNA
gccagggactaaagtcaaaagcctta

SEQ ID NO: 17685 - DNA, 22 bp, synthetic construct
  misc_feature 1..22: note = Synthetic Construct
  source 1..22: mol_type = other DNA
gggagccaggatttggaactct

SEQ ID NO: 17686 - DNA, 21 bp, synthetic construct
  misc_feature 1..21: note = Synthetic Construct
  source 1..21: mol_type = other DNA
taataccgcccgcagcctctt

SEQ ID NO: 17687 - DNA, 22 bp, synthetic construct
  misc_feature 1..22: note = Synthetic Construct
  source 1..22: mol_type = other DNA
cccaggcaactttctggactgt

SEQ ID NO: 17688 - DNA, 24 bp, synthetic construct
  misc_feature 1..24: note = Synthetic Construct
  source 1..24: mol_type = other DNA
cattttgatgcataccacccttgt

SEQ ID NO: 17689 - DNA, 22 bp, synthetic construct
  misc_feature 1..22: note = Synthetic Construct
  source 1..22: mol_type = other DNA
cgaggtgctaagggaagacaat

SEQ ID NO: 17690 - DNA, 30 bp, synthetic construct
  misc_feature 1..30: note = Synthetic Construct
  source 1..30: mol_type = other DNA
cccatcccagaattgagagaataaggtgta

SEQ ID NO: 17691 - DNA, 23 bp, synthetic construct
  misc_feature 1..23: note = Synthetic Construct
  source 1..23: mol_type = other DNA
gcccatgcctatacagtgctttc

SEQ ID NO: 17692 - DNA, 25 bp, synthetic construct
  misc_feature 1..25: note = Synthetic Construct
  source 1..25: mol_type = other DNA
gcccacaaaccacacatctttcatc

SEQ ID NO: 17693 - DNA, 25 bp, synthetic construct
  misc_feature 1..25: note = Synthetic Construct
  source 1..25: mol_type = other DNA
gaaacccagtgaacatgaaggaaga

SEQ ID NO: 17694 - DNA, 25 bp, synthetic construct
  misc_feature 1..25: note = Synthetic Construct
  source 1..25: mol_type = other DNA
cgagttccatggttttgttccaatc

SEQ ID NO: 17695 - DNA, 26 bp, synthetic construct
  misc_feature 1..26: note = Synthetic Construct
  source 1..26: mol_type = other DNA
cagttgcctttgtggttaagacatac

SEQ ID NO: 17696 - DNA, 24 bp, synthetic construct
  misc_feature 1..24: note = Synthetic Construct
  source 1..24: mol_type = other DNA
ccgattcctttgcagtgtgacttg

SEQ ID NO: 17697 - DNA, 22 bp, synthetic construct
  misc_feature 1..22: note = Synthetic Construct
  source 1..22: mol_type = other DNA
gttgcctgtttgggagatcact

SEQ ID NO: 17698 - DNA, 22 bp, synthetic construct
  misc_feature 1..22: note = Synthetic Construct
  source 1..22: mol_type = other DNA
tgccattagtcatgctgtcact

SEQ ID NO: 17699 - DNA, 27 bp, synthetic construct
  misc_feature 1..27: note = Synthetic Construct
  source 1..27: mol_type = other DNA
ctgcaggtgaacagacaaaaatcatgt

SEQ ID NO: 17700 - DNA, 24 bp, synthetic construct
  misc_feature 1..24: note = Synthetic Construct
  source 1..24: mol_type = other DNA
gggaggagctgacacagttctcta

SEQ ID NO: 17701 - DNA, 24 bp, synthetic construct
  misc_feature 1..24: note = Synthetic Construct
  source 1..24: mol_type = other DNA
aaacgcttcctccttcaagtatca

SEQ ID NO: 17702 - DNA, 22 bp, synthetic construct
  misc_feature 1..22: note = Synthetic Construct
  source 1..22: mol_type = other DNA
ccactgtcaccttcacacaagt

SEQ ID NO: 17703 - DNA, 30 bp, synthetic construct
  misc_feature 1..30: note = Synthetic Construct
  source 1..30: mol_type = other DNA
cagagcacttctataagatggaggcaaaaa

SEQ ID NO: 17704 - DNA, 22 bp, synthetic construct
  misc_feature 1..22: note = Synthetic Construct
  source 1..22: mol_type = other DNA
ctggggcctcttcaagcactaa

SEQ ID NO: 17705 - DNA, 24 bp, synthetic construct
  misc_feature 1..24: note = Synthetic Construct
  source 1..24: mol_type = other DNA
actggatggattcccaatgaactt

SEQ ID NO: 17706 - DNA, 25 bp, synthetic construct
  misc_feature 1..25: note = Synthetic Construct
  source 1..25: mol_type = other DNA
gggcagctcaaactaagcagtgtag

SEQ ID NO: 17707 - DNA, 26 bp, synthetic construct
  misc_feature 1..26: note = Synthetic Construct
  source 1..26: mol_type = other DNA
cctcactcctaacagctgctctttca

SEQ ID NO: 17708 - DNA, 25 bp, synthetic construct
  misc_feature 1..25: note = Synthetic Construct
  source 1..25: mol_type = other DNA
gtccaagcccaatcactagttcctt

SEQ ID NO: 17709 - DNA, 22 bp, synthetic construct
  misc_feature 1..22: note = Synthetic Construct
  source 1..22: mol_type = other DNA
acggaagcatctccgactcctt

SEQ ID NO: 17710 - DNA, 23 bp, synthetic construct
  misc_feature 1..23: note = Synthetic Construct
  source 1..23: mol_type = other DNA
gctctgcttccagtagggcttat

SEQ ID NO: 17711 - DNA, 28 bp, synthetic construct
  misc_feature 1..28: note = Synthetic Construct
  source 1..28: mol_type = other DNA
gcaagcactggattcaacaatgtgtttc

SEQ ID NO: 17712 - DNA, 25 bp, synthetic construct
  misc_feature 1..25: note = Synthetic Construct
  source 1..25: mol_type = other DNA
ctaacataggaaactgccaggagat

SEQ ID NO: 17713 - DNA, 24 bp, synthetic construct
  misc_feature 1..24: note = Synthetic Construct
  source 1..24: mol_type = other DNA
ggtgtggacagagaagggtgaaaa

SEQ ID NO: 17714 - DNA, 27 bp, synthetic construct
  misc_feature 1..27: note = Synthetic Construct
  source 1..27: mol_type = other DNA
tgtcagatgtttcttggttaggacatc

SEQ ID NO: 17715 - DNA, 26 bp, synthetic construct
  misc_feature 1..26: note = Synthetic Construct
  source 1..26: mol_type = other DNA
ggaaccaaagccttcataacatcttc

SEQ ID NO: 17716 - DNA, 24 bp, synthetic construct
  misc_feature 1..24: note = Synthetic Construct
  source 1..24: mol_type = other DNA
gcttaggggtagtgcaggaataag

SEQ ID NO: 17717 - DNA, 22 bp, synthetic construct
  misc_feature 1..22: note = Synthetic Construct
  source 1..22: mol_type = other DNA
ttttggaactgcacacctgttg

SEQ ID NO: 17718 - DNA, 27 bp, synthetic construct
  misc_feature 1..27: note = Synthetic Construct
  source 1..27: mol_type = other DNA
tcctcctccatttacagtgacatttag

SEQ ID NO: 17719 - DNA, 24 bp, synthetic construct
  misc_feature 1..24: note = Synthetic Construct
  source 1..24: mol_type = other DNA
ccaggaaacccaatgacaccttgt

SEQ ID NO: 17720 - DNA, 25 bp, synthetic construct
  misc_feature 1..25: note = Synthetic Construct
  source 1..25: mol_type = other DNA
caagaataaggacaggctggtgaac

SEQ ID NO: 17721 - DNA, 24 bp, synthetic construct
  misc_feature 1..24: note = Synthetic Construct
  source 1..24: mol_type = other DNA
ccccaccttggatttgcctctaac

SEQ ID NO: 17722 - DNA, 26 bp, synthetic construct
  misc_feature 1..26: note = Synthetic Construct
  source 1..26: mol_type = other DNA
tgggagtggaatatacaggaacatca

SEQ ID NO: 17723 - DNA, 26 bp, synthetic construct
  misc_feature 1..26: note = Synthetic Construct
  source 1..26: mol_type = other DNA
acactgatactgagagagaggtcata

SEQ ID NO: 17724 - DNA, 29 bp, synthetic construct
  misc_feature 1..29: note = Synthetic Construct
  source 1..29: mol_type = other DNA
gctgaaattctacatggggttcctaggtt

SEQ ID NO: 17725 - DNA, 22 bp, synthetic construct
  misc_feature 1..22: note = Synthetic Construct
  source 1..22: mol_type = other DNA
tgctgcttcagctggggtaatg

SEQ ID NO: 17726 - DNA, 22 bp, synthetic construct
  misc_feature 1..22: note = Synthetic Construct
  source 1..22: mol_type = other DNA
gcccactggaaacacaccatgt

SEQ ID NO: 17727 - DNA, 28 bp, synthetic construct
  misc_feature 1..28: note = Synthetic Construct
  source 1..28: mol_type = other DNA
ctgtttctgccatggatactggtaattg

SEQ ID NO: 17728 - DNA, 25 bp, synthetic construct
  misc_feature 1..25: note = Synthetic Construct
  source 1..25: mol_type = other DNA
cacgtgtcttcatgtagagctgctt

SEQ ID NO: 17729 - DNA, 24 bp, synthetic construct
  misc_feature 1..24: note = Synthetic Construct
  source 1..24: mol_type = other DNA
cctgtttgtacaggaactgtgtgt

SEQ ID NO: 17730 - DNA, 21 bp, synthetic construct
  misc_feature 1..21: note = Synthetic Construct
  source 1..21: mol_type = other DNA
ccagcctgcatcgtccttact

SEQ ID NO: 17731 - DNA, 27 bp, synthetic construct
  misc_feature 1..27: note = Synthetic Construct
  source 1..27: mol_type = other DNA
cccacatttattaaaccgtgtgcttct

SEQ ID NO: 17732 - DNA, 29 bp, synthetic construct
  misc_feature 1..29: note = Synthetic Construct
  source 1..29: mol_type = other DNA
ctgtagcttaaaagtaggggagtcctaga

SEQ ID NO: 17733 - DNA, 26 bp, synthetic construct
  misc_feature 1..26: note = Synthetic Construct
  source 1..26: mol_type = other DNA
cagagatagccctcttacagatcaag

SEQ ID NO: 17734 - DNA, 22 bp, synthetic construct
  misc_feature 1..22: note = Synthetic Construct
  source 1..22: mol_type = other DNA
gctctacaggcatggtgacaag

SEQ ID NO: 17735 - DNA, 26 bp, synthetic construct
  misc_feature 1..26: note = Synthetic Construct
  source 1..26: mol_type = other DNA
gcactgcaatatcatcatcctagctt

SEQ ID NO: 17736 - DNA, 20 bp, synthetic construct
  misc_feature 1..20: note = Synthetic Construct
  source 1..20: mol_type = other DNA
cgcacatggaccatcacaca

SEQ ID NO: 17737 - DNA, 22 bp, synthetic construct
  misc_feature 1..22: note = Synthetic Construct
  source 1..22: mol_type = other DNA
gacaaaaggccaattgcaggaa

SEQ ID NO: 17738 - DNA, 24 bp, synthetic construct
  misc_feature 1..24: note = Synthetic Construct
  source 1..24: mol_type = other DNA
ttgggtaataccaggactcccata

SEQ ID NO: 17739 - DNA, 24 bp, synthetic construct
  misc_feature 1..24: note = Synthetic Construct
  source 1..24: mol_type = other DNA
tgcctaaaaccagtcatggacttc

SEQ ID NO: 17740 - DNA, 27 bp, synthetic construct
  misc_feature 1..27: note = Synthetic Construct
  source 1..27: mol_type = other DNA
ccacacgtcaagcactttctaactttc

SEQ ID NO: 17741 - DNA, 22 bp, synthetic construct
  misc_feature 1..22: note = Synthetic Construct
  source 1..22: mol_type = other DNA
gatgcatggcagaaccctaaac

SEQ ID NO: 17742 - DNA, 24 bp, synthetic construct
  misc_feature 1..24: note = Synthetic Construct
  source 1..24: mol_type = other DNA
cgggctggatgaagagaaggtaca

SEQ ID NO: 17743 - DNA, 24 bp, synthetic construct
  misc_feature 1..24: note = Synthetic Construct
  source 1..24: mol_type = other DNA
ctcaagtgaaactgccttttggat

SEQ ID NO: 17744 - DNA, 29 bp, synthetic construct
  misc_feature 1..29: note = Synthetic Construct
  source 1..29: mol_type = other DNA
gccaaagaacctactcctcatgatgtttt

SEQ ID NO: 17745 - DNA, 23 bp, synthetic construct
  misc_feature 1..23: note = Synthetic Construct
  source 1..23: mol_type = other DNA
ggctatggcacagacagtaggtt

SEQ ID NO: 17746 - DNA, 21 bp, synthetic construct
  misc_feature 1..21: note = Synthetic Construct
  source 1..21: mol_type = other DNA
cgcccacaaagacgattcgat

SEQ ID NO: 17747 - DNA, 24 bp, synthetic construct
  misc_feature 1..24: note = Synthetic Construct
  source 1..24: mol_type = other DNA
cttctctcccaggtaaggctaact

SEQ ID NO: 17748 - DNA, 25 bp, synthetic construct
  misc_feature 1..25: note = Synthetic Construct
  source 1..25: mol_type = other DNA
tcccttgtttgtcctccaacttaaa

SEQ ID NO: 17749 - DNA, 28 bp, synthetic construct
  misc_feature 1..28: note = Synthetic Construct
  source 1..28: mol_type = other DNA
gggtgacagagtcttaaacatccacatt

SEQ ID NO: 17750 - DNA, 24 bp, synthetic construct
  misc_feature 1..24: note = Synthetic Construct
  source 1..24: mol_type = other DNA
ccttgccagtttccccatattttc

SEQ ID NO: 17751 - DNA, 27 bp, synthetic construct
  misc_feature 1..27: note = Synthetic Construct
  source 1..27: mol_type = other DNA
ggagtaatcaagtgccattgggttttc

SEQ ID NO: 17752 - DNA, 21 bp, synthetic construct
  misc_feature 1..21: note = Synthetic Construct
  source 1..21: mol_type = other DNA
cgcccctttacccttttctct

SEQ ID NO: 17753 - DNA, 23 bp, synthetic construct
  misc_feature 1..23: note = Synthetic Construct
  source 1..23: mol_type = other DNA
ccatggccacattctgggtctaa

SEQ ID NO: 17754 - DNA, 26 bp, synthetic construct
  misc_feature 1..26: note = Synthetic Construct
  source 1..26: mol_type = other DNA
aggtttggggtaggttctttctttag

SEQ ID NO: 17755 - DNA, 21 bp, synthetic construct
  misc_feature 1..21: note = Synthetic Construct
  source 1..21: mol_type = other DNA
cccagaagtccccagagacaa

SEQ ID NO: 17756 - DNA, 25 bp, synthetic construct
  misc_feature 1..25: note = Synthetic Construct
  source 1..25: mol_type = other DNA
acttccctccaagttaaagtgtgaa

SEQ ID NO: 17757 - DNA, 24 bp, synthetic construct
  misc_feature 1..24: note = Synthetic Construct
  source 1..24: mol_type = other DNA
ctggtttggggttgctcctttagt

SEQ ID NO: 17758 - DNA, 23 bp, synthetic construct
  misc_feature 1..23: note = Synthetic Construct
  source 1..23: mol_type = other DNA
gctgttggtgttgttgcctctta

SEQ ID NO: 17759 - DNA, 20 bp, synthetic construct
  misc_feature 1..20: note = Synthetic Construct
  source 1..20: mol_type = other DNA
aagctctgccaccctgtagt

SEQ ID NO: 17760 - DNA, 23 bp, synthetic construct
  misc_feature 1..23: note = Synthetic Construct
  source 1..23: mol_type = other DNA
ccctgtcctaagccactcttttc

SEQ ID NO: 17761 - DNA, 24 bp, synthetic construct
  misc_feature 1..24: note = Synthetic Construct
  source 1..24: mol_type = other DNA
tggatggatatttgttggctgtca

SEQ ID NO: 17762 - DNA, 23 bp, synthetic construct
  misc_feature 1..23: note = Synthetic Construct
  source 1..23: mol_type = other DNA
ctgtgcaaggttagaggcaaaag

SEQ ID NO: 17763 - DNA, 26 bp, synthetic construct
  misc_feature 1..26: note = Synthetic Construct
  source 1..26: mol_type = other DNA
gaggccatcagctttttctctctttg

SEQ ID NO: 17764 - DNA, 24 bp, synthetic construct
  misc_feature 1..24: note = Synthetic Construct
  source 1..24: mol_type = other DNA
tgccctggcatacctctctcatag

SEQ ID NO: 17765 - DNA, 24 bp, synthetic construct
  misc_feature 1..24: note = Synthetic Construct
  source 1..24: mol_type = other DNA
cgacaacaacattgcgaggtctct

SEQ ID NO: 17766 - DNA, 25 bp, synthetic construct
  misc_feature 1..25: note = Synthetic Construct
  source 1..25: mol_type = other DNA
gacaccagtaactgagacaatgcta

SEQ ID NO: 17767 - DNA, 24 bp, synthetic construct
  misc_feature 1..24: note = Synthetic Construct
  source 1..24: mol_type = other DNA
gtcctggacactgatgttttgtga

SEQ ID NO: 17768 - DNA, 26 bp, synthetic construct
  misc_feature 1..26: note = Synthetic Construct
  source 1..26: mol_type = other DNA
aggaggaggatagccttatttcttct

SEQ ID NO: 17769 - DNA, 24 bp, synthetic construct
  misc_feature 1..24: note = Synthetic Construct
  source 1..24: mol_type = other DNA
cttcaggccacagagtaaaacctt

SEQ ID NO: 17770 - DNA, 25 bp, synthetic construct
  misc_feature 1..25: note = Synthetic Construct
  source 1..25: mol_type = other DNA
ggggtgctgttaatatcctccgttt

SEQ ID NO: 17771 - DNA, 23 bp, synthetic construct
  misc_feature 1..23: note = Synthetic Construct
  source 1..23: mol_type = other DNA
ggacaagcgacactggagataag

SEQ ID NO: 17772 - DNA, 22 bp, synthetic construct
  misc_feature 1..22: note = Synthetic Construct
  source 1..22: mol_type = other DNA
ttgactaacacgtcacgacact

SEQ ID NO: 17773 - DNA, 23 bp, synthetic construct
  misc_feature 1..23: note = Synthetic Construct
  source 1..23: mol_type = other DNA
tcatggggtaagagaggttctca

SEQ ID NO: 17774 - DNA, 20 bp, synthetic construct
  misc_feature 1..20: note = Synthetic Construct
  source 1..20: mol_type = other DNA
agggcttttggtgccacgat

SEQ ID NO: 17775 - DNA, 26 bp, synthetic construct
  misc_feature 1..26: note = Synthetic Construct
  source 1..26: mol_type = other DNA
gctcttcctgctgtttatcccagaga

SEQ ID NO: 17776 - DNA, 21 bp, synthetic construct
  misc_feature 1..21: note = Synthetic Construct
  source 1..21: mol_type = other DNA
tttcactcgcaatcccacaga

SEQ ID NO: 17777 - DNA, 22 bp, synthetic construct
  misc_feature 1..22: note = Synthetic Construct
  source 1..22: mol_type = other DNA
ctgccaatccatcagtccttct

SEQ ID NO: 17778 - DNA, 29 bp, synthetic construct
  misc_feature 1..29: note = Synthetic Construct
  source 1..29: mol_type = other DNA
ggggagaagaagttgagttctagatgctt

SEQ ID NO: 17779 - DNA, 22 bp, synthetic construct
  misc_feature 1..22: note = Synthetic Construct
  source 1..22: mol_type = other DNA
ggatgcattgcactaagcatgt

SEQ ID NO: 17780 - DNA, 24 bp, synthetic construct
  misc_feature 1..24: note = Synthetic Construct
  source 1..24: mol_type = other DNA
cagcttgcagaggctagtctttct

SEQ ID NO: 17781 - DNA, 22 bp, synthetic construct
  misc_feature 1..22: note = Synthetic Construct
  source 1..22: mol_type = other DNA
cgaggtactgtgggtctggaaa

SEQ ID NO: 17782 - DNA, 22 bp, synthetic construct
  misc_feature 1..22: note = Synthetic Construct
  source 1..22: mol_type = other DNA
ctgtatgggctctgtgcaggat

SEQ ID NO: 17783 - DNA, 27 bp, synthetic construct
  misc_feature 1..27: note = Synthetic Construct
  source 1..27: mol_type = other DNA
ccctgtaagcaagaacaatgccttcat

SEQ ID NO: 17784 - DNA, 25 bp, synthetic construct
  misc_feature 1..25: note = Synthetic Construct
  source 1..25: mol_type = other DNA
gagtctctcacaaatggtggtctca

SEQ ID NO: 17785 - DNA, 24 bp, synthetic construct
  misc_feature 1..24: note = Synthetic Construct
  source 1..24: mol_type = other DNA
gccaccatgcccttattctgtttg

SEQ ID NO: 17786 - DNA, 30 bp, synthetic construct
  misc_feature 1..30: note = Synthetic Construct
  source 1..30: mol_type = other DNA
ctgtctggcctaaaatgtttacttggctat

SEQ ID NO: 17787 - DNA, 24 bp, synthetic construct
  misc_feature 1..24: note = Synthetic Construct
  source 1..24: mol_type = other DNA
ggaacaacagtcctgagtgcagat

SEQ ID NO: 17788 - DNA, 26 bp, synthetic construct
  misc_feature 1..26: note = Synthetic Construct
  source 1..26: mol_type = other DNA
cgttagcatgtataagagcagtcttc

SEQ ID NO: 17789 - DNA, 25 bp, synthetic construct
  misc_feature 1..25: note = Synthetic Construct
  source 1..25: mol_type = other DNA
gttgatgacacctcaactgtgactt

SEQ ID NO: 17790 - DNA, 26 bp, synthetic construct
  misc_feature 1..26: note = Synthetic Construct
  source 1..26: mol_type = other DNA
ccatccagatcttaggagaaacaaga

SEQ ID NO: 17791 - DNA, 24 bp, synthetic construct
  misc_feature 1..24: note = Synthetic Construct
  source 1..24: mol_type = other DNA
ggcacatctcaatagccccagaca

SEQ ID NO: 17792 - DNA, 22 bp, synthetic construct
  misc_feature 1..22: note = Synthetic Construct
  source 1..22: mol_type = other DNA
ggagggccatcaacaatgtgaa

SEQ ID NO: 17793 - DNA, 21 bp, synthetic construct
  misc_feature 1..21: note = Synthetic Construct
  source 1..21: mol_type = other DNA
agggcccttccttgtggagaa

SEQ ID NO: 17794 - DNA, 22 bp, synthetic construct
  misc_feature 1..22: note = Synthetic Construct
  source 1..22: mol_type = other DNA
ctcaggcccttgtagtccagtt

SEQ ID NO: 17795 - DNA, 20 bp, synthetic construct
  misc_feature 1..20: note = Synthetic Construct
  source 1..20: mol_type = other DNA
gccaggcacatgatggcatt

SEQ ID NO: 17796 - DNA, 22 bp, synthetic construct
  misc_feature 1..22: note = Synthetic Construct
  source 1..22: mol_type = other DNA
ccctttcacgacactggcatct

SEQ ID NO: 17797 - DNA, 24 bp, synthetic construct
  misc_feature 1..24: note = Synthetic Construct
  source 1..24: mol_type = other DNA
ggcttggcagtttcagctatgtgt

SEQ ID NO: 17798 - DNA, 24 bp, synthetic construct
  misc_feature 1..24: note = Synthetic Construct
  source 1..24: mol_type = other DNA
acaggtacttagagcactccctta

SEQ ID NO: 17799 - DNA, 23 bp, synthetic construct
  misc_feature 1..23: note = Synthetic Construct
  source 1..23: mol_type = other DNA
ggggagtgaatggggtgtagaag

SEQ ID NO: 17800 - DNA, 27 bp, synthetic construct
  misc_feature 1..27: note = Synthetic Construct
  source 1..27: mol_type = other DNA
ggttccctgagaattccattgaagata

SEQ ID NO: 17801 - DNA, 22 bp, synthetic construct
  misc_feature 1..22: note = Synthetic Construct
  source 1..22: mol_type = other DNA
cagccctggataaggcaagaga

SEQ ID NO: 17802 - DNA, 26 bp, synthetic construct
  misc_feature 1..26: note = Synthetic Construct
  source 1..26: mol_type = other DNA
ggctagaagttccttcaaggcagata

SEQ ID NO: 17803 - DNA, 24 bp, synthetic construct
  misc_feature 1..24: note = Synthetic Construct
  source 1..24: mol_type = other DNA
ggtaacgattacagctgccaacta

SEQ ID NO: 17804 - DNA, 22 bp, synthetic construct
  misc_feature 1..22: note = Synthetic Construct
  source 1..22: mol_type = other DNA
ccttgggttgcttctccctgaa

SEQ ID NO: 17805 - DNA, 23 bp, synthetic construct
  misc_feature 1..23: note = Synthetic Construct
  source 1..23: mol_type = other DNA
ggtagcataatccccgccttatc

SEQ ID NO: 17806 - DNA, 22 bp, synthetic construct
  misc_feature 1..22: note = Synthetic Construct
  source 1..22: mol_type = other DNA
aggaatgggatgggagaaggat

SEQ ID NO: 17807 - DNA, 24 bp, synthetic construct
  misc_feature 1..24: note = Synthetic Construct
  source 1..24: mol_type = other DNA
ctgccttgtctttgctctcactct

SEQ ID NO: 17808 - DNA, 24 bp, synthetic construct
  misc_feature 1..24: note = Synthetic Construct
  source 1..24: mol_type = other DNA
gggctggactaaaaggtaaacagt

SEQ ID NO: 17809 - DNA, 27 bp, synthetic construct
  misc_feature 1..27: note = Synthetic Construct
  source 1..27: mol_type = other DNA
cctgcagctgatacagtagatggctaa

SEQ ID NO: 17810 - DNA, 26 bp, synthetic construct
  misc_feature 1..26: note = Synthetic Construct
  source 1..26: mol_type = other DNA
gcctgtcttagggaattgtgttggtt

SEQ ID NO: 17811 - DNA, 21 bp, synthetic construct
  misc_feature 1..21: note = Synthetic Construct
  source 1..21: mol_type = other DNA
ggccacggtttaccaggaaca

SEQ ID NO: 17812 - DNA, 23 bp, synthetic construct
  misc_feature 1..23: note = Synthetic Construct
  source 1..23: mol_type = other DNA
ctcccaacacacaaacccatcta

SEQ ID NO: 17813 - DNA, 27 bp, synthetic construct
  misc_feature 1..27: note = Synthetic Construct
  source 1..27: mol_type = other DNA
ctcatcatgggtgatttccttgtggat

SEQ ID NO: 17814 - DNA, 22 bp, synthetic construct
  misc_feature 1..22: note = Synthetic Construct
  source 1..22: mol_type = other DNA
gcacagtcaatatgggcaggaa

SEQ ID NO: 17815 - DNA, 24 bp, synthetic construct
  misc_feature 1..24: note = Synthetic Construct
  source 1..24: mol_type = other DNA
gccatttccactgatcccttgttg

SEQ ID NO: 17816 - DNA, 23 bp, synthetic construct
  misc_feature 1..23: note = Synthetic Construct
  source 1..23: mol_type = other DNA
cagcacctggatccaagacactt

SEQ ID NO: 17817 - DNA, 21 bp, synthetic construct
  misc_feature 1..21: note = Synthetic Construct
  source 1..21: mol_type = other DNA
gacgaagcagaacccactcat

SEQ ID NO: 17818 - DNA, 24 bp, synthetic construct
  misc_feature 1..24: note = Synthetic Construct
  source 1..24: mol_type = other DNA
cctgtgagacacaactatccaaca

SEQ ID NO: 17819 - DNA, 23 bp, synthetic construct
  misc_feature 1..23: note = Synthetic Construct
  source 1..23: mol_type = other DNA
aggcagtgacagaatcgagacta

SEQ ID NO: 17820 - DNA, 22 bp, synthetic construct
  misc_feature 1..22: note = Synthetic Construct
  source 1..22: mol_type = other DNA
gagggtgaggaaaacgctgtga

SEQ ID NO: 17821 - DNA, 20 bp, synthetic construct
  misc_feature 1..20: note = Synthetic Construct
  source 1..20: mol_type = other DNA
tgaccccttgggcatcttga

SEQ ID NO: 17822 - DNA, 23 bp, synthetic construct
  misc_feature 1..23: note = Synthetic Construct
  source 1..23: mol_type = other DNA
cccttagcttcccattgttgtgt

SEQ ID NO: 17823 - DNA, 26 bp, synthetic construct
  misc_feature 1..26: note = Synthetic Construct
  source 1..26: mol_type = other DNA
cacaagaaggctttcccagtatcaac

SEQ ID NO: 17824 - DNA, 24 bp, synthetic construct
  misc_feature 1..24: note = Synthetic Construct
  source 1..24: mol_type = other DNA
cctgctgttagttttccaccacaa

SEQ ID NO: 17825 - DNA, 21 bp, synthetic construct
  misc_feature 1..21: note = Synthetic Construct
  source 1..21: mol_type = other DNA
gggctttggaagacactgcaa

SEQ ID NO: 17826 - DNA, 24 bp, synthetic construct
  misc_feature 1..24: note = Synthetic Construct
  source 1..24: mol_type = other DNA
agtgctgtgctacctaattgcttt

SEQ ID NO: 17827 - DNA, 22 bp, synthetic construct
  misc_feature 1..22: note = Synthetic Construct
  source 1..22: mol_type = other DNA
gtgccgatctaatcgcaagtga

SEQ ID NO: 17828 - DNA, 25 bp, synthetic construct
  misc_feature 1..25: note = Synthetic Construct
  source 1..25: mol_type = other DNA
ggattttggttgccttttcccacta

SEQ ID NO: 17829 - DNA, 23 bp, synthetic construct
  misc_feature 1..23: note = Synthetic Construct
  source 1..23: mol_type = other DNA
ccagcagcaacagcacacatttt

SEQ ID NO: 17830 - DNA, 24 bp, synthetic construct
  misc_feature 1..24: note = Synthetic Construct
  source 1..24: mol_type = other DNA
gtggcaacatacaaacagcactaa

SEQ ID NO: 17831 - DNA, 23 bp, synthetic construct
  misc_feature 1..23: note = Synthetic Construct
  source 1..23: mol_type = other DNA
gctgtcatcagacccaagccaaa

SEQ ID NO: 17832 - DNA, 23 bp, synthetic construct
  misc_feature 1..23: note = Synthetic Construct
  source 1..23: mol_type = other DNA
tggcaagagctgacatttaccaa

SEQ ID NO: 17833 - DNA, 26 bp, synthetic construct
  misc_feature 1..26: note = Synthetic Construct
  source 1..26: mol_type = other DNA
ccacctatactgaacttaggggaaga

SEQ ID NO: 17834 - DNA, 22 bp, synthetic construct
  misc_feature 1..22: note = Synthetic Construct
  source 1..22: mol_type = other DNA
accaggaaccttcttgggcata

SEQ ID NO: 17835 - DNA, 24 bp, synthetic construct
  misc_feature 1..24: note = Synthetic Construct
  source 1..24: mol_type = other DNA
caccatgcaggggtttattactga

SEQ ID NO: 17836 - DNA, 22 bp, synthetic construct
  misc_feature 1..22: note = Synthetic Construct
  source 1..22: mol_type = other DNA
gttagcgttttggggaggtagt

SEQ ID NO: 17837 - DNA, 27 bp, synthetic construct
  misc_feature 1..27: note = Synthetic Construct
  source 1..27: mol_type = other DNA
ccttgcttgaaatttcccgtatagatg

SEQ ID NO: 17838 - DNA, 26 bp, synthetic construct
  misc_feature 1..26: note = Synthetic Construct
  source 1..26: mol_type = other DNA
caggccagagttaatcagatttggaa

SEQ ID NO: 17839 - DNA, 20 bp, synthetic construct
  misc_feature 1..20: note = Synthetic Construct
  source 1..20: mol_type = other DNA
gggctggaagaggctgcaaa

SEQ ID NO: 17840 - DNA, 25 bp, synthetic construct
  misc_feature 1..25: note = Synthetic Construct
  source 1..25: mol_type = other DNA
ggttcctgtgtgtagctgatcattc

SEQ ID NO: 17841 - DNA, 22 bp, synthetic construct
  misc_feature 1..22: note = Synthetic Construct
  source 1..22: mol_type = other DNA
gcctcaagtgcaggaaaagaca

SEQ ID NO: 17842 - DNA, 26 bp, synthetic construct
  misc_feature 1..26: note = Synthetic Construct
  source 1..26: mol_type = other DNA
gtgcctgctagtacatctggtgttag

SEQ ID NO: 17843 - DNA, 22 bp, synthetic construct
  misc_feature 1..22: note = Synthetic Construct
  source 1..22: mol_type = other DNA
ggtgccactgactccaaggaaa

SEQ ID NO: 17844 - DNA, 24 bp, synthetic construct
  misc_feature 1..24: note = Synthetic Construct
  source 1..24: mol_type = other DNA
tcttcttctgcaactctgttccaa

SEQ ID NO: 17845 - DNA, 22 bp, synthetic construct
  misc_feature 1..22: note = Synthetic Construct
  source 1..22: mol_type = other DNA
gatggtgccttgttgctgaatc

SEQ ID NO: 17846 - DNA, 23 bp, synthetic construct
  misc_feature 1..23: note = Synthetic Construct
  source 1..23: mol_type = other DNA
ctctctgcttgtgagtggtgaca

SEQ ID NO: 17847 - DNA, 25 bp, synthetic construct
  misc_feature 1..25: note = Synthetic Construct
  source 1..25: mol_type = other DNA
ccccacaccaagtatttttgctctt

SEQ ID NO: 17848 - DNA, 27 bp, synthetic construct
  misc_feature 1..27: note = Synthetic Construct
  source 1..27: mol_type = other DNA
ggataggtcagttaattgggattcaga

SEQ ID NO: 17849 - DNA, 20 bp, synthetic construct
  misc_feature 1..20: note = Synthetic Construct
  source 1..20: mol_type = other DNA
ttgcaggagccccttccaat

SEQ ID NO: 17850 - DNA, 20 bp, synthetic construct
  misc_feature 1..20: note = Synthetic Construct
  source 1..20: mol_type = other DNA
gggtgccagttctgctgcat

SEQ ID NO: 17851 - DNA, 30 bp, synthetic construct
  misc_feature 1..30: note = Synthetic Construct
  source 1..30: mol_type = other DNA
gtgagaaggggtctagtatttagggaaaaa

SEQ ID NO: 17852 - DNA, 23 bp, synthetic construct
  misc_feature 1..23: note = Synthetic Construct
  source 1..23: mol_type = other DNA
caccaagctcattctctgccaat

SEQ ID NO: 17853 - DNA, 22 bp, synthetic construct
  misc_feature 1..22: note = Synthetic Construct
  source 1..22: mol_type = other DNA
ggtggccaagtgcagaagaaca

SEQ ID NO: 17854 - DNA, 26 bp, synthetic construct
  misc_feature 1..26: note = Synthetic Construct
  source 1..26: mol_type = other DNA
cctgaacaaatttcagtggcagacaa

SEQ ID NO: 17855 - DNA, 25 bp, synthetic construct
  misc_feature 1..25: note = Synthetic Construct
  source 1..25: mol_type = other DNA
ccctttcctttcttctgctccaagt

SEQ ID NO: 17856 - DNA, 26 bp, synthetic construct
  misc_feature 1..26: note = Synthetic Construct
  source 1..26: mol_type = other DNA
gagatagcaagtacaaaccacacgta

SEQ ID NO: 17857 - DNA, 20 bp, synthetic construct
  misc_feature 1..20: note = Synthetic Construct
  source 1..20: mol_type = other DNA
ttgacacgcaaccccacaca

SEQ ID NO: 17858 - DNA, 27 bp, synthetic construct
  misc_feature 1..27: note = Synthetic Construct
  source 1..27: mol_type = other DNA
gctccttttcctcagcacataaacata

SEQ ID NO: 17859 - DNA, 21 bp, synthetic construct
  misc_feature 1..21: note = Synthetic Construct
  source 1..21: mol_type = other DNA
cggcatgagcgaagaggatct

SEQ ID NO: 17860 - DNA, 25 bp, synthetic construct
  misc_feature 1..25: note = Synthetic Construct
  source 1..25: mol_type = other DNA
gcaatctccaggacccctaaaattc

SEQ ID NO: 17861 - DNA, 21 bp, synthetic construct
  misc_feature 1..21: note = Synthetic Construct
  source 1..21: mol_type = other DNA
tggagaagggccaacatcagt

SEQ ID NO: 17862 - DNA, 21 bp, synthetic construct
  misc_feature 1..21: note = Synthetic Construct
  source 1..21: mol_type = other DNA
gcaggtttttggttgccttga

SEQ ID NO: 17863 - DNA, 22 bp, synthetic construct
  misc_feature 1..22: note = Synthetic Construct
  source 1..22: mol_type = other DNA
gggtctctgtcgccatctttct

SEQ ID NO: 17864 - DNA, 26 bp, synthetic construct
  misc_feature 1..26: note = Synthetic Construct
  source 1..26: mol_type = other DNA
tcgtgagtgggtcatttatgtcttag

SEQ ID NO: 17865 - DNA, 23 bp, synthetic construct
  misc_feature 1..23: note = Synthetic Construct
  source 1..23: mol_type = other DNA
gtcctgacaaagcaggacataca

SEQ ID NO: 17866 - DNA, 25 bp, synthetic construct
  misc_feature 1..25: note = Synthetic Construct
  source 1..25: mol_type = other DNA
ggaatcaattgtttgccagcacagt

SEQ ID NO: 17867 - DNA, 23 bp, synthetic construct
  misc_feature 1..23: note = Synthetic Construct
  source 1..23: mol_type = other DNA
ttgctcctccttttctcctcttc

SEQ ID NO: 17868 - DNA, 24 bp, synthetic construct
  misc_feature 1..24: note = Synthetic Construct
  source 1..24: mol_type = other DNA
tctctcgggcaaacttacatttca

SEQ ID NO: 17869 - DNA, 23 bp, synthetic construct
  misc_feature 1..23: note = Synthetic Construct
  source 1..23: mol_type = other DNA
cccacagtttgacaagcagactt

SEQ ID NO: 17870 - DNA, 22 bp, synthetic construct
  misc_feature 1..22: note = Synthetic Construct
  source 1..22: mol_type = other DNA
agggagcctcttcctcagatgt

SEQ ID NO: 17871 - DNA, 22 bp, synthetic construct
  misc_feature 1..22: note = Synthetic Construct
  source 1..22: mol_type = other DNA
gctggggagtgtcaatgagcaa

SEQ ID NO: 17872 - DNA, 21 bp, synthetic construct
  misc_feature 1..21: note = Synthetic Construct
  source 1..21: mol_type = other DNA
ggagtgcgttcatgagtcagt

SEQ ID NO: 17873 - DNA, 21 bp, synthetic construct
  misc_feature 1..21: note = Synthetic Construct
  source 1..21: mol_type = other DNA
gggctaaaagggcacactgta

SEQ ID NO: 17874 - DNA, 27 bp, synthetic construct
  misc_feature 1..27: note = Synthetic Construct
  source 1..27: mol_type = other DNA
gaaccaaagactggtaagaccattaac

SEQ ID NO: 17875 - DNA, 22 bp, synthetic construct
  misc_feature 1..22: note = Synthetic Construct
  source 1..22: mol_type = other DNA
tgggtgaaacagggcagtcttg

SEQ ID NO: 17876 - DNA, 24 bp, synthetic construct
  misc_feature 1..24: note = Synthetic Construct
  source 1..24: mol_type = other DNA
gctcacaggggtttggggttattg

SEQ ID NO: 17877 - DNA, 27 bp, synthetic construct
  misc_feature 1..27: note = Synthetic Construct
  source 1..27: mol_type = other DNA
gatcctagtgattctttgggacctaac

SEQ ID NO: 17878 - DNA, 22 bp, synthetic construct
  misc_feature 1..22: note = Synthetic Construct
  source 1..22: mol_type = other DNA
ccctggaggaaaacggtacaca

SEQ ID NO: 17879 - DNA, 23 bp, synthetic construct
  misc_feature 1..23: note = Synthetic Construct
  source 1..23: mol_type = other DNA
catgacaccagttgccacaaatc

SEQ ID NO: 17880 - DNA, 23 bp, synthetic construct
  misc_feature 1..23: note = Synthetic Construct
  source 1..23: mol_type = other DNA
gctccaccacttctttgagtttc

SEQ ID NO: 17881 - DNA, 22 bp, synthetic construct
  misc_feature 1..22: note = Synthetic Construct
  source 1..22: mol_type = other DNA
gaggtcagttggacccttcaga

SEQ ID NO: 17882 - DNA, 22 bp, synthetic construct
  misc_feature 1..22: note = Synthetic Construct
  source 1..22: mol_type = other DNA
actcatctgatgcccctctagt

SEQ ID NO: 17883 - DNA, 25 bp, synthetic construct
  misc_feature 1..25: note = Synthetic Construct
  source 1..25: mol_type = other DNA
gaaatgtcctttcctttctgcactt

SEQ ID NO: 17884 - DNA, 25 bp, synthetic construct
  misc_feature 1..25: note = Synthetic Construct
  source 1..25: mol_type = other DNA
ggattcctgggctactccatttttc

SEQ ID NO: 17885 - DNA, 23 bp, synthetic construct
  misc_feature 1..23: note = Synthetic Construct
  source 1..23: mol_type = other DNA
gccctgccactcagctttctatc

SEQ ID NO: 17886 - DNA, 20 bp, synthetic construct
  misc_feature 1..20: note = Synthetic Construct
  source 1..20: mol_type = other DNA
tgcactcaccagacccaagt

SEQ ID NO: 17887 - DNA, 24 bp, synthetic construct
  misc_feature 1..24: note = Synthetic Construct
  source 1..24: mol_type = other DNA
tgttcaatcagttggcagactttc

SEQ ID NO: 17888 - DNA, 29 bp, synthetic construct
  misc_feature 1..29: note = Synthetic Construct
  source 1..29: mol_type = other DNA
ggtggagagtgtctactactgttgagaag

SEQ ID NO: 17889 - DNA, 28 bp, synthetic construct
  misc_feature 1..28: note = Synthetic Construct
  source 1..28: mol_type = other DNA
gcctctttcctttcctaacagtctcttc

SEQ ID NO: 17890 - DNA, 22 bp, synthetic construct
  misc_feature 1..22: note = Synthetic Construct
  source 1..22: mol_type = other DNA
gtggccaggtcagggatacatt

SEQ ID NO: 17891 - DNA, 22 bp, synthetic construct
  misc_feature 1..22: note = Synthetic Construct
  source 1..22: mol_type = other DNA
gctctctgggaagacagagttc

SEQ ID NO: 17892 - DNA, 24 bp, synthetic construct
  misc_feature 1..24: note = Synthetic Construct
  source 1..24: mol_type = other DNA
gggtgctgtattggaatccttagt

SEQ ID NO: 17893 - DNA, 27 bp, synthetic construct
  misc_feature 1..27: note = Synthetic Construct
  source 1..27: mol_type = other DNA
ggggttgaagagaaaggttaggacaag

SEQ ID NO: 17894 - DNA, 22 bp, synthetic construct
  misc_feature 1..22: note = Synthetic Construct
  source 1..22: mol_type = other DNA
ccctcggcataaaccctactca

SEQ ID NO: 17895 - DNA, 24 bp, synthetic construct
  misc_feature 1..24: note = Synthetic Construct
  source 1..24: mol_type = other DNA
gcaaatgtgaccctaggcagaaac

SEQ ID NO: 17896 - DNA, 24 bp, synthetic construct
  misc_feature 1..24: note = Synthetic Construct
  source 1..24: mol_type = other DNA
gcgctcaatcttgagttgttgaag

SEQ ID NO: 17897 - DNA, 25 bp, synthetic construct
  misc_feature 1..25: note = Synthetic Construct
  source 1..25: mol_type = other DNA
gctgtcttgacaactttgtgcttca

SEQ ID NO: 17898 - DNA, 24 bp, synthetic construct
  misc_feature 1..24: note = Synthetic Construct
  source 1..24: mol_type = other DNA
gccaatcctttctcacgataccta

SEQ ID NO: 17899 - DNA, 24 bp, synthetic construct
  misc_feature 1..24: note = Synthetic Construct
  source 1..24: mol_type = other DNA
cgctttggagagctattgcttaaa

SEQ ID NO: 17900 - DNA, 19 bp, synthetic construct
  misc_feature 1..19: note = Synthetic Construct
  source 1..19: mol_type = other DNA
ttctgggcgagggatggta

SEQ ID NO: 17901 - DNA, 24 bp, synthetic construct
  misc_feature 1..24: note = Synthetic Construct
  source 1..24: mol_type = other DNA
ggaacatcaaggtagtgtggatca

SEQ ID NO: 17902 - DNA, 27 bp, synthetic construct
  misc_feature 1..27: note = Synthetic Construct
  source 1..27: mol_type = other DNA
ctcttgacacttgtggccaagttaatc

SEQ ID NO: 17903 - DNA, 24 bp, synthetic construct
  misc_feature 1..24: note = Synthetic Construct
  source 1..24: mol_type = other DNA
ggggtgtaggagcaagataagcaa

SEQ ID NO: 17904 - DNA, 26 bp, synthetic construct
  misc_feature 1..26: note = Synthetic Construct
  source 1..26: mol_type = other DNA
cttctcagcaagtgggaaagaatgtt

SEQ ID NO: 17905 - DNA, 23 bp, synthetic construct
  misc_feature 1..23: note = Synthetic Construct
  source 1..23: mol_type = other DNA
cccagtgtctaacaaggcactct

SEQ ID NO: 17906 - DNA, 24 bp, synthetic construct
  misc_feature 1..24: note = Synthetic Construct
  source 1..24: mol_type = other DNA
gggaggagcacattaaaagtggaa

SEQ ID NO: 17907 - DNA, 21 bp, synthetic construct
  misc_feature 1..21: note = Synthetic Construct
  source 1..21: mol_type = other DNA
cctcccatacagggccaaact

SEQ ID NO: 17908 - DNA, 27 bp, synthetic construct
  misc_feature 1..27: note = Synthetic Construct
  source 1..27: mol_type = other DNA
gctgctgatgaaagaatcacatcatct

SEQ ID NO: 17909 - DNA, 25 bp, synthetic construct
  misc_feature 1..25: note = Synthetic Construct
  source 1..25: mol_type = other DNA
ccaagaaccaagacctcaacctgaa

SEQ ID NO: 17910 - DNA, 22 bp, synthetic construct
  misc_feature 1..22: note = Synthetic Construct
  source 1..22: mol_type = other DNA
ctggctggcactaaggaagcaa

SEQ ID NO: 17911 - DNA, 22 bp, synthetic construct
  misc_feature 1..22: note = Synthetic Construct
  source 1..22: mol_type = other DNA
gcatcctgcaatgctgggaaag

SEQ ID NO: 17912 - DNA, 26 bp, synthetic construct
  misc_feature 1..26: note = Synthetic Construct
  source 1..26: mol_type = other DNA
ccaactcacttagcattgcattgtgt

SEQ ID NO: 17913 - DNA, 25 bp, synthetic construct
  misc_feature 1..25: note = Synthetic Construct
  source 1..25: mol_type = other DNA
ggacgtatagagagctgagactttg

SEQ ID NO: 17914 - DNA, 27 bp, synthetic construct
  misc_feature 1..27: note = Synthetic Construct
  source 1..27: mol_type = other DNA
gggcttacacactttactgtcacactt

SEQ ID NO: 17915 - DNA, 25 bp, synthetic construct
  misc_feature 1..25: note = Synthetic Construct
  source 1..25: mol_type = other DNA
ggcagtgtaaaatgcctcacagatg

SEQ ID NO: 17916 - DNA, 24 bp, synthetic construct
  misc_feature 1..24: note = Synthetic Construct
  source 1..24: mol_type = other DNA
tcaggcttttaacccaccagtatt

SEQ ID NO: 17917 - DNA, 25 bp, synthetic construct
  misc_feature 1..25: note = Synthetic Construct
  source 1..25: mol_type = other DNA
ctgctcacaacctagcaacctcttt

SEQ ID NO: 17918 - DNA, 23 bp, synthetic construct
  misc_feature 1..23: note = Synthetic Construct
  source 1..23: mol_type = other DNA
cagcagccaaaccgtttaaccat

SEQ ID NO: 17919 - DNA, 25 bp, synthetic construct
  misc_feature 1..25: note = Synthetic Construct
  source 1..25: mol_type = other DNA
cctgaacctactccatctgttccta

SEQ ID NO: 17920 - DNA, 25 bp, synthetic construct
  misc_feature 1..25: note = Synthetic Construct
  source 1..25: mol_type = other DNA
ccaactgcctgaaggtctgtttttg

SEQ ID NO: 17921 - DNA, 25 bp, synthetic construct
  misc_feature 1..25: note = Synthetic Construct
  source 1..25: mol_type = other DNA
gcaccttactctctagccccaagtt

SEQ ID NO: 17922 - DNA, 25 bp, synthetic construct
  misc_feature 1..25: note = Synthetic Construct
  source 1..25: mol_type = other DNA
cagattcctaactcaccttcagcaa

SEQ ID NO: 17923 - DNA, 22 bp, synthetic construct
  misc_feature 1..22: note = Synthetic Construct
  source 1..22: mol_type = other DNA
cccgtcacacgactaggaaaga

SEQ ID NO: 17924 - DNA, 23 bp, synthetic construct
  misc_feature 1..23: note = Synthetic Construct
  source 1..23: mol_type = other DNA
gcagttactcctcttccccactt

SEQ ID NO: 17925 - DNA, 22 bp, synthetic construct
  misc_feature 1..22: note = Synthetic Construct
  source 1..22: mol_type = other DNA
gcctggttcagcagtctcagtt

SEQ ID NO: 17926 - DNA, 24 bp, synthetic construct
  misc_feature 1..24: note = Synthetic Construct
  source 1..24: mol_type = other DNA
gactgccctttttcacttggtgat

SEQ ID NO: 17927 - DNA, 21 bp, synthetic construct
  misc_feature 1..21: note = Synthetic Construct
  source 1..21: mol_type = other DNA
gctgacacccgtacccagaga

SEQ ID NO: 17928 - DNA, 23 bp, synthetic construct
  misc_feature 1..23: note = Synthetic Construct
  source 1..23: mol_type = other DNA
gaaccccaggacatctattggtt

SEQ ID NO: 17929 - DNA, 24 bp, synthetic construct
  misc_feature 1..24: note = Synthetic Construct
  source 1..24: mol_type = other DNA
ccaggtttcccttgcagtttcagt

SEQ ID NO: 17930 - DNA, 22 bp, synthetic construct
  misc_feature 1..22: note = Synthetic Construct
  source 1..22: mol_type = other DNA
agacaccatgtctcctcacaga

SEQ ID NO: 17931 - DNA, 28 bp, synthetic construct
  misc_feature 1..28: note = Synthetic Construct
  source 1..28: mol_type = other DNA
gggctgaccattaacttaggtttacact

SEQ ID NO: 17932 - DNA, 26 bp, synthetic construct
  misc_feature 1..26: note = Synthetic Construct
  source 1..26: mol_type = other DNA
ccatgtcaggaaagtcctcatgtttc

SEQ ID NO: 17933 - DNA, 25 bp, synthetic construct
  misc_feature 1..25: note = Synthetic Construct
  source 1..25: mol_type = other DNA
gggtcctccatgtcatctaacaaac

SEQ ID NO: 17934 - DNA, 23 bp, synthetic construct
  misc_feature 1..23: note = Synthetic Construct
  source 1..23: mol_type = other DNA
tgggatagagtggggaaatggat

SEQ ID NO: 17935 - DNA, 23 bp, synthetic construct
  misc_feature 1..23: note = Synthetic Construct
  source 1..23: mol_type = other DNA
gggcacatttaagaagccctgat

SEQ ID NO: 17936 - DNA, 27 bp, synthetic construct
  misc_feature 1..27: note = Synthetic Construct
  source 1..27: mol_type = other DNA
ggcataaaaatagggatgggaccatta

SEQ ID NO: 17937 - DNA, 22 bp, synthetic construct
  misc_feature 1..22: note = Synthetic Construct
  source 1..22: mol_type = other DNA
tgcggtcagaagagtagtcaga

SEQ ID NO: 17938 - DNA, 27 bp, synthetic construct
  misc_feature 1..27: note = Synthetic Construct
  source 1..27: mol_type = other DNA
cccctagttactacagagctaagacaa

SEQ ID NO: 17939 - DNA, 21 bp, synthetic construct
  misc_feature 1..21: note = Synthetic Construct
  source 1..21: mol_type = other DNA
gcctggcaaaggagctgtcat

SEQ ID NO: 17940 - DNA, 25 bp, synthetic construct
  misc_feature 1..25: note = Synthetic Construct
  source 1..25: mol_type = other DNA
ccagttgctctcaagtttgcctttg

SEQ ID NO: 17941 - DNA, 24 bp, synthetic construct
  misc_feature 1..24: note = Synthetic Construct
  source 1..24: mol_type = other DNA
gactaaccaacgaaaacagcaagt

SEQ ID NO: 17942 - DNA, 22 bp, synthetic construct
  misc_feature 1..22: note = Synthetic Construct
  source 1..22: mol_type = other DNA
gtctgtgtccaccaggctatga

SEQ ID NO: 17943 - DNA, 20 bp, synthetic construct
  misc_feature 1..20: note = Synthetic Construct
  source 1..20: mol_type = other DNA
acgaccttgcgggtgattct

SEQ ID NO: 17944 - DNA, 21 bp, synthetic construct
  misc_feature 1..21: note = Synthetic Construct
  source 1..21: mol_type = other DNA
gccaccaccatgctggctaaa

SEQ ID NO: 17945 - DNA, 24 bp, synthetic construct
  misc_feature 1..24: note = Synthetic Construct
  source 1..24: mol_type = other DNA
ccctgaagcgttccaaacatctca

SEQ ID NO: 17946 - DNA, 25 bp, synthetic construct
  misc_feature 1..25: note = Synthetic Construct
  source 1..25: mol_type = other DNA
gcaacttgacgtagatagaggagat

SEQ ID NO: 17947 - DNA, 22 bp, synthetic construct
  misc_feature 1..22: note = Synthetic Construct
  source 1..22: mol_type = other DNA
gggcccactttctggttcatag

SEQ ID NO: 17948 - DNA, 27 bp, synthetic construct
  misc_feature 1..27: note = Synthetic Construct
  source 1..27: mol_type = other DNA
ggtaagaacagtggatgagaaatggat

SEQ ID NO: 17949 - DNA, 23 bp, synthetic construct
  misc_feature 1..23: note = Synthetic Construct
  source 1..23: mol_type = other DNA
tggaagtcccatagccttactga

SEQ ID NO: 17950 - DNA, 24 bp, synthetic construct
  misc_feature 1..24: note = Synthetic Construct
  source 1..24: mol_type = other DNA
ctgtctcttctggcaaatccttca

SEQ ID NO: 17951 - DNA, 26 bp, synthetic construct
  misc_feature 1..26: note = Synthetic Construct
  source 1..26: mol_type = other DNA
cctgattcctcacttcacatggaatc

SEQ ID NO: 17952 - DNA, 20 bp, synthetic construct
  misc_feature 1..20: note = Synthetic Construct
  source 1..20: mol_type = other DNA
gtcactcatgggctcggaaa

SEQ ID NO: 17953 - DNA, 21 bp, synthetic construct
  misc_feature 1..21: note = Synthetic Construct
  source 1..21: mol_type = other DNA
ggcctcctagaccacttcaga

SEQ ID NO: 17954 - DNA, 22 bp, synthetic construct
  misc_feature 1..22: note = Synthetic Construct
  source 1..22: mol_type = other DNA
ctgacatcgcactggccaaaac

SEQ ID NO: 17955 - DNA, 22 bp, synthetic construct
  misc_feature 1..22: note = Synthetic Construct
  source 1..22: mol_type = other DNA
ccaaatgagggtcccactgctt

SEQ ID NO: 17956 - DNA, 28 bp, synthetic construct
  misc_feature 1..28: note = Synthetic Construct
  source 1..28: mol_type = other DNA
gacatgcttcaccaaacttcagactcta

SEQ ID NO: 17957 - DNA, 22 bp, synthetic construct
  misc_feature 1..22: note = Synthetic Construct
  source 1..22: mol_type = other DNA
ggcacaaagaggctgtcctgaa

SEQ ID NO: 17958 - DNA, 22 bp, synthetic construct
  misc_feature 1..22: note = Synthetic Construct
  source 1..22: mol_type = other DNA
tcaccgaagtcctcctccatca

SEQ ID NO: 17959 - DNA, 22 bp, synthetic construct
  misc_feature 1..22: note = Synthetic Construct
  source 1..22: mol_type = other DNA
gtgggcagaggaaaaacacttc

SEQ ID NO: 17960 - DNA, 27 bp, synthetic construct
  misc_feature 1..27: note = Synthetic Construct
  source 1..27: mol_type = other DNA
ctcattgccagttacataaacctgtga

SEQ ID NO: 17961 - DNA, 24 bp, synthetic construct
  misc_feature 1..24: note = Synthetic Construct
  source 1..24: mol_type = other DNA
cccctttccctctcaactggaaga

SEQ ID NO: 17962 - DNA, 23 bp, synthetic construct
  misc_feature 1..23: note = Synthetic Construct
  source 1..23: mol_type = other DNA
cctccaggctaagaacccttttg

SEQ ID NO: 17963 - DNA, 21 bp, synthetic construct
  misc_feature 1..21: note = Synthetic Construct
  source 1..21: mol_type = other DNA
actttgcctggggaagtcagt

SEQ ID NO: 17964 - DNA, 22 bp, synthetic construct
  misc_feature 1..22: note = Synthetic Construct
  source 1..22: mol_type = other DNA
tccccagctgtctagtggttct

SEQ ID NO: 17965 - DNA, 22 bp, synthetic construct
  misc_feature 1..22: note = Synthetic Construct
  source 1..22: mol_type = other DNA
gggccttggtgaacatcgtctt

SEQ ID NO: 17966 - DNA, 24 bp, synthetic construct
  misc_feature 1..24: note = Synthetic Construct
  source 1..24: mol_type = other DNA
ctcggtggctttttaagttcatgt

SEQ ID NO: 17967 - DNA, 22 bp, synthetic construct
  misc_feature 1..22: note = Synthetic Construct
  source 1..22: mol_type = other DNA
ggtgagttgctggaggctcatt

SEQ ID NO: 17968 - DNA, 25 bp, synthetic construct
  misc_feature 1..25: note = Synthetic Construct
  source 1..25: mol_type = other DNA
gagcaagcaagaagtcattgaaact

SEQ ID NO: 17969 - DNA, 27 bp, synthetic construct
  misc_feature 1..27: note = Synthetic Construct
  source 1..27: mol_type = other DNA
gcaagaagtacagttgagacacaaaca

SEQ ID NO: 17970 - DNA, 24 bp, synthetic construct
  misc_feature 1..24: note = Synthetic Construct
  source 1..24: mol_type = other DNA
agccaaaaccatttggaaccattg

SEQ ID NO: 17971 - DNA, 26 bp, synthetic construct
  misc_feature 1..26: note = Synthetic Construct
  source 1..26: mol_type = other DNA
cctgacttattgcctcaaacctctac

SEQ ID NO: 17972 - DNA, 24 bp, synthetic construct
  misc_feature 1..24: note = Synthetic Construct
  source 1..24: mol_type = other DNA
ggggcatgctaagagtcaggagta

SEQ ID NO: 17973 - DNA, 21 bp, synthetic construct
  misc_feature 1..21: note = Synthetic Construct
  source 1..21: mol_type = other DNA
gtgaatcatgggcaggacctt

SEQ ID NO: 17974 - DNA, 26 bp, synthetic construct
  misc_feature 1..26: note = Synthetic Construct
  source 1..26: mol_type = other DNA
gttcagactggtatggacagtaaaca

SEQ ID NO: 17975 - DNA, 26 bp, synthetic construct
  misc_feature 1..26: note = Synthetic Construct
  source 1..26: mol_type = other DNA
gccttggataagcggtaatcctgaca

SEQ ID NO: 17976 - DNA, 22 bp, synthetic construct
  misc_feature 1..22: note = Synthetic Construct
  source 1..22: mol_type = other DNA
cacatggcctgggttggaatca

SEQ ID NO: 17977 - DNA, 25 bp, synthetic construct
  misc_feature 1..25: note = Synthetic Construct
  source 1..25: mol_type = other DNA
gacatatcataggtgtccagcacat

SEQ ID NO: 17978 - DNA, 24 bp, synthetic construct
  misc_feature 1..24: note = Synthetic Construct
  source 1..24: mol_type = other DNA
ggttatcctcttccggtggagttg

SEQ ID NO: 17979 - DNA, 23 bp, synthetic construct
  misc_feature 1..23: note = Synthetic Construct
  source 1..23: mol_type = other DNA
ctcatcacacagagggagagctt

SEQ ID NO: 17980 - DNA, 24 bp, synthetic construct
  misc_feature 1..24: note = Synthetic Construct
  source 1..24: mol_type = other DNA
cccttcatggctcaatctggcatt

SEQ ID NO: 17981 - DNA, 24 bp, synthetic construct
  misc_feature 1..24: note = Synthetic Construct
  source 1..24: mol_type = other DNA
ggtaactggaccagaacaggttag

SEQ ID NO: 17982 - DNA, 25 bp, synthetic construct
  misc_feature 1..25: note = Synthetic Construct
  source 1..25: mol_type = other DNA
tgatcaccggcagattcaattaaga

SEQ ID NO: 17983 - DNA, 22 bp, synthetic construct
  misc_feature 1..22: note = Synthetic Construct
  source 1..22: mol_type = other DNA
tgtcacccagaaaaagctcagt

SEQ ID NO: 17984 - DNA, 23 bp, synthetic construct
  misc_feature 1..23: note = Synthetic Construct
  source 1..23: mol_type = other DNA
cactcccttgtttaggcatccaa

SEQ ID NO: 17985 - DNA, 23 bp, synthetic construct
  misc_feature 1..23: note = Synthetic Construct
  source 1..23: mol_type = other DNA
gccagggcccataatttcactct

SEQ ID NO: 17986 - DNA, 24 bp, synthetic construct
  misc_feature 1..24: note = Synthetic Construct
  source 1..24: mol_type = other DNA
ctacttgcctgtgtggacaatact

SEQ ID NO: 17987 - DNA, 23 bp, synthetic construct
  misc_feature 1..23: note = Synthetic Construct
  source 1..23: mol_type = other DNA
aagcagcggatcaacttcttttc

SEQ ID NO: 17988 - DNA, 28 bp, synthetic construct
  misc_feature 1..28: note = Synthetic Construct
  source 1..28: mol_type = other DNA
gctgagtgagtgataaaggacagttgta

SEQ ID NO: 17989 - DNA, 24 bp, synthetic construct
  misc_feature 1..24: note = Synthetic Construct
  source 1..24: mol_type = other DNA
tcttatcctgtacctcccatgctt

SEQ ID NO: 17990 - DNA, 20 bp, synthetic construct
  misc_feature 1..20: note = Synthetic Construct
  source 1..20: mol_type = other DNA
gggtgatgcgctcttccaaa

SEQ ID NO: 17991 - DNA, 20 bp, synthetic construct
  misc_feature 1..20: note = Synthetic Construct
  source 1..20: mol_type = other DNA
tgccacctattccccagtgt

SEQ ID NO: 17992 - DNA, 27 bp, synthetic construct
  misc_feature 1..27: note = Synthetic Construct
  source 1..27: mol_type = other DNA
cgttgtgtacaacaagaaggagagaag

SEQ ID NO: 17993 - DNA, 22 bp, synthetic construct
  misc_feature 1..22: note = Synthetic Construct
  source 1..22: mol_type = other DNA
cctacacctgcttcctgtcctt

SEQ ID NO: 17994 - DNA, 25 bp, synthetic construct
  misc_feature 1..25: note = Synthetic Construct
  source 1..25: mol_type = other DNA
ctgtcactgaccatttggagttttg

SEQ ID NO: 17995 - DNA, 25 bp, synthetic construct
  misc_feature 1..25: note = Synthetic Construct
  source 1..25: mol_type = other DNA
ggtggggaggtgagattttgtgatg

SEQ ID NO: 17996 - DNA, 21 bp, synthetic construct
  misc_feature 1..21: note = Synthetic Construct
  source 1..21: mol_type = other DNA
tccgtttgggctcacctcagt

SEQ ID NO: 17997 - DNA, 24 bp, synthetic construct
  misc_feature 1..24: note = Synthetic Construct
  source 1..24: mol_type = other DNA
ggctggttttctcaggggaataag

SEQ ID NO: 17998 - DNA, 24 bp, synthetic construct
  misc_feature 1..24: note = Synthetic Construct
  source 1..24: mol_type = other DNA
cgcatccattacacctgggacatt

SEQ ID NO: 17999 - DNA, 25 bp, synthetic construct
  misc_feature 1..25: note = Synthetic Construct
  source 1..25: mol_type = other DNA
ttcaggtcttggcttaaatgtcaac

SEQ ID NO: 18000 - DNA, 23 bp, synthetic construct
  misc_feature 1..23: note = Synthetic Construct
  source 1..23: mol_type = other DNA
gttgggcagtgacttgctttttc

SEQ ID NO: 18001 - DNA, 24 bp, synthetic construct
  misc_feature 1..24: note = Synthetic Construct
  source 1..24: mol_type = other DNA
gtgtccgaaagagagcaaggagtt

SEQ ID NO: 18002 - DNA, 22 bp, synthetic construct
  misc_feature 1..22: note = Synthetic Construct
  source 1..22: mol_type = other DNA
gcagggaacaggcgaatgtgta

SEQ ID NO: 18003 - DNA, 20 bp, synthetic construct
  misc_feature 1..20: note = Synthetic Construct
  source 1..20: mol_type = other DNA
cagcaattcagccccagtgt

SEQ ID NO: 18004 - DNA, 24 bp, synthetic construct
  misc_feature 1..24: note = Synthetic Construct
  source 1..24: mol_type = other DNA
ggctagctctctgtggagttgaag

SEQ ID NO: 18005 - DNA, 24 bp, synthetic construct
  misc_feature 1..24: note = Synthetic Construct
  source 1..24: mol_type = other DNA
gctggggtttgaactcaggtctgt

SEQ ID NO: 18006 - DNA, 26 bp, synthetic construct
  misc_feature 1..26: note = Synthetic Construct
  source 1..26: mol_type = other DNA
gtgctgaatgctgttctcagagtttg

SEQ ID NO: 18007 - DNA, 25 bp, synthetic construct
  misc_feature 1..25: note = Synthetic Construct
  source 1..25: mol_type = other DNA
cgaggaccatccagtttttccaaag

SEQ ID NO: 18008 - DNA, 28 bp, synthetic construct
  misc_feature 1..28: note = Synthetic Construct
  source 1..28: mol_type = other DNA
ggaatgcctgggatgatttactaagaga

SEQ ID NO: 18009 - DNA, 25 bp, synthetic construct
  misc_feature 1..25: note = Synthetic Construct
  source 1..25: mol_type = other DNA
gtccctcctaatccagatactcaca

SEQ ID NO: 18010 - DNA, 23 bp, synthetic construct
  misc_feature 1..23: note = Synthetic Construct
  source 1..23: mol_type = other DNA
ggtgctctgaggatccaatggta

SEQ ID NO: 18011 - DNA, 22 bp, synthetic construct
  misc_feature 1..22: note = Synthetic Construct
  source 1..22: mol_type = other DNA
ctcccaggaaacacagcaatga

SEQ ID NO: 18012 - DNA, 23 bp, synthetic construct
  misc_feature 1..23: note = Synthetic Construct
  source 1..23: mol_type = other DNA
gcaaaaggatgtgagcagagcat

SEQ ID NO: 18013 - DNA, 23 bp, synthetic construct
  misc_feature 1..23: note = Synthetic Construct
  source 1..23: mol_type = other DNA
tctctgactcccaatcccctaac

SEQ ID NO: 18014 - DNA, 22 bp, synthetic construct
  misc_feature 1..22: note = Synthetic Construct
  source 1..22: mol_type = other DNA
gtggtgggttgatgaggacaag

SEQ ID NO: 18015 - DNA, 22 bp, synthetic construct
  misc_feature 1..22: note = Synthetic Construct
  source 1..22: mol_type = other DNA
cacccagccgatttagggtaat

SEQ ID NO: 18016 - DNA, 28 bp, synthetic construct
  misc_feature 1..28: note = Synthetic Construct
  source 1..28: mol_type = other DNA
cccaatgtcagttaagcaagtgttccta

SEQ ID NO: 18017 - DNA, 26 bp, synthetic construct
  misc_feature 1..26: note = Synthetic Construct
  source 1..26: mol_type = other DNA
ccatacaaccttgtgggatacaatct

SEQ ID NO: 18018 - DNA, 25 bp, synthetic construct
  misc_feature 1..25: note = Synthetic Construct
  source 1..25: mol_type = other DNA
cacatgcaaatgcaaactgcagaag

SEQ ID NO: 18019 - DNA, 23 bp, synthetic construct
  misc_feature 1..23: note = Synthetic Construct
  source 1..23: mol_type = other DNA
gcatcatttccctgtggcgagtt

SEQ ID NO: 18020 - DNA, 26 bp, synthetic construct
  misc_feature 1..26: note = Synthetic Construct
  source 1..26: mol_type = other DNA
gcacattataaggatcctggctttga

SEQ ID NO: 18021 - DNA, 23 bp, synthetic construct
  misc_feature 1..23: note = Synthetic Construct
  source 1..23: mol_type = other DNA
cagtgggaaggaaatgggacaga

SEQ ID NO: 18022 - DNA, 24 bp, synthetic construct
  misc_feature 1..24: note = Synthetic Construct
  source 1..24: mol_type = other DNA
tgtggaagaaggatcctcatggta

SEQ ID NO: 18023 - DNA, 22 bp, synthetic construct
  misc_feature 1..22: note = Synthetic Construct
  source 1..22: mol_type = other DNA
gcctgtagatccattggccttt

SEQ ID NO: 18024 - DNA, 24 bp, synthetic construct
  misc_feature 1..24: note = Synthetic Construct
  source 1..24: mol_type = other DNA
cctccaaacttcctgagagagatg

SEQ ID NO: 18025 - DNA, 23 bp, synthetic construct
  misc_feature 1..23: note = Synthetic Construct
  source 1..23: mol_type = other DNA
gagctggggagacttagtcagat

SEQ ID NO: 18026 - DNA, 25 bp, synthetic construct
  misc_feature 1..25: note = Synthetic Construct
  source 1..25: mol_type = other DNA
gttagagactggaagatgccataca

SEQ ID NO: 18027 - DNA, 24 bp, synthetic construct
  misc_feature 1..24: note = Synthetic Construct
  source 1..24: mol_type = other DNA
cctcttgagtctttacctgtgtgt

SEQ ID NO: 18028 - DNA, 20 bp, synthetic construct
  misc_feature 1..20: note = Synthetic Construct
  source 1..20: mol_type = other DNA
gcattgggtgcacgttgaga

SEQ ID NO: 18029 - DNA, 22 bp, synthetic construct
  misc_feature 1..22: note = Synthetic Construct
  source 1..22: mol_type = other DNA
ccgaagatggcaatgacgttga

SEQ ID NO: 18030 - DNA, 23 bp, synthetic construct
  misc_feature 1..23: note = Synthetic Construct
  source 1..23: mol_type = other DNA
cgcaggctctggaattctttact

SEQ ID NO: 18031 - DNA, 26 bp, synthetic construct
  misc_feature 1..26: note = Synthetic Construct
  source 1..26: mol_type = other DNA
gaccttgcccacaaaagtcaatgttc

SEQ ID NO: 18032 - DNA, 20 bp, synthetic construct
  misc_feature 1..20: note = Synthetic Construct
  source 1..20: mol_type = other DNA
tgggtctcaagtggcccaaa

SEQ ID NO: 18033 - DNA, 23 bp, synthetic construct
  misc_feature 1..23: note = Synthetic Construct
  source 1..23: mol_type = other DNA
gtggggattatctgggagtgtga

SEQ ID NO: 18034 - DNA, 25 bp, synthetic construct
  misc_feature 1..25: note = Synthetic Construct
  source 1..25: mol_type = other DNA
gggcaaatagctcctttcgatccta

SEQ ID NO: 18035 - DNA, 20 bp, synthetic construct
  misc_feature 1..20: note = Synthetic Construct
  source 1..20: mol_type = other DNA
gggcaggtatgaggctgaca

SEQ ID NO: 18036 - DNA, 24 bp, synthetic construct
  misc_feature 1..24: note = Synthetic Construct
  source 1..24: mol_type = other DNA
ggctatggcttcactccatctttc

SEQ ID NO: 18037 - DNA, 23 bp, synthetic construct
  misc_feature 1..23: note = Synthetic Construct
  source 1..23: mol_type = other DNA
gttgaagttccctgcatttcaca

SEQ ID NO: 18038 - DNA, 25 bp, synthetic construct
  misc_feature 1..25: note = Synthetic Construct
  source 1..25: mol_type = other DNA
gaccctgcagtagtacttttgttct

SEQ ID NO: 18039 - DNA, 25 bp, synthetic construct
  misc_feature 1..25: note = Synthetic Construct
  source 1..25: mol_type = other DNA
gcctcatgtaactctctgggtatga

SEQ ID NO: 18040 - DNA, 26 bp, synthetic construct
  misc_feature 1..26: note = Synthetic Construct
  source 1..26: mol_type = other DNA
ccaatgcctcaatttctccaggaaac

SEQ ID NO: 18041 - DNA, 25 bp, synthetic construct
  misc_feature 1..25: note = Synthetic Construct
  source 1..25: mol_type = other DNA
tgatgcttctagtccacagactttc

SEQ ID NO: 18042 - DNA, 23 bp, synthetic construct
  misc_feature 1..23: note = Synthetic Construct
  source 1..23: mol_type = other DNA
ggtggctggaagtttgttgaaga

SEQ ID NO: 18043 - DNA, 25 bp, synthetic construct
  misc_feature 1..25: note = Synthetic Construct
  source 1..25: mol_type = other DNA
tgtttgtcatcagtctggaatgctt

SEQ ID NO: 18044 - DNA, 23 bp, synthetic construct
  misc_feature 1..23: note = Synthetic Construct
  source 1..23: mol_type = other DNA
ggaaccgcatttaggtcgtgttg

SEQ ID NO: 18045 - DNA, 28 bp, synthetic construct
  misc_feature 1..28: note = Synthetic Construct
  source 1..28: mol_type = other DNA
ctgaaccaactaaaaacaggtggtgttg

SEQ ID NO: 18046 - DNA, 20 bp, synthetic construct
  misc_feature 1..20: note = Synthetic Construct
  source 1..20: mol_type = other DNA
gggccccatagcttgcaaat

SEQ ID NO: 18047 - DNA, 25 bp, synthetic construct
  misc_feature 1..25: note = Synthetic Construct
  source 1..25: mol_type = other DNA
ccctgcttttcctaagggcagattt

SEQ ID NO: 18048 - DNA, 24 bp, synthetic construct
  misc_feature 1..24: note = Synthetic Construct
  source 1..24: mol_type = other DNA
gcccggtgctttgttttactgtga

SEQ ID NO: 18049 - DNA, 27 bp, synthetic construct
  misc_feature 1..27: note = Synthetic Construct
  source 1..27: mol_type = other DNA
gggtcatggtttcaaggaaatggattg

SEQ ID NO: 18050 - DNA, 25 bp, synthetic construct
  misc_feature 1..25: note = Synthetic Construct
  source 1..25: mol_type = other DNA
ggctatgggagaaacagtaccatgt

SEQ ID NO: 18051 - DNA, 23 bp, synthetic construct
  misc_feature 1..23: note = Synthetic Construct
  source 1..23: mol_type = other DNA
cctgccctgtagtcttcctgtct

SEQ ID NO: 18052 - DNA, 24 bp, synthetic construct
  misc_feature 1..24: note = Synthetic Construct
  source 1..24: mol_type = other DNA
ctggcctgtgtttttaggccattt

SEQ ID NO: 18053 - DNA, 25 bp, synthetic construct
  misc_feature 1..25: note = Synthetic Construct
  source 1..25: mol_type = other DNA
ggaaagacagttaaggctggctcta

SEQ ID NO: 18054 - DNA, 23 bp, synthetic construct
  misc_feature 1..23: note = Synthetic Construct
  source 1..23: mol_type = other DNA
gggagtaggttgccttcttgcta

SEQ ID NO: 18055 - DNA, 24 bp, synthetic construct
  misc_feature 1..24: note = Synthetic Construct
  source 1..24: mol_type = other DNA
cctgaagaacgcgattgacccatt

SEQ ID NO: 18056 - DNA, 26 bp, synthetic construct
  misc_feature 1..26: note = Synthetic Construct
  source 1..26: mol_type = other DNA
ctcacctgcttgtttgattctcctta

SEQ ID NO: 18057 - DNA, 24 bp, synthetic construct
  misc_feature 1..24: note = Synthetic Construct
  source 1..24: mol_type = other DNA
gcggaattcagtcagacagtgaac

SEQ ID NO: 18058 - DNA, 23 bp, synthetic construct
  misc_feature 1..23: note = Synthetic Construct
  source 1..23: mol_type = other DNA
acacaggctgaaggaaatgatgt

SEQ ID NO: 18059 - DNA, 23 bp, synthetic construct
  misc_feature 1..23: note = Synthetic Construct
  source 1..23: mol_type = other DNA
cggttatcagccagaaggggttt

SEQ ID NO: 18060 - DNA, 21 bp, synthetic construct
  misc_feature 1..21: note = Synthetic Construct
  source 1..21: mol_type = other DNA
gggtggatggaagggatgtga

SEQ ID NO: 18061 - DNA, 25 bp, synthetic construct
  misc_feature 1..25: note = Synthetic Construct
  source 1..25: mol_type = other DNA
gtaccaaccctcgtaagttccttag

SEQ ID NO: 18062 - DNA, 19 bp, synthetic construct
  misc_feature 1..19: note = Synthetic Construct
  source 1..19: mol_type = other DNA
gcaccaagaccacgaccaa

SEQ ID NO: 18063 - DNA, 24 bp, synthetic construct
  misc_feature 1..24: note = Synthetic Construct
  source 1..24: mol_type = other DNA
gcccttggcttattttcccctttc

SEQ ID NO: 18064 - DNA, 26 bp, synthetic construct
  misc_feature 1..26: note = Synthetic Construct
  source 1..26: mol_type = other DNA
gggctccctattttccaaagatcaga

SEQ ID NO: 18065 - DNA, 22 bp, synthetic construct
  misc_feature 1..22: note = Synthetic Construct
  source 1..22: mol_type = other DNA
gttgccctgagatgttcactgt

SEQ ID NO: 18066 - DNA, 24 bp, synthetic construct
  misc_feature 1..24: note = Synthetic Construct
  source 1..24: mol_type = other DNA
ggcacaagtgagctgagtttcaga

SEQ ID NO: 18067 - DNA, 26 bp, synthetic construct
  misc_feature 1..26: note = Synthetic Construct
  source 1..26: mol_type = other DNA
gctaggaggtccgaattcttttgaac

SEQ ID NO: 18068 - DNA, 21 bp, synthetic construct
  misc_feature 1..21: note = Synthetic Construct
  source 1..21: mol_type = other DNA
tgcccctggaaagactacaga

SEQ ID NO: 18069 - DNA, 27 bp, synthetic construct
  misc_feature 1..27: note = Synthetic Construct
  source 1..27: mol_type = other DNA
gggaagttcaaattgctgagcttgtag

SEQ ID NO: 18070 - DNA, 26 bp, synthetic construct
  misc_feature 1..26: note = Synthetic Construct
  source 1..26: mol_type = other DNA
ccaaccagctatgctaccatttctac

SEQ ID NO: 18071 - DNA, 25 bp, synthetic construct
  misc_feature 1..25: note = Synthetic Construct
  source 1..25: mol_type = other DNA
gcaacaggagatttttggttgtttg

SEQ ID NO: 18072 - DNA, 22 bp, synthetic construct
  misc_feature 1..22: note = Synthetic Construct
  source 1..22: mol_type = other DNA
tgtgtcaggttttaggctgctt

SEQ ID NO: 18073 - DNA, 20 bp, synthetic construct
  misc_feature 1..20: note = Synthetic Construct
  source 1..20: mol_type = other DNA
aggccacaaagcctcacatc

SEQ ID NO: 18074 - DNA, 23 bp, synthetic construct
  misc_feature 1..23: note = Synthetic Construct
  source 1..23: mol_type = other DNA
aacaggagtagcagaaaggcaaa

SEQ ID NO: 18075 - DNA, 26 bp, synthetic construct
  misc_feature 1..26: note = Synthetic Construct
  source 1..26: mol_type = other DNA
cagcagcttaaacaaccatgagaagt

SEQ ID NO: 18076 - DNA, 26 bp, synthetic construct
  misc_feature 1..26: note = Synthetic Construct
  source 1..26: mol_type = other DNA
ccttcatcattggtagcctagctgta

SEQ ID NO: 18077 - DNA, 23 bp, synthetic construct
  misc_feature 1..23: note = Synthetic Construct
  source 1..23: mol_type = other DNA
gtcaacccgaatagctcctttct

SEQ ID NO: 18078 - DNA, 22 bp, synthetic construct
  misc_feature 1..22: note = Synthetic Construct
  source 1..22: mol_type = other DNA
ccccacatcacagggctttaga

SEQ ID NO: 18079 - DNA, 19 bp, synthetic construct
  misc_feature 1..19: note = Synthetic Construct
  source 1..19: mol_type = other DNA
tccgctcaagcgtccaagt

SEQ ID NO: 18080 - DNA, 26 bp, synthetic construct
  misc_feature 1..26: note = Synthetic Construct
  source 1..26: mol_type = other DNA
cctggaatggttttatctgacaggtt

SEQ ID NO: 18081 - DNA, 22 bp, synthetic construct
  misc_feature 1..22: note = Synthetic Construct
  source 1..22: mol_type = other DNA
ggccctgactttgctccaagat

SEQ ID NO: 18082 - DNA, 24 bp, synthetic construct
  misc_feature 1..24: note = Synthetic Construct
  source 1..24: mol_type = other DNA
caggcgttatcaactttcccactt

SEQ ID NO: 18083 - DNA, 26 bp, synthetic construct
  misc_feature 1..26: note = Synthetic Construct
  source 1..26: mol_type = other DNA
ccctctgaatcactctctgctcttca

SEQ ID NO: 18084 - DNA, 24 bp, synthetic construct
  misc_feature 1..24: note = Synthetic Construct
  source 1..24: mol_type = other DNA
gctgtcttctctaacacccagtct

SEQ ID NO: 18085 - DNA, 23 bp, synthetic construct
  misc_feature 1..23: note = Synthetic Construct
  source 1..23: mol_type = other DNA
caggcatggtcagaagggttaag

SEQ ID NO: 18086 - DNA, 22 bp, synthetic construct
  misc_feature 1..22: note = Synthetic Construct
  source 1..22: mol_type = other DNA
gatgctcttaggcatgggaagt

SEQ ID NO: 18087 - DNA, 22 bp, synthetic construct
  misc_feature 1..22: note = Synthetic Construct
  source 1..22: mol_type = other DNA
tgtgtgtttctgctccttcctt

SEQ ID NO: 18088 - DNA, 24 bp, synthetic construct
  misc_feature 1..24: note = Synthetic Construct
  source 1..24: mol_type = other DNA
gttttcctgttgccttgactcaca

SEQ ID NO: 18089 - DNA, 29 bp, synthetic construct
  misc_feature 1..29: note = Synthetic Construct
  source 1..29: mol_type = other DNA
ggggctgttaaatagaatccactcctttg

SEQ ID NO: 18090 - DNA, 21 bp, synthetic construct
  misc_feature 1..21: note = Synthetic Construct
  source 1..21: mol_type = other DNA
ggcttctgtgagggcgatgtt

SEQ ID NO: 18091 - DNA, 22 bp, synthetic construct
  misc_feature 1..22: note = Synthetic Construct
  source 1..22: mol_type = other DNA
ggggtggaaacgttggaagcta

SEQ ID NO: 18092 - DNA, 24 bp, synthetic construct
  misc_feature 1..24: note = Synthetic Construct
  source 1..24: mol_type = other DNA
ggacactgtcaggttactgaggtt

SEQ ID NO: 18093 - DNA, 24 bp, synthetic construct
  misc_feature 1..24: note = Synthetic Construct
  source 1..24: mol_type = other DNA
ccgcctccttcacatttccactac

SEQ ID NO: 18094 - DNA, 23 bp, synthetic construct
  misc_feature 1..23: note = Synthetic Construct
  source 1..23: mol_type = other DNA
gtcacaggctaagggttctgaag

SEQ ID NO: 18095 - DNA, 26 bp, synthetic construct
  misc_feature 1..26: note = Synthetic Construct
  source 1..26: mol_type = other DNA
gtcgagctaagaaggttgtggaaaag

SEQ ID NO: 18096 - DNA, 24 bp, synthetic construct
  misc_feature 1..24: note = Synthetic Construct
  source 1..24: mol_type = other DNA
ctgcgtctgaatggagatgtgcta

SEQ ID NO: 18097 - DNA, 25 bp, synthetic construct
  misc_feature 1..25: note = Synthetic Construct
  source 1..25: mol_type = other DNA
tttgatacaatctgtgtggggatga

SEQ ID NO: 18098 - DNA, 25 bp, synthetic construct
  misc_feature 1..25: note = Synthetic Construct
  source 1..25: mol_type = other DNA
ggaagggatctgaagaaggggtcta

SEQ ID NO: 18099 - DNA, 25 bp, synthetic construct
  misc_feature 1..25: note = Synthetic Construct
  source 1..25: mol_type = other DNA
ccagtctcactcacacccagatagt

SEQ ID NO: 18100 - DNA, 24 bp, synthetic construct
  misc_feature 1..24: note = Synthetic Construct
  source 1..24: mol_type = other DNA
gggcatctgaattgctctgggaat

SEQ ID NO: 18101 - DNA, 27 bp, synthetic construct
  misc_feature 1..27: note = Synthetic Construct
  source 1..27: mol_type = other DNA
ggtctcattaattccatcctcccatca

SEQ ID NO: 18102 - DNA, 23 bp, synthetic construct
  misc_feature 1..23: note = Synthetic Construct
  source 1..23: mol_type = other DNA
ggggtggcataaatttgctcttc

SEQ ID NO: 18103 - DNA, 26 bp, synthetic construct
  misc_feature 1..26: note = Synthetic Construct
  source 1..26: mol_type = other DNA
cctccagttaccattttgaacctctt

SEQ ID NO: 18104 - DNA, 24 bp, synthetic construct
  misc_feature 1..24: note = Synthetic Construct
  source 1..24: mol_type = other DNA
ggtgactggcagctcttagtggaa

SEQ ID NO: 18105 - DNA, 21 bp, synthetic construct
  misc_feature 1..21: note = Synthetic Construct
  source 1..21: mol_type = other DNA
gcacctcacttgccttacctt

SEQ ID NO: 18106 - DNA, 22 bp, synthetic construct
  misc_feature 1..22: note = Synthetic Construct
  source 1..22: mol_type = other DNA
gcttctgagagggctacagttg

SEQ ID NO: 18107 - DNA, 21 bp, synthetic construct
  misc_feature 1..21: note = Synthetic Construct
  source 1..21: mol_type = other DNA
cacactctgggcaatggtgtt

SEQ ID NO: 18108 - DNA, 25 bp, synthetic construct
  misc_feature 1..25: note = Synthetic Construct
  source 1..25: mol_type = other DNA
cactcctgaatcctcctccctaaca

SEQ ID NO: 18109 - DNA, 24 bp, synthetic construct
  misc_feature 1..24: note = Synthetic Construct
  source 1..24: mol_type = other DNA
gcacttcaattcagcatgtccaaa

SEQ ID NO: 18110 - DNA, 26 bp, synthetic construct
  misc_feature 1..26: note = Synthetic Construct
  source 1..26: mol_type = other DNA
catgcagattcatagccactcctaga

SEQ ID NO: 18111 - DNA, 27 bp, synthetic construct
  misc_feature 1..27: note = Synthetic Construct
  source 1..27: mol_type = other DNA
gggcagatttttgatgtaggttcttag

SEQ ID NO: 18112 - DNA, 26 bp, synthetic construct
  misc_feature 1..26: note = Synthetic Construct
  source 1..26: mol_type = other DNA
caagcatctacatccctttccagaga

SEQ ID NO: 18113 - DNA, 25 bp, synthetic construct
  misc_feature 1..25: note = Synthetic Construct
  source 1..25: mol_type = other DNA
acagacagaagcatggtcttaggta

SEQ ID NO: 18114 - DNA, 23 bp, synthetic construct
  misc_feature 1..23: note = Synthetic Construct
  source 1..23: mol_type = other DNA
ccacgaaccttgtctttgccatt

SEQ ID NO: 18115 - DNA, 24 bp, synthetic construct
  misc_feature 1..24: note = Synthetic Construct
  source 1..24: mol_type = other DNA
ggagcagtggaaaaatcccacatc

SEQ ID NO: 18116 - DNA, 21 bp, synthetic construct
  misc_feature 1..21: note = Synthetic Construct
  source 1..21: mol_type = other DNA
gcacagcttttcctcggtgtt

SEQ ID NO: 18117 - DNA, 25 bp, synthetic construct
  misc_feature 1..25: note = Synthetic Construct
  source 1..25: mol_type = other DNA
ggtaccccaggatatgcaagtcttc

SEQ ID NO: 18118 - DNA, 30 bp, synthetic construct
  misc_feature 1..30: note = Synthetic Construct
  source 1..30: mol_type = other DNA
ggtcaccacattatttccgtcttatctctt

SEQ ID NO: 18119 - DNA, 22 bp, synthetic construct
  misc_feature 1..22: note = Synthetic Construct
  source 1..22: mol_type = other DNA
ggggagctttgccatcacatct

SEQ ID NO: 18120 - DNA, 22 bp, synthetic construct
  misc_feature 1..22: note = Synthetic Construct
  source 1..22: mol_type = other DNA
agccaagacacacatagagcaa

SEQ ID NO: 18121 - DNA, 22 bp, synthetic construct
  misc_feature 1..22: note = Synthetic Construct
  source 1..22: mol_type = other DNA
ccaggttccctgctggaagtat

SEQ ID NO: 18122 - DNA, 23 bp, synthetic construct
  misc_feature 1..23: note = Synthetic Construct
  source 1..23: mol_type = other DNA
gcattgtgtgggttctggtttct

SEQ ID NO: 18123 - DNA, 23 bp, synthetic construct
  misc_feature 1..23: note = Synthetic Construct
  source 1..23: mol_type = other DNA
cctccgaccagattgagaacttg

SEQ ID NO: 18124 - DNA, 20 bp, synthetic construct
  misc_feature 1..20: note = Synthetic Construct
  source 1..20: mol_type = other DNA
ggaacacctctgggcacttg

SEQ ID NO: 18125 - DNA, 23 bp, synthetic construct
  misc_feature 1..23: note = Synthetic Construct
  source 1..23: mol_type = other DNA
gcaaactggcaggagttggaatg

SEQ ID NO: 18126 - DNA, 27 bp, synthetic construct
  misc_feature 1..27: note = Synthetic Construct
  source 1..27: mol_type = other DNA
gggtttcgctgttaagaaaggaccaaa

SEQ ID NO: 18127 - DNA, 25 bp, synthetic construct
  misc_feature 1..25: note = Synthetic Construct
  source 1..25: mol_type = other DNA
gggaagctatctctcaagcattact

SEQ ID NO: 18128 - DNA, 26 bp, synthetic construct
  misc_feature 1..26: note = Synthetic Construct
  source 1..26: mol_type = other DNA
gccacataaacatagccacagaggat

SEQ ID NO: 18129 - DNA, 23 bp, synthetic construct
  misc_feature 1..23: note = Synthetic Construct
  source 1..23: mol_type = other DNA
gtgtggggtcttcatgattcact

SEQ ID NO: 18130 - DNA, 22 bp, synthetic construct
  misc_feature 1..22: note = Synthetic Construct
  source 1..22: mol_type = other DNA
acctgaccttcctgcttgtttg

SEQ ID NO: 18131 - DNA, 24 bp, synthetic construct
  misc_feature 1..24: note = Synthetic Construct
  source 1..24: mol_type = other DNA
gagggaggacttgatcatgaggtt

SEQ ID NO: 18132 - DNA, 22 bp, synthetic construct
  misc_feature 1..22: note = Synthetic Construct
  source 1..22: mol_type = other DNA
tcatctgtgagcaatcctgctt

SEQ ID NO: 18133 - DNA, 22 bp, synthetic construct
  misc_feature 1..22: note = Synthetic Construct
  source 1..22: mol_type = other DNA
gcgtgaacacgttagggacctt

SEQ ID NO: 18134 - DNA, 22 bp, synthetic construct
  misc_feature 1..22: note = Synthetic Construct
  source 1..22: mol_type = other DNA
ccaggtgcgctcaatcccattt

SEQ ID NO: 18135 - DNA, 25 bp, synthetic construct
  misc_feature 1..25: note = Synthetic Construct
  source 1..25: mol_type = other DNA
gcattcacaggacaaagaccattag

SEQ ID NO: 18136 - DNA, 25 bp, synthetic construct
  misc_feature 1..25: note = Synthetic Construct
  source 1..25: mol_type = other DNA
tgacagctccaccataattacttga

SEQ ID NO: 18137 - DNA, 25 bp, synthetic construct
  misc_feature 1..25: note = Synthetic Construct
  source 1..25: mol_type = other DNA
cctgttgataaggcccaggacaaaa

SEQ ID NO: 18138 - DNA, 21 bp, synthetic construct
  misc_feature 1..21: note = Synthetic Construct
  source 1..21: mol_type = other DNA
gtggcagccatagctgaaagt

SEQ ID NO: 18139 - DNA, 22 bp, synthetic construct
  misc_feature 1..22: note = Synthetic Construct
  source 1..22: mol_type = other DNA
cagctcgttcacgtctcagtca

SEQ ID NO: 18140 - DNA, 21 bp, synthetic construct
  misc_feature 1..21: note = Synthetic Construct
  source 1..21: mol_type = other DNA
ccctgcttctctggtgcattg

SEQ ID NO: 18141 - DNA, 22 bp, synthetic construct
  misc_feature 1..22: note = Synthetic Construct
  source 1..22: mol_type = other DNA
tcccactttggtgagacaggaa

SEQ ID NO: 18142 - DNA, 22 bp, synthetic construct
  misc_feature 1..22: note = Synthetic Construct
  source 1..22: mol_type = other DNA
ggcagtagtagggtgctgattc

SEQ ID NO: 18143 - DNA, 23 bp, synthetic construct
  misc_feature 1..23: note = Synthetic Construct
  source 1..23: mol_type = other DNA
ggttgccatagctgcttcctcaa

SEQ ID NO: 18144 - DNA, 25 bp, synthetic construct
  misc_feature 1..25: note = Synthetic Construct
  source 1..25: mol_type = other DNA
cacagtgtctgtcctaagaatgtgt

SEQ ID NO: 18145 - DNA, 19 bp, synthetic construct
  misc_feature 1..19: note = Synthetic Construct
  source 1..19: mol_type = other DNA
gtgggccacttgcctcttt

SEQ ID NO: 18146 - DNA, 27 bp, synthetic construct
  misc_feature 1..27: note = Synthetic Construct
  source 1..27: mol_type = other DNA
gctcctgatctgagagagaaagtgtgt

SEQ ID NO: 18147 - DNA, 25 bp, synthetic construct
  misc_feature 1..25: note = Synthetic Construct
  source 1..25: mol_type = other DNA
gtggtgaagtggattcctctctgat

SEQ ID NO: 18148 - DNA, 24 bp, synthetic construct
  misc_feature 1..24: note = Synthetic Construct
  source 1..24: mol_type = other DNA
gcctcaaggcctaagaatatcagt

SEQ ID NO: 18149 - DNA, 24 bp, synthetic construct
  misc_feature 1..24: note = Synthetic Construct
  source 1..24: mol_type = other DNA
gcccctcctccttacatggataac

SEQ ID NO: 18150 - DNA, 28 bp, synthetic construct
  misc_feature 1..28: note = Synthetic Construct
  source 1..28: mol_type = other DNA
cgcaaccaaacacccttattactagaga

SEQ ID NO: 18151 - DNA, 30 bp, synthetic construct
  misc_feature 1..30: note = Synthetic Construct
  source 1..30: mol_type = other DNA
ggaagtctatgtttgaaaggaagccaacat

SEQ ID NO: 18152 - DNA, 27 bp, synthetic construct
  misc_feature 1..27: note = Synthetic Construct
  source 1..27: mol_type = other DNA
caggttgtaggtaaaaatggggtcaga

SEQ ID NO: 18153 - DNA, 23 bp, synthetic construct
  misc_feature 1..23: note = Synthetic Construct
  source 1..23: mol_type = other DNA
gccccatcccatttaggatcaca

SEQ ID NO: 18154 - DNA, 28 bp, synthetic construct
  misc_feature 1..28: note = Synthetic Construct
  source 1..28: mol_type = other DNA
gctaatcttacaggagagtatgggaaac

SEQ ID NO: 18155 - DNA, 24 bp, synthetic construct
  misc_feature 1..24: note = Synthetic Construct
  source 1..24: mol_type = other DNA
gtgagccatttgagactggaaaaa

SEQ ID NO: 18156 - DNA, 24 bp, synthetic construct
  misc_feature 1..24: note = Synthetic Construct
  source 1..24: mol_type = other DNA
ggtccgtcctatgtcctattccaa

SEQ ID NO: 18157 - DNA, 21 bp, synthetic construct
  misc_feature 1..21: note = Synthetic Construct
  source 1..21: mol_type = other DNA
ggtgaggcttagccgtgttct

SEQ ID NO: 18158 - DNA, 24 bp, synthetic construct
  misc_feature 1..24: note = Synthetic Construct
  source 1..24: mol_type = other DNA
gcagccctctactggtttatggaa

SEQ ID NO: 18159 - DNA, 21 bp, synthetic construct
  misc_feature 1..21: note = Synthetic Construct
  source 1..21: mol_type = other DNA
actgccgtggaaacatcaagt

SEQ ID NO: 18160 - DNA, 22 bp, synthetic construct
  misc_feature 1..22: note = Synthetic Construct
  source 1..22: mol_type = other DNA
gaccacctaggggatcaaggaa

SEQ ID NO: 18161 - DNA, 25 bp, synthetic construct
  misc_feature 1..25: note = Synthetic Construct
  source 1..25: mol_type = other DNA
tttcactactgctgtaggtatgctt

SEQ ID NO: 18162 - DNA, 26 bp, synthetic construct
  misc_feature 1..26: note = Synthetic Construct
  source 1..26: mol_type = other DNA
ccacactctcaagatcctgttggtta

SEQ ID NO: 18163 - DNA, 21 bp, synthetic construct
  misc_feature 1..21: note = Synthetic Construct
  source 1..21: mol_type = other DNA
gtgtcagacatggcggcaaat

SEQ ID NO: 18164 - DNA, 25 bp, synthetic construct
  misc_feature 1..25: note = Synthetic Construct
  source 1..25: mol_type = other DNA
gtgagtgcctctatctggaaaggat

SEQ ID NO: 18165 - DNA, 26 bp, synthetic construct
  misc_feature 1..26: note = Synthetic Construct
  source 1..26: mol_type = other DNA
gttggatgcctaatgatttcccttca

SEQ ID NO: 18166 - DNA, 22 bp, synthetic construct
  misc_feature 1..22: note = Synthetic Construct
  source 1..22: mol_type = other DNA
ggtgggatgctttacgcagaga

SEQ ID NO: 18167 - DNA, 25 bp, synthetic construct
  misc_feature 1..25: note = Synthetic Construct
  source 1..25: mol_type = other DNA
ggggttctgttttctcccattcttc

SEQ ID NO: 18168 - DNA, 23 bp, synthetic construct
  misc_feature 1..23: note = Synthetic Construct
  source 1..23: mol_type = other DNA
cctggccatcaaagtgggacttc

SEQ ID NO: 18169 - DNA, 25 bp, synthetic construct
  misc_feature 1..25: note = Synthetic Construct
  source 1..25: mol_type = other DNA
gaagaacaccattggatcacagaac

SEQ ID NO: 18170 - DNA, 23 bp, synthetic construct
  misc_feature 1..23: note = Synthetic Construct
  source 1..23: mol_type = other DNA
gccactcttgggcctgatacatt

SEQ ID NO: 18171 - DNA, 26 bp, synthetic construct
  misc_feature 1..26: note = Synthetic Construct
  source 1..26: mol_type = other DNA
ctccatcctctctcagaacctcagtt

SEQ ID NO: 18172 - DNA, 25 bp, synthetic construct
  misc_feature 1..25: note = Synthetic Construct
  source 1..25: mol_type = other DNA
gagacgctctcccatatccagtcta

SEQ ID NO: 18173 - DNA, 22 bp, synthetic construct
  misc_feature 1..22: note = Synthetic Construct
  source 1..22: mol_type = other DNA
ccgtggcacagaaaggagatgt

SEQ ID NO: 18174 - DNA, 26 bp, synthetic construct
  misc_feature 1..26: note = Synthetic Construct
  source 1..26: mol_type = other DNA
gccaagactaatcctgatggagtgat

SEQ ID NO: 18175 - DNA, 30 bp, synthetic construct; identical to SEQ ID NO: 4777
  misc_feature 1..30: note = Synthetic Construct
  source 1..30: mol_type = other DNA

SEQ ID NO: 18176 - DNA, 25 bp, synthetic construct
  misc_feature 1..25: note = Synthetic Construct
  source 1..25: mol_type = other DNA
gtttcacgaacctaaatgtggtgat

SEQ ID NO: 18177 - DNA, 20 bp, synthetic construct
  misc_feature 1..20: note = Synthetic Construct
  source 1..20: mol_type = other DNA
cccagctccatggcaaacat

SEQ ID NO: 18178 - DNA, 22 bp, synthetic construct
  misc_feature 1..22: note = Synthetic Construct
  source 1..22: mol_type = other DNA
agggccaggtagcttactgaag

SEQ ID NO: 18179 - DNA, 19 bp, synthetic construct
  misc_feature 1..19: note = Synthetic Construct
  source 1..19: mol_type = other DNA
ccgcagtgtccacctcagt

SEQ ID NO: 18180 - DNA, 27 bp, synthetic construct
  misc_feature 1..27: note = Synthetic Construct
  source 1..27: mol_type = other DNA
acaggtacagccatactcaaaaagtag

SEQ ID NO: 18181 - DNA, 24 bp, synthetic construct
  misc_feature 1..24: note = Synthetic Construct
  source 1..24: mol_type = other DNA
gccactgggagatgtgtcataaac

SEQ ID NO: 18182 - DNA, 24 bp, synthetic construct
  misc_feature 1..24: note = Synthetic Construct
  source 1..24: mol_type = other DNA
aagagagcttgggtagacagtttc

SEQ ID NO: 18183 - DNA, 20 bp, synthetic construct
  misc_feature 1..20: note = Synthetic Construct
  source 1..20: mol_type = other DNA
ggcctttgcacgtggagttt

SEQ ID NO: 18184 - DNA, 22 bp, synthetic construct
  misc_feature 1..22: note = Synthetic Construct
  source 1..22: mol_type = other DNA
tctcagctcccaggatttctgt

SEQ ID NO: 18185 - DNA, 23 bp, synthetic construct
  misc_feature 1..23: note = Synthetic Construct
  source 1..23: mol_type = other DNA
ggtcgggagtgatgggttagtga

SEQ ID NO: 18186 - DNA, 21 bp, synthetic construct
  misc_feature 1..21: note = Synthetic Construct
  source 1..21: mol_type = other DNA
gcccaggactgatgacaggta

SEQ ID NO: 18187 - DNA, 23 bp, synthetic construct
  misc_feature 1..23: note = Synthetic Construct
  source 1..23: mol_type = other DNA
ctctgcacttctacccaggcaat

SEQ ID NO: 18188 - DNA, 25 bp, synthetic construct
  misc_feature 1..25: note = Synthetic Construct
  source 1..25: mol_type = other DNA
gaggactatatgtgggagtgcttga

SEQ ID NO: 18189 - DNA, 25 bp, synthetic construct
  misc_feature 1..25: note = Synthetic Construct
  source 1..25: mol_type = other DNA
gttgcctctttaatgctctgcaaat

SEQ ID NO: 18190 - DNA, 25 bp, synthetic construct
  misc_feature 1..25: note = Synthetic Construct
  source 1..25: mol_type = other DNA
ccttttcagtgtacccaggattcat

SEQ ID NO: 18191 - DNA, 24 bp, synthetic construct
  misc_feature 1..24: note = Synthetic Construct
  source 1..24: mol_type = other DNA
tcatgtgcctcagaaagtcattgt

SEQ ID NO: 18192 - DNA, 22 bp, synthetic construct
  misc_feature 1..22: note = Synthetic Construct
  source 1..22: mol_type = other DNA
cagatccctctgctggtacaga

SEQ ID NO: 18193 - DNA, 22 bp, synthetic construct
  misc_feature 1..22: note = Synthetic Construct
  source 1..22: mol_type = other DNA
ggctttagttgggtggcgtagt

SEQ ID NO: 18194 - DNA, 25 bp, synthetic construct
  misc_feature 1..25: note = Synthetic Construct
  source 1..25: mol_type = other DNA
cccatagcacagaccagttggatga

SEQ ID NO: 18195 - DNA, 24 bp, synthetic construct
  misc_feature 1..24: note = Synthetic Construct
  source 1..24: mol_type = other DNA
gcaggggttggtttcattttggat

SEQ ID NO: 18196 - DNA, 24 bp, synthetic construct
  misc_feature 1..24: note = Synthetic Construct
  source 1..24: mol_type = other DNA
catcactctgtcctcgagtaggtt

SEQ ID NO: 18197 - DNA, 26 bp, synthetic construct
  misc_feature 1..26: note = Synthetic Construct
  source 1..26: mol_type = other DNA
cgagaagaagtaagctgggatacaga

SEQ ID NO: 18198 - DNA, 24 bp, synthetic construct
  misc_feature 1..24: note = Synthetic Construct
  source 1..24: mol_type = other DNA
ctcctggtggtttgactcatccta

SEQ ID NO: 18199 - DNA, 23 bp, synthetic construct
  misc_feature 1..23: note = Synthetic Construct
  source 1..23: mol_type = other DNA
gtctcatcaacagtcacctgtca

SEQ ID NO: 18200 - DNA, 27 bp, synthetic construct
  misc_feature 1..27: note = Synthetic Construct
  source 1..27: mol_type = other DNA
gttttaagaacccagtgagtgacaaga

SEQ ID NO: 18201 - DNA, 23 bp, synthetic construct
  misc_feature 1..23: note = Synthetic Construct
  source 1..23: mol_type = other DNA
ctcacaccccttgtaagccattg

SEQ ID NO: 18202 - DNA, 28 bp, synthetic construct
  misc_feature 1..28: note = Synthetic Construct
  source 1..28: mol_type = other DNA
ggggctaagattctaacccagagtttgt

SEQ ID NO: 18203 - DNA, 26 bp, synthetic construct
  misc_feature 1..26: note = Synthetic Construct
  source 1..26: mol_type = other DNA
ggcaatagacagcatctagaatccat

SEQ ID NO: 18204 - DNA, 26 bp, synthetic construct
  misc_feature 1..26: note = Synthetic Construct
  source 1..26: mol_type = other DNA
ccagcaggaatgttagcactcaccta

SEQ ID NO: 18205 - DNA, 24 bp, synthetic construct
  misc_feature 1..24: note = Synthetic Construct
  source 1..24: mol_type = other DNA
ggtctgcagcagttctagctctca

SEQ ID NO: 18206 - DNA, 26 bp, synthetic construct
  misc_feature 1..26: note = Synthetic Construct
  source 1..26: mol_type = other DNA
gaccctcctgaagatgtttctactct

SEQ ID NO: 18207 - DNA, 24 bp, synthetic construct
  misc_feature 1..24: note = Synthetic Construct
  source 1..24: mol_type = other DNA
ttacattgacagcagggaacagat

SEQ ID NO: 18208 - DNA, 24 bp, synthetic construct
  misc_feature 1..24: note = Synthetic Construct
  source 1..24: mol_type = other DNA
ctggtgttcccagttcagaagcat

SEQ ID NO: 18209 - DNA, 22 bp, synthetic construct
  misc_feature 1..22: note = Synthetic Construct
  source 1..22: mol_type = other DNA
cctgcctgaaggtcccttctta

SEQ ID NO: 18210 - DNA, 21 bp, synthetic construct
  misc_feature 1..21: note = Synthetic Construct
  source 1..21: mol_type = other DNA
agaccccagacactgaaggaa

SEQ ID NO: 18211 - DNA, 20 bp, synthetic construct
  misc_feature 1..20: note = Synthetic Construct
  source 1..20: mol_type = other DNA
ggctcaagtctggaggcatt

SEQ ID NO: 18212 - DNA, 24 bp, synthetic construct
  misc_feature 1..24: note = Synthetic Construct
  source 1..24: mol_type = other DNA
ctctggccctggtagtaaatgagt

SEQ ID NO: 18213 - DNA, 26 bp, synthetic construct
  misc_feature 1..26: note = Synthetic Construct
  source 1..26: mol_type = other DNA
ggactttctttaccctcatcccttgt

SEQ ID NO: 18214 - DNA, 23 bp, synthetic construct
  misc_feature 1..23: note = Synthetic Construct
  source 1..23: mol_type = other DNA
gcacctaccagttgtcagaaaca

SEQ ID NO: 18215 - DNA, 23 bp, synthetic construct
  misc_feature 1..23: note = Synthetic Construct
  source 1..23: mol_type = other DNA
gaccagttcacttgtccactgta

SEQ ID NO: 18216 - DNA, 22 bp, synthetic construct
  misc_feature 1..22: note = Synthetic Construct
  source 1..22: mol_type = other DNA
cctgctcatggaatgtggttga

SEQ ID NO: 18217 - DNA, 26 bp, synthetic construct
  misc_feature 1..26: note = Synthetic Construct
  source 1..26: mol_type = other DNA
cagcgtcttttacgtacgttttgttc

SEQ ID NO: 18218 - DNA, 23 bp, synthetic construct
  misc_feature 1..23: note = Synthetic Construct
  source 1..23: mol_type = other DNA
ggtgtcagacatttctgggtact

SEQ ID NO: 18219 - DNA, 27 bp, synthetic construct
  misc_feature 1..27: note = Synthetic Construct
  source 1..27: mol_type = other DNA
gtcagatcaacccatttatgcctgaga

SEQ ID NO: 18220 - DNA, 24 bp, synthetic construct
  misc_feature 1..24: note = Synthetic Construct
  source 1..24: mol_type = other DNA
ggagaaatgctgttgcagactcta

SEQ ID NO: 18221 - DNA, 20 bp, synthetic construct
  misc_feature 1..20: note = Synthetic Construct
  source 1..20: mol_type = other DNA
ggggctgttaggtggcacaa

SEQ ID NO: 18222 - DNA, 25 bp, synthetic construct
  misc_feature 1..25: note = Synthetic Construct
  source 1..25: mol_type = other DNA
gagaataaccatgatggaggggaaa

SEQ ID NO: 18223 - DNA, 26 bp, synthetic construct
  misc_feature 1..26: note = Synthetic Construct
  source 1..26: mol_type = other DNA
ggttccccagatcaaagaatcgaaga

SEQ ID NO: 18224 - DNA, 24 bp, synthetic construct
  misc_feature 1..24: note = Synthetic Construct
  source 1..24: mol_type = other DNA
ctcttatgcccttggccatactct

SEQ ID NO: 18225 - DNA, 20 bp, synthetic construct
  misc_feature 1..20: note = Synthetic Construct
  source 1..20: mol_type = other DNA
cctgtattggctgcgtgagt

SEQ ID NO: 18226 - DNA, 24 bp, synthetic construct
  misc_feature 1..24: note = Synthetic Construct
  source 1..24: mol_type = other DNA
gggtagagggactggtctaccaaa

SEQ ID NO: 18227 - DNA, 25 bp, synthetic construct
  misc_feature 1..25: note = Synthetic Construct
  source 1..25: mol_type = other DNA
ccactgttttctcagagcttcactt

SEQ ID NO: 18228 - DNA, 26 bp, synthetic construct
  misc_feature 1..26: note = Synthetic Construct
  source 1..26: mol_type = other DNA
gagttgatccaggattcggtattttg

SEQ ID NO: 18229 - DNA, 22 bp, synthetic construct
  misc_feature 1..22: note = Synthetic Construct
  source 1..22: mol_type = other DNA
gcttctccagcatcacgtctct

SEQ ID NO: 18230 - DNA, 30 bp, synthetic construct
  misc_feature 1..30: note = Synthetic Construct
  source 1..30: mol_type = other DNA
gacgaggtttaatcaactagctgtgacatt

SEQ ID NO: 18231 - DNA, 24 bp, synthetic construct
  misc_feature 1..24: note = Synthetic Construct
  source 1..24: mol_type = other DNA
accaggggaactaaagatgacaag

SEQ ID NO: 18232 - DNA, 25 bp, synthetic construct
  misc_feature 1..25: note = Synthetic Construct
  source 1..25: mol_type = other DNA
ggggaaggcctaacactaaggtgat

SEQ ID NO: 18233 - DNA, 22 bp, synthetic construct
  misc_feature 1..22: note = Synthetic Construct
  source 1..22: mol_type = other DNA
ttccttggtcctccgaggcata

SEQ ID NO: 18234 - DNA, 27 bp, synthetic construct
  misc_feature 1..27: note = Synthetic Construct
  source 1..27: mol_type = other DNA
agattatctctgcttggataccgattc

SEQ ID NO: 18235 - DNA, 21 bp, synthetic construct
  misc_feature 1..21: note = Synthetic Construct
  source 1..21: mol_type = other DNA
ggtggtgttcggcctgatctt

SEQ ID NO: 18236 - DNA, 23 bp, synthetic construct
  misc_feature 1..23: note = Synthetic Construct
  source 1..23: mol_type = other DNA
cgactctgagccaaaacccatag

SEQ ID NO: 18237 - DNA, 25 bp, synthetic construct
  misc_feature 1..25: note = Synthetic Construct
  source 1..25: mol_type = other DNA
gtgggaggatgactttggagctatg

SEQ ID NO: 18238 - DNA, 24 bp, synthetic construct
  misc_feature 1..24: note = Synthetic Construct
  source 1..24: mol_type = other DNA
tgataagtgccttctgcaggtttt

SEQ ID NO: 18239 - DNA, 23 bp, synthetic construct
  misc_feature 1..23: note = Synthetic Construct
  source 1..23: mol_type = other DNA
ggactgagtaggggatggcttga

SEQ ID NO: 18240 - DNA, 26 bp, synthetic construct
  misc_feature 1..26: note = Synthetic Construct
  source 1..26: mol_type = other DNA
gaccccgtttagtcctaacctcaatc

SEQ ID NO: 18241 - DNA, 23 bp, synthetic construct
  misc_feature 1..23: note = Synthetic Construct
  source 1..23: mol_type = other DNA
gcccctactttgggacaagaaca

SEQ ID NO: 18242 - DNA, 24 bp, synthetic construct
  misc_feature 1..24: note = Synthetic Construct
  source 1..24: mol_type = other DNA
ggatacagaagatgggaggcatag

SEQ ID NO: 18243 - DNA, 25 bp, synthetic construct
  misc_feature 1..25: note = Synthetic Construct
  source 1..25: mol_type = other DNA
tgtactggcgaagaaacagaaaagt

SEQ ID NO: 18244 - DNA, 24 bp, synthetic construct
  misc_feature 1..24: note = Synthetic Construct
  source 1..24: mol_type = other DNA
ccggactaacagggcttggtatct

SEQ ID NO: 18245 - DNA, 23 bp, synthetic construct
  misc_feature 1..23: note = Synthetic Construct
  source 1..23: mol_type = other DNA
ggcctccttgtgtttacttgttg

SEQ ID NO: 18246 - DNA, 23 bp, synthetic construct
  misc_feature 1..23: note = Synthetic Construct
  source 1..23: mol_type = other DNA
cagcccagtgattgtccatcttc

SEQ ID NO: 18247 - DNA, 25 bp, synthetic construct
  misc_feature 1..25: note = Synthetic Construct
  source 1..25: mol_type = other DNA
ctcacctgtctttgcaactttggtt

SEQ ID NO: 18248 - DNA, 22 bp, synthetic construct
  misc_feature 1..22: note = Synthetic Construct
  source 1..22: mol_type = other DNA
cagtgtgggtagagggcaagaa

SEQ ID NO: 18249 - DNA, 22 bp, synthetic construct
  misc_feature 1..22: note = Synthetic Construct
  source 1..22: mol_type = other DNA
tccactggtctatggcctgaca

SEQ ID NO: 18250 - DNA, 26 bp, synthetic construct
  misc_feature 1..26: note = Synthetic Construct
  source 1..26: mol_type = other DNA
ccagggaagctactgatgtggaatta

SEQ ID NO: 18251 - DNA, 26 bp, synthetic construct
  misc_feature 1..26: note = Synthetic Construct
  source 1..26: mol_type = other DNA
gccaaggacagatgtgatctgatgta

SEQ ID NO: 18252 - DNA, 22 bp, synthetic construct
  misc_feature 1..22: note = Synthetic Construct
  source 1..22: mol_type = other DNA
acctctgcaaacaagggattga

SEQ ID NO: 18253 - DNA, 22 bp, synthetic construct
  misc_feature 1..22: note = Synthetic Construct
  source 1..22: mol_type = other DNA
ctcctaacccacagaggagtct

SEQ ID NO: 18254 - DNA, 22 bp, synthetic construct
  misc_feature 1..22: note = Synthetic Construct
  source 1..22: mol_type = other DNA
gctggttcgtcccctattcatc

SEQ ID NO: 18255 - DNA, 23 bp, synthetic construct
  misc_feature 1..23: note = Synthetic Construct
  source 1..23: mol_type = other DNA
gaaagagccagaagactcagcat

SEQ ID NO: 18256 - DNA, 21 bp, synthetic construct
  misc_feature 1..21: note = Synthetic Construct
  source 1..21: mol_type = other DNA
ggcccaataggtgctgacctt

SEQ ID NO: 18257 - DNA, 27 bp, synthetic construct
  misc_feature 1..27: note = Synthetic Construct
  source 1..27: mol_type = other DNA
agttgagaactgggacattaaggtatg

SEQ ID NO: 18258 - DNA, 24 bp, synthetic construct
  misc_feature 1..24: note = Synthetic Construct
  source 1..24: mol_type = other DNA
ccagttttgaggatcacagtgaca

SEQ ID NO: 18259 - DNA, 25 bp, synthetic construct
  misc_feature 1..25: note = Synthetic Construct
  source 1..25: mol_type = other DNA
gcaccaggatgtatgatgggaggta

SEQ ID NO: 18260 - DNA, 22 bp, synthetic construct
  misc_feature 1..22: note = Synthetic Construct
  source 1..22: mol_type = other DNA
ctggagacatccacgccattca

SEQ ID NO: 18261 - DNA, 24 bp, synthetic construct
  misc_feature 1..24: note = Synthetic Construct
  source 1..24: mol_type = other DNA
cccttgaacttgagccctttccaa

SEQ ID NO: 18262 - DNA, 21 bp, synthetic construct
  misc_feature 1..21: note = Synthetic Construct
  source 1..21: mol_type = other DNA
accttcctggtgcctgtgatg

SEQ ID NO: 18263 - DNA, 22 bp, synthetic construct
  misc_feature 1..22: note = Synthetic Construct
  source 1..22: mol_type = other DNA
gcgtggagatctgggcattaag

SEQ ID NO: 18264 - DNA, 24 bp, synthetic construct
  misc_feature 1..24: note = Synthetic Construct
  source 1..24: mol_type = other DNA
gcatccacccatcttgaaaacttc

SEQ ID NO: 18265 - DNA, 23 bp, synthetic construct
  misc_feature 1..23: note = Synthetic Construct
  source 1..23: mol_type = other DNA
gccaccagatggatggctattct

SEQ ID NO: 18266 - DNA, 23 bp, synthetic construct
  misc_feature 1..23: note = Synthetic Construct
  source 1..23: mol_type = other DNA
agcttctgtgatgagaggacact

SEQ ID NO: 18267 - DNA, 22 bp, synthetic construct
  misc_feature 1..22: note = Synthetic Construct
  source 1..22: mol_type = other DNA
tgaggaagaaccaggagactca

SEQ ID NO: 18268 - DNA, 25 bp, synthetic construct
  misc_feature 1..25: note = Synthetic Construct
  source 1..25: mol_type = other DNA
cccatgtcactccttttcgttccta

SEQ ID NO: 18269 - DNA, 26 bp, synthetic construct
  misc_feature 1..26: note = Synthetic Construct
  source 1..26: mol_type = other DNA
gagtcccttgtgtaagaaccatcttc

SEQ ID NO: 18270 - DNA, 24 bp, synthetic construct
  misc_feature 1..24: note = Synthetic Construct
  source 1..24: mol_type = other DNA
gagtcatgaggtcctgtttcatct

SEQ ID NO: 18271 - DNA, 29 bp, synthetic construct
  misc_feature 1..29: note = Synthetic Construct
  source 1..29: mol_type = other DNA
ccctctgattatgacatctctagggaaca

SEQ ID NO: 18272 - DNA, 26 bp, synthetic construct
  misc_feature 1..26: note = Synthetic Construct
  source 1..26: mol_type = other DNA
gctcttcgagtcatttctggtcattc

SEQ ID NO: 18273 - DNA, 20 bp, synthetic construct
  misc_feature 1..20: note = Synthetic Construct
  source 1..20: mol_type = other DNA
ggccacaaggctggtgtctt

SEQ ID NO: 18274 - DNA, 22 bp, synthetic construct
  misc_feature 1..22: note = Synthetic Construct
  source 1..22: mol_type = other DNA
tgggacctgaacaaaccaggta

SEQ ID NO: 18275 - DNA, 25 bp, synthetic construct
  misc_feature 1..25: note = Synthetic Construct
  source 1..25: mol_type = other DNA
cctgagcgagttgaaggaattgtgt

SEQ ID NO: 18276 - DNA, 25 bp, synthetic construct
  misc_feature 1..25: note = Synthetic Construct
  source 1..25: mol_type = other DNA
cccagcagctttgctttagtaggta

SEQ ID NO: 18277 - DNA, 21 bp, synthetic construct
  misc_feature 1..21: note = Synthetic Construct
  source 1..21: mol_type = other DNA
ggctagtccactgcagactga

SEQ ID NO: 18278 - DNA, 23 bp, synthetic construct
  misc_feature 1..23: note = Synthetic Construct
  source 1..23: mol_type = other DNA
gtgcccaaccttggagatggtta

SEQ ID NO: 18279 - DNA, 22 bp, synthetic construct
  misc_feature 1..22: note = Synthetic Construct
  source 1..22: mol_type = other DNA
ctgggtctgtgaccttgctgta

SEQ ID NO: 18280 - DNA, 22 bp, synthetic construct
  misc_feature 1..22: note = Synthetic Construct
  source 1..22: mol_type = other DNA
caaaccccaagtcctcgttttc

SEQ ID NO: 18281 - DNA, 24 bp, synthetic construct
  misc_feature 1..24: note = Synthetic Construct
  source 1..24: mol_type = other DNA
ccctcctaatttgggttgcctgaa

SEQ ID NO: 18282 - DNA, 26 bp, synthetic construct
  misc_feature 1..26: note = Synthetic Construct
  source 1..26: mol_type = other DNA
ccacttctcagagctaacctgctgta

SEQ ID NO: 18283 - DNA, 20 bp, synthetic construct
  misc_feature 1..20: note = Synthetic Construct
  source 1..20: mol_type = other DNA
ctgcagatcggaccggatac

SEQ ID NO: 18284 - DNA, 23 bp, synthetic construct
  misc_feature 1..23: note = Synthetic Construct
  source 1..23: mol_type = other DNA
caaggtctgcttgctgtgtgatg

SEQ ID NO: 18285 - DNA, 26 bp, synthetic construct
  misc_feature 1..26: note = Synthetic Construct
  source 1..26: mol_type = other DNA
ggactggagtttcttcagagtagttg

SEQ ID NO: 18286 - DNA, 22 bp, synthetic construct
  misc_feature 1..22: note = Synthetic Construct
  source 1..22: mol_type = other DNA
tgtgcgtggatttcagtcatgt

SEQ ID NO: 18287 - DNA, 22 bp, synthetic construct
  misc_feature 1..22: note = Synthetic Construct
  source 1..22: mol_type = other DNA
ccgtttgccttcaaccctgaga

SEQ ID NO: 18288 - DNA, 23 bp, synthetic construct
  misc_feature 1..23: note = Synthetic Construct
  source 1..23: mol_type = other DNA
ggcatcagcagtatccgttcctt

SEQ ID NO: 18289 - DNA, 20 bp, synthetic construct
  misc_feature 1..20: note = Synthetic Construct
  source 1..20: mol_type = other DNA
ccccacatccagccaccatt

SEQ ID NO: 18290 - DNA, 24 bp, synthetic construct
  misc_feature 1..24: note = Synthetic Construct
  source 1..24: mol_type = other DNA
gctgcatttgggtcgttttgtttc

SEQ ID NO: 18291 - DNA, 22 bp, synthetic construct
  misc_feature 1..22: note = Synthetic Construct
  source 1..22: mol_type = other DNA
ggactctgtgctttggcctgaa

SEQ ID NO: 18292 - DNA, 19 bp, synthetic construct
  misc_feature 1..19: note = Synthetic Construct
  source 1..19: mol_type = other DNA
ggcctcacacgcacgtttc

SEQ ID NO: 18293 - DNA, 27 bp, synthetic construct
  misc_feature 1..27: note = Synthetic Construct
  source 1..27: mol_type = other DNA
cctgaccacgttatttattggttggaa

SEQ ID NO: 18294 - DNA, 25 bp, synthetic construct
  misc_feature 1..25: note = Synthetic Construct
  source 1..25: mol_type = other DNA
gctggaacagaccttaaaggcaatg

SEQ ID NO: 18295 - DNA, 22 bp, synthetic construct
  misc_feature 1..22: note = Synthetic Construct
  source 1..22: mol_type = other DNA
ctggctttggaatcggtctttg

SEQ ID NO: 18296 - DNA, 24 bp, synthetic construct
  misc_feature 1..24: note = Synthetic Construct
  source 1..24: mol_type = other DNA
acagcgaggaaaggaaggaaatag

SEQ ID NO: 18297 - DNA, 26 bp, synthetic construct
  misc_feature 1..26: note = Synthetic Construct
  source 1..26: mol_type = other DNA
ggaaacaaagcttgcctagagtttct

SEQ ID NO: 18298 - DNA, 20 bp, synthetic construct
  misc_feature 1..20: note = Synthetic Construct
  source 1..20: mol_type = other DNA
gtccgtgtcagtgtgtgact

SEQ ID NO: 18299 - DNA, 26 bp, synthetic construct
  misc_feature 1..26: note = Synthetic Construct
  source 1..26: mol_type = other DNA
ggcaaaagccacgtatttctctccaa

SEQ ID NO: 18300 - DNA, 25 bp, synthetic construct
  misc_feature 1..25: note = Synthetic Construct
  source 1..25: mol_type = other DNA
actgtgtggagagtaaatgggattc

SEQ ID NO: 18301 - DNA, 21 bp, synthetic construct
  misc_feature 1..21: note = Synthetic Construct
  source 1..21: mol_type = other DNA
agccattgcgagaccctgatg

SEQ ID NO: 18302 - DNA, 22 bp, synthetic construct
  misc_feature 1..22: note = Synthetic Construct
  source 1..22: mol_type = other DNA
gaggccctgaagctgagaacaa

SEQ ID NO: 18303 - DNA, 23 bp, synthetic construct
  misc_feature 1..23: note = Synthetic Construct
  source 1..23: mol_type = other DNA
gtgacccctcttaaccgcaaatg

SEQ ID NO: 18304 - DNA, 25 bp, synthetic construct
  misc_feature 1..25: note = Synthetic Construct
  source 1..25: mol_type = other DNA
ggtttcacctgtactagaggcattc

SEQ ID NO: 18305 - DNA, 23 bp, synthetic construct
  misc_feature 1..23: note = Synthetic Construct
  source 1..23: mol_type = other DNA
ctacccactgtggacacatgtaa

SEQ ID NO: 18306 - DNA, 24 bp, synthetic construct
  misc_feature 1..24: note = Synthetic Construct
  source 1..24: mol_type = other DNA
actcaggggcctttagttatgatg

SEQ ID NO: 18307 - DNA, 23 bp, synthetic construct
  misc_feature 1..23: note = Synthetic Construct
  source 1..23: mol_type = other DNA
gcctctgtacctctctctgcatt

SEQ ID NO: 18308 - DNA, 21 bp, synthetic construct
  misc_feature 1..21: note = Synthetic Construct
  source 1..21: mol_type = other DNA
ggcccagccttaagttcatca

SEQ ID NO: 18309 - DNA, 22 bp, synthetic construct
  misc_feature 1..22: note = Synthetic Construct
  source 1..22: mol_type = other DNA
ctctgtcgctgacactggatgt

SEQ ID NO: 18310 - DNA, 25 bp, synthetic construct
  misc_feature 1..25: note = Synthetic Construct
  source 1..25: mol_type = other DNA
gtcagaatgatcccgagagtgagtt

SEQ ID NO: 18311 - DNA, 24 bp, synthetic construct
  misc_feature 1..24: note = Synthetic Construct
  source 1..24: mol_type = other DNA
gctcacacactgtctcatttcaac

SEQ ID NO: 18312 - DNA, 23 bp, synthetic construct
  misc_feature 1..23: note = Synthetic Construct
  source 1..23: mol_type = other DNA
ctcccttttcctccacgaggatt

SEQ ID NO: 18313 - DNA, 24 bp, synthetic construct
  misc_feature 1..24: note = Synthetic Construct
  source 1..24: mol_type = other DNA
ctatgggccatttacccattgaac

SEQ ID NO: 18314 - DNA, 22 bp, synthetic construct
  misc_feature 1..22: note = Synthetic Construct
  source 1..22: mol_type = other DNA
cagggagtgtgtgggtttggtt

SEQ ID NO: 18315 - DNA, 22 bp, synthetic construct
  misc_feature 1..22: note = Synthetic Construct
  source 1..22: mol_type = other DNA
ggggtcacaccaaagggattga

SEQ ID NO: 18316 - DNA, 24 bp, synthetic construct
  misc_feature 1..24: note = Synthetic Construct
  source 1..24: mol_type = other DNA
ccctacattcaaggaccaggttga

SEQ ID NO: 18317 - DNA, 22 bp, synthetic construct
  misc_feature 1..22: note = Synthetic Construct
  source 1..22: mol_type = other DNA
cgcttgctgactgcttcctttg

SEQ ID NO: 18318 - DNA, 20 bp, synthetic construct
  misc_feature 1..20: note = Synthetic Construct
  source 1..20: mol_type = other DNA
ggcttcacagctgcagcaaa

SEQ ID NO: 18319 - DNA, 26 bp, synthetic construct
  misc_feature 1..26: note = Synthetic Construct
  source 1..26: mol_type = other DNA
ccagcactggaaagagtaagtcattg

SEQ ID NO: 18320 - DNA, 25 bp, synthetic construct
  misc_feature 1..25: note = Synthetic Construct
  source 1..25: mol_type = other DNA
gcagctgaacagtacaataccatgt

SEQ ID NO: 18321 - DNA, 20 bp, synthetic construct
  misc_feature 1..20: note = Synthetic Construct
  source 1..20: mol_type = other DNA
cacgtggctttgcacacagt

SEQ ID NO: 18322 - DNA, 24 bp, synthetic construct
  misc_feature 1..24: note = Synthetic Construct
  source 1..24: mol_type = other DNA
gggaagttcatcttcatgggtttg

SEQ ID NO: 18323 - DNA, 21 bp, synthetic construct
  misc_feature 1..21: note = Synthetic Construct
  source 1..21: mol_type = other DNA
ggaggccaaatgcagatgagt

SEQ ID NO: 18324 - DNA, 24 bp, synthetic construct
  misc_feature 1..24: note = Synthetic Construct
  source 1..24: mol_type = other DNA
gctggcaactggaaatgggaaatg

SEQ ID NO: 18325 - DNA, 22 bp, synthetic construct
  misc_feature 1..22: note = Synthetic Construct
  source 1..22: mol_type = other DNA
cctgagaagcactctcccttgt

SEQ ID NO: 18326 - DNA, 22 bp, synthetic construct
  misc_feature 1..22: note = Synthetic Construct
  source 1..22: mol_type = other DNA
tgaaggagcacaattgcaggat

SEQ ID NO: 18327 - DNA, 23 bp, synthetic construct
  misc_feature 1..23: note = Synthetic Construct
  source 1..23: mol_type = other DNA
cacgtgataccaacagtggatgt

SEQ ID NO: 18328 - DNA, 25 bp, synthetic construct
  misc_feature 1..25: note = Synthetic Construct
  source 1..25: mol_type = other DNA
gagctcaccaggaagtatagcatct

SEQ ID NO: 18329 - DNA, 21 bp, synthetic construct
  misc_feature 1..21: note = Synthetic Construct
  source 1..21: mol_type = other DNA
ccctgtactctgcgtctgtct

SEQ ID NO: 18330 - DNA, 23 bp, synthetic construct
  misc_feature 1..23: note = Synthetic Construct
  source 1..23: mol_type = other DNA
gtcatccctcatcaagggcagaa

SEQ ID NO: 18331 - DNA, 24 bp, synthetic construct
  misc_feature 1..24: note = Synthetic Construct
  source 1..24: mol_type = other DNA
gcgaggggtatgggctaatagttg

SEQ ID NO: 18332 - DNA, 22 bp, synthetic construct
  misc_feature 1..22: note = Synthetic Construct
  source 1..22: mol_type = other DNA
tgtcctgtgtcccagctctagt

SEQ ID NO: 18333 - DNA, 24 bp, synthetic construct
  misc_feature 1..24: note = Synthetic Construct
  source 1..24: mol_type = other DNA
ccaaagtgtcaccagcagagacat

SEQ ID NO: 18334 - DNA, 24 bp, synthetic construct
  misc_feature 1..24: note = Synthetic Construct
  source 1..24: mol_type = other DNA
ctggggatgaatctgctttaccat

SEQ ID NO: 18335 - DNA, 24 bp, synthetic construct
  misc_feature 1..24: note = Synthetic Construct
  source 1..24: mol_type = other DNA
cagcgataacttccttccactcaa

SEQ ID NO: 18336 - DNA, 24 bp, synthetic construct
  misc_feature 1..24: note = Synthetic Construct
  source 1..24: mol_type = other DNA
ggaccagcctctacttgctactgt

SEQ ID NO: 18337 - DNA, 24 bp, synthetic construct
  misc_feature 1..24: note = Synthetic Construct
  source 1..24: mol_type = other DNA
tgtaacctagatgaccatgcgttt

SEQ ID NO: 18338 - DNA, 26 bp, synthetic construct
  misc_feature 1..26: note = Synthetic Construct
  source 1..26: mol_type = other DNA
gccagctttttgctatttccttccat

SEQ ID NO: 18339 - DNA, 23 bp, synthetic construct
  misc_feature 1..23: note = Synthetic Construct
  source 1..23: mol_type = other DNA
aggggttaggcggaaaaagtatg

SEQ ID NO: 18340 - DNA, 29 bp, synthetic construct
  misc_feature 1..29: note = Synthetic Construct
  source 1..29: mol_type = other DNA
ggagagacaatcaactatgtctcttgtga

SEQ ID NO: 18341 - DNA, 24 bp, synthetic construct
  misc_feature 1..24: note = Synthetic Construct
  source 1..24: mol_type = other DNA
cctcttttccctacttcccacttc

SEQ ID NO: 18342 - DNA, 26 bp, synthetic construct
  misc_feature 1..26: note = Synthetic Construct
  source 1..26: mol_type = other DNA
cacttggccataaagcaattctcaac

SEQ ID NO: 18343 - DNA, 21 bp, synthetic construct
  misc_feature 1..21: note = Synthetic Construct
  source 1..21: mol_type = other DNA
gacggcagcagaggattttga

SEQ ID NO: 18344 - DNA, 22 bp, synthetic construct
  misc_feature 1..22: note = Synthetic Construct
  source 1..22: mol_type = other DNA
gaatgctgccaaagggaactga

SEQ ID NO: 18345 - DNA, 26 bp, synthetic construct
  misc_feature 1..26: note = Synthetic Construct
  source 1..26: mol_type = other DNA
gcagaggaagttagaggtgggatatt

SEQ ID NO: 18346 - DNA, 20 bp, synthetic construct
  misc_feature 1..20: note = Synthetic Construct
  source 1..20: mol_type = other DNA
gtggactttcagcgccaact

SEQ ID NO: 18347 - DNA, 22 bp, synthetic construct
  misc_feature 1..22: note = Synthetic Construct
  source 1..22: mol_type = other DNA
ctcctaactcacgtccgggtat

SEQ ID NO: 18348 - DNA, 24 bp, synthetic construct
  misc_feature 1..24: note = Synthetic Construct
  source 1..24: mol_type = other DNA
ccaaggggacatttaacgctgtga

SEQ ID NO: 18349 - DNA, 27 bp, synthetic construct
  misc_feature 1..27: note = Synthetic Construct
  source 1..27: mol_type = other DNA
gactttagaactcctgctaccaacatt

SEQ ID NO: 18350 - DNA, 25 bp, synthetic construct
  misc_feature 1..25: note = Synthetic Construct
  source 1..25: mol_type = other DNA
gggagtggtaaaaggcttggacttc

SEQ ID NO: 18351 - DNA, 21 bp, synthetic construct
  misc_feature 1..21: note = Synthetic Construct
  source 1..21: mol_type = other DNA
caaggtgtcagtctgccttgt

SEQ ID NO: 18352 - DNA, 21 bp, synthetic construct
  misc_feature 1..21: note = Synthetic Construct
  source 1..21: mol_type = other DNA
tgcctgcagaaggggatgtga

SEQ ID NO: 18353 - DNA, 22 bp, synthetic construct
  misc_feature 1..22: note = Synthetic Construct
  source 1..22: mol_type = other DNA
aggggaggaacatgaggctgaa

SEQ ID NO: 18354 - DNA, 24 bp, synthetic construct
  misc_feature 1..24: note = Synthetic Construct
  source 1..24: mol_type = other DNA
ggtggcttcaggaataggggacaa

SEQ ID NO: 18355 - DNA, 27 bp, synthetic construct
  misc_feature 1..27: note = Synthetic Construct
  source 1..27: mol_type = other DNA
ggttctaggatctgtctgggagatcaa

SEQ ID NO: 18356 - DNA, 24 bp, synthetic construct
  misc_feature 1..24: note = Synthetic Construct
  source 1..24: mol_type = other DNA
actgctcctaagataggcgatttc

SEQ ID NO: 18357 - DNA, 26 bp, synthetic construct
  misc_feature 1..26: note = Synthetic Construct
  source 1..26: mol_type = other DNA
caccaagcatacctgagtcataccta

SEQ ID NO: 18358 - DNA, 22 bp, synthetic construct
  misc_feature 1..22: note = Synthetic Construct
  source 1..22: mol_type = other DNA
agcttccatccgtcccatctat

SEQ ID NO: 18359 - DNA, 27 bp, synthetic construct
  misc_feature 1..27: note = Synthetic Construct
  source 1..27: mol_type = other DNA
cgatagctacccttgctttttcctctt

SEQ ID NO: 18360 - DNA, 22 bp, synthetic construct
  misc_feature 1..22: note = Synthetic Construct
  source 1..22: mol_type = other DNA
cctgctctaggctgcaagtgtt

SEQ ID NO: 18361 - DNA, 25 bp, synthetic construct
  misc_feature 1..25: note = Synthetic Construct
  source 1..25: mol_type = other DNA
ctggactcctgctgatagagtcttg

SEQ ID NO: 18362 - DNA, 24 bp, synthetic construct
  misc_feature 1..24: note = Synthetic Construct
  source 1..24: mol_type = other DNA
gcccttgatcctcctaggctattg

SEQ ID NO: 18363 - DNA, 23 bp, synthetic construct
  misc_feature 1..23: note = Synthetic Construct
  source 1..23: mol_type = other DNA
agtggctgagaatgagacctcta

SEQ ID NO: 18364 - DNA, 24 bp, synthetic construct
  misc_feature 1..24: note = Synthetic Construct
  source 1..24: mol_type = other DNA
cctgttggtccaaatccttactga

SEQ ID NO: 18365 - DNA, 27 bp, synthetic construct
  misc_feature 1..27: note = Synthetic Construct
  source 1..27: mol_type = other DNA
gactgtggtttcaacaccttataccta

SEQ ID NO: 18366 - DNA, 27 bp, synthetic construct
  misc_feature 1..27: note = Synthetic Construct
  source 1..27: mol_type = other DNA
ccttctggctaaatctacctgctcttc

SEQ ID NO: 18367 - DNA, 30 bp, synthetic construct
  misc_feature 1..30: note = Synthetic Construct
  source 1..30: mol_type = other DNA
ccatgtgaggtagataggatttgctctagt

SEQ ID NO: 18368 - DNA, 22 bp, synthetic construct
  misc_feature 1..22: note = Synthetic Construct
  source 1..22: mol_type = other DNA
ctcacaggccagggatttcaga

SEQ ID NO: 18369 - DNA, 27 bp, synthetic construct
  misc_feature 1..27: note = Synthetic Construct
  source 1..27: mol_type = other DNA
gagcttgagatcctttctgaagaagtt

SEQ ID NO: 18370 - DNA, 24 bp, synthetic construct
  misc_feature 1..24: note = Synthetic Construct
  source 1..24: mol_type = other DNA
tgtatttgggtgcatgagttggtt

SEQ ID NO: 18371 - DNA, 24 bp, synthetic construct
  misc_feature 1..24: note = Synthetic Construct
  source 1..24: mol_type = other DNA
gggtccctaattttggtgatgact

SEQ ID NO: 18372 - DNA, 25 bp, synthetic construct
  misc_feature 1..25: note = Synthetic Construct
  source 1..25: mol_type = other DNA
gcagccattgtctgtaggacttgat

SEQ ID NO: 18373 - DNA, 26 bp, synthetic construct
  misc_feature 1..26: note = Synthetic Construct
  source 1..26: mol_type = other DNA
gcaagctcatttgcaaggtagagaac

SEQ ID NO: 18374 - DNA, 24 bp, synthetic construct
  misc_feature 1..24: note = Synthetic Construct
  source 1..24: mol_type = other DNA
ccttcttgagtctgatcactcgtt

SEQ ID NO: 18375 - DNA, 24 bp, synthetic construct
  misc_feature 1..24: note = Synthetic Construct
  source 1..24: mol_type = other DNA
gggatttcccacacttctcctctt

SEQ ID NO: 18376 - DNA, 26 bp, synthetic construct
  misc_feature 1..26: note = Synthetic Construct
  source 1..26: mol_type = other DNA
ccacctcgaagctttagtaccctaag

SEQ ID NO: 18377 - DNA, 25 bp, synthetic construct
  misc_feature 1..25: note = Synthetic Construct
  source 1..25: mol_type = other DNA
gaccatccacagacttaaagaggaa

SEQ ID NO: 18378 - DNA, 24 bp, synthetic construct
  misc_feature 1..24: note = Synthetic Construct
  source 1..24: mol_type = other DNA
gctccagcctagatacaacacttg

SEQ ID NO: 18379 - DNA, 23 bp, synthetic construct
  misc_feature 1..23: note = Synthetic Construct
  source 1..23: mol_type = other DNA
gacagccagctaacactgtggaa

SEQ ID NO: 18380 - DNA, 21 bp, synthetic construct
  misc_feature 1..21: note = Synthetic Construct
  source 1..21: mol_type = other DNA
ccacgaaacaggaccatgaca

SEQ ID NO: 18381 - DNA, 21 bp, synthetic construct
  misc_feature 1..21: note = Synthetic Construct
  source 1..21: mol_type = other DNA
acccagacacggcttgactct

SEQ ID NO: 18382 - DNA, 23 bp, synthetic construct
  misc_feature 1..23: note = Synthetic Construct
  source 1..23: mol_type = other DNA
ccaccgtctatgtcaacgccatt

SEQ ID NO: 18383 - DNA, 23 bp, synthetic construct
  misc_feature 1..23: note = Synthetic Construct
  source 1..23: mol_type = other DNA
tggaggcagaggtttagagagaa

SEQ ID NO: 18384 - DNA, 24 bp, synthetic construct
  misc_feature 1..24: note = Synthetic Construct
  source 1..24: mol_type = other DNA
ctgtcacctctttcgtggtacagt

SEQ ID NO: 18385 - DNA, 28 bp, synthetic construct
  misc_feature 1..28: note = Synthetic Construct
  source 1..28: mol_type = other DNA
gaggcgagatagaaaagtagttggtgaa

SEQ ID NO: 18386 - DNA, 26 bp, synthetic construct
  misc_feature 1..26: note = Synthetic Construct
  source 1..26: mol_type = other DNA
gtggtactgaaaccccagtttagctt

SEQ ID NO: 18387 - DNA, 21 bp, synthetic construct
  misc_feature 1..21: note = Synthetic Construct
  source 1..21: mol_type = other DNA
tgccttagtgctggcctctct

SEQ ID NO: 18388 - DNA, 25 bp, synthetic construct
  misc_feature 1..25: note = Synthetic Construct
  source 1..25: mol_type = other DNA
accaaagccgtgtattcgtttattc

SEQ ID NO: 18389 - DNA, 23 bp, synthetic construct
  misc_feature 1..23: note = Synthetic Construct
  source 1..23: mol_type = other DNA
ggaccaggtttctagcagtgaga

SEQ ID NO: 18390 - DNA, 22 bp, synthetic construct
  misc_feature 1..22: note = Synthetic Construct
  source 1..22: mol_type = other DNA
cacacagccatggacattcaga

SEQ ID NO: 18391 - DNA, 24 bp, synthetic construct
  misc_feature 1..24: note = Synthetic Construct
  source 1..24: mol_type = other DNA
gatgtaatgctcaagaggctgaga

SEQ ID NO: 18392 - DNA, 24 bp, synthetic construct
  misc_feature 1..24: note = Synthetic Construct
  source 1..24: mol_type = other DNA
caccagaagcagtttgtcttcagt

SEQ ID NO: 18393 - DNA, 22 bp, synthetic construct
  misc_feature 1..22: note = Synthetic Construct
  source 1..22: mol_type = other DNA
gcagtcacaccaggctcaaatc

SEQ ID NO: 18394 - DNA, 25 bp, synthetic construct
  misc_feature 1..25: note = Synthetic Construct
  source 1..25: mol_type = other DNA
ctggctgcaaatatgtgcctgttac

SEQ ID NO: 18395 - DNA, 26 bp, synthetic construct
  misc_feature 1..26: note = Synthetic Construct
  source 1..26: mol_type = other DNA
cccaaagtcatcaattcttcctgaga

SEQ ID NO: 18396 - DNA, 22 bp, synthetic construct
  misc_feature 1..22: note = Synthetic Construct
  source 1..22: mol_type = other DNA
ccctacctgcatctcctcaaac

SEQ ID NO: 18397 - DNA, 22 bp, synthetic construct
  misc_feature 1..22: note = Synthetic Construct
  source 1..22: mol_type = other DNA
agagtggcagcagtgggaatag

SEQ ID NO: 18398 - DNA, 27 bp, synthetic construct
  misc_feature 1..27: note = Synthetic Construct
  source 1..27: mol_type = other DNA
cggttttaccctgaaaagaaaccaaac

SEQ ID NO: 18399 - DNA, 25 bp, synthetic construct
  misc_feature 1..25: note = Synthetic Construct
  source 1..25: mol_type = other DNA
atctgagaagtagcactagggagaa

SEQ ID NO: 18400 - DNA, 24 bp, synthetic construct
  misc_feature 1..24: note = Synthetic Construct
  source 1..24: mol_type = other DNA
gccttgacaaacaatgtgagcaat

SEQ ID NO: 18401 - DNA, 21 bp, synthetic construct
  misc_feature 1..21: note = Synthetic Construct
  source 1..21: mol_type = other DNA
gtttgcctcttgggctcattg

SEQ ID NO: 18402 - DNA, 24 bp, synthetic construct
  misc_feature 1..24: note = Synthetic Construct
  source 1..24: mol_type = other DNA
cagagggtctggtaaactctggta

SEQ ID NO: 18403 - DNA, 26 bp, synthetic construct
  misc_feature 1..26: note = Synthetic Construct
  source 1..26: mol_type = other DNA
cctgtctttgaatggctctcctcaga

SEQ ID NO: 18404 - DNA, 25 bp, synthetic construct
  misc_feature 1..25: note = Synthetic Construct
  source 1..25: mol_type = other DNA
gtgggagaatagtggttctgcctat

SEQ ID NO: 18405 - DNA, 22 bp, synthetic construct
  misc_feature 1..22: note = Synthetic Construct
  source 1..22: mol_type = other DNA
cacccatgctagggactcttga

SEQ ID NO: 18406 - DNA, 23 bp, synthetic construct
  misc_feature 1..23: note = Synthetic Construct
  source 1..23: mol_type = other DNA
cagcagaaacagtgggatgtagt

SEQ ID NO: 18407 - DNA, 22 bp, synthetic construct
  misc_feature 1..22: note = Synthetic Construct
  source 1..22: mol_type = other DNA
acctgtgcatctgcctctgttg

SEQ ID NO: 18408 - DNA, 24 bp, synthetic construct
  misc_feature 1..24: note = Synthetic Construct
  source 1..24: mol_type = other DNA
gcctgcttacatcccactcaaaag

SEQ ID NO: 18409 - DNA, 24 bp, synthetic construct
  misc_feature 1..24: note = Synthetic Construct
  source 1..24: mol_type = other DNA
tctgagtctctcctttcaggacaa

SEQ ID NO: 18410 - DNA, 24 bp, synthetic construct
  misc_feature 1..24: note = Synthetic Construct
  source 1..24: mol_type = other DNA
cccttcactcattcctggggttag

SEQ ID NO: 18411 - DNA, 22 bp, synthetic construct
  misc_feature 1..22: note = Synthetic Construct
  source 1..22: mol_type = other DNA
gcatggcaaagaccacttcctt

SEQ ID NO: 18412 - DNA, 21 bp, synthetic construct
  misc_feature 1..21: note = Synthetic Construct
  source 1..21: mol_type = other DNA
ggcagggtgtagggagaaaag

SEQ ID NO: 18413 - DNA, 26 bp, synthetic construct
  misc_feature 1..26: note = Synthetic Construct
  source 1..26: mol_type = other DNA
ctggctgttgatgaggaaaagggtat

SEQ ID NO: 18414 - DNA, 26 bp, synthetic construct
  misc_feature 1..26: note = Synthetic Construct
  source 1..26: mol_type = other DNA
cacagggtgtcagactttagggagta

SEQ ID NO: 18415 - DNA, 26 bp, synthetic construct
  misc_feature 1..26: note = Synthetic Construct
  source 1..26: mol_type = other DNA
gtgaaaggaggtgctgttagtaattg

SEQ ID NO: 18416 - DNA, 27 bp, synthetic construct
  misc_feature 1..27: note = Synthetic Construct
  source 1..27: mol_type = other DNA
gtgccatattgaccatcttccttttac

SEQ ID NO: 18417 - DNA, 22 bp, synthetic construct
  misc_feature 1..22: note = Synthetic Construct
  source 1..22: mol_type = other DNA
cccaccttcagggtgtgtgatg

SEQ ID NO: 18418 - DNA, 22 bp, synthetic construct
  misc_feature 1..22: note = Synthetic Construct
  source 1..22: mol_type = other DNA
ggtggtggaaatgttccgatga

SEQ ID NO: 18419 - DNA, 20 bp, synthetic construct
  misc_feature 1..20: note = Synthetic Construct
  source 1..20: mol_type = other DNA
gtcctggaccatgggcagat

SEQ ID NO: 18420 - DNA, 22 bp, synthetic construct
  misc_feature 1..22: note = Synthetic Construct
  source 1..22: mol_type = other DNA
ctgtttcacttgcactgtgtgt

SEQ ID NO: 18421 - DNA, 25 bp, synthetic construct
  misc_feature 1..25: note = Synthetic Construct
  source 1..25: mol_type = other DNA
ccgtagactgtccagagagatgaca

SEQ ID NO: 18422 - DNA, 21 bp, synthetic construct
  misc_feature 1..21: note = Synthetic Construct
  source 1..21: mol_type = other DNA
ccaaagcacgaaacgccttgt

SEQ ID NO: 18423 - DNA, 21 bp, synthetic construct
  misc_feature 1..21: note = Synthetic Construct
  source 1..21: mol_type = other DNA
tccatgctacaagggcagagt

SEQ ID NO: 18424 - DNA, 25 bp, synthetic construct
  misc_feature 1..25: note = Synthetic Construct
  source 1..25: mol_type = other DNA
ggacacagaatgaaccactgactga

SEQ ID NO: 18425 - DNA, 26 bp, synthetic construct
  misc_feature 1..26: note = Synthetic Construct
  source 1..26: mol_type = other DNA
gacagcttagacagaaacctcttttg

SEQ ID NO: 18426 - DNA, 23 bp, synthetic construct
  misc_feature 1..23: note = Synthetic Construct
  source 1..23: mol_type = other DNA
gccgaagatctctgcatttcaca

SEQ ID NO: 18427 - DNA, 20 bp, synthetic construct
  misc_feature 1..20: note = Synthetic Construct
  source 1..20: mol_type = other DNA
tgccgtggaacggtctgttt

SEQ ID NO: 18428 - DNA, 26 bp, synthetic construct
  misc_feature 1..26: note = Synthetic Construct
  source 1..26: mol_type = other DNA
gcagagacagaaggcagggtaagaaa

SEQ ID NO: 18429 - DNA, 25 bp, synthetic construct
  misc_feature 1..25: note = Synthetic Construct
  source 1..25: mol_type = other DNA
gggatgcaactatctccttcccatt

SEQ ID NO: 18430 - DNA, 28 bp, synthetic construct
  misc_feature 1..28: note = Synthetic Construct
  source 1..28: mol_type = other DNA
gtgtgtggatgaaaactctggtctctta

SEQ ID NO: 18431 - DNA, 26 bp, synthetic construct
  misc_feature 1..26: note = Synthetic Construct
  source 1..26: mol_type = other DNA
gcatctggcatgcactcttcacttag

SEQ ID NO: 18432 - DNA, 24 bp, synthetic construct
  misc_feature 1..24: note = Synthetic Construct
  source 1..24: mol_type = other DNA
ctccagacctcttgaattgactga

SEQ ID NO: 18433 - DNA, 26 bp, synthetic construct
  misc_feature 1..26: note = Synthetic Construct
  source 1..26: mol_type = other DNA
gttccagtagagctggatacatacaa

SEQ ID NO: 18434 - DNA, 26 bp, synthetic construct
  misc_feature 1..26: note = Synthetic Construct
  source 1..26: mol_type = other DNA
ctgggccatttaccatatgtcaggaa

SEQ ID NO: 18435 - DNA, 21 bp, synthetic construct
  misc_feature 1..21: note = Synthetic Construct
  source 1..21: mol_type = other DNA
ccatgtggcaggtgaggatgt

SEQ ID NO: 18436 - DNA, 24 bp, synthetic construct
  misc_feature 1..24: note = Synthetic Construct
  source 1..24: mol_type = other DNA
aggaagagcgtatgtagagagcat

SEQ ID NO: 18437 - DNA, 22 bp, synthetic construct
  misc_feature 1..22: note = Synthetic Construct
  source 1..22: mol_type = other DNA
cccagaattcccctgctgaaga

SEQ ID NO: 18438 - DNA, 26 bp, synthetic construct
  misc_feature 1..26: note = Synthetic Construct
  source 1..26: mol_type = other DNA
gctgtggtttcagagtctcaccctaa

SEQ ID NO: 18439 - DNA, 22 bp, synthetic construct
  misc_feature 1..22: note = Synthetic Construct
  source 1..22: mol_type = other DNA
cactccaatgcctcctgtggtt

SEQ ID NO: 18440 - DNA, 24 bp, synthetic construct
  misc_feature 1..24: note = Synthetic Construct
  source 1..24: mol_type = other DNA
ccctgtgagacttcatccccttca

SEQ ID NO: 18441 - DNA, 25 bp, synthetic construct
  misc_feature 1..25: note = Synthetic Construct
  source 1..25: mol_type = other DNA
ggggaagtttttgaaggcaaaacaa

SEQ ID NO: 18442 - DNA, 24 bp, synthetic construct
  misc_feature 1..24: note = Synthetic Construct
  source 1..24: mol_type = other DNA
aggggattaagaggcaaaggaatg

SEQ ID NO: 18443 - DNA, 23 bp, synthetic construct
  misc_feature 1..23: note = Synthetic Construct
  source 1..23: mol_type = other DNA
ctgggttcaagttttggctcttc

SEQ ID NO: 18444 - DNA, 21 bp, synthetic construct
  misc_feature 1..21: note = Synthetic Construct
  source 1..21: mol_type = other DNA
agtgccttcgtaagcgattca

SEQ ID NO: 18445 - DNA, 26 bp, synthetic construct
  misc_feature 1..26: note = Synthetic Construct
  source 1..26: mol_type = other DNA
ctgtagactttggcttattcgacctt

SEQ ID NO: 18446 - DNA, 28 bp, synthetic construct
  misc_feature 1..28: note = Synthetic Construct
  source 1..28: mol_type = other DNA
gctggtcctctggttttgtaaccctatt

SEQ ID NO: 18447 - DNA, 24 bp, synthetic construct
  misc_feature 1..24: note = Synthetic Construct
  source 1..24: mol_type = other DNA
ccatggtcagcatgatatcctcaa

SEQ ID NO: 18448 - DNA, 19 bp, synthetic construct
  misc_feature 1..19: note = Synthetic Construct
  source 1..19: mol_type = other DNA
aggctcgccctctcctctt

SEQ ID NO: 18449 - DNA, 24 bp, synthetic construct
  misc_feature 1..24: note = Synthetic Construct
  source 1..24: mol_type = other DNA
gctctctagaagcgctttcccaaa

SEQ ID NO: 18450 - DNA, 26 bp, synthetic construct
  misc_feature 1..26: note = Synthetic Construct
  source 1..26: mol_type = other DNA
ctttcaattccagagcttgtcccata

SEQ ID NO: 18451 - DNA, 28 bp, synthetic construct
  misc_feature 1..28: note = Synthetic Construct
  source 1..28: mol_type = other DNA
cgagaactacggtttcaaaggaaagaag

SEQ ID NO: 18452 - DNA, 21 bp, synthetic construct
  misc_feature 1..21: note = Synthetic Construct
  source 1..21: mol_type = other DNA
cggcaaatgcagcacaaaatc

SEQ ID NO: 18453 - DNA, 22 bp, synthetic construct
  misc_feature 1..22: note = Synthetic Construct
  source 1..22: mol_type = other DNA
cctggttcaaacgggagcgtat

SEQ ID NO: 18454 - DNA, 21 bp, synthetic construct
  misc_feature 1..21: note = Synthetic Construct
  source 1..21: mol_type = other DNA
ggatgctgtcgatgtcactct

SEQ ID NO: 18455 - DNA, 23 bp, synthetic construct
  misc_feature 1..23: note = Synthetic Construct
  source 1..23: mol_type = other DNA
ctccaccatagggagtgactttg

SEQ ID NO: 18456 - DNA, 20 bp, synthetic construct
  misc_feature 1..20: note = Synthetic Construct
  source 1..20: mol_type = other DNA
tgttcccacctcgccacaaa

SEQ ID NO: 18457 - DNA, 26 bp, synthetic construct
  misc_feature 1..26: note = Synthetic Construct
  source 1..26: mol_type = other DNA
ggagtctttttcaaagcgtgggtaac

SEQ ID NO: 18458 - DNA, 27 bp, synthetic construct
  misc_feature 1..27: note = Synthetic Construct
  source 1..27: mol_type = other DNA
gcagtaagcaccagtgaatatctgatt

SEQ ID NO: 18459 - DNA, 26 bp, synthetic construct
  misc_feature 1..26: note = Synthetic Construct
  source 1..26: mol_type = other DNA
ccagagatacttgagatggtcacact

SEQ ID NO: 18460 - DNA, 20 bp, synthetic construct
  misc_feature 1..20: note = Synthetic Construct
  source 1..20: mol_type = other DNA
ttgccagagtgctgtcatgt

SEQ ID NO: 18461 - DNA, 24 bp, synthetic construct
  misc_feature 1..24: note = Synthetic Construct
  source 1..24: mol_type = other DNA
aggattggcataggaacaagtgat

SEQ ID NO: 18462 - DNA, 21 bp, synthetic construct
  misc_feature 1..21: note = Synthetic Construct
  source 1..21: mol_type = other DNA
ccgtctttgtgccacctgttg

SEQ ID NO: 18463 - DNA, 24 bp, synthetic construct
  misc_feature 1..24: note = Synthetic Construct
  source 1..24: mol_type = other DNA
ggcacagattaactgcgtctgact

SEQ ID NO: 18464 - DNA, 25 bp, synthetic construct
  misc_feature 1..25: note = Synthetic Construct
  source 1..25: mol_type = other DNA
gcgtatcttctgcatacactagctt

SEQ ID NO: 18465 - DNA, 20 bp, synthetic construct
  misc_feature 1..20: note = Synthetic Construct
  source 1..20: mol_type = other DNA
aaggcgatgggaacctcaga

SEQ ID NO: 18466 - DNA, 24 bp, synthetic construct
  misc_feature 1..24: note = Synthetic Construct
  source 1..24: mol_type = other DNA
gccagaacctggtctgaactccaa

SEQ ID NO: 18467 - DNA, 22 bp, synthetic construct
  misc_feature 1..22: note = Synthetic Construct
  source 1..22: mol_type = other DNA
ggggaaaccatgaaggcttgaa

SEQ ID NO: 18468 - DNA, 22 bp, synthetic construct
  misc_feature 1..22: note = Synthetic Construct
  source 1..22: mol_type = other DNA
ggccaccattggcagtatcatc

SEQ ID NO: 18469 - DNA, 20 bp, synthetic construct
  misc_feature 1..20: note = Synthetic Construct
  source 1..20: mol_type = other DNA
cgtgggtgaagcgcagagta

SEQ ID NO: 18470 - DNA, 21 bp, synthetic construct
  misc_feature 1..21: note = Synthetic Construct
  source 1..21: mol_type = other DNA
tcagggcatagggcctagaag

SEQ ID NO: 18471 - DNA, 21 bp, synthetic construct
  misc_feature 1..21: note = Synthetic Construct
  source 1..21: mol_type = other DNA
gcccacagagaccatccatct

SEQ ID NO: 18472 - DNA, 23 bp, synthetic construct
  misc_feature 1..23: note = Synthetic Construct
  source 1..23: mol_type = other DNA
gtgggattcagccattcctgcta

SEQ ID NO: 18473 - DNA, 27 bp, synthetic construct
  misc_feature 1..27: note = Synthetic Construct
  source 1..27: mol_type = other DNA
cctcagacagagctgggtttaaattct

SEQ ID NO: 18474 - DNA, 19 bp, synthetic construct
  misc_feature 1..19: note = Synthetic Construct
  source 1..19: mol_type = other DNA
ggggacagcagcgttcctt

SEQ ID NO: 18475 - DNA, 19 bp, synthetic construct
  misc_feature 1..19: note = Synthetic Construct
  source 1..19: mol_type = other DNA
tgctactgggtgccaggaa

SEQ ID NO: 18476 - DNA, 25 bp, synthetic construct
  misc_feature 1..25: note = Synthetic Construct
  source 1..25: mol_type = other DNA
cctgccacatgttctatctgtgtct

SEQ ID NO: 18477 - DNA, 24 bp, synthetic construct
  misc_feature 1..24: note = Synthetic Construct
  source 1..24: mol_type = other DNA
cagtgattgtcctaaggccaggtt

SEQ ID NO: 18478 - DNA, 30 bp, synthetic construct
  misc_feature 1..30: note = Synthetic Construct
  source 1..30: mol_type = other DNA
gggattctctaggaggagataactttctga

SEQ ID NO: 18479 - DNA, 22 bp, synthetic construct
  misc_feature 1..22: note = Synthetic Construct
  source 1..22: mol_type = other DNA
ggagcaggttggaggttagcat

SEQ ID NO: 18480 - DNA, 28 bp, synthetic construct
  misc_feature 1..28: note = Synthetic Construct
  source 1..28: mol_type = other DNA
gctgtggaatgcagttgaatgactttct

SEQ ID NO: 18481 - DNA, 21 bp, synthetic construct
  misc_feature 1..21: note = Synthetic Construct
  source 1..21: mol_type = other DNA
tgctgaacgtcacacagtgat

SEQ ID NO: 18482 - DNA, 25 bp, synthetic construct
  misc_feature 1..25: note = Synthetic Construct
  source 1..25: mol_type = other DNA
gcaatcttggctaatgagaccattt

SEQ ID NO: 18483 - DNA, 26 bp, synthetic construct
  misc_feature 1..26: note = Synthetic Construct
  source 1..26: mol_type = other DNA
gcccttctattctacactgacgtaaa

SEQ ID NO: 18484 - DNA, 25 bp, synthetic construct
  misc_feature 1..25: note = Synthetic Construct
  source 1..25: mol_type = other DNA
ggagaaacaaccaccatgggaatga

SEQ ID NO: 18485 - DNA, 24 bp, synthetic construct
  misc_feature 1..24: note = Synthetic Construct
  source 1..24: mol_type = other DNA
cacagtgctgacttcctttctact

SEQ ID NO: 18486 - DNA, 24 bp, synthetic construct
  misc_feature 1..24: note = Synthetic Construct
  source 1..24: mol_type = other DNA
gggccacctggatgtagacttttg

SEQ ID NO: 18487 - DNA, 24 bp, synthetic construct
  misc_feature 1..24: note = Synthetic Construct
  source 1..24: mol_type = other DNA
gggacaaatcttcctaccccattc

SEQ ID NO: 18488 - DNA, 25 bp, synthetic construct
  misc_feature 1..25: note = Synthetic Construct
  source 1..25: mol_type = other DNA
agtactgggatttgctacagagaag

SEQ ID NO: 18489 - DNA, 26 bp, synthetic construct
  misc_feature 1..26: note = Synthetic Construct
  source 1..26: mol_type = other DNA
ggggaggtatcagagcctttttctga

SEQ ID NO: 18490 - DNA, 30 bp, synthetic construct
  misc_feature 1..30: note = Synthetic Construct
  source 1..30: mol_type = other DNA
ccatgaaactcaatgacactgtttctgtca

SEQ ID NO: 18491 - DNA, 27 bp, synthetic construct
  misc_feature 1..27: note = Synthetic Construct
  source 1..27: mol_type = other DNA
ctgatcttgtactgctagcccttatag

SEQ ID NO: 18492 - DNA, 23 bp, synthetic construct
  misc_feature 1..23: note = Synthetic Construct
  source 1..23: mol_type = other DNA
aatggcaatgacccaacatgaag

SEQ ID NO: 18493 - DNA, 22 bp, synthetic construct
  misc_feature 1..22: note = Synthetic Construct
  source 1..22: mol_type = other DNA
ggaggaaagcagggatgcatgt

SEQ ID NO: 18494 - DNA, 22 bp, synthetic construct
  misc_feature 1..22: note = Synthetic Construct
  source 1..22: mol_type = other DNA
ctgtgcctcaaggagacagtga

SEQ ID NO: 18495 - DNA, 22 bp, synthetic construct
  misc_feature 1..22: note = Synthetic Construct
  source 1..22: mol_type = other DNA
ctgctgtcaacaggcagtgaaa

SEQ ID NO: 18496 - DNA, 21 bp, synthetic construct
  misc_feature 1..21: note = Synthetic Construct
  source 1..21: mol_type = other DNA
acttcgggagccacagtccaa

SEQ ID NO: 18497 - DNA, 27 bp, synthetic construct
  misc_feature 1..27: note = Synthetic Construct
  source 1..27: mol_type = other DNA
ccaccttgttttagattttggctctga

SEQ ID NO: 18498 - DNA, 26 bp, synthetic construct
  misc_feature 1..26: note = Synthetic Construct
  source 1..26: mol_type = other DNA
cagacaggcacctttcaaactcttct

SEQ ID NO: 18499 - DNA, 23 bp, synthetic construct
  misc_feature 1..23: note = Synthetic Construct
  source 1..23: mol_type = other DNA
tgctgatacactgactcggtact

SEQ ID NO: 18500 - DNA, 25 bp, synthetic construct
  misc_feature 1..25: note = Synthetic Construct
  source 1..25: mol_type = other DNA
gggagccagtcattaatcgaaatgt

SEQ ID NO: 18501 - DNA, 24 bp, synthetic construct
  misc_feature 1..24: note = Synthetic Construct
  source 1..24: mol_type = other DNA
gtgccttacctttgccagttctgt

SEQ ID NO: 18502 - DNA, 27 bp, synthetic construct
  misc_feature 1..27: note = Synthetic Construct
  source 1..27: mol_type = other DNA
ctgagactggattgggataaggagatg

SEQ ID NO: 18503 - DNA, 22 bp, synthetic construct
  misc_feature 1..22: note = Synthetic Construct
  source 1..22: mol_type = other DNA
ccccagcttcatctccttggaa

SEQ ID NO: 18504 - DNA, 25 bp, synthetic construct
  misc_feature 1..25: note = Synthetic Construct
  source 1..25: mol_type = other DNA
gcatgataggaagtgtgcgtgatag

SEQ ID NO: 18505 - DNA, 22 bp, synthetic construct
  misc_feature 1..22: note = Synthetic Construct
  source 1..22: mol_type = other DNA
cacctcctggttagaggcattc

SEQ ID NO: 18506 - DNA, 23 bp, synthetic construct
  misc_feature 1..23: note = Synthetic Construct
  source 1..23: mol_type = other DNA
acactgaggacaggaactactga

SEQ ID NO: 18507 - DNA, 28 bp, synthetic construct
  misc_feature 1..28: note = Synthetic Construct
  source 1..28: mol_type = other DNA
gtgagtgtggttagtacctcctaatctt

SEQ ID NO: 18508 - DNA, 22 bp, synthetic construct
  misc_feature 1..22: note = Synthetic Construct
  source 1..22: mol_type = other DNA
gtctggccattccagggagatt

SEQ ID NO: 18509 - DNA, 22 bp, synthetic construct
  misc_feature 1..22: note = Synthetic Construct
  source 1..22: mol_type = other DNA
cagccttgttgctggagggaat

SEQ ID NO: 18510 - DNA, 30 bp, synthetic construct
  misc_feature 1..30: note = Synthetic Construct
  source 1..30: mol_type = other DNA
cgaaattaacagagttctctctggttccaa

SEQ ID NO: 18511 - DNA, 22 bp, synthetic construct
  misc_feature 1..22: note = Synthetic Construct
  source 1..22: mol_type = other DNA
ctggagcaggaaggcttgttac

SEQ ID NO: 18512 - DNA, 28 bp, synthetic construct
  misc_feature 1..28: note = Synthetic Construct
  source 1..28: mol_type = other DNA
gtgttcctggacatgtgtttgataccta

SEQ ID NO: 18513 - DNA, 20 bp, synthetic construct
  misc_feature 1..20: note = Synthetic Construct
  source 1..20: mol_type = other DNA
atggcccagcctctgagtga

SEQ ID NO: 18514 - DNA, 22 bp, synthetic construct
  misc_feature 1..22: note = Synthetic Construct
  source 1..22: mol_type = other DNA
gcaccacgagcttggactttca

SEQ ID NO: 18515 - DNA, 21 bp, synthetic construct
  misc_feature 1..21: note = Synthetic Construct
  source 1..21: mol_type = other DNA
gcgatgcttctggatctgcaa

SEQ ID NO: 18516 - DNA, 26 bp, synthetic construct
  misc_feature 1..26: note = Synthetic Construct
  source 1..26: mol_type = other DNA
ccagcctctgaaggaattggtctatg

SEQ ID NO: 18517 - DNA, 21 bp, synthetic construct
  misc_feature 1..21: note = Synthetic Construct
  source 1..21: mol_type = other DNA
tcccctgatggagagttgcat

SEQ ID NO: 18518 - DNA, 24 bp, synthetic construct
  misc_feature 1..24: note = Synthetic Construct
  source 1..24: mol_type = other DNA
gcagtggaagataggcaagaggaa

SEQ ID NO: 18519 - DNA, 23 bp, synthetic construct
  misc_feature 1..23: note = Synthetic Construct
  source 1..23: mol_type = other DNA
ccaacaggattgtcggtgaattg

SEQ ID NO: 18520 - DNA, 26 bp, synthetic construct
  misc_feature 1..26: note = Synthetic Construct
  source 1..26: mol_type = other DNA
ccaccctgaattttctaggtgtgaac

SEQ ID NO: 18521 - DNA, 23 bp, synthetic construct
  misc_feature 1..23: note = Synthetic Construct
  source 1..23: mol_type = other DNA
gctcactacgaacctgagaccta

SEQ ID NO: 18522 - DNA, 27 bp, synthetic construct
  misc_feature 1..27: note = Synthetic Construct
  source 1..27: mol_type = other DNA
gaccaggaacacatcttgagagttaag

SEQ ID NO: 18523 - DNA, 25 bp, synthetic construct
  misc_feature 1..25: note = Synthetic Construct
  source 1..25: mol_type = other DNA
cctgcaactagcaaattcggctttt

SEQ ID NO: 18524 - DNA, 24 bp, synthetic construct
  misc_feature 1..24: note = Synthetic Construct
  source 1..24: mol_type = other DNA
tgagattcaccactcttcctgaac

SEQ ID NO: 18525 - DNA, 25 bp, synthetic construct
  misc_feature 1..25: note = Synthetic Construct
  source 1..25: mol_type = other DNA
ggtgcaacagactgagagcaatcta

SEQ ID NO: 18526 - DNA, 27 bp, synthetic construct
  misc_feature 1..27: note = Synthetic Construct
  source 1..27: mol_type = other DNA
gaagcagtgggtgagatataggatgat

SEQ ID NO: 18527 - DNA, 22 bp, synthetic construct
  misc_feature 1..22: note = Synthetic Construct
  source 1..22: mol_type = other DNA
agtgaggctcagtgccatcttg

SEQ ID NO: 18528 - DNA, 23 bp, synthetic construct
  misc_feature 1..23: note = Synthetic Construct
  source 1..23: mol_type = other DNA
ggcctttccaacccgattgagta

SEQ ID NO: 18529 - DNA, 23 bp, synthetic construct
  misc_feature 1..23: note = Synthetic Construct
  source 1..23: mol_type = other DNA
ggtcccatgtagggaagtctctt

SEQ ID NO: 18530 - DNA, 19 bp, synthetic construct
  misc_feature 1..19: note = Synthetic Construct
  source 1..19: mol_type = other DNA
acgcagacagggaccagat

SEQ ID NO: 18531 - DNA, 25 bp, synthetic construct
  misc_feature 1..25: note = Synthetic Construct
  source 1..25: mol_type = other DNA
caagtttcaaggaacaggcactaag

SEQ ID NO: 18532 - DNA, 23 bp, synthetic construct
  misc_feature 1..23: note = Synthetic Construct
  source 1..23: mol_type = other DNA
caatgctgggatctttcctccaa

SEQ ID NO: 18533 - DNA, 23 bp, synthetic construct
  misc_feature 1..23: note = Synthetic Construct
  source 1..23: mol_type = other DNA
ccgttcggtcaaaggacatgcaa

SEQ ID NO: 18534 - DNA, 26 bp, synthetic construct
  misc_feature 1..26: note = Synthetic Construct
  source 1..26: mol_type = other DNA
gctactctgggtggttctaactgttg

SEQ ID NO: 18535 - DNA, 22 bp, synthetic construct
  misc_feature 1..22: note = Synthetic Construct
  source 1..22: mol_type = other DNA
ctgccaatagctaggggagcat

SEQ ID NO: 18536 - DNA, 25 bp, synthetic construct
  misc_feature 1..25: note = Synthetic Construct
  source 1..25: mol_type = other DNA
ccaggttagcatacagaaggccaat

SEQ ID NO: 18537 - DNA, 22 bp, synthetic construct
  misc_feature 1..22: note = Synthetic Construct
  source 1..22: mol_type = other DNA
ctccctagtgcttggtgctact

SEQ ID NO: 18538 - DNA, 23 bp, synthetic construct
  misc_feature 1..23: note = Synthetic Construct
  source 1..23: mol_type = other DNA
cggatttggagtagtgggcaatg

SEQ ID NO: 18539 - DNA, 22 bp, synthetic construct
  misc_feature 1..22: note = Synthetic Construct
  source 1..22: mol_type = other DNA
cccatcgggagaatcacacact

SEQ ID NO: 18540 - DNA, 24 bp, synthetic construct
  misc_feature 1..24: note = Synthetic Construct
  source 1..24: mol_type = other DNA
ggctctggaagagagtaggcaaat

SEQ ID NO: 18541 - DNA, 26 bp, synthetic construct
  misc_feature 1..26: note = Synthetic Construct
  source 1..26: mol_type = other DNA
ccgtatctcctccagtccattactgt

SEQ ID NO: 18542 - DNA, 25 bp, synthetic construct
  misc_feature 1..25: note = Synthetic Construct
  source 1..25: mol_type = other DNA
acacctttgctgatctctgctatac

SEQ ID NO: 18543 - DNA, 27 bp, synthetic construct
  misc_feature 1..27: note = Synthetic Construct
  source 1..27: mol_type = other DNA
ctgttcctgcagattacttgctactgt

SEQ ID NO: 18544 - DNA, 21 bp, synthetic construct
  misc_feature 1..21: note = Synthetic Construct
  source 1..21: mol_type = other DNA
cctgtggttcaagcctccaat

SEQ ID NO: 18545 - DNA, 26 bp, synthetic construct
  misc_feature 1..26: note = Synthetic Construct
  source 1..26: mol_type = other DNA
agatcaggttctaagggtcataccaa

SEQ ID NO: 18546 - DNA, 30 bp, synthetic construct
  misc_feature 1..30: note = Synthetic Construct
  source 1..30: mol_type = other DNA
ggagagaggctaactgacatatactggtaa

SEQ ID NO: 18547 - DNA, 24 bp, synthetic construct
  misc_feature 1..24: note = Synthetic Construct
  source 1..24: mol_type = other DNA
gcccagtgtctgatgtgtagaaag

SEQ ID NO: 18548 - DNA, 24 bp, synthetic construct
  misc_feature 1..24: note = Synthetic Construct
  source 1..24: mol_type = other DNA
gaacaagggatgtctcctcttcaa

SEQ ID NO: 18549 - DNA, 23 bp, synthetic construct
  misc_feature 1..23: note = Synthetic Construct
  source 1..23: mol_type = other DNA
gcaaggacacaagcgaagagact

SEQ ID NO: 18550 - DNA, 22 bp, synthetic construct
  misc_feature 1..22: note = Synthetic Construct
  source 1..22: mol_type = other DNA
gcaccatgggtttgcctctact

SEQ ID NO: 18551 - DNA, 23 bp, synthetic construct
  misc_feature 1..23: note = Synthetic Construct
  source 1..23: mol_type = other DNA
agcctcctatgattcccagaact

SEQ ID NO: 18552 - DNA, 26 bp, synthetic construct
  misc_feature 1..26: note = Synthetic Construct
  source 1..26: mol_type = other DNA
gcagaggttcagagggaaagatgttc

SEQ ID NO: 18553 - DNA, 24 bp, synthetic construct
  misc_feature 1..24: note = Synthetic Construct
  source 1..24: mol_type = other DNA
gtcatcatgtgacaacctgtgact

SEQ ID NO: 18554 - DNA, 21 bp, synthetic construct
  misc_feature 1..21: note = Synthetic Construct
  source 1..21: mol_type = other DNA
ggcacgagtaagtgtgtctga

SEQ ID NO: 18555 - DNA, 20 bp, synthetic construct
  misc_feature 1..20: note = Synthetic Construct
  source 1..20: mol_type = other DNA
ggcctgcatgggtcactatt

SEQ ID NO: 18556 - DNA, 25 bp, synthetic construct
  misc_feature 1..25: note = Synthetic Construct
  source 1..25: mol_type = other DNA
ccagtctgtccttgaaaacaacaca

SEQ ID NO: 18557 - DNA, 25 bp, synthetic construct
  misc_feature 1..25: note = Synthetic Construct
  source 1..25: mol_type = other DNA
gcatccgccttagataaacaaagaa

SEQ ID NO: 18558 - DNA, 26 bp, synthetic construct
  misc_feature 1..26: note = Synthetic Construct
  source 1..26: mol_type = other DNA
cacattgacttctttccatgccctat

SEQ ID NO: 18559 - DNA, 24 bp, synthetic construct
  misc_feature 1..24: note = Synthetic Construct
  source 1..24: mol_type = other DNA
ccctgaagtgagtcaggagctgta

SEQ ID NO: 18560 - DNA, 21 bp, synthetic construct
  misc_feature 1..21: note = Synthetic Construct
  source 1..21: mol_type = other DNA
tgccatcccattgaggagtga

SEQ ID NO: 18561 - DNA, 27 bp, synthetic construct
  misc_feature 1..27: note = Synthetic Construct
  source 1..27: mol_type = other DNA
ccatcttttctagagtgggaattgtct

SEQ ID NO: 18562 - DNA, 24 bp, synthetic construct
  misc_feature 1..24: note = Synthetic Construct
  source 1..24: mol_type = other DNA
cctggcctctgattccatccaaac

SEQ ID NO: 18563 - DNA, 24 bp, synthetic construct
  misc_feature 1..24: note = Synthetic Construct
  source 1..24: mol_type = other DNA
gggttttgctttgtggtggtgttg

SEQ ID NO: 18564 - DNA, 22 bp, synthetic construct
  misc_feature 1..22: note = Synthetic Construct
  source 1..22: mol_type = other DNA
aggcacccattcctgtcacttg

SEQ ID NO: 18565 - DNA, 23 bp, synthetic construct
  misc_feature 1..23: note = Synthetic Construct
  source 1..23: mol_type = other DNA
cgaatgggtatcgatgtccttga

SEQ ID NO: 18566 - DNA, 24 bp, synthetic construct
  misc_feature 1..24: note = Synthetic Construct
  source 1..24: mol_type = other DNA
tgactgcgttgagcttagaagtta

SEQ ID NO: 18567 - DNA, 20 bp, synthetic construct
  misc_feature 1..20: note = Synthetic Construct
  source 1..20: mol_type = other DNA
gtccaagtccagccttcaca

SEQ ID NO: 18568 - DNA, 24 bp, synthetic construct
  misc_feature 1..24: note = Synthetic Construct
  source 1..24: mol_type = other DNA
gctgggaaccttggcctgtatatc

SEQ ID NO: 18569 - DNA, 24 bp, synthetic construct
  misc_feature 1..24: note = Synthetic Construct
  source 1..24: mol_type = other DNA
gcttcctgtttccacgtaggtttc

SEQ ID NO: 18570 - DNA, 21 bp, synthetic construct
  misc_feature 1..21: note = Synthetic Construct
  source 1..21: mol_type = other DNA
ggctggaaaggatggtgctat

SEQ ID NO: 18571 - DNA, 27 bp, synthetic construct
  misc_feature 1..27: note = Synthetic Construct
  source 1..27: mol_type = other DNA
gagtggctaactggtcctaaattcaaa

SEQ ID NO: 18572 - DNA, 21 bp, synthetic construct
  misc_feature 1..21: note = Synthetic Construct
  source 1..21: mol_type = other DNA
gcctcaaactcctgggctcaa

SEQ ID NO: 18573 - DNA, 24 bp, synthetic construct
  misc_feature 1..24: note = Synthetic Construct
  source 1..24: mol_type = other DNA
ccctctggcagtgtgttagcagat

SEQ ID NO: 18574 - DNA, 24 bp, synthetic construct
  misc_feature 1..24: note = Synthetic Construct
  source 1..24: mol_type = other DNA
ggcttacactgccctctgagatac

SEQ ID NO: 18575 - DNA, 26 bp, synthetic construct
  misc_feature 1..26: note = Synthetic Construct
  source 1..26: mol_type = other DNA
ccagagttccctctttgggaatcaga

SEQ ID NO: 18576 - DNA, 24 bp, synthetic construct
  misc_feature 1..24: note = Synthetic Construct
  source 1..24: mol_type = other DNA
caggacttgtgtctgtggctaaac

SEQ ID NO: 18577 - DNA, 24 bp, synthetic construct
  misc_feature 1..24: note = Synthetic Construct
  source 1..24: mol_type = other DNA
gcttctcgtgactcattcatgttt

SEQ ID NO: 18578 - DNA, 24 bp, synthetic construct
  misc_feature 1..24: note = Synthetic Construct
  source 1..24: mol_type = other DNA
cccttgtctccaagtgagctattc

SEQ ID NO: 18579 - DNA, 26 bp, synthetic construct
  misc_feature 1..26: note = Synthetic Construct
  source 1..26: mol_type = other DNA
cgtggcctaaacttttccaaagacat

SEQ ID NO: 18580 - DNA, 21 bp, synthetic construct
  misc_feature 1..21: note = Synthetic Construct
  source 1..21: mol_type = other DNA
ggtgatggctgatgagtggtt

SEQ ID NO: 18581 - DNA, 21 bp, synthetic construct
  misc_feature 1..21: note = Synthetic Construct
  source 1..21: mol_type = other DNA
gtcacttgctcaccccaatga

SEQ ID NO: 18582 - DNA, 26 bp, synthetic construct
  misc_feature 1..26: note = Synthetic Construct
  source 1..26: mol_type = other DNA
cctgtgtgggacagtaaatgtaggta

SEQ ID NO: 18583 - DNA, 24 bp, synthetic construct
  misc_feature 1..24: note = Synthetic Construct
  source 1..24: mol_type = other DNA
ccttcaggtactgagggtgtctct

SEQ ID NO: 18584 - DNA, 26 bp, synthetic construct
  misc_feature 1..26: note = Synthetic Construct
  source 1..26: mol_type = other DNA
gtgaagggactactgaaaactgaaga

SEQ ID NO: 18585 - DNA, 27 bp, synthetic construct
  misc_feature 1..27: note = Synthetic Construct
  source 1..27: mol_type = other DNA
ggctccatctaagattttcaggagtca

SEQ ID NO: 18586 - DNA, 25 bp, synthetic construct
  misc_feature 1..25: note = Synthetic Construct
  source 1..25: mol_type = other DNA
gtgttccccaaaacaattcccagtt

SEQ ID NO: 18587 - DNA, 25 bp, synthetic construct
  misc_feature 1..25: note = Synthetic Construct
  source 1..25: mol_type = other DNA
gcaagtctcctagttacgcaagtca

SEQ ID NO: 18588 - DNA, 30 bp, synthetic construct
  misc_feature 1..30: note = Synthetic Construct
  source 1..30: mol_type = other DNA
ggtgaaatctcagctcagttctttcagatt

SEQ ID NO: 18589 - DNA, 23 bp, synthetic construct
  misc_feature 1..23: note = Synthetic Construct
  source 1..23: mol_type = other DNA
agacgtaagagctatgtggcaaa

SEQ ID NO: 18590 - DNA, 25 bp, synthetic construct
  misc_feature 1..25: note = Synthetic Construct
  source 1..25: mol_type = other DNA
gctttctgtgattgccaataccatt

SEQ ID NO: 18591 - DNA, 26 bp, synthetic construct
  misc_feature 1..26: note = Synthetic Construct
  source 1..26: mol_type = other DNA
gcacacaatatgccatttcctctgaa

SEQ ID NO: 18592 - DNA, 23 bp, synthetic construct
  misc_feature 1..23: note = Synthetic Construct
  source 1..23: mol_type = other DNA
tgggaaatggtgttgcctcatag

SEQ ID NO: 18593 - DNA, 22 bp, synthetic construct
  misc_feature 1..22: note = Synthetic Construct
  source 1..22: mol_type = other DNA
ctgacatgccaagtgcccagaa

SEQ ID NO: 18594 - DNA, 24 bp, synthetic construct
  misc_feature 1..24: note = Synthetic Construct
  source 1..24: mol_type = other DNA
ggcaaagacctgaagaatgacgat

SEQ ID NO: 18595 - DNA, 22 bp, synthetic construct
  misc_feature 1..22: note = Synthetic Construct
  source 1..22: mol_type = other DNA
cgcagctacaacataagccaaa

SEQ ID NO: 18596 - DNA, 22 bp, synthetic construct
  misc_feature 1..22: note = Synthetic Construct
  source 1..22: mol_type = other DNA
cgcacatgcatcctctggtact

SEQ ID NO: 18597 - DNA, 24 bp, synthetic construct
  misc_feature 1..24: note = Synthetic Construct
  source 1..24: mol_type = other DNA
ggaaactgtgcatcctagttctga

SEQ ID NO: 18598 - DNA, 20 bp, synthetic construct
  misc_feature 1..20: note = Synthetic Construct
  source 1..20: mol_type = other DNA
agctgaagctgcaggaggat

SEQ ID NO: 18599 - DNA, 26 bp, synthetic construct
  misc_feature 1..26: note = Synthetic Construct
  source 1..26: mol_type = other DNA
tgcctccagatctagtaatactgctt

SEQ ID NO: 18600 - DNA, 24 bp, synthetic construct
  misc_feature 1..24: note = Synthetic Construct
  source 1..24: mol_type = other DNA
ccacaacctttagactgaggtctt

SEQ ID NO: 18601 - DNA, 20 bp, synthetic construct
  misc_feature 1..20: note = Synthetic Construct
  source 1..20: mol_type = other DNA
gcaaagcactggccacattg

SEQ ID NO: 18602 - DNA, 27 bp, synthetic construct
  misc_feature 1..27: note = Synthetic Construct
  source 1..27: mol_type = other DNA
cacactggttaaaagtggcatgtatga

SEQ ID NO: 18603 - DNA, 22 bp, synthetic construct
  misc_feature 1..22: note = Synthetic Construct
  source 1..22: mol_type = other DNA
ggaaagcagctggcactgatga

SEQ ID NO: 18604 - DNA, 29 bp, synthetic construct
  misc_feature 1..29: note = Synthetic Construct
  source 1..29: mol_type = other DNA
ctcccttctataataccactcacagatag

SEQ ID NO: 18605 - DNA, 21 bp, synthetic construct
  misc_feature 1..21: note = Synthetic Construct
  source 1..21: mol_type = other DNA
gccgtgtttacgctcttcttg

SEQ ID NO: 18606 - DNA, 23 bp, synthetic construct
  misc_feature 1..23: note = Synthetic Construct
  source 1..23: mol_type = other DNA
gccatttacacccgttccacagt

SEQ ID NO: 18607 - DNA, 24 bp, synthetic construct
  misc_feature 1..24: note = Synthetic Construct
  source 1..24: mol_type = other DNA
ccgagaggcacagaccaatgaaga

SEQ ID NO: 18608 - DNA, 24 bp, synthetic construct
  misc_feature 1..24: note = Synthetic Construct
  source 1..24: mol_type = other DNA
ggatagtgagttcctcgtggatga

SEQ ID NO: 18609 - DNA, 24 bp, synthetic construct
  misc_feature 1..24: note = Synthetic Construct
  source 1..24: mol_type = other DNA
cctccccattctgaggcactctta

SEQ ID NO: 18610 - DNA, 22 bp, synthetic construct
  misc_feature 1..22: note = Synthetic Construct
  source 1..22: mol_type = other DNA
gcccaggagttgacctttcaat

SEQ ID NO: 18611 - DNA, 27 bp, synthetic construct
  misc_feature 1..27: note = Synthetic Construct
  source 1..27: mol_type = other DNA
aggagtatagtaagttctcggtagcat

SEQ ID NO: 18612 - DNA, 25 bp, synthetic construct
  misc_feature 1..25: note = Synthetic Construct
  source 1..25: mol_type = other DNA
tgagcttgttctggtccttatcttt

SEQ ID NO: 18613 - DNA, 21 bp, synthetic construct
  misc_feature 1..21: note = Synthetic Construct
  source 1..21: mol_type = other DNA
cgggtagtaagcacacagcaa

SEQ ID NO: 18614 - DNA, 28 bp, synthetic construct
  misc_feature 1..28: note = Synthetic Construct
  source 1..28: mol_type = other DNA
ggagagtaaagccaccatctaagggtta

SEQ ID NO: 18615 - DNA, 25 bp, synthetic construct
  misc_feature 1..25: note = Synthetic Construct
  source 1..25: mol_type = other DNA
aggggcacttccaaaaacataatct

SEQ ID NO: 18616 - DNA, 26 bp, synthetic construct
  misc_feature 1..26: note = Synthetic Construct
  source 1..26: mol_type = other DNA
ctgggaaacagtcattaccaacatac

SEQ ID NO: 18617 - DNA, 28 bp, synthetic construct
  misc_feature 1..28: note = Synthetic Construct
  source 1..28: mol_type = other DNA
gcagtgacaagaaattaggccaagtcta

SEQ ID NO: 18618 - DNA, 24 bp, synthetic construct
  misc_feature 1..24: note = Synthetic Construct
  source 1..24: mol_type = other DNA
gcacacagtgagttcatggcaaag

SEQ ID NO: 18619 - DNA, 24 bp, synthetic construct
  misc_feature 1..24: note = Synthetic Construct
  source 1..24: mol_type = other DNA
ttcctcctgaaacggaaagaatga

SEQ ID NO: 18620 - DNA, 24 bp, synthetic construct
  misc_feature 1..24: note = Synthetic Construct
  source 1..24: mol_type = other DNA
tggaaccctaatcctgttcagcta

SEQ ID NO: 18621 - DNA, 28 bp, synthetic construct
  misc_feature 1..28: note = Synthetic Construct
  source 1..28: mol_type = other DNA
ctgtcttagctgtcagaataccaactgt

SEQ ID NO: 18622 - DNA, 20 bp, synthetic construct
  misc_feature 1..20: note = Synthetic Construct
  source 1..20: mol_type = other DNA
cagtgccacagcacttctca

SEQ ID NO: 18623 - DNA, 23 bp, synthetic construct
  misc_feature 1..23: note = Synthetic Construct
  source 1..23: mol_type = other DNA
gctactctcacggccctcttcta

SEQ ID NO: 18624 - DNA, 24 bp, synthetic construct
  misc_feature 1..24: note = Synthetic Construct
  source 1..24: mol_type = other DNA
cctctcaacgaaggcataatgcta

SEQ ID NO: 18625 - DNA, 27 bp, synthetic construct
  misc_feature 1..27: note = Synthetic Construct
  source 1..27: mol_type = other DNA
gtcaccatttctggatagtctgaggaa

SEQ ID NO: 18626 - DNA, 23 bp, synthetic construct
  misc_feature 1..23: note = Synthetic Construct
  source 1..23: mol_type = other DNA
tgacccagaagagtttggagttg

SEQ ID NO: 18627 - DNA, 24 bp, synthetic construct
  misc_feature 1..24: note = Synthetic Construct
  source 1..24: mol_type = other DNA
agtgaattgaagagggcaggaaat

SEQ ID NO: 18628 - DNA, 23 bp, synthetic construct
  misc_feature 1..23: note = Synthetic Construct
  source 1..23: mol_type = other DNA
gtggcagtggcaaaagaacacaa

SEQ ID NO: 18629 - DNA, 20 bp, synthetic construct
  misc_feature 1..20: note = Synthetic Construct
  source 1..20: mol_type = other DNA
ggtctgtgctcgcttggtta

SEQ ID NO: 18630 - DNA, 27 bp, synthetic construct
  misc_feature 1..27: note = Synthetic Construct
  source 1..27: mol_type = other DNA
gagtagtccaggttatcctcagagtca

SEQ ID NO: 18631 - DNA, 21 bp, synthetic construct
  misc_feature 1..21: note = Synthetic Construct
  source 1..21: mol_type = other DNA
gcttcacttggcagctgtttc

SEQ ID NO: 18632 - DNA, 25 bp, synthetic construct
  misc_feature 1..25: note = Synthetic Construct
  source 1..25: mol_type = other DNA
gctggggagatgtctttggattttg

SEQ ID NO: 18633 - DNA, 27 bp, synthetic construct
  misc_feature 1..27: note = Synthetic Construct
  source 1..27: mol_type = other DNA
gcatggcagaagctagaaagaaaggat

SEQ ID NO: 18634 - DNA, 26 bp, synthetic construct
  misc_feature 1..26: note = Synthetic Construct
  source 1..26: mol_type = other DNA
cctaagtggttggttcagaattcact

SEQ ID NO: 18635 - DNA, 21 bp, synthetic construct
  misc_feature 1..21: note = Synthetic Construct
  source 1..21: mol_type = other DNA
tcagcatgtagccttgccaaa

SEQ ID NO: 18636 - DNA, 25 bp, synthetic construct
  misc_feature 1..25: note = Synthetic Construct
  source 1..25: mol_type = other DNA
gcccattatttccccactactctct

SEQ ID NO: 18637 - DNA, 25 bp, synthetic construct
  misc_feature 1..25: note = Synthetic Construct
  source 1..25: mol_type = other DNA
ccagctagaccggaaagtacaggat

SEQ ID NO: 18638 - DNA, 22 bp, synthetic construct
  misc_feature 1..22: note = Synthetic Construct
  source 1..22: mol_type = other DNA
tgctgctcaagtgtttccttct

SEQ ID NO: 18639 - DNA, 27 bp, synthetic construct
  misc_feature 1..27: note = Synthetic Construct
  source 1..27: mol_type = other DNA
cctttctagagtggtgccattatctca

SEQ ID NO: 18640 - DNA, 22 bp, synthetic construct
  misc_feature 1..22: note = Synthetic Construct
  source 1..22: mol_type = other DNA
ggaggcctttctgaaccatctt

SEQ ID NO: 18641 - DNA, 22 bp, synthetic construct
  misc_feature 1..22: note = Synthetic Construct
  source 1..22: mol_type = other DNA
ctgttgtaggcctgaggcattg

SEQ ID NO: 18642 - DNA, 22 bp, synthetic construct
  misc_feature 1..22: note = Synthetic Construct
  source 1..22: mol_type = other DNA
gggctacactggatgacagctt

SEQ ID NO: 18643 - DNA, 25 bp, synthetic construct
  misc_feature 1..25: note = Synthetic Construct
  source 1..25: mol_type = other DNA
gctttggaatttggggtgacctttc

SEQ ID NO: 18644 - DNA, 28 bp, synthetic construct
  misc_feature 1..28: note = Synthetic Construct
  source 1..28: mol_type = other DNA
gcccttgttcatggataaagagcatttg

SEQ ID NO: 18645 - DNA, 25 bp, synthetic construct
  misc_feature 1..25: note = Synthetic Construct
  source 1..25: mol_type = other DNA
ccagatgcccatgatagtccttttc

SEQ ID NO: 18646 - DNA, 25 bp, synthetic construct
  misc_feature 1..25: note = Synthetic Construct
  source 1..25: mol_type = other DNA
gaggctgatggaaatggtaaagcaa

SEQ ID NO: 18647 - DNA, 22 bp, synthetic construct
  misc_feature 1..22: note = Synthetic Construct
  source 1..22: mol_type = other DNA
ccctcggttacagcaacagttc

SEQ ID NO: 18648 - DNA, 23 bp, synthetic construct
  misc_feature 1..23: note = Synthetic Construct
  source 1..23: mol_type = other DNA
ggggatcaacgagagcctagagt

SEQ ID NO: 18649 - DNA, 27 bp, synthetic construct
  misc_feature 1..27: note = Synthetic Construct
  source 1..27: mol_type = other DNA
cccagagatagttcctactgaccactt

SEQ ID NO: 18650 - DNA, 22 bp, synthetic construct
  misc_feature 1..22: note = Synthetic Construct
  source 1..22: mol_type = other DNA
cgccaacagggtttggagtagt

SEQ ID NO: 18651 - DNA, 28 bp, synthetic construct
  misc_feature 1..28: note = Synthetic Construct
  source 1..28: mol_type = other DNA
cctgaccatctttgcaaatcaggcttta

SEQ ID NO: 18652 - DNA, 23 bp, synthetic construct
  misc_feature 1..23: note = Synthetic Construct
  source 1..23: mol_type = other DNA
gggtaccagtccttccacttttg

SEQ ID NO: 18653 - DNA, 22 bp, synthetic construct
  misc_feature 1..22: note = Synthetic Construct
  source 1..22: mol_type = other DNA
gcttggggcaagagttgtttac

SEQ ID NO: 18654 - DNA, 21 bp, synthetic construct
  misc_feature 1..21: note = Synthetic Construct
  source 1..21: mol_type = other DNA
cagggtgactgacatgggttt

SEQ ID NO: 18655 - DNA, 22 bp, synthetic construct
  misc_feature 1..22: note = Synthetic Construct
  source 1..22: mol_type = other DNA
aggagttgcctctgggtcagtt

SEQ ID NO: 18656 - DNA, 29 bp, synthetic construct
  misc_feature 1..29: note = Synthetic Construct
  source 1..29: mol_type = other DNA
gaagattgggcatggttacatccatatac

SEQ ID NO: 18657 - DNA, 20 bp, synthetic construct
  misc_feature 1..20: note = Synthetic Construct
  source 1..20: mol_type = other DNA
cctgcctcactgctccttct

SEQ ID NO: 18658 - DNA, 22 bp, synthetic construct
  misc_feature 1..22: note = Synthetic Construct
  source 1..22: mol_type = other DNA
gggaggaaccaagttcccattg

SEQ ID NO: 18659 - DNA, 27 bp, synthetic construct
  misc_feature 1..27: note = Synthetic Construct
  source 1..27: mol_type = other DNA
cagtatcacaagcctcactttggtttc

SEQ ID NO: 18660 - DNA, 25 bp, synthetic construct
  misc_feature 1..25: note = Synthetic Construct
  source 1..25: mol_type = other DNA
cagaagtggtattctgggcatgaac

SEQ ID NO: 18661 - DNA, 29 bp, synthetic construct
  misc_feature 1..29: note = Synthetic Construct
  source 1..29: mol_type = other DNA
gctgctacttcttcttttggctaactttc

SEQ ID NO: 18662 - DNA, 22 bp, synthetic construct
  misc_feature 1..22: note = Synthetic Construct
  source 1..22: mol_type = other DNA
ctcacacagccttctgggatca

SEQ ID NO: 18663 - DNA, 23 bp, synthetic construct
  misc_feature 1..23: note = Synthetic Construct
  source 1..23: mol_type = other DNA
ccatgtaaggtgggtggaaggaa

SEQ ID NO: 18664 - DNA, 22 bp, synthetic construct
  misc_feature 1..22: note = Synthetic Construct
  source 1..22: mol_type = other DNA
gggatctctcactccacacagt

SEQ ID NO: 18665 - DNA, 22 bp, synthetic construct
  misc_feature 1..22: note = Synthetic Construct
  source 1..22: mol_type = other DNA
ggccaggtttaggaaggcttta

SEQ ID NO: 18666 - DNA, 26 bp, synthetic construct
  misc_feature 1..26: note = Synthetic Construct
  source 1..26: mol_type = other DNA
ggaggctgtagttgctctcatatcta

SEQ ID NO: 18667 - DNA, 29 bp, synthetic construct
  misc_feature 1..29: note = Synthetic Construct
  source 1..29: mol_type = other DNA
cagcttggtaacccacataaatactcaac

SEQ ID NO: 18668 - DNA, 25 bp, synthetic construct
  misc_feature 1..25: note = Synthetic Construct
  source 1..25: mol_type = other DNA
ccataaccacacaggaagtctgatg

SEQ ID NO: 18669 - DNA, 22 bp, synthetic construct
  misc_feature 1..22: note = Synthetic Construct
  source 1..22: mol_type = other DNA
gaggagcctggaactgaccaaa

SEQ ID NO: 18670 - DNA, 27 bp, synthetic construct
  misc_feature 1..27: note = Synthetic Construct
  source 1..27: mol_type = other DNA
gggaggaatgtttactttgccttgaca

SEQ ID NO: 18671 - DNA, 25 bp, synthetic construct
  misc_feature 1..25: note = Synthetic Construct
  source 1..25: mol_type = other DNA
actcgctatccttttcatgttggat

SEQ ID NO: 18672 - DNA, 25 bp, synthetic construct
  misc_feature 1..25: note = Synthetic Construct
  source 1..25: mol_type = other DNA
gcaagaggaatggacagtagagaag

SEQ ID NO: 18673 - DNA, 21 bp, synthetic construct
  misc_feature 1..21: note = Synthetic Construct
  source 1..21: mol_type = other DNA
cttagcgtcacacagcagaca

SEQ ID NO: 18674 - DNA, 24 bp, synthetic construct
  misc_feature 1..24: note = Synthetic Construct
  source 1..24: mol_type = other DNA
gacctcaccatcatccatgtgttc

SEQ ID NO: 18675 - DNA, 21 bp, synthetic construct
  misc_feature 1..21: note = Synthetic Construct
  source 1..21: mol_type = other DNA
tgctcccctgagatggagact

SEQ ID NO: 18676 - DNA, 25 bp, synthetic construct
  misc_feature 1..25: note = Synthetic Construct
  source 1..25: mol_type = other DNA
agccatctaccactgttctttcaat

SEQ ID NO: 18677 - DNA, 22 bp, synthetic construct
  misc_feature 1..22: note = Synthetic Construct
  source 1..22: mol_type = other DNA
gggcaaattccccgacatcaga

SEQ ID NO: 18678 - DNA, 26 bp, synthetic construct
  misc_feature 1..26: note = Synthetic Construct
  source 1..26: mol_type = other DNA
ggtatccgaatggaggaccaagtaat

SEQ ID NO: 18679 - DNA, 23 bp, synthetic construct
  misc_feature 1..23: note = Synthetic Construct
  source 1..23: mol_type = other DNA
ggcccgcctcaaaaatctaccaa

SEQ ID NO: 18680 - DNA, 24 bp, synthetic construct
  misc_feature 1..24: note = Synthetic Construct
  source 1..24: mol_type = other DNA
tggccaatagaatgtgtgaggaat

SEQ ID NO: 18681 - DNA, 24 bp, synthetic construct
  misc_feature 1..24: note = Synthetic Construct
  source 1..24: mol_type = other DNA
gggcggaaaagatacaccccataa

SEQ ID NO: 18682 - DNA, 23 bp, synthetic construct
  misc_feature 1..23: note = Synthetic Construct
  source 1..23: mol_type = other DNA
cagcatcgcagtcctgttatttc

SEQ ID NO: 18683 - DNA, 25 bp, synthetic construct
  misc_feature 1..25: note = Synthetic Construct
  source 1..25: mol_type = other DNA
cacgcttagatttcagtgagcaaga

SEQ ID NO: 18684 - DNA, 27 bp, synthetic construct
  misc_feature 1..27: note = Synthetic Construct
  source 1..27: mol_type = other DNA
cactggtttctaggaccatgttaaaag

SEQ ID NO: 18685 - DNA, 24 bp, synthetic construct
  misc_feature 1..24: note = Synthetic Construct
  source 1..24: mol_type = other DNA
gtgaagatccacagctcggaatac

SEQ ID NO: 18686 - DNA, 27 bp, synthetic construct
  misc_feature 1..27: note = Synthetic Construct
  source 1..27: mol_type = other DNA
gctaggtggttactttaggttggatag

SEQ ID NO: 18687 - DNA, 23 bp, synthetic construct
  misc_feature 1..23: note = Synthetic Construct
  source 1..23: mol_type = other DNA
aggtaacgcactgacttttgagt

SEQ ID NO: 18688 - DNA, 20 bp, synthetic construct
  misc_feature 1..20: note = Synthetic Construct
  source 1..20: mol_type = other DNA
aactcgccagggctgttgat

SEQ ID NO: 18689 - DNA, 24 bp, synthetic construct
  misc_feature 1..24: note = Synthetic Construct
  source 1..24: mol_type = other DNA
cctcctcagatgaccagagaaatc

SEQ ID NO: 18690 - DNA, 26 bp, synthetic construct
  misc_feature 1..26: note = Synthetic Construct
  source 1..26: mol_type = other DNA
cctcagtcaggtttccagaaggtact

SEQ ID NO: 18691 - DNA, 20 bp, synthetic construct
  misc_feature 1..20: note = Synthetic Construct
  source 1..20: mol_type = other DNA
gcaaccggtgccaccataga

SEQ ID NO: 18692 - DNA, 24 bp, synthetic construct
  misc_feature 1..24: note = Synthetic Construct
  source 1..24: mol_type = other DNA
cccctaactcgattgccaacagaa

SEQ ID NO: 18693 - DNA, 24 bp, synthetic construct
  misc_feature 1..24: note = Synthetic Construct
  source 1..24: mol_type = other DNA
cctgggaggtaagcccattgtaag

SEQ ID NO: 18694 - DNA, 24 bp, synthetic construct
  misc_feature 1..24: note = Synthetic Construct
  source 1..24: mol_type = other DNA
ccagacctcagaaatgtcctgttc

SEQ ID NO: 18695 - DNA, 22 bp, synthetic construct
  misc_feature 1..22: note = Synthetic Construct
  source 1..22: mol_type = other DNA
ggagactggctttggcaacaca

SEQ ID NO: 18696 - DNA, 20 bp, synthetic construct
  misc_feature 1..20: note = Synthetic Construct
  source 1..20: mol_type = other DNA
tgccacacaacctggtgctt

SEQ ID NO: 18697 - DNA, 21 bp, synthetic construct
  misc_feature 1..21: note = Synthetic Construct
  source 1..21: mol_type = other DNA
ggatcttgcgtccaggccttt

SEQ ID NO: 18698 - DNA, 20 bp, synthetic construct
  misc_feature 1..20: note = Synthetic Construct
  source 1..20: mol_type = other DNA
tgggtttaggcggcatcctt

SEQ ID NO: 18699 - DNA, 21 bp, synthetic construct
  misc_feature 1..21: note = Synthetic Construct
  source 1..21: mol_type = other DNA
ggcctgcatcaaacagggaat

SEQ ID NO: 18700 - DNA, 22 bp, synthetic construct
  misc_feature 1..22: note = Synthetic Construct
  source 1..22: mol_type = other DNA
gctggatggtatgtagccaact

SEQ ID NO: 18701 - DNA, 25 bp, synthetic construct
  misc_feature 1..25: note = Synthetic Construct
  source 1..25: mol_type = other DNA
ccccaaagtctgtgcttttcctact

SEQ ID NO: 18702 - DNA, 21 bp, synthetic construct
  misc_feature 1..21: note = Synthetic Construct
  source 1..21: mol_type = other DNA
cctctggagcattgcagatca

SEQ ID NO: 18703 - DNA, 25 bp, synthetic construct
  misc_feature 1..25: note = Synthetic Construct
  source 1..25: mol_type = other DNA
ggattccagcaactttcagcaggta

SEQ ID NO: 18704 - DNA, 23 bp, synthetic construct
  misc_feature 1..23: note = Synthetic Construct
  source 1..23: mol_type = other DNA
cgcttgtcccaggatggacttag

SEQ ID NO: 18705 - DNA, 20 bp, synthetic construct
  misc_feature 1..20: note = Synthetic Construct
  source 1..20: mol_type = other DNA
agggcatgtccactgcattc

SEQ ID NO: 18706 - DNA, 24 bp, synthetic construct
  misc_feature 1..24: note = Synthetic Construct
  source 1..24: mol_type = other DNA
agtgggtctgttcctcagtaattc

SEQ ID NO: 18707 - DNA, 23 bp, synthetic construct
  misc_feature 1..23: note = Synthetic Construct
  source 1..23: mol_type = other DNA
gcaaatggcctggctagaaggaa

SEQ ID NO: 18708 - DNA, 27 bp, synthetic construct
  misc_feature 1..27: note = Synthetic Construct
  source 1..27: mol_type = other DNA
gctgtgtaccagaatcttctgttttgt

SEQ ID NO: 18709 - DNA, 23 bp, synthetic construct
  misc_feature 1..23: note = Synthetic Construct
  source 1..23: mol_type = other DNA
gtcctgagagctgtccctttatg

SEQ ID NO: 18710 - DNA, 24 bp, synthetic construct
  misc_feature 1..24: note = Synthetic Construct
  source 1..24: mol_type = other DNA
ccagacttgccttcaagcatgtta

SEQ ID NO: 18711 - DNA, 23 bp, synthetic construct
  misc_feature 1..23: note = Synthetic Construct
  source 1..23: mol_type = other DNA
gtccatctcactgcggagaagtt

SEQ ID NO: 18712 - DNA, 24 bp, synthetic construct
  misc_feature 1..24: note = Synthetic Construct
  source 1..24: mol_type = other DNA
ggccgagtcaaacaaacgatgttg

SEQ ID NO: 18713 - DNA, 25 bp, synthetic construct
  misc_feature 1..25: note = Synthetic Construct
  source 1..25: mol_type = other DNA
gcagtttatccttgggacagacagt

SEQ ID NO: 18714 - DNA, 22 bp, synthetic construct
  misc_feature 1..22: note = Synthetic Construct
  source 1..22: mol_type = other DNA
ccaaaggccaggaagagggtat

SEQ ID NO: 18715 - DNA, 25 bp, synthetic construct
  misc_feature 1..25: note = Synthetic Construct
  source 1..25: mol_type = other DNA
ctgaggaagtccatgtttcccctta

SEQ ID NO: 18716 - DNA, 22 bp, synthetic construct
  misc_feature 1..22: note = Synthetic Construct
  source 1..22: mol_type = other DNA
tcgccccttgagtgagagaaga

SEQ ID NO: 18717 - DNA, 23 bp, synthetic construct
  misc_feature 1..23: note = Synthetic Construct
  source 1..23: mol_type = other DNA
gcacttccagttgcagatacctt

SEQ ID NO: 18718 - DNA, 23 bp, synthetic construct
  misc_feature 1..23: note = Synthetic Construct
  source 1..23: mol_type = other DNA
ccaccctgatttcggctttgtga

SEQ ID NO: 18719 - DNA, 26 bp, synthetic construct
  misc_feature 1..26: note = Synthetic Construct
  source 1..26: mol_type = other DNA
catccctgaattgtcagttgttccat

SEQ ID NO: 18720 - DNA, 23 bp, synthetic construct
  misc_feature 1..23: note = Synthetic Construct
  source 1..23: mol_type = other DNA
cggctccatcagttcctgagagt

SEQ ID NO: 18721 - DNA, 24 bp, synthetic construct
  misc_feature 1..24: note = Synthetic Construct
  source 1..24: mol_type = other DNA
gcctctggctcaagatgtctcaca

SEQ ID NO: 18722 - DNA, 19 bp, synthetic construct
  misc_feature 1..19: note = Synthetic Construct
  source 1..19: mol_type = other DNA
accgggagaacgcacttca

SEQ ID NO: 18723 - DNA, 22 bp, synthetic construct
  misc_feature 1..22: note = Synthetic Construct
  source 1..22: mol_type = other DNA
acctcctttccccagcatgaag

SEQ ID NO: 18724 - DNA, 26 bp, synthetic construct
  misc_feature 1..26: note = Synthetic Construct
  source 1..26: mol_type = other DNA
ccttccagaagccaaacacaatctca

SEQ ID NO: 18725 - DNA, 25 bp, synthetic construct
  misc_feature 1..25: note = Synthetic Construct
  source 1..25: mol_type = other DNA
gtctcgatgtaaagttgaggactct

SEQ ID NO: 18726 - DNA, 24 bp, synthetic construct
  misc_feature 1..24: note = Synthetic Construct
  source 1..24: mol_type = other DNA
gaggctagttagcaccaagtctga

SEQ ID NO: 18727 - DNA, 26 bp, synthetic construct
  misc_feature 1..26: note = Synthetic Construct
  source 1..26: mol_type = other DNA
aaggatgtacctgcagggttatctac

SEQ ID NO: 18728 - DNA, 23 bp, synthetic construct
  misc_feature 1..23: note = Synthetic Construct
  source 1..23: mol_type = other DNA
caccaagatgggtgatgatggtt

SEQ ID NO: 18729 - DNA, 24 bp, synthetic construct
  misc_feature 1..24: note = Synthetic Construct
  source 1..24: mol_type = other DNA
cgtctcagtgactttggcagtgat

SEQ ID NO: 18730 - DNA, 21 bp, synthetic construct
  misc_feature 1..21: note = Synthetic Construct
  source 1..21: mol_type = other DNA
gactgttgtggtgcagcttgt

SEQ ID NO: 18731 - DNA, 23 bp, synthetic construct
  misc_feature 1..23: note = Synthetic Construct
  source 1..23: mol_type = other DNA
gcttcaggaagcctttaggaact

SEQ ID NO: 18732 - DNA, 29 bp, synthetic construct
  misc_feature 1..29: note = Synthetic Construct
  source 1..29: mol_type = other DNA
gataatcaggtagataggatgacctgttc

SEQ ID NO: 18733 - DNA, 22 bp, synthetic construct
  misc_feature 1..22: note = Synthetic Construct
  source 1..22: mol_type = other DNA
gggcagctctgaactgtcattg

SEQ ID NO: 18734 - DNA, 26 bp, synthetic construct
  misc_feature 1..26: note = Synthetic Construct
  source 1..26: mol_type = other DNA
gccagagaaaccttaagctgaacata

SEQ ID NO: 18735 - DNA, 26 bp, synthetic construct
  misc_feature 1..26: note = Synthetic Construct
  source 1..26: mol_type = other DNA
gcaagcacttgtgtgaagtattccaa

SEQ ID NO: 18736 - DNA, 27 bp, synthetic construct
  misc_feature 1..27: note = Synthetic Construct
  source 1..27: mol_type = other DNA
cctttattcctgaaggatctgggttgt

SEQ ID NO: 18737 - DNA, 27 bp, synthetic construct
  misc_feature 1..27: note = Synthetic Construct
  source 1..27: mol_type = other DNA
gacaggtgtctaaaacttcttcctgta

SEQ ID NO: 18738 - DNA, 25 bp, synthetic construct
  misc_feature 1..25: note = Synthetic Construct
  source 1..25: mol_type = other DNA
gctggccctttaaatatcccagaga

SEQ ID NO: 18739 - DNA, 22 bp, synthetic construct
  misc_feature 1..22: note = Synthetic Construct
  source 1..22: mol_type = other DNA
tggccctcagagtcacagtgta

SEQ ID NO: 18740 - DNA, 22 bp, synthetic construct
  misc_feature 1..22: note = Synthetic Construct
  source 1..22: mol_type = other DNA
tgactgaaagcacctagcaaca

SEQ ID NO: 18741 - DNA, 23 bp, synthetic construct
  misc_feature 1..23: note = Synthetic Construct
  source 1..23: mol_type = other DNA
agcaactgtgcttttgagaggat

SEQ ID NO: 18742 - DNA, 25 bp, synthetic construct
  misc_feature 1..25: note = Synthetic Construct
  source 1..25: mol_type = other DNA
ccaaacctcagtaaatggggagatt

SEQ ID NO: 18743 - DNA, 24 bp, synthetic construct
  misc_feature 1..24: note = Synthetic Construct
  source 1..24: mol_type = other DNA
ggaagcccaaacctcaaggtaaga

SEQ ID NO: 18744 - DNA, 20 bp, synthetic construct
  misc_feature 1..20: note = Synthetic Construct
  source 1..20: mol_type = other DNA
gtgcttgcggcttgcaatga

SEQ ID NO: 18745 - DNA, 25 bp, synthetic construct
  misc_feature 1..25: note = Synthetic Construct
  source 1..25: mol_type = other DNA
cccgttttgaacagtgagtcaattc

SEQ ID NO: 18746 - DNA, 26 bp, synthetic construct
  misc_feature 1..26: note = Synthetic Construct
  source 1..26: mol_type = other DNA
ccaattctctggtgatactgcgaaca

SEQ ID NO: 18747 - DNA, 24 bp, synthetic construct
  misc_feature 1..24: note = Synthetic Construct
  source 1..24: mol_type = other DNA
tctgggcagagttaagaaggaaga

SEQ ID NO: 18748 - DNA, 22 bp, synthetic construct
  misc_feature 1..22: note = Synthetic Construct
  source 1..22: mol_type = other DNA
cagttcccatgtgtgctgtaga

SEQ ID NO: 18749 - DNA, 22 bp, synthetic construct
  misc_feature 1..22: note = Synthetic Construct
  source 1..22: mol_type = other DNA
ccaggtaccgattgggcagttt

SEQ ID NO: 18750 - DNA, 23 bp, synthetic construct
  misc_feature 1..23: note = Synthetic Construct
  source 1..23: mol_type = other DNA
ccttccaaggagactctggtact

SEQ ID NO: 18751 - DNA, 24 bp, synthetic construct
  misc_feature 1..24: note = Synthetic Construct
  source 1..24: mol_type = other DNA
cagagtcaggttagaagggctgaa

SEQ ID NO: 18752 - DNA, 24 bp, synthetic construct
  misc_feature 1..24: note = Synthetic Construct
  source 1..24: mol_type = other DNA
ggggttgggactatgaggaagtgt

SEQ ID NO: 18753 - DNA, 23 bp, synthetic construct
  misc_feature 1..23: note = Synthetic Construct
  source 1..23: mol_type = other DNA
tccaaacacacatgcctttctct

SEQ ID NO: 18754 - DNA, 24 bp, synthetic construct
  misc_feature 1..24: note = Synthetic Construct
  source 1..24: mol_type = other DNA
ccacctggccctgtagacatttga

SEQ ID NO: 18755 - DNA, 22 bp, synthetic construct
  misc_feature 1..22: note = Synthetic Construct
  source 1..22: mol_type = other DNA
ggctgccaactgtactggaact

SEQ ID NO: 18756 - DNA, 23 bp, synthetic construct
  misc_feature 1..23: note = Synthetic Construct
  source 1..23: mol_type = other DNA
ctgtgacaaagctggcacaaact

SEQ ID NO: 18757 - DNA, 25 bp, synthetic construct
  misc_feature 1..25: note = Synthetic Construct
  source 1..25: mol_type = other DNA
gacaccaccatgaattccagcctaa

SEQ ID NO: 18758 - DNA, 20 bp, synthetic construct
  misc_feature 1..20: note = Synthetic Construct
  source 1..20: mol_type = other DNA
tcccagtggctctcctttca

SEQ ID NO: 18759 - DNA, 27 bp, synthetic construct
  misc_feature 1..27: note = Synthetic Construct
  source 1..27: mol_type = other DNA
aggtggactaagtagaagtagggtatc

SEQ ID NO: 18760 - DNA, 20 bp, synthetic construct
  misc_feature 1..20: note = Synthetic Construct
  source 1..20: mol_type = other DNA
aggtgtcaggctccatgtct

SEQ ID NO: 18761 - DNA, 26 bp, synthetic construct
  misc_feature 1..26: note = Synthetic Construct
  source 1..26: mol_type = other DNA
cctcctaacttgacccagagagctaa

SEQ ID NO: 18762 - DNA, 29 bp, synthetic construct
  misc_feature 1..29: note = Synthetic Construct
  source 1..29: mol_type = other DNA
gcaatgaggtgaaaagcttctgttcatac

SEQ ID NO: 18763 - DNA, 23 bp, synthetic construct
  misc_feature 1..23: note = Synthetic Construct
  source 1..23: mol_type = other DNA
gcgtgtagcttttcagtcactct

SEQ ID NO: 18764 - DNA, 22 bp, synthetic construct
  misc_feature 1..22: note = Synthetic Construct
  source 1..22: mol_type = other DNA
gctggctgtaatgaaggaggat

SEQ ID NO: 18765 - DNA, 22 bp, synthetic construct
  misc_feature 1..22: note = Synthetic Construct
  source 1..22: mol_type = other DNA
ccgtgagtgccgtcatcttgta

SEQ ID NO: 18766 - DNA, 27 bp, synthetic construct
  misc_feature 1..27: note = Synthetic Construct
  source 1..27: mol_type = other DNA
cctgtctgtcaaaagtctcttgctttg

SEQ ID NO: 18767 - DNA, 24 bp, synthetic construct
  misc_feature 1..24: note = Synthetic Construct
  source 1..24: mol_type = other DNA
ggattttcggacgcatcattgaga

SEQ ID NO: 18768 - DNA, 24 bp, synthetic construct
  misc_feature 1..24: note = Synthetic Construct
  source 1..24: mol_type = other DNA
cccatttgtgcttccacatactct

SEQ ID NO: 18769 - DNA, 24 bp, synthetic construct
  misc_feature 1..24: note = Synthetic Construct
  source 1..24: mol_type = other DNA
cccttacctggagcatggtgaatc

SEQ ID NO: 18770 - DNA, 20 bp, synthetic construct
  misc_feature 1..20: note = Synthetic Construct
  source 1..20: mol_type = other DNA
tgggcctgtgtgcctgattc

SEQ ID NO: 18771 - DNA, 24 bp, synthetic construct
  misc_feature 1..24: note = Synthetic Construct
  source 1..24: mol_type = other DNA
ggctgatgcatatttgggagtaca

SEQ ID NO: 18772 - DNA, 20 bp, synthetic construct
  misc_feature 1..20: note = Synthetic Construct
  source 1..20: mol_type = other DNA
ggccagtcaccccaaagaca

SEQ ID NO: 18773 - DNA, 23 bp, synthetic construct
  misc_feature 1..23: note = Synthetic Construct
  source 1..23: mol_type = other DNA
gggaaaaggccattcaggcaagt

SEQ ID NO: 18774 - DNA, 23 bp, synthetic construct
  misc_feature 1..23: note = Synthetic Construct
  source 1..23: mol_type = other DNA
ccaggagaagaaggccagtgatg

SEQ ID NO: 18775 - DNA, 23 bp, synthetic construct
  misc_feature 1..23: note = Synthetic Construct
  source 1..23: mol_type = other DNA
gggccatgaacagtgaaaggatt

SEQ ID NO: 18776 - DNA, 26 bp, synthetic construct
  misc_feature 1..26: note = Synthetic Construct
  source 1..26: mol_type = other DNA
ccacactgtagtccagttgaaggaaa

SEQ ID NO: 18777 - DNA, 23 bp, synthetic construct
  misc_feature 1..23: note = Synthetic Construct
  source 1..23: mol_type = other DNA
gcaagtgtacctggttggaccat

SEQ ID NO: 18778 - DNA, 22 bp, synthetic construct
  misc_feature 1..22: note = Synthetic Construct
  source 1..22: mol_type = other DNA
ggtggaatccgtgagcacaaac

SEQ ID NO: 18779 - DNA, 27 bp, synthetic construct
  misc_feature 1..27: note = Synthetic Construct
  source 1..27: mol_type = other DNA
ctcacatagagaagaaacagagcaaga

SEQ ID NO: 18780 - DNA, 22 bp, synthetic construct
  misc_feature 1..22: note = Synthetic Construct
  source 1..22: mol_type = other DNA
ggctaaacctcctgctgcaatc

SEQ ID NO: 18781 - DNA, 24 bp, synthetic construct
  misc_feature 1..24: note = Synthetic Construct
  source 1..24: mol_type = other DNA
ctcctatgcaggtctcaactggta

SEQ ID NO: 18782 - DNA, 23 bp, synthetic construct
  misc_feature 1..23: note = Synthetic Construct
  source 1..23: mol_type = other DNA
gccatcctggtgtagctggtaag

SEQ ID NO: 18783 - DNA, 23 bp, synthetic construct
  misc_feature 1..23: note = Synthetic Construct
  source 1..23: mol_type = other DNA
gcactcatgccattcagcaggta

SEQ ID NO: 18784 - DNA, 21 bp, synthetic construct
  misc_feature 1..21: note = Synthetic Construct
  source 1..21: mol_type = other DNA
ccgtctgtggtgtcattgtga

SEQ ID NO: 18785 - DNA, 22 bp, synthetic construct
  misc_feature 1..22: note = Synthetic Construct
  source 1..22: mol_type = other DNA
cactggggcaaacagatcatca

SEQ ID NO: 18786 - DNA, 22 bp, synthetic construct
  misc_feature 1..22: note = Synthetic Construct
  source 1..22: mol_type = other DNA
gggatccttccttgccttcact

SEQ ID NO: 18787 - DNA, 26 bp, synthetic construct
  misc_feature 1..26: note = Synthetic Construct
  source 1..26: mol_type = other DNA
gcagagagatggagagagatggtctt

SEQ ID NO: 18788 - DNA, 23 bp, synthetic construct
  misc_feature 1..23: note = Synthetic Construct
  source 1..23: mol_type = other DNA
caccctccctatagagcttcaga

SEQ ID NO: 18789 - DNA, 25 bp, synthetic construct
  misc_feature 1..25: note = Synthetic Construct
  source 1..25: mol_type = other DNA
tgagggcaatgtcttagaaagcata

SEQ ID NO: 18790 - DNA, 23 bp, synthetic construct
  misc_feature 1..23: note = Synthetic Construct
  source 1..23: mol_type = other DNA
tctggaacacagcaagactcaag

SEQ ID NO: 18791 - DNA, 27 bp, synthetic construct
  misc_feature 1..27: note = Synthetic Construct
  source 1..27: mol_type = other DNA
gaaaggtgttgcatttactctcgtatg

SEQ ID NO: 18792 - DNA, 24 bp, synthetic construct
  misc_feature 1..24: note = Synthetic Construct
  source 1..24: mol_type = other DNA
gactagaggagggtaggaggaagt

SEQ ID NO: 18793 - DNA, 27 bp, synthetic construct
  misc_feature 1..27: note = Synthetic Construct
  source 1..27: mol_type = other DNA
gcgtcatccctagcacaattttagact

SEQ ID NO: 18794 - DNA, 27 bp, synthetic construct
  misc_feature 1..27: note = Synthetic Construct
  source 1..27: mol_type = other DNA
ggctgtgaggttttagatacacccttt

SEQ ID NO: 18795 - DNA, 24 bp, synthetic construct
  misc_feature 1..24: note = Synthetic Construct
  source 1..24: mol_type = other DNA
ggcagccagacatcttctctaaat

SEQ ID NO: 18796 - DNA, 24 bp, synthetic construct
  misc_feature 1..24: note = Synthetic Construct
  source 1..24: mol_type = other DNA
gcatcagctaaatgcatggtcctt

SEQ ID NO: 18797 - DNA, 26 bp, synthetic construct
  misc_feature 1..26: note = Synthetic Construct
  source 1..26: mol_type = other DNA
tctgacttaggttttcttggctgtag

SEQ ID NO: 18798 - DNA, 25 bp, synthetic construct
  misc_feature 1..25: note = Synthetic Construct
  source 1..25: mol_type = other DNA
gcctgcagttcaataaggctactgt

SEQ ID NO: 18799 - DNA, 23 bp, synthetic construct
  misc_feature 1..23: note = Synthetic Construct
  source 1..23: mol_type = other DNA
actgagcatgcttttgctctcaa

SEQ ID NO: 18800 - DNA, 26 bp, synthetic construct
  misc_feature 1..26: note = Synthetic Construct
  source 1..26: mol_type = other DNA
cggtcaaacatgaggatgagaaaact

SEQ ID NO: 18801 - DNA, 24 bp, synthetic construct
  misc_feature 1..24: note = Synthetic Construct
  source 1..24: mol_type = other DNA
caccgtataattagcgggaagtgt

SEQ ID NO: 18802 - DNA, 22 bp, synthetic construct
  misc_feature 1..22: note = Synthetic Construct
  source 1..22: mol_type = other DNA
tggaggtgagtgctgagacaga

SEQ ID NO: 18803 - DNA, 25 bp, synthetic construct
  misc_feature 1..25: note = Synthetic Construct
  source 1..25: mol_type = other DNA
ggggaggaaagatgatgagggaagt

SEQ ID NO: 18804 - DNA, 25 bp, synthetic construct
  misc_feature 1..25: note = Synthetic Construct
  source 1..25: mol_type = other DNA
gggtggcctagtttgaaagagtgat

SEQ ID NO: 18805 - DNA, 20 bp, synthetic construct
  misc_feature 1..20: note = Synthetic Construct
  source 1..20: mol_type = other DNA
gagcaagcaagcagcacact

SEQ ID NO: 18806 - DNA, 28 bp, synthetic construct
  misc_feature 1..28: note = Synthetic Construct
  source 1..28: mol_type = other DNA
cctgtagtgatttccaagacctcaccat

SEQ ID NO: 18807 - DNA, 26 bp, synthetic construct
  misc_feature 1..26: note = Synthetic Construct
  source 1..26: mol_type = other DNA
gcatgttattctctccaggtccagaa

SEQ ID NO: 18808 - DNA, 23 bp, synthetic construct
  misc_feature 1..23: note = Synthetic Construct
  source 1..23: mol_type = other DNA
gcagtgtctagcacacaatgtca

SEQ ID NO: 18809 - DNA, 25 bp, synthetic construct
  misc_feature 1..25: note = Synthetic Construct
  source 1..25: mol_type = other DNA
cttgcacagtgtagaatctgaggat

SEQ ID NO: 18810 - DNA, 27 bp, synthetic construct
  misc_feature 1..27: note = Synthetic Construct
  source 1..27: mol_type = other DNA
ccaaccctgattcattccagtaatgtt

SEQ ID NO: 18811 - DNA, 24 bp, synthetic construct
  misc_feature 1..24: note = Synthetic Construct
  source 1..24: mol_type = other DNA
cccttcctgtttctcaacctgtgt

SEQ ID NO: 18812 - DNA, 25 bp, synthetic construct
  misc_feature 1..25: note = Synthetic Construct
  source 1..25: mol_type = other DNA
ggcttatgaaccaaaccacttgtct

SEQ ID NO: 18813 - DNA, 28 bp, synthetic construct
  misc_feature 1..28: note = Synthetic Construct
  source 1..28: mol_type = other DNA
cactgttctgttactgacagggaaaaag

SEQ ID NO: 18814 - DNA, 19 bp, synthetic construct
  misc_feature 1..19: note = Synthetic Construct
  source 1..19: mol_type = other DNA
gggccagcttgtggagagt

SEQ ID NO: 18815 - DNA, 24 bp, synthetic construct
  misc_feature 1..24: note = Synthetic Construct
  source 1..24: mol_type = other DNA
gctgatgagtcaagtgctatctgt

SEQ ID NO: 18816 - DNA, 26 bp, synthetic construct
  misc_feature 1..26: note = Synthetic Construct
  source 1..26: mol_type = other DNA
ctcttgtctactgagccattgcagtt

SEQ ID NO: 18817 - DNA, 22 bp, synthetic construct
  misc_feature 1..22: note = Synthetic Construct
  source 1..22: mol_type = other DNA
aggaagcaccaggaacccatct

SEQ ID NO: 18818 - DNA, 23 bp, synthetic construct
  misc_feature 1..23: note = Synthetic Construct
  source 1..23: mol_type = other DNA
cactttgggctcctccttccttt

SEQ ID NO: 18819 - DNA, 25 bp, synthetic construct
  misc_feature 1..25: note = Synthetic Construct
  source 1..25: mol_type = other DNA
tggggatgactacttttgctattgt

SEQ ID NO: 18820 - DNA, 22 bp, synthetic construct
  misc_feature 1..22: note = Synthetic Construct
  source 1..22: mol_type = other DNA
gggaaggattccagtggtcgat

SEQ ID NO: 18821 - DNA, 25 bp, synthetic construct
  misc_feature 1..25: note = Synthetic Construct
  source 1..25: mol_type = other DNA
ctcttggaaaagtgagagcgttttg

SEQ ID NO: 18822 - DNA, 25 bp, synthetic construct
  misc_feature 1..25: note = Synthetic Construct
  source 1..25: mol_type = other DNA
ctggggtagtatgtttgcccttcta

SEQ ID NO: 18823 - DNA, 24 bp, synthetic construct
  misc_feature 1..24: note = Synthetic Construct
  source 1..24: mol_type = other DNA
ggtacccgaagaaggctattccaa

SEQ ID NO: 18824 - DNA, 23 bp, synthetic construct
  misc_feature 1..23: note = Synthetic Construct
  source 1..23: mol_type = other DNA
gggcagaagagtggaaacagcta

SEQ ID NO: 18825 - DNA, 21 bp, synthetic construct
  misc_feature 1..21: note = Synthetic Construct
  source 1..21: mol_type = other DNA
ggtggtgccttattgctgcat

SEQ ID NO: 18826 - DNA, 20 bp, synthetic construct
  misc_feature 1..20: note = Synthetic Construct
  source 1..20: mol_type = other DNA
tggagtggcaggagtcttca

SEQ ID NO: 18827 - DNA, 22 bp, synthetic construct
  misc_feature 1..22: note = Synthetic Construct
  source 1..22: mol_type = other DNA
tcctgctaggagggtgatctct

SEQ ID NO: 18828 - DNA, 20 bp, synthetic construct
  misc_feature 1..20: note = Synthetic Construct
  source 1..20: mol_type = other DNA
ggtggtactggccctgaaca

SEQ ID NO: 18829 - DNA, 22 bp, synthetic construct
  misc_feature 1..22: note = Synthetic Construct
  source 1..22: mol_type = other DNA
gattccagctaccccagctttc

SEQ ID NO: 18830 - DNA, 24 bp, synthetic construct
  misc_feature 1..24: note = Synthetic Construct
  source 1..24: mol_type = other DNA
gatgaagatggcactggatgtttc

SEQ ID NO: 18831 - DNA, 21 bp, synthetic construct
  misc_feature 1..21: note = Synthetic Construct
  source 1..21: mol_type = other DNA
gtccagcatagccagtcactt

SEQ ID NO: 18832 - DNA, 25 bp, synthetic construct
  misc_feature 1..25: note = Synthetic Construct
  source 1..25: mol_type = other DNA
cagcaaagctgcaatttgtctatct

SEQ ID NO: 18833 - DNA, 29 bp, synthetic construct
  misc_feature 1..29: note = Synthetic Construct
  source 1..29: mol_type = other DNA
ccttgtattcattccatacctgctctttg

SEQ ID NO: 18834 - DNA, 23 bp, synthetic construct
  misc_feature 1..23: note = Synthetic Construct
  source 1..23: mol_type = other DNA
cccagacccaccttacaggttct

SEQ ID NO: 18835 - DNA, 25 bp, synthetic construct
  misc_feature 1..25: note = Synthetic Construct
  source 1..25: mol_type = other DNA
tcttgaatcagacaaagagcaccat

SEQ ID NO: 18836 - DNA, 22 bp, synthetic construct
  misc_feature 1..22: note = Synthetic Construct
  source 1..22: mol_type = other DNA
catggactcaagactccacaca

SEQ ID NO: 18837 - DNA, 21 bp, synthetic construct
  misc_feature 1..21: note = Synthetic Construct
  source 1..21: mol_type = other DNA
ggtcagagcaggcattgttgt

SEQ ID NO: 18838 - DNA, 23 bp, synthetic construct
  misc_feature 1..23: note = Synthetic Construct
  source 1..23: mol_type = other DNA
tgggtttgaggcacagttagatg

SEQ ID NO: 18839 - DNA, 21 bp, synthetic construct
  misc_feature 1..21: note = Synthetic Construct
  source 1..21: mol_type = other DNA
tgtggaccagagcctcatgta

SEQ ID NO: 18840 - DNA, 22 bp, synthetic construct
  misc_feature 1..22: note = Synthetic Construct
  source 1..22: mol_type = other DNA
ggggtgccatttcagctaccat

SEQ ID NO: 18841 - DNA, 26 bp, synthetic construct
  misc_feature 1..26: note = Synthetic Construct
  source 1..26: mol_type = other DNA
tctcagctcttaggcagaaatcttac

SEQ ID NO: 18842 - DNA, 22 bp, synthetic construct
  misc_feature 1..22: note = Synthetic Construct
  source 1..22: mol_type = other DNA
tctgcccttacctccttcttct

SEQ ID NO: 18843 - DNA, 23 bp, synthetic construct
  misc_feature 1..23: note = Synthetic Construct
  source 1..23: mol_type = other DNA
accgagttagagccttgactttc

SEQ ID NO: 18844 - DNA, 26 bp, synthetic construct
  misc_feature 1..26: note = Synthetic Construct
  source 1..26: mol_type = other DNA
gtcccaggttaatgagtctagaggaa

SEQ ID NO: 18845 - DNA, 22 bp, synthetic construct
  misc_feature 1..22: note = Synthetic Construct
  source 1..22: mol_type = other DNA
cccctgatgatccacacccatt

SEQ ID NO: 18846 - DNA, 26 bp, synthetic construct
  misc_feature 1..26: note = Synthetic Construct
  source 1..26: mol_type = other DNA
ccattgaatgtagaacatgcctctct

SEQ ID NO: 18847 - DNA, 25 bp, synthetic construct
  misc_feature 1..25: note = Synthetic Construct
  source 1..25: mol_type = other DNA
gccagcacttctggatgttacattg

SEQ ID NO: 18848 - DNA, 22 bp, synthetic construct
  misc_feature 1..22: note = Synthetic Construct
  source 1..22: mol_type = other DNA
aggtttcaggccatccctctct

SEQ ID NO: 18849 - DNA, 26 bp, synthetic construct
  misc_feature 1..26: note = Synthetic Construct
  source 1..26: mol_type = other DNA
gagactttcgcaaggttttcagcaat

SEQ ID NO: 18850 - DNA, 27 bp, synthetic construct
  misc_feature 1..27: note = Synthetic Construct
  source 1..27: mol_type = other DNA
ggaagggctgtttacagaacaagtaca

SEQ ID NO: 18851 - DNA, 28 bp, synthetic construct
  misc_feature 1..28: note = Synthetic Construct
  source 1..28: mol_type = other DNA
ggtgccatagaattactccaagggtctt

SEQ ID NO: 18852 - DNA, 23 bp, synthetic construct
  misc_feature 1..23: note = Synthetic Construct
  source 1..23: mol_type = other DNA
gcaagagtccatgataggcatgt

SEQ ID NO: 18853 - DNA, 28 bp, synthetic construct
  misc_feature 1..28: note = Synthetic Construct
  source 1..28: mol_type = other DNA
gcctacactatttcatcccatggtaaac

SEQ ID NO: 18854 - DNA, 25 bp, synthetic construct
  misc_feature 1..25: note = Synthetic Construct
  source 1..25: mol_type = other DNA
actttgtgatgtgttcctacctctt

SEQ ID NO: 18855 - DNA, 27 bp, synthetic construct
  misc_feature 1..27: note = Synthetic Construct
  source 1..27: mol_type = other DNA
gacagaaacctgtttgaactcatggta

SEQ ID NO: 18856 - DNA, 24 bp, synthetic construct
  misc_feature 1..24: note = Synthetic Construct
  source 1..24: mol_type = other DNA
gctctagagtatgacggggacaca

SEQ ID NO: 18857 - DNA, 25 bp, synthetic construct
  misc_feature 1..25: note = Synthetic Construct
  source 1..25: mol_type = other DNA
gagtgctcaaaagctattcccagtt

SEQ ID NO: 18858 - DNA, 22 bp, synthetic construct
  misc_feature 1..22: note = Synthetic Construct
  source 1..22: mol_type = other DNA
ccttggcctgaatcctcctaca

SEQ ID NO: 18859 - DNA, 20 bp, synthetic construct
  misc_feature 1..20: note = Synthetic Construct
  source 1..20: mol_type = other DNA
gcagcagcctgtgctttcat

SEQ ID NO: 18860 - DNA, 24 bp, synthetic construct
  misc_feature 1..24: note = Synthetic Construct
  source 1..24: mol_type = other DNA
atgtgaggtcacacttcctttgat

SEQ ID NO: 18861 - DNA, 26 bp, synthetic construct
  misc_feature 1..26: note = Synthetic Construct
  source 1..26: mol_type = other DNA
gcctgctttaagactttttgcagttc

SEQ ID NO: 18862 - DNA, 23 bp, synthetic construct
  misc_feature 1..23: note = Synthetic Construct
  source 1..23: mol_type = other DNA
aggtgcaaaggtagaggaacaac

SEQ ID NO: 18863 - DNA, 22 bp, synthetic construct
  misc_feature 1..22: note = Synthetic Construct
  source 1..22: mol_type = other DNA
ccaggactctctcggttgagtt

SEQ ID NO: 18864 - DNA, 24 bp, synthetic construct
  misc_feature 1..24: note = Synthetic Construct
  source 1..24: mol_type = other DNA
cttgtcttctcaggttgcttgttt

SEQ ID NO: 18865 - DNA, 25 bp, synthetic construct
  misc_feature 1..25: note = Synthetic Construct
  source 1..25: mol_type = other DNA
gtgactgtagcattcccagttctct

SEQ ID NO: 18866 - DNA, 27 bp, synthetic construct
  misc_feature 1..27: note = Synthetic Construct
  source 1..27: mol_type = other DNA
ccctgatcaaatcatacctgaagtcaa

SEQ ID NO: 18867 - DNA, 23 bp, synthetic construct
  misc_feature 1..23: note = Synthetic Construct
  source 1..23: mol_type = other DNA
gggactttgggaacacacagcat

SEQ ID NO: 18868 - DNA, 25 bp, synthetic construct
  misc_feature 1..25: note = Synthetic Construct
  source 1..25: mol_type = other DNA
ccaacactaaaagcaaccgtttgaa

SEQ ID NO: 18869 - DNA, 26 bp, synthetic construct
  misc_feature 1..26: note = Synthetic Construct
  source 1..26: mol_type = other DNA
ggggctgtattgcaaaagatgctact

SEQ ID NO: 18870 - DNA, 28 bp, synthetic construct
  misc_feature 1..28: note = Synthetic Construct
  source 1..28: mol_type = other DNA
ggatgggaaagaaattggtctggaaaga

SEQ ID NO: 18871 - DNA, 24 bp, synthetic construct
  misc_feature 1..24: note = Synthetic Construct
  source 1..24: mol_type = other DNA
ctccaaaggaaccttcccagtaaa

SEQ ID NO: 18872 - DNA, 22 bp, synthetic construct
  misc_feature 1..22: note = Synthetic Construct
  source 1..22: mol_type = other DNA
ccttcagccttgtcacgcttct

SEQ ID NO: 18873 - DNA, 23 bp, synthetic construct
  misc_feature 1..23: note = Synthetic Construct
  source 1..23: mol_type = other DNA
acactatgtgcttttgccacaga

SEQ ID NO: 18874 - DNA, 20 bp, synthetic construct
  misc_feature 1..20: note = Synthetic Construct
  source 1..20: mol_type = other DNA
tggactgtgcaggtgtctga

SEQ ID NO: 18875 - DNA, 22 bp, synthetic construct
  misc_feature 1..22: note = Synthetic Construct
  source 1..22: mol_type = other DNA
agtccccattattgtgctcgtt

SEQ ID NO: 18876 - DNA, 24 bp, synthetic construct
  misc_feature 1..24: note = Synthetic Construct
  source 1..24: mol_type = other DNA
cagggtctccactctgtaactttt

SEQ ID NO: 18877 - DNA, 25 bp, synthetic construct
  misc_feature 1..25: note = Synthetic Construct
  source 1..25: mol_type = other DNA
gtgggctagaattttggctctgaca

SEQ ID NO: 18878 - DNA, 24 bp, synthetic construct
  misc_feature 1..24: note = Synthetic Construct
  source 1..24: mol_type = other DNA
acagtagtgtgaaaccagggaaat

SEQ ID NO: 18879 - DNA, 25 bp, synthetic construct
  misc_feature 1..25: note = Synthetic Construct
  source 1..25: mol_type = other DNA
cctccgattgctttttgtgttccta

SEQ ID NO: 18880 - DNA, 25 bp, synthetic construct
  misc_feature 1..25: note = Synthetic Construct
  source 1..25: mol_type = other DNA
ctggcttcagaactttctcctctat

SEQ ID NO: 18881 - DNA, 26 bp, synthetic construct
  misc_feature 1..26: note = Synthetic Construct
  source 1..26: mol_type = other DNA
caggcagggagcttattcagatctac

SEQ ID NO: 18882 - DNA, 26 bp, synthetic construct
  misc_feature 1..26: note = Synthetic Construct
  source 1..26: mol_type = other DNA
ccctcaataaactgggagacccattg

SEQ ID NO: 18883 - DNA, 24 bp, synthetic construct
  misc_feature 1..24: note = Synthetic Construct
  source 1..24: mol_type = other DNA
gaaggctgaggagctctgatttta

SEQ ID NO: 18884 - DNA, 24 bp, synthetic construct
  misc_feature 1..24: note = Synthetic Construct
  source 1..24: mol_type = other DNA
gtaggtgcaaacaaactgggtttt

SEQ ID NO: 18885 - DNA, 20 bp, synthetic construct
  misc_feature 1..20: note = Synthetic Construct
  source 1..20: mol_type = other DNA
tcactcccaagctccgttct

SEQ ID NO: 18886 - DNA, 22 bp, synthetic construct
  misc_feature 1..22: note = Synthetic Construct
  source 1..22: mol_type = other DNA
gcctgggtccaaaggtagaaga

SEQ ID NO: 18887 - DNA, 27 bp, synthetic construct
  misc_feature 1..27: note = Synthetic Construct
  source 1..27: mol_type = other DNA
ctgaggtgaatttgtaaagggtcattg

SEQ ID NO: 18888 - DNA, 28 bp, synthetic construct
  misc_feature 1..28: note = Synthetic Construct
  source 1..28: mol_type = other DNA
ggggctataaaagtgattacagctccta

SEQ ID NO: 18889 - DNA, 22 bp, synthetic construct
  misc_feature 1..22: note = Synthetic Construct
  source 1..22: mol_type = other DNA
cccagcagatgggatggaaact

SEQ ID NO: 18890 - DNA, 24 bp, synthetic construct
  misc_feature 1..24: note = Synthetic Construct
  source 1..24: mol_type = other DNA
caatagcatggtggagtgcacata

SEQ ID NO: 18891 - DNA, 22 bp, synthetic construct
  misc_feature 1..22: note = Synthetic Construct
  source 1..22: mol_type = other DNA
gcatatcctgccaactgtgtca

SEQ ID NO: 18892 - DNA, 24 bp, synthetic construct
  misc_feature 1..24: note = Synthetic Construct
  source 1..24: mol_type = other DNA
tgccaacaaggtgaaatagcagat

SEQ ID NO: 18893 - DNA, 25 bp, synthetic construct
  misc_feature 1..25: note = Synthetic Construct
  source 1..25: mol_type = other DNA
gcagaagggagagttttgagagact

SEQ ID NO: 18894 - DNA, 22 bp, synthetic construct
  misc_feature 1..22: note = Synthetic Construct
  source 1..22: mol_type = other DNA
ggctaagctgttgccaggttct

SEQ ID NO: 18895 - DNA, 20 bp, synthetic construct
  misc_feature 1..20: note = Synthetic Construct
  source 1..20: mol_type = other DNA
acctgcatttccgtggtgaa

SEQ ID NO: 18896 - DNA, 25 bp, synthetic construct
  misc_feature 1..25: note = Synthetic Construct
  source 1..25: mol_type = other DNA
caagaaagaggagccggaatgattt

SEQ ID NO: 18897 - DNA, 26 bp, synthetic construct
  misc_feature 1..26: note = Synthetic Construct
  source 1..26: mol_type = other DNA
gcatggaatctcaatatggcttggaa

SEQ ID NO: 18898 - DNA, 20 bp, synthetic construct
  misc_feature 1..20: note = Synthetic Construct
  source 1..20: mol_type = other DNA
gcggggctgtaccacctaga

SEQ ID NO: 18899 - DNA, 22 bp, synthetic construct
  misc_feature 1..22: note = Synthetic Construct
  source 1..22: mol_type = other DNA
agccccagagatgttaggatgt

SEQ ID NO: 18900 - DNA, 23 bp, synthetic construct
  misc_feature 1..23: note = Synthetic Construct
  source 1..23: mol_type = other DNA
ggtaaacaggaggcagaaactgt

SEQ ID NO: 18901 - DNA, 22 bp, synthetic construct
  misc_feature 1..22: note = Synthetic Construct
  source 1..22: mol_type = other DNA
gcaggccagagtaagagcttca

SEQ ID NO: 18902 - DNA, 22 bp, synthetic construct
  misc_feature 1..22: note = Synthetic Construct
  source 1..22: mol_type = other DNA
ccctctgtggaatgagggtaga

SEQ ID NO: 18903 - DNA, 27 bp, synthetic construct
  misc_feature 1..27: note = Synthetic Construct
  source 1..27: mol_type = other DNA
gacagtgacctgctccattttattaag

SEQ ID NO: 18904 - DNA, 24 bp, synthetic construct
  misc_feature 1..24: note = Synthetic Construct
  source 1..24: mol_type = other DNA
cccaccaatgagtcacaagcatca

SEQ ID NO: 18905 - DNA, 26 bp, synthetic construct
  misc_feature 1..26: note = Synthetic Construct
  source 1..26: mol_type = other DNA
ccctaacatgccagtttctaccatct

SEQ ID NO: 18906 - DNA, 21 bp, synthetic construct
  misc_feature 1..21: note = Synthetic Construct
  source 1..21: mol_type = other DNA
acccagatgttcccagacaga

SEQ ID NO: 18907 - DNA, 22 bp, synthetic construct
  misc_feature 1..22: note = Synthetic Construct
  source 1..22: mol_type = other DNA
ctgcccaggttttgcaggaaga

SEQ ID NO: 18908 - DNA, 24 bp, synthetic construct
  misc_feature 1..24: note = Synthetic Construct
  source 1..24: mol_type = other DNA
gctggattttgggagagacaggtt

SEQ ID NO: 18909 - DNA, 22 bp, synthetic construct
  misc_feature 1..22: note = Synthetic Construct
  source 1..22: mol_type = other DNA
tgtcccagagaacccgatctga

SEQ ID NO: 18910 - DNA, 24 bp, synthetic construct
  misc_feature 1..24: note = Synthetic Construct
  source 1..24: mol_type = other DNA
gctccatccctttctagggcaaca

SEQ ID NO: 18911 - DNA, 22 bp, synthetic construct
  misc_feature 1..22: note = Synthetic Construct
  source 1..22: mol_type = other DNA
ggactggacacaggagcatctt

SEQ ID NO: 18912 - DNA, 22 bp, synthetic construct
  misc_feature 1..22: note = Synthetic Construct
  source 1..22: mol_type = other DNA
gggttctttcccttggctgatt

SEQ ID NO: 18913 - DNA, 24 bp, synthetic construct
  misc_feature 1..24: note = Synthetic Construct
  source 1..24: mol_type = other DNA
cctctgaggcaataccgtggaatc

SEQ ID NO: 18914 - DNA, 26 bp, synthetic construct
  misc_feature 1..26: note = Synthetic Construct
  source 1..26: mol_type = other DNA
gctgctacatgtctcagatgagttta

SEQ ID NO: 18915 - DNA, 25 bp, synthetic construct
  misc_feature 1..25: note = Synthetic Construct
  source 1..25: mol_type = other DNA
ggactacagccaccaagtgatgatg

SEQ ID NO: 18916 - DNA, 23 bp, synthetic construct
  misc_feature 1..23: note = Synthetic Construct
  source 1..23: mol_type = other DNA
caggctggtagctgtctttggta

SEQ ID NO: 18917 - DNA, 24 bp, synthetic construct
  misc_feature 1..24: note = Synthetic Construct
  source 1..24: mol_type = other DNA
gcactgtcttactgcaaggaaaat

SEQ ID NO: 18918 - DNA, 23 bp, synthetic construct
  misc_feature 1..23: note = Synthetic Construct
  source 1..23: mol_type = other DNA
gtgcttcagctgtttccgtctca

SEQ ID NO: 18919 - DNA, 25 bp, synthetic construct
  misc_feature 1..25: note = Synthetic Construct
  source 1..25: mol_type = other DNA
gggtacggtaaatgatgatgtgctt

SEQ ID NO: 18920 - DNA, 25 bp, synthetic construct
  misc_feature 1..25: note = Synthetic Construct
  source 1..25: mol_type = other DNA
agagcatccctaatcatggtacaga

SEQ ID NO: 18921 - DNA, 24 bp, synthetic construct
  misc_feature 1..24: note = Synthetic Construct
  source 1..24: mol_type = other DNA
gtgcaagccagacatgatgaaaca

SEQ ID NO: 18922 - DNA, 22 bp, synthetic construct
  misc_feature 1..22: note = Synthetic Construct
  source 1..22: mol_type = other DNA
cgaccgtccacatgttcctttc

SEQ ID NO: 18923 - DNA, 22 bp, synthetic construct
  misc_feature 1..22: note = Synthetic Construct
  source 1..22: mol_type = other DNA
acctccagcctttagcacttac

SEQ ID NO: 18924 - DNA, 24 bp, synthetic construct
  misc_feature 1..24: note = Synthetic Construct
  source 1..24: mol_type = other DNA
gtggaaacttcagtgggagagtat

SEQ ID NO: 18925 - DNA, 22 bp, synthetic construct
  misc_feature 1..22: note = Synthetic Construct
  source 1..22: mol_type = other DNA
tggaaccctgagccacctgtat

SEQ ID NO: 18926 - DNA, 23 bp, synthetic construct
  misc_feature 1..23: note = Synthetic Construct
  source 1..23: mol_type = other DNA
gctgctggaagagctacaacctt

SEQ ID NO: 18927 - DNA, 22 bp, synthetic construct
  misc_feature 1..22: note = Synthetic Construct
  source 1..22: mol_type = other DNA
gtcccatcacaccacaaaggtt

SEQ ID NO: 18928 - DNA, 24 bp, synthetic construct
  misc_feature 1..24: note = Synthetic Construct
  source 1..24: mol_type = other DNA
ggggcatcatccagtttttctgta

SEQ ID NO: 18929 - DNA, 23 bp, synthetic construct
  misc_feature 1..23: note = Synthetic Construct
  source 1..23: mol_type = other DNA
gtttggactgtcttcccctgttg

SEQ ID NO: 18930 - DNA, 22 bp, synthetic construct
  misc_feature 1..22: note = Synthetic Construct
  source 1..22: mol_type = other DNA
gggaaagaggtgcttcttctga

SEQ ID NO: 18931 - DNA, 23 bp, synthetic construct
  misc_feature 1..23: note = Synthetic Construct
  source 1..23: mol_type = other DNA
gacccaccaaaaactagcactgt

SEQ ID NO: 18932 - DNA, 23 bp, synthetic construct
  misc_feature 1..23: note = Synthetic Construct
  source 1..23: mol_type = other DNA
gctgagattttgcccagtacgtt

SEQ ID NO: 18933 - DNA, 23 bp, synthetic construct
  misc_feature 1..23: note = Synthetic Construct
  source 1..23: mol_type = other DNA
cctgtgacacttctcctgaaaca

SEQ ID NO: 18934 - DNA, 23 bp, synthetic construct
  misc_feature 1..23: note = Synthetic Construct
  source 1..23: mol_type = other DNA
gtcattgctgagagactctgtgt

SEQ ID NO: 18935 - DNA, 25 bp, synthetic construct
  misc_feature 1..25: note = Synthetic Construct
  source 1..25: mol_type = other DNA
ctggaaggtgtgcaaaatagtctct

SEQ ID NO: 18936 - DNA, 23 bp, synthetic construct
  misc_feature 1..23: note = Synthetic Construct
  source 1..23: mol_type = other DNA
ggtcctcacttcacatgggtgtt

SEQ ID NO: 18937 - DNA, 24 bp, synthetic construct
  misc_feature 1..24: note = Synthetic Construct
  source 1..24: mol_type = other DNA
gggatggtgagtggtggaagttac

SEQ ID NO: 18938 - DNA, 25 bp, synthetic construct
  misc_feature 1..25: note = Synthetic Construct
  source 1..25: mol_type = other DNA
atcgcccagaaggtgataaataagt

SEQ ID NO: 18939 - DNA, 26 bp, synthetic construct
  misc_feature 1..26: note = Synthetic Construct
  source 1..26: mol_type = other DNA
ccttggaaaacactttgtggcaatac

SEQ ID NO: 18940 - DNA, 25 bp, synthetic construct
  misc_feature 1..25: note = Synthetic Construct
  source 1..25: mol_type = other DNA
gctgtcctttataacagcgtggaaa

SEQ ID NO: 18941 - DNA, 22 bp, synthetic construct
  misc_feature 1..22: note = Synthetic Construct
  source 1..22: mol_type = other DNA
gcctgtttcaggagttgcattc

SEQ ID NO: 18942 - DNA, 22 bp, synthetic construct
  misc_feature 1..22: note = Synthetic Construct
  source 1..22: mol_type = other DNA
gctccgcagtgatgtggaagat

SEQ ID NO: 18943 - DNA, 27 bp, synthetic construct
  misc_feature 1..27: note = Synthetic Construct
  source 1..27: mol_type = other DNA
ccagaccctgttgcagcaatatgttta

SEQ ID NO: 18944 - DNA, 25 bp, synthetic construct
  misc_feature 1..25: note = Synthetic Construct
  source 1..25: mol_type = other DNA
gcctggaagaagcctgaattgtttc

SEQ ID NO: 18945 - DNA, 23 bp, synthetic construct
  misc_feature 1..23: note = Synthetic Construct
  source 1..23: mol_type = other DNA
tgtgggcagaatgtgagaagatg

SEQ ID NO: 18946 - DNA, 23 bp, synthetic construct
  misc_feature 1..23: note = Synthetic Construct
  source 1..23: mol_type = other DNA
ggcagatacacacactgcagaca

SEQ ID NO: 18947 - DNA, 26 bp, synthetic construct
  misc_feature 1..26: note = Synthetic Construct
  source 1..26: mol_type = other DNA
cacaggtgcaaaccattaatcacaga

SEQ ID NO: 18948 - DNA, 26 bp, synthetic construct
  misc_feature 1..26: note = Synthetic Construct
  source 1..26: mol_type = other DNA
ctgaactcctcacagtctcagataca

SEQ ID NO: 18949 - DNA, 23 bp, synthetic construct
  misc_feature 1..23: note = Synthetic Construct
  source 1..23: mol_type = other DNA
ccttgcatgcatactcacctcta

SEQ ID NO: 18950 - DNA, 27 bp, synthetic construct
  misc_feature 1..27: note = Synthetic Construct
  source 1..27: mol_type = other DNA
gtgatcctcccaagtggctattactac

SEQ ID NO: 18951 - DNA, 27 bp, synthetic construct
  misc_feature 1..27: note = Synthetic Construct
  source 1..27: mol_type = other DNA
gagaaaccttttgctaggcataagtag

SEQ ID NO: 18952 - DNA, 22 bp, synthetic construct
  misc_feature 1..22: note = Synthetic Construct
  source 1..22: mol_type = other DNA
gcttcctccgactatcggaatc

SEQ ID NO: 18953 - DNA, 26 bp, synthetic construct
  misc_feature 1..26: note = Synthetic Construct
  source 1..26: mol_type = other DNA
caccagggttccataaacactgagat

SEQ ID NO: 18954 - DNA, 25 bp, synthetic construct
  misc_feature 1..25: note = Synthetic Construct
  source 1..25: mol_type = other DNA
ccacctgaggaatgagtagctggaa

SEQ ID NO: 18955 - DNA, 24 bp, synthetic construct
  misc_feature 1..24: note = Synthetic Construct
  source 1..24: mol_type = other DNA
gctctgctatccttgggttctttt

SEQ ID NO: 18956 - DNA, 26 bp, synthetic construct
  misc_feature 1..26: note = Synthetic Construct
  source 1..26: mol_type = other DNA
gtgagtttcctgtgacctaaccatgt

SEQ ID NO: 18957 - DNA, 23 bp, synthetic construct
  misc_feature 1..23: note = Synthetic Construct
  source 1..23: mol_type = other DNA
gccacatgcacactgagcttttc

SEQ ID NO: 18958 - DNA, 22 bp, synthetic construct
  misc_feature 1..22: note = Synthetic Construct
  source 1..22: mol_type = other DNA
cttgccttggttaggcttgctt

SEQ ID NO: 18959 - DNA, 24 bp, synthetic construct
  misc_feature 1..24: note = Synthetic Construct
  source 1..24: mol_type = other DNA
gtcccaagagggtatgtggctaga

SEQ ID NO: 18960 - DNA, 23 bp, synthetic construct
  misc_feature 1..23: note = Synthetic Construct
  source 1..23: mol_type = other DNA
cccggtcttattgactggacttc

SEQ ID NO: 18961 - DNA, 25 bp, synthetic construct
  misc_feature 1..25: note = Synthetic Construct
  source 1..25: mol_type = other DNA
tcaacctagttgggtagtgttttca

SEQ ID NO: 18962 - DNA, 22 bp, synthetic construct
  misc_feature 1..22: note = Synthetic Construct
  source 1..22: mol_type = other DNA
gggtggtctcttcaaactgcaa

SEQ ID NO: 18963 - DNA, 21 bp, synthetic construct
  misc_feature 1..21: note = Synthetic Construct
  source 1..21: mol_type = other DNA
cgagggccaaatgggcagaat

SEQ ID NO: 18964 - DNA, 20 bp, synthetic construct
  misc_feature 1..20: note = Synthetic Construct
  source 1..20: mol_type = other DNA
ttgcctcagaggagcacaca

SEQ ID NO: 18965 - DNA, 24 bp, synthetic construct
  misc_feature 1..24: note = Synthetic Construct
  source 1..24: mol_type = other DNA
gctccatccaaaaggcatggaaga

SEQ ID NO: 18966 - DNA, 23 bp, synthetic construct
  misc_feature 1..23: note = Synthetic Construct
  source 1..23: mol_type = other DNA
gctgctgcataagctgcaaggta

SEQ ID NO: 18967 - DNA, 22 bp, synthetic construct
  misc_feature 1..22: note = Synthetic Construct
  source 1..22: mol_type = other DNA
agcctcccttcatctcctctgt

SEQ ID NO: 18968 - DNA, 24 bp, synthetic construct
  misc_feature 1..24: note = Synthetic Construct
  source 1..24: mol_type = other DNA
gccacaccatcttaactggcatca

SEQ ID NO: 18969 - DNA, 22 bp, synthetic construct
  misc_feature 1..22: note = Synthetic Construct
  source 1..22: mol_type = other DNA
gctcaaagagcttccagagagt

SEQ ID NO: 18970 - DNA, 24 bp, synthetic construct
  misc_feature 1..24: note = Synthetic Construct
  source 1..24: mol_type = other DNA
gcggtccacaaaatgaatggcttt

SEQ ID NO: 18971 - DNA, 22 bp, synthetic construct
  misc_feature 1..22: note = Synthetic Construct
  source 1..22: mol_type = other DNA
cacagaggcctccaatgctgta

SEQ ID NO: 18972 - DNA, 27 bp, synthetic construct
  misc_feature 1..27: note = Synthetic Construct
  source 1..27: mol_type = other DNA
ggtaggaactttggagtcacccttttc

SEQ ID NO: 18973 - DNA, 24 bp, synthetic construct
  misc_feature 1..24: note = Synthetic Construct
  source 1..24: mol_type = other DNA
gaacaagtgtggaagagtgtggta

SEQ ID NO: 18974 - DNA, 24 bp, synthetic construct
  misc_feature 1..24: note = Synthetic Construct
  source 1..24: mol_type = other DNA
gaggacaacacagtgaaccagaga

SEQ ID NO: 18975 - DNA, 24 bp, synthetic construct
  misc_feature 1..24: note = Synthetic Construct
  source 1..24: mol_type = other DNA
cctctgagtacctgtgggagtgaa

SEQ ID NO: 18976 - DNA, 25 bp, synthetic construct
  misc_feature 1..25: note = Synthetic Construct
  source 1..25: mol_type = other DNA
ccagaccttgtggtaggtacagttg

SEQ ID NO: 18977 - DNA, 23 bp, synthetic construct
  misc_feature 1..23: note = Synthetic Construct
  source 1..23: mol_type = other DNA
gtcggctatggcagtatgctaac

SEQ ID NO: 18978 - DNA, 27 bp, synthetic construct
  misc_feature 1..27: note = Synthetic Construct
  source 1..27: mol_type = other DNA
gatgctaaggttgttcggctagaattt

SEQ ID NO: 18979 - DNA, 26 bp, synthetic construct
  misc_feature 1..26: note = Synthetic Construct
  source 1..26: mol_type = other DNA
ggattccgtctatcatccagtgaata

SEQ ID NO: 18980 - DNA, 22 bp, synthetic construct
  misc_feature 1..22: note = Synthetic Construct
  source 1..22: mol_type = other DNA
aggctggggtaacccttggaat

SEQ ID NO: 18981 - DNA, 26 bp, synthetic construct
  misc_feature 1..26: note = Synthetic Construct
  source 1..26: mol_type = other DNA
agaccccatatttctccctattgaac

SEQ ID NO: 18982 - DNA, 22 bp, synthetic construct
  misc_feature 1..22: note = Synthetic Construct
  source 1..22: mol_type = other DNA
ggtcaggaccaagagtggacat

SEQ ID NO: 18983 - DNA, 24 bp, synthetic construct
  misc_feature 1..24: note = Synthetic Construct
  source 1..24: mol_type = other DNA
tgcaagtgtccatacagtcttgat

SEQ ID NO: 18984 - DNA, 25 bp, synthetic construct
  misc_feature 1..25: note = Synthetic Construct
  source 1..25: mol_type = other DNA
agtgttaactcacaagggctcatac

SEQ ID NO: 18985 - DNA, 22 bp, synthetic construct
  misc_feature 1..22: note = Synthetic Construct
  source 1..22: mol_type = other DNA
gtctcatgcagagttggtgact

SEQ ID NO: 18986 - DNA, 22 bp, synthetic construct
  misc_feature 1..22: note = Synthetic Construct
  source 1..22: mol_type = other DNA
ggggcaagtggaatggaagtca

SEQ ID NO: 18987 - DNA, 27 bp, synthetic construct
  misc_feature 1..27: note = Synthetic Construct
  source 1..27: mol_type = other DNA
ggtgcagattagcagaacattctaaag

SEQ ID NO: 18988 - DNA, 21 bp, synthetic construct
  misc_feature 1..21: note = Synthetic Construct
  source 1..21: mol_type = other DNA
gaaactgaagcccgctactca

SEQ ID NO: 18989 - DNA, 25 bp, synthetic construct
  misc_feature 1..25: note = Synthetic Construct
  source 1..25: mol_type = other DNA
gagcctcatgtctttgaagcctttc

SEQ ID NO: 18990 - DNA, 27 bp, synthetic construct
  misc_feature 1..27: note = Synthetic Construct
  source 1..27: mol_type = other DNA
gacaggttttgttctggacaataggaa

SEQ ID NO: 18991 - DNA, 25 bp, synthetic construct
  misc_feature 1..25: note = Synthetic Construct
  source 1..25: mol_type = other DNA
ccactcccaacacacttttcttcat

SEQ ID NO: 18992 - DNA, 26 bp, synthetic construct
  misc_feature 1..26: note = Synthetic Construct
  source 1..26: mol_type = other DNA
gacctaagctcttcctgactttgact

SEQ ID NO: 18993 - DNA, 26 bp, synthetic construct
  misc_feature 1..26: note = Synthetic Construct
  source 1..26: mol_type = other DNA
cgcatccataaagagggatccagagt

SEQ ID NO: 18994 - DNA, 25 bp, synthetic construct
  misc_feature 1..25: note = Synthetic Construct
  source 1..25: mol_type = other DNA
tgttggttggtagagcttattgcta

SEQ ID NO: 18995 - DNA, 23 bp, synthetic construct
  misc_feature 1..23: note = Synthetic Construct
  source 1..23: mol_type = other DNA
tcagggcctcaaaattccctaga

SEQ ID NO: 18996 - DNA, 26 bp, synthetic construct
  misc_feature 1..26: note = Synthetic Construct
  source 1..26: mol_type = other DNA
ctcttagctatatcccctcccctctt

SEQ ID NO: 18997 - DNA, 25 bp, synthetic construct
  misc_feature 1..25: note = Synthetic Construct
  source 1..25: mol_type = other DNA
gacagacaaaactcctgcgagatac

SEQ ID NO: 18998 - DNA, 21 bp, synthetic construct
  misc_feature 1..21: note = Synthetic Construct
  source 1..21: mol_type = other DNA
gaggctcctcatgtgcttgaa

SEQ ID NO: 18999 - DNA, 25 bp, synthetic construct
  misc_feature 1..25: note = Synthetic Construct
  source 1..25: mol_type = other DNA
gcaataagccaggtaggattgttca

SEQ ID NO: 19000 - DNA, 24 bp, synthetic construct
  misc_feature 1..24: note = Synthetic Construct
  source 1..24: mol_type = other DNA
ccatttctggtaggtcctgagcaa

SEQ ID NO: 19001 - DNA, 24 bp, synthetic construct
  misc_feature 1..24: note = Synthetic Construct
  source 1..24: mol_type = other DNA
gggcagcaacttacactcttaatc

SEQ ID NO: 19002 - DNA, 21 bp, synthetic construct
  misc_feature 1..21: note = Synthetic Construct
  source 1..21: mol_type = other DNA
ggtgtgacaagcacaccttca

SEQ ID NO: 19003 - DNA, 23 bp, synthetic construct
  misc_feature 1..23: note = Synthetic Construct
  source 1..23: mol_type = other DNA
ggaggaaacctttggtagggaaa

SEQ ID NO: 19004 - DNA, 26 bp, synthetic construct
  misc_feature 1..26: note = Synthetic Construct
  source 1..26: mol_type = other DNA
gtcaccttttgtccacttgattgatg

SEQ ID NO: 19005 - DNA, 24 bp, synthetic construct
  misc_feature 1..24: note = Synthetic Construct
  source 1..24: mol_type = other DNA
ccacctctgtaaacatgcaaggaa

SEQ ID NO: 19006 - DNA, 24 bp, synthetic construct
  misc_feature 1..24: note = Synthetic Construct
  source 1..24: mol_type = other DNA
ctcagtcacatgtagttgctgttg

SEQ ID NO: 19007 - DNA, 22 bp, synthetic construct
  misc_feature 1..22: note = Synthetic Construct
  source 1..22: mol_type = other DNA
tgtctctgcctgacccacaatc

SEQ ID NO: 19008 - DNA, 22 bp, synthetic construct
  misc_feature 1..22: note = Synthetic Construct
  source 1..22: mol_type = other DNA
ggcacttggcaacattccactt

SEQ ID NO: 19009 - DNA, 22 bp, synthetic construct
  misc_feature 1..22: note = Synthetic Construct
  source 1..22: mol_type = other DNA
tcaagacatctgtgcccgatac

SEQ ID NO: 19010 - DNA, 23 bp, synthetic construct
  misc_feature 1..23: note = Synthetic Construct
  source 1..23: mol_type = other DNA
gtgaggaagactactgccagaaa

SEQ ID NO: 19011 - DNA, 25 bp, synthetic construct
  misc_feature 1..25: note = Synthetic Construct
  source 1..25: mol_type = other DNA
ctgggagtcttcagacctgtctttg

SEQ ID NO: 19012 - DNA, 22 bp, synthetic construct
  misc_feature 1..22: note = Synthetic Construct
  source 1..22: mol_type = other DNA
cactgtgcctttgctgtgaaac

SEQ ID NO: 19013 - DNA, 25 bp, synthetic construct
  misc_feature 1..25: note = Synthetic Construct
  source 1..25: mol_type = other DNA
ggctagtaggttttgctggttcaga

SEQ ID NO: 19014 - DNA, 23 bp, synthetic construct
  misc_feature 1..23: note = Synthetic Construct
  source 1..23: mol_type = other DNA
ggagtaggactccagctcaggta

SEQ ID NO: 19015 - DNA, 23 bp, synthetic construct
  misc_feature 1..23: note = Synthetic Construct
  source 1..23: mol_type = other DNA
gtggaggctaaaacctggctgtt

SEQ ID NO: 19016 - DNA, 22 bp, synthetic construct
  misc_feature 1..22: note = Synthetic Construct
  source 1..22: mol_type = other DNA
ctcaggtccacagtggcattct

SEQ ID NO: 19017 - DNA, 22 bp, synthetic construct
  misc_feature 1..22: note = Synthetic Construct
  source 1..22: mol_type = other DNA
cggttcttcccagagcccatag

SEQ ID NO: 19018 - DNA, 22 bp, synthetic construct
  misc_feature 1..22: note = Synthetic Construct
  source 1..22: mol_type = other DNA
tgtctcgcttctctctggatgt

SEQ ID NO: 19019 - DNA, 26 bp, synthetic construct
  misc_feature 1..26: note = Synthetic Construct
  source 1..26: mol_type = other DNA
gtgagaacaggtgtctaggagagcta

SEQ ID NO: 19020 - DNA, 21 bp, synthetic construct
  misc_feature 1..21: note = Synthetic Construct
  source 1..21: mol_type = other DNA
gctcactttgcccacggtttg

SEQ ID NO: 19021 - DNA, 25 bp, synthetic construct
  misc_feature 1..25: note = Synthetic Construct
  source 1..25: mol_type = other DNA
gctgggattgaacctagctctgagt

SEQ ID NO: 19022 - DNA, 24 bp, synthetic construct
  misc_feature 1..24: note = Synthetic Construct
  source 1..24: mol_type = other DNA
ggcagcctttcttctccttgactt

SEQ ID NO: 19023 - DNA, 25 bp, synthetic construct
  misc_feature 1..25: note = Synthetic Construct
  source 1..25: mol_type = other DNA
ccttcacttccaagggtatgctaag

SEQ ID NO: 19024 - DNA, 25 bp, synthetic construct
  misc_feature 1..25: note = Synthetic Construct
  source 1..25: mol_type = other DNA
gatggggtttttatggttgggcttt

SEQ ID NO: 19025 - DNA, 24 bp, synthetic construct
  misc_feature 1..24: note = Synthetic Construct
  source 1..24: mol_type = other DNA
acatacagccttgcacatttctga

SEQ ID NO: 19026 - DNA, 20 bp, synthetic construct
  misc_feature 1..20: note = Synthetic Construct
  source 1..20: mol_type = other DNA
ggggagaacagatgccaaca

SEQ ID NO: 19027 - DNA, 27 bp, synthetic construct
  misc_feature 1..27: note = Synthetic Construct
  source 1..27: mol_type = other DNA
cctggtcaaggatcttatcccagaagt

SEQ ID NO: 19028 - DNA, 24 bp, synthetic construct
  misc_feature 1..24: note = Synthetic Construct
  source 1..24: mol_type = other DNA
gggcctgaagatacaggcttcctt

SEQ ID NO: 19029 - DNA, 26 bp, synthetic construct
  misc_feature 1..26: note = Synthetic Construct
  source 1..26: mol_type = other DNA
cgagctgatctgagtacaatcacaga

SEQ ID NO: 19030 - DNA, 22 bp, synthetic construct
  misc_feature 1..22: note = Synthetic Construct
  source 1..22: mol_type = other DNA
ggccagattggacaaggactgt

SEQ ID NO: 19031 - DNA, 22 bp, synthetic construct
  misc_feature 1..22: note = Synthetic Construct
  source 1..22: mol_type = other DNA
gcttgcctctatcctcctcttc

SEQ ID NO: 19032 - DNA, 21 bp, synthetic construct
  misc_feature 1..21: note = Synthetic Construct
  source 1..21: mol_type = other DNA
gccatgaaagccagcatctgt

SEQ ID NO: 19033 - DNA, 23 bp, synthetic construct
  misc_feature 1..23: note = Synthetic Construct
  source 1..23: mol_type = other DNA
agtgtgcttcccacatcaaagat

SEQ ID NO: 19034 - DNA, 25 bp, synthetic construct
  misc_feature 1..25: note = Synthetic Construct
  source 1..25: mol_type = other DNA
ggacagacactgattaagggcaact

SEQ ID NO: 19035 - DNA, 24 bp, synthetic construct
  misc_feature 1..24: note = Synthetic Construct
  source 1..24: mol_type = other DNA
cgcaaacattcacagcttaacaca

SEQ ID NO: 19036 - DNA, 27 bp, synthetic construct
  misc_feature 1..27: note = Synthetic Construct
  source 1..27: mol_type = other DNA
caggtatcactagattgttctcccaat

SEQ ID NO: 19037 - DNA, 22 bp, synthetic construct
  misc_feature 1..22: note = Synthetic Construct
  source 1..22: mol_type = other DNA
acttggccagctctctcacttc

SEQ ID NO: 19038 - DNA, 23 bp, synthetic construct
  misc_feature 1..23: note = Synthetic Construct
  source 1..23: mol_type = other DNA
gctgtcccaaatgattcctgctt

SEQ ID NO: 19039 - DNA, 22 bp, synthetic construct
  misc_feature 1..22: note = Synthetic Construct
  source 1..22: mol_type = other DNA
ggatcagcggagttttggtcat

SEQ ID NO: 19040 - DNA, 27 bp, synthetic construct
  misc_feature 1..27: note = Synthetic Construct
  source 1..27: mol_type = other DNA
ggtttcttggtttcaagggaaggaatg

SEQ ID NO: 19041 - DNA, 23 bp, synthetic construct
  misc_feature 1..23: note = Synthetic Construct
  source 1..23: mol_type = other DNA
cggcttgtgaaaaacacaaggaa

SEQ ID NO: 19042 - DNA, 21 bp, synthetic construct
  misc_feature 1..21: note = Synthetic Construct
  source 1..21: mol_type = other DNA
ggatgtgctgcatcccaaaca

SEQ ID NO: 19043 - DNA, 25 bp, synthetic construct
  misc_feature 1..25: note = Synthetic Construct
  source 1..25: mol_type = other DNA
ggcatgtacaaaacaagcccttgaa

SEQ ID NO: 19044 - DNA, 26 bp, synthetic construct
  misc_feature 1..26: note = Synthetic Construct
  source 1..26: mol_type = other DNA
cccaagagtttcaggtaagagtttgt

SEQ ID NO: 19045 - DNA, 26 bp, synthetic construct
  misc_feature 1..26: note = Synthetic Construct
  source 1..26: mol_type = other DNA
gccagttctgaaaacttccactaaca

SEQ ID NO: 19046 - DNA, 23 bp, synthetic construct
  misc_feature 1..23: note = Synthetic Construct
  source 1..23: mol_type = other DNA
gcgtggtaagtacgatgggaagt

SEQ ID NO: 19047 - DNA, 26 bp, synthetic construct
  misc_feature 1..26: note = Synthetic Construct
  source 1..26: mol_type = other DNA
cagcttcattcagtacattccctttg

SEQ ID NO: 19048 - DNA, 27 bp, synthetic construct
  misc_feature 1..27: note = Synthetic Construct
  source 1..27: mol_type = other DNA
caaactgcaggggaaattatgatctga

SEQ ID NO: 19049 - DNA, 20 bp, synthetic construct
  misc_feature 1..20: note = Synthetic Construct
  source 1..20: mol_type = other DNA
tgactcctgcctgggtcaaa

SEQ ID NO: 19050 - DNA, 24 bp, synthetic construct
  misc_feature 1..24: note = Synthetic Construct
  source 1..24: mol_type = other DNA
aacagtggagagtgtgctaaagtt

SEQ ID NO: 19051 - DNA, 20 bp, synthetic construct
  misc_feature 1..20: note = Synthetic Construct
  source 1..20: mol_type = other DNA
tccctggagttgtcctccaa

SEQ ID NO: 19052 - DNA, 20 bp, synthetic construct
  misc_feature 1..20: note = Synthetic Construct
  source 1..20: mol_type = other DNA
agccagacttgggcagaaga

SEQ ID NO: 19053 - DNA, 23 bp, synthetic construct
  misc_feature 1..23: note = Synthetic Construct
  source 1..23: mol_type = other DNA
ggcggaatcagcatctaggatag

SEQ ID NO: 19054 - DNA, 30 bp, synthetic construct
  misc_feature 1..30: note = Synthetic Construct
  source 1..30: mol_type = other DNA
gcaggaagttaaaacaaactgagcactaca

SEQ ID NO: 19055 - DNA, 26 bp, synthetic construct
  misc_feature 1..26: note = Synthetic Construct
  source 1..26: mol_type = other DNA
cacacccaaattatccattcgctgat

SEQ ID NO: 19056 - DNA, 28 bp, synthetic construct
  misc_feature 1..28: note = Synthetic Construct
  source 1..28: mol_type = other DNA
gtcctcacacctactgttccttaagttg

SEQ ID NO: 19057 - DNA, 23 bp, synthetic construct
  misc_feature 1..23: note = Synthetic Construct
  source 1..23: mol_type = other DNA
aagatgttttccctggccttctt

SEQ ID NO: 19058 - DNA, 23 bp, synthetic construct
  misc_feature 1..23: note = Synthetic Construct
  source 1..23: mol_type = other DNA
gagaggttccttctcggtcttac

SEQ ID NO: 19059 - DNA, 26 bp, synthetic construct
  misc_feature 1..26: note = Synthetic Construct
  source 1..26: mol_type = other DNA
gcaatggaatcccaaggaaacatagt

SEQ ID NO: 19060 - DNA, 24 bp, synthetic construct
  misc_feature 1..24: note = Synthetic Construct
  source 1..24: mol_type = other DNA
tgatcgtggaaatggatctcaagt

SEQ ID NO: 19061 - DNA, 26 bp, synthetic construct
  misc_feature 1..26: note = Synthetic Construct
  source 1..26: mol_type = other DNA
gagtcagccaataaagagagacttgt

SEQ ID NO: 19062 - DNA, 21 bp, synthetic construct
  misc_feature 1..21: note = Synthetic Construct
  source 1..21: mol_type = other DNA
gccacgttcttcccattgtca

SEQ ID NO: 19063 - DNA, 23 bp, synthetic construct
  misc_feature 1..23: note = Synthetic Construct
  source 1..23: mol_type = other DNA
tgccacctaaatgaagacccttt

SEQ ID NO: 19064 - DNA, 22 bp, synthetic construct
  misc_feature 1..22: note = Synthetic Construct
  source 1..22: mol_type = other DNA
caccctttggtcctcctgtatc

SEQ ID NO: 19065 - DNA, 24 bp, synthetic construct
  misc_feature 1..24: note = Synthetic Construct
  source 1..24: mol_type = other DNA
cccagtatgtcccaggcaatctgt

SEQ ID NO: 19066 - DNA, 23 bp, synthetic construct
  misc_feature 1..23: note = Synthetic Construct
  source 1..23: mol_type = other DNA
gtccttgctcatgactcagaact

SEQ ID NO: 19067 - DNA, 22 bp, synthetic construct
  misc_feature 1..22: note = Synthetic Construct
  source 1..22: mol_type = other DNA
gctggtgactgcacatttttca

SEQ ID NO: 19068 - DNA, 21 bp, synthetic construct
  misc_feature 1..21: note = Synthetic Construct
  source 1..21: mol_type = other DNA
gctgagtatctgcgtgtctgt

SEQ ID NO: 19069 - DNA, 23 bp, synthetic construct
  misc_feature 1..23: note = Synthetic Construct
  source 1..23: mol_type = other DNA
gcttggccttactgtacttctct

SEQ ID NO: 19070 - DNA, 24 bp, synthetic construct
  misc_feature 1..24: note = Synthetic Construct
  source 1..24: mol_type = other DNA
ggagcaagtgggtatgttgagaag

SEQ ID NO: 19071 - DNA, 25 bp, synthetic construct
  misc_feature 1..25: note = Synthetic Construct
  source 1..25: mol_type = other DNA
ggaggaccggtttacattcctgatg

SEQ ID NO: 19072 - DNA, 24 bp, synthetic construct
  misc_feature 1..24: note = Synthetic Construct
  source 1..24: mol_type = other DNA
gcattagcctcttagtggttcctt

SEQ ID NO: 19073 - DNA, 24 bp, synthetic construct
  misc_feature 1..24: note = Synthetic Construct
  source 1..24: mol_type = other DNA
acaacacttacctcccatgcattt

SEQ ID NO: 19074 - DNA, 22 bp, synthetic construct
  misc_feature 1..22: note = Synthetic Construct
  source 1..22: mol_type = other DNA
cactgtgactggcctgttcgtt

SEQ ID NO: 19075 - DNA, 21 bp, synthetic construct
  misc_feature 1..21: note = Synthetic Construct
  source 1..21: mol_type = other DNA
agccgtttgggaaaagtggaa

SEQ ID NO: 19076 - DNA, 26 bp, synthetic construct
  misc_feature 1..26: note = Synthetic Construct
  source 1..26: mol_type = other DNA
gtccctaaggtaaggatggaaaatct

SEQ ID NO: 19077 - DNA, 23 bp, synthetic construct
  misc_feature 1..23: note = Synthetic Construct
  source 1..23: mol_type = other DNA
gctttcgaaggggtgttcttttc

SEQ ID NO: 19078 - DNA, 25 bp, synthetic construct
  misc_feature 1..25: note = Synthetic Construct
  source 1..25: mol_type = other DNA
cagcttgttggagaagcatctttac

SEQ ID NO: 19079 - DNA, 24 bp, synthetic construct
  misc_feature 1..24: note = Synthetic Construct
  source 1..24: mol_type = other DNA
ctgtttgacaccgaaacactgcat

SEQ ID NO: 19080 - DNA, 21 bp, synthetic construct
  misc_feature 1..21: note = Synthetic Construct
  source 1..21: mol_type = other DNA
gtgcctctgttgtccagagtt

SEQ ID NO: 19081 - DNA, 25 bp, synthetic construct
  misc_feature 1..25: note = Synthetic Construct
  source 1..25: mol_type = other DNA
gggcaaaagaagtgcaaatgcaaca

SEQ ID NO: 19082 - DNA, 21 bp, synthetic construct
  misc_feature 1..21: note = Synthetic Construct
  source 1..21: mol_type = other DNA
tgcagcagagactgtccacta

SEQ ID NO: 19083 - DNA, 22 bp, synthetic construct
  misc_feature 1..22: note = Synthetic Construct
  source 1..22: mol_type = other DNA
tggacatcacatctgcatggaa

SEQ ID NO: 19084 - DNA, 23 bp, synthetic construct
  misc_feature 1..23: note = Synthetic Construct
  source 1..23: mol_type = other DNA
gctatccctggacttctcggtta

SEQ ID NO: 19085 - DNA, 23 bp, synthetic construct
  misc_feature 1..23: note = Synthetic Construct
  source 1..23: mol_type = other DNA
ggcagccttaattcccaccacaa

SEQ ID NO: 19086 - DNA, 23 bp, synthetic construct
  misc_feature 1..23: note = Synthetic Construct
  source 1..23: mol_type = other DNA
cgtaagaggttgacaggtgctat

SEQ ID NO: 19087 - DNA, 20 bp, synthetic construct
  misc_feature 1..20: note = Synthetic Construct
  source 1..20: mol_type = other DNA
tggctcctaccacaccttgt

SEQ ID NO: 19088 - DNA, 24 bp, synthetic construct
  misc_feature 1..24: note = Synthetic Construct
  source 1..24: mol_type = other DNA
cacacagatgctactggagtgaac

SEQ ID NO: 19089 - DNA, 21 bp, synthetic construct
  misc_feature 1..21: note = Synthetic Construct
  source 1..21: mol_type = other DNA
aggtcggtcttcccagctaga

SEQ ID NO: 19090 - DNA, 22 bp, synthetic construct
  misc_feature 1..22: note = Synthetic Construct
  source 1..22: mol_type = other DNA
cgggagagttccttcctgttca

SEQ ID NO: 19091 - DNA, 22 bp, synthetic construct
  misc_feature 1..22: note = Synthetic Construct
  source 1..22: mol_type = other DNA
gagggaacaccatgtcctcaca

SEQ ID NO: 19092 - DNA, 23 bp, synthetic construct
  misc_feature 1..23: note = Synthetic Construct
  source 1..23: mol_type = other DNA
ccacagtgaggtcaaatggatca

SEQ ID NO: 19093 - DNA, 26 bp, synthetic construct
  misc_feature 1..26: note = Synthetic Construct
  source 1..26: mol_type = other DNA
catgaacgagactccaaggtaattct

SEQ ID NO: 19094 - DNA, 26 bp, synthetic construct
  misc_feature 1..26: note = Synthetic Construct
  source 1..26: mol_type = other DNA
ctgtaagtaagcttgactccctgtat

SEQ ID NO: 19095 - DNA, 24 bp, synthetic construct
  misc_feature 1..24: note = Synthetic Construct
  source 1..24: mol_type = other DNA
ctggaaagatagagctgccacgat

SEQ ID NO: 19096 - DNA, 24 bp, synthetic construct
  misc_feature 1..24: note = Synthetic Construct
  source 1..24: mol_type = other DNA
gtggtttaccaactgcactaccaa

SEQ ID NO: 19097 - DNA, 20 bp, synthetic construct
  misc_feature 1..20: note = Synthetic Construct
  source 1..20: mol_type = other DNA
tgaggccctgcacttactga

SEQ ID NO: 19098 - DNA, 22 bp, synthetic construct
  misc_feature 1..22: note = Synthetic Construct
  source 1..22: mol_type = other DNA
cagcttcctggttactgtgtga

SEQ ID NO: 19099 - DNA, 20 bp, synthetic construct
  misc_feature 1..20: note = Synthetic Construct
  source 1..20: mol_type = other DNA
gtgtgcccaagaccctcttc

SEQ ID NO: 19100 - DNA, 23 bp, synthetic construct
  misc_feature 1..23: note = Synthetic Construct
  source 1..23: mol_type = other DNA
ggcagcatggtctcaggaggata

SEQ ID NO: 19101 - DNA, 27 bp, synthetic construct
  misc_feature 1..27: note = Synthetic Construct
  source 1..27: mol_type = other DNA
ccccaaatggtagtgaactctgcaata

SEQ ID NO: 19102 - DNA, 23 bp, synthetic construct
  misc_feature 1..23: note = Synthetic Construct
  source 1..23: mol_type = other DNA
tctgctccagctgtctagacttt

SEQ ID NO: 19103 - DNA, 26 bp, synthetic construct
  misc_feature 1..26: note = Synthetic Construct
  source 1..26: mol_type = other DNA
ctgtacagcatcacagctacctaaac

SEQ ID NO: 19104 - DNA, 25 bp, synthetic construct
  misc_feature 1..25: note = Synthetic Construct
  source 1..25: mol_type = other DNA
gatgtgtctccagtattgtgtctgt

SEQ ID NO: 19105 - DNA, 22 bp, synthetic construct
  misc_feature 1..22: note = Synthetic Construct
  source 1..22: mol_type = other DNA
ggaggagagaggcagaactgta

SEQ ID NO: 19106 - DNA, 20 bp, synthetic construct
  misc_feature 1..20: note = Synthetic Construct
  source 1..20: mol_type = other DNA
gcggttagcgctagacaaca

SEQ ID NO: 19107 - DNA, 22 bp, synthetic construct
  misc_feature 1..22: note = Synthetic Construct
  source 1..22: mol_type = other DNA
cccagaggttctgcatgttttg

SEQ ID NO: 19108 - DNA, 24 bp, synthetic construct
  misc_feature 1..24: note = Synthetic Construct
  source 1..24: mol_type = other DNA
ccccagacaggtagtcctgagatt

SEQ ID NO: 19109 - DNA, 27 bp, synthetic construct
  misc_feature 1..27: note = Synthetic Construct
  source 1..27: mol_type = other DNA
gctggaaagataatcgttgaggccaaa

SEQ ID NO: 19110 - DNA, 22 bp, synthetic construct
  misc_feature 1..22: note = Synthetic Construct
  source 1..22: mol_type = other DNA
ggcggttgagagaaatggtaga

SEQ ID NO: 19111 - DNA, 24 bp, synthetic construct
  misc_feature 1..24: note = Synthetic Construct
  source 1..24: mol_type = other DNA
aagtatctcaaaacagcggggtta

SEQ ID NO: 19112 - DNA, 22 bp, synthetic construct
  misc_feature 1..22: note = Synthetic Construct
  source 1..22: mol_type = other DNA
gccgtaaagtcctgccacttac

SEQ ID NO: 19113 - DNA, 22 bp, synthetic construct
  misc_feature 1..22: note = Synthetic Construct
  source 1..22: mol_type = other DNA
gccggggttttgcatagcttca

SEQ ID NO: 19114 - DNA, 23 bp, synthetic construct
  misc_feature 1..23: note = Synthetic Construct
  source 1..23: mol_type = other DNA
agtgactatcagtgcccacaaac

SEQ ID NO: 19115 - DNA, 24 bp, synthetic construct
  misc_feature 1..24: note = Synthetic Construct
  source 1..24: mol_type = other DNA
tgtccttggttgagtcactctttg

SEQ ID NO: 19116 - DNA, 22 bp, synthetic construct
  misc_feature 1..22: note = Synthetic Construct
  source 1..22: mol_type = other DNA
tggatcaactctccccttgact

SEQ ID NO: 19117 - DNA, 21 bp, synthetic construct
  misc_feature 1..21: note = Synthetic Construct
  source 1..21: mol_type = other DNA
aggacacaggctgaccacaca

SEQ ID NO: 19118 - DNA, 26 bp, synthetic construct
  misc_feature 1..26: note = Synthetic Construct
  source 1..26: mol_type = other DNA
gtctcttgttcacaatccaaggagat

SEQ ID NO: 19119 - DNA, 25 bp, synthetic construct
  misc_feature 1..25: note = Synthetic Construct
  source 1..25: mol_type = other DNA
gaggatctatcggaatcctctgtct

SEQ ID NO: 19120 - DNA, 24 bp, synthetic construct
  misc_feature 1..24: note = Synthetic Construct
  source 1..24: mol_type = other DNA
tccagcaaagctacttctgtgaaa

SEQ ID NO: 19121 - DNA, 22 bp, synthetic construct
  misc_feature 1..22: note = Synthetic Construct
  source 1..22: mol_type = other DNA
ctctccagcgttacccgatttc

SEQ ID NO: 19122 - DNA, 23 bp, synthetic construct
  misc_feature 1..23: note = Synthetic Construct
  source 1..23: mol_type = other DNA
cgttccctctcttcttccccttt

SEQ ID NO: 19123 - DNA, 28 bp, synthetic construct
  misc_feature 1..28: note = Synthetic Construct
  source 1..28: mol_type = other DNA
gggaaagcaagtagaggtactaacatga

SEQ ID NO: 19124 - DNA, 21 bp, synthetic construct
  misc_feature 1..21: note = Synthetic Construct
  source 1..21: mol_type = other DNA
agcaccgtttctggatgtgat

SEQ ID NO: 19125 - DNA, 23 bp, synthetic construct
  misc_feature 1..23: note = Synthetic Construct
  source 1..23: mol_type = other DNA
gaggagacaggcaattagcacat

SEQ ID NO: 19126 - DNA, 23 bp, synthetic construct
  misc_feature 1..23: note = Synthetic Construct
  source 1..23: mol_type = other DNA
ccaggtgggactgtcttatctct

SEQ ID NO: 19127 - DNA, 20 bp, synthetic construct
  misc_feature 1..20: note = Synthetic Construct
  source 1..20: mol_type = other DNA
tcacacctggaaccctgctt

SEQ ID NO: 19128 - DNA, 22 bp, synthetic construct
  misc_feature 1..22: note = Synthetic Construct
  source 1..22: mol_type = other DNA
ccctactcactcccttctcagt

SEQ ID NO: 19129 - DNA, 25 bp, synthetic construct
  misc_feature 1..25: note = Synthetic Construct
  source 1..25: mol_type = other DNA
cccgcaaggtggaaggtaatagtag

SEQ ID NO: 19130 - DNA, 26 bp, synthetic construct
  misc_feature 1..26: note = Synthetic Construct
  source 1..26: mol_type = other DNA
gctagcagttgatgagagtggatttc

SEQ ID NO: 19131 - DNA, 19 bp, synthetic construct
  misc_feature 1..19: note = Synthetic Construct
  source 1..19: mol_type = other DNA
ggggccacaaatggggaat

SEQ ID NO: 19132 - DNA, 24 bp, synthetic construct
  misc_feature 1..24: note = Synthetic Construct
  source 1..24: mol_type = other DNA
gggtggtttgcgcttcttatcaca

SEQ ID NO: 19133 - DNA, 26 bp, synthetic construct
  misc_feature 1..26: note = Synthetic Construct
  source 1..26: mol_type = other DNA
ctagcagctcttaacagatgatgttg

SEQ ID NO: 19134 - DNA, 22 bp, synthetic construct
  misc_feature 1..22: note = Synthetic Construct
  source 1..22: mol_type = other DNA
ggtggtgtgagggctggatatt

SEQ ID NO: 19135 - DNA, 23 bp, synthetic construct
  misc_feature 1..23: note = Synthetic Construct
  source 1..23: mol_type = other DNA
ctggttggcattatttgctccaa

SEQ ID NO: 19136 - DNA, 25 bp, synthetic construct
  misc_feature 1..25: note = Synthetic Construct
  source 1..25: mol_type = other DNA
gtgtctgtcctctccacatgtcttg

SEQ ID NO: 19137 - DNA, 25 bp, synthetic construct
  misc_feature 1..25: note = Synthetic Construct
  source 1..25: mol_type = other DNA
cacaccctgaagtcactatcctttc

SEQ ID NO: 19138 - DNA, 24 bp, synthetic construct
  misc_feature 1..24: note = Synthetic Construct
  source 1..24: mol_type = other DNA
gctcgaattcactactgggctaaa

SEQ ID NO: 19139 - DNA, 24 bp, synthetic construct
  misc_feature 1..24: note = Synthetic Construct
  source 1..24: mol_type = other DNA
ccatcttctttgccatgcagcaat

SEQ ID NO: 19140 - DNA, 25 bp, synthetic construct
  misc_feature 1..25: note = Synthetic Construct
  source 1..25: mol_type = other DNA
ctcagaaatcacctcctccctgaag

SEQ ID NO: 19141 - DNA, 21 bp, synthetic construct
  misc_feature 1..21: note = Synthetic Construct
  source 1..21: mol_type = other DNA
gctgttcaccgcacattcagt

SEQ ID NO: 19142 - DNA, 24 bp, synthetic construct
  misc_feature 1..24: note = Synthetic Construct
  source 1..24: mol_type = other DNA
ctctgtctcctgtccctggaatac

SEQ ID NO: 19143 - DNA, 23 bp, synthetic construct
  misc_feature 1..23: note = Synthetic Construct
  source 1..23: mol_type = other DNA
ggctcttgcactgctcctatttg

SEQ ID NO: 19144 - DNA, 21 bp, synthetic construct
  misc_feature 1..21: note = Synthetic Construct
  source 1..21: mol_type = other DNA
tgaccccatgttccagctact

SEQ ID NO: 19145 - DNA, 24 bp, synthetic construct
  misc_feature 1..24: note = Synthetic Construct
  source 1..24: mol_type = other DNA
catctgtgagacaactggtgaact

SEQ ID NO: 19146 - DNA, 22 bp, synthetic construct
  misc_feature 1..22: note = Synthetic Construct
  source 1..22: mol_type = other DNA
gtgcagtgagaggcgaagtaca

SEQ ID NO: 19147 - DNA, 25 bp, synthetic construct
  misc_feature 1..25: note = Synthetic Construct
  source 1..25: mol_type = other DNA
gaagtacataggggtgaccatgaaa

SEQ ID NO: 19148 - DNA, 19 bp, synthetic construct
  misc_feature 1..19: note = Synthetic Construct
  source 1..19: mol_type = other DNA
agcgctctgcgatttcctt

SEQ ID NO: 19149 - DNA, 22 bp, synthetic construct
  misc_feature 1..22: note = Synthetic Construct
  source 1..22: mol_type = other DNA
tcacaccacccatctggagtca

SEQ ID NO: 19150 - DNA, 26 bp, synthetic construct
  misc_feature 1..26: note = Synthetic Construct
  source 1..26: mol_type = other DNA
ggaggcaaggaaacatagtctttaac

SEQ ID NO: 19151 - DNA, 27 bp, synthetic construct
  misc_feature 1..27: note = Synthetic Construct
  source 1..27: mol_type = other DNA
cagttttcaggccacgttctaaacaag

SEQ ID NO: 19152 - DNA, 28 bp, synthetic construct
  misc_feature 1..28: note = Synthetic Construct
  source 1..28: mol_type = other DNA
gcaggcatggtataaaacccattccatt

SEQ ID NO: 19153 - DNA, 23 bp, synthetic construct
  misc_feature 1..23: note = Synthetic Construct
  source 1..23: mol_type = other DNA
ccctctgtggggtacttggtaga

SEQ ID NO: 19154 - DNA, 28 bp, synthetic construct
  misc_feature 1..28: note = Synthetic Construct
  source 1..28: mol_type = other DNA
ggtgagaaatgctgttatccacctttag

SEQ ID NO: 19155 - DNA, 23 bp, synthetic construct
  misc_feature 1..23: note = Synthetic Construct
  source 1..23: mol_type = other DNA
gcgcagatcaccttgttctccat

SEQ ID NO: 19156 - DNA, 22 bp, synthetic construct
  misc_feature 1..22: note = Synthetic Construct
  source 1..22: mol_type = other DNA
ggaaggggctgtccttcttcta

SEQ ID NO: 19157 - DNA, 22 bp, synthetic construct
  misc_feature 1..22: note = Synthetic Construct
  source 1..22: mol_type = other DNA
ccacaccaaacgggtgtgaaac

SEQ ID NO: 19158 - DNA, 25 bp, synthetic construct
  misc_feature 1..25: note = Synthetic Construct
  source 1..25: mol_type = other DNA
tggatcgtgatatggcgtttttaag

SEQ ID NO: 19159 - DNA, 26 bp, synthetic construct
  misc_feature 1..26: note = Synthetic Construct
  source 1..26: mol_type = other DNA
gggttttggcttaaagcagtctgagt

SEQ ID NO: 19160 - DNA, 24 bp, synthetic construct
  misc_feature 1..24: note = Synthetic Construct
  source 1..24: mol_type = other DNA
gggaagaggacaaagtgggactgt

SEQ ID NO: 19161 - DNA, 22 bp, synthetic construct
  misc_feature 1..22: note = Synthetic Construct
  source 1..22: mol_type = other DNA
cctcccaatccctgacctgtaa

SEQ ID NO: 19162 - DNA, 21 bp, synthetic construct
  misc_feature 1..21: note = Synthetic Construct
  source 1..21: mol_type = other DNA
acacctccatctcggccacaa

SEQ ID NO: 19163 - DNA, 26 bp, synthetic construct
  misc_feature 1..26: note = Synthetic Construct
  source 1..26: mol_type = other DNA
ggagttttacccactccacctgattc

SEQ ID NO: 19164 - DNA, 24 bp, synthetic construct
  misc_feature 1..24: note = Synthetic Construct
  source 1..24: mol_type = other DNA
ggcagcatgtgtgtgtttccatct

SEQ ID NO: 19165 - DNA, 23 bp, synthetic construct
  misc_feature 1..23: note = Synthetic Construct
  source 1..23: mol_type = other DNA
cctgaatgccaactggagggaat

SEQ ID NO: 19166 - DNA, 23 bp, synthetic construct
  misc_feature 1..23: note = Synthetic Construct
  source 1..23: mol_type = other DNA
tctccatttctgacgggacattt

SEQ ID NO: 19167 - DNA, 23 bp, synthetic construct
  misc_feature 1..23: note = Synthetic Construct
  source 1..23: mol_type = other DNA
ccaggacccagacataggtggat

SEQ ID NO: 19168 - DNA, 22 bp, synthetic construct
  misc_feature 1..22: note = Synthetic Construct
  source 1..22: mol_type = other DNA
gctcagacacactcctggaaca

SEQ ID NO: 19169 - DNA, 26 bp, synthetic construct
  misc_feature 1..26: note = Synthetic Construct
  source 1..26: mol_type = other DNA
cagtttcacctctgagcattgatttc

SEQ ID NO: 19170 - DNA, 29 bp, synthetic construct
  misc_feature 1..29: note = Synthetic Construct
  source 1..29: mol_type = other DNA
ggtttctacagttgcctgttatagagaag

SEQ ID NO: 19171 - DNA, 23 bp, synthetic construct
  misc_feature 1..23: note = Synthetic Construct
  source 1..23: mol_type = other DNA
aggacaaccagagaggaacaatg

SEQ ID NO: 19172 - DNA, 22 bp, synthetic construct
  misc_feature 1..22: note = Synthetic Construct
  source 1..22: mol_type = other DNA
gagaggccactttcagccacta

SEQ ID NO: 19173 - DNA, 25 bp, synthetic construct
  misc_feature 1..25: note = Synthetic Construct
  source 1..25: mol_type = other DNA
ggtagctgggagaaaagaaggttag

SEQ ID NO: 19174 - DNA, 26 bp, synthetic construct
  misc_feature 1..26: note = Synthetic Construct
  source 1..26: mol_type = other DNA
gggatgaagatcgaaaataggaccaa

SEQ ID NO: 19175 - DNA, 21 bp, synthetic construct
  misc_feature 1..21: note = Synthetic Construct
  source 1..21: mol_type = other DNA
gccaacgggaaacacattgaa

SEQ ID NO: 19176 - DNA, 25 bp, synthetic construct
  misc_feature 1..25: note = Synthetic Construct
  source 1..25: mol_type = other DNA
gtgacttcctcacactcctggattc

SEQ ID NO: 19177 - DNA, 21 bp, synthetic construct
  misc_feature 1..21: note = Synthetic Construct
  source 1..21: mol_type = other DNA
gtggagccaaaccaagccaat

SEQ ID NO: 19178 - DNA, 22 bp, synthetic construct
  misc_feature 1..22: note = Synthetic Construct
  source 1..22: mol_type = other DNA
caggctcagttgaggtgaggtt

SEQ ID NO: 19179 - DNA, 22 bp, synthetic construct
  misc_feature 1..22: note = Synthetic Construct
  source 1..22: mol_type = other DNA
gcaaaatggccaggtacgatgt

SEQ ID NO: 19180 - DNA, 25 bp, synthetic construct
  misc_feature 1..25: note = Synthetic Construct
  source 1..25: mol_type = other DNA
gtttccagtctctgctcattaggaa

SEQ ID NO: 19181 - DNA, 22 bp, synthetic construct
  misc_feature 1..22: note = Synthetic Construct
  source 1..22: mol_type = other DNA
agatgggctcttcctgctcatc

SEQ ID NO: 19182 - DNA, 29 bp, synthetic construct
  misc_feature 1..29: note = Synthetic Construct
  source 1..29: mol_type = other DNA
ccagccttgattctttggaatcctgttac

SEQ ID NO: 19183 - DNA, 22 bp, synthetic construct
  misc_feature 1..22: note = Synthetic Construct
  source 1..22: mol_type = other DNA
tccatcccctggcctcaaatct

SEQ ID NO: 19184 - DNA, 27 bp, synthetic construct
  misc_feature 1..27: note = Synthetic Construct
  source 1..27: mol_type = other DNA
gtgtgccagtgtacttcattcatctgt

SEQ ID NO: 19185 - DNA, 23 bp, synthetic construct
  misc_feature 1..23: note = Synthetic Construct
  source 1..23: mol_type = other DNA
ccttgcgagtgacttcagtgttg

SEQ ID NO: 19186 - DNA, 22 bp, synthetic construct
  misc_feature 1..22: note = Synthetic Construct
  source 1..22: mol_type = other DNA
acgtcctggaagtcagtgtaac

SEQ ID NO: 19187 - DNA, 24 bp, synthetic construct
  misc_feature 1..24: note = Synthetic Construct
  source 1..24: mol_type = other DNA
gaccacccaaaaagagaactgttg

SEQ ID NO: 19188 - DNA, 29 bp, synthetic construct
  misc_feature 1..29: note = Synthetic Construct
  source 1..29: mol_type = other DNA
gggaaccaaaacaagcactaaagtgtgat

SEQ ID NO: 19189 - DNA, 21 bp, synthetic construct
  misc_feature 1..21: note = Synthetic Construct
  source 1..21: mol_type = other DNA
ggggatcttgcactcacttgt

SEQ ID NO: 19190 - DNA, 27 bp, synthetic construct
  misc_feature 1..27: note = Synthetic Construct
  source 1..27: mol_type = other DNA
gtcctgtagcatcagacctttaagaca

SEQ ID NO: 19191 - DNA, 26 bp, synthetic construct
  misc_feature 1..26: note = Synthetic Construct
  source 1..26: mol_type = other DNA
ccctgcatctttcaaaggcatctttc

SEQ ID NO: 19192 - DNA, 23 bp, synthetic construct
  misc_feature 1..23: note = Synthetic Construct
  source 1..23: mol_type = other DNA
ccagttcaagggcaaaggctact

SEQ ID NO: 19193 - DNA, 27 bp, synthetic construct
  misc_feature 1..27: note = Synthetic Construct
  source 1..27: mol_type = other DNA
gtgactcctaatgaaggcagactccta

SEQ ID NO: 19194 - DNA, 22 bp, synthetic construct
  misc_feature 1..22: note = Synthetic Construct
  source 1..22: mol_type = other DNA
gtgggctttgcagtcaggacat

SEQ ID NO: 19195 - DNA, 27 bp, synthetic construct
  misc_feature 1..27: note = Synthetic Construct
  source 1..27: mol_type = other DNA
gaagaggggattgaatagtcaggttac

SEQ ID NO: 19196 - DNA, 24 bp, synthetic construct
  misc_feature 1..24: note = Synthetic Construct
  source 1..24: mol_type = other DNA
tgcctctagaatggcactgtttag

SEQ ID NO: 19197 - DNA, 25 bp, synthetic construct
  misc_feature 1..25: note = Synthetic Construct
  source 1..25: mol_type = other DNA
gtgtcaggggtagtgagtttggttt

SEQ ID NO: 19198 - DNA, 22 bp, synthetic construct
  misc_feature 1..22: note = Synthetic Construct
  source 1..22: mol_type = other DNA
tcctgtggacatacccagttga

SEQ ID NO: 19199 - DNA, 24 bp, synthetic construct
  misc_feature 1..24: note = Synthetic Construct
  source 1..24: mol_type = other DNA
gccagcagatgagtcatggagtat

SEQ ID NO: 19200 - DNA, 25 bp, synthetic construct
  misc_feature 1..25: note = Synthetic Construct
  source 1..25: mol_type = other DNA
gtgggatgccaagaacttgactttg

SEQ ID NO: 19201 - DNA, 25 bp, synthetic construct
  misc_feature 1..25: note = Synthetic Construct
  source 1..25: mol_type = other DNA
gagcaatgagagagcaatgcgttat

SEQ ID NO: 19202 - DNA, 24 bp, synthetic construct
  misc_feature 1..24: note = Synthetic Construct
  source 1..24: mol_type = other DNA
gccacagggaatctgtgtttgaag

SEQ ID NO: 19203 - DNA, 23 bp, synthetic construct
  misc_feature 1..23: note = Synthetic Construct
  source 1..23: mol_type = other DNA
cgtgctgacttaggcagattttg

SEQ ID NO: 19204 - DNA, 22 bp, synthetic construct
  misc_feature 1..22: note = Synthetic Construct
  source 1..22: mol_type = other DNA
gccaacaaaagtcctcgctttg

SEQ ID NO: 19205 - DNA, 22 bp, synthetic construct
  misc_feature 1..22: note = Synthetic Construct
  source 1..22: mol_type = other DNA
ccaggaaaagaggtgactgcat

SEQ ID NO: 19206 - DNA, 24 bp, synthetic construct
  misc_feature 1..24: note = Synthetic Construct
  source 1..24: mol_type = other DNA
ctcagcatgttctaagggcagaga

SEQ ID NO: 19207 - DNA, 21 bp, synthetic construct
  misc_feature 1..21: note = Synthetic Construct
  source 1..21: mol_type = other DNA
gtcctctgcccatgagtgaac

SEQ ID NO: 19208 - DNA, 21 bp, synthetic construct
  misc_feature 1..21: note = Synthetic Construct
  source 1..21: mol_type = other DNA
ccctggaaatgcatccacgat

SEQ ID NO: 19209 - DNA, 27 bp, synthetic construct
  misc_feature 1..27: note = Synthetic Construct
  source 1..27: mol_type = other DNA
ggcttgagtgaaatggtagtactcaaa

SEQ ID NO: 19210 - DNA, 24 bp, synthetic construct
  misc_feature 1..24: note = Synthetic Construct
  source 1..24: mol_type = other DNA
gcctagtgtaggcaaaggaagtct

SEQ ID NO: 19211 - DNA, 22 bp, synthetic construct
  misc_feature 1..22: note = Synthetic Construct
  source 1..22: mol_type = other DNA
tgggccctgtagagtgcatttc

SEQ ID NO: 19212 - DNA, 20 bp, synthetic construct
  misc_feature 1..20: note = Synthetic Construct
  source 1..20: mol_type = other DNA
gtgtcctgggtgtgtgttca

SEQ ID NO: 19213 - DNA, 24 bp, synthetic construct
  misc_feature 1..24: note = Synthetic Construct
  source 1..24: mol_type = other DNA
ctcctacttgggtggaggaagtct

SEQ ID NO: 19214 - DNA, 27 bp, synthetic construct
  misc_feature 1..27: note = Synthetic Construct
  source 1..27: mol_type = other DNA
gtagcagtacagatgagtgacatagat

SEQ ID NO: 19215 - DNA, 29 bp, synthetic construct
  misc_feature 1..29: note = Synthetic Construct
  source 1..29: mol_type = other DNA
gggtttcctgcaaaaatggagagcttttt

SEQ ID NO: 19216 - DNA, 24 bp, synthetic construct
  misc_feature 1..24: note = Synthetic Construct
  source 1..24: mol_type = other DNA
caaaccaagcacttctccaaaact

SEQ ID NO: 19217 - DNA, 24 bp, synthetic construct
  misc_feature 1..24: note = Synthetic Construct
  source 1..24: mol_type = other DNA
gcccctctttctctgcatctggta

SEQ ID NO: 19218 - DNA, 23 bp, synthetic construct
  misc_feature 1..23: note = Synthetic Construct
  source 1..23: mol_type = other DNA
cctttcagccacacctgtctttg

SEQ ID NO: 19219 - DNA, 24 bp, synthetic construct
  misc_feature 1..24: note = Synthetic Construct
  source 1..24: mol_type = other DNA
ggagactgtatccaggcagtgtgt

SEQ ID NO: 19220 - DNA, 20 bp, synthetic construct
  misc_feature 1..20: note = Synthetic Construct
  source 1..20: mol_type = other DNA
gcccctctcttgctggcatt

SEQ ID NO: 19221 - DNA, 20 bp, synthetic construct
  misc_feature 1..20: note = Synthetic Construct
  source 1..20: mol_type = other DNA
gcagccctttttgcgaggat

SEQ ID NO: 19222 - DNA, 24 bp, synthetic construct
  misc_feature 1..24: note = Synthetic Construct
  source 1..24: mol_type = other DNA
gagctttgggaaaggggaaagaga

SEQ ID NO: 19223 - DNA, 22 bp, synthetic construct
  misc_feature 1..22: note = Synthetic Construct
  source 1..22: mol_type = other DNA
tggcctcgggttttagatgaac

SEQ ID NO: 19224 - DNA, 24 bp, synthetic construct
  misc_feature 1..24: note = Synthetic Construct
  source 1..24: mol_type = other DNA
gcaccttacagtgccaactgtttc

SEQ ID NO: 19225 - DNA, 28 bp, synthetic construct
  misc_feature 1..28: note = Synthetic Construct
  source 1..28: mol_type = other DNA
ccacttctctgtgaccatttgtttggta

SEQ ID NO: 19226 - DNA, 21 bp, synthetic construct
  misc_feature 1..21: note = Synthetic Construct
  source 1..21: mol_type = other DNA
tgggcaggtcacaccctgaat

SEQ ID NO: 19227 - DNA, 20 bp, synthetic construct
  misc_feature 1..20: note = Synthetic Construct
  source 1..20: mol_type = other DNA
cacttgtccacgctgcgttt

SEQ ID NO: 19228 - DNA, 24 bp, synthetic construct
  misc_feature 1..24: note = Synthetic Construct
  source 1..24: mol_type = other DNA
ccatcttcagctcttgctttgctt

SEQ ID NO: 19229 - DNA, 25 bp, synthetic construct
  misc_feature 1..25: note = Synthetic Construct
  source 1..25: mol_type = other DNA
ggggtctccttagtatcatcccttt

SEQ ID NO: 19230 - DNA, 23 bp, synthetic construct
  misc_feature 1..23: note = Synthetic Construct
  source 1..23: mol_type = other DNA
ccttcctggatgtgccttgaagt

SEQ ID NO: 19231 - DNA, 20 bp, synthetic construct
  misc_feature 1..20: note = Synthetic Construct
  source 1..20: mol_type = other DNA
ccgggtcacaccaaccatct

SEQ ID NO: 19232 - DNA, 24 bp, synthetic construct
  misc_feature 1..24: note = Synthetic Construct
  source 1..24: mol_type = other DNA
gggtcccactgttaccaactcttg

SEQ ID NO: 19233 - DNA, 24 bp, synthetic construct
  misc_feature 1..24: note = Synthetic Construct
  source 1..24: mol_type = other DNA
gtgtggagtcaaacactcctggtt

SEQ ID NO: 19234 - DNA, 29 bp, synthetic construct
  misc_feature 1..29: note = Synthetic Construct
  source 1..29: mol_type = other DNA
ggatgaaaagaaacccagacagagacttt

SEQ ID NO: 19235 - DNA, 22 bp, synthetic construct
  misc_feature 1..22: note = Synthetic Construct
  source 1..22: mol_type = other DNA
tggggttgtctcagtggtgcta

SEQ ID NO: 19236 - DNA, 25 bp, synthetic construct
  misc_feature 1..25: note = Synthetic Construct
  source 1..25: mol_type = other DNA
ggggtctgctgtagaattcctgttg

SEQ ID NO: 19237 - DNA, 26 bp, synthetic construct
  misc_feature 1..26: note = Synthetic Construct
  source 1..26: mol_type = other DNA
gtttctggaagacaaatcggcattac

SEQ ID NO: 19238 - DNA, 29 bp, synthetic construct
  misc_feature 1..29: note = Synthetic Construct
  source 1..29: mol_type = other DNA
ccctgcatcatattctgtgaaacactttg

SEQ ID NO: 19239 - DNA, 22 bp, synthetic construct
  misc_feature 1..22: note = Synthetic Construct
  source 1..22: mol_type = other DNA
gggcaggcaatttcccctaaga

SEQ ID NO: 19240 - DNA, 22 bp, synthetic construct
  misc_feature 1..22: note = Synthetic Construct
  source 1..22: mol_type = other DNA
ctctctgataaggccccggttt

SEQ ID NO: 19241 - DNA, 24 bp, synthetic construct
  misc_feature 1..24: note = Synthetic Construct
  source 1..24: mol_type = other DNA
ccaccaaggaccctatgagcagtt

SEQ ID NO: 19242 - DNA, 21 bp, synthetic construct
  misc_feature 1..21: note = Synthetic Construct
  source 1..21: mol_type = other DNA
tcccatccagagtccgaccat

SEQ ID NO: 19243 - DNA, 22 bp, synthetic construct
  misc_feature 1..22: note = Synthetic Construct
  source 1..22: mol_type = other DNA
gaaccagcagatttggggctat

SEQ ID NO: 19244 - DNA, 22 bp, synthetic construct
  misc_feature 1..22: note = Synthetic Construct
  source 1..22: mol_type = other DNA
gggcccgctttttaacactttg

SEQ ID NO: 19245 - DNA, 26 bp, synthetic construct
  misc_feature 1..26: note = Synthetic Construct
  source 1..26: mol_type = other DNA
gagagtagttgtggatacccgagaaa

SEQ ID NO: 19246 - DNA, 24 bp, synthetic construct
  misc_feature 1..24: note = Synthetic Construct
  source 1..24: mol_type = other DNA
tgctcaaaaccagtagcactttca

SEQ ID NO: 19247 - DNA, 24 bp, synthetic construct
  misc_feature 1..24: note = Synthetic Construct
  source 1..24: mol_type = other DNA
ccaacctagacttccagcgttaag

SEQ ID NO: 19248 - DNA, 22 bp, synthetic construct
  misc_feature 1..22: note = Synthetic Construct
  source 1..22: mol_type = other DNA
gcaaagggccccagttttgctt

SEQ ID NO: 19249 - DNA, 27 bp, synthetic construct
  misc_feature 1..27: note = Synthetic Construct
  source 1..27: mol_type = other DNA
gccttgcagagaaacacatttttggat

SEQ ID NO: 19250 - DNA, 26 bp, synthetic construct
  misc_feature 1..26: note = Synthetic Construct
  source 1..26: mol_type = other DNA
ggggagtatcattttcccagctccaa

SEQ ID NO: 19251 - DNA, 21 bp, synthetic construct
  misc_feature 1..21: note = Synthetic Construct
  source 1..21: mol_type = other DNA
gtgtgtccgttgtgtgcaact

SEQ ID NO: 19252 - DNA, 18 bp, synthetic construct
  misc_feature 1..18: note = Synthetic Construct
  source 1..18: mol_type = other DNA
agcggtgtagccgtctga

SEQ ID NO: 19253 - DNA, 22 bp, synthetic construct
  misc_feature 1..22: note = Synthetic Construct
  source 1..22: mol_type = other DNA
cgctgaaggaccctcctcaaag

SEQ ID NO: 19254 - DNA, 20 bp, synthetic construct
  misc_feature 1..20: note = Synthetic Construct
  source 1..20: mol_type = other DNA
agagaggccctgaggacttg

SEQ ID NO: 19255 - DNA, 25 bp, synthetic construct
  misc_feature 1..25: note = Synthetic Construct
  source 1..25: mol_type = other DNA
tgtaactaaagtgtaggctgcgtat

SEQ ID NO: 19256 - DNA, 23 bp, synthetic construct
  misc_feature 1..23: note = Synthetic Construct
  source 1..23: mol_type = other DNA
gaccaacgatgtgttgtgctctt

SEQ ID NO: 19257 - DNA, 22 bp, synthetic construct
  misc_feature 1..22: note = Synthetic Construct
  source 1..22: mol_type = other DNA
ggtgtccatgcgggctttagta

SEQ ID NO: 19258 - DNA, 24 bp, synthetic construct
  misc_feature 1..24: note = Synthetic Construct
  source 1..24: mol_type = other DNA
ctcggggatttgggaaatcactct

SEQ ID NO: 19259 - DNA, 22 bp, synthetic construct
  misc_feature 1..22: note = Synthetic Construct
  source 1..22: mol_type = other DNA
cacgatgggagaggtcatcttg

SEQ ID NO: 19260 - DNA, 21 bp, synthetic construct
  misc_feature 1..21: note = Synthetic Construct
  source 1..21: mol_type = other DNA
gcctttggcgacatcgtcttc

SEQ ID NO: 19261 - DNA, 28 bp, synthetic construct
  misc_feature 1..28: note = Synthetic Construct
  source 1..28: mol_type = other DNA
gcaagaccccatgaaaatcaatggaaca

SEQ ID NO: 19262 - DNA, 24 bp, synthetic construct
  misc_feature 1..24: note = Synthetic Construct
  source 1..24: mol_type = other DNA
gcagctgcaccatttacagcctaa

SEQ ID NO: 19263 - DNA, 19 bp, synthetic construct
  misc_feature 1..19: note = Synthetic Construct
  source 1..19: mol_type = other DNA
tggccaggcagctctgtca

SEQ ID NO: 19264 - DNA, 25 bp, synthetic construct
  misc_feature 1..25: note = Synthetic Construct
  source 1..25: mol_type = other DNA
ccaaactcattgtttctcctggttt

SEQ ID NO: 19265 - DNA, 26 bp, synthetic construct
  misc_feature 1..26: note = Synthetic Construct
  source 1..26: mol_type = other DNA
gctgtggaaaggtcatctgagacatc

SEQ ID NO: 19266 - DNA, 21 bp, synthetic construct
  misc_feature 1..21: note = Synthetic Construct
  source 1..21: mol_type = other DNA
tcacatccactggccgcattc

SEQ ID NO: 19267 - DNA, 23 bp, synthetic construct
  misc_feature 1..23: note = Synthetic Construct
  source 1..23: mol_type = other DNA
tggccctgctgaaactttagaac

SEQ ID NO: 19268 - DNA, 21 bp, synthetic construct
  misc_feature 1..21: note = Synthetic Construct
  source 1..21: mol_type = other DNA
cgtccacttccaggaccagaa

SEQ ID NO: 19269 - DNA, 20 bp, synthetic construct
  misc_feature 1..20: note = Synthetic Construct
  source 1..20: mol_type = other DNA
aggtagtcggtgagcaggaa

SEQ ID NO: 19270 - DNA, 26 bp, synthetic construct
  misc_feature 1..26: note = Synthetic Construct
  source 1..26: mol_type = other DNA
ggaagtttcccttgtgtgaaagtcaa

SEQ ID NO: 19271 - DNA, 22 bp, synthetic construct
  misc_feature 1..22: note = Synthetic Construct
  source 1..22: mol_type = other DNA
ggttggcttgtcaccctagaga

SEQ ID NO: 19272 - DNA, 25 bp, synthetic construct
  misc_feature 1..25: note = Synthetic Construct
  source 1..25: mol_type = other DNA
gtgatgcttttgggaattcacttct

SEQ ID NO: 19273 - DNA, 22 bp, synthetic construct
  misc_feature 1..22: note = Synthetic Construct
  source 1..22: mol_type = other DNA
ccgaattttccgaggaccaagt

SEQ ID NO: 19274 - DNA, 23 bp, synthetic construct
  misc_feature 1..23: note = Synthetic Construct
  source 1..23: mol_type = other DNA
gctctgctagatgctgaggatga

SEQ ID NO: 19275 - DNA, 25 bp, synthetic construct
  misc_feature 1..25: note = Synthetic Construct
  source 1..25: mol_type = other DNA
ctgggaagaggtggataaatgttca

SEQ ID NO: 19276 - DNA, 24 bp, synthetic construct
  misc_feature 1..24: note = Synthetic Construct
  source 1..24: mol_type = other DNA
agggagggaatgtgaagagaaagt

SEQ ID NO: 19277 - DNA, 24 bp, synthetic construct
  misc_feature 1..24: note = Synthetic Construct
  source 1..24: mol_type = other DNA
gcttcccagtgcttaggaccacat

SEQ ID NO: 19278 - DNA, 24 bp, synthetic construct
  misc_feature 1..24: note = Synthetic Construct
  source 1..24: mol_type = other DNA
gaggctttgactggatgatgttca

SEQ ID NO: 19279 - DNA, 22 bp, synthetic construct
  misc_feature 1..22: note = Synthetic Construct
  source 1..22: mol_type = other DNA
gcccatgtcaaccccatccaaa

SEQ ID NO: 19280 - DNA, 24 bp, synthetic construct
  misc_feature 1..24: note = Synthetic Construct
  source 1..24: mol_type = other DNA
gttggatcctttctagctccaaga

SEQ ID NO: 19281 - DNA, 24 bp, synthetic construct
  misc_feature 1..24: note = Synthetic Construct
  source 1..24: mol_type = other DNA
gcctcagaccctatttgacacaag

SEQ ID NO: 19282 - DNA, 22 bp, synthetic construct
  misc_feature 1..22: note = Synthetic Construct
  source 1..22: mol_type = other DNA
agaggggtattgccctgtctaa

SEQ ID NO: 19283 - DNA, 22 bp, synthetic construct
  misc_feature 1..22: note = Synthetic Construct
  source 1..22: mol_type = other DNA
cgaactctccatccctgcttct

SEQ ID NO: 19284 - DNA, 26 bp, synthetic construct
  misc_feature 1..26: note = Synthetic Construct
  source 1..26: mol_type = other DNA
gtgggctagtttatccttccaaaatc

SEQ ID NO: 19285 - DNA, 22 bp, synthetic construct
  misc_feature 1..22: note = Synthetic Construct
  source 1..22: mol_type = other DNA
gcgctggagtatggtggtgtaa

SEQ ID NO: 19286 - DNA, 22 bp, synthetic construct
  misc_feature 1..22: note = Synthetic Construct
  source 1..22: mol_type = other DNA
gtgccgactgtttttgctcaca

SEQ ID NO: 19287 - DNA, 22 bp, synthetic construct
  misc_feature 1..22: note = Synthetic Construct
  source 1..22: mol_type = other DNA
cactggaggttggtggaagcaa

SEQ ID NO: 19288 - DNA, 23 bp, synthetic construct
  misc_feature 1..23: note = Synthetic Construct
  source 1..23: mol_type = other DNA
gccacagttggctctatctgcta

SEQ ID NO: 19289 - DNA, 25 bp, synthetic construct
  misc_feature 1..25: note = Synthetic Construct
  source 1..25: mol_type = other DNA
gactcccaattagcgctctttttca

SEQ ID NO: 19290 - DNA, 24 bp, synthetic construct
  misc_feature 1..24: note = Synthetic Construct
  source 1..24: mol_type = other DNA
gacttttcacccacacatgggatt

SEQ ID NO: 19291 - DNA, 23 bp, synthetic construct
  misc_feature 1..23: note = Synthetic Construct
  source 1..23: mol_type = other DNA
gcatgggcatcattagtcacaca

SEQ ID NO: 19292 - DNA, 22 bp, synthetic construct
  misc_feature 1..22: note = Synthetic Construct
  source 1..22: mol_type = other DNA
ccctgcagaaccacttccgtta

SEQ ID NO: 19293 - DNA, 22 bp, synthetic construct
  misc_feature 1..22: note = Synthetic Construct
  source 1..22: mol_type = other DNA
gccacctgagaccatgcttcta

SEQ ID NO: 19294 - DNA, 22 bp, synthetic construct
  misc_feature 1..22: note = Synthetic Construct
  source 1..22: mol_type = other DNA
ggcttatcctggcaccgattct

SEQ ID NO: 19295 - DNA, 23 bp, synthetic construct
  misc_feature 1..23: note = Synthetic Construct
  source 1..23: mol_type = other DNA
gggagacaaactcattggagtca

SEQ ID NO: 19296 - DNA, 24 bp, synthetic construct
  misc_feature 1..24: note = Synthetic Construct
  source 1..24: mol_type = other DNA
ggaaagcacattgtccagatggtt

SEQ ID NO: 19297 - DNA, 20 bp, synthetic construct
  misc_feature 1..20: note = Synthetic Construct
  source 1..20: mol_type = other DNA
ggcccacacatgcatgaaga

SEQ ID NO: 19298 - DNA, 26 bp, synthetic construct
  misc_feature 1..26: note = Synthetic Construct
  source 1..26: mol_type = other DNA
ggcttgatctgctgttactggagaag

SEQ ID NO: 19299 - DNA, 25 bp, synthetic construct
  misc_feature 1..25: note = Synthetic Construct
  source 1..25: mol_type = other DNA
cccaaagctccctcattaccttctt

SEQ ID NO: 19300 - DNA, 22 bp, synthetic construct
  misc_feature 1..22: note = Synthetic Construct
  source 1..22: mol_type = other DNA
ccagtggggcattactgggtta

SEQ ID NO: 19301 - DNA, 24 bp, synthetic construct
  misc_feature 1..24: note = Synthetic Construct
  source 1..24: mol_type = other DNA
ggaggcctttcagggatcttgcta

SEQ ID NO: 19302 - DNA, 22 bp, synthetic construct
  misc_feature 1..22: note = Synthetic Construct
  source 1..22: mol_type = other DNA
ggtgtgtgaggctaatccttga

SEQ ID NO: 19303 - DNA, 23 bp, synthetic construct
  misc_feature 1..23: note = Synthetic Construct
  source 1..23: mol_type = other DNA
cctccagagaagtcggcaatgtt

SEQ ID NO: 19304 - DNA, 22 bp, synthetic construct
  misc_feature 1..22: note = Synthetic Construct
  source 1..22: mol_type = other DNA
gagcgaaagtgcgaggtcatag

SEQ ID NO: 19305 - DNA, 22 bp, synthetic construct
  misc_feature 1..22: note = Synthetic Construct
  source 1..22: mol_type = other DNA
acagtgaaccagccccatcttc

SEQ ID NO: 19306 - DNA, 26 bp, synthetic construct
  misc_feature 1..26: note = Synthetic Construct
  source 1..26: mol_type = other DNA
gaccagcttccttatgacttttggtt

SEQ ID NO: 19307 - DNA, 25 bp, synthetic construct
  misc_feature 1..25: note = Synthetic Construct
  source 1..25: mol_type = other DNA
cccatacacgtcactgtctctcaca

SEQ ID NO: 19308 - DNA, 22 bp, synthetic construct
  misc_feature 1..22: note = Synthetic Construct
  source 1..22: mol_type = other DNA
caagaaccccaggtcagagaac

SEQ ID NO: 19309 - DNA, 24 bp, synthetic construct
  misc_feature 1..24: note = Synthetic Construct
  source 1..24: mol_type = other DNA
gtggtagcagcaaagactgtaatc

SEQ ID NO: 19310 - DNA, 23 bp, synthetic construct
  misc_feature 1..23: note = Synthetic Construct
  source 1..23: mol_type = other DNA
gcacacacaaggacttgctcaca

SEQ ID NO: 19311 - DNA, 22 bp, synthetic construct
  misc_feature 1..22: note = Synthetic Construct
  source 1..22: mol_type = other DNA
gcgaacaggcaggaaagactca

SEQ ID NO: 19312 - DNA, 26 bp, synthetic construct
  misc_feature 1..26: note = Synthetic Construct
  source 1..26: mol_type = other DNA
gttacatgagtagaagggttgggtta

SEQ ID NO: 19313 - DNA, 23 bp, synthetic construct
  misc_feature 1..23: note = Synthetic Construct
  source 1..23: mol_type = other DNA
gtacagcccagcaattctacctt

SEQ ID NO: 19314 - DNA, 29 bp, synthetic construct
  misc_feature 1..29: note = Synthetic Construct
  source 1..29: mol_type = other DNA
ggtgtcatctctgtggcaatattgtgatg

SEQ ID NO: 19315 - DNA, 22 bp, synthetic construct
  misc_feature 1..22: note = Synthetic Construct
  source 1..22: mol_type = other DNA
gctgccgggaaaaccatgtaga

SEQ ID NO: 19316 - DNA, 24 bp, synthetic construct
  misc_feature 1..24: note = Synthetic Construct
  source 1..24: mol_type = other DNA
cggcagtgatctcaatgacaggat

SEQ ID NO: 19317 - DNA, 21 bp, synthetic construct
  misc_feature 1..21: note = Synthetic Construct
  source 1..21: mol_type = other DNA
gccaaggaagctcgagggatt

SEQ ID NO: 19318 - DNA, 23 bp, synthetic construct
  misc_feature 1..23: note = Synthetic Construct
  source 1..23: mol_type = other DNA
ctctccctgctatgtccctgaac

SEQ ID NO: 19319 - DNA, 26 bp, synthetic construct
  misc_feature 1..26: note = Synthetic Construct
  source 1..26: mol_type = other DNA
gacttcaaacaatgaagaggggacta

SEQ ID NO: 19320 - DNA, 27 bp, synthetic construct
  misc_feature 1..27: note = Synthetic Construct
  source 1..27: mol_type = other DNA
ggtgttgtacgtgggaaatttgggata

SEQ ID NO: 19321 - DNA, 29 bp, synthetic construct
  misc_feature 1..29: note = Synthetic Construct
  source 1..29: mol_type = other DNA
ggagagatgagaagggaacagatgatttt

SEQ ID NO: 19322 - DNA, 21 bp, synthetic construct
  misc_feature 1..21: note = Synthetic Construct
  source 1..21: mol_type = other DNA
gcacatcgtttctgcgtcttg

SEQ ID NO: 19323 - DNA, 22 bp, synthetic construct
  misc_feature 1..22: note = Synthetic Construct
  source 1..22: mol_type = other DNA
tccctcctgttggtctctcctt

SEQ ID NO: 19324 - DNA, 22 bp, synthetic construct
  misc_feature 1..22: note = Synthetic Construct
  source 1..22: mol_type = other DNA
gacagcccaaatcccagagagt

SEQ ID NO: 19325 - DNA, 20 bp, synthetic construct
  misc_feature 1..20: note = Synthetic Construct
  source 1..20: mol_type = other DNA
gcaagcgggaagatggaaga

SEQ ID NO: 19326 - DNA, 24 bp, synthetic construct
  misc_feature 1..24: note = Synthetic Construct
  source 1..24: mol_type = other DNA
ccgcctcaataccaggactcttag

SEQ ID NO: 19327 - DNA, 27 bp, synthetic construct
  misc_feature 1..27: note = Synthetic Construct
  source 1..27: mol_type = other DNA
gctattgttctcacctatgttgtgttg

SEQ ID NO: 19328 - DNA, 22 bp, synthetic construct
  misc_feature 1..22: note = Synthetic Construct
  source 1..22: mol_type = other DNA
gctggctttagagctgggcata

SEQ ID NO: 19329 - DNA, 26 bp, synthetic construct
  misc_feature 1..26: note = Synthetic Construct
  source 1..26: mol_type = other DNA
ggattttcctctacagagtggtttct

SEQ ID NO: 19330 - DNA, 22 bp, synthetic construct
  misc_feature 1..22: note = Synthetic Construct
  source 1..22: mol_type = other DNA
ctgcttgtgagaaggagaccaa

SEQ ID NO: 19331 - DNA, 24 bp, synthetic construct
  misc_feature 1..24: note = Synthetic Construct
  source 1..24: mol_type = other DNA
gcttggccatgttcttggaagcta

SEQ ID NO: 19332 - DNA, 24 bp, synthetic construct
  misc_feature 1..24: note = Synthetic Construct
  source 1..24: mol_type = other DNA
ggttgcttctgcacaaatccaagt

SEQ ID NO: 19333 - DNA, 22 bp, synthetic construct
  misc_feature 1..22: note = Synthetic Construct
  source 1..22: mol_type = other DNA
cccgctctgtttgactcagtgt

SEQ ID NO: 19334 - DNA, 23 bp, synthetic construct
  misc_feature 1..23: note = Synthetic Construct
  source 1..23: mol_type = other DNA
agaggaattgcgaaaccatgact

SEQ ID NO: 19335 - DNA, 20 bp, synthetic construct
  misc_feature 1..20: note = Synthetic Construct
  source 1..20: mol_type = other DNA
tgagcgtggagatggtgatg

SEQ ID NO: 19336 - DNA, 23 bp, synthetic construct
  misc_feature 1..23: note = Synthetic Construct
  source 1..23: mol_type = other DNA
tcggaagggactttctagtctgt

SEQ ID NO: 19337 - DNA, 22 bp, synthetic construct
  misc_feature 1..22: note = Synthetic Construct
  source 1..22: mol_type = other DNA
ctcccagcaccttctgacaaac

SEQ ID NO: 19338 - DNA, 19 bp, synthetic construct
  misc_feature 1..19: note = Synthetic Construct
  source 1..19: mol_type = other DNA
tgacccgcacagcatcttg

SEQ ID NO: 19339 - DNA, 23 bp, synthetic construct
  misc_feature 1..23: note = Synthetic Construct
  source 1..23: mol_type = other DNA
ggatcctgctttccagtctgtca

SEQ ID NO: 19340 - DNA, 23 bp, synthetic construct
  misc_feature 1..23: note = Synthetic Construct
  source 1..23: mol_type = other DNA
ggagttctttgctccgtgtctgt

SEQ ID NO: 19341 - DNA, 24 bp, synthetic construct
  misc_feature 1..24: note = Synthetic Construct
  source 1..24: mol_type = other DNA
gtggtggtgttatggctaggttag

SEQ ID NO: 19342 - DNA, 26 bp, synthetic construct
  misc_feature 1..26: note = Synthetic Construct
  source 1..26: mol_type = other DNA
cttccaaaccccagattctttagtct

SEQ ID NO: 19343 - DNA, 23 bp, synthetic construct
  misc_feature 1..23: note = Synthetic Construct
  source 1..23: mol_type = other DNA
tcctgcccttagagtcagaaaga

SEQ ID NO: 19344 - DNA, 21 bp, synthetic construct
  misc_feature 1..21: note = Synthetic Construct
  source 1..21: mol_type = other DNA
cccctgattgacagccagcaa

SEQ ID NO: 19345 - DNA, 29 bp, synthetic construct
  misc_feature 1..29: note = Synthetic Construct
  source 1..29: mol_type = other DNA
gtcttctgtctacttggacctttaagtca

SEQ ID NO: 19346 - DNA, 24 bp, synthetic construct
  misc_feature 1..24: note = Synthetic Construct
  source 1..24: mol_type = other DNA
cctcaggacctttgagcagtccaa

SEQ ID NO: 19347 - DNA, 24 bp, synthetic construct
  misc_feature 1..24: note = Synthetic Construct
  source 1..24: mol_type = other DNA
ccagctgctgtttcaagagtgcat

SEQ ID NO: 19348 - DNA, 24 bp, synthetic construct
  misc_feature 1..24: note = Synthetic Construct
  source 1..24: mol_type = other DNA
cccaggtgtgtgtaacaaaagttc

SEQ ID NO: 19349 - DNA, 24 bp, synthetic construct
  misc_feature 1..24: note = Synthetic Construct
  source 1..24: mol_type = other DNA
ggagacaaacaagacagaggagat

SEQ ID NO: 19350 - DNA, 22 bp, synthetic construct
  misc_feature 1..22: note = Synthetic Construct
  source 1..22: mol_type = other DNA
ggacctgtgtgatagcaagcat

SEQ ID NO: 19351 - DNA, 24 bp, synthetic construct
  misc_feature 1..24: note = Synthetic Construct
  source 1..24: mol_type = other DNA
ggactggtctaagtgggtgtcact

SEQ ID NO: 19352 - DNA, 22 bp, synthetic construct
  misc_feature 1..22: note = Synthetic Construct
  source 1..22: mol_type = other DNA
cagagcaggacaatggctctac

SEQ ID NO: 19353 - DNA, 25 bp, synthetic construct
  misc_feature 1..25: note = Synthetic Construct
  source 1..25: mol_type = other DNA
gcttcggactgatttctgctgtgtt

SEQ ID NO: 19354 - DNA, 23 bp, synthetic construct
  misc_feature 1..23: note = Synthetic Construct
  source 1..23: mol_type = other DNA
gcagtagcgagttgactccatca

SEQ ID NO: 19355 - DNA, 25 bp, synthetic construct
  misc_feature 1..25: note = Synthetic Construct
  source 1..25: mol_type = other DNA
ccacagtgcaaggtgaatttagact

SEQ ID NO: 19356 - DNA, 21 bp, synthetic construct
  misc_feature 1..21: note = Synthetic Construct
  source 1..21: mol_type = other DNA
ggctggtcttccttgctgtaa

SEQ ID NO: 19357 - DNA, 21 bp, synthetic construct
  misc_feature 1..21: note = Synthetic Construct
  source 1..21: mol_type = other DNA
gcactggcatttccctttgtt

SEQ ID NO: 19358 - DNA, 22 bp, synthetic construct
  misc_feature 1..22: note = Synthetic Construct
  source 1..22: mol_type = other DNA
gtccagaaccactagggcatga

SEQ ID NO: 19359 - DNA, 28 bp, synthetic construct
  misc_feature 1..28: note = Synthetic Construct
  source 1..28: mol_type = other DNA
gaaggaaagaggagtatgtgtcttcatc

SEQ ID NO: 19360 - DNA, 25 bp, synthetic construct
  misc_feature 1..25: note = Synthetic Construct
  source 1..25: mol_type = other DNA
ctgcttctcttcgcttttgcatttc

SEQ ID NO: 19361 - DNA, 23 bp, synthetic construct
  misc_feature 1..23: note = Synthetic Construct
  source 1..23: mol_type = other DNA
gctccccggtcattctctcttct

SEQ ID NO: 19362 - DNA, 21 bp, synthetic construct
  misc_feature 1..21: note = Synthetic Construct
  source 1..21: mol_type = other DNA
ccggggctatgcaatgtatca

SEQ ID NO: 19363 - DNA, 23 bp, synthetic construct
  misc_feature 1..23: note = Synthetic Construct
  source 1..23: mol_type = other DNA
ctgcctcttggaacactaacagt

SEQ ID NO: 19364 - DNA, 23 bp, synthetic construct
  misc_feature 1..23: note = Synthetic Construct
  source 1..23: mol_type = other DNA
gcttcaccccgaaatcagagaca

SEQ ID NO: 19365 - DNA, 26 bp, synthetic construct
  misc_feature 1..26: note = Synthetic Construct
  source 1..26: mol_type = other DNA
gtcagactccataagtaccgtttaca

SEQ ID NO: 19366 - DNA, 23 bp, synthetic construct
  misc_feature 1..23: note = Synthetic Construct
  source 1..23: mol_type = other DNA
ccagagcatgctgacgcgtattt

SEQ ID NO: 19367 - DNA, 26 bp, synthetic construct
  misc_feature 1..26: note = Synthetic Construct
  source 1..26: mol_type = other DNA
ggtttgtggtgaattgtcaagcatgt

SEQ ID NO: 19368 - DNA, 22 bp, synthetic construct
  misc_feature 1..22: note = Synthetic Construct
  source 1..22: mol_type = other DNA
gcagcccaagatcactggagtt

SEQ ID NO: 19369 - DNA, 21 bp, synthetic construct
  misc_feature 1..21: note = Synthetic Construct
  source 1..21: mol_type = other DNA
tcagctgtggcgggtactgaa

SEQ ID NO: 19370 - DNA, 26 bp, synthetic construct
  misc_feature 1..26: note = Synthetic Construct
  source 1..26: mol_type = other DNA
cgtactaccacgtatccaactctttg

SEQ ID NO: 19371 - DNA, 23 bp, synthetic construct
  misc_feature 1..23: note = Synthetic Construct
  source 1..23: mol_type = other DNA
aacttggagtggagatgcagaaa

SEQ ID NO: 19372 - DNA, 22 bp, synthetic construct
  misc_feature 1..22: note = Synthetic Construct
  source 1..22: mol_type = other DNA
aaccaggccaagacctttcttt

SEQ ID NO: 19373 - DNA, 20 bp, synthetic construct
  misc_feature 1..20: note = Synthetic Construct
  source 1..20: mol_type = other DNA
gcttgactgccagtgtccaa

SEQ ID NO: 19374 - DNA, 22 bp, synthetic construct
  misc_feature 1..22: note = Synthetic Construct
  source 1..22: mol_type = other DNA
cgctgtccagttttccctgtgt

SEQ ID NO: 19375 - DNA, 23 bp, synthetic construct
  misc_feature 1..23: note = Synthetic Construct
  source 1..23: mol_type = other DNA
agccttgagagaggtgtgatgat

SEQ ID NO: 19376 - DNA, 22 bp, synthetic construct
  misc_feature 1..22: note = Synthetic Construct
  source 1..22: mol_type = other DNA
caggtaacatgcgttccctttg

SEQ ID NO: 19377 - DNA, 23 bp, synthetic construct
  misc_feature 1..23: note = Synthetic Construct
  source 1..23: mol_type = other DNA
caacagcgcactacaaaggctat

SEQ ID NO: 19378 - DNA, 25 bp, synthetic construct
  misc_feature 1..25: note = Synthetic Construct
  source 1..25: mol_type = other DNA
gactgcagaatacagaggacgactt

SEQ ID NO: 19379 - DNA, 25 bp, synthetic construct
  misc_feature 1..25: note = Synthetic Construct
  source 1..25: mol_type = other DNA
cttccttagaaaggtggcatcaagt

SEQ ID NO: 19380 - DNA, 23 bp, synthetic construct
  misc_feature 1..23: note = Synthetic Construct
  source 1..23: mol_type = other DNA
cattgtgggcaaaagagcaaaac

SEQ ID NO: 19381 - DNA, 27 bp, synthetic construct
  misc_feature 1..27: note = Synthetic Construct
  source 1..27: mol_type = other DNA
cctgggacaaaacctctttctctgaat

SEQ ID NO: 19382 - DNA, 23 bp, synthetic construct
  misc_feature 1..23: note = Synthetic Construct
  source 1..23: mol_type = other DNA
ggaagacagagtgttgggaggta

SEQ ID NO: 19383 - DNA, 24 bp, synthetic construct
  misc_feature 1..24: note = Synthetic Construct
  source 1..24: mol_type = other DNA
gggacaaaggtaggggtgtgatac

SEQ ID NO: 19384 - DNA, 22 bp, synthetic construct
  misc_feature 1..22: note = Synthetic Construct
  source 1..22: mol_type = other DNA
gcggaattcctcaaggcacaga

SEQ ID NO: 19385 - DNA, 25 bp, synthetic construct
  misc_feature 1..25: note = Synthetic Construct
  source 1..25: mol_type = other DNA
ccactggtttatcccactggcattt

SEQ ID NO: 19386 - DNA, 22 bp, synthetic construct
  misc_feature 1..22: note = Synthetic Construct
  source 1..22: mol_type = other DNA
gggctattggtctggcacacat

SEQ ID NO: 19387 - DNA, 22 bp, synthetic construct
  misc_feature 1..22: note = Synthetic Construct
  source 1..22: mol_type = other DNA
ggtgggtgcttccactcatcat

SEQ ID NO: 19388 - DNA, 24 bp, synthetic construct
  misc_feature 1..24: note = Synthetic Construct
  source 1..24: mol_type = other DNA
ctggctgttagactgtgatgaaga

SEQ ID NO: 19389 - DNA, 23 bp, synthetic construct
  misc_feature 1..23: note = Synthetic Construct
  source 1..23: mol_type = other DNA
gcagcttggccttagaacctttc

SEQ ID NO: 19390 - DNA, 25 bp, synthetic construct
  misc_feature 1..25: note = Synthetic Construct
  source 1..25: mol_type = other DNA
gggaaggctattttactgacccaaa

SEQ ID NO: 19391 - DNA, 24 bp, synthetic construct
  misc_feature 1..24: note = Synthetic Construct
  source 1..24: mol_type = other DNA
cacccatacttgctgggttcaaca

SEQ ID NO: 19392 - DNA, 25 bp, synthetic construct
  misc_feature 1..25: note = Synthetic Construct
  source 1..25: mol_type = other DNA
gaaaccaacctctcaatccatcaag

SEQ ID NO: 19393 - DNA, 25 bp, synthetic construct
  misc_feature 1..25: note = Synthetic Construct
  source 1..25: mol_type = other DNA
gggctcaagctgttctatgcctaac

SEQ ID NO: 19394 - DNA, 24 bp, synthetic construct
  misc_feature 1..24: note = Synthetic Construct
  source 1..24: mol_type = other DNA
gaccttacccagcagttcaagcat

SEQ ID NO: 19395 - DNA, 23 bp, synthetic construct
  misc_feature 1..23: note = Synthetic Construct
  source 1..23: mol_type = other DNA
gccataatttcagggaggacgta

SEQ ID NO: 19396 - DNA, 21 bp, synthetic construct
  misc_feature 1..21: note = Synthetic Construct
  source 1..21: mol_type = other DNA
acctggcctcaagtggtccat

SEQ ID NO: 19397 - DNA, 26 bp, synthetic construct
  misc_feature 1..26: note = Synthetic Construct
  source 1..26: mol_type = other DNA
ggtctgtcttgcttttaactggattg

SEQ ID NO: 19398 - DNA, 22 bp, synthetic construct
  misc_feature 1..22: note = Synthetic Construct
  source 1..22: mol_type = other DNA
tcctggctctgtgagcaactac

SEQ ID NO: 19399 - DNA, 22 bp, synthetic construct
  misc_feature 1..22: note = Synthetic Construct
  source 1..22: mol_type = other DNA
gggcaaagcacagtcagtcatc

SEQ ID NO: 19400 - DNA, 24 bp, synthetic construct
  misc_feature 1..24: note = Synthetic Construct
  source 1..24: mol_type = other DNA
gctgacaatgtcctgttgctgaca

SEQ ID NO: 19401 - DNA, 22 bp, synthetic construct
  misc_feature 1..22: note = Synthetic Construct
  source 1..22: mol_type = other DNA
gctgagtgtcccagaagctaag

SEQ ID NO: 19402 - DNA, 22 bp, synthetic construct
  misc_feature 1..22: note = Synthetic Construct
  source 1..22: mol_type = other DNA
gcctgactttgtatgcctggat

SEQ ID NO: 19403 - DNA, 22 bp, synthetic construct
  misc_feature 1..22: note = Synthetic Construct
  source 1..22: mol_type = other DNA
gctgcttggttcacatgcttac

SEQ ID NO: 19404 - DNA, 20 bp, synthetic construct
  misc_feature 1..20: note = Synthetic Construct
  source 1..20: mol_type = other DNA
gcagggagtctgctccttca

SEQ ID NO: 19405 - DNA, 24 bp, synthetic construct
  misc_feature 1..24: note = Synthetic Construct
  source 1..24: mol_type = other DNA
ctagcctctgtttccagctttaca

SEQ ID NO: 19406 - DNA, 21 bp, synthetic construct
  misc_feature 1..21: note = Synthetic Construct
  source 1..21: mol_type = other DNA
gggcgtcaattgcaactcttc

SEQ ID NO: 19407 - DNA, 22 bp, synthetic construct
  misc_feature 1..22: note = Synthetic Construct
  source 1..22: mol_type = other DNA
gggattggggacctgcttcaaa

SEQ ID NO: 19408 - DNA, 22 bp, synthetic construct
  misc_feature 1..22: note = Synthetic Construct
  source 1..22: mol_type = other DNA
actcccagatgcataggacact

SEQ ID NO: 19409 - DNA, 20 bp, synthetic construct
  misc_feature 1..20: note = Synthetic Construct
  source 1..20: mol_type = other DNA
aaggtttggggacggtctca

SEQ ID NO: 19410 - DNA, 24 bp, synthetic construct
  misc_feature 1..24: note = Synthetic Construct
  source 1..24: mol_type = other DNA
cactgcaacagtcacagtctaaca

SEQ ID NO: 19411 - DNA, 26 bp, synthetic construct
  misc_feature 1..26: note = Synthetic Construct
  source 1..26: mol_type = other DNA
catccacagtccaggaataggatttt

SEQ ID NO: 19412 - DNA, 26 bp, synthetic construct
  misc_feature 1..26: note = Synthetic Construct
  source 1..26: mol_type = other DNA
gctttgttctaggacattggctgttc

SEQ ID NO: 19413 - DNA, 25 bp, synthetic construct
  misc_feature 1..25: note = Synthetic Construct
  source 1..25: mol_type = other DNA
gagccagtgttaaaatggcatgaga

SEQ ID NO: 19414 - DNA, 22 bp, synthetic construct
  misc_feature 1..22: note = Synthetic Construct
  source 1..22: mol_type = other DNA
ggcaccaaaattccaacagcaa

SEQ ID NO: 19415 - DNA, 22 bp, synthetic construct
  misc_feature 1..22: note = Synthetic Construct
  source 1..22: mol_type = other DNA
catgaacttggggcttgtgtca

SEQ ID NO: 19416 - DNA, 24 bp, synthetic construct
  misc_feature 1..24: note = Synthetic Construct
  source 1..24: mol_type = other DNA
ctttgggcaaaacacacagacaag

SEQ ID NO: 19417 - DNA, 20 bp, synthetic construct
  misc_feature 1..20: note = Synthetic Construct
  source 1..20: mol_type = other DNA
cccatctccagccccacaaa

SEQ ID NO: 19418 - DNA, 23 bp, synthetic construct
  misc_feature 1..23: note = Synthetic Construct
  source 1..23: mol_type = other DNA
tgcagccaagtaactgactcttc

SEQ ID NO: 19419 - DNA, 25 bp, synthetic construct
  misc_feature 1..25: note = Synthetic Construct
  source 1..25: mol_type = other DNA
gcagacctcttacatgaagtgaatg

SEQ ID NO: 19420 - DNA, 21 bp, synthetic construct
  misc_feature 1..21: note = Synthetic Construct
  source 1..21: mol_type = other DNA
ctgtctcaggcaaagctggat

SEQ ID NO: 19421 - DNA, 26 bp, synthetic construct
  misc_feature 1..26: note = Synthetic Construct
  source 1..26: mol_type = other DNA
ggcaagaatcagatagcacccacaaa

SEQ ID NO: 19422 - DNA, 25 bp, synthetic construct
  misc_feature 1..25: note = Synthetic Construct
  source 1..25: mol_type = other DNA
ggcctaaggcatcctgtatcccaaa

SEQ ID NO: 19423 - DNA, 18 bp, synthetic construct
  misc_feature 1..18: note = Synthetic Construct
  source 1..18: mol_type = other DNA
agatgcgggacccactga

SEQ ID NO: 19424 - DNA, 24 bp, synthetic construct
  misc_feature 1..24: note = Synthetic Construct
  source 1..24: mol_type = other DNA
gccccatgactatcgtgtgaggtt

SEQ ID NO: 19425 - DNA, 22 bp, synthetic construct
  misc_feature 1..22: note = Synthetic Construct
  source 1..22: mol_type = other DNA
gttaccgcagcagcatgtttac

SEQ ID NO: 19426 - DNA, 23 bp, synthetic construct
  misc_feature 1..23: note = Synthetic Construct
  source 1..23: mol_type = other DNA
ccctacaaatgccagcagctttc

SEQ ID NO: 19427 - DNA, 26 bp, synthetic construct
  misc_feature 1..26: note = Synthetic Construct
  source 1..26: mol_type = other DNA
cccggatattattagccagttagcaa

SEQ ID NO: 19428 - DNA, 27 bp, synthetic construct
  misc_feature 1..27: note = Synthetic Construct
  source 1..27: mol_type = other DNA
gcatggaaagagaaatctggtgtggat

SEQ ID NO: 19429 - DNA, 24 bp, synthetic construct
  misc_feature 1..24: note = Synthetic Construct
  source 1..24: mol_type = other DNA
cctggcagtgtatgaagaggcatt

SEQ ID NO: 19430 - DNA, 24 bp, synthetic construct
  misc_feature 1..24: note = Synthetic Construct
  source 1..24: mol_type = other DNA
ggggagtgtgactgaaggaaaaac

SEQ ID NO: 19431 - DNA, 24 bp, synthetic construct
  misc_feature 1..24: note = Synthetic Construct
  source 1..24: mol_type = other DNA
gcccaaaatggaccagttcaaaac

SEQ ID NO: 19432 - DNA, 20 bp, synthetic construct
  misc_feature 1..20: note = Synthetic Construct
  source 1..20: mol_type = other DNA
tccaggcttgccccttctca

SEQ ID NO: 19433 - DNA, 24 bp, synthetic construct
  misc_feature 1..24: note = Synthetic Construct
  source 1..24: mol_type = other DNA
gggtaatgccgagtagagaattga

SEQ ID NO: 19434 - DNA, 24 bp, synthetic construct
  misc_feature 1..24: note = Synthetic Construct
  source 1..24: mol_type = other DNA
tgtcctttttcattggagggtaca

SEQ ID NO: 19435 - DNA, 22 bp, synthetic construct
  misc_feature 1..22: note = Synthetic Construct
  source 1..22: mol_type = other DNA
tgccctctcctccctgcaaata

SEQ ID NO: 19436 - DNA, 22 bp, synthetic construct
  misc_feature 1..22: note = Synthetic Construct
  source 1..22: mol_type = other DNA
cagctcccagtcacagtgtttc

SEQ ID NO: 19437 - DNA, 23 bp, synthetic construct
  misc_feature 1..23: note = Synthetic Construct
  source 1..23: mol_type = other DNA
gtcatgtcccgctgttctgatgt

SEQ ID NO: 19438 - DNA, 25 bp, synthetic construct
  misc_feature 1..25: note = Synthetic Construct
  source 1..25: mol_type = other DNA
acctggaagttaccagtctttgaac

SEQ ID NO: 19439 - DNA, 24 bp, synthetic construct
  misc_feature 1..24: note = Synthetic Construct
  source 1..24: mol_type = other DNA
ctggaggtagagccttggactttc

SEQ ID NO: 19440 - DNA, 26 bp, synthetic construct
  misc_feature 1..26: note = Synthetic Construct
  source 1..26: mol_type = other DNA
tccccaagagatgttagcttttctac

SEQ ID NO: 19441 - DNA, 22 bp, synthetic construct
  misc_feature 1..22: note = Synthetic Construct
  source 1..22: mol_type = other DNA
cggacaggtttcatgcggagta

SEQ ID NO: 19442 - DNA, 26 bp, synthetic construct
  misc_feature 1..26: note = Synthetic Construct
  source 1..26: mol_type = other DNA
ggtgtctttccagaggctttctcttc

SEQ ID NO: 19443 - DNA, 24 bp, synthetic construct
  misc_feature 1..24: note = Synthetic Construct
  source 1..24: mol_type = other DNA
cgatccagagagatgctggcaaaa

SEQ ID NO: 19444 - DNA, 27 bp, synthetic construct
  misc_feature 1..27: note = Synthetic Construct
  source 1..27: mol_type = other DNA
gaagctgtgtatcctaagagcactttc

SEQ ID NO: 19445 - DNA, 22 bp, synthetic construct
  misc_feature 1..22: note = Synthetic Construct
  source 1..22: mol_type = other DNA
ggccctgaaatccagcaagatg

SEQ ID NO: 19446 - DNA, 22 bp, synthetic construct
  misc_feature 1..22: note = Synthetic Construct
  source 1..22: mol_type = other DNA
ggagcagataacgggtccaatg

SEQ ID NO: 19447 - DNA, 20 bp, synthetic construct
  misc_feature 1..20: note = Synthetic Construct
  source 1..20: mol_type = other DNA
tgtggaagcggggaaactga

SEQ ID NO: 19448 - DNA, 27 bp, synthetic construct
  misc_feature 1..27: note = Synthetic Construct
  source 1..27: mol_type = other DNA
ggcctatggtagcaaccactgctataa

SEQ ID NO: 19449 - DNA, 25 bp, synthetic construct
  misc_feature 1..25: note = Synthetic Construct
  source 1..25: mol_type = other DNA
ctctccggcgatgtaatttctggat

SEQ ID NO: 19450 - DNA, 27 bp, synthetic construct
  misc_feature 1..27: note = Synthetic Construct
  source 1..27: mol_type = other DNA
tgctatagagagaggacaacttgagat

SEQ ID NO: 19451 - DNA, 23 bp, synthetic construct
  misc_feature 1..23: note = Synthetic Construct
  source 1..23: mol_type = other DNA
ccacactcagcctagcattcaga

SEQ ID NO: 19452 - DNA, 24 bp, synthetic construct
  misc_feature 1..24: note = Synthetic Construct
  source 1..24: mol_type = other DNA
cgttaaatcctcacacagttgctt

SEQ ID NO: 19453 - DNA, 22 bp, synthetic construct
  misc_feature 1..22: note = Synthetic Construct
  source 1..22: mol_type = other DNA
ggcgaactcgctgtggtattgt

SEQ ID NO: 19454 - DNA, 22 bp, synthetic construct
  misc_feature 1..22: note = Synthetic Construct
  source 1..22: mol_type = other DNA
caccttggccatgccaacattc

SEQ ID NO: 19455 - DNA, 25 bp, synthetic construct
  misc_feature 1..25: note = Synthetic Construct
  source 1..25: mol_type = other DNA
aagcaggaggaataagtgtgaatga

SEQ ID NO: 19456 - DNA, 24 bp, synthetic construct
  misc_feature 1..24: note = Synthetic Construct
  source 1..24: mol_type = other DNA
cctgccaatctcagcactttctct

SEQ ID NO: 19457 - DNA, 24 bp, synthetic construct
  misc_feature 1..24: note = Synthetic Construct
  source 1..24: mol_type = other DNA
ggctttgcaggtcatacagcttct

SEQ ID NO: 19458 - DNA, 20 bp, synthetic construct
  misc_feature 1..20: note = Synthetic Construct
  source 1..20: mol_type = other DNA
gggttgttgcctgcttgctt

SEQ ID NO: 19459 - DNA, 22 bp, synthetic construct
  misc_feature 1..22: note = Synthetic Construct
  source 1..22: mol_type = other DNA
gcaggggtaagaagcagagaag

SEQ ID NO: 19460 - DNA, 26 bp, synthetic construct
  misc_feature 1..26: note = Synthetic Construct
  source 1..26: mol_type = other DNA
ggctcacaacggaaaagagtatttct

SEQ ID NO: 19461 - DNA, 22 bp, synthetic construct
  misc_feature 1..22: note = Synthetic Construct
  source 1..22: mol_type = other DNA
gcaagagtgctggaggaacaga

SEQ ID NO: 19462 - DNA, 27 bp, synthetic construct
  misc_feature 1..27: note = Synthetic Construct
  source 1..27: mol_type = other DNA
gggcattaggacaaagtaggaggtact

SEQ ID NO: 19463 - DNA, 22 bp, synthetic construct
  misc_feature 1..22: note = Synthetic Construct
  source 1..22: mol_type = other DNA
ccctgtaggccttggcatttct

SEQ ID NO: 19464 - DNA, 23 bp, synthetic construct
  misc_feature 1..23: note = Synthetic Construct
  source 1..23: mol_type = other DNA
gctggcttttggtttcaagaaca

SEQ ID NO: 19465 - DNA, 25 bp, synthetic construct
  misc_feature 1..25: note = Synthetic Construct
  source 1..25: mol_type = other DNA
ggaaggctgtgatttcattttggtt

SEQ ID NO: 19466 - DNA, 29 bp, synthetic construct
  misc_feature 1..29: note = Synthetic Construct
  source 1..29: mol_type = other DNA
ctggtaagactaaataaccctcactcact

SEQ ID NO: 19467 - DNA, 26 bp, synthetic construct
  misc_feature 1..26: note = Synthetic Construct
  source 1..26: mol_type = other DNA
caggatggttgtatgggtatacttga

SEQ ID NO: 19468 - DNA, 23 bp, synthetic construct
  misc_feature 1..23: note = Synthetic Construct
  source 1..23: mol_type = other DNA
agtttgtctagggccatgctaag

SEQ ID NO: 19469 - DNA, 20 bp, synthetic construct
  misc_feature 1..20: note = Synthetic Construct
  source 1..20: mol_type = other DNA
gcagggtcccgattcaatgt

SEQ ID NO: 19470 - DNA, 22 bp, synthetic construct
  misc_feature 1..22: note = Synthetic Construct
  source 1..22: mol_type = other DNA
acttgcctctgctctcattgaa

SEQ ID NO: 19471 - DNA, 20 bp, synthetic construct
  misc_feature 1..20: note = Synthetic Construct
  source 1..20: mol_type = other DNA
tctggaagccccagtgttgt

SEQ ID NO: 19472 - DNA, 23 bp, synthetic construct
  misc_feature 1..23: note = Synthetic Construct
  source 1..23: mol_type = other DNA
agaaaagggcaagtccccataaa

SEQ ID NO: 19473 - DNA, 21 bp, synthetic construct
  misc_feature 1..21: note = Synthetic Construct
  source 1..21: mol_type = other DNA
gcctagtggtaaagccccatt

SEQ ID NO: 19474 - DNA, 24 bp, synthetic construct
  misc_feature 1..24: note = Synthetic Construct
  source 1..24: mol_type = other DNA
ctctctaccctctgtcagcacatc

SEQ ID NO: 19475 - DNA, 23 bp, synthetic construct
  misc_feature 1..23: note = Synthetic Construct
  source 1..23: mol_type = other DNA
cccacttgcccatatccaagttt

SEQ ID NO: 19476 - DNA, 29 bp, synthetic construct
  misc_feature 1..29: note = Synthetic Construct
  source 1..29: mol_type = other DNA
gggaaacgagtgacctctattattactca

SEQ ID NO: 19477 - DNA, 22 bp, synthetic construct
  misc_feature 1..22: note = Synthetic Construct
  source 1..22: mol_type = other DNA
ggtggtttgagatgccaccttt

SEQ ID NO: 19478 - DNA, 23 bp, synthetic construct
  misc_feature 1..23: note = Synthetic Construct
  source 1..23: mol_type = other DNA
ggtatgaccaggatggtgtggtt

SEQ ID NO: 19479 - DNA, 28 bp, synthetic construct
  misc_feature 1..28: note = Synthetic Construct
  source 1..28: mol_type = other DNA
gggagaatacggaagaactattggattg

SEQ ID NO: 19480 - DNA, 26 bp, synthetic construct
  misc_feature 1..26: note = Synthetic Construct
  source 1..26: mol_type = other DNA
ccatggtgagcattaaaacactctca

SEQ ID NO: 19481 - DNA, 23 bp, synthetic construct
  misc_feature 1..23: note = Synthetic Construct
  source 1..23: mol_type = other DNA
acaagacccagtttctgccattc

SEQ ID NO: 19482 - DNA, 21 bp, synthetic construct
  misc_feature 1..21: note = Synthetic Construct
  source 1..21: mol_type = other DNA
actcagccgttgtttgtggaa

SEQ ID NO: 19483 - DNA, 27 bp, synthetic construct
  misc_feature 1..27: note = Synthetic Construct
  source 1..27: mol_type = other DNA
tctaggagctgatactcttctagtgaa

SEQ ID NO: 19484 - DNA, 22 bp, synthetic construct
  misc_feature 1..22: note = Synthetic Construct
  source 1..22: mol_type = other DNA
tccatgcaccttggtggagaag

SEQ ID NO: 19485 - DNA, 23 bp, synthetic construct
  misc_feature 1..23: note = Synthetic Construct
  source 1..23: mol_type = other DNA
gatccttgttggcttctcaccta

SEQ ID NO: 19486 - DNA, 26 bp, synthetic construct
  misc_feature 1..26: note = Synthetic Construct
  source 1..26: mol_type = other DNA
acagaccaactggatctttcacatac

SEQ ID NO: 19487 - DNA, 23 bp, synthetic construct
  misc_feature 1..23: note = Synthetic Construct
  source 1..23: mol_type = other DNA
gagcagactgccattgtgcctat

SEQ ID NO: 19488 - DNA, 24 bp, synthetic construct
  misc_feature 1..24: note = Synthetic Construct
  source 1..24: mol_type = other DNA
gaaagaaggccagatgtgtgacta

SEQ ID NO: 19489 - DNA, 27 bp, synthetic construct
  misc_feature 1..27: note = Synthetic Construct
  source 1..27: mol_type = other DNA
gcagccaagattctaagtctgtctgaa

SEQ ID NO: 19490 - DNA, 26 bp, synthetic construct
  misc_feature 1..26: note = Synthetic Construct
  source 1..26: mol_type = other DNA
gtggtatagggctcagatacaagaag

SEQ ID NO: 19491 - DNA, 24 bp, synthetic construct
  misc_feature 1..24: note = Synthetic Construct
  source 1..24: mol_type = other DNA
cctgtttcatgccagccaatgttc

SEQ ID NO: 19492 - DNA, 26 bp, synthetic construct
  misc_feature 1..26: note = Synthetic Construct
  source 1..26: mol_type = other DNA
caggtgacatccagggacaaataaag

SEQ ID NO: 19493 - DNA, 22 bp, synthetic construct
  misc_feature 1..22: note = Synthetic Construct
  source 1..22: mol_type = other DNA
ccctggggagctatggaactga

SEQ ID NO: 19494 - DNA, 23 bp, synthetic construct
  misc_feature 1..23: note = Synthetic Construct
  source 1..23: mol_type = other DNA
gaaccccaatttgctcaggtgtt

SEQ ID NO: 19495 - DNA, 24 bp, synthetic construct
  misc_feature 1..24: note = Synthetic Construct
  source 1..24: mol_type = other DNA
gaatgaccccatactgtggtttgt

SEQ ID NO: 19496 - DNA, 22 bp, synthetic construct
  misc_feature 1..22: note = Synthetic Construct
  source 1..22: mol_type = other DNA
ctgatgcagctgggcttctaac

SEQ ID NO: 19497 - DNA, 28 bp, synthetic construct
  misc_feature 1..28: note = Synthetic Construct
  source 1..28: mol_type = other DNA
gggaatctgaagtccaaaacatggtaag

SEQ ID NO: 19498 - DNA, 28 bp, synthetic construct
  misc_feature 1..28: note = Synthetic Construct
  source 1..28: mol_type = other DNA
cctcctaacggccaaatagaacatgtag

SEQ ID NO: 19499 - DNA, 25 bp, synthetic construct
  misc_feature 1..25: note = Synthetic Construct
  source 1..25: mol_type = other DNA
gccttctattgatccttcacccaaa

SEQ ID NO: 19500 - DNA, 26 bp, synthetic construct
  misc_feature 1..26: note = Synthetic Construct
  source 1..26: mol_type = other DNA
gtgtttgagaagacccttggaaaagt

SEQ ID NO: 19501 - DNA, 23 bp, synthetic construct
  misc_feature 1..23: note = Synthetic Construct
  source 1..23: mol_type = other DNA
acacccagcaaatgaagcaatct

SEQ ID NO: 19502 - DNA, 22 bp, synthetic construct
  misc_feature 1..22: note = Synthetic Construct
  source 1..22: mol_type = other DNA
cagatccgtcaggctcaacact

SEQ ID NO: 19503 - DNA, 24 bp, synthetic construct
  misc_feature 1..24: note = Synthetic Construct
  source 1..24: mol_type = other DNA
ggaggtgggtacagagaaaagcta

SEQ ID NO: 19504 - DNA, 23 bp, synthetic construct
  misc_feature 1..23: note = Synthetic Construct
  source 1..23: mol_type = other DNA
ctgttggtttcgagcaaacacat

SEQ ID NO: 19505 - DNA, 26 bp, synthetic construct
  misc_feature 1..26: note = Synthetic Construct
  source 1..26: mol_type = other DNA
ggaaggctccaataacaccatgagat

SEQ ID NO: 19506 - DNA, 22 bp, synthetic construct
  misc_feature 1..22: note = Synthetic Construct
  source 1..22: mol_type = other DNA
gagaagatcaccaagggcaact

SEQ ID NO: 19507 - DNA, 23 bp, synthetic construct
  misc_feature 1..23: note = Synthetic Construct
  source 1..23: mol_type = other DNA
ctcatcaccattgacgtcctaca

SEQ ID NO: 19508 - DNA, 21 bp, synthetic construct
  misc_feature 1..21: note = Synthetic Construct
  source 1..21: mol_type = other DNA
gggcctgtttgcctctctgaa

SEQ ID NO: 19509 - DNA, 20 bp, synthetic construct
  misc_feature 1..20: note = Synthetic Construct
  source 1..20: mol_type = other DNA
actctctccgacctgcatct

SEQ ID NO: 19510 - DNA, 24 bp, synthetic construct
  misc_feature 1..24: note = Synthetic Construct
  source 1..24: mol_type = other DNA
cccttcactctgtgaattccttct

SEQ ID NO: 19511 - DNA, 23 bp, synthetic construct
  misc_feature 1..23: note = Synthetic Construct
  source 1..23: mol_type = other DNA
cctgtcagtagcagtccctcaaa

SEQ ID NO: 19512 - DNA, 24 bp, synthetic construct
  misc_feature 1..24: note = Synthetic Construct
  source 1..24: mol_type = other DNA
gagcgatttccagggaaacacaga

SEQ ID NO: 19513 - DNA, 26 bp, synthetic construct
  misc_feature 1..26: note = Synthetic Construct
  source 1..26: mol_type = other DNA
cctacaccaacactgtttctccacaa

SEQ ID NO: 19514 - DNA, 23 bp, synthetic construct
  misc_feature 1..23: note = Synthetic Construct
  source 1..23: mol_type = other DNA
gcccagcccatctgttttaccaa

SEQ ID NO: 19515 - DNA, 24 bp, synthetic construct
  misc_feature 1..24: note = Synthetic Construct
  source 1..24: mol_type = other DNA
ctgactgcatggacacttcctgtt

SEQ ID NO: 19516 - DNA, 26 bp, synthetic construct
  misc_feature 1..26: note = Synthetic Construct
  source 1..26: mol_type = other DNA
ctgggtatgatgtttatgggtgagta

SEQ ID NO: 19517 - DNA, 27 bp, synthetic construct
  misc_feature 1..27: note = Synthetic Construct
  source 1..27: mol_type = other DNA
cgaaacatttaaatcggctctgtgaac

SEQ ID NO: 19518 - DNA, 26 bp, synthetic construct
  misc_feature 1..26: note = Synthetic Construct
  source 1..26: mol_type = other DNA
aagtcccagtgatctgttagagaaag

SEQ ID NO: 19519 - DNA, 24 bp, synthetic construct
  misc_feature 1..24: note = Synthetic Construct
  source 1..24: mol_type = other DNA
acctgatgtttcaagagctggtta

SEQ ID NO: 19520 - DNA, 24 bp, synthetic construct
  misc_feature 1..24: note = Synthetic Construct
  source 1..24: mol_type = other DNA
gagttctggcagtctgtgttttca

SEQ ID NO: 19521 - DNA, 25 bp, synthetic construct
  misc_feature 1..25: note = Synthetic Construct
  source 1..25: mol_type = other DNA
gcctgttactcttggagacagagtt

SEQ ID NO: 19522 - DNA, 22 bp, synthetic construct
  misc_feature 1..22: note = Synthetic Construct
  source 1..22: mol_type = other DNA
cacccaggctttctggcagatt

SEQ ID NO: 19523 - DNA, 27 bp, synthetic construct
  misc_feature 1..27: note = Synthetic Construct
  source 1..27: mol_type = other DNA
cgtgccacaatagtttttagagggttt

SEQ ID NO: 19524 - DNA, 20 bp, synthetic construct
  misc_feature 1..20: note = Synthetic Construct
  source 1..20: mol_type = other DNA
ttaccgcgtccggaacttca

SEQ ID NO: 19525 - DNA, 22 bp, synthetic construct
  misc_feature 1..22: note = Synthetic Construct
  source 1..22: mol_type = other DNA
ggcatgcaagtcaagagtcaag

SEQ ID NO: 19526 - DNA, 26 bp, synthetic construct
  misc_feature 1..26: note = Synthetic Construct
  source 1..26: mol_type = other DNA
agtaagagagggaagggatattgcat

SEQ ID NO: 19527 - DNA, 21 bp, synthetic construct
  misc_feature 1..21: note = Synthetic Construct
  source 1..21: mol_type = other DNA
gccctctacccctctctgcaa

SEQ ID NO: 19528 - DNA, 25 bp, synthetic construct
  misc_feature 1..25: note = Synthetic Construct
  source 1..25: mol_type = other DNA
ggaattcagtctgtacaagggatca

SEQ ID NO: 19529 - DNA, 23 bp, synthetic construct
  misc_feature 1..23: note = Synthetic Construct
  source 1..23: mol_type = other DNA
gcacgtccaaatcttgctcaatc

SEQ ID NO: 19530 - DNA, 27 bp, synthetic construct
  misc_feature 1..27: note = Synthetic Construct
  source 1..27: mol_type = other DNA
ccacactgcatttggaatttggtattg

SEQ ID NO: 19531 - DNA, 28 bp, synthetic construct
  misc_feature 1..28: note = Synthetic Construct
  source 1..28: mol_type = other DNA
gacacctgactccctaaaagaaacttga

SEQ ID NO: 19532 - DNA, 24 bp, synthetic construct
  misc_feature 1..24: note = Synthetic Construct
  source 1..24: mol_type = other DNA
ggccctccagaataagtgtgaaga

SEQ ID NO: 19533 - DNA, 22 bp, synthetic construct
  misc_feature 1..22: note = Synthetic Construct
  source 1..22: mol_type = other DNA
ccacttctacctggccgatttc

SEQ ID NO: 19534 - DNA, 21 bp, synthetic construct
  misc_feature 1..21: note = Synthetic Construct
  source 1..21: mol_type = other DNA
agagggctagagggctgaaat

SEQ ID NO: 19535 - DNA, 21 bp, synthetic construct
  misc_feature 1..21: note = Synthetic Construct
  source 1..21: mol_type = other DNA
agtgtccatccagtccacgta

SEQ ID NO: 19536 - DNA, 24 bp, synthetic construct
  misc_feature 1..24: note = Synthetic Construct
  source 1..24: mol_type = other DNA
tcttcccacacgtttatggacaat

SEQ ID NO: 19537 - DNA, 24 bp, synthetic construct
  misc_feature 1..24: note = Synthetic Construct
  source 1..24: mol_type = other DNA
gcaaaacagacaggcagccaatag

SEQ ID NO: 19538 - DNA, 25 bp, synthetic construct
  misc_feature 1..25: note = Synthetic Construct
  source 1..25: mol_type = other DNA
cctgtgctgctagactcaccagtaa

SEQ ID NO: 19539 - DNA, 24 bp, synthetic construct
  misc_feature 1..24: note = Synthetic Construct
  source 1..24: mol_type = other DNA
ccctatacggcttcaccaaaaagt

SEQ ID NO: 19540 - DNA, 25 bp, synthetic construct
  misc_feature 1..25: note = Synthetic Construct
  source 1..25: mol_type = other DNA
ggcagttctcaacttgcagtaatag

SEQ ID NO: 19541 - DNA, 25 bp, synthetic construct
  misc_feature 1..25: note = Synthetic Construct
  source 1..25: mol_type = other DNA
gcatgaaaggggctaaggtcctagt

SEQ ID NO: 19542 - DNA, 22 bp, synthetic construct
  misc_feature 1..22: note = Synthetic Construct
  source 1..22: mol_type = other DNA
ggcattgcaccatcccctaaga

SEQ ID NO: 19543 - DNA, 22 bp, synthetic construct
  misc_feature 1..22: note = Synthetic Construct
  source 1..22: mol_type = other DNA
cagaggcagcttggagtactga

SEQ ID NO: 19544 - DNA, 22 bp, synthetic construct
  misc_feature 1..22: note = Synthetic Construct
  source 1..22: mol_type = other DNA
ctgggtttctgggttccctttc

SEQ ID NO: 19545 - DNA, 26 bp, synthetic construct
  misc_feature 1..26: note = Synthetic Construct
  source 1..26: mol_type = other DNA
gggtttagggacagaattcaactttc

SEQ ID NO: 19546 - DNA, 24 bp, synthetic construct
  misc_feature 1..24: note = Synthetic Construct
  source 1..24: mol_type = other DNA
gggaggctaagtgatacacacaca

SEQ ID NO: 19547 - DNA, 24 bp, synthetic construct
  misc_feature 1..24: note = Synthetic Construct
  source 1..24: mol_type = other DNA
ctccaccaaagcgattaggagact

SEQ ID NO: 19548 - DNA, 24 bp, synthetic construct
  misc_feature 1..24: note = Synthetic Construct
  source 1..24: mol_type = other DNA
gggtgaccaaagacggaaagtaga

SEQ ID NO: 19549 - DNA, 25 bp, synthetic construct
  misc_feature 1..25: note = Synthetic Construct
  source 1..25: mol_type = other DNA
ctccaagaggtttccctagttgtga

SEQ ID NO: 19550 - DNA, 22 bp, synthetic construct
  misc_feature 1..22: note = Synthetic Construct
  source 1..22: mol_type = other DNA
gtcctgcctggattgggctttt

SEQ ID NO: 19551 - DNA, 23 bp, synthetic construct
  misc_feature 1..23: note = Synthetic Construct
  source 1..23: mol_type = other DNA
ggtgggcttcatgctagggtttt

SEQ ID NO: 19552 - DNA, 24 bp, synthetic construct
  misc_feature 1..24: note = Synthetic Construct
  source 1..24: mol_type = other DNA
tgatagtgaggagccaagatcact

SEQ ID NO: 19553 - DNA, 24 bp, synthetic construct
  misc_feature 1..24: note = Synthetic Construct
  source 1..24: mol_type = other DNA
gcaaaagatgcctgtggacaaaga

SEQ ID NO: 19554 - DNA, 23 bp, synthetic construct
  misc_feature 1..23: note = Synthetic Construct
  source 1..23: mol_type = other DNA
tgcattcttcccagtggagaaac

SEQ ID NO: 19555 - DNA, 30 bp, synthetic construct
  misc_feature 1..30: note = Synthetic Construct
  source 1..30: mol_type = other DNA
ctcgtacagtactcttgggtgtaaaaattg

SEQ ID NO: 19556 - DNA, 22 bp, synthetic construct
  misc_feature 1..22: note = Synthetic Construct
  source 1..22: mol_type = other DNA
tgggtgtttagtccctgagagt

SEQ ID NO: 19557 - DNA, 22 bp, synthetic construct
  misc_feature 1..22: note = Synthetic Construct
  source 1..22: mol_type = other DNA
gctgggagaagggtttgtgtca

SEQ ID NO: 19558 - DNA, 24 bp, synthetic construct
  misc_feature 1..24: note = Synthetic Construct
  source 1..24: mol_type = other DNA
ggcctaatcaggaatggcttcttc

SEQ ID NO: 19559 - DNA, 24 bp, synthetic construct
  misc_feature 1..24: note = Synthetic Construct
  source 1..24: mol_type = other DNA
gccagtcactcacacttgggctat

SEQ ID NO: 19560 - DNA, 20 bp, synthetic construct
  misc_feature 1..20: note = Synthetic Construct
  source 1..20: mol_type = other DNA
aggggaagtccttgccttga

SEQ ID NO: 19561 - DNA, 24 bp, synthetic construct
  misc_feature 1..24: note = Synthetic Construct
  source 1..24: mol_type = other DNA
ggtgaaaggtgacttgtggtctga

SEQ ID NO: 19562 - DNA, 27 bp, synthetic construct
  misc_feature 1..27: note = Synthetic Construct
  source 1..27: mol_type = other DNA
cagcatttctaaccttgtttcccaatc

SEQ ID NO: 19563 - DNA, 20 bp, synthetic construct
  misc_feature 1..20: note = Synthetic Construct
  source 1..20: mol_type = other DNA
agcctgtgagctgggttttg

SEQ ID NO: 19564 - DNA, 23 bp, synthetic construct
  misc_feature 1..23: note = Synthetic Construct
  source 1..23: mol_type = other DNA
ctgccatgacagcccatttctca

SEQ ID NO: 19565 - DNA, 20 bp, synthetic construct
  misc_feature 1..20: note = Synthetic Construct
  source 1..20: mol_type = other DNA
ggacgcgcaaaggtgttttc

SEQ ID NO: 19566 - DNA, 23 bp, synthetic construct
  misc_feature 1..23: note = Synthetic Construct
  source 1..23: mol_type = other DNA
cggcagccaaaatatagcagaga

SEQ ID NO: 19567 - DNA, 21 bp, synthetic construct
  misc_feature 1..21: note = Synthetic Construct
  source 1..21: mol_type = other DNA
gccagaagatgctggcaaaaa

SEQ ID NO: 19568 - DNA, 21 bp, synthetic construct
  misc_feature 1..21: note = Synthetic Construct
  source 1..21: mol_type = other DNA
tgagctggtactggtgtctct

SEQ ID NO: 19569 - DNA, 23 bp, synthetic construct
  misc_feature 1..23: note = Synthetic Construct
  source 1..23: mol_type = other DNA
acaattgccctgaagttgtgtca

SEQ ID NO: 19570 - DNA, 20 bp, synthetic construct
  misc_feature 1..20: note = Synthetic Construct
  source 1..20: mol_type = other DNA
cccgctgattcagggactct

SEQ ID NO: 19571 - DNA, 22 bp, synthetic construct
  misc_feature 1..22: note = Synthetic Construct
  source 1..22: mol_type = other DNA
gcgtgtttgaaccaacatctga

SEQ ID NO: 19572 - DNA, 25 bp, synthetic construct
  misc_feature 1..25: note = Synthetic Construct
  source 1..25: mol_type = other DNA
gccctaacacctacaaacccctttt

SEQ ID NO: 19573 - DNA, 26 bp, synthetic construct
  misc_feature 1..26: note = Synthetic Construct
  source 1..26: mol_type = other DNA
cctgtggtttagcttctgtgttccat

SEQ ID NO: 19574 - DNA, 27 bp, synthetic construct
  misc_feature 1..27: note = Synthetic Construct
  source 1..27: mol_type = other DNA
gcaaaccagaaactagagaaaggtatc

SEQ ID NO: 19575 - DNA, 30 bp, synthetic construct
  misc_feature 1..30: note = Synthetic Construct
  source 1..30: mol_type = other DNA
gtcattgctcttctgtaatcctcagttttc

SEQ ID NO: 19576 - DNA, 22 bp, synthetic construct
  misc_feature 1..22: note = Synthetic Construct
  source 1..22: mol_type = other DNA
ccaccatcagggagaagggata

SEQ ID NO: 19577 - DNA, 27 bp, synthetic construct
  misc_feature 1..27: note = Synthetic Construct
  source 1..27: mol_type = other DNA
cgtccctaaaaccatcttccttcttca

SEQ ID NO: 19578 - DNA, 21 bp, synthetic construct
  misc_feature 1..21: note = Synthetic Construct
  source 1..21: mol_type = other DNA
ccctctgcatgcgtgtctatc

SEQ ID NO: 19579 - DNA, 24 bp, synthetic construct
  misc_feature 1..24: note = Synthetic Construct
  source 1..24: mol_type = other DNA
gccaacagtgtagtggacacaagt

SEQ ID NO: 19580 - DNA, 25 bp, synthetic construct
  misc_feature 1..25: note = Synthetic Construct
  source 1..25: mol_type = other DNA
ctttgctaatcaaccctcagcaact

SEQ ID NO: 19581 - DNA, 21 bp, synthetic construct
  misc_feature 1..21: note = Synthetic Construct
  source 1..21: mol_type = other DNA
ccagactccctcccagctaga

SEQ ID NO: 19582 - DNA, 24 bp, synthetic construct
  misc_feature 1..24: note = Synthetic Construct
  source 1..24: mol_type = other DNA
ctcagtcctgaacaggtcaccatt

SEQ ID NO: 19583 - DNA, 24 bp, synthetic construct
  misc_feature 1..24: note = Synthetic Construct
  source 1..24: mol_type = other DNA
gaccaccacactgatgtcaagaga

SEQ ID NO: 19584 - DNA, 28 bp, synthetic construct
  misc_feature 1..28: note = Synthetic Construct
  source 1..28: mol_type = other DNA
cctaatggacctaactcaagagtcatag

SEQ ID NO: 19585 - DNA, 24 bp, synthetic construct
  misc_feature 1..24: note = Synthetic Construct
  source 1..24: mol_type = other DNA
tcagccatgacagaagcaaatcta

SEQ ID NO: 19586 - DNA, 24 bp, synthetic construct
  misc_feature 1..24: note = Synthetic Construct
  source 1..24: mol_type = other DNA
ccagtgataagcagctgggatttg

SEQ ID NO: 19587 - DNA, 24 bp, synthetic construct
  misc_feature 1..24: note = Synthetic Construct
  source 1..24: mol_type = other DNA
ggcttgtatgtggactgcaaggtt

SEQ ID NO: 19588 - DNA, 23 bp, synthetic construct
  misc_feature 1..23: note = Synthetic Construct
  source 1..23: mol_type = other DNA
gtctccagctcaatgcaaaggat

SEQ ID NO: 19589 - DNA, 25 bp, synthetic construct
  misc_feature 1..25: note = Synthetic Construct
  source 1..25: mol_type = other DNA
ggtcagagaaggggagttggaaaac

SEQ ID NO: 19590 - DNA, 20 bp, synthetic construct
  misc_feature 1..20: note = Synthetic Construct
  source 1..20: mol_type = other DNA
tgggctccaagaggcaacaa

SEQ ID NO: 19591 - DNA, 28 bp, synthetic construct
  misc_feature 1..28: note = Synthetic Construct
  source 1..28: mol_type = other DNA
cccattctcagtatagggtttccactca

SEQ ID NO: 19592 - DNA, 27 bp, synthetic construct
  misc_feature 1..27: note = Synthetic Construct
  source 1..27: mol_type = other DNA
ccctttgcatcaaatctatcaggaagt

SEQ ID NO: 19593 - DNA, 23 bp, synthetic construct
  misc_feature 1..23: note = Synthetic Construct
  source 1..23: mol_type = other DNA
ccctcaaaacaatggagctggaa

SEQ ID NO: 19594 - DNA, 23 bp, synthetic construct
  misc_feature 1..23: note = Synthetic Construct
  source 1..23: mol_type = other DNA
cattcctgctggtcttggttagt

SEQ ID NO: 19595 - DNA, 22 bp, synthetic construct
  misc_feature 1..22: note = Synthetic Construct
  source 1..22: mol_type = other DNA
gttctgggccacgacatagaga

SEQ ID NO: 19596 - DNA, 23 bp, synthetic construct
  misc_feature 1..23: note = Synthetic Construct
  source 1..23: mol_type = other DNA
ggctggttgtcttgaggaaatgt

SEQ ID NO: 19597 - DNA, 22 bp, synthetic construct
  misc_feature 1..22: note = Synthetic Construct
  source 1..22: mol_type = other DNA
ggcccttgagaaggtgaaggat

SEQ ID NO: 19598 - DNA, 26 bp, synthetic construct
  misc_feature 1..26: note = Synthetic Construct
  source 1..26: mol_type = other DNA
gcatcagtttccctttctctggttga

SEQ ID NO: 19599 - DNA, 26 bp, synthetic construct
  misc_feature 1..26: note = Synthetic Construct
  source 1..26: mol_type = other DNA
gccctgtggaaagattctaacagttc

SEQ ID NO: 19600 - DNA, 22 bp, synthetic construct
  misc_feature 1..22: note = Synthetic Construct
  source 1..22: mol_type = other DNA
gcaccacactttcccgagtgta

SEQ ID NO: 19601 - DNA, 22 bp, synthetic construct
  misc_feature 1..22: note = Synthetic Construct
  source 1..22: mol_type = other DNA
ccccacaactactcccctttct

SEQ ID NO: 19602 - DNA, 25 bp, synthetic construct
  misc_feature 1..25: note = Synthetic Construct
  source 1..25: mol_type = other DNA
gccttgacaaactgaattccagaga

SEQ ID NO: 19603 - DNA, 22 bp, synthetic construct
  misc_feature 1..22: note = Synthetic Construct
  source 1..22: mol_type = other DNA
ggcagtagcatcaccagagaag

SEQ ID NO: 19604 - DNA, 25 bp, synthetic construct
  misc_feature 1..25: note = Synthetic Construct
  source 1..25: mol_type = other DNA
tgcttagtggtcatcttttccttga

SEQ ID NO: 19605 - DNA, 24 bp, synthetic construct
  misc_feature 1..24: note = Synthetic Construct
  source 1..24: mol_type = other DNA
ccaaagtcagagcagggaagttca

SEQ ID NO: 19606 - DNA, 29 bp, synthetic construct
  misc_feature 1..29: note = Synthetic Construct
  source 1..29: mol_type = other DNA
ggctacacagaacctatataaccatcttg

SEQ ID NO: 19607 - DNA, 27 bp, synthetic construct
  misc_feature 1..27: note = Synthetic Construct
  source 1..27: mol_type = other DNA
gtgaggtcaaatcatagacaggtggaa

SEQ ID NO: 19608 - DNA, 30 bp, synthetic construct
  misc_feature 1..30: note = Synthetic Construct
  source 1..30: mol_type = other DNA
cggtagatctgaacaaccaaaagatgcaaa

SEQ ID NO: 19609 - DNA, 27 bp, synthetic construct
  misc_feature 1..27: note = Synthetic Construct
  source 1..27: mol_type = other DNA
ccttgttaggcaaatgatgcagtcttc

SEQ ID NO: 19610 - DNA, 26 bp, synthetic construct
  misc_feature 1..26: note = Synthetic Construct
  source 1..26: mol_type = other DNA
ggagactgaatgagaatcaaggttgt

SEQ ID NO: 19611 - DNA, 24 bp, synthetic construct
  misc_feature 1..24: note = Synthetic Construct
  source 1..24: mol_type = other DNA
ctgacacttgcctcctccatgaaa

SEQ ID NO: 19612 - DNA, 21 bp, synthetic construct
  misc_feature 1..21: note = Synthetic Construct
  source 1..21: mol_type = other DNA
acctgtcacgtagggctgctt

SEQ ID NO: 19613 - DNA, 24 bp, synthetic construct
  misc_feature 1..24: note = Synthetic Construct
  source 1..24: mol_type = other DNA
cgtgtgctttaggctcctctgaaa

SEQ ID NO: 19614 - DNA, 27 bp, synthetic construct
  misc_feature 1..27: note = Synthetic Construct
  source 1..27: mol_type = other DNA
gaagatgagctgaatagcagtcaaaca

SEQ ID NO: 19615 - DNA, 27 bp, synthetic construct
  misc_feature 1..27: note = Synthetic Construct
  source 1..27: mol_type = other DNA
cgctcagattaggtgatcagaagcatt

SEQ ID NO: 19616 - DNA, 23 bp, synthetic construct
  misc_feature 1..23: note = Synthetic Construct
  source 1..23: mol_type = other DNA
ctgtggctgtacacaaggactca

SEQ ID NO: 19617 - DNA, 28 bp, synthetic construct
  misc_feature 1..28: note = Synthetic Construct
  source 1..28: mol_type = other DNA
gacctttatacgaagtcccttccctttg

SEQ ID NO: 19618 - DNA, 27 bp, synthetic construct
  misc_feature 1..27: note = Synthetic Construct
  source 1..27: mol_type = other DNA
gtgtactaaatcccaactctccttaca

SEQ ID NO: 19619 - DNA, 28 bp, synthetic construct
  misc_feature 1..28: note = Synthetic Construct
  source 1..28: mol_type = other DNA
ggtagcgattctcaaatcacatggaaag

SEQ ID NO: 19620 - DNA, 19 bp, synthetic construct
  misc_feature 1..19: note = Synthetic Construct
  source 1..19: mol_type = other DNA
ggtcaactgagcggagcat

SEQ ID NO: 19621 - DNA, 25 bp, synthetic construct
  misc_feature 1..25: note = Synthetic Construct
  source 1..25: mol_type = other DNA
gttctcccaccaaaaattccacttc

SEQ ID NO: 19622 - DNA, 22 bp, synthetic construct
  misc_feature 1..22: note = Synthetic Construct
  source 1..22: mol_type = other DNA
agcaagccaatccgggaagaag

SEQ ID NO: 19623 - DNA, 26 bp, synthetic construct
  misc_feature 1..26: note = Synthetic Construct
  source 1..26: mol_type = other DNA
ccaagagcataaccacagaggtcctt

SEQ ID NO: 19624 - DNA, 24 bp, synthetic construct
  misc_feature 1..24: note = Synthetic Construct
  source 1..24: mol_type = other DNA
gcagttcatggcaggattttgaac

SEQ ID NO: 19625 - DNA, 24 bp, synthetic construct
  misc_feature 1..24: note = Synthetic Construct
  source 1..24: mol_type = other DNA
gccatagctggagattggacttac

SEQ ID NO: 19626 - DNA, 22 bp, synthetic construct
  misc_feature 1..22: note = Synthetic Construct
  source 1..22: mol_type = other DNA
ggttgctcgcagagagatggaa

SEQ ID NO: 19627 - DNA, 22 bp, synthetic construct
  misc_feature 1..22: note = Synthetic Construct
  source 1..22: mol_type = other DNA
ccacctgaaccgtctgttccat

SEQ ID NO: 19628 - DNA, 26 bp, synthetic construct
  misc_feature 1..26: note = Synthetic Construct
  source 1..26: mol_type = other DNA
cagaggagaaatgtgtggaacccaat

SEQ ID NO: 19629 - DNA, 20 bp, synthetic construct
  misc_feature 1..20: note = Synthetic Construct
  source 1..20: mol_type = other DNA
gggctgtgaaaggcttctct

SEQ ID NO: 19630 - DNA, 22 bp, synthetic construct
  misc_feature 1..22: note = Synthetic Construct
  source 1..22: mol_type = other DNA
ccttgacggttgaacgggagtt

SEQ ID NO: 19631 - DNA, 26 bp, synthetic construct
  misc_feature 1..26: note = Synthetic Construct
  source 1..26: mol_type = other DNA
cttggtccacatttaaggcacttttc

SEQ ID NO: 19632 - DNA, 20 bp, synthetic construct
  misc_feature 1..20: note = Synthetic Construct
  source 1..20: mol_type = other DNA
ggccctgaacacacatgcta

SEQ ID NO: 19633 - DNA, 22 bp, synthetic construct
  misc_feature 1..22: note = Synthetic Construct
  source 1..22: mol_type = other DNA
catctacatggcagggaagtgt

SEQ ID NO: 19634 - DNA, 23 bp, synthetic construct
  misc_feature 1..23: note = Synthetic Construct
  source 1..23: mol_type = other DNA
gcatcttaagtgccacaggttgt

SEQ ID NO: 19635 - DNA, 22 bp, synthetic construct
  misc_feature 1..22: note = Synthetic Construct
  source 1..22: mol_type = other DNA
ggtgaggatgctaccccaactt

SEQ ID NO: 19636 - DNA, 25 bp, synthetic construct
  misc_feature 1..25: note = Synthetic Construct
  source 1..25: mol_type = other DNA
ctggccacattccggaaatataaac

SEQ ID NO: 19637 - DNA, 26 bp, synthetic construct
  misc_feature 1..26: note = Synthetic Construct
  source 1..26: mol_type = other DNA
gagactaggtctcccttacatttgtt

SEQ ID NO: 19638 - DNA, 24 bp, synthetic construct
  misc_feature 1..24: note = Synthetic Construct
  source 1..24: mol_type = other DNA
ggctaattggctggatccctcact

SEQ ID NO: 19639 - DNA, 28 bp, synthetic construct
  misc_feature 1..28: note = Synthetic Construct
  source 1..28: mol_type = other DNA
gtgacctgctaaagaaatacagcctaca

SEQ ID NO: 19640 - DNA, 19 bp, synthetic construct
  misc_feature 1..19: note = Synthetic Construct
  source 1..19: mol_type = other DNA
cagatcggcagccaacaga

SEQ ID NO: 19641 - DNA, 24 bp, synthetic construct
  misc_feature 1..24: note = Synthetic Construct
  source 1..24: mol_type = other DNA
ctgtggttgtgagaagggctatac

SEQ ID NO: 19642 - DNA, 22 bp, synthetic construct
  misc_feature 1..22: note = Synthetic Construct
  source 1..22: mol_type = other DNA
gcagacctttgggcctagagaa

SEQ ID NO: 19643 - DNA, 29 bp, synthetic construct
  misc_feature 1..29: note = Synthetic Construct
  source 1..29: mol_type = other DNA
gggatccaaacttactcttttgcatgtga

SEQ ID NO: 19644 - DNA, 27 bp, synthetic construct
  misc_feature 1..27: note = Synthetic Construct
  source 1..27: mol_type = other DNA
ggcaaaggatgatatagaggagtccaa

SEQ ID NO: 19645 - DNA, 23 bp, synthetic construct
  misc_feature 1..23: note = Synthetic Construct
  source 1..23: mol_type = other DNA
gcctggaatagaggcttgtggaa

SEQ ID NO: 19646 - DNA, 22 bp, synthetic construct
  misc_feature 1..22: note = Synthetic Construct
  source 1..22: mol_type = other DNA
ctcctgtggagcctccttttca

SEQ ID NO: 19647 - DNA, 21 bp, synthetic construct
  misc_feature 1..21: note = Synthetic Construct
  source 1..21: mol_type = other DNA
gccagttgggagccagaacaa

SEQ ID NO: 19648 - DNA, 21 bp, synthetic construct
  misc_feature 1..21: note = Synthetic Construct
  source 1..21: mol_type = other DNA
ggagggttgctgttgctctga

SEQ ID NO: 19649 - DNA, 27 bp, synthetic construct
  misc_feature 1..27: note = Synthetic Construct
  source 1..27: mol_type = other DNA
cacccaggggtatagaagtgtttcttc

SEQ ID NO: 19650 - DNA, 25 bp, synthetic construct
  misc_feature 1..25: note = Synthetic Construct
  source 1..25: mol_type = other DNA
tcttactagcaaaacaaggggttca

SEQ ID NO: 19651 - DNA, 24 bp, synthetic construct
  misc_feature 1..24: note = Synthetic Construct
  source 1..24: mol_type = other DNA
gctgtataagctccacctcccaat

SEQ ID NO: 19652 - DNA, 22 bp, synthetic construct
  misc_feature 1..22: note = Synthetic Construct
  source 1..22: mol_type = other DNA
gcacccttagcacagggttcaa

SEQ ID NO: 19653 - DNA, 21 bp, synthetic construct
  misc_feature 1..21: note = Synthetic Construct
  source 1..21: mol_type = other DNA
aggccctatacgcccctgttt

SEQ ID NO: 19654 - DNA, 21 bp, synthetic construct
  misc_feature 1..21: note = Synthetic Construct
  source 1..21: mol_type = other DNA
ggaggacatgacccgaacctt

SEQ ID NO: 19655 - DNA, 25 bp, synthetic construct
  misc_feature 1..25: note = Synthetic Construct
  source 1..25: mol_type = other DNA
ggaaaagcctaactaagctctcgat

SEQ ID NO: 19656 - DNA, 28 bp, synthetic construct
  misc_feature 1..28: note = Synthetic Construct
  source 1..28: mol_type = other DNA
gactgtgactggatctggattttagaca

SEQ ID NO: 19657 - DNA, 23 bp, synthetic construct
  misc_feature 1..23: note = Synthetic Construct
  source 1..23: mol_type = other DNA
gagagcctgtgatgaggaagaca

SEQ ID NO: 19658 - DNA, 23 bp, synthetic construct
  misc_feature 1..23: note = Synthetic Construct
  source 1..23: mol_type = other DNA
tcagcagcttcccagagataaac

SEQ ID NO: 19659 - DNA, 23 bp, synthetic construct
  misc_feature 1..23: note = Synthetic Construct
  source 1..23: mol_type = other DNA
ctcctttgctcgaagtcgacagt

SEQ ID NO: 19660 - DNA, 22 bp, synthetic construct
  misc_feature 1..22: note = Synthetic Construct
  source 1..22: mol_type = other DNA
gcaggctgtagctcatcctatg

SEQ ID NO: 19661 - DNA, 23 bp, synthetic construct
  misc_feature 1..23: note = Synthetic Construct
  source 1..23: mol_type = other DNA
gtgagtgactccatgtccacaga

SEQ ID NO: 19662 - DNA, 22 bp, synthetic construct
  misc_feature 1..22: note = Synthetic Construct
  source 1..22: mol_type = other DNA
gccacacacgtccctgatgaaa

SEQ ID NO: 19663 - DNA, 21 bp, synthetic construct
  misc_feature 1..21: note = Synthetic Construct
  source 1..21: mol_type = other DNA
tcaacgcaaagggcactaact

SEQ ID NO: 19664 - DNA, 25 bp, synthetic construct
  misc_feature 1..25: note = Synthetic Construct
  source 1..25: mol_type = other DNA
ggcaacccagtcacagataatcttc

SEQ ID NO: 19665 - DNA, 22 bp, synthetic construct
  misc_feature 1..22: note = Synthetic Construct
  source 1..22: mol_type = other DNA
ccagtaccaaagaagccgctat

SEQ ID NO: 19666 - DNA, 21 bp, synthetic construct
  misc_feature 1..21: note = Synthetic Construct
  source 1..21: mol_type = other DNA
tgcagcgattttggggaatga

SEQ ID NO: 19667 - DNA, 23 bp, synthetic construct
  misc_feature 1..23: note = Synthetic Construct
  source 1..23: mol_type = other DNA
tgaaacagcctctgctccttatc

SEQ ID NO: 19668 - DNA, 22 bp, synthetic construct
  misc_feature 1..22: note = Synthetic Construct
  source 1..22: mol_type = other DNA
ccagctgttctctcagctcttc

SEQ ID NO: 19669 - DNA, 25 bp, synthetic construct
  misc_feature 1..25: note = Synthetic Construct
  source 1..25: mol_type = other DNA
tgggttggaaggagaagatgttaga

SEQ ID NO: 19670 - DNA, 24 bp, synthetic construct
  misc_feature 1..24: note = Synthetic Construct
  source 1..24: mol_type = other DNA
ccgggtgttcacagctttagtttc

SEQ ID NO: 19671 - DNA, 25 bp, synthetic construct
  misc_feature 1..25: note = Synthetic Construct
  source 1..25: mol_type = other DNA
ggctctgagagtcttccttatgtga

SEQ ID NO: 19672 - DNA, 21 bp, synthetic construct
  misc_feature 1..21: note = Synthetic Construct
  source 1..21: mol_type = other DNA
ccctccaatggctttccatca

SEQ ID NO: 19673 - DNA, 22 bp, synthetic construct
  misc_feature 1..22: note = Synthetic Construct
  source 1..22: mol_type = other DNA
agagagcatgtgtgagcttgtt

SEQ ID NO: 19674 - DNA, 23 bp, synthetic construct
  misc_feature 1..23: note = Synthetic Construct
  source 1..23: mol_type = other DNA
gctaggagaaagcaggtggaaga

SEQ ID NO: 19675 - DNA, 22 bp, synthetic construct
  misc_feature 1..22: note = Synthetic Construct
  source 1..22: mol_type = other DNA
gccaaggaacacacagcaagtt

SEQ ID NO: 19676 - DNA, 25 bp, synthetic construct
  misc_feature 1..25: note = Synthetic Construct
  source 1..25: mol_type = other DNA
cctcattctcactgttggacgttct

SEQ ID NO: 19677 - DNA, 24 bp, synthetic construct
  misc_feature 1..24: note = Synthetic Construct
  source 1..24: mol_type = other DNA
ctctgcctactttcttgtggcaaa

SEQ ID NO: 19678 - DNA, 23 bp, synthetic construct
  misc_feature 1..23: note = Synthetic Construct
  source 1..23: mol_type = other DNA
cctcatacctaggtgcagagaca

SEQ ID NO: 19679 - DNA, 21 bp, synthetic construct
  misc_feature 1..21: note = Synthetic Construct
  source 1..21: mol_type = other DNA
gctctgtcaatacccctgcaa

SEQ ID NO: 19680 - DNA, 23 bp, synthetic construct
  misc_feature 1..23: note = Synthetic Construct
  source 1..23: mol_type = other DNA
gtgctgcatcaaggagtctgaag

SEQ ID NO: 19681 - DNA, 20 bp, synthetic construct
  misc_feature 1..20: note = Synthetic Construct
  source 1..20: mol_type = other DNA
agcctgagttccagcctttg

SEQ ID NO: 19682 - DNA, 26 bp, synthetic construct
  misc_feature 1..26: note = Synthetic Construct
  source 1..26: mol_type = other DNA
cccacctctccaaataaaggagattc

SEQ ID NO: 19683 - DNA, 27 bp, synthetic construct
  misc_feature 1..27: note = Synthetic Construct
  source 1..27: mol_type = other DNA
ggccatcctcttcatttcagatcagtt

SEQ ID NO: 19684 - DNA, 24 bp, synthetic construct
  misc_feature 1..24: note = Synthetic Construct
  source 1..24: mol_type = other DNA
cagagagtcctcgaatttggtgaa

SEQ ID NO: 19685 - DNA, 21 bp, synthetic construct
  misc_feature 1..21: note = Synthetic Construct
  source 1..21: mol_type = other DNA
gaagcaactggagcaggctta

SEQ ID NO: 19686 - DNA, 25 bp, synthetic construct
  misc_feature 1..25: note = Synthetic Construct
  source 1..25: mol_type = other DNA
tggccaatgagataaaaggagttga

SEQ ID NO: 19687 - DNA, 30 bp, synthetic construct
  misc_feature 1..30: note = Synthetic Construct
  source 1..30: mol_type = other DNA
gagaggatgagcaatagttaaagagactga

SEQ ID NO: 19688 - DNA, 23 bp, synthetic construct
  misc_feature 1..23: note = Synthetic Construct
  source 1..23: mol_type = other DNA
cgatgagacaaataccggctgaa

SEQ ID NO: 19689 - DNA, 24 bp, synthetic construct
  misc_feature 1..24: note = Synthetic Construct
  source 1..24: mol_type = other DNA
ccaactctgaaaggtgctgtggaa

SEQ ID NO: 19690 - DNA, 25 bp, synthetic construct
  misc_feature 1..25: note = Synthetic Construct
  source 1..25: mol_type = other DNA
cgtgttgctaggtactgggattcat

SEQ ID NO: 19691 - DNA, 23 bp, synthetic construct
  misc_feature 1..23: note = Synthetic Construct
  source 1..23: mol_type = other DNA
ggagcctttgatggactggcatt

SEQ ID NO: 19692 - DNA, 22 bp, synthetic construct
  misc_feature 1..22: note = Synthetic Construct
  source 1..22: mol_type = other DNA
agagctggtgagagaggagtca

SEQ ID NO: 19693 - DNA, 25 bp, synthetic construct
  misc_feature 1..25: note = Synthetic Construct
  source 1..25: mol_type = other DNA
ccactctcgggtgaaccagtacata

SEQ ID NO: 19694 - DNA, 27 bp, synthetic construct
  misc_feature 1..27: note = Synthetic Construct
  source 1..27: mol_type = other DNA
gtgttccttctggaccctgaattctaa

SEQ ID NO: 19695 - DNA, 25 bp, synthetic construct
  misc_feature 1..25: note = Synthetic Construct
  source 1..25: mol_type = other DNA
gagtcctacttctgctaggacattg

SEQ ID NO: 19696 - DNA, 22 bp, synthetic construct
  misc_feature 1..22: note = Synthetic Construct
  source 1..22: mol_type = other DNA
accacaaccatcccagccattc

SEQ ID NO: 19697 - DNA, 26 bp, synthetic construct
  misc_feature 1..26: note = Synthetic Construct
  source 1..26: mol_type = other DNA
ctgttatctgcttcacacctccttct

SEQ ID NO: 19698 - DNA, 25 bp, synthetic construct
  misc_feature 1..25: note = Synthetic Construct
  source 1..25: mol_type = other DNA
cagcaagagaaatagcccgatccat

SEQ ID NO: 19699 - DNA, 27 bp, synthetic construct
  misc_feature 1..27: note = Synthetic Construct
  source 1..27: mol_type = other DNA
cagttatagagggacaaactgctcaca

SEQ ID NO: 19700 - DNA, 25 bp, synthetic construct
  misc_feature 1..25: note = Synthetic Construct
  source 1..25: mol_type = other DNA
gcagtggttggtttcatctttcact

SEQ ID NO: 19701 - DNA, 28 bp, synthetic construct
  misc_feature 1..28: note = Synthetic Construct
  source 1..28: mol_type = other DNA
ctggagttccttggatttctacagtgtt

SEQ ID NO: 19702 - DNA, 23 bp, synthetic construct
  misc_feature 1..23: note = Synthetic Construct
  source 1..23: mol_type = other DNA
cctacactctgccctccttatct

SEQ ID NO: 19703 - DNA, 26 bp, synthetic construct
  misc_feature 1..26: note = Synthetic Construct
  source 1..26: mol_type = other DNA
caagtaagtctggtgtcagcagtaac

SEQ ID NO: 19704 - DNA, 20 bp, synthetic construct
  misc_feature 1..20: note = Synthetic Construct
  source 1..20: mol_type = other DNA
cgtgttggtgccatgtgctt

SEQ ID NO: 19705 - DNA, 27 bp, synthetic construct
  misc_feature 1..27: note = Synthetic Construct
  source 1..27: mol_type = other DNA
ccacattgccaataaaaggtccctgaa

SEQ ID NO: 19706 - DNA, 22 bp, synthetic construct
  misc_feature 1..22: note = Synthetic Construct
  source 1..22: mol_type = other DNA
ggagacagcagggtctgagaga

SEQ ID NO: 19707 - DNA, 21 bp, synthetic construct
  misc_feature 1..21: note = Synthetic Construct
  source 1..21: mol_type = other DNA
ccctggctccaaccctaaact

SEQ ID NO: 19708 - DNA, 23 bp, synthetic construct
  misc_feature 1..23: note = Synthetic Construct
  source 1..23: mol_type = other DNA
cccttggtaatgcttgccctaga

SEQ ID NO: 19709 - DNA, 22 bp, synthetic construct
  misc_feature 1..22: note = Synthetic Construct
  source 1..22: mol_type = other DNA
gttagccagactggaggctaag

SEQ ID NO: 19710 - DNA, 25 bp, synthetic construct
  misc_feature 1..25: note = Synthetic Construct
  source 1..25: mol_type = other DNA
gaattacagcctgctgtgcattaaa

SEQ ID NO: 19711 - DNA, 23 bp, synthetic construct
  misc_feature 1..23: note = Synthetic Construct
  source 1..23: mol_type = other DNA
ggggagggagtactcacagcaat

SEQ ID NO: 19712 - DNA, 26 bp, synthetic construct
  misc_feature 1..26: note = Synthetic Construct
  source 1..26: mol_type = other DNA
gcattgggtcttttaccagtgaccaa

SEQ ID NO: 19713 - DNA, 26 bp, synthetic construct
  misc_feature 1..26: note = Synthetic Construct
  source 1..26: mol_type = other DNA
cactgcacacaatcaggtttatgctt

SEQ ID NO: 19714 - DNA, 23 bp, synthetic construct
  misc_feature 1..23: note = Synthetic Construct
  source 1..23: mol_type = other DNA
gggagctgagacttgccctaatc

SEQ ID NO: 19715 - DNA, 21 bp, synthetic construct
  misc_feature 1..21: note = Synthetic Construct
  source 1..21: mol_type = other DNA
gctgggtgagaggggaagaga

SEQ ID NO: 19716 - DNA, 22 bp, synthetic construct
  misc_feature 1..22: note = Synthetic Construct
  source 1..22: mol_type = other DNA
gccccaggctgttattccaatg

SEQ ID NO: 19717 - DNA, 24 bp, synthetic construct
  misc_feature 1..24: note = Synthetic Construct
  source 1..24: mol_type = other DNA
gtgtccctgctaccctggatttac

SEQ ID NO: 19718 - DNA, 26 bp, synthetic construct
  misc_feature 1..26: note = Synthetic Construct
  source 1..26: mol_type = other DNA
catcctttctcctagactggcaaaga

SEQ ID NO: 19719 - DNA, 20 bp, synthetic construct
  misc_feature 1..20: note = Synthetic Construct
  source 1..20: mol_type = other DNA
tgcataaagggcggcagtag

SEQ ID NO: 19720 - DNA, 23 bp, synthetic construct
  misc_feature 1..23: note = Synthetic Construct
  source 1..23: mol_type = other DNA
ctgtgtttgcatccactccctaa

SEQ ID NO: 19721 - DNA, 23 bp, synthetic construct
  misc_feature 1..23: note = Synthetic Construct
  source 1..23: mol_type = other DNA
gttaaagtgccgtgagcgattag

SEQ ID NO: 19722 - DNA, 22 bp, synthetic construct
  misc_feature 1..22: note = Synthetic Construct
  source 1..22: mol_type = other DNA
ggcaacactggtagcaccgtaa

SEQ ID NO: 19723 - DNA, 26 bp, synthetic construct
  misc_feature 1..26: note = Synthetic Construct
  source 1..26: mol_type = other DNA
agttgggcagattgaagtaaccttag

SEQ ID NO: 19724 - DNA, 22 bp, synthetic construct
  misc_feature 1..22: note = Synthetic Construct
  source 1..22: mol_type = other DNA
agctcgattccctgtgcagttc

SEQ ID NO: 19725 - DNA, 23 bp, synthetic construct
  misc_feature 1..23: note = Synthetic Construct
  source 1..23: mol_type = other DNA
agggccaattttgttccactact

SEQ ID NO: 19726 - DNA, 23 bp, synthetic construct
  misc_feature 1..23: note = Synthetic Construct
  source 1..23: mol_type = other DNA
agaaaggcaagcattccaagcta

SEQ ID NO: 19727 - DNA, 20 bp, synthetic construct
  misc_feature 1..20: note = Synthetic Construct
  source 1..20: mol_type = other DNA
agcgtcgaacacaccacaga

SEQ ID NO: 19728 - DNA, 24 bp, synthetic construct
  misc_feature 1..24: note = Synthetic Construct
  source 1..24: mol_type = other DNA
ggcatccagggagatgtgggaaat

SEQ ID NO: 19729 - DNA, 22 bp, synthetic construct
  misc_feature 1..22: note = Synthetic Construct
  source 1..22: mol_type = other DNA
cccagcccaatcaggctaaact

SEQ ID NO: 19730 - DNA, 24 bp, synthetic construct
  misc_feature 1..24: note = Synthetic Construct
  source 1..24: mol_type = other DNA
cctacagaactactggccaaggat

SEQ ID NO: 19731 - DNA, 25 bp, synthetic construct
  misc_feature 1..25: note = Synthetic Construct
  source 1..25: mol_type = other DNA
ttcttaatgtgtcagcagagagtca

SEQ ID NO: 19732 - DNA, 23 bp, synthetic construct
  misc_feature 1..23: note = Synthetic Construct
  source 1..23: mol_type = other DNA
gcactggaaagcagcttggtaga

SEQ ID NO: 19733 - DNA, 26 bp, synthetic construct
  misc_feature 1..26: note = Synthetic Construct
  source 1..26: mol_type = other DNA
gtgtggaggggtaaagtagggattct

SEQ ID NO: 19734 - DNA, 25 bp, synthetic construct
  misc_feature 1..25: note = Synthetic Construct
  source 1..25: mol_type = other DNA
tcccattgtgtttctcaggaaagat

SEQ ID NO: 19735 - DNA, 26 bp, synthetic construct
  misc_feature 1..26: note = Synthetic Construct
  source 1..26: mol_type = other DNA
cgataatccaacccaaagcagaaact

SEQ ID NO: 19736 - DNA, 20 bp, synthetic construct
  misc_feature 1..20: note = Synthetic Construct
  source 1..20: mol_type = other DNA
tgtagtgctcctggctcaga

SEQ ID NO: 19737 - DNA, 22 bp, synthetic construct
  misc_feature 1..22: note = Synthetic Construct
  source 1..22: mol_type = other DNA
ccctgaaccccatcaagccaat

SEQ ID NO: 19738 - DNA, 24 bp, synthetic construct
  misc_feature 1..24: note = Synthetic Construct
  source 1..24: mol_type = other DNA
ggcctcatgggagttcttttggat

SEQ ID NO: 19739 - DNA, 25 bp, synthetic construct
  misc_feature 1..25: note = Synthetic Construct
  source 1..25: mol_type = other DNA
tgtgtgacatgtacaggtgaaagtt

SEQ ID NO: 19740 - DNA, 27 bp, synthetic construct
  misc_feature 1..27: note = Synthetic Construct
  source 1..27: mol_type = other DNA
gccagatttggtttacctctaatcatc

SEQ ID NO: 19741 - DNA, 23 bp, synthetic construct
  misc_feature 1..23: note = Synthetic Construct
  source 1..23: mol_type = other DNA
agctcagtcatcccagtttctct

SEQ ID NO: 19742 - DNA, 23 bp, synthetic construct
  misc_feature 1..23: note = Synthetic Construct
  source 1..23: mol_type = other DNA
ggggccccattaggacacattac

SEQ ID NO: 19743 - DNA, 22 bp, synthetic construct
  misc_feature 1..22: note = Synthetic Construct
  source 1..22: mol_type = other DNA
gccagccattgctcagtttttc

SEQ ID NO: 19744 - DNA, 22 bp, synthetic construct
  misc_feature 1..22: note = Synthetic Construct
  source 1..22: mol_type = other DNA
ggtggctgtaatcccatcttca

SEQ ID NO: 19745 - DNA, 23 bp, synthetic construct
  misc_feature 1..23: note = Synthetic Construct
  source 1..23: mol_type = other DNA
ctgtgtgggacaaaaagcacttg

SEQ ID NO: 19746 - DNA, 23 bp, synthetic construct
  misc_feature 1..23: note = Synthetic Construct
  source 1..23: mol_type = other DNA
gtggcgttgggaaaaagaagtag

SEQ ID NO: 19747 - DNA, 21 bp, synthetic construct
  misc_feature 1..21: note = Synthetic Construct
  source 1..21: mol_type = other DNA
gagggagaatggcacacatca

SEQ ID NO: 19748 - DNA, 25 bp, synthetic construct
  misc_feature 1..25: note = Synthetic Construct
  source 1..25: mol_type = other DNA
ggaagtgaggagggaagaacagtct

SEQ ID NO: 19749 - DNA, 23 bp, synthetic construct
  misc_feature 1..23: note = Synthetic Construct
  source 1..23: mol_type = other DNA
cctgttgttccgcatccatctct

SEQ ID NO: 19750 - DNA, 22 bp, synthetic construct
  misc_feature 1..22: note = Synthetic Construct
  source 1..22: mol_type = other DNA
gtgcctgctgtttggttgagta

SEQ ID NO: 19751 - DNA, 26 bp, synthetic construct
  misc_feature 1..26: note = Synthetic Construct
  source 1..26: mol_type = other DNA
gacctactcttgggtgatgacagtaa

SEQ ID NO: 19752 - DNA, 24 bp, synthetic construct
  misc_feature 1..24: note = Synthetic Construct
  source 1..24: mol_type = other DNA
cctacctcccaggtttgctgtatg

SEQ ID NO: 19753 - DNA, 23 bp, synthetic construct
  misc_feature 1..23: note = Synthetic Construct
  source 1..23: mol_type = other DNA
cctctccactttgtccccacttc

SEQ ID NO: 19754 - DNA, 24 bp, synthetic construct
  misc_feature 1..24: note = Synthetic Construct
  source 1..24: mol_type = other DNA
cacaccgaccttgaactcctcttc

SEQ ID NO: 19755 - DNA, 24 bp, synthetic construct
  misc_feature 1..24: note = Synthetic Construct
  source 1..24: mol_type = other DNA
ggtcagcccacagagagagtttag

SEQ ID NO: 19756 - DNA, 27 bp, synthetic construct
  misc_feature 1..27: note = Synthetic Construct
  source 1..27: mol_type = other DNA
gtccaaggaagatagtctgggttgatg

SEQ ID NO: 19757 - DNA, 20 bp, synthetic construct
  misc_feature 1..20: note = Synthetic Construct
  source 1..20: mol_type = other DNA
aggcctttcctgcccctcaa

SEQ ID NO: 19758 - DNA, 21 bp, synthetic construct
  misc_feature 1..21: note = Synthetic Construct
  source 1..21: mol_type = other DNA
aggccaagtttagctgtgtgt

SEQ ID NO: 19759 - DNA, 23 bp, synthetic construct
  misc_feature 1..23: note = Synthetic Construct
  source 1..23: mol_type = other DNA
tcatccagtccaacctcttcctt

SEQ ID NO: 19760 - DNA, 21 bp, synthetic construct
  misc_feature 1..21: note = Synthetic Construct
  source 1..21: mol_type = other DNA
aggcagagacagaacccagaa

SEQ ID NO: 19761 - DNA, 22 bp, synthetic construct
  misc_feature 1..22: note = Synthetic Construct
  source 1..22: mol_type = other DNA
ccaaaccagagcacactcaact

SEQ ID NO: 19762 - DNA, 24 bp, synthetic construct
  misc_feature 1..24: note = Synthetic Construct
  source 1..24: mol_type = other DNA
acctcttcccctcatcctttatgt

SEQ ID NO: 19763 - DNA, 26 bp, synthetic construct
  misc_feature 1..26: note = Synthetic Construct
  source 1..26: mol_type = other DNA
ctgtgttatctaggattgcaccttct

SEQ ID NO: 19764 - DNA, 20 bp, synthetic construct
  misc_feature 1..20: note = Synthetic Construct
  source 1..20: mol_type = other DNA
cggccacattgtgagtctgt

SEQ ID NO: 19765 - DNA, 24 bp, synthetic construct
  misc_feature 1..24: note = Synthetic Construct
  source 1..24: mol_type = other DNA
caaatgtctggcccttggatatga

SEQ ID NO: 19766 - DNA, 22 bp, synthetic construct
  misc_feature 1..22: note = Synthetic Construct
  source 1..22: mol_type = other DNA
tggggtttggagtccatgttac

SEQ ID NO: 19767 - DNA, 26 bp, synthetic construct
  misc_feature 1..26: note = Synthetic Construct
  source 1..26: mol_type = other DNA
gcaggaagcatgtaaagaacaagaag

SEQ ID NO: 19768 - DNA, 22 bp, synthetic construct
  misc_feature 1..22: note = Synthetic Construct
  source 1..22: mol_type = other DNA
cctgtggaaggtggttgtcaga

SEQ ID NO: 19769 - DNA, 24 bp, synthetic construct
  misc_feature 1..24: note = Synthetic Construct
  source 1..24: mol_type = other DNA
gaattgtcaatcccagcagtcaga

SEQ ID NO: 19770 - DNA, 23 bp, synthetic construct
  misc_feature 1..23: note = Synthetic Construct
  source 1..23: mol_type = other DNA
aatgggtggtgttctggaagatt

SEQ ID NO: 19771 - DNA, 21 bp, synthetic construct
  misc_feature 1..21: note = Synthetic Construct
  source 1..21: mol_type = other DNA
gggtctgaaaggggcagattg

SEQ ID NO: 19772 - DNA, 22 bp, synthetic construct
  misc_feature 1..22: note = Synthetic Construct
  source 1..22: mol_type = other DNA
gggacaccaatctgggacagaa

SEQ ID NO: 19773 - DNA, 24 bp, synthetic construct
  misc_feature 1..24: note = Synthetic Construct
  source 1..24: mol_type = other DNA
acgctggtagaggttctttcattt

SEQ ID NO: 19774 - DNA, 22 bp, synthetic construct
  misc_feature 1..22: note = Synthetic Construct
  source 1..22: mol_type = other DNA
gcagagagtcaggcaggagaca

SEQ ID NO: 19775 - DNA, 22 bp, synthetic construct
  misc_feature 1..22: note = Synthetic Construct
  source 1..22: mol_type = other DNA
ccagcatagtggtagcccttca

SEQ ID NO: 19776 - DNA, 24 bp, synthetic construct
  misc_feature 1..24: note = Synthetic Construct
  source 1..24: mol_type = other DNA
ctctcaaacacttagctggcaaaa

SEQ ID NO: 19777 - DNA, 21 bp, synthetic construct
  misc_feature 1..21: note = Synthetic Construct
  source 1..21: mol_type = other DNA
gctccaaagccctccttcatc

SEQ ID NO: 19778 - DNA, 24 bp, synthetic construct
  misc_feature 1..24: note = Synthetic Construct
  source 1..24: mol_type = other DNA
ccgtgcctatcagttctccatttg

SEQ ID NO: 19779 - DNA, 23 bp, synthetic construct
  misc_feature 1..23: note = Synthetic Construct
  source 1..23: mol_type = other DNA
tcctacagtcctcctcgctcaag

SEQ ID NO: 19780 - DNA, 27 bp, synthetic construct
  misc_feature 1..27: note = Synthetic Construct
  source 1..27: mol_type = other DNA
ctgacatgtgcttttaagtccctgcta

SEQ ID NO: 19781 - DNA, 25 bp, synthetic construct
  misc_feature 1..25: note = Synthetic Construct
  source 1..25: mol_type = other DNA
gccctaactgatcccatgagaggtt

SEQ ID NO: 19782 - DNA, 22 bp, synthetic construct
  misc_feature 1..22: note = Synthetic Construct
  source 1..22: mol_type = other DNA
acagcccctgtagctagtggaa

SEQ ID NO: 19783 - DNA, 25 bp, synthetic construct
  misc_feature 1..25: note = Synthetic Construct
  source 1..25: mol_type = other DNA
catttcagtccttgacgtaccaatc

SEQ ID NO: 19784 - DNA, 19 bp, synthetic construct
  misc_feature 1..19: note = Synthetic Construct
  source 1..19: mol_type = other DNA
atggacccttccgctgaca

SEQ ID NO: 19785 - DNA, 20 bp, synthetic construct
  misc_feature 1..20: note = Synthetic Construct
  source 1..20: mol_type = other DNA
tgcccttgtgctccccattc

SEQ ID NO: 19786 - DNA, 28 bp, synthetic construct
  misc_feature 1..28: note = Synthetic Construct
  source 1..28: mol_type = other DNA
ccatcctccagtatatccctcctgtatg

SEQ ID NO: 19787 - DNA, 23 bp, synthetic construct
  misc_feature 1..23: note = Synthetic Construct
  source 1..23: mol_type = other DNA
ggcttccctgcttcagagataga

SEQ ID NO: 19788 - DNA, 26 bp, synthetic construct
  misc_feature 1..26: note = Synthetic Construct
  source 1..26: mol_type = other DNA
ctgacataggatcacttctgtagcat

SEQ ID NO: 19789 - DNA, 26 bp, synthetic construct
  misc_feature 1..26: note = Synthetic Construct
  source 1..26: mol_type = other DNA
cagagctgaatttcctggctaaggat

SEQ ID NO: 19790 - DNA, 26 bp, synthetic construct
  misc_feature 1..26: note = Synthetic Construct
  source 1..26: mol_type = other DNA
gcaaatgtatgccttgttgggcattg

SEQ ID NO: 19791 - DNA, 25 bp, synthetic construct
  misc_feature 1..25: note = Synthetic Construct
  source 1..25: mol_type = other DNA
gcccagacatatcctcagtcatttg

SEQ ID NO: 19792 - DNA, 20 bp, synthetic construct
  misc_feature 1..20: note = Synthetic Construct
  source 1..20: mol_type = other DNA
ggggcttctcagccattcaa

SEQ ID NO: 19793 - DNA, 25 bp, synthetic construct
  misc_feature 1..25: note = Synthetic Construct
  source 1..25: mol_type = other DNA
ctgtgcctgacaaagtagtgacaga

SEQ ID NO: 19794 - DNA, 22 bp, synthetic construct
  misc_feature 1..22: note = Synthetic Construct
  source 1..22: mol_type = other DNA
gaggcaaggaaagaccgtatca

SEQ ID NO: 19795 - DNA, 22 bp, synthetic construct
  misc_feature 1..22: note = Synthetic Construct
  source 1..22: mol_type = other DNA
aggggtgcagttagtgctatga

SEQ ID NO: 19796 - DNA, 25 bp, synthetic construct
  misc_feature 1..25: note = Synthetic Construct
  source 1..25: mol_type = other DNA
ggctgctgttacaagacagagacat

SEQ ID NO: 19797 - DNA, 23 bp, synthetic construct
  misc_feature 1..23: note = Synthetic Construct
  source 1..23: mol_type = other DNA
ccaggaagctggcaagagttttt

SEQ ID NO: 19798 - DNA, 23 bp, synthetic construct
  misc_feature 1..23: note = Synthetic Construct
  source 1..23: mol_type = other DNA
cacttcctgccacttgccttaaa

SEQ ID NO: 19799 - DNA, 18 bp, synthetic construct
  misc_feature 1..18: note = Synthetic Construct
  source 1..18: mol_type = other DNA
actcgcagctgccgctaa

SEQ ID NO: 19800 - DNA, 27 bp, synthetic construct
  misc_feature 1..27: note = Synthetic Construct
  source 1..27: mol_type = other DNA
ggatctgagcccatttgactataaaac

SEQ ID NO: 19801 - DNA, 25 bp, synthetic construct
  misc_feature 1..25: note = Synthetic Construct
  source 1..25: mol_type = other DNA
gctaggttcaagtgaggataacact

SEQ ID NO: 19802 - DNA, 26 bp, synthetic construct
  misc_feature 1..26: note = Synthetic Construct
  source 1..26: mol_type = other DNA
gtctcaggaataaagctactggttca

SEQ ID NO: 19803 - DNA, 23 bp, synthetic construct
  misc_feature 1..23: note = Synthetic Construct
  source 1..23: mol_type = other DNA
ccccagtgtccccatcttggtaa

SEQ ID NO: 19804 - DNA, 23 bp, synthetic construct
  misc_feature 1..23: note = Synthetic Construct
  source 1..23: mol_type = other DNA
caagaacaatgggtgctgagtct

SEQ ID NO: 19805 - DNA, 25 bp, synthetic construct
  misc_feature 1..25: note = Synthetic Construct
  source 1..25: mol_type = other DNA
ggcagattcaccatgtatgttttgt

SEQ ID NO: 19806 - DNA, 26 bp, synthetic construct
  misc_feature 1..26: note = Synthetic Construct
  source 1..26: mol_type = other DNA
ggagcagatcacctaaatctaaggaa

SEQ ID NO: 19807 - DNA, 23 bp, synthetic construct
  misc_feature 1..23: note = Synthetic Construct
  source 1..23: mol_type = other DNA
tggctgacagttattgtcccatt

SEQ ID NO: 19808 - DNA, 23 bp, synthetic construct
  misc_feature 1..23: note = Synthetic Construct
  source 1..23: mol_type = other DNA
tcctgaattcccaggtcttgtct

SEQ ID NO: 19809 - DNA, 26 bp, synthetic construct
  misc_feature 1..26: note = Synthetic Construct
  source 1..26: mol_type = other DNA
gactggcatgtgtctagatatgttgt

SEQ ID NO: 19810 - DNA, 26 bp, synthetic construct
  misc_feature 1..26: note = Synthetic Construct
  source 1..26: mol_type = other DNA
gggagcaagaatagaagaaggtgact

SEQ ID NO: 19811 - DNA, 22 bp, synthetic construct
  misc_feature 1..22: note = Synthetic Construct
  source 1..22: mol_type = other DNA
ggtaagtgtccatccagccatt

SEQ ID NO: 19812 - DNA, 21 bp, synthetic construct
  misc_feature 1..21: note = Synthetic Construct
  source 1..21: mol_type = other DNA
agccctgcaagacctagagat

SEQ ID NO: 19813 - DNA, 22 bp, synthetic construct
  misc_feature 1..22: note = Synthetic Construct
  source 1..22: mol_type = other DNA
tcagagagaggggaagcccaaa

SEQ ID NO: 19814 - DNA, 27 bp, synthetic construct
  misc_feature 1..27: note = Synthetic Construct
  source 1..27: mol_type = other DNA
ctctccctctatattaaaacggtgcat

SEQ ID NO: 19815 - DNA, 30 bp, synthetic construct
  misc_feature 1..30: note = Synthetic Construct
  source 1..30: mol_type = other DNA
gacagaagaaatccaagacccagagatatt

SEQ ID NO: 19816 - DNA, 25 bp, synthetic construct
  misc_feature 1..25: note = Synthetic Construct
  source 1..25: mol_type = other DNA
gcacccaaccacttttgtactcttg

SEQ ID NO: 19817 - DNA, 27 bp, synthetic construct
  misc_feature 1..27: note = Synthetic Construct
  source 1..27: mol_type = other DNA
gggagtagcctagaagtgatatagaga

SEQ ID NO: 19818 - DNA, 23 bp, synthetic construct
  misc_feature 1..23: note = Synthetic Construct
  source 1..23: mol_type = other DNA
ggccatgctgagaattgcaggaa

SEQ ID NO: 19819 - DNA, 24 bp, synthetic construct
  misc_feature 1..24: note = Synthetic Construct
  source 1..24: mol_type = other DNA
gttatgcactcctcagccagtatc

SEQ ID NO: 19820 - DNA, 22 bp, synthetic construct
  misc_feature 1..22: note = Synthetic Construct
  source 1..22: mol_type = other DNA
cctgaagtagagcctccagcat

SEQ ID NO: 19821 - DNA, 24 bp, synthetic construct
  misc_feature 1..24: note = Synthetic Construct
  source 1..24: mol_type = other DNA
ccatggggataccttcaactgtaa

SEQ ID NO: 19822 - DNA, 21 bp, synthetic construct
  misc_feature 1..21: note = Synthetic Construct
  source 1..21: mol_type = other DNA
ggggcaagttctcagccttga

SEQ ID NO: 19823 - DNA, 22 bp, synthetic construct
  misc_feature 1..22: note = Synthetic Construct
  source 1..22: mol_type = other DNA
atgccagtctagctcagctttt

SEQ ID NO: 19824 - DNA, 22 bp, synthetic construct
  misc_feature 1..22: note = Synthetic Construct
  source 1..22: mol_type = other DNA
ccaagatctaagccaccaccat

SEQ ID NO: 19825 - DNA, 22 bp, synthetic construct
  misc_feature 1..22: note = Synthetic Construct
  source 1..22: mol_type = other DNA
cctcccaagtggcatgaggaaa

SEQ ID NO: 19826 - DNA, 23 bp, synthetic construct
  misc_feature 1..23: note = Synthetic Construct
  source 1..23: mol_type = other DNA
gccagagacgttactgactggtt

SEQ ID NO: 19827 - DNA, 26 bp, synthetic construct
  misc_feature 1..26: note = Synthetic Construct
  source 1..26: mol_type = other DNA
cagtcctttgtgttccattgaaggat

SEQ ID NO: 19828 - DNA, 25 bp, synthetic construct
  misc_feature 1..25: note = Synthetic Construct
  source 1..25: mol_type = other DNA
ggatgtgcaccttgatgagtagaaa

SEQ ID NO: 19829 - DNA, 20 bp, synthetic construct
  misc_feature 1..20: note = Synthetic Construct
  source 1..20: mol_type = other DNA
ggctctgaagcagctggaat

SEQ ID NO: 19830 - DNA, 24 bp, synthetic construct
  misc_feature 1..24: note = Synthetic Construct
  source 1..24: mol_type = other DNA
tggcatgactcaatcctatgcttt

SEQ ID NO: 19831 - DNA, 28 bp, synthetic construct
  misc_feature 1..28: note = Synthetic Construct
  source 1..28: mol_type = other DNA
gctcccttgctactataaagtgatgttc

SEQ ID NO: 19832 - DNA, 24 bp, synthetic construct
  misc_feature 1..24: note = Synthetic Construct
  source 1..24: mol_type = other DNA
gcacagagacccatgagagttgaa

SEQ ID NO: 19833 - DNA, 25 bp, synthetic construct
  misc_feature 1..25: note = Synthetic Construct
  source 1..25: mol_type = other DNA
gggtgtcgaaaggatccagagatta

SEQ ID NO: 19834 - DNA, 29 bp, synthetic construct
  misc_feature 1..29: note = Synthetic Construct
  source 1..29: mol_type = other DNA
gcctccaatatttacgaacttgccttgta

SEQ ID NO: 19835 - DNA, 22 bp, synthetic construct
  misc_feature 1..22: note = Synthetic Construct
  source 1..22: mol_type = other DNA
gaaggtaccaaaccctgctcaa

SEQ ID NO: 19836 - DNA, 25 bp, synthetic construct
  misc_feature 1..25: note = Synthetic Construct
  source 1..25: mol_type = other DNA
gtcagacccctattcctctggacaa

SEQ ID NO: 19837 - DNA, 24 bp, synthetic construct
  misc_feature 1..24: note = Synthetic Construct
  source 1..24: mol_type = other DNA
cccaaggacgtcaagtgtttctgt

SEQ ID NO: 19838 - DNA, 23 bp, synthetic construct
  misc_feature 1..23: note = Synthetic Construct
  source 1..23: mol_type = other DNA
gagaccaaaaaggtcagccatgt

SEQ ID NO: 19839 - DNA, 21 bp, synthetic construct
  misc_feature 1..21: note = Synthetic Construct
  source 1..21: mol_type = other DNA
cgctgagacccagggcttcta

SEQ ID NO: 19840 - DNA, 22 bp, synthetic construct
  misc_feature 1..22: note = Synthetic Construct
  source 1..22: mol_type = other DNA
gccaccgggctaatttccatgt

SEQ ID NO: 19841 - DNA, 23 bp, synthetic construct
  misc_feature 1..23: note = Synthetic Construct
  source 1..23: mol_type = other DNA
gcaccaagtgcatgacaaatgta

SEQ ID NO: 19842 - DNA, 24 bp, synthetic construct
  misc_feature 1..24: note = Synthetic Construct
  source 1..24: mol_type = other DNA
tggatgcttcacctgtcttagtct

SEQ ID NO: 19843 - DNA, 23 bp, synthetic construct
  misc_feature 1..23: note = Synthetic Construct
  source 1..23: mol_type = other DNA
gtcacaagtcctgaccagttaca

SEQ ID NO: 19844 - DNA, 25 bp, synthetic construct
  misc_feature 1..25: note = Synthetic Construct
  source 1..25: mol_type = other DNA
gagcagtggtcctttatcatcatct

SEQ ID NO: 19845 - DNA, 23 bp, synthetic construct
  misc_feature 1..23: note = Synthetic Construct
  source 1..23: mol_type = other DNA
gctcaacaggaggatcagagcat

SEQ ID NO: 19846 - DNA, 24 bp, synthetic construct
  misc_feature 1..24: note = Synthetic Construct
  source 1..24: mol_type = other DNA
gggagatacacaacactgctcaga

SEQ ID NO: 19847 - DNA, 22 bp, synthetic construct
  misc_feature 1..22: note = Synthetic Construct
  source 1..22: mol_type = other DNA
gagtggtggtaggacagagaca

SEQ ID NO: 19848 - DNA, 21 bp, synthetic construct
  misc_feature 1..21: note = Synthetic Construct
  source 1..21: mol_type = other DNA
agaggcaagatggtgggatga

SEQ ID NO: 19849 - DNA, 28 bp, synthetic construct
  misc_feature 1..28: note = Synthetic Construct
  source 1..28: mol_type = other DNA
gggtaagacattccccactaaatccata

SEQ ID NO: 19850 - DNA, 24 bp, synthetic construct
  misc_feature 1..24: note = Synthetic Construct
  source 1..24: mol_type = other DNA
ggattggcattgtttgcctgtatg

SEQ ID NO: 19851 - DNA, 24 bp, synthetic construct
  misc_feature 1..24: note = Synthetic Construct
  source 1..24: mol_type = other DNA
gggtttttgtgagcctgataggaa

SEQ ID NO: 19852 - DNA, 25 bp, synthetic construct
  misc_feature 1..25: note = Synthetic Construct
  source 1..25: mol_type = other DNA
cactcaaaaacatgctgctttctct

SEQ ID NO: 19853 - DNA, 25 bp, synthetic construct
  misc_feature 1..25: note = Synthetic Construct
  source 1..25: mol_type = other DNA
cactaggcaccatactcacatactt

SEQ ID NO: 19854 - DNA, 21 bp, synthetic construct
  misc_feature 1..21: note = Synthetic Construct
  source 1..21: mol_type = other DNA
gctaaccccagccctcacttc

SEQ ID NO: 19855 - DNA, 25 bp, synthetic construct
  misc_feature 1..25: note = Synthetic Construct
  source 1..25: mol_type = other DNA
cgaggccattgtagaacaagaaatc

SEQ ID NO: 19856 - DNA, 22 bp, synthetic construct
  misc_feature 1..22: note = Synthetic Construct
  source 1..22: mol_type = other DNA
gcatgccctccttcatggtcta

SEQ ID NO: 19857 - DNA, 20 bp, synthetic construct
  misc_feature 1..20: note = Synthetic Construct
  source 1..20: mol_type = other DNA
acccagcatgcaaagtcagt

SEQ ID NO: 19858 - DNA, 21 bp, synthetic construct
  misc_feature 1..21: note = Synthetic Construct
  source 1..21: mol_type = other DNA
ccggggcaaaacttggtaaac

SEQ ID NO: 19859 - DNA, 21 bp, synthetic construct
  misc_feature 1..21: note = Synthetic Construct
  source 1..21: mol_type = other DNA
tcagcattgcttcacctgtgt

SEQ ID NO: 19860 - DNA, 29 bp, synthetic construct
  misc_feature 1..29: note = Synthetic Construct
  source 1..29: mol_type = other DNA
cccatggcctaaaggattaagagagtttc

SEQ ID NO: 19861 - DNA, 24 bp, synthetic construct
  misc_feature 1..24: note = Synthetic Construct
  source 1..24: mol_type = other DNA
caagagctccacttacgtccaaag

SEQ ID NO: 19862 - DNA, 24 bp, synthetic construct
  misc_feature 1..24: note = Synthetic Construct
  source 1..24: mol_type = other DNA
gtccagttttccaggtccaagaca

SEQ ID NO: 19863 - DNA, 28 bp, synthetic construct
  misc_feature 1..28: note = Synthetic Construct
  source 1..28: mol_type = other DNA
ccctccaccttaaatgctctttcctgta

SEQ ID NO: 19864 - DNA, 23 bp, synthetic construct
  misc_feature 1..23: note = Synthetic Construct
  source 1..23: mol_type = other DNA
tttggggttggtttcctgtactt

SEQ ID NO: 19865 - DNA, 23 bp, synthetic construct
  misc_feature 1..23: note = Synthetic Construct
  source 1..23: mol_type = other DNA
tgcagcaccacactcaataatgt

SEQ ID NO: 19866 - DNA, 25 bp, synthetic construct
  misc_feature 1..25: note = Synthetic Construct
  source 1..25: mol_type = other DNA
aggtcagttacttggttgtcaagaa

SEQ ID NO: 19867 - DNA, 23 bp, synthetic construct
  misc_feature 1..23: note = Synthetic Construct
  source 1..23: mol_type = other DNA
agtgggagaactgaagacctcat

SEQ ID NO: 19868 - DNA, 24 bp, synthetic construct
  misc_feature 1..24: note = Synthetic Construct
  source 1..24: mol_type = other DNA
ttcagaggtgttaggttcagcaaa

SEQ ID NO: 19869 - DNA, 19 bp, synthetic construct
  misc_feature 1..19: note = Synthetic Construct
  source 1..19: mol_type = other DNA
ccgcgaagagcccctgaaa

SEQ ID NO: 19870 - DNA, 22 bp, synthetic construct
  misc_feature 1..22: note = Synthetic Construct
  source 1..22: mol_type = other DNA
gcagtggggtttgttcatggta

SEQ ID NO: 19871 - DNA, 25 bp, synthetic construct
  misc_feature 1..25: note = Synthetic Construct
  source 1..25: mol_type = other DNA
gcttggtttttggaaccattcttga

SEQ ID NO: 19872 - DNA, 25 bp, synthetic construct
  misc_feature 1..25: note = Synthetic Construct
  source 1..25: mol_type = other DNA
gtgctttgcatacagtaggtcatca

SEQ ID NO: 19873 - DNA, 23 bp, synthetic construct
  misc_feature 1..23: note = Synthetic Construct
  source 1..23: mol_type = other DNA
ggcggggtaccaagtaaagttgt

SEQ ID NO: 19874 - DNA, 26 bp, synthetic construct
  misc_feature 1..26: note = Synthetic Construct
  source 1..26: mol_type = other DNA
cgggtcaacatttacactgactccaa

SEQ ID NO: 19875 - DNA, 24 bp, synthetic construct
  misc_feature 1..24: note = Synthetic Construct
  source 1..24: mol_type = other DNA
gactgtgtttgagaggggcttcta

SEQ ID NO: 19876 - DNA, 23 bp, synthetic construct
  misc_feature 1..23: note = Synthetic Construct
  source 1..23: mol_type = other DNA
acccttaagaggcatttgtgtca

SEQ ID NO: 19877 - DNA, 27 bp, synthetic construct
  misc_feature 1..27: note = Synthetic Construct
  source 1..27: mol_type = other DNA
gactcctagttgctgaagtctctgtag

SEQ ID NO: 19878 - DNA, 30 bp, synthetic construct
  misc_feature 1..30: note = Synthetic Construct
  source 1..30: mol_type = other DNA
ggaatggtcctataacctaaggtgtttact

SEQ ID NO: 19879 - DNA, 25 bp, synthetic construct
  misc_feature 1..25: note = Synthetic Construct
  source 1..25: mol_type = other DNA
caaggggagagacattattggcatt

SEQ ID NO: 19880 - DNA, 27 bp, synthetic construct
  misc_feature 1..27: note = Synthetic Construct
  source 1..27: mol_type = other DNA
ggagaagccaaaataagggtgttgttg

SEQ ID NO: 19881 - DNA, 21 bp, synthetic construct
  misc_feature 1..21: note = Synthetic Construct
  source 1..21: mol_type = other DNA
acgttgccccagaccctatca

SEQ ID NO: 19882 - DNA, 23 bp, synthetic construct
  misc_feature 1..23: note = Synthetic Construct
  source 1..23: mol_type = other DNA
ctctcagcgcaagaacctagaag

SEQ ID NO: 19883 - DNA, 23 bp, synthetic construct
  misc_feature 1..23: note = Synthetic Construct
  source 1..23: mol_type = other DNA
cagagaagctaatgtggcagtga

SEQ ID NO: 19884 - DNA, 22 bp, synthetic construct
  misc_feature 1..22: note = Synthetic Construct
  source 1..22: mol_type = other DNA
tggagtcaggcctagggtttag

SEQ ID NO: 19885 - DNA, 22 bp, synthetic construct
  misc_feature 1..22: note = Synthetic Construct
  source 1..22: mol_type = other DNA
tccactctttgaggctgtgaga

SEQ ID NO: 19886 - DNA, 29 bp, synthetic construct
  misc_feature 1..29: note = Synthetic Construct
  source 1..29: mol_type = other DNA
gcaaccattttcatgcccctttagtatca

SEQ ID NO: 19887 - DNA, 21 bp, synthetic construct
  misc_feature 1..21: note = Synthetic Construct
  source 1..21: mol_type = other DNA
tggggaaagggaagaggacat

SEQ ID NO: 19888 - DNA, 25 bp, synthetic construct
  misc_feature 1..25: note = Synthetic Construct
  source 1..25: mol_type = other DNA
caggaagaaatagggctactgtcaa

SEQ ID NO: 19889 - DNA, 24 bp, synthetic construct
  misc_feature 1..24: note = Synthetic Construct
  source 1..24: mol_type = other DNA
gcaactttttgccttggtgttgtt

SEQ ID NO: 19890 - DNA, 22 bp, synthetic construct
  misc_feature 1..22: note = Synthetic Construct
  source 1..22: mol_type = other DNA
agagccaggtacatgccagcta

SEQ ID NO: 19891 - DNA, 25 bp, synthetic construct
  misc_feature 1..25: note = Synthetic Construct
  source 1..25: mol_type = other DNA
gggtttaggaatggcaggtcatttg

SEQ ID NO: 19892 - DNA, 22 bp, synthetic construct
  misc_feature 1..22: note = Synthetic Construct
  source 1..22: mol_type = other DNA
tcctacacctgcctctccaatc

SEQ ID NO: 19893 - DNA, 24 bp, synthetic construct
  misc_feature 1..24: note = Synthetic Construct
  source 1..24: mol_type = other DNA
actctggctgctggaataaacaat

SEQ ID NO: 19894 - DNA, 24 bp, synthetic construct
  misc_feature 1..24: note = Synthetic Construct
  source 1..24: mol_type = other DNA
gtggctgttgtcagactttgattc

SEQ ID NO: 19895 - DNA, 22 bp, synthetic construct
  misc_feature 1..22: note = Synthetic Construct
  source 1..22: mol_type = other DNA
ggcctgcttcaaagtcccagaa

SEQ ID NO: 19896 - DNA, 22 bp, synthetic construct
  misc_feature 1..22: note = Synthetic Construct
  source 1..22: mol_type = other DNA
ctctcagctagcagacccacat

SEQ ID NO: 19897 - DNA, 25 bp, synthetic construct
  misc_feature 1..25: note = Synthetic Construct
  source 1..25: mol_type = other DNA
cagtttggtgaatggaaggttctga

SEQ ID NO: 19898 - DNA, 20 bp, synthetic construct
  misc_feature 1..20: note = Synthetic Construct
  source 1..20: mol_type = other DNA
agctgccatttccccacaat

SEQ ID NO: 19899 - DNA, 25 bp, synthetic construct
  misc_feature 1..25: note = Synthetic Construct
  source 1..25: mol_type = other DNA
gccccaggtcttttcaggcatttag

SEQ ID NO: 19900 - DNA, 27 bp, synthetic construct
  misc_feature 1..27: note = Synthetic Construct
  source 1..27: mol_type = other DNA
gccctttagaaagcttgaagtccttag

SEQ ID NO: 19901 - DNA, 20 bp, synthetic construct
  misc_feature 1..20: note = Synthetic Construct
  source 1..20: mol_type = other DNA
aggccagcccctggagaact

SEQ ID NO: 19902 - DNA, 24 bp, synthetic construct
  misc_feature 1..24: note = Synthetic Construct
  source 1..24: mol_type = other DNA
cacggcagtcttcaatgagtcaga

SEQ ID NO: 19903 - DNA, 21 bp, synthetic construct
  misc_feature 1..21: note = Synthetic Construct
  source 1..21: mol_type = other DNA
gggtgggtgcttggttaacat

SEQ ID NO: 19904 - DNA, 26 bp, synthetic construct
  misc_feature 1..26: note = Synthetic Construct
  source 1..26: mol_type = other DNA
gcaaccttggttcatatccattcgtt

SEQ ID NO: 19905 - DNA, 29 bp, synthetic construct
  misc_feature 1..29: note = Synthetic Construct
  source 1..29: mol_type = other DNA
ggaagtttcttaaaggtaggaaccccata

SEQ ID NO: 19906 - DNA, 27 bp, synthetic construct
  misc_feature 1..27: note = Synthetic Construct
  source 1..27: mol_type = other DNA
ggggaatttgtcttgcaccttagatgt

SEQ ID NO: 19907 - DNA, 24 bp, synthetic construct
  misc_feature 1..24: note = Synthetic Construct
  source 1..24: mol_type = other DNA
ggatgcaagccactttagcactca

SEQ ID NO: 19908 - DNA, 26 bp, synthetic construct
  misc_feature 1..26: note = Synthetic Construct
  source 1..26: mol_type = other DNA
gtgaaggattaaaacagcccaactgt

SEQ ID NO: 19909 - DNA, 23 bp, synthetic construct
  misc_feature 1..23: note = Synthetic Construct
  source 1..23: mol_type = other DNA
gagaagggaactggaaggcgaat

SEQ ID NO: 19910 - DNA, 26 bp, synthetic construct
  misc_feature 1..26: note = Synthetic Construct
  source 1..26: mol_type = other DNA
cagtatggatcatgcttctcttgtca

SEQ ID NO: 19911 - DNA, 21 bp, synthetic construct
  misc_feature 1..21: note = Synthetic Construct
  source 1..21: mol_type = other DNA
tcacagcaacaagccatgtga

SEQ ID NO: 19912 - DNA, 23 bp, synthetic construct
  misc_feature 1..23: note = Synthetic Construct
  source 1..23: mol_type = other DNA
ctgttgttccaaacctccctttc

SEQ ID NO: 19913 - DNA, 22 bp, synthetic construct
  misc_feature 1..22: note = Synthetic Construct
  source 1..22: mol_type = other DNA
ctgcccatctccttctgtcttc

SEQ ID NO: 19914 - DNA, 22 bp, synthetic construct
  misc_feature 1..22: note = Synthetic Construct
  source 1..22: mol_type = other DNA
ctgctgaagtcctcctctgtct

SEQ ID NO: 19915 - DNA, 23 bp, synthetic construct
  misc_feature 1..23: note = Synthetic Construct
  source 1..23: mol_type = other DNA
ccaccaactactgcagtctgaac

SEQ ID NO: 19916 - DNA, 23 bp, synthetic construct
  misc_feature 1..23: note = Synthetic Construct
  source 1..23: mol_type = other DNA
gtccccagtgtgtttcctagact

SEQ ID NO: 19917 - DNA, 24 bp, synthetic construct
  misc_feature 1..24: note = Synthetic Construct
  source 1..24: mol_type = other DNA
gtttgactgtctggcgttctttct

SEQ ID NO: 19918 - DNA, 22 bp, synthetic construct
  misc_feature 1..22: note = Synthetic Construct
  source 1..22: mol_type = other DNA
gcaatggcctccaccatacgat

SEQ ID NO: 19919 - DNA, 20 bp, synthetic construct
  misc_feature 1..20: note = Synthetic Construct
  source 1..20: mol_type = other DNA
gccagggcatttgcactttg

SEQ ID NO: 19920 - DNA, 26 bp, synthetic construct
  misc_feature 1..26: note = Synthetic Construct
  source 1..26: mol_type = other DNA
gcaccatttggtttctgctcatttag

SEQ ID NO: 19921 - DNA, 25 bp, synthetic construct
  misc_feature 1..25: note = Synthetic Construct
  source 1..25: mol_type = other DNA
ggaagtgaaggaggcttctcctgat

SEQ ID NO: 19922 - DNA, 23 bp, synthetic construct
  misc_feature 1..23: note = Synthetic Construct
  source 1..23: mol_type = other DNA
gcccagggaaatctccacttatc

SEQ ID NO: 19923 - DNA, 30 bp, synthetic construct
  misc_feature 1..30: note = Synthetic Construct
  source 1..30: mol_type = other DNA
ccaagataagaagtacaggccaatttcgtt

SEQ ID NO: 19924 - DNA, 24 bp, synthetic construct
  misc_feature 1..24: note = Synthetic Construct
  source 1..24: mol_type = other DNA
gttactgactcactgtaggcacaa

SEQ ID NO: 19925 - DNA, 24 bp, synthetic construct
  misc_feature 1..24: note = Synthetic Construct
  source 1..24: mol_type = other DNA
acataagtcacgctggacaaagaa

SEQ ID NO: 19926 - DNA, 27 bp, synthetic construct
  misc_feature 1..27: note = Synthetic Construct
  source 1..27: mol_type = other DNA
cacaagatgtgtgttcttagccattac

SEQ ID NO: 19927 - DNA, 24 bp, synthetic construct
  misc_feature 1..24: note = Synthetic Construct
  source 1..24: mol_type = other DNA
gggcactgatgctatctctggaaa

SEQ ID NO: 19928 - DNA, 25 bp, synthetic construct
  misc_feature 1..25: note = Synthetic Construct
  source 1..25: mol_type = other DNA
gtcaggatcacctccagactgtact

SEQ ID NO: 19929 - DNA, 23 bp, synthetic construct
  misc_feature 1..23: note = Synthetic Construct
  source 1..23: mol_type = other DNA
gctgactctgtggaagtgtggtt

SEQ ID NO: 19930 - DNA, 26 bp, synthetic construct
  misc_feature 1..26: note = Synthetic Construct
  source 1..26: mol_type = other DNA
gtgatggtgttttctggagaggattg

SEQ ID NO: 19931 - DNA, 25 bp, synthetic construct
  misc_feature 1..25: note = Synthetic Construct
  source 1..25: mol_type = other DNA
gctcacctctcttggtagtttcact

SEQ ID NO: 19932 - DNA, 23 bp, synthetic construct
  misc_feature 1..23: note = Synthetic Construct
  source 1..23: mol_type = other DNA
agagccctttggaatttcagctt

SEQ ID NO: 19933 - DNA, 24 bp, synthetic construct
  misc_feature 1..24: note = Synthetic Construct
  source 1..24: mol_type = other DNA
ggtggctcttttagccgactttag

SEQ ID NO: 19934 - DNA, 27 bp, synthetic construct
  misc_feature 1..27: note = Synthetic Construct
  source 1..27: mol_type = other DNA
ggccaaggttagtaattcatggagaga

SEQ ID NO: 19935 - DNA, 24 bp, synthetic construct
  misc_feature 1..24: note = Synthetic Construct
  source 1..24: mol_type = other DNA
tctcaggaagaaagggtagactgt

SEQ ID NO: 19936 - DNA, 21 bp, synthetic construct
  misc_feature 1..21: note = Synthetic Construct
  source 1..21: mol_type = other DNA
acggaggacaggtctctgcta

SEQ ID NO: 19937 - DNA, 24 bp, synthetic construct
  misc_feature 1..24: note = Synthetic Construct
  source 1..24: mol_type = other DNA
tgactactttgggaatggggacta

SEQ ID NO: 19938 - DNA, 24 bp, synthetic construct
  misc_feature 1..24: note = Synthetic Construct
  source 1..24: mol_type = other DNA
gcaggcttcatgctagtgaagaaa

SEQ ID NO: 19939 - DNA, 24 bp, synthetic construct
  misc_feature 1..24: note = Synthetic Construct
  source 1..24: mol_type = other DNA
cccactagccactgaatgtgaatc

SEQ ID NO: 19940 - DNA, 25 bp, synthetic construct
  misc_feature 1..25: note = Synthetic Construct
  source 1..25: mol_type = other DNA
cagctggttttgaccagttttgtct

SEQ ID NO: 19941 - DNA, 25 bp, synthetic construct
  misc_feature 1..25: note = Synthetic Construct
  source 1..25: mol_type = other DNA
cacaatagggcaatcgaagggaaac

SEQ ID NO: 19942 - DNA, 24 bp, synthetic construct
  misc_feature 1..24: note = Synthetic Construct
  source 1..24: mol_type = other DNA
tgatcctttagtctggggctcaca

SEQ ID NO: 19943 - DNA, 22 bp, synthetic construct
  misc_feature 1..22: note = Synthetic Construct
  source 1..22: mol_type = other DNA
gctccagttccactttgcgttt

SEQ ID NO: 19944 - DNA, 19 bp, synthetic construct
  misc_feature 1..19: note = Synthetic Construct
  source 1..19: mol_type = other DNA
gccacctatgccccaaagt

SEQ ID NO: 19945 - DNA, 23 bp, synthetic construct
  misc_feature 1..23: note = Synthetic Construct
  source 1..23: mol_type = other DNA
ggcagggcagatagttccactaa

SEQ ID NO: 19946 - DNA, 29 bp, synthetic construct
  misc_feature 1..29: note = Synthetic Construct
  source 1..29: mol_type = other DNA
ggcaaattcctgaatatcttgccttcagt

SEQ ID NO: 19947 - DNA, 22 bp, synthetic construct
  misc_feature 1..22: note = Synthetic Construct
  source 1..22: mol_type = other DNA
caagcagtgaccaggagacctt

SEQ ID NO: 19948 - DNA, 23 bp, synthetic construct
  misc_feature 1..23: note = Synthetic Construct
  source 1..23: mol_type = other DNA
tggttgaagcactgtcactgtaa

SEQ ID NO: 19949 - DNA, 25 bp, synthetic construct
  misc_feature 1..25: note = Synthetic Construct
  source 1..25: mol_type = other DNA
gaagctggatatttcctgggactct

SEQ ID NO: 19950 - DNA, 28 bp, synthetic construct
  misc_feature 1..28: note = Synthetic Construct
  source 1..28: mol_type = other DNA
gctctctcactgatcctttctggactaa

SEQ ID NO: 19951 - DNA, 27 bp, synthetic construct
  misc_feature 1..27: note = Synthetic Construct
  source 1..27: mol_type = other DNA
cacaagctatgaacacatcagactaca

SEQ ID NO: 19952 - DNA, 23 bp, synthetic construct
  misc_feature 1..23: note = Synthetic Construct
  source 1..23: mol_type = other DNA
gtgtgcatcacttctgctcacat

SEQ ID NO: 19953 - DNA, 23 bp, synthetic construct
  misc_feature 1..23: note = Synthetic Construct
  source 1..23: mol_type = other DNA
gagttttcccctccaatgtgact

SEQ ID NO: 19954 - DNA, 24 bp, synthetic construct
  misc_feature 1..24: note = Synthetic Construct
  source 1..24: mol_type = other DNA
tggactgcttctgtctctgttcta

SEQ ID NO: 19955 - DNA, 23 bp, synthetic construct
  misc_feature 1..23: note = Synthetic Construct
  source 1..23: mol_type = other DNA
tgcttggagtaccacatgaaaca

SEQ ID NO: 19956 - DNA, 26 bp, synthetic construct
  misc_feature 1..26: note = Synthetic Construct
  source 1..26: mol_type = other DNA
gcttgccttttcaagagactcacctt

SEQ ID NO: 19957 - DNA, 26 bp, synthetic construct
  misc_feature 1..26: note = Synthetic Construct
  source 1..26: mol_type = other DNA
gccaccactttaatcaccttgcctaa

SEQ ID NO: 19958 - DNA, 22 bp, synthetic construct
  misc_feature 1..22: note = Synthetic Construct
  source 1..22: mol_type = other DNA
acacctggttgaaaccaagaca

SEQ ID NO: 19959 - DNA, 22 bp, synthetic construct
  misc_feature 1..22: note = Synthetic Construct
  source 1..22: mol_type = other DNA
cctgtgcttgaggagccaagaa

SEQ ID NO: 19960 - DNA, 26 bp, synthetic construct
  misc_feature 1..26: note = Synthetic Construct
  source 1..26: mol_type = other DNA
gttgcatcctctgctttactttgaac

SEQ ID NO: 19961 - DNA, 25 bp, synthetic construct
  misc_feature 1..25: note = Synthetic Construct
  source 1..25: mol_type = other DNA
cccagtttccttctctcaggaatca

SEQ ID NO: 19962 - DNA, 26 bp, synthetic construct
  misc_feature 1..26: note = Synthetic Construct
  source 1..26: mol_type = other DNA
gtgaattggcctcagaacattacaga

SEQ ID NO: 19963 - DNA, 21 bp, synthetic construct
  misc_feature 1..21: note = Synthetic Construct
  source 1..21: mol_type = other DNA
cggttttcgtgcagggtgatg

SEQ ID NO: 19964 - DNA, 24 bp, synthetic construct
  misc_feature 1..24: note = Synthetic Construct
  source 1..24: mol_type = other DNA
aggggaaagagggtgaatttgatt

SEQ ID NO: 19965 - DNA, 23 bp, synthetic construct
  misc_feature 1..23: note = Synthetic Construct
  source 1..23: mol_type = other DNA
cccacttttggtctcctgagtgt

SEQ ID NO: 19966 - DNA, 24 bp, synthetic construct
  misc_feature 1..24: note = Synthetic Construct
  source 1..24: mol_type = other DNA
ggcataatgtcatgtccaccttgt

SEQ ID NO: 19967 - DNA, 24 bp, synthetic construct
  misc_feature 1..24: note = Synthetic Construct
  source 1..24: mol_type = other DNA
gcctccggtttgtaatgcaaataa

SEQ ID NO: 19968 - DNA, 26 bp, synthetic construct
  misc_feature 1..26: note = Synthetic Construct
  source 1..26: mol_type = other DNA
ggacctcagcactttttgtagcatta

SEQ ID NO: 19969 - DNA, 24 bp, synthetic construct
  misc_feature 1..24: note = Synthetic Construct
  source 1..24: mol_type = other DNA
ccttttctccgtgtagtgcagagt

SEQ ID NO: 19970 - DNA, 25 bp, synthetic construct
  misc_feature 1..25: note = Synthetic Construct
  source 1..25: mol_type = other DNA
aggcaaaggtgtatttagcagaaac

SEQ ID NO: 19971 - DNA, 26 bp, synthetic construct
  misc_feature 1..26: note = Synthetic Construct
  source 1..26: mol_type = other DNA
tcctttcagtcctcattcttccctat

SEQ ID NO: 19972 - DNA, 22 bp, synthetic construct
  misc_feature 1..22: note = Synthetic Construct
  source 1..22: mol_type = other DNA
tggggagggacatggcctaaaa

SEQ ID NO: 19973 - DNA, 27 bp, synthetic construct
  misc_feature 1..27: note = Synthetic Construct
  source 1..27: mol_type = other DNA
cttgaccacctctctaaataagtctga

SEQ ID NO: 19974 - DNA, 23 bp, synthetic construct
  misc_feature 1..23: note = Synthetic Construct
  source 1..23: mol_type = other DNA
gatgggaggtcatttcaccaagt

SEQ ID NO: 19975 - DNA, 22 bp, synthetic construct
  misc_feature 1..22: note = Synthetic Construct
  source 1..22: mol_type = other DNA
tggtcttgtcccaggttgtagt

SEQ ID NO: 19976 - DNA, 23 bp, synthetic construct
  misc_feature 1..23: note = Synthetic Construct
  source 1..23: mol_type = other DNA
tcctggcacatttgtcttctgtt

SEQ ID NO: 19977 - DNA, 23 bp, synthetic construct
  misc_feature 1..23: note = Synthetic Construct
  source 1..23: mol_type = other DNA
ccctggctcaacaaactggaagt

SEQ ID NO: 19978 - DNA, 26 bp, synthetic construct
  misc_feature 1..26: note = Synthetic Construct
  source 1..26: mol_type = other DNA
ctcaggtggcatgatataaacaggaa

SEQ ID NO: 19979 - DNA, 25 bp, synthetic construct
  misc_feature 1..25: note = Synthetic Construct
  source 1..25: mol_type = other DNA
ctgctttaggtggcattggactttg

SEQ ID NO: 19980 - DNA, 24 bp, synthetic construct
  misc_feature 1..24: note = Synthetic Construct
  source 1..24: mol_type = other DNA
gggttgctgataagtggagaggaa

SEQ ID NO: 19981 - DNA, 22 bp, synthetic construct
  misc_feature 1..22: note = Synthetic Construct
  source 1..22: mol_type = other DNA
gtgagagggaagcacgactttc

SEQ ID NO: 19982 - DNA, 24 bp, synthetic construct
  misc_feature 1..24: note = Synthetic Construct
  source 1..24: mol_type = other DNA
acccctcctcaatcactaaggaaa

SEQ ID NO: 19983 - DNA, 26 bp, synthetic construct
  misc_feature 1..26: note = Synthetic Construct
  source 1..26: mol_type = other DNA
gcatctttactaatagctggctcagt

SEQ ID NO: 19984 - DNA, 21 bp, synthetic construct
  misc_feature 1..21: note = Synthetic Construct
  source 1..21: mol_type = other DNA
gcccaggtttggctcagtttg

SEQ ID NO: 19985 - DNA, 20 bp, synthetic construct
  misc_feature 1..20: note = Synthetic Construct
  source 1..20: mol_type = other DNA
tgacgcactacggtgacaag

SEQ ID NO: 19986 - DNA, 24 bp, synthetic construct
  misc_feature 1..24: note = Synthetic Construct
  source 1..24: mol_type = other DNA
tgtgtaggcagtttagtgcatctt

SEQ ID NO: 19987 - DNA, 22 bp, synthetic construct
  misc_feature 1..22: note = Synthetic Construct
  source 1..22: mol_type = other DNA
aaagaggatttccgcagtgtct

SEQ ID NO: 19988 - DNA, 22 bp, synthetic construct
  misc_feature 1..22: note = Synthetic Construct
  source 1..22: mol_type = other DNA
cggcaatccactacaggtgaac

SEQ ID NO: 19989 - DNA, 22 bp, synthetic construct
  misc_feature 1..22: note = Synthetic Construct
  source 1..22: mol_type = other DNA
caaccattagacccagcgaagt

SEQ ID NO: 19990 - DNA, 25 bp, synthetic construct
  misc_feature 1..25: note = Synthetic Construct
  source 1..25: mol_type = other DNA
agaaccctatgatgatgtcctcctt

SEQ ID NO: 19991 - DNA, 22 bp, synthetic construct
  misc_feature 1..22: note = Synthetic Construct
  source 1..22: mol_type = other DNA
ccagtcactgtgggtcatttct

SEQ ID NO: 19992 - DNA, 27 bp, synthetic construct
  misc_feature 1..27: note = Synthetic Construct
  source 1..27: mol_type = other DNA
ggatagagctacaggatgcatctaaaa

SEQ ID NO: 19993 - DNA, 25 bp, synthetic construct
  misc_feature 1..25: note = Synthetic Construct
  source 1..25: mol_type = other DNA
gtgtgacagattgattgtgttccat

SEQ ID NO: 19994 - DNA, 24 bp, synthetic construct
  misc_feature 1..24: note = Synthetic Construct
  source 1..24: mol_type = other DNA
ggctcacattgaaacctgctgaga

SEQ ID NO: 19995 - DNA, 26 bp, synthetic construct
  misc_feature 1..26: note = Synthetic Construct
  source 1..26: mol_type = other DNA
ggaaagttgttagctcctgtctgtct

SEQ ID NO: 19996 - DNA, 24 bp, synthetic construct
  misc_feature 1..24: note = Synthetic Construct
  source 1..24: mol_type = other DNA
cagacttcattcaggacaggagaa

SEQ ID NO: 19997 - DNA, 22 bp, synthetic construct
  misc_feature 1..22: note = Synthetic Construct
  source 1..22: mol_type = other DNA
tgggtgacgatgccaggattag

SEQ ID NO: 19998 - DNA, 22 bp, synthetic construct
  misc_feature 1..22: note = Synthetic Construct
  source 1..22: mol_type = other DNA
gggctctttagtcaggttgtgt

SEQ ID NO: 19999 - DNA, 21 bp, synthetic construct
  misc_feature 1..21: note = Synthetic Construct
  source 1..21: mol_type = other DNA
ggctccagttagcctctgcaa

SEQ ID NO: 20000 - DNA, 22 bp, synthetic construct
  misc_feature 1..22: note = Synthetic Construct
  source 1..22: mol_type = other DNA
ctcagggaggaaaccctactgt

SEQ ID NO: 20001 - DNA, 21 bp, synthetic construct
  misc_feature 1..21: note = Synthetic Construct
  source 1..21: mol_type = other DNA
tcttggttgcaccctgaaact

SEQ ID NO: 20002 - DNA, 22 bp, synthetic construct
  misc_feature 1..22: note = Synthetic Construct
  source 1..22: mol_type = other DNA
ccttccttgcctcccagttaca

SEQ ID NO: 20003 - DNA, 22 bp, synthetic construct
  misc_feature 1..22: note = Synthetic Construct
  source 1..22: mol_type = other DNA
gtctgtgaagtcagccgtggtt

SEQ ID NO: 20004 - DNA, 25 bp, synthetic construct
  misc_feature 1..25: note = Synthetic Construct
  source 1..25: mol_type = other DNA
ggggtagcagcagatactaaaggaa

SEQ ID NO: 20005 - DNA, 18 bp, synthetic construct
  misc_feature 1..18: note = Synthetic Construct
  source 1..18: mol_type = other DNA
accctgacacccgcacaa

SEQ ID NO: 20006 - DNA, 26 bp, synthetic construct
  misc_feature 1..26: note = Synthetic Construct
  source 1..26: mol_type = other DNA
gcagtatgaagagactttcccataga

SEQ ID NO: 20007 - DNA, 23 bp, synthetic construct
  misc_feature 1..23: note = Synthetic Construct
  source 1..23: mol_type = other DNA
ggaaggagctgatggtacacaga

SEQ ID NO: 20008 - DNA, 24 bp, synthetic construct
  misc_feature 1..24: note = Synthetic Construct
  source 1..24: mol_type = other DNA
cccttccttggctgaagtgaacta

SEQ ID NO: 20009 - DNA, 28 bp, synthetic construct
  misc_feature 1..28: note = Synthetic Construct
  source 1..28: mol_type = other DNA
gcgtctctccaagttctagcagttattc

SEQ ID NO: 20010 - DNA, 22 bp, synthetic construct
  misc_feature 1..22: note = Synthetic Construct
  source 1..22: mol_type = other DNA
ggtggggaaatgtcaggagtct

SEQ ID NO: 20011 - DNA, 23 bp, synthetic construct
  misc_feature 1..23: note = Synthetic Construct
  source 1..23: mol_type = other DNA
ggctcaaacatggctccatcact

SEQ ID NO: 20012 - DNA, 22 bp, synthetic construct
  misc_feature 1..22: note = Synthetic Construct
  source 1..22: mol_type = other DNA
gctacaggcacaggacaagtga

SEQ ID NO: 20013 - DNA, 22 bp, synthetic construct
  misc_feature 1..22: note = Synthetic Construct
  source 1..22: mol_type = other DNA
gccagccatactcttcctgaca

SEQ ID NO: 20014 - DNA, 25 bp, synthetic construct
  misc_feature 1..25: note = Synthetic Construct
  source 1..25: mol_type = other DNA
gcaactccaatgccataagcatgaa

SEQ ID NO: 20015 - DNA, 21 bp, synthetic construct
  misc_feature 1..21: note = Synthetic Construct
  source 1..21: mol_type = other DNA
tggatggacgaggagcctgta

SEQ ID NO: 20016 - DNA, 25 bp, synthetic construct
  misc_feature 1..25: note = Synthetic Construct
  source 1..25: mol_type = other DNA
ccctgacatctatgagaaggaccta

SEQ ID NO: 20017 - DNA, 25 bp, synthetic construct
  misc_feature 1..25: note = Synthetic Construct
  source 1..25: mol_type = other DNA
ctcactaagaccagcaagtctgcta

SEQ ID NO: 20018 - DNA, 22 bp, synthetic construct
  misc_feature 1..22: note = Synthetic Construct
  source 1..22: mol_type = other DNA
tgtggtcaaggagctggagaga

SEQ ID NO: 20019 - DNA, 28 bp, synthetic construct
  misc_feature 1..28: note = Synthetic Construct
  source 1..28: mol_type = other DNA
gctatgcaatttctgctaacaggaggta

SEQ ID NO: 20020 - DNA, 27 bp, synthetic construct
  misc_feature 1..27: note = Synthetic Construct
  source 1..27: mol_type = other DNA
cctcagaaatgaaccctttccttccaa

SEQ ID NO: 20021 - DNA, 20 bp, synthetic construct
  misc_feature 1..20: note = Synthetic Construct
  source 1..20: mol_type = other DNA
agtgcttggtgtggggaaag

SEQ ID NO: 20022 - DNA, 22 bp, synthetic construct
  misc_feature 1..22: note = Synthetic Construct
  source 1..22: mol_type = other DNA
gcttaaaggccctctgggatct

SEQ ID NO: 20023 - DNA, 22 bp, synthetic construct
  misc_feature 1..22: note = Synthetic Construct
  source 1..22: mol_type = other DNA
gcctaagttcaggttgccaaag

SEQ ID NO: 20024 - DNA, 24 bp, synthetic construct
  misc_feature 1..24: note = Synthetic Construct
  source 1..24: mol_type = other DNA
gggagcacattcatgacagcattt

SEQ ID NO: 20025 - DNA, 24 bp, synthetic construct
  misc_feature 1..24: note = Synthetic Construct
  source 1..24: mol_type = other DNA
gcaggaaaactcattccacagaag

SEQ ID NO: 20026 - DNA, 22 bp, synthetic construct
  misc_feature 1..22: note = Synthetic Construct
  source 1..22: mol_type = other DNA
ccctgtgagcatggtctgttct

SEQ ID NO: 20027 - DNA, 22 bp, synthetic construct
  misc_feature 1..22: note = Synthetic Construct
  source 1..22: mol_type = other DNA
cagctcagtaagaggcgggtat

SEQ ID NO: 20028 - DNA, 22 bp, synthetic construct
  misc_feature 1..22: note = Synthetic Construct
  source 1..22: mol_type = other DNA
gcaaagggaaaggagggatgtt

SEQ ID NO: 20029 - DNA, 26 bp, synthetic construct
  misc_feature 1..26: note = Synthetic Construct
  source 1..26: mol_type = other DNA
tccacctaggtttgtttgactctaag

SEQ ID NO: 20030 - DNA, 25 bp, synthetic construct
  misc_feature 1..25: note = Synthetic Construct
  source 1..25: mol_type = other DNA
accatgttcttctggtcacgttatt

SEQ ID NO: 20031 - DNA, 25 bp, synthetic construct
  misc_feature 1..25: note = Synthetic Construct
  source 1..25: mol_type = other DNA
tgggcattacatttgtcctcttgaa

SEQ ID NO: 20032 - DNA, 23 bp, synthetic construct
  misc_feature 1..23: note = Synthetic Construct
  source 1..23: mol_type = other DNA
ggtctgtgtactcctcccctaca

SEQ ID NO: 20033 - DNA, 25 bp, synthetic construct
  misc_feature 1..25: note = Synthetic Construct
  source 1..25: mol_type = other DNA
cagctcattccttccataagagtca

SEQ ID NO: 20034 - DNA, 22 bp, synthetic construct
  misc_feature 1..22: note = Synthetic Construct
  source 1..22: mol_type = other DNA
gggcatactgcccttgccatta

SEQ ID NO: 20035 - DNA, 20 bp, synthetic construct
  misc_feature 1..20: note = Synthetic Construct
  source 1..20: mol_type = other DNA
cttctccaccaacgccttct

SEQ ID NO: 20036 - DNA, 24 bp, synthetic construct
  misc_feature 1..24: note = Synthetic Construct
  source 1..24: mol_type = other DNA
tgaacctagaaatggcctgaccta

SEQ ID NO: 20037 - DNA, 23 bp, synthetic construct
  misc_feature 1..23: note = Synthetic Construct
  source 1..23: mol_type = other DNA
ggggtatgagtcatggagccaat

SEQ ID NO: 20038 - DNA, 25 bp, synthetic construct
  misc_feature 1..25: note = Synthetic Construct
  source 1..25: mol_type = other DNA
ccgggttgacttcctatccatttga

SEQ ID NO: 20039 - DNA, 28 bp, synthetic construct
  misc_feature 1..28: note = Synthetic Construct
  source 1..28: mol_type = other DNA
ggccttgtaattacgttccttctctaca

SEQ ID NO: 20040 - DNA, 25 bp, synthetic construct
  misc_feature 1..25: note = Synthetic Construct
  source 1..25: mol_type = other DNA
cactagagatggaaaggggcatatt

SEQ ID NO: 20041 - DNA, 22 bp, synthetic construct
  misc_feature 1..22: note = Synthetic Construct
  source 1..22: mol_type = other DNA
tgccatgtcctactgcttccta

SEQ ID NO: 20042 - DNA, 23 bp, synthetic construct
  misc_feature 1..23: note = Synthetic Construct
  source 1..23: mol_type = other DNA
cccacccttagatcagggatagt

SEQ ID NO: 20043 - DNA, 25 bp, synthetic construct
  misc_feature 1..25: note = Synthetic Construct
  source 1..25: mol_type = other DNA
gttggatgttttctctcccatgcaa

SEQ ID NO: 20044 - DNA, 25 bp, synthetic construct
  misc_feature 1..25: note = Synthetic Construct
  source 1..25: mol_type = other DNA
ctgaagggttaatgtctggctgtca

SEQ ID NO: 20045 - DNA, 22 bp, synthetic construct
  misc_feature 1..22: note = Synthetic Construct
  source 1..22: mol_type = other DNA
cctggaagccaggtacattcaa

SEQ ID NO: 20046 - DNA, 20 bp, synthetic construct
  misc_feature 1..20: note = Synthetic Construct
  source 1..20: mol_type = other DNA
tgtgccgatgggaggaaatg

SEQ ID NO: 20047 - DNA, 24 bp, synthetic construct
  misc_feature 1..24: note = Synthetic Construct
  source 1..24: mol_type = other DNA
gtgcccggacagaaaagactttca

SEQ ID NO: 20048 - DNA, 24 bp, synthetic construct
  misc_feature 1..24: note = Synthetic Construct
  source 1..24: mol_type = other DNA
tcagctctgttttatgggtgacaa

SEQ ID NO: 20049 - DNA, 22 bp, synthetic construct
  misc_feature 1..22: note = Synthetic Construct
  source 1..22: mol_type = other DNA
agggagggtagctggggtttac

SEQ ID NO: 20050 - DNA, 20 bp, synthetic construct
  misc_feature 1..20: note = Synthetic Construct
  source 1..20: mol_type = other DNA
gcggctttagctggaagcaa

SEQ ID NO: 20051 - DNA, 24 bp, synthetic construct
  misc_feature 1..24: note = Synthetic Construct
  source 1..24: mol_type = other DNA
ggatcccagctccttccatcatgt

SEQ ID NO: 20052 - DNA, 24 bp, synthetic construct
  misc_feature 1..24: note = Synthetic Construct
  source 1..24: mol_type = other DNA
gctcttgtcgtctcgcttttcttc

SEQ ID NO: 20053 - DNA, 22 bp, synthetic construct
  misc_feature 1..22: note = Synthetic Construct
  source 1..22: mol_type = other DNA
tggggaaaggatgcagttttca

SEQ ID NO: 20054 - DNA, 24 bp, synthetic construct
  misc_feature 1..24: note = Synthetic Construct
  source 1..24: mol_type = other DNA
cgtcctttgttgcaatctcaactt

SEQ ID NO: 20055 - DNA, 23 bp, synthetic construct
  misc_feature 1..23: note = Synthetic Construct
  source 1..23: mol_type = other DNA
gccgctatcagtacgagagttgt

SEQ ID NO: 20056 - DNA, 25 bp, synthetic construct
  misc_feature 1..25: note = Synthetic Construct
  source 1..25: mol_type = other DNA
ccgggatcttaactggaatgacctt

SEQ ID NO: 20057 - DNA, 22 bp, synthetic construct
  misc_feature 1..22: note = Synthetic Construct
  source 1..22: mol_type = other DNA
ggtctctgaggtctccctttga

SEQ ID NO: 20058 - DNA, 25 bp, synthetic construct
  misc_feature 1..25: note = Synthetic Construct
  source 1..25: mol_type = other DNA
gcttaaaaagaatgtcctgggttca

SEQ ID NO: 20059 - DNA, 26 bp, synthetic construct
  misc_feature 1..26: note = Synthetic Construct
  source 1..26: mol_type = other DNA
caacatgaaacatgggctccaaatct

SEQ ID NO: 20060 - DNA, 22 bp, synthetic construct
  misc_feature 1..22: note = Synthetic Construct
  source 1..22: mol_type = other DNA
gaggtgggcaaaggaacacgta

SEQ ID NO: 20061 - DNA, 21 bp, synthetic construct
  misc_feature 1..21: note = Synthetic Construct
  source 1..21: mol_type = other DNA
tggaggccttaggtcttgctt

SEQ ID NO: 20062 - DNA, 22 bp, synthetic construct
  misc_feature 1..22: note = Synthetic Construct
  source 1..22: mol_type = other DNA
cagggaggaacaagtggcatga

SEQ ID NO: 20063 - DNA, 24 bp, synthetic construct
  misc_feature 1..24: note = Synthetic Construct
  source 1..24: mol_type = other DNA
ggccctgaagtatgctcttaaagt

SEQ ID NO: 20064 - DNA, 22 bp, synthetic construct
  misc_feature 1..22: note = Synthetic Construct
  source 1..22: mol_type = other DNA
aggggttatatctggcctggaa

SEQ ID NO: 20065 - DNA, 25 bp, synthetic construct
  misc_feature 1..25: note = Synthetic Construct
  source 1..25: mol_type = other DNA
gactcttctccagttccaggaaaat

SEQ ID NO: 20066 - DNA, 22 bp, synthetic construct
  misc_feature 1..22: note = Synthetic Construct
  source 1..22: mol_type = other DNA
gcagtgatggaactgccaccta

SEQ ID NO: 20067 - DNA, 23 bp, synthetic construct
  misc_feature 1..23: note = Synthetic Construct
  source 1..23: mol_type = other DNA
cctgtaggtcccaggaaggtaaa

SEQ ID NO: 20068 - DNA, 25 bp, synthetic construct
  misc_feature 1..25: note = Synthetic Construct
  source 1..25: mol_type = other DNA
ccagataccattttgcctcatgtca

SEQ ID NO: 20069 - DNA, 22 bp, synthetic construct
  misc_feature 1..22: note = Synthetic Construct
  source 1..22: mol_type = other DNA
gtgtcgtttagcacgagcagtt

SEQ ID NO: 20070 - DNA, 24 bp, synthetic construct
  misc_feature 1..24: note = Synthetic Construct
  source 1..24: mol_type = other DNA
cctgtggttggtaccctctcttct

SEQ ID NO: 20071 - DNA, 22 bp, synthetic construct
  misc_feature 1..22: note = Synthetic Construct
  source 1..22: mol_type = other DNA
gaccagacctctgctgctttgt

SEQ ID NO: 20072 - DNA, 27 bp, synthetic construct
  misc_feature 1..27: note = Synthetic Construct
  source 1..27: mol_type = other DNA
gcttctaatagagaccattctcctgaa

SEQ ID NO: 20073 - DNA, 24 bp, synthetic construct
  misc_feature 1..24: note = Synthetic Construct
  source 1..24: mol_type = other DNA
ggcaagtaagtcttccctcctttg

SEQ ID NO: 20074 - DNA, 20 bp, synthetic construct
  misc_feature 1..20: note = Synthetic Construct
  source 1..20: mol_type = other DNA
tgggctggaatcctgactct

SEQ ID NO: 20075 - DNA, 20 bp, synthetic construct
  misc_feature 1..20: note = Synthetic Construct
  source 1..20: mol_type = other DNA
gttgggcgtgatgaggactt

SEQ ID NO: 20076 - DNA, 23 bp, synthetic construct
  misc_feature 1..23: note = Synthetic Construct
  source 1..23: mol_type = other DNA
caagtgaggctttgtgccttttc

SEQ ID NO: 20077 - DNA, 25 bp, synthetic construct
  misc_feature 1..25: note = Synthetic Construct
  source 1..25: mol_type = other DNA
gagaaaagaaaggggcaagaattga

SEQ ID NO: 20078 - DNA, 23 bp, synthetic construct
  misc_feature 1..23: note = Synthetic Construct
  source 1..23: mol_type = other DNA
tcgctctttggtaaagtgagaca

SEQ ID NO: 20079 - DNA, 24 bp, synthetic construct
  misc_feature 1..24: note = Synthetic Construct
  source 1..24: mol_type = other DNA
caacttaagtgcctcaggctgtct

SEQ ID NO: 20080 - DNA, 22 bp, synthetic construct
  misc_feature 1..22: note = Synthetic Construct
  source 1..22: mol_type = other DNA
gcccaagaacccacaatcaatc

SEQ ID NO: 20081 - DNA, 24 bp, synthetic construct
  misc_feature 1..24: note = Synthetic Construct
  source 1..24: mol_type = other DNA
ccgtcacagtccaagtaaaagcta

SEQ ID NO: 20082 - DNA, 28 bp, synthetic construct
  misc_feature 1..28: note = Synthetic Construct
  source 1..28: mol_type = other DNA
gggagttagaaagggcctctaacagttt

SEQ ID NO: 20083 - DNA, 24 bp, synthetic construct
  misc_feature 1..24: note = Synthetic Construct
  source 1..24: mol_type = other DNA
cgctaaacactcttcagacagaca

SEQ ID NO: 20084 - DNA, 25 bp, synthetic construct
  misc_feature 1..25: note = Synthetic Construct
  source 1..25: mol_type = other DNA
ggggctactgatgaagcacatatag

SEQ ID NO: 20085 - DNA, 22 bp, synthetic construct
  misc_feature 1..22: note = Synthetic Construct
  source 1..22: mol_type = other DNA
ggccctgtgaaccttgtagctt

SEQ ID NO: 20086 - DNA, 21 bp, synthetic construct
  misc_feature 1..21: note = Synthetic Construct
  source 1..21: mol_type = other DNA
ccgtgcgaggaaagtgacagt

SEQ ID NO: 20087 - DNA, 24 bp, synthetic construct
  misc_feature 1..24: note = Synthetic Construct
  source 1..24: mol_type = other DNA
gggagagtcagtgaccaaagtatg

SEQ ID NO: 20088 - DNA, 24 bp, synthetic construct
  misc_feature 1..24: note = Synthetic Construct
  source 1..24: mol_type = other DNA
cgaggagatgaagggagcagaaat

SEQ ID NO: 20089 - DNA, 25 bp, synthetic construct
  misc_feature 1..25: note = Synthetic Construct
  source 1..25: mol_type = other DNA
agaccttcaagaggaaagtgagagt

SEQ ID NO: 20090 - DNA, 24 bp, synthetic construct
  misc_feature 1..24: note = Synthetic Construct
  source 1..24: mol_type = other DNA
aggactcagaatccactccctatg

SEQ ID NO: 20091 - DNA, 24 bp, synthetic construct
  misc_feature 1..24: note = Synthetic Construct
  source 1..24: mol_type = other DNA
tgaggtggtgagaatgaacctact

SEQ ID NO: 20092 - DNA, 21 bp, synthetic construct
  misc_feature 1..21: note = Synthetic Construct
  source 1..21: mol_type = other DNA
cccagtgcttcctgtttccaa

SEQ ID NO: 20093 - DNA, 26 bp, synthetic construct
  misc_feature 1..26: note = Synthetic Construct
  source 1..26: mol_type = other DNA
ggtcaggtggggtttttattcaccaa

SEQ ID NO: 20094 - DNA, 22 bp, synthetic construct
  misc_feature 1..22: note = Synthetic Construct
  source 1..22: mol_type = other DNA
gctgtcaaagcaagtgggaaga

SEQ ID NO: 20095 - DNA, 25 bp, synthetic construct
  misc_feature 1..25: note = Synthetic Construct
  source 1..25: mol_type = other DNA
gccagatagagagcttgtgggttct

SEQ ID NO: 20096 - DNA, 28 bp, synthetic construct
  misc_feature 1..28: note = Synthetic Construct
  source 1..28: mol_type = other DNA
ggttaaatgacatccactaggccaaaac

SEQ ID NO: 20097 - DNA, 25 bp, synthetic construct
  misc_feature 1..25: note = Synthetic Construct
  source 1..25: mol_type = other DNA
ggcagcataggtaggtttggaattg

SEQ ID NO: 20098 - DNA, 25 bp, synthetic construct
  misc_feature 1..25: note = Synthetic Construct
  source 1..25: mol_type = other DNA
cactcacatcccattgtccatatct

SEQ ID NO: 20099 - DNA, 22 bp, synthetic construct
  misc_feature 1..22: note = Synthetic Construct
  source 1..22: mol_type = other DNA
ccacgggacacagtcagcatta

SEQ ID NO: 20100 - DNA, 22 bp, synthetic construct
  misc_feature 1..22: note = Synthetic Construct
  source 1..22: mol_type = other DNA
ctgacacagtcctgccagatga

SEQ ID NO: 20101 - DNA, 21 bp, synthetic construct
  misc_feature 1..21: note = Synthetic Construct
  source 1..21: mol_type = other DNA
ctgcgttgaaggtgactggat

SEQ ID NO: 20102 - DNA, 21 bp, synthetic construct
  misc_feature 1..21: note = Synthetic Construct
  source 1..21: mol_type = other DNA
gttccgcaggcattctaccat

SEQ ID NO: 20103 - DNA, 24 bp, synthetic construct
  misc_feature 1..24: note = Synthetic Construct
  source 1..24: mol_type = other DNA
cccatctgcttcacagggttatac

SEQ ID NO: 20104 - DNA, 23 bp, synthetic construct
  misc_feature 1..23: note = Synthetic Construct
  source 1..23: mol_type = other DNA
ccgatgcttcaaccacacctaga

SEQ ID NO: 20105 - DNA, 24 bp, synthetic construct
  misc_feature 1..24: note = Synthetic Construct
  source 1..24: mol_type = other DNA
gcaggctcctgtaaggaaggagtt

SEQ ID NO: 20106 - DNA, 20 bp, synthetic construct
  misc_feature 1..20: note = Synthetic Construct
  source 1..20: mol_type = other DNA
tgccactgtcttggccgtaa

SEQ ID NO: 20107 - DNA, 24 bp, synthetic construct
  misc_feature 1..24: note = Synthetic Construct
  source 1..24: mol_type = other DNA
ctgtatgtcaccccaagggagtat

SEQ ID NO: 20108 - DNA, 24 bp, synthetic construct
  misc_feature 1..24: note = Synthetic Construct
  source 1..24: mol_type = other DNA
ccagggagccccttaggattaact

SEQ ID NO: 20109 - DNA, 23 bp, synthetic construct
  misc_feature 1..23: note = Synthetic Construct
  source 1..23: mol_type = other DNA
gcccaggcaaaagcagggatatt

SEQ ID NO: 20110 - DNA, 30 bp, synthetic construct
  misc_feature 1..30: note = Synthetic Construct
  source 1..30: mol_type = other DNA
cgaaagtaagggctaaagtctcttctgatg

SEQ ID NO: 20111 - DNA, 27 bp, synthetic construct
  misc_feature 1..27: note = Synthetic Construct
  source 1..27: mol_type = other DNA
ggaggagtgcctcatgttatgataagt

SEQ ID NO: 20112 - DNA, 26 bp, synthetic construct
  misc_feature 1..26: note = Synthetic Construct
  source 1..26: mol_type = other DNA
cctctctggtaggatgcaactgaaaa

SEQ ID NO: 20113 - DNA, 26 bp, synthetic construct
  misc_feature 1..26: note = Synthetic Construct
  source 1..26: mol_type = other DNA
gggacctaccattaccattcccatct

SEQ ID NO: 20114 - DNA, 20 bp, synthetic construct
  misc_feature 1..20: note = Synthetic Construct
  source 1..20: mol_type = other DNA
agcatggttgcaggcacaga

SEQ ID NO: 20115 - DNA, 22 bp, synthetic construct
  misc_feature 1..22: note = Synthetic Construct
  source 1..22: mol_type = other DNA
gccaacacgaagtcgcttcaca

SEQ ID NO: 20116 - DNA, 24 bp, synthetic construct
  misc_feature 1..24: note = Synthetic Construct
  source 1..24: mol_type = other DNA
tgcctgaattccaacgaggatttt

SEQ ID NO: 20117 - DNA, 22 bp, synthetic construct
  misc_feature 1..22: note = Synthetic Construct
  source 1..22: mol_type = other DNA
gtggtctaggcaatccctcagt

SEQ ID NO: 20118 - DNA, 30 bp, synthetic construct
  misc_feature 1..30: note = Synthetic Construct
  source 1..30: mol_type = other DNA
ggttgtctaggaataggctatagattggaa

SEQ ID NO: 20119 - DNA, 22 bp, synthetic construct
  misc_feature 1..22: note = Synthetic Construct
  source 1..22: mol_type = other DNA
gtgcagttttgctttccctctt

SEQ ID NO: 20120 - DNA, 24 bp, synthetic construct
  misc_feature 1..24: note = Synthetic Construct
  source 1..24: mol_type = other DNA
cacgcaagctccttaagctattgt

SEQ ID NO: 20121 - DNA, 20 bp, synthetic construct
  misc_feature 1..20: note = Synthetic Construct
  source 1..20: mol_type = other DNA
tgtccttccgtgtgctgctt

SEQ ID NO: 20122 - DNA, 24 bp, synthetic construct
  misc_feature 1..24: note = Synthetic Construct
  source 1..24: mol_type = other DNA
ggcttctgggaaaacccaagtaaa

SEQ ID NO: 20123 - DNA, 20 bp, synthetic construct
  misc_feature 1..20: note = Synthetic Construct
  source 1..20: mol_type = other DNA
tggccaggatttggcagtga

SEQ ID NO: 20124 - DNA, 25 bp, synthetic construct
  misc_feature 1..25: note = Synthetic Construct
  source 1..25: mol_type = other DNA
ggagaatggccttaggagtctgaca

SEQ ID NO: 20125 - DNA, 22 bp, synthetic construct
  misc_feature 1..22: note = Synthetic Construct
  source 1..22: mol_type = other DNA
gctcctgaaactgagccacaca

SEQ ID NO: 20126 - DNA, 24 bp, synthetic construct
  misc_feature 1..24: note = Synthetic Construct
  source 1..24: mol_type = other DNA
gtgtcattcaccacagaaccatgt

SEQ ID NO: 20127 - DNA, 25 bp, synthetic construct
  misc_feature 1..25: note = Synthetic Construct
  source 1..25: mol_type = other DNA
ctccggctttaacacttcaaagact

SEQ ID NO: 20128 - DNA, 24 bp, synthetic construct
  misc_feature 1..24: note = Synthetic Construct
  source 1..24: mol_type = other DNA
actgaccgcaaaggaaataaggat

SEQ ID NO: 20129 - DNA, 25 bp, synthetic construct
  misc_feature 1..25: note = Synthetic Construct
  source 1..25: mol_type = other DNA
gtgcaactgggtgactaaagaccaa

SEQ ID NO: 20130 - DNA, 25 bp, synthetic construct
  misc_feature 1..25: note = Synthetic Construct
  source 1..25: mol_type = other DNA
gctgtctcagtgcaacaacaagtga

SEQ ID NO: 20131 - DNA, 21 bp, synthetic construct
  misc_feature 1..21: note = Synthetic Construct
  source 1..21: mol_type = other DNA
cccacttcaggcccctctctt

SEQ ID NO: 20132 - DNA, 29 bp, synthetic construct
  misc_feature 1..29: note = Synthetic Construct
  source 1..29: mol_type = other DNA
ggcacagcctttagaatagcctctaaaat

SEQ ID NO: 20133 - DNA, 26 bp, synthetic construct
  misc_feature 1..26: note = Synthetic Construct
  source 1..26: mol_type = other DNA
gtccgatgtaatggaaaagagacaca

SEQ ID NO: 20134 - DNA, 26 bp, synthetic construct
  misc_feature 1..26: note = Synthetic Construct
  source 1..26: mol_type = other DNA
gcagagagagctcacatcttaccatt

SEQ ID NO: 20135 - DNA, 24 bp, synthetic construct
  misc_feature 1..24: note = Synthetic Construct
  source 1..24: mol_type = other DNA
ggcatgtattgacaaaggcttctt

SEQ ID NO: 20136 - DNA, 20 bp, synthetic construct
  misc_feature 1..20: note = Synthetic Construct
  source 1..20: mol_type = other DNA
ggcagcagactgcctgactt

SEQ ID NO: 20137 - DNA, 23 bp, synthetic construct
  misc_feature 1..23: note = Synthetic Construct
  source 1..23: mol_type = other DNA
cacgctgagagaagcagcatttg

SEQ ID NO: 20138 - DNA, 24 bp, synthetic construct
  misc_feature 1..24: note = Synthetic Construct
  source 1..24: mol_type = other DNA
ccagaggctgatctgcactaccaa

SEQ ID NO: 20139 - DNA, 20 bp, synthetic construct
  misc_feature 1..20: note = Synthetic Construct
  source 1..20: mol_type = other DNA
tggggtgaagccagaagtca

SEQ ID NO: 20140 - DNA, 26 bp, synthetic construct
  misc_feature 1..26: note = Synthetic Construct
  source 1..26: mol_type = other DNA
gtccaccagaggcatgttaaaaggta

SEQ ID NO: 20141 - DNA, 20 bp, synthetic construct
  misc_feature 1..20: note = Synthetic Construct
  source 1..20: mol_type = other DNA
accaagcccaagtcctcctt

SEQ ID NO: 20142 - DNA, 25 bp, synthetic construct
  misc_feature 1..25: note = Synthetic Construct
  source 1..25: mol_type = other DNA
cacgtcgtaaacatgactggtttta

SEQ ID NO: 20143 - DNA, 24 bp, synthetic construct
  misc_feature 1..24: note = Synthetic Construct
  source 1..24: mol_type = other DNA
gccccatctctacttgtcactgat

SEQ ID NO: 20144 - DNA, 23 bp, synthetic construct
  misc_feature 1..23: note = Synthetic Construct
  source 1..23: mol_type = other DNA
cttctgtcagacctacctgcatt

SEQ ID NO: 20145 - DNA, 24 bp, synthetic construct
  misc_feature 1..24: note = Synthetic Construct
  source 1..24: mol_type = other DNA
ctgtgtggtttgtctggtgggtta

SEQ ID NO: 20146 - DNA, 22 bp, synthetic construct
  misc_feature 1..22: note = Synthetic Construct
  source 1..22: mol_type = other DNA
ggcaacagagaacgtgatgaag

SEQ ID NO: 20147 - DNA, 20 bp, synthetic construct
  misc_feature 1..20: note = Synthetic Construct
  source 1..20: mol_type = other DNA
tccctcccaaactgctctca

SEQ ID NO: 20148 - DNA, 22 bp, synthetic construct
  misc_feature 1..22: note = Synthetic Construct
  source 1..22: mol_type = other DNA
ggcagaaggcaggagctttgaa

SEQ ID NO: 20149 - DNA, 27 bp, synthetic construct
  misc_feature 1..27: note = Synthetic Construct
  source 1..27: mol_type = other DNA
ggcacatgccatatgattgatactgat

SEQ ID NO: 20150 - DNA, 23 bp, synthetic construct
  misc_feature 1..23: note = Synthetic Construct
  source 1..23: mol_type = other DNA
ggggcgaacacatctaaaaccat

SEQ ID NO: 20151 - DNA, 23 bp, synthetic construct
  misc_feature 1..23: note = Synthetic Construct
  source 1..23: mol_type = other DNA
ctcccaatgcaaccctgttcttg

SEQ ID NO: 20152 - DNA, 27 bp, synthetic construct
  misc_feature 1..27: note = Synthetic Construct
  source 1..27: mol_type = other DNA
ggcaacccatgttatttagtagggaaa

SEQ ID NO: 20153 - DNA, 21 bp, synthetic construct
  misc_feature 1..21: note = Synthetic Construct
  source 1..21: mol_type = other DNA
gagctggcaaaagcacaactt

SEQ ID NO: 20154 - DNA, 21 bp, synthetic construct
  misc_feature 1..21: note = Synthetic Construct
  source 1..21: mol_type = other DNA
cgtgtggaactgcacctcatc

SEQ ID NO: 20155 - DNA, 22 bp, synthetic construct
  misc_feature 1..22: note = Synthetic Construct
  source 1..22: mol_type = other DNA
cagggccccttttcacaacaac

SEQ ID NO: 20156 - DNA, 22 bp, synthetic construct
  misc_feature 1..22: note = Synthetic Construct
  source 1..22: mol_type = other DNA
ttcgctgctgcatttctagtct

SEQ ID NO: 20157 - DNA, 22 bp, synthetic construct
  misc_feature 1..22: note = Synthetic Construct
  source 1..22: mol_type = other DNA
tctctagatgcccaggaactgt

SEQ ID NO: 20158 - DNA, 21 bp, synthetic construct
  misc_feature 1..21: note = Synthetic Construct
  source 1..21: mol_type = other DNA
ggtgtgtgtttccacctgtgt

SEQ ID NO: 20159 - DNA, 24 bp, synthetic construct
  misc_feature 1..24: note = Synthetic Construct
  source 1..24: mol_type = other DNA
gcagcttgtgaccatgacaagaaa

SEQ ID NO: 20160 - DNA, 21 bp, synthetic construct
  misc_feature 1..21: note = Synthetic Construct
  source 1..21: mol_type = other DNA
cggggcagtgagtcaggagta

SEQ ID NO: 20161 - DNA, 22 bp, synthetic construct
  misc_feature 1..22: note = Synthetic Construct
  source 1..22: mol_type = other DNA
aggcacacaacaaagcagaaga

SEQ ID NO: 20162 - DNA, 27 bp, synthetic construct
  misc_feature 1..27: note = Synthetic Construct
  source 1..27: mol_type = other DNA
ccaccttatagggtagccctcatatct

SEQ ID NO: 20163 - DNA, 22 bp, synthetic construct
  misc_feature 1..22: note = Synthetic Construct
  source 1..22: mol_type = other DNA
gttcaaatgcgcagctcttagt

SEQ ID NO: 20164 - DNA, 20 bp, synthetic construct
  misc_feature 1..20: note = Synthetic Construct
  source 1..20: mol_type = other DNA
gcatatgacctgcgccttga

SEQ ID NO: 20165 - DNA, 22 bp, synthetic construct
  misc_feature 1..22: note = Synthetic Construct
  source 1..22: mol_type = other DNA
ctccaaaggaggtgtggtcaac

SEQ ID NO: 20166 - DNA, 28 bp, synthetic construct
  misc_feature 1..28: note = Synthetic Construct
  source 1..28: mol_type = other DNA
ggggtagatctagttgttttggaccatt

SEQ ID NO: 20167 - DNA, 22 bp, synthetic construct
  misc_feature 1..22: note = Synthetic Construct
  source 1..22: mol_type = other DNA
ccttcgccagggtaccattttc

SEQ ID NO: 20168 - DNA, 27 bp, synthetic construct
  misc_feature 1..27: note = Synthetic Construct
  source 1..27: mol_type = other DNA
ctcatcttacctgttttcacggctact

SEQ ID NO: 20169 - DNA, 23 bp, synthetic construct
  misc_feature 1..23: note = Synthetic Construct
  source 1..23: mol_type = other DNA
gcacatgccaatgtgggtgttag

SEQ ID NO: 20170 - DNA, 25 bp, synthetic construct
  misc_feature 1..25: note = Synthetic Construct
  source 1..25: mol_type = other DNA
ccaacatatacactgcaccttgagt

SEQ ID NO: 20171 - DNA, 25 bp, synthetic construct
  misc_feature 1..25: note = Synthetic Construct
  source 1..25: mol_type = other DNA
ccatctttgaacccctactgcctat

SEQ ID NO: 20172 - DNA, 23 bp, synthetic construct
  misc_feature 1..23: note = Synthetic Construct
  source 1..23: mol_type = other DNA
actaaggcaatgctgagtggaaa

SEQ ID NO: 20173 - DNA, 20 bp, synthetic construct
  misc_feature 1..20: note = Synthetic Construct
  source 1..20: mol_type = other DNA
tgggaaggttccaggcagtt

SEQ ID NO: 20174 - DNA, 22 bp, synthetic construct
  misc_feature 1..22: note = Synthetic Construct
  source 1..22: mol_type = other DNA
tggcagctactggagactcgta

SEQ ID NO: 20175 - DNA, 25 bp, synthetic construct
  misc_feature 1..25: note = Synthetic Construct
  source 1..25: mol_type = other DNA
caggagatgtacctttcaccaaaac

SEQ ID NO: 20176 - DNA, 26 bp, synthetic construct
  misc_feature 1..26: note = Synthetic Construct
  source 1..26: mol_type = other DNA
ggggtaggatggagataggtttcaga

SEQ ID NO: 20177 - DNA, 27 bp, synthetic construct
  misc_feature 1..27: note = Synthetic Construct
  source 1..27: mol_type = other DNA
ctcaatttggagggtctgaattggttt

SEQ ID NO: 20178 - DNA, 24 bp, synthetic construct
  misc_feature 1..24: note = Synthetic Construct
  source 1..24: mol_type = other DNA
gatccaagccaatggggtattttc

SEQ ID NO: 20179 - DNA, 25 bp, synthetic construct
  misc_feature 1..25: note = Synthetic Construct
  source 1..25: mol_type = other DNA
gccatcttagatcacaggagggaaa

SEQ ID NO: 20180 - DNA, 26 bp, synthetic construct
  misc_feature 1..26: note = Synthetic Construct
  source 1..26: mol_type = other DNA
caccatatccccttagggtcttgaca

SEQ ID NO: 20181 - DNA, 24 bp, synthetic construct
  misc_feature 1..24: note = Synthetic Construct
  source 1..24: mol_type = other DNA
ggcaaacagggagaatgggaatac

SEQ ID NO: 20182 - DNA, 24 bp, synthetic construct
  misc_feature 1..24: note = Synthetic Construct
  source 1..24: mol_type = other DNA
gtgcaaggagagctgaatccatgt

SEQ ID NO: 20183 - DNA, 22 bp, synthetic construct
  misc_feature 1..22: note = Synthetic Construct
  source 1..22: mol_type = other DNA
gtggtggggtttgttggcattc

SEQ ID NO: 20184 - DNA, 25 bp, synthetic construct
  misc_feature 1..25: note = Synthetic Construct
  source 1..25: mol_type = other DNA
cgcaaccctgtttgttcaaagattc

SEQ ID NO: 20185 - DNA, 27 bp, synthetic construct
  misc_feature 1..27: note = Synthetic Construct
  source 1..27: mol_type = other DNA
gggtagaggagacttcagtagttgtca

SEQ ID NO: 20186 - DNA, 24 bp, synthetic construct
  misc_feature 1..24: note = Synthetic Construct
  source 1..24: mol_type = other DNA
ctttttctcatacctgcgcactct

SEQ ID NO: 20187 - DNA, 20 bp, synthetic construct
  misc_feature 1..20: note = Synthetic Construct
  source 1..20: mol_type = other DNA
aaccacggaatgcgggactt

SEQ ID NO: 20188 - DNA, 23 bp, synthetic construct
  misc_feature 1..23: note = Synthetic Construct
  source 1..23: mol_type = other DNA
tgacctggctatgcctgtttaat

SEQ ID NO: 20189 - DNA, 22 bp, synthetic construct
  misc_feature 1..22: note = Synthetic Construct
  source 1..22: mol_type = other DNA
gtctgggaggaggaacaggaaa

SEQ ID NO: 20190 - DNA, 23 bp, synthetic construct
  misc_feature 1..23: note = Synthetic Construct
  source 1..23: mol_type = other DNA
gcttgatgcaaaggaaggaaact

SEQ ID NO: 20191 - DNA, 23 bp, synthetic construct
  misc_feature 1..23: note = Synthetic Construct
  source 1..23: mol_type = other DNA
gcccaatgccgttaaagatctga

SEQ ID NO: 20192 - DNA, 24 bp, synthetic construct
  misc_feature 1..24: note = Synthetic Construct
  source 1..24: mol_type = other DNA
ctctcccaatttagcaccagcata

SEQ ID NO: 20193 - DNA, 22 bp, synthetic construct
  misc_feature 1..22: note = Synthetic Construct
  source 1..22: mol_type = other DNA
ccctaactaggccagggagcaa

SEQ ID NO: 20194 - DNA, 24 bp, synthetic construct
  misc_feature 1..24: note = Synthetic Construct
  source 1..24: mol_type = other DNA
ggggcttcccatagctaggattgt

SEQ ID NO: 20195 - DNA, 23 bp, synthetic construct
  misc_feature 1..23: note = Synthetic Construct
  source 1..23: mol_type = other DNA
aggggagtacaaagccatcattg

SEQ ID NO: 20196 - DNA, 24 bp, synthetic construct
  misc_feature 1..24: note = Synthetic Construct
  source 1..24: mol_type = other DNA
cactctcagtgggaagggaattag

SEQ ID NO: 20197 - DNA, 22 bp, synthetic construct
  misc_feature 1..22: note = Synthetic Construct
  source 1..22: mol_type = other DNA
tgtcttgaaacagctcgtcact

SEQ ID NO: 20198 - DNA, 29 bp, synthetic construct
  misc_feature 1..29: note = Synthetic Construct
  source 1..29: mol_type = other DNA
gagacccaataatggctgtagggatttta

SEQ ID NO: 20199 - DNA, 25 bp, synthetic construct
  misc_feature 1..25: note = Synthetic Construct
  source 1..25: mol_type = other DNA
ctcaccaaggtccaccaattttcat

SEQ ID NO: 20200 - DNA, 27 bp, synthetic construct
  misc_feature 1..27: note = Synthetic Construct
  source 1..27: mol_type = other DNA
ctccatccaatctgctgacctaagaac

SEQ ID NO: 20201 - DNA, 23 bp, synthetic construct
  misc_feature 1..23: note = Synthetic Construct
  source 1..23: mol_type = other DNA
actgctttctagcatgtcaccaa

SEQ ID NO: 20202 - DNA, 25 bp, synthetic construct
  misc_feature 1..25: note = Synthetic Construct
  source 1..25: mol_type = other DNA
gggaacatccttgcaataactccta

SEQ ID NO: 20203 - DNA, 24 bp, synthetic construct
  misc_feature 1..24: note = Synthetic Construct
  source 1..24: mol_type = other DNA
gggctccaggtttagttagcagat

SEQ ID NO: 20204 - DNA, 22 bp, synthetic construct
  misc_feature 1..22: note = Synthetic Construct
  source 1..22: mol_type = other DNA
cgctacgtgacttctgcttagt

SEQ ID NO: 20205 - DNA, 23 bp, synthetic construct
  misc_feature 1..23: note = Synthetic Construct
  source 1..23: mol_type = other DNA
caccaagatggctaagtgacgaa

SEQ ID NO: 20206 - DNA, 22 bp, synthetic construct
  misc_feature 1..22: note = Synthetic Construct
  source 1..22: mol_type = other DNA
gcctgggtaagtgatggcatag

SEQ ID NO: 20207 - DNA, 25 bp, synthetic construct
  misc_feature 1..25: note = Synthetic Construct
  source 1..25: mol_type = other DNA
ggtcaactataggcttgcacgtgat

SEQ ID NO: 20208 - DNA, 25 bp, synthetic construct
  misc_feature 1..25: note = Synthetic Construct
  source 1..25: mol_type = other DNA
cgctgactccaagtttctctatttg

SEQ ID NO: 20209 - DNA, 21 bp, synthetic construct
  misc_feature 1..21: note = Synthetic Construct
  source 1..21: mol_type = other DNA
gggtgtgctgtttacgtggat

SEQ ID NO: 20210 - DNA, 22 bp, synthetic construct
  misc_feature 1..22: note = Synthetic Construct
  source 1..22: mol_type = other DNA
tgttggaggtcagtcaggttgt

SEQ ID NO: 20211 - DNA, 24 bp, synthetic construct
  misc_feature 1..24: note = Synthetic Construct
  source 1..24: mol_type = other DNA
gtagggcagatcaaaggaatgaga

SEQ ID NO: 20212 - DNA, 23 bp, synthetic construct
  misc_feature 1..23: note = Synthetic Construct
  source 1..23: mol_type = other DNA
cctgagccaaaccatgcatcttc

SEQ ID NO: 20213 - DNA, 23 bp, synthetic construct
  misc_feature 1..23: note = Synthetic Construct
  source 1..23: mol_type = other DNA
aggttaggtggtcctcagctatg

SEQ ID NO: 20214 - DNA, 22 bp, synthetic construct
  misc_feature 1..22: note = Synthetic Construct
  source 1..22: mol_type = other DNA
agagcactcctcaaccaacttc

SEQ ID NO: 20215 - DNA, 24 bp, synthetic construct
  misc_feature 1..24: note = Synthetic Construct
  source 1..24: mol_type = other DNA
ctggcacacctgttgatgttgaag

SEQ ID NO: 20216 - DNA, 24 bp, synthetic construct
  misc_feature 1..24: note = Synthetic Construct
  source 1..24: mol_type = other DNA
ggcttcacagaagaggtggtatga

SEQ ID NO: 20217 - DNA, 21 bp, synthetic construct
  misc_feature 1..21: note = Synthetic Construct
  source 1..21: mol_type = other DNA
gctaggcgctacccctagaag

SEQ ID NO: 20218 - DNA, 26 bp, synthetic construct
  misc_feature 1..26: note = Synthetic Construct
  source 1..26: mol_type = other DNA
cctggatgtagcagataagggttttc

SEQ ID NO: 20219 - DNA, 25 bp, synthetic construct
  misc_feature 1..25: note = Synthetic Construct
  source 1..25: mol_type = other DNA
cccactggaaggaagctttaagatg

SEQ ID NO: 20220 - DNA, 27 bp, synthetic construct
  misc_feature 1..27: note = Synthetic Construct
  source 1..27: mol_type = other DNA
ctagctctctcgtatcattcagactac

SEQ ID NO: 20221 - DNA, 22 bp, synthetic construct
  misc_feature 1..22: note = Synthetic Construct
  source 1..22: mol_type = other DNA
ttcacacagctgtcacagacaa

SEQ ID NO: 20222 - DNA, 25 bp, synthetic construct
  misc_feature 1..25: note = Synthetic Construct
  source 1..25: mol_type = other DNA
cttgaggtctgattggatgaagtga

SEQ ID NO: 20223 - DNA, 26 bp, synthetic construct
  misc_feature 1..26: note = Synthetic Construct
  source 1..26: mol_type = other DNA
cacgtccactaaaattcctgctcttg

SEQ ID NO: 20224 - DNA, 22 bp, synthetic construct
  misc_feature 1..22: note = Synthetic Construct
  source 1..22: mol_type = other DNA
ccagaggcaaagggaagactca

SEQ ID NO: 20225 - DNA, 27 bp, synthetic construct
  misc_feature 1..27: note = Synthetic Construct
  source 1..27: mol_type = other DNA
ggccatagataacctgatgaacacaag

SEQ ID NO: 20226 - DNA, 25 bp, synthetic construct
  misc_feature 1..25: note = Synthetic Construct
  source 1..25: mol_type = other DNA
tgaacttgattctacaggcagtgat

SEQ ID NO: 20227 - DNA, 21 bp, synthetic construct
  misc_feature 1..21: note = Synthetic Construct
  source 1..21: mol_type = other DNA
tggctgctacaccaaatcgtt

SEQ ID NO: 20228 - DNA, 23 bp, synthetic construct
  misc_feature 1..23: note = Synthetic Construct
  source 1..23: mol_type = other DNA
acagtgcaaagaaggggcttaaa

SEQ ID NO: 20229 - DNA, 27 bp, synthetic construct
  misc_feature 1..27: note = Synthetic Construct
  source 1..27: mol_type = other DNA
ggctttgtgactgctttgactaacaga

SEQ ID NO: 20230 - DNA, 22 bp, synthetic construct
  misc_feature 1..22: note = Synthetic Construct
  source 1..22: mol_type = other DNA
ccgccaatcctctccaacttgt

SEQ ID NO: 20231 - DNA, 25 bp, synthetic construct
  misc_feature 1..25: note = Synthetic Construct
  source 1..25: mol_type = other DNA
ggtctgttcctaaaggtcggagact

SEQ ID NO: 20232 - DNA, 25 bp, synthetic construct
  misc_feature 1..25: note = Synthetic Construct
  source 1..25: mol_type = other DNA
ggggattgaaattcagcaccaccaa

SEQ ID NO: 20233 - DNA, 28 bp, synthetic construct
  misc_feature 1..28: note = Synthetic Construct
  source 1..28: mol_type = other DNA
cggagtaagtctttgtctcaaacagcat

SEQ ID NO: 20234 - DNA, 20 bp, synthetic construct
  misc_feature 1..20: note = Synthetic Construct
  source 1..20: mol_type = other DNA
aaggcaggtgctgctcctat

SEQ ID NO: 20235 - DNA, 23 bp, synthetic construct
  misc_feature 1..23: note = Synthetic Construct
  source 1..23: mol_type = other DNA
ggggtgcagtagccctctatgaa

SEQ ID NO: 20236 - DNA, 23 bp, synthetic construct
  misc_feature 1..23: note = Synthetic Construct
  source 1..23: mol_type = other DNA
cgtttcggaagctaacgctttct

SEQ ID NO: 20237 - DNA, 25 bp, synthetic construct
  misc_feature 1..25: note = Synthetic Construct
  source 1..25: mol_type = other DNA
acattgtacagatgctgcctaagaa

SEQ ID NO: 20238 - DNA, 25 bp, synthetic construct
  misc_feature 1..25: note = Synthetic Construct
  source 1..25: mol_type = other DNA
ggatgaaaagtggaagacagggaaa

SEQ ID NO: 20239 - DNA, 23 bp, synthetic construct
  misc_feature 1..23: note = Synthetic Construct
  source 1..23: mol_type = other DNA
gcacccacttaccttctccatag

SEQ ID NO: 20240 - DNA, 25 bp, synthetic construct
  misc_feature 1..25: note = Synthetic Construct
  source 1..25: mol_type = other DNA
gagctgttgtgtcatggtgaaaaat

SEQ ID NO: 20241 - DNA, 23 bp, synthetic construct
  misc_feature 1..23: note = Synthetic Construct
  source 1..23: mol_type = other DNA
tgctagagactcagatcccaaga

SEQ ID NO: 20242 - DNA, 22 bp, synthetic construct
  misc_feature 1..22: note = Synthetic Construct
  source 1..22: mol_type = other DNA
ctggtccccatgtttgctttct

SEQ ID NO: 20243 - DNA, 22 bp, synthetic construct
  misc_feature 1..22: note = Synthetic Construct
  source 1..22: mol_type = other DNA
agcggtgtgaggtagagacact

SEQ ID NO: 20244 - DNA, 23 bp, synthetic construct
  misc_feature 1..23: note = Synthetic Construct
  source 1..23: mol_type = other DNA
gcagcctgacaaccttggtaagt

SEQ ID NO: 20245 - DNA, 27 bp, synthetic construct
  misc_feature 1..27: note = Synthetic Construct
  source 1..27: mol_type = other DNA
ctctaactacaacattggcctcagaac

SEQ ID NO: 20246 - DNA, 26 bp, synthetic construct
  misc_feature 1..26: note = Synthetic Construct
  source 1..26: mol_type = other DNA
ctgtgaaccaatagacggaattgatg

SEQ ID NO: 20247 - DNA, 23 bp, synthetic construct
  misc_feature 1..23: note = Synthetic Construct
  source 1..23: mol_type = other DNA
cagagctggactaagacttgctt

SEQ ID NO: 20248 - DNA, 21 bp, synthetic construct
  misc_feature 1..21: note = Synthetic Construct
  source 1..21: mol_type = other DNA
tccacctcttcgctgcctttg

SEQ ID NO: 20249 - DNA, 24 bp, synthetic construct
  misc_feature 1..24: note = Synthetic Construct
  source 1..24: mol_type = other DNA
tcccaaagtgaatgctgacataga

SEQ ID NO: 20250 - DNA, 26 bp, synthetic construct
  misc_feature 1..26: note = Synthetic Construct
  source 1..26: mol_type = other DNA
gctgtcgttgcctatacaactgttac

SEQ ID NO: 20251 - DNA, 22 bp, synthetic construct
  misc_feature 1..22: note = Synthetic Construct
  source 1..22: mol_type = other DNA
ggagcctactgggaatcaggaa

SEQ ID NO: 20252 - DNA, 25 bp, synthetic construct
  misc_feature 1..25: note = Synthetic Construct
  source 1..25: mol_type = other DNA
ggaagagctgggctttgttttctgt

SEQ ID NO: 20253 - DNA, 24 bp, synthetic construct
  misc_feature 1..24: note = Synthetic Construct
  source 1..24: mol_type = other DNA
gccagatgcaggaaaggaacaatg

SEQ ID NO: 20254 - DNA, 23 bp, synthetic construct
  misc_feature 1..23: note = Synthetic Construct
  source 1..23: mol_type = other DNA
cgatcaggacactgagcctatca

SEQ ID NO: 20255 - DNA, 26 bp, synthetic construct
  misc_feature 1..26: note = Synthetic Construct
  source 1..26: mol_type = other DNA
ttggagaggtagatgaaagaggagat

SEQ ID NO: 20256 - DNA, 21 bp, synthetic construct
  misc_feature 1..21: note = Synthetic Construct
  source 1..21: mol_type = other DNA
ccccagtgcaacacagagctt

SEQ ID NO: 20257 - DNA, 19 bp, synthetic construct
  misc_feature 1..19: note = Synthetic Construct
  source 1..19: mol_type = other DNA
aggagcaaccgcgccatac

SEQ ID NO: 20258 - DNA, 23 bp, synthetic construct
  misc_feature 1..23: note = Synthetic Construct
  source 1..23: mol_type = other DNA
cggccctcatctttcaggaagta

SEQ ID NO: 20259 - DNA, 22 bp, synthetic construct
  misc_feature 1..22: note = Synthetic Construct
  source 1..22: mol_type = other DNA
ctggctgcttcctcttcctatc

SEQ ID NO: 20260 - DNA, 29 bp, synthetic construct
  misc_feature 1..29: note = Synthetic Construct
  source 1..29: mol_type = other DNA
gggatctaggcatataaacagttctcttc

SEQ ID NO: 20261 - DNA, 22 bp, synthetic construct
  misc_feature 1..22: note = Synthetic Construct
  source 1..22: mol_type = other DNA
ctggagctcattggctggaagt

SEQ ID NO: 20262 - DNA, 23 bp, synthetic construct
  misc_feature 1..23: note = Synthetic Construct
  source 1..23: mol_type = other DNA
ggtattctctgctgcatggatct

SEQ ID NO: 20263 - DNA, 26 bp, synthetic construct
  misc_feature 1..26: note = Synthetic Construct
  source 1..26: mol_type = other DNA
gaccccttaaactttctggagcaaac

SEQ ID NO: 20264 - DNA, 21 bp, synthetic construct
  misc_feature 1..21: note = Synthetic Construct
  source 1..21: mol_type = other DNA
ccctctcagggccttggtttc

SEQ ID NO: 20265 - DNA, 26 bp, synthetic construct
  misc_feature 1..26: note = Synthetic Construct
  source 1..26: mol_type = other DNA
gctaaggacaccatgaaggatagcaa

SEQ ID NO: 20266 - DNA, 20 bp, synthetic construct
  misc_feature 1..20: note = Synthetic Construct
  source 1..20: mol_type = other DNA
aagtcaggcgctgtctggaa

SEQ ID NO: 20267 - DNA, 20 bp, synthetic construct
  misc_feature 1..20: note = Synthetic Construct
  source 1..20: mol_type = other DNA
tggcagtgagggagggattc

SEQ ID NO: 20268 - DNA, 22 bp, synthetic construct
  misc_feature 1..22: note = Synthetic Construct
  source 1..22: mol_type = other DNA
tgggaggagattcgcctgatga

SEQ ID NO: 20269 - DNA, 25 bp, synthetic construct
  misc_feature 1..25: note = Synthetic Construct
  source 1..25: mol_type = other DNA
gcccagatttaagaagagagggatt

SEQ ID NO: 20270 - DNA, 24 bp, synthetic construct
  misc_feature 1..24: note = Synthetic Construct
  source 1..24: mol_type = other DNA
ctgtcctccaagcctgtacaaagt

SEQ ID NO: 20271 - DNA, 22 bp, synthetic construct
  misc_feature 1..22: note = Synthetic Construct
  source 1..22: mol_type = other DNA
acccctctaccttccagtgaac

SEQ ID NO: 20272 - DNA, 22 bp, synthetic construct
  misc_feature 1..22: note = Synthetic Construct
  source 1..22: mol_type = other DNA
gccagtttcttcagctccaagt

SEQ ID NO: 20273 - DNA, 21 bp, synthetic construct
  misc_feature 1..21: note = Synthetic Construct
  source 1..21: mol_type = other DNA
ccctgaagctgttcggctttg

SEQ ID NO: 20274 - DNA, 21 bp, synthetic construct
  misc_feature 1..21: note = Synthetic Construct
  source 1..21: mol_type = other DNA
tggggagggatcagagacaca

SEQ ID NO: 20275 - DNA, 22 bp, synthetic construct
  misc_feature 1..22: note = Synthetic Construct
  source 1..22: mol_type = other DNA
gcctcttgaggagggacctttc

SEQ ID NO: 20276 - DNA, 22 bp, synthetic construct
  misc_feature 1..22: note = Synthetic Construct
  source 1..22: mol_type = other DNA
tcccactgccctaagtctttga

SEQ ID NO: 20277 - DNA, 21 bp, synthetic construct
  misc_feature 1..21: note = Synthetic Construct
  source 1..21: mol_type = other DNA
cgccaatggctctcctcactt

SEQ ID NO: 20278 - DNA, 25 bp, synthetic construct
  misc_feature 1..25: note = Synthetic Construct
  source 1..25: mol_type = other DNA
cttcccagcatattgcaaagacaca

SEQ ID NO: 20279 - DNA, 24 bp, synthetic construct
  misc_feature 1..24: note = Synthetic Construct
  source 1..24: mol_type = other DNA
gaacctgtgtggacctgatcaaac

SEQ ID NO: 20280 - DNA, 24 bp, synthetic construct
  misc_feature 1..24: note = Synthetic Construct
  source 1..24: mol_type = other DNA
gctgtggtttgggctgaagaattt

SEQ ID NO: 20281 - DNA, 22 bp, synthetic construct
  misc_feature 1..22: note = Synthetic Construct
  source 1..22: mol_type = other DNA
gctcaagggttggactccatgt

SEQ ID NO: 20282 - DNA, 22 bp, synthetic construct
  misc_feature 1..22: note = Synthetic Construct
  source 1..22: mol_type = other DNA
gggatgtggtgggaatcaccat

SEQ ID NO: 20283 - DNA, 26 bp, synthetic construct
  misc_feature 1..26: note = Synthetic Construct
  source 1..26: mol_type = other DNA
cagaaactaccaggtgcttcatggtt

SEQ ID NO: 20284 - DNA, 21 bp, synthetic construct
  misc_feature 1..21: note = Synthetic Construct
  source 1..21: mol_type = other DNA
ggcctcatcttcccagtgctt

SEQ ID NO: 20285 - DNA, 25 bp, synthetic construct
  misc_feature 1..25: note = Synthetic Construct
  source 1..25: mol_type = other DNA
gtcaggggcatcttagttttctgta

SEQ ID NO: 20286 - DNA, 26 bp, synthetic construct
  misc_feature 1..26: note = Synthetic Construct
  source 1..26: mol_type = other DNA
actctcctttactggatcttcctact

SEQ ID NO: 20287 - DNA, 24 bp, synthetic construct
  misc_feature 1..24: note = Synthetic Construct
  source 1..24: mol_type = other DNA
ccttggagtcaccctagattcttc

SEQ ID NO: 20288 - DNA, 22 bp, synthetic construct
  misc_feature 1..22: note = Synthetic Construct
  source 1..22: mol_type = other DNA
agcccctgatgtacctttctgt

SEQ ID NO: 20289 - DNA, 25 bp, synthetic construct
  misc_feature 1..25: note = Synthetic Construct
  source 1..25: mol_type = other DNA
ctagtccatggatactggcatttct

SEQ ID NO: 20290 - DNA, 20 bp, synthetic construct
  misc_feature 1..20: note = Synthetic Construct
  source 1..20: mol_type = other DNA
gccagcatggttggcttttg

SEQ ID NO: 20291 - DNA, 23 bp, synthetic construct
  misc_feature 1..23: note = Synthetic Construct
  source 1..23: mol_type = other DNA
ggccaccttagaggtttgtttgt

SEQ ID NO: 20292 - DNA, 22 bp, synthetic construct
  misc_feature 1..22: note = Synthetic Construct
  source 1..22: mol_type = other DNA
ggggagggtcaactgtcctcta

SEQ ID NO: 20293 - DNA, 22 bp, synthetic construct
  misc_feature 1..22: note = Synthetic Construct
  source 1..22: mol_type = other DNA
ccaacccattccaaggcagtca

SEQ ID NO: 20294 - DNA, 24 bp, synthetic construct
  misc_feature 1..24: note = Synthetic Construct
  source 1..24: mol_type = other DNA
tgaatcctagagagcggaactttg

SEQ ID NO: 20295 - DNA, 27 bp, synthetic construct
  misc_feature 1..27: note = Synthetic Construct
  source 1..27: mol_type = other DNA
gtgttacctgtcatttcctacccttag

SEQ ID NO: 20296 - DNA, 21 bp, synthetic construct
  misc_feature 1..21: note = Synthetic Construct
  source 1..21: mol_type = other DNA
attcccctgtgccgggacttc

SEQ ID NO: 20297 - DNA, 26 bp, synthetic construct
  misc_feature 1..26: note = Synthetic Construct
  source 1..26: mol_type = other DNA
gcaatggctagctcttagctattcta

SEQ ID NO: 20298 - DNA, 23 bp, synthetic construct
  misc_feature 1..23: note = Synthetic Construct
  source 1..23: mol_type = other DNA
gccatgtgcctttggtcatgaga

SEQ ID NO: 20299 - DNA, 24 bp, synthetic construct
  misc_feature 1..24: note = Synthetic Construct
  source 1..24: mol_type = other DNA
gacaagcctcttcacgatgaaaca

SEQ ID NO: 20300 - DNA, 27 bp, synthetic construct
  misc_feature 1..27: note = Synthetic Construct
  source 1..27: mol_type = other DNA
ggatatttgtacggggacctcctatac

SEQ ID NO: 20301 - DNA, 20 bp, synthetic construct
  misc_feature 1..20: note = Synthetic Construct
  source 1..20: mol_type = other DNA
ttgacctctgcctgccattc

SEQ ID NO: 20302 - DNA, 20 bp, synthetic construct
  misc_feature 1..20: note = Synthetic Construct
  source 1..20: mol_type = other DNA
tgtgggcaggcctcttagat

SEQ ID NO: 20303 - DNA, 28 bp, synthetic construct
  misc_feature 1..28: note = Synthetic Construct
  source 1..28: mol_type = other DNA
cagctccttccccttaagaagtaaatca

SEQ ID NO: 20304 - DNA, 25 bp, synthetic construct
  misc_feature 1..25: note = Synthetic Construct
  source 1..25: mol_type = other DNA
gcccttagaacacaggatccagaag

SEQ ID NO: 20305 - DNA, 27 bp, synthetic construct
  misc_feature 1..27: note = Synthetic Construct
  source 1..27: mol_type = other DNA
ccaagtctgtcgtgcaaaaattctaac

SEQ ID NO: 20306 - DNA, 29 bp, synthetic construct
  misc_feature 1..29: note = Synthetic Construct
  source 1..29: mol_type = other DNA
gactaggaagctaaagaatcagtgagagt

SEQ ID NO: 20307 - DNA, 25 bp, synthetic construct
  misc_feature 1..25: note = Synthetic Construct
  source 1..25: mol_type = other DNA
gacgggtgactaagtctcacagttg

SEQ ID NO: 20308 - DNA, 23 bp, synthetic construct
  misc_feature 1..23: note = Synthetic Construct
  source 1..23: mol_type = other DNA
ccctggaaagactgattggcatt

SEQ ID NO: 20309 - DNA, 20 bp, synthetic construct
  misc_feature 1..20: note = Synthetic Construct
  source 1..20: mol_type = other DNA
ccggattcacgagtgcctaa

SEQ ID NO: 20310 - DNA, 23 bp, synthetic construct
  misc_feature 1..23: note = Synthetic Construct
  source 1..23: mol_type = other DNA
gggaattggcatttctggcaaca

SEQ ID NO: 20311 - DNA, 23 bp, synthetic construct
  misc_feature 1..23: note = Synthetic Construct
  source 1..23: mol_type = other DNA
ccccttccattttccctttcctt

SEQ ID NO: 20312 - DNA, 25 bp, synthetic construct
  misc_feature 1..25: note = Synthetic Construct
  source 1..25: mol_type = other DNA
tcgccatctacccagaaaagattta

SEQ ID NO: 20313 - DNA, 20 bp, synthetic construct
  misc_feature 1..20: note = Synthetic Construct
  source 1..20: mol_type = other DNA
tgcgacaaggctctctgact

SEQ ID NO: 20314 - DNA, 23 bp, synthetic construct
  misc_feature 1..23: note = Synthetic Construct
  source 1..23: mol_type = other DNA
gggcgaccataaattgccctgaa

SEQ ID NO: 20315 - DNA, 22 bp, synthetic construct
  misc_feature 1..22: note = Synthetic Construct
  source 1..22: mol_type = other DNA
gcctagacccagaggcaattct

SEQ ID NO: 20316 - DNA, 27 bp, synthetic construct
  misc_feature 1..27: note = Synthetic Construct
  source 1..27: mol_type = other DNA
ccagtgaaggtttctgacatgaccata

SEQ ID NO: 20317 - DNA, 21 bp, synthetic construct
  misc_feature 1..21: note = Synthetic Construct
  source 1..21: mol_type = other DNA
gccaggatgtacggcgtgtaa

SEQ ID NO: 20318 - DNA, 21 bp, synthetic construct
  misc_feature 1..21: note = Synthetic Construct
  source 1..21: mol_type = other DNA
tgttctgtctggctggcattc

SEQ ID NO: 20319 - DNA, 21 bp, synthetic construct
  misc_feature 1..21: note = Synthetic Construct
  source 1..21: mol_type = other DNA
cctggctgataccttggcttt

SEQ ID NO: 20320 - DNA, 22 bp, synthetic construct
  misc_feature 1..22: note = Synthetic Construct
  source 1..22: mol_type = other DNA
caaccagtctggggtagagcaa

SEQ ID NO: 20321 - DNA, 30 bp, synthetic construct
  misc_feature 1..30: note = Synthetic Construct
  source 1..30: mol_type = other DNA
ggaccgaagaatgttttgaactacaccata

SEQ ID NO: 20322 - DNA, 24 bp, synthetic construct
  misc_feature 1..24: note = Synthetic Construct
  source 1..24: mol_type = other DNA
gagggttcagttagcctgagtatc

SEQ ID NO: 20323 - DNA, 27 bp, synthetic construct
  misc_feature 1..27: note = Synthetic Construct
  source 1..27: mol_type = other DNA
gcattagtgagtgtgagctatggttag

SEQ ID NO: 20324 - DNA, 25 bp, synthetic construct
  misc_feature 1..25: note = Synthetic Construct
  source 1..25: mol_type = other DNA
gcagggaccctattgtaacaagaca

SEQ ID NO: 20325 - DNA, 24 bp, synthetic construct
  misc_feature 1..24: note = Synthetic Construct
  source 1..24: mol_type = other DNA
ccacagggactgattcagcagtga

SEQ ID NO: 20326 - DNA, 24 bp, synthetic construct
  misc_feature 1..24: note = Synthetic Construct
  source 1..24: mol_type = other DNA
ggggagagacaggatcaaccagta

SEQ ID NO: 20327 - DNA, 24 bp, synthetic construct
  misc_feature 1..24: note = Synthetic Construct
  source 1..24: mol_type = other DNA
ccccaggtattctcagcttcaatg

SEQ ID NO: 20328 - DNA, 22 bp, synthetic construct
  misc_feature 1..22: note = Synthetic Construct
  source 1..22: mol_type = other DNA
ttccaaagcctgcggaattcta

SEQ ID NO: 20329 - DNA, 30 bp, synthetic construct
  misc_feature 1..30: note = Synthetic Construct
  source 1..30: mol_type = other DNA
gggaacaatcagtggtcactatatttgcat

SEQ ID NO: 20330 - DNA, 24 bp, synthetic construct
  misc_feature 1..24: note = Synthetic Construct
  source 1..24: mol_type = other DNA
cactgctcagatcacccttaaaga

SEQ ID NO: 20331 - DNA, 30 bp, synthetic construct
  misc_feature 1..30: note = Synthetic Construct
  source 1..30: mol_type = other DNA
ccagtttaactttgaatgctcaacgcttct

SEQ ID NO: 20332 - DNA, 22 bp, synthetic construct
  misc_feature 1..22: note = Synthetic Construct
  source 1..22: mol_type = other DNA
ccaccctgtaaaagcaggaaga

SEQ ID NO: 20333 - DNA, 25 bp, synthetic construct
  misc_feature 1..25: note = Synthetic Construct
  source 1..25: mol_type = other DNA
cgtaagtcctttgtggcctccaata

SEQ ID NO: 20334 - DNA, 22 bp, synthetic construct
  misc_feature 1..22: note = Synthetic Construct
  source 1..22: mol_type = other DNA
ggtggaggaatgctctgctaaa

SEQ ID NO: 20335 - DNA, 24 bp, synthetic construct
  misc_feature 1..24: note = Synthetic Construct
  source 1..24: mol_type = other DNA
ggtgattgctgcagatgggctaag

SEQ ID NO: 20336 - DNA, 27 bp, synthetic construct
  misc_feature 1..27: note = Synthetic Construct
  source 1..27: mol_type = other DNA
gcagcattaacattgctgaacgtttct

SEQ ID NO: 20337 - DNA, 30 bp, synthetic construct
  misc_feature 1..30: note = Synthetic Construct
  source 1..30: mol_type = other DNA
gagcaacactgatggagaagaaagaaatgt

SEQ ID NO: 20338 - DNA, 22 bp, synthetic construct
  misc_feature 1..22: note = Synthetic Construct
  source 1..22: mol_type = other DNA
ggctgtgctagacaggttgaag

SEQ ID NO: 20339 - DNA, 26 bp, synthetic construct
  misc_feature 1..26: note = Synthetic Construct
  source 1..26: mol_type = other DNA
cacatgagtgagcctgaaagtggata

SEQ ID NO: 20340 - DNA, 23 bp, synthetic construct
  misc_feature 1..23: note = Synthetic Construct
  source 1..23: mol_type = other DNA
ctggtgctctccatgcactcatt

SEQ ID NO: 20341 - DNA, 25 bp, synthetic construct
  misc_feature 1..25: note = Synthetic Construct
  source 1..25: mol_type = other DNA
gagggtttattcaccatccatcaca

SEQ ID NO: 20342 - DNA, 24 bp, synthetic construct
  misc_feature 1..24: note = Synthetic Construct
  source 1..24: mol_type = other DNA
ctggagtctgaagtcccctgaatc

SEQ ID NO: 20343 - DNA, 22 bp, synthetic construct
  misc_feature 1..22: note = Synthetic Construct
  source 1..22: mol_type = other DNA
gttctggccactctttctctgt

SEQ ID NO: 20344 - DNA, 28 bp, synthetic construct
  misc_feature 1..28: note = Synthetic Construct
  source 1..28: mol_type = other DNA
cctggaaaatttcttctccagtcccaaa

SEQ ID NO: 20345 - DNA, 26 bp, synthetic construct
  misc_feature 1..26: note = Synthetic Construct
  source 1..26: mol_type = other DNA
gccatgctttgtagttatgggagaga

SEQ ID NO: 20346 - DNA, 27 bp, synthetic construct
  misc_feature 1..27: note = Synthetic Construct
  source 1..27: mol_type = other DNA
ctgaatctactcagctccattgacaag

SEQ ID NO: 20347 - DNA, 25 bp, synthetic construct
  misc_feature 1..25: note = Synthetic Construct
  source 1..25: mol_type = other DNA
gcatggagtatattgctgctgaaag

SEQ ID NO: 20348 - DNA, 27 bp, synthetic construct
  misc_feature 1..27: note = Synthetic Construct
  source 1..27: mol_type = other DNA
ggtcagagagagaacaaacacttcctt

SEQ ID NO: 20349 - DNA, 22 bp, synthetic construct
  misc_feature 1..22: note = Synthetic Construct
  source 1..22: mol_type = other DNA
cttccaagccagtccaccaaca

SEQ ID NO: 20350 - DNA, 24 bp, synthetic construct
  misc_feature 1..24: note = Synthetic Construct
  source 1..24: mol_type = other DNA
ggtcgtgtttggaagagacacaca

SEQ ID NO: 20351 - DNA, 23 bp, synthetic construct
  misc_feature 1..23: note = Synthetic Construct
  source 1..23: mol_type = other DNA
agctccatagcaacctctctgaa

SEQ ID NO: 20352 - DNA, 23 bp, synthetic construct
  misc_feature 1..23: note = Synthetic Construct
  source 1..23: mol_type = other DNA
acccttccttgcaagacattgat

SEQ ID NO: 20353 - DNA, 27 bp, synthetic construct
  misc_feature 1..27: note = Synthetic Construct
  source 1..27: mol_type = other DNA
gggagaatagcaagtctggtagcaaag

SEQ ID NO: 20354 - DNA, 24 bp, synthetic construct
  misc_feature 1..24: note = Synthetic Construct
  source 1..24: mol_type = other DNA
ggatctgtggctgttttcaagaag

SEQ ID NO: 20355 - DNA, 25 bp, synthetic construct
  misc_feature 1..25: note = Synthetic Construct
  source 1..25: mol_type = other DNA
agggctatttcataggcttggattc

SEQ ID NO: 20356 - DNA, 25 bp, synthetic construct
  misc_feature 1..25: note = Synthetic Construct
  source 1..25: mol_type = other DNA
gagacagcaggtatttgttcagttg

SEQ ID NO: 20357 - DNA, 22 bp, synthetic construct
  misc_feature 1..22: note = Synthetic Construct
  source 1..22: mol_type = other DNA
ccctggctctgagctcatttca

SEQ ID NO: 20358 - DNA, 26 bp, synthetic construct
  misc_feature 1..26: note = Synthetic Construct
  source 1..26: mol_type = other DNA
gctctccatagcctcatttcccacta

SEQ ID NO: 20359 - DNA, 26 bp, synthetic construct
  misc_feature 1..26: note = Synthetic Construct
  source 1..26: mol_type = other DNA
gcaacaaccttgtgtaaatcccttca

SEQ ID NO: 20360 - DNA, 24 bp, synthetic construct
  misc_feature 1..24: note = Synthetic Construct
  source 1..24: mol_type = other DNA
ctcaagcgatcctccctctctttg

SEQ ID NO: 20361 - DNA, 22 bp, synthetic construct
  misc_feature 1..22: note = Synthetic Construct
  source 1..22: mol_type = other DNA
tggtttgcacttcactcgtttc

SEQ ID NO: 20362 - DNA, 23 bp, synthetic construct
  misc_feature 1..23: note = Synthetic Construct
  source 1..23: mol_type = other DNA
gcttttgcaccattgtgaagttg

SEQ ID NO: 20363 - DNA, 24 bp, synthetic construct
  misc_feature 1..24: note = Synthetic Construct
  source 1..24: mol_type = other DNA
ctgaaccgtctgtgggaaagttct

SEQ ID NO: 20364 - DNA, 24 bp, synthetic construct
  misc_feature 1..24: note = Synthetic Construct
  source 1..24: mol_type = other DNA
ctcccataggcacatcaattctga

SEQ ID NO: 20365 - DNA, 29 bp, synthetic construct
  misc_feature 1..29: note = Synthetic Construct
  source 1..29: mol_type = other DNA
ctgttcagaatcaggactgactactctct

SEQ ID NO: 20366 - DNA, 24 bp, synthetic construct
  misc_feature 1..24: note = Synthetic Construct
  source 1..24: mol_type = other DNA
cccttagttgtgaaggatggttct

SEQ ID NO: 20367 - DNA, 21 bp, synthetic construct
  misc_feature 1..21: note = Synthetic Construct
  source 1..21: mol_type = other DNA
gctggcatctactggcacaca

SEQ ID NO: 20368 - DNA, 20 bp, synthetic construct
  misc_feature 1..20: note = Synthetic Construct
  source 1..20: mol_type = other DNA
ggactgtgtcggtggtttga

SEQ ID NO: 20369 - DNA, 24 bp, synthetic construct
  misc_feature 1..24: note = Synthetic Construct
  source 1..24: mol_type = other DNA
cagtaagttctgaggtcctgtgtt

SEQ ID NO: 20370 - DNA, 22 bp, synthetic construct
  misc_feature 1..22: note = Synthetic Construct
  source 1..22: mol_type = other DNA
gaggaaagggtggccatcatca

SEQ ID NO: 20371 - DNA, 23 bp, synthetic construct
  misc_feature 1..23: note = Synthetic Construct
  source 1..23: mol_type = other DNA
gctgcacaggattttccacaatg

SEQ ID NO: 20372 - DNA, 22 bp, synthetic construct
  misc_feature 1..22: note = Synthetic Construct
  source 1..22: mol_type = other DNA
ttgcctgggcttttgaggtatt

SEQ ID NO: 20373 - DNA, 20 bp, synthetic construct
  misc_feature 1..20: note = Synthetic Construct
  source 1..20: mol_type = other DNA
ctgctctttgctccgtgaca

SEQ ID NO: 20374 - DNA, 20 bp, synthetic construct
  misc_feature 1..20: note = Synthetic Construct
  source 1..20: mol_type = other DNA
tcagactggccttcgagaca

SEQ ID NO: 20375 - DNA, 22 bp, synthetic construct
  misc_feature 1..22: note = Synthetic Construct
  source 1..22: mol_type = other DNA
ggaccccagtcactgcatttca

SEQ ID NO: 20376 - DNA, 27 bp, synthetic construct
  misc_feature 1..27: note = Synthetic Construct
  source 1..27: mol_type = other DNA
gcagatcttggagatgacccataattc

SEQ ID NO: 20377 - DNA, 24 bp, synthetic construct
  misc_feature 1..24: note = Synthetic Construct
  source 1..24: mol_type = other DNA
gcaaagagccaacttctgatctgt

SEQ ID NO: 20378 - DNA, 24 bp, synthetic construct
  misc_feature 1..24: note = Synthetic Construct
  source 1..24: mol_type = other DNA
aggtaaggagggcagtttctatga

SEQ ID NO: 20379 - DNA, 21 bp, synthetic construct
  misc_feature 1..21: note = Synthetic Construct
  source 1..21: mol_type = other DNA
cgtggtaacaccgcactcaag

SEQ ID NO: 20380 - DNA, 24 bp, synthetic construct
  misc_feature 1..24: note = Synthetic Construct
  source 1..24: mol_type = other DNA
gggtccaaaggacatttcagacta

SEQ ID NO: 20381 - DNA, 20 bp, synthetic construct
  misc_feature 1..20: note = Synthetic Construct
  source 1..20: mol_type = other DNA
agggctgtgtgaggttccat

SEQ ID NO: 20382 - DNA, 25 bp, synthetic construct
  misc_feature 1..25: note = Synthetic Construct
  source 1..25: mol_type = other DNA
gccttgaagttgccttcaaaacact

SEQ ID NO: 20383 - DNA, 23 bp, synthetic construct
  misc_feature 1..23: note = Synthetic Construct
  source 1..23: mol_type = other DNA
gcctgaccaattctgtggctctt

SEQ ID NO: 20384 - DNA, 24 bp, synthetic construct
  misc_feature 1..24: note = Synthetic Construct
  source 1..24: mol_type = other DNA
ggtctcatctcactgtgtctcaac

SEQ ID NO: 20385 - DNA, 27 bp, synthetic construct
  misc_feature 1..27: note = Synthetic Construct
  source 1..27: mol_type = other DNA
cgggcaatggataaccaagttttcttc

SEQ ID NO: 20386 - DNA, 26 bp, synthetic construct
  misc_feature 1..26: note = Synthetic Construct
  source 1..26: mol_type = other DNA
gtgtcatcccacattgagtgaaaact

SEQ ID NO: 20387 - DNA, 22 bp, synthetic construct
  misc_feature 1..22: note = Synthetic Construct
  source 1..22: mol_type = other DNA
ccctcgtcagcttttccactct

SEQ ID NO: 20388 - DNA, 25 bp, synthetic construct
  misc_feature 1..25: note = Synthetic Construct
  source 1..25: mol_type = other DNA
cttggtccttggtgccttatttagt

SEQ ID NO: 20389 - DNA, 25 bp, synthetic construct
  misc_feature 1..25: note = Synthetic Construct
  source 1..25: mol_type = other DNA
cgtgggcctaagttttcaactcatt

SEQ ID NO: 20390 - DNA, 22 bp, synthetic construct
  misc_feature 1..22: note = Synthetic Construct
  source 1..22: mol_type = other DNA
tggagacccatgctgtcaggaa

SEQ ID NO: 20391 - DNA, 23 bp, synthetic construct
  misc_feature 1..23: note = Synthetic Construct
  source 1..23: mol_type = other DNA
ccaaggaggctgaatgaagtgat

SEQ ID NO: 20392 - DNA, 23 bp, synthetic construct
  misc_feature 1..23: note = Synthetic Construct
  source 1..23: mol_type = other DNA
tgaagaaccattgctgtcctgat

SEQ ID NO: 20393 - DNA, 22 bp, synthetic construct
  misc_feature 1..22: note = Synthetic Construct
  source 1..22: mol_type = other DNA
tccatccacctcggtctccaaa

SEQ ID NO: 20394 - DNA, 22 bp, synthetic construct
  misc_feature 1..22: note = Synthetic Construct
  source 1..22: mol_type = other DNA
agggtcattttctggcctttga

SEQ ID NO: 20395 - DNA, 22 bp, synthetic construct
  misc_feature 1..22: note = Synthetic Construct
  source 1..22: mol_type = other DNA
gtgttctggacacggacgtaag

SEQ ID NO: 20396 - DNA, 28 bp, synthetic construct
  misc_feature 1..28: note = Synthetic Construct
  source 1..28: mol_type = other DNA
gtggatctttgctcttggtgaagatgta

SEQ ID NO: 20397 - DNA, 18 bp, synthetic construct
  misc_feature 1..18: note = Synthetic Construct
  source 1..18: mol_type = other DNA
ttggggcatgccgtcact

SEQ ID NO: 20398 - DNA, 27 bp, synthetic construct
  misc_feature 1..27: note = Synthetic Construct
  source 1..27: mol_type = other DNA
gacaaggtggtcctcagatagattaca

SEQ ID NO: 20399 - DNA, 21 bp, synthetic construct
  misc_feature 1..21: note = Synthetic Construct
  source 1..21: mol_type = other DNA
agtgtgctaacttggctgcaa

SEQ ID NO: 20400 - DNA, 28 bp, synthetic construct
  misc_feature 1..28: note = Synthetic Construct
  source 1..28: mol_type = other DNA
ggcagtggacttaaaatatggggaagat

SEQ ID NO: 20401 - DNA, 24 bp, synthetic construct
  misc_feature 1..24: note = Synthetic Construct
  source 1..24: mol_type = other DNA
gccaaaggttgtctaactggtagt

SEQ ID NO: 20402 - DNA, 21 bp, synthetic construct
  misc_feature 1..21: note = Synthetic Construct
  source 1..21: mol_type = other DNA
cctgcaccgtgccttctcatt

SEQ ID NO: 20403 - DNA, 23 bp, synthetic construct
  misc_feature 1..23: note = Synthetic Construct
  source 1..23: mol_type = other DNA
ctggaatcagctgctgtggtatg

SEQ ID NO: 20404 - DNA, 22 bp, synthetic construct
  misc_feature 1..22: note = Synthetic Construct
  source 1..22: mol_type = other DNA
gcagctacacatccccttctct

SEQ ID NO: 20405 - DNA, 22 bp, synthetic construct
  misc_feature 1..22: note = Synthetic Construct
  source 1..22: mol_type = other DNA
cctctccatttctgggctcctt

SEQ ID NO: 20406 - DNA, 25 bp, synthetic construct
  misc_feature 1..25: note = Synthetic Construct
  source 1..25: mol_type = other DNA
gcaggagtcagaaaagtaacacaaa

SEQ ID NO: 20407 - DNA, 25 bp, synthetic construct
  misc_feature 1..25: note = Synthetic Construct
  source 1..25: mol_type = other DNA
gtgaaggggctgagtcaaaatgaac

SEQ ID NO: 20408 - DNA, 24 bp, synthetic construct
  misc_feature 1..24: note = Synthetic Construct
  source 1..24: mol_type = other DNA
cagtggttttcaggagccctaatc

SEQ ID NO: 20409 - DNA, 23 bp, synthetic construct
  misc_feature 1..23: note = Synthetic Construct
  source 1..23: mol_type = other DNA
gtgtcatttgctcgtttgccttt

SEQ ID NO: 20410 - DNA, 22 bp, synthetic construct
  misc_feature 1..22: note = Synthetic Construct
  source 1..22: mol_type = other DNA
ggtggggcacaaattcagttac

SEQ ID NO: 20411 - DNA, 26 bp, synthetic construct
  misc_feature 1..26: note = Synthetic Construct
  source 1..26: mol_type = other DNA
gcactttacacatcctgatgtctctt

SEQ ID NO: 20412 - DNA, 20 bp, synthetic construct
  misc_feature 1..20: note = Synthetic Construct
  source 1..20: mol_type = other DNA
ccaggctttgggaacaccat

SEQ ID NO: 20413 - DNA, 26 bp, synthetic construct
  misc_feature 1..26: note = Synthetic Construct
  source 1..26: mol_type = other DNA
gcctgacatttttcctagagggagat

SEQ ID NO: 20414 - DNA, 24 bp, synthetic construct
  misc_feature 1..24: note = Synthetic Construct
  source 1..24: mol_type = other DNA
agaagggaactcagaggttaccaa

SEQ ID NO: 20415 - DNA, 20 bp, synthetic construct
  misc_feature 1..20: note = Synthetic Construct
  source 1..20: mol_type = other DNA
ggcttcagcagggtcagact

SEQ ID NO: 20416 - DNA, 23 bp, synthetic construct
  misc_feature 1..23: note = Synthetic Construct
  source 1..23: mol_type = other DNA
cccactacaccatgagctcttct

SEQ ID NO: 20417 - DNA, 25 bp, synthetic construct
  misc_feature 1..25: note = Synthetic Construct
  source 1..25: mol_type = other DNA
ccatgtgaaaaactgcttcccttct

SEQ ID NO: 20418 - DNA, 23 bp, synthetic construct
  misc_feature 1..23: note = Synthetic Construct
  source 1..23: mol_type = other DNA
gctcaggggtttagccttctttg

SEQ ID NO: 20419 - DNA, 26 bp, synthetic construct
  misc_feature 1..26: note = Synthetic Construct
  source 1..26: mol_type = other DNA
caagaaggaagccaagtttggttatg

SEQ ID NO: 20420 - DNA, 25 bp, synthetic construct
  misc_feature 1..25: note = Synthetic Construct
  source 1..25: mol_type = other DNA
cacagtcctgatggttgtcatggtt

SEQ ID NO: 20421 - DNA, 25 bp, synthetic construct
  misc_feature 1..25: note = Synthetic Construct
  source 1..25: mol_type = other DNA
cagaagacaagatctctcccagatg

SEQ ID NO: 20422 - DNA, 23 bp, synthetic construct
  misc_feature 1..23: note = Synthetic Construct
  source 1..23: mol_type = other DNA
gtctcctttgacactggccaaaa

SEQ ID NO: 20423 - DNA, 21 bp, synthetic construct
  misc_feature 1..21: note = Synthetic Construct
  source 1..21: mol_type = other DNA
tcaacacacatggggttgcat

SEQ ID NO: 20424 - DNA, 26 bp, synthetic construct
  misc_feature 1..26: note = Synthetic Construct
  source 1..26: mol_type = other DNA
ggacctagtcttattggactgggaat

SEQ ID NO: 20425 - DNA, 27 bp, synthetic construct
  misc_feature 1..27: note = Synthetic Construct
  source 1..27: mol_type = other DNA
cgcccggccttatatagtattttcact

SEQ ID NO: 20426 - DNA, 27 bp, synthetic construct
  misc_feature 1..27: note = Synthetic Construct
  source 1..27: mol_type = other DNA
ctctggcctttttagtttacagagttc

SEQ ID NO: 20427 - DNA, 24 bp, synthetic construct
  misc_feature 1..24: note = Synthetic Construct
  source 1..24: mol_type = other DNA
tgctcattcacttgggatttggaa

SEQ ID NO: 20428 - DNA, 24 bp, synthetic construct
  misc_feature 1..24: note = Synthetic Construct
  source 1..24: mol_type = other DNA
ccatcacctgcaatgcccattagt

SEQ ID NO: 20429 - DNA, 26 bp, synthetic construct
  misc_feature 1..26: note = Synthetic Construct
  source 1..26: mol_type = other DNA
ggcactggggattactagaggaataa

SEQ ID NO: 20430 - DNA, 25 bp, synthetic construct
  misc_feature 1..25: note = Synthetic Construct
  source 1..25: mol_type = other DNA
tctctcttcagccgagatgtaattg

SEQ ID NO: 20431 - DNA, 24 bp, synthetic construct
  misc_feature 1..24: note = Synthetic Construct
  source 1..24: mol_type = other DNA
aggtgtgttggagaggaaaaacaa

SEQ ID NO: 20432 - DNA, 22 bp, synthetic construct
  misc_feature 1..22: note = Synthetic Construct
  source 1..22: mol_type = other DNA
ggccccacaaaccttcttttct

SEQ ID NO: 20433 - DNA, 21 bp, synthetic construct
  misc_feature 1..21: note = Synthetic Construct
  source 1..21: mol_type = other DNA
ggcttgtgtcacgaagggaaa

SEQ ID NO: 20434 - DNA, 22 bp, synthetic construct
  misc_feature 1..22: note = Synthetic Construct
  source 1..22: mol_type = other DNA
gcacaagactcacaacctctgt

SEQ ID NO: 20435 - DNA, 25 bp, synthetic construct
  misc_feature 1..25: note = Synthetic Construct
  source 1..25: mol_type = other DNA
ggcctcagatatttttggacgcaat

SEQ ID NO: 20436 - DNA, 25 bp, synthetic construct
  misc_feature 1..25: note = Synthetic Construct
  source 1..25: mol_type = other DNA
gccctctagttctcagtttgacaga

SEQ ID NO: 20437 - DNA, 22 bp, synthetic construct
  misc_feature 1..22: note = Synthetic Construct
  source 1..22: mol_type = other DNA
gtcccagaagtggcacagatca

SEQ ID NO: 20438 - DNA, 23 bp, synthetic construct
  misc_feature 1..23: note = Synthetic Construct
  source 1..23: mol_type = other DNA
agatgggaactagcctggtatgt

SEQ ID NO: 20439 - DNA, 24 bp, synthetic construct
  misc_feature 1..24: note = Synthetic Construct
  source 1..24: mol_type = other DNA
gccgtgggatcttgactgcaattt

SEQ ID NO: 20440 - DNA, 22 bp, synthetic construct
  misc_feature 1..22: note = Synthetic Construct
  source 1..22: mol_type = other DNA
gtcccttcgtttgtcaccttct

SEQ ID NO: 20441 - DNA, 30 bp, synthetic construct
  misc_feature 1..30: note = Synthetic Construct
  source 1..30: mol_type = other DNA
ggagctgaaaaacaattactgaacccgtta

SEQ ID NO: 20442 - DNA, 28 bp, synthetic construct
  misc_feature 1..28: note = Synthetic Construct
  source 1..28: mol_type = other DNA
gcctgatctattagaggagcagagatgt

SEQ ID NO: 20443 - DNA, 24 bp, synthetic construct
  misc_feature 1..24: note = Synthetic Construct
  source 1..24: mol_type = other DNA
gccatctggggaaaactggagaac

SEQ ID NO: 20444 - DNA, 25 bp, synthetic construct
  misc_feature 1..25: note = Synthetic Construct
  source 1..25: mol_type = other DNA
ctgcaaaggtcagagctgtttgttg

SEQ ID NO: 20445 - DNA, 22 bp, synthetic construct
  misc_feature 1..22: note = Synthetic Construct
  source 1..22: mol_type = other DNA
gagctggcctttgtgagtctct

SEQ ID NO: 20446 - DNA, 22 bp, synthetic construct
  misc_feature 1..22: note = Synthetic Construct
  source 1..22: mol_type = other DNA
gtgctgaaagcaaggcgagaag

SEQ ID NO: 20447 - DNA, 23 bp, synthetic construct
  misc_feature 1..23: note = Synthetic Construct
  source 1..23: mol_type = other DNA
ctggaaaacaggcagagcaaaga

SEQ ID NO: 20448 - DNA, 23 bp, synthetic construct
  misc_feature 1..23: note = Synthetic Construct
  source 1..23: mol_type = other DNA
tccagtatacagaagcagcgttt

SEQ ID NO: 20449 - DNA, 30 bp, synthetic construct
  misc_feature 1..30: note = Synthetic Construct
  source 1..30: mol_type = other DNA
ccagatataccgatcactgggtatcagttc

SEQ ID NO: 20450 - DNA, 22 bp, synthetic construct
  misc_feature 1..22: note = Synthetic Construct
  source 1..22: mol_type = other DNA
gcaggcccaccttctcatgaat

SEQ ID NO: 20451 - DNA, 26 bp, synthetic construct
  misc_feature 1..26: note = Synthetic Construct
  source 1..26: mol_type = other DNA
cctctccaacttaaacccttgatttc

SEQ ID NO: 20452 - DNA, 22 bp, synthetic construct
  misc_feature 1..22: note = Synthetic Construct
  source 1..22: mol_type = other DNA
tccccagactgtggtgattttc

SEQ ID NO: 20453 - DNA, 24 bp, synthetic construct
  misc_feature 1..24: note = Synthetic Construct
  source 1..24: mol_type = other DNA
tggaggagaggaggtattttggtt

SEQ ID NO: 20454 - DNA, 24 bp, synthetic construct
  misc_feature 1..24: note = Synthetic Construct
  source 1..24: mol_type = other DNA
ggactctgggacattgggaactgt

SEQ ID NO: 20455 - DNA, 24 bp, synthetic construct
  misc_feature 1..24: note = Synthetic Construct
  source 1..24: mol_type = other DNA
ccagatgttttggtctgtgcagta

SEQ ID NO: 20456 - DNA, 22 bp, synthetic construct
  misc_feature 1..22: note = Synthetic Construct
  source 1..22: mol_type = other DNA
ggcgagagtaagagccagtaag

SEQ ID NO: 20457 - DNA, 29 bp, synthetic construct
  misc_feature 1..29: note = Synthetic Construct
  source 1..29: mol_type = other DNA
ccctttatccactagattctatccctact

SEQ ID NO: 20458 - DNA, 28 bp, synthetic construct
  misc_feature 1..28: note = Synthetic Construct
  source 1..28: mol_type = other DNA
ccttgccatattcccattcatgctgtag

SEQ ID NO: 20459 - DNA, 23 bp, synthetic construct
  misc_feature 1..23: note = Synthetic Construct
  source 1..23: mol_type = other DNA
ccagtgaacaaggtgaggtgtag

SEQ ID NO: 20460 - DNA, 23 bp, synthetic construct
  misc_feature 1..23: note = Synthetic Construct
  source 1..23: mol_type = other DNA
aaagtccctgatgaagtgctgtt

SEQ ID NO: 20461 - DNA, 22 bp, synthetic construct
  misc_feature 1..22: note = Synthetic Construct
  source 1..22: mol_type = other DNA
ccaacacctcaggctaccttct

SEQ ID NO: 20462 - DNA, 23 bp, synthetic construct
  misc_feature 1..23: note = Synthetic Construct
  source 1..23: mol_type = other DNA
agttgccctgaattcttgtgtga

SEQ ID NO: 20463 - DNA, 23 bp, synthetic construct
  misc_feature 1..23: note = Synthetic Construct
  source 1..23: mol_type = other DNA
gctatcaaaggcctgacaacaag

SEQ ID NO: 20464 - DNA, 21 bp, synthetic construct
  misc_feature 1..21: note = Synthetic Construct
  source 1..21: mol_type = other DNA
tggcctaaggaggggtgaatc

SEQ ID NO: 20465 - DNA, 22 bp, synthetic construct
  misc_feature 1..22: note = Synthetic Construct
  source 1..22: mol_type = other DNA
gccctgcttagatccactttgt

SEQ ID NO: 20466 - DNA, 25 bp, synthetic construct
  misc_feature 1..25: note = Synthetic Construct
  source 1..25: mol_type = other DNA
gctggtacagctgatagagagacta

SEQ ID NO: 20467 - DNA, 23 bp, synthetic construct
  misc_feature 1..23: note = Synthetic Construct
  source 1..23: mol_type = other DNA
ggtgtcaaacactcactctgtca

SEQ ID NO: 20468 - DNA, 25 bp, synthetic construct
  misc_feature 1..25: note = Synthetic Construct
  source 1..25: mol_type = other DNA
caggggtttgtttgatccattttga

SEQ ID NO: 20469 - DNA, 22 bp, synthetic construct
  misc_feature 1..22: note = Synthetic Construct
  source 1..22: mol_type = other DNA
agggaggatcaccaggaagaaa

SEQ ID NO: 20470 - DNA, 21 bp, synthetic construct
  misc_feature 1..21: note = Synthetic Construct
  source 1..21: mol_type = other DNA
agggccgtgacacttgctcta

SEQ ID NO: 20471 - DNA, 23 bp, synthetic construct
  misc_feature 1..23: note = Synthetic Construct
  source 1..23: mol_type = other DNA
gcagagctaatgttttgggcaat

SEQ ID NO: 20472 - DNA, 26 bp, synthetic construct
  misc_feature 1..26: note = Synthetic Construct
  source 1..26: mol_type = other DNA
cctggttcaacagttcaatgctgtct

SEQ ID NO: 20473 - DNA, 24 bp, synthetic construct
  misc_feature 1..24: note = Synthetic Construct
  source 1..24: mol_type = other DNA
gcctttgcctaagacagagagaac

SEQ ID NO: 20474 - DNA, 29 bp, synthetic construct
  misc_feature 1..29: note = Synthetic Construct
  source 1..29: mol_type = other DNA
gtctctgtgttcagaaggtagttttgact

SEQ ID NO: 20475 - DNA, 23 bp, synthetic construct
  misc_feature 1..23: note = Synthetic Construct
  source 1..23: mol_type = other DNA
ggctttgagcagctttgatgaag

SEQ ID NO: 20476 - DNA, 22 bp, synthetic construct
  misc_feature 1..22: note = Synthetic Construct
  source 1..22: mol_type = other DNA
gcagtgaagccaggtcctctaa

SEQ ID NO: 20477 - DNA, 27 bp, synthetic construct
  misc_feature 1..27: note = Synthetic Construct
  source 1..27: mol_type = other DNA
ggaacagcccacctatatatccagatt

SEQ ID NO: 20478 - DNA, 25 bp, synthetic construct
  misc_feature 1..25: note = Synthetic Construct
  source 1..25: mol_type = other DNA
gctaactcttgcttcgacaagaaac

SEQ ID NO: 20479 - DNA, 24 bp, synthetic construct
  misc_feature 1..24: note = Synthetic Construct
  source 1..24: mol_type = other DNA
ggacagacgtagagcccagaatac

SEQ ID NO: 20480 - DNA, 23 bp, synthetic construct
  misc_feature 1..23: note = Synthetic Construct
  source 1..23: mol_type = other DNA
gcaaagacagtggtgaaggatga

SEQ ID NO: 20481 - DNA, 23 bp, synthetic construct
  misc_feature 1..23: note = Synthetic Construct
  source 1..23: mol_type = other DNA
cccaagaaggcacagaaccacaa

SEQ ID NO: 20482 - DNA, 22 bp, synthetic construct
  misc_feature 1..22: note = Synthetic Construct
  source 1..22: mol_type = other DNA
atcctaccctactggggagcta

SEQ ID NO: 20483 - DNA, 26 bp, synthetic construct
  misc_feature 1..26: note = Synthetic Construct
  source 1..26: mol_type = other DNA
tgtcacagtccagttgtctgaataac

SEQ ID NO: 20484 - DNA, 22 bp, synthetic construct
  misc_feature 1..22: note = Synthetic Construct
  source 1..22: mol_type = other DNA
ccctgtttgcactctgccatct

SEQ ID NO: 20485 - DNA, 22 bp, synthetic construct
  misc_feature 1..22: note = Synthetic Construct
  source 1..22: mol_type = other DNA
ggccacagaagggagaaagagt

SEQ ID NO: 20486 - DNA, 29 bp, synthetic construct
  misc_feature 1..29: note = Synthetic Construct
  source 1..29: mol_type = other DNA
gctgctggtattattcaggagttacattg

SEQ ID NO: 20487 - DNA, 24 bp, synthetic construct
  misc_feature 1..24: note = Synthetic Construct
  source 1..24: mol_type = other DNA
gagcaactctagctcaaagcaaca

SEQ ID NO: 20488 - DNA, 26 bp, synthetic construct
  misc_feature 1..26: note = Synthetic Construct
  source 1..26: mol_type = other DNA
cgtgaaggacatttcttcttctgcat

SEQ ID NO: 20489 - DNA, 24 bp, synthetic construct
  misc_feature 1..24: note = Synthetic Construct
  source 1..24: mol_type = other DNA
ggtggctgtttaggagagagttag

SEQ ID NO: 20490 - DNA, 23 bp, synthetic construct
  misc_feature 1..23: note = Synthetic Construct
  source 1..23: mol_type = other DNA
ctgtgagtcggcttgttttctca

SEQ ID NO: 20491 - DNA, 24 bp, synthetic construct
  misc_feature 1..24: note = Synthetic Construct
  source 1..24: mol_type = other DNA
cagccactggaaagtgagaggata

SEQ ID NO: 20492 - DNA, 25 bp, synthetic construct
  misc_feature 1..25: note = Synthetic Construct
  source 1..25: mol_type = other DNA
ccttagaggtaaacagcaactgaga

SEQ ID NO: 20493 - DNA, 23 bp, synthetic construct
  misc_feature 1..23: note = Synthetic Construct
  source 1..23: mol_type = other DNA
gcccactagaacccttcacaatc

SEQ ID NO: 20494 - DNA, 23 bp, synthetic construct
  misc_feature 1..23: note = Synthetic Construct
  source 1..23: mol_type = other DNA
gggtatgggacccagtgtgatct

SEQ ID NO: 20495 - DNA, 22 bp, synthetic construct
  misc_feature 1..22: note = Synthetic Construct
  source 1..22: mol_type = other DNA
tcctgttcaccatcctctccaa

SEQ ID NO: 20496 - DNA, 27 bp, synthetic construct
  misc_feature 1..27: note = Synthetic Construct
  source 1..27: mol_type = other DNA
gtggacttgattttaaggacaccaaca

SEQ ID NO: 20497 - DNA, 26 bp, synthetic construct
  misc_feature 1..26: note = Synthetic Construct
  source 1..26: mol_type = other DNA
tctcatctcagtggctcacatttatc

SEQ ID NO: 20498 - DNA, 25 bp, synthetic construct
  misc_feature 1..25: note = Synthetic Construct
  source 1..25: mol_type = other DNA
ggattttagctgtcaggagacaaca

SEQ ID NO: 20499 - DNA, 22 bp, synthetic construct
  misc_feature 1..22: note = Synthetic Construct
  source 1..22: mol_type = other DNA
agcccctcctaccacagctaac

SEQ ID NO: 20500 - DNA, 27 bp, synthetic construct
  misc_feature 1..27: note = Synthetic Construct
  source 1..27: mol_type = other DNA
cccaagcaagagattatcaatgcttca

SEQ ID NO: 20501 - DNA, 25 bp, synthetic construct
  misc_feature 1..25: note = Synthetic Construct
  source 1..25: mol_type = other DNA
gcagcaattggtaacaaggtgcata

SEQ ID NO: 20502 - DNA, 27 bp, synthetic construct
  misc_feature 1..27: note = Synthetic Construct
  source 1..27: mol_type = other DNA
ggaaaccagttcagaaaagggaggaaa

SEQ ID NO: 20503 - DNA, 24 bp, synthetic construct
  misc_feature 1..24: note = Synthetic Construct
  source 1..24: mol_type = other DNA
gaagcaagacaccttcacaagaca

SEQ ID NO: 20504 - DNA, 24 bp, synthetic construct
  misc_feature 1..24: note = Synthetic Construct
  source 1..24: mol_type = other DNA
gagtcttagggccttgagtgaaca

SEQ ID NO: 20505 - DNA, 20 bp, synthetic construct
  misc_feature 1..20: note = Synthetic Construct
  source 1..20: mol_type = other DNA
gcctcagcaagtctgctctt

SEQ ID NO: 20506 - DNA, 22 bp, synthetic construct
  misc_feature 1..22: note = Synthetic Construct
  source 1..22: mol_type = other DNA
ggggcttctagagccactttac

SEQ ID NO: 20507 - DNA, 22 bp, synthetic construct
  misc_feature 1..22: note = Synthetic Construct
  source 1..22: mol_type = other DNA
ggtggtgaaggagcttcctaag

SEQ ID NO: 20508 - DNA, 26 bp, synthetic construct
  misc_feature 1..26: note = Synthetic Construct
  source 1..26: mol_type = other DNA
ttctagggccctcacttattatccta

SEQ ID NO: 20509 - DNA, 21 bp, synthetic construct
  misc_feature 1..21: note = Synthetic Construct
  source 1..21: mol_type = other DNA
tggtctgccaactttgctgtt

SEQ ID NO: 20510 - DNA, 21 bp, synthetic construct
  misc_feature 1..21: note = Synthetic Construct
  source 1..21: mol_type = other DNA
acaaggccacccaggaaccta

SEQ ID NO: 20511 - DNA, 28 bp, synthetic construct
  misc_feature 1..28: note = Synthetic Construct
  source 1..28: mol_type = other DNA
cccaagaattctgctaggacctaaaaac

SEQ ID NO: 20512 - DNA, 21 bp, synthetic construct
  misc_feature 1..21: note = Synthetic Construct
  source 1..21: mol_type = other DNA
tgaagaccccaagagcctact

SEQ ID NO: 20513 - DNA, 23 bp, synthetic construct
  misc_feature 1..23: note = Synthetic Construct
  source 1..23: mol_type = other DNA
ggtgggacaaaagccagatcaca

SEQ ID NO: 20514 - DNA, 23 bp, synthetic construct
  misc_feature 1..23: note = Synthetic Construct
  source 1..23: mol_type = other DNA
gagacaaaactgcaagccagtga

SEQ ID NO: 20515 - DNA, 20 bp, synthetic construct
  misc_feature 1..20: note = Synthetic Construct
  source 1..20: mol_type = other DNA
tccatacagctggccacaga

SEQ ID NO: 20516 - DNA, 25 bp, synthetic construct
  misc_feature 1..25: note = Synthetic Construct
  source 1..25: mol_type = other DNA
cacaactgtgctatgctaggggtat

SEQ ID NO: 20517 - DNA, 24 bp, synthetic construct
  misc_feature 1..24: note = Synthetic Construct
  source 1..24: mol_type = other DNA
gctacaggcagtgaattcgtgatg

SEQ ID NO: 20518 - DNA, 25 bp, synthetic construct
  misc_feature 1..25: note = Synthetic Construct
  source 1..25: mol_type = other DNA
ggtcatgctactgtctaaggtgcaa

SEQ ID NO: 20519 - DNA, 24 bp, synthetic construct
  misc_feature 1..24: note = Synthetic Construct
  source 1..24: mol_type = other DNA
ctgaagtgaactgatgtggagtca

SEQ ID NO: 20520 - DNA, 28 bp, synthetic construct
  misc_feature 1..28: note = Synthetic Construct
  source 1..28: mol_type = other DNA
ggtcatgccagtgattacaatggagtaa

SEQ ID NO: 20521 - DNA, 22 bp, synthetic construct
  misc_feature 1..22: note = Synthetic Construct
  source 1..22: mol_type = other DNA
actgggtcaactgaagggtaga

SEQ ID NO: 20522 - DNA, 26 bp, synthetic construct
  misc_feature 1..26: note = Synthetic Construct
  source 1..26: mol_type = other DNA
gcaacatggaagtcagggtaatcttg

SEQ ID NO: 20523 - DNA, 22 bp, synthetic construct
  misc_feature 1..22: note = Synthetic Construct
  source 1..22: mol_type = other DNA
ggcctcagcttccacttttcaa

SEQ ID NO: 20524 - DNA, 21 bp, synthetic construct
  misc_feature 1..21: note = Synthetic Construct
  source 1..21: mol_type = other DNA
tgcccttcaccctaccaaact

SEQ ID NO: 20525 - DNA, 23 bp, synthetic construct
  misc_feature 1..23: note = Synthetic Construct
  source 1..23: mol_type = other DNA
ccactagacagtgcatctggatt

SEQ ID NO: 20526 - DNA, 23 bp, synthetic construct
  misc_feature 1..23: note = Synthetic Construct
  source 1..23: mol_type = other DNA
gtgccttactctcacctcagtca

SEQ ID NO: 20527 - DNA, 25 bp, synthetic construct
  misc_feature 1..25: note = Synthetic Construct
  source 1..25: mol_type = other DNA
gctgcttggatgactcagctgtttt

SEQ ID NO: 20528 - DNA, 24 bp, synthetic construct
  misc_feature 1..24: note = Synthetic Construct
  source 1..24: mol_type = other DNA
gccccagttttcatgccaacatac

SEQ ID NO: 20529 - DNA, 26 bp, synthetic construct
  misc_feature 1..26: note = Synthetic Construct
  source 1..26: mol_type = other DNA
ccagaggaaagaattgtgtggtccat

SEQ ID NO: 20530 - DNA, 23 bp, synthetic construct
  misc_feature 1..23: note = Synthetic Construct
  source 1..23: mol_type = other DNA
ggcattgttccacagaagcaagt

SEQ ID NO: 20531 - DNA, 23 bp, synthetic construct
  misc_feature 1..23: note = Synthetic Construct
  source 1..23: mol_type = other DNA
gaaatttaagcggcatgggttga

SEQ ID NO: 20532 - DNA, 24 bp, synthetic construct
  misc_feature 1..24: note = Synthetic Construct
  source 1..24: mol_type = other DNA
gcctgtactagtctctcccaggaa

SEQ ID NO: 20533 - DNA, 26 bp, synthetic construct
  misc_feature 1..26: note = Synthetic Construct
  source 1..26: mol_type = other DNA
ggtcagaaataccccatctgtgatga

SEQ ID NO: 20534 - DNA, 25 bp, synthetic construct
  misc_feature 1..25: note = Synthetic Construct
  source 1..25: mol_type = other DNA
ggcgctaatctccatgcattttact

SEQ ID NO: 20535 - DNA, 23 bp, synthetic construct
  misc_feature 1..23: note = Synthetic Construct
  source 1..23: mol_type = other DNA
tgtggtcaaggatggtgagattg

SEQ ID NO: 20536 - DNA, 27 bp, synthetic construct
  misc_feature 1..27: note = Synthetic Construct
  source 1..27: mol_type = other DNA
acttacccaaggataaacctaccaaga

SEQ ID NO: 20537 - DNA, 22 bp, synthetic construct
  misc_feature 1..22: note = Synthetic Construct
  source 1..22: mol_type = other DNA
cttctctcctggggcctacttt

SEQ ID NO: 20538 - DNA, 25 bp, synthetic construct
  misc_feature 1..25: note = Synthetic Construct
  source 1..25: mol_type = other DNA
ccacctgactttcttaggagcacaa

SEQ ID NO: 20539 - DNA, 22 bp, synthetic construct
  misc_feature 1..22: note = Synthetic Construct
  source 1..22: mol_type = other DNA
gggaggaaccaaggtggacaag

SEQ ID NO: 20540 - DNA, 23 bp, synthetic construct
  misc_feature 1..23: note = Synthetic Construct
  source 1..23: mol_type = other DNA
tgccagtgtgaatcttaccaagt

SEQ ID NO: 20541 - DNA, 22 bp, synthetic construct
  misc_feature 1..22: note = Synthetic Construct
  source 1..22: mol_type = other DNA
ggcctgcccatctcctttatgt

SEQ ID NO: 20542 - DNA, 23 bp, synthetic construct
  misc_feature 1..23: note = Synthetic Construct
  source 1..23: mol_type = other DNA
ctgcctgtgtttctaggctcttc

SEQ ID NO: 20543 - DNA, 26 bp, synthetic construct
  misc_feature 1..26: note = Synthetic Construct
  source 1..26: mol_type = other DNA
ctggaggagctaggtagcagaaatag

SEQ ID NO: 20544 - DNA, 22 bp, synthetic construct
  misc_feature 1..22: note = Synthetic Construct
  source 1..22: mol_type = other DNA
gggctgggtgttggggatataa

SEQ ID NO: 20545 - DNA, 29 bp, synthetic construct
  misc_feature 1..29: note = Synthetic Construct
  source 1..29: mol_type = other DNA
cagagtgaagacctctttgactatgattg

SEQ ID NO: 20546 - DNA, 23 bp, synthetic construct
  misc_feature 1..23: note = Synthetic Construct
  source 1..23: mol_type = other DNA
cttcccctagatagctggctttg

SEQ ID NO: 20547 - DNA, 29 bp, synthetic construct
  misc_feature 1..29: note = Synthetic Construct
  source 1..29: mol_type = other DNA
cccaagtaaacccactaatttcacacttg

SEQ ID NO: 20548 - DNA, 27 bp, synthetic construct
  misc_feature 1..27: note = Synthetic Construct
  source 1..27: mol_type = other DNA
ccctacacaatggatgagtgactggat

SEQ ID NO: 20549 - DNA, 25 bp, synthetic construct
  misc_feature 1..25: note = Synthetic Construct
  source 1..25: mol_type = other DNA
accaggagagtgtgatgttatggat

SEQ ID NO: 20550 - DNA, 26 bp, synthetic construct
  misc_feature 1..26: note = Synthetic Construct
  source 1..26: mol_type = other DNA
ggctcagaccattgtatttcttccat

SEQ ID NO: 20551 - DNA, 25 bp, synthetic construct
  misc_feature 1..25: note = Synthetic Construct
  source 1..25: mol_type = other DNA
ggccaagacagtctacctcatgtgt

SEQ ID NO: 20552 - DNA, 28 bp, synthetic construct
  misc_feature 1..28: note = Synthetic Construct
  source 1..28: mol_type = other DNA
ctcctcttctcccatatacaactggaat

SEQ ID NO: 20553 - DNA, 22 bp, synthetic construct
  misc_feature 1..22: note = Synthetic Construct
  source 1..22: mol_type = other DNA
gagtggatgacacgcaatgcaa

SEQ ID NO: 20554 - DNA, 30 bp, synthetic construct
  misc_feature 1..30: note = Synthetic Construct
  source 1..30: mol_type = other DNA
gtctaccccagagattatttccctcatact

SEQ ID NO: 20555 - DNA, 21 bp, synthetic construct
  misc_feature 1..21: note = Synthetic Construct
  source 1..21: mol_type = other DNA
gctcaaggggaggggaatgta

SEQ ID NO: 20556 - DNA, 22 bp, synthetic construct
  misc_feature 1..22: note = Synthetic Construct
  source 1..22: mol_type = other DNA
ggagctggttacagagggcttt

SEQ ID NO: 20557 - DNA, 24 bp, synthetic construct
  misc_feature 1..24: note = Synthetic Construct
  source 1..24: mol_type = other DNA
cccttgtgggtgtatgagggaagt

SEQ ID NO: 20558 - DNA, 22 bp, synthetic construct
  misc_feature 1..22: note = Synthetic Construct
  source 1..22: mol_type = other DNA
gaggcaagagagtgaggctttc

SEQ ID NO: 20559 - DNA, 23 bp, synthetic construct
  misc_feature 1..23: note = Synthetic Construct
  source 1..23: mol_type = other DNA
gtttgtgtagacaccctctgctt

SEQ ID NO: 20560 - DNA, 24 bp, synthetic construct
  misc_feature 1..24: note = Synthetic Construct
  source 1..24: mol_type = other DNA
ggagccagacaggtaagaagtaaa

SEQ ID NO: 20561 - DNA, 24 bp, synthetic construct
  misc_feature 1..24: note = Synthetic Construct
  source 1..24: mol_type = other DNA
cagccttcctgaactgaacagaca

SEQ ID NO: 20562 - DNA, 24 bp, synthetic construct
  misc_feature 1..24: note = Synthetic Construct
  source 1..24: mol_type = other DNA
gccaggactcaagtggaagagaag

SEQ ID NO: 20563 - DNA, 22 bp, synthetic construct
  misc_feature 1..22: note = Synthetic Construct
  source 1..22: mol_type = other DNA
gttggcttgaacctgggattga

SEQ ID NO: 20564 - DNA, 20 bp, synthetic construct
  misc_feature 1..20: note = Synthetic Construct
  source 1..20: mol_type = other DNA
tcccctttgcctctcaccat

SEQ ID NO: 20565 - DNA, 20 bp, synthetic construct
  misc_feature 1..20: note = Synthetic Construct
  source 1..20: mol_type = other DNA
gagagccattgcccatctgt

SEQ ID NO: 20566 - DNA, 24 bp, synthetic construct
  misc_feature 1..24: note = Synthetic Construct
  source 1..24: mol_type = other DNA
accgaaagacagagtttgtcagat

SEQ ID NO: 20567 - DNA, 21 bp, synthetic construct
  misc_feature 1..21: note = Synthetic Construct
  source 1..21: mol_type = other DNA
tctccgtccctccctctcaaa

SEQ ID NO: 20568 - DNA, 23 bp, synthetic construct
  misc_feature 1..23: note = Synthetic Construct
  source 1..23: mol_type = other DNA
agcaacccagctagttctgaaaa

SEQ ID NO: 20569 - DNA, 23 bp, synthetic construct
  misc_feature 1..23: note = Synthetic Construct
  source 1..23: mol_type = other DNA
cctctggtttgcccctaaattct

SEQ ID NO: 20570 - DNA, 23 bp, synthetic construct
  misc_feature 1..23: note = Synthetic Construct
  source 1..23: mol_type = other DNA
gctagaaactgtgaggcttgagt

SEQ ID NO: 20571 - DNA, 23 bp, synthetic construct
  misc_feature 1..23: note = Synthetic Construct
  source 1..23: mol_type = other DNA
gtccgtgctttatccagatccaa

SEQ ID NO: 20572 - DNA, 25 bp, synthetic construct
  misc_feature 1..25: note = Synthetic Construct
  source 1..25: mol_type = other DNA
ctggaccctttctagcatcttctct

SEQ ID NO: 20573 - DNA, 22 bp, synthetic construct
  misc_feature 1..22: note = Synthetic Construct
  source 1..22: mol_type = other DNA
ccaccaagcattccctgcaagt

SEQ ID NO: 20574 - DNA, 26 bp, synthetic construct
  misc_feature 1..26: note = Synthetic Construct
  source 1..26: mol_type = other DNA
cgtagaatgtcttgtatggtgagagt

SEQ ID NO: 20575 - DNA, 22 bp, synthetic construct
  misc_feature 1..22: note = Synthetic Construct
  source 1..22: mol_type = other DNA
ggaggtgaagactgaggcacaa

SEQ ID NO: 20576 - DNA, 21 bp, synthetic construct
  misc_feature 1..21: note = Synthetic Construct
  source 1..21: mol_type = other DNA
tccaccctcttgcacctttct

SEQ ID NO: 20577 - DNA, 24 bp, synthetic construct
  misc_feature 1..24: note = Synthetic Construct
  source 1..24: mol_type = other DNA
gttttggaaaatgcagcactcaag

SEQ ID NO: 20578 - DNA, 24 bp, synthetic construct
  misc_feature 1..24: note = Synthetic Construct
  source 1..24: mol_type = other DNA
tttctctaccacccaagaaagcat

SEQ ID NO: 20579 - DNA, 24 bp, synthetic construct
  misc_feature 1..24: note = Synthetic Construct
  source 1..24: mol_type = other DNA
ccaggaagtgttgaagtgactgaa

SEQ ID NO: 20580 - DNA, 22 bp, synthetic construct
  misc_feature 1..22: note = Synthetic Construct
  source 1..22: mol_type = other DNA
gggaaatccaagcccagaggtt

SEQ ID NO: 20581 - DNA, 25 bp, synthetic construct
  misc_feature 1..25: note = Synthetic Construct
  source 1..25: mol_type = other DNA
ggggataacccaaagctatttgcat

SEQ ID NO: 20582 - DNA, 22 bp, synthetic construct
  misc_feature 1..22: note = Synthetic Construct
  source 1..22: mol_type = other DNA
ccttgcatctgcatcccttaga

SEQ ID NO: 20583 - DNA, 22 bp, synthetic construct
  misc_feature 1..22: note = Synthetic Construct
  source 1..22: mol_type = other DNA
cagatgttgcaggcacctctca

SEQ ID NO: 20584 - DNA, 23 bp, synthetic construct
  misc_feature 1..23: note = Synthetic Construct
  source 1..23: mol_type = other DNA
ggggttggggaaatatcctgctt

SEQ ID NO: 20585 - DNA, 27 bp, synthetic construct
  misc_feature 1..27: note = Synthetic Construct
  source 1..27: mol_type = other DNA
gggaggtagcatttgaactaagtcttg

SEQ ID NO: 20586 - DNA, 28 bp, synthetic construct
  misc_feature 1..28: note = Synthetic Construct
  source 1..28: mol_type = other DNA
gccactcaagctaatcctgaaattggaa

SEQ ID NO: 20587 - DNA, 26 bp, synthetic construct
  misc_feature 1..26: note = Synthetic Construct
  source 1..26: mol_type = other DNA
tgtcctttcctacccatgaatgaaac

SEQ ID NO: 20588 - DNA, 27 bp, synthetic construct
  misc_feature 1..27: note = Synthetic Construct
  source 1..27: mol_type = other DNA
gcatagcatgagaaataccttgcagtt

SEQ ID NO: 20589 - DNA, 27 bp, synthetic construct
  misc_feature 1..27: note = Synthetic Construct
  source 1..27: mol_type = other DNA
gggaaagtgtaccacgatttgttcaga

SEQ ID NO: 20590 - DNA, 29 bp, synthetic construct
  misc_feature 1..29: note = Synthetic Construct
  source 1..29: mol_type = other DNA
cagggaacatagtcaatgcctgagttaat

SEQ ID NO: 20591 - DNA, 21 bp, synthetic construct
  misc_feature 1..21: note = Synthetic Construct
  source 1..21: mol_type = other DNA
cagctcctttgccacagcata

SEQ ID NO: 20592 - DNA, 24 bp, synthetic construct
  misc_feature 1..24: note = Synthetic Construct
  source 1..24: mol_type = other DNA
ggggccaaatgtgctaattgttca

SEQ ID NO: 20593 - DNA, 24 bp, synthetic construct
  misc_feature 1..24: note = Synthetic Construct
  source 1..24: mol_type = other DNA
actttactctgtcctcaccctagt

SEQ ID NO: 20594 - DNA, 25 bp, synthetic construct
  misc_feature 1..25: note = Synthetic Construct
  source 1..25: mol_type = other DNA
gagcaagaattactgcctccagata

SEQ ID NO: 20595 - DNA, 25 bp, synthetic construct
  misc_feature 1..25: note = Synthetic Construct
  source 1..25: mol_type = other DNA
cctgaaaagctgctagtggatgttg

SEQ ID NO: 20596 - DNA, 30 bp, synthetic construct
  misc_feature 1..30: note = Synthetic Construct
  source 1..30: mol_type = other DNA
ccctcccttgcaatttgatatagtcctaag

SEQ ID NO: 20597 - DNA, 24 bp, synthetic construct
  misc_feature 1..24: note = Synthetic Construct
  source 1..24: mol_type = other DNA
ggacattgtgattgaccgaaccta

SEQ ID NO: 20598 - DNA, 23 bp, synthetic construct
  misc_feature 1..23: note = Synthetic Construct
  source 1..23: mol_type = other DNA
ctgttgggagggagttggatgaa

SEQ ID NO: 20599 - DNA, 26 bp, synthetic construct
  misc_feature 1..26: note = Synthetic Construct
  source 1..26: mol_type = other DNA
gttacgctcggtgaagaatgtttaag

SEQ ID NO: 20600 - DNA, 20 bp, synthetic construct
  misc_feature 1..20: note = Synthetic Construct
  source 1..20: mol_type = other DNA
ctgttttcctggccgcatct

SEQ ID NO: 20601 - DNA, 25 bp, synthetic construct
  misc_feature 1..25: note = Synthetic Construct
  source 1..25: mol_type = other DNA
tgtaacaaacatggaccagaacagt

SEQ ID NO: 20602 - DNA, 24 bp, synthetic construct
  misc_feature 1..24: note = Synthetic Construct
  source 1..24: mol_type = other DNA
ctgaggctttcctgactccagaat

SEQ ID NO: 20603 - DNA, 24 bp, synthetic construct
  misc_feature 1..24: note = Synthetic Construct
  source 1..24: mol_type = other DNA
ggtgcctgctgcatagcatagtag

SEQ ID NO: 20604 - DNA, 27 bp, synthetic construct
  misc_feature 1..27: note = Synthetic Construct
  source 1..27: mol_type = other DNA
ggtctgcttgatctctgactactccta

SEQ ID NO: 20605 - DNA, 27 bp, synthetic construct
  misc_feature 1..27: note = Synthetic Construct
  source 1..27: mol_type = other DNA
gttgtgatgctaaagggctaatggata

SEQ ID NO: 20606 - DNA, 23 bp, synthetic construct
  misc_feature 1..23: note = Synthetic Construct
  source 1..23: mol_type = other DNA
cagagggcttagctcacttcgtt

SEQ ID NO: 20607 - DNA, 22 bp, synthetic construct
  misc_feature 1..22: note = Synthetic Construct
  source 1..22: mol_type = other DNA
ggctcaagcaatcttcctgtct

SEQ ID NO: 20608 - DNA, 26 bp, synthetic construct
  misc_feature 1..26: note = Synthetic Construct
  source 1..26: mol_type = other DNA
gtttctgctttcaatgtccagacttc

SEQ ID NO: 20609 - DNA, 22 bp, synthetic construct
  misc_feature 1..22: note = Synthetic Construct
  source 1..22: mol_type = other DNA
tccccacaatctccctggtact

SEQ ID NO: 20610 - DNA, 21 bp, synthetic construct
  misc_feature 1..21: note = Synthetic Construct
  source 1..21: mol_type = other DNA
gcttccagtgtggggatgtga

SEQ ID NO: 20611 - DNA, 27 bp, synthetic construct
  misc_feature 1..27: note = Synthetic Construct
  source 1..27: mol_type = other DNA
gctccattttctgagctggaaaagttc

SEQ ID NO: 20612 - DNA, 25 bp, synthetic construct
  misc_feature 1..25: note = Synthetic Construct
  source 1..25: mol_type = other DNA
gagtgagagaatccaagaggacaag

SEQ ID NO: 20613 - DNA, 24 bp, synthetic construct
  misc_feature 1..24: note = Synthetic Construct
  source 1..24: mol_type = other DNA
ccaccaacagaggacatcagaact

SEQ ID NO: 20614 - DNA, 26 bp, synthetic construct
  misc_feature 1..26: note = Synthetic Construct
  source 1..26: mol_type = other DNA
ggtgggacatcatttctgaccagtag

SEQ ID NO: 20615 - DNA, 22 bp, synthetic construct
  misc_feature 1..22: note = Synthetic Construct
  source 1..22: mol_type = other DNA
cgcttcatcccattggcctaca

SEQ ID NO: 20616 - DNA, 25 bp, synthetic construct
  misc_feature 1..25: note = Synthetic Construct
  source 1..25: mol_type = other DNA
gtattgacaggtcttctgccttcta

SEQ ID NO: 20617 - DNA, 21 bp, synthetic construct
  misc_feature 1..21: note = Synthetic Construct
  source 1..21: mol_type = other DNA
tgcttatggtcccagctcttg

SEQ ID NO: 20618 - DNA, 24 bp, synthetic construct
  misc_feature 1..24: note = Synthetic Construct
  source 1..24: mol_type = other DNA
gactgacaggcagaatacctgtgt

SEQ ID NO: 20619 - DNA, 27 bp, synthetic construct
  misc_feature 1..27: note = Synthetic Construct
  source 1..27: mol_type = other DNA
ctgaacccctgctctacacttaagaag

SEQ ID NO: 20620 - DNA, 24 bp, synthetic construct
  misc_feature 1..24: note = Synthetic Construct
  source 1..24: mol_type = other DNA
gcagatggactaccatgccttgtt

SEQ ID NO: 20621 - DNA, 23 bp, synthetic construct
  misc_feature 1..23: note = Synthetic Construct
  source 1..23: mol_type = other DNA
ggaagcatgacagcaggactgta

SEQ ID NO: 20622 - DNA, 22 bp, synthetic construct
  misc_feature 1..22: note = Synthetic Construct
  source 1..22: mol_type = other DNA
aggatcctgctaggtgctgaat

SEQ ID NO: 20623 - DNA, 24 bp, synthetic construct
  misc_feature 1..24: note = Synthetic Construct
  source 1..24: mol_type = other DNA
gcaaaaacgaatcatgcccaaaac

SEQ ID NO: 20624 - DNA, 24 bp, synthetic construct
  misc_feature 1..24: note = Synthetic Construct
  source 1..24: mol_type = other DNA
cggggaccaaatttacagggacaa

SEQ ID NO: 20625 - DNA, 23 bp, synthetic construct
  misc_feature 1..23: note = Synthetic Construct
  source 1..23: mol_type = other DNA
cccgggagggtcttagagtttgt

SEQ ID NO: 20626 - DNA, 21 bp, synthetic construct
  misc_feature 1..21: note = Synthetic Construct
  source 1..21: mol_type = other DNA
cccctgcttcatgggctcaaa

SEQ ID NO: 20627 - DNA, 20 bp, synthetic construct
  misc_feature 1..20: note = Synthetic Construct
  source 1..20: mol_type = other DNA
accacatcccagctcacaga

SEQ ID NO: 20628 - DNA, 26 bp, synthetic construct
  misc_feature 1..26: note = Synthetic Construct
  source 1..26: mol_type = other DNA
gggcattaatgagcacattccttttc

SEQ ID NO: 20629 - DNA, 24 bp, synthetic construct
  misc_feature 1..24: note = Synthetic Construct
  source 1..24: mol_type = other DNA
gttgttggctcagtcaatgagaag

SEQ ID NO: 20630 - DNA, 27 bp, synthetic construct
  misc_feature 1..27: note = Synthetic Construct
  source 1..27: mol_type = other DNA
cgcctctgattctaatcccactattac

SEQ ID NO: 20631 - DNA, 25 bp, synthetic construct
  misc_feature 1..25: note = Synthetic Construct
  source 1..25: mol_type = other DNA
ggctactggtctcagacaaagatac

SEQ ID NO: 20632 - DNA, 24 bp, synthetic construct
  misc_feature 1..24: note = Synthetic Construct
  source 1..24: mol_type = other DNA
gcctgaaggtgagacaatcagaaa

SEQ ID NO: 20633 - DNA, 21 bp, synthetic construct
  misc_feature 1..21: note = Synthetic Construct
  source 1..21: mol_type = other DNA
agtggggtatgcctgcagttg

SEQ ID NO: 20634 - DNA, 25 bp, synthetic construct
  misc_feature 1..25: note = Synthetic Construct
  source 1..25: mol_type = other DNA
gtgtggactcgaagaggattgttga

SEQ ID NO: 20635 - DNA, 23 bp, synthetic construct
  misc_feature 1..23: note = Synthetic Construct
  source 1..23: mol_type = other DNA
gagcacgatcctgaaacaggtta

SEQ ID NO: 20636 - DNA, 21 bp, synthetic construct
  misc_feature 1..21: note = Synthetic Construct
  source 1..21: mol_type = other DNA
agtcagtctggcccagcagta

SEQ ID NO: 20637 - DNA, 24 bp, synthetic construct
  misc_feature 1..24: note = Synthetic Construct
  source 1..24: mol_type = other DNA
ccacctggcaaatgcagttaaagt

SEQ ID NO: 20638 - DNA, 25 bp, synthetic construct
  misc_feature 1..25: note = Synthetic Construct
  source 1..25: mol_type = other DNA
ggggtaatagggcttaggaggaaca

SEQ ID NO: 20639 - DNA, 21 bp, synthetic construct
  misc_feature 1..21: note = Synthetic Construct
  source 1..21: mol_type = other DNA
acagggctgagaccagcacat

SEQ ID NO: 20640 - DNA, 30 bp, synthetic construct
  misc_feature 1..30: note = Synthetic Construct
  source 1..30: mol_type = other DNA
cactgctagtacaggttgtaaattggtatg

SEQ ID NO: 20641 - DNA, 24 bp, synthetic construct
  misc_feature 1..24: note = Synthetic Construct
  source 1..24: mol_type = other DNA
ggtgctgactccaactactgaaac

SEQ ID NO: 20642 - DNA, 23 bp, synthetic construct
  misc_feature 1..23: note = Synthetic Construct
  source 1..23: mol_type = other DNA
cttggctgctgattggaattgtt

SEQ ID NO: 20643 - DNA, 23 bp, synthetic construct
  misc_feature 1..23: note = Synthetic Construct
  source 1..23: mol_type = other DNA
ccagccagtaaagccttgtatga

SEQ ID NO: 20644 - DNA, 24 bp, synthetic construct
  misc_feature 1..24: note = Synthetic Construct
  source 1..24: mol_type = other DNA
gctccttcattcccttggcaagta

SEQ ID NO: 20645 - DNA, 22 bp, synthetic construct
  misc_feature 1..22: note = Synthetic Construct
  source 1..22: mol_type = other DNA
ggaaggcatctggggctctaag

SEQ ID NO: 20646 - DNA, 20 bp, synthetic construct
  misc_feature 1..20: note = Synthetic Construct
  source 1..20: mol_type = other DNA
agggcatcctcgagccaaat

SEQ ID NO: 20647 - DNA, 26 bp, synthetic construct
  misc_feature 1..26: note = Synthetic Construct
  source 1..26: mol_type = other DNA
ggatgtatccagatggtgtgtgaaag

SEQ ID NO: 20648 - DNA, 24 bp, synthetic construct
  misc_feature 1..24: note = Synthetic Construct
  source 1..24: mol_type = other DNA
gggactagtgtaccttctggtcta

SEQ ID NO: 20649 - DNA, 22 bp, synthetic construct
  misc_feature 1..22: note = Synthetic Construct
  source 1..22: mol_type = other DNA
ggacgtggtttgctaaggtgtt

SEQ ID NO: 20650 - DNA, 20 bp, synthetic construct
  misc_feature 1..20: note = Synthetic Construct
  source 1..20: mol_type = other DNA
actgtgtcccctggcaccta

SEQ ID NO: 20651 - DNA, 20 bp, synthetic construct
  misc_feature 1..20: note = Synthetic Construct
  source 1..20: mol_type = other DNA
ggcaggatctgccagcaaaa

SEQ ID NO: 20652 - DNA, 23 bp, synthetic construct
  misc_feature 1..23: note = Synthetic Construct
  source 1..23: mol_type = other DNA
gtccttcctgtctgctcttggta

SEQ ID NO: 20653 - DNA, 24 bp, synthetic construct
  misc_feature 1..24: note = Synthetic Construct
  source 1..24: mol_type = other DNA
cccagacataccagtgaggcttga

SEQ ID NO: 20654 - DNA, 24 bp, synthetic construct
  misc_feature 1..24: note = Synthetic Construct
  source 1..24: mol_type = other DNA
gttgaagccagatcatggaagact

SEQ ID NO: 20655 - DNA, 24 bp, synthetic construct
  misc_feature 1..24: note = Synthetic Construct
  source 1..24: mol_type = other DNA
tctggaaagcagtacagcatcttt

SEQ ID NO: 20656 - DNA, 26 bp, synthetic construct
  misc_feature 1..26: note = Synthetic Construct
  source 1..26: mol_type = other DNA
caagatctcgtgctattcgtgttttg

SEQ ID NO: 20657 - DNA, 26 bp, synthetic construct
  misc_feature 1..26: note = Synthetic Construct
  source 1..26: mol_type = other DNA
ccatctgccatgatagtattgtgtct

SEQ ID NO: 20658 - DNA, 22 bp, synthetic construct
  misc_feature 1..22: note = Synthetic Construct
  source 1..22: mol_type = other DNA
cggtgtttggggtcccatgtat

SEQ ID NO: 20659 - DNA, 25 bp, synthetic construct
  misc_feature 1..25: note = Synthetic Construct
  source 1..25: mol_type = other DNA
ggctttgttaggacagacccagttc

SEQ ID NO: 20660 - DNA, 24 bp, synthetic construct
  misc_feature 1..24: note = Synthetic Construct
  source 1..24: mol_type = other DNA
cctggccctgtattagctgtggat

SEQ ID NO: 20661 - DNA, 20 bp, synthetic construct
  misc_feature 1..20: note = Synthetic Construct
  source 1..20: mol_type = other DNA
cctccagcctggcctgatac

SEQ ID NO: 20662 - DNA, 28 bp, synthetic construct
  misc_feature 1..28: note = Synthetic Construct
  source 1..28: mol_type = other DNA
ggggagaaaacattccacccataagata

SEQ ID NO: 20663 - DNA, 22 bp, synthetic construct
  misc_feature 1..22: note = Synthetic Construct
  source 1..22: mol_type = other DNA
gtcaaaggcaggagccatgaga

SEQ ID NO: 20664 - DNA, 25 bp, synthetic construct
  misc_feature 1..25: note = Synthetic Construct
  source 1..25: mol_type = other DNA
tgtcatatgaggacacagtgtttga

SEQ ID NO: 20665 - DNA, 25 bp, synthetic construct
  misc_feature 1..25: note = Synthetic Construct
  source 1..25: mol_type = other DNA
ggacattatatgtcagggagtgcaa

SEQ ID NO: 20666 - DNA, 25 bp, synthetic construct
  misc_feature 1..25: note = Synthetic Construct
  source 1..25: mol_type = other DNA
gagaggcaggtgtgagaaatcattg

SEQ ID NO: 20667 - DNA, 27 bp, synthetic construct
  misc_feature 1..27: note = Synthetic Construct
  source 1..27: mol_type = other DNA
cccatctttgtgtgggaaagttagtga

SEQ ID NO: 20668 - DNA, 23 bp, synthetic construct
  misc_feature 1..23: note = Synthetic Construct
  source 1..23: mol_type = other DNA
gtccagctgttcatggagtcaac

SEQ ID NO: 20669 - DNA, 22 bp, synthetic construct
  misc_feature 1..22: note = Synthetic Construct
  source 1..22: mol_type = other DNA
tcaggttagtgggttcccttct

SEQ ID NO: 20670 - DNA, 24 bp, synthetic construct
  misc_feature 1..24: note = Synthetic Construct
  source 1..24: mol_type = other DNA
ccctagcaacaccaaggaacaaag

SEQ ID NO: 20671 - DNA, 27 bp, synthetic construct
  misc_feature 1..27: note = Synthetic Construct
  source 1..27: mol_type = other DNA
ggaaagaataggtaggagtgcttctct

SEQ ID NO: 20672 - DNA, 26 bp, synthetic construct
  misc_feature 1..26: note = Synthetic Construct
  source 1..26: mol_type = other DNA
tggcagagaaagtctgagagtaaatg

SEQ ID NO: 20673 - DNA, 24 bp, synthetic construct
  misc_feature 1..24: note = Synthetic Construct
  source 1..24: mol_type = other DNA
accctctcataacctcacttgaca

SEQ ID NO: 20674 - DNA, 22 bp, synthetic construct
  misc_feature 1..22: note = Synthetic Construct
  source 1..22: mol_type = other DNA
gggcaggtagcatctacagcaa

SEQ ID NO: 20675 - DNA, 24 bp, synthetic construct
  misc_feature 1..24: note = Synthetic Construct
  source 1..24: mol_type = other DNA
ggccaacagaccaagaagtgctta

SEQ ID NO: 20676 - DNA, 26 bp, synthetic construct
  misc_feature 1..26: note = Synthetic Construct
  source 1..26: mol_type = other DNA
ccagggagctctaggatagaactgaa

SEQ ID NO: 20677 - DNA, 27 bp, synthetic construct
  misc_feature 1..27: note = Synthetic Construct
  source 1..27: mol_type = other DNA
ggaagtgggtctttgaagagatcatgt

SEQ ID NO: 20678 - DNA, 22 bp, synthetic construct
  misc_feature 1..22: note = Synthetic Construct
  source 1..22: mol_type = other DNA
gctgccaggatgaaaccagaga

SEQ ID NO: 20679 - DNA, 24 bp, synthetic construct
  misc_feature 1..24: note = Synthetic Construct
  source 1..24: mol_type = other DNA
gtttggtgtttaatggggcgatag

SEQ ID NO: 20680 - DNA, 24 bp, synthetic construct
  misc_feature 1..24: note = Synthetic Construct
  source 1..24: mol_type = other DNA
gttcagtggaaaactgatgcaact

SEQ ID NO: 20681 - DNA, 25 bp, synthetic construct
  misc_feature 1..25: note = Synthetic Construct
  source 1..25: mol_type = other DNA
cccatctttctggctcattccatct

SEQ ID NO: 20682 - DNA, 25 bp, synthetic construct
  misc_feature 1..25: note = Synthetic Construct
  source 1..25: mol_type = other DNA
gctttaggaccaagttgctgaattg

SEQ ID NO: 20683 - DNA, 21 bp, synthetic construct
  misc_feature 1..21: note = Synthetic Construct
  source 1..21: mol_type = other DNA
ggggctcaaacaggtaaggtt

SEQ ID NO: 20684 - DNA, 22 bp, synthetic construct
  misc_feature 1..22: note = Synthetic Construct
  source 1..22: mol_type = other DNA
cccagcaaagccatgctacagt

SEQ ID NO: 20685 - DNA, 26 bp, synthetic construct
  misc_feature 1..26: note = Synthetic Construct
  source 1..26: mol_type = other DNA
gcctgaaacaaccaaataccaggaaa

SEQ ID NO: 20686 - DNA, 25 bp, synthetic construct
  misc_feature 1..25: note = Synthetic Construct
  source 1..25: mol_type = other DNA
caccctggaacctatgggaagaatg

SEQ ID NO: 20687 - DNA, 21 bp, synthetic construct
  misc_feature 1..21: note = Synthetic Construct
  source 1..21: mol_type = other DNA
aacctgcagaagcacatcagt

SEQ ID NO: 20688 - DNA, 30 bp, synthetic construct
  misc_feature 1..30: note = Synthetic Construct
  source 1..30: mol_type = other DNA
caagttaagtagtgtagaaatcgggagtag

SEQ ID NO: 20689 - DNA, 26 bp, synthetic construct
  misc_feature 1..26: note = Synthetic Construct
  source 1..26: mol_type = other DNA
cccagaccttatcctgtagctgaatg

SEQ ID NO: 20690 - DNA, 21 bp, synthetic construct
  misc_feature 1..21: note = Synthetic Construct
  source 1..21: mol_type = other DNA
aggtagcctcttggcatctgt

SEQ ID NO: 20691 - DNA, 24 bp, synthetic construct
  misc_feature 1..24: note = Synthetic Construct
  source 1..24: mol_type = other DNA
gggcctcagaaaactactggaact

SEQ ID NO: 20692 - DNA, 24 bp, synthetic construct
  misc_feature 1..24: note = Synthetic Construct
  source 1..24: mol_type = other DNA
gaaaggcataaaccccacaagcta

SEQ ID NO: 20693 - DNA, 22 bp, synthetic construct
  misc_feature 1..22: note = Synthetic Construct
  source 1..22: mol_type = other DNA
tgcaaggttcgaatcgagtgat

SEQ ID NO: 20694 - DNA, 27 bp, synthetic construct
  misc_feature 1..27: note = Synthetic Construct
  source 1..27: mol_type = other DNA
ggaagagctggatcagagggatgataa

SEQ ID NO: 20695 - DNA, 23 bp, synthetic construct
  misc_feature 1..23: note = Synthetic Construct
  source 1..23: mol_type = other DNA
ctgggatagatggtgtccgactt

SEQ ID NO: 20696 - DNA, 23 bp, synthetic construct
  misc_feature 1..23: note = Synthetic Construct
  source 1..23: mol_type = other DNA
ggccctactgaaacaggagagtt

SEQ ID NO: 20697 - DNA, 22 bp, synthetic construct
  misc_feature 1..22: note = Synthetic Construct
  source 1..22: mol_type = other DNA
gcctatcggctggtaggatgaa

SEQ ID NO: 20698 - DNA, 25 bp, synthetic construct
  misc_feature 1..25: note = Synthetic Construct
  source 1..25: mol_type = other DNA
gccatacacaaacaagcacacaatc

SEQ ID NO: 20699 - DNA, 21 bp, synthetic construct
  misc_feature 1..21: note = Synthetic Construct
  source 1..21: mol_type = other DNA
ggcgcagatacagcggactta

SEQ ID NO: 20700 - DNA, 26 bp, synthetic construct
  misc_feature 1..26: note = Synthetic Construct
  source 1..26: mol_type = other DNA
gggaagacagagatatgtgaccgttt

SEQ ID NO: 20701 - DNA, 23 bp, synthetic construct
  misc_feature 1..23: note = Synthetic Construct
  source 1..23: mol_type = other DNA
gggcagcttgaaggaatgtggaa

SEQ ID NO: 20702 - DNA, 20 bp, synthetic construct
  misc_feature 1..20: note = Synthetic Construct
  source 1..20: mol_type = other DNA
agcttgtgtggcaggtgtgt

SEQ ID NO: 20703 - DNA, 22 bp, synthetic construct
  misc_feature 1..22: note = Synthetic Construct
  source 1..22: mol_type = other DNA
tgtcccttttccttgggactgt

SEQ ID NO: 20704 - DNA, 26 bp, synthetic construct
  misc_feature 1..26: note = Synthetic Construct
  source 1..26: mol_type = other DNA
gctgtttcttctggcaacaaagtttc

SEQ ID NO: 20705 - DNA, 22 bp, synthetic construct
  misc_feature 1..22: note = Synthetic Construct
  source 1..22: mol_type = other DNA
ggccctccattcgaaagtcaac

SEQ ID NO: 20706 - DNA, 24 bp, synthetic construct
  misc_feature 1..24: note = Synthetic Construct
  source 1..24: mol_type = other DNA
gcccagacacctattgactggaaa

SEQ ID NO: 20707 - DNA, 22 bp, synthetic construct
  misc_feature 1..22: note = Synthetic Construct
  source 1..22: mol_type = other DNA
gcccatgcactgatgactccaa

SEQ ID NO: 20708 - DNA, 23 bp, synthetic construct
  misc_feature 1..23: note = Synthetic Construct
  source 1..23: mol_type = other DNA
ctgattccagagcttggggagaa

SEQ ID NO: 20709 - DNA, 27 bp, synthetic construct
  misc_feature 1..27: note = Synthetic Construct
  source 1..27: mol_type = other DNA
gggcccatttcagcattagaactcatc

SEQ ID NO: 20710 - DNA, 23 bp, synthetic construct
  misc_feature 1..23: note = Synthetic Construct
  source 1..23: mol_type = other DNA
cacaggaatccagagccactatg

SEQ ID NO: 20711 - DNA, 26 bp, synthetic construct
  misc_feature 1..26: note = Synthetic Construct
  source 1..26: mol_type = other DNA
gactgattcatttgtgttcccgagtt

SEQ ID NO: 20712 - DNA, 24 bp, synthetic construct
  misc_feature 1..24: note = Synthetic Construct
  source 1..24: mol_type = other DNA
agccctaccaatgcattcattcaa

SEQ ID NO: 20713 - DNA, 25 bp, synthetic construct
  misc_feature 1..25: note = Synthetic Construct
  source 1..25: mol_type = other DNA
ggagaagttattggtccaaggtgat

SEQ ID NO: 20714 - DNA, 21 bp, synthetic construct
  misc_feature 1..21: note = Synthetic Construct
  source 1..21: mol_type = other DNA
cctgcttttggcatggtcttg

SEQ ID NO: 20715 - DNA, 26 bp, synthetic construct
  misc_feature 1..26: note = Synthetic Construct
  source 1..26: mol_type = other DNA
gtccttgtggtccaagttcaactctt

SEQ ID NO: 20716 - DNA, 22 bp, synthetic construct
  misc_feature 1..22: note = Synthetic Construct
  source 1..22: mol_type = other DNA
caagtgggcatttggggtctct

SEQ ID NO: 20717 - DNA, 25 bp, synthetic construct
  misc_feature 1..25: note = Synthetic Construct
  source 1..25: mol_type = other DNA
agttgctgaactaaggcagctattt

SEQ ID NO: 20718 - DNA, 25 bp, synthetic construct
  misc_feature 1..25: note = Synthetic Construct
  source 1..25: mol_type = other DNA
gggaaaccccacctaagtcactttc

SEQ ID NO: 20719 - DNA, 23 bp, synthetic construct
  misc_feature 1..23: note = Synthetic Construct
  source 1..23: mol_type = other DNA
ggctggtttggtgttttcctttc

SEQ ID NO: 20720 - DNA, 24 bp, synthetic construct
  misc_feature 1..24: note = Synthetic Construct
  source 1..24: mol_type = other DNA
cagtgagggaaatttgctgtgtag

SEQ ID NO: 20721 - DNA, 25 bp, synthetic construct
  misc_feature 1..25: note = Synthetic Construct
  source 1..25: mol_type = other DNA
gctgttaaatccagatgacccaaac

SEQ ID NO: 20722 - DNA, 27 bp, synthetic construct
  misc_feature 1..27: note = Synthetic Construct
  source 1..27: mol_type = other DNA
ggaacatctgaagatcatgtgtcttgt

SEQ ID NO: 20723 - DNA, 26 bp, synthetic construct
  misc_feature 1..26: note = Synthetic Construct
  source 1..26: mol_type = other DNA
tcttggtgtaatggggtaggtctaat

SEQ ID NO: 20724 - DNA, 22 bp, synthetic construct
  misc_feature 1..22: note = Synthetic Construct
  source 1..22: mol_type = other DNA
gaggcaaccaacaacccttttg

SEQ ID NO: 20725 - DNA, 27 bp, synthetic construct
  misc_feature 1..27: note = Synthetic Construct
  source 1..27: mol_type = other DNA
ccagatgtggtttcattctgtgagcaa

SEQ ID NO: 20726 - DNA, 25 bp, synthetic construct
  misc_feature 1..25: note = Synthetic Construct
  source 1..25: mol_type = other DNA
tctgggatggggaaaggatattagt

SEQ ID NO: 20727 - DNA, 22 bp, synthetic construct
  misc_feature 1..22: note = Synthetic Construct
  source 1..22: mol_type = other DNA
caaccctggctctccttccaaa

SEQ ID NO: 20728 - DNA, 24 bp, synthetic construct
  misc_feature 1..24: note = Synthetic Construct
  source 1..24: mol_type = other DNA
gtatggcaactgaagaccaagaga

SEQ ID NO: 20729 - DNA, 27 bp, synthetic construct
  misc_feature 1..27: note = Synthetic Construct
  source 1..27: mol_type = other DNA
gactggacttctactttcactggaaac

SEQ ID NO: 20730 - DNA, 21 bp, synthetic construct
  misc_feature 1..21: note = Synthetic Construct
  source 1..21: mol_type = other DNA
ttcgattggcccctggctcta

SEQ ID NO: 20731 - DNA, 25 bp, synthetic construct
  misc_feature 1..25: note = Synthetic Construct
  source 1..25: mol_type = other DNA
gaactaccactgtagcatctcaact

SEQ ID NO: 20732 - DNA, 21 bp, synthetic construct
  misc_feature 1..21: note = Synthetic Construct
  source 1..21: mol_type = other DNA
tggcttgcttgagcccatatt

SEQ ID NO: 20733 - DNA, 24 bp, synthetic construct
  misc_feature 1..24: note = Synthetic Construct
  source 1..24: mol_type = other DNA
gtttgcactgagttgcacatactt

SEQ ID NO: 20734 - DNA, 25 bp, synthetic construct
  misc_feature 1..25: note = Synthetic Construct
  source 1..25: mol_type = other DNA
gaggggagaaatggaaatcaactgt

SEQ ID NO: 20735 - DNA, 22 bp, synthetic construct
  misc_feature 1..22: note = Synthetic Construct
  source 1..22: mol_type = other DNA
ccaggctagaaaggcctggtaa

SEQ ID NO: 20736 - DNA, 24 bp, synthetic construct
  misc_feature 1..24: note = Synthetic Construct
  source 1..24: mol_type = other DNA
catgtaggcttcctgtccctatac

SEQ ID NO: 20737 - DNA, 25 bp, synthetic construct
  misc_feature 1..25: note = Synthetic Construct
  source 1..25: mol_type = other DNA
ggcaaaagaaagcaagatgcctatg

SEQ ID NO: 20738 - DNA, 22 bp, synthetic construct
  misc_feature 1..22: note = Synthetic Construct
  source 1..22: mol_type = other DNA
gtctacccagtgctgcagtttc

SEQ ID NO: 20739 - DNA, 28 bp, synthetic construct
  misc_feature 1..28: note = Synthetic Construct
  source 1..28: mol_type = other DNA
gcaaggaaatacactgtcactactccta

SEQ ID NO: 20740 - DNA, 26 bp, synthetic construct
  misc_feature 1..26: note = Synthetic Construct
  source 1..26: mol_type = other DNA
gggccaaatttcaaagtcagatggat

SEQ ID NO: 20741 - DNA, 26 bp, synthetic construct
  misc_feature 1..26: note = Synthetic Construct
  source 1..26: mol_type = other DNA
ccaactctgctttggagaacctgtta

SEQ ID NO: 20742 - DNA, 22 bp, synthetic construct
  misc_feature 1..22: note = Synthetic Construct
  source 1..22: mol_type = other DNA
ctgtcagctcacgagtgtgttt

SEQ ID NO: 20743 - DNA, 24 bp, synthetic construct
  misc_feature 1..24: note = Synthetic Construct
  source 1..24: mol_type = other DNA
cccaggaagaagcagaggtagttg

SEQ ID NO: 20744 - DNA, 30 bp, synthetic construct
  misc_feature 1..30: note = Synthetic Construct
  source 1..30: mol_type = other DNA
gacttggtccataaaaatctctccttgcat

SEQ ID NO: 20745 - DNA, 23 bp, synthetic construct
  misc_feature 1..23: note = Synthetic Construct
  source 1..23: mol_type = other DNA
ggggcaaattaggctgacctttg

SEQ ID NO: 20746 - DNA, 25 bp, synthetic construct
  misc_feature 1..25: note = Synthetic Construct
  source 1..25: mol_type = other DNA
cagtctcctttgccattctgctaca

SEQ ID NO: 20747 - DNA, 21 bp, synthetic construct
  misc_feature 1..21: note = Synthetic Construct
  source 1..21: mol_type = other DNA
acaccataggtagggctcaca

SEQ ID NO: 20748 - DNA, 22 bp, synthetic construct
  misc_feature 1..22: note = Synthetic Construct
  source 1..22: mol_type = other DNA
tctgttgcctcagctcttttca

SEQ ID NO: 20749 - DNA, 25 bp, synthetic construct
  misc_feature 1..25: note = Synthetic Construct
  source 1..25: mol_type = other DNA
acttggagttggtaggtgtctttag

SEQ ID NO: 20750 - DNA, 24 bp, synthetic construct
  misc_feature 1..24: note = Synthetic Construct
  source 1..24: mol_type = other DNA
gcaatgtcgcagagaaggtagtct

SEQ ID NO: 20751 - DNA, 22 bp, synthetic construct
  misc_feature 1..22: note = Synthetic Construct
  source 1..22: mol_type = other DNA
gtggggagactctagactggat

SEQ ID NO: 20752 - DNA, 20 bp, synthetic construct
  misc_feature 1..20: note = Synthetic Construct
  source 1..20: mol_type = other DNA
accgtgtcgcatggttctct

SEQ ID NO: 20753 - DNA, 22 bp, synthetic construct
  misc_feature 1..22: note = Synthetic Construct
  source 1..22: mol_type = other DNA
gaggaagagcaagatggcagaa

SEQ ID NO: 20754 - DNA, 25 bp, synthetic construct
  misc_feature 1..25: note = Synthetic Construct
  source 1..25: mol_type = other DNA
gtcagaaccaggtatcactgagcta

SEQ ID NO: 20755 - DNA, 25 bp, synthetic construct
  misc_feature 1..25: note = Synthetic Construct
  source 1..25: mol_type = other DNA
tccgaaaagccattgtgtttaccta

SEQ ID NO: 20756 - DNA, 25 bp, synthetic construct
  misc_feature 1..25: note = Synthetic Construct
  source 1..25: mol_type = other DNA
cacttatctctaggggtccagaaga

SEQ ID NO: 20757 - DNA, 22 bp, synthetic construct
  misc_feature 1..22: note = Synthetic Construct
  source 1..22: mol_type = other DNA
cctggccaaaccctgttaccta

SEQ ID NO: 20758 - DNA, 22 bp, synthetic construct
  misc_feature 1..22: note = Synthetic Construct
  source 1..22: mol_type = other DNA
aggttcagctccccactagtct

SEQ ID NO: 20759 - DNA, 24 bp, synthetic construct
  misc_feature 1..24: note = Synthetic Construct
  source 1..24: mol_type = other DNA
ctctctgtagtactttgcccaaca

SEQ ID NO: 20760 - DNA, 27 bp, synthetic construct
  misc_feature 1..27: note = Synthetic Construct
  source 1..27: mol_type = other DNA
cctctacacccttggaatactctcctt

SEQ ID NO: 20761 - DNA, 27 bp, synthetic construct
  misc_feature 1..27: note = Synthetic Construct
  source 1..27: mol_type = other DNA
cactgatggtctttcttctggaccttt

SEQ ID NO: 20762 - DNA, 23 bp, synthetic construct
  misc_feature 1..23: note = Synthetic Construct
  source 1..23: mol_type = other DNA
ggagctacagacctggctctctt

SEQ ID NO: 20763 - DNA, 23 bp, synthetic construct
  misc_feature 1..23: note = Synthetic Construct
  source 1..23: mol_type = other DNA
gtgcttagagctggatggctgaa

SEQ ID NO: 20764 - DNA, 24 bp, synthetic construct
  misc_feature 1..24: note = Synthetic Construct
  source 1..24: mol_type = other DNA
tctgctctttgagaactgttgctt

SEQ ID NO: 20765 - DNA, 22 bp, synthetic construct
  misc_feature 1..22: note = Synthetic Construct
  source 1..22: mol_type = other DNA
gccctaactcccaggtgacatt

SEQ ID NO: 20766 - DNA, 26 bp, synthetic construct
  misc_feature 1..26: note = Synthetic Construct
  source 1..26: mol_type = other DNA
gcttaaggggaaagaatggagcaaac

SEQ ID NO: 20767 - DNA, 20 bp, synthetic construct
  misc_feature 1..20: note = Synthetic Construct
  source 1..20: mol_type = other DNA
gcccttcagagctgccattc

SEQ ID NO: 20768 - DNA, 22 bp, synthetic construct
  misc_feature 1..22: note = Synthetic Construct
  source 1..22: mol_type = other DNA
cgggcagccttttcaaagaagt

SEQ ID NO: 20769 - DNA, 22 bp, synthetic construct
  misc_feature 1..22: note = Synthetic Construct
  source 1..22: mol_type = other DNA
agccagtccaggataggccaaa

SEQ ID NO: 20770 - DNA, 20 bp, synthetic construct
  misc_feature 1..20: note = Synthetic Construct
  source 1..20: mol_type = other DNA
gggcagggtgggaaaagttc

SEQ ID NO: 20771 - DNA, 25 bp, synthetic construct
  misc_feature 1..25: note = Synthetic Construct
  source 1..25: mol_type = other DNA
agcccggtaagataaattcctgatt

SEQ ID NO: 20772 - DNA, 22 bp, synthetic construct
  misc_feature 1..22: note = Synthetic Construct
  source 1..22: mol_type = other DNA
ggcacccaattgttttgaggtt

SEQ ID NO: 20773 - DNA, 24 bp, synthetic construct
  misc_feature 1..24: note = Synthetic Construct
  source 1..24: mol_type = other DNA
cccttttggagtagcaagggttac

SEQ ID NO: 20774 - DNA, 24 bp, synthetic construct
  misc_feature 1..24: note = Synthetic Construct
  source 1..24: mol_type = other DNA
caccatcccttaatgctcttgtga

SEQ ID NO: 20775 - DNA, 24 bp, synthetic construct
  misc_feature 1..24: note = Synthetic Construct
  source 1..24: mol_type = other DNA
caaggcacaagtgaaaagctggaa

SEQ ID NO: 20776 - DNA, 23 bp, synthetic construct
  misc_feature 1..23: note = Synthetic Construct
  source 1..23: mol_type = other DNA
gggatgtgtggttttggcagaag

SEQ ID NO: 20777 - DNA, 23 bp, synthetic construct
  misc_feature 1..23: note = Synthetic Construct
  source 1..23: mol_type = other DNA
ccatcttgctactacgcctctct

SEQ ID NO: 20778 - DNA, 24 bp, synthetic construct
  misc_feature 1..24: note = Synthetic Construct
  source 1..24: mol_type = other DNA
ggcagtagagtcacatcaccttga

SEQ ID NO: 20779 - DNA, 22 bp, synthetic construct
  misc_feature 1..22: note = Synthetic Construct
  source 1..22: mol_type = other DNA
tccctttaccctgggcttcaca

SEQ ID NO: 20780 - DNA, 26 bp, synthetic construct
  misc_feature 1..26: note = Synthetic Construct
  source 1..26: mol_type = other DNA
caatgcctgttaccctaggtattact

SEQ ID NO: 20781 - DNA, 22 bp, synthetic construct
  misc_feature 1..22: note = Synthetic Construct
  source 1..22: mol_type = other DNA
caacgtctatcctgtgcctgaa

SEQ ID NO: 20782 - DNA, 25 bp, synthetic construct
  misc_feature 1..25: note = Synthetic Construct
  source 1..25: mol_type = other DNA
ggcaagtgttgaaaaacttcctgtt

SEQ ID NO: 20783 - DNA, 23 bp, synthetic construct
  misc_feature 1..23: note = Synthetic Construct
  source 1..23: mol_type = other DNA
caggttgtgttggatgcgtaaag

SEQ ID NO: 20784 - DNA, 22 bp, synthetic construct
  misc_feature 1..22: note = Synthetic Construct
  source 1..22: mol_type = other DNA
ggccatcctgtagccaccaaat

SEQ ID NO: 20785 - DNA, 24 bp, synthetic construct
  misc_feature 1..24: note = Synthetic Construct
  source 1..24: mol_type = other DNA
ccaggttgcatcccttctcaggaa

SEQ ID NO: 20786 - DNA, 21 bp, synthetic construct
  misc_feature 1..21: note = Synthetic Construct
  source 1..21: mol_type = other DNA
ggctccattccaatggcacaa

SEQ ID NO: 20787 - DNA, 23 bp, synthetic construct
  misc_feature 1..23: note = Synthetic Construct
  source 1..23: mol_type = other DNA
ggccttgaaatgcagcggagaaa

SEQ ID NO: 20788 - DNA, 25 bp, synthetic construct
  misc_feature 1..25: note = Synthetic Construct
  source 1..25: mol_type = other DNA
tgaatcaaatcttctggcgtaggat

SEQ ID NO: 20789 - DNA, 23 bp, synthetic construct
  misc_feature 1..23: note = Synthetic Construct
  source 1..23: mol_type = other DNA
gcaaagctcaacctcagggattc

SEQ ID NO: 20790 - DNA, 24 bp, synthetic construct
  misc_feature 1..24: note = Synthetic Construct
  source 1..24: mol_type = other DNA
gtagtcccatctgctagagaggtt

SEQ ID NO: 20791 - DNA, 24 bp, synthetic construct
  misc_feature 1..24: note = Synthetic Construct
  source 1..24: mol_type = other DNA
ggcctccaaaaggtagcttgttct

SEQ ID NO: 20792 - DNA, 28 bp, synthetic construct
  misc_feature 1..28: note = Synthetic Construct
  source 1..28: mol_type = other DNA
cctctcttcctcctctttcaatgtgcta

SEQ ID NO: 20793 - DNA, 22 bp, synthetic construct
  misc_feature 1..22: note = Synthetic Construct
  source 1..22: mol_type = other DNA
ggcagcagttcatgggtagaga

SEQ ID NO: 20794 - DNA, 22 bp, synthetic construct
  misc_feature 1..22: note = Synthetic Construct
  source 1..22: mol_type = other DNA
gggccacaagcctttgagtgta

SEQ ID NO: 20795 - DNA, 21 bp, synthetic construct
  misc_feature 1..21: note = Synthetic Construct
  source 1..21: mol_type = other DNA
gggaatgccccgttttgaatc

SEQ ID NO: 20796 - DNA, 24 bp, synthetic construct
  misc_feature 1..24: note = Synthetic Construct
  source 1..24: mol_type = other DNA
tcaaggcagcatagtgtcatgaat

SEQ ID NO: 20797 - DNA, 22 bp, synthetic construct
  misc_feature 1..22: note = Synthetic Construct
  source 1..22: mol_type = other DNA
tgcgatgtccgtgatgatgatg

SEQ ID NO: 20798 - DNA, 28 bp, synthetic construct
  misc_feature 1..28: note = Synthetic Construct
  source 1..28: mol_type = other DNA
ggagagctgtactatggtaaagttgaga

SEQ ID NO: 20799 - DNA, 26 bp, synthetic construct
  misc_feature 1..26: note = Synthetic Construct
  source 1..26: mol_type = other DNA
acacaaacactacctacctcctaagt

SEQ ID NO: 20800 - DNA, 26 bp, synthetic construct
  misc_feature 1..26: note = Synthetic Construct
  source 1..26: mol_type = other DNA
cctcaggggaatgaacttcttttaga

SEQ ID NO: 20801 - DNA, 21 bp, synthetic construct
  misc_feature 1..21: note = Synthetic Construct
  source 1..21: mol_type = other DNA
aggtgcagaaaggccatgaag

SEQ ID NO: 20802 - DNA, 22 bp, synthetic construct
  misc_feature 1..22: note = Synthetic Construct
  source 1..22: mol_type = other DNA
gctatgcgagagggttgcttga

SEQ ID NO: 20803 - DNA, 26 bp, synthetic construct
  misc_feature 1..26: note = Synthetic Construct
  source 1..26: mol_type = other DNA
ccctgtgctgttctcattattctttg

SEQ ID NO: 20804 - DNA, 21 bp, synthetic construct
  misc_feature 1..21: note = Synthetic Construct
  source 1..21: mol_type = other DNA
gcccaaggctatgtcttctgt

SEQ ID NO: 20805 - DNA, 21 bp, synthetic construct
  misc_feature 1..21: note = Synthetic Construct
  source 1..21: mol_type = other DNA
agggctccatgatctcacctt

SEQ ID NO: 20806 - DNA, 22 bp, synthetic construct
  misc_feature 1..22: note = Synthetic Construct
  source 1..22: mol_type = other DNA
ggactgttgtggtactggcaat

SEQ ID NO: 20807 - DNA, 24 bp, synthetic construct
  misc_feature 1..24: note = Synthetic Construct
  source 1..24: mol_type = other DNA
gcagctaagtggcagctcatcttg

SEQ ID NO: 20808 - DNA, 25 bp, synthetic construct
  misc_feature 1..25: note = Synthetic Construct
  source 1..25: mol_type = other DNA
gtcgtttgcttgctgttttaactgt

SEQ ID NO: 20809 - DNA, 23 bp, synthetic construct
  misc_feature 1..23: note = Synthetic Construct
  source 1..23: mol_type = other DNA
gccagaaagtgggctttgagtgt

SEQ ID NO: 20810 - DNA, 24 bp, synthetic construct
  misc_feature 1..24: note = Synthetic Construct
  source 1..24: mol_type = other DNA
ggtgtctcagactactcccatgat

SEQ ID NO: 20811 - DNA, 26 bp, synthetic construct
  misc_feature 1..26: note = Synthetic Construct
  source 1..26: mol_type = other DNA
gaacgatagcccctaaaatgatgtgt

SEQ ID NO: 20812 - DNA, 26 bp, synthetic construct
  misc_feature 1..26: note = Synthetic Construct
  source 1..26: mol_type = other DNA
gctacccagagatagaagcacaccta

SEQ ID NO: 20813 - DNA, 23 bp, synthetic construct
  misc_feature 1..23: note = Synthetic Construct
  source 1..23: mol_type = other DNA
cgctgaccaagtcttgtttgaat

SEQ ID NO: 20814 - DNA, 24 bp, synthetic construct
  misc_feature 1..24: note = Synthetic Construct
  source 1..24: mol_type = other DNA
gggcctttatactcacagccatag

SEQ ID NO: 20815 - DNA, 25 bp, synthetic construct
  misc_feature 1..25: note = Synthetic Construct
  source 1..25: mol_type = other DNA
gggcatgcaattcagggatatggaa

SEQ ID NO: 20816 - DNA, 23 bp, synthetic construct
  misc_feature 1..23: note = Synthetic Construct
  source 1..23: mol_type = other DNA
cccatctttccccacgaagtatg

SEQ ID NO: 20817 - DNA, 22 bp, synthetic construct
  misc_feature 1..22: note = Synthetic Construct
  source 1..22: mol_type = other DNA
agctgataccctccaggtcttt

SEQ ID NO: 20818 - DNA, 25 bp, synthetic construct
  misc_feature 1..25: note = Synthetic Construct
  source 1..25: mol_type = other DNA
tgacgatagtcacaccttcacaaag

SEQ ID NO: 20819 - DNA, 23 bp, synthetic construct
  misc_feature 1..23: note = Synthetic Construct
  source 1..23: mol_type = other DNA
gtagcccagccttattcaaggaa

SEQ ID NO: 20820 - DNA, 22 bp, synthetic construct
  misc_feature 1..22: note = Synthetic Construct
  source 1..22: mol_type = other DNA
gctagctgctgagacagtgaag

SEQ ID NO: 20821 - DNA, 20 bp, synthetic construct
  misc_feature 1..20: note = Synthetic Construct
  source 1..20: mol_type = other DNA
tggcagcactacctgagagt

SEQ ID NO: 20822 - DNA, 23 bp, synthetic construct
  misc_feature 1..23: note = Synthetic Construct
  source 1..23: mol_type = other DNA
gccccttaggtaactgctgatag

SEQ ID NO: 20823 - DNA, 24 bp, synthetic construct
  misc_feature 1..24: note = Synthetic Construct
  source 1..24: mol_type = other DNA
tgctctctgaattgactcactgtt

SEQ ID NO: 20824 - DNA, 23 bp, synthetic construct
  misc_feature 1..23: note = Synthetic Construct
  source 1..23: mol_type = other DNA
ttgatcaccatgactctgcatgt

SEQ ID NO: 20825 - DNA, 27 bp, synthetic construct
  misc_feature 1..27: note = Synthetic Construct
  source 1..27: mol_type = other DNA
cctgctcaaactgatttctcactctct

SEQ ID NO: 20826 - DNA, 24 bp, synthetic construct
  misc_feature 1..24: note = Synthetic Construct
  source 1..24: mol_type = other DNA
gaggtgcctgtttcctttctggat

SEQ ID NO: 20827 - DNA, 27 bp, synthetic construct
  misc_feature 1..27: note = Synthetic Construct
  source 1..27: mol_type = other DNA
ccctttcgactctcaaaacttccttac

SEQ ID NO: 20828 - DNA, 22 bp, synthetic construct
  misc_feature 1..22: note = Synthetic Construct
  source 1..22: mol_type = other DNA
tcctcccagaaacctggtgctt

SEQ ID NO: 20829 - DNA, 22 bp, synthetic construct
  misc_feature 1..22: note = Synthetic Construct
  source 1..22: mol_type = other DNA
gcctgccaccatttcatggtta

SEQ ID NO: 20830 - DNA, 23 bp, synthetic construct
  misc_feature 1..23: note = Synthetic Construct
  source 1..23: mol_type = other DNA
ctgtgacaccaaaggcagaaaca

SEQ ID NO: 20831 - DNA, 22 bp, synthetic construct
  misc_feature 1..22: note = Synthetic Construct
  source 1..22: mol_type = other DNA
ggtcggaatgatgacccctgtt

SEQ ID NO: 20832 - DNA, 22 bp, synthetic construct
  misc_feature 1..22: note = Synthetic Construct
  source 1..22: mol_type = other DNA
gagcattccagcagaggtcagt

SEQ ID NO: 20833 - DNA, 23 bp, synthetic construct
  misc_feature 1..23: note = Synthetic Construct
  source 1..23: mol_type = other DNA
ccaggagccagacttgagaatca

SEQ ID NO: 20834 - DNA, 25 bp, synthetic construct
  misc_feature 1..25: note = Synthetic Construct
  source 1..25: mol_type = other DNA
gggtagaagccattggtatagttca

SEQ ID NO: 20835 - DNA, 24 bp, synthetic construct
  misc_feature 1..24: note = Synthetic Construct
  source 1..24: mol_type = other DNA
gtgccagtccttgtgttaggttct

SEQ ID NO: 20836 - DNA, 21 bp, synthetic construct
  misc_feature 1..21: note = Synthetic Construct
  source 1..21: mol_type = other DNA
accagcctctgtaccggcaat

SEQ ID NO: 20837 - DNA, 22 bp, synthetic construct
  misc_feature 1..22: note = Synthetic Construct
  source 1..22: mol_type = other DNA
gctctgggatcatcacacaaca

SEQ ID NO: 20838 - DNA, 24 bp, synthetic construct
  misc_feature 1..24: note = Synthetic Construct
  source 1..24: mol_type = other DNA
tgacgcttctgtttccaacagtta

SEQ ID NO: 20839 - DNA, 26 bp, synthetic construct
  misc_feature 1..26: note = Synthetic Construct
  source 1..26: mol_type = other DNA
cctctctgtacttttgcactcactgt

SEQ ID NO: 20840 - DNA, 22 bp, synthetic construct
  misc_feature 1..22: note = Synthetic Construct
  source 1..22: mol_type = other DNA
cctcccctctcacacaggaaga

SEQ ID NO: 20841 - DNA, 27 bp, synthetic construct
  misc_feature 1..27: note = Synthetic Construct
  source 1..27: mol_type = other DNA
cacatttcccaaaccagactgtagaga

SEQ ID NO: 20842 - DNA, 23 bp, synthetic construct
  misc_feature 1..23: note = Synthetic Construct
  source 1..23: mol_type = other DNA
gattccagcagcatgaacagaca

SEQ ID NO: 20843 - DNA, 27 bp, synthetic construct
  misc_feature 1..27: note = Synthetic Construct
  source 1..27: mol_type = other DNA
ggaaagggtactgggatttttgtttag

SEQ ID NO: 20844 - DNA, 22 bp, synthetic construct
  misc_feature 1..22: note = Synthetic Construct
  source 1..22: mol_type = other DNA
cctgagctagcctttccacact

SEQ ID NO: 20845 - DNA, 24 bp, synthetic construct
  misc_feature 1..24: note = Synthetic Construct
  source 1..24: mol_type = other DNA
ccctcaggtttgggaatagtcatc

SEQ ID NO: 20846 - DNA, 22 bp, synthetic construct
  misc_feature 1..22: note = Synthetic Construct
  source 1..22: mol_type = other DNA
gtcgtcactacaaggggctcaa

SEQ ID NO: 20847 - DNA, 22 bp, synthetic construct
  misc_feature 1..22: note = Synthetic Construct
  source 1..22: mol_type = other DNA
tggggtcctcacaaggaaatgt

SEQ ID NO: 20848 - DNA, 24 bp, synthetic construct
  misc_feature 1..24: note = Synthetic Construct
  source 1..24: mol_type = other DNA
gtagaagactactgctctggcaaa

SEQ ID NO: 20849 - DNA, 23 bp, synthetic construct
  misc_feature 1..23: note = Synthetic Construct
  source 1..23: mol_type = other DNA
gagctgggaatttggtggttttg

SEQ ID NO: 20850 - DNA, 22 bp, synthetic construct
  misc_feature 1..22: note = Synthetic Construct
  source 1..22: mol_type = other DNA
caccacaggtttcttgccaatc

SEQ ID NO: 20851 - DNA, 23 bp, synthetic construct
  misc_feature 1..23: note = Synthetic Construct
  source 1..23: mol_type = other DNA
ccctggaggtcagacagagaagt

SEQ ID NO: 20852 - DNA, 21 bp, synthetic construct
  misc_feature 1..21: note = Synthetic Construct
  source 1..21: mol_type = other DNA
gaggagtgtggtggttggaaa

SEQ ID NO: 20853 - DNA, 20 bp, synthetic construct
  misc_feature 1..20: note = Synthetic Construct
  source 1..20: mol_type = other DNA
tgtgctgcgctgacactttg

SEQ ID NO: 20854 - DNA, 22 bp, synthetic construct
  misc_feature 1..22: note = Synthetic Construct
  source 1..22: mol_type = other DNA
ctctccaggtacaaccccagta

SEQ ID NO: 20855 - DNA, 23 bp, synthetic construct
  misc_feature 1..23: note = Synthetic Construct
  source 1..23: mol_type = other DNA
ccgtcttcaaagccaatgctaag

SEQ ID NO: 20856 - DNA, 23 bp, synthetic construct
  misc_feature 1..23: note = Synthetic Construct
  source 1..23: mol_type = other DNA
ggagggcagcatgggataaagaa

SEQ ID NO: 20857 - DNA, 24 bp, synthetic construct
  misc_feature 1..24: note = Synthetic Construct
  source 1..24: mol_type = other DNA
tgttgccaaaagttgctcagtaag

SEQ ID NO: 20858 - DNA, 24 bp, synthetic construct
  misc_feature 1..24: note = Synthetic Construct
  source 1..24: mol_type = other DNA
cccacacgctaaaggcaagaaaac

SEQ ID NO: 20859 - DNA, 22 bp, synthetic construct
  misc_feature 1..22: note = Synthetic Construct
  source 1..22: mol_type = other DNA
gccctctaccctttccactaac

SEQ ID NO: 20860 - DNA, 23 bp, synthetic construct
  misc_feature 1..23: note = Synthetic Construct
  source 1..23: mol_type = other DNA
ctgcctttcaccaagttcctttc

SEQ ID NO: 20861 - DNA, 21 bp, synthetic construct
  misc_feature 1..21: note = Synthetic Construct
  source 1..21: mol_type = other DNA
gccgatggttgcattcctact

SEQ ID NO: 20862 - DNA, 22 bp, synthetic construct
  misc_feature 1..22: note = Synthetic Construct
  source 1..22: mol_type = other DNA
ccactggggttgagagagaaca

SEQ ID NO: 20863 - DNA, 20 bp, synthetic construct
  misc_feature 1..20: note = Synthetic Construct
  source 1..20: mol_type = other DNA
ccattgctggccgtgtcact

SEQ ID NO: 20864 - DNA, 25 bp, synthetic construct
  misc_feature 1..25: note = Synthetic Construct
  source 1..25: mol_type = other DNA
gaccacctttttcctacagagatgt

SEQ ID NO: 20865 - DNA, 25 bp, synthetic construct
  misc_feature 1..25: note = Synthetic Construct
  source 1..25: mol_type = other DNA
agtggagctgtttgttttctaccta

SEQ ID NO: 20866 - DNA, 26 bp, synthetic construct
  misc_feature 1..26: note = Synthetic Construct
  source 1..26: mol_type = other DNA
ggggttctgaggtgcacatagttaag

SEQ ID NO: 20867 - DNA, 22 bp, synthetic construct
  misc_feature 1..22: note = Synthetic Construct
  source 1..22: mol_type = other DNA
ctctactcgcaagggtctggtt

SEQ ID NO: 20868 - DNA, 24 bp, synthetic construct
  misc_feature 1..24: note = Synthetic Construct
  source 1..24: mol_type = other DNA
gcctgtccagtctcatctagcatt

SEQ ID NO: 20869 - DNA, 22 bp, synthetic construct
  misc_feature 1..22: note = Synthetic Construct
  source 1..22: mol_type = other DNA
gtagtggagcacccaaacactt

SEQ ID NO: 20870 - DNA, 22 bp, synthetic construct
  misc_feature 1..22: note = Synthetic Construct
  source 1..22: mol_type = other DNA
aagagagagctgtcctccttga

SEQ ID NO: 20871 - DNA, 23 bp, synthetic construct
  misc_feature 1..23: note = Synthetic Construct
  source 1..23: mol_type = other DNA
cttctttagggcttggtgtcact

SEQ ID NO: 20872 - DNA, 21 bp, synthetic construct
  misc_feature 1..21: note = Synthetic Construct
  source 1..21: mol_type = other DNA
gctgctttggtctggctgttg

SEQ ID NO: 20873 - DNA, 22 bp, synthetic construct
  misc_feature 1..22: note = Synthetic Construct
  source 1..22: mol_type = other DNA
cagtttcccctgggagcacttt

SEQ ID NO: 20874 - DNA, 27 bp, synthetic construct
  misc_feature 1..27: note = Synthetic Construct
  source 1..27: mol_type = other DNA
cgagttatctaatcctcccctacaatg

SEQ ID NO: 20875 - DNA, 22 bp, synthetic construct
  misc_feature 1..22: note = Synthetic Construct
  source 1..22: mol_type = other DNA
cctccctgcaaagacacttaca

SEQ ID NO: 20876 - DNA, 25 bp, synthetic construct
  misc_feature 1..25: note = Synthetic Construct
  source 1..25: mol_type = other DNA
tgcagctgtactttatggatgacaa

SEQ ID NO: 20877 - DNA, 22 bp, synthetic construct
  misc_feature 1..22: note = Synthetic Construct
  source 1..22: mol_type = other DNA
tctggctctatcacctgggttt

SEQ ID NO: 20878 - DNA, 20 bp, synthetic construct
  misc_feature 1..20: note = Synthetic Construct
  source 1..20: mol_type = other DNA
aaggggagtcgcatgggtta

SEQ ID NO: 20879 - DNA, 21 bp, synthetic construct
  misc_feature 1..21: note = Synthetic Construct
  source 1..21: mol_type = other DNA
agcggaaaaacctggctaaga

SEQ ID NO: 20880 - DNA, 23 bp, synthetic construct
  misc_feature 1..23: note = Synthetic Construct
  source 1..23: mol_type = other DNA
ggcagactgtgacgttagtgaga

SEQ ID NO: 20881 - DNA, 27 bp, synthetic construct
  misc_feature 1..27: note = Synthetic Construct
  source 1..27: mol_type = other DNA
gccattggaacctagaattctgtctgt

SEQ ID NO: 20882 - DNA, 24 bp, synthetic construct
  misc_feature 1..24: note = Synthetic Construct
  source 1..24: mol_type = other DNA
ccacactactccatgccaggatct

SEQ ID NO: 20883 - DNA, 26 bp, synthetic construct
  misc_feature 1..26: note = Synthetic Construct
  source 1..26: mol_type = other DNA
agtcacagaactccccagaaatatac

SEQ ID NO: 20884 - DNA, 26 bp, synthetic construct
  misc_feature 1..26: note = Synthetic Construct
  source 1..26: mol_type = other DNA
cacccttggctatagctgctaatttc

SEQ ID NO: 20885 - DNA, 22 bp, synthetic construct
  misc_feature 1..22: note = Synthetic Construct
  source 1..22: mol_type = other DNA
gccttttgggagcccgaactat

SEQ ID NO: 20886 - DNA, 24 bp, synthetic construct
  misc_feature 1..24: note = Synthetic Construct
  source 1..24: mol_type = other DNA
ccagttccccacagaggaggaaaa

SEQ ID NO: 20887 - DNA, 26 bp, synthetic construct
  misc_feature 1..26: note = Synthetic Construct
  source 1..26: mol_type = other DNA
cctgtcaacatgatggtcgtagtaac

SEQ ID NO: 20888 - DNA, 26 bp, synthetic construct
  misc_feature 1..26: note = Synthetic Construct
  source 1..26: mol_type = other DNA
cctgtgtaacatgacttgtactccta

SEQ ID NO: 20889 - DNA, 25 bp, synthetic construct
  misc_feature 1..25: note = Synthetic Construct
  source 1..25: mol_type = other DNA
gaagaaaagcagttcatcccaaaca

SEQ ID NO: 20890 - DNA, 26 bp, synthetic construct
  misc_feature 1..26: note = Synthetic Construct
  source 1..26: mol_type = other DNA
gggagcttgctttctctctttactct

SEQ ID NO: 20891 - DNA, 21 bp, synthetic construct
  misc_feature 1..21: note = Synthetic Construct
  source 1..21: mol_type = other DNA
cctggttgggtgtctttgtgt

SEQ ID NO: 20892 - DNA, 24 bp, synthetic construct
  misc_feature 1..24: note = Synthetic Construct
  source 1..24: mol_type = other DNA
agaagagaggtccttctggtatgt

SEQ ID NO: 20893 - DNA, 22 bp, synthetic construct
  misc_feature 1..22: note = Synthetic Construct
  source 1..22: mol_type = other DNA
gggcaaaggagtggcataatct

SEQ ID NO: 20894 - DNA, 23 bp, synthetic construct
  misc_feature 1..23: note = Synthetic Construct
  source 1..23: mol_type = other DNA
ggctcatggtagctacacctttc

SEQ ID NO: 20895 - DNA, 24 bp, synthetic construct
  misc_feature 1..24: note = Synthetic Construct
  source 1..24: mol_type = other DNA
ggcttcagcagagtaaagtaggaa

SEQ ID NO: 20896 - DNA, 25 bp, synthetic construct
  misc_feature 1..25: note = Synthetic Construct
  source 1..25: mol_type = other DNA
ccaactctcctccaaacagtgattc

SEQ ID NO: 20897 - DNA, 25 bp, synthetic construct
  misc_feature 1..25: note = Synthetic Construct
  source 1..25: mol_type = other DNA
cagattacacgcgattcacaaatca

SEQ ID NO: 20898 - DNA, 27 bp, synthetic construct
  misc_feature 1..27: note = Synthetic Construct
  source 1..27: mol_type = other DNA
gaaggaagtagaatccaccagatcaac

SEQ ID NO: 20899 - DNA, 27 bp, synthetic construct
  misc_feature 1..27: note = Synthetic Construct
  source 1..27: mol_type = other DNA
ggaggaggaatcaatgatggtgtagat

SEQ ID NO: 20900 - DNA, 25 bp, synthetic construct
  misc_feature 1..25: note = Synthetic Construct
  source 1..25: mol_type = other DNA
gtctgctagggttaaacagggcttt

SEQ ID NO: 20901 - DNA, 26 bp, synthetic construct
  misc_feature 1..26: note = Synthetic Construct
  source 1..26: mol_type = other DNA
cagcacagccatcatttcttccaatg

SEQ ID NO: 20902 - DNA, 26 bp, synthetic construct
  misc_feature 1..26: note = Synthetic Construct
  source 1..26: mol_type = other DNA
gagatgtgcctatactgcgtttgaag

SEQ ID NO: 20903 - DNA, 23 bp, synthetic construct
  misc_feature 1..23: note = Synthetic Construct
  source 1..23: mol_type = other DNA
tgggagggaatgaggtgttatct

SEQ ID NO: 20904 - DNA, 27 bp, synthetic construct
  misc_feature 1..27: note = Synthetic Construct
  source 1..27: mol_type = other DNA
gagacaaaatcccactgtcaggataac

SEQ ID NO: 20905 - DNA, 22 bp, synthetic construct
  misc_feature 1..22: note = Synthetic Construct
  source 1..22: mol_type = other DNA
ggcacagaagtagaggctgtag

SEQ ID NO: 20906 - DNA, 22 bp, synthetic construct
  misc_feature 1..22: note = Synthetic Construct
  source 1..22: mol_type = other DNA
acaccccaggtcctgactgata

SEQ ID NO: 20907 - DNA, 23 bp, synthetic construct
  misc_feature 1..23: note = Synthetic Construct
  source 1..23: mol_type = other DNA
cctcttgtttgccccaagctttc

SEQ ID NO: 20908 - DNA, 25 bp, synthetic construct
  misc_feature 1..25: note = Synthetic Construct
  source 1..25: mol_type = other DNA
gcttttcaagaacgggagacacaca

SEQ ID NO: 20909 - DNA, 26 bp, synthetic construct
  misc_feature 1..26: note = Synthetic Construct
  source 1..26: mol_type = other DNA
ccaggaaggaatgtttttacctcttc

SEQ ID NO: 20910 - DNA, 23 bp, synthetic construct
  misc_feature 1..23: note = Synthetic Construct
  source 1..23: mol_type = other DNA
ggagtggctttcattaccctcaa

SEQ ID NO: 20911 - DNA, 25 bp, synthetic construct
  misc_feature 1..25: note = Synthetic Construct
  source 1..25: mol_type = other DNA
cctggctttagtatatgccgagaca

SEQ ID NO: 20912 - DNA, 26 bp, synthetic construct
  misc_feature 1..26: note = Synthetic Construct
  source 1..26: mol_type = other DNA
gcccaaactccacttaagagcagaaa

SEQ ID NO: 20913 - DNA, 20 bp, synthetic construct
  misc_feature 1..20: note = Synthetic Construct
  source 1..20: mol_type = other DNA
aggctccagttggggacaca

SEQ ID NO: 20914 - DNA, 21 bp, synthetic construct
  misc_feature 1..21: note = Synthetic Construct
  source 1..21: mol_type = other DNA
cacttccatccacctgcaaca

SEQ ID NO: 20915 - DNA, 22 bp, synthetic construct
  misc_feature 1..22: note = Synthetic Construct
  source 1..22: mol_type = other DNA
gcagctcctcctacaacaaaga

SEQ ID NO: 20916 - DNA, 23 bp, synthetic construct
  misc_feature 1..23: note = Synthetic Construct
  source 1..23: mol_type = other DNA
ctgcctgttggagagacttgaca

SEQ ID NO: 20917 - DNA, 20 bp, synthetic construct
  misc_feature 1..20: note = Synthetic Construct
  source 1..20: mol_type = other DNA
ccgtgtttgcccctcctttt

SEQ ID NO: 20918 - DNA, 23 bp, synthetic construct
  misc_feature 1..23: note = Synthetic Construct
  source 1..23: mol_type = other DNA
gccctacagggaagatgcagaga

SEQ ID NO: 20919 - DNA, 27 bp, synthetic construct
  misc_feature 1..27: note = Synthetic Construct
  source 1..27: mol_type = other DNA
cctcaggggtatatcaactttgtgtca

SEQ ID NO: 20920 - DNA, 26 bp, synthetic construct
  misc_feature 1..26: note = Synthetic Construct
  source 1..26: mol_type = other DNA
ctacttggaaactccctcttccttag

SEQ ID NO: 20921 - DNA, 21 bp, synthetic construct
  misc_feature 1..21: note = Synthetic Construct
  source 1..21: mol_type = other DNA
ttgccgagacagggatttcaa

SEQ ID NO: 20922 - DNA, 28 bp, synthetic construct
  misc_feature 1..28: note = Synthetic Construct
  source 1..28: mol_type = other DNA
gcctctctgacaatgaccataaccctta

SEQ ID NO: 20923 - DNA, 24 bp, synthetic construct
  misc_feature 1..24: note = Synthetic Construct
  source 1..24: mol_type = other DNA
tcacttcccagtggtgatatgagt

SEQ ID NO: 20924 - DNA, 22 bp, synthetic construct
  misc_feature 1..22: note = Synthetic Construct
  source 1..22: mol_type = other DNA
cctcctgcaagagcagcattga

SEQ ID NO: 20925 - DNA, 23 bp, synthetic construct
  misc_feature 1..23: note = Synthetic Construct
  source 1..23: mol_type = other DNA
gctggccttgtgatctgctttga

SEQ ID NO: 20926 - DNA, 22 bp, synthetic construct
  misc_feature 1..22: note = Synthetic Construct
  source 1..22: mol_type = other DNA
ggaggcaaagggaggatagtca

SEQ ID NO: 20927 - DNA, 25 bp, synthetic construct
  misc_feature 1..25: note = Synthetic Construct
  source 1..25: mol_type = other DNA
gcttgtcaagttctctctgatgcaa

SEQ ID NO: 20928 - DNA, 20 bp, synthetic construct
  misc_feature 1..20: note = Synthetic Construct
  source 1..20: mol_type = other DNA
actcaccatgggtgggtcaa

SEQ ID NO: 20929 - DNA, 23 bp, synthetic construct
  misc_feature 1..23: note = Synthetic Construct
  source 1..23: mol_type = other DNA
cggcaaaatccgagaaggacgtt

SEQ ID NO: 20930 - DNA, 24 bp, synthetic construct
  misc_feature 1..24: note = Synthetic Construct
  source 1..24: mol_type = other DNA
ccattgcagaaagatgtggtcttg

SEQ ID NO: 20931 - DNA, 24 bp, synthetic construct
  misc_feature 1..24: note = Synthetic Construct
  source 1..24: mol_type = other DNA
cccaccattaccgaagtagccatt

SEQ ID NO: 20932 - DNA, 22 bp, synthetic construct
  misc_feature 1..22: note = Synthetic Construct
  source 1..22: mol_type = other DNA
ccctgggcttgtagttttgctt

SEQ ID NO: 20933 - DNA, 20 bp, synthetic construct
  misc_feature 1..20: note = Synthetic Construct
  source 1..20: mol_type = other DNA
acacaccccgctccattact

SEQ ID NO: 20934 - DNA, 22 bp, synthetic construct
  misc_feature 1..22: note = Synthetic Construct
  source 1..22: mol_type = other DNA
cctgccacacatttttggtgaa

SEQ ID NO: 20935 - DNA, 25 bp, synthetic construct
  misc_feature 1..25: note = Synthetic Construct
  source 1..25: mol_type = other DNA
ggcactggctgctaattaaggcaat

SEQ ID NO: 20936 - DNA, 22 bp, synthetic construct
  misc_feature 1..22: note = Synthetic Construct
  source 1..22: mol_type = other DNA
gccactactggcatcttagcaa

SEQ ID NO: 20937 - DNA, 27 bp, synthetic construct
  misc_feature 1..27: note = Synthetic Construct
  source 1..27: mol_type = other DNA
tctgagacagcttctttacttgacttc

SEQ ID NO: 20938 - DNA, 23 bp, synthetic construct
  misc_feature 1..23: note = Synthetic Construct
  source 1..23: mol_type = other DNA
ggagcctggtggtacttttgttc

SEQ ID NO: 20939 - DNA, 23 bp, synthetic construct
  misc_feature 1..23: note = Synthetic Construct
  source 1..23: mol_type = other DNA
cgggaatcaggcaagagatccaa

SEQ ID NO: 20940 - DNA, 24 bp, synthetic construct
  misc_feature 1..24: note = Synthetic Construct
  source 1..24: mol_type = other DNA
gggccagtaggaacatctgtgaac

SEQ ID NO: 20941 - DNA, 27 bp, synthetic construct
  misc_feature 1..27: note = Synthetic Construct
  source 1..27: mol_type = other DNA
gttaggagggtgtaaatctgtgaatga

SEQ ID NO: 20942 - DNA, 21 bp, synthetic construct
  misc_feature 1..21: note = Synthetic Construct
  source 1..21: mol_type = other DNA
gctgtcaccttccggttggat

SEQ ID NO: 20943 - DNA, 22 bp, synthetic construct
  misc_feature 1..22: note = Synthetic Construct
  source 1..22: mol_type = other DNA
ggtcagacactggcttgtccat

SEQ ID NO: 20944 - DNA, 22 bp, synthetic construct
  misc_feature 1..22: note = Synthetic Construct
  source 1..22: mol_type = other DNA
gggtctgcgtgaagagaaaaca

SEQ ID NO: 20945 - DNA, 26 bp, synthetic construct
  misc_feature 1..26: note = Synthetic Construct
  source 1..26: mol_type = other DNA
gtcttccttttacaacctacgtgaca

SEQ ID NO: 20946 - DNA, 21 bp, synthetic construct
  misc_feature 1..21: note = Synthetic Construct
  source 1..21: mol_type = other DNA
gctgcttcgttcctttgttgt

SEQ ID NO: 20947 - DNA, 22 bp, synthetic construct
  misc_feature 1..22: note = Synthetic Construct
  source 1..22: mol_type = other DNA
ctgcccctggttagaatcaact

SEQ ID NO: 20948 - DNA, 23 bp, synthetic construct
  misc_feature 1..23: note = Synthetic Construct
  source 1..23: mol_type = other DNA
gctgtgactcatccacactgtct

SEQ ID NO: 20949 - DNA, 22 bp, synthetic construct
  misc_feature 1..22: note = Synthetic Construct
  source 1..22: mol_type = other DNA
gggcaggtggatgctaagtttg

SEQ ID NO: 20950 - DNA, 25 bp, synthetic construct
  misc_feature 1..25: note = Synthetic Construct
  source 1..25: mol_type = other DNA
ccttacatcaaagagggtgaactgt

SEQ ID NO: 20951 - DNA, 23 bp, synthetic construct
  misc_feature 1..23: note = Synthetic Construct
  source 1..23: mol_type = other DNA
gtgtgtgacagcgatatgagcta

SEQ ID NO: 20952 - DNA, 21 bp, synthetic construct
  misc_feature 1..21: note = Synthetic Construct
  source 1..21: mol_type = other DNA
aggccagagtttgtccaggat

SEQ ID NO: 20953 - DNA, 24 bp, synthetic construct
  misc_feature 1..24: note = Synthetic Construct
  source 1..24: mol_type = other DNA
actgcagttaccttgctttctttc

SEQ ID NO: 20954 - DNA, 24 bp, synthetic construct
  misc_feature 1..24: note = Synthetic Construct
  source 1..24: mol_type = other DNA
cagcaggggctactgtatttgtgt

SEQ ID NO: 20955 - DNA, 26 bp, synthetic construct
  misc_feature 1..26: note = Synthetic Construct
  source 1..26: mol_type = other DNA
ggtttttgagacacaagtctgctgat

SEQ ID NO: 20956 - DNA, 24 bp, synthetic construct
  misc_feature 1..24: note = Synthetic Construct
  source 1..24: mol_type = other DNA
ggacgggtgaagggattttcaaac

SEQ ID NO: 20957 - DNA, 22 bp, synthetic construct
  misc_feature 1..22: note = Synthetic Construct
  source 1..22: mol_type = other DNA
gcacacacagactggctagaag

SEQ ID NO: 20958 - DNA, 23 bp, synthetic construct
  misc_feature 1..23: note = Synthetic Construct
  source 1..23: mol_type = other DNA
gtgacactgcaaaggagctgaaa

SEQ ID NO: 20959 - DNA, 22 bp, synthetic construct
  misc_feature 1..22: note = Synthetic Construct
  source 1..22: mol_type = other DNA
cctgcttcctggaaatgagcaa

SEQ ID NO: 20960 - DNA, 21 bp, synthetic construct
  misc_feature 1..21: note = Synthetic Construct
  source 1..21: mol_type = other DNA
cggaggcgatgaacagggaaa

SEQ ID NO: 20961 - DNA, 28 bp, synthetic construct
  misc_feature 1..28: note = Synthetic Construct
  source 1..28: mol_type = other DNA
ggtttctcagggagtttactcttgcatt

SEQ ID NO: 20962 - DNA, 20 bp, synthetic construct
  misc_feature 1..20: note = Synthetic Construct
  source 1..20: mol_type = other DNA
tcagcacttgccccaacttc

SEQ ID NO: 20963 - DNA, 22 bp, synthetic construct
  misc_feature 1..22: note = Synthetic Construct
  source 1..22: mol_type = other DNA
gggttgaacagttgctgcaaag

SEQ ID NO: 20964 - DNA, 24 bp, synthetic construct
  misc_feature 1..24: note = Synthetic Construct
  source 1..24: mol_type = other DNA
ccaccatcactactaccactctgt

SEQ ID NO: 20965 - DNA, 25 bp, synthetic construct
  misc_feature 1..25: note = Synthetic Construct
  source 1..25: mol_type = other DNA
ccagccataaccagaggtcaagttc

SEQ ID NO: 20966 - DNA, 23 bp, synthetic construct
  misc_feature 1..23: note = Synthetic Construct
  source 1..23: mol_type = other DNA
tgctggacaccttgaattgtttc

SEQ ID NO: 20967 - DNA, 24 bp, synthetic construct
  misc_feature 1..24: note = Synthetic Construct
  source 1..24: mol_type = other DNA
ggatggcgctagagacaggtgata

SEQ ID NO: 20968 - DNA, 21 bp, synthetic construct
  misc_feature 1..21: note = Synthetic Construct
  source 1..21: mol_type = other DNA
ccaccaaccttgcttccaagt

SEQ ID NO: 20969 - DNA, 28 bp, synthetic construct
  misc_feature 1..28: note = Synthetic Construct
  source 1..28: mol_type = other DNA
ccatgtcctgatatacagccttgcaaat

SEQ ID NO: 20970 - DNA, 21 bp, synthetic construct
  misc_feature 1..21: note = Synthetic Construct
  source 1..21: mol_type = other DNA
tgccaggggttttctctctgt

SEQ ID NO: 20971 - DNA, 24 bp, synthetic construct
  misc_feature 1..24: note = Synthetic Construct
  source 1..24: mol_type = other DNA
gcagctggcaattttgctctttct

SEQ ID NO: 20972 - DNA, 22 bp, synthetic construct
  misc_feature 1..22: note = Synthetic Construct
  source 1..22: mol_type = other DNA
gggcagccaacatagcctagaa

SEQ ID NO: 20973 - DNA, 23 bp, synthetic construct
  misc_feature 1..23: note = Synthetic Construct
  source 1..23: mol_type = other DNA
gccggttgagacacaagacagtt

SEQ ID NO: 20974 - DNA, 26 bp, synthetic construct
  misc_feature 1..26: note = Synthetic Construct
  source 1..26: mol_type = other DNA
ccctcaaatggatggattgtgtggta

SEQ ID NO: 20975 - DNA, 23 bp, synthetic construct
  misc_feature 1..23: note = Synthetic Construct
  source 1..23: mol_type = other DNA
gcatatgggacaatcgtggcttt

SEQ ID NO: 20976 - DNA, 23 bp, synthetic construct
  misc_feature 1..23: note = Synthetic Construct
  source 1..23: mol_type = other DNA
gctttccagcctcgtttctcact

SEQ ID NO: 20977 - DNA, 26 bp, synthetic construct
  misc_feature 1..26: note = Synthetic Construct
  source 1..26: mol_type = other DNA
cagtggagcagaaaaacccatacatc

SEQ ID NO: 20978 - DNA, 22 bp, synthetic construct
  misc_feature 1..22: note = Synthetic Construct
  source 1..22: mol_type = other DNA
ggggcgcattgaaagtgaggat

SEQ ID NO: 20979 - DNA, 26 bp, synthetic construct
  misc_feature 1..26: note = Synthetic Construct
  source 1..26: mol_type = other DNA
gagctctgactgaatgatgtgctact

SEQ ID NO: 20980 - DNA, 25 bp, synthetic construct
  misc_feature 1..25: note = Synthetic Construct
  source 1..25: mol_type = other DNA
ccatgagcagcagagtttagcttgt

SEQ ID NO: 20981 - DNA, 21 bp, synthetic construct
  misc_feature 1..21: note = Synthetic Construct
  source 1..21: mol_type = other DNA
acccacttgggttcctccatt

SEQ ID NO: 20982 - DNA, 25 bp, synthetic construct
  misc_feature 1..25: note = Synthetic Construct
  source 1..25: mol_type = other DNA
ccagaggtaacttctcctcccatga

SEQ ID NO: 20983 - DNA, 22 bp, synthetic construct
  misc_feature 1..22: note = Synthetic Construct
  source 1..22: mol_type = other DNA
gtgagaaaaggcaaggcaacat

SEQ ID NO: 20984 - DNA, 22 bp, synthetic construct
  misc_feature 1..22: note = Synthetic Construct
  source 1..22: mol_type = other DNA
cctggtgtttgcttggcaacta

SEQ ID NO: 20985 - DNA, 25 bp, synthetic construct
  misc_feature 1..25: note = Synthetic Construct
  source 1..25: mol_type = other DNA
ccatggactgacaaaatgcaagttc

SEQ ID NO: 20986 - DNA, 22 bp, synthetic construct
  misc_feature 1..22: note = Synthetic Construct
  source 1..22: mol_type = other DNA
ctcgtacgggtaacggttgcta

SEQ ID NO: 20987 - DNA, 20 bp, synthetic construct
  misc_feature 1..20: note = Synthetic Construct
  source 1..20: mol_type = other DNA
gctttgcggagggccttcaa

SEQ ID NO: 20988 - DNA, 25 bp, synthetic construct
  misc_feature 1..25: note = Synthetic Construct
  source 1..25: mol_type = other DNA
gcattcacagcaatctcagccattt

SEQ ID NO: 20989 - DNA, 23 bp, synthetic construct
  misc_feature 1..23: note = Synthetic Construct
  source 1..23: mol_type = other DNA
tgccagaaaggtctcctgataca

SEQ ID NO: 20990 - DNA, 26 bp, synthetic construct
  misc_feature 1..26: note = Synthetic Construct
  source 1..26: mol_type = other DNA
gagactgttaggttaatcctgtgcta

SEQ ID NO: 20991 - DNA, 23 bp, synthetic construct
  misc_feature 1..23: note = Synthetic Construct
  source 1..23: mol_type = other DNA
ggcacatgtttgctcttggcttt

SEQ ID NO: 20992 - DNA, 25 bp, synthetic construct
  misc_feature 1..25: note = Synthetic Construct
  source 1..25: mol_type = other DNA
gggtttactgcctttgagtgcttac

SEQ ID NO: 20993 - DNA, 24 bp, synthetic construct
  misc_feature 1..24: note = Synthetic Construct
  source 1..24: mol_type = other DNA
ggaccgactgctgttgtcctaaag

SEQ ID NO: 20994 - DNA, 26 bp, synthetic construct
  misc_feature 1..26: note = Synthetic Construct
  source 1..26: mol_type = other DNA
cctctgtggctgaacaagaatagaag

SEQ ID NO: 20995 - DNA, 24 bp, synthetic construct
  misc_feature 1..24: note = Synthetic Construct
  source 1..24: mol_type = other DNA
gggcatctctgaaagttgtccaaa

SEQ ID NO: 20996 - DNA, 26 bp, synthetic construct
  misc_feature 1..26: note = Synthetic Construct
  source 1..26: mol_type = other DNA
ggtaaaccaataagcccagagaggaa

SEQ ID NO: 20997 - DNA, 25 bp, synthetic construct
  misc_feature 1..25: note = Synthetic Construct
  source 1..25: mol_type = other DNA
gccacatgtctactgttagccaatc

SEQ ID NO: 20998 - DNA, 23 bp, synthetic construct
  misc_feature 1..23: note = Synthetic Construct
  source 1..23: mol_type = other DNA
ggggaccaatcaggggtactttc

SEQ ID NO: 20999 - DNA, 26 bp, synthetic construct
  misc_feature 1..26: note = Synthetic Construct
  source 1..26: mol_type = other DNA
cagagaggaacttgggaacattcagt

SEQ ID NO: 21000 - DNA, 20 bp, synthetic construct
  misc_feature 1..20: note = Synthetic Construct
  source 1..20: mol_type = other DNA
aggactctgggctgaactga

SEQ ID NO: 21001 - DNA, 22 bp, synthetic construct
  misc_feature 1..22: note = Synthetic Construct
  source 1..22: mol_type = other DNA
cactcactgtcatggcccagtt

SEQ ID NO: 21002 - DNA, 20 bp, synthetic construct
  misc_feature 1..20: note = Synthetic Construct
  source 1..20: mol_type = other DNA
tgcttgccctcggaatgatg

SEQ ID NO: 21003 - DNA, 23 bp, synthetic construct
  misc_feature 1..23: note = Synthetic Construct
  source 1..23: mol_type = other DNA
cagcccaacctaattcaccacaa

SEQ ID NO: 21004 - DNA, 24 bp, synthetic construct
  misc_feature 1..24: note = Synthetic Construct
  source 1..24: mol_type = other DNA
ccactgtcctcatagtgtgcttct

SEQ ID NO: 21005 - DNA, 25 bp, synthetic construct
  misc_feature 1..25: note = Synthetic Construct
  source 1..25: mol_type = other DNA
ggactgaacaagcacagacggtaac

SEQ ID NO: 21006 - DNA, 22 bp, synthetic construct
  misc_feature 1..22: note = Synthetic Construct
  source 1..22: mol_type = other DNA
ggtcaacgggctctgacttttc

SEQ ID NO: 21007 - DNA, 27 bp, synthetic construct
  misc_feature 1..27: note = Synthetic Construct
  source 1..27: mol_type = other DNA
ggaagcttctgatcctcttaagtgcta

SEQ ID NO: 21008 - DNA, 23 bp, synthetic construct
  misc_feature 1..23: note = Synthetic Construct
  source 1..23: mol_type = other DNA
cgtctgcctgtctgtaagggtat

SEQ ID NO: 21009 - DNA, 20 bp, synthetic construct
  misc_feature 1..20: note = Synthetic Construct
  source 1..20: mol_type = other DNA
tctgtctggaggcggagttg

SEQ ID NO: 21010 - DNA, 27 bp, synthetic construct
  misc_feature 1..27: note = Synthetic Construct
  source 1..27: mol_type = other DNA
cctgtgagtaagtgtctcaccaagtct

SEQ ID NO: 21011 - DNA, 22 bp, synthetic construct
  misc_feature 1..22: note = Synthetic Construct
  source 1..22: mol_type = other DNA
tggggtaccatcagggcaattc

SEQ ID NO: 21012 - DNA, 23 bp, synthetic construct
  misc_feature 1..23: note = Synthetic Construct
  source 1..23: mol_type = other DNA
tgcttatgacaggagtggagaga

SEQ ID NO: 21013 - DNA, 20 bp, synthetic construct
  misc_feature 1..20: note = Synthetic Construct
  source 1..20: mol_type = other DNA
cccgattcgccaccttttca

SEQ ID NO: 21014 - DNA, 23 bp, synthetic construct
  misc_feature 1..23: note = Synthetic Construct
  source 1..23: mol_type = other DNA
gtgcctccattccaggaacaagt

SEQ ID NO: 21015 - DNA, 27 bp, synthetic construct
  misc_feature 1..27: note = Synthetic Construct
  source 1..27: mol_type = other DNA
cctacttgaaacaaatcaggtgtgcat

SEQ ID NO: 21016 - DNA, 24 bp, synthetic construct
  misc_feature 1..24: note = Synthetic Construct
  source 1..24: mol_type = other DNA
cagagaactgtggatcaagactga

SEQ ID NO: 21017 - DNA, 24 bp, synthetic construct
  misc_feature 1..24: note = Synthetic Construct
  source 1..24: mol_type = other DNA
ggatcagtctggcttctgatttct

SEQ ID NO: 21018 - DNA, 23 bp, synthetic construct
  misc_feature 1..23: note = Synthetic Construct
  source 1..23: mol_type = other DNA
gaaacccaactctgacacactga

SEQ ID NO: 21019 - DNA, 26 bp, synthetic construct
  misc_feature 1..26: note = Synthetic Construct
  source 1..26: mol_type = other DNA
cccataagacaggaactgagctttga

SEQ ID NO: 21020 - DNA, 22 bp, synthetic construct
  misc_feature 1..22: note = Synthetic Construct
  source 1..22: mol_type = other DNA
cgtggggtaactcatggtctct

SEQ ID NO: 21021 - DNA, 23 bp, synthetic construct
  misc_feature 1..23: note = Synthetic Construct
  source 1..23: mol_type = other DNA
gaccaaaggcaatccagagtgta

SEQ ID NO: 21022 - DNA, 27 bp, synthetic construct
  misc_feature 1..27: note = Synthetic Construct
  source 1..27: mol_type = other DNA
gtttaatgttggttctctgcctagact

SEQ ID NO: 21023 - DNA, 28 bp, synthetic construct
  misc_feature 1..28: note = Synthetic Construct
  source 1..28: mol_type = other DNA
ccataattgctagccacagtttgcttac

SEQ ID NO: 21024 - DNA, 25 bp, synthetic construct
  misc_feature 1..25: note = Synthetic Construct
  source 1..25: mol_type = other DNA
gcacaatcattgctattggccgtaa

SEQ ID NO: 21025 - DNA, 23 bp, synthetic construct
  misc_feature 1..23: note = Synthetic Construct
  source 1..23: mol_type = other DNA
tccacacatcaaacttggagcat

SEQ ID NO: 21026 - DNA, 23 bp, synthetic construct
  misc_feature 1..23: note = Synthetic Construct
  source 1..23: mol_type = other DNA
cctcatctcagactgccgtagaa

SEQ ID NO: 21027 - DNA, 24 bp, synthetic construct
  misc_feature 1..24: note = Synthetic Construct
  source 1..24: mol_type = other DNA
ggatgtgatagctggatcctgaag

SEQ ID NO: 21028 - DNA, 25 bp, synthetic construct
  misc_feature 1..25: note = Synthetic Construct
  source 1..25: mol_type = other DNA
gttccaaggcctattttagcagttg

SEQ ID NO: 21029 - DNA, 25 bp, synthetic construct
  misc_feature 1..25: note = Synthetic Construct
  source 1..25: mol_type = other DNA
gccctctcttcctttgaacttttgt

SEQ ID NO: 21030 - DNA, 26 bp, synthetic construct
  misc_feature 1..26: note = Synthetic Construct
  source 1..26: mol_type = other DNA
ggatgacagcataaagtccagaccaa

SEQ ID NO: 21031 - DNA, 23 bp, synthetic construct
  misc_feature 1..23: note = Synthetic Construct
  source 1..23: mol_type = other DNA
gtcaccacccattggattgttgt

SEQ ID NO: 21032 - DNA, 22 bp, synthetic construct
  misc_feature 1..22: note = Synthetic Construct
  source 1..22: mol_type = other DNA
ccaccccattctctgaccaatc

SEQ ID NO: 21033 - DNA, 24 bp, synthetic construct
  misc_feature 1..24: note = Synthetic Construct
  source 1..24: mol_type = other DNA
ccaaacaaagtgcctcttctttca

SEQ ID NO: 21034 - DNA, 24 bp, synthetic construct
  misc_feature 1..24: note = Synthetic Construct
  source 1..24: mol_type = other DNA
cacctaagtcagcttgtgctcttc

SEQ ID NO: 21035 - DNA, 25 bp, synthetic construct
  misc_feature 1..25: note = Synthetic Construct
  source 1..25: mol_type = other DNA
gtgttgtttggcccataaggtatgt

SEQ ID NO: 21036 - DNA, 26 bp, synthetic construct
  misc_feature 1..26: note = Synthetic Construct
  source 1..26: mol_type = other DNA
caccacacatgccaatgctcatattc

SEQ ID NO: 21037 - DNA, 21 bp, synthetic construct
  misc_feature 1..21: note = Synthetic Construct
  source 1..21: mol_type = other DNA
actgtgcattcaggcaaggtt

SEQ ID NO: 21038 - DNA, 27 bp, synthetic construct
  misc_feature 1..27: note = Synthetic Construct
  source 1..27: mol_type = other DNA
gtgtttgtgtagaaggtttgagtgcta

SEQ ID NO: 21039 - DNA, 21 bp, synthetic construct
  misc_feature 1..21: note = Synthetic Construct
  source 1..21: mol_type = other DNA
cgacaactgcactcctctgaa

SEQ ID NO: 21040 - DNA, 21 bp, synthetic construct
  misc_feature 1..21: note = Synthetic Construct
  source 1..21: mol_type = other DNA
ccatgccctgggctgattgtt

SEQ ID NO: 21041 - DNA, 28 bp, synthetic construct
  misc_feature 1..28: note = Synthetic Construct
  source 1..28: mol_type = other DNA
gcttggctgatgttaaagcttactcctt

SEQ ID NO: 21042 - DNA, 26 bp, synthetic construct
  misc_feature 1..26: note = Synthetic Construct
  source 1..26: mol_type = other DNA
ggtttagttcctggatctcacactga

SEQ ID NO: 21043 - DNA, 25 bp, synthetic construct
  misc_feature 1..25: note = Synthetic Construct
  source 1..25: mol_type = other DNA
gcatctcaggactgagtgactctac

SEQ ID NO: 21044 - DNA, 26 bp, synthetic construct
  misc_feature 1..26: note = Synthetic Construct
  source 1..26: mol_type = other DNA
gacatgggttatggaatgaggcaaat

SEQ ID NO: 21045 - DNA, 23 bp, synthetic construct
  misc_feature 1..23: note = Synthetic Construct
  source 1..23: mol_type = other DNA
gcagtttctctgttgtgggaaga

SEQ ID NO: 21046 - DNA, 26 bp, synthetic construct
  misc_feature 1..26: note = Synthetic Construct
  source 1..26: mol_type = other DNA
cctcccacaattttacccatgtcttc

SEQ ID NO: 21047 - DNA, 24 bp, synthetic construct
  misc_feature 1..24: note = Synthetic Construct
  source 1..24: mol_type = other DNA
cccgtcacaagtctgagtctaagt

SEQ ID NO: 21048 - DNA, 23 bp, synthetic construct
  misc_feature 1..23: note = Synthetic Construct
  source 1..23: mol_type = other DNA
tcccacatgaaggcaaactttct

SEQ ID NO: 21049 - DNA, 25 bp, synthetic construct
  misc_feature 1..25: note = Synthetic Construct
  source 1..25: mol_type = other DNA
agggtgagaaggagttatccaactt

SEQ ID NO: 21050 - DNA, 20 bp, synthetic construct
  misc_feature 1..20: note = Synthetic Construct
  source 1..20: mol_type = other DNA
cccacactggttgtccacat

SEQ ID NO: 21051 - DNA, 24 bp, synthetic construct
  misc_feature 1..24: note = Synthetic Construct
  source 1..24: mol_type = other DNA
cacgtccacctacatctcccttac

SEQ ID NO: 21052 - DNA, 27 bp, synthetic construct
  misc_feature 1..27: note = Synthetic Construct
  source 1..27: mol_type = other DNA
ggttttcagatggtaaagtggtgtcaa

SEQ ID NO: 21053 - DNA, 23 bp, synthetic construct
  misc_feature 1..23: note = Synthetic Construct
  source 1..23: mol_type = other DNA
ccaaagttgaggcaagcatgaca

SEQ ID NO: 21054 - DNA, 23 bp, synthetic construct
  misc_feature 1..23: note = Synthetic Construct
  source 1..23: mol_type = other DNA
tctaggtacagcctgagcattca

SEQ ID NO: 21055 - DNA, 24 bp, synthetic construct
  misc_feature 1..24: note = Synthetic Construct
  source 1..24: mol_type = other DNA
ggcctgactttgtcatggaaggat

SEQ ID NO: 21056 - DNA, 23 bp, synthetic construct
  misc_feature 1..23: note = Synthetic Construct
  source 1..23: mol_type = other DNA
ctgtggctttagctgagagttca

SEQ ID NO: 21057 - DNA, 25 bp, synthetic construct
  misc_feature 1..25: note = Synthetic Construct
  source 1..25: mol_type = other DNA
gaggaagagttgcaatacagccaat

SEQ ID NO: 21058 - DNA, 28 bp, synthetic construct
  misc_feature 1..28: note = Synthetic Construct
  source 1..28: mol_type = other DNA
gggtaatcccagcatgaaatgaggtaaa

SEQ ID NO: 21059 - DNA, 25 bp, synthetic construct
  misc_feature 1..25: note = Synthetic Construct
  source 1..25: mol_type = other DNA
ggacagccactccttagttgtttga

SEQ ID NO: 21060 - DNA, 22 bp, synthetic construct
  misc_feature 1..22: note = Synthetic Construct
  source 1..22: mol_type = other DNA
gggtcatgtctccatccagtga

SEQ ID NO: 21061 - DNA, 23 bp, synthetic construct
  misc_feature 1..23: note = Synthetic Construct
  source 1..23: mol_type = other DNA
ccaggagtgtcaaatcagctctt

SEQ ID NO: 21062 - DNA, 24 bp, synthetic construct
  misc_feature 1..24: note = Synthetic Construct
  source 1..24: mol_type = other DNA
ctcctctccctcattacctctcaa

SEQ ID NO: 21063 - DNA, 22 bp, synthetic construct
  misc_feature 1..22: note = Synthetic Construct
  source 1..22: mol_type = other DNA
cgcatgtccctaatgcgtggat

SEQ ID NO: 21064 - DNA, 22 bp, synthetic construct
  misc_feature 1..22: note = Synthetic Construct
  source 1..22: mol_type = other DNA
gcacagccagcattcccatagt

SEQ ID NO: 21065 - DNA, 24 bp, synthetic construct
  misc_feature 1..24: note = Synthetic Construct
  source 1..24: mol_type = other DNA
cgttgcctacagttctcctctatc

SEQ ID NO: 21066 - DNA, 25 bp, synthetic construct
  misc_feature 1..25: note = Synthetic Construct
  source 1..25: mol_type = other DNA
ccgagaatgtcacttctgctgtatc

SEQ ID NO: 21067 - DNA, 24 bp, synthetic construct
  misc_feature 1..24: note = Synthetic Construct
  source 1..24: mol_type = other DNA
gccaagtctgtggctagaggaagt

SEQ ID NO: 21068 - DNA, 24 bp, synthetic construct
  misc_feature 1..24: note = Synthetic Construct
  source 1..24: mol_type = other DNA
ggctgcccgattcttaaatcattc

SEQ ID NO: 21069 - DNA, 24 bp, synthetic construct
  misc_feature 1..24: note = Synthetic Construct
  source 1..24: mol_type = other DNA
accggaagccttaaccaatttttg

SEQ ID NO: 21070 - DNA, 24 bp, synthetic construct
  misc_feature 1..24: note = Synthetic Construct
  source 1..24: mol_type = other DNA
ccctggaacccctacctgtcttat

SEQ ID NO: 21071 - DNA, 20 bp, synthetic construct
  misc_feature 1..20: note = Synthetic Construct
  source 1..20: mol_type = other DNA
gcccacaacccactgagcat

SEQ ID NO: 21072 - DNA, 26 bp, synthetic construct
  misc_feature 1..26: note = Synthetic Construct
  source 1..26: mol_type = other DNA
gtatttaccccagatgggatgtttca

SEQ ID NO: 21073 - DNA, 22 bp, synthetic construct
  misc_feature 1..22: note = Synthetic Construct
  source 1..22: mol_type = other DNA
cagggctggagttgtgatgagt

SEQ ID NO: 21074 - DNA, 26 bp, synthetic construct
  misc_feature 1..26: note = Synthetic Construct
  source 1..26: mol_type = other DNA
tcccactatcagaacattacctggat

SEQ ID NO: 21075 - DNA, 22 bp, synthetic construct
  misc_feature 1..22: note = Synthetic Construct
  source 1..22: mol_type = other DNA
gtggagcttccacgtgatcctt

SEQ ID NO: 21076 - DNA, 25 bp, synthetic construct
  misc_feature 1..25: note = Synthetic Construct
  source 1..25: mol_type = other DNA
gttcctaccccataggatcaagatg

SEQ ID NO: 21077 - DNA, 23 bp, synthetic construct
  misc_feature 1..23: note = Synthetic Construct
  source 1..23: mol_type = other DNA
ctgaatggtgaacaggacagtct

SEQ ID NO: 21078 - DNA, 24 bp, synthetic construct
  misc_feature 1..24: note = Synthetic Construct
  source 1..24: mol_type = other DNA
tcagccttcgacatctttcattgt

SEQ ID NO: 21079 - DNA, 27 bp, synthetic construct
  misc_feature 1..27: note = Synthetic Construct
  source 1..27: mol_type = other DNA
ggaaagggctcacagaaaattaagaga

SEQ ID NO: 21080 - DNA, 25 bp, synthetic construct
  misc_feature 1..25: note = Synthetic Construct
  source 1..25: mol_type = other DNA
gggctatttccattgtaagcacttt

SEQ ID NO: 21081 - DNA, 26 bp, synthetic construct
  misc_feature 1..26: note = Synthetic Construct
  source 1..26: mol_type = other DNA
cttggtatggtcaagaaaacggaaac

SEQ ID NO: 21082 - DNA, 25 bp, synthetic construct
  misc_feature 1..25: note = Synthetic Construct
  source 1..25: mol_type = other DNA
ggctgagactctaggacaggtaatg

SEQ ID NO: 21083 - DNA, 25 bp, synthetic construct
  misc_feature 1..25: note = Synthetic Construct
  source 1..25: mol_type = other DNA
gcatcgaaagggatgtagtcactta

SEQ ID NO: 21084 - DNA, 26 bp, synthetic construct
  misc_feature 1..26: note = Synthetic Construct
  source 1..26: mol_type = other DNA
cctccccagaggtaataacgatgtag

SEQ ID NO: 21085 - DNA, 23 bp, synthetic construct
  misc_feature 1..23: note = Synthetic Construct
  source 1..23: mol_type = other DNA
caaaaccacacacaacacaccat

SEQ ID NO: 21086 - DNA, 23 bp, synthetic construct
  misc_feature 1..23: note = Synthetic Construct
  source 1..23: mol_type = other DNA
gccaaagaccaaaaccacctaga

SEQ ID NO: 21087 - DNA, 24 bp, synthetic construct
  misc_feature 1..24: note = Synthetic Construct
  source 1..24: mol_type = other DNA
catctcaagcattcacacccagat

SEQ ID NO: 21088 - DNA, 26 bp, synthetic construct
  misc_feature 1..26: note = Synthetic Construct
  source 1..26: mol_type = other DNA
accactcctttcacacaaatcctatg

SEQ ID NO: 21089 - DNA, 27 bp, synthetic construct
  misc_feature 1..27: note = Synthetic Construct
  source 1..27: mol_type = other DNA
ccacgttagatacctgacaacctcaga

SEQ ID NO: 21090 - DNA, 22 bp, synthetic construct
  misc_feature 1..22: note = Synthetic Construct
  source 1..22: mol_type = other DNA
ccctgccaaattttccctggtt

SEQ ID NO: 21091 - DNA, 22 bp, synthetic construct
  misc_feature 1..22: note = Synthetic Construct
  source 1..22: mol_type = other DNA
ggagtcaagcccagccaagttt

SEQ ID NO: 21092 - DNA, 23 bp, synthetic construct
  misc_feature 1..23: note = Synthetic Construct
  source 1..23: mol_type = other DNA
tgagaggcattgggagatagcaa

SEQ ID NO: 21093 - DNA, 24 bp, synthetic construct
  misc_feature 1..24: note = Synthetic Construct
  source 1..24: mol_type = other DNA
ggaagatcctagcaagaggtgaaa

SEQ ID NO: 21094 - DNA, 24 bp, synthetic construct
  misc_feature 1..24: note = Synthetic Construct
  source 1..24: mol_type = other DNA
ccttgccatagcaggtagtagaag

SEQ ID NO: 21095 - DNA, 26 bp, synthetic construct
  misc_feature 1..26: note = Synthetic Construct
  source 1..26: mol_type = other DNA
cacaacctgagtattcccctgtattc

SEQ ID NO: 21096 - DNA, 22 bp, synthetic construct
  misc_feature 1..22: note = Synthetic Construct
  source 1..22: mol_type = other DNA
cccatgctcatcactgcccaat

SEQ ID NO: 21097 - DNA, 25 bp, synthetic construct
  misc_feature 1..25: note = Synthetic Construct
  source 1..25: mol_type = other DNA
ctgaagcaaggcacctatgaactct

SEQ ID NO: 21098 - DNA, 24 bp, synthetic construct
  misc_feature 1..24: note = Synthetic Construct
  source 1..24: mol_type = other DNA
gcatgtcccaaacacttcctgtgt

SEQ ID NO: 21099 - DNA, 25 bp, synthetic construct
  misc_feature 1..25: note = Synthetic Construct
  source 1..25: mol_type = other DNA
ctgcattccattcgcttttccaaat

SEQ ID NO: 21100 - DNA, 24 bp, synthetic construct
  misc_feature 1..24: note = Synthetic Construct
  source 1..24: mol_type = other DNA
aggggagcagagatctagggattc

SEQ ID NO: 21101 - DNA, 22 bp, synthetic construct
  misc_feature 1..22: note = Synthetic Construct
  source 1..22: mol_type = other DNA
ggctgccgttaggatgtagaac

SEQ ID NO: 21102 - DNA, 22 bp, synthetic construct
  misc_feature 1..22: note = Synthetic Construct
  source 1..22: mol_type = other DNA
cacacaaacctgagcagccatt

SEQ ID NO: 21103 - DNA, 24 bp, synthetic construct
  misc_feature 1..24: note = Synthetic Construct
  source 1..24: mol_type = other DNA
cacttgccttacaaccacctgatg

SEQ ID NO: 21104 - DNA, 22 bp, synthetic construct
  misc_feature 1..22: note = Synthetic Construct
  source 1..22: mol_type = other DNA
cacttccacttccaccccttga

SEQ ID NO: 21105 - DNA, 24 bp, synthetic construct
  misc_feature 1..24: note = Synthetic Construct
  source 1..24: mol_type = other DNA
tgttgccagtaatatacgccatct

SEQ ID NO: 21106 - DNA, 24 bp, synthetic construct
  misc_feature 1..24: note = Synthetic Construct
  source 1..24: mol_type = other DNA
gcccatagcttcctaaacctccat

SEQ ID NO: 21107 - DNA, 26 bp, synthetic construct
  misc_feature 1..26: note = Synthetic Construct
  source 1..26: mol_type = other DNA
ccaaacctgtaatttgctgaggtaca

SEQ ID NO: 21108 - DNA, 26 bp, synthetic construct
  misc_feature 1..26: note = Synthetic Construct
  source 1..26: mol_type = other DNA
gccattgtgtggaagacatagtgtga

SEQ ID NO: 21109 - DNA, 24 bp, synthetic construct
  misc_feature 1..24: note = Synthetic Construct
  source 1..24: mol_type = other DNA
gattcagacccagactccagattt

SEQ ID NO: 21110 - DNA, 22 bp, synthetic construct
  misc_feature 1..22: note = Synthetic Construct
  source 1..22: mol_type = other DNA
ctcctgcggtgtttttgtctct

SEQ ID NO: 21111 - DNA, 27 bp, synthetic construct
  misc_feature 1..27: note = Synthetic Construct
  source 1..27: mol_type = other DNA
cctggtttacatctactcccaactttc

SEQ ID NO: 21112 - DNA, 26 bp, synthetic construct
  misc_feature 1..26: note = Synthetic Construct
  source 1..26: mol_type = other DNA
gctaaggaggattctaaaggtgctaa

SEQ ID NO: 21113 - DNA, 23 bp, synthetic construct
  misc_feature 1..23: note = Synthetic Construct
  source 1..23: mol_type = other DNA
cagtcactgcttgaacaccatgt

SEQ ID NO: 21114 - DNA, 23 bp, synthetic construct
  misc_feature 1..23: note = Synthetic Construct
  source 1..23: mol_type = other DNA
gccaggagctttgagagcttgta

SEQ ID NO: 21115 - DNA, 25 bp, synthetic construct
  misc_feature 1..25: note = Synthetic Construct
  source 1..25: mol_type = other DNA
tgacttgggagaccattcatttcaa

SEQ ID NO: 21116 - DNA, 26 bp, synthetic construct
  misc_feature 1..26: note = Synthetic Construct
  source 1..26: mol_type = other DNA
gcatttaaggggtattcgtgggacta

SEQ ID NO: 21117 - DNA, 23 bp, synthetic construct
  misc_feature 1..23: note = Synthetic Construct
  source 1..23: mol_type = other DNA
gggcagtttgtgtcacagtcttt

SEQ ID NO: 21118 - DNA, 24 bp, synthetic construct
  misc_feature 1..24: note = Synthetic Construct
  source 1..24: mol_type = other DNA
ctgcaagctgtggttttcagtttc

SEQ ID NO: 21119 - DNA, 26 bp, synthetic construct
  misc_feature 1..26: note = Synthetic Construct
  source 1..26: mol_type = other DNA
cagattccagccacaaatatctcatc

SEQ ID NO: 21120 - DNA, 22 bp, synthetic construct
  misc_feature 1..22: note = Synthetic Construct
  source 1..22: mol_type = other DNA
ttgggaaaccagggtccagaga

SEQ ID NO: 21121 - DNA, 21 bp, synthetic construct
  misc_feature 1..21: note = Synthetic Construct
  source 1..21: mol_type = other DNA
gcaggaggtaactggggcata

SEQ ID NO: 21122 - DNA, 26 bp, synthetic construct
  misc_feature 1..26: note = Synthetic Construct
  source 1..26: mol_type = other DNA
gctgagcattttacactgaccctttg

SEQ ID NO: 21123 - DNA, 23 bp, synthetic construct
  misc_feature 1..23: note = Synthetic Construct
  source 1..23: mol_type = other DNA
agggtaagctgaggcaagtttag

SEQ ID NO: 21124 - DNA, 27 bp, synthetic construct
  misc_feature 1..27: note = Synthetic Construct
  source 1..27: mol_type = other DNA
ggcttgttcttatggtagggttccaaa

SEQ ID NO: 21125 - DNA, 24 bp, synthetic construct
  misc_feature 1..24: note = Synthetic Construct
  source 1..24: mol_type = other DNA
ggtggaagaatgaggctgtacctt

SEQ ID NO: 21126 - DNA, 21 bp, synthetic construct
  misc_feature 1..21: note = Synthetic Construct
  source 1..21: mol_type = other DNA
ggtaggcaatggcctggtatt

SEQ ID NO: 21127 - DNA, 25 bp, synthetic construct
  misc_feature 1..25: note = Synthetic Construct
  source 1..25: mol_type = other DNA
ctgtggactctttcatcttgcatgt

SEQ ID NO: 21128 - DNA, 27 bp, synthetic construct
  misc_feature 1..27: note = Synthetic Construct
  source 1..27: mol_type = other DNA
caagaggggaaaaatcctctttagaca

SEQ ID NO: 21129 - DNA, 25 bp, synthetic construct
  misc_feature 1..25: note = Synthetic Construct
  source 1..25: mol_type = other DNA
ccaagtaacactgcagctttaagaa

SEQ ID NO: 21130 - DNA, 22 bp, synthetic construct
  misc_feature 1..22: note = Synthetic Construct
  source 1..22: mol_type = other DNA
gctctgtcatccccagctgaaa

SEQ ID NO: 21131 - DNA, 22 bp, synthetic construct
  misc_feature 1..22: note = Synthetic Construct
  source 1..22: mol_type = other DNA
ctgccaacagcacttgtcatac

SEQ ID NO: 21132 - DNA, 27 bp, synthetic construct
  misc_feature 1..27: note = Synthetic Construct
  source 1..27: mol_type = other DNA
ctggggtaaaaggaggttatcaagcat

SEQ ID NO: 21133 - DNA, 24 bp, synthetic construct
  misc_feature 1..24: note = Synthetic Construct
  source 1..24: mol_type = other DNA
ctctctccctgcttagatgtttgt

SEQ ID NO: 21134 - DNA, 27 bp, synthetic construct
  misc_feature 1..27: note = Synthetic Construct
  source 1..27: mol_type = other DNA
cggctaagctaacgatattccatctct

SEQ ID NO: 21135 - DNA, 23 bp, synthetic construct
  misc_feature 1..23: note = Synthetic Construct
  source 1..23: mol_type = other DNA
ggctcccatttgttgtcggctaa

SEQ ID NO: 21136 - DNA, 23 bp, synthetic construct
  misc_feature 1..23: note = Synthetic Construct
  source 1..23: mol_type = other DNA
ccgcttagccaatatgccctttg

SEQ ID NO: 21137 - DNA, 26 bp, synthetic construct
  misc_feature 1..26: note = Synthetic Construct
  source 1..26: mol_type = other DNA
gaacacaggtcagtttcaggtagatg

SEQ ID NO: 21138 - DNA, 28 bp, synthetic construct
  misc_feature 1..28: note = Synthetic Construct
  source 1..28: mol_type = other DNA
cagtgttctgtttaaggtcacctcttct

SEQ ID NO: 21139 - DNA, 22 bp, synthetic construct
  misc_feature 1..22: note = Synthetic Construct
  source 1..22: mol_type = other DNA
gctcagagcagcactcgttttg

SEQ ID NO: 21140 - DNA, 22 bp, synthetic construct
  misc_feature 1..22: note = Synthetic Construct
  source 1..22: mol_type = other DNA
ccacagctcagattgactcaca

SEQ ID NO: 21141 - DNA, 23 bp, synthetic construct
  misc_feature 1..23: note = Synthetic Construct
  source 1..23: mol_type = other DNA
ccctcagcaatgtcgctagtagt

SEQ ID NO: 21142 - DNA, 22 bp, synthetic construct
  misc_feature 1..22: note = Synthetic Construct
  source 1..22: mol_type = other DNA
ggagcacatggtgactctctga

SEQ ID NO: 21143 - DNA, 24 bp, synthetic construct
  misc_feature 1..24: note = Synthetic Construct
  source 1..24: mol_type = other DNA
cggtgggtcctacacctgagaata

SEQ ID NO: 21144 - DNA, 22 bp, synthetic construct
  misc_feature 1..22: note = Synthetic Construct
  source 1..22: mol_type = other DNA
ccccaatctgtgccttcatgtt

SEQ ID NO: 21145 - DNA, 24 bp, synthetic construct
  misc_feature 1..24: note = Synthetic Construct
  source 1..24: mol_type = other DNA
cctcaggcataaagccaggtcagt

SEQ ID NO: 21146 - DNA, 24 bp, synthetic construct
  misc_feature 1..24: note = Synthetic Construct
  source 1..24: mol_type = other DNA
tcatccaagagttctaccctgtct

SEQ ID NO: 21147 - DNA, 26 bp, synthetic construct
  misc_feature 1..26: note = Synthetic Construct
  source 1..26: mol_type = other DNA
cctttctacacatccagcctaagttc

SEQ ID NO: 21148 - DNA, 25 bp, synthetic construct
  misc_feature 1..25: note = Synthetic Construct
  source 1..25: mol_type = other DNA
gacagtccctcactgagtaggttga

SEQ ID NO: 21149 - DNA, 25 bp, synthetic construct
  misc_feature 1..25: note = Synthetic Construct
  source 1..25: mol_type = other DNA
gcctcaggatacttttagcagaaga

SEQ ID NO: 21150 - DNA, 23 bp, synthetic construct
  misc_feature 1..23: note = Synthetic Construct
  source 1..23: mol_type = other DNA
gaacccaggcatagagagtctga

SEQ ID NO: 21151 - DNA, 22 bp, synthetic construct
  misc_feature 1..22: note = Synthetic Construct
  source 1..22: mol_type = other DNA
gtagctggaatgcacagcctta

SEQ ID NO: 21152 - DNA, 20 bp, synthetic construct
  misc_feature 1..20: note = Synthetic Construct
  source 1..20: mol_type = other DNA
cccgtgacgaaagcttccaa

SEQ ID NO: 21153 - DNA, 23 bp, synthetic construct
  misc_feature 1..23: note = Synthetic Construct
  source 1..23: mol_type = other DNA
gcagacagtgacacacctgtaag

SEQ ID NO: 21154 - DNA, 22 bp, synthetic construct
  misc_feature 1..22: note = Synthetic Construct
  source 1..22: mol_type = other DNA
ccctgactgcctaagctgaaga

SEQ ID NO: 21155 - DNA, 22 bp, synthetic construct
  misc_feature 1..22: note = Synthetic Construct
  source 1..22: mol_type = other DNA
gggtcctcctattgtggtgcaa

SEQ ID NO: 21156 - DNA, 22 bp, synthetic construct
  misc_feature 1..22: note = Synthetic Construct
  source 1..22: mol_type = other DNA
ccaagcctctccccaagctaga

SEQ ID NO: 21157 - DNA, 28 bp, synthetic construct
  misc_feature 1..28: note = Synthetic Construct
  source 1..28: mol_type = other DNA
gcctgaacctatcctactaaatcagtca

SEQ ID NO: 21158 - DNA, 24 bp, synthetic construct
  misc_feature 1..24: note = Synthetic Construct
  source 1..24: mol_type = other DNA
caaggagaatgtgccccttctaaa

SEQ ID NO: 21159 - DNA, 27 bp, synthetic construct
  misc_feature 1..27: note = Synthetic Construct
  source 1..27: mol_type = other DNA
ctgttgttcccaggttggaatgaaatg

SEQ ID NO: 21160 - DNA, 22 bp, synthetic construct
  misc_feature 1..22: note = Synthetic Construct
  source 1..22: mol_type = other DNA
gttccctctttcccctgagtgt

SEQ ID NO: 21161 - DNA, 26 bp, synthetic construct
  misc_feature 1..26: note = Synthetic Construct
  source 1..26: mol_type = other DNA
tccaggtaatgtgtgaagggtttatg

SEQ ID NO: 21162 - DNA, 29 bp, synthetic construct
  misc_feature 1..29: note = Synthetic Construct
  source 1..29: mol_type = other DNA
ggctgatggctaaaacttactgtttccta

SEQ ID NO: 21163 - DNA, 24 bp, synthetic construct
  misc_feature 1..24: note = Synthetic Construct
  source 1..24: mol_type = other DNA
tctcctccttccatcctcttttga

SEQ ID NO: 21164 - DNA, 23 bp, synthetic construct
  misc_feature 1..23: note = Synthetic Construct
  source 1..23: mol_type = other DNA
ctgacactggcttttgactggaa

SEQ ID NO: 21165 - DNA, 24 bp, synthetic construct
  misc_feature 1..24: note = Synthetic Construct
  source 1..24: mol_type = other DNA
gcatgattcccagttcctagatgt

SEQ ID NO: 21166 - DNA, 24 bp, synthetic construct
  misc_feature 1..24: note = Synthetic Construct
  source 1..24: mol_type = other DNA
gctgtgaactgtggaaaacacaga

SEQ ID NO: 21167 - DNA, 27 bp, synthetic construct
  misc_feature 1..27: note = Synthetic Construct
  source 1..27: mol_type = other DNA
ggcattgggaaacttgagctatgtact

SEQ ID NO: 21168 - DNA, 23 bp, synthetic construct
  misc_feature 1..23: note = Synthetic Construct
  source 1..23: mol_type = other DNA
ggctgtgtgtgttctctggtcat

SEQ ID NO: 21169 - DNA, 24 bp, synthetic construct
  misc_feature 1..24: note = Synthetic Construct
  source 1..24: mol_type = other DNA
ggtggcagagaaagcctaaaattc

SEQ ID NO: 21170 - DNA, 25 bp, synthetic construct
  misc_feature 1..25: note = Synthetic Construct
  source 1..25: mol_type = other DNA
cccagcacacacttaaaaagaacaa

SEQ ID NO: 21171 - DNA, 23 bp, synthetic construct
  misc_feature 1..23: note = Synthetic Construct
  source 1..23: mol_type = other DNA
gctcctgtacttgccaatagcat

SEQ ID NO: 21172 - DNA, 25 bp, synthetic construct
  misc_feature 1..25: note = Synthetic Construct
  source 1..25: mol_type = other DNA
ccccttatgtccttccttaccacat

SEQ ID NO: 21173 - DNA, 23 bp, synthetic construct
  misc_feature 1..23: note = Synthetic Construct
  source 1..23: mol_type = other DNA
gctgccttgctttcttggtgaca

SEQ ID NO: 21174 - DNA, 25 bp, synthetic construct
  misc_feature 1..25: note = Synthetic Construct
  source 1..25: mol_type = other DNA
acactccagtaaaacgttccttaca

SEQ ID NO: 21175 - DNA, 22 bp, synthetic construct
  misc_feature 1..22: note = Synthetic Construct
  source 1..22: mol_type = other DNA
ttccttgtggtggtccaagatg

SEQ ID NO: 21176 - DNA, 25 bp, synthetic construct
  misc_feature 1..25: note = Synthetic Construct
  source 1..25: mol_type = other DNA
gtcaccacagaaacacacctttaac

SEQ ID NO: 21177 - DNA, 22 bp, synthetic construct
  misc_feature 1..22: note = Synthetic Construct
  source 1..22: mol_type = other DNA
ctgccctgaatcctactgtgtt

SEQ ID NO: 21178 - DNA, 26 bp, synthetic construct
  misc_feature 1..26: note = Synthetic Construct
  source 1..26: mol_type = other DNA
ggtgcattttggactagcagaagcat

SEQ ID NO: 21179 - DNA, 22 bp, synthetic construct
  misc_feature 1..22: note = Synthetic Construct
  source 1..22: mol_type = other DNA
tcctgaggctattggcggaact

SEQ ID NO: 21180 - DNA, 25 bp, synthetic construct
  misc_feature 1..25: note = Synthetic Construct
  source 1..25: mol_type = other DNA
gctgttggtttcattttggagaaac

SEQ ID NO: 21181 - DNA, 28 bp, synthetic construct
  misc_feature 1..28: note = Synthetic Construct
  source 1..28: mol_type = other DNA
gagatgctatttttggtggatggcaaag

SEQ ID NO: 21182 - DNA, 24 bp, synthetic construct
  misc_feature 1..24: note = Synthetic Construct
  source 1..24: mol_type = other DNA
gccatccttcatggtagagacact

SEQ ID NO: 21183 - DNA, 25 bp, synthetic construct
  misc_feature 1..25: note = Synthetic Construct
  source 1..25: mol_type = other DNA
ggaacagcaaggttgctagtctgta

SEQ ID NO: 21184 - DNA, 24 bp, synthetic construct
  misc_feature 1..24: note = Synthetic Construct
  source 1..24: mol_type = other DNA
gtgacaaacccacttccaggattg

SEQ ID NO: 21185 - DNA, 23 bp, synthetic construct
  misc_feature 1..23: note = Synthetic Construct
  source 1..23: mol_type = other DNA
gctgttctcacagacacactgtt

SEQ ID NO: 21186 - DNA, 23 bp, synthetic construct
  misc_feature 1..23: note = Synthetic Construct
  source 1..23: mol_type = other DNA
ctgcccttcctgttttcctgcta

SEQ ID NO: 21187 - DNA, 23 bp, synthetic construct
  misc_feature 1..23: note = Synthetic Construct
  source 1..23: mol_type = other DNA
gcagcccaatagcagaactgtgt

SEQ ID NO: 21188 - DNA, 22 bp, synthetic construct
  misc_feature 1..22: note = Synthetic Construct
  source 1..22: mol_type = other DNA
tgctggagtagaccaagagtca

SEQ ID NO: 21189 - DNA, 20 bp, synthetic construct
  misc_feature 1..20: note = Synthetic Construct
  source 1..20: mol_type = other DNA
aacgtgggccattcctccta

SEQ ID NO: 21190 - DNA, 23 bp, synthetic construct
  misc_feature 1..23: note = Synthetic Construct
  source 1..23: mol_type = other DNA
cactttctggctcacagatggta

SEQ ID NO: 21191 - DNA, 30 bp, synthetic construct
  misc_feature 1..30: note = Synthetic Construct
  source 1..30: mol_type = other DNA
gtgttttggctgtactatctctagtgcaaa

SEQ ID NO: 21192 - DNA, 25 bp, synthetic construct
  misc_feature 1..25: note = Synthetic Construct
  source 1..25: mol_type = other DNA
cacaaaaccagtgtccccagtattc

SEQ ID NO: 21193 - DNA, 23 bp, synthetic construct
  misc_feature 1..23: note = Synthetic Construct
  source 1..23: mol_type = other DNA
gctcttccaagcctttcattgtt

SEQ ID NO: 21194 - DNA, 26 bp, synthetic construct
  misc_feature 1..26: note = Synthetic Construct
  source 1..26: mol_type = other DNA
gggactatcctgaagcatgtaaaagt

SEQ ID NO: 21195 - DNA, 23 bp, synthetic construct
  misc_feature 1..23: note = Synthetic Construct
  source 1..23: mol_type = other DNA
tctggacttgacagtgacagatg

SEQ ID NO: 21196 - DNA, 25 bp, synthetic construct
  misc_feature 1..25: note = Synthetic Construct
  source 1..25: mol_type = other DNA
gtaagaaaagcttcactggaacaca

SEQ ID NO: 21197 - DNA, 23 bp, synthetic construct
  misc_feature 1..23: note = Synthetic Construct
  source 1..23: mol_type = other DNA
cggctcatttgcaatgggcatca

SEQ ID NO: 21198 - DNA, 21 bp, synthetic construct
  misc_feature 1..21: note = Synthetic Construct
  source 1..21: mol_type = other DNA
gggaactgcaggccatagaca

SEQ ID NO: 21199 - DNA, 23 bp, synthetic construct
  misc_feature 1..23: note = Synthetic Construct
  source 1..23: mol_type = other DNA
ccctgcctctaatcctccagtgt

SEQ ID NO: 21200 - DNA, 21 bp, synthetic construct
  misc_feature 1..21: note = Synthetic Construct
  source 1..21: mol_type = other DNA
tttccctgccctgggctcaca

SEQ ID NO: 21201 - DNA, 20 bp, synthetic construct
  misc_feature 1..20: note = Synthetic Construct
  source 1..20: mol_type = other DNA
ggctctgcctcactgtgact

SEQ ID NO: 21202 - DNA, 21 bp, synthetic construct
  misc_feature 1..21: note = Synthetic Construct
  source 1..21: mol_type = other DNA
tcaccctcttactgcctccaa

SEQ ID NO: 21203 - DNA, 26 bp, synthetic construct
  misc_feature 1..26: note = Synthetic Construct
  source 1..26: mol_type = other DNA
gagccagagtgtaaagagggatccta

SEQ ID NO: 21204 - DNA, 22 bp, synthetic construct
  misc_feature 1..22: note = Synthetic Construct
  source 1..22: mol_type = other DNA
caggagggattgtgtggtctga

SEQ ID NO: 21205 - DNA, 23 bp, synthetic construct
  misc_feature 1..23: note = Synthetic Construct
  source 1..23: mol_type = other DNA
gctccaatcccggactagcctta

SEQ ID NO: 21206 - DNA, 20 bp, synthetic construct
  misc_feature 1..20: note = Synthetic Construct
  source 1..20: mol_type = other DNA
gccacgttaagggcccaagt

SEQ ID NO: 21207 - DNA, 25 bp, synthetic construct
  misc_feature 1..25: note = Synthetic Construct
  source 1..25: mol_type = other DNA
gaaaaatagtctgccccatccatct

SEQ ID NO: 21208 - DNA, 24 bp, synthetic construct
  misc_feature 1..24: note = Synthetic Construct
  source 1..24: mol_type = other DNA
cctttgatagcaccactggcaaga

SEQ ID NO: 21209 - DNA, 24 bp, synthetic construct
  misc_feature 1..24: note = Synthetic Construct
  source 1..24: mol_type = other DNA
gaggtgtgttgattgtgctaccta

SEQ ID NO: 21210 - DNA, 21 bp, synthetic construct
  misc_feature 1..21: note = Synthetic Construct
  source 1..21: mol_type = other DNA
ggtgcagatcggtgctcacaa

SEQ ID NO: 21211 - DNA, 29 bp, synthetic construct
  misc_feature 1..29: note = Synthetic Construct
  source 1..29: mol_type = other DNA
ccaaggaaggtggtgaagtattattcagt

SEQ ID NO: 21212 - DNA, 28 bp, synthetic construct
  misc_feature 1..28: note = Synthetic Construct
  source 1..28: mol_type = other DNA
ggacatatgttgcaggtagagctaggaa

SEQ ID NO: 21213 - DNA, 24 bp, synthetic construct
  misc_feature 1..24: note = Synthetic Construct
  source 1..24: mol_type = other DNA
gctagaccaaggatccctctgatg

SEQ ID NO: 21214 - DNA, 22 bp, synthetic construct
  misc_feature 1..22: note = Synthetic Construct
  source 1..22: mol_type = other DNA
tggagtggattcaggcttgcta

SEQ ID NO: 21215 - DNA, 25 bp, synthetic construct
  misc_feature 1..25: note = Synthetic Construct
  source 1..25: mol_type = other DNA
ccttcaacaaaggttaggccacaaa

SEQ ID NO: 21216 - DNA, 23 bp, synthetic construct
  misc_feature 1..23: note = Synthetic Construct
  source 1..23: mol_type = other DNA
agccaaagaaggaggagcttatg

SEQ ID NO: 21217 - DNA, 22 bp, synthetic construct
  misc_feature 1..22: note = Synthetic Construct
  source 1..22: mol_type = other DNA
ggtcctgggcatacagtgattt

SEQ ID NO: 21218 - DNA, 28 bp, synthetic construct
  misc_feature 1..28: note = Synthetic Construct
  source 1..28: mol_type = other DNA
ctgaacacgtacactctatcttcccaaa

SEQ ID NO: 21219 - DNA, 25 bp, synthetic construct
  misc_feature 1..25: note = Synthetic Construct
  source 1..25: mol_type = other DNA
gtgcctgctgataaaaactcactac

SEQ ID NO: 21220 - DNA, 21 bp, synthetic construct
  misc_feature 1..21: note = Synthetic Construct
  source 1..21: mol_type = other DNA
ggcagtgcatcagttcctctt

SEQ ID NO: 21221 - DNA, 25 bp, synthetic construct
  misc_feature 1..25: note = Synthetic Construct
  source 1..25: mol_type = other DNA
gaccagggagcatattactggatca

SEQ ID NO: 21222 - DNA, 20 bp, synthetic construct
  misc_feature 1..20: note = Synthetic Construct
  source 1..20: mol_type = other DNA
gctgggaacagggtttcaca

SEQ ID NO: 21223 - DNA, 23 bp, synthetic construct
  misc_feature 1..23: note = Synthetic Construct
  source 1..23: mol_type = other DNA
cagctgtggtaggggctatagaa

SEQ ID NO: 21224 - DNA, 23 bp, synthetic construct
  misc_feature 1..23: note = Synthetic Construct
  source 1..23: mol_type = other DNA
ccaaaacctccaaagtcgtgaag

SEQ ID NO: 21225 - DNA, 24 bp, synthetic construct
  misc_feature 1..24: note = Synthetic Construct
  source 1..24: mol_type = other DNA
ctaagctcagaagccatccaatct

SEQ ID NO: 21226 - DNA, 27 bp, synthetic construct
  misc_feature 1..27: note = Synthetic Construct
  source 1..27: mol_type = other DNA
ctgaaacagtaggaactcaaggtgcaa

SEQ ID NO: 21227 - DNA, 22 bp, synthetic construct
  misc_feature 1..22: note = Synthetic Construct
  source 1..22: mol_type = other DNA
aggacaaggctgttctggtact

SEQ ID NO: 21228 - DNA, 22 bp, synthetic construct
  misc_feature 1..22: note = Synthetic Construct
  source 1..22: mol_type = other DNA
ggggaaggatagagcagtgcaa

SEQ ID NO: 21229 - DNA, 24 bp, synthetic construct
  misc_feature 1..24: note = Synthetic Construct
  source 1..24: mol_type = other DNA
gtgtgtaggtgagcctgaccaaag

SEQ ID NO: 21230 - DNA, 22 bp, synthetic construct
  misc_feature 1..22: note = Synthetic Construct
  source 1..22: mol_type = other DNA
ggctaccaactagccagtgctt

SEQ ID NO: 21231 - DNA, 24 bp, synthetic construct
  misc_feature 1..24: note = Synthetic Construct
  source 1..24: mol_type = other DNA
agggcagaacgatgtaaaaacaac

SEQ ID NO: 21232 - DNA, 26 bp, synthetic construct
  misc_feature 1..26: note = Synthetic Construct
  source 1..26: mol_type = other DNA
tcctacctaatctaaccctcatgcta

SEQ ID NO: 21233 - DNA, 22 bp, synthetic construct
  misc_feature 1..22: note = Synthetic Construct
  source 1..22: mol_type = other DNA
gccgtgaacaggcttactctca

SEQ ID NO: 21234 - DNA, 28 bp, synthetic construct
  misc_feature 1..28: note = Synthetic Construct
  source 1..28: mol_type = other DNA
cctctaggaatttaactccacccacaac

SEQ ID NO: 21235 - DNA, 22 bp, synthetic construct
  misc_feature 1..22: note = Synthetic Construct
  source 1..22: mol_type = other DNA
acggtcctaccagtgttgatga

SEQ ID NO: 21236 - DNA, 24 bp, synthetic construct
  misc_feature 1..24: note = Synthetic Construct
  source 1..24: mol_type = other DNA
gggaggtggaagacatgatggata

SEQ ID NO: 21237 - DNA, 25 bp, synthetic construct
  misc_feature 1..25: note = Synthetic Construct
  source 1..25: mol_type = other DNA
gttgagtgatggcaaaatgggtgaa

SEQ ID NO: 21238 - DNA, 22 bp, synthetic construct
  misc_feature 1..22: note = Synthetic Construct
  source 1..22: mol_type = other DNA
cccagtccccttttccactaga

SEQ ID NO: 21239 - DNA, 28 bp, synthetic construct
  misc_feature 1..28: note = Synthetic Construct
  source 1..28: mol_type = other DNA
gcctgtttgctctctatacccataccta

SEQ ID NO: 21240 - DNA, 24 bp, synthetic construct
  misc_feature 1..24: note = Synthetic Construct
  source 1..24: mol_type = other DNA
ggctttgccacttgtcatgctaac

SEQ ID NO: 21241 - DNA, 24 bp, synthetic construct
  misc_feature 1..24: note = Synthetic Construct
  source 1..24: mol_type = other DNA
gctgtggatagcagtagcaacact

SEQ ID NO: 21242 - DNA, 24 bp, synthetic construct
  misc_feature 1..24: note = Synthetic Construct
  source 1..24: mol_type = other DNA
ggagcctctctctgggttctatct

SEQ ID NO: 21243 - DNA, 22 bp, synthetic construct
  misc_feature 1..22: note = Synthetic Construct
  source 1..22: mol_type = other DNA
gcccaacccctaaagactgaca

SEQ ID NO: 21244 - DNA, 23 bp, synthetic construct
  misc_feature 1..23: note = Synthetic Construct
  source 1..23: mol_type = other DNA
gtggctgctgttagacgtgttag

SEQ ID NO: 21245 - DNA, 22 bp, synthetic construct
  misc_feature 1..22: note = Synthetic Construct
  source 1..22: mol_type = other DNA
gcctcacacagggaatgagaga

SEQ ID NO: 21246 - DNA, 26 bp, synthetic construct
  misc_feature 1..26: note = Synthetic Construct
  source 1..26: mol_type = other DNA
ctgggttcaaagctaattctgccatt

SEQ ID NO: 21247 - DNA, 24 bp, synthetic construct
  misc_feature 1..24: note = Synthetic Construct
  source 1..24: mol_type = other DNA
agcctctgaactgtaagatgcaaa

SEQ ID NO: 21248 - DNA, 22 bp, synthetic construct
  misc_feature 1..22: note = Synthetic Construct
  source 1..22: mol_type = other DNA
cacacagccagccagtcctatt

SEQ ID NO: 21249 - DNA, 21 bp, synthetic construct
  misc_feature 1..21: note = Synthetic Construct
  source 1..21: mol_type = other DNA
ccggatcctcaacccaagaag

SEQ ID NO: 21250 - DNA, 25 bp, synthetic construct
  misc_feature 1..25: note = Synthetic Construct
  source 1..25: mol_type = other DNA
agtggaatgtcttgaaggagagatg

SEQ ID NO: 21251 - DNA, 24 bp, synthetic construct
  misc_feature 1..24: note = Synthetic Construct
  source 1..24: mol_type = other DNA
gggagaatgagtgactgctgacat

SEQ ID NO: 21252 - DNA, 24 bp, synthetic construct
  misc_feature 1..24: note = Synthetic Construct
  source 1..24: mol_type = other DNA
gttctggccaaccttactgtcttc

SEQ ID NO: 21253 - DNA, 22 bp, synthetic construct
  misc_feature 1..22: note = Synthetic Construct
  source 1..22: mol_type = other DNA
ccgagttccaggctaggagtat

SEQ ID NO: 21254 - DNA, 23 bp, synthetic construct
  misc_feature 1..23: note = Synthetic Construct
  source 1..23: mol_type = other DNA
ccagtggagactttcaccccata

SEQ ID NO: 21255 - DNA, 26 bp, synthetic construct
  misc_feature 1..26: note = Synthetic Construct
  source 1..26: mol_type = other DNA
cctcaatgtagacaaggaagatgtca

SEQ ID NO: 21256 - DNA, 22 bp, synthetic construct
  misc_feature 1..22: note = Synthetic Construct
  source 1..22: mol_type = other DNA
gtgaagcctgggtgtagctttg

SEQ ID NO: 21257 - DNA, 21 bp, synthetic construct
  misc_feature 1..21: note = Synthetic Construct
  source 1..21: mol_type = other DNA
tgtaccaggtggctgctcttg

SEQ ID NO: 21258 - DNA, 25 bp, synthetic construct
  misc_feature 1..25: note = Synthetic Construct
  source 1..25: mol_type = other DNA
cggtttaagttcagcaggaaaaagt

SEQ ID NO: 21259 - DNA, 22 bp, synthetic construct
  misc_feature 1..22: note = Synthetic Construct
  source 1..22: mol_type = other DNA
tggctcagagatcgtcccttct

SEQ ID NO: 21260 - DNA, 27 bp, synthetic construct
  misc_feature 1..27: note = Synthetic Construct
  source 1..27: mol_type = other DNA
ggttcaaagacaactgtgaagcgatga

SEQ ID NO: 21261 - DNA, 28 bp, synthetic construct
  misc_feature 1..28: note = Synthetic Construct
  source 1..28: mol_type = other DNA
gacctatgggctttacaattggagtaga

SEQ ID NO: 21262 - DNA, 23 bp, synthetic construct
  misc_feature 1..23: note = Synthetic Construct
  source 1..23: mol_type = other DNA
ccagaaggctttgagccatcaca

SEQ ID NO: 21263 - DNA, 24 bp, synthetic construct
  misc_feature 1..24: note = Synthetic Construct
  source 1..24: mol_type = other DNA
ctctctgagcagctgaagttctgt

SEQ ID NO: 21264 - DNA, 21 bp, synthetic construct
  misc_feature 1..21: note = Synthetic Construct
  source 1..21: mol_type = other DNA
caccggcatatgtgccaagaa

SEQ ID NO: 21265 - DNA, 24 bp, synthetic construct
  misc_feature 1..24: note = Synthetic Construct
  source 1..24: mol_type = other DNA
gaatcctttgaacccaggactttg

SEQ ID NO: 21266 - DNA, 22 bp, synthetic construct
  misc_feature 1..22: note = Synthetic Construct
  source 1..22: mol_type = other DNA
ggtgtagccacgtcccaattct

SEQ ID NO: 21267 - DNA, 26 bp, synthetic construct
  misc_feature 1..26: note = Synthetic Construct
  source 1..26: mol_type = other DNA
ccaaacggatgtatgtaggacaccaa

SEQ ID NO: 21268 - DNA, 25 bp, synthetic construct
  misc_feature 1..25: note = Synthetic Construct
  source 1..25: mol_type = other DNA
cttcctgtgattgctttccctttga

SEQ ID NO: 21269 - DNA, 26 bp, synthetic construct
  misc_feature 1..26: note = Synthetic Construct
  source 1..26: mol_type = other DNA
gacagttggctgacgatattctcctt

SEQ ID NO: 21270 - DNA, 24 bp, synthetic construct
  misc_feature 1..24: note = Synthetic Construct
  source 1..24: mol_type = other DNA
ccccttgaaactggcttatactct

SEQ ID NO: 21271 - DNA, 23 bp, synthetic construct
  misc_feature 1..23: note = Synthetic Construct
  source 1..23: mol_type = other DNA
ggtgaccaagggtaggtatgaca

SEQ ID NO: 21272 - DNA, 24 bp, synthetic construct
  misc_feature 1..24: note = Synthetic Construct
  source 1..24: mol_type = other DNA
ggaagtgaccaagctgacatggaa

SEQ ID NO: 21273 - DNA, 24 bp, synthetic construct
  misc_feature 1..24: note = Synthetic Construct
  source 1..24: mol_type = other DNA
ccgtggagttggtttgagggagat

SEQ ID NO: 21274 - DNA, 23 bp, synthetic construct
  misc_feature 1..23: note = Synthetic Construct
  source 1..23: mol_type = other DNA
cgcccaggtacagagaatagcat

SEQ ID NO: 21275 - DNA, 23 bp, synthetic construct
  misc_feature 1..23: note = Synthetic Construct
  source 1..23: mol_type = other DNA
ccacctggtgaacttgagcttga

SEQ ID NO: 21276 - DNA, 22 bp, synthetic construct
  misc_feature 1..22: note = Synthetic Construct
  source 1..22: mol_type = other DNA
gatcccagttgtgtgcccttag

SEQ ID NO: 21277 - DNA, 24 bp, synthetic construct
  misc_feature 1..24: note = Synthetic Construct
  source 1..24: mol_type = other DNA
gggtggtgaggagatcagactgta

SEQ ID NO: 21278 - DNA, 24 bp, synthetic construct
  misc_feature 1..24: note = Synthetic Construct
  source 1..24: mol_type = other DNA
cacacacagagaaaaggtcacttc

SEQ ID NO: 21279 - DNA, 27 bp, synthetic construct
  misc_feature 1..27: note = Synthetic Construct
  source 1..27: mol_type = other DNA
gcaagcctaatcgggattttagctctt

SEQ ID NO: 21280 - DNA, 23 bp, synthetic construct
  misc_feature 1..23: note = Synthetic Construct
  source 1..23: mol_type = other DNA
ggagaacagagccacatgctaac

SEQ ID NO: 21281 - DNA, 23 bp, synthetic construct
  misc_feature 1..23: note = Synthetic Construct
  source 1..23: mol_type = other DNA
gctcctcgtggaatcctgaaatg

SEQ ID NO: 21282 - DNA, 26 bp, synthetic construct
  misc_feature 1..26: note = Synthetic Construct
  source 1..26: mol_type = other DNA
gccctctgagagtagtcaggaaacta

SEQ ID NO: 21283 - DNA, 26 bp, synthetic construct
  misc_feature 1..26: note = Synthetic Construct
  source 1..26: mol_type = other DNA
gctggtatggagaacaattcctgaca

SEQ ID NO: 21284 - DNA, 23 bp, synthetic construct
  misc_feature 1..23: note = Synthetic Construct
  source 1..23: mol_type = other DNA
ccctctcttgcctggtctatttt

SEQ ID NO: 21285 - DNA, 23 bp, synthetic construct
  misc_feature 1..23: note = Synthetic Construct
  source 1..23: mol_type = other DNA
ccctgcattccttcttcttggat

SEQ ID NO: 21286 - DNA, 27 bp, synthetic construct
  misc_feature 1..27: note = Synthetic Construct
  source 1..27: mol_type = other DNA
gcaaggaatcttgtgtctctatgattg

SEQ ID NO: 21287 - DNA, 26 bp, synthetic construct
  misc_feature 1..26: note = Synthetic Construct
  source 1..26: mol_type = other DNA
ctggaggaataccaatcagacgacaa

SEQ ID NO: 21288 - DNA, 23 bp, synthetic construct
  misc_feature 1..23: note = Synthetic Construct
  source 1..23: mol_type = other DNA
atgcaagggtgatgaagaaggaa

SEQ ID NO: 21289 - DNA, 27 bp, synthetic construct
  misc_feature 1..27: note = Synthetic Construct
  source 1..27: mol_type = other DNA
ggagttaagagggagttgaagtcaaag

SEQ ID NO: 21290 - DNA, 26 bp, synthetic construct
  misc_feature 1..26: note = Synthetic Construct
  source 1..26: mol_type = other DNA
actctgcctctgagattctagatagt

SEQ ID NO: 21291 - DNA, 22 bp, synthetic construct
  misc_feature 1..22: note = Synthetic Construct
  source 1..22: mol_type = other DNA
tcctcattcctcagagctgaca

SEQ ID NO: 21292 - DNA, 20 bp, synthetic construct
  misc_feature 1..20: note = Synthetic Construct
  source 1..20: mol_type = other DNA
gacgggtactacgggtccat

SEQ ID NO: 21293 - DNA, 26 bp, synthetic construct
  misc_feature 1..26: note = Synthetic Construct
  source 1..26: mol_type = other DNA
gactgcctctatgaagccatttccta

SEQ ID NO: 21294 - DNA, 24 bp, synthetic construct
  misc_feature 1..24: note = Synthetic Construct
  source 1..24: mol_type = other DNA
cagccacaaggaacaatctcaaaa

SEQ ID NO: 21295 - DNA, 20 bp, synthetic construct
  misc_feature 1..20: note = Synthetic Construct
  source 1..20: mol_type = other DNA
tgccagctctgcctctctaa

SEQ ID NO: 21296 - DNA, 26 bp, synthetic construct
  misc_feature 1..26: note = Synthetic Construct
  source 1..26: mol_type = other DNA
gagtaggacttcttacatggcagttg

SEQ ID NO: 21297 - DNA, 20 bp, synthetic construct
  misc_feature 1..20: note = Synthetic Construct
  source 1..20: mol_type = other DNA
acagtcacctctgcctgtct

SEQ ID NO: 21298 - DNA, 22 bp, synthetic construct
  misc_feature 1..22: note = Synthetic Construct
  source 1..22: mol_type = other DNA
gggtctgatcaccccaacattc

SEQ ID NO: 21299 - DNA, 28 bp, synthetic construct
  misc_feature 1..28: note = Synthetic Construct
  source 1..28: mol_type = other DNA
cccaggaacttaaatgaaatgggcatac

SEQ ID NO: 21300 - DNA, 20 bp, synthetic construct
  misc_feature 1..20: note = Synthetic Construct
  source 1..20: mol_type = other DNA
tcggagctgtctgggaagtt

SEQ ID NO: 21301 - DNA, 24 bp, synthetic construct
  misc_feature 1..24: note = Synthetic Construct
  source 1..24: mol_type = other DNA
ccacatgcctcctatatgctttgt

SEQ ID NO: 21302 - DNA, 22 bp, synthetic construct
  misc_feature 1..22: note = Synthetic Construct
  source 1..22: mol_type = other DNA
cagcaccactttgcactacttc

SEQ ID NO: 21303 - DNA, 24 bp, synthetic construct
  misc_feature 1..24: note = Synthetic Construct
  source 1..24: mol_type = other DNA
agttctctccagtctcttccagtt

SEQ ID NO: 21304 - DNA, 22 bp, synthetic construct
  misc_feature 1..22: note = Synthetic Construct
  source 1..22: mol_type = other DNA
gccctgagtccattccaagtct

SEQ ID NO: 21305 - DNA, 24 bp, synthetic construct
  misc_feature 1..24: note = Synthetic Construct
  source 1..24: mol_type = other DNA
cgcaaactggtatccctggtcaac

SEQ ID NO: 21306 - DNA, 29 bp, synthetic construct
  misc_feature 1..29: note = Synthetic Construct
  source 1..29: mol_type = other DNA
gaccaatggaagcaactacagaaactttg

SEQ ID NO: 21307 - DNA, 19 bp, synthetic construct
  misc_feature 1..19: note = Synthetic Construct
  source 1..19: mol_type = other DNA
agcgctcttggcctttgtt

SEQ ID NO: 21308 - DNA, 24 bp, synthetic construct
  misc_feature 1..24: note = Synthetic Construct
  source 1..24: mol_type = other DNA
cctccaacattcctcctctacaac

SEQ ID NO: 21309 - DNA, 23 bp, synthetic construct
  misc_feature 1..23: note = Synthetic Construct
  source 1..23: mol_type = other DNA
agggaagtccctggctcctaaag

SEQ ID NO: 21310 - DNA, 25 bp, synthetic construct
  misc_feature 1..25: note = Synthetic Construct
  source 1..25: mol_type = other DNA
caaatggcccagctatatctgattg

SEQ ID NO: 21311 - DNA, 22 bp, synthetic construct
  misc_feature 1..22: note = Synthetic Construct
  source 1..22: mol_type = other DNA
cacccaaggagggctgtaatga

SEQ ID NO: 21312 - DNA, 29 bp, synthetic construct
  misc_feature 1..29: note = Synthetic Construct
  source 1..29: mol_type = other DNA
ccaaagagatctaggacacagacataact

SEQ ID NO: 21313 - DNA, 21 bp, synthetic construct
  misc_feature 1..21: note = Synthetic Construct
  source 1..21: mol_type = other DNA
tccaggtgccattccccattg

SEQ ID NO: 21314 - DNA, 27 bp, synthetic construct
  misc_feature 1..27: note = Synthetic Construct
  source 1..27: mol_type = other DNA
ccaattctcttgttccattagcgagaa

SEQ ID NO: 21315 - DNA, 21 bp, synthetic construct
  misc_feature 1..21: note = Synthetic Construct
  source 1..21: mol_type = other DNA
gtggctcttcccattggcttt

SEQ ID NO: 21316 - DNA, 24 bp, synthetic construct
  misc_feature 1..24: note = Synthetic Construct
  source 1..24: mol_type = other DNA
gcacctgaccatacttgctacact

SEQ ID NO: 21317 - DNA, 26 bp, synthetic construct
  misc_feature 1..26: note = Synthetic Construct
  source 1..26: mol_type = other DNA
acccagatctctgcttctaaaacttg

SEQ ID NO: 21318 - DNA, 29 bp, synthetic construct
  misc_feature 1..29: note = Synthetic Construct
  source 1..29: mol_type = other DNA
cagagctctatactgagctttccctctat

SEQ ID NO: 21319 - DNA, 22 bp, synthetic construct
  misc_feature 1..22: note = Synthetic Construct
  source 1..22: mol_type = other DNA
ccatgcctgctattgccactat

SEQ ID NO: 21320 - DNA, 23 bp, synthetic construct
  misc_feature 1..23: note = Synthetic Construct
  source 1..23: mol_type = other DNA
acatgcaggagcttagagactga

SEQ ID NO: 21321 - DNA, 25 bp, synthetic construct
  misc_feature 1..25: note = Synthetic Construct
  source 1..25: mol_type = other DNA
actggacccttagttccatccatag

SEQ ID NO: 21322 - DNA, 26 bp, synthetic construct
  misc_feature 1..26: note = Synthetic Construct
  source 1..26: mol_type = other DNA
gcatggcagaaaaactacctttgtca

SEQ ID NO: 21323 - DNA, 25 bp, synthetic construct
  misc_feature 1..25: note = Synthetic Construct
  source 1..25: mol_type = other DNA
gcatgtacacagtgcatacctctga

SEQ ID NO: 21324 - DNA, 25 bp, synthetic construct
  misc_feature 1..25: note = Synthetic Construct
  source 1..25: mol_type = other DNA
gtgactcacaccaatgacagttaca

SEQ ID NO: 21325 - DNA, 24 bp, synthetic construct
  misc_feature 1..24: note = Synthetic Construct
  source 1..24: mol_type = other DNA
ccgacgttgtcatctcacattatc

SEQ ID NO: 21326 - DNA, 25 bp, synthetic construct
  misc_feature 1..25: note = Synthetic Construct
  source 1..25: mol_type = other DNA
gctctctgcaaatgggaggatggta

SEQ ID NO: 21327 - DNA, 21 bp, synthetic construct
  misc_feature 1..21: note = Synthetic Construct
  source 1..21: mol_type = other DNA
ctcttggtttccaggcagaca

SEQ ID NO: 21328 - DNA, 20 bp, synthetic construct
  misc_feature 1..20: note = Synthetic Construct
  source 1..20: mol_type = other DNA
ggtggtttgtgtgggtctga

SEQ ID NO: 21329 - DNA, 22 bp, synthetic construct
  misc_feature 1..22: note = Synthetic Construct
  source 1..22: mol_type = other DNA
cctttgtgaatgcctgatgcaa

SEQ ID NO: 21330 - DNA, 23 bp, synthetic construct
  misc_feature 1..23: note = Synthetic Construct
  source 1..23: mol_type = other DNA
ggcaaactccacttcagcaggat

SEQ ID NO: 21331 - DNA, 23 bp, synthetic construct
  misc_feature 1..23: note = Synthetic Construct
  source 1..23: mol_type = other DNA
tccactctggattcctgaacaac

SEQ ID NO: 21332 - DNA, 22 bp, synthetic construct
  misc_feature 1..22: note = Synthetic Construct
  source 1..22: mol_type = other DNA
agggaaccagcaaaaccaatga

SEQ ID NO: 21333 - DNA, 20 bp, synthetic construct
  misc_feature 1..20: note = Synthetic Construct
  source 1..20: mol_type = other DNA
gcggcagtgtttcctctgtt

SEQ ID NO: 21334 - DNA, 27 bp, synthetic construct
  misc_feature 1..27: note = Synthetic Construct
  source 1..27: mol_type = other DNA
gtctaaggaagtctgtaggctgaatac

SEQ ID NO: 21335 - DNA, 23 bp, synthetic construct
  misc_feature 1..23: note = Synthetic Construct
  source 1..23: mol_type = other DNA
agcacttcccctttgatccattc

SEQ ID NO: 21336 - DNA, 22 bp, synthetic construct
  misc_feature 1..22: note = Synthetic Construct
  source 1..22: mol_type = other DNA
ggggacataggcaacaggacaa

SEQ ID NO: 21337 - DNA, 22 bp, synthetic construct
  misc_feature 1..22: note = Synthetic Construct
  source 1..22: mol_type = other DNA
gagcttctcactgtcccctgta

SEQ ID NO: 21338 - DNA, 23 bp, synthetic construct
  misc_feature 1..23: note = Synthetic Construct
  source 1..23: mol_type = other DNA
tgtccaaggaatgggaagggtaa

SEQ ID NO: 21339 - DNA, 22 bp, synthetic construct
  misc_feature 1..22: note = Synthetic Construct
  source 1..22: mol_type = other DNA
cgccccaacagaagaggaagtt

SEQ ID NO: 21340 - DNA, 22 bp, synthetic construct
  misc_feature 1..22: note = Synthetic Construct
  source 1..22: mol_type = other DNA
acgcaatgccttttcagagcta

SEQ ID NO: 21341 - DNA, 23 bp, synthetic construct
  misc_feature 1..23: note = Synthetic Construct
  source 1..23: mol_type = other DNA
ctccattgccctgtcttcagagt

SEQ ID NO: 21342 - DNA, 25 bp, synthetic construct
  misc_feature 1..25: note = Synthetic Construct
  source 1..25: mol_type = other DNA
ggaaaccacaacaatctcactgaag

SEQ ID NO: 21343 - DNA, 22 bp, synthetic construct
  misc_feature 1..22: note = Synthetic Construct
  source 1..22: mol_type = other DNA
caccctccagtttctggtttca

SEQ ID NO: 21344 - DNA, 23 bp, synthetic construct
  misc_feature 1..23: note = Synthetic Construct
  source 1..23: mol_type = other DNA
ggctcactccaaagcccatattc

SEQ ID NO: 21345 - DNA, 26 bp, synthetic construct
  misc_feature 1..26: note = Synthetic Construct
  source 1..26: mol_type = other DNA
gttggcatcagacaactcttacctat

SEQ ID NO: 21346 - DNA, 24 bp, synthetic construct
  misc_feature 1..24: note = Synthetic Construct
  source 1..24: mol_type = other DNA
cgcatattgcaggaaccaggtagt

SEQ ID NO: 21347 - DNA, 26 bp, synthetic construct
  misc_feature 1..26: note = Synthetic Construct
  source 1..26: mol_type = other DNA
cgaggagggaccaaccaagattaaca

SEQ ID NO: 21348 - DNA, 23 bp, synthetic construct
  misc_feature 1..23: note = Synthetic Construct
  source 1..23: mol_type = other DNA
agggcttaccagggtgaggtatc

SEQ ID NO: 21349 - DNA, 23 bp, synthetic construct
  misc_feature 1..23: note = Synthetic Construct
  source 1..23: mol_type = other DNA
ctgtgacacccgttttcctgaga

SEQ ID NO: 21350 - DNA, 26 bp, synthetic construct
  misc_feature 1..26: note = Synthetic Construct
  source 1..26: mol_type = other DNA
gtcttcactagactagccctgcagta

SEQ ID NO: 21351 - DNA, 26 bp, synthetic construct
  misc_feature 1..26: note = Synthetic Construct
  source 1..26: mol_type = other DNA
cacaggtctatttagtgcagggaact

SEQ ID NO: 21352 - DNA, 24 bp, synthetic construct
  misc_feature 1..24: note = Synthetic Construct
  source 1..24: mol_type = other DNA
actgattgcatatggggtttgaca

SEQ ID NO: 21353 - DNA, 21 bp, synthetic construct
  misc_feature 1..21: note = Synthetic Construct
  source 1..21: mol_type = other DNA
agcctgcagtacccctcttgt

SEQ ID NO: 21354 - DNA, 23 bp, synthetic construct
  misc_feature 1..23: note = Synthetic Construct
  source 1..23: mol_type = other DNA
tggggttctttcatgctttgtgt

SEQ ID NO: 21355 - DNA, 25 bp, synthetic construct
  misc_feature 1..25: note = Synthetic Construct
  source 1..25: mol_type = other DNA
ctgagtaggacagtgatcccagagt

SEQ ID NO: 21356 - DNA, 24 bp, synthetic construct
  misc_feature 1..24: note = Synthetic Construct
  source 1..24: mol_type = other DNA
ccaagctgcaaagtaaacttggat

SEQ ID NO: 21357 - DNA, 22 bp, synthetic construct
  misc_feature 1..22: note = Synthetic Construct
  source 1..22: mol_type = other DNA
gcccacctctttatggaacgta

SEQ ID NO: 21358 - DNA, 30 bp, synthetic construct
  misc_feature 1..30: note = Synthetic Construct
  source 1..30: mol_type = other DNA
cagcagagctggtatttaagtattctggtt

SEQ ID NO: 21359 - DNA, 22 bp, synthetic construct
  misc_feature 1..22: note = Synthetic Construct
  source 1..22: mol_type = other DNA
ggtccaagatggaatgggttct

SEQ ID NO: 21360 - DNA, 26 bp, synthetic construct
  misc_feature 1..26: note = Synthetic Construct
  source 1..26: mol_type = other DNA
gagcttaggctgtttctatccagtca

SEQ ID NO: 21361 - DNA, 25 bp, synthetic construct
  misc_feature 1..25: note = Synthetic Construct
  source 1..25: mol_type = other DNA
cctgaaacttgcaaagcctcacaga

SEQ ID NO: 21362 - DNA, 22 bp, synthetic construct
  misc_feature 1..22: note = Synthetic Construct
  source 1..22: mol_type = other DNA
tgcagtgtcaagctttgtcaga

SEQ ID NO: 21363 - DNA, 22 bp, synthetic construct
  misc_feature 1..22: note = Synthetic Construct
  source 1..22: mol_type = other DNA
gccagcactcacaactagactt

SEQ ID NO: 21364 - DNA, 22 bp, synthetic construct
  misc_feature 1..22: note = Synthetic Construct
  source 1..22: mol_type = other DNA
tgtgtgggctttcactctcaag

SEQ ID NO: 21365 - DNA, 26 bp, synthetic construct
  misc_feature 1..26: note = Synthetic Construct
  source 1..26: mol_type = other DNA
tgcatggatcttcatagtcctactct

SEQ ID NO: 21366 - DNA, 26 bp, synthetic construct
  misc_feature 1..26: note = Synthetic Construct
  source 1..26: mol_type = other DNA
gagttcttctcttcctccacctaaaa

SEQ ID NO: 21367 - DNA, 23 bp, synthetic construct
  misc_feature 1..23: note = Synthetic Construct
  source 1..23: mol_type = other DNA
cgtgagcattagtagcagtgaca

SEQ ID NO: 21368 - DNA, 26 bp, synthetic construct
  misc_feature 1..26: note = Synthetic Construct
  source 1..26: mol_type = other DNA
gactgtcagcaagcaaacaatacaag

SEQ ID NO: 21369 - DNA, 25 bp, synthetic construct
  misc_feature 1..25: note = Synthetic Construct
  source 1..25: mol_type = other DNA
ctgagatccaaggagctgtacaaag

SEQ ID NO: 21370 - DNA, 24 bp, synthetic construct
  misc_feature 1..24: note = Synthetic Construct
  source 1..24: mol_type = other DNA
ggaggtttggaactggtagagaga

SEQ ID NO: 21371 - DNA, 22 bp, synthetic construct
  misc_feature 1..22: note = Synthetic Construct
  source 1..22: mol_type = other DNA
ggctgttaggttgggagaggat

SEQ ID NO: 21372 - DNA, 23 bp, synthetic construct
  misc_feature 1..23: note = Synthetic Construct
  source 1..23: mol_type = other DNA
ctgccttccatagttgccaccaa

SEQ ID NO: 21373 - DNA, 27 bp, synthetic construct
  misc_feature 1..27: note = Synthetic Construct
  source 1..27: mol_type = other DNA
ctctggaaaaggctgagaaaactccta

SEQ ID NO: 21374 - DNA, 22 bp, synthetic construct
  misc_feature 1..22: note = Synthetic Construct
  source 1..22: mol_type = other DNA
gttgagggctagagggctaaga

SEQ ID NO: 21375 - DNA, 22 bp, synthetic construct
  misc_feature 1..22: note = Synthetic Construct
  source 1..22: mol_type = other DNA
aaggctggagctaggagtcaca

SEQ ID NO: 21376 - DNA, 23 bp, synthetic construct
  misc_feature 1..23: note = Synthetic Construct
  source 1..23: mol_type = other DNA
gccatgacagttgagtcacacat

SEQ ID NO: 21377 - DNA, 22 bp, synthetic construct
  misc_feature 1..22: note = Synthetic Construct
  source 1..22: mol_type = other DNA
actgcattcccaccataccaaa

SEQ ID NO: 21378 - DNA, 25 bp, synthetic construct
  misc_feature 1..25: note = Synthetic Construct
  source 1..25: mol_type = other DNA
tgaaacctcagtagggatcttccat

SEQ ID NO: 21379 - DNA, 22 bp, synthetic construct
  misc_feature 1..22: note = Synthetic Construct
  source 1..22: mol_type = other DNA
ggttgtgaagccgcacttggtt

SEQ ID NO: 21380 - DNA, 25 bp, synthetic construct
  misc_feature 1..25: note = Synthetic Construct
  source 1..25: mol_type = other DNA
gcaagaggattgggcatactggtaa

SEQ ID NO: 21381 - DNA, 21 bp, synthetic construct
  misc_feature 1..21: note = Synthetic Construct
  source 1..21: mol_type = other DNA
gcgcagccagaaatgatgaac

SEQ ID NO: 21382 - DNA, 27 bp, synthetic construct
  misc_feature 1..27: note = Synthetic Construct
  source 1..27: mol_type = other DNA
ccgtctgcttacatctccatttaggtt

SEQ ID NO: 21383 - DNA, 26 bp, synthetic construct
  misc_feature 1..26: note = Synthetic Construct
  source 1..26: mol_type = other DNA
cactcttcactatctgaggccatgaa

SEQ ID NO: 21384 - DNA, 20 bp, synthetic construct
  misc_feature 1..20: note = Synthetic Construct
  source 1..20: mol_type = other DNA
tcccttcagcagagcagtca

SEQ ID NO: 21385 - DNA, 22 bp, synthetic construct
  misc_feature 1..22: note = Synthetic Construct
  source 1..22: mol_type = other DNA
gacagagatggtgcatggatgt

SEQ ID NO: 21386 - DNA, 22 bp, synthetic construct
  misc_feature 1..22: note = Synthetic Construct
  source 1..22: mol_type = other DNA
gtgcctgcctgttaatgagtgt

SEQ ID NO: 21387 - DNA, 24 bp, synthetic construct
  misc_feature 1..24: note = Synthetic Construct
  source 1..24: mol_type = other DNA
ccctcttggtgaatgtcctctagt

SEQ ID NO: 21388 - DNA, 24 bp, synthetic construct
  misc_feature 1..24: note = Synthetic Construct
  source 1..24: mol_type = other DNA
gtggtaagtttggaaggaggctta

SEQ ID NO: 21389 - DNA, 20 bp, synthetic construct
  misc_feature 1..20: note = Synthetic Construct
  source 1..20: mol_type = other DNA
gcgcaggaatgtgtgcatga

SEQ ID NO: 21390 - DNA, 22 bp, synthetic construct
  misc_feature 1..22: note = Synthetic Construct
  source 1..22: mol_type = other DNA
cacctcctttgctgctaccata

SEQ ID NO: 21391 - DNA, 23 bp, synthetic construct
  misc_feature 1..23: note = Synthetic Construct
  source 1..23: mol_type = other DNA
ggggcccagatacactcttcttc

SEQ ID NO: 21392 - DNA, 25 bp, synthetic construct
  misc_feature 1..25: note = Synthetic Construct
  source 1..25: mol_type = other DNA
cctgtctttggaaatccgaccacta

SEQ ID NO: 21393 - DNA, 22 bp, synthetic construct
  misc_feature 1..22: note = Synthetic Construct
  source 1..22: mol_type = other DNA
gctttcccgaacaaggttcact

SEQ ID NO: 21394 - DNA, 22 bp, synthetic construct
  misc_feature 1..22: note = Synthetic Construct
  source 1..22: mol_type = other DNA
ggggagaggatgaagtgggttt

SEQ ID NO: 21395 - DNA, 23 bp, synthetic construct
  misc_feature 1..23: note = Synthetic Construct
  source 1..23: mol_type = other DNA
gggcctgggtatcctaacctcat

SEQ ID NO: 21396 - DNA, 23 bp, synthetic construct
  misc_feature 1..23: note = Synthetic Construct
  source 1..23: mol_type = other DNA
tcagcgcattaccagtcctttag

SEQ ID NO: 21397 - DNA, 25 bp, synthetic construct
  misc_feature 1..25: note = Synthetic Construct
  source 1..25: mol_type = other DNA
ggggattgttaggacttatcacact

SEQ ID NO: 21398 - DNA, 22 bp, synthetic construct
  misc_feature 1..22: note = Synthetic Construct
  source 1..22: mol_type = other DNA
tggggctgaagggttgactgta

SEQ ID NO: 21399 - DNA, 23 bp, synthetic construct
  misc_feature 1..23: note = Synthetic Construct
  source 1..23: mol_type = other DNA
cctttgccattcctggacactct

SEQ ID NO: 21400 - DNA, 26 bp, synthetic construct
  misc_feature 1..26: note = Synthetic Construct
  source 1..26: mol_type = other DNA
ggaacacctaccctttatgtgtaact

SEQ ID NO: 21401 - DNA, 27 bp, synthetic construct
  misc_feature 1..27: note = Synthetic Construct
  source 1..27: mol_type = other DNA
gcctgagcaaagtaagtttagggttct

SEQ ID NO: 21402 - DNA, 25 bp, synthetic construct
  misc_feature 1..25: note = Synthetic Construct
  source 1..25: mol_type = other DNA
tcctagggctgagttttgagatttg

SEQ ID NO: 21403 - DNA, 23 bp, synthetic construct
  misc_feature 1..23: note = Synthetic Construct
  source 1..23: mol_type = other DNA
ggatggagggtccttcattttct

SEQ ID NO: 21404 - DNA, 27 bp, synthetic construct
  misc_feature 1..27: note = Synthetic Construct
  source 1..27: mol_type = other DNA
gcctggaaaccaaatgattgtcaaaga

SEQ ID NO: 21405 - DNA, 25 bp, synthetic construct
  misc_feature 1..25: note = Synthetic Construct
  source 1..25: mol_type = other DNA
gtgggactcaaagatcttccagaat

SEQ ID NO: 21406 - DNA, 25 bp, synthetic construct
  misc_feature 1..25: note = Synthetic Construct
  source 1..25: mol_type = other DNA
gcccagggttcaagtttagtgtttg

SEQ ID NO: 21407 - DNA, 24 bp, synthetic construct
  misc_feature 1..24: note = Synthetic Construct
  source 1..24: mol_type = other DNA
ccaccctccaaaacaagtcactct

SEQ ID NO: 21408 - DNA, 23 bp, synthetic construct
  misc_feature 1..23: note = Synthetic Construct
  source 1..23: mol_type = other DNA
gccagagcatgtacctagcaaac

SEQ ID NO: 21409 - DNA, 22 bp, synthetic construct
  misc_feature 1..22: note = Synthetic Construct
  source 1..22: mol_type = other DNA
gcacccttggaatagggattga

SEQ ID NO: 21410 - DNA, 24 bp, synthetic construct
  misc_feature 1..24: note = Synthetic Construct
  source 1..24: mol_type = other DNA
gacattggctgtcaaagttccatt

SEQ ID NO: 21411 - DNA, 22 bp, synthetic construct
  misc_feature 1..22: note = Synthetic Construct
  source 1..22: mol_type = other DNA
agccataccttagggccagaac

SEQ ID NO: 21412 - DNA, 23 bp, synthetic construct
  misc_feature 1..23: note = Synthetic Construct
  source 1..23: mol_type = other DNA
caccctgcagttgacatgggaaa

SEQ ID NO: 21413 - DNA, 29 bp, synthetic construct
  misc_feature 1..29: note = Synthetic Construct
  source 1..29: mol_type = other DNA
ggaaactcaggtttaagcccataaggaaa

SEQ ID NO: 21414 - DNA, 24 bp, synthetic construct
  misc_feature 1..24: note = Synthetic Construct
  source 1..24: mol_type = other DNA
ggcttgagttggcctttctcagat

SEQ ID NO: 21415 - DNA, 27 bp, synthetic construct
  misc_feature 1..27: note = Synthetic Construct
  source 1..27: mol_type = other DNA
gcttaattgccagattccgtattcaag

SEQ ID NO: 21416 - DNA, 24 bp, synthetic construct
  misc_feature 1..24: note = Synthetic Construct
  source 1..24: mol_type = other DNA
ggctgggatatcaaaggagctaga

SEQ ID NO: 21417 - DNA, 22 bp, synthetic construct
  misc_feature 1..22: note = Synthetic Construct
  source 1..22: mol_type = other DNA
cagttggtcaccacgtgtgttt

SEQ ID NO: 21418 - DNA, 25 bp, synthetic construct
  misc_feature 1..25: note = Synthetic Construct
  source 1..25: mol_type = other DNA
tgccaaggtagatctcgttcatttc

SEQ ID NO: 21419 - DNA, 19 bp, synthetic construct
  misc_feature 1..19: note = Synthetic Construct
  source 1..19: mol_type = other DNA
aggccaggggctgtgtcat

SEQ ID NO: 21420 - DNA, 25 bp, synthetic construct
  misc_feature 1..25: note = Synthetic Construct
  source 1..25: mol_type = other DNA
gcacacttgcctgaaatgagacaca

SEQ ID NO: 21421 - DNA, 22 bp, synthetic construct
  misc_feature 1..22: note = Synthetic Construct
  source 1..22: mol_type = other DNA
gggctagaacaacaagccaagt

SEQ ID NO: 21422 - DNA, 22 bp, synthetic construct
  misc_feature 1..22: note = Synthetic Construct
  source 1..22: mol_type = other DNA
gtgacgtgtgtcaccactggaa

SEQ ID NO: 21423 - DNA, 23 bp, synthetic construct
  misc_feature 1..23: note = Synthetic Construct
  source 1..23: mol_type = other DNA
gtcccaaccaaatactgcacaga

SEQ ID NO: 21424 - DNA, 22 bp, synthetic construct
  misc_feature 1..22: note = Synthetic Construct
  source 1..22: mol_type = other DNA
ggcaggactggttgagaacatc

SEQ ID NO: 21425 - DNA, 23 bp, synthetic construct
  misc_feature 1..23: note = Synthetic Construct
  source 1..23: mol_type = other DNA
agagcctgagcaacgtgtataag

SEQ ID NO: 21426 - DNA, 26 bp, synthetic construct
  misc_feature 1..26: note = Synthetic Construct
  source 1..26: mol_type = other DNA
tgatgggccctagttttctacttttg

SEQ ID NO: 21427 - DNA, 23 bp, synthetic construct
  misc_feature 1..23: note = Synthetic Construct
  source 1..23: mol_type = other DNA
aggctaaggttaaggcactgaag

SEQ ID NO: 21428 - DNA, 21 bp, synthetic construct
  misc_feature 1..21: note = Synthetic Construct
  source 1..21: mol_type = other DNA
cctgcttccctgccacttttg

SEQ ID NO: 21429 - DNA, 23 bp, synthetic construct
  misc_feature 1..23: note = Synthetic Construct
  source 1..23: mol_type = other DNA
cgtgcggtgacttctttctgtga

SEQ ID NO: 21430 - DNA, 23 bp, synthetic construct
  misc_feature 1..23: note = Synthetic Construct
  source 1..23: mol_type = other DNA
tgctgaaaggctgccatatttgt

SEQ ID NO: 21431 - DNA, 25 bp, synthetic construct
  misc_feature 1..25: note = Synthetic Construct
  source 1..25: mol_type = other DNA
ccctctcaatgtccatttgtgtaga

SEQ ID NO: 21432 - DNA, 22 bp, synthetic construct
  misc_feature 1..22: note = Synthetic Construct
  source 1..22: mol_type = other DNA
gcaaagagagcccctcgaactt

SEQ ID NO: 21433 - DNA, 27 bp, synthetic construct
  misc_feature 1..27: note = Synthetic Construct
  source 1..27: mol_type = other DNA
ggaaggaacaacctcattatggtttca

SEQ ID NO: 21434 - DNA, 23 bp, synthetic construct
  misc_feature 1..23: note = Synthetic Construct
  source 1..23: mol_type = other DNA
ccccacaatgagtctctgcaact

SEQ ID NO: 21435 - DNA, 24 bp, synthetic construct
  misc_feature 1..24: note = Synthetic Construct
  source 1..24: mol_type = other DNA
caacaggacttgatcaccaagcaa

SEQ ID NO: 21436 - DNA, 20 bp, synthetic construct
  misc_feature 1..20: note = Synthetic Construct
  source 1..20: mol_type = other DNA
tccacagtgacacggagcta

SEQ ID NO: 21437 - DNA, 24 bp, synthetic construct
  misc_feature 1..24: note = Synthetic Construct
  source 1..24: mol_type = other DNA
cacagaatctctctgcctgcatca

SEQ ID NO: 21438 - DNA, 26 bp, synthetic construct
  misc_feature 1..26: note = Synthetic Construct
  source 1..26: mol_type = other DNA
gctggttgataaattgccacgacttc

SEQ ID NO: 21439 - DNA, 23 bp, synthetic construct
  misc_feature 1..23: note = Synthetic Construct
  source 1..23: mol_type = other DNA
gctttggggctactcccttccta

SEQ ID NO: 21440 - DNA, 24 bp, synthetic construct
  misc_feature 1..24: note = Synthetic Construct
  source 1..24: mol_type = other DNA
gccagggataaagctggcttcaga

SEQ ID NO: 21441 - DNA, 25 bp, synthetic construct
  misc_feature 1..25: note = Synthetic Construct
  source 1..25: mol_type = other DNA
ctcctcagtgcaattagaggacttc

SEQ ID NO: 21442 - DNA, 23 bp, synthetic construct
  misc_feature 1..23: note = Synthetic Construct
  source 1..23: mol_type = other DNA
gctgcaacaagggatcagactca

SEQ ID NO: 21443 - DNA, 26 bp, synthetic construct
  misc_feature 1..26: note = Synthetic Construct
  source 1..26: mol_type = other DNA
gcttctgaatgtctctggaatgacaa

SEQ ID NO: 21444 - DNA, 22 bp, synthetic construct
  misc_feature 1..22: note = Synthetic Construct
  source 1..22: mol_type = other DNA
tgccaggtagtgggtgagtcaa

SEQ ID NO: 21445 - DNA, 25 bp, synthetic construct
  misc_feature 1..25: note = Synthetic Construct
  source 1..25: mol_type = other DNA
ctcgtagccgcaagtagaaatgaag

SEQ ID NO: 21446 - DNA, 22 bp, synthetic construct
  misc_feature 1..22: note = Synthetic Construct
  source 1..22: mol_type = other DNA
agatggaggctcctccttgaca

SEQ ID NO: 21447 - DNA, 26 bp, synthetic construct
  misc_feature 1..26: note = Synthetic Construct
  source 1..26: mol_type = other DNA
gattgcccaaggaacatatagaggaa

SEQ ID NO: 21448 - DNA, 22 bp, synthetic construct
  misc_feature 1..22: note = Synthetic Construct
  source 1..22: mol_type = other DNA
cagacatgtgtggagcgactgt

SEQ ID NO: 21449 - DNA, 24 bp, synthetic construct
  misc_feature 1..24: note = Synthetic Construct
  source 1..24: mol_type = other DNA
ccctggaaacagtacctacccaat

SEQ ID NO: 21450 - DNA, 20 bp, synthetic construct
  misc_feature 1..20: note = Synthetic Construct
  source 1..20: mol_type = other DNA
ggccaaatgcctgcaaaaga

SEQ ID NO: 21451 - DNA, 24 bp, synthetic construct
  misc_feature 1..24: note = Synthetic Construct
  source 1..24: mol_type = other DNA
agccaagagctggtttttagaaga

SEQ ID NO: 21452 - DNA, 24 bp, synthetic construct
  misc_feature 1..24: note = Synthetic Construct
  source 1..24: mol_type = other DNA
tgtcttcaaacactcagcaccttt

SEQ ID NO: 21453 - DNA, 21 bp, synthetic construct
  misc_feature 1..21: note = Synthetic Construct
  source 1..21: mol_type = other DNA
cctttgtgtccctccccttct

SEQ ID NO: 21454 - DNA, 30 bp, synthetic construct
  misc_feature 1..30: note = Synthetic Construct
  source 1..30: mol_type = other DNA
ggtggatcttttgttagggctacatttcta

SEQ ID NO: 21455 - DNA, 25 bp, synthetic construct
  misc_feature 1..25: note = Synthetic Construct
  source 1..25: mol_type = other DNA
ccagatctgacttcatggagtgttg

SEQ ID NO: 21456 - DNA, 25 bp, synthetic construct
  misc_feature 1..25: note = Synthetic Construct
  source 1..25: mol_type = other DNA
gtcctgctacatctaaccttccttt

SEQ ID NO: 21457 - DNA, 23 bp, synthetic construct
  misc_feature 1..23: note = Synthetic Construct
  source 1..23: mol_type = other DNA
gctcagagagtccatgaccactt

SEQ ID NO: 21458 - DNA, 23 bp, synthetic construct
  misc_feature 1..23: note = Synthetic Construct
  source 1..23: mol_type = other DNA
gctctgcttccatctcagtcaca

SEQ ID NO: 21459 - DNA, 25 bp, synthetic construct
  misc_feature 1..25: note = Synthetic Construct
  source 1..25: mol_type = other DNA
gtggtgtaaaggttagaagcacaaa

SEQ ID NO: 21460 - DNA, 22 bp, synthetic construct
  misc_feature 1..22: note = Synthetic Construct
  source 1..22: mol_type = other DNA
cagtgcccagaaattgccaaca

SEQ ID NO: 21461 - DNA, 22 bp, synthetic construct
  misc_feature 1..22: note = Synthetic Construct
  source 1..22: mol_type = other DNA
cgctctaggagtttgcagtaca

SEQ ID NO: 21462 - DNA, 21 bp, synthetic construct
  misc_feature 1..21: note = Synthetic Construct
  source 1..21: mol_type = other DNA
agagcaaggcccactcagaga

SEQ ID NO: 21463 - DNA, 24 bp, synthetic construct
  misc_feature 1..24: note = Synthetic Construct
  source 1..24: mol_type = other DNA
ggtggagagtgaatctggcaaatg

SEQ ID NO: 21464 - DNA, 24 bp, synthetic construct
  misc_feature 1..24: note = Synthetic Construct
  source 1..24: mol_type = other DNA
gccccaataaagtggtgcttgact

SEQ ID NO: 21465 - DNA, 22 bp, synthetic construct
  misc_feature 1..22: note = Synthetic Construct
  source 1..22: mol_type = other DNA
cagtgttggcagccaggataca

SEQ ID NO: 21466 - DNA, 20 bp, synthetic construct
  misc_feature 1..20: note = Synthetic Construct
  source 1..20: mol_type = other DNA
actcccaaccccagcagtct

SEQ ID NO: 21467 - DNA, 23 bp, synthetic construct
  misc_feature 1..23: note = Synthetic Construct
  source 1..23: mol_type = other DNA
ctctggggactctttccatcaga

SEQ ID NO: 21468 - DNA, 22 bp, synthetic construct
  misc_feature 1..22: note = Synthetic Construct
  source 1..22: mol_type = other DNA
gcctggaactgcatggcttaga

SEQ ID NO: 21469 - DNA, 23 bp, synthetic construct
  misc_feature 1..23: note = Synthetic Construct
  source 1..23: mol_type = other DNA
cccaactgtcacctccttctatg

SEQ ID NO: 21470 - DNA, 23 bp, synthetic construct
  misc_feature 1..23: note = Synthetic Construct
  source 1..23: mol_type = other DNA
cggggtgggaagaagtaggacat

SEQ ID NO: 21471 - DNA, 23 bp, synthetic construct
  misc_feature 1..23: note = Synthetic Construct
  source 1..23: mol_type = other DNA
gaaagcaagtccattgctccaaa

SEQ ID NO: 21472 - DNA, 25 bp, synthetic construct
  misc_feature 1..25: note = Synthetic Construct
  source 1..25: mol_type = other DNA
gcacaggatgaggctattctctgaa

SEQ ID NO: 21473 - DNA, 30 bp, synthetic construct
  misc_feature 1..30: note = Synthetic Construct
  source 1..30: mol_type = other DNA
gctgcttggaatagtttgttctcatcttag

SEQ ID NO: 21474 - DNA, 24 bp, synthetic construct
  misc_feature 1..24: note = Synthetic Construct
  source 1..24: mol_type = other DNA
cagggtgtagccatctgatttaca

SEQ ID NO: 21475 - DNA, 22 bp, synthetic construct
  misc_feature 1..22: note = Synthetic Construct
  source 1..22: mol_type = other DNA
caaggtgggccaaggaaactga

SEQ ID NO: 21476 - DNA, 24 bp, synthetic construct
  misc_feature 1..24: note = Synthetic Construct
  source 1..24: mol_type = other DNA
acccactccaattttgaagcaaac

SEQ ID NO: 21477 - DNA, 23 bp, synthetic construct
  misc_feature 1..23: note = Synthetic Construct
  source 1..23: mol_type = other DNA
caggcttggaaagggagtgatag

SEQ ID NO: 21478 - DNA, 23 bp, synthetic construct
  misc_feature 1..23: note = Synthetic Construct
  source 1..23: mol_type = other DNA
gacagccaaaagccaggtgttag

SEQ ID NO: 21479 - DNA, 26 bp, synthetic construct
  misc_feature 1..26: note = Synthetic Construct
  source 1..26: mol_type = other DNA
ggttgttggctgttagagcgtatttc

SEQ ID NO: 21480 - DNA, 20 bp, synthetic construct
  misc_feature 1..20: note = Synthetic Construct
  source 1..20: mol_type = other DNA
tgggtggtagggcacattca

SEQ ID NO: 21481 - DNA, 26 bp, synthetic construct
  misc_feature 1..26: note = Synthetic Construct
  source 1..26: mol_type = other DNA
gggtgttatagccagaccagaaaaca

SEQ ID NO: 21482 - DNA, 24 bp, synthetic construct
  misc_feature 1..24: note = Synthetic Construct
  source 1..24: mol_type = other DNA
ccaggtagctaagcagtgaagaca

SEQ ID NO: 21483 - DNA, 26 bp, synthetic construct
  misc_feature 1..26: note = Synthetic Construct
  source 1..26: mol_type = other DNA
ggcaaggcaatttggattatgcttca

SEQ ID NO: 21484 - DNA, 23 bp, synthetic construct
  misc_feature 1..23: note = Synthetic Construct
  source 1..23: mol_type = other DNA
ggaatgtctgctttcactgcttt

SEQ ID NO: 21485 - DNA, 22 bp, synthetic construct
  misc_feature 1..22: note = Synthetic Construct
  source 1..22: mol_type = other DNA
cctgtacagcatctgtcgctat

SEQ ID NO: 21486 - DNA, 22 bp, synthetic construct
  misc_feature 1..22: note = Synthetic Construct
  source 1..22: mol_type = other DNA
gaacaggccagattcgcctaag

SEQ ID NO: 21487 - DNA, 25 bp, synthetic construct
  misc_feature 1..25: note = Synthetic Construct
  source 1..25: mol_type = other DNA
gtttcttttcacctccaacatggaa

SEQ ID NO: 21488 - DNA, 24 bp, synthetic construct
  misc_feature 1..24: note = Synthetic Construct
  source 1..24: mol_type = other DNA
ccctacttgggtaccttgttgcta

SEQ ID NO: 21489 - DNA, 24 bp, synthetic construct
  misc_feature 1..24: note = Synthetic Construct
  source 1..24: mol_type = other DNA
aggttgagtccatgagtacagaca

SEQ ID NO: 21490 - DNA, 24 bp, synthetic construct
  misc_feature 1..24: note = Synthetic Construct
  source 1..24: mol_type = other DNA
ccgaacttcagggaatagccaaga

SEQ ID NO: 21491 - DNA, 23 bp, synthetic construct
  misc_feature 1..23: note = Synthetic Construct
  source 1..23: mol_type = other DNA
gctcaaaccccacctacttgtct

SEQ ID NO: 21492 - DNA, 24 bp, synthetic construct
  misc_feature 1..24: note = Synthetic Construct
  source 1..24: mol_type = other DNA
cctccccaagaagtagtcttcgat

SEQ ID NO: 21493 - DNA, 24 bp, synthetic construct
  misc_feature 1..24: note = Synthetic Construct
  source 1..24: mol_type = other DNA
gcaatctcctcaccctctggagaa

SEQ ID NO: 21494 - DNA, 24 bp, synthetic construct
  misc_feature 1..24: note = Synthetic Construct
  source 1..24: mol_type = other DNA
agcaacaagcttggtatgttcaag

SEQ ID NO: 21495 - DNA, 25 bp, synthetic construct
  misc_feature 1..25: note = Synthetic Construct
  source 1..25: mol_type = other DNA
ccccagtgtttgagtgagtactttg

SEQ ID NO: 21496 - DNA, 23 bp, synthetic construct
  misc_feature 1..23: note = Synthetic Construct
  source 1..23: mol_type = other DNA
cccactgggagaaaagggagtga

SEQ ID NO: 21497 - DNA, 24 bp, synthetic construct
  misc_feature 1..24: note = Synthetic Construct
  source 1..24: mol_type = other DNA
ggctgaatagacaaccagccttga

SEQ ID NO: 21498 - DNA, 23 bp, synthetic construct
  misc_feature 1..23: note = Synthetic Construct
  source 1..23: mol_type = other DNA
ctctgtcaccaactctgtgtcat

SEQ ID NO: 21499 - DNA, 24 bp, synthetic construct
  misc_feature 1..24: note = Synthetic Construct
  source 1..24: mol_type = other DNA
ctcttcatggaatgggtgatcctt

SEQ ID NO: 21500 - DNA, 23 bp, synthetic construct
  misc_feature 1..23: note = Synthetic Construct
  source 1..23: mol_type = other DNA
ccttctcactccctagctttgtt

SEQ ID NO: 21501 - DNA, 23 bp, synthetic construct
  misc_feature 1..23: note = Synthetic Construct
  source 1..23: mol_type = other DNA
ggctgtgctgaagttttgtctct

SEQ ID NO: 21502 - DNA, 25 bp, synthetic construct
  misc_feature 1..25: note = Synthetic Construct
  source 1..25: mol_type = other DNA
cgtaacctctacatggccaatgact

SEQ ID NO: 21503 - DNA, 24 bp, synthetic construct
  misc_feature 1..24: note = Synthetic Construct
  source 1..24: mol_type = other DNA
gtcctctccttgctgtctccaaag

SEQ ID NO: 21504 - DNA, 25 bp, synthetic construct
  misc_feature 1..25: note = Synthetic Construct
  source 1..25: mol_type = other DNA
gtctgcttggatgtagagaggtcaa

SEQ ID NO: 21505 - DNA, 22 bp, synthetic construct
  misc_feature 1..22: note = Synthetic Construct
  source 1..22: mol_type = other DNA
cagggctaccaaggtttccatt

SEQ ID NO: 21506 - DNA, 25 bp, synthetic construct
  misc_feature 1..25: note = Synthetic Construct
  source 1..25: mol_type = other DNA
ggagacgattcccaatgtcaatgtt

SEQ ID NO: 21507 - DNA, 27 bp, synthetic construct
  misc_feature 1..27: note = Synthetic Construct
  source 1..27: mol_type = other DNA
cagttactttacccagacattgtcatc

SEQ ID NO: 21508 - DNA, 27 bp, synthetic construct
  misc_feature 1..27: note = Synthetic Construct
  source 1..27: mol_type = other DNA
ccttgggtgggaatttttgaagagaaa

SEQ ID NO: 21509 - DNA, 20 bp, synthetic construct
  misc_feature 1..20: note = Synthetic Construct
  source 1..20: mol_type = other DNA
aggcccagtgatgcacagat

SEQ ID NO: 21510 - DNA, 23 bp, synthetic construct
  misc_feature 1..23: note = Synthetic Construct
  source 1..23: mol_type = other DNA
ggcggataagcccagatagtttc

SEQ ID NO: 21511 - DNA, 24 bp, synthetic construct
  misc_feature 1..24: note = Synthetic Construct
  source 1..24: mol_type = other DNA
gggcagaaaccatatctttgcatt

SEQ ID NO: 21512 - DNA, 25 bp, synthetic construct
  misc_feature 1..25: note = Synthetic Construct
  source 1..25: mol_type = other DNA
gcaccttggatgattcttgagaaaa

SEQ ID NO: 21513 - DNA, 24 bp, synthetic construct
  misc_feature 1..24: note = Synthetic Construct
  source 1..24: mol_type = other DNA
cctccgacctacaaaactactgaa

SEQ ID NO: 21514 - DNA, 24 bp, synthetic construct
  misc_feature 1..24: note = Synthetic Construct
  source 1..24: mol_type = other DNA
gcaaggatgggttcagttgcattt

SEQ ID NO: 21515 - DNA, 25 bp, synthetic construct
  misc_feature 1..25: note = Synthetic Construct
  source 1..25: mol_type = other DNA
ccactcatagcattgagggccaaag

SEQ ID NO: 21516 - DNA, 21 bp, synthetic construct
  misc_feature 1..21: note = Synthetic Construct
  source 1..21: mol_type = other DNA
ccagcagaagtggggatgtga

SEQ ID NO: 21517 - DNA, 22 bp, synthetic construct
  misc_feature 1..22: note = Synthetic Construct
  source 1..22: mol_type = other DNA
acaattgtgatgccgtgggaat

SEQ ID NO: 21518 - DNA, 25 bp, synthetic construct
  misc_feature 1..25: note = Synthetic Construct
  source 1..25: mol_type = other DNA
cagggcttgatctttggtagagtga

SEQ ID NO: 21519 - DNA, 29 bp, synthetic construct
  misc_feature 1..29: note = Synthetic Construct
  source 1..29: mol_type = other DNA
ggggcttttgtaaggctggaagtatttag

SEQ ID NO: 21520 - DNA, 24 bp, synthetic construct
  misc_feature 1..24: note = Synthetic Construct
  source 1..24: mol_type = other DNA
ggagacctgtcaatcccacagaag

SEQ ID NO: 21521 - DNA, 24 bp, synthetic construct
  misc_feature 1..24: note = Synthetic Construct
  source 1..24: mol_type = other DNA
ccaggtgggtcagaaaacatcaca

SEQ ID NO: 21522 - DNA, 26 bp, synthetic construct
  misc_feature 1..26: note = Synthetic Construct
  source 1..26: mol_type = other DNA
ggcgctcactcaggaaaattaaccat

SEQ ID NO: 21523 - DNA, 25 bp, synthetic construct
  misc_feature 1..25: note = Synthetic Construct
  source 1..25: mol_type = other DNA
cgtgttctgaggacctacagttatt

SEQ ID NO: 21524 - DNA, 21 bp, synthetic construct
  misc_feature 1..21: note = Synthetic Construct
  source 1..21: mol_type = other DNA
tgacagtgcacacagtgactt

SEQ ID NO: 21525 - DNA, 19 bp, synthetic construct
  misc_feature 1..19: note = Synthetic Construct
  source 1..19: mol_type = other DNA
accagatgggctccacaca

SEQ ID NO: 21526 - DNA, 23 bp, synthetic construct
  misc_feature 1..23: note = Synthetic Construct
  source 1..23: mol_type = other DNA
cccaacctcagcatagcttttga

SEQ ID NO: 21527 - DNA, 24 bp, synthetic construct
  misc_feature 1..24: note = Synthetic Construct
  source 1..24: mol_type = other DNA
gggctttgctcagtcttcctgttc

SEQ ID NO: 21528 - DNA, 26 bp, synthetic construct
  misc_feature 1..26: note = Synthetic Construct
  source 1..26: mol_type = other DNA
gcagatccagtaaagacaacctgtca

SEQ ID NO: 21529 - DNA, 23 bp, synthetic construct
  misc_feature 1..23: note = Synthetic Construct
  source 1..23: mol_type = other DNA
gcaccagttccccttttctcctt

SEQ ID NO: 21530 - DNA, 23 bp, synthetic construct
  misc_feature 1..23: note = Synthetic Construct
  source 1..23: mol_type = other DNA
ctggtttcccacatgctgtgtct

SEQ ID NO: 21531 - DNA, 23 bp, synthetic construct
  misc_feature 1..23: note = Synthetic Construct
  source 1..23: mol_type = other DNA
ccagattcagtcctcacccttgt

SEQ ID NO: 21532 - DNA, 27 bp, synthetic construct
  misc_feature 1..27: note = Synthetic Construct
  source 1..27: mol_type = other DNA
ctgatagcttgtgacctaagcctagta

SEQ ID NO: 21533 - DNA, 20 bp, synthetic construct
  misc_feature 1..20: note = Synthetic Construct
  source 1..20: mol_type = other DNA
gctctcctccctcccagtct

SEQ ID NO: 21534 - DNA, 24 bp, synthetic construct
  misc_feature 1..24: note = Synthetic Construct
  source 1..24: mol_type = other DNA
gaggaagacagcttggaagtttga

SEQ ID NO: 21535 - DNA, 25 bp, synthetic construct
  misc_feature 1..25: note = Synthetic Construct
  source 1..25: mol_type = other DNA
cactaaccctaaaccacctcctgaa

SEQ ID NO: 21536 - DNA, 23 bp, synthetic construct
  misc_feature 1..23: note = Synthetic Construct
  source 1..23: mol_type = other DNA
ctccccaaagggtacagtaggaa

SEQ ID NO: 21537 - DNA, 22 bp, synthetic construct
  misc_feature 1..22: note = Synthetic Construct
  source 1..22: mol_type = other DNA
gttcttcgtcttccctgaccat

SEQ ID NO: 21538 - DNA, 25 bp, synthetic construct
  misc_feature 1..25: note = Synthetic Construct
  source 1..25: mol_type = other DNA
gtccagtgagtggtatctgttggaa

SEQ ID NO: 21539 - DNA, 27 bp, synthetic construct
  misc_feature 1..27: note = Synthetic Construct
  source 1..27: mol_type = other DNA
gacctgaacaagaatgtgatgcctaag

SEQ ID NO: 21540 - DNA, 24 bp, synthetic construct
  misc_feature 1..24: note = Synthetic Construct
  source 1..24: mol_type = other DNA
tgccaggagaagatccaagttttg

SEQ ID NO: 21541 - DNA, 23 bp, synthetic construct
  misc_feature 1..23: note = Synthetic Construct
  source 1..23: mol_type = other DNA
aacagagggtatgggatgtgttg

SEQ ID NO: 21542 - DNA, 24 bp, synthetic construct
  misc_feature 1..24: note = Synthetic Construct
  source 1..24: mol_type = other DNA
gacccaaatctctctttcctctgt

SEQ ID NO: 21543 - DNA, 22 bp, synthetic construct
  misc_feature 1..22: note = Synthetic Construct
  source 1..22: mol_type = other DNA
tggggaggtgttgatggagttg

SEQ ID NO: 21544 - DNA, 20 bp, synthetic construct
  misc_feature 1..20: note = Synthetic Construct
  source 1..20: mol_type = other DNA
actcgctaaccccacgactt

SEQ ID NO: 21545 - DNA, 29 bp, synthetic construct
  misc_feature 1..29: note = Synthetic Construct
  source 1..29: mol_type = other DNA
cctgggatttgaaggatttctagggaact

SEQ ID NO: 21546 - DNA, 20 bp, synthetic construct
  misc_feature 1..20: note = Synthetic Construct
  source 1..20: mol_type = other DNA
ggagtagctgtgccaacctt

SEQ ID NO: 21547 - DNA, 25 bp, synthetic construct
  misc_feature 1..25: note = Synthetic Construct
  source 1..25: mol_type = other DNA
cagagcaaggcagtcatacaagtga

SEQ ID NO: 21548 - DNA, 23 bp, synthetic construct
  misc_feature 1..23: note = Synthetic Construct
  source 1..23: mol_type = other DNA
acaccccttcactttccttctct

SEQ ID NO: 21549 - DNA, 23 bp, synthetic construct
  misc_feature 1..23: note = Synthetic Construct
  source 1..23: mol_type = other DNA
ggcaaacgtaaggaaggatgact

SEQ ID NO: 21550 - DNA, 22 bp, synthetic construct
  misc_feature 1..22: note = Synthetic Construct
  source 1..22: mol_type = other DNA
gtgtagcagaagtgaggcaagt

SEQ ID NO: 21551 - DNA, 21 bp, synthetic construct
  misc_feature 1..21: note = Synthetic Construct
  source 1..21: mol_type = other DNA
ccagctaattggtggcaggtt

SEQ ID NO: 21552 - DNA, 24 bp, synthetic construct
  misc_feature 1..24: note = Synthetic Construct
  source 1..24: mol_type = other DNA
gtggcaaagcagttttgttggttt

SEQ ID NO: 21553 - DNA, 25 bp, synthetic construct
  misc_feature 1..25: note = Synthetic Construct
  source 1..25: mol_type = other DNA
ggtgagctatgtgaaaatgccctat

SEQ ID NO: 21554 - DNA, 25 bp, synthetic construct
  misc_feature 1..25: note = Synthetic Construct
  source 1..25: mol_type = other DNA
cctttgacaactgatgtaagccaat

SEQ ID NO: 21555 - DNA, 24 bp, synthetic construct
  misc_feature 1..24: note = Synthetic Construct
  source 1..24: mol_type = other DNA
tcaccatcaccaataacagcagta

SEQ ID NO: 21556 - DNA, 23 bp, synthetic construct
  misc_feature 1..23: note = Synthetic Construct
  source 1..23: mol_type = other DNA
cactcctgcatctcttcccatag

SEQ ID NO: 21557 - DNA, 21 bp, synthetic construct
  misc_feature 1..21: note = Synthetic Construct
  source 1..21: mol_type = other DNA
ttctctgccccaggaggttga

SEQ ID NO: 21558 - DNA, 22 bp, synthetic construct
  misc_feature 1..22: note = Synthetic Construct
  source 1..22: mol_type = other DNA
tctggtgctttaggggatccat

SEQ ID NO: 21559 - DNA, 23 bp, synthetic construct
  misc_feature 1..23: note = Synthetic Construct
  source 1..23: mol_type = other DNA
gcgtgcttcacttaactgggata

SEQ ID NO: 21560 - DNA, 24 bp, synthetic construct
  misc_feature 1..24: note = Synthetic Construct
  source 1..24: mol_type = other DNA
cagtagtgcgtcatagctcactgt

SEQ ID NO: 21561 - DNA, 30 bp, synthetic construct
  misc_feature 1..30: note = Synthetic Construct
  source 1..30: mol_type = other DNA
ggtaactgtttagtccacacttagggaatc

SEQ ID NO: 21562 - DNA, 25 bp, synthetic construct
  misc_feature 1..25: note = Synthetic Construct
  source 1..25: mol_type = other DNA
gcagaggtgtgtttcaacctaatgt

SEQ ID NO: 21563 - DNA, 27 bp, synthetic construct
  misc_feature 1..27: note = Synthetic Construct
  source 1..27: mol_type = other DNA
ccctagcctgatgacaaatgtttctac

SEQ ID NO: 21564 - DNA, 25 bp, synthetic construct
  misc_feature 1..25: note = Synthetic Construct
  source 1..25: mol_type = other DNA
attgctcccattctacaacagaaga

SEQ ID NO: 21565 - DNA, 21 bp, synthetic construct
  misc_feature 1..21: note = Synthetic Construct
  source 1..21: mol_type = other DNA
gcacaacccctctccctgttc

SEQ ID NO: 21566 - DNA, 24 bp, synthetic construct
  misc_feature 1..24: note = Synthetic Construct
  source 1..24: mol_type = other DNA
ggtggtggtaaatgacgtggatgt

SEQ ID NO: 21567 - DNA, 23 bp, synthetic construct
  misc_feature 1..23: note = Synthetic Construct
  source 1..23: mol_type = other DNA
ccttacagctgagtcctggtcta

SEQ ID NO: 21568 - DNA, 26 bp, synthetic construct
  misc_feature 1..26: note = Synthetic Construct
  source 1..26: mol_type = other DNA
gatgacttccaaaaggggaaagaaac

SEQ ID NO: 21569 - DNA, 22 bp, synthetic construct
  misc_feature 1..22: note = Synthetic Construct
  source 1..22: mol_type = other DNA
ggtgacatctgcttgccaggaa

SEQ ID NO: 21570 - DNA, 24 bp, synthetic construct
  misc_feature 1..24: note = Synthetic Construct
  source 1..24: mol_type = other DNA
ccctgacagagtcctctctacctt

SEQ ID NO: 21571 - DNA, 23 bp, synthetic construct
  misc_feature 1..23: note = Synthetic Construct
  source 1..23: mol_type = other DNA
gacccagatggatgagtctgaag

SEQ ID NO: 21572 - DNA, 26 bp, synthetic construct
  misc_feature 1..26: note = Synthetic Construct
  source 1..26: mol_type = other DNA
ggaacttacatgttcctggtgtggtt

SEQ ID NO: 21573 - DNA, 23 bp, synthetic construct
  misc_feature 1..23: note = Synthetic Construct
  source 1..23: mol_type = other DNA
caggcgtttgttcaggctcaaag

SEQ ID NO: 21574 - DNA, 25 bp, synthetic construct
  misc_feature 1..25: note = Synthetic Construct
  source 1..25: mol_type = other DNA
ctgcttaagctgatccaggtcaaaa

SEQ ID NO: 21575 - DNA, 25 bp, synthetic construct
  misc_feature 1..25: note = Synthetic Construct
  source 1..25: mol_type = other DNA
catggtccagaagttggaaaagcta

SEQ ID NO: 21576 - DNA, 23 bp, synthetic construct
  misc_feature 1..23: note = Synthetic Construct
  source 1..23: mol_type = other DNA
catccaagtcattggcaggaatc

SEQ ID NO: 21577 - DNA, 20 bp, synthetic construct
  misc_feature 1..20: note = Synthetic Construct
  source 1..20: mol_type = other DNA
gctggtgttggcagtgtttg

SEQ ID NO: 21578 - DNA, 24 bp, synthetic construct
  misc_feature 1..24: note = Synthetic Construct
  source 1..24: mol_type = other DNA
gtcagtgaccagggagtctgtaag

SEQ ID NO: 21579 - DNA, 21 bp, synthetic construct
  misc_feature 1..21: note = Synthetic Construct
  source 1..21: mol_type = other DNA
ggacctttttggctgcagaag

SEQ ID NO: 21580 - DNA, 21 bp, synthetic construct
  misc_feature 1..21: note = Synthetic Construct
  source 1..21: mol_type = other DNA
ccaggagcattgctgttgcat

SEQ ID NO: 21581 - DNA, 27 bp, synthetic construct
  misc_feature 1..27: note = Synthetic Construct
  source 1..27: mol_type = other DNA
ccaatgtctagctgtgtctagctctat

SEQ ID NO: 21582 - DNA, 22 bp, synthetic construct
  misc_feature 1..22: note = Synthetic Construct
  source 1..22: mol_type = other DNA
gggagcccggtttgctctataa

SEQ ID NO: 21583 - DNA, 23 bp, synthetic construct
  misc_feature 1..23: note = Synthetic Construct
  source 1..23: mol_type = other DNA
agatctagaaccaaggccactga

SEQ ID NO: 21584 - DNA, 24 bp, synthetic construct
  misc_feature 1..24: note = Synthetic Construct
  source 1..24: mol_type = other DNA
cagccctattgtaccctggctaag

SEQ ID NO: 21585 - DNA, 26 bp, synthetic construct
  misc_feature 1..26: note = Synthetic Construct
  source 1..26: mol_type = other DNA
acatttggggagatgagacctactaa

SEQ ID NO: 21586 - DNA, 25 bp, synthetic construct
  misc_feature 1..25: note = Synthetic Construct
  source 1..25: mol_type = other DNA
acacaggcatccttaaccaataaca

SEQ ID NO: 21587 - DNA, 23 bp, synthetic construct
  misc_feature 1..23: note = Synthetic Construct
  source 1..23: mol_type = other DNA
tgccttcacatcaagggtgattc

SEQ ID NO: 21588 - DNA, 29 bp, synthetic construct
  misc_feature 1..29: note = Synthetic Construct
  source 1..29: mol_type = other DNA
ggtaaagacaaggactttctccatgatgt

SEQ ID NO: 21589 - DNA, 24 bp, synthetic construct
  misc_feature 1..24: note = Synthetic Construct
  source 1..24: mol_type = other DNA
agaacccatgtctagtagccttca

SEQ ID NO: 21590 - DNA, 22 bp, synthetic construct
  misc_feature 1..22: note = Synthetic Construct
  source 1..22: mol_type = other DNA
ccaactacagggaaggctggaa

SEQ ID NO: 21591 - DNA, 24 bp, synthetic construct
  misc_feature 1..24: note = Synthetic Construct
  source 1..24: mol_type = other DNA
gtcattgcctagatcgtccagtag

SEQ ID NO: 21592 - DNA, 24 bp, synthetic construct
  misc_feature 1..24: note = Synthetic Construct
  source 1..24: mol_type = other DNA
caggtgtacacagcacacccttag

SEQ ID NO: 21593 - DNA, 23 bp, synthetic construct
  misc_feature 1..23: note = Synthetic Construct
  source 1..23: mol_type = other DNA
aaaagcaacagtgagggagatca

SEQ ID NO: 21594 - DNA, 25 bp, synthetic construct
  misc_feature 1..25: note = Synthetic Construct
  source 1..25: mol_type = other DNA
caggtcccatgtgaagtgttaggat

SEQ ID NO: 21595 - DNA, 23 bp, synthetic construct
  misc_feature 1..23: note = Synthetic Construct
  source 1..23: mol_type = other DNA
cgggaggacaatttctggcaatg

SEQ ID NO: 21596 - DNA, 22 bp, synthetic construct
  misc_feature 1..22: note = Synthetic Construct
  source 1..22: mol_type = other DNA
ccagatggctgtgagtgtctgt

SEQ ID NO: 21597 - DNA, 26 bp, synthetic construct
  misc_feature 1..26: note = Synthetic Construct
  source 1..26: mol_type = other DNA
ggtcacgtaacttcctaaaagtccat

SEQ ID NO: 21598 - DNA, 27 bp, synthetic construct
  misc_feature 1..27: note = Synthetic Construct
  source 1..27: mol_type = other DNA
caagaactgagaaaaggccttcaaaga

SEQ ID NO: 21599 - DNA, 24 bp, synthetic construct
  misc_feature 1..24: note = Synthetic Construct
  source 1..24: mol_type = other DNA
ccgcatgctttattctagccactt

SEQ ID NO: 21600 - DNA, 22 bp, synthetic construct
  misc_feature 1..22: note = Synthetic Construct
  source 1..22: mol_type = other DNA
ccacaaagtgctctgggctttc

SEQ ID NO: 21601 - DNA, 22 bp, synthetic construct
  misc_feature 1..22: note = Synthetic Construct
  source 1..22: mol_type = other DNA
gagtgttgaggacggaaagtca

SEQ ID NO: 21602 - DNA, 22 bp, synthetic construct
  misc_feature 1..22: note = Synthetic Construct
  source 1..22: mol_type = other DNA
ccctatgggaggcaacccttct

SEQ ID NO: 21603 - DNA, 21 bp, synthetic construct
  misc_feature 1..21: note = Synthetic Construct
  source 1..21: mol_type = other DNA
tgaggatcgcattgagcaaca

SEQ ID NO: 21604 - DNA, 26 bp, synthetic construct
  misc_feature 1..26: note = Synthetic Construct
  source 1..26: mol_type = other DNA
ccaggctgctaaacattttccagaga

SEQ ID NO: 21605 - DNA, 23 bp, synthetic construct
  misc_feature 1..23: note = Synthetic Construct
  source 1..23: mol_type = other DNA
ggagtcatgccttctgcaatttt

SEQ ID NO: 21606 - DNA, 26 bp, synthetic construct
  misc_feature 1..26: note = Synthetic Construct
  source 1..26: mol_type = other DNA
gaagtgggtagagatggaagaaggaa

SEQ ID NO: 21607 - DNA, 23 bp, synthetic construct
  misc_feature 1..23: note = Synthetic Construct
  source 1..23: mol_type = other DNA
cttgactgatagttcccggcttt

SEQ ID NO: 21608 - DNA, 22 bp, synthetic construct
  misc_feature 1..22: note = Synthetic Construct
  source 1..22: mol_type = other DNA
ggaacactggggacttgtctga

SEQ ID NO: 21609 - DNA, 24 bp, synthetic construct
  misc_feature 1..24: note = Synthetic Construct
  source 1..24: mol_type = other DNA
ggaagtccaggagtggagatgtca

SEQ ID NO: 21610 - DNA, 22 bp, synthetic construct
  misc_feature 1..22: note = Synthetic Construct
  source 1..22: mol_type = other DNA
tcctttgggtaccaggagatga

SEQ ID NO: 21611 - DNA, 21 bp, synthetic construct
  misc_feature 1..21: note = Synthetic Construct
  source 1..21: mol_type = other DNA
ggcttcatctccacccatgaa

SEQ ID NO: 21612 - DNA, 26 bp, synthetic construct
  misc_feature 1..26: note = Synthetic Construct
  source 1..26: mol_type = other DNA
gcctcccaatataactgactgctttc

SEQ ID NO: 21613 - DNA, 25 bp, synthetic construct
  misc_feature 1..25: note = Synthetic Construct
  source 1..25: mol_type = other DNA
gacatgagggagagaggtgttctca

SEQ ID NO: 21614 - DNA, 25 bp, synthetic construct
  misc_feature 1..25: note = Synthetic Construct
  source 1..25: mol_type = other DNA
ggagacactacctgtaggtcaaaag

SEQ ID NO: 21615 - DNA, 23 bp, synthetic construct
  misc_feature 1..23: note = Synthetic Construct
  source 1..23: mol_type = other DNA
gctatcactgggttctccgaact

SEQ ID NO: 21616 - DNA, 29 bp, synthetic construct
  misc_feature 1..29: note = Synthetic Construct
  source 1..29: mol_type = other DNA
ggtcttattaaccctaagaagctgtgaac

SEQ ID NO: 21617 - DNA, 24 bp, synthetic construct
  misc_feature 1..24: note = Synthetic Construct
  source 1..24: mol_type = other DNA
acttctcgcagctttcctaaatca

SEQ ID NO: 21618 - DNA, 22 bp, synthetic construct
  misc_feature 1..22: note = Synthetic Construct
  source 1..22: mol_type = other DNA
gacagccttacagagactgctt

SEQ ID NO: 21619 - DNA, 20 bp, synthetic construct
  misc_feature 1..20: note = Synthetic Construct
  source 1..20: mol_type = other DNA
agtgagtggctcctgcatgt

SEQ ID NO: 21620 - DNA, 25 bp, synthetic construct
  misc_feature 1..25: note = Synthetic Construct
  source 1..25: mol_type = other DNA
gaagctgtagcaaggaggagaaatg

SEQ ID NO: 21621 - DNA, 22 bp, synthetic construct
  misc_feature 1..22: note = Synthetic Construct
  source 1..22: mol_type = other DNA
aggctcaccttgcatccacttg

SEQ ID NO: 21622 - DNA, 23 bp, synthetic construct
  misc_feature 1..23: note = Synthetic Construct
  source 1..23: mol_type = other DNA
actcaccaaagtgtgccctaaac

SEQ ID NO: 21623 - DNA, 24 bp, synthetic construct
  misc_feature 1..24: note = Synthetic Construct
  source 1..24: mol_type = other DNA
agaagacatggagttgggatttgt

SEQ ID NO: 21624 - DNA, 20 bp, synthetic construct
  misc_feature 1..20: note = Synthetic Construct
  source 1..20: mol_type = other DNA
gcgtcactgttggcatcaca

SEQ ID NO: 21625 - DNA, 20 bp, synthetic construct
  misc_feature 1..20: note = Synthetic Construct
  source 1..20: mol_type = other DNA
actgcctggcctgctatttc

SEQ ID NO: 21626 - DNA, 26 bp, synthetic construct
  misc_feature 1..26: note = Synthetic Construct
  source 1..26: mol_type = other DNA
ggattgtgacagcacagtaacagttg

SEQ ID NO: 21627 - DNA, 27 bp, synthetic construct
  misc_feature 1..27: note = Synthetic Construct
  source 1..27: mol_type = other DNA
tcacaatctggagtcacagacattatc

SEQ ID NO: 21628 - DNA, 22 bp, synthetic construct
  misc_feature 1..22: note = Synthetic Construct
  source 1..22: mol_type = other DNA
ggagtcagtggcctgagttcta

SEQ ID NO: 21629 - DNA, 22 bp, synthetic construct
  misc_feature 1..22: note = Synthetic Construct
  source 1..22: mol_type = other DNA
cgccaccagacaaatggtgttg

SEQ ID NO: 21630 - DNA, 25 bp, synthetic construct
  misc_feature 1..25: note = Synthetic Construct
  source 1..25: mol_type = other DNA
cccagtttctgcttcaactcactgt

SEQ ID NO: 21631 - DNA, 27 bp, synthetic construct
  misc_feature 1..27: note = Synthetic Construct
  source 1..27: mol_type = other DNA
ccttgatctgtctgactgagtggattt

SEQ ID NO: 21632 - DNA, 24 bp, synthetic construct
  misc_feature 1..24: note = Synthetic Construct
  source 1..24: mol_type = other DNA
ggggttgagaatgaacttgtcact

SEQ ID NO: 21633 - DNA, 26 bp, synthetic construct
  misc_feature 1..26: note = Synthetic Construct
  source 1..26: mol_type = other DNA
cctgcaattcttgactgaatggtttg

SEQ ID NO: 21634 - DNA, 23 bp, synthetic construct
  misc_feature 1..23: note = Synthetic Construct
  source 1..23: mol_type = other DNA
gagggaagaaggttcaggtcagt

SEQ ID NO: 21635 - DNA, 22 bp, synthetic construct
  misc_feature 1..22: note = Synthetic Construct
  source 1..22: mol_type = other DNA
cccactgtgccccatgttgttt

SEQ ID NO: 21636 - DNA, 23 bp, synthetic construct
  misc_feature 1..23: note = Synthetic Construct
  source 1..23: mol_type = other DNA
ggtggaaggctaccctgacatac

SEQ ID NO: 21637 - DNA, 22 bp, synthetic construct
  misc_feature 1..22: note = Synthetic Construct
  source 1..22: mol_type = other DNA
gcctgatgtgatgggaggttgt

SEQ ID NO: 21638 - DNA, 23 bp, synthetic construct
  misc_feature 1..23: note = Synthetic Construct
  source 1..23: mol_type = other DNA
tgcgggaaattccagtgattaga

SEQ ID NO: 21639 - DNA, 25 bp, synthetic construct
  misc_feature 1..25: note = Synthetic Construct
  source 1..25: mol_type = other DNA
ccctccacacagattggtaagcaaa

SEQ ID NO: 21640 - DNA, 24 bp, synthetic construct
  misc_feature 1..24: note = Synthetic Construct
  source 1..24: mol_type = other DNA
ggtgtgtctgaggatagacgttac

SEQ ID NO: 21641 - DNA, 24 bp, synthetic construct
  misc_feature 1..24: note = Synthetic Construct
  source 1..24: mol_type = other DNA
gtcagcgtctctctccctgataca

SEQ ID NO: 21642 - DNA, 22 bp, synthetic construct
  misc_feature 1..22: note = Synthetic Construct
  source 1..22: mol_type = other DNA
ctctccatgtctggtcccttgt

SEQ ID NO: 21643 - DNA, 23 bp, synthetic construct
  misc_feature 1..23: note = Synthetic Construct
  source 1..23: mol_type = other DNA
ctccaccatgcaacttgtgaaag

SEQ ID NO: 21644 - DNA, 24 bp, synthetic construct
  misc_feature 1..24: note = Synthetic Construct
  source 1..24: mol_type = other DNA
gcctggtccaccctagaaggaata

SEQ ID NO: 21645 - DNA, 21 bp, synthetic construct
  misc_feature 1..21: note = Synthetic Construct
  source 1..21: mol_type = other DNA
caagactgagctggtctgcaa

SEQ ID NO: 21646 - DNA, 25 bp, synthetic construct
  misc_feature 1..25: note = Synthetic Construct
  source 1..25: mol_type = other DNA
gcttcaggggaagttttgtccatac

SEQ ID NO: 21647 - DNA, 23 bp, synthetic construct
  misc_feature 1..23: note = Synthetic Construct
  source 1..23: mol_type = other DNA
ctgggtgctctgagaaaggtgat

SEQ ID NO: 21648 - DNA, 24 bp, synthetic construct
  misc_feature 1..24: note = Synthetic Construct
  source 1..24: mol_type = other DNA
gcccgctgaagatgagatttcaag

SEQ ID NO: 21649 - DNA, 23 bp, synthetic construct
  misc_feature 1..23: note = Synthetic Construct
  source 1..23: mol_type = other DNA
cctgccaaaaagagaagggaact

SEQ ID NO: 21650 - DNA, 24 bp, synthetic construct
  misc_feature 1..24: note = Synthetic Construct
  source 1..24: mol_type = other DNA
gaccttgctaggcactgtgatttg

SEQ ID NO: 21651 - DNA, 27 bp, synthetic construct
  misc_feature 1..27: note = Synthetic Construct
  source 1..27: mol_type = other DNA
caggatgcagtaaatggcaaagactac

SEQ ID NO: 21652 - DNA, 23 bp, synthetic construct
  misc_feature 1..23: note = Synthetic Construct
  source 1..23: mol_type = other DNA
tttacaggctagatgcggaaaca

SEQ ID NO: 21653 - DNA, 23 bp, synthetic construct
  misc_feature 1..23: note = Synthetic Construct
  source 1..23: mol_type = other DNA
tgaggacgagggatgagaagatg

SEQ ID NO: 21654 - DNA, 23 bp, synthetic construct
  misc_feature 1..23: note = Synthetic Construct
  source 1..23: mol_type = other DNA
ggtttgctctgcagtctggtcaa

SEQ ID NO: 21655 - DNA, 21 bp, synthetic construct
  misc_feature 1..21: note = Synthetic Construct
  source 1..21: mol_type = other DNA
tccatgggacttgaggtggaa

SEQ ID NO: 21656 - DNA, 20 bp, synthetic construct
  misc_feature 1..20: note = Synthetic Construct
  source 1..20: mol_type = other DNA
gccaagcagatctccactgt

SEQ ID NO: 21657 - DNA, 22 bp, synthetic construct
  misc_feature 1..22: note = Synthetic Construct
  source 1..22: mol_type = other DNA
catacccacctcaggctactgt

SEQ ID NO: 21658 - DNA, 28 bp, synthetic construct
  misc_feature 1..28: note = Synthetic Construct
  source 1..28: mol_type = other DNA
ggagtctcaatccctgcaatagaacagt

SEQ ID NO: 21659 - DNA, 24 bp, synthetic construct
  misc_feature 1..24: note = Synthetic Construct
  source 1..24: mol_type = other DNA
ctccctccttcattggtgaagaca

SEQ ID NO: 21660 - DNA, 23 bp, synthetic construct
  misc_feature 1..23: note = Synthetic Construct
  source 1..23: mol_type = other DNA
tcaatgcggtaatgggtcctaag

SEQ ID NO: 21661 - DNA, 26 bp, synthetic construct
  misc_feature 1..26: note = Synthetic Construct
  source 1..26: mol_type = other DNA
cagctaacacagtatctcttcactca

SEQ ID NO: 21662 - DNA, 23 bp, synthetic construct
  misc_feature 1..23: note = Synthetic Construct
  source 1..23: mol_type = other DNA
cgacaaagtttgcaggcagtaac

SEQ ID NO: 21663 - DNA, 22 bp, synthetic construct
  misc_feature 1..22: note = Synthetic Construct
  source 1..22: mol_type = other DNA
ccttgtctgtcaccctggttca

SEQ ID NO: 21664 - DNA, 22 bp, synthetic construct
  misc_feature 1..22: note = Synthetic Construct
  source 1..22: mol_type = other DNA
ctgcctgcaagtcaggatgaga

SEQ ID NO: 21665 - DNA, 26 bp, synthetic construct
  misc_feature 1..26: note = Synthetic Construct
  source 1..26: mol_type = other DNA
ctctccttcccctttaaaccttgtga

SEQ ID NO: 21666 - DNA, 22 bp, synthetic construct
  misc_feature 1..22: note = Synthetic Construct
  source 1..22: mol_type = other DNA
ggtcctggcccagttccaattt

SEQ ID NO: 21667 - DNA, 19 bp, synthetic construct
  misc_feature 1..19: note = Synthetic Construct
  source 1..19: mol_type = other DNA
agcaggttggggccaatga

SEQ ID NO: 21668 - DNA, 22 bp, synthetic construct
  misc_feature 1..22: note = Synthetic Construct
  source 1..22: mol_type = other DNA
agctggagtgaggatggagttc

SEQ ID NO: 21669 - DNA, 22 bp, synthetic construct
  misc_feature 1..22: note = Synthetic Construct
  source 1..22: mol_type = other DNA
agtgcgaggaagccaccatcta

SEQ ID NO: 21670 - DNA, 24 bp, synthetic construct
  misc_feature 1..24: note = Synthetic Construct
  source 1..24: mol_type = other DNA
gacctggtattggtgaccctaaga

SEQ ID NO: 21671 - DNA, 24 bp, synthetic construct
  misc_feature 1..24: note = Synthetic Construct
  source 1..24: mol_type = other DNA
ggctgggacatgaaatccttgact

SEQ ID NO: 21672 - DNA, 24 bp, synthetic construct
  misc_feature 1..24: note = Synthetic Construct
  source 1..24: mol_type = other DNA
cgctgttggttaaatttgcagttg

SEQ ID NO: 21673 - DNA, 20 bp, synthetic construct
  misc_feature 1..20: note = Synthetic Construct
  source 1..20: mol_type = other DNA
gcagccacagacaacacaga

SEQ ID NO: 21674 - DNA, 24 bp, synthetic construct
  misc_feature 1..24: note = Synthetic Construct
  source 1..24: mol_type = other DNA
ggtgacatggtgggtagtggatga

SEQ ID NO: 21675 - DNA, 25 bp, synthetic construct
  misc_feature 1..25: note = Synthetic Construct
  source 1..25: mol_type = other DNA
ggttttgagagggtaggtaggtttg

SEQ ID NO: 21676 - DNA, 26 bp, synthetic construct
  misc_feature 1..26: note = Synthetic Construct
  source 1..26: mol_type = other DNA
gcagtgtcttggaaaggaaagggata

SEQ ID NO: 21677 - DNA, 23 bp, synthetic construct
  misc_feature 1..23: note = Synthetic Construct
  source 1..23: mol_type = other DNA
ctggtgttaggctcctggatatg

SEQ ID NO: 21678 - DNA, 20 bp, synthetic construct
  misc_feature 1..20: note = Synthetic Construct
  source 1..20: mol_type = other DNA
tgcctggtgccttcacactt

SEQ ID NO: 21679 - DNA, 26 bp, synthetic construct
  misc_feature 1..26: note = Synthetic Construct
  source 1..26: mol_type = other DNA
cagcctcttagtttttccacccttct

SEQ ID NO: 21680 - DNA, 23 bp, synthetic construct
  misc_feature 1..23: note = Synthetic Construct
  source 1..23: mol_type = other DNA
atgtgtagggactagaggtcgtt

SEQ ID NO: 21681 - DNA, 22 bp, synthetic construct
  misc_feature 1..22: note = Synthetic Construct
  source 1..22: mol_type = other DNA
ctccagagagtgacctctccat

SEQ ID NO: 21682 - DNA, 19 bp, synthetic construct
  misc_feature 1..19: note = Synthetic Construct
  source 1..19: mol_type = other DNA
tcccagctccaggctccaa

SEQ ID NO: 21683 - DNA, 29 bp, synthetic construct
  misc_feature 1..29: note = Synthetic Construct
  source 1..29: mol_type = other DNA
gggatcagtggaaacattgaatgcctttt

SEQ ID NO: 21684 - DNA, 25 bp, synthetic construct
  misc_feature 1..25: note = Synthetic Construct
  source 1..25: mol_type = other DNA
gcagagggtttatcccattccaaac

SEQ ID NO: 21685 - DNA, 27 bp, synthetic construct
  misc_feature 1..27: note = Synthetic Construct
  source 1..27: mol_type = other DNA
gcttgttacacagctgcctattatttc

SEQ ID NO: 21686 - DNA, 26 bp, synthetic construct
  misc_feature 1..26: note = Synthetic Construct
  source 1..26: mol_type = other DNA
gtgcactgaaattcctcagtggttac

SEQ ID NO: 21687 - DNA, 25 bp, synthetic construct
  misc_feature 1..25: note = Synthetic Construct
  source 1..25: mol_type = other DNA
gcaaagctgtcttttgtgaggaaga

SEQ ID NO: 21688 - DNA, 22 bp, synthetic construct
  misc_feature 1..22: note = Synthetic Construct
  source 1..22: mol_type = other DNA
tctacctgcaaaggtccactca

SEQ ID NO: 21689 - DNA, 20 bp, synthetic construct
  misc_feature 1..20: note = Synthetic Construct
  source 1..20: mol_type = other DNA
tggtggatgaaggcgacgtt

SEQ ID NO: 21690 - DNA, 27 bp, synthetic construct
  misc_feature 1..27: note = Synthetic Construct
  source 1..27: mol_type = other DNA
gccatatttgctgtttcacagccttag

SEQ ID NO: 21691 - DNA, 27 bp, synthetic construct
  misc_feature 1..27: note = Synthetic Construct
  source 1..27: mol_type = other DNA
gcacggtttcatcactaagttgagatt

SEQ ID NO: 21692 - DNA, 20 bp, synthetic construct
  misc_feature 1..20: note = Synthetic Construct
  source 1..20: mol_type = other DNA
ggctgcatcaaacccactct

SEQ ID NO: 21693 - DNA, 22 bp, synthetic construct
  misc_feature 1..22: note = Synthetic Construct
  source 1..22: mol_type = other DNA
gccatcacctaggtccaactac

SEQ ID NO: 21694 - DNA, 24 bp, synthetic construct
  misc_feature 1..24: note = Synthetic Construct
  source 1..24: mol_type = other DNA
gtcaagctcaactgtcatctgctt

SEQ ID NO: 21695 - DNA, 26 bp, synthetic construct
  misc_feature 1..26: note = Synthetic Construct
  source 1..26: mol_type = other DNA
gccttcatcgaggtaggataatttgt

SEQ ID NO: 21696 - DNA, 22 bp, synthetic construct
  misc_feature 1..22: note = Synthetic Construct
  source 1..22: mol_type = other DNA
gtgtgctcatccatcccacctt

SEQ ID NO: 21697 - DNA, 25 bp, synthetic construct
  misc_feature 1..25: note = Synthetic Construct
  source 1..25: mol_type = other DNA
cccaaactgcctattctaggacgaa

SEQ ID NO: 21698 - DNA, 22 bp, synthetic construct
  misc_feature 1..22: note = Synthetic Construct
  source 1..22: mol_type = other DNA
acaggctcttgacccctaaagt

SEQ ID NO: 21699 - DNA, 24 bp, synthetic construct
  misc_feature 1..24: note = Synthetic Construct
  source 1..24: mol_type = other DNA
cgtggcagaatttgtttggagaga

SEQ ID NO: 21700 - DNA, 21 bp, synthetic construct
  misc_feature 1..21: note = Synthetic Construct
  source 1..21: mol_type = other DNA
agccctgtgaaagggagattg

SEQ ID NO: 21701 - DNA, 21 bp, synthetic construct
  misc_feature 1..21: note = Synthetic Construct
  source 1..21: mol_type = other DNA
agcctctggaagagccaggaa

SEQ ID NO: 21702 - DNA, 23 bp, synthetic construct
  misc_feature 1..23: note = Synthetic Construct
  source 1..23: mol_type = other DNA
gccataccaccaagggctatttg

SEQ ID NO: 21703 - DNA, 22 bp, synthetic construct
  misc_feature 1..22: note = Synthetic Construct
  source 1..22: mol_type = other DNA
gggcagcgtgttagaccctaaa

SEQ ID NO: 21704 - DNA, 22 bp, synthetic construct
  misc_feature 1..22: note = Synthetic Construct
  source 1..22: mol_type = other DNA
cccagtgacctttcctcaccat

SEQ ID NO: 21705 - DNA, 27 bp, synthetic construct
  misc_feature 1..27: note = Synthetic Construct
  source 1..27: mol_type = other DNA
ctgctgaaattagaggttaggctgaga

SEQ ID NO: 21706 - DNA, 24 bp, synthetic construct
  misc_feature 1..24: note = Synthetic Construct
  source 1..24: mol_type = other DNA
actgttcccagattttcagcaaac

SEQ ID NO: 21707 - DNA, 24 bp, synthetic construct
  misc_feature 1..24: note = Synthetic Construct
  source 1..24: mol_type = other DNA
ggggattagggtgctaatggattc

SEQ ID NO: 21708 - DNA, 24 bp, synthetic construct
  misc_feature 1..24: note = Synthetic Construct
  source 1..24: mol_type = other DNA
gctgggaacacaggtgcatgtaag

SEQ ID NO: 21709 - DNA, 20 bp, synthetic construct
  misc_feature 1..20: note = Synthetic Construct
  source 1..20: mol_type = other DNA
gaccctgttgtgaggctgtt

SEQ ID NO: 21710 - DNA, 26 bp, synthetic construct
  misc_feature 1..26: note = Synthetic Construct
  source 1..26: mol_type = other DNA
ccgtaaaacaccaatgactacctttg

SEQ ID NO: 21711 - DNA, 24 bp, synthetic construct
  misc_feature 1..24: note = Synthetic Construct
  source 1..24: mol_type = other DNA
gggctgcatgaaacagaacgtgta

SEQ ID NO: 21712 - DNA, 22 bp, synthetic construct
  misc_feature 1..22: note = Synthetic Construct
  source 1..22: mol_type = other DNA
ctcaacccagtagccagagtga

SEQ ID NO: 21713 - DNA, 22 bp, synthetic construct
  misc_feature 1..22: note = Synthetic Construct
  source 1..22: mol_type = other DNA
tgggcatcttacatgggtgttg

SEQ ID NO: 21714 - DNA, 24 bp, synthetic construct
  misc_feature 1..24: note = Synthetic Construct
  source 1..24: mol_type = other DNA
cagccttcatgctttctgaacttg

SEQ ID NO: 21715 - DNA, 24 bp, synthetic construct
  misc_feature 1..24: note = Synthetic Construct
  source 1..24: mol_type = other DNA
ggaaagtcagcattagcagcaagt

SEQ ID NO: 21716 - DNA, 24 bp, synthetic construct
  misc_feature 1..24: note = Synthetic Construct
  source 1..24: mol_type = other DNA
ggcttgttactcaccccaggaaga

SEQ ID NO: 21717 - DNA, 22 bp, synthetic construct
  misc_feature 1..22: note = Synthetic Construct
  source 1..22: mol_type = other DNA
tgtctgggctcttgcatctttg

SEQ ID NO: 21718 - DNA, 25 bp, synthetic construct
  misc_feature 1..25: note = Synthetic Construct
  source 1..25: mol_type = other DNA
caaacctgcatgtgatacgtttaga

SEQ ID NO: 21719 - DNA, 27 bp, synthetic construct
  misc_feature 1..27: note = Synthetic Construct
  source 1..27: mol_type = other DNA
gcaacatacccaaatgctaatgctagt

SEQ ID NO: 21720 - DNA, 22 bp, synthetic construct
  misc_feature 1..22: note = Synthetic Construct
  source 1..22: mol_type = other DNA
ccagcagtggctgttctctgaa

SEQ ID NO: 21721 - DNA, 22 bp, synthetic construct
  misc_feature 1..22: note = Synthetic Construct
  source 1..22: mol_type = other DNA
tcgcctctacggaccaaacttc

SEQ ID NO: 21722 - DNA, 21 bp, synthetic construct
  misc_feature 1..21: note = Synthetic Construct
  source 1..21: mol_type = other DNA
gggcttgtttcgagggtcact

SEQ ID NO: 21723 - DNA, 26 bp, synthetic construct
  misc_feature 1..26: note = Synthetic Construct
  source 1..26: mol_type = other DNA
cccagttagtaacaaagagtggtttc

SEQ ID NO: 21724 - DNA, 22 bp, synthetic construct
  misc_feature 1..22: note = Synthetic Construct
  source 1..22: mol_type = other DNA
ggccacgcagctagtaaacaga

SEQ ID NO: 21725 - DNA, 21 bp, synthetic construct
  misc_feature 1..21: note = Synthetic Construct
  source 1..21: mol_type = other DNA
cgtcacatggcttgggctttc

SEQ ID NO: 21726 - DNA, 21 bp, synthetic construct
  misc_feature 1..21: note = Synthetic Construct
  source 1..21: mol_type = other DNA
aacgtgctcacagggagaaaa

SEQ ID NO: 21727 - DNA, 20 bp, synthetic construct
  misc_feature 1..20: note = Synthetic Construct
  source 1..20: mol_type = other DNA
gccagctccatggcctttgt

SEQ ID NO: 21728 - DNA, 27 bp, synthetic construct
  misc_feature 1..27: note = Synthetic Construct
  source 1..27: mol_type = other DNA
ggactcaaagacattgatttcccttca

SEQ ID NO: 21729 - DNA, 27 bp, synthetic construct
  misc_feature 1..27: note = Synthetic Construct
  source 1..27: mol_type = other DNA
caaggtctatatcccttccccttgaac

SEQ ID NO: 21730 - DNA, 23 bp, synthetic construct
  misc_feature 1..23: note = Synthetic Construct
  source 1..23: mol_type = other DNA
ggagggctttggtgttctgaatc

SEQ ID NO: 21731 - DNA, 24 bp, synthetic construct
  misc_feature 1..24: note = Synthetic Construct
  source 1..24: mol_type = other DNA
gcctttactttcctagtgggatga

SEQ ID NO: 21732 - DNA, 24 bp, synthetic construct
  misc_feature 1..24: note = Synthetic Construct
  source 1..24: mol_type = other DNA
caggaaatgggagcttagaaggtt

SEQ ID NO: 21733 - DNA, 24 bp, synthetic construct
  misc_feature 1..24: note = Synthetic Construct
  source 1..24: mol_type = other DNA
acctagttacagactgggctctac

SEQ ID NO: 21734 - DNA, 25 bp, synthetic construct
  misc_feature 1..25: note = Synthetic Construct
  source 1..25: mol_type = other DNA
aagagcaagaatcatccgtatctgt

SEQ ID NO: 21735 - DNA, 30 bp, synthetic construct
  misc_feature 1..30: note = Synthetic Construct
  source 1..30: mol_type = other DNA
cctagagataggagcatctacttctcacaa

SEQ ID NO: 21736 - DNA, 22 bp, synthetic construct
  misc_feature 1..22: note = Synthetic Construct
  source 1..22: mol_type = other DNA
tcccctggcatatggtggttca

SEQ ID NO: 21737 - DNA, 25 bp, synthetic construct
  misc_feature 1..25: note = Synthetic Construct
  source 1..25: mol_type = other DNA
ttcaccacattgtcctgattactgt

SEQ ID NO: 21738 - DNA, 23 bp, synthetic construct
  misc_feature 1..23: note = Synthetic Construct
  source 1..23: mol_type = other DNA
gtgggttaggatggtaggtgctt

SEQ ID NO: 21739 - DNA, 20 bp, synthetic construct
  misc_feature 1..20: note = Synthetic Construct
  source 1..20: mol_type = other DNA
ccttaagcgcatgccagaca

SEQ ID NO: 21740 - DNA, 21 bp, synthetic construct
  misc_feature 1..21: note = Synthetic Construct
  source 1..21: mol_type = other DNA
ttgtcagtggccacgcctttc

SEQ ID NO: 21741 - DNA, 23 bp, synthetic construct
  misc_feature 1..23: note = Synthetic Construct
  source 1..23: mol_type = other DNA
cctaaggaagggtctctccttct

SEQ ID NO: 21742 - DNA, 21 bp, synthetic construct
  misc_feature 1..21: note = Synthetic Construct
  source 1..21: mol_type = other DNA
tgcctcactccagggctttac

SEQ ID NO: 21743 - DNA, 20 bp, synthetic construct
  misc_feature 1..20: note = Synthetic Construct
  source 1..20: mol_type = other DNA
tccttggcctcagcgacctt

SEQ ID NO: 21744 - DNA, 20 bp, synthetic construct
  misc_feature 1..20: note = Synthetic Construct
  source 1..20: mol_type = other DNA
ggagaccatggctgctgttg

SEQ ID NO: 21745 - DNA, 25 bp, synthetic construct
  misc_feature 1..25: note = Synthetic Construct
  source 1..25: mol_type = other DNA
ccccaagtcttttctagagggatga

SEQ ID NO: 21746 - DNA, 22 bp, synthetic construct
  misc_feature 1..22: note = Synthetic Construct
  source 1..22: mol_type = other DNA
cccttgtgggaagtgagaaaca

SEQ ID NO: 21747 - DNA, 23 bp, synthetic construct
  misc_feature 1..23: note = Synthetic Construct
  source 1..23: mol_type = other DNA
aggacatgacctaccccagattc

SEQ ID NO: 21748 - DNA, 26 bp, synthetic construct
  misc_feature 1..26: note = Synthetic Construct
  source 1..26: mol_type = other DNA
ccacttggctctcatttctctctttc

SEQ ID NO: 21749 - DNA, 28 bp, synthetic construct
  misc_feature 1..28: note = Synthetic Construct
  source 1..28: mol_type = other DNA
cgtttccacactccccattatacttaca

SEQ ID NO: 21750 - DNA, 24 bp, synthetic construct
  misc_feature 1..24: note = Synthetic Construct
  source 1..24: mol_type = other DNA
caaaagtagtcctggtgctgattg

SEQ ID NO: 21751 - DNA, 22 bp, synthetic construct
  misc_feature 1..22: note = Synthetic Construct
  source 1..22: mol_type = other DNA
ggtgactgtgtactgggcttct

SEQ ID NO: 21752 - DNA, 24 bp, synthetic construct
  misc_feature 1..24: note = Synthetic Construct
  source 1..24: mol_type = other DNA
gccttgaatgacggctctttcctt

SEQ ID NO: 21753 - DNA, 24 bp, synthetic construct
  misc_feature 1..24: note = Synthetic Construct
  source 1..24: mol_type = other DNA
agaaaccgttatggtggattgctt

SEQ ID NO: 21754 - DNA, 21 bp, synthetic construct
  misc_feature 1..21: note = Synthetic Construct
  source 1..21: mol_type = other DNA
tggtcccacatttccaagcaa

SEQ ID NO: 21755 - DNA, 25 bp, synthetic construct
  misc_feature 1..25: note = Synthetic Construct
  source 1..25: mol_type = other DNA
gagcagagatggctgtaagtcaaac

SEQ ID NO: 21756 - DNA, 25 bp, synthetic construct
  misc_feature 1..25: note = Synthetic Construct
  source 1..25: mol_type = other DNA
ggcatatcccaccagaaatgggttt

SEQ ID NO: 21757 - DNA, 21 bp, synthetic construct
  misc_feature 1..21: note = Synthetic Construct
  source 1..21: mol_type = other DNA
ccggggcctatcctagcatgt

SEQ ID NO: 21758 - DNA, 24 bp, synthetic construct
  misc_feature 1..24: note = Synthetic Construct
  source 1..24: mol_type = other DNA
ttcctccaatccagttgtctcttc

SEQ ID NO: 21759 - DNA, 22 bp, synthetic construct
  misc_feature 1..22: note = Synthetic Construct
  source 1..22: mol_type = other DNA
ggaggaaggtgtgggctacata

SEQ ID NO: 21760 - DNA, 22 bp, synthetic construct
  misc_feature 1..22: note = Synthetic Construct
  source 1..22: mol_type = other DNA
gggtttgtagtcggagctcttg

SEQ ID NO: 21761 - DNA, 27 bp, synthetic construct
  misc_feature 1..27: note = Synthetic Construct
  source 1..27: mol_type = other DNA
gctccacctaagtgtaaatggagttca

SEQ ID NO: 21762 - DNA, 30 bp, synthetic construct
  misc_feature 1..30: note = Synthetic Construct
  source 1..30: mol_type = other DNA
ctgttgtggtcttatggaaacttgatctga

SEQ ID NO: 21763 - DNA, 22 bp, synthetic construct
  misc_feature 1..22: note = Synthetic Construct
  source 1..22: mol_type = other DNA
tccccaaaacccaggtccatga

SEQ ID NO: 21764 - DNA, 24 bp, synthetic construct
  misc_feature 1..24: note = Synthetic Construct
  source 1..24: mol_type = other DNA
gaggaaggccagattgagggtaac

SEQ ID NO: 21765 - DNA, 22 bp, synthetic construct
  misc_feature 1..22: note = Synthetic Construct
  source 1..22: mol_type = other DNA
agacagttgccagaagtcacaa

SEQ ID NO: 21766 - DNA, 22 bp, synthetic construct
  misc_feature 1..22: note = Synthetic Construct
  source 1..22: mol_type = other DNA
gcatctgccaacagatgtgtga

SEQ ID NO: 21767 - DNA, 22 bp, synthetic construct
  misc_feature 1..22: note = Synthetic Construct
  source 1..22: mol_type = other DNA
ggtgctacccacttccaaggtt

SEQ ID NO: 21768 - DNA, 21 bp, synthetic construct
  misc_feature 1..21: note = Synthetic Construct
  source 1..21: mol_type = other DNA
tccacctccaatccacctcaa

SEQ ID NO: 21769 - DNA, 24 bp, synthetic construct
  misc_feature 1..24: note = Synthetic Construct
  source 1..24: mol_type = other DNA
acaggtggccttttagagagtttc

SEQ ID NO: 21770 - DNA, 24 bp, synthetic construct
  misc_feature 1..24: note = Synthetic Construct
  source 1..24: mol_type = other DNA
cctcccctcttaccctgttcttct

SEQ ID NO: 21771 - DNA, 20 bp, synthetic construct
  misc_feature 1..20: note = Synthetic Construct
  source 1..20: mol_type = other DNA
tccaagtggagtggggagaa

SEQ ID NO: 21772 - DNA, 27 bp, synthetic construct
  misc_feature 1..27: note = Synthetic Construct
  source 1..27: mol_type = other DNA
gaccctacagaagaaagttgtgaacat

SEQ ID NO: 21773 - DNA, 23 bp, synthetic construct
  misc_feature 1..23: note = Synthetic Construct
  source 1..23: mol_type = other DNA
gggcagaaatgcccaatgtgaag

SEQ ID NO: 21774 - DNA, 24 bp, synthetic construct
  misc_feature 1..24: note = Synthetic Construct
  source 1..24: mol_type = other DNA
cactcagcagatgaggagatgtgt

SEQ ID NO: 21775 - DNA, 21 bp, synthetic construct
  misc_feature 1..21: note = Synthetic Construct
  source 1..21: mol_type = other DNA
acacaggtgccttccactatg

SEQ ID NO: 21776 - DNA, 19 bp, synthetic construct
  misc_feature 1..19: note = Synthetic Construct
  source 1..19: mol_type = other DNA
ttggcggcgtccactgaga

SEQ ID NO: 21777 - DNA, 22 bp, synthetic construct
  misc_feature 1..22: note = Synthetic Construct
  source 1..22: mol_type = other DNA
cgggcctccttgttatgctaga

SEQ ID NO: 21778 - DNA, 22 bp, synthetic construct
  misc_feature 1..22: note = Synthetic Construct
  source 1..22: mol_type = other DNA
cgaggcaggacttccctttgtt

SEQ ID NO: 21779 - DNA, 23 bp, synthetic construct
  misc_feature 1..23: note = Synthetic Construct
  source 1..23: mol_type = other DNA
cttcctggatggctggacttaaa

SEQ ID NO: 21780 - DNA, 26 bp, synthetic construct
  misc_feature 1..26: note = Synthetic Construct
  source 1..26: mol_type = other DNA
caagtccagcctactcaatttacgtt

SEQ ID NO: 21781 - DNA, 25 bp, synthetic construct
  misc_feature 1..25: note = Synthetic Construct
  source 1..25: mol_type = other DNA
ccacctttcctctgtttcagcctta

SEQ ID NO: 21782 - DNA, 22 bp, synthetic construct
  misc_feature 1..22: note = Synthetic Construct
  source 1..22: mol_type = other DNA
cagcacatgggagctggttttg

SEQ ID NO: 21783 - DNA, 23 bp, synthetic construct
  misc_feature 1..23: note = Synthetic Construct
  source 1..23: mol_type = other DNA
cagcagccatgctttcatcattc

SEQ ID NO: 21784 - DNA, 22 bp, synthetic construct
  misc_feature 1..22: note = Synthetic Construct
  source 1..22: mol_type = other DNA
acctcccgccatattcctctca

SEQ ID NO: 21785 - DNA, 25 bp, synthetic construct
  misc_feature 1..25: note = Synthetic Construct
  source 1..25: mol_type = other DNA
gcaagggaaatgtgtgctttattca

SEQ ID NO: 21786 - DNA, 23 bp, synthetic construct
  misc_feature 1..23: note = Synthetic Construct
  source 1..23: mol_type = other DNA
cctatggtttccggtctgtgcat

SEQ ID NO: 21787 - DNA, 26 bp, synthetic construct
  misc_feature 1..26: note = Synthetic Construct
  source 1..26: mol_type = other DNA
gtgcttatcatccaaacccagtcaac

SEQ ID NO: 21788 - DNA, 21 bp, synthetic construct
  misc_feature 1..21: note = Synthetic Construct
  source 1..21: mol_type = other DNA
gggagtggatgcagctcaaca

SEQ ID NO: 21789 - DNA, 24 bp, synthetic construct
  misc_feature 1..24: note = Synthetic Construct
  source 1..24: mol_type = other DNA
cccgtaatcgtgtctaagcacaaa

SEQ ID NO: 21790 - DNA, 27 bp, synthetic construct
  misc_feature 1..27: note = Synthetic Construct
  source 1..27: mol_type = other DNA
gcagttaagtggtttaagtggtgttag

SEQ ID NO: 21791 - DNA, 26 bp, synthetic construct
  misc_feature 1..26: note = Synthetic Construct
  source 1..26: mol_type = other DNA
ggcggctctttaaacaaactcgttct

SEQ ID NO: 21792 - DNA, 29 bp, synthetic construct
  misc_feature 1..29: note = Synthetic Construct
  source 1..29: mol_type = other DNA
cagtttgacttgtgatccattccactttg

SEQ ID NO: 21793 - DNA, 28 bp, synthetic construct
  misc_feature 1..28: note = Synthetic Construct
  source 1..28: mol_type = other DNA
ggagtcttcagtggtttttaggttcaag

SEQ ID NO: 21794 - DNA, 27 bp, synthetic construct
  misc_feature 1..27: note = Synthetic Construct
  source 1..27: mol_type = other DNA
gagaggtaactatcactcttgcctttt

SEQ ID NO: 21795 - DNA, 23 bp, synthetic construct
  misc_feature 1..23: note = Synthetic Construct
  source 1..23: mol_type = other DNA
ccaccaaaacttggactgccata

SEQ ID NO: 21796 - DNA, 20 bp, synthetic construct
  misc_feature 1..20: note = Synthetic Construct
  source 1..20: mol_type = other DNA
cggggcttctgtgggtcatt

SEQ ID NO: 21797 - DNA, 22 bp, synthetic construct
  misc_feature 1..22: note = Synthetic Construct
  source 1..22: mol_type = other DNA
gacgctgatctttacgcccaat

SEQ ID NO: 21798 - DNA, 22 bp, synthetic construct
  misc_feature 1..22: note = Synthetic Construct
  source 1..22: mol_type = other DNA
gcagtgggataagtggcttcaa

SEQ ID NO: 21799 - DNA, 23 bp, synthetic construct
  misc_feature 1..23: note = Synthetic Construct
  source 1..23: mol_type = other DNA
gggatctgaacctctttgggatt

SEQ ID NO: 21800 - DNA, 26 bp, synthetic construct
  misc_feature 1..26: note = Synthetic Construct
  source 1..26: mol_type = other DNA
gaggaacaggctctcactagacattg

SEQ ID NO: 21801 - DNA, 24 bp, synthetic construct
  misc_feature 1..24: note = Synthetic Construct
  source 1..24: mol_type = other DNA
gcccagtttcatggtcctagagaa

SEQ ID NO: 21802 - DNA, 27 bp, synthetic construct
  misc_feature 1..27: note = Synthetic Construct
  source 1..27: mol_type = other DNA
ccgaggactatagaagagtgaggtttc

SEQ ID NO: 21803 - DNA, 25 bp, synthetic construct
  misc_feature 1..25: note = Synthetic Construct
  source 1..25: mol_type = other DNA
gaaggggaatgaacaagaggagaga

SEQ ID NO: 21804 - DNA, 23 bp, synthetic construct
  misc_feature 1..23: note = Synthetic Construct
  source 1..23: mol_type = other DNA
gctcagctcacagtcccttacaa

SEQ ID NO: 21805 - DNA, 27 bp, synthetic construct
  misc_feature 1..27: note = Synthetic Construct
  source 1..27: mol_type = other DNA
gcttttggttgagttacagtgggttac

SEQ ID NO: 21806 - DNA, 24 bp, synthetic construct
  misc_feature 1..24: note = Synthetic Construct
  source 1..24: mol_type = other DNA
ggactgtgtccacatctggagctt

SEQ ID NO: 21807 - DNA, 26 bp, synthetic construct
  misc_feature 1..26: note = Synthetic Construct
  source 1..26: mol_type = other DNA
gctccatcagcttaatctaccctact

SEQ ID NO: 21808 - DNA, 23 bp, synthetic construct
  misc_feature 1..23: note = Synthetic Construct
  source 1..23: mol_type = other DNA
ctgggagtgtctctctcttgagt

SEQ ID NO: 21809 - DNA, 22 bp, synthetic construct
  misc_feature 1..22: note = Synthetic Construct
  source 1..22: mol_type = other DNA
gagaggggagaagcaggagata

SEQ ID NO: 21810 - DNA, 23 bp, synthetic construct
  misc_feature 1..23: note = Synthetic Construct
  source 1..23: mol_type = other DNA
ccagcccaagatgttctgtggat

SEQ ID NO: 21811 - DNA, 25 bp, synthetic construct
  misc_feature 1..25: note = Synthetic Construct
  source 1..25: mol_type = other DNA
ccagcattcccctcctctcaaaatc

SEQ ID NO: 21812 - DNA, 21 bp, synthetic construct
  misc_feature 1..21: note = Synthetic Construct
  source 1..21: mol_type = other DNA
tggaaagacaagccccagaca

SEQ ID NO: 21813 - DNA, 23 bp, synthetic construct
  misc_feature 1..23: note = Synthetic Construct
  source 1..23: mol_type = other DNA
ccacattccaaagccagggaaaa

SEQ ID NO: 21814 - DNA, 27 bp, synthetic construct
  misc_feature 1..27: note = Synthetic Construct
  source 1..27: mol_type = other DNA
ccacttttgagtggaaaatgcatccaa

SEQ ID NO: 21815 - DNA, 26 bp, synthetic construct
  misc_feature 1..26: note = Synthetic Construct
  source 1..26: mol_type = other DNA
ctgctgattgcctgacaatttggatt

SEQ ID NO: 21816 - DNA, 22 bp, synthetic construct
  misc_feature 1..22: note = Synthetic Construct
  source 1..22: mol_type = other DNA
accagggactgagcattaccaa

SEQ ID NO: 21817 - DNA, 24 bp, synthetic construct
  misc_feature 1..24: note = Synthetic Construct
  source 1..24: mol_type = other DNA
gcatctcaacactcacctccattg

SEQ ID NO: 21818 - DNA, 23 bp, synthetic construct
  misc_feature 1..23: note = Synthetic Construct
  source 1..23: mol_type = other DNA
gcgtgtggaaaacttggctctca

SEQ ID NO: 21819 - DNA, 21 bp, synthetic construct
  misc_feature 1..21: note = Synthetic Construct
  source 1..21: mol_type = other DNA
acctcagcctccagcacctta

SEQ ID NO: 21820 - DNA, 23 bp, synthetic construct
  misc_feature 1..23: note = Synthetic Construct
  source 1..23: mol_type = other DNA
accagcacaaccatgaaaactct

SEQ ID NO: 21821 - DNA, 21 bp, synthetic construct
  misc_feature 1..21: note = Synthetic Construct
  source 1..21: mol_type = other DNA
gctgcaatggaagccacttga

SEQ ID NO: 21822 - DNA, 20 bp, synthetic construct
  misc_feature 1..20: note = Synthetic Construct
  source 1..20: mol_type = other DNA
ggcgggacacatcaaaggaa

SEQ ID NO: 21823 - DNA, 21 bp, synthetic construct
  misc_feature 1..21: note = Synthetic Construct
  source 1..21: mol_type = other DNA
gggtcagtgggagtcctgtct

SEQ ID NO: 21824 - DNA, 20 bp, synthetic construct
  misc_feature 1..20: note = Synthetic Construct
  source 1..20: mol_type = other DNA
aggcttctccttcccagtga

SEQ ID NO: 21825 - DNA, 25 bp, synthetic construct
  misc_feature 1..25: note = Synthetic Construct
  source 1..25: mol_type = other DNA
gcctgggttctaggtaacaaagcaa

SEQ ID NO: 21826 - DNA, 21 bp, synthetic construct
  misc_feature 1..21: note = Synthetic Construct
  source 1..21: mol_type = other DNA
gccccagactgatttggactt

SEQ ID NO: 21827 - DNA, 22 bp, synthetic construct
  misc_feature 1..22: note = Synthetic Construct
  source 1..22: mol_type = other DNA
gagaagctgggaccagatcagt

SEQ ID NO: 21828 - DNA, 21 bp, synthetic construct
  misc_feature 1..21: note = Synthetic Construct
  source 1..21: mol_type = other DNA
ggaactgtccctgctggcaat

SEQ ID NO: 21829 - DNA, 25 bp, synthetic construct
  misc_feature 1..25: note = Synthetic Construct
  source 1..25: mol_type = other DNA
aacccatcacactgtcttaacttga

SEQ ID NO: 21830 - DNA, 22 bp, synthetic construct
  misc_feature 1..22: note = Synthetic Construct
  source 1..22: mol_type = other DNA
tcttgcttgccagcatcagtag

SEQ ID NO: 21831 - DNA, 23 bp, synthetic construct
  misc_feature 1..23: note = Synthetic Construct
  source 1..23: mol_type = other DNA
cacctcgcttcaaaatcctcttc

SEQ ID NO: 21832 - DNA, 24 bp, synthetic construct
  misc_feature 1..24: note = Synthetic Construct
  source 1..24: mol_type = other DNA
gcaaataccgaccccactatgtca

SEQ ID NO: 21833 - DNA, 22 bp, synthetic construct
  misc_feature 1..22: note = Synthetic Construct
  source 1..22: mol_type = other DNA
cagggtggagtgaagggctttt

SEQ ID NO: 21834 - DNA, 25 bp, synthetic construct
  misc_feature 1..25: note = Synthetic Construct
  source 1..25: mol_type = other DNA
gcaggtgttttctttccacctgtag

SEQ ID NO: 21835 - DNA, 23 bp, synthetic construct
  misc_feature 1..23: note = Synthetic Construct
  source 1..23: mol_type = other DNA
gctcacacaggctatgggtccta

SEQ ID NO: 21836 - DNA, 24 bp, synthetic construct
  misc_feature 1..24: note = Synthetic Construct
  source 1..24: mol_type = other DNA
tccacttgtctatgtgcctcattc

SEQ ID NO: 21837 - DNA, 23 bp, synthetic construct
  misc_feature 1..23: note = Synthetic Construct
  source 1..23: mol_type = other DNA
tctgcagcccaaaaatctcatct

SEQ ID NO: 21838 - DNA, 25 bp, synthetic construct
  misc_feature 1..25: note = Synthetic Construct
  source 1..25: mol_type = other DNA
cccagcgattgtgtatctaggtgtt

SEQ ID NO: 21839 - DNA, 28 bp, synthetic construct
  misc_feature 1..28: note = Synthetic Construct
  source 1..28: mol_type = other DNA
cctccctagaaggaactgtagttaatca

SEQ ID NO: 21840 - DNA, 23 bp, synthetic construct
  misc_feature 1..23: note = Synthetic Construct
  source 1..23: mol_type = other DNA
gccagcagctgaaggtaaaccaa

SEQ ID NO: 21841 - DNA, 18 bp, synthetic construct
  misc_feature 1..18: note = Synthetic Construct
  source 1..18: mol_type = other DNA
tcatgcgtgctgggcaaa

SEQ ID NO: 21842 - DNA, 20 bp, synthetic construct
  misc_feature 1..20: note = Synthetic Construct
  source 1..20: mol_type = other DNA
gcttggtttacgcccaggaa

SEQ ID NO: 21843 - DNA, 22 bp, synthetic construct
  misc_feature 1..22: note = Synthetic Construct
  source 1..22: mol_type = other DNA
ggccacagtctctgctgttgaa

SEQ ID NO: 21844 - DNA, 26 bp, synthetic construct
  misc_feature 1..26: note = Synthetic Construct
  source 1..26: mol_type = other DNA
ctcagatatgggtatgtgaccatcaa

SEQ ID NO: 21845 - DNA, 20 bp, synthetic construct
  misc_feature 1..20: note = Synthetic Construct
  source 1..20: mol_type = other DNA
ccctccatccactcgctact

SEQ ID NO: 21846 - DNA, 27 bp, synthetic construct
  misc_feature 1..27: note = Synthetic Construct
  source 1..27: mol_type = other DNA
ccttatagctgcttgctaaccaaaagt

SEQ ID NO: 21847 - DNA, 21 bp, synthetic construct
  misc_feature 1..21: note = Synthetic Construct
  source 1..21: mol_type = other DNA
gctatcctcctcacccagtca

SEQ ID NO: 21848 - DNA, 24 bp, synthetic construct
  misc_feature 1..24: note = Synthetic Construct
  source 1..24: mol_type = other DNA
ggagcagtcaggtgagaggtaaga

SEQ ID NO: 21849 - DNA, 23 bp, synthetic construct
  misc_feature 1..23: note = Synthetic Construct
  source 1..23: mol_type = other DNA
gccctggggaaagaaaagtcaga

SEQ ID NO: 21850 - DNA, 21 bp, synthetic construct
  misc_feature 1..21: note = Synthetic Construct
  source 1..21: mol_type = other DNA
cagcaagtcatggcagggaaa

SEQ ID NO: 21851 - DNA, 24 bp, synthetic construct
  misc_feature 1..24: note = Synthetic Construct
  source 1..24: mol_type = other DNA
gtcaggatcgctattcacgtcatc

SEQ ID NO: 21852 - DNA, 23 bp, synthetic construct
  misc_feature 1..23: note = Synthetic Construct
  source 1..23: mol_type = other DNA
gtgagtgtggcaccatggatgta

SEQ ID NO: 21853 - DNA, 23 bp, synthetic construct
  misc_feature 1..23: note = Synthetic Construct
  source 1..23: mol_type = other DNA
ccagccatgaaccttccttctgt

SEQ ID NO: 21854 - DNA, 22 bp, synthetic construct
  misc_feature 1..22: note = Synthetic Construct
  source 1..22: mol_type = other DNA
ctctgtatgccagctccctttc

SEQ ID NO: 21855 - DNA, 24 bp, synthetic construct
  misc_feature 1..24: note = Synthetic Construct
  source 1..24: mol_type = other DNA
ggtggaaggaacatagagttgcat

SEQ ID NO: 21856 - DNA, 26 bp, synthetic construct
  misc_feature 1..26: note = Synthetic Construct
  source 1..26: mol_type = other DNA
gcatccattgctatctcagcatcagt

SEQ ID NO: 21857 - DNA, 23 bp, synthetic construct
  misc_feature 1..23: note = Synthetic Construct
  source 1..23: mol_type = other DNA
gctatgccacttcctctgagact

SEQ ID NO: 21858 - DNA, 21 bp, synthetic construct
  misc_feature 1..21: note = Synthetic Construct
  source 1..21: mol_type = other DNA
gcacagcactgaggacagctt

SEQ ID NO: 21859 - DNA, 21 bp, synthetic construct
  misc_feature 1..21: note = Synthetic Construct
  source 1..21: mol_type = other DNA
agaaacaccaaagggcagaca

SEQ ID NO: 21860 - DNA, 22 bp, synthetic construct
  misc_feature 1..22: note = Synthetic Construct
  source 1..22: mol_type = other DNA
gcactgtgagcacaggttcttc

SEQ ID NO: 21861 - DNA, 24 bp, synthetic construct
  misc_feature 1..24: note = Synthetic Construct
  source 1..24: mol_type = other DNA
gacccttcaatctggagctgagtt

SEQ ID NO: 21862 - DNA, 23 bp, synthetic construct
  misc_feature 1..23: note = Synthetic Construct
  source 1..23: mol_type = other DNA
gctgggccccataattgaaggta

SEQ ID NO: 21863 - DNA, 23 bp, synthetic construct
  misc_feature 1..23: note = Synthetic Construct
  source 1..23: mol_type = other DNA
gaccttctgggaaccagttttct

SEQ ID NO: 21864 - DNA, 27 bp, synthetic construct
  misc_feature 1..27: note = Synthetic Construct
  source 1..27: mol_type = other DNA
cactggaggatcacaaactgtattttc

SEQ ID NO: 21865 - DNA, 25 bp, synthetic construct
  misc_feature 1..25: note = Synthetic Construct
  source 1..25: mol_type = other DNA
cggaaaacttggaaggaaggagaag

SEQ ID NO: 21866 - DNA, 23 bp, synthetic construct
  misc_feature 1..23: note = Synthetic Construct
  source 1..23: mol_type = other DNA
gaactcccggctttgaacaattc

SEQ ID NO: 21867 - DNA, 22 bp, synthetic construct
  misc_feature 1..22: note = Synthetic Construct
  source 1..22: mol_type = other DNA
gcgtctcagggcgcatttgtat

SEQ ID NO: 21868 - DNA, 22 bp, synthetic construct
  misc_feature 1..22: note = Synthetic Construct
  source 1..22: mol_type = other DNA
gccactgtgtcgagtccttcaa

SEQ ID NO: 21869 - DNA, 23 bp, synthetic construct
  misc_feature 1..23: note = Synthetic Construct
  source 1..23: mol_type = other DNA
tgaggaagagcgagctttcttag

SEQ ID NO: 21870 - DNA, 24 bp, synthetic construct
  misc_feature 1..24: note = Synthetic Construct
  source 1..24: mol_type = other DNA
cctagaggccactgttactctgaa

SEQ ID NO: 21871 - DNA, 22 bp, synthetic construct
  misc_feature 1..22: note = Synthetic Construct
  source 1..22: mol_type = other DNA
agctgtccaaatccagctctac

SEQ ID NO: 21872 - DNA, 23 bp, synthetic construct
  misc_feature 1..23: note = Synthetic Construct
  source 1..23: mol_type = other DNA
ggaaaggcttatcgggaggttgt

SEQ ID NO: 21873 - DNA, 26 bp, synthetic construct
  misc_feature 1..26: note = Synthetic Construct
  source 1..26: mol_type = other DNA
caggcaccaaagatgtaactactaga

SEQ ID NO: 21874 - DNA, 23 bp, synthetic construct
  misc_feature 1..23: note = Synthetic Construct
  source 1..23: mol_type = other DNA
cgtcctcctaacctggtggtctt

SEQ ID NO: 21875 - DNA, 23 bp, synthetic construct
  misc_feature 1..23: note = Synthetic Construct
  source 1..23: mol_type = other DNA
gctgagttctggcaaatgggaaa

SEQ ID NO: 21876 - DNA, 26 bp, synthetic construct
  misc_feature 1..26: note = Synthetic Construct
  source 1..26: mol_type = other DNA
gccatcttcacagagttcatggtcta

SEQ ID NO: 21877 - DNA, 26 bp, synthetic construct
  misc_feature 1..26: note = Synthetic Construct
  source 1..26: mol_type = other DNA
gcaaaggccctgctaattttctctgt

SEQ ID NO: 21878 - DNA, 24 bp, synthetic construct
  misc_feature 1..24: note = Synthetic Construct
  source 1..24: mol_type = other DNA
ccggagtgagaagacaaggagtct

SEQ ID NO: 21879 - DNA, 26 bp, synthetic construct
  misc_feature 1..26: note = Synthetic Construct
  source 1..26: mol_type = other DNA
gctaagaagaaaggctcactgaaagt

SEQ ID NO: 21880 - DNA, 21 bp, synthetic construct
  misc_feature 1..21: note = Synthetic Construct
  source 1..21: mol_type = other DNA
ccttcaaacccggggatgcta

SEQ ID NO: 21881 - DNA, 22 bp, synthetic construct
  misc_feature 1..22: note = Synthetic Construct
  source 1..22: mol_type = other DNA
cagggcttctctgcttttccaa

SEQ ID NO: 21882 - DNA, 22 bp, synthetic construct
  misc_feature 1..22: note = Synthetic Construct
  source 1..22: mol_type = other DNA
ccctccactactccctggattt

SEQ ID NO: 21883 - DNA, 23 bp, synthetic construct
  misc_feature 1..23: note = Synthetic Construct
  source 1..23: mol_type = other DNA
caaaaccgttcacccacacattg

SEQ ID NO: 21884 - DNA, 23 bp, synthetic construct
  misc_feature 1..23: note = Synthetic Construct
  source 1..23: mol_type = other DNA
aagccttcagaacctgagacttc

SEQ ID NO: 21885 - DNA, 23 bp, synthetic construct
  misc_feature 1..23: note = Synthetic Construct
  source 1..23: mol_type = other DNA
ggagccagttgtcagttgcgtta

SEQ ID NO: 21886 - DNA, 20 bp, synthetic construct
  misc_feature 1..20: note = Synthetic Construct
  source 1..20: mol_type = other DNA
tcgtagcctcactcctgcaa

SEQ ID NO: 21887 - DNA, 22 bp, synthetic construct
  misc_feature 1..22: note = Synthetic Construct
  source 1..22: mol_type = other DNA
ccaacaccacagttaccaggaa

SEQ ID NO: 21888 - DNA, 23 bp, synthetic construct
  misc_feature 1..23: note = Synthetic Construct
  source 1..23: mol_type = other DNA
ggcagtaaccatagtccatgcaa

SEQ ID NO: 21889 - DNA, 20 bp, synthetic construct
  misc_feature 1..20: note = Synthetic Construct
  source 1..20: mol_type = other DNA
gctgtggttggctggtaact

SEQ ID NO: 21890 - DNA, 25 bp, synthetic construct
  misc_feature 1..25: note = Synthetic Construct
  source 1..25: mol_type = other DNA
cctcttccacccctttactttcagt

SEQ ID NO: 21891 - DNA, 23 bp, synthetic construct
  misc_feature 1..23: note = Synthetic Construct
  source 1..23: mol_type = other DNA
ggaagtcccagaatgaggtttca

SEQ ID NO: 21892 - DNA, 24 bp, synthetic construct
  misc_feature 1..24: note = Synthetic Construct
  source 1..24: mol_type = other DNA
ctgggaagggttacagtgagtcat

SEQ ID NO: 21893 - DNA, 21 bp, synthetic construct
  misc_feature 1..21: note = Synthetic Construct
  source 1..21: mol_type = other DNA
agcttggagctctagggtctt

SEQ ID NO: 21894 - DNA, 24 bp, synthetic construct
  misc_feature 1..24: note = Synthetic Construct
  source 1..24: mol_type = other DNA
ccaccaagacgggtctctctgtaa

SEQ ID NO: 21895 - DNA, 22 bp, synthetic construct
  misc_feature 1..22: note = Synthetic Construct
  source 1..22: mol_type = other DNA
gctgttcactcctcctgctcta

SEQ ID NO: 21896 - DNA, 23 bp, synthetic construct
  misc_feature 1..23: note = Synthetic Construct
  source 1..23: mol_type = other DNA
gtcacttagaagcacccatctgt

SEQ ID NO: 21897 - DNA, 24 bp, synthetic construct
  misc_feature 1..24: note = Synthetic Construct
  source 1..24: mol_type = other DNA
ggagcagggctaactcacatgaag

SEQ ID NO: 21898 - DNA, 21 bp, synthetic construct
  misc_feature 1..21: note = Synthetic Construct
  source 1..21: mol_type = other DNA
cgtgctgttaggagcaagaga

SEQ ID NO: 21899 - DNA, 25 bp, synthetic construct
  misc_feature 1..25: note = Synthetic Construct
  source 1..25: mol_type = other DNA
cctgaatctgttgtggatcaagtgt

SEQ ID NO: 21900 - DNA, 22 bp, synthetic construct
  misc_feature 1..22: note = Synthetic Construct
  source 1..22: mol_type = other DNA
tgggatgaggcagaggcttgaa

SEQ ID NO: 21901 - DNA, 23 bp, synthetic construct
  misc_feature 1..23: note = Synthetic Construct
  source 1..23: mol_type = other DNA
gggcactacactccaagatgcaa

SEQ ID NO: 21902 - DNA, 22 bp, synthetic construct
  misc_feature 1..22: note = Synthetic Construct
  source 1..22: mol_type = other DNA
caaacgtggtagacccgacact

SEQ ID NO: 21903 - DNA, 27 bp, synthetic construct
  misc_feature 1..27: note = Synthetic Construct
  source 1..27: mol_type = other DNA
acttctgggcttaaaatggagttctac

SEQ ID NO: 21904 - DNA, 21 bp, synthetic construct
  misc_feature 1..21: note = Synthetic Construct
  source 1..21: mol_type = other DNA
cggtggctatgcgtgtaaaga

SEQ ID NO: 21905 - DNA, 26 bp, synthetic construct
  misc_feature 1..26: note = Synthetic Construct
  source 1..26: mol_type = other DNA
gctgaaccaatcaatctgagagtctt

SEQ ID NO: 21906 - DNA, 25 bp, synthetic construct
  misc_feature 1..25: note = Synthetic Construct
  source 1..25: mol_type = other DNA
ggctgggatcaagttctgtctctgt

SEQ ID NO: 21907 - DNA, 25 bp, synthetic construct
  misc_feature 1..25: note = Synthetic Construct
  source 1..25: mol_type = other DNA
tgctcttgtttcatttgtggctatg

SEQ ID NO: 21908 - DNA, 20 bp, synthetic construct
  misc_feature 1..20: note = Synthetic Construct
  source 1..20: mol_type = other DNA
ccagccacagtgatctgctt

SEQ ID NO: 21909 - DNA, 27 bp, synthetic construct
  misc_feature 1..27: note = Synthetic Construct
  source 1..27: mol_type = other DNA
ggttcttcattttggagagcacgattg

SEQ ID NO: 21910 - DNA, 28 bp, synthetic construct
  misc_feature 1..28: note = Synthetic Construct
  source 1..28: mol_type = other DNA
ggctgagtccatttttataaccgtgtgt

SEQ ID NO: 21911 - DNA, 21 bp, synthetic construct
  misc_feature 1..21: note = Synthetic Construct
  source 1..21: mol_type = other DNA
ggggctgtctcagctctttgt

SEQ ID NO: 21912 - DNA, 24 bp, synthetic construct
  misc_feature 1..24: note = Synthetic Construct
  source 1..24: mol_type = other DNA
cccactggaagagtgacttagctt

SEQ ID NO: 21913 - DNA, 20 bp, synthetic construct
  misc_feature 1..20: note = Synthetic Construct
  source 1..20: mol_type = other DNA
cttgcccaaacccactcctt

SEQ ID NO: 21914 - DNA, 24 bp, synthetic construct
  misc_feature 1..24: note = Synthetic Construct
  source 1..24: mol_type = other DNA
ccccagtgcctcttgtctctgata

SEQ ID NO: 21915 - DNA, 22 bp, synthetic construct
  misc_feature 1..22: note = Synthetic Construct
  source 1..22: mol_type = other DNA
gtgaaaaggggaagcgaagatg

SEQ ID NO: 21916 - DNA, 24 bp, synthetic construct
  misc_feature 1..24: note = Synthetic Construct
  source 1..24: mol_type = other DNA
tctctcttcccctctcaactgatt

SEQ ID NO: 21917 - DNA, 23 bp, synthetic construct
  misc_feature 1..23: note = Synthetic Construct
  source 1..23: mol_type = other DNA
cctgccttactaccccaatcatc

SEQ ID NO: 21918 - DNA, 20 bp, synthetic construct
  misc_feature 1..20: note = Synthetic Construct
  source 1..20: mol_type = other DNA
aggctcagaggcaagacaga

SEQ ID NO: 21919 - DNA, 22 bp, synthetic construct
  misc_feature 1..22: note = Synthetic Construct
  source 1..22: mol_type = other DNA
cccaggaccacaagcacacttt

SEQ ID NO: 21920 - DNA, 22 bp, synthetic construct
  misc_feature 1..22: note = Synthetic Construct
  source 1..22: mol_type = other DNA
cacggaggtgagcatgatgcaa

SEQ ID NO: 21921 - DNA, 24 bp, synthetic construct
  misc_feature 1..24: note = Synthetic Construct
  source 1..24: mol_type = other DNA
ctggggtctgtctctggatgatct

SEQ ID NO: 21922 - DNA, 30 bp, synthetic construct
  misc_feature 1..30: note = Synthetic Construct
  source 1..30: mol_type = other DNA
gcctctccacctttttagaataagggtatc

SEQ ID NO: 21923 - DNA, 27 bp, synthetic construct
  misc_feature 1..27: note = Synthetic Construct
  source 1..27: mol_type = other DNA
ctcctgcaatatcccttattcaagagt

SEQ ID NO: 21924 - DNA, 24 bp, synthetic construct
  misc_feature 1..24: note = Synthetic Construct
  source 1..24: mol_type = other DNA
ccaagacacatttgcctctctact

SEQ ID NO: 21925 - DNA, 22 bp, synthetic construct
  misc_feature 1..22: note = Synthetic Construct
  source 1..22: mol_type = other DNA
ctttcaccgttaacctgcgttt

SEQ ID NO: 21926 - DNA, 25 bp, synthetic construct
  misc_feature 1..25: note = Synthetic Construct
  source 1..25: mol_type = other DNA
gccctgtattactccacagtgtatg

SEQ ID NO: 21927 - DNA, 23 bp, synthetic construct
  misc_feature 1..23: note = Synthetic Construct
  source 1..23: mol_type = other DNA
gcctggatggttctagggctttc

SEQ ID NO: 21928 - DNA, 23 bp, synthetic construct
  misc_feature 1..23: note = Synthetic Construct
  source 1..23: mol_type = other DNA
cttgcacacagagggtggtcatt

SEQ ID NO: 21929 - DNA, 27 bp, synthetic construct
  misc_feature 1..27: note = Synthetic Construct
  source 1..27: mol_type = other DNA
gacactgactctcttctgtctcagatt

SEQ ID NO: 21930 - DNA, 22 bp, synthetic construct
  misc_feature 1..22: note = Synthetic Construct
  source 1..22: mol_type = other DNA
ccctcttctccttccaccagtt

SEQ ID NO: 21931 - DNA, 22 bp, synthetic construct
  misc_feature 1..22: note = Synthetic Construct
  source 1..22: mol_type = other DNA
gaggtggcaatagcgttgtgtt

SEQ ID NO: 21932 - DNA, 22 bp, synthetic construct
  misc_feature 1..22: note = Synthetic Construct
  source 1..22: mol_type = other DNA
gcacaacttccccatcttgctt

SEQ ID NO: 21933 - DNA, 22 bp, synthetic construct
  misc_feature 1..22: note = Synthetic Construct
  source 1..22: mol_type = other DNA
gccaccctgcatattgccttca

SEQ ID NO: 21934 - DNA, 22 bp, synthetic construct
  misc_feature 1..22: note = Synthetic Construct
  source 1..22: mol_type = other DNA
gttccccacataccttgcttgt

SEQ ID NO: 21935 - DNA, 23 bp, synthetic construct
  misc_feature 1..23: note = Synthetic Construct
  source 1..23: mol_type = other DNA
gcggatggatgtctaacccagtt

SEQ ID NO: 21936 - DNA, 20 bp, synthetic construct
  misc_feature 1..20: note = Synthetic Construct
  source 1..20: mol_type = other DNA
agcgtttggccttgggtaag

SEQ ID NO: 21937 - DNA, 29 bp, synthetic construct
  misc_feature 1..29: note = Synthetic Construct
  source 1..29: mol_type = other DNA
ccggaatatcagccccatatttatctaca

SEQ ID NO: 21938 - DNA, 22 bp, synthetic construct
  misc_feature 1..22: note = Synthetic Construct
  source 1..22: mol_type = other DNA
ctgtgtggttgcattcccttga

SEQ ID NO: 21939 - DNA, 21 bp, synthetic construct
  misc_feature 1..21: note = Synthetic Construct
  source 1..21: mol_type = other DNA
ctggctgtctactgcaagcaa

SEQ ID NO: 21940 - DNA, 25 bp, synthetic construct
  misc_feature 1..25: note = Synthetic Construct
  source 1..25: mol_type = other DNA
gggacacagaacaattcaggactct

SEQ ID NO: 21941 - DNA, 25 bp, synthetic construct
  misc_feature 1..25: note = Synthetic Construct
  source 1..25: mol_type = other DNA
cctggggcaagttttcaagcctatc

SEQ ID NO: 21942 - DNA, 24 bp, synthetic construct
  misc_feature 1..24: note = Synthetic Construct
  source 1..24: mol_type = other DNA
gtcacccagttcctacttgacagt

SEQ ID NO: 21943 - DNA, 26 bp, synthetic construct
  misc_feature 1..26: note = Synthetic Construct
  source 1..26: mol_type = other DNA
gtcacaaacccctacagttactcctt

SEQ ID NO: 21944 - DNA, 24 bp, synthetic construct
  misc_feature 1..24: note = Synthetic Construct
  source 1..24: mol_type = other DNA
agtgcttgattccacgtatctgtt

SEQ ID NO: 21945 - DNA, 23 bp, synthetic construct
  misc_feature 1..23: note = Synthetic Construct
  source 1..23: mol_type = other DNA
gttaggtgccattagcagcagta

SEQ ID NO: 21946 - DNA, 25 bp, synthetic construct
  misc_feature 1..25: note = Synthetic Construct
  source 1..25: mol_type = other DNA
gcccctggttagttacaggaagaag

SEQ ID NO: 21947 - DNA, 24 bp, synthetic construct
  misc_feature 1..24: note = Synthetic Construct
  source 1..24: mol_type = other DNA
cctaccagataagccttgagcaat

SEQ ID NO: 21948 - DNA, 23 bp, synthetic construct
  misc_feature 1..23: note = Synthetic Construct
  source 1..23: mol_type = other DNA
gcagaccttgtctcgcttagttc

SEQ ID NO: 21949 - DNA, 28 bp, synthetic construct
  misc_feature 1..28: note = Synthetic Construct
  source 1..28: mol_type = other DNA
gccagaagtgcctattcctaaaccaatc

SEQ ID NO: 21950 - DNA, 24 bp, synthetic construct
  misc_feature 1..24: note = Synthetic Construct
  source 1..24: mol_type = other DNA
gcctccagttggttcagaaaatga

SEQ ID NO: 21951 - DNA, 22 bp, synthetic construct
  misc_feature 1..22: note = Synthetic Construct
  source 1..22: mol_type = other DNA
cgctaccatgtccagctaggtt

SEQ ID NO: 21952 - DNA, 20 bp, synthetic construct
  misc_feature 1..20: note = Synthetic Construct
  source 1..20: mol_type = other DNA
acagacaccagccagcttca

SEQ ID NO: 21953 - DNA, 24 bp, synthetic construct
  misc_feature 1..24: note = Synthetic Construct
  source 1..24: mol_type = other DNA
gtggactctggtctacatgggaaa

SEQ ID NO: 21954 - DNA, 24 bp, synthetic construct
  misc_feature 1..24: note = Synthetic Construct
  source 1..24: mol_type = other DNA
gcagttcttcacactccttgctat

SEQ ID NO: 21955 - DNA, 22 bp, synthetic construct
  misc_feature 1..22: note = Synthetic Construct
  source 1..22: mol_type = other DNA
tgccaagaaccttagggacatc

SEQ ID NO: 21956 - DNA, 24 bp, synthetic construct
  misc_feature 1..24: note = Synthetic Construct
  source 1..24: mol_type = other DNA
ggcctcaacccataaaaacgatca

SEQ ID NO: 21957 - DNA, 24 bp, synthetic construct
  misc_feature 1..24: note = Synthetic Construct
  source 1..24: mol_type = other DNA
ctcattcctaacccaggactgaac

SEQ ID NO: 21958 - DNA, 25 bp, synthetic construct
  misc_feature 1..25: note = Synthetic Construct
  source 1..25: mol_type = other DNA
gcaggcacctagtatcaagccaaag

SEQ ID NO: 21959 - DNA, 23 bp, synthetic construct
  misc_feature 1..23: note = Synthetic Construct
  source 1..23: mol_type = other DNA
ccatatgactggcaggtcctcaa

SEQ ID NO: 21960 - DNA, 27 bp, synthetic construct
  misc_feature 1..27: note = Synthetic Construct
  source 1..27: mol_type = other DNA
ccacaaccagctcttgtagtgaaagta

SEQ ID NO: 21961 - DNA, 24 bp, synthetic construct
  misc_feature 1..24: note = Synthetic Construct
  source 1..24: mol_type = other DNA
gcaagccagggaagaatccagttg

SEQ ID NO: 21962 - DNA, 25 bp, synthetic construct
  misc_feature 1..25: note = Synthetic Construct
  source 1..25: mol_type = other DNA
gggtgatgccaacttccaatcttag

SEQ ID NO: 21963 - DNA, 23 bp, synthetic construct
  misc_feature 1..23: note = Synthetic Construct
  source 1..23: mol_type = other DNA
gctaatgttggtcctccagttct

SEQ ID NO: 21964 - DNA, 27 bp, synthetic construct
  misc_feature 1..27: note = Synthetic Construct
  source 1..27: mol_type = other DNA
gtcctccttttgaagcacacttctttg

SEQ ID NO: 21965 - DNA, 25 bp, synthetic construct
  misc_feature 1..25: note = Synthetic Construct
  source 1..25: mol_type = other DNA
ctgggaggctgggaaatttgatagt

SEQ ID NO: 21966 - DNA, 21 bp, synthetic construct
  misc_feature 1..21: note = Synthetic Construct
  source 1..21: mol_type = other DNA
gacggggcttaaagctgtttg

SEQ ID NO: 21967 - DNA, 22 bp, synthetic construct
  misc_feature 1..22: note = Synthetic Construct
  source 1..22: mol_type = other DNA
ttcccagctaggggaagctaac

SEQ ID NO: 21968 - DNA, 20 bp, synthetic construct
  misc_feature 1..20: note = Synthetic Construct
  source 1..20: mol_type = other DNA
gctgctgttgcccgttcttc

SEQ ID NO: 21969 - DNA, 25 bp, synthetic construct
  misc_feature 1..25: note = Synthetic Construct
  source 1..25: mol_type = other DNA
gtctgtttgctgattcctcctccat

SEQ ID NO: 21970 - DNA, 22 bp, synthetic construct
  misc_feature 1..22: note = Synthetic Construct
  source 1..22: mol_type = other DNA
agccaccaaagggaaatgttct

SEQ ID NO: 21971 - DNA, 24 bp, synthetic construct
  misc_feature 1..24: note = Synthetic Construct
  source 1..24: mol_type = other DNA
ccggtataacattgcctccctaag

SEQ ID NO: 21972 - DNA, 23 bp, synthetic construct
  misc_feature 1..23: note = Synthetic Construct
  source 1..23: mol_type = other DNA
aagaaggcaggactgaatgtcaa

SEQ ID NO: 21973 - DNA, 23 bp, synthetic construct
  misc_feature 1..23: note = Synthetic Construct
  source 1..23: mol_type = other DNA
acaacatggctgtcttcctgaaa

SEQ ID NO: 21974 - DNA, 21 bp, synthetic construct
  misc_feature 1..21: note = Synthetic Construct
  source 1..21: mol_type = other DNA
tgctgagagttttcgctgtca

SEQ ID NO: 21975 - DNA, 22 bp, synthetic construct
  misc_feature 1..22: note = Synthetic Construct
  source 1..22: mol_type = other DNA
tgtcccatctctgccagtgaac

SEQ ID NO: 21976 - DNA, 22 bp, synthetic construct
  misc_feature 1..22: note = Synthetic Construct
  source 1..22: mol_type = other DNA
agagaaaagcaggcctggaatg

SEQ ID NO: 21977 - DNA, 20 bp, synthetic construct
  misc_feature 1..20: note = Synthetic Construct
  source 1..20: mol_type = other DNA
aggcgtcactttctgctgtt

SEQ ID NO: 21978 - DNA, 20 bp, synthetic construct
  misc_feature 1..20: note = Synthetic Construct
  source 1..20: mol_type = other DNA
ccaatgctgggaccggatct

SEQ ID NO: 21979 - DNA, 22 bp, synthetic construct
  misc_feature 1..22: note = Synthetic Construct
  source 1..22: mol_type = other DNA
tccctccattcccatggcttca

SEQ ID NO: 21980 - DNA, 26 bp, synthetic construct
  misc_feature 1..26: note = Synthetic Construct
  source 1..26: mol_type = other DNA
ctgccttagaagaaatctctgggaaa

SEQ ID NO: 21981 - DNA, 23 bp, synthetic construct
  misc_feature 1..23: note = Synthetic Construct
  source 1..23: mol_type = other DNA
acagcacatagtctcagggttca

SEQ ID NO: 21982 - DNA, 23 bp, synthetic construct
  misc_feature 1..23: note = Synthetic Construct
  source 1..23: mol_type = other DNA
gggccctgaaatatggagccttt

SEQ ID NO: 21983 - DNA, 22 bp, synthetic construct
  misc_feature 1..22: note = Synthetic Construct
  source 1..22: mol_type = other DNA
gccataggatcaccagccatct

SEQ ID NO: 21984 - DNA, 22 bp, synthetic construct
  misc_feature 1..22: note = Synthetic Construct
  source 1..22: mol_type = other DNA
gctctcaaactctggggacctt

SEQ ID NO: 21985 - DNA, 22 bp, synthetic construct
  misc_feature 1..22: note = Synthetic Construct
  source 1..22: mol_type = other DNA
cccacgagatgcattccctcta

SEQ ID NO: 21986 - DNA, 23 bp, synthetic construct
  misc_feature 1..23: note = Synthetic Construct
  source 1..23: mol_type = other DNA
ggattgaggcaaaagccaacaga

SEQ ID NO: 21987 - DNA, 21 bp, synthetic construct
  misc_feature 1..21: note = Synthetic Construct
  source 1..21: mol_type = other DNA
ggggtgggcaaagcagttaga

SEQ ID NO: 21988 - DNA, 22 bp, synthetic construct
  misc_feature 1..22: note = Synthetic Construct
  source 1..22: mol_type = other DNA
tgcagtgaaaatgcagcagatg

SEQ ID NO: 21989 - DNA, 26 bp, synthetic construct
  misc_feature 1..26: note = Synthetic Construct
  source 1..26: mol_type = other DNA
cacatgctgccatttataccttgttc

SEQ ID NO: 21990 - DNA, 23 bp, synthetic construct
  misc_feature 1..23: note = Synthetic Construct
  source 1..23: mol_type = other DNA
tccacgtagtctgtctccatgat

SEQ ID NO: 21991 - DNA, 20 bp, synthetic construct
  misc_feature 1..20: note = Synthetic Construct
  source 1..20: mol_type = other DNA
cagcagcccaacctaagaca

SEQ ID NO: 21992 - DNA, 25 bp, synthetic construct
  misc_feature 1..25: note = Synthetic Construct
  source 1..25: mol_type = other DNA
tgcagacactcaaactcatttgttg

SEQ ID NO: 21993 - DNA, 23 bp, synthetic construct
  misc_feature 1..23: note = Synthetic Construct
  source 1..23: mol_type = other DNA
ataccacctgtgtgctgttacat

SEQ ID NO: 21994 - DNA, 21 bp, synthetic construct
  misc_feature 1..21: note = Synthetic Construct
  source 1..21: mol_type = other DNA
tccttggccacacatgtcaag

SEQ ID NO: 21995 - DNA, 24 bp, synthetic construct
  misc_feature 1..24: note = Synthetic Construct
  source 1..24: mol_type = other DNA
gcaagcctcagtgtgagttttcaa

SEQ ID NO: 21996 - DNA, 29 bp, synthetic construct
  misc_feature 1..29: note = Synthetic Construct
  source 1..29: mol_type = other DNA
gacagtagtccctttattgcctataccta

SEQ ID NO: 21997 - DNA, 22 bp, synthetic construct
  misc_feature 1..22: note = Synthetic Construct
  source 1..22: mol_type = other DNA
acacttgccagtggtccctaag

SEQ ID NO: 21998 - DNA, 24 bp, synthetic construct
  misc_feature 1..24: note = Synthetic Construct
  source 1..24: mol_type = other DNA
agtggtttgctttagctgaactga

SEQ ID NO: 21999 - DNA, 24 bp, synthetic construct
  misc_feature 1..24: note = Synthetic Construct
  source 1..24: mol_type = other DNA
gactataacccgcagacgaactca

SEQ ID NO: 22000 - DNA, 20 bp, synthetic construct
  misc_feature 1..20: note = Synthetic Construct
  source 1..20: mol_type = other DNA
tgcttccgctgctcccagta

SEQ ID NO: 22001 - DNA, 24 bp, synthetic construct
  misc_feature 1..24: note = Synthetic Construct
  source 1..24: mol_type = other DNA
cgtagtgattcagagacccaggtt

SEQ ID NO: 22002 - DNA, 24 bp, synthetic construct
  misc_feature 1..24: note = Synthetic Construct
  source 1..24: mol_type = other DNA
cccttatgcctggtaggactggtt

SEQ ID NO: 22003 - DNA, 23 bp, synthetic construct
  misc_feature 1..23: note = Synthetic Construct
  source 1..23: mol_type = other DNA
ccacacccacttctatgcctttg

SEQ ID NO: 22004 - DNA, 28 bp, synthetic construct
  misc_feature 1..28: note = Synthetic Construct
  source 1..28: mol_type = other DNA
gctaaacttaacatctcagcctcctttc

SEQ ID NO: 22005 - DNA, 20 bp, synthetic construct
  misc_feature 1..20: note = Synthetic Construct
  source 1..20: mol_type = other DNA
agagaccccagggtgctagt

SEQ ID NO: 22006 - DNA, 23 bp, synthetic construct
  misc_feature 1..23: note = Synthetic Construct
  source 1..23: mol_type = other DNA
gtcgtctagggaaccatgtcagt

SEQ ID NO: 22007 - DNA, 20 bp, synthetic construct
  misc_feature 1..20: note = Synthetic Construct
  source 1..20: mol_type = other DNA
gccctgaacgcatcttccta

SEQ ID NO: 22008 - DNA, 23 bp, synthetic construct
  misc_feature 1..23: note = Synthetic Construct
  source 1..23: mol_type = other DNA
gccaagcaatgatgccttatgat

SEQ ID NO: 22009 - DNA, 25 bp, synthetic construct
  misc_feature 1..25: note = Synthetic Construct
  source 1..25: mol_type = other DNA
tgctgtcactggaaatagttgagat

SEQ ID NO: 22010 - DNA, 30 bp, synthetic construct
  misc_feature 1..30: note = Synthetic Construct
  source 1..30: mol_type = other DNA
gtgacattaaacaggacactgacattcttg

SEQ ID NO: 22011 - DNA, 26 bp, synthetic construct
  misc_feature 1..26: note = Synthetic Construct
  source 1..26: mol_type = other DNA
caggtattagggacctctgagctact

SEQ ID NO: 22012 - DNA, 19 bp, synthetic construct
  misc_feature 1..19: note = Synthetic Construct
  source 1..19: mol_type = other DNA
tgctcgatccgggaactgt

SEQ ID NO: 22013 - DNA, 26 bp, synthetic construct
  misc_feature 1..26: note = Synthetic Construct
  source 1..26: mol_type = other DNA
cactccacacttaacgaaggctattc

SEQ ID NO: 22014 - DNA, 27 bp, synthetic construct
  misc_feature 1..27: note = Synthetic Construct
  source 1..27: mol_type = other DNA
ccgcattgactgacacagttaaagaca

SEQ ID NO: 22015 - DNA, 25 bp, synthetic construct
  misc_feature 1..25: note = Synthetic Construct
  source 1..25: mol_type = other DNA
gcagggatctaacccctaaaacatc

SEQ ID NO: 22016 - DNA, 28 bp, synthetic construct
  misc_feature 1..28: note = Synthetic Construct
  source 1..28: mol_type = other DNA
cggagtgtgcacaagaatatttggatgt

SEQ ID NO: 22017 - DNA, 25 bp, synthetic construct
  misc_feature 1..25: note = Synthetic Construct
  source 1..25: mol_type = other DNA
cagcccacatggtaattgccttaaa

SEQ ID NO: 22018 - DNA, 21 bp, synthetic construct
  misc_feature 1..21: note = Synthetic Construct
  source 1..21: mol_type = other DNA
agaacccgaagagacccagaa

SEQ ID NO: 22019 - DNA, 24 bp, synthetic construct
  misc_feature 1..24: note = Synthetic Construct
  source 1..24: mol_type = other DNA
cagcatcacccctacatgactaaa

SEQ ID NO: 22020 - DNA, 25 bp, synthetic construct
  misc_feature 1..25: note = Synthetic Construct
  source 1..25: mol_type = other DNA
gcacttgtgtgatacctgcacttca

SEQ ID NO: 22021 - DNA, 22 bp, synthetic construct
  misc_feature 1..22: note = Synthetic Construct
  source 1..22: mol_type = other DNA
gtctcagggtgcctgatctgtt

SEQ ID NO: 22022 - DNA, 18 bp, synthetic construct
  misc_feature 1..18: note = Synthetic Construct
  source 1..18: mol_type = other DNA
tcagctccggacccatgt

SEQ ID NO: 22023 - DNA, 24 bp, synthetic construct
  misc_feature 1..24: note = Synthetic Construct
  source 1..24: mol_type = other DNA
cggccctatctcatctctgtctga

SEQ ID NO: 22024 - DNA, 27 bp, synthetic construct
  misc_feature 1..27: note = Synthetic Construct
  source 1..27: mol_type = other DNA
ggaaccactaaaacaaattgccgagta

SEQ ID NO: 22025 - DNA, 22 bp, synthetic construct
  misc_feature 1..22: note = Synthetic Construct
  source 1..22: mol_type = other DNA
gcctcggaagcaatgggttatg

SEQ ID NO: 22026 - DNA, 24 bp, synthetic construct
  misc_feature 1..24: note = Synthetic Construct
  source 1..24: mol_type = other DNA
gctctcacgaggacatttctcaca

SEQ ID NO: 22027 - DNA, 21 bp, synthetic construct
  misc_feature 1..21: note = Synthetic Construct
  source 1..21: mol_type = other DNA
gggcacagtcctcccagtttc

SEQ ID NO: 22028 - DNA, 25 bp, synthetic construct
  misc_feature 1..25: note = Synthetic Construct
  source 1..25: mol_type = other DNA
ggccagggagtgaacataaatccaa

SEQ ID NO: 22029 - DNA, 27 bp, synthetic construct
  misc_feature 1..27: note = Synthetic Construct
  source 1..27: mol_type = other DNA
caccttagcaccctgaagaataaaatc

SEQ ID NO: 22030 - DNA, 25 bp, synthetic construct
  misc_feature 1..25: note = Synthetic Construct
  source 1..25: mol_type = other DNA
ggttcagaagagtaagggcttcagt

SEQ ID NO: 22031 - DNA, 26 bp, synthetic construct
  misc_feature 1..26: note = Synthetic Construct
  source 1..26: mol_type = other DNA
cccagtcctctttctcctgaaaccaa

SEQ ID NO: 22032 - DNA, 24 bp, synthetic construct
  misc_feature 1..24: note = Synthetic Construct
  source 1..24: mol_type = other DNA
gcagagtgtccatgtgtaacaaag

SEQ ID NO: 22033 - DNA, 22 bp, synthetic construct
  misc_feature 1..22: note = Synthetic Construct
  source 1..22: mol_type = other DNA
gggctcctttggcatcagcatt

SEQ ID NO: 22034 - DNA, 23 bp, synthetic construct
  misc_feature 1..23: note = Synthetic Construct
  source 1..23: mol_type = other DNA
ctccccttgcatttaccctcctt

SEQ ID NO: 22035 - DNA, 27 bp, synthetic construct
  misc_feature 1..27: note = Synthetic Construct
  source 1..27: mol_type = other DNA
tcctcctcttttaagacttagcacatc

SEQ ID NO: 22036 - DNA, 25 bp, synthetic construct
  misc_feature 1..25: note = Synthetic Construct
  source 1..25: mol_type = other DNA
acctgctgactaatacaagctgaag

SEQ ID NO: 22037 - DNA, 21 bp, synthetic construct
  misc_feature 1..21: note = Synthetic Construct
  source 1..21: mol_type = other DNA
gccctggctgaaatggtgagt

SEQ ID NO: 22038 - DNA, 24 bp, synthetic construct
  misc_feature 1..24: note = Synthetic Construct
  source 1..24: mol_type = other DNA
cacaagaggttgatgacccataca

SEQ ID NO: 22039 - DNA, 24 bp, synthetic construct
  misc_feature 1..24: note = Synthetic Construct
  source 1..24: mol_type = other DNA
tggtgcatccgatgagaatgaaaa

SEQ ID NO: 22040 - DNA, 25 bp, synthetic construct
  misc_feature 1..25: note = Synthetic Construct
  source 1..25: mol_type = other DNA
cctcctaattagcaagggagctaac

SEQ ID NO: 22041 - DNA, 23 bp, synthetic construct
  misc_feature 1..23: note = Synthetic Construct
  source 1..23: mol_type = other DNA
ccagagacttcggacaccagaga

SEQ ID NO: 22042 - DNA, 20 bp, synthetic construct
  misc_feature 1..20: note = Synthetic Construct
  source 1..20: mol_type = other DNA
tgcccaaggccatggaacta

SEQ ID NO: 22043 - DNA, 25 bp, synthetic construct
  misc_feature 1..25: note = Synthetic Construct
  source 1..25: mol_type = other DNA
cgaccttccaaacaaccatgcaaag

SEQ ID NO: 22044 - DNA, 25 bp, synthetic construct
  misc_feature 1..25: note = Synthetic Construct
  source 1..25: mol_type = other DNA
cgtcaaaacaaagtgactgctcatt

SEQ ID NO: 22045 - DNA, 22 bp, synthetic construct
  misc_feature 1..22: note = Synthetic Construct
  source 1..22: mol_type = other DNA
gccagaaatggggagaccagtt

SEQ ID NO: 22046 - DNA, 25 bp, synthetic construct
  misc_feature 1..25: note = Synthetic Construct
  source 1..25: mol_type = other DNA
agcctgcctcgtatattaagtttca

SEQ ID NO: 22047 - DNA, 22 bp, synthetic construct
  misc_feature 1..22: note = Synthetic Construct
  source 1..22: mol_type = other DNA
cctccccactttcgccttttca

SEQ ID NO: 22048 - DNA, 28 bp, synthetic construct
  misc_feature 1..28: note = Synthetic Construct
  source 1..28: mol_type = other DNA
cccattagaaggtagcttttgactgaag

SEQ ID NO: 22049 - DNA, 24 bp, synthetic construct
  misc_feature 1..24: note = Synthetic Construct
  source 1..24: mol_type = other DNA
acacctgactcactctgttcatac

SEQ ID NO: 22050 - DNA, 22 bp, synthetic construct
  misc_feature 1..22: note = Synthetic Construct
  source 1..22: mol_type = other DNA
gacccacactgcccaattaaga

SEQ ID NO: 22051 - DNA, 25 bp, synthetic construct
  misc_feature 1..25: note = Synthetic Construct
  source 1..25: mol_type = other DNA
tggggaactcaaccttcattttaca

SEQ ID NO: 22052 - DNA, 22 bp, synthetic construct
  misc_feature 1..22: note = Synthetic Construct
  source 1..22: mol_type = other DNA
tgcctgatagggatgctgtttg

SEQ ID NO: 22053 - DNA, 30 bp, synthetic construct
  misc_feature 1..30: note = Synthetic Construct
  source 1..30: mol_type = other DNA
gacccaaaatgcccttattttagtggagta

SEQ ID NO: 22054 - DNA, 26 bp, synthetic construct
  misc_feature 1..26: note = Synthetic Construct
  source 1..26: mol_type = other DNA
ggcctttgcttgtcctagtaaactct

SEQ ID NO: 22055 - DNA, 22 bp, synthetic construct
  misc_feature 1..22: note = Synthetic Construct
  source 1..22: mol_type = other DNA
gtcccttggaaaaggtggacaa

SEQ ID NO: 22056 - DNA, 26 bp, synthetic construct
  misc_feature 1..26: note = Synthetic Construct
  source 1..26: mol_type = other DNA
gcatgaaacacttgggaaagcacata

SEQ ID NO: 22057 - DNA, 28 bp, synthetic construct
  misc_feature 1..28: note = Synthetic Construct
  source 1..28: mol_type = other DNA
cgtggggtgtatagtctaaggattgaga

SEQ ID NO: 22058 - DNA, 25 bp, synthetic construct
  misc_feature 1..25: note = Synthetic Construct
  source 1..25: mol_type = other DNA
acaagaaggctgtcactttacaaga

SEQ ID NO: 22059 - DNA, 27 bp, synthetic construct
  misc_feature 1..27: note = Synthetic Construct
  source 1..27: mol_type = other DNA
gaagaaggtgcttctgagaaatgtagt

SEQ ID NO: 22060 - DNA, 25 bp, synthetic construct
  misc_feature 1..25: note = Synthetic Construct
  source 1..25: mol_type = other DNA
gaggtctggtcgatcttgtgactac

SEQ ID NO: 22061 - DNA, 22 bp, synthetic construct
  misc_feature 1..22: note = Synthetic Construct
  source 1..22: mol_type = other DNA
gccaccatggattcatcctctt

SEQ ID NO: 22062 - DNA, 27 bp, synthetic construct
  misc_feature 1..27: note = Synthetic Construct
  source 1..27: mol_type = other DNA
cctaaacaaccctggttgaaaggtatc

SEQ ID NO: 22063 - DNA, 24 bp, synthetic construct
  misc_feature 1..24: note = Synthetic Construct
  source 1..24: mol_type = other DNA
tggctgagggtcttttacttgatt

SEQ ID NO: 22064 - DNA, 27 bp, synthetic construct
  misc_feature 1..27: note = Synthetic Construct
  source 1..27: mol_type = other DNA
cacggttagacttaaacaaggctagat

SEQ ID NO: 22065 - DNA, 20 bp, synthetic construct
  misc_feature 1..20: note = Synthetic Construct
  source 1..20: mol_type = other DNA
cacccacccagtgcaaaaca

SEQ ID NO: 22066 - DNA, 26 bp, synthetic construct
  misc_feature 1..26: note = Synthetic Construct
  source 1..26: mol_type = other DNA
ctccctaagtacatgggatctctttc

SEQ ID NO: 22067 - DNA, 22 bp, synthetic construct
  misc_feature 1..22: note = Synthetic Construct
  source 1..22: mol_type = other DNA
gcacagccagtgttacccaaac

SEQ ID NO: 22068 - DNA, 20 bp, synthetic construct
  misc_feature 1..20: note = Synthetic Construct
  source 1..20: mol_type = other DNA
tgggctcagaggatggactt

SEQ ID NO: 22069 - DNA, 23 bp, synthetic construct
  misc_feature 1..23: note = Synthetic Construct
  source 1..23: mol_type = other DNA
gcgtgtgacatttcgctccctta

SEQ ID NO: 22070 - DNA, 27 bp, synthetic construct
  misc_feature 1..27: note = Synthetic Construct
  source 1..27: mol_type = other DNA
gggtaagaaggcaagaatgatacaaca

SEQ ID NO: 22071 - DNA, 23 bp, synthetic construct
  misc_feature 1..23: note = Synthetic Construct
  source 1..23: mol_type = other DNA
ctgctcaccctaacctgagaagt

SEQ ID NO: 22072 - DNA, 24 bp, synthetic construct
  misc_feature 1..24: note = Synthetic Construct
  source 1..24: mol_type = other DNA
gcagggaggaaagcttccacttga

SEQ ID NO: 22073 - DNA, 22 bp, synthetic construct
  misc_feature 1..22: note = Synthetic Construct
  source 1..22: mol_type = other DNA
gccaatctgagagatgcctgaa

SEQ ID NO: 22074 - DNA, 22 bp, synthetic construct
  misc_feature 1..22: note = Synthetic Construct
  source 1..22: mol_type = other DNA
gcagccaaaactggaacagcaa

SEQ ID NO: 22075 - DNA, 27 bp, synthetic construct
  misc_feature 1..27: note = Synthetic Construct
  source 1..27: mol_type = other DNA
ccagtgacctacttgggagatttctgt

SEQ ID NO: 22076 - DNA, 24 bp, synthetic construct
  misc_feature 1..24: note = Synthetic Construct
  source 1..24: mol_type = other DNA
ttggtcacacgtagagtgtaacat

SEQ ID NO: 22077 - DNA, 22 bp, synthetic construct
  misc_feature 1..22: note = Synthetic Construct
  source 1..22: mol_type = other DNA
tctgtgtggacccctggcaata

SEQ ID NO: 22078 - DNA, 23 bp, synthetic construct
  misc_feature 1..23: note = Synthetic Construct
  source 1..23: mol_type = other DNA
cccgttaaccttgtggtccttgt

SEQ ID NO: 22079 - DNA, 23 bp, synthetic construct
  misc_feature 1..23: note = Synthetic Construct
  source 1..23: mol_type = other DNA
gccacatgcaagcaagctaggta

SEQ ID NO: 22080 - DNA, 28 bp, synthetic construct
  misc_feature 1..28: note = Synthetic Construct
  source 1..28: mol_type = other DNA
gggctatgccatgaaaacttagttgatg

SEQ ID NO: 22081 - DNA, 20 bp, synthetic construct
  misc_feature 1..20: note = Synthetic Construct
  source 1..20: mol_type = other DNA
agtgtgtcccagctgcactt

SEQ ID NO: 22082 - DNA, 27 bp, synthetic construct
  misc_feature 1..27: note = Synthetic Construct
  source 1..27: mol_type = other DNA
cactcacctttagctgacattgaggtt

SEQ ID NO: 22083 - DNA, 23 bp, synthetic construct
  misc_feature 1..23: note = Synthetic Construct
  source 1..23: mol_type = other DNA
caatgcccacatacctcttcact

SEQ ID NO: 22084 - DNA, 23 bp, synthetic construct
  misc_feature 1..23: note = Synthetic Construct
  source 1..23: mol_type = other DNA
gagtggcttttgggtgagagaag

SEQ ID NO: 22085 - DNA, 22 bp, synthetic construct
  misc_feature 1..22: note = Synthetic Construct
  source 1..22: mol_type = other DNA
ctccagtgctcttgctgactgt

SEQ ID NO: 22086 - DNA, 25 bp, synthetic construct
  misc_feature 1..25: note = Synthetic Construct
  source 1..25: mol_type = other DNA
gtggcagttcccaagctagagatag

SEQ ID NO: 22087 - DNA, 24 bp, synthetic construct
  misc_feature 1..24: note = Synthetic Construct
  source 1..24: mol_type = other DNA
cacactggacgtactggacgtatg

SEQ ID NO: 22088 - DNA, 22 bp, synthetic construct
  misc_feature 1..22: note = Synthetic Construct
  source 1..22: mol_type = other DNA
caaggtgtcagtgggtttgctt

SEQ ID NO: 22089 - DNA, 27 bp, synthetic construct
  misc_feature 1..27: note = Synthetic Construct
  source 1..27: mol_type = other DNA
ccttgtaactgggatagaaaagcacat

SEQ ID NO: 22090 - DNA, 24 bp, synthetic construct
  misc_feature 1..24: note = Synthetic Construct
  source 1..24: mol_type = other DNA
agatccacaaagcatttggtccta

SEQ ID NO: 22091 - DNA, 23 bp, synthetic construct
  misc_feature 1..23: note = Synthetic Construct
  source 1..23: mol_type = other DNA
gcaattcctggacagctcctagt

SEQ ID NO: 22092 - DNA, 23 bp, synthetic construct
  misc_feature 1..23: note = Synthetic Construct
  source 1..23: mol_type = other DNA
tcagaggccatttctagggtctt

SEQ ID NO: 22093 - DNA, 22 bp, synthetic construct
  misc_feature 1..22: note = Synthetic Construct
  source 1..22: mol_type = other DNA
gcatggcagaatcaaggctcat

SEQ ID NO: 22094 - DNA, 23 bp, synthetic construct
  misc_feature 1..23: note = Synthetic Construct
  source 1..23: mol_type = other DNA
acacacctggaagagaaaacctt

SEQ ID NO: 22095 - DNA, 27 bp, synthetic construct
  misc_feature 1..27: note = Synthetic Construct
  source 1..27: mol_type = other DNA
gagcttgaactcgaagtattaggtgta

SEQ ID NO: 22096 - DNA, 22 bp, synthetic construct
  misc_feature 1..22: note = Synthetic Construct
  source 1..22: mol_type = other DNA
cagcacggtagtggcaaaggta

SEQ ID NO: 22097 - DNA, 26 bp, synthetic construct
  misc_feature 1..26: note = Synthetic Construct
  source 1..26: mol_type = other DNA
gcttgaaatctcatccccagcacttg

SEQ ID NO: 22098 - DNA, 21 bp, synthetic construct
  misc_feature 1..21: note = Synthetic Construct
  source 1..21: mol_type = other DNA
gctgagtgtcgtccaaagtct

SEQ ID NO: 22099 - DNA, 24 bp, synthetic construct
  misc_feature 1..24: note = Synthetic Construct
  source 1..24: mol_type = other DNA
cccaggatcaagagaaagggacat

SEQ ID NO: 22100 - DNA, 25 bp, synthetic construct
  misc_feature 1..25: note = Synthetic Construct
  source 1..25: mol_type = other DNA
caccctcgagttctatttccaggta

SEQ ID NO: 22101 - DNA, 23 bp, synthetic construct
  misc_feature 1..23: note = Synthetic Construct
  source 1..23: mol_type = other DNA
gggcttctaggtccctggtcttt

SEQ ID NO: 22102 - DNA, 23 bp, synthetic construct
  misc_feature 1..23: note = Synthetic Construct
  source 1..23: mol_type = other DNA
tcaaactctggccttctgacttt

SEQ ID NO: 22103 - DNA, 20 bp, synthetic construct
  misc_feature 1..20: note = Synthetic Construct
  source 1..20: mol_type = other DNA
cgctaactgcctgcctgact

SEQ ID NO: 22104 - DNA, 25 bp, synthetic construct
  misc_feature 1..25: note = Synthetic Construct
  source 1..25: mol_type = other DNA
ccggttctgtacaagatccagattg

SEQ ID NO: 22105 - DNA, 23 bp, synthetic construct
  misc_feature 1..23: note = Synthetic Construct
  source 1..23: mol_type = other DNA
ggctccaaatcaccacaccaaac

SEQ ID NO: 22106 - DNA, 22 bp, synthetic construct
  misc_feature 1..22: note = Synthetic Construct
  source 1..22: mol_type = other DNA
gtgggacacagacagcatcctt

SEQ ID NO: 22107 - DNA, 24 bp, synthetic construct
  misc_feature 1..24: note = Synthetic Construct
  source 1..24: mol_type = other DNA
ccaggtctctaccttctcctctgt

SEQ ID NO: 22108 - DNA, 23 bp, synthetic construct
  misc_feature 1..23: note = Synthetic Construct
  source 1..23: mol_type = other DNA
gaggcgaataaggtaggctggtt

SEQ ID NO: 22109 - DNA, 24 bp, synthetic construct
  misc_feature 1..24: note = Synthetic Construct
  source 1..24: mol_type = other DNA
gcacaccaaatcccacctctcttc

SEQ ID NO: 22110 - DNA, 22 bp, synthetic construct
  misc_feature 1..22: note = Synthetic Construct
  source 1..22: mol_type = other DNA
tggccagtgggagtcagtacat

SEQ ID NO: 22111 - DNA, 26 bp, synthetic construct
  misc_feature 1..26: note = Synthetic Construct
  source 1..26: mol_type = other DNA
tgagtaactgagatggtgcaacttac

SEQ ID NO: 22112 - DNA, 26 bp, synthetic construct
  misc_feature 1..26: note = Synthetic Construct
  source 1..26: mol_type = other DNA
ggaagtggtttctatctcacctgtct

SEQ ID NO: 22113 - DNA, 21 bp, synthetic construct
  misc_feature 1..21: note = Synthetic Construct
  source 1..21: mol_type = other DNA
gacgagaagtctggtgggttt

SEQ ID NO: 22114 - DNA, 23 bp, synthetic construct
  misc_feature 1..23: note = Synthetic Construct
  source 1..23: mol_type = other DNA
ctgggatagtggcttctgagcaa

SEQ ID NO: 22115 - DNA, 23 bp, synthetic construct
  misc_feature 1..23: note = Synthetic Construct
  source 1..23: mol_type = other DNA
ccacttcccactccagttaccat

SEQ ID NO: 22116 - DNA, 24 bp, synthetic construct
  misc_feature 1..24: note = Synthetic Construct
  source 1..24: mol_type = other DNA
gtgagccttggtttcagtcacact

SEQ ID NO: 22117 - DNA, 22 bp, synthetic construct
  misc_feature 1..22: note = Synthetic Construct
  source 1..22: mol_type = other DNA
gcggagatgacaaacctgttct

SEQ ID NO: 22118 - DNA, 25 bp, synthetic construct
  misc_feature 1..25: note = Synthetic Construct
  source 1..25: mol_type = other DNA
tgcttaattgagtgctgtgtgattc

SEQ ID NO: 22119 - DNA, 24 bp, synthetic construct
  misc_feature 1..24: note = Synthetic Construct
  source 1..24: mol_type = other DNA
cccagttgaagtaggaagcagcat

SEQ ID NO: 22120 - DNA, 24 bp, synthetic construct
  misc_feature 1..24: note = Synthetic Construct
  source 1..24: mol_type = other DNA
ctcccaacaactcacatggactga

SEQ ID NO: 22121 - DNA, 22 bp, synthetic construct
  misc_feature 1..22: note = Synthetic Construct
  source 1..22: mol_type = other DNA
gggtatggagataggggtcaca

SEQ ID NO: 22122 - DNA, 24 bp, synthetic construct
  misc_feature 1..24: note = Synthetic Construct
  source 1..24: mol_type = other DNA
cctgtccattctgcattgcacttg

SEQ ID NO: 22123 - DNA, 26 bp, synthetic construct
  misc_feature 1..26: note = Synthetic Construct
  source 1..26: mol_type = other DNA
cccttattgccatttggactcaaaga

SEQ ID NO: 22124 - DNA, 19 bp, synthetic construct
  misc_feature 1..19: note = Synthetic Construct
  source 1..19: mol_type = other DNA
tggcagtaggcaggagtgt

SEQ ID NO: 22125 - DNA, 25 bp, synthetic construct
  misc_feature 1..25: note = Synthetic Construct
  source 1..25: mol_type = other DNA
tcacccttgataagagagggaaatg

SEQ ID NO: 22126 - DNA, 23 bp, synthetic construct
  misc_feature 1..23: note = Synthetic Construct
  source 1..23: mol_type = other DNA
aggaaagtgtccttgcaggattg

SEQ ID NO: 22127 - DNA, 21 bp, synthetic construct
  misc_feature 1..21: note = Synthetic Construct
  source 1..21: mol_type = other DNA
tgatgcctacagggagacact

SEQ ID NO: 22128 - DNA, 23 bp, synthetic construct
  misc_feature 1..23: note = Synthetic Construct
  source 1..23: mol_type = other DNA
gccaaagccactttctccagtgt

SEQ ID NO: 22129 - DNA, 23 bp, synthetic construct
  misc_feature 1..23: note = Synthetic Construct
  source 1..23: mol_type = other DNA
gcacgggactcagaatagccaaa

SEQ ID NO: 22130 - DNA, 22 bp, synthetic construct
  misc_feature 1..22: note = Synthetic Construct
  source 1..22: mol_type = other DNA
ctgattgccgtgctagttgtgt

SEQ ID NO: 22131 - DNA, 22 bp, synthetic construct
  misc_feature 1..22: note = Synthetic Construct
  source 1..22: mol_type = other DNA
gtcagtcgcagttccagtcaac

SEQ ID NO: 22132 - DNA, 22 bp, synthetic construct
  misc_feature 1..22: note = Synthetic Construct
  source 1..22: mol_type = other DNA
cgggacttgagtcaggttgtga

SEQ ID NO: 22133 - DNA, 23 bp, synthetic construct
  misc_feature 1..23: note = Synthetic Construct
  source 1..23: mol_type = other DNA
ctcaggacttctggacattcaca

SEQ ID NO: 22134 - DNA, 24 bp, synthetic construct
  misc_feature 1..24: note = Synthetic Construct
  source 1..24: mol_type = other DNA
gaaccaaggagtgacacaatctga

SEQ ID NO: 22135 - DNA, 28 bp, synthetic construct
  misc_feature 1..28: note = Synthetic Construct
  source 1..28: mol_type = other DNA
ggcatggatatggcacagaataagaaac

SEQ ID NO: 22136 - DNA, 22 bp, synthetic construct
  misc_feature 1..22: note = Synthetic Construct
  source 1..22: mol_type = other DNA
gaggttcacagggcttgggtat

SEQ ID NO: 22137 - DNA, 24 bp, synthetic construct
  misc_feature 1..24: note = Synthetic Construct
  source 1..24: mol_type = other DNA
caatgaggttgtcttagcccttgt

SEQ ID NO: 22138 - DNA, 21 bp, synthetic construct
  misc_feature 1..21: note = Synthetic Construct
  source 1..21: mol_type = other DNA
agcagatgtgctgccacatag

SEQ ID NO: 22139 - DNA, 25 bp, synthetic construct
  misc_feature 1..25: note = Synthetic Construct
  source 1..25: mol_type = other DNA
gccaggaacgatgtgttaaatgctt

SEQ ID NO: 22140 - DNA, 20 bp, synthetic construct
  misc_feature 1..20: note = Synthetic Construct
  source 1..20: mol_type = other DNA
accttccacccagtcactca

SEQ ID NO: 22141 - DNA, 22 bp, synthetic construct
  misc_feature 1..22: note = Synthetic Construct
  source 1..22: mol_type = other DNA
gcctcaacccagttaggccaat

SEQ ID NO: 22142 - DNA, 20 bp, synthetic construct
  misc_feature 1..20: note = Synthetic Construct
  source 1..20: mol_type = other DNA
ggaggctgcttttgcctgtt

SEQ ID NO: 22143 - DNA, 23 bp, synthetic construct
  misc_feature 1..23: note = Synthetic Construct
  source 1..23: mol_type = other DNA
cccagtgtagctctgtgagtagt

SEQ ID NO: 22144 - DNA, 23 bp, synthetic construct
  misc_feature 1..23: note = Synthetic Construct
  source 1..23: mol_type = other DNA
actggtcttgttccagcttcttc

SEQ ID NO: 22145 - DNA, 21 bp, synthetic construct
  misc_feature 1..21: note = Synthetic Construct
  source 1..21: mol_type = other DNA
tggtgtttgactggggcctta

SEQ ID NO: 22146 - DNA, 21 bp, synthetic construct
  misc_feature 1..21: note = Synthetic Construct
  source 1..21: mol_type = other DNA
aggccagatgtcctgccaatg

SEQ ID NO: 22147 - DNA, 30 bp, synthetic construct
  misc_feature 1..30: note = Synthetic Construct
  source 1..30: mol_type = other DNA
gccaaggaacccaatactgataaacagaag

SEQ ID NO: 22148 - DNA, 23 bp, synthetic construct
  misc_feature 1..23: note = Synthetic Construct
  source 1..23: mol_type = other DNA
ctggcaactgacccaacctattg

SEQ ID NO: 22149 - DNA, 24 bp, synthetic construct
  misc_feature 1..24: note = Synthetic Construct
  source 1..24: mol_type = other DNA
gtgacctttggctctaccactaac

SEQ ID NO: 22150 - DNA, 25 bp, synthetic construct
  misc_feature 1..25: note = Synthetic Construct
  source 1..25: mol_type = other DNA
cacagtgcctgttctatctctcgat

SEQ ID NO: 22151 - DNA, 24 bp, synthetic construct
  misc_feature 1..24: note = Synthetic Construct
  source 1..24: mol_type = other DNA
ccagaatttgcccagaagctctca

SEQ ID NO: 22152 - DNA, 22 bp, synthetic construct
  misc_feature 1..22: note = Synthetic Construct
  source 1..22: mol_type = other DNA
ccaccccagattcaggtacttc

SEQ ID NO: 22153 - DNA, 22 bp, synthetic construct
  misc_feature 1..22: note = Synthetic Construct
  source 1..22: mol_type = other DNA
ctccaactgcacccaaatgctt

SEQ ID NO: 22154 - DNA, 19 bp, synthetic construct
  misc_feature 1..19: note = Synthetic Construct
  source 1..19: mol_type = other DNA
agggcaactcggcggaaag

SEQ ID NO: 22155 - DNA, 22 bp, synthetic construct
  misc_feature 1..22: note = Synthetic Construct
  source 1..22: mol_type = other DNA
ggaggcgcttacagtacctctt

SEQ ID NO: 22156 - DNA, 24 bp, synthetic construct
  misc_feature 1..24: note = Synthetic Construct
  source 1..24: mol_type = other DNA
ggctgcttcttcaacccctagttc

SEQ ID NO: 22157 - DNA, 26 bp, synthetic construct
  misc_feature 1..26: note = Synthetic Construct
  source 1..26: mol_type = other DNA
gactggatacttagctgtgcttcctt

SEQ ID NO: 22158 - DNA, 22 bp, synthetic construct
  misc_feature 1..22: note = Synthetic Construct
  source 1..22: mol_type = other DNA
ccttcctgaacgtccacctgaa

SEQ ID NO: 22159 - DNA, 25 bp, synthetic construct
  misc_feature 1..25: note = Synthetic Construct
  source 1..25: mol_type = other DNA
gccctccataatttggtccccttca

SEQ ID NO: 22160 - DNA, 26 bp, synthetic construct
  misc_feature 1..26: note = Synthetic Construct
  source 1..26: mol_type = other DNA
cctaccccagactatgatgattgagt

SEQ ID NO: 22161 - DNA, 27 bp, synthetic construct
  misc_feature 1..27: note = Synthetic Construct
  source 1..27: mol_type = other DNA
gaagtgcttgatctcagagtttagtga

SEQ ID NO: 22162 - DNA, 22 bp, synthetic construct
  misc_feature 1..22: note = Synthetic Construct
  source 1..22: mol_type = other DNA
cagacaccctcaagctcagtca

SEQ ID NO: 22163 - DNA, 24 bp, synthetic construct
  misc_feature 1..24: note = Synthetic Construct
  source 1..24: mol_type = other DNA
gtggggtatcacagcaatcctact

SEQ ID NO: 22164 - DNA, 22 bp, synthetic construct
  misc_feature 1..22: note = Synthetic Construct
  source 1..22: mol_type = other DNA
tgacactggagtgacaggacaa

SEQ ID NO: 22165 - DNA, 19 bp, synthetic construct
  misc_feature 1..19: note = Synthetic Construct
  source 1..19: mol_type = other DNA
agtgaccttgcgggagtct

SEQ ID NO: 22166 - DNA, 24 bp, synthetic construct
  misc_feature 1..24: note = Synthetic Construct
  source 1..24: mol_type = other DNA
ttctgggttcattctgggtctatg

SEQ ID NO: 22167 - DNA, 23 bp, synthetic construct
  misc_feature 1..23: note = Synthetic Construct
  source 1..23: mol_type = other DNA
cccacctttacttggaggtcaga

SEQ ID NO: 22168 - DNA, 20 bp, synthetic construct
  misc_feature 1..20: note = Synthetic Construct
  source 1..20: mol_type = other DNA
aagggctgtgggcacctaag

SEQ ID NO: 22169 - DNA, 26 bp, synthetic construct
  misc_feature 1..26: note = Synthetic Construct
  source 1..26: mol_type = other DNA
gttcctgtattgcaaaggctatcatc

SEQ ID NO: 22170 - DNA, 21 bp, synthetic construct
  misc_feature 1..21: note = Synthetic Construct
  source 1..21: mol_type = other DNA
ccctgctaacccaccctgtct

SEQ ID NO: 22171 - DNA, 21 bp, synthetic construct
  misc_feature 1..21: note = Synthetic Construct
  source 1..21: mol_type = other DNA
acccagggttccagtctaaca

SEQ ID NO: 22172 - DNA, 20 bp, synthetic construct
  misc_feature 1..20: note = Synthetic Construct
  source 1..20: mol_type = other DNA
tcctccatggcagcagtgtt

SEQ ID NO: 22173 - DNA, 25 bp, synthetic construct
  misc_feature 1..25: note = Synthetic Construct
  source 1..25: mol_type = other DNA
ctctcctgaaaggaatcatgcaaac

SEQ ID NO: 22174 - DNA, 25 bp, synthetic construct
  misc_feature 1..25: note = Synthetic Construct
  source 1..25: mol_type = other DNA
gtgagcatgaagtgaagtggggatt

SEQ ID NO: 22175 - DNA, 24 bp, synthetic construct
  misc_feature 1..24: note = Synthetic Construct
  source 1..24: mol_type = other DNA
gcatccaatcaccctatctgagaa

SEQ ID NO: 22176 - DNA, 22 bp, synthetic construct
  misc_feature 1..22: note = Synthetic Construct
  source 1..22: mol_type = other DNA
tgaccttggtacttccctgtgt

SEQ ID NO: 22177 - DNA, 25 bp, synthetic construct
  misc_feature 1..25: note = Synthetic Construct
  source 1..25: mol_type = other DNA
gttgggaaaagagtttggagtcaga

SEQ ID NO: 22178 - DNA, 23 bp, synthetic construct
  misc_feature 1..23: note = Synthetic Construct
  source 1..23: mol_type = other DNA
gggaaatcgaggaaagggagctt

SEQ ID NO: 22179 - DNA, 23 bp, synthetic construct
  misc_feature 1..23: note = Synthetic Construct
  source 1..23: mol_type = other DNA
gcaggagtgaggaaatggggaaa

SEQ ID NO: 22180 - DNA, 24 bp, synthetic construct
  misc_feature 1..24: note = Synthetic Construct
  source 1..24: mol_type = other DNA
gtgaagcaagttggaggttgatga

SEQ ID NO: 22181 - DNA, 22 bp, synthetic construct
  misc_feature 1..22: note = Synthetic Construct
  source 1..22: mol_type = other DNA
aggccctgactctcatcctaac

SEQ ID NO: 22182 - DNA, 24 bp, synthetic construct
  misc_feature 1..24: note = Synthetic Construct
  source 1..24: mol_type = other DNA
ccctccacctgtacctagtgtcaa

SEQ ID NO: 22183 - DNA, 22 bp, synthetic construct
  misc_feature 1..22: note = Synthetic Construct
  source 1..22: mol_type = other DNA
gcctacaagcatggcacgatct

SEQ ID NO: 22184 - DNA, 25 bp, synthetic construct
  misc_feature 1..25: note = Synthetic Construct
  source 1..25: mol_type = other DNA
gttcaaaaatatggccaaggcttct

SEQ ID NO: 22185 - DNA, 19 bp, synthetic construct
  misc_feature 1..19: note = Synthetic Construct
  source 1..19: mol_type = other DNA
ggtcagtggcgtgggctta

SEQ ID NO: 22186 - DNA, 23 bp, synthetic construct
  misc_feature 1..23: note = Synthetic Construct
  source 1..23: mol_type = other DNA
ccacaggttgtaagacaggtcaa

SEQ ID NO: 22187 - DNA, 24 bp, synthetic construct
  misc_feature 1..24: note = Synthetic Construct
  source 1..24: mol_type = other DNA
gaggtgttgcctatcaggttgaga

SEQ ID NO: 22188 - DNA, 23 bp, synthetic construct
  misc_feature 1..23: note = Synthetic Construct
  source 1..23: mol_type = other DNA
caaacgagcttttggtgatggat

SEQ ID NO: 22189 - DNA, 24 bp, synthetic construct
  misc_feature 1..24: note = Synthetic Construct
  source 1..24: mol_type = other DNA
tgcactcgacagttcatagagatg

SEQ ID NO: 22190 - DNA, 24 bp, synthetic construct
  misc_feature 1..24: note = Synthetic Construct
  source 1..24: mol_type = other DNA
cacccgtaccctaactcaccatac

SEQ ID NO: 22191 - DNA, 26 bp, synthetic construct
  misc_feature 1..26: note = Synthetic Construct
  source 1..26: mol_type = other DNA
ggaactttcaaagcaatagcctcctt

SEQ ID NO: 22192 - DNA, 25 bp, synthetic construct
  misc_feature 1..25: note = Synthetic Construct
  source 1..25: mol_type = other DNA
gtgttccaaaaccggattgtagtga

SEQ ID NO: 22193 - DNA, 20 bp, synthetic construct
  misc_feature 1..20: note = Synthetic Construct
  source 1..20: mol_type = other DNA
gctccacaaagggcaaccaa

SEQ ID NO: 22194 - DNA, 25 bp, synthetic construct
  misc_feature 1..25: note = Synthetic Construct
  source 1..25: mol_type = other DNA
gtcttcccttttagtggaacccatt

SEQ ID NO: 22195 - DNA, 21 bp, synthetic construct
  misc_feature 1..21: note = Synthetic Construct
  source 1..21: mol_type = other DNA
agctcgccacaatcttcttga

SEQ ID NO: 22196 - DNA, 26 bp, synthetic construct
  misc_feature 1..26: note = Synthetic Construct
  source 1..26: mol_type = other DNA
gcgtaaagtcaaggaaaaccccttac

SEQ ID NO: 22197 - DNA, 20 bp, synthetic construct
  misc_feature 1..20: note = Synthetic Construct
  source 1..20: mol_type = other DNA
cggaccgaaaggcagcatag

SEQ ID NO: 22198 - DNA, 22 bp, synthetic construct
  misc_feature 1..22: note = Synthetic Construct
  source 1..22: mol_type = other DNA
gccccaaaagcttggagggtaa

SEQ ID NO: 22199 - DNA, 23 bp, synthetic construct
  misc_feature 1..23: note = Synthetic Construct
  source 1..23: mol_type = other DNA
gcaagttagctcactgtcacctt

SEQ ID NO: 22200 - DNA, 20 bp, synthetic construct
  misc_feature 1..20: note = Synthetic Construct
  source 1..20: mol_type = other DNA
gctgacctttgcccctgtaa

SEQ ID NO: 22201 - DNA, 22 bp, synthetic construct
  misc_feature 1..22: note = Synthetic Construct
  source 1..22: mol_type = other DNA
gcagcgattgtgaggaaagagt

SEQ ID NO: 22202 - DNA, 23 bp, synthetic construct
  misc_feature 1..23: note = Synthetic Construct
  source 1..23: mol_type = other DNA
ccatgaaagcctggcatcctgtt

SEQ ID NO: 22203 - DNA, 23 bp, synthetic construct
  misc_feature 1..23: note = Synthetic Construct
  source 1..23: mol_type = other DNA
cttgcttaaaggcctccctcatc

SEQ ID NO: 22204 - DNA, 23 bp, synthetic construct
  misc_feature 1..23: note = Synthetic Construct
  source 1..23: mol_type = other DNA
gacatctggagtagcaggagaca

SEQ ID NO: 22205 - DNA, 25 bp, synthetic construct
  misc_feature 1..25: note = Synthetic Construct
  source 1..25: mol_type = other DNA
ggtgcggagaaatgtcattggtttg

SEQ ID NO: 22206 - DNA, 26 bp, synthetic construct
  misc_feature 1..26: note = Synthetic Construct
  source 1..26: mol_type = other DNA
gagacaacctctccctttatggactt

SEQ ID NO: 22207 - DNA, 20 bp, synthetic construct
  misc_feature 1..20: note = Synthetic Construct
  source 1..20: mol_type = other DNA
gcccatgtgccaaggagaca

SEQ ID NO: 22208 - DNA, 25 bp, synthetic construct
  misc_feature 1..25: note = Synthetic Construct
  source 1..25: mol_type = other DNA
ttcacgcttctcaatacccctattt

SEQ ID NO: 22209 - DNA, 24 bp, synthetic construct
  misc_feature 1..24: note = Synthetic Construct
  source 1..24: mol_type = other DNA
gccaggccttaggttttactgatg

SEQ ID NO: 22210 - DNA, 22 bp, synthetic construct
  misc_feature 1..22: note = Synthetic Construct
  source 1..22: mol_type = other DNA
cctcctcgacagaagctgaaca

SEQ ID NO: 22211 - DNA, 24 bp, synthetic construct
  misc_feature 1..24: note = Synthetic Construct
  source 1..24: mol_type = other DNA
ctgttcctctgatccctgagtagt

SEQ ID NO: 22212 - DNA, 25 bp, synthetic construct
  misc_feature 1..25: note = Synthetic Construct
  source 1..25: mol_type = other DNA
gtgaaatattgccccatgctaggtt

SEQ ID NO: 22213 - DNA, 26 bp, synthetic construct
  misc_feature 1..26: note = Synthetic Construct
  source 1..26: mol_type = other DNA
ctctcaggcataactgcagagttctt

SEQ ID NO: 22214 - DNA, 21 bp, synthetic construct
  misc_feature 1..21: note = Synthetic Construct
  source 1..21: mol_type = other DNA
tggagggaaagtggtgtgtgt

SEQ ID NO: 22215 - DNA, 22 bp, synthetic construct
  misc_feature 1..22: note = Synthetic Construct
  source 1..22: mol_type = other DNA
ccagcccaaatagcggtagctt

SEQ ID NO: 22216 - DNA, 26 bp, synthetic construct
  misc_feature 1..26: note = Synthetic Construct
  source 1..26: mol_type = other DNA
ggtctctgttggacctccaatattct

SEQ ID NO: 22217 - DNA, 27 bp, synthetic construct
  misc_feature 1..27: note = Synthetic Construct
  source 1..27: mol_type = other DNA
gctgtgaggttggttagaatcatttgt

SEQ ID NO: 22218 - DNA, 24 bp, synthetic construct
  misc_feature 1..24: note = Synthetic Construct
  source 1..24: mol_type = other DNA
ggttggagtagcttgtccagtctt

SEQ ID NO: 22219 - DNA, 21 bp, synthetic construct
  misc_feature 1..21: note = Synthetic Construct
  source 1..21: mol_type = other DNA
gcctcagcatcttgggctttt

SEQ ID NO: 22220 - DNA, 27 bp, synthetic construct
  misc_feature 1..27: note = Synthetic Construct
  source 1..27: mol_type = other DNA
ggtgtcctaagaatgactaaggtctga

SEQ ID NO: 22221 - DNA, 26 bp, synthetic construct
  misc_feature 1..26: note = Synthetic Construct
  source 1..26: mol_type = other DNA
gtgagagtaaggaagtgctttacaac

SEQ ID NO: 22222 - DNA, 21 bp, synthetic construct
  misc_feature 1..21: note = Synthetic Construct
  source 1..21: mol_type = other DNA
tgctcctcaaagctcccaaac

SEQ ID NO: 22223 - DNA, 25 bp, synthetic construct
  misc_feature 1..25: note = Synthetic Construct
  source 1..25: mol_type = other DNA
ctgcatttttccagaagcccactat

SEQ ID NO: 22224 - DNA, 24 bp, synthetic construct
  misc_feature 1..24: note = Synthetic Construct
  source 1..24: mol_type = other DNA
ctggggctgtaacttcatctgttt

SEQ ID NO: 22225 - DNA, 26 bp, synthetic construct
  misc_feature 1..26: note = Synthetic Construct
  source 1..26: mol_type = other DNA
ccccttcaggatagaaaggacctaag

SEQ ID NO: 22226 - DNA, 23 bp, synthetic construct
  misc_feature 1..23: note = Synthetic Construct
  source 1..23: mol_type = other DNA
caagggcctacctacatccgttt

SEQ ID NO: 22227 - DNA, 22 bp, synthetic construct
  misc_feature 1..22: note = Synthetic Construct
  source 1..22: mol_type = other DNA
gcacagagcacatcctggcata

SEQ ID NO: 22228 - DNA, 23 bp, synthetic construct
  misc_feature 1..23: note = Synthetic Construct
  source 1..23: mol_type = other DNA
tggcattgagacacttcttggat

SEQ ID NO: 22229 - DNA, 30 bp, synthetic construct
  misc_feature 1..30: note = Synthetic Construct
  source 1..30: mol_type = other DNA
gggagaccaaatcctttgtaatagacacat

SEQ ID NO: 22230 - DNA, 26 bp, synthetic construct
  misc_feature 1..26: note = Synthetic Construct
  source 1..26: mol_type = other DNA
caccaatgactttgactgtgggagaa

SEQ ID NO: 22231 - DNA, 23 bp, synthetic construct
  misc_feature 1..23: note = Synthetic Construct
  source 1..23: mol_type = other DNA
cagtggtgctactttcagtgtct

SEQ ID NO: 22232 - DNA, 24 bp, synthetic construct
  misc_feature 1..24: note = Synthetic Construct
  source 1..24: mol_type = other DNA
gccaaccctgtaaaaactttgtgt

SEQ ID NO: 22233 - DNA, 19 bp, synthetic construct
  misc_feature 1..19: note = Synthetic Construct
  source 1..19: mol_type = other DNA
atggctccagcaggggaaa

SEQ ID NO: 22234 - DNA, 21 bp, synthetic construct
  misc_feature 1..21: note = Synthetic Construct
  source 1..21: mol_type = other DNA
acccagcacctagggttccaa

SEQ ID NO: 22235 - DNA, 22 bp, synthetic construct
  misc_feature 1..22: note = Synthetic Construct
  source 1..22: mol_type = other DNA
gccaccttggctcattatgact

SEQ ID NO: 22236 - DNA, 24 bp, synthetic construct
  misc_feature 1..24: note = Synthetic Construct
  source 1..24: mol_type = other DNA
ccacaggctgtcctaactcctctt

SEQ ID NO: 22237 - DNA, 25 bp, synthetic construct
  misc_feature 1..25: note = Synthetic Construct
  source 1..25: mol_type = other DNA
gtggtggaagttctataccggagaa

SEQ ID NO: 22238 - DNA, 23 bp, synthetic construct
  misc_feature 1..23: note = Synthetic Construct
  source 1..23: mol_type = other DNA
ccaatcaggggaatggcagaaag

SEQ ID NO: 22239 - DNA, 21 bp, synthetic construct
  misc_feature 1..21: note = Synthetic Construct
  source 1..21: mol_type = other DNA
tcgccccagtttgtgcctaag

SEQ ID NO: 22240 - DNA, 23 bp, synthetic construct
  misc_feature 1..23: note = Synthetic Construct
  source 1..23: mol_type = other DNA
gaggctacttcacatggcctaat

SEQ ID NO: 22241 - DNA, 25 bp, synthetic construct
  misc_feature 1..25: note = Synthetic Construct
  source 1..25: mol_type = other DNA
gcatgattcagaaccgctagagcat

SEQ ID NO: 22242 - DNA, 20 bp, synthetic construct
  misc_feature 1..20: note = Synthetic Construct
  source 1..20: mol_type = other DNA
gcgcgtgttgtggtcaatgt

SEQ ID NO: 22243 - DNA, 26 bp, synthetic construct
  misc_feature 1..26: note = Synthetic Construct
  source 1..26: mol_type = other DNA
cacctttcaacttcacctctccgtta

SEQ ID NO: 22244 - DNA, 24 bp, synthetic construct
  misc_feature 1..24: note = Synthetic Construct
  source 1..24: mol_type = other DNA
ggtggacattttcccttgcacttg

SEQ ID NO: 22245 - DNA, 20 bp, synthetic construct
  misc_feature 1..20: note = Synthetic Construct
  source 1..20: mol_type = other DNA
cccacttggatgccagaaca

SEQ ID NO: 22246 - DNA, 25 bp, synthetic construct
  misc_feature 1..25: note = Synthetic Construct
  source 1..25: mol_type = other DNA
gggtgcaaggaagcaaaaaggaaga

SEQ ID NO: 22247 - DNA, 27 bp, synthetic construct
  misc_feature 1..27: note = Synthetic Construct
  source 1..27: mol_type = other DNA
gaagaatgacaaggcattagctaggat

SEQ ID NO: 22248 - DNA, 24 bp, synthetic construct
  misc_feature 1..24: note = Synthetic Construct
  source 1..24: mol_type = other DNA
ggccattaaaggaatgacgtggat

SEQ ID NO: 22249 - DNA, 24 bp, synthetic construct
  misc_feature 1..24: note = Synthetic Construct
  source 1..24: mol_type = other DNA
gctcctctgaactacaacaacctt

SEQ ID NO: 22250 - DNA, 22 bp, synthetic construct
  misc_feature 1..22: note = Synthetic Construct
  source 1..22: mol_type = other DNA
ctttctgtgggcctgtgatagt

SEQ ID NO: 22251 - DNA, 23 bp, synthetic construct
  misc_feature 1..23: note = Synthetic Construct
  source 1..23: mol_type = other DNA
caaccgtcttcccacaagtctga

SEQ ID NO: 22252 - DNA, 22 bp, synthetic construct
  misc_feature 1..22: note = Synthetic Construct
  source 1..22: mol_type = other DNA
aggtactcagggctcaaaggaa

SEQ ID NO: 22253 - DNA, 25 bp, synthetic construct
  misc_feature 1..25: note = Synthetic Construct
  source 1..25: mol_type = other DNA
gaaatggttaggcttctctctgctt

SEQ ID NO: 22254 - DNA, 21 bp, synthetic construct
  misc_feature 1..21: note = Synthetic Construct
  source 1..21: mol_type = other DNA
ggggagtgagggaggagctta

SEQ ID NO: 22255 - DNA, 24 bp, synthetic construct
  misc_feature 1..24: note = Synthetic Construct
  source 1..24: mol_type = other DNA
gggaatggcatgtcatgatttgtt

SEQ ID NO: 22256 - DNA, 23 bp, synthetic construct
  misc_feature 1..23: note = Synthetic Construct
  source 1..23: mol_type = other DNA
gtcacagcctctcaaggttcagt

SEQ ID NO: 22257 - DNA, 23 bp, synthetic construct
  misc_feature 1..23: note = Synthetic Construct
  source 1..23: mol_type = other DNA
cagtgtcagcttcttccgtggat

SEQ ID NO: 22258 - DNA, 22 bp, synthetic construct
  misc_feature 1..22: note = Synthetic Construct
  source 1..22: mol_type = other DNA
gccacccaatggtgaatgctaa

SEQ ID NO: 22259 - DNA, 23 bp, synthetic construct
  misc_feature 1..23: note = Synthetic Construct
  source 1..23: mol_type = other DNA
gaggtgaaggcagacatgtggaa

SEQ ID NO: 22260 - DNA, 24 bp, synthetic construct
  misc_feature 1..24: note = Synthetic Construct
  source 1..24: mol_type = other DNA
tggggtcaaatacaacaagagaca

SEQ ID NO: 22261 - DNA, 22 bp, synthetic construct
  misc_feature 1..22: note = Synthetic Construct
  source 1..22: mol_type = other DNA
ggcttggagcatggcaggaaat

SEQ ID NO: 22262 - DNA, 24 bp, synthetic construct
  misc_feature 1..24: note = Synthetic Construct
  source 1..24: mol_type = other DNA
ctgctccttgacattgcagacact

SEQ ID NO: 22263 - DNA, 24 bp, synthetic construct
  misc_feature 1..24: note = Synthetic Construct
  source 1..24: mol_type = other DNA
ccttagctgcaagagagcctgtta

SEQ ID NO: 22264 - DNA, 22 bp, synthetic construct
  misc_feature 1..22: note = Synthetic Construct
  source 1..22: mol_type = other DNA
ctttgtagaggtggcaggaaca

SEQ ID NO: 22265 - DNA, 24 bp, synthetic construct
  misc_feature 1..24: note = Synthetic Construct
  source 1..24: mol_type = other DNA
caccctcgcttactgggatactga

SEQ ID NO: 22266 - DNA, 24 bp, synthetic construct
  misc_feature 1..24: note = Synthetic Construct
  source 1..24: mol_type = other DNA
ggtaggcccagtaattggtacttg

SEQ ID NO: 22267 - DNA, 26 bp, synthetic construct
  misc_feature 1..26: note = Synthetic Construct
  source 1..26: mol_type = other DNA
cagtacccttttataggcagcaactt

SEQ ID NO: 22268 - DNA, 23 bp, synthetic construct
  misc_feature 1..23: note = Synthetic Construct
  source 1..23: mol_type = other DNA
gttcccaaatctgcaacccaaag

SEQ ID NO: 22269 - DNA, 24 bp, synthetic construct
  misc_feature 1..24: note = Synthetic Construct
  source 1..24: mol_type = other DNA
gttgcctcacacactagacctttg

SEQ ID NO: 22270 - DNA, 24 bp, synthetic construct
  misc_feature 1..24: note = Synthetic Construct
  source 1..24: mol_type = other DNA
tccatcagggaagaaccacttatg

SEQ ID NO: 22271 - DNA, 22 bp, synthetic construct
  misc_feature 1..22: note = Synthetic Construct
  source 1..22: mol_type = other DNA
cctgtgtattggggcaatgctt

SEQ ID NO: 22272 - DNA, 25 bp, synthetic construct
  misc_feature 1..25: note = Synthetic Construct
  source 1..25: mol_type = other DNA
gacaggattccatagggtcttgttt

SEQ ID NO: 22273 - DNA, 23 bp, synthetic construct
  misc_feature 1..23: note = Synthetic Construct
  source 1..23: mol_type = other DNA
cagagagcaagtgacagagtcat

SEQ ID NO: 22274 - DNA, 22 bp, synthetic construct
  misc_feature 1..22: note = Synthetic Construct
  source 1..22: mol_type = other DNA
tctgcatgtccaacactgaact

SEQ ID NO: 22275 - DNA, 20 bp, synthetic construct
  misc_feature 1..20: note = Synthetic Construct
  source 1..20: mol_type = other DNA
gcagtggcaatgtggcaaga

SEQ ID NO: 22276 - DNA, 24 bp, synthetic construct
  misc_feature 1..24: note = Synthetic Construct
  source 1..24: mol_type = other DNA
gctctccacaagaagatggcagtt

SEQ ID NO: 22277 - DNA, 23 bp, synthetic construct
  misc_feature 1..23: note = Synthetic Construct
  source 1..23: mol_type = other DNA
actttgggtctctggttcctgta

SEQ ID NO: 22278 - DNA, 23 bp, synthetic construct
  misc_feature 1..23: note = Synthetic Construct
  source 1..23: mol_type = other DNA
ggctcccaatgcaaagaccttca

SEQ ID NO: 22279 - DNA, 25 bp, synthetic construct
  misc_feature 1..25: note = Synthetic Construct
  source 1..25: mol_type = other DNA
gggtgcaggaacattacctggagta

SEQ ID NO: 22280 - DNA, 29 bp, synthetic construct
  misc_feature 1..29: note = Synthetic Construct
  source 1..29: mol_type = other DNA
gcaaggggtatattgagtttcagtgacta

SEQ ID NO: 22281 - DNA, 20 bp, synthetic construct
  misc_feature 1..20: note = Synthetic Construct
  source 1..20: mol_type = other DNA
ccaggggcattgatgggttt

SEQ ID NO: 22282 - DNA, 22 bp, synthetic construct
  misc_feature 1..22: note = Synthetic Construct
  source 1..22: mol_type = other DNA
cagcaaaaccaatgcagtgtga

SEQ ID NO: 22283 - DNA, 26 bp, synthetic construct
  misc_feature 1..26: note = Synthetic Construct
  source 1..26: mol_type = other DNA
agatcttaggatcaaggggaacacta

SEQ ID NO: 22284 - DNA, 27 bp, synthetic construct
  misc_feature 1..27: note = Synthetic Construct
  source 1..27: mol_type = other DNA
ggcccagtctcactatctaagtacaga

SEQ ID NO: 22285 - DNA, 20 bp, synthetic construct
  misc_feature 1..20: note = Synthetic Construct
  source 1..20: mol_type = other DNA
tggaagcaggctggatcact

SEQ ID NO: 22286 - DNA, 20 bp, synthetic construct
  misc_feature 1..20: note = Synthetic Construct
  source 1..20: mol_type = other DNA
agcaggaaatgggcctgaag

SEQ ID NO: 22287 - DNA, 25 bp, synthetic construct
  misc_feature 1..25: note = Synthetic Construct
  source 1..25: mol_type = other DNA
ggcctcatttacttttgttgccttt

SEQ ID NO: 22288 - DNA, 26 bp, synthetic construct
  misc_feature 1..26: note = Synthetic Construct
  source 1..26: mol_type = other DNA
ctgtagaagacggacctcaacaatca

SEQ ID NO: 22289 - DNA, 22 bp, synthetic construct
  misc_feature 1..22: note = Synthetic Construct
  source 1..22: mol_type = other DNA
gggtgactgccaagtccagaaa

SEQ ID NO: 22290 - DNA, 22 bp, synthetic construct
  misc_feature 1..22: note = Synthetic Construct
  source 1..22: mol_type = other DNA
aggtgcaaggtatgcactgatt

SEQ ID NO: 22291 - DNA, 22 bp, synthetic construct
  misc_feature 1..22: note = Synthetic Construct
  source 1..22: mol_type = other DNA
acggccttgaaaacaccattca

SEQ ID NO: 22292 - DNA, 24 bp, synthetic construct
  misc_feature 1..24: note = Synthetic Construct
  source 1..24: mol_type = other DNA
ccatgaggacacaatcagtctcaa

SEQ ID NO: 22293 - DNA, 22 bp, synthetic construct
  misc_feature 1..22: note = Synthetic Construct
  source 1..22: mol_type = other DNA
gcccatatcggtgaggatggat

SEQ ID NO: 22294 - DNA, 25 bp, synthetic construct
  misc_feature 1..25: note = Synthetic Construct
  source 1..25: mol_type = other DNA
gccaagttcctctggtaacaaagtt

SEQ ID NO: 22295 - DNA, 23 bp, synthetic construct
  misc_feature 1..23: note = Synthetic Construct
  source 1..23: mol_type = other DNA
ggtggtggctactaccaaaatgt

SEQ ID NO: 22296 - DNA, 24 bp, synthetic construct
  misc_feature 1..24: note = Synthetic Construct
  source 1..24: mol_type = other DNA
cagaaacagccacctagctggtaa

SEQ ID NO: 22297 - DNA, 24 bp, synthetic construct
  misc_feature 1..24: note = Synthetic Construct
  source 1..24: mol_type = other DNA
cccaggacatctcttccactgctt

SEQ ID NO: 22298 - DNA, 20 bp, synthetic construct
  misc_feature 1..20: note = Synthetic Construct
  source 1..20: mol_type = other DNA
acgagccacgacggctctga

SEQ ID NO: 22299 - DNA, 22 bp, synthetic construct
  misc_feature 1..22: note = Synthetic Construct
  source 1..22: mol_type = other DNA
gtcaagcaggtaacagcagact

SEQ ID NO: 22300 - DNA, 27 bp, synthetic construct
  misc_feature 1..27: note = Synthetic Construct
  source 1..27: mol_type = other DNA
ccacaaataggcagtttacagcatgaa

SEQ ID NO: 22301 - DNA, 21 bp, synthetic construct
  misc_feature 1..21: note = Synthetic Construct
  source 1..21: mol_type = other DNA
gggctttgacagtcagcagat

SEQ ID NO: 22302 - DNA, 22 bp, synthetic construct
  misc_feature 1..22: note = Synthetic Construct
  source 1..22: mol_type = other DNA
ggtgctgcctttaggggagttt

SEQ ID NO: 22303 - DNA, 25 bp, synthetic construct
  misc_feature 1..25: note = Synthetic Construct
  source 1..25: mol_type = other DNA
ccagcatctgtgagaaaacttcgtt

SEQ ID NO: 22304 - DNA, 21 bp, synthetic construct
  misc_feature 1..21: note = Synthetic Construct
  source 1..21: mol_type = other DNA
gagtggccagctgcataaaag

SEQ ID NO: 22305 - DNA, 21 bp, synthetic construct
  misc_feature 1..21: note = Synthetic Construct
  source 1..21: mol_type = other DNA
gcacagtttgcaagccacttc

SEQ ID NO: 22306 - DNA, 26 bp, synthetic construct
  misc_feature 1..26: note = Synthetic Construct
  source 1..26: mol_type = other DNA
cgtgtttctgggatgagttagtctgt

SEQ ID NO: 22307 - DNA, 23 bp, synthetic construct
  misc_feature 1..23: note = Synthetic Construct
  source 1..23: mol_type = other DNA
gggacattggtagagcaaagagt

SEQ ID NO: 22308 - DNA, 22 bp, synthetic construct
  misc_feature 1..22: note = Synthetic Construct
  source 1..22: mol_type = other DNA
gcagcgagagcttagcacatct

SEQ ID NO: 22309 - DNA, 21 bp, synthetic construct
  misc_feature 1..21: note = Synthetic Construct
  source 1..21: mol_type = other DNA
gtttgggtcagtggcaagaga

SEQ ID NO: 22310 - DNA, 22 bp, synthetic construct
  misc_feature 1..22: note = Synthetic Construct
  source 1..22: mol_type = other DNA
gacagaggaaaccggggaaact

SEQ ID NO: 22311 - DNA, 24 bp, synthetic construct
  misc_feature 1..24: note = Synthetic Construct
  source 1..24: mol_type = other DNA
gtggaggggatgatggagttcaga

SEQ ID NO: 22312 - DNA, 23 bp, synthetic construct
  misc_feature 1..23: note = Synthetic Construct
  source 1..23: mol_type = other DNA
gggcagaagattagggaggtctt

SEQ ID NO: 22313 - DNA, 22 bp, synthetic construct
  misc_feature 1..22: note = Synthetic Construct
  source 1..22: mol_type = other DNA
tgggcttggatcctatgggaaa

SEQ ID NO: 22314 - DNA, 25 bp, synthetic construct
  misc_feature 1..25: note = Synthetic Construct
  source 1..25: mol_type = other DNA
cattcaggacttggtttttcgtaca

SEQ ID NO: 22315 - DNA, 23 bp, synthetic construct
  misc_feature 1..23: note = Synthetic Construct
  source 1..23: mol_type = other DNA
cacaggggtctaggcaaatctca

SEQ ID NO: 22316 - DNA, 23 bp, synthetic construct
  misc_feature 1..23: note = Synthetic Construct
  source 1..23: mol_type = other DNA
cctgttccttccactccttttca

SEQ ID NO: 22317 - DNA, 22 bp, synthetic construct
  misc_feature 1..22: note = Synthetic Construct
  source 1..22: mol_type = other DNA
ccacaaagctcccctaccatgt

SEQ ID NO: 22318 - DNA, 26 bp, synthetic construct
  misc_feature 1..26: note = Synthetic Construct
  source 1..26: mol_type = other DNA
caaaggctgtttcagaactgatctct

SEQ ID NO: 22319 - DNA, 24 bp, synthetic construct
  misc_feature 1..24: note = Synthetic Construct
  source 1..24: mol_type = other DNA
gccctacccagtgaggagtagtag

SEQ ID NO: 22320 - DNA, 20 bp, synthetic construct
  misc_feature 1..20: note = Synthetic Construct
  source 1..20: mol_type = other DNA
atccagaaggcagcaagcaa

SEQ ID NO: 22321 - DNA, 25 bp, synthetic construct
  misc_feature 1..25: note = Synthetic Construct
  source 1..25: mol_type = other DNA
cctgctgtagacattcaacaaccaa

SEQ ID NO: 22322 - DNA, 25 bp, synthetic construct
  misc_feature 1..25: note = Synthetic Construct
  source 1..25: mol_type = other DNA
cacgggaagtcaaatcaattacgat

SEQ ID NO: 22323 - DNA, 28 bp, synthetic construct
  misc_feature 1..28: note = Synthetic Construct
  source 1..28: mol_type = other DNA
ggttttgacctcccggaatattaggaaa

SEQ ID NO: 22324 - DNA, 25 bp, synthetic construct
  misc_feature 1..25: note = Synthetic Construct
  source 1..25: mol_type = other DNA
ggcttttgggtgtcaagaacacact

SEQ ID NO: 22325 - DNA, 26 bp, synthetic construct
  misc_feature 1..26: note = Synthetic Construct
  source 1..26: mol_type = other DNA
tgcacgtagttgctaagagagttatg

SEQ ID NO: 22326 - DNA, 24 bp, synthetic construct
  misc_feature 1..24: note = Synthetic Construct
  source 1..24: mol_type = other DNA
gactgattatgaggcaacgtgtgt

SEQ ID NO: 22327 - DNA, 20 bp, synthetic construct
  misc_feature 1..20: note = Synthetic Construct
  source 1..20: mol_type = other DNA
tggccatcttgggcgtagaa

SEQ ID NO: 22328 - DNA, 21 bp, synthetic construct
  misc_feature 1..21: note = Synthetic Construct
  source 1..21: mol_type = other DNA
ccggagcacaaagcaagtgaa

SEQ ID NO: 22329 - DNA, 21 bp, synthetic construct
  misc_feature 1..21: note = Synthetic Construct
  source 1..21: mol_type = other DNA
acacaccaacaggcacagaag

SEQ ID NO: 22330 - DNA, 24 bp, synthetic construct
  misc_feature 1..24: note = Synthetic Construct
  source 1..24: mol_type = other DNA
cgcttcatcaacctcaatggtaag

SEQ ID NO: 22331 - DNA, 26 bp, synthetic construct
  misc_feature 1..26: note = Synthetic Construct
  source 1..26: mol_type = other DNA
gtcttaggaggaaagtgtccaggttt

SEQ ID NO: 22332 - DNA, 25 bp, synthetic construct
  misc_feature 1..25: note = Synthetic Construct
  source 1..25: mol_type = other DNA
ccatcagtggagctttcagttcttc

SEQ ID NO: 22333 - DNA, 23 bp, synthetic construct
  misc_feature 1..23: note = Synthetic Construct
  source 1..23: mol_type = other DNA
gcacagcatggaaatgagagaca

SEQ ID NO: 22334 - DNA, 24 bp, synthetic construct
  misc_feature 1..24: note = Synthetic Construct
  source 1..24: mol_type = other DNA
aggcactaaaagctgacctaaagt

SEQ ID NO: 22335 - DNA, 20 bp, synthetic construct
  misc_feature 1..20: note = Synthetic Construct
  source 1..20: mol_type = other DNA
agtggctccagtgtggatga

SEQ ID NO: 22336 - DNA, 22 bp, synthetic construct
  misc_feature 1..22: note = Synthetic Construct
  source 1..22: mol_type = other DNA
gcttgccttgtagcttggtgtt

SEQ ID NO: 22337 - DNA, 23 bp, synthetic construct
  misc_feature 1..23: note = Synthetic Construct
  source 1..23: mol_type = other DNA
agggtaaggggagagaggagtct

SEQ ID NO: 22338 - DNA, 20 bp, synthetic construct
  misc_feature 1..20: note = Synthetic Construct
  source 1..20: mol_type = other DNA
agagtcttggtcccggagtt

SEQ ID NO: 22339 - DNA, 22 bp, synthetic construct
  misc_feature 1..22: note = Synthetic Construct
  source 1..22: mol_type = other DNA
tggaagacaggggtggaaaaag

SEQ ID NO: 22340 - DNA, 22 bp, synthetic construct
  misc_feature 1..22: note = Synthetic Construct
  source 1..22: mol_type = other DNA
tgtgcctgctagaagggtaaag

SEQ ID NO: 22341 - DNA, 22 bp, synthetic construct
  misc_feature 1..22: note = Synthetic Construct
  source 1..22: mol_type = other DNA
cacttcgtttttgcaggacaca

SEQ ID NO: 22342 - DNA, 21 bp, synthetic construct
  misc_feature 1..21: note = Synthetic Construct
  source 1..21: mol_type = other DNA
tgcagccatttggaggagaga

SEQ ID NO: 22343 - DNA, 23 bp, synthetic construct
  misc_feature 1..23: note = Synthetic Construct
  source 1..23: mol_type = other DNA
ctcgtctgttggcagagacaact

SEQ ID NO: 22344 - DNA, 27 bp, synthetic construct
  misc_feature 1..27: note = Synthetic Construct
  source 1..27: mol_type = other DNA
ggggaagagtaatctatgggagctaac

SEQ ID NO: 22345 - DNA, 23 bp, synthetic construct
  misc_feature 1..23: note = Synthetic Construct
  source 1..23: mol_type = other DNA
ccctgaccatgtcccttttgaca

SEQ ID NO: 22346 - DNA, 24 bp, synthetic construct
  misc_feature 1..24: note = Synthetic Construct
  source 1..24: mol_type = other DNA
gctgtagggtcaaagaatgtgact

SEQ ID NO: 22347 - DNA, 21 bp, synthetic construct
  misc_feature 1..21: note = Synthetic Construct
  source 1..21: mol_type = other DNA
gcagcatgcaagccattgtca

SEQ ID NO: 22348 - DNA, 27 bp, synthetic construct
  misc_feature 1..27: note = Synthetic Construct
  source 1..27: mol_type = other DNA
tggtgactaagattaagggcagtatct

SEQ ID NO: 22349 - DNA, 24 bp, synthetic construct
  misc_feature 1..24: note = Synthetic Construct
  source 1..24: mol_type = other DNA
caacttgccagtcttccacgtatc

SEQ ID NO: 22350 - DNA, 23 bp, synthetic construct
  misc_feature 1..23: note = Synthetic Construct
  source 1..23: mol_type = other DNA
ctggtcctctgcatagacctaac

SEQ ID NO: 22351 - DNA, 23 bp, synthetic construct
  misc_feature 1..23: note = Synthetic Construct
  source 1..23: mol_type = other DNA
gcctgtgtcacatccctgagaag

SEQ ID NO: 22352 - DNA, 23 bp, synthetic construct
  misc_feature 1..23: note = Synthetic Construct
  source 1..23: mol_type = other DNA
tcctccttcactccctgtcatag

SEQ ID NO: 22353 - DNA, 26 bp, synthetic construct
  misc_feature 1..26: note = Synthetic Construct
  source 1..26: mol_type = other DNA
ggagaaggtctcattaagggagtaga

SEQ ID NO: 22354 - DNA, 22 bp, synthetic construct
  misc_feature 1..22: note = Synthetic Construct
  source 1..22: mol_type = other DNA
ggagggatgatggaggtggatt

SEQ ID NO: 22355 - DNA, 26 bp, synthetic construct
  misc_feature 1..26: note = Synthetic Construct
  source 1..26: mol_type = other DNA
caagccttattcagttcttggcatca

SEQ ID NO: 22356 - DNA, 25 bp, synthetic construct
  misc_feature 1..25: note = Synthetic Construct
  source 1..25: mol_type = other DNA
gtcaatagccaggaaacatgggtaa

SEQ ID NO: 22357 - DNA, 21 bp, synthetic construct
  misc_feature 1..21: note = Synthetic Construct
  source 1..21: mol_type = other DNA
gcaacctgcaccggtcttttg

SEQ ID NO: 22358 - DNA, 28 bp, synthetic construct
  misc_feature 1..28: note = Synthetic Construct
  source 1..28: mol_type = other DNA
ctcccctagttattaagggtgaggtatc

SEQ ID NO: 22359 - DNA, 24 bp, synthetic construct
  misc_feature 1..24: note = Synthetic Construct
  source 1..24: mol_type = other DNA
gggcttgtatcccactccaactac

SEQ ID NO: 22360 - DNA, 22 bp, synthetic construct
  misc_feature 1..22: note = Synthetic Construct
  source 1..22: mol_type = other DNA
ttggggctgagaatacctctct

SEQ ID NO: 22361 - DNA, 24 bp, synthetic construct
  misc_feature 1..24: note = Synthetic Construct
  source 1..24: mol_type = other DNA
cctgtgtactgtttgcttgggata

SEQ ID NO: 22362 - DNA, 24 bp, synthetic construct
  misc_feature 1..24: note = Synthetic Construct
  source 1..24: mol_type = other DNA
gggcactaagaagggctcagagat

SEQ ID NO: 22363 - DNA, 25 bp, synthetic construct
  misc_feature 1..25: note = Synthetic Construct
  source 1..25: mol_type = other DNA
cctagatccagcctctatcgagttc

SEQ ID NO: 22364 - DNA, 25 bp, synthetic construct
  misc_feature 1..25: note = Synthetic Construct
  source 1..25: mol_type = other DNA
tgccaccaggatattgattgagatt

SEQ ID NO: 22365 - DNA, 22 bp, synthetic construct
  misc_feature 1..22: note = Synthetic Construct
  source 1..22: mol_type = other DNA
cagccctaagggtgggatttca

SEQ ID NO: 22366 - DNA, 24 bp, synthetic construct
  misc_feature 1..24: note = Synthetic Construct
  source 1..24: mol_type = other DNA
acgccaggccagaaaaatattaca

SEQ ID NO: 22367 - DNA, 21 bp, synthetic construct
  misc_feature 1..21: note = Synthetic Construct
  source 1..21: mol_type = other DNA
gacccaagtcgcgtcaattct

SEQ ID NO: 22368 - DNA, 28 bp, synthetic construct
  misc_feature 1..28: note = Synthetic Construct
  source 1..28: mol_type = other DNA
gggagagctggtctataagaggaacttg

SEQ ID NO: 22369 - DNA, 23 bp, synthetic construct
  misc_feature 1..23: note = Synthetic Construct
  source 1..23: mol_type = other DNA
tgcctgtagcatttgacaaccat

SEQ ID NO: 22370 - DNA, 25 bp, synthetic construct
  misc_feature 1..25: note = Synthetic Construct
  source 1..25: mol_type = other DNA
ggtgggtaaatctgcctatttcaga

SEQ ID NO: 22371 - DNA, 28 bp, synthetic construct
  misc_feature 1..28: note = Synthetic Construct
  source 1..28: mol_type = other DNA
ccaccctagtcaatgtcactatcctttc

SEQ ID NO: 22372 - DNA, 22 bp, synthetic construct
  misc_feature 1..22: note = Synthetic Construct
  source 1..22: mol_type = other DNA
gcctgtctgccaatttgaacat

SEQ ID NO: 22373 - DNA, 23 bp, synthetic construct
  misc_feature 1..23: note = Synthetic Construct
  source 1..23: mol_type = other DNA
cagtaggcctgaagaaccactct

SEQ ID NO: 22374 - DNA, 20 bp, synthetic construct
  misc_feature 1..20: note = Synthetic Construct
  source 1..20: mol_type = other DNA
ccactgacaggtctgctgtt

SEQ ID NO: 22375 - DNA, 20 bp, synthetic construct
  misc_feature 1..20: note = Synthetic Construct
  source 1..20: mol_type = other DNA
tggggactctgcaggtcaaa

SEQ ID NO: 22376 - DNA, 22 bp, synthetic construct
  misc_feature 1..22: note = Synthetic Construct
  source 1..22: mol_type = other DNA
tgggttgtcagtcacccaggta

SEQ ID NO: 22377 - DNA, 27 bp, synthetic construct
  misc_feature 1..27: note = Synthetic Construct
  source 1..27: mol_type = other DNA
gcctcaaggtctcatttgcatagaaag

SEQ ID NO: 22378 - DNA, 22 bp, synthetic construct
  misc_feature 1..22: note = Synthetic Construct
  source 1..22: mol_type = other DNA
gctgctggtccattctgagttg

SEQ ID NO: 22379 - DNA, 27 bp, synthetic construct
  misc_feature 1..27: note = Synthetic Construct
  source 1..27: mol_type = other DNA
gtgcagaatcaaagacagtgtagaaac

SEQ ID NO: 22380 - DNA, 20 bp, synthetic construct
  misc_feature 1..20: note = Synthetic Construct
  source 1..20: mol_type = other DNA
gccctgagaccaagcaatca

SEQ ID NO: 22381 - DNA, 28 bp, synthetic construct
  misc_feature 1..28: note = Synthetic Construct
  source 1..28: mol_type = other DNA
gtggtatgccttccttccatactaaaca

SEQ ID NO: 22382 - DNA, 22 bp, synthetic construct
  misc_feature 1..22: note = Synthetic Construct
  source 1..22: mol_type = other DNA
gtgcccttccttcccagtttca

SEQ ID NO: 22383 - DNA, 26 bp, synthetic construct
  misc_feature 1..26: note = Synthetic Construct
  source 1..26: mol_type = other DNA
cacactagaataggtagggtgctctt

SEQ ID NO: 22384 - DNA, 22 bp, synthetic construct
  misc_feature 1..22: note = Synthetic Construct
  source 1..22: mol_type = other DNA
tgcttcggagtaagacctccat

SEQ ID NO: 22385 - DNA, 23 bp, synthetic construct
  misc_feature 1..23: note = Synthetic Construct
  source 1..23: mol_type = other DNA
gacatgtggccagttggatcagt

SEQ ID NO: 22386 - DNA, 20 bp, synthetic construct
  misc_feature 1..20: note = Synthetic Construct
  source 1..20: mol_type = other DNA
tgtttccccactccccaaga

SEQ ID NO: 22387 - DNA, 23 bp, synthetic construct
  misc_feature 1..23: note = Synthetic Construct
  source 1..23: mol_type = other DNA
gccagatgctatgtagtggcaaa

SEQ ID NO: 22388 - DNA, 26 bp, synthetic construct
  misc_feature 1..26: note = Synthetic Construct
  source 1..26: mol_type = other DNA
tgatcaggcacaatactctagtctca

SEQ ID NO: 22389 - DNA, 24 bp, synthetic construct
  misc_feature 1..24: note = Synthetic Construct
  source 1..24: mol_type = other DNA
ccaggtactatcagtgccgactgt

SEQ ID NO: 22390 - DNA, 23 bp, synthetic construct
  misc_feature 1..23: note = Synthetic Construct
  source 1..23: mol_type = other DNA
ctgttgtttggagccaaaagtgt

SEQ ID NO: 22391 - DNA, 23 bp, synthetic construct
  misc_feature 1..23: note = Synthetic Construct
  source 1..23: mol_type = other DNA
ccttccacaatgcagagcagtga

SEQ ID NO: 22392 - DNA, 28 bp, synthetic construct
  misc_feature 1..28: note = Synthetic Construct
  source 1..28: mol_type = other DNA
ctctgccctgtaagttttctactgacta

SEQ ID NO: 22393 - DNA, 26 bp, synthetic construct
  misc_feature 1..26: note = Synthetic Construct
  source 1..26: mol_type = other DNA
ggagaaggtctttctacagtgaaact

SEQ ID NO: 22394 - DNA, 26 bp, synthetic construct
  misc_feature 1..26: note = Synthetic Construct
  source 1..26: mol_type = other DNA
cggcaagactaggaataccagaggaa

SEQ ID NO: 22395 - DNA, 27 bp, synthetic construct
  misc_feature 1..27: note = Synthetic Construct
  source 1..27: mol_type = other DNA
gcatcttcacatacaggaaggagcaaa

SEQ ID NO: 22396 - DNA, 25 bp, synthetic construct
  misc_feature 1..25: note = Synthetic Construct
  source 1..25: mol_type = other DNA
ggtaaagctgctcaatgggcaatag

SEQ ID NO: 22397 - DNA, 22 bp, synthetic construct
  misc_feature 1..22: note = Synthetic Construct
  source 1..22: mol_type = other DNA
gcacccatgttgctctcagtgt

SEQ ID NO: 22398 - DNA, 25 bp, synthetic construct
  misc_feature 1..25: note = Synthetic Construct
  source 1..25: mol_type = other DNA
cctgtttcctagcttggctctcttt

SEQ ID NO: 22399 - DNA, 25 bp, synthetic construct
  misc_feature 1..25: note = Synthetic Construct
  source 1..25: mol_type = other DNA
tcaccaacaccttcctggaattaag

SEQ ID NO: 22400 - DNA, 25 bp, synthetic construct
  misc_feature 1..25: note = Synthetic Construct
  source 1..25: mol_type = other DNA
tgcatggatcacagtttcttctgta

SEQ ID NO: 22401 - DNA, 27 bp, synthetic construct
  misc_feature 1..27: note = Synthetic Construct
  source 1..27: mol_type = other DNA
ccatgtttcctctcaattctctgaaag

SEQ ID NO: 22402 - DNA, 20 bp, synthetic construct
  misc_feature 1..20: note = Synthetic Construct
  source 1..20: mol_type = other DNA
ggtgatgtggccagacttgt

SEQ ID NO: 22403 - DNA, 26 bp, synthetic construct
  misc_feature 1..26: note = Synthetic Construct
  source 1..26: mol_type = other DNA
cttgtgtagggacaaaagcataccaa

SEQ ID NO: 22404 - DNA, 21 bp, synthetic construct
  misc_feature 1..21: note = Synthetic Construct
  source 1..21: mol_type = other DNA
ccaaaggcccaggagaggttt

SEQ ID NO: 22405 - DNA, 30 bp, synthetic construct
  misc_feature 1..30: note = Synthetic Construct
  source 1..30: mol_type = other DNA
gagaactgactctcccagatataaagagtt

SEQ ID NO: 22406 - DNA, 27 bp, synthetic construct
  misc_feature 1..27: note = Synthetic Construct
  source 1..27: mol_type = other DNA
tctctgtgatttaggttcctgctttag

SEQ ID NO: 22407 - DNA, 23 bp, synthetic construct
  misc_feature 1..23: note = Synthetic Construct
  source 1..23: mol_type = other DNA
gcctggcctcaattctcattttt

SEQ ID NO: 22408 - DNA, 30 bp, synthetic construct
  misc_feature 1..30: note = Synthetic Construct
  source 1..30: mol_type = other DNA
cttggtatggaatcctagtgtattctgact

SEQ ID NO: 22409 - DNA, 22 bp, synthetic construct
  misc_feature 1..22: note = Synthetic Construct
  source 1..22: mol_type = other DNA
ttcctgtgagagcatgtgtgtt

SEQ ID NO: 22410 - DNA, 22 bp, synthetic construct
  misc_feature 1..22: note = Synthetic Construct
  source 1..22: mol_type = other DNA
ccagctagaggctactctgtca

SEQ ID NO: 22411 - DNA, 23 bp, synthetic construct
  misc_feature 1..23: note = Synthetic Construct
  source 1..23: mol_type = other DNA
ggcagagtcaaaaggaagtcaac

SEQ ID NO: 22412 - DNA, 23 bp, synthetic construct
  misc_feature 1..23: note = Synthetic Construct
  source 1..23: mol_type = other DNA
tgctggactcagggttgaatatg

SEQ ID NO: 22413 - DNA, 25 bp, synthetic construct
  misc_feature 1..25: note = Synthetic Construct
  source 1..25: mol_type = other DNA
acacctgcgaaacactttattgtag

SEQ ID NO: 22414 - DNA, 23 bp, synthetic construct
  misc_feature 1..23: note = Synthetic Construct
  source 1..23: mol_type = other DNA
cctgtcattaccagtgactgcat

SEQ ID NO: 22415 - DNA, 24 bp, synthetic construct
  misc_feature 1..24: note = Synthetic Construct
  source 1..24: mol_type = other DNA
ggcatcctttgacccatgatgaga

SEQ ID NO: 22416 - DNA, 20 bp, synthetic construct
  misc_feature 1..20: note = Synthetic Construct
  source 1..20: mol_type = other DNA
aggaccaggcctccttgttt

SEQ ID NO: 22417 - DNA, 22 bp, synthetic construct
  misc_feature 1..22: note = Synthetic Construct
  source 1..22: mol_type = other DNA
ccacaatgacctagcagacctt

SEQ ID NO: 22418 - DNA, 21 bp, synthetic construct
  misc_feature 1..21: note = Synthetic Construct
  source 1..21: mol_type = other DNA
ccagcttcaccattggctttc

SEQ ID NO: 22419 - DNA, 27 bp, synthetic construct
  misc_feature 1..27: note = Synthetic Construct
  source 1..27: mol_type = other DNA
gtgtctactaataagtaccagggcaaa

SEQ ID NO: 22420 - DNA, 26 bp, synthetic construct
  misc_feature 1..26: note = Synthetic Construct
  source 1..26: mol_type = other DNA
tctgaaagtaccccattcaagtcaag

SEQ ID NO: 22421 - DNA, 24 bp, synthetic construct
  misc_feature 1..24: note = Synthetic Construct
  source 1..24: mol_type = other DNA
gtggtcatttcctcagtgccagaa

SEQ ID NO: 22422 - DNA, 22 bp, synthetic construct
  misc_feature 1..22: note = Synthetic Construct
  source 1..22: mol_type = other DNA
ggttttgcttccaagggactgt

SEQ ID NO: 22423 - DNA, 26 bp, synthetic construct
  misc_feature 1..26: note = Synthetic Construct
  source 1..26: mol_type = other DNA
ggcatattcagcacaatctgctttac

SEQ ID NO: 22424 - DNA, 25 bp, synthetic construct
  misc_feature 1..25: note = Synthetic Construct
  source 1..25: mol_type = other DNA
gccatgagttgatgattgcgaggaa

SEQ ID NO: 22425 - DNA, 22 bp, synthetic construct
  misc_feature 1..22: note = Synthetic Construct
  source 1..22: mol_type = other DNA
gcagcaatgcccaggtactaca

SEQ ID NO: 22426 - DNA, 23 bp, synthetic construct
  misc_feature 1..23: note = Synthetic Construct
  source 1..23: mol_type = other DNA
cttgtggggtctggaatttggat

SEQ ID NO: 22427 - DNA, 24 bp, synthetic construct
  misc_feature 1..24: note = Synthetic Construct
  source 1..24: mol_type = other DNA
tggtcctgggtgtagtctggattc

SEQ ID NO: 22428 - DNA, 23 bp, synthetic construct
  misc_feature 1..23: note = Synthetic Construct
  source 1..23: mol_type = other DNA
ggaggcacaaacatgcattcaga

SEQ ID NO: 22429 - DNA, 25 bp, synthetic construct
  misc_feature 1..25: note = Synthetic Construct
  source 1..25: mol_type = other DNA
gtacttgtgcttggatgttttgcta

SEQ ID NO: 22430 - DNA, 24 bp, synthetic construct
  misc_feature 1..24: note = Synthetic Construct
  source 1..24: mol_type = other DNA
tgggagttaagagtgagtggaatg

SEQ ID NO: 22431 - DNA, 22 bp, synthetic construct
  misc_feature 1..22: note = Synthetic Construct
  source 1..22: mol_type = other DNA
ccagagcacacagcttcacaac

SEQ ID NO: 22432 - DNA, 21 bp, synthetic construct
  misc_feature 1..21: note = Synthetic Construct
  source 1..21: mol_type = other DNA
tctcaccgatgttgggctcta

SEQ ID NO: 22433 - DNA, 22 bp, synthetic construct
  misc_feature 1..22: note = Synthetic Construct
  source 1..22: mol_type = other DNA
gacacaatgctgcgtgttgctt

SEQ ID NO: 22434 - DNA, 22 bp, synthetic construct
  misc_feature 1..22: note = Synthetic Construct
  source 1..22: mol_type = other DNA
gagtgagtgagggtgggaagtt

SEQ ID NO: 22435 - DNA, 20 bp, synthetic construct
  misc_feature 1..20: note = Synthetic Construct
  source 1..20: mol_type = other DNA
tgcccaaagctcctgctagt

SEQ ID NO: 22436 - DNA, 24 bp, synthetic construct
  misc_feature 1..24: note = Synthetic Construct
  source 1..24: mol_type = other DNA
cagaggcctgagtttgtttagttg

SEQ ID NO: 22437 - DNA, 21 bp, synthetic construct
  misc_feature 1..21: note = Synthetic Construct
  source 1..21: mol_type = other DNA
aggccagcctccacacatact

SEQ ID NO: 22438 - DNA, 22 bp, synthetic construct
  misc_feature 1..22: note = Synthetic Construct
  source 1..22: mol_type = other DNA
gccattttgagagctgccctat

SEQ ID NO: 22439 - DNA, 25 bp, synthetic construct
  misc_feature 1..25: note = Synthetic Construct
  source 1..25: mol_type = other DNA
cccacacaatcacaccttacctttc

SEQ ID NO: 22440 - DNA, 26 bp, synthetic construct
  misc_feature 1..26: note = Synthetic Construct
  source 1..26: mol_type = other DNA
gggacttctgtttctcagagtagttc

SEQ ID NO: 22441 - DNA, 22 bp, synthetic construct
  misc_feature 1..22: note = Synthetic Construct
  source 1..22: mol_type = other DNA
tgagaaggcaggagcagtgata

SEQ ID NO: 22442 - DNA, 24 bp, synthetic construct
  misc_feature 1..24: note = Synthetic Construct
  source 1..24: mol_type = other DNA
gggtctgtatagccccatttcaca

SEQ ID NO: 22443 - DNA, 24 bp, synthetic construct
  misc_feature 1..24: note = Synthetic Construct
  source 1..24: mol_type = other DNA
ggatgcacttaattcgcccaacaa

SEQ ID NO: 22444 - DNA, 22 bp, synthetic construct
  misc_feature 1..22: note = Synthetic Construct
  source 1..22: mol_type = other DNA
gcaagttttggcttgagagctt

SEQ ID NO: 22445 - DNA, 24 bp, synthetic construct
  misc_feature 1..24: note = Synthetic Construct
  source 1..24: mol_type = other DNA
gcactgtctgcttccttctagact

SEQ ID NO: 22446 - DNA, 20 bp, synthetic construct
  misc_feature 1..20: note = Synthetic Construct
  source 1..20: mol_type = other DNA
gcgggcagtgatcattggaa

SEQ ID NO: 22447 - DNA, 26 bp, synthetic construct
  misc_feature 1..26: note = Synthetic Construct
  source 1..26: mol_type = other DNA
ggtgagggtgaaatcaatagcagaag

SEQ ID NO: 22448 - DNA, 22 bp, synthetic construct
  misc_feature 1..22: note = Synthetic Construct
  source 1..22: mol_type = other DNA
cacagacccaaaacgcaacaca

SEQ ID NO: 22449 - DNA, 24 bp, synthetic construct
  misc_feature 1..24: note = Synthetic Construct
  source 1..24: mol_type = other DNA
gacctcctggattttctccctttg

SEQ ID NO: 22450 - DNA, 26 bp, synthetic construct
  misc_feature 1..26: note = Synthetic Construct
  source 1..26: mol_type = other DNA
gcatgggaggggtagtctattagcaa

SEQ ID NO: 22451 - DNA, 25 bp, synthetic construct
  misc_feature 1..25: note = Synthetic Construct
  source 1..25: mol_type = other DNA
gtggtggttaggacagttgaaccaa

SEQ ID NO: 22452 - DNA, 21 bp, synthetic construct
  misc_feature 1..21: note = Synthetic Construct
  source 1..21: mol_type = other DNA
acagctacccctcccattaca

SEQ ID NO: 22453 - DNA, 25 bp, synthetic construct
  misc_feature 1..25: note = Synthetic Construct
  source 1..25: mol_type = other DNA
ggacagttgttgacctaggctgcta

SEQ ID NO: 22454 - DNA, 23 bp, synthetic construct
  misc_feature 1..23: note = Synthetic Construct
  source 1..23: mol_type = other DNA
ggggcagactgagtgtataggaa

SEQ ID NO: 22455 - DNA, 25 bp, synthetic construct
  misc_feature 1..25: note = Synthetic Construct
  source 1..25: mol_type = other DNA
gccacatgacaacatgtagctggaa

SEQ ID NO: 22456 - DNA, 21 bp, synthetic construct
  misc_feature 1..21: note = Synthetic Construct
  source 1..21: mol_type = other DNA
cctgactgggtcagctttcaa

SEQ ID NO: 22457 - DNA, 22 bp, synthetic construct
  misc_feature 1..22: note = Synthetic Construct
  source 1..22: mol_type = other DNA
cctggtttccccttcatgcaaa

SEQ ID NO: 22458 - DNA, 23 bp, synthetic construct
  misc_feature 1..23: note = Synthetic Construct
  source 1..23: mol_type = other DNA
ggaacacaggactggttcagaaa

SEQ ID NO: 22459 - DNA, 26 bp, synthetic construct
  misc_feature 1..26: note = Synthetic Construct
  source 1..26: mol_type = other DNA
ccgctcttcagagtgactaccctaac

SEQ ID NO: 22460 - DNA, 23 bp, synthetic construct
  misc_feature 1..23: note = Synthetic Construct
  source 1..23: mol_type = other DNA
tggtccttgtagatgggaagaca

SEQ ID NO: 22461 - DNA, 22 bp, synthetic construct
  misc_feature 1..22: note = Synthetic Construct
  source 1..22: mol_type = other DNA
ccagaggacttcagccagttgt

SEQ ID NO: 22462 - DNA, 23 bp, synthetic construct
  misc_feature 1..23: note = Synthetic Construct
  source 1..23: mol_type = other DNA
cctggccctcatagggagataga

SEQ ID NO: 22463 - DNA, 22 bp, synthetic construct
  misc_feature 1..22: note = Synthetic Construct
  source 1..22: mol_type = other DNA
ctggctgcgtattttggcatgt

SEQ ID NO: 22464 - DNA, 28 bp, synthetic construct
  misc_feature 1..28: note = Synthetic Construct
  source 1..28: mol_type = other DNA
ggcaaaactgttatggtgacaagacaga

SEQ ID NO: 22465 - DNA, 22 bp, synthetic construct
  misc_feature 1..22: note = Synthetic Construct
  source 1..22: mol_type = other DNA
ggggcacaaaatgcaccacaga

SEQ ID NO: 22466 - DNA, 23 bp, synthetic construct
  misc_feature 1..23: note = Synthetic Construct
  source 1..23: mol_type = other DNA
tggatggagttcaccactcaatg

SEQ ID NO: 22467 - DNA, 22 bp, synthetic construct
  misc_feature 1..22: note = Synthetic Construct
  source 1..22: mol_type = other DNA
ccccggtttttcacagtacaga

SEQ ID NO: 22468 - DNA, 21 bp, synthetic construct
  misc_feature 1..21: note = Synthetic Construct
  source 1..21: mol_type = other DNA
ccagacagacgccttccagtt

SEQ ID NO: 22469 - DNA, 30 bp, synthetic construct
  misc_feature 1..30: note = Synthetic Construct
  source 1..30: mol_type = other DNA
cagcctcaaaatatattacagggaccatac

SEQ ID NO: 22470 - DNA, 20 bp, synthetic construct
  misc_feature 1..20: note = Synthetic Construct
  source 1..20: mol_type = other DNA
gcgtgctccaaccagtcttg

SEQ ID NO: 22471 - DNA, 21 bp, synthetic construct
  misc_feature 1..21: note = Synthetic Construct
  source 1..21: mol_type = other DNA
cgtgtgcaatctggagcatgt

SEQ ID NO: 22472 - DNA, 23 bp, synthetic construct
  misc_feature 1..23: note = Synthetic Construct
  source 1..23: mol_type = other DNA
gggttcaagtcctcatcgtgtct

SEQ ID NO: 22473 - DNA, 25 bp, synthetic construct
  misc_feature 1..25: note = Synthetic Construct
  source 1..25: mol_type = other DNA
tctgtgtctgacctttcacttttct

SEQ ID NO: 22474 - DNA, 27 bp, synthetic construct
  misc_feature 1..27: note = Synthetic Construct
  source 1..27: mol_type = other DNA
cggtacagtgagtttctgcatagattt

SEQ ID NO: 22475 - DNA, 27 bp, synthetic construct
  misc_feature 1..27: note = Synthetic Construct
  source 1..27: mol_type = other DNA
cctgctactaaagttactctcccattg

SEQ ID NO: 22476 - DNA, 25 bp, synthetic construct
  misc_feature 1..25: note = Synthetic Construct
  source 1..25: mol_type = other DNA
agtccagggaaagcattgatgatag

SEQ ID NO: 22477 - DNA, 22 bp, synthetic construct
  misc_feature 1..22: note = Synthetic Construct
  source 1..22: mol_type = other DNA
acccatcccacaaaaccagatg

SEQ ID NO: 22478 - DNA, 24 bp, synthetic construct
  misc_feature 1..24: note = Synthetic Construct
  source 1..24: mol_type = other DNA
ccgactgtccagctttttcgtaag

SEQ ID NO: 22479 - DNA, 27 bp, synthetic construct
  misc_feature 1..27: note = Synthetic Construct
  source 1..27: mol_type = other DNA
ggagcatcttttccaacactatgaatc

SEQ ID NO: 22480 - DNA, 23 bp, synthetic construct
  misc_feature 1..23: note = Synthetic Construct
  source 1..23: mol_type = other DNA
acctaagccacagagtgcttatc

SEQ ID NO: 22481 - DNA, 23 bp, synthetic construct
  misc_feature 1..23: note = Synthetic Construct
  source 1..23: mol_type = other DNA
cccaactgtgttctgcctacaag

SEQ ID NO: 22482 - DNA, 21 bp, synthetic construct
  misc_feature 1..21: note = Synthetic Construct
  source 1..21: mol_type = other DNA
ctgcaggcagatcatcccaat

SEQ ID NO: 22483 - DNA, 22 bp, synthetic construct
  misc_feature 1..22: note = Synthetic Construct
  source 1..22: mol_type = other DNA
ggagtagcaggtttccgtgatg

SEQ ID NO: 22484 - DNA, 23 bp, synthetic construct
  misc_feature 1..23: note = Synthetic Construct
  source 1..23: mol_type = other DNA
gactggaacaggtaaggggaaag

SEQ ID NO: 22485 - DNA, 24 bp, synthetic construct
  misc_feature 1..24: note = Synthetic Construct
  source 1..24: mol_type = other DNA
tcaattcagtcttcctgagtgcaa

SEQ ID NO: 22486 - DNA, 22 bp, synthetic construct
  misc_feature 1..22: note = Synthetic Construct
  source 1..22: mol_type = other DNA
ccacagtcagtccagtctccaa

SEQ ID NO: 22487 - DNA, 26 bp, synthetic construct
  misc_feature 1..26: note = Synthetic Construct
  source 1..26: mol_type = other DNA
ctcatagccaggattcacagatccat

SEQ ID NO: 22488 - DNA, 26 bp, synthetic construct
  misc_feature 1..26: note = Synthetic Construct
  source 1..26: mol_type = other DNA
gacagtgcaggattgagtaaatgcaa

SEQ ID NO: 22489 - DNA, 22 bp, synthetic construct
  misc_feature 1..22: note = Synthetic Construct
  source 1..22: mol_type = other DNA
gcaggtatgctggctggtgaaa

SEQ ID NO: 22490 - DNA, 27 bp, synthetic construct
  misc_feature 1..27: note = Synthetic Construct
  source 1..27: mol_type = other DNA
gacaaatggctttgcatatccccatac

SEQ ID NO: 22491 - DNA, 24 bp, synthetic construct
  misc_feature 1..24: note = Synthetic Construct
  source 1..24: mol_type = other DNA
accaacgggaaatcccagttaatc

SEQ ID NO: 22492 - DNA, 24 bp, synthetic construct
  misc_feature 1..24: note = Synthetic Construct
  source 1..24: mol_type = other DNA
gctccaggcttgcttaggctagaa

SEQ ID NO: 22493 - DNA, 25 bp, synthetic construct
  misc_feature 1..25: note = Synthetic Construct
  source 1..25: mol_type = other DNA
gcttggaaaggcagtaggaaagtgt

SEQ ID NO: 22494 - DNA, 24 bp, synthetic construct
  misc_feature 1..24: note = Synthetic Construct
  source 1..24: mol_type = other DNA
tggccatgaaaggaggtacaattc

SEQ ID NO: 22495 - DNA, 20 bp, synthetic construct
  misc_feature 1..20: note = Synthetic Construct
  source 1..20: mol_type = other DNA
gccgtgtgtttccagagctt

SEQ ID NO: 22496 - DNA, 25 bp, synthetic construct
  misc_feature 1..25: note = Synthetic Construct
  source 1..25: mol_type = other DNA
gggacttattgtagccccttagtca

SEQ ID NO: 22497 - DNA, 21 bp, synthetic construct
  misc_feature 1..21: note = Synthetic Construct
  source 1..21: mol_type = other DNA
ataggaggtgcgggcagattc

SEQ ID NO: 22498 - DNA, 23 bp, synthetic construct
  misc_feature 1..23: note = Synthetic Construct
  source 1..23: mol_type = other DNA
aatgtgatgaggaagtggcatct

SEQ ID NO: 22499 - DNA, 22 bp, synthetic construct
  misc_feature 1..22: note = Synthetic Construct
  source 1..22: mol_type = other DNA
ggaagggattaagtggcaggtt

SEQ ID NO: 22500 - DNA, 26 bp, synthetic construct
  misc_feature 1..26: note = Synthetic Construct
  source 1..26: mol_type = other DNA
gcagacactgatatcccctacccatt

SEQ ID NO: 22501 - DNA, 27 bp, synthetic construct
  misc_feature 1..27: note = Synthetic Construct
  source 1..27: mol_type = other DNA
ctccctcagctaagctatacagtcagt

SEQ ID NO: 22502 - DNA, 25 bp, synthetic construct
  misc_feature 1..25: note = Synthetic Construct
  source 1..25: mol_type = other DNA
cctccaaagagtctgtccacaatga

SEQ ID NO: 22503 - DNA, 21 bp, synthetic construct
  misc_feature 1..21: note = Synthetic Construct
  source 1..21: mol_type = other DNA
gccagcaccatggaagaggta

SEQ ID NO: 22504 - DNA, 27 bp, synthetic construct
  misc_feature 1..27: note = Synthetic Construct
  source 1..27: mol_type = other DNA
gtcatggaatcctcttctttagccata

SEQ ID NO: 22505 - DNA, 21 bp, synthetic construct
  misc_feature 1..21: note = Synthetic Construct
  source 1..21: mol_type = other DNA
actccaccaacctgccctttg

SEQ ID NO: 22506 - DNA, 24 bp, synthetic construct
  misc_feature 1..24: note = Synthetic Construct
  source 1..24: mol_type = other DNA
agaaccgtggtcttcaaatagcat

SEQ ID NO: 22507 - DNA, 21 bp, synthetic construct
  misc_feature 1..21: note = Synthetic Construct
  source 1..21: mol_type = other DNA
agcaagagttgaggggcattg

SEQ ID NO: 22508 - DNA, 20 bp, synthetic construct
  misc_feature 1..20: note = Synthetic Construct
  source 1..20: mol_type = other DNA
cccactaacagcgccaagtt

SEQ ID NO: 22509 - DNA, 24 bp, synthetic construct
  misc_feature 1..24: note = Synthetic Construct
  source 1..24: mol_type = other DNA
gactccttggctttcacaaagaga

SEQ ID NO: 22510 - DNA, 24 bp, synthetic construct
  misc_feature 1..24: note = Synthetic Construct
  source 1..24: mol_type = other DNA
cagccgtgcataatttgggtgtag

SEQ ID NO: 22511 - DNA, 24 bp, synthetic construct
  misc_feature 1..24: note = Synthetic Construct
  source 1..24: mol_type = other DNA
ccctcctgtatctcatccccattc

SEQ ID NO: 22512 - DNA, 21 bp, synthetic construct
  misc_feature 1..21: note = Synthetic Construct
  source 1..21: mol_type = other DNA
caccatgccattttgctgtga

SEQ ID NO: 22513 - DNA, 27 bp, synthetic construct
  misc_feature 1..27: note = Synthetic Construct
  source 1..27: mol_type = other DNA
cagacatgaagctcactgaaggtgtaa

SEQ ID NO: 22514 - DNA, 26 bp, synthetic construct
  misc_feature 1..26: note = Synthetic Construct
  source 1..26: mol_type = other DNA
gcacagctaacatactcagtggtgaa

SEQ ID NO: 22515 - DNA, 24 bp, synthetic construct
  misc_feature 1..24: note = Synthetic Construct
  source 1..24: mol_type = other DNA
cagagcctttgctcatcccactac

SEQ ID NO: 22516 - DNA, 22 bp, synthetic construct
  misc_feature 1..22: note = Synthetic Construct
  source 1..22: mol_type = other DNA
gtgaatcccagcgggttacaag

SEQ ID NO: 22517 - DNA, 19 bp, synthetic construct
  misc_feature 1..19: note = Synthetic Construct
  source 1..19: mol_type = other DNA
gcacgtgctggtgctcaga

SEQ ID NO: 22518 - DNA, 23 bp, synthetic construct
  misc_feature 1..23: note = Synthetic Construct
  source 1..23: mol_type = other DNA
ccctactcccagccaatttccat

SEQ ID NO: 22519 - DNA, 24 bp, synthetic construct
  misc_feature 1..24: note = Synthetic Construct
  source 1..24: mol_type = other DNA
gtctacacacacagcctcactatg

SEQ ID NO: 22520 - DNA, 26 bp, synthetic construct
  misc_feature 1..26: note = Synthetic Construct
  source 1..26: mol_type = other DNA
ggcacatactgtactcttgcatgttg

SEQ ID NO: 22521 - DNA, 25 bp, synthetic construct
  misc_feature 1..25: note = Synthetic Construct
  source 1..25: mol_type = other DNA
cctaatccacgatctcctcatctgt

SEQ ID NO: 22522 - DNA, 24 bp, synthetic construct
  misc_feature 1..24: note = Synthetic Construct
  source 1..24: mol_type = other DNA
gcaattccctgaagatacctgcta

SEQ ID NO: 22523 - DNA, 23 bp, synthetic construct
  misc_feature 1..23: note = Synthetic Construct
  source 1..23: mol_type = other DNA
cgggtacacaattgtccccagtt

SEQ ID NO: 22524 - DNA, 20 bp, synthetic construct
  misc_feature 1..20: note = Synthetic Construct
  source 1..20: mol_type = other DNA
acttgggcgaggtggctaag

SEQ ID NO: 22525 - DNA, 24 bp, synthetic construct
  misc_feature 1..24: note = Synthetic Construct
  source 1..24: mol_type = other DNA
tcactggtatgtctgggaaagttg

SEQ ID NO: 22526 - DNA, 24 bp, synthetic construct
  misc_feature 1..24: note = Synthetic Construct
  source 1..24: mol_type = other DNA
gcacccaagtggagagggtaaatc

SEQ ID NO: 22527 - DNA, 23 bp, synthetic construct
  misc_feature 1..23: note = Synthetic Construct
  source 1..23: mol_type = other DNA
cccaagaagctctctgtgctatg

SEQ ID NO: 22528 - DNA, 21 bp, synthetic construct
  misc_feature 1..21: note = Synthetic Construct
  source 1..21: mol_type = other DNA
gctcctgcacaagcacagatg

SEQ ID NO: 22529 - DNA, 25 bp, synthetic construct
  misc_feature 1..25: note = Synthetic Construct
  source 1..25: mol_type = other DNA
ctgaacacctccttgagtacagttc

SEQ ID NO: 22530 - DNA, 24 bp, synthetic construct
  misc_feature 1..24: note = Synthetic Construct
  source 1..24: mol_type = other DNA
cccagtttgcaagaagcatgaaag

SEQ ID NO: 22531 - DNA, 27 bp, synthetic construct
  misc_feature 1..27: note = Synthetic Construct
  source 1..27: mol_type = other DNA
ggttattccgtgttcttgatcttgctt

SEQ ID NO: 22532 - DNA, 21 bp, synthetic construct
  misc_feature 1..21: note = Synthetic Construct
  source 1..21: mol_type = other DNA
gcagtggcagaagggcatttg

SEQ ID NO: 22533 - DNA, 25 bp, synthetic construct
  misc_feature 1..25: note = Synthetic Construct
  source 1..25: mol_type = other DNA
ctcctctaagaaactaagggcaaca

SEQ ID NO: 22534 - DNA, 23 bp, synthetic construct
  misc_feature 1..23: note = Synthetic Construct
  source 1..23: mol_type = other DNA
cgctaggttgtgtactgggaaca

SEQ ID NO: 22535 - DNA, 26 bp, synthetic construct
  misc_feature 1..26: note = Synthetic Construct
  source 1..26: mol_type = other DNA
gcccatagcttgtcccattgactgtt

SEQ ID NO: 22536 - DNA, 30 bp, synthetic construct
  misc_feature 1..30: note = Synthetic Construct
  source 1..30: mol_type = other DNA
ccctaagctttaccttagatggagagaaag

SEQ ID NO: 22537 - DNA, 25 bp, synthetic construct
  misc_feature 1..25: note = Synthetic Construct
  source 1..25: mol_type = other DNA
cacactggaaccaaagacctttatc

SEQ ID NO: 22538 - DNA, 24 bp, synthetic construct
  misc_feature 1..24: note = Synthetic Construct
  source 1..24: mol_type = other DNA
gggctgagtaacaagagtggttct

SEQ ID NO: 22539 - DNA, 25 bp, synthetic construct
  misc_feature 1..25: note = Synthetic Construct
  source 1..25: mol_type = other DNA
ggtttccctgtagcttaagaaccat

SEQ ID NO: 22540 - DNA, 24 bp, synthetic construct
  misc_feature 1..24: note = Synthetic Construct
  source 1..24: mol_type = other DNA
ggtggagaatgacaacatgcagaa

SEQ ID NO: 22541 - DNA, 24 bp, synthetic construct
  misc_feature 1..24: note = Synthetic Construct
  source 1..24: mol_type = other DNA
accagtgggattgatgagacaaaa

SEQ ID NO: 22542 - DNA, 22 bp, synthetic construct
  misc_feature 1..22: note = Synthetic Construct
  source 1..22: mol_type = other DNA
ccacagagcctagcaaggtgtt

SEQ ID NO: 22543 - DNA, 22 bp, synthetic construct
  misc_feature 1..22: note = Synthetic Construct
  source 1..22: mol_type = other DNA
cccttctgtgcaatgggacttg

SEQ ID NO: 22544 - DNA, 20 bp, synthetic construct
  misc_feature 1..20: note = Synthetic Construct
  source 1..20: mol_type = other DNA
tgttggcttctgcagtgtga

SEQ ID NO: 22545 - DNA, 26 bp, synthetic construct
  misc_feature 1..26: note = Synthetic Construct
  source 1..26: mol_type = other DNA
ccaactgagaacttgcttcccaaaag

SEQ ID NO: 22546 - DNA, 22 bp, synthetic construct
  misc_feature 1..22: note = Synthetic Construct
  source 1..22: mol_type = other DNA
ctgcccaggcttttgacttttg

SEQ ID NO: 22547 - DNA, 23 bp, synthetic construct
  misc_feature 1..23: note = Synthetic Construct
  source 1..23: mol_type = other DNA
gtgaaagctagcatctggggttt

SEQ ID NO: 22548 - DNA, 25 bp, synthetic construct
  misc_feature 1..25: note = Synthetic Construct
  source 1..25: mol_type = other DNA
caaaatcctggggatacagactctt

SEQ ID NO: 22549 - DNA, 22 bp, synthetic construct
  misc_feature 1..22: note = Synthetic Construct
  source 1..22: mol_type = other DNA
gaacccactggaatacgtcctt

SEQ ID NO: 22550 - DNA, 23 bp, synthetic construct
  misc_feature 1..23: note = Synthetic Construct
  source 1..23: mol_type = other DNA
gacatgatctgacccttgacaca

SEQ ID NO: 22551 - DNA, 22 bp, synthetic construct
  misc_feature 1..22: note = Synthetic Construct
  source 1..22: mol_type = other DNA
agggagcttagaggaaggtcaa

SEQ ID NO: 22552 - DNA, 22 bp, synthetic construct
  misc_feature 1..22: note = Synthetic Construct
  source 1..22: mol_type = other DNA
cagccacattccagagccaatc

SEQ ID NO: 22553 - DNA, 25 bp, synthetic construct
  misc_feature 1..25: note = Synthetic Construct
  source 1..25: mol_type = other DNA
gtgtgtgtgggctttatgaagaaaa

SEQ ID NO: 22554 - DNA, 24 bp, synthetic construct
  misc_feature 1..24: note = Synthetic Construct
  source 1..24: mol_type = other DNA
gaagtgaagaagagtggtcagcta

SEQ ID NO: 22555 - DNA, 24 bp, synthetic construct
  misc_feature 1..24: note = Synthetic Construct
  source 1..24: mol_type = other DNA
accatggtttccttgtcagcataa

SEQ ID NO: 22556 - DNA, 26 bp, synthetic construct
  misc_feature 1..26: note = Synthetic Construct
  source 1..26: mol_type = other DNA
gaaatcagcttctctctcactcagtt

SEQ ID NO: 22557 - DNA, 25 bp, synthetic construct
  misc_feature 1..25: note = Synthetic Construct
  source 1..25: mol_type = other DNA
tgtggtagaagagttgtctccattg

SEQ ID NO: 22558 - DNA, 23 bp, synthetic construct
  misc_feature 1..23: note = Synthetic Construct
  source 1..23: mol_type = other DNA
gcctagcttcaagagctccttct

SEQ ID NO: 22559 - DNA, 22 bp, synthetic construct
  misc_feature 1..22: note = Synthetic Construct
  source 1..22: mol_type = other DNA
gtggcttacccaccagcaaact

SEQ ID NO: 22560 - DNA, 22 bp, synthetic construct
  misc_feature 1..22: note = Synthetic Construct
  source 1..22: mol_type = other DNA
ctgagtgttctggggctagttt

SEQ ID NO: 22561 - DNA, 24 bp, synthetic construct
  misc_feature 1..24: note = Synthetic Construct
  source 1..24: mol_type = other DNA
cagagggctagtgtatctccaaga

SEQ ID NO: 22562 - DNA, 23 bp, synthetic construct
  misc_feature 1..23: note = Synthetic Construct
  source 1..23: mol_type = other DNA
gtctctgggcttaatgtgcaagt

SEQ ID NO: 22563 - DNA, 26 bp, synthetic construct
  misc_feature 1..26: note = Synthetic Construct
  source 1..26: mol_type = other DNA
cacagtggacttgtttgttcttgagt

SEQ ID NO: 22564 - DNA, 26 bp, synthetic construct
  misc_feature 1..26: note = Synthetic Construct
  source 1..26: mol_type = other DNA
gctccatttatgttcccattgtgtct

SEQ ID NO: 22565 - DNA, 26 bp, synthetic construct
  misc_feature 1..26: note = Synthetic Construct
  source 1..26: mol_type = other DNA
gcttatttggtaacgactaggcagat

SEQ ID NO: 22566 - DNA, 22 bp, synthetic construct
  misc_feature 1..22: note = Synthetic Construct
  source 1..22: mol_type = other DNA
tctccagagcctttgcttccta

SEQ ID NO: 22567 - DNA, 24 bp, synthetic construct
  misc_feature 1..24: note = Synthetic Construct
  source 1..24: mol_type = other DNA
ccaccagcattcaagtgcaatgta

SEQ ID NO: 22568 - DNA, 22 bp, synthetic construct
  misc_feature 1..22: note = Synthetic Construct
  source 1..22: mol_type = other DNA
accttccaggtctcagctctct

SEQ ID NO: 22569 - DNA, 24 bp, synthetic construct
  misc_feature 1..24: note = Synthetic Construct
  source 1..24: mol_type = other DNA
cacccttgagacaatgggttgtag

SEQ ID NO: 22570 - DNA, 25 bp, synthetic construct
  misc_feature 1..25: note = Synthetic Construct
  source 1..25: mol_type = other DNA
ggacatggaaagattgggacaggtt

SEQ ID NO: 22571 - DNA, 21 bp, synthetic construct
  misc_feature 1..21: note = Synthetic Construct
  source 1..21: mol_type = other DNA
ccagtgtcagctgggttttgt

SEQ ID NO: 22572 - DNA, 25 bp, synthetic construct
  misc_feature 1..25: note = Synthetic Construct
  source 1..25: mol_type = other DNA
aggtaaaggggtggaaaaagacatc

SEQ ID NO: 22573 - DNA, 27 bp, synthetic construct
  misc_feature 1..27: note = Synthetic Construct
  source 1..27: mol_type = other DNA
ccttctaacaccccttctctgtgagat

SEQ ID NO: 22574 - DNA, 23 bp, synthetic construct
  misc_feature 1..23: note = Synthetic Construct
  source 1..23: mol_type = other DNA
gagtgaagaccagcagacagaag

SEQ ID NO: 22575 - DNA, 25 bp, synthetic construct
  misc_feature 1..25: note = Synthetic Construct
  source 1..25: mol_type = other DNA
ggtggaaccaaagaagaaagggttt

SEQ ID NO: 22576 - DNA, 22 bp, synthetic construct
  misc_feature 1..22: note = Synthetic Construct
  source 1..22: mol_type = other DNA
gctgccacctaggaaacaaagt

SEQ ID NO: 22577 - DNA, 21 bp, synthetic construct
  misc_feature 1..21: note = Synthetic Construct
  source 1..21: mol_type = other DNA
ggggacatcgtggtcttgcat

SEQ ID NO: 22578 - DNA, 24 bp, synthetic construct
  misc_feature 1..24: note = Synthetic Construct
  source 1..24: mol_type = other DNA
gccacttgcaaagaacacttttgt

SEQ ID NO: 22579 - DNA, 20 bp, synthetic construct
  misc_feature 1..20: note = Synthetic Construct
  source 1..20: mol_type = other DNA
gcctttctgcctggctcttg

SEQ ID NO: 22580 - DNA, 25 bp, synthetic construct
  misc_feature 1..25: note = Synthetic Construct
  source 1..25: mol_type = other DNA
ggaccatttagactcactgccatca

SEQ ID NO: 22581 - DNA, 27 bp, synthetic construct
  misc_feature 1..27: note = Synthetic Construct
  source 1..27: mol_type = other DNA
acccgtgtattatgactttcagagttc

SEQ ID NO: 22582 - DNA, 24 bp, synthetic construct
  misc_feature 1..24: note = Synthetic Construct
  source 1..24: mol_type = other DNA
tggggaggtaaccaaatcttttga

SEQ ID NO: 22583 - DNA, 21 bp, synthetic construct
  misc_feature 1..21: note = Synthetic Construct
  source 1..21: mol_type = other DNA
ccaaggacttgggacgacttt

SEQ ID NO: 22584 - DNA, 22 bp, synthetic construct
  misc_feature 1..22: note = Synthetic Construct
  source 1..22: mol_type = other DNA
gacgttgctgtgtcctttgctt

SEQ ID NO: 22585 - DNA, 25 bp, synthetic construct
  misc_feature 1..25: note = Synthetic Construct
  source 1..25: mol_type = other DNA
gccactggatagcatcattggatct

SEQ ID NO: 22586 - DNA, 26 bp, synthetic construct
  misc_feature 1..26: note = Synthetic Construct
  source 1..26: mol_type = other DNA
ccgcttccataacctggagataccta

SEQ ID NO: 22587 - DNA, 24 bp, synthetic construct
  misc_feature 1..24: note = Synthetic Construct
  source 1..24: mol_type = other DNA
cccctctattcaaggctatgttgt

SEQ ID NO: 22588 - DNA, 21 bp, synthetic construct
  misc_feature 1..21: note = Synthetic Construct
  source 1..21: mol_type = other DNA
catgccgaacagccttctttc

SEQ ID NO: 22589 - DNA, 24 bp, synthetic construct
  misc_feature 1..24: note = Synthetic Construct
  source 1..24: mol_type = other DNA
cctgaggggaggtaggaggaaaaa

SEQ ID NO: 22590 - DNA, 23 bp, synthetic construct
  misc_feature 1..23: note = Synthetic Construct
  source 1..23: mol_type = other DNA
tgaagcctcagatcctagagtca

SEQ ID NO: 22591 - DNA, 27 bp, synthetic construct
  misc_feature 1..27: note = Synthetic Construct
  source 1..27: mol_type = other DNA
gggcatctaacaactacccatgcattt

SEQ ID NO: 22592 - DNA, 24 bp, synthetic construct
  misc_feature 1..24: note = Synthetic Construct
  source 1..24: mol_type = other DNA
gagagccatcacattctggtcttc

SEQ ID NO: 22593 - DNA, 25 bp, synthetic construct
  misc_feature 1..25: note = Synthetic Construct
  source 1..25: mol_type = other DNA
gaatccacccattcaaggaaagaag

SEQ ID NO: 22594 - DNA, 24 bp, synthetic construct
  misc_feature 1..24: note = Synthetic Construct
  source 1..24: mol_type = other DNA
ggcagtagtgctccaaatatgcta

SEQ ID NO: 22595 - DNA, 23 bp, synthetic construct
  misc_feature 1..23: note = Synthetic Construct
  source 1..23: mol_type = other DNA
tggctacagacaagtgaggatga

SEQ ID NO: 22596 - DNA, 24 bp, synthetic construct
  misc_feature 1..24: note = Synthetic Construct
  source 1..24: mol_type = other DNA
actcaaagcaaaagagggacaact

SEQ ID NO: 22597 - DNA, 21 bp, synthetic construct
  misc_feature 1..21: note = Synthetic Construct
  source 1..21: mol_type = other DNA
acacatggggtctcaggaact

SEQ ID NO: 22598 - DNA, 27 bp, synthetic construct
  misc_feature 1..27: note = Synthetic Construct
  source 1..27: mol_type = other DNA
cctcactagaccttaactgggatgact

SEQ ID NO: 22599 - DNA, 26 bp, synthetic construct
  misc_feature 1..26: note = Synthetic Construct
  source 1..26: mol_type = other DNA
gccatccttgcttgtatccttctctt

SEQ ID NO: 22600 - DNA, 24 bp, synthetic construct
  misc_feature 1..24: note = Synthetic Construct
  source 1..24: mol_type = other DNA
ctgagtcacacagtccattgaaac

SEQ ID NO: 22601 - DNA, 22 bp, synthetic construct
  misc_feature 1..22: note = Synthetic Construct
  source 1..22: mol_type = other DNA
tgctgacagccctcctaagcta

SEQ ID NO: 22602 - DNA, 26 bp, synthetic construct
  misc_feature 1..26: note = Synthetic Construct
  source 1..26: mol_type = other DNA
gcctccattgtctctctcctggataa

SEQ ID NO: 22603 - DNA, 22 bp, synthetic construct
  misc_feature 1..22: note = Synthetic Construct
  source 1..22: mol_type = other DNA
ggccggagaaaggtttggcatt

SEQ ID NO: 22604 - DNA, 27 bp, synthetic construct
  misc_feature 1..27: note = Synthetic Construct
  source 1..27: mol_type = other DNA
gccaccaattcctttggatgatccttt

SEQ ID NO: 22605 - DNA, 23 bp, synthetic construct
  misc_feature 1..23: note = Synthetic Construct
  source 1..23: mol_type = other DNA
tccattccatgttggagcaaaac

SEQ ID NO: 22606 - DNA, 24 bp, synthetic construct
  misc_feature 1..24: note = Synthetic Construct
  source 1..24: mol_type = other DNA
tgagtaggaatggcaacagctaat

SEQ ID NO: 22607 - DNA, 21 bp, synthetic construct
  misc_feature 1..21: note = Synthetic Construct
  source 1..21: mol_type = other DNA
cccattcagtggggtttcgtt

SEQ ID NO: 22608 - DNA, 25 bp, synthetic construct
  misc_feature 1..25: note = Synthetic Construct
  source 1..25: mol_type = other DNA
cggcacagagtggttaagaataaga

SEQ ID NO: 22609 - DNA, 27 bp, synthetic construct
  misc_feature 1..27: note = Synthetic Construct
  source 1..27: mol_type = other DNA
gcatcagaactcatagacacttgattg

SEQ ID NO: 22610 - DNA, 26 bp, synthetic construct
  misc_feature 1..26: note = Synthetic Construct
  source 1..26: mol_type = other DNA
gtggcatggaagaatcatgtgcttag

SEQ ID NO: 22611 - DNA, 22 bp, synthetic construct
  misc_feature 1..22: note = Synthetic Construct
  source 1..22: mol_type = other DNA
accttctcatagcccagtctgt

SEQ ID NO: 22612 - DNA, 25 bp, synthetic construct
  misc_feature 1..25: note = Synthetic Construct
  source 1..25: mol_type = other DNA
gctcttaaatagctcacacgctagt

SEQ ID NO: 22613 - DNA, 23 bp, synthetic construct
  misc_feature 1..23: note = Synthetic Construct
  source 1..23: mol_type = other DNA
cgtttgtggaatggctcaagatt

SEQ ID NO: 22614 - DNA, 21 bp, synthetic construct
  misc_feature 1..21: note = Synthetic Construct
  source 1..21: mol_type = other DNA
tccccaccttgagtgctcagt

SEQ ID NO: 22615 - DNA, 25 bp, synthetic construct
  misc_feature 1..25: note = Synthetic Construct
  source 1..25: mol_type = other DNA
gctctatacattgtggtgcctgcaa

SEQ ID NO: 22616 - DNA, 24 bp, synthetic construct
  misc_feature 1..24: note = Synthetic Construct
  source 1..24: mol_type = other DNA
gagtatgggatcaggtccatgtca

SEQ ID NO: 22617 - DNA, 27 bp, synthetic construct
  misc_feature 1..27: note = Synthetic Construct
  source 1..27: mol_type = other DNA
ggcaaaccctacattctgtgtaaaaac

SEQ ID NO: 22618 - DNA, 23 bp, synthetic construct
  misc_feature 1..23: note = Synthetic Construct
  source 1..23: mol_type = other DNA
gctggtgactggttcatcctaga

SEQ ID NO: 22619 - DNA, 20 bp, synthetic construct
  misc_feature 1..20: note = Synthetic Construct
  source 1..20: mol_type = other DNA
gcgtgctagccaaactgttg

SEQ ID NO: 22620 - DNA, 22 bp, synthetic construct
  misc_feature 1..22: note = Synthetic Construct
  source 1..22: mol_type = other DNA
ggttgggaagactgtgggacaa

SEQ ID NO: 22621 - DNA, 25 bp, synthetic construct
  misc_feature 1..25: note = Synthetic Construct
  source 1..25: mol_type = other DNA
ccaagtggtggcaattacaggacta

SEQ ID NO: 22622 - DNA, 21 bp, synthetic construct
  misc_feature 1..21: note = Synthetic Construct
  source 1..21: mol_type = other DNA
tggtcactcagggtgggtaag

SEQ ID NO: 22623 - DNA, 20 bp, synthetic construct
  misc_feature 1..20: note = Synthetic Construct
  source 1..20: mol_type = other DNA
acacactccccaccccaaac

SEQ ID NO: 22624 - DNA, 22 bp, synthetic construct
  misc_feature 1..22: note = Synthetic Construct
  source 1..22: mol_type = other DNA
gcttcccactctgcccatcaat

SEQ ID NO: 22625 - DNA, 23 bp, synthetic construct
  misc_feature 1..23: note = Synthetic Construct
  source 1..23: mol_type = other DNA
caccaccgtagatccaaaagtgt

SEQ ID NO: 22626 - DNA, 21 bp, synthetic construct
  misc_feature 1..21: note = Synthetic Construct
  source 1..21: mol_type = other DNA
ggtgctattgctccctgttca

SEQ ID NO: 22627 - DNA, 23 bp, synthetic construct
  misc_feature 1..23: note = Synthetic Construct
  source 1..23: mol_type = other DNA
gaacctctccttttacggtgcaa

SEQ ID NO: 22628 - DNA, 24 bp, synthetic construct
  misc_feature 1..24: note = Synthetic Construct
  source 1..24: mol_type = other DNA
ctctctggccaggtgacattgtag

SEQ ID NO: 22629 - DNA, 23 bp, synthetic construct
  misc_feature 1..23: note = Synthetic Construct
  source 1..23: mol_type = other DNA
gctcaaaaccggcattgatggta

SEQ ID NO: 22630 - DNA, 20 bp, synthetic construct
  misc_feature 1..20: note = Synthetic Construct
  source 1..20: mol_type = other DNA
tcaaccaaccagcggtcaga

SEQ ID NO: 22631 - DNA, 23 bp, synthetic construct
  misc_feature 1..23: note = Synthetic Construct
  source 1..23: mol_type = other DNA
gagtttccgtcacaacgttcctt

SEQ ID NO: 22632 - DNA, 23 bp, synthetic construct
  misc_feature 1..23: note = Synthetic Construct
  source 1..23: mol_type = other DNA
agggagggagttattgtgctact

SEQ ID NO: 22633 - DNA, 22 bp, synthetic construct
  misc_feature 1..22: note = Synthetic Construct
  source 1..22: mol_type = other DNA
gaagctgggttgaagtgctttg

SEQ ID NO: 22634 - DNA, 25 bp, synthetic construct
  misc_feature 1..25: note = Synthetic Construct
  source 1..25: mol_type = other DNA
ggagagttatcaatgagccttctgt

SEQ ID NO: 22635 - DNA, 21 bp, synthetic construct
  misc_feature 1..21: note = Synthetic Construct
  source 1..21: mol_type = other DNA
tggcaaagtgagaacctgcat

SEQ ID NO: 22636 - DNA, 23 bp, synthetic construct
  misc_feature 1..23: note = Synthetic Construct
  source 1..23: mol_type = other DNA
cgtgtgtcctggaagagatggaa

SEQ ID NO: 22637 - DNA, 25 bp, synthetic construct
  misc_feature 1..25: note = Synthetic Construct
  source 1..25: mol_type = other DNA
gagagacagcaattctggggaacat

SEQ ID NO: 22638 - DNA, 22 bp, synthetic construct
  misc_feature 1..22: note = Synthetic Construct
  source 1..22: mol_type = other DNA
agggttggactaggggaagtga

SEQ ID NO: 22639 - DNA, 25 bp, synthetic construct
  misc_feature 1..25: note = Synthetic Construct
  source 1..25: mol_type = other DNA
ggtttctccctgaaatcgtgtgtga

SEQ ID NO: 22640 - DNA, 22 bp, synthetic construct
  misc_feature 1..22: note = Synthetic Construct
  source 1..22: mol_type = other DNA
ctgcaccttggcaacactttga

SEQ ID NO: 22641 - DNA, 23 bp, synthetic construct
  misc_feature 1..23: note = Synthetic Construct
  source 1..23: mol_type = other DNA
ggaccccaggattgaggagacaa

SEQ ID NO: 22642 - DNA, 19 bp, synthetic construct
  misc_feature 1..19: note = Synthetic Construct
  source 1..19: mol_type = other DNA
tgcacatgcgctcttctca

SEQ ID NO: 22643 - DNA, 26 bp, synthetic construct
  misc_feature 1..26: note = Synthetic Construct
  source 1..26: mol_type = other DNA
ctcactaaacttttccccagaactca

SEQ ID NO: 22644 - DNA, 24 bp, synthetic construct
  misc_feature 1..24: note = Synthetic Construct
  source 1..24: mol_type = other DNA
cctctgaagggagactgaaacaac

SEQ ID NO: 22645 - DNA, 20 bp, synthetic construct
  misc_feature 1..20: note = Synthetic Construct
  source 1..20: mol_type = other DNA
gcaagaatgcttggctgcaa

SEQ ID NO: 22646 - DNA, 21 bp, synthetic construct
  misc_feature 1..21: note = Synthetic Construct
  source 1..21: mol_type = other DNA
gtggcatttcactgccctttg

SEQ ID NO: 22647 - DNA, 23 bp, synthetic construct
  misc_feature 1..23: note = Synthetic Construct
  source 1..23: mol_type = other DNA
gcagcttgttcaattgtggttca

SEQ ID NO: 22648 - DNA, 26 bp, synthetic construct
  misc_feature 1..26: note = Synthetic Construct
  source 1..26: mol_type = other DNA
gtgaggatgagttttcagtggctatc

SEQ ID NO: 22649 - DNA, 27 bp, synthetic construct
  misc_feature 1..27: note = Synthetic Construct
  source 1..27: mol_type = other DNA
ccctggacaaaatgtaacagccaaagt

SEQ ID NO: 22650 - DNA, 24 bp, synthetic construct
  misc_feature 1..24: note = Synthetic Construct
  source 1..24: mol_type = other DNA
acctagctatccttccagcatttc

SEQ ID NO: 22651 - DNA, 23 bp, synthetic construct
  misc_feature 1..23: note = Synthetic Construct
  source 1..23: mol_type = other DNA
gctggacaaactactgcctcttc

SEQ ID NO: 22652 - DNA, 22 bp, synthetic construct
  misc_feature 1..22: note = Synthetic Construct
  source 1..22: mol_type = other DNA
gccaatagctgcttgatgcaat

SEQ ID NO: 22653 - DNA, 22 bp, synthetic construct
  misc_feature 1..22: note = Synthetic Construct
  source 1..22: mol_type = other DNA
tagttgcccgggattcccaaga

SEQ ID NO: 22654 - DNA, 20 bp, synthetic construct
  misc_feature 1..20: note = Synthetic Construct
  source 1..20: mol_type = other DNA
gggagaggctggtcctgagt

SEQ ID NO: 22655 - DNA, 25 bp, synthetic construct
  misc_feature 1..25: note = Synthetic Construct
  source 1..25: mol_type = other DNA
gtttgtgaaaggtcaatgtgaggaa

SEQ ID NO: 22656 - DNA, 22 bp, synthetic construct
  misc_feature 1..22: note = Synthetic Construct
  source 1..22: mol_type = other DNA
tcctcgggagctcacaacctta

SEQ ID NO: 22657 - DNA, 20 bp, synthetic construct
  misc_feature 1..20: note = Synthetic Construct
  source 1..20: mol_type = other DNA
tcccactgatgccagaccaa

SEQ ID NO: 22658 - DNA, 27 bp, synthetic construct
  misc_feature 1..27: note = Synthetic Construct
  source 1..27: mol_type = other DNA
cccagcttaagcaaaatagggcaagta

SEQ ID NO: 22659 - DNA, 26 bp, synthetic construct
  misc_feature 1..26: note = Synthetic Construct
  source 1..26: mol_type = other DNA
tggccagtagtaagttgagaagacta

SEQ ID NO: 22660 - DNA, 20 bp, synthetic construct
  misc_feature 1..20: note = Synthetic Construct
  source 1..20: mol_type = other DNA
ccggaagcttcacgttctgt

SEQ ID NO: 22661 - DNA, 22 bp, synthetic construct
  misc_feature 1..22: note = Synthetic Construct
  source 1..22: mol_type = other DNA
ggagggagagctccatctctga

SEQ ID NO: 22662 - DNA, 20 bp, synthetic construct
  misc_feature 1..20: note = Synthetic Construct
  source 1..20: mol_type = other DNA
ccggcaataggactcagcaa

SEQ ID NO: 22663 - DNA, 21 bp, synthetic construct
  misc_feature 1..21: note = Synthetic Construct
  source 1..21: mol_type = other DNA
tagggcaggtgtcctctgcat

SEQ ID NO: 22664 - DNA, 28 bp, synthetic construct
  misc_feature 1..28: note = Synthetic Construct
  source 1..28: mol_type = other DNA
gtgaaccaagctatactacctgcttttc

SEQ ID NO: 22665 - DNA, 25 bp, synthetic construct
  misc_feature 1..25: note = Synthetic Construct
  source 1..25: mol_type = other DNA
ggcttctgtgctcatagttcacact

SEQ ID NO: 22666 - DNA, 22 bp, synthetic construct
  misc_feature 1..22: note = Synthetic Construct
  source 1..22: mol_type = other DNA
gggcacacggaggtgaaaaagt

SEQ ID NO: 22667 - DNA, 23 bp, synthetic construct
  misc_feature 1..23: note = Synthetic Construct
  source 1..23: mol_type = other DNA
cgggagccgttataccagcttag

SEQ ID NO: 22668 - DNA, 23 bp, synthetic construct
  misc_feature 1..23: note = Synthetic Construct
  source 1..23: mol_type = other DNA
gcttcctatgaccaagtcccttt

SEQ ID NO: 22669 - DNA, 20 bp, synthetic construct
  misc_feature 1..20: note = Synthetic Construct
  source 1..20: mol_type = other DNA
gtgttggccagacccactgt

SEQ ID NO: 22670 - DNA, 23 bp, synthetic construct
  misc_feature 1..23: note = Synthetic Construct
  source 1..23: mol_type = other DNA
gggcacttttgagttgggctttg

SEQ ID NO: 22671 - DNA, 21 bp, synthetic construct
  misc_feature 1..21: note = Synthetic Construct
  source 1..21: mol_type = other DNA
gcagctcggtgcctaatggtt

SEQ ID NO: 22672 - DNA, 24 bp, synthetic construct
  misc_feature 1..24: note = Synthetic Construct
  source 1..24: mol_type = other DNA
cagacctggcaggatcagaatagt

SEQ ID NO: 22673 - DNA, 22 bp, synthetic construct
  misc_feature 1..22: note = Synthetic Construct
  source 1..22: mol_type = other DNA
tgcaatgcagaggagaaaggtt

SEQ ID NO: 22674 - DNA, 25 bp, synthetic construct
  misc_feature 1..25: note = Synthetic Construct
  source 1..25: mol_type = other DNA
agtcacaggtatcctgactctcata

SEQ ID NO: 22675 - DNA, 22 bp, synthetic construct
  misc_feature 1..22: note = Synthetic Construct
  source 1..22: mol_type = other DNA
ggagcaatcagccttgcagaga

SEQ ID NO: 22676 - DNA, 18 bp, synthetic construct
  misc_feature 1..18: note = Synthetic Construct
  source 1..18: mol_type = other DNA
tggcgcccggaaaaccat

SEQ ID NO: 22677 - DNA, 22 bp, synthetic construct
  misc_feature 1..22: note = Synthetic Construct
  source 1..22: mol_type = other DNA
ttcaagagcatccttgcgctat

SEQ ID NO: 22678 - DNA, 24 bp, synthetic construct
  misc_feature 1..24: note = Synthetic Construct
  source 1..24: mol_type = other DNA
accttgagaaggtggtatttgtgt

SEQ ID NO: 22679 - DNA, 24 bp, synthetic construct
  misc_feature 1..24: note = Synthetic Construct
  source 1..24: mol_type = other DNA
agaaagaccccaggtaagaaccat

SEQ ID NO: 22680 - DNA, 23 bp, synthetic construct
  misc_feature 1..23: note = Synthetic Construct
  source 1..23: mol_type = other DNA
cactcacacatccacaggagaca

SEQ ID NO: 22681 - DNA, 23 bp, synthetic construct
  misc_feature 1..23: note = Synthetic Construct
  source 1..23: mol_type = other DNA
gacgcagtatcccacagagcatt

SEQ ID NO: 22682 - DNA, 21 bp, synthetic construct
  misc_feature 1..21: note = Synthetic Construct
  source 1..21: mol_type = other DNA
accagctctgagtcaggaagt

SEQ ID NO: 22683 - DNA, 22 bp, synthetic construct
  misc_feature 1..22: note = Synthetic Construct
  source 1..22: mol_type = other DNA
cccacagtccgacgagtgtttt

SEQ ID NO: 22684 - DNA, 25 bp, synthetic construct
  misc_feature 1..25: note = Synthetic Construct
  source 1..25: mol_type = other DNA
tcactccactttacaggcacatatt

SEQ ID NO: 22685 - DNA, 23 bp, synthetic construct
  misc_feature 1..23: note = Synthetic Construct
  source 1..23: mol_type = other DNA
acgaggatcagacaagtcacaga

SEQ ID NO: 22686 - DNA, 23 bp, synthetic construct
  misc_feature 1..23: note = Synthetic Construct
  source 1..23: mol_type = other DNA
cccatgaccccaggttggaattg

SEQ ID NO: 22687 - DNA, 21 bp, synthetic construct
  misc_feature 1..21: note = Synthetic Construct
  source 1..21: mol_type = other DNA
cactctgtgcagttgctggtt

SEQ ID NO: 22688 - DNA, 22 bp, synthetic construct
  misc_feature 1..22: note = Synthetic Construct
  source 1..22: mol_type = other DNA
gtctgtggagcacaccttggaa

SEQ ID NO: 22689 - DNA, 20 bp, synthetic construct
  misc_feature 1..20: note = Synthetic Construct
  source 1..20: mol_type = other DNA
gcctttccactgagccatga

SEQ ID NO: 22690 - DNA, 23 bp, synthetic construct
  misc_feature 1..23: note = Synthetic Construct
  source 1..23: mol_type = other DNA
cagcctggttggttagattctgt

SEQ ID NO: 22691 - DNA, 24 bp, synthetic construct
  misc_feature 1..24: note = Synthetic Construct
  source 1..24: mol_type = other DNA
cttatgtgtggctttggcttcttg

SEQ ID NO: 22692 - DNA, 21 bp, synthetic construct
  misc_feature 1..21: note = Synthetic Construct
  source 1..21: mol_type = other DNA
ggggctgaatcagacaaggaa

SEQ ID NO: 22693 - DNA, 20 bp, synthetic construct
  misc_feature 1..20: note = Synthetic Construct
  source 1..20: mol_type = other DNA
cacagcttggaaggcctgaa

SEQ ID NO: 22694 - DNA, 24 bp, synthetic construct
  misc_feature 1..24: note = Synthetic Construct
  source 1..24: mol_type = other DNA
ctcatgatgtcaaatgctgctcaa

SEQ ID NO: 22695 - DNA, 23 bp, synthetic construct
  misc_feature 1..23: note = Synthetic Construct
  source 1..23: mol_type = other DNA
gttctggtgacagacaaccttct

SEQ ID NO: 22696 - DNA, 21 bp, synthetic construct
  misc_feature 1..21: note = Synthetic Construct
  source 1..21: mol_type = other DNA
tgagcagcacagtccaattct

SEQ ID NO: 22697 - DNA, 23 bp, synthetic construct
  misc_feature 1..23: note = Synthetic Construct
  source 1..23: mol_type = other DNA
cccctgggaaagttactgtcgat

SEQ ID NO: 22698 - DNA, 21 bp, synthetic construct
  misc_feature 1..21: note = Synthetic Construct
  source 1..21: mol_type = other DNA
gtcagtgagctgccagttttc

SEQ ID NO: 22699 - DNA, 21 bp, synthetic construct
  misc_feature 1..21: note = Synthetic Construct
  source 1..21: mol_type = other DNA
tcccaaatcctgagcctgtca

SEQ ID NO: 22700 - DNA, 28 bp, synthetic construct
  misc_feature 1..28: note = Synthetic Construct
  source 1..28: mol_type = other DNA
gccaacctatagacacaactttggttac

SEQ ID NO: 22701 - DNA, 25 bp, synthetic construct
  misc_feature 1..25: note = Synthetic Construct
  source 1..25: mol_type = other DNA
gttgacttccggcagtaagtgatga

SEQ ID NO: 22702 - DNA, 24 bp, synthetic construct
  misc_feature 1..24: note = Synthetic Construct
  source 1..24: mol_type = other DNA
actgggacatttctcacgttatca

SEQ ID NO: 22703 - DNA, 23 bp, synthetic construct
  misc_feature 1..23: note = Synthetic Construct
  source 1..23: mol_type = other DNA
ggaatccagcccatcctcacatc

SEQ ID NO: 22704 - DNA, 20 bp, synthetic construct
  misc_feature 1..20: note = Synthetic Construct
  source 1..20: mol_type = other DNA
actgcaccaccacacggaaa

SEQ ID NO: 22705 - DNA, 22 bp, synthetic construct
  misc_feature 1..22: note = Synthetic Construct
  source 1..22: mol_type = other DNA
ccttcaagggctttctctcaca

SEQ ID NO: 22706 - DNA, 24 bp, synthetic construct
  misc_feature 1..24: note = Synthetic Construct
  source 1..24: mol_type = other DNA
acttccacatggcttaaacagaga

SEQ ID NO: 22707 - DNA, 25 bp, synthetic construct
  misc_feature 1..25: note = Synthetic Construct
  source 1..25: mol_type = other DNA
tcgtgaagaagatggagaggagtta

SEQ ID NO: 22708 - DNA, 21 bp, synthetic construct
  misc_feature 1..21: note = Synthetic Construct
  source 1..21: mol_type = other DNA
ctgggaccaacccatttcaca

SEQ ID NO: 22709 - DNA, 22 bp, synthetic construct
  misc_feature 1..22: note = Synthetic Construct
  source 1..22: mol_type = other DNA
aaggaagtggggtatggactga

SEQ ID NO: 22710 - DNA, 24 bp, synthetic construct
  misc_feature 1..24: note = Synthetic Construct
  source 1..24: mol_type = other DNA
tgttggccacatacattgttctca

SEQ ID NO: 22711 - DNA, 19 bp, synthetic construct
  misc_feature 1..19: note = Synthetic Construct
  source 1..19: mol_type = other DNA
ctcctgccttcggggatgt

SEQ ID NO: 22712 - DNA, 21 bp, synthetic construct
  misc_feature 1..21: note = Synthetic Construct
  source 1..21: mol_type = other DNA
cacaggccagagattcaccat

SEQ ID NO: 22713 - DNA, 21 bp, synthetic construct
  misc_feature 1..21: note = Synthetic Construct
  source 1..21: mol_type = other DNA
tgggaagcctaccttgactct

SEQ ID NO: 22714 - DNA, 24 bp, synthetic construct
  misc_feature 1..24: note = Synthetic Construct
  source 1..24: mol_type = other DNA
aagcccctgagaatctaaaagcaa

SEQ ID NO: 22715 - DNA, 19 bp, synthetic construct
  misc_feature 1..19: note = Synthetic Construct
  source 1..19: mol_type = other DNA
cgacagggcctcccaattc

SEQ ID NO: 22716 - DNA, 24 bp, synthetic construct
  misc_feature 1..24: note = Synthetic Construct
  source 1..24: mol_type = other DNA
aggtagacaccggaagtaatcaca

SEQ ID NO: 22717 - DNA, 22 bp, synthetic construct
  misc_feature 1..22: note = Synthetic Construct
  source 1..22: mol_type = other DNA
tcaggtagaggtcgccaaggtt

SEQ ID NO: 22718 - DNA, 24 bp, synthetic construct
  misc_feature 1..24: note = Synthetic Construct
  source 1..24: mol_type = other DNA
ggaggctatgagaagtgaggtttg

SEQ ID NO: 22719 - DNA, 23 bp, synthetic construct
  misc_feature 1..23: note = Synthetic Construct
  source 1..23: mol_type = other DNA
gggcggttaaagagcttcagaga

SEQ ID NO: 22720 - DNA, 24 bp, synthetic construct
  misc_feature 1..24: note = Synthetic Construct
  source 1..24: mol_type = other DNA
tggtcttctttatgcccaacaaac

SEQ ID NO: 22721 - DNA, 20 bp, synthetic construct
  misc_feature 1..20: note = Synthetic Construct
  source 1..20: mol_type = other DNA
ctcacacgggctcacattct

SEQ ID NO: 22722 - DNA, 19 bp, synthetic construct
  misc_feature 1..19: note = Synthetic Construct
  source 1..19: mol_type = other DNA
cctgctcaccgatgctcaa

SEQ ID NO: 22723 - DNA, 24 bp, synthetic construct
  misc_feature 1..24: note = Synthetic Construct
  source 1..24: mol_type = other DNA
ggtcagaaacagagcctgtaaaac

SEQ ID NO: 22724 - DNA, 25 bp, synthetic construct
  misc_feature 1..25: note = Synthetic Construct
  source 1..25: mol_type = other DNA
cctgagacagaagcagtagcgtctt

SEQ ID NO: 22725 - DNA, 20 bp, synthetic construct
  misc_feature 1..20: note = Synthetic Construct
  source 1..20: mol_type = other DNA
cgcaaaatgggctcctgctt

SEQ ID NO: 22726 - DNA, 22 bp, synthetic construct
  misc_feature 1..22: note = Synthetic Construct
  source 1..22: mol_type = other DNA
gccggattaggggtgaactttg

SEQ ID NO: 22727 - DNA, 24 bp, synthetic construct
  misc_feature 1..24: note = Synthetic Construct
  source 1..24: mol_type = other DNA
ggaggtattctggcttccctaaga

SEQ ID NO: 22728 - DNA, 26 bp, synthetic construct
  misc_feature 1..26: note = Synthetic Construct
  source 1..26: mol_type = other DNA
ggaagggtgagtttagcacaatggtt

SEQ ID NO: 22729 - DNA, 22 bp, synthetic construct
  misc_feature 1..22: note = Synthetic Construct
  source 1..22: mol_type = other DNA
cccacttgcacaaatgcaaaga

SEQ ID NO: 22730 - DNA, 21 bp, synthetic construct
  misc_feature 1..21: note = Synthetic Construct
  source 1..21: mol_type = other DNA
agctgtggttttcctgtgtca

SEQ ID NO: 22731 - DNA, 24 bp, synthetic construct
  misc_feature 1..24: note = Synthetic Construct
  source 1..24: mol_type = other DNA
tgtgtgtgtttagcaagggatttc

SEQ ID NO: 22732 - DNA, 21 bp, synthetic construct
  misc_feature 1..21: note = Synthetic Construct
  source 1..21: mol_type = other DNA
cgtttggcaacggagatgtgt

SEQ ID NO: 22733 - DNA, 22 bp, synthetic construct
  misc_feature 1..22: note = Synthetic Construct
  source 1..22: mol_type = other DNA
tgcccacccttttcttttgctt

SEQ ID NO: 22734 - DNA, 23 bp, synthetic construct
  misc_feature 1..23: note = Synthetic Construct
  source 1..23: mol_type = other DNA
gggctatacatttctgggctcaa

SEQ ID NO: 22735 - DNA, 22 bp, synthetic construct
  misc_feature 1..22: note = Synthetic Construct
  source 1..22: mol_type = other DNA
tacattcccctctcccgcaaca

SEQ ID NO: 22736 - DNA, 25 bp, synthetic construct
  misc_feature 1..25: note = Synthetic Construct
  source 1..25: mol_type = other DNA
ccagccaatcaggatcatggacaga

SEQ ID NO: 22737 - DNA, 20 bp, synthetic construct
  misc_feature 1..20: note = Synthetic Construct
  source 1..20: mol_type = other DNA
ggcccatgactctgctggat

SEQ ID NO: 22738 - DNA, 19 bp, synthetic construct
  misc_feature 1..19: note = Synthetic Construct
  source 1..19: mol_type = other DNA
ggaggcatctccggctaca

SEQ ID NO: 22739 - DNA, 24 bp, synthetic construct
  misc_feature 1..24: note = Synthetic Construct
  source 1..24: mol_type = other DNA
agtgcaaggttggagaatgaaaag

SEQ ID NO: 22740 - DNA, 22 bp, synthetic construct
  misc_feature 1..22: note = Synthetic Construct
  source 1..22: mol_type = other DNA
cgagttggcctcgtcttaccaa

SEQ ID NO: 22741 - DNA, 22 bp, synthetic construct
  misc_feature 1..22: note = Synthetic Construct
  source 1..22: mol_type = other DNA
cgtggcagctggctttagaatc

SEQ ID NO: 22742 - DNA, 22 bp, synthetic construct
  misc_feature 1..22: note = Synthetic Construct
  source 1..22: mol_type = other DNA
tggtgcagccacctctcttatc

SEQ ID NO: 22743 - DNA, 21 bp, synthetic construct
  misc_feature 1..21: note = Synthetic Construct
  source 1..21: mol_type = other DNA
ctctggcacatgcgttagttg

SEQ ID NO: 22744 - DNA, 24 bp, synthetic construct
  misc_feature 1..24: note = Synthetic Construct
  source 1..24: mol_type = other DNA
ggggctttggataacaccaaggta

SEQ ID NO: 22745 - DNA, 20 bp, synthetic construct
  misc_feature 1..20: note = Synthetic Construct
  source 1..20: mol_type = other DNA
ttgcaacccctccgacattc

SEQ ID NO: 22746 - DNA, 21 bp, synthetic construct
  misc_feature 1..21: note = Synthetic Construct
  source 1..21: mol_type = other DNA
aggagaagttcaggggaccaa

SEQ ID NO: 22747 - DNA, 24 bp, synthetic construct
  misc_feature 1..24: note = Synthetic Construct
  source 1..24: mol_type = other DNA
agagctgctatcatgatgtggaaa

SEQ ID NO: 22748 - DNA, 21 bp, synthetic construct
  misc_feature 1..21: note = Synthetic Construct
  source 1..21: mol_type = other DNA
agggtgagtctggaagaggtt

SEQ ID NO: 22749 - DNA, 22 bp, synthetic construct
  misc_feature 1..22: note = Synthetic Construct
  source 1..22: mol_type = other DNA
ccccactcccctcaaggtatgt

SEQ ID NO: 22750 - DNA, 22 bp, synthetic construct
  misc_feature 1..22: note = Synthetic Construct
  source 1..22: mol_type = other DNA
gtcaccctctgaggtacacact

SEQ ID NO: 22751 - DNA, 23 bp, synthetic construct
  misc_feature 1..23: note = Synthetic Construct
  source 1..23: mol_type = other DNA
atgacaacatcacggacagagaa

SEQ ID NO: 22752 - DNA, 22 bp, synthetic construct
  misc_feature 1..22: note = Synthetic Construct
  source 1..22: mol_type = other DNA
tgacaaatgccgaagggattct

SEQ ID NO: 22753 - DNA, 24 bp, synthetic construct
  misc_feature 1..24: note = Synthetic Construct
  source 1..24: mol_type = other DNA
ctatgtttcagccacaccacattc

SEQ ID NO: 22754 - DNA, 23 bp, synthetic construct
  misc_feature 1..23: note = Synthetic Construct
  source 1..23: mol_type = other DNA
caggcttgttcgggaaatacaag

SEQ ID NO: 22755 - DNA, 20 bp, synthetic construct
  misc_feature 1..20: note = Synthetic Construct
  source 1..20: mol_type = other DNA
gccgaggtttcaaggtccaa

SEQ ID NO: 22756 - DNA, 22 bp, synthetic construct
  misc_feature 1..22: note = Synthetic Construct
  source 1..22: mol_type = other DNA
tgctcaactcaaacaggacact

SEQ ID NO: 22757 - DNA, 18 bp, synthetic construct
  misc_feature 1..18: note = Synthetic Construct
  source 1..18: mol_type = other DNA
tgcggcgatgtggctgta

SEQ ID NO: 22758 - DNA, 23 bp, synthetic construct
  misc_feature 1..23: note = Synthetic Construct
  source 1..23: mol_type = other DNA
cagagggtggatggatacagttc

SEQ ID NO: 22759 - DNA, 19 bp, synthetic construct
  misc_feature 1..19: note = Synthetic Construct
  source 1..19: mol_type = other DNA
cgtggcctcctgcactgat

SEQ ID NO: 22760 - DNA, 21 bp, synthetic construct
  misc_feature 1..21: note = Synthetic Construct
  source 1..21: mol_type = other DNA
gtgcaggctcaagttgcttct

SEQ ID NO: 22761 - DNA, 24 bp, synthetic construct
  misc_feature 1..24: note = Synthetic Construct
  source 1..24: mol_type = other DNA
gcttgcttggaaccgattttggat

SEQ ID NO: 22762 - DNA, 19 bp, synthetic construct
  misc_feature 1..19: note = Synthetic Construct
  source 1..19: mol_type = other DNA
ggcgggaccgagtgcttta

SEQ ID NO: 22763 - DNA, 26 bp, synthetic construct
  misc_feature 1..26: note = Synthetic Construct
  source 1..26: mol_type = other DNA
cctcaattactccccagatgttcaga

SEQ ID NO: 22764 - DNA, 22 bp, synthetic construct
  misc_feature 1..22: note = Synthetic Construct
  source 1..22: mol_type = other DNA
tcagcaggaggaaggatgtttg

SEQ ID NO: 22765 - DNA, 20 bp, synthetic construct
  misc_feature 1..20: note = Synthetic Construct
  source 1..20: mol_type = other DNA
accttccggccatgtgtgaa

SEQ ID NO: 22766 - DNA, 26 bp, synthetic construct
  misc_feature 1..26: note = Synthetic Construct
  source 1..26: mol_type = other DNA
caaatctgctctgtctatgctaggaa

SEQ ID NO: 22767 - DNA, 22 bp, synthetic construct
  misc_feature 1..22: note = Synthetic Construct
  source 1..22: mol_type = other DNA
agctcctgacattatgcccaaa

SEQ ID NO: 22768 - DNA, 24 bp, synthetic construct
  misc_feature 1..24: note = Synthetic Construct
  source 1..24: mol_type = other DNA
gggaaagccagacatcctctccta

SEQ ID NO: 22769 - DNA, 22 bp, synthetic construct
  misc_feature 1..22: note = Synthetic Construct
  source 1..22: mol_type = other DNA
gcccaggtagaggaacaaatca

SEQ ID NO: 22770 - DNA, 26 bp, synthetic construct
  misc_feature 1..26: note = Synthetic Construct
  source 1..26: mol_type = other DNA
ggagaatatcaagctgtcatgggatt

SEQ ID NO: 22771 - DNA, 23 bp, synthetic construct
  misc_feature 1..23: note = Synthetic Construct
  source 1..23: mol_type = other DNA
ccaaacgaggccctctctcttct

SEQ ID NO: 22772 - DNA, 20 bp, synthetic construct
  misc_feature 1..20: note = Synthetic Construct
  source 1..20: mol_type = other DNA
gcccagaagagtgcttgaca

SEQ ID NO: 22773 - DNA, 24 bp, synthetic construct
  misc_feature 1..24: note = Synthetic Construct
  source 1..24: mol_type = other DNA
ggcagtccttaactcctggttttc

SEQ ID NO: 22774 - DNA, 23 bp, synthetic construct
  misc_feature 1..23: note = Synthetic Construct
  source 1..23: mol_type = other DNA
ccagcacattcagtccagaatca

SEQ ID NO: 22775 - DNA, 20 bp, synthetic construct
  misc_feature 1..20: note = Synthetic Construct
  source 1..20: mol_type = other DNA
cagccaagtgcagactggaa

SEQ ID NO: 22776 - DNA, 22 bp, synthetic construct
  misc_feature 1..22: note = Synthetic Construct
  source 1..22: mol_type = other DNA
tcctggcaaatcttgcacaaag

SEQ ID NO: 22777 - DNA, 26 bp, synthetic construct
  misc_feature 1..26: note = Synthetic Construct
  source 1..26: mol_type = other DNA
gtgggattacattcacagatgcagaa

SEQ ID NO: 22778 - DNA, 22 bp, synthetic construct
  misc_feature 1..22: note = Synthetic Construct
  source 1..22: mol_type = other DNA
agaccttcacctctgccacagt

SEQ ID NO: 22779 - DNA, 22 bp, synthetic construct
  misc_feature 1..22: note = Synthetic Construct
  source 1..22: mol_type = other DNA
ggaacaggagaagagcaaggaa

SEQ ID NO: 22780 - DNA, 24 bp, synthetic construct
  misc_feature 1..24: note = Synthetic Construct
  source 1..24: mol_type = other DNA
actgatgctaccaaagaggctaga

SEQ ID NO: 22781 - DNA, 20 bp, synthetic construct
  misc_feature 1..20: note = Synthetic Construct
  source 1..20: mol_type = other DNA
cacaaccgctttccccttga

SEQ ID NO: 22782 - DNA, 22 bp, synthetic construct
  misc_feature 1..22: note = Synthetic Construct
  source 1..22: mol_type = other DNA
gggagacactgcaggacaaagt

SEQ ID NO: 22783 - DNA, 21 bp, synthetic construct
  misc_feature 1..21: note = Synthetic Construct
  source 1..21: mol_type = other DNA
gtgcctgagagtttcctggtt

SEQ ID NO: 22784 - DNA, 22 bp, synthetic construct
  misc_feature 1..22: note = Synthetic Construct
  source 1..22: mol_type = other DNA
cacagtgctgtagttgcctgtt

SEQ ID NO: 22785 - DNA, 23 bp, synthetic construct
  misc_feature 1..23: note = Synthetic Construct
  source 1..23: mol_type = other DNA
gccacaatctaggacctgcagaa

SEQ ID NO: 22786 - DNA, 23 bp, synthetic construct
  misc_feature 1..23: note = Synthetic Construct
  source 1..23: mol_type = other DNA
tttctgccctagttcaggtcatc

SEQ ID NO: 22787 - DNA, 29 bp, synthetic construct
  misc_feature 1..29: note = Synthetic Construct
  source 1..29: mol_type = other DNA
ccttgaagatgcaacagacattcttctac

SEQ ID NO: 22788 - DNA, 18 bp, synthetic construct
  misc_feature 1..18: note = Synthetic Construct
  source 1..18: mol_type = other DNA
ggatgcaggcaggcaagt

SEQ ID NO: 22789 - DNA, 24 bp, synthetic construct
  misc_feature 1..24: note = Synthetic Construct
  source 1..24: mol_type = other DNA
gtgctagagagcgaaatacctgtt

SEQ ID NO: 22790 - DNA, 24 bp, synthetic construct
  misc_feature 1..24: note = Synthetic Construct
  source 1..24: mol_type = other DNA
ccacagaactcccactcgaataag

SEQ ID NO: 22791 - DNA, 21 bp, synthetic construct
  misc_feature 1..21: note = Synthetic Construct
  source 1..21: mol_type = other DNA
ccccagaccaatccgaagtgt

SEQ ID NO: 22792 - DNA, 21 bp, synthetic construct
  misc_feature 1..21: note = Synthetic Construct
  source 1..21: mol_type = other DNA
aagcaacccagttccttccaa

SEQ ID NO: 22793 - DNA, 21 bp, synthetic construct
  misc_feature 1..21: note = Synthetic Construct
  source 1..21: mol_type = other DNA
cagctgctgcctcatttgcat

SEQ ID NO: 22794 - DNA, 23 bp, synthetic construct
  misc_feature 1..23: note = Synthetic Construct
  source 1..23: mol_type = other DNA
aatggtagcctttgagacgatgt

SEQ ID NO: 22795 - DNA, 24 bp, synthetic construct
  misc_feature 1..24: note = Synthetic Construct
  source 1..24: mol_type = other DNA
gccccttcttttctatgaggatgt

SEQ ID NO: 22796 - DNA, 22 bp, synthetic construct
  misc_feature 1..22: note = Synthetic Construct
  source 1..22: mol_type = other DNA
agcatgggaaccagtgttcatc

SEQ ID NO: 22797 - DNA, 21 bp, synthetic construct
  misc_feature 1..21: note = Synthetic Construct
  source 1..21: mol_type = other DNA
tgacaggacgaggagactcaa

SEQ ID NO: 22798 - DNA, 23 bp, synthetic construct
  misc_feature 1..23: note = Synthetic Construct
  source 1..23: mol_type = other DNA
tctgccttgcagagttacagaat

SEQ ID NO: 22799 - DNA, 23 bp, synthetic construct
  misc_feature 1..23: note = Synthetic Construct
  source 1..23: mol_type = other DNA
aaccttttcgctacccatgtact

SEQ ID NO: 22800 - DNA, 21 bp, synthetic construct
  misc_feature 1..21: note = Synthetic Construct
  source 1..21: mol_type = other DNA
ccgagctcgtctgggtttgaa

SEQ ID NO: 22801 - DNA, 20 bp, synthetic construct
  misc_feature 1..20: note = Synthetic Construct
  source 1..20: mol_type = other DNA
ctatctgcccgcatcacctt

SEQ ID NO: 22802 - DNA, 19 bp, synthetic construct
  misc_feature 1..19: note = Synthetic Construct
  source 1..19: mol_type = other DNA
cgacggctcggagagaatc

SEQ ID NO: 22803 - DNA, 20 bp, synthetic construct
  misc_feature 1..20: note = Synthetic Construct
  source 1..20: mol_type = other DNA
cccacgggtttgggtagctt

SEQ ID NO: 22804 - DNA, 24 bp, synthetic construct
  misc_feature 1..24: note = Synthetic Construct
  source 1..24: mol_type = other DNA
cttgaccttgctctagcagttttg

SEQ ID NO: 22805 - DNA, 22 bp, synthetic construct
  misc_feature 1..22: note = Synthetic Construct
  source 1..22: mol_type = other DNA
ctcacgtagtctccaccgtcat

SEQ ID NO: 22806 - DNA, 22 bp, synthetic construct
  misc_feature 1..22: note = Synthetic Construct
  source 1..22: mol_type = other DNA
aaccctttcaaccctccacatt

SEQ ID NO: 22807 - DNA, 21 bp, synthetic construct
  misc_feature 1..21: note = Synthetic Construct
  source 1..21: mol_type = other DNA
agttctcaggccaccttgttc

SEQ ID NO: 22808 - DNA, 19 bp, synthetic construct
  misc_feature 1..19: note = Synthetic Construct
  source 1..19: mol_type = other DNA
cccgcaggactgagcacaa

SEQ ID NO: 22809 - DNA, 21 bp, synthetic construct
  misc_feature 1..21: note = Synthetic Construct
  source 1..21: mol_type = other DNA
catccaggcacaccgttaaga

SEQ ID NO: 22810 - DNA, 20 bp, synthetic construct
  misc_feature 1..20: note = Synthetic Construct
  source 1..20: mol_type = other DNA
tcgggagcacgtttgcagat

SEQ ID NO: 22811 - DNA, 22 bp, synthetic construct
  misc_feature 1..22: note = Synthetic Construct
  source 1..22: mol_type = other DNA
ggttgctctcacgggaataaga

SEQ ID NO: 22812 - DNA, 23 bp, synthetic construct
  misc_feature 1..23: note = Synthetic Construct
  source 1..23: mol_type = other DNA
ccggtaaacccaatccaaacaaa

SEQ ID NO: 22813 - DNA, 18 bp, synthetic construct
  misc_feature 1..18: note = Synthetic Construct
  source 1..18: mol_type = other DNA
tgcacactgcgtcagctt

SEQ ID NO: 22814 - DNA, 27 bp, synthetic construct
  misc_feature 1..27: note = Synthetic Construct
  source 1..27: mol_type = other DNA
gcatgcttcacaaacattatcccattc

SEQ ID NO: 22815 - DNA, 22 bp, synthetic construct
  misc_feature 1..22: note = Synthetic Construct
  source 1..22: mol_type = other DNA
gggcatccaaggagagaagaga

SEQ ID NO: 22816 - DNA, 21 bp, synthetic construct
  misc_feature 1..21: note = Synthetic Construct
  source 1..21: mol_type = other DNA
tgtcagcctggcttctgtaag

SEQ ID NO: 22817 - DNA, 21 bp, synthetic construct
  misc_feature 1..21: note = Synthetic Construct
  source 1..21: mol_type = other DNA
tgagctggcctggtgaaatag

SEQ ID NO: 22818 - DNA, 25 bp, synthetic construct
  misc_feature 1..25: note = Synthetic Construct
  source 1..25: mol_type = other DNA
acctcaccttctaattctggactgt

SEQ ID NO: 22819 - DNA, 22 bp, synthetic construct
  misc_feature 1..22: note = Synthetic Construct
  source 1..22: mol_type = other DNA
cgtgacagctaatcacccacat

SEQ ID NO: 22820 - DNA, 24 bp, synthetic construct
  misc_feature 1..24: note = Synthetic Construct
  source 1..24: mol_type = other DNA
ggaacacctctccctcaattcttt

SEQ ID NO: 22821 - DNA, 23 bp, synthetic construct
  misc_feature 1..23: note = Synthetic Construct
  source 1..23: mol_type = other DNA
ccttggcagagggagatttgaga

SEQ ID NO: 22822 - DNA, 20 bp, synthetic construct
  misc_feature 1..20: note = Synthetic Construct
  source 1..20: mol_type = other DNA
gtgaagcgtcctcctgttga

SEQ ID NO: 22823 - DNA, 25 bp, synthetic construct
  misc_feature 1..25: note = Synthetic Construct
  source 1..25: mol_type = other DNA
ccagactagccgaattttccaggat

SEQ ID NO: 22824 - DNA, 24 bp, synthetic construct
  misc_feature 1..24: note = Synthetic Construct
  source 1..24: mol_type = other DNA
tctggagaaagtgacagggtaaga

SEQ ID NO: 22825 - DNA, 25 bp, synthetic construct
  misc_feature 1..25: note = Synthetic Construct
  source 1..25: mol_type = other DNA
gaaaggctgggtatttttgaaccaa

SEQ ID NO: 22826 - DNA, 24 bp, synthetic construct
  misc_feature 1..24: note = Synthetic Construct
  source 1..24: mol_type = other DNA
cacaacctcacattctccaggtta

SEQ ID NO: 22827 - DNA, 22 bp, synthetic construct
  misc_feature 1..22: note = Synthetic Construct
  source 1..22: mol_type = other DNA
gagcccacgtatcagctcaaca

SEQ ID NO: 22828 - DNA, 22 bp, synthetic construct
  misc_feature 1..22: note = Synthetic Construct
  source 1..22: mol_type = other DNA
actgcaacctttttgcctgaga

SEQ ID NO: 22829 - DNA, 20 bp, synthetic construct
  misc_feature 1..20: note = Synthetic Construct
  source 1..20: mol_type = other DNA
tctcaccgcttggtcagagt

SEQ ID NO: 22830 - DNA, 21 bp, synthetic construct
  misc_feature 1..21: note = Synthetic Construct
  source 1..21: mol_type = other DNA
tctccagccctcagtccttct

SEQ ID NO: 22831 - DNA, 21 bp, synthetic construct
  misc_feature 1..21: note = Synthetic Construct
  source 1..21: mol_type = other DNA
tgagaggtcaccacacacaga

SEQ ID NO: 22832 - DNA, 25 bp, synthetic construct
  misc_feature 1..25: note = Synthetic Construct
  source 1..25: mol_type = other DNA
tcatcccagcatcatttgttgagaa

SEQ ID NO: 22833 - DNA, 22 bp, synthetic construct
  misc_feature 1..22: note = Synthetic Construct
  source 1..22: mol_type = other DNA
ccgcctctccacctttgaactt

SEQ ID NO: 22834 - DNA, 25 bp, synthetic construct
  misc_feature 1..25: note = Synthetic Construct
  source 1..25: mol_type = other DNA
cgacaatttaaggcgagacatggaa

SEQ ID NO: 22835 - DNA, 21 bp, synthetic construct
  misc_feature 1..21: note = Synthetic Construct
  source 1..21: mol_type = other DNA
gcacattgccaccgtccagat

SEQ ID NO: 22836 - DNA, 21 bp, synthetic construct
  misc_feature 1..21: note = Synthetic Construct
  source 1..21: mol_type = other DNA
cccatccttcaagtcgtggtt

SEQ ID NO: 22837 - DNA, 22 bp, synthetic construct
  misc_feature 1..22: note = Synthetic Construct
  source 1..22: mol_type = other DNA
acccggtggagtcaggatttga

SEQ ID NO: 22838 - DNA, 21 bp, synthetic construct
  misc_feature 1..21: note = Synthetic Construct
  source 1..21: mol_type = other DNA
tggatgggttggcttggtact

SEQ ID NO: 22839 - DNA, 23 bp, synthetic construct
  misc_feature 1..23: note = Synthetic Construct
  source 1..23: mol_type = other DNA
gctgtgtatttgttgagccttgt

SEQ ID NO: 22840 - DNA, 25 bp, synthetic construct
  misc_feature 1..25: note = Synthetic Construct
  source 1..25: mol_type = other DNA
ggggtgaggtactgcagttaaacat

SEQ ID NO: 22841 - DNA, 19 bp, synthetic construct
  misc_feature 1..19: note = Synthetic Construct
  source 1..19: mol_type = other DNA
atcggcgcgagccaggatt

SEQ ID NO: 22842 - DNA, 24 bp, synthetic construct
  misc_feature 1..24: note = Synthetic Construct
  source 1..24: mol_type = other DNA
gcagtctctcaactctgctgttgt

SEQ ID NO: 22843 - DNA, 20 bp, synthetic construct
  misc_feature 1..20: note = Synthetic Construct
  source 1..20: mol_type = other DNA
agggatgtcctccccaactt

SEQ ID NO: 22844 - DNA, 22 bp, synthetic construct
  misc_feature 1..22: note = Synthetic Construct
  source 1..22: mol_type = other DNA
gtcagcaccatgtagcagatgt

SEQ ID NO: 22845 - DNA, 20 bp, synthetic construct
  misc_feature 1..20: note = Synthetic Construct
  source 1..20: mol_type = other DNA
ccagcattggggcagcttct

SEQ ID NO: 22846 - DNA, 23 bp, synthetic construct
  misc_feature 1..23: note = Synthetic Construct
  source 1..23: mol_type = other DNA
gccctttaaggaaccttgctaca

SEQ ID NO: 22847 - DNA, 21 bp, synthetic construct
  misc_feature 1..21: note = Synthetic Construct
  source 1..21: mol_type = other DNA
tccaggtccactactgtgtca

SEQ ID NO: 22848 - DNA, 21 bp, synthetic construct
  misc_feature 1..21: note = Synthetic Construct
  source 1..21: mol_type = other DNA
cccttgggtccctcttcttca

SEQ ID NO: 22849 - DNA, 20 bp, synthetic construct
  misc_feature 1..20: note = Synthetic Construct
  source 1..20: mol_type = other DNA
ggcgggtattgtgcctgaca

SEQ ID NO: 22850 - DNA, 24 bp, synthetic construct
  misc_feature 1..24: note = Synthetic Construct
  source 1..24: mol_type = other DNA
ccattctgccaaatttctgtgtgt

SEQ ID NO: 22851 - DNA, 24 bp, synthetic construct
  misc_feature 1..24: note = Synthetic Construct
  source 1..24: mol_type = other DNA
ggggagcagaatggatttgtcact

SEQ ID NO: 22852 - DNA, 22 bp, synthetic construct
  misc_feature 1..22: note = Synthetic Construct
  source 1..22: mol_type = other DNA
cagctactcaggcaaccacaga

SEQ ID NO: 22853 - DNA, 25 bp, synthetic construct
  misc_feature 1..25: note = Synthetic Construct
  source 1..25: mol_type = other DNA
aggcagatcactaactggttctaag

SEQ ID NO: 22854 - DNA, 23 bp, synthetic construct
  misc_feature 1..23: note = Synthetic Construct
  source 1..23: mol_type = other DNA
tcagtagagccttgaggtagctt

SEQ ID NO: 22855 - DNA, 21 bp, synthetic construct
  misc_feature 1..21: note = Synthetic Construct
  source 1..21: mol_type = other DNA
cctgccctaccaacccacatt

SEQ ID NO: 22856 - DNA, 22 bp, synthetic construct
  misc_feature 1..22: note = Synthetic Construct
  source 1..22: mol_type = other DNA
ccctctgcttttgctccagata

SEQ ID NO: 22857 - DNA, 24 bp, synthetic construct
  misc_feature 1..24: note = Synthetic Construct
  source 1..24: mol_type = other DNA
aagccaagctaaatcttccctgaa

SEQ ID NO: 22858 - DNA, 19 bp, synthetic construct
  misc_feature 1..19: note = Synthetic Construct
  source 1..19: mol_type = other DNA
aggccttcagcctgagaca

SEQ ID NO: 22859 - DNA, 20 bp, synthetic construct
  misc_feature 1..20: note = Synthetic Construct
  source 1..20: mol_type = other DNA
tcttcctgggcacgttcttc

SEQ ID NO: 22860 - DNA, 22 bp, synthetic construct
  misc_feature 1..22: note = Synthetic Construct
  source 1..22: mol_type = other DNA
gggatctctgcagcatgacttg

SEQ ID NO: 22861 - DNA, 23 bp, synthetic construct
  misc_feature 1..23: note = Synthetic Construct
  source 1..23: mol_type = other DNA
tcaacacctttttcggtgacagt

SEQ ID NO: 22862 - DNA, 22 bp, synthetic construct
  misc_feature 1..22: note = Synthetic Construct
  source 1..22: mol_type = other DNA
ccgcgctctacctcttgattta

SEQ ID NO: 22863 - DNA, 23 bp, synthetic construct
  misc_feature 1..23: note = Synthetic Construct
  source 1..23: mol_type = other DNA
tctgttcttgaacatgccagtga

SEQ ID NO: 22864 - DNA, 20 bp, synthetic construct
  misc_feature 1..20: note = Synthetic Construct
  source 1..20: mol_type = other DNA
gcagtaggtggagggtgttc

SEQ ID NO: 22865 - DNA, 22 bp, synthetic construct
  misc_feature 1..22: note = Synthetic Construct
  source 1..22: mol_type = other DNA
agaccttcctggcttccttttg

SEQ ID NO: 22866 - DNA, 20 bp, synthetic construct
  misc_feature 1..20: note = Synthetic Construct
  source 1..20: mol_type = other DNA
atgggcctgaggcagattgt

SEQ ID NO: 22867 - DNA, 22 bp, synthetic construct
  misc_feature 1..22: note = Synthetic Construct
  source 1..22: mol_type = other DNA
gcaagaggaaagaccagcatca

SEQ ID NO: 22868 - DNA, 19 bp, synthetic construct
  misc_feature 1..19: note = Synthetic Construct
  source 1..19: mol_type = other DNA
caaccctgggctggactgt

SEQ ID NO: 22869 - DNA, 20 bp, synthetic construct
  misc_feature 1..20: note = Synthetic Construct
  source 1..20: mol_type = other DNA
cagccgcaaagagagcctaa

SEQ ID NO: 22870 - DNA, 26 bp, synthetic construct
  misc_feature 1..26: note = Synthetic Construct
  source 1..26: mol_type = other DNA
gaacacaccaggtttctgcactagat

SEQ ID NO: 22871 - DNA, 20 bp, synthetic construct
  misc_feature 1..20: note = Synthetic Construct
  source 1..20: mol_type = other DNA
ccccgctctctgtcccatca

SEQ ID NO: 22872 - DNA, 20 bp, synthetic construct
  misc_feature 1..20: note = Synthetic Construct
  source 1..20: mol_type = other DNA
atcgggagtcacagcacttg

SEQ ID NO: 22873 - DNA, 26 bp, synthetic construct
  misc_feature 1..26: note = Synthetic Construct
  source 1..26: mol_type = other DNA
ctgagagaggagtctatcttccttga

SEQ ID NO: 22874 - DNA, 21 bp, synthetic construct
  misc_feature 1..21: note = Synthetic Construct
  source 1..21: mol_type = other DNA
ggccaagggtgaactggagaa

SEQ ID NO: 22875 - DNA, 20 bp, synthetic construct
  misc_feature 1..20: note = Synthetic Construct
  source 1..20: mol_type = other DNA
ccccgccaggtactgtctca

SEQ ID NO: 22876 - DNA, 19 bp, synthetic construct
  misc_feature 1..19: note = Synthetic Construct
  source 1..19: mol_type = other DNA
ggaccagggctgcgagaaa

SEQ ID NO: 22877 - DNA, 25 bp, synthetic construct
  misc_feature 1..25: note = Synthetic Construct
  source 1..25: mol_type = other DNA
gtgggacatcttatgatccgcttag

SEQ ID NO: 22878 - DNA, 25 bp, synthetic construct
  misc_feature 1..25: note = Synthetic Construct
  source 1..25: mol_type = other DNA
tgagtgtctaaacatgggcacatac

SEQ ID NO: 22879 - DNA, 20 bp, synthetic construct
  misc_feature 1..20: note = Synthetic Construct
  source 1..20: mol_type = other DNA
agcctgccctaccccaatct

SEQ ID NO: 22880 - DNA, 25 bp, synthetic construct
  misc_feature 1..25: note = Synthetic Construct
  source 1..25: mol_type = other DNA
tgactatttgactggtcctggtaac

SEQ ID NO: 22881 - DNA, 23 bp, synthetic construct
  misc_feature 1..23: note = Synthetic Construct
  source 1..23: mol_type = other DNA
gggacttgaccttgcttccacaa

SEQ ID NO: 22882 - DNA, 20 bp, synthetic construct
  misc_feature 1..20: note = Synthetic Construct
  source 1..20: mol_type = other DNA
aagtaccgccctcgtctgtt

SEQ ID NO: 22883 - DNA, 20 bp, synthetic construct
  misc_feature 1..20: note = Synthetic Construct
  source 1..20: mol_type = other DNA
tgccatggcgtgttggatct

SEQ ID NO: 22884 - DNA, 21 bp, synthetic construct
  misc_feature 1..21: note = Synthetic Construct
  source 1..21: mol_type = other DNA
agagacccttggcaggtgcat

SEQ ID NO: 22885 - DNA, 23 bp, synthetic construct
  misc_feature 1..23: note = Synthetic Construct
  source 1..23: mol_type = other DNA
cacattagtctgggagcttggtt

SEQ ID NO: 22886 - DNA, 23 bp, synthetic construct
  misc_feature 1..23: note = Synthetic Construct
  source 1..23: mol_type = other DNA
ccccagtactcaggggactttgt

SEQ ID NO: 22887 - DNA, 19 bp, synthetic construct
  misc_feature 1..19: note = Synthetic Construct
  source 1..19: mol_type = other DNA
gatgggccatgtggcttct

SEQ ID NO: 22888 - DNA, 21 bp, synthetic construct
  misc_feature 1..21: note = Synthetic Construct
  source 1..21: mol_type = other DNA
tctccccagtggagcttatgt

SEQ ID NO: 22889 - DNA, 20 bp, synthetic construct
  misc_feature 1..20: note = Synthetic Construct
  source 1..20: mol_type = other DNA
caccaacaagctggctctga

SEQ ID NO: 22890 - DNA, 19 bp, synthetic construct
  misc_feature 1..19: note = Synthetic Construct
  source 1..19: mol_type = other DNA
cggctccaagttcccacat

SEQ ID NO: 22891 - DNA, 21 bp, synthetic construct
  misc_feature 1..21: note = Synthetic Construct
  source 1..21: mol_type = other DNA
tgtccaaggttgaggggttgt

SEQ ID NO: 22892 - DNA, 23 bp, synthetic construct
  misc_feature 1..23: note = Synthetic Construct
  source 1..23: mol_type = other DNA
ctggaatggctgttaggcacctt

SEQ ID NO: 22893 - DNA, 27 bp, synthetic construct
  misc_feature 1..27: note = Synthetic Construct
  source 1..27: mol_type = other DNA
gcacataactgtacctcctaagccata

SEQ ID NO: 22894 - DNA, 25 bp, synthetic construct
  misc_feature 1..25: note = Synthetic Construct
  source 1..25: mol_type = other DNA
gggaaagcaatgctgtgtgtttatg

SEQ ID NO: 22895 - DNA, 21 bp, synthetic construct
  misc_feature 1..21: note = Synthetic Construct
  source 1..21: mol_type = other DNA
tcccacagtcaggccaaccat

SEQ ID NO: 22896 - DNA, 21 bp, synthetic construct
  misc_feature 1..21: note = Synthetic Construct
  source 1..21: mol_type = other DNA
acagctggacccagggaagtt

SEQ ID NO: 22897 - DNA, 22 bp, synthetic construct
  misc_feature 1..22: note = Synthetic Construct
  source 1..22: mol_type = other DNA
cctggtggcataagggatgctt

SEQ ID NO: 22898 - DNA, 23 bp, synthetic construct
  misc_feature 1..23: note = Synthetic Construct
  source 1..23: mol_type = other DNA
gatgttggtactcgcttctcagt

SEQ ID NO: 22899 - DNA, 25 bp, synthetic construct
  misc_feature 1..25: note = Synthetic Construct
  source 1..25: mol_type = other DNA
gggttactaaagggcagttctgttc

SEQ ID NO: 22900 - DNA, 21 bp, synthetic construct
  misc_feature 1..21: note = Synthetic Construct
  source 1..21: mol_type = other DNA
tcctaggctgaccagtgtcat

SEQ ID NO: 22901 - DNA, 21 bp, synthetic construct
  misc_feature 1..21: note = Synthetic Construct
  source 1..21: mol_type = other DNA
gcctttccccagtccatttct

SEQ ID NO: 22902 - DNA, 21 bp, synthetic construct
  misc_feature 1..21: note = Synthetic Construct
  source 1..21: mol_type = other DNA
tgtctttcaccagcccagact

SEQ ID NO: 22903 - DNA, 26 bp, synthetic construct
  misc_feature 1..26: note = Synthetic Construct
  source 1..26: mol_type = other DNA
cgtgtgagaaaaacctctcctactac

SEQ ID NO: 22904 - DNA, 25 bp, synthetic construct
  misc_feature 1..25: note = Synthetic Construct
  source 1..25: mol_type = other DNA
tgtccaacagctttacatagcacat

SEQ ID NO: 22905 - DNA, 21 bp, synthetic construct
  misc_feature 1..21: note = Synthetic Construct
  source 1..21: mol_type = other DNA
cagaagcagtgagctgtggtt

SEQ ID NO: 22906 - DNA, 20 bp, synthetic construct
  misc_feature 1..20: note = Synthetic Construct
  source 1..20: mol_type = other DNA
ctgggcctgcagaaatgcta

SEQ ID NO: 22907 - DNA, 22 bp, synthetic construct
  misc_feature 1..22: note = Synthetic Construct
  source 1..22: mol_type = other DNA
cactgaggcgatgctctgatct

SEQ ID NO: 22908 - DNA, 24 bp, synthetic construct
  misc_feature 1..24: note = Synthetic Construct
  source 1..24: mol_type = other DNA
tggcctccttctctaaaagcattc

SEQ ID NO: 22909 - DNA, 23 bp, synthetic construct
  misc_feature 1..23: note = Synthetic Construct
  source 1..23: mol_type = other DNA
cactcacaactcctttcccaagt

SEQ ID NO: 22910 - DNA, 19 bp, synthetic construct
  misc_feature 1..19: note = Synthetic Construct
  source 1..19: mol_type = other DNA
gcgtgggcaaagcctccat

SEQ ID NO: 22911 - DNA, 20 bp, synthetic construct
  misc_feature 1..20: note = Synthetic Construct
  source 1..20: mol_type = other DNA
atccactgccctgaccttgt

SEQ ID NO: 22912 - DNA, 20 bp, synthetic construct
  misc_feature 1..20: note = Synthetic Construct
  source 1..20: mol_type = other DNA
actccaaaccccacctgcta

SEQ ID NO: 22913 - DNA, 22 bp, synthetic construct
  misc_feature 1..22: note = Synthetic Construct
  source 1..22: mol_type = other DNA
gggtcctaaccctcagtcttgt

SEQ ID NO: 22914 - DNA, 21 bp, synthetic construct
  misc_feature 1..21: note = Synthetic Construct
  source 1..21: mol_type = other DNA
acagggctcctggttctaact

SEQ ID NO: 22915 - DNA, 23 bp, synthetic construct
  misc_feature 1..23: note = Synthetic Construct
  source 1..23: mol_type = other DNA
ctctaggagcatgggtcaccaaa

SEQ ID NO: 22916 - DNA, 18 bp, synthetic construct
  misc_feature 1..18: note = Synthetic Construct
  source 1..18: mol_type = other DNA
aagccggcaggctgagtt

SEQ ID NO: 22917 - DNA, 22 bp, synthetic construct
  misc_feature 1..22: note = Synthetic Construct
  source 1..22: mol_type = other DNA
ggagccacaaggaatgcagagt

SEQ ID NO: 22918 - DNA, 20 bp, synthetic construct
  misc_feature 1..20: note = Synthetic Construct
  source 1..20: mol_type = other DNA
caagaccctgccacctctct

SEQ ID NO: 22919 - DNA, 18 bp, synthetic construct
  misc_feature 1..18: note = Synthetic Construct
  source 1..18: mol_type = other DNA
ggtgcagccttgctcact

SEQ ID NO: 22920 - DNA, 21 bp, synthetic construct
  misc_feature 1..21: note = Synthetic Construct
  source 1..21: mol_type = other DNA
gcggaaggtggaagaaccttt

SEQ ID NO: 22921 - DNA, 24 bp, synthetic construct
  misc_feature 1..24: note = Synthetic Construct
  source 1..24: mol_type = other DNA
gggcacactgaagtctagaagcaa

SEQ ID NO: 22922 - DNA, 21 bp, synthetic construct
  misc_feature 1..21: note = Synthetic Construct
  source 1..21: mol_type = other DNA
tgggcccatctcttgactttc

SEQ ID NO: 22923 - DNA, 22 bp, synthetic construct
  misc_feature 1..22: note = Synthetic Construct
  source 1..22: mol_type = other DNA
gaaggatgagcggatggctcta

SEQ ID NO: 22924 - DNA, 25 bp, synthetic construct
  misc_feature 1..25: note = Synthetic Construct
  source 1..25: mol_type = other DNA
gcagtacttggggtcgtatatctgt

SEQ ID NO: 22925 - DNA, 21 bp, synthetic construct
  misc_feature 1..21: note = Synthetic Construct
  source 1..21: mol_type = other DNA
tccacctacctgtgggcaatc

SEQ ID NO: 22926 - DNA, 21 bp, synthetic construct
  misc_feature 1..21: note = Synthetic Construct
  source 1..21: mol_type = other DNA
cccgggtacaacagtgacctt

SEQ ID NO: 22927 - DNA, 22 bp, synthetic construct
  misc_feature 1..22: note = Synthetic Construct
  source 1..22: mol_type = other DNA
tctcccggaaagtccggttcta

SEQ ID NO: 22928 - DNA, 22 bp, synthetic construct
  misc_feature 1..22: note = Synthetic Construct
  source 1..22: mol_type = other DNA
cacccaagctctcactgttact

SEQ ID NO: 22929 - DNA, 19 bp, synthetic construct
  misc_feature 1..19: note = Synthetic Construct
  source 1..19: mol_type = other DNA
gggccagctgaccaactac

SEQ ID NO: 22930 - DNA, 20 bp, synthetic construct
  misc_feature 1..20: note = Synthetic Construct
  source 1..20: mol_type = other DNA
ctccctgaagcagcagcaaa

SEQ ID NO: 22931 - DNA, 22 bp, synthetic construct
  misc_feature 1..22: note = Synthetic Construct
  source 1..22: mol_type = other DNA
gctgtcacactgaccctggatt

SEQ ID NO: 22932 - DNA, 20 bp, synthetic construct
  misc_feature 1..20: note = Synthetic Construct
  source 1..20: mol_type = other DNA
gccatgctgagagcctctgt

SEQ ID NO: 22933 - DNA, 24 bp, synthetic construct
  misc_feature 1..24: note = Synthetic Construct
  source 1..24: mol_type = other DNA
gtccacgtgtggaacatgtttatt

SEQ ID NO: 22934 - DNA, 24 bp, synthetic construct
  misc_feature 1..24: note = Synthetic Construct
  source 1..24: mol_type = other DNA
gcaaggagctgatctcatctgtgt

SEQ ID NO: 22935 - DNA, 22 bp, synthetic construct
  misc_feature 1..22: note = Synthetic Construct
  source 1..22: mol_type = other DNA
caaagggctccttccccacaaa

SEQ ID NO: 22936 - DNA, 20 bp, synthetic construct
  misc_feature 1..20: note = Synthetic Construct
  source 1..20: mol_type = other DNA
gggaagcctttgagggttgt

SEQ ID NO: 22937 - DNA, 20 bp, synthetic construct
  misc_feature 1..20: note = Synthetic Construct
  source 1..20: mol_type = other DNA
tctgcacccctgccctgtgt

SEQ ID NO: 22938 - DNA, 22 bp, synthetic construct
  misc_feature 1..22: note = Synthetic Construct
  source 1..22: mol_type = other DNA
tccccagagtgcacaactcctt

SEQ ID NO: 22939 - DNA, 23 bp, synthetic construct
  misc_feature 1..23: note = Synthetic Construct
  source 1..23: mol_type = other DNA
gtttggctgcacgtagagaaaag

SEQ ID NO: 22940 - DNA, 19 bp, synthetic construct
  misc_feature 1..19: note = Synthetic Construct
  source 1..19: mol_type = other DNA
gttggcactggggccttct

SEQ ID NO: 22941 - DNA, 24 bp, synthetic construct
  misc_feature 1..24: note = Synthetic Construct
  source 1..24: mol_type = other DNA
gactcagtcagtagagagggagaa

SEQ ID NO: 22942 - DNA, 20 bp, synthetic construct
  misc_feature 1..20: note = Synthetic Construct
  source 1..20: mol_type = other DNA
cgtggggagggagaccactt

SEQ ID NO: 22943 - DNA, 25 bp, synthetic construct
  misc_feature 1..25: note = Synthetic Construct
  source 1..25: mol_type = other DNA
tcttcttttgacagactgggaacat

SEQ ID NO: 22944 - DNA, 22 bp, synthetic construct
  misc_feature 1..22: note = Synthetic Construct
  source 1..22: mol_type = other DNA
accttctgaggtttggggtaga

SEQ ID NO: 22945 - DNA, 22 bp, synthetic construct
  misc_feature 1..22: note = Synthetic Construct
  source 1..22: mol_type = other DNA
tgtaaggctaagccgcattttg

SEQ ID NO: 22946 - DNA, 22 bp, synthetic construct
  misc_feature 1..22: note = Synthetic Construct
  source 1..22: mol_type = other DNA
tgaccagaaccactcggacaga

SEQ ID NO: 22947 - DNA, 20 bp, synthetic construct
  misc_feature 1..20: note = Synthetic Construct
  source 1..20: mol_type = other DNA
acaggcccactgccctgtct

SEQ ID NO: 22948 - DNA, 20 bp, synthetic construct
  misc_feature 1..20: note = Synthetic Construct
  source 1..20: mol_type = other DNA
gctgacggctggaatcatct

SEQ ID NO: 22949 - DNA, 24 bp, synthetic construct
  misc_feature 1..24: note = Synthetic Construct
  source 1..24: mol_type = other DNA
agctcaggtaaaaggtcaaagaca

SEQ ID NO: 22950 - DNA, 21 bp, synthetic construct
  misc_feature 1..21: note = Synthetic Construct
  source 1..21: mol_type = other DNA
gcaggccagtaacgtcaattc

SEQ ID NO: 22951 - DNA, 22 bp, synthetic construct
  misc_feature 1..22: note = Synthetic Construct
  source 1..22: mol_type = other DNA
agtgcttcaagcctgagattgt

SEQ ID NO: 22952 - DNA, 21 bp, synthetic construct
  misc_feature 1..21: note = Synthetic Construct
  source 1..21: mol_type = other DNA
cccggttccctccttctccat

SEQ ID NO: 22953 - DNA, 22 bp, synthetic construct
  misc_feature 1..22: note = Synthetic Construct
  source 1..22: mol_type = other DNA
ggtgaccgatggcactgaatgt

SEQ ID NO: 22954 - DNA, 22 bp, synthetic construct
  misc_feature 1..22: note = Synthetic Construct
  source 1..22: mol_type = other DNA
caccctgatcacctgggaaaag

SEQ ID NO: 22955 - DNA, 21 bp, synthetic construct
  misc_feature 1..21: note = Synthetic Construct
  source 1..21: mol_type = other DNA
tgctgtcagccactctacaca

SEQ ID NO: 22956 - DNA, 24 bp, synthetic construct
  misc_feature 1..24: note = Synthetic Construct
  source 1..24: mol_type = other DNA
ttcccttaatgcaatggaggtcaa

SEQ ID NO: 22957 - DNA, 20 bp, synthetic construct
  misc_feature 1..20: note = Synthetic Construct
  source 1..20: mol_type = other DNA
caagcttgctccctgacact

SEQ ID NO: 22958 - DNA, 20 bp, synthetic construct
  misc_feature 1..20: note = Synthetic Construct
  source 1..20: mol_type = other DNA
aggcagtgccaggtcctgaa

SEQ ID NO: 22959 - DNA, 22 bp, synthetic construct
  misc_feature 1..22: note = Synthetic Construct
  source 1..22: mol_type = other DNA
tccttccagggttcgtttgttt

SEQ ID NO: 22960 - DNA, 24 bp, synthetic construct
  misc_feature 1..24: note = Synthetic Construct
  source 1..24: mol_type = other DNA
gcagttaccagggacattactgaa

SEQ ID NO: 22961 - DNA, 24 bp, synthetic construct
  misc_feature 1..24: note = Synthetic Construct
  source 1..24: mol_type = other DNA
ggacctgaagtggatgagctttgt

SEQ ID NO: 22962 - DNA, 20 bp, synthetic construct
  misc_feature 1..20: note = Synthetic Construct
  source 1..20: mol_type = other DNA
agccctggaccagattgaga

SEQ ID NO: 22963 - DNA, 24 bp, synthetic construct
  misc_feature 1..24: note = Synthetic Construct
  source 1..24: mol_type = other DNA
gcagaaggagcacctctctccata

SEQ ID NO: 22964 - DNA, 20 bp, synthetic construct
  misc_feature 1..20: note = Synthetic Construct
  source 1..20: mol_type = other DNA
gtcacagccatccagtgcaa

SEQ ID NO: 22965 - DNA, 20 bp, synthetic construct
  misc_feature 1..20: note = Synthetic Construct
  source 1..20: mol_type = other DNA
gagcgagccttgccttgtta

SEQ ID NO: 22966 - DNA, 22 bp, synthetic construct
  misc_feature 1..22: note = Synthetic Construct
  source 1..22: mol_type = other DNA
aaggctagagtgggaactgact

SEQ ID NO: 22967 - DNA, 23 bp, synthetic construct
  misc_feature 1..23: note = Synthetic Construct
  source 1..23: mol_type = other DNA
acattgttcatggaggagtgcaa

SEQ ID NO: 22968 - DNA, 24 bp, synthetic construct
  misc_feature 1..24: note = Synthetic Construct
  source 1..24: mol_type = other DNA
gagggaaactgaagatggagcttt

SEQ ID NO: 22969 - DNA, 19 bp, synthetic construct
  misc_feature 1..19: note = Synthetic Construct
  source 1..19: mol_type = other DNA
caagggctggggctcacat

SEQ ID NO: 22970 - DNA, 20 bp, synthetic construct
  misc_feature 1..20: note = Synthetic Construct
  source 1..20: mol_type = other DNA
cagacacagtcagcgtccat

SEQ ID NO: 22971 - DNA, 23 bp, synthetic construct
  misc_feature 1..23: note = Synthetic Construct
  source 1..23: mol_type = other DNA
tgttcttcagaatgtgccgtttc

SEQ ID NO: 22972 - DNA, 23 bp, synthetic construct
  misc_feature 1..23: note = Synthetic Construct
  source 1..23: mol_type = other DNA
ctgcaaaaatcctgacccagtct

SEQ ID NO: 22973 - DNA, 20 bp, synthetic construct
  misc_feature 1..20: note = Synthetic Construct
  source 1..20: mol_type = other DNA
ccaccttgttggctctgagt

SEQ ID NO: 22974 - DNA, 20 bp, synthetic construct
  misc_feature 1..20: note = Synthetic Construct
  source 1..20: mol_type = other DNA
cctggagcggctgtctcata

SEQ ID NO: 22975 - DNA, 27 bp, synthetic construct
  misc_feature 1..27: note = Synthetic Construct
  source 1..27: mol_type = other DNA
cagtctgtctgaacccatttacaccaa

SEQ ID NO: 22976 - DNA, 24 bp, synthetic construct
  misc_feature 1..24: note = Synthetic Construct
  source 1..24: mol_type = other DNA
cagtgtgagtgctgagaaacaaag

SEQ ID NO: 22977 - DNA, 22 bp, synthetic construct
  misc_feature 1..22: note = Synthetic Construct
  source 1..22: mol_type = other DNA
cacccctgggaaggatggaaat

SEQ ID NO: 22978 - DNA, 18 bp, synthetic construct
  misc_feature 1..18: note = Synthetic Construct
  source 1..18: mol_type = other DNA
agggctgcatgccacaga

SEQ ID NO: 22979 - DNA, 23 bp, synthetic construct
  misc_feature 1..23: note = Synthetic Construct
  source 1..23: mol_type = other DNA
cctgtactcccttccctggtatc

SEQ ID NO: 22980 - DNA, 19 bp, synthetic construct
  misc_feature 1..19: note = Synthetic Construct
  source 1..19: mol_type = other DNA
tctctgtgccaggctgtgt

SEQ ID NO: 22981 - DNA, 22 bp, synthetic construct
  misc_feature 1..22: note = Synthetic Construct
  source 1..22: mol_type = other DNA
tctgagacttcctcccttgtga

SEQ ID NO: 22982 - DNA, 24 bp, synthetic construct
  misc_feature 1..24: note = Synthetic Construct
  source 1..24: mol_type = other DNA
cctcatggtcggtcttggtgactt

SEQ ID NO: 22983 - DNA, 19 bp, synthetic construct
  misc_feature 1..19: note = Synthetic Construct
  source 1..19: mol_type = other DNA
agacggagagcccctgttg

SEQ ID NO: 22984 - DNA, 24 bp, synthetic construct
  misc_feature 1..24: note = Synthetic Construct
  source 1..24: mol_type = other DNA
catgggtacaagctccaattcctt

SEQ ID NO: 22985 - DNA, 24 bp, synthetic construct
  misc_feature 1..24: note = Synthetic Construct
  source 1..24: mol_type = other DNA
gagggaaagggttggggaaaaatc

SEQ ID NO: 22986 - DNA, 24 bp, synthetic construct
  misc_feature 1..24: note = Synthetic Construct
  source 1..24: mol_type = other DNA
gcactagaaagggaaggaactaca

SEQ ID NO: 22987 - DNA, 22 bp, synthetic construct
  misc_feature 1..22: note = Synthetic Construct
  source 1..22: mol_type = other DNA
gaggtaagccttgggcatttct

SEQ ID NO: 22988 - DNA, 21 bp, synthetic construct
  misc_feature 1..21: note = Synthetic Construct
  source 1..21: mol_type = other DNA
gtgaggtgatgggcagactac

SEQ ID NO: 22989 - DNA, 22 bp, synthetic construct
  misc_feature 1..22: note = Synthetic Construct
  source 1..22: mol_type = other DNA
ccttaccagcaggccttcacaa

SEQ ID NO: 22990 - DNA, 22 bp, synthetic construct
  misc_feature 1..22: note = Synthetic Construct
  source 1..22: mol_type = other DNA
tacccacccacccagtcccatt

SEQ ID NO: 22991 - DNA, 23 bp, synthetic construct
  misc_feature 1..23: note = Synthetic Construct
  source 1..23: mol_type = other DNA
cgaacttgctgggagtgtagaac

SEQ ID NO: 22992 - DNA, 22 bp, synthetic construct
  misc_feature 1..22: note = Synthetic Construct
  source 1..22: mol_type = other DNA
ctgtggtccttggtgtcagaga

SEQ ID NO: 22993 - DNA, 22 bp, synthetic construct
  misc_feature 1..22: note = Synthetic Construct
  source 1..22: mol_type = other DNA
ccaaggggctacagtgacaaca

SEQ ID NO: 22994 - DNA, 22 bp, synthetic construct
  misc_feature 1..22: note = Synthetic Construct
  source 1..22: mol_type = other DNA
cagcagtgtggcctttctctac

SEQ ID NO: 22995 - DNA, 20 bp, synthetic construct
  misc_feature 1..20: note = Synthetic Construct
  source 1..20: mol_type = other DNA
tgccacacggagcttgtttc

SEQ ID NO: 22996 - DNA, 25 bp, synthetic construct
  misc_feature 1..25: note = Synthetic Construct
  source 1..25: mol_type = other DNA
caccatgtacttgcactctcagaaa

SEQ ID NO: 22997 - DNA, 20 bp, synthetic construct
  misc_feature 1..20: note = Synthetic Construct
  source 1..20: mol_type = other DNA
cgccaacgtggctgatgttt

SEQ ID NO: 22998 - DNA, 22 bp, synthetic construct
  misc_feature 1..22: note = Synthetic Construct
  source 1..22: mol_type = other DNA
cctggccttactcttcctgagt

SEQ ID NO: 22999 - DNA, 23 bp, synthetic construct
  misc_feature 1..23: note = Synthetic Construct
  source 1..23: mol_type = other DNA
gacttcctgcaagcatttcaaca

SEQ ID NO: 23000 - DNA, 21 bp, synthetic construct
  misc_feature 1..21: note = Synthetic Construct
  source 1..21: mol_type = other DNA
tcaagccaggagacccataca

SEQ ID NO: 23001 - DNA, 22 bp, synthetic construct
  misc_feature 1..22: note = Synthetic Construct
  source 1..22: mol_type = other DNA
cccggaagcactagctcgtaag

SEQ ID NO: 23002 - DNA, 21 bp, synthetic construct
  misc_feature 1..21: note = Synthetic Construct
  source 1..21: mol_type = other DNA
cgctcgcagctttgactgtag

SEQ ID NO: 23003 - DNA, 22 bp, synthetic construct
  misc_feature 1..22: note = Synthetic Construct
  source 1..22: mol_type = other DNA
gcgtctggtctgtgagggtaga

SEQ ID NO: 23004 - DNA, 23 bp, synthetic construct
  misc_feature 1..23: note = Synthetic Construct
  source 1..23: mol_type = other DNA
gagcgtggagagaaaagcaatgt

SEQ ID NO: 23005 - DNA, 21 bp, synthetic construct
  misc_feature 1..21: note = Synthetic Construct
  source 1..21: mol_type = other DNA
cgataagcccgtgttcctgtt

SEQ ID NO: 23006 - DNA, 21 bp, synthetic construct
  misc_feature 1..21: note = Synthetic Construct
  source 1..21: mol_type = other DNA
acgctggatctccaggacact

SEQ ID NO: 23007 - DNA, 24 bp, synthetic construct
  misc_feature 1..24: note = Synthetic Construct
  source 1..24: mol_type = other DNA
caccctcttccctgttaaaggatt

SEQ ID NO: 23008 - DNA, 25 bp, synthetic construct
  misc_feature 1..25: note = Synthetic Construct
  source 1..25: mol_type = other DNA
gctgattctgtgcaaagtccagtgt

SEQ ID NO: 23009 - DNA, 22 bp, synthetic construct
  misc_feature 1..22: note = Synthetic Construct
  source 1..22: mol_type = other DNA
cgatgaaaggctgggagctgaa

SEQ ID NO: 23010 - DNA, 20 bp, synthetic construct
  misc_feature 1..20: note = Synthetic Construct
  source 1..20: mol_type = other DNA
ccggccactggctgctatac

SEQ ID NO: 23011 - DNA, 22 bp, synthetic construct
  misc_feature 1..22: note = Synthetic Construct
  source 1..22: mol_type = other DNA
ctctgcatgtggagcaaaccaa

SEQ ID NO: 23012 - DNA, 21 bp, synthetic construct
  misc_feature 1..21: note = Synthetic Construct
  source 1..21: mol_type = other DNA
aggtaaggggaggctgcagaa

SEQ ID NO: 23013 - DNA, 23 bp, synthetic construct
  misc_feature 1..23: note = Synthetic Construct
  source 1..23: mol_type = other DNA
gctagataatgctgcctgctttg

SEQ ID NO: 23014 - DNA, 26 bp, synthetic construct
  misc_feature 1..26: note = Synthetic Construct
  source 1..26: mol_type = other DNA
ctgaaaagatcactaccaggatgcta

SEQ ID NO: 23015 - DNA, 22 bp, synthetic construct
  misc_feature 1..22: note = Synthetic Construct
  source 1..22: mol_type = other DNA
agacaacagcgttgcttgagta

SEQ ID NO: 23016 - DNA, 23 bp, synthetic construct
  misc_feature 1..23: note = Synthetic Construct
  source 1..23: mol_type = other DNA
agggagagcctctgatgaaaagt

SEQ ID NO: 23017 - DNA, 22 bp, synthetic construct
  misc_feature 1..22: note = Synthetic Construct
  source 1..22: mol_type = other DNA
ccagtgtaggctcacattctgt

SEQ ID NO: 23018 - DNA, 22 bp, synthetic construct
  misc_feature 1..22: note = Synthetic Construct
  source 1..22: mol_type = other DNA
cccaggagtctctgtccattgt

SEQ ID NO: 23019 - DNA, 22 bp, synthetic construct
  misc_feature 1..22: note = Synthetic Construct
  source 1..22: mol_type = other DNA
tcctggtgtggacgtgtctcat

SEQ ID NO: 23020 - DNA, 22 bp, synthetic construct
  misc_feature 1..22: note = Synthetic Construct
  source 1..22: mol_type = other DNA
cgtcaggggtcccttctttttg

SEQ ID NO: 23021 - DNA, 24 bp, synthetic construct
  misc_feature 1..24: note = Synthetic Construct
  source 1..24: mol_type = other DNA
gccagagccttcatttgggagaaa

SEQ ID NO: 23022 - DNA, 19 bp, synthetic construct
  misc_feature 1..19: note = Synthetic Construct
  source 1..19: mol_type = other DNA
tgggcctcctccagccttt

SEQ ID NO: 23023 - DNA, 23 bp, synthetic construct
  misc_feature 1..23: note = Synthetic Construct
  source 1..23: mol_type = other DNA
gttttcccaggcctctcttcttc

SEQ ID NO: 23024 - DNA, 23 bp, synthetic construct
  misc_feature 1..23: note = Synthetic Construct
  source 1..23: mol_type = other DNA
gggatgtacccaaaggcttctct

SEQ ID NO: 23025 - DNA, 22 bp, synthetic construct
  misc_feature 1..22: note = Synthetic Construct
  source 1..22: mol_type = other DNA
ggtgcttcacagggttcacagt

SEQ ID NO: 23026 - DNA, 20 bp, synthetic construct
  misc_feature 1..20: note = Synthetic Construct
  source 1..20: mol_type = other DNA
agccagcaggtgccattcat

SEQ ID NO: 23027 - DNA, 23 bp, synthetic construct
  misc_feature 1..23: note = Synthetic Construct
  source 1..23: mol_type = other DNA
gggaagtaaacatcccagcttca

SEQ ID NO: 23028 - DNA, 21 bp, synthetic construct
  misc_feature 1..21: note = Synthetic Construct
  source 1..21: mol_type = other DNA
gcagttctccctgcaggcttt

SEQ ID NO: 23029 - DNA, 27 bp, synthetic construct
  misc_feature 1..27: note = Synthetic Construct
  source 1..27: mol_type = other DNA
cttcccgtattgctaaggaactattct

SEQ ID NO: 23030 - DNA, 22 bp, synthetic construct
  misc_feature 1..22: note = Synthetic Construct
  source 1..22: mol_type = other DNA
ctgtgcagcagaggcagttatg

SEQ ID NO: 23031 - DNA, 21 bp, synthetic construct
  misc_feature 1..21: note = Synthetic Construct
  source 1..21: mol_type = other DNA
gggcctcgaaaggcagaaatc

SEQ ID NO: 23032 - DNA, 22 bp, synthetic construct
  misc_feature 1..22: note = Synthetic Construct
  source 1..22: mol_type = other DNA
gcatccatccgggcagttttca

SEQ ID NO: 23033 - DNA, 26 bp, synthetic construct
  misc_feature 1..26: note = Synthetic Construct
  source 1..26: mol_type = other DNA
gaagagcaggagctacttctatccat

SEQ ID NO: 23034 - DNA, 24 bp, synthetic construct
  misc_feature 1..24: note = Synthetic Construct
  source 1..24: mol_type = other DNA
gaccccagactcagtcagtagatg

SEQ ID NO: 23035 - DNA, 24 bp, synthetic construct
  misc_feature 1..24: note = Synthetic Construct
  source 1..24: mol_type = other DNA
caaactggaaaccatacccacttc

SEQ ID NO: 23036 - DNA, 20 bp, synthetic construct
  misc_feature 1..20: note = Synthetic Construct
  source 1..20: mol_type = other DNA
tggggctccaccagccagaa

SEQ ID NO: 23037 - DNA, 22 bp, synthetic construct
  misc_feature 1..22: note = Synthetic Construct
  source 1..22: mol_type = other DNA
gcgtctaacagcctcacccaat

SEQ ID NO: 23038 - DNA, 21 bp, synthetic construct
  misc_feature 1..21: note = Synthetic Construct
  source 1..21: mol_type = other DNA
ctggtgggagtgggcttattt

SEQ ID NO: 23039 - DNA, 28 bp, synthetic construct
  misc_feature 1..28: note = Synthetic Construct
  source 1..28: mol_type = other DNA
gcaagtgttatcagaagtccaccttagt

SEQ ID NO: 23040 - DNA, 24 bp, synthetic construct
  misc_feature 1..24: note = Synthetic Construct
  source 1..24: mol_type = other DNA
tgagccaaagactttccctgtatt

SEQ ID NO: 23041 - DNA, 20 bp, synthetic construct
  misc_feature 1..20: note = Synthetic Construct
  source 1..20: mol_type = other DNA
gccagacgcaggcctagtaa

SEQ ID NO: 23042 - DNA, 20 bp, synthetic construct
  misc_feature 1..20: note = Synthetic Construct
  source 1..20: mol_type = other DNA
tggccacgtcctctccacta

SEQ ID NO: 23043 - DNA, 24 bp, synthetic construct
  misc_feature 1..24: note = Synthetic Construct
  source 1..24: mol_type = other DNA
acagcaggcttaatcctagaggta

SEQ ID NO: 23044 - DNA, 24 bp, synthetic construct
  misc_feature 1..24: note = Synthetic Construct
  source 1..24: mol_type = other DNA
cccagagttgcagtaggacacagt

SEQ ID NO: 23045 - DNA, 19 bp, synthetic construct
  misc_feature 1..19: note = Synthetic Construct
  source 1..19: mol_type = other DNA
ctgcttgccccgacctctt

SEQ ID NO: 23046 - DNA, 19 bp, synthetic construct
  misc_feature 1..19: note = Synthetic Construct
  source 1..19: mol_type = other DNA
tgcccggctcagtttgaat

SEQ ID NO: 23047 - DNA, 23 bp, synthetic construct
  misc_feature 1..23: note = Synthetic Construct
  source 1..23: mol_type = other DNA
ctgccttagggatctgggtgatg

SEQ ID NO: 23048 - DNA, 22 bp, synthetic construct
  misc_feature 1..22: note = Synthetic Construct
  source 1..22: mol_type = other DNA
ggctttggaaggagccatctgt

SEQ ID NO: 23049 - DNA, 20 bp, synthetic construct
  misc_feature 1..20: note = Synthetic Construct
  source 1..20: mol_type = other DNA
ccagcttcagtgtgcaccaa

SEQ ID NO: 23050 - DNA, 25 bp, synthetic construct
  misc_feature 1..25: note = Synthetic Construct
  source 1..25: mol_type = other DNA
cctgagagctgtactgttgctcgaa

SEQ ID NO: 23051 - DNA, 21 bp, synthetic construct
  misc_feature 1..21: note = Synthetic Construct
  source 1..21: mol_type = other DNA
tttcctcactgggtgggatct

SEQ ID NO: 23052 - DNA, 20 bp, synthetic construct
  misc_feature 1..20: note = Synthetic Construct
  source 1..20: mol_type = other DNA
gcgggcaattccacatctga

SEQ ID NO: 23053 - DNA, 22 bp, synthetic construct
  misc_feature 1..22: note = Synthetic Construct
  source 1..22: mol_type = other DNA
ccaactcagggcaagtggttct

SEQ ID NO: 23054 - DNA, 26 bp, synthetic construct
  misc_feature 1..26: note = Synthetic Construct
  source 1..26: mol_type = other DNA
ggttgcaaagtactgtgggaataaag

SEQ ID NO: 23055 - DNA, 22 bp, synthetic construct
  misc_feature 1..22: note = Synthetic Construct
  source 1..22: mol_type = other DNA
gaggacttgggcctttcctatc

SEQ ID NO: 23056 - DNA, 19 bp, synthetic construct
  misc_feature 1..19: note = Synthetic Construct
  source 1..19: mol_type = other DNA
tctgcgatgcgttcctgtt

SEQ ID NO: 23057 - DNA, 20 bp, synthetic construct
  misc_feature 1..20: note = Synthetic Construct
  source 1..20: mol_type = other DNA
gtgaagcttgggctggtttg

SEQ ID NO: 23058 - DNA, 24 bp, synthetic construct
  misc_feature 1..24: note = Synthetic Construct
  source 1..24: mol_type = other DNA
ccatacaaagcaagagtgggaagt

SEQ ID NO: 23059 - DNA, 22 bp, synthetic construct
  misc_feature 1..22: note = Synthetic Construct
  source 1..22: mol_type = other DNA
gggaggggtttccccactaaga

SEQ ID NO: 23060 - DNA, 23 bp, synthetic construct
  misc_feature 1..23: note = Synthetic Construct
  source 1..23: mol_type = other DNA
catcttccaatgtggagctgtca

SEQ ID NO: 23061 - DNA, 19 bp, synthetic construct
  misc_feature 1..19: note = Synthetic Construct
  source 1..19: mol_type = other DNA
cagccgctgactgcctcat

SEQ ID NO: 23062 - DNA, 21 bp, synthetic construct
  misc_feature 1..21: note = Synthetic Construct
  source 1..21: mol_type = other DNA
cgaaaaggggatggtgctttc

SEQ ID NO: 23063 - DNA, 20 bp, synthetic construct
  misc_feature 1..20: note = Synthetic Construct
  source 1..20: mol_type = other DNA
cccctgctggtggtctgttc

SEQ ID NO: 23064 - DNA, 19 bp, synthetic construct
  misc_feature 1..19: note = Synthetic Construct
  source 1..19: mol_type = other DNA
gggcctgggttctccttct

SEQ ID NO: 23065 - DNA, 22 bp, synthetic construct
  misc_feature 1..22: note = Synthetic Construct
  source 1..22: mol_type = other DNA
cagtgcctgtggttctcacact

SEQ ID NO: 23066 - DNA, 23 bp, synthetic construct
  misc_feature 1..23: note = Synthetic Construct
  source 1..23: mol_type = other DNA
gcttacactgacgctgcaactga

SEQ ID NO: 23067 - DNA, 19 bp, synthetic construct
  misc_feature 1..19: note = Synthetic Construct
  source 1..19: mol_type = other DNA
tgccctgcacctctgatct

SEQ ID NO: 23068 - DNA, 20 bp, synthetic construct
  misc_feature 1..20: note = Synthetic Construct
  source 1..20: mol_type = other DNA
ggaggccaccacacctccta

SEQ ID NO: 23069 - DNA, 21 bp, synthetic construct
  misc_feature 1..21: note = Synthetic Construct
  source 1..21: mol_type = other DNA
tctcagccgactcagatcact

SEQ ID NO: 23070 - DNA, 22 bp, synthetic construct
  misc_feature 1..22: note = Synthetic Construct
  source 1..22: mol_type = other DNA
cattctggagtgtgggtggatt

SEQ ID NO: 23071 - DNA, 22 bp, synthetic construct
  misc_feature 1..22: note = Synthetic Construct
  source 1..22: mol_type = other DNA
acggtgaaaaatgaggctgtgt

SEQ ID NO: 23072 - DNA, 19 bp, synthetic construct
  misc_feature 1..19: note = Synthetic Construct
  source 1..19: mol_type = other DNA
ggggacaggaggcatgaga

SEQ ID NO: 23073 - DNA, 20 bp, synthetic construct
  misc_feature 1..20: note = Synthetic Construct
  source 1..20: mol_type = other DNA
tgccactgcgtcatctgtga

SEQ ID NO: 23074 - DNA, 19 bp, synthetic construct
  misc_feature 1..19: note = Synthetic Construct
  source 1..19: mol_type = other DNA
ggcgcctggggacttcatt

SEQ ID NO: 23075 - DNA, 22 bp, synthetic construct
  misc_feature 1..22: note = Synthetic Construct
  source 1..22: mol_type = other DNA
ctctggccccacaaatcaatgt

SEQ ID NO: 23076 - DNA, 24 bp, synthetic construct
  misc_feature 1..24: note = Synthetic Construct
  source 1..24: mol_type = other DNA
accctgtccccaataccctgtatc

SEQ ID NO: 23077 - DNA, 24 bp, synthetic construct
  misc_feature 1..24: note = Synthetic Construct
  source 1..24: mol_type = other DNA
gcctgacctatgaccttcagtaac

SEQ ID NO: 23078 - DNA, 20 bp, synthetic construct
  misc_feature 1..20: note = Synthetic Construct
  source 1..20: mol_type = other DNA
ggagccaccatgacgactgt

SEQ ID NO: 23079 - DNA, 24 bp, synthetic construct
  misc_feature 1..24: note = Synthetic Construct
  source 1..24: mol_type = other DNA
cctgagccctaacaatgatccaaa

SEQ ID NO: 23080 - DNA, 18 bp, synthetic construct
  misc_feature 1..18: note = Synthetic Construct
  source 1..18: mol_type = other DNA
tgagcctcctgcctgcta

SEQ ID NO: 23081 - DNA, 18 bp, synthetic construct
  misc_feature 1..18: note = Synthetic Construct
  source 1..18: mol_type = other DNA
gtgccctttggccaccat

SEQ ID NO: 23082 - DNA, 21 bp, synthetic construct
  misc_feature 1..21: note = Synthetic Construct
  source 1..21: mol_type = other DNA
gctggatgggcagacaggaaa

SEQ ID NO: 23083 - DNA, 19 bp, synthetic construct
  misc_feature 1..19: note = Synthetic Construct
  source 1..19: mol_type = other DNA
acacggccgtccagtcagt

SEQ ID NO: 23084 - DNA, 20 bp, synthetic construct
  misc_feature 1..20: note = Synthetic Construct
  source 1..20: mol_type = other DNA
tgcgtgacaaggggcaagat

SEQ ID NO: 23085 - DNA, 21 bp, synthetic construct
  misc_feature 1..21: note = Synthetic Construct
  source 1..21: mol_type = other DNA
ccaccaggactcgggtcttct

SEQ ID NO: 23086 - DNA, 24 bp, synthetic construct
  misc_feature 1..24: note = Synthetic Construct
  source 1..24: mol_type = other DNA
ggacctccctggatgaagatgaga

SEQ ID NO: 23087 - DNA, 20 bp, synthetic construct
  misc_feature 1..20: note = Synthetic Construct
  source 1..20: mol_type = other DNA
ggggacaccgatgggagaca

SEQ ID NO: 23088 - DNA, 21 bp, synthetic construct
  misc_feature 1..21: note = Synthetic Construct
  source 1..21: mol_type = other DNA
gtggaatgcaggactgtgtct

SEQ ID NO: 23089 - DNA, 23 bp, synthetic construct
  misc_feature 1..23: note = Synthetic Construct
  source 1..23: mol_type = other DNA
ccagaccccttgactctatccaa

SEQ ID NO: 23090 - DNA, 20 bp, synthetic construct
  misc_feature 1..20: note = Synthetic Construct
  source 1..20: mol_type = other DNA
tccacttcagctgcgccaaa

SEQ ID NO: 23091 - DNA, 22 bp, synthetic construct
  misc_feature 1..22: note = Synthetic Construct
  source 1..22: mol_type = other DNA
gtgtgtgatttggcccggatct

SEQ ID NO: 23092 - DNA, 20 bp, synthetic construct
  misc_feature 1..20: note = Synthetic Construct
  source 1..20: mol_type = other DNA
agaagggatcaccccacctt

SEQ ID NO: 23093 - DNA, 24 bp, synthetic construct
  misc_feature 1..24: note = Synthetic Construct
  source 1..24: mol_type = other DNA
ctccgcctcaagtaccttgaattt

SEQ ID NO: 23094 - DNA, 22 bp, synthetic construct
  misc_feature 1..22: note = Synthetic Construct
  source 1..22: mol_type = other DNA
gcttggactcatggtacacgtt

SEQ ID NO: 23095 - DNA, 25 bp, synthetic construct
  misc_feature 1..25: note = Synthetic Construct
  source 1..25: mol_type = other DNA
catcgccactacaattcacctctga

SEQ ID NO: 23096 - DNA, 22 bp, synthetic construct
  misc_feature 1..22: note = Synthetic Construct
  source 1..22: mol_type = other DNA
ctcccttgccactttcctctga

SEQ ID NO: 23097 - DNA, 22 bp, synthetic construct
  misc_feature 1..22: note = Synthetic Construct
  source 1..22: mol_type = other DNA
gccaacaccttgatggcaggtt

SEQ ID NO: 23098 - DNA, 23 bp, synthetic construct
  misc_feature 1..23: note = Synthetic Construct
  source 1..23: mol_type = other DNA
gttatcccatcgattccctgcat

SEQ ID NO: 23099 - DNA, 18 bp, synthetic construct
  misc_feature 1..18: note = Synthetic Construct
  source 1..18: mol_type = other DNA
tgcgaggcagagcacgtt

SEQ ID NO: 23100 - DNA, 24 bp, synthetic construct
  misc_feature 1..24: note = Synthetic Construct
  source 1..24: mol_type = other DNA
ggggatgggttacaatgtatgtct

SEQ ID NO: 23101 - DNA, 23 bp, synthetic construct
  misc_feature 1..23: note = Synthetic Construct
  source 1..23: mol_type = other DNA
gattggggaatgcagcttacaga

SEQ ID NO: 23102 - DNA, 21 bp, synthetic construct
  misc_feature 1..21: note = Synthetic Construct
  source 1..21: mol_type = other DNA
caggctttggggcaacagaga

SEQ ID NO: 23103 - DNA, 21 bp, synthetic construct
  misc_feature 1..21: note = Synthetic Construct
  source 1..21: mol_type = other DNA
ggggcatctgccttctggaat

SEQ ID NO: 23104 - DNA, 22 bp, synthetic construct
  misc_feature 1..22: note = Synthetic Construct
  source 1..22: mol_type = other DNA
cactagagccagctcggaatac

SEQ ID NO: 23105 - DNA, 24 bp, synthetic construct
  misc_feature 1..24: note = Synthetic Construct
  source 1..24: mol_type = other DNA
cggattctcagagagcaagcgtaa

SEQ ID NO: 23106 - DNA, 18 bp, synthetic construct
  misc_feature 1..18: note = Synthetic Construct
  source 1..18: mol_type = other DNA
gctgcacccttggagcat

SEQ ID NO: 23107 - DNA, 21 bp, synthetic construct
  misc_feature 1..21: note = Synthetic Construct
  source 1..21: mol_type = other DNA
tttccgtgccctgaccactct

SEQ ID NO: 23108 - DNA, 22 bp, synthetic construct
  misc_feature 1..22: note = Synthetic Construct
  source 1..22: mol_type = other DNA
gctttcagggtggtgagtgagt

SEQ ID NO: 23109 - DNA, 26 bp, synthetic construct
  misc_feature 1..26: note = Synthetic Construct
  source 1..26: mol_type = other DNA
gccagaggacatatttccaagcaatc

SEQ ID NO: 23110 - DNA, 22 bp, synthetic construct
  misc_feature 1..22: note = Synthetic Construct
  source 1..22: mol_type = other DNA
cacagactcacacgggtgttca

SEQ ID NO: 23111 - DNA, 22 bp, synthetic construct
  misc_feature 1..22: note = Synthetic Construct
  source 1..22: mol_type = other DNA
ccctcaggcaaaatcccataca

SEQ ID NO: 23112 - DNA, 24 bp, synthetic construct
  misc_feature 1..24: note = Synthetic Construct
  source 1..24: mol_type = other DNA
ctctctgtccctctggagtaagaa

SEQ ID NO: 23113 - DNA, 24 bp, synthetic construct
  misc_feature 1..24: note = Synthetic Construct
  source 1..24: mol_type = other DNA
tctctgactaccatcttccactgt

SEQ ID NO: 23114 - DNA, 22 bp, synthetic construct
  misc_feature 1..22: note = Synthetic Construct
  source 1..22: mol_type = other DNA
cgcagcaccatagtcacagcaa

SEQ ID NO: 23115 - DNA, 21 bp, synthetic construct
  misc_feature 1..21: note = Synthetic Construct
  source 1..21: mol_type = other DNA
gccttggatgatggagcaagt

SEQ ID NO: 23116 - DNA, 24 bp, synthetic construct
  misc_feature 1..24: note = Synthetic Construct
  source 1..24: mol_type = other DNA
gtctccaaactgtcctttcctcaa

SEQ ID NO: 23117 - DNA, 22 bp, synthetic construct
  misc_feature 1..22: note = Synthetic Construct
  source 1..22: mol_type = other DNA
aagtgagggctgcaaggagtca

SEQ ID NO: 23118 - DNA, 20 bp, synthetic construct
  misc_feature 1..20: note = Synthetic Construct
  source 1..20: mol_type = other DNA
acgtggtgatctgggagaga

SEQ ID NO: 23119 - DNA, 19 bp, synthetic construct
  misc_feature 1..19: note = Synthetic Construct
  source 1..19: mol_type = other DNA
aggccgaggagctggactt

SEQ ID NO: 23120 - DNA, 24 bp, synthetic construct
  misc_feature 1..24: note = Synthetic Construct
  source 1..24: mol_type = other DNA
caaggtgtgcccaatccaactatc

SEQ ID NO: 23121 - DNA, 19 bp, synthetic construct
  misc_feature 1..19: note = Synthetic Construct
  source 1..19: mol_type = other DNA
ggtggtggtccctcagtct

SEQ ID NO: 23122 - DNA, 19 bp, synthetic construct
  misc_feature 1..19: note = Synthetic Construct
  source 1..19: mol_type = other DNA
aagggcacggccagtaaac

SEQ ID NO: 23123 - DNA, 20 bp, synthetic construct
  misc_feature 1..20: note = Synthetic Construct
  source 1..20: mol_type = other DNA
agcctggggcctgggaatta

SEQ ID NO: 23124 - DNA, 20 bp, synthetic construct
  misc_feature 1..20: note = Synthetic Construct
  source 1..20: mol_type = other DNA
caccgtggctgtgtggagat

SEQ ID NO: 23125 - DNA, 22 bp, synthetic construct
  misc_feature 1..22: note = Synthetic Construct
  source 1..22: mol_type = other DNA
tggagagatgggctctccttag

SEQ ID NO: 23126 - DNA, 24 bp, synthetic construct
  misc_feature 1..24: note = Synthetic Construct
  source 1..24: mol_type = other DNA
ctgcattacctgccctacctatct

SEQ ID NO: 23127 - DNA, 20 bp, synthetic construct
  misc_feature 1..20: note = Synthetic Construct
  source 1..20: mol_type = other DNA
ccctgcgggacttgtggtaa

SEQ ID NO: 23128 - DNA, 23 bp, synthetic construct
  misc_feature 1..23: note = Synthetic Construct
  source 1..23: mol_type = other DNA
cagtggtgtccctaaagcactct

SEQ ID NO: 23129 - DNA, 23 bp, synthetic construct
  misc_feature 1..23: note = Synthetic Construct
  source 1..23: mol_type = other DNA
acggggctgctataaggattaag

SEQ ID NO: 23130 - DNA, 24 bp, synthetic construct
  misc_feature 1..24: note = Synthetic Construct
  source 1..24: mol_type = other DNA
cgacagaggctgtgaatccccaaa

SEQ ID NO: 23131 - DNA, 22 bp, synthetic construct
  misc_feature 1..22: note = Synthetic Construct
  source 1..22: mol_type = other DNA
gccactgatccaggtgacttct

SEQ ID NO: 23132 - DNA, 22 bp, synthetic construct
  misc_feature 1..22: note = Synthetic Construct
  source 1..22: mol_type = other DNA
gccagctcgacagtttcttaca

SEQ ID NO: 23133 - DNA, 20 bp, synthetic construct
  misc_feature 1..20: note = Synthetic Construct
  source 1..20: mol_type = other DNA
agtgggatggggctgctgtt

SEQ ID NO: 23134 - DNA, 23 bp, synthetic construct
  misc_feature 1..23: note = Synthetic Construct
  source 1..23: mol_type = other DNA
gcagagtcccttggtggtgtaag

SEQ ID NO: 23135 - DNA, 21 bp, synthetic construct
  misc_feature 1..21: note = Synthetic Construct
  source 1..21: mol_type = other DNA
caggcccacattctccacaga

SEQ ID NO: 23136 - DNA, 22 bp, synthetic construct
  misc_feature 1..22: note = Synthetic Construct
  source 1..22: mol_type = other DNA
tgcaaacatggacgggtttgat

SEQ ID NO: 23137 - DNA, 24 bp, synthetic construct
  misc_feature 1..24: note = Synthetic Construct
  source 1..24: mol_type = other DNA
gtgttgcagcactaaaacatcaca

SEQ ID NO: 23138 - DNA, 24 bp, synthetic construct
  misc_feature 1..24: note = Synthetic Construct
  source 1..24: mol_type = other DNA
acaaagggaaatccaatggtcact

SEQ ID NO: 23139 - DNA, 20 bp, synthetic construct
  misc_feature 1..20: note = Synthetic Construct
  source 1..20: mol_type = other DNA
gctgggaagctctgcctcaa

SEQ ID NO: 23140 - DNA, 21 bp, synthetic construct
  misc_feature 1..21: note = Synthetic Construct
  source 1..21: mol_type = other DNA
tgggaagtccacccactccaa

SEQ ID NO: 23141 - DNA, 22 bp, synthetic construct
  misc_feature 1..22: note = Synthetic Construct
  source 1..22: mol_type = other DNA
ccacggaggaagaaccagaagt

SEQ ID NO: 23142 - DNA, 20 bp, synthetic construct
  misc_feature 1..20: note = Synthetic Construct
  source 1..20: mol_type = other DNA
atcacccggaggacccatgt

SEQ ID NO: 23143 - DNA, 21 bp, synthetic construct
  misc_feature 1..21: note = Synthetic Construct
  source 1..21: mol_type = other DNA
aggggcctaagtgggctcttc

SEQ ID NO: 23144 - DNA, 22 bp, synthetic construct
  misc_feature 1..22: note = Synthetic Construct
  source 1..22: mol_type = other DNA
gaaaaacgggttagggcagaga

SEQ ID NO: 23145 - DNA, 20 bp, synthetic construct
  misc_feature 1..20: note = Synthetic Construct
  source 1..20: mol_type = other DNA
cggaatgggatgccttggaa

SEQ ID NO: 23146 - DNA, 18 bp, synthetic construct
  misc_feature 1..18: note = Synthetic Construct
  source 1..18: mol_type = other DNA
cactgtcccgctgcagat

SEQ ID NO: 23147 - DNA, 24 bp, synthetic construct
  misc_feature 1..24: note = Synthetic Construct
  source 1..24: mol_type = other DNA
tgtcacagatcagttggtgaatgt

SEQ ID NO: 23148 - DNA, 21 bp, synthetic construct
  misc_feature 1..21: note = Synthetic Construct
  source 1..21: mol_type = other DNA
ccaggacccgagatggtctgt

SEQ ID NO: 23149 - DNA, 23 bp, synthetic construct
  misc_feature 1..23: note = Synthetic Construct
  source 1..23: mol_type = other DNA
agagaccaagggcttctctctaa

SEQ ID NO: 23150 - DNA, 23 bp, synthetic construct
  misc_feature 1..23: note = Synthetic Construct
  source 1..23: mol_type = other DNA
gagggaggtgaatccacgagaga

SEQ ID NO: 23151 - DNA, 20 bp, synthetic construct
  misc_feature 1..20: note = Synthetic Construct
  source 1..20: mol_type = other DNA
agggccaccacggtgagaaa

SEQ ID NO: 23152 - DNA, 22 bp, synthetic construct
  misc_feature 1..22: note = Synthetic Construct
  source 1..22: mol_type = other DNA
agagagccatcctcccttccaa

SEQ ID NO: 23153 - DNA, 23 bp, synthetic construct
  misc_feature 1..23: note = Synthetic Construct
  source 1..23: mol_type = other DNA
acttctgagcaagtgtgatgtga

SEQ ID NO: 23154 - DNA, 22 bp, synthetic construct
  misc_feature 1..22: note = Synthetic Construct
  source 1..22: mol_type = other DNA
ggcgacagttcctctggactta

SEQ ID NO: 23155 - DNA, 22 bp, synthetic construct
  misc_feature 1..22: note = Synthetic Construct
  source 1..22: mol_type = other DNA
cagattggcgacccacccttat

SEQ ID NO: 23156 - DNA, 24 bp, synthetic construct
  misc_feature 1..24: note = Synthetic Construct
  source 1..24: mol_type = other DNA
ggcctttcctaagctgatggttga

SEQ ID NO: 23157 - DNA, 24 bp, synthetic construct
  misc_feature 1..24: note = Synthetic Construct
  source 1..24: mol_type = other DNA
gctggcatctaatgctgccatgtt

SEQ ID NO: 23158 - DNA, 22 bp, synthetic construct
  misc_feature 1..22: note = Synthetic Construct
  source 1..22: mol_type = other DNA
gctgctcagagagaaactgcat

SEQ ID NO: 23159 - DNA, 22 bp, synthetic construct
  misc_feature 1..22: note = Synthetic Construct
  source 1..22: mol_type = other DNA
gatccgcctgagaaggaacaag

SEQ ID NO: 23160 - DNA, 22 bp, synthetic construct
  misc_feature 1..22: note = Synthetic Construct
  source 1..22: mol_type = other DNA
atgccctcgagaccagctagaa

SEQ ID NO: 23161 - DNA, 21 bp, synthetic construct
  misc_feature 1..21: note = Synthetic Construct
  source 1..21: mol_type = other DNA
gaggtttggggtgcgaatgat

SEQ ID NO: 23162 - DNA, 22 bp, synthetic construct
  misc_feature 1..22: note = Synthetic Construct
  source 1..22: mol_type = other DNA
gcagaagttgctggttctgttt

SEQ ID NO: 23163 - DNA, 20 bp, synthetic construct
  misc_feature 1..20: note = Synthetic Construct
  source 1..20: mol_type = other DNA
gggcagaggcaggaccattg

SEQ ID NO: 23164 - DNA, 24 bp, synthetic construct
  misc_feature 1..24: note = Synthetic Construct
  source 1..24: mol_type = other DNA
gctggtattttcgtttctgcatgt

SEQ ID NO: 23165 - DNA, 19 bp, synthetic construct
  misc_feature 1..19: note = Synthetic Construct
  source 1..19: mol_type = other DNA
ttgcccctcctcccctcaa

SEQ ID NO: 23166 - DNA, 23 bp, synthetic construct
  misc_feature 1..23: note = Synthetic Construct
  source 1..23: mol_type = other DNA
acatgcctacacccaaagtcatc

SEQ ID NO: 23167 - DNA, 20 bp, synthetic construct
  misc_feature 1..20: note = Synthetic Construct
  source 1..20: mol_type = other DNA
tgcctggaggaaggaagtca

SEQ ID NO: 23168 - DNA, 23 bp, synthetic construct
  misc_feature 1..23: note = Synthetic Construct
  source 1..23: mol_type = other DNA
ccttccctctggattttgggttt

SEQ ID NO: 23169 - DNA, 20 bp, synthetic construct
  misc_feature 1..20: note = Synthetic Construct
  source 1..20: mol_type = other DNA
agctcctcacccagcctcaa

SEQ ID NO: 23170 - DNA, 21 bp, synthetic construct
  misc_feature 1..21: note = Synthetic Construct
  source 1..21: mol_type = other DNA
acacctgtggaccatgtctga

SEQ ID NO: 23171 - DNA, 22 bp, synthetic construct
  misc_feature 1..22: note = Synthetic Construct
  source 1..22: mol_type = other DNA
gccccaggtatgcttgaccatt

SEQ ID NO: 23172 - DNA, 20 bp, synthetic construct
  misc_feature 1..20: note = Synthetic Construct
  source 1..20: mol_type = other DNA
acccagcaacccacgaaatc

SEQ ID NO: 23173 - DNA, 25 bp, synthetic construct
  misc_feature 1..25: note = Synthetic Construct
  source 1..25: mol_type = other DNA
ggagaccagaacatgacactccaat

SEQ ID NO: 23174 - DNA, 20 bp, synthetic construct
  misc_feature 1..20: note = Synthetic Construct
  source 1..20: mol_type = other DNA
ctgggcaccttgcagctttt

SEQ ID NO: 23175 - DNA, 21 bp, synthetic construct
  misc_feature 1..21: note = Synthetic Construct
  source 1..21: mol_type = other DNA
aggccctgtttccctggaatg

SEQ ID NO: 23176 - DNA, 21 bp, synthetic construct
  misc_feature 1..21: note = Synthetic Construct
  source 1..21: mol_type = other DNA
atctgccgagccaggtcactt

SEQ ID NO: 23177 - DNA, 21 bp, synthetic construct
  misc_feature 1..21: note = Synthetic Construct
  source 1..21: mol_type = other DNA
ggttttgcccaccacctctga

SEQ ID NO: 23178 - DNA, 23 bp, synthetic construct
  misc_feature 1..23: note = Synthetic Construct
  source 1..23: mol_type = other DNA
aaggttgtgctttctctcgctat

SEQ ID NO: 23179 - DNA, 22 bp, synthetic construct
  misc_feature 1..22: note = Synthetic Construct
  source 1..22: mol_type = other DNA
ccttagctcggtcgcctaaact

SEQ ID NO: 23180 - DNA, 23 bp, synthetic construct
  misc_feature 1..23: note = Synthetic Construct
  source 1..23: mol_type = other DNA
cccactatggcaaagatccatca

SEQ ID NO: 23181 - DNA, 20 bp, synthetic construct
  misc_feature 1..20: note = Synthetic Construct
  source 1..20: mol_type = other DNA
tggcacccagtcatctgcta

SEQ ID NO: 23182 - DNA, 23 bp, synthetic construct
  misc_feature 1..23: note = Synthetic Construct
  source 1..23: mol_type = other DNA
catccccgtgtttcaaaggaaag

SEQ ID NO: 23183 - DNA, 23 bp, synthetic construct
  misc_feature 1..23: note = Synthetic Construct
  source 1..23: mol_type = other DNA
aaggacgtacaatttcggagtca

SEQ ID NO: 23184 - DNA, 21 bp, synthetic construct
  misc_feature 1..21: note = Synthetic Construct
  source 1..21: mol_type = other DNA
tccttccctagctgggccttt

SEQ ID NO: 23185 - DNA, 19 bp, synthetic construct
  misc_feature 1..19: note = Synthetic Construct
  source 1..19: mol_type = other DNA
ggggcgataggcacacaca

SEQ ID NO: 23186 - DNA, 22 bp, synthetic construct
  misc_feature 1..22: note = Synthetic Construct
  source 1..22: mol_type = other DNA
ctgacataggtggctggagtga

SEQ ID NO: 23187 - DNA, 22 bp, synthetic construct
  misc_feature 1..22: note = Synthetic Construct
  source 1..22: mol_type = other DNA
ccgcagacagagaagcagtcta

SEQ ID NO: 23188 - DNA, 20 bp, synthetic construct
  misc_feature 1..20: note = Synthetic Construct
  source 1..20: mol_type = other DNA
gactgccgcagctcttgtaa

SEQ ID NO: 23189 - DNA, 22 bp, synthetic construct
  misc_feature 1..22: note = Synthetic Construct
  source 1..22: mol_type = other DNA
gccatggtttagggtcctggat

SEQ ID NO: 23190 - DNA, 20 bp, synthetic construct
  misc_feature 1..20: note = Synthetic Construct
  source 1..20: mol_type = other DNA
ctccccgggtagagcagtga

SEQ ID NO: 23191 - DNA, 22 bp, synthetic construct
  misc_feature 1..22: note = Synthetic Construct
  source 1..22: mol_type = other DNA
cactggggcttccctttacgat

SEQ ID NO: 23192 - DNA, 22 bp, synthetic construct
  misc_feature 1..22: note = Synthetic Construct
  source 1..22: mol_type = other DNA
ccgatggccaaaggctctcaaa

SEQ ID NO: 23193 - DNA, 21 bp, synthetic construct
  misc_feature 1..21: note = Synthetic Construct
  source 1..21: mol_type = other DNA
acacacttcatcacgccttgt

SEQ ID NO: 23194 - DNA, 24 bp, synthetic construct
  misc_feature 1..24: note = Synthetic Construct
  source 1..24: mol_type = other DNA
tccttgatctcccactccattttc

SEQ ID NO: 23195 - DNA, 20 bp, synthetic construct
  misc_feature 1..20: note = Synthetic Construct
  source 1..20: mol_type = other DNA
acctggctggccacttctca

SEQ ID NO: 23196 - DNA, 19 bp, synthetic construct
  misc_feature 1..19: note = Synthetic Construct
  source 1..19: mol_type = other DNA
acctgcctgcctcgtgttc

SEQ ID NO: 23197 - DNA, 20 bp, synthetic construct
  misc_feature 1..20: note = Synthetic Construct
  source 1..20: mol_type = other DNA
aagtctcagggccactccat

SEQ ID NO: 23198 - DNA, 21 bp, synthetic construct
  misc_feature 1..21: note = Synthetic Construct
  source 1..21: mol_type = other DNA
atcaggcccagagagacatga

SEQ ID NO: 23199 - DNA, 22 bp, synthetic construct
  misc_feature 1..22: note = Synthetic Construct
  source 1..22: mol_type = other DNA
ggatgaggggctggcttcatac

SEQ ID NO: 23200 - DNA, 19 bp, synthetic construct
  misc_feature 1..19: note = Synthetic Construct
  source 1..19: mol_type = other DNA
accccagggaagcaagcat

SEQ ID NO: 23201 - DNA, 18 bp, synthetic construct
  misc_feature 1..18: note = Synthetic Construct
  source 1..18: mol_type = other DNA
cgcgtggctgcttgagaa

SEQ ID NO: 23202 - DNA, 23 bp, synthetic construct
  misc_feature 1..23: note = Synthetic Construct
  source 1..23: mol_type = other DNA
agctcaagggaagatgtctccta

SEQ ID NO: 23203 - DNA, 23 bp, synthetic construct
  misc_feature 1..23: note = Synthetic Construct
  source 1..23: mol_type = other DNA
gccctcctcaaagttaggactga

SEQ ID NO: 23204 - DNA, 22 bp, synthetic construct
  misc_feature 1..22: note = Synthetic Construct
  source 1..22: mol_type = other DNA
tcgccctagccctggaaattca

SEQ ID NO: 23205 - DNA, 20 bp, synthetic construct
  misc_feature 1..20: note = Synthetic Construct
  source 1..20: mol_type = other DNA
gggcagtgtccgcaaagttc

SEQ ID NO: 23206 - DNA, 22 bp, synthetic construct
  misc_feature 1..22: note = Synthetic Construct
  source 1..22: mol_type = other DNA
agactccgtcaccctccacaat

SEQ ID NO: 23207 - DNA, 21 bp, synthetic construct
  misc_feature 1..21: note = Synthetic Construct
  source 1..21: mol_type = other DNA
ttgtagccgttccaagagcaa

SEQ ID NO: 23208 - DNA, 24 bp, synthetic construct
  misc_feature 1..24: note = Synthetic Construct
  source 1..24: mol_type = other DNA
ccagaaaacctgtaggcaagatgt

SEQ ID NO: 23209 - DNA, 20 bp, synthetic construct
  misc_feature 1..20: note = Synthetic Construct
  source 1..20: mol_type = other DNA
cgactcacccgctcagcaaa

SEQ ID NO: 23210 - DNA, 19 bp, synthetic construct
  misc_feature 1..19: note = Synthetic Construct
  source 1..19: mol_type = other DNA
ctgccaggcctctctcaca

SEQ ID NO: 23211 - DNA, 20 bp, synthetic construct
  misc_feature 1..20: note = Synthetic Construct
  source 1..20: mol_type = other DNA
cctgtccctgagccctctgt

SEQ ID NO: 23212 - DNA, 20 bp, synthetic construct
  misc_feature 1..20: note = Synthetic Construct
  source 1..20: mol_type = other DNA
acggctggtccttccagtca

SEQ ID NO: 23213 - DNA, 21 bp, synthetic construct
  misc_feature 1..21: note = Synthetic Construct
  source 1..21: mol_type = other DNA
ctcgagcctttgtggacatct

SEQ ID NO: 23214 - DNA, 20 bp, synthetic construct
  misc_feature 1..20: note = Synthetic Construct
  source 1..20: mol_type = other DNA
catgcacactctgcctcgaa

SEQ ID NO: 23215 - DNA, 24 bp, synthetic construct
  misc_feature 1..24: note = Synthetic Construct
  source 1..24: mol_type = other DNA
gccaaatcacctccatcactcaag

SEQ ID NO: 23216 - DNA, 23 bp, synthetic construct
  misc_feature 1..23: note = Synthetic Construct
  source 1..23: mol_type = other DNA
cggacaccaactgtcttgttttg

SEQ ID NO: 23217 - DNA, 20 bp, synthetic construct
  misc_feature 1..20: note = Synthetic Construct
  source 1..20: mol_type = other DNA
ccaccatgcctgttctcact

SEQ ID NO: 23218 - DNA, 25 bp, synthetic construct
  misc_feature 1..25: note = Synthetic Construct
  source 1..25: mol_type = other DNA
gatttagttgcacctttcccaagtt

SEQ ID NO: 23219 - DNA, 20 bp, synthetic construct
  misc_feature 1..20: note = Synthetic Construct
  source 1..20: mol_type = other DNA
tgtgctgccagctgtggtta

SEQ ID NO: 23220 - DNA, 20 bp, synthetic construct
  misc_feature 1..20: note = Synthetic Construct
  source 1..20: mol_type = other DNA
cagcccctcgtttctgttct

SEQ ID NO: 23221 - DNA, 21 bp, synthetic construct
  misc_feature 1..21: note = Synthetic Construct
  source 1..21: mol_type = other DNA
ttcctcttccgccccaacact

SEQ ID NO: 23222 - DNA, 23 bp, synthetic construct
  misc_feature 1..23: note = Synthetic Construct
  source 1..23: mol_type = other DNA
cctctgagacctgaatggtgtga

SEQ ID NO: 23223 - DNA, 21 bp, synthetic construct
  misc_feature 1..21: note = Synthetic Construct
  source 1..21: mol_type = other DNA
ggaagagccgtctccccttga

SEQ ID NO: 23224 - DNA, 19 bp, synthetic construct
  misc_feature 1..19: note = Synthetic Construct
  source 1..19: mol_type = other DNA
acgtggccccagtgtgact

SEQ ID NO: 23225 - DNA, 21 bp, synthetic construct
  misc_feature 1..21: note = Synthetic Construct
  source 1..21: mol_type = other DNA
ggctgcagcagagactgcttt

SEQ ID NO: 23226 - DNA, 23 bp, synthetic construct
  misc_feature 1..23: note = Synthetic Construct
  source 1..23: mol_type = other DNA
ctcaatgagaccgatgcaagttc

SEQ ID NO: 23227 - DNA, 22 bp, synthetic construct
  misc_feature 1..22: note = Synthetic Construct
  source 1..22: mol_type = other DNA
tggacacagaggcagaagagat

SEQ ID NO: 23228 - DNA, 22 bp, synthetic construct
  misc_feature 1..22: note = Synthetic Construct
  source 1..22: mol_type = other DNA
cctcgctagccaactcttctga

SEQ ID NO: 23229 - DNA, 22 bp, synthetic construct
  misc_feature 1..22: note = Synthetic Construct
  source 1..22: mol_type = other DNA
aaggctcccctgcatcctaaag

SEQ ID NO: 23230 - DNA, 26 bp, synthetic construct
  misc_feature 1..26: note = Synthetic Construct
  source 1..26: mol_type = other DNA
ccaggctagacacagaggatgtttac

SEQ ID NO: 23231 - DNA, 23 bp, synthetic construct
  misc_feature 1..23: note = Synthetic Construct
  source 1..23: mol_type = other DNA
agaagcagcatatggtggaaact

SEQ ID NO: 23232 - DNA, 18 bp, synthetic construct
  misc_feature 1..18: note = Synthetic Construct
  source 1..18: mol_type = other DNA
gcgtggtgctggttggaa

SEQ ID NO: 23233 - DNA, 23 bp, synthetic construct
  misc_feature 1..23: note = Synthetic Construct
  source 1..23: mol_type = other DNA
tgctttgctggggatcttttctt

SEQ ID NO: 23234 - DNA, 22 bp, synthetic construct
  misc_feature 1..22: note = Synthetic Construct
  source 1..22: mol_type = other DNA
cctgacccgaatgccaacttca

SEQ ID NO: 23235 - DNA, 19 bp, synthetic construct
  misc_feature 1..19: note = Synthetic Construct
  source 1..19: mol_type = other DNA
ctgatgcccagtgccacat

SEQ ID NO: 23236 - DNA, 21 bp, synthetic construct
  misc_feature 1..21: note = Synthetic Construct
  source 1..21: mol_type = other DNA
acgctggcaggctctcaatag

SEQ ID NO: 23237 - DNA, 20 bp, synthetic construct
  misc_feature 1..20: note = Synthetic Construct
  source 1..20: mol_type = other DNA
gccttggcccctcaaacaag

SEQ ID NO: 23238 - DNA, 21 bp, synthetic construct
  misc_feature 1..21: note = Synthetic Construct
  source 1..21: mol_type = other DNA
tgctacctttggcagggtgta

SEQ ID NO: 23239 - DNA, 22 bp, synthetic construct
  misc_feature 1..22: note = Synthetic Construct
  source 1..22: mol_type = other DNA
agaaggaacggctccagtgatg

SEQ ID NO: 23240 - DNA, 27 bp, synthetic construct
  misc_feature 1..27: note = Synthetic Construct
  source 1..27: mol_type = other DNA
gcctaaggtttttcttaggtcttggta

SEQ ID NO: 23241 - DNA, 24 bp, synthetic construct
  misc_feature 1..24: note = Synthetic Construct
  source 1..24: mol_type = other DNA
ccagaggaagcttgtttgatgaga

SEQ ID NO: 23242 - DNA, 20 bp, synthetic construct
  misc_feature 1..20: note = Synthetic Construct
  source 1..20: mol_type = other DNA
tctccccacacttgcccttt

SEQ ID NO: 23243 - DNA, 19 bp, synthetic construct
  misc_feature 1..19: note = Synthetic Construct
  source 1..19: mol_type = other DNA
gcaggcacctgcagtcaca

SEQ ID NO: 23244 - DNA, 22 bp, synthetic construct
  misc_feature 1..22: note = Synthetic Construct
  source 1..22: mol_type = other DNA
ccagcaaaggctccttccttct

SEQ ID NO: 23245 - DNA, 23 bp, synthetic construct
  misc_feature 1..23: note = Synthetic Construct
  source 1..23: mol_type = other DNA
ccgccaaaatctactgggacttt

SEQ ID NO: 23246 - DNA, 19 bp, synthetic construct
  misc_feature 1..19: note = Synthetic Construct
  source 1..19: mol_type = other DNA
agccctgccgagtgacgat

SEQ ID NO: 23247 - DNA, 23 bp, synthetic construct
  misc_feature 1..23: note = Synthetic Construct
  source 1..23: mol_type = other DNA
ctcccaccacccttcctagaaca

SEQ ID NO: 23248 - DNA, 20 bp, synthetic construct
  misc_feature 1..20: note = Synthetic Construct
  source 1..20: mol_type = other DNA
aggttagagcccctgtgcaa

SEQ ID NO: 23249 - DNA, 23 bp, synthetic construct
  misc_feature 1..23: note = Synthetic Construct
  source 1..23: mol_type = other DNA
ggaaaatgcacggtggaaagaga

SEQ ID NO: 23250 - DNA, 21 bp, synthetic construct
  misc_feature 1..21: note = Synthetic Construct
  source 1..21: mol_type = other DNA
aggtacatgggctcagagaca

SEQ ID NO: 23251 - DNA, 20 bp, synthetic construct
  misc_feature 1..20: note = Synthetic Construct
  source 1..20: mol_type = other DNA
gaggtgggtttgcagtggtt

SEQ ID NO: 23252 - DNA, 23 bp, synthetic construct
  misc_feature 1..23: note = Synthetic Construct
  source 1..23: mol_type = other DNA
tccaccctttcctagcctttctt

SEQ ID NO: 23253 - DNA, 25 bp, synthetic construct
  misc_feature 1..25: note = Synthetic Construct
  source 1..25: mol_type = other DNA
gcaacatagaagcaaggcagttttt

SEQ ID NO: 23254 - DNA, 24 bp, synthetic construct
  misc_feature 1..24: note = Synthetic Construct
  source 1..24: mol_type = other DNA
cacagggcatgatttcctggctta

SEQ ID NO: 23255 - DNA, 20 bp, synthetic construct
  misc_feature 1..20: note = Synthetic Construct
  source 1..20: mol_type = other DNA
atgggcggagttgtgttcaa

SEQ ID NO: 23256 - DNA, 26 bp, synthetic construct
  misc_feature 1..26: note = Synthetic Construct
  source 1..26: mol_type = other DNA
gctacttcccaatttggtttgacaca

SEQ ID NO: 23257 - DNA, 19 bp, synthetic construct
  misc_feature 1..19: note = Synthetic Construct
  source 1..19: mol_type = other DNA
tgctggggcaaggctcaaa

SEQ ID NO: 23258 - DNA, 20 bp, synthetic construct
  misc_feature 1..20: note = Synthetic Construct
  source 1..20: mol_type = other DNA
acatgtgaccccagggatgt

SEQ ID NO: 23259 - DNA, 20 bp, synthetic construct
  misc_feature 1..20: note = Synthetic Construct
  source 1..20: mol_type = other DNA
tggtccctgtcttgcagtct

SEQ ID NO: 23260 - DNA, 23 bp, synthetic construct
  misc_feature 1..23: note = Synthetic Construct
  source 1..23: mol_type = other DNA
cccagaccctggaataggacttg

SEQ ID NO: 23261 - DNA, 19 bp, synthetic construct
  misc_feature 1..19: note = Synthetic Construct
  source 1..19: mol_type = other DNA
agggctgccccttcacctt

SEQ ID NO: 23262 - DNA, 22 bp, synthetic construct
  misc_feature 1..22: note = Synthetic Construct
  source 1..22: mol_type = other DNA
ggctgaggcaaggtttttgcat

SEQ ID NO: 23263 - DNA, 21 bp, synthetic construct
  misc_feature 1..21: note = Synthetic Construct
  source 1..21: mol_type = other DNA
cctccccttctctccactgat

SEQ ID NO: 23264 - DNA, 21 bp, synthetic construct
  misc_feature 1..21: note = Synthetic Construct
  source 1..21: mol_type = other DNA
agtgaccacaggtgcaagaag

SEQ ID NO: 23265 - DNA, 24 bp, synthetic construct
  misc_feature 1..24: note = Synthetic Construct
  source 1..24: mol_type = other DNA
tgtgtatccttgggatctggtaca

SEQ ID NO: 23266 - DNA, 23 bp, synthetic construct
  misc_feature 1..23: note = Synthetic Construct
  source 1..23: mol_type = other DNA
gagctttcctgatgccttacact

SEQ ID NO: 23267 - DNA, 19 bp, synthetic construct
  misc_feature 1..19: note = Synthetic Construct
  source 1..19: mol_type = other DNA
cgcaggcttctgctgttga

SEQ ID NO: 23268 - DNA, 24 bp, synthetic construct
  misc_feature 1..24: note = Synthetic Construct
  source 1..24: mol_type = other DNA
tgacctgaaagctctttgttccat

SEQ ID NO: 23269 - DNA, 22 bp, synthetic construct
  misc_feature 1..22: note = Synthetic Construct
  source 1..22: mol_type = other DNA
cctctggaggccccactgtaat

SEQ ID NO: 23270 - DNA, 25 bp, synthetic construct
  misc_feature 1..25: note = Synthetic Construct
  source 1..25: mol_type = other DNA
ttctagtacatgccttttggtggat

SEQ ID NO: 23271 - DNA, 21 bp, synthetic construct
  misc_feature 1..21: note = Synthetic Construct
  source 1..21: mol_type = other DNA
gcatggaaccagggcatgact

SEQ ID NO: 23272 - DNA, 21 bp, synthetic construct
  misc_feature 1..21: note = Synthetic Construct
  source 1..21: mol_type = other DNA
cgctttgtccccactcttaca

SEQ ID NO: 23273 - DNA, 23 bp, synthetic construct
  misc_feature 1..23: note = Synthetic Construct
  source 1..23: mol_type = other DNA
cactctgtgcaaaccagttgtag

SEQ ID NO: 23274 - DNA, 21 bp, synthetic construct
  misc_feature 1..21: note = Synthetic Construct
  source 1..21: mol_type = other DNA
tcagcacccatcttgctcatc

SEQ ID NO: 23275 - DNA, 20 bp, synthetic construct
  misc_feature 1..20: note = Synthetic Construct
  source 1..20: mol_type = other DNA
ggagactcctaccccagctt

SEQ ID NO: 23276 - DNA, 23 bp, synthetic construct
  misc_feature 1..23: note = Synthetic Construct
  source 1..23: mol_type = other DNA
ggggattgttaatggccgagact

SEQ ID NO: 23277 - DNA, 21 bp, synthetic construct
  misc_feature 1..21: note = Synthetic Construct
  source 1..21: mol_type = other DNA
acccaccacttgcacagttac

SEQ ID NO: 23278 - DNA, 23 bp, synthetic construct
  misc_feature 1..23: note = Synthetic Construct
  source 1..23: mol_type = other DNA
gggtccctaagcactgtgagaag

SEQ ID NO: 23279 - DNA, 20 bp, synthetic construct
  misc_feature 1..20: note = Synthetic Construct
  source 1..20: mol_type = other DNA
aaccaggccttgcggtaaag

SEQ ID NO: 23280 - DNA, 24 bp, synthetic construct
  misc_feature 1..24: note = Synthetic Construct
  source 1..24: mol_type = other DNA
cctagggaacagtccactgagaga

SEQ ID NO: 23281 - DNA, 24 bp, synthetic construct
  misc_feature 1..24: note = Synthetic Construct
  source 1..24: mol_type = other DNA
gcccgtgttttgaagctactgtct

SEQ ID NO: 23282 - DNA, 24 bp, synthetic construct
  misc_feature 1..24: note = Synthetic Construct
  source 1..24: mol_type = other DNA
gccaaccagttcagttgggagtca

SEQ ID NO: 23283 - DNA, 24 bp, synthetic construct
  misc_feature 1..24: note = Synthetic Construct
  source 1..24: mol_type = other DNA
gccagctagtggctttaaccaagt

SEQ ID NO: 23284 - DNA, 20 bp, synthetic construct
  misc_feature 1..20: note = Synthetic Construct
  source 1..20: mol_type = other DNA
gcttcgcccatggctgtctt

SEQ ID NO: 23285 - DNA, 22 bp, synthetic construct
  misc_feature 1..22: note = Synthetic Construct
  source 1..22: mol_type = other DNA
cgtgatctaccccactgagaca

SEQ ID NO: 23286 - DNA, 20 bp, synthetic construct
  misc_feature 1..20: note = Synthetic Construct
  source 1..20: mol_type = other DNA
agttgggcatggaggcatgt

SEQ ID NO: 23287 - DNA, 21 bp, synthetic construct
  misc_feature 1..21: note = Synthetic Construct
  source 1..21: mol_type = other DNA
aggccttgcaggagagaaatg

SEQ ID NO: 23288 - DNA, 25 bp, synthetic construct
  misc_feature 1..25: note = Synthetic Construct
  source 1..25: mol_type = other DNA
cacctctgctttaggtctcaggttt

SEQ ID NO: 23289 - DNA, 25 bp, synthetic construct
  misc_feature 1..25: note = Synthetic Construct
  source 1..25: mol_type = other DNA
cgatgctgagactaaggagcctaaa

SEQ ID NO: 23290 - DNA, 24 bp, synthetic construct
  misc_feature 1..24: note = Synthetic Construct
  source 1..24: mol_type = other DNA
gtcactcattctgctctacccaaa

SEQ ID NO: 23291 - DNA, 25 bp, synthetic construct
  misc_feature 1..25: note = Synthetic Construct
  source 1..25: mol_type = other DNA
gagcatcctcgagaattgcatttga

SEQ ID NO: 23292 - DNA, 25 bp, synthetic construct
  misc_feature 1..25: note = Synthetic Construct
  source 1..25: mol_type = other DNA
gacaagtcagctggtgaagagtgaa

SEQ ID NO: 23293 - DNA, 23 bp, synthetic construct
  misc_feature 1..23: note = Synthetic Construct
  source 1..23: mol_type = other DNA
gcctgtggcaaacttgaacatga

SEQ ID NO: 23294 - DNA, 23 bp, synthetic construct
  misc_feature 1..23: note = Synthetic Construct
  source 1..23: mol_type = other DNA
tccactgtggtttgagtggaaag

SEQ ID NO: 23295 - DNA, 24 bp, synthetic construct
  misc_feature 1..24: note = Synthetic Construct
  source 1..24: mol_type = other DNA
agactcgctcattcactctcattt

SEQ ID NO: 23296 - DNA, 22 bp, synthetic construct
  misc_feature 1..22: note = Synthetic Construct
  source 1..22: mol_type = other DNA
gaatccagctcagccccttcta

SEQ ID NO: 23297 - DNA, 23 bp, synthetic construct
  misc_feature 1..23: note = Synthetic Construct
  source 1..23: mol_type = other DNA
tcaagcagaacaggactgacaat

SEQ ID NO: 23298 - DNA, 20 bp, synthetic construct
  misc_feature 1..20: note = Synthetic Construct
  source 1..20: mol_type = other DNA
tctcagccttcccgcttcat

SEQ ID NO: 23299 - DNA, 19 bp, synthetic construct
  misc_feature 1..19: note = Synthetic Construct
  source 1..19: mol_type = other DNA
agggcccaggttccttctt

SEQ ID NO: 23300 - DNA, 22 bp, synthetic construct
  misc_feature 1..22: note = Synthetic Construct
  source 1..22: mol_type = other DNA
tcccttccaggatgaccattga

SEQ ID NO: 23301 - DNA, 19 bp, synthetic construct
  misc_feature 1..19: note = Synthetic Construct
  source 1..19: mol_type = other DNA
agccaggaagcctcagagt

SEQ ID NO: 23302 - DNA, 22 bp, synthetic construct
  misc_feature 1..22: note = Synthetic Construct
  source 1..22: mol_type = other DNA
ttgctctaccctcctccagctt

SEQ ID NO: 23303 - DNA, 25 bp, synthetic construct
  misc_feature 1..25: note = Synthetic Construct
  source 1..25: mol_type = other DNA
cccctgccctattttaaccacaaag

SEQ ID NO: 23304 - DNA, 20 bp, synthetic construct
  misc_feature 1..20: note = Synthetic Construct
  source 1..20: mol_type = other DNA
ccactgcacccagccaatct

SEQ ID NO: 23305 - DNA, 20 bp, synthetic construct
  misc_feature 1..20: note = Synthetic Construct
  source 1..20: mol_type = other DNA
aggcaggaagcctgttcaga

SEQ ID NO: 23306 - DNA, 25 bp, synthetic construct
  misc_feature 1..25: note = Synthetic Construct
  source 1..25: mol_type = other DNA
tgtgcaaactctgtgatggaatgta

SEQ ID NO: 23307 - DNA, 20 bp, synthetic construct
  misc_feature 1..20: note = Synthetic Construct
  source 1..20: mol_type = other DNA
aggggcccttctggaggttt

SEQ ID NO: 23308 - DNA, 22 bp, synthetic construct
  misc_feature 1..22: note = Synthetic Construct
  source 1..22: mol_type = other DNA
tcgttccaccatgcttttcctt

SEQ ID NO: 23309 - DNA, 22 bp, synthetic construct
  misc_feature 1..22: note = Synthetic Construct
  source 1..22: mol_type = other DNA
tgcttaaacgaacagggctttg

SEQ ID NO: 23310 - DNA, 21 bp, synthetic construct
  misc_feature 1..21: note = Synthetic Construct
  source 1..21: mol_type = other DNA
tctgcaggggtgtggtatttc

SEQ ID NO: 23311 - DNA, 22 bp, synthetic construct
  misc_feature 1..22: note = Synthetic Construct
  source 1..22: mol_type = other DNA
ccacctatgccacccaaggtat

SEQ ID NO: 23312 - DNA, 23 bp, synthetic construct
  misc_feature 1..23: note = Synthetic Construct
  source 1..23: mol_type = other DNA
cccctccctcgcagaagtataag

SEQ ID NO: 23313 - DNA, 24 bp, synthetic construct
  misc_feature 1..24: note = Synthetic Construct
  source 1..24: mol_type = other DNA
gccttcctaatgccacccagatca

SEQ ID NO: 23314 - DNA, 22 bp, synthetic construct
  misc_feature 1..22: note = Synthetic Construct
  source 1..22: mol_type = other DNA
gcctcagtctcggttagcttca

SEQ ID NO: 23315 - DNA, 20 bp, synthetic construct
  misc_feature 1..20: note = Synthetic Construct
  source 1..20: mol_type = other DNA
tgccctgtgccctcaattct

SEQ ID NO: 23316 - DNA, 23 bp, synthetic construct
  misc_feature 1..23: note = Synthetic Construct
  source 1..23: mol_type = other DNA
accctgtactcctctcattcaca

SEQ ID NO: 23317 - DNA, 19 bp, synthetic construct
  misc_feature 1..19: note = Synthetic Construct
  source 1..19: mol_type = other DNA
ccgcgtctggtcgcttctt

SEQ ID NO: 23318 - DNA, 20 bp, synthetic construct
  misc_feature 1..20: note = Synthetic Construct
  source 1..20: mol_type = other DNA
ctggaggagagggcagtcat

SEQ ID NO: 23319 - DNA, 23 bp, synthetic construct
  misc_feature 1..23: note = Synthetic Construct
  source 1..23: mol_type = other DNA
gggattacaaagttgcgcgtttc

SEQ ID NO: 23320 - DNA, 20 bp, synthetic construct
  misc_feature 1..20: note = Synthetic Construct
  source 1..20: mol_type = other DNA
ggatggagacggcaggaatg

SEQ ID NO: 23321 - DNA, 24 bp, synthetic construct
  misc_feature 1..24: note = Synthetic Construct
  source 1..24: mol_type = other DNA
ggacagagaatcaggtcacggtat

SEQ ID NO: 23322 - DNA, 20 bp, synthetic construct
  misc_feature 1..20: note = Synthetic Construct
  source 1..20: mol_type = other DNA
acctcggcctcaggacttct

SEQ ID NO: 23323 - DNA, 22 bp, synthetic construct
  misc_feature 1..22: note = Synthetic Construct
  source 1..22: mol_type = other DNA
tgctcacaggctcggagatagt

SEQ ID NO: 23324 - DNA, 21 bp, synthetic construct
  misc_feature 1..21: note = Synthetic Construct
  source 1..21: mol_type = other DNA
agcagtcaggtgctcctcctt

SEQ ID NO: 23325 - DNA, 19 bp, synthetic construct
  misc_feature 1..19: note = Synthetic Construct
  source 1..19: mol_type = other DNA
tggtatggggcggcagtga

SEQ ID NO: 23326 - DNA, 20 bp, synthetic construct
  misc_feature 1..20: note = Synthetic Construct
  source 1..20: mol_type = other DNA
cccagctgacacaggctcat

SEQ ID NO: 23327 - DNA, 25 bp, synthetic construct
  misc_feature 1..25: note = Synthetic Construct
  source 1..25: mol_type = other DNA
gtgtccagtctccttgagtcatttg

SEQ ID NO: 23328 - DNA, 19 bp, synthetic construct
  misc_feature 1..19: note = Synthetic Construct
  source 1..19: mol_type = other DNA
ggaggcatgccccatctca

SEQ ID NO: 23329 - DNA, 20 bp, synthetic construct
  misc_feature 1..20: note = Synthetic Construct
  source 1..20: mol_type = other DNA
gtggtgcttgttgccactgt

SEQ ID NO: 23330 - DNA, 24 bp, synthetic construct
  misc_feature 1..24: note = Synthetic Construct
  source 1..24: mol_type = other DNA
gggcagtgatagaactgacatttg

SEQ ID NO: 23331 - DNA, 20 bp, synthetic construct
  misc_feature 1..20: note = Synthetic Construct
  source 1..20: mol_type = other DNA
ggaacgtcagtggtcagctt

SEQ ID NO: 23332 - DNA, 23 bp, synthetic construct
  misc_feature 1..23: note = Synthetic Construct
  source 1..23: mol_type = other DNA
tgtcaccctctctgctcataagt

SEQ ID NO: 23333 - DNA, 22 bp, synthetic construct
  misc_feature 1..22: note = Synthetic Construct
  source 1..22: mol_type = other DNA
gttccatccccaaggacacaga

SEQ ID NO: 23334 - DNA, 23 bp, synthetic construct
  misc_feature 1..23: note = Synthetic Construct
  source 1..23: mol_type = other DNA
gggactggaccaagaagggtatg

SEQ ID NO: 23335 - DNA, 22 bp, synthetic construct
  misc_feature 1..22: note = Synthetic Construct
  source 1..22: mol_type = other DNA
ccatggcagaagctcaggaaac

SEQ ID NO: 23336 - DNA, 22 bp, synthetic construct
  misc_feature 1..22: note = Synthetic Construct
  source 1..22: mol_type = other DNA
ggtctcgctctgtgacaccatt

SEQ ID NO: 23337 - DNA, 23 bp, synthetic construct
  misc_feature 1..23: note = Synthetic Construct
  source 1..23: mol_type = other DNA
gcttccccgtgactgtctcctat

SEQ ID NO: 23338 - DNA, 25 bp, synthetic construct
  misc_feature 1..25: note = Synthetic Construct
  source 1..25: mol_type = other DNA
gagagggtactggtagaagcatttc

SEQ ID NO: 23339 - DNA, 20 bp, synthetic construct
  misc_feature 1..20: note = Synthetic Construct
  source 1..20: mol_type = other DNA
aagtgtggggccctcctaag

SEQ ID NO: 23340 - DNA, 22 bp, synthetic construct
  misc_feature 1..22: note = Synthetic Construct
  source 1..22: mol_type = other DNA
gcagctgctgtctctgcaattc

SEQ ID NO: 23341 - DNA, 21 bp, synthetic construct
  misc_feature 1..21: note = Synthetic Construct
  source 1..21: mol_type = other DNA
ccttgtcctgtgcatctctgt

SEQ ID NO: 23342 - DNA, 23 bp, synthetic construct
  misc_feature 1..23: note = Synthetic Construct
  source 1..23: mol_type = other DNA
caaaggcaaaaagtggcatctgt

SEQ ID NO: 23343 - DNA, 22 bp, synthetic construct
  misc_feature 1..22: note = Synthetic Construct
  source 1..22: mol_type = other DNA
gagcctacctctgtggacttca

SEQ ID NO: 23344 - DNA, 24 bp, synthetic construct
  misc_feature 1..24: note = Synthetic Construct
  source 1..24: mol_type = other DNA
ggaaaaccctctgagcctcacatt

SEQ ID NO: 23345 - DNA, 22 bp, synthetic construct
  misc_feature 1..22: note = Synthetic Construct
  source 1..22: mol_type = other DNA
cggccccttagcttgagttagt

SEQ ID NO: 23346 - DNA, 21 bp, synthetic construct
  misc_feature 1..21: note = Synthetic Construct
  source 1..21: mol_type = other DNA
gaggctgcctagagagacaga

SEQ ID NO: 23347 - DNA, 19 bp, synthetic construct
  misc_feature 1..19: note = Synthetic Construct
  source 1..19: mol_type = other DNA
ggccacgcatgggcatttg

SEQ ID NO: 23348 - DNA, 19 bp, synthetic construct
  misc_feature 1..19: note = Synthetic Construct
  source 1..19: mol_type = other DNA
ggggctcgcgtctctgttt

SEQ ID NO: 23349 - DNA, 22 bp, synthetic construct
  misc_feature 1..22: note = Synthetic Construct
  source 1..22: mol_type = other DNA
ctgtgggatgtcctggaactac

SEQ ID NO: 23350 - DNA, 24 bp, synthetic construct
  misc_feature 1..24: note = Synthetic Construct
  source 1..24: mol_type = other DNA
cttcgagaaaggcttggagatact

SEQ ID NO: 23351 - DNA, 19 bp, synthetic construct
  misc_feature 1..19: note = Synthetic Construct
  source 1..19: mol_type = other DNA
tggccctcaaggagctgta

SEQ ID NO: 23352 - DNA, 22 bp, synthetic construct
  misc_feature 1..22: note = Synthetic Construct
  source 1..22: mol_type = other DNA
gcacccagccagcaattggata

SEQ ID NO: 23353 - DNA, 20 bp, synthetic construct
  misc_feature 1..20: note = Synthetic Construct
  source 1..20: mol_type = other DNA
ccccgattctgcgtttgctt

SEQ ID NO: 23354 - DNA, 22 bp, synthetic construct
  misc_feature 1..22: note = Synthetic Construct
  source 1..22: mol_type = other DNA
agaacccggtccacatgctaac

SEQ ID NO: 23355 - DNA, 22 bp, synthetic construct
  misc_feature 1..22: note = Synthetic Construct
  source 1..22: mol_type = other DNA
ccaaggccctcctctctctaag

SEQ ID NO: 23356 - DNA, 23 bp, synthetic construct
  misc_feature 1..23: note = Synthetic Construct
  source 1..23: mol_type = other DNA
cacaggcagttagggtaggttct

SEQ ID NO: 23357 - DNA, 21 bp, synthetic construct
  misc_feature 1..21: note = Synthetic Construct
  source 1..21: mol_type = other DNA
tccccacgatggcagtgagtt

SEQ ID NO: 23358 - DNA, 22 bp, synthetic construct
  misc_feature 1..22: note = Synthetic Construct
  source 1..22: mol_type = other DNA
tggagcaatatggtgcactgtt

SEQ ID NO: 23359 - DNA, 24 bp, synthetic construct
  misc_feature 1..24: note = Synthetic Construct
  source 1..24: mol_type = other DNA
cactctgtcaagttttgccgtctt

SEQ ID NO: 23360 - DNA, 22 bp, synthetic construct
  misc_feature 1..22: note = Synthetic Construct
  source 1..22: mol_type = other DNA
gcaggcatgacagactttcctt

SEQ ID NO: 23361 - DNA, 23 bp, synthetic construct
  misc_feature 1..23: note = Synthetic Construct
  source 1..23: mol_type = other DNA
gcgttccccatggcatgtctaaa

SEQ ID NO: 23362 - DNA, 24 bp, synthetic construct
  misc_feature 1..24: note = Synthetic Construct
  source 1..24: mol_type = other DNA
ttggagtggacgtcttcctatttc

SEQ ID NO: 23363 - DNA, 20 bp, synthetic construct
  misc_feature 1..20: note = Synthetic Construct
  source 1..20: mol_type = other DNA
cagggctccctcctccattt

SEQ ID NO: 23364 - DNA, 26 bp, synthetic construct
  misc_feature 1..26: note = Synthetic Construct
  source 1..26: mol_type = other DNA
cagcactgagttcattgcctcaaaaa

SEQ ID NO: 23365 - DNA, 23 bp, synthetic construct
  misc_feature 1..23: note = Synthetic Construct
  source 1..23: mol_type = other DNA
gccataggagagaccctgaatct

SEQ ID NO: 23366 - DNA, 22 bp, synthetic construct
  misc_feature 1..22: note = Synthetic Construct
  source 1..22: mol_type = other DNA
gactgcaacagaggctgaccta

SEQ ID NO: 23367 - DNA, 18 bp, synthetic construct
  misc_feature 1..18: note = Synthetic Construct
  source 1..18: mol_type = other DNA
tgccctgggtggtcttgt

SEQ ID NO: 23368 - DNA, 25 bp, synthetic construct
  misc_feature 1..25: note = Synthetic Construct
  source 1..25: mol_type = other DNA
cagcagagacctgatagccctatgt

SEQ ID NO: 23369 - DNA, 23 bp, synthetic construct
  misc_feature 1..23: note = Synthetic Construct
  source 1..23: mol_type = other DNA
gcaacaggttttgtcctctggtt

SEQ ID NO: 23370 - DNA, 22 bp, synthetic construct
  misc_feature 1..22: note = Synthetic Construct
  source 1..22: mol_type = other DNA
cctcgtcctcctcccatccaaa

SEQ ID NO: 23371 - DNA, 19 bp, synthetic construct
  misc_feature 1..19: note = Synthetic Construct
  source 1..19: mol_type = other DNA
ctggaaacggccccagagt

SEQ ID NO: 23372 - DNA, 22 bp, synthetic construct
  misc_feature 1..22: note = Synthetic Construct
  source 1..22: mol_type = other DNA
tggtggggacattttcctgaag

SEQ ID NO: 23373 - DNA, 20 bp, synthetic construct
  misc_feature 1..20: note = Synthetic Construct
  source 1..20: mol_type = other DNA
ctggttgcagtgtggagcat

SEQ ID NO: 23374 - DNA, 21 bp, synthetic construct
  misc_feature 1..21: note = Synthetic Construct
  source 1..21: mol_type = other DNA
tcagatgtcaaccccgcctat

SEQ ID NO: 23375 - DNA, 20 bp, synthetic construct
  misc_feature 1..20: note = Synthetic Construct
  source 1..20: mol_type = other DNA
cggcgactactggaggcttt

SEQ ID NO: 23376 - DNA, 22 bp, synthetic construct
  misc_feature 1..22: note = Synthetic Construct
  source 1..22: mol_type = other DNA
aggtagcccagcagttctccat

SEQ ID NO: 23377 - DNA, 20 bp, synthetic construct
  misc_feature 1..20: note = Synthetic Construct
  source 1..20: mol_type = other DNA
tggcctgcctcacttgctta

SEQ ID NO: 23378 - DNA, 21 bp, synthetic construct
  misc_feature 1..21: note = Synthetic Construct
  source 1..21: mol_type = other DNA
tccggaagacacgagaggaaa

SEQ ID NO: 23379 - DNA, 23 bp, synthetic construct
  misc_feature 1..23: note = Synthetic Construct
  source 1..23: mol_type = other DNA
acatgggttttgagtcagccatt

SEQ ID NO: 23380 - DNA, 25 bp, synthetic construct
  misc_feature 1..25: note = Synthetic Construct
  source 1..25: mol_type = other DNA
gaaccttggctctttgcaagtcatc

SEQ ID NO: 23381 - DNA, 20 bp, synthetic construct
  misc_feature 1..20: note = Synthetic Construct
  source 1..20: mol_type = other DNA
tgactgactgggccttcaga

SEQ ID NO: 23382 - DNA, 25 bp, synthetic construct
  misc_feature 1..25: note = Synthetic Construct
  source 1..25: mol_type = other DNA
ggcaaggcagccaataaaggatgta

SEQ ID NO: 23383 - DNA, 21 bp, synthetic construct
  misc_feature 1..21: note = Synthetic Construct
  source 1..21: mol_type = other DNA
gggcctgttgggcttgttttg

SEQ ID NO: 23384 - DNA, 24 bp, synthetic construct
  misc_feature 1..24: note = Synthetic Construct
  source 1..24: mol_type = other DNA
caaagtggtgagttccttgggttt

SEQ ID NO: 23385 - DNA, 20 bp, synthetic construct
  misc_feature 1..20: note = Synthetic Construct
  source 1..20: mol_type = other DNA
ttgccctcccagtggcttca

SEQ ID NO: 23386 - DNA, 19 bp, synthetic construct
  misc_feature 1..19: note = Synthetic Construct
  source 1..19: mol_type = other DNA
ggtgctctagggcctcaca

SEQ ID NO: 23387 - DNA, 24 bp, synthetic construct
  misc_feature 1..24: note = Synthetic Construct
  source 1..24: mol_type = other DNA
cagtgaggaacgtattcagcctat

SEQ ID NO: 23388 - DNA, 19 bp, synthetic construct
  misc_feature 1..19: note = Synthetic Construct
  source 1..19: mol_type = other DNA
ggcatcgctccacccaagt

SEQ ID NO: 23389 - DNA, 23 bp, synthetic construct
  misc_feature 1..23: note = Synthetic Construct
  source 1..23: mol_type = other DNA
aaagaaagaggccatgtggtaca

SEQ ID NO: 23390 - DNA, 19 bp, synthetic construct
  misc_feature 1..19: note = Synthetic Construct
  source 1..19: mol_type = other DNA
tctggccacctggcgattt

SEQ ID NO: 23391 - DNA, 24 bp, synthetic construct
  misc_feature 1..24: note = Synthetic Construct
  source 1..24: mol_type = other DNA
gacatgacccacaaagccttcctt

SEQ ID NO: 23392 - DNA, 20 bp, synthetic construct
  misc_feature 1..20: note = Synthetic Construct
  source 1..20: mol_type = other DNA
tgcctgacctccatggaaac

SEQ ID NO: 23393 - DNA, 21 bp, synthetic construct
  misc_feature 1..21: note = Synthetic Construct
  source 1..21: mol_type = other DNA
gcccatgtgaggcatagactt

SEQ ID NO: 23394 - DNA, 20 bp, synthetic construct
  misc_feature 1..20: note = Synthetic Construct
  source 1..20: mol_type = other DNA
agaaagccgaggctcagaga

SEQ ID NO: 23395 - DNA, 24 bp, synthetic construct
  misc_feature 1..24: note = Synthetic Construct
  source 1..24: mol_type = other DNA
aggcaagctagctgatatcctttc

SEQ ID NO: 23396 - DNA, 22 bp, synthetic construct
  misc_feature 1..22: note = Synthetic Construct
  source 1..22: mol_type = other DNA
ggtggagtgacccaaaccttca

SEQ ID NO: 23397 - DNA, 27 bp, synthetic construct
  misc_feature 1..27: note = Synthetic Construct
  source 1..27: mol_type = other DNA
ggcatgctttcaatatatcctcctagt

SEQ ID NO: 23398 - DNA, 20 bp, synthetic construct
  misc_feature 1..20: note = Synthetic Construct
  source 1..20: mol_type = other DNA
ccgggaaacctgggaagtga

SEQ ID NO: 23399 - DNA, 22 bp, synthetic construct
  misc_feature 1..22: note = Synthetic Construct
  source 1..22: mol_type = other DNA
cctggtgagtaacggagagtca

SEQ ID NO: 23400 - DNA, 24 bp, synthetic construct
  misc_feature 1..24: note = Synthetic Construct
  source 1..24: mol_type = other DNA
caggcatgggcagtttcttttatc

SEQ ID NO: 23401 - DNA, 22 bp, synthetic construct
  misc_feature 1..22: note = Synthetic Construct
  source 1..22: mol_type = other DNA
accctctgcttctggtgtcagt

SEQ ID NO: 23402 - DNA, 20 bp, synthetic construct
  misc_feature 1..20: note = Synthetic Construct
  source 1..20: mol_type = other DNA
acgcctacagtgagcggaaa

SEQ ID NO: 23403 - DNA, 21 bp, synthetic construct
  misc_feature 1..21: note = Synthetic Construct
  source 1..21: mol_type = other DNA
ggggcatggaatcaggaactt

SEQ ID NO: 23404 - DNA, 22 bp, synthetic construct
  misc_feature 1..22: note = Synthetic Construct
  source 1..22: mol_type = other DNA
ttagagtgggagcggagacctt

SEQ ID NO: 23405 - DNA, 24 bp, synthetic construct
  misc_feature 1..24: note = Synthetic Construct
  source 1..24: mol_type = other DNA
gcaatgatcagtggcgttttcaga

SEQ ID NO: 23406 - DNA, 20 bp, synthetic construct
  misc_feature 1..20: note = Synthetic Construct
  source 1..20: mol_type = other DNA
accacagggttgggcaatga

SEQ ID NO: 23407 - DNA, 19 bp, synthetic construct
  misc_feature 1..19: note = Synthetic Construct
  source 1..19: mol_type = other DNA
acggtgcccggccatttct

SEQ ID NO: 23408 - DNA, 23 bp, synthetic construct
  misc_feature 1..23: note = Synthetic Construct
  source 1..23: mol_type = other DNA
gcatgtgcctgttttctaaccat

SEQ ID NO: 23409 - DNA, 24 bp, synthetic construct
  misc_feature 1..24: note = Synthetic Construct
  source 1..24: mol_type = other DNA
gcccaccttatacctcgctcaact

SEQ ID NO: 23410 - DNA, 22 bp, synthetic construct
  misc_feature 1..22: note = Synthetic Construct
  source 1..22: mol_type = other DNA
cctcctgccaccacatctatca

SEQ ID NO: 23411 - DNA, 21 bp, synthetic construct
  misc_feature 1..21: note = Synthetic Construct
  source 1..21: mol_type = other DNA
tggtgacggaggatggcagaa

SEQ ID NO: 23412 - DNA, 22 bp, synthetic construct
  misc_feature 1..22: note = Synthetic Construct
  source 1..22: mol_type = other DNA
tgcatcccacctgtctatgact

SEQ ID NO: 23413 - DNA, 21 bp, synthetic construct
  misc_feature 1..21: note = Synthetic Construct
  source 1..21: mol_type = other DNA
agccagagttctgccttcttg

SEQ ID NO: 23414 - DNA, 20 bp, synthetic construct
  misc_feature 1..20: note = Synthetic Construct
  source 1..20: mol_type = other DNA
aggctgcgagtttggcagat

SEQ ID NO: 23415 - DNA, 18 bp, synthetic construct
  misc_feature 1..18: note = Synthetic Construct
  source 1..18: mol_type = other DNA
gtccctgctggtgcactt

SEQ ID NO: 23416 - DNA, 23 bp, synthetic construct
  misc_feature 1..23: note = Synthetic Construct
  source 1..23: mol_type = other DNA
gcactatgcagcaggaacctaag

SEQ ID NO: 23417 - DNA, 20 bp, synthetic construct
  misc_feature 1..20: note = Synthetic Construct
  source 1..20: mol_type = other DNA
acaggcctggttggctttgt

SEQ ID NO: 23418 - DNA, 26 bp, synthetic construct
  misc_feature 1..26: note = Synthetic Construct
  source 1..26: mol_type = other DNA
ccaggtcagggtatattatggaaaca

SEQ ID NO: 23419 - DNA, 20 bp, synthetic construct
  misc_feature 1..20: note = Synthetic Construct
  source 1..20: mol_type = other DNA
ccgtggccactcattcaaga

SEQ ID NO: 23420 - DNA, 24 bp, synthetic construct
  misc_feature 1..24: note = Synthetic Construct
  source 1..24: mol_type = other DNA
gggctcacttggatggtcctaaag

SEQ ID NO: 23421 - DNA, 24 bp, synthetic construct
  misc_feature 1..24: note = Synthetic Construct
  source 1..24: mol_type = other DNA
ccaagtgtgacagtgtctttgttt

SEQ ID NO: 23422 - DNA, 26 bp, synthetic construct
  misc_feature 1..26: note = Synthetic Construct
  source 1..26: mol_type = other DNA
cgatacaagtggatggctcttcattc

SEQ ID NO: 23423 - DNA, 25 bp, synthetic construct
  misc_feature 1..25: note = Synthetic Construct
  source 1..25: mol_type = other DNA
catctcaccagatcttgagtgctaa

SEQ ID NO: 23424 - DNA, 20 bp, synthetic construct
  misc_feature 1..20: note = Synthetic Construct
  source 1..20: mol_type = other DNA
aggtggagctgccatcttga

SEQ ID NO: 23425 - DNA, 24 bp, synthetic construct
  misc_feature 1..24: note = Synthetic Construct
  source 1..24: mol_type = other DNA
agacacagttagccagacctattg

SEQ ID NO: 23426 - DNA, 26 bp, synthetic construct
  misc_feature 1..26: note = Synthetic Construct
  source 1..26: mol_type = other DNA
gacatgtcgggaggcttaatctgaac

SEQ ID NO: 23427 - DNA, 23 bp, synthetic construct
  misc_feature 1..23: note = Synthetic Construct
  source 1..23: mol_type = other DNA
cctgcctaaaggtttgcagacaa

SEQ ID NO: 23428 - DNA, 24 bp, synthetic construct
  misc_feature 1..24: note = Synthetic Construct
  source 1..24: mol_type = other DNA
ccacccagatggacctccctttta

SEQ ID NO: 23429 - DNA, 20 bp, synthetic construct
  misc_feature 1..20: note = Synthetic Construct
  source 1..20: mol_type = other DNA
tgcctgtgtgactgccctta

SEQ ID NO: 23430 - DNA, 23 bp, synthetic construct
  misc_feature 1..23: note = Synthetic Construct
  source 1..23: mol_type = other DNA
gaattctgccgtctggttctttc

SEQ ID NO: 23431 - DNA, 22 bp, synthetic construct
  misc_feature 1..22: note = Synthetic Construct
  source 1..22: mol_type = other DNA
acccaatgtcctttgccagtag

SEQ ID NO: 23432 - DNA, 20 bp, synthetic construct
  misc_feature 1..20: note = Synthetic Construct
  source 1..20: mol_type = other DNA
ggctgcagtacacccagact

SEQ ID NO: 23433 - DNA, 28 bp, synthetic construct
  misc_feature 1..28: note = Synthetic Construct
  source 1..28: mol_type = other DNA
gtctttggggtaatcacccacagttaaa

SEQ ID NO: 23434 - DNA, 22 bp, synthetic construct
  misc_feature 1..22: note = Synthetic Construct
  source 1..22: mol_type = other DNA
cacacaccttttggcccttttg

SEQ ID NO: 23435 - DNA, 23 bp, synthetic construct
  misc_feature 1..23: note = Synthetic Construct
  source 1..23: mol_type = other DNA
tctggaggggtaaaaagctgact

SEQ ID NO: 23436 - DNA, 24 bp, synthetic construct
  misc_feature 1..24: note = Synthetic Construct
  source 1..24: mol_type = other DNA
gtaggaccaaaacatggagactgt

SEQ ID NO: 23437 - DNA, 22 bp, synthetic construct
  misc_feature 1..22: note = Synthetic Construct
  source 1..22: mol_type = other DNA
cactaagtgcccgagtcaggtt

SEQ ID NO: 23438 - DNA, 21 bp, synthetic construct
  misc_feature 1..21: note = Synthetic Construct
  source 1..21: mol_type = other DNA
caaccattggtgcggcaaaac

SEQ ID NO: 23439 - DNA, 23 bp, synthetic construct
  misc_feature 1..23: note = Synthetic Construct
  source 1..23: mol_type = other DNA
gacagcacatgctatccctactt

SEQ ID NO: 23440 - DNA, 23 bp, synthetic construct
  misc_feature 1..23: note = Synthetic Construct
  source 1..23: mol_type = other DNA
agaaaccagactgtgagggaaga

SEQ ID NO: 23441 - DNA, 20 bp, synthetic construct
  misc_feature 1..20: note = Synthetic Construct
  source 1..20: mol_type = other DNA
aggggaagggtccctcattt

SEQ ID NO: 23442 - DNA, 22 bp, synthetic construct
  misc_feature 1..22: note = Synthetic Construct
  source 1..22: mol_type = other DNA
accttaggtaccagctcagaca

SEQ ID NO: 23443 - DNA, 20 bp, synthetic construct
  misc_feature 1..20: note = Synthetic Construct
  source 1..20: mol_type = other DNA
agggctcttgagaccagcaa

SEQ ID NO: 23444 - DNA, 22 bp, synthetic construct
  misc_feature 1..22: note = Synthetic Construct
  source 1..22: mol_type = other DNA
gtgtggattgttgcaggaggaa

SEQ ID NO: 23445 - DNA, 24 bp, synthetic construct
  misc_feature 1..24: note = Synthetic Construct
  source 1..24: mol_type = other DNA
cagcaaagactggattcctactca

SEQ ID NO: 23446 - DNA, 25 bp, synthetic construct
  misc_feature 1..25: note = Synthetic Construct
  source 1..25: mol_type = other DNA
ggcatcattgcattcaaagacattc

SEQ ID NO: 23447 - DNA, 20 bp, synthetic construct
  misc_feature 1..20: note = Synthetic Construct
  source 1..20: mol_type = other DNA
cacccatggccacctttctt

SEQ ID NO: 23448 - DNA, 25 bp, synthetic construct
  misc_feature 1..25: note = Synthetic Construct
  source 1..25: mol_type = other DNA
cctctctgatcatttggcaggaaga

SEQ ID NO: 23449 - DNA, 25 bp, synthetic construct
  misc_feature 1..25: note = Synthetic Construct
  source 1..25: mol_type = other DNA
tcattgtaactagggactccacgta

SEQ ID NO: 23450 - DNA, 25 bp, synthetic construct
  misc_feature 1..25: note = Synthetic Construct
  source 1..25: mol_type = other DNA
catattaccctgggaatcacagcaa

SEQ ID NO: 23451 - DNA, 21 bp, synthetic construct
  misc_feature 1..21: note = Synthetic Construct
  source 1..21: mol_type = other DNA
ttggcctgccacatcccctat

SEQ ID NO: 23452 - DNA, 21 bp, synthetic construct
  misc_feature 1..21: note = Synthetic Construct
  source 1..21: mol_type = other DNA
cccaaatggcagaggctgtgt

SEQ ID NO: 23453 - DNA, 24 bp, synthetic construct
  misc_feature 1..24: note = Synthetic Construct
  source 1..24: mol_type = other DNA
cctgattcccttcagttctgttct

SEQ ID NO: 23454 - DNA, 26 bp, synthetic construct
  misc_feature 1..26: note = Synthetic Construct
  source 1..26: mol_type = other DNA
tgcactaatgtcttagaggagctttc

SEQ ID NO: 23455 - DNA, 22 bp, synthetic construct
  misc_feature 1..22: note = Synthetic Construct
  source 1..22: mol_type = other DNA
caaggccacacaggatgtgtct

SEQ ID NO: 23456 - DNA, 23 bp, synthetic construct
  misc_feature 1..23: note = Synthetic Construct
  source 1..23: mol_type = other DNA
gggtccagggtataggtggaaga

SEQ ID NO: 23457 - DNA, 22 bp, synthetic construct
  misc_feature 1..22: note = Synthetic Construct
  source 1..22: mol_type = other DNA
gcgcctctggaaaggtgagatt

SEQ ID NO: 23458 - DNA, 27 bp, synthetic construct
  misc_feature 1..27: note = Synthetic Construct
  source 1..27: mol_type = other DNA
ggcctggtgtaaatttctacctacata

SEQ ID NO: 23459 - DNA, 23 bp, synthetic construct
  misc_feature 1..23: note = Synthetic Construct
  source 1..23: mol_type = other DNA
tgagtgaaatgcaaaggctgcta

SEQ ID NO: 23460 - DNA, 23 bp, synthetic construct
  misc_feature 1..23: note = Synthetic Construct
  source 1..23: mol_type = other DNA
cacctggatgattgccattgctt

SEQ ID NO: 23461 - DNA, 23 bp, synthetic construct
  misc_feature 1..23: note = Synthetic Construct
  source 1..23: mol_type = other DNA
ggtcagtgacagatccaggacta

SEQ ID NO: 23462 - DNA, 22 bp, synthetic construct
  misc_feature 1..22: note = Synthetic Construct
  source 1..22: mol_type = other DNA
tttcaggccctagctccaggat

SEQ ID NO: 23463 - DNA, 23 bp, synthetic construct
  misc_feature 1..23: note = Synthetic Construct
  source 1..23: mol_type = other DNA
cagcctctttcctagggttgtgt

SEQ ID NO: 23464 - DNA, 25 bp, synthetic construct
  misc_feature 1..25: note = Synthetic Construct
  source 1..25: mol_type = other DNA
ggcagttattgcagcaaggaaatct

SEQ ID NO: 23465 - DNA, 20 bp, synthetic construct
  misc_feature 1..20: note = Synthetic Construct
  source 1..20: mol_type = other DNA
gccaccctaagtgctcatgt

SEQ ID NO: 23466 - DNA, 23 bp, synthetic construct
  misc_feature 1..23: note = Synthetic Construct
  source 1..23: mol_type = other DNA
caggacaaggtgctcagagtttc

SEQ ID NO: 23467 - DNA, 20 bp, synthetic construct
  misc_feature 1..20: note = Synthetic Construct
  source 1..20: mol_type = other DNA
aagatggaggccggcagttc

SEQ ID NO: 23468 - DNA, 20 bp, synthetic construct
  misc_feature 1..20: note = Synthetic Construct
  source 1..20: mol_type = other DNA
gttgaggctgaagcccatga

SEQ ID NO: 23469 - DNA, 24 bp, synthetic construct
  misc_feature 1..24: note = Synthetic Construct
  source 1..24: mol_type = other DNA
ccacttagcattgcttgtcatcaa

SEQ ID NO: 23470 - DNA, 20 bp, synthetic construct
  misc_feature 1..20: note = Synthetic Construct
  source 1..20: mol_type = other DNA
tccaggaacaaccgcacagt

SEQ ID NO: 23471 - DNA, 22 bp, synthetic construct
  misc_feature 1..22: note = Synthetic Construct
  source 1..22: mol_type = other DNA
ggagccccaagaaccttggatt

SEQ ID NO: 23472 - DNA, 23 bp, synthetic construct
  misc_feature 1..23: note = Synthetic Construct
  source 1..23: mol_type = other DNA
ggctatcgaagccttcatgtcta

SEQ ID NO: 23473 - DNA, 22 bp, synthetic construct
  misc_feature 1..22: note = Synthetic Construct
  source 1..22: mol_type = other DNA
gtgacaactgtgtgggtgagta

SEQ ID NO: 23474 - DNA, 21 bp, synthetic construct
  misc_feature 1..21: note = Synthetic Construct
  source 1..21: mol_type = other DNA
tgggacacctgagtcatggat

SEQ ID NO: 23475 - DNA, 23 bp, synthetic construct
  misc_feature 1..23: note = Synthetic Construct
  source 1..23: mol_type = other DNA
agtactcattttggcagcacgta

SEQ ID NO: 23476 - DNA, 21 bp, synthetic construct
  misc_feature 1..21: note = Synthetic Construct
  source 1..21: mol_type = other DNA
caggctgctcaaggcattagt

SEQ ID NO: 23477 - DNA, 25 bp, synthetic construct
  misc_feature 1..25: note = Synthetic Construct
  source 1..25: mol_type = other DNA
ggttgttgttcccggactctgaata

SEQ ID NO: 23478 - DNA, 22 bp, synthetic construct
  misc_feature 1..22: note = Synthetic Construct
  source 1..22: mol_type = other DNA
ggattgaggaaggtagcgcttt

SEQ ID NO: 23479 - DNA, 24 bp, synthetic construct
  misc_feature 1..24: note = Synthetic Construct
  source 1..24: mol_type = other DNA
gtggtagtaaagctggtgatgaca

SEQ ID NO: 23480 - DNA, 20 bp, synthetic construct
  misc_feature 1..20: note = Synthetic Construct
  source 1..20: mol_type = other DNA
cccagcaccaatcccatgaa

SEQ ID NO: 23481 - DNA, 26 bp, synthetic construct
  misc_feature 1..26: note = Synthetic Construct
  source 1..26: mol_type = other DNA
caaattacaggcaatgacgcacatag

SEQ ID NO: 23482 - DNA, 23 bp, synthetic construct
  misc_feature 1..23: note = Synthetic Construct
  source 1..23: mol_type = other DNA
tctggccactttaacacctcatt

SEQ ID NO: 23483 - DNA, 24 bp, synthetic construct
  misc_feature 1..24: note = Synthetic Construct
  source 1..24: mol_type = other DNA
gggtcatgcttcgcttgatactgt

SEQ ID NO: 23484 - DNA, 22 bp, synthetic construct
  misc_feature 1..22: note = Synthetic Construct
  source 1..22: mol_type = other DNA
tctctaccccaccccagcaaat

SEQ ID NO: 23485 - DNA, 24 bp, synthetic construct
  misc_feature 1..24: note = Synthetic Construct
  source 1..24: mol_type = other DNA
caccagagccctccattcctaaac

SEQ ID NO: 23486 - DNA, 19 bp, synthetic construct
  misc_feature 1..19: note = Synthetic Construct
  source 1..19: mol_type = other DNA
ggagggcaagggcatctca

SEQ ID NO: 23487 - DNA, 22 bp, synthetic construct
  misc_feature 1..22: note = Synthetic Construct
  source 1..22: mol_type = other DNA
ctcccctgtgcactctttcact

SEQ ID NO: 23488 - DNA, 24 bp, synthetic construct
  misc_feature 1..24: note = Synthetic Construct
  source 1..24: mol_type = other DNA
gtggtagatagacccggctagact

SEQ ID NO: 23489 - DNA, 21 bp, synthetic construct
  misc_feature 1..21: note = Synthetic Construct
  source 1..21: mol_type = other DNA
ggtcctgagcaactgggtaaa

SEQ ID NO: 23490 - DNA, 20 bp, synthetic construct
  misc_feature 1..20: note = Synthetic Construct
  source 1..20: mol_type = other DNA
gaagatgggacaggcgttgt

SEQ ID NO: 23491 - DNA, 22 bp, synthetic construct
  misc_feature 1..22: note = Synthetic Construct
  source 1..22: mol_type = other DNA
gggtaaggtgtgcccttgttct

SEQ ID NO: 23492 - DNA, 20 bp, synthetic construct
  misc_feature 1..20: note = Synthetic Construct
  source 1..20: mol_type = other DNA
caagcggagcacagaactga

SEQ ID NO: 23493 - DNA, 24 bp, synthetic construct
  misc_feature 1..24: note = Synthetic Construct
  source 1..24: mol_type = other DNA
gcaagatcccaacctccaggagaa

SEQ ID NO: 23494 - DNA, 23 bp, synthetic construct
  misc_feature 1..23: note = Synthetic Construct
  source 1..23: mol_type = other DNA
ggagacatcctcgcctgaaccta

SEQ ID NO: 23495 - DNA, 27 bp, synthetic construct
  misc_feature 1..27: note = Synthetic Construct
  source 1..27: mol_type = other DNA
ggcctgagctaagctttttctttgcta

SEQ ID NO: 23496 - DNA, 19 bp, synthetic construct
  misc_feature 1..19: note = Synthetic Construct
  source 1..19: mol_type = other DNA
cgccagcattctgctgctt

SEQ ID NO: 23497 - DNA, 19 bp, synthetic construct
  misc_feature 1..19: note = Synthetic Construct
  source 1..19: mol_type = other DNA
acagtggtgcccagtgtga

SEQ ID NO: 23498 - DNA, 25 bp, synthetic construct
  misc_feature 1..25: note = Synthetic Construct
  source 1..25: mol_type = other DNA
gcagaataaacaggttcttgtgtca

SEQ ID NO: 23499 - DNA, 22 bp, synthetic construct
  misc_feature 1..22: note = Synthetic Construct
  source 1..22: mol_type = other DNA
cccaatcagccccagacatttg

SEQ ID NO: 23500 - DNA, 21 bp, synthetic construct
  misc_feature 1..21: note = Synthetic Construct
  source 1..21: mol_type = other DNA
tcgctctctctccacctctgt

SEQ ID NO: 23501 - DNA, 20 bp, synthetic construct
  misc_feature 1..20: note = Synthetic Construct
  source 1..20: mol_type = other DNA
gtgtgtggcaaggtgtgtct

SEQ ID NO: 23502 - DNA, 21 bp, synthetic construct
  misc_feature 1..21: note = Synthetic Construct
  source 1..21: mol_type = other DNA
aggtgggattggaggttggaa

SEQ ID NO: 23503 - DNA, 20 bp, synthetic construct
  misc_feature 1..20: note = Synthetic Construct
  source 1..20: mol_type = other DNA
caggcagagaggaagccaaa

SEQ ID NO: 23504 - DNA, 19 bp, synthetic construct
  misc_feature 1..19: note = Synthetic Construct
  source 1..19: mol_type = other DNA
cctgcctccccaacagtga

SEQ ID NO: 23505 - DNA, 23 bp, synthetic construct
  misc_feature 1..23: note = Synthetic Construct
  source 1..23: mol_type = other DNA
tcccttaacaagtcacccacttc

SEQ ID NO: 23506 - DNA, 21 bp, synthetic construct
  misc_feature 1..21: note = Synthetic Construct
  source 1..21: mol_type = other DNA
cccctcagcctgtatgtctct

SEQ ID NO: 23507 - DNA, 23 bp, synthetic construct
  misc_feature 1..23: note = Synthetic Construct
  source 1..23: mol_type = other DNA
cccttcctaagtgccagagaaac

SEQ ID NO: 23508 - DNA, 20 bp, synthetic construct
  misc_feature 1..20: note = Synthetic Construct
  source 1..20: mol_type = other DNA
aacctcactgttgcgtgagt

SEQ ID NO: 23509 - DNA, 22 bp, synthetic construct
  misc_feature 1..22: note = Synthetic Construct
  source 1..22: mol_type = other DNA
ccctgctcccacaaactcttta

SEQ ID NO: 23510 - DNA, 27 bp, synthetic construct
  misc_feature 1..27: note = Synthetic Construct
  source 1..27: mol_type = other DNA
cagagtaggattagccacttcagtaag

SEQ ID NO: 23511 - DNA, 23 bp, synthetic construct
  misc_feature 1..23: note = Synthetic Construct
  source 1..23: mol_type = other DNA
gctcggagactctgcctctctat

SEQ ID NO: 23512 - DNA, 22 bp, synthetic construct
  misc_feature 1..22: note = Synthetic Construct
  source 1..22: mol_type = other DNA
cctcaatgcaggggcagtctat

SEQ ID NO: 23513 - DNA, 22 bp, synthetic construct
  misc_feature 1..22: note = Synthetic Construct
  source 1..22: mol_type = other DNA
aaaattgtagccccacccatgt

SEQ ID NO: 23514 - DNA, 25 bp, synthetic construct
  misc_feature 1..25: note = Synthetic Construct
  source 1..25: mol_type = other DNA
gggagtttaccgctaagatgttttc

SEQ ID NO: 23515 - DNA, 21 bp, synthetic construct
  misc_feature 1..21: note = Synthetic Construct
  source 1..21: mol_type = other DNA
gcctgaggtccatgactttgt

SEQ ID NO: 23516 - DNA, 20 bp, synthetic construct
  misc_feature 1..20: note = Synthetic Construct
  source 1..20: mol_type = other DNA
aggcccactgtcacatggat

SEQ ID NO: 23517 - DNA, 19 bp, synthetic construct
  misc_feature 1..19: note = Synthetic Construct
  source 1..19: mol_type = other DNA
gcggtaggctgcctgaaca

SEQ ID NO: 23518 - DNA, 20 bp, synthetic construct
  misc_feature 1..20: note = Synthetic Construct
  source 1..20: mol_type = other DNA
tgggttccccgaggctctgt

SEQ ID NO: 23519 - DNA, 25 bp, synthetic construct
  misc_feature 1..25: note = Synthetic Construct
  source 1..25: mol_type = other DNA
catagcactgggatcaagaaagact

SEQ ID NO: 23520 - DNA, 23 bp, synthetic construct
  misc_feature 1..23: note = Synthetic Construct
  source 1..23: mol_type = other DNA
gtctgttcactccaaagcacaag

SEQ ID NO: 23521 - DNA, 22 bp, synthetic construct
  misc_feature 1..22: note = Synthetic Construct
  source 1..22: mol_type = other DNA
agggaccctagaggacaggaaa

SEQ ID NO: 23522 - DNA, 22 bp, synthetic construct
  misc_feature 1..22: note = Synthetic Construct
  source 1..22: mol_type = other DNA
ctgctgttggaccctaaacact

SEQ ID NO: 23523 - DNA, 21 bp, synthetic construct
  misc_feature 1..21: note = Synthetic Construct
  source 1..21: mol_type = other DNA
tcaggctttcctgtccctctt

SEQ ID NO: 23524 - DNA, 25 bp, synthetic construct
  misc_feature 1..25: note = Synthetic Construct
  source 1..25: mol_type = other DNA
ttggatattgtttgtcacccctaca

SEQ ID NO: 23525 - DNA, 19 bp, synthetic construct
  misc_feature 1..19: note = Synthetic Construct
  source 1..19: mol_type = other DNA
ggcccacctcgtcactatg

SEQ ID NO: 23526 - DNA, 22 bp, synthetic construct
  misc_feature 1..22: note = Synthetic Construct
  source 1..22: mol_type = other DNA
gcttacaacgcaacttcacaca

SEQ ID NO: 23527 - DNA, 21 bp, synthetic construct
  misc_feature 1..21: note = Synthetic Construct
  source 1..21: mol_type = other DNA
cccaccctgagccttcacttc

SEQ ID NO: 23528 - DNA, 20 bp, synthetic construct
  misc_feature 1..20: note = Synthetic Construct
  source 1..20: mol_type = other DNA
ttggtggcgcccatgagtct

SEQ ID NO: 23529 - DNA, 21 bp, synthetic construct
  misc_feature 1..21: note = Synthetic Construct
  source 1..21: mol_type = other DNA
ttgaaagcctcgtgccatttg

SEQ ID NO: 23530 - DNA, 24 bp, synthetic construct
  misc_feature 1..24: note = Synthetic Construct
  source 1..24: mol_type = other DNA
tttaggtgggatgtgaatgtgtca

SEQ ID NO: 23531 - DNA, 23 bp, synthetic construct
  misc_feature 1..23: note = Synthetic Construct
  source 1..23: mol_type = other DNA
cacataagggaacaagcgcacaa

SEQ ID NO: 23532 - DNA, 23 bp, synthetic construct
  misc_feature 1..23: note = Synthetic Construct
  source 1..23: mol_type = other DNA
cctccaacctagactggatgtca

SEQ ID NO: 23533 - DNA, 22 bp, synthetic construct
  misc_feature 1..22: note = Synthetic Construct
  source 1..22: mol_type = other DNA
gacttggtcgtgggttttgaga

SEQ ID NO: 23534 - DNA, 22 bp, synthetic construct
  misc_feature 1..22: note = Synthetic Construct
  source 1..22: mol_type = other DNA
tgactgctgacacgggaggaat

SEQ ID NO: 23535 - DNA, 20 bp, synthetic construct
  misc_feature 1..20: note = Synthetic Construct
  source 1..20: mol_type = other DNA
tggtggcgagggtagaagat

SEQ ID NO: 23536 - DNA, 24 bp, synthetic construct
  misc_feature 1..24: note = Synthetic Construct
  source 1..24: mol_type = other DNA
actcacagtaatccaggggaaaag

SEQ ID NO: 23537 - DNA, 24 bp, synthetic construct
  misc_feature 1..24: note = Synthetic Construct
  source 1..24: mol_type = other DNA
ctgcaaaaataccagggaggaact

SEQ ID NO: 23538 - DNA, 22 bp, synthetic construct
  misc_feature 1..22: note = Synthetic Construct
  source 1..22: mol_type = other DNA
actctcacacccttaggccttt

SEQ ID NO: 23539 - DNA, 20 bp, synthetic construct
  misc_feature 1..20: note = Synthetic Construct
  source 1..20: mol_type = other DNA
accgcgccccatcacttact

SEQ ID NO: 23540 - DNA, 22 bp, synthetic construct
  misc_feature 1..22: note = Synthetic Construct
  source 1..22: mol_type = other DNA
ctgaccctgggcaaatgactct

SEQ ID NO: 23541 - DNA, 20 bp, synthetic construct
  misc_feature 1..20: note = Synthetic Construct
  source 1..20: mol_type = other DNA
cgccacggactaatgctgtt

SEQ ID NO: 23542 - DNA, 23 bp, synthetic construct
  misc_feature 1..23: note = Synthetic Construct
  source 1..23: mol_type = other DNA
ttggctttgtatctccagcaact

SEQ ID NO: 23543 - DNA, 23 bp, synthetic construct
  misc_feature 1..23: note = Synthetic Construct
  source 1..23: mol_type = other DNA
catcgctaccgggttatgttttc

SEQ ID NO: 23544 - DNA, 21 bp, synthetic construct
  misc_feature 1..21: note = Synthetic Construct
  source 1..21: mol_type = other DNA
agaggcaaaatccgcacctaa

SEQ ID NO: 23545 - DNA, 22 bp, synthetic construct
  misc_feature 1..22: note = Synthetic Construct
  source 1..22: mol_type = other DNA
ccctgcccttctcactcacaaa

SEQ ID NO: 23546 - DNA, 22 bp, synthetic construct
  misc_feature 1..22: note = Synthetic Construct
  source 1..22: mol_type = other DNA
catgcatgaccctgctcacttt

SEQ ID NO: 23547 - DNA, 24 bp, synthetic construct
  misc_feature 1..24: note = Synthetic Construct
  source 1..24: mol_type = other DNA
ggcctgccttaagttctgctaaag

SEQ ID NO: 23548 - DNA, 23 bp, synthetic construct
  misc_feature 1..23: note = Synthetic Construct
  source 1..23: mol_type = other DNA
ggagttctgcacttgtgatgttc

SEQ ID NO: 23549 - DNA, 21 bp, synthetic construct
  misc_feature 1..21: note = Synthetic Construct
  source 1..21: mol_type = other DNA
gcgtccaaggctgggtaaaga

SEQ ID NO: 23550 - DNA, 20 bp, synthetic construct
  misc_feature 1..20: note = Synthetic Construct
  source 1..20: mol_type = other DNA
ggcagcctgggtatgtcttg

SEQ ID NO: 23551 - DNA, 25 bp, synthetic construct
  misc_feature 1..25: note = Synthetic Construct
  source 1..25: mol_type = other DNA
tcaacttgattgtctccacactgta

SEQ ID NO: 23552 - DNA, 23 bp, synthetic construct
  misc_feature 1..23: note = Synthetic Construct
  source 1..23: mol_type = other DNA
ggccggccatcccagtataattt

SEQ ID NO: 23553 - DNA, 18 bp, synthetic construct
  misc_feature 1..18: note = Synthetic Construct
  source 1..18: mol_type = other DNA
gtgcggggcttgaaggat

SEQ ID NO: 23554 - DNA, 25 bp, synthetic construct
  misc_feature 1..25: note = Synthetic Construct
  source 1..25: mol_type = other DNA
ttgttcctatcgattacccaccaaa

SEQ ID NO: 23555 - DNA, 26 bp, synthetic construct
  misc_feature 1..26: note = Synthetic Construct
  source 1..26: mol_type = other DNA
ctagtaccactttctccttgctcatt

SEQ ID NO: 23556 - DNA, 22 bp, synthetic construct
  misc_feature 1..22: note = Synthetic Construct
  source 1..22: mol_type = other DNA
ctgccagaccacaccaatctca

SEQ ID NO: 23557 - DNA, 19 bp, synthetic construct
  misc_feature 1..19: note = Synthetic Construct
  source 1..19: mol_type = other DNA
ccaggcaggacgcaactca

SEQ ID NO: 23558 - DNA, 23 bp, synthetic construct
  misc_feature 1..23: note = Synthetic Construct
  source 1..23: mol_type = other DNA
tggtatagccactctggcatttt

SEQ ID NO: 23559 - DNA, 24 bp, synthetic construct
  misc_feature 1..24: note = Synthetic Construct
  source 1..24: mol_type = other DNA
ggaggagtgcgtgcagaagtatca

SEQ ID NO: 23560 - DNA, 22 bp, synthetic construct
  misc_feature 1..22: note = Synthetic Construct
  source 1..22: mol_type = other DNA
gcctctgttttctcgggctaag

SEQ ID NO: 23561 - DNA, 22 bp, synthetic construct
  misc_feature 1..22: note = Synthetic Construct
  source 1..22: mol_type = other DNA
ccatctaccctgtgcccagaaa

SEQ ID NO: 23562 - DNA, 19 bp, synthetic construct
  misc_feature 1..19: note = Synthetic Construct
  source 1..19: mol_type = other DNA
gcccacgtcttggccttgt

SEQ ID NO: 23563 - DNA, 22 bp, synthetic construct
  misc_feature 1..22: note = Synthetic Construct
  source 1..22: mol_type = other DNA
tccgcttccacaacccaagaac

SEQ ID NO: 23564 - DNA, 25 bp, synthetic construct
  misc_feature 1..25: note = Synthetic Construct
  source 1..25: mol_type = other DNA
ccactttgccaaattccctttcatc

SEQ ID NO: 23565 - DNA, 19 bp, synthetic construct
  misc_feature 1..19: note = Synthetic Construct
  source 1..19: mol_type = other DNA
acgaggacccgcgatgtct

SEQ ID NO: 23566 - DNA, 21 bp, synthetic construct
  misc_feature 1..21: note = Synthetic Construct
  source 1..21: mol_type = other DNA
cggccagagactcactcagaa

SEQ ID NO: 23567 - DNA, 21 bp, synthetic construct
  misc_feature 1..21: note = Synthetic Construct
  source 1..21: mol_type = other DNA
acccaccaacaccacattgat

SEQ ID NO: 23568 - DNA, 22 bp, synthetic construct
  misc_feature 1..22: note = Synthetic Construct
  source 1..22: mol_type = other DNA
tcccttgagcctcctctgttct

SEQ ID NO: 23569 - DNA, 21 bp, synthetic construct
  misc_feature 1..21: note = Synthetic Construct
  source 1..21: mol_type = other DNA
ggggacagtgggaggatgtca

SEQ ID NO: 23570 - DNA, 21 bp, synthetic construct
  misc_feature 1..21: note = Synthetic Construct
  source 1..21: mol_type = other DNA
actggctagctcccagtgatg

SEQ ID NO: 23571 - DNA, 20 bp, synthetic construct
  misc_feature 1..20: note = Synthetic Construct
  source 1..20: mol_type = other DNA
cgccacctggacaggaaaca

SEQ ID NO: 23572 - DNA, 22 bp, synthetic construct
  misc_feature 1..22: note = Synthetic Construct
  source 1..22: mol_type = other DNA
agcaatcctcaggccaggaaag

SEQ ID NO: 23573 - DNA, 23 bp, synthetic construct
  misc_feature 1..23: note = Synthetic Construct
  source 1..23: mol_type = other DNA
gcctctgttacctttctcccatt

SEQ ID NO: 23574 - DNA, 19 bp, synthetic construct
  misc_feature 1..19: note = Synthetic Construct
  source 1..19: mol_type = other DNA
agctgctgggagtgggaaa

SEQ ID NO: 23575 - DNA, 21 bp, synthetic construct
  misc_feature 1..21: note = Synthetic Construct
  source 1..21: mol_type = other DNA
gcccagtgaaagggcaaaact

SEQ ID NO: 23576 - DNA, 21 bp, synthetic construct
  misc_feature 1..21: note = Synthetic Construct
  source 1..21: mol_type = other DNA
ggtccgtgcagactggacaat

SEQ ID NO: 23577 - DNA, 23 bp, synthetic construct
  misc_feature 1..23: note = Synthetic Construct
  source 1..23: mol_type = other DNA
tccatcacatgctggtgaaatgt

SEQ ID NO: 23578 - DNA, 22 bp, synthetic construct
  misc_feature 1..22: note = Synthetic Construct
  source 1..22: mol_type = other DNA
tctatgctcagggcctaacact

SEQ ID NO: 23579 - DNA, 20 bp, synthetic construct
  misc_feature 1..20: note = Synthetic Construct
  source 1..20: mol_type = other DNA
caccttcccacgttgcctat

SEQ ID NO: 23580 - DNA, 25 bp, synthetic construct
  misc_feature 1..25: note = Synthetic Construct
  source 1..25: mol_type = other DNA
tgagctacccatcagggttattttt

SEQ ID NO: 23581 - DNA, 24 bp, synthetic construct
  misc_feature 1..24: note = Synthetic Construct
  source 1..24: mol_type = other DNA
ccattgagtttcaactggggtaca

SEQ ID NO: 23582 - DNA, 22 bp, synthetic construct
  misc_feature 1..22: note = Synthetic Construct
  source 1..22: mol_type = other DNA
gcctcatcaacgacccgattca

SEQ ID NO: 23583 - DNA, 18 bp, synthetic construct
  misc_feature 1..18: note = Synthetic Construct
  source 1..18: mol_type = other DNA
accaggaccccactggtt

SEQ ID NO: 23584 - DNA, 20 bp, synthetic construct
  misc_feature 1..20: note = Synthetic Construct
  source 1..20: mol_type = other DNA
aggtctcagccctgactgtt

SEQ ID NO: 23585 - DNA, 24 bp, synthetic construct
  misc_feature 1..24: note = Synthetic Construct
  source 1..24: mol_type = other DNA
tggtttaccctgaatccactctga

SEQ ID NO: 23586 - DNA, 22 bp, synthetic construct
  misc_feature 1..22: note = Synthetic Construct
  source 1..22: mol_type = other DNA
accatatgaccgtcaggcttct

SEQ ID NO: 23587 - DNA, 19 bp, synthetic construct
  misc_feature 1..19: note = Synthetic Construct
  source 1..19: mol_type = other DNA
ccaggggttggcgtgaaag

SEQ ID NO: 23588 - DNA, 25 bp, synthetic construct
  misc_feature 1..25: note = Synthetic Construct
  source 1..25: mol_type = other DNA
caaaccaagtgcctggtagatttca

SEQ ID NO: 23589 - DNA, 19 bp, synthetic construct
  misc_feature 1..19: note = Synthetic Construct
  source 1..19: mol_type = other DNA
cctccacctgcccatcagt

SEQ ID NO: 23590 - DNA, 22 bp, synthetic construct
  misc_feature 1..22: note = Synthetic Construct
  source 1..22: mol_type = other DNA
gtagccaggcatgcatttttga

SEQ ID NO: 23591 - DNA, 22 bp, synthetic construct
  misc_feature 1..22: note = Synthetic Construct
  source 1..22: mol_type = other DNA
cccagctgtccaaaggacttca

SEQ ID NO: 23592 - DNA, 18 bp, synthetic construct
  misc_feature 1..18: note = Synthetic Construct
  source 1..18: mol_type = other DNA
ctgtcccgtgcgttccaa

SEQ ID NO: 23593 - DNA, 20 bp, synthetic construct
  misc_feature 1..20: note = Synthetic Construct
  source 1..20: mol_type = other DNA
gccacctccctcccagctaa

SEQ ID NO: 23594 - DNA, 26 bp, synthetic construct
  misc_feature 1..26: note = Synthetic Construct
  source 1..26: mol_type = other DNA
gcactttgcctttgatgcctgaaata

SEQ ID NO: 23595 - DNA, 23 bp, synthetic construct
  misc_feature 1..23: note = Synthetic Construct
  source 1..23: mol_type = other DNA
ccgcacagtagcacctctgtaag

SEQ ID NO: 23596 - DNA, 20 bp, synthetic construct
  misc_feature 1..20: note = Synthetic Construct
  source 1..20: mol_type = other DNA
ggcctcctcctctccccatt

SEQ ID NO: 23597 - DNA, 21 bp, synthetic construct
  misc_feature 1..21: note = Synthetic Construct
  source 1..21: mol_type = other DNA
tcccacccctcgatccccata

SEQ ID NO: 23598 - DNA, 21 bp, synthetic construct
  misc_feature 1..21: note = Synthetic Construct
  source 1..21: mol_type = other DNA
gaaggacatggccatcagcaa

SEQ ID NO: 23599 - DNA, 19 bp, synthetic construct
  misc_feature 1..19: note = Synthetic Construct
  source 1..19: mol_type = other DNA
aggcagagggcggtgtctt

SEQ ID NO: 23600 - DNA, 19 bp, synthetic construct
  misc_feature 1..19: note = Synthetic Construct
  source 1..19: mol_type = other DNA
cgtctgccttcctgggttt

SEQ ID NO: 23601 - DNA, 21 bp, synthetic construct
  misc_feature 1..21: note = Synthetic Construct
  source 1..21: mol_type = other DNA
aggtgaccatgtgaccacaga

SEQ ID NO: 23602 - DNA, 25 bp, synthetic construct
  misc_feature 1..25: note = Synthetic Construct
  source 1..25: mol_type = other DNA
gggtagcttattggggttcagttct

SEQ ID NO: 23603 - DNA, 22 bp, synthetic construct
  misc_feature 1..22: note = Synthetic Construct
  source 1..22: mol_type = other DNA
gccgttattgcaggcacaatct

SEQ ID NO: 23604 - DNA, 20 bp, synthetic construct
  misc_feature 1..20: note = Synthetic Construct
  source 1..20: mol_type = other DNA
aagcaggcaggaaggagaca

SEQ ID NO: 23605 - DNA, 22 bp, synthetic construct
  misc_feature 1..22: note = Synthetic Construct
  source 1..22: mol_type = other DNA
tggaccaactctcacagcagat

SEQ ID NO: 23606 - DNA, 23 bp, synthetic construct
  misc_feature 1..23: note = Synthetic Construct
  source 1..23: mol_type = other DNA
caggccaatggacagtgaagcta

SEQ ID NO: 23607 - DNA, 21 bp, synthetic construct
  misc_feature 1..21: note = Synthetic Construct
  source 1..21: mol_type = other DNA
ggtggcgaaggggtagtgaaa

SEQ ID NO: 23608 - DNA, 20 bp, synthetic construct
  misc_feature 1..20: note = Synthetic Construct
  source 1..20: mol_type = other DNA
acttcccgggcctggcttct

SEQ ID NO: 23609 - DNA, 24 bp, synthetic construct
  misc_feature 1..24: note = Synthetic Construct
  source 1..24: mol_type = other DNA
gctaggaaccttccaggcatttta

SEQ ID NO: 23610 - DNA, 27 bp, synthetic construct
  misc_feature 1..27: note = Synthetic Construct
  source 1..27: mol_type = other DNA
gttctgactttctagtaaccaccgatt

SEQ ID NO: 23611 - DNA, 19 bp, synthetic construct
  misc_feature 1..19: note = Synthetic Construct
  source 1..19: mol_type = other DNA
tccacagccgtgcatctga

SEQ ID NO: 23612 - DNA, 23 bp, synthetic construct
  misc_feature 1..23: note = Synthetic Construct
  source 1..23: mol_type = other DNA
gtgatgccaacttgggcctatga

SEQ ID NO: 23613 - DNA, 22 bp, synthetic construct
  misc_feature 1..22: note = Synthetic Construct
  source 1..22: mol_type = other DNA
gctgaaagctttgctggcttct

SEQ ID NO: 23614 - DNA, 27 bp, synthetic construct
  misc_feature 1..27: note = Synthetic Construct
  source 1..27: mol_type = other DNA
caatgggtaactaggcaagggaattat

SEQ ID NO: 23615 - DNA, 24 bp, synthetic construct
  misc_feature 1..24: note = Synthetic Construct
  source 1..24: mol_type = other DNA
cccggcctccttataatggaaaga

SEQ ID NO: 23616 - DNA, 21 bp, synthetic construct
  misc_feature 1..21: note = Synthetic Construct
  source 1..21: mol_type = other DNA
gccagttctggcgatggctaa

SEQ ID NO: 23617 - DNA, 22 bp, synthetic construct
  misc_feature 1..22: note = Synthetic Construct
  source 1..22: mol_type = other DNA
ttccctaccccttccccagaac

SEQ ID NO: 23618 - DNA, 23 bp, synthetic construct
  misc_feature 1..23: note = Synthetic Construct
  source 1..23: mol_type = other DNA
ggaagaaagccctctcgagacaa

SEQ ID NO: 23619 - DNA, 26 bp, synthetic construct
  misc_feature 1..26: note = Synthetic Construct
  source 1..26: mol_type = other DNA
gaactagccaccttgatgtcatctgt

SEQ ID NO: 23620 - DNA, 21 bp, synthetic construct
  misc_feature 1..21: note = Synthetic Construct
  source 1..21: mol_type = other DNA
tgcccaccagtgagactaaac

SEQ ID NO: 23621 - DNA, 22 bp, synthetic construct
  misc_feature 1..22: note = Synthetic Construct
  source 1..22: mol_type = other DNA
gcaggtgctaagtgtcctgctt

SEQ ID NO: 23622 - DNA, 25 bp, synthetic construct
  misc_feature 1..25: note = Synthetic Construct
  source 1..25: mol_type = other DNA
gagttcctttccctccagtttcttg

SEQ ID NO: 23623 - DNA, 20 bp, synthetic construct
  misc_feature 1..20: note = Synthetic Construct
  source 1..20: mol_type = other DNA
gccagctgaggactctcctt

SEQ ID NO: 23624 - DNA, 22 bp, synthetic construct
  misc_feature 1..22: note = Synthetic Construct
  source 1..22: mol_type = other DNA
cagtgccagtggaatcccagat

SEQ ID NO: 23625 - DNA, 22 bp, synthetic construct
  misc_feature 1..22: note = Synthetic Construct
  source 1..22: mol_type = other DNA
ctcagcctccctgagaacaaac

SEQ ID NO: 23626 - DNA, 20 bp, synthetic construct
  misc_feature 1..20: note = Synthetic Construct
  source 1..20: mol_type = other DNA
gccatgccctttccaacctt

SEQ ID NO: 23627 - DNA, 20 bp, synthetic construct
  misc_feature 1..20: note = Synthetic Construct
  source 1..20: mol_type = other DNA
acagactgcgtgtcctgcaa

SEQ ID NO: 23628 - DNA, 23 bp, synthetic construct
  misc_feature 1..23: note = Synthetic Construct
  source 1..23: mol_type = other DNA
gattacgaacgtagggcacaaac

SEQ ID NO: 23629 - DNA, 23 bp, synthetic construct
  misc_feature 1..23: note = Synthetic Construct
  source 1..23: mol_type = other DNA
cccaggggttcctgaagtgaaaa

SEQ ID NO: 23630 - DNA, 22 bp, synthetic construct
  misc_feature 1..22: note = Synthetic Construct
  source 1..22: mol_type = other DNA
gcccatccccaggagttaggat

SEQ ID NO: 23631 - DNA, 24 bp, synthetic construct
  misc_feature 1..24: note = Synthetic Construct
  source 1..24: mol_type = other DNA
aacttcctcaaacttccactccat

SEQ ID NO: 23632 - DNA, 21 bp, synthetic construct
  misc_feature 1..21: note = Synthetic Construct
  source 1..21: mol_type = other DNA
ggctttgagagcagggttgaa

SEQ ID NO: 23633 - DNA, 20 bp, synthetic construct
  misc_feature 1..20: note = Synthetic Construct
  source 1..20: mol_type = other DNA
ccacgttgggatgtgaggtt

SEQ ID NO: 23634 - DNA, 22 bp, synthetic construct
  misc_feature 1..22: note = Synthetic Construct
  source 1..22: mol_type = other DNA
ctggagccaggaagccaagaaa

SEQ ID NO: 23635 - DNA, 22 bp, synthetic construct
  misc_feature 1..22: note = Synthetic Construct
  source 1..22: mol_type = other DNA
ggatgtctgctgttgcctcttc

SEQ ID NO: 23636 - DNA, 21 bp, synthetic construct
  misc_feature 1..21: note = Synthetic Construct
  source 1..21: mol_type = other DNA
ttccagagggctccacccaaa

SEQ ID NO: 23637 - DNA, 22 bp, synthetic construct
  misc_feature 1..22: note = Synthetic Construct
  source 1..22: mol_type = other DNA
ctcggtctcctcgtacctactt

SEQ ID NO: 23638 - DNA, 22 bp, synthetic construct
  misc_feature 1..22: note = Synthetic Construct
  source 1..22: mol_type = other DNA
acgacccacttcctccttctgt

SEQ ID NO: 23639 - DNA, 25 bp, synthetic construct
  misc_feature 1..25: note = Synthetic Construct
  source 1..25: mol_type = other DNA
ccaagatgctcatccaagaatggaa

SEQ ID NO: 23640 - DNA, 21 bp, synthetic construct
  misc_feature 1..21: note = Synthetic Construct
  source 1..21: mol_type = other DNA
tgaaaaaccctggggagcaaa

SEQ ID NO: 23641 - DNA, 22 bp, synthetic construct
  misc_feature 1..22: note = Synthetic Construct
  source 1..22: mol_type = other DNA
gagagggccaagatgggaacat

SEQ ID NO: 23642 - DNA, 20 bp, synthetic construct
  misc_feature 1..20: note = Synthetic Construct
  source 1..20: mol_type = other DNA
ccccaacacactgcacagaa

SEQ ID NO: 23643 - DNA, 26 bp, synthetic construct
  misc_feature 1..26: note = Synthetic Construct
  source 1..26: mol_type = other DNA
ctgctctgctcaatccataccatttc

SEQ ID NO: 23644 - DNA, 20 bp, synthetic construct
  misc_feature 1..20: note = Synthetic Construct
  source 1..20: mol_type = other DNA
caagggcaagcccagtgtct

SEQ ID NO: 23645 - DNA, 19 bp, synthetic construct
  misc_feature 1..19: note = Synthetic Construct
  source 1..19: mol_type = other DNA
cggggaggccatcactgtt

SEQ ID NO: 23646 - DNA, 21 bp, synthetic construct
  misc_feature 1..21: note = Synthetic Construct
  source 1..21: mol_type = other DNA
gcccatggtcactagctcaaa

SEQ ID NO: 23647 - DNA, 22 bp, synthetic construct
  misc_feature 1..22: note = Synthetic Construct
  source 1..22: mol_type = other DNA
gctcccagatgtttcggatcaa

SEQ ID NO: 23648 - DNA, 20 bp, synthetic construct
  misc_feature 1..20: note = Synthetic Construct
  source 1..20: mol_type = other DNA
tccccaggtgtctgtggaaa

SEQ ID NO: 23649 - DNA, 21 bp, synthetic construct
  misc_feature 1..21: note = Synthetic Construct
  source 1..21: mol_type = other DNA
gttcagcccaacctggaaagt

SEQ ID NO: 23650 - DNA, 26 bp, synthetic construct
  misc_feature 1..26: note = Synthetic Construct
  source 1..26: mol_type = other DNA
gatttttcaaggacctactggacact

SEQ ID NO: 23651 - DNA, 22 bp, synthetic construct
  misc_feature 1..22: note = Synthetic Construct
  source 1..22: mol_type = other DNA
cccaaggcagtggtatttccaa

SEQ ID NO: 23652 - DNA, 21 bp, synthetic construct
  misc_feature 1..21: note = Synthetic Construct
  source 1..21: mol_type = other DNA
agggtggtggcctacaggatt

SEQ ID NO: 23653 - DNA, 20 bp, synthetic construct
  misc_feature 1..20: note = Synthetic Construct
  source 1..20: mol_type = other DNA
tacaacgcgccaggtgtaac

SEQ ID NO: 23654 - DNA, 20 bp, synthetic construct
  misc_feature 1..20: note = Synthetic Construct
  source 1..20: mol_type = other DNA
acagcggcctccttcctttt

SEQ ID NO: 23655 - DNA, 23 bp, synthetic construct
  misc_feature 1..23: note = Synthetic Construct
  source 1..23: mol_type = other DNA
ttgcatggttgaatgcactgtag

SEQ ID NO: 23656 - DNA, 21 bp, synthetic construct
  misc_feature 1..21: note = Synthetic Construct
  source 1..21: mol_type = other DNA
acctcaggatgctgccatttg

SEQ ID NO: 23657 - DNA, 19 bp, synthetic construct
  misc_feature 1..19: note = Synthetic Construct
  source 1..19: mol_type = other DNA
cagcagctggtgggcaaag

SEQ ID NO: 23658 - DNA, 22 bp, synthetic construct
  misc_feature 1..22: note = Synthetic Construct
  source 1..22: mol_type = other DNA
gagccacctgaaaccaccaaag

SEQ ID NO: 23659 - DNA, 20 bp, synthetic construct
  misc_feature 1..20: note = Synthetic Construct
  source 1..20: mol_type = other DNA
gcccttgcggctctacatta

SEQ ID NO: 23660 - DNA, 20 bp, synthetic construct
  misc_feature 1..20: note = Synthetic Construct
  source 1..20: mol_type = other DNA
tgaggcaggcattggacatt

SEQ ID NO: 23661 - DNA, 24 bp, synthetic construct
  misc_feature 1..24: note = Synthetic Construct
  source 1..24: mol_type = other DNA
tcttgctttgcctaacagggtatt

SEQ ID NO: 23662 - DNA, 23 bp, synthetic construct
  misc_feature 1..23: note = Synthetic Construct
  source 1..23: mol_type = other DNA
gcatttttggcccactgaacact

SEQ ID NO: 23663 - DNA, 24 bp, synthetic construct
  misc_feature 1..24: note = Synthetic Construct
  source 1..24: mol_type = other DNA
ggtgccaagctgagaaggtacttg

SEQ ID NO: 23664 - DNA, 20 bp, synthetic construct
  misc_feature 1..20: note = Synthetic Construct
  source 1..20: mol_type = other DNA
gcagaagagcctcacacact

SEQ ID NO: 23665 - DNA, 23 bp, synthetic construct
  misc_feature 1..23: note = Synthetic Construct
  source 1..23: mol_type = other DNA
ggaaatggctggcctgtaacctt

SEQ ID NO: 23666 - DNA, 23 bp, synthetic construct
  misc_feature 1..23: note = Synthetic Construct
  source 1..23: mol_type = other DNA
aatctcctggtcccacccctact

SEQ ID NO: 23667 - DNA, 19 bp, synthetic construct
  misc_feature 1..19: note = Synthetic Construct
  source 1..19: mol_type = other DNA
tggcaccctggctctctct

SEQ ID NO: 23668 - DNA, 21 bp, synthetic construct
  misc_feature 1..21: note = Synthetic Construct
  source 1..21: mol_type = other DNA
agctcagccagtgcttgattt

SEQ ID NO: 23669 - DNA, 18 bp, synthetic construct
  misc_feature 1..18: note = Synthetic Construct
  source 1..18: mol_type = other DNA
aaggggcggcaacattca

SEQ ID NO: 23670 - DNA, 20 bp, synthetic construct
  misc_feature 1..20: note = Synthetic Construct
  source 1..20: mol_type = other DNA
atgtactgtgcccgcgactt

SEQ ID NO: 23671 - DNA, 23 bp, synthetic construct
  misc_feature 1..23: note = Synthetic Construct
  source 1..23: mol_type = other DNA
gccactgacaaattgccgagttt

SEQ ID NO: 23672 - DNA, 23 bp, synthetic construct
  misc_feature 1..23: note = Synthetic Construct
  source 1..23: mol_type = other DNA
gggtagacatggtggacgtggat

SEQ ID NO: 23673 - DNA, 20 bp, synthetic construct
  misc_feature 1..20: note = Synthetic Construct
  source 1..20: mol_type = other DNA
cctcagcagtgccacaaatg

SEQ ID NO: 23674 - DNA, 23 bp, synthetic construct
  misc_feature 1..23: note = Synthetic Construct
  source 1..23: mol_type = other DNA
gctcatggggctgaagatagaca

SEQ ID NO: 23675 - DNA, 21 bp, synthetic construct
  misc_feature 1..21: note = Synthetic Construct
  source 1..21: mol_type = other DNA
aggtctgtggccctagcatgt

SEQ ID NO: 23676 - DNA, 22 bp, synthetic construct
  misc_feature 1..22: note = Synthetic Construct
  source 1..22: mol_type = other DNA
accctggtcattgctggaaaag

SEQ ID NO: 23677 - DNA, 22 bp, synthetic construct
  misc_feature 1..22: note = Synthetic Construct
  source 1..22: mol_type = other DNA
ccaacatcccagccaaatcaag

SEQ ID NO: 23678 - DNA, 21 bp, synthetic construct
  misc_feature 1..21: note = Synthetic Construct
  source 1..21: mol_type = other DNA
ggtgacggtgtcttcacttca

SEQ ID NO: 23679 - DNA, 22 bp, synthetic construct
  misc_feature 1..22: note = Synthetic Construct
  source 1..22: mol_type = other DNA
ggtatcagacagccctgcatct

SEQ ID NO: 23680 - DNA, 20 bp, synthetic construct
  misc_feature 1..20: note = Synthetic Construct
  source 1..20: mol_type = other DNA
agtcgcgtctggtagagcat

SEQ ID NO: 23681 - DNA, 19 bp, synthetic construct
  misc_feature 1..19: note = Synthetic Construct
  source 1..19: mol_type = other DNA
tgctgccgtggctctcaca

SEQ ID NO: 23682 - DNA, 22 bp, synthetic construct
  misc_feature 1..22: note = Synthetic Construct
  source 1..22: mol_type = other DNA
accctcatccagcactccacta

SEQ ID NO: 23683 - DNA, 21 bp, synthetic construct
  misc_feature 1..21: note = Synthetic Construct
  source 1..21: mol_type = other DNA
tgtttcagcctccaacgtgat

SEQ ID NO: 23684 - DNA, 20 bp, synthetic construct
  misc_feature 1..20: note = Synthetic Construct
  source 1..20: mol_type = other DNA
atctccagacgtcggcaatg

SEQ ID NO: 23685 - DNA, 21 bp, synthetic construct
  misc_feature 1..21: note = Synthetic Construct
  source 1..21: mol_type = other DNA
gcagggaagaggcagcattga

SEQ ID NO: 23686 - DNA, 20 bp, synthetic construct
  misc_feature 1..20: note = Synthetic Construct
  source 1..20: mol_type = other DNA
agcgtgtgcagggtaatgaa

SEQ ID NO: 23687 - DNA, 22 bp, synthetic construct
  misc_feature 1..22: note = Synthetic Construct
  source 1..22: mol_type = other DNA
gttctccactgcgtggtgacta

SEQ ID NO: 23688 - DNA, 24 bp, synthetic construct
  misc_feature 1..24: note = Synthetic Construct
  source 1..24: mol_type = other DNA
actgctgatttttctccagaccat

SEQ ID NO: 23689 - DNA, 20 bp, synthetic construct
  misc_feature 1..20: note = Synthetic Construct
  source 1..20: mol_type = other DNA
aatccggttcccacctccat

SEQ ID NO: 23690 - DNA, 23 bp, synthetic construct
  misc_feature 1..23: note = Synthetic Construct
  source 1..23: mol_type = other DNA
gggaggtggtggagtcagaatca

SEQ ID NO: 23691 - DNA, 25 bp, synthetic construct
  misc_feature 1..25: note = Synthetic Construct
  source 1..25: mol_type = other DNA
acacacagctaaaagaaagcagttg

SEQ ID NO: 23692 - DNA, 21 bp, synthetic construct
  misc_feature 1..21: note = Synthetic Construct
  source 1..21: mol_type = other DNA
acctttgtgcctgctgaatct

SEQ ID NO: 23693 - DNA, 20 bp, synthetic construct
  misc_feature 1..20: note = Synthetic Construct
  source 1..20: mol_type = other DNA
gactggctggcaccaagatt

SEQ ID NO: 23694 - DNA, 25 bp, synthetic construct
  misc_feature 1..25: note = Synthetic Construct
  source 1..25: mol_type = other DNA
ccttctacagacattgcaggtcatc

SEQ ID NO: 23695 - DNA, 26 bp, synthetic construct
  misc_feature 1..26: note = Synthetic Construct
  source 1..26: mol_type = other DNA
ggacaatgattttgagctacggtgta

SEQ ID NO: 23696 - DNA, 21 bp, synthetic construct
  misc_feature 1..21: note = Synthetic Construct
  source 1..21: mol_type = other DNA
aacccacagggtcccctaaca

SEQ ID NO: 23697 - DNA, 22 bp, synthetic construct
  misc_feature 1..22: note = Synthetic Construct
  source 1..22: mol_type = other DNA
cactgccaggggaagaaactga

SEQ ID NO: 23698 - DNA, 25 bp, synthetic construct
  misc_feature 1..25: note = Synthetic Construct
  source 1..25: mol_type = other DNA
gtctatgccagttgctagaggaaac

SEQ ID NO: 23699 - DNA, 20 bp, synthetic construct
  misc_feature 1..20: note = Synthetic Construct
  source 1..20: mol_type = other DNA
ggggaccatcagtgccatct

SEQ ID NO: 23700 - DNA, 19 bp, synthetic construct
  misc_feature 1..19: note = Synthetic Construct
  source 1..19: mol_type = other DNA
ccgccaggcttcagacctt

SEQ ID NO: 23701 - DNA, 18 bp, synthetic construct
  misc_feature 1..18: note = Synthetic Construct
  source 1..18: mol_type = other DNA
tgggcctcccctgaacaa

SEQ ID NO: 23702 - DNA, 24 bp, synthetic construct
  misc_feature 1..24: note = Synthetic Construct
  source 1..24: mol_type = other DNA
gaggagtcaaggaatcgaggatga

SEQ ID NO: 23703 - DNA, 25 bp, synthetic construct
  misc_feature 1..25: note = Synthetic Construct
  source 1..25: mol_type = other DNA
ggtaatgtgtagaccccacagttca

SEQ ID NO: 23704 - DNA, 21 bp, synthetic construct
  misc_feature 1..21: note = Synthetic Construct
  source 1..21: mol_type = other DNA
tgaacccacagccccatctca

SEQ ID NO: 23705 - DNA, 20 bp, synthetic construct
  misc_feature 1..20: note = Synthetic Construct
  source 1..20: mol_type = other DNA
acctgcggcaagatctcagt

SEQ ID NO: 23706 - DNA, 20 bp, synthetic construct
  misc_feature 1..20: note = Synthetic Construct
  source 1..20: mol_type = other DNA
tgctgggtccctggatggat

SEQ ID NO: 23707 - DNA, 22 bp, synthetic construct
  misc_feature 1..22: note = Synthetic Construct
  source 1..22: mol_type = other DNA
actctccaccaggcatgcagat

SEQ ID NO: 23708 - DNA, 22 bp, synthetic construct
  misc_feature 1..22: note = Synthetic Construct
  source 1..22: mol_type = other DNA
tctgagagaggctggctacctt

SEQ ID NO: 23709 - DNA, 21 bp, synthetic construct
  misc_feature 1..21: note = Synthetic Construct
  source 1..21: mol_type = other DNA
agcctgaggacttggcagtca

SEQ ID NO: 23710 - DNA, 20 bp, synthetic construct
  misc_feature 1..20: note = Synthetic Construct
  source 1..20: mol_type = other DNA
tcgggcaactgctcctctgt

SEQ ID NO: 23711 - DNA, 20 bp, synthetic construct
  misc_feature 1..20: note = Synthetic Construct
  source 1..20: mol_type = other DNA
gggacaactttggggcttga

SEQ ID NO: 23712 - DNA, 20 bp, synthetic construct
  misc_feature 1..20: note = Synthetic Construct
  source 1..20: mol_type = other DNA
ggccaagctttcagcctttc

SEQ ID NO: 23713 - DNA, 24 bp, synthetic construct
  misc_feature 1..24: note = Synthetic Construct
  source 1..24: mol_type = other DNA
ctggatgagaatggttggcctaat

SEQ ID NO: 23714 - DNA, 19 bp, synthetic construct
  misc_feature 1..19: note = Synthetic Construct
  source 1..19: mol_type = other DNA
agcgagccctgcagcaaga

SEQ ID NO: 23715 - DNA, 22 bp, synthetic construct
  misc_feature 1..22: note = Synthetic Construct
  source 1..22: mol_type = other DNA
cagagcagggctgtcattgtct

SEQ ID NO: 23716 - DNA, 24 bp, synthetic construct
  misc_feature 1..24: note = Synthetic Construct
  source 1..24: mol_type = other DNA
caggaaatccaggggacagaagaa

SEQ ID NO: 23717 - DNA, 22 bp, synthetic construct
  misc_feature 1..22: note = Synthetic Construct
  source 1..22: mol_type = other DNA
ggccaaacacatcagggagcaa

SEQ ID NO: 23718 - DNA, 20 bp, synthetic construct
  misc_feature 1..20: note = Synthetic Construct
  source 1..20: mol_type = other DNA
tggggctgctgggagaggaa

SEQ ID NO: 23719 - DNA, 20 bp, synthetic construct
  misc_feature 1..20: note = Synthetic Construct
  source 1..20: mol_type = other DNA
gggtggcaaccctcagattc

SEQ ID NO: 23720 - DNA, 24 bp, synthetic construct
  misc_feature 1..24: note = Synthetic Construct
  source 1..24: mol_type = other DNA
cttgtttgccagatttacctgtgt

SEQ ID NO: 23721 - DNA, 20 bp, synthetic construct
  misc_feature 1..20: note = Synthetic Construct
  source 1..20: mol_type = other DNA
gcttgtggtcctgggtgtca

SEQ ID NO: 23722 - DNA, 22 bp, synthetic construct
  misc_feature 1..22: note = Synthetic Construct
  source 1..22: mol_type = other DNA
aaggcgaggtcacctgagtaag

SEQ ID NO: 23723 - DNA, 23 bp, synthetic construct
  misc_feature 1..23: note = Synthetic Construct
  source 1..23: mol_type = other DNA
ccagaagaggtgtggcctgaaag

SEQ ID NO: 23724 - DNA, 21 bp, synthetic construct
  misc_feature 1..21: note = Synthetic Construct
  source 1..21: mol_type = other DNA
cagtcagtagagggcgctgtt

SEQ ID NO: 23725 - DNA, 24 bp, synthetic construct
  misc_feature 1..24: note = Synthetic Construct
  source 1..24: mol_type = other DNA
ggatgggaatgggtaaggcacaga

SEQ ID NO: 23726 - DNA, 23 bp, synthetic construct
  misc_feature 1..23: note = Synthetic Construct
  source 1..23: mol_type = other DNA
ggagcttttgactggggttcact

SEQ ID NO: 23727 - DNA, 22 bp, synthetic construct
  misc_feature 1..22: note = Synthetic Construct
  source 1..22: mol_type = other DNA
ccaaggtccctggtctggaagt

SEQ ID NO: 23728 - DNA, 20 bp, synthetic construct
  misc_feature 1..20: note = Synthetic Construct
  source 1..20: mol_type = other DNA
gggcagagcaatagccgaaa

SEQ ID NO: 23729 - DNA, 21 bp, synthetic construct
  misc_feature 1..21: note = Synthetic Construct
  source 1..21: mol_type = other DNA
ggcccacgtggtcagattgtt

SEQ ID NO: 23730 - DNA, 23 bp, synthetic construct
  misc_feature 1..23: note = Synthetic Construct
  source 1..23: mol_type = other DNA
cgagagcctgagcatgtacaaat

SEQ ID NO: 23731 - DNA, 28 bp, synthetic construct
  misc_feature 1..28: note = Synthetic Construct
  source 1..28: mol_type = other DNA
gttatcttctcactgtcctgttccttag

SEQ ID NO: 23732 - DNA, 22 bp, synthetic construct
  misc_feature 1..22: note = Synthetic Construct
  source 1..22: mol_type = other DNA
gcttctgcccagtgctcaagat

SEQ ID NO: 23733 - DNA, 25 bp, synthetic construct
  misc_feature 1..25: note = Synthetic Construct
  source 1..25: mol_type = other DNA
ggctctgtagggcttctagaatgtt

SEQ ID NO: 23734 - DNA, 22 bp, synthetic construct
  misc_feature 1..22: note = Synthetic Construct
  source 1..22: mol_type = other DNA
gggtgtagagcaggatgggtta

SEQ ID NO: 23735 - DNA, 24 bp, synthetic construct
  misc_feature 1..24: note = Synthetic Construct
  source 1..24: mol_type = other DNA
gtccccgaaacccacactgtattc

SEQ ID NO: 23736 - DNA, 21 bp, synthetic construct
  misc_feature 1..21: note = Synthetic Construct
  source 1..21: mol_type = other DNA
cccaaaactgaggtggagctt

SEQ ID NO: 23737 - DNA, 21 bp, synthetic construct
  misc_feature 1..21: note = Synthetic Construct
  source 1..21: mol_type = other DNA
gtgaccagtgctagctgacaa

SEQ ID NO: 23738 - DNA, 22 bp, synthetic construct
  misc_feature 1..22: note = Synthetic Construct
  source 1..22: mol_type = other DNA
ttccggaggtcagatcccaaga

SEQ ID NO: 23739 - DNA, 19 bp, synthetic construct
  misc_feature 1..19: note = Synthetic Construct
  source 1..19: mol_type = other DNA
cagctcatccgcccacaga

SEQ ID NO: 23740 - DNA, 19 bp, synthetic construct
  misc_feature 1..19: note = Synthetic Construct
  source 1..19: mol_type = other DNA
agggagcagcgcgactgaa

SEQ ID NO: 23741 - DNA, 23 bp, synthetic construct
  misc_feature 1..23: note = Synthetic Construct
  source 1..23: mol_type = other DNA
ggcagtggggtccatttgaaaca

SEQ ID NO: 23742 - DNA, 21 bp, synthetic construct
  misc_feature 1..21: note = Synthetic Construct
  source 1..21: mol_type = other DNA
tctccagaagcctcgccttga

SEQ ID NO: 23743 - DNA, 23 bp, synthetic construct
  misc_feature 1..23: note = Synthetic Construct
  source 1..23: mol_type = other DNA
gccgcatgtctctacttcttctt

SEQ ID NO: 23744 - DNA, 20 bp, synthetic construct
  misc_feature 1..20: note = Synthetic Construct
  source 1..20: mol_type = other DNA
aggccgagcagctttagtct

SEQ ID NO: 23745 - DNA, 23 bp, synthetic construct
  misc_feature 1..23: note = Synthetic Construct
  source 1..23: mol_type = other DNA
tcaagatggagcacaacaaccaa

SEQ ID NO: 23746 - DNA, 22 bp, synthetic construct
  misc_feature 1..22: note = Synthetic Construct
  source 1..22: mol_type = other DNA
gtgttgagcaggcaacttgtga

SEQ ID NO: 23747 - DNA, 21 bp, synthetic construct
  misc_feature 1..21: note = Synthetic Construct
  source 1..21: mol_type = other DNA
actcatcaccttggcatgctt

SEQ ID NO: 23748 - DNA, 25 bp, synthetic construct
  misc_feature 1..25: note = Synthetic Construct
  source 1..25: mol_type = other DNA
tcagccaagaaggtatttgttggaa

SEQ ID NO: 23749 - DNA, 23 bp, synthetic construct
  misc_feature 1..23: note = Synthetic Construct
  source 1..23: mol_type = other DNA
caatgcaggagcttctccacaaa

SEQ ID NO: 23750 - DNA, 22 bp, synthetic construct
  misc_feature 1..22: note = Synthetic Construct
  source 1..22: mol_type = other DNA
cccaccaaagggagccaattct

SEQ ID NO: 23751 - DNA, 21 bp, synthetic construct
  misc_feature 1..21: note = Synthetic Construct
  source 1..21: mol_type = other DNA
ctttgccctggcatctgaaac

SEQ ID NO: 23752 - DNA, 20 bp, synthetic construct
  misc_feature 1..20: note = Synthetic Construct
  source 1..20: mol_type = other DNA
ctctggcacctggaaacact

SEQ ID NO: 23753 - DNA, 24 bp, synthetic construct
  misc_feature 1..24: note = Synthetic Construct
  source 1..24: mol_type = other DNA
tcatccatcctgagccaaatttct

SEQ ID NO: 23754 - DNA, 24 bp, synthetic construct
  misc_feature 1..24: note = Synthetic Construct
  source 1..24: mol_type = other DNA
aaatccagccacaggatgatacaa

SEQ ID NO: 23755 - DNA, 23 bp, synthetic construct
  misc_feature 1..23: note = Synthetic Construct
  source 1..23: mol_type = other DNA
gcaccaaggaagcatcaggtact

SEQ ID NO: 23756 - DNA, 20 bp, synthetic construct
  misc_feature 1..20: note = Synthetic Construct
  source 1..20: mol_type = other DNA
ctgctcaggggccagacttc

SEQ ID NO: 23757 - DNA, 27 bp, synthetic construct
  misc_feature 1..27: note = Synthetic Construct
  source 1..27: mol_type = other DNA
gaagagcagtttcacttatctgtgtca

SEQ ID NO: 23758 - DNA, 23 bp, synthetic construct
  misc_feature 1..23: note = Synthetic Construct
  source 1..23: mol_type = other DNA
gcctccggatctgttgctagtga

SEQ ID NO: 23759 - DNA, 22 bp, synthetic construct
  misc_feature 1..22: note = Synthetic Construct
  source 1..22: mol_type = other DNA
aggggagcctcagcatcctaaa

SEQ ID NO: 23760 - DNA, 19 bp, synthetic construct
  misc_feature 1..19: note = Synthetic Construct
  source 1..19: mol_type = other DNA
cggctgactgcagttgtct

SEQ ID NO: 23761 - DNA, 20 bp, synthetic construct
  misc_feature 1..20: note = Synthetic Construct
  source 1..20: mol_type = other DNA
tcgcttcgggctttcagcaa

SEQ ID NO: 23762 - DNA, 23 bp, synthetic construct
  misc_feature 1..23: note = Synthetic Construct
  source 1..23: mol_type = other DNA
gatcagaactcctggcatgatga

SEQ ID NO: 23763 - DNA, 20 bp, synthetic construct
  misc_feature 1..20: note = Synthetic Construct
  source 1..20: mol_type = other DNA
gagagcccctcaggctcttg

SEQ ID NO: 23764 - DNA, 22 bp, synthetic construct
  misc_feature 1..22: note = Synthetic Construct
  source 1..22: mol_type = other DNA
ccccaggagagctggtgtatga

SEQ ID NO: 23765 - DNA, 21 bp, synthetic construct
  misc_feature 1..21: note = Synthetic Construct
  source 1..21: mol_type = other DNA
actgtcctgttccacccttca

SEQ ID NO: 23766 - DNA, 22 bp, synthetic construct
  misc_feature 1..22: note = Synthetic Construct
  source 1..22: mol_type = other DNA
agggcccctactaccactttag

SEQ ID NO: 23767 - DNA, 24 bp, synthetic construct
  misc_feature 1..24: note = Synthetic Construct
  source 1..24: mol_type = other DNA
gaccagggaagaaagacctctgaa

SEQ ID NO: 23768 - DNA, 22 bp, synthetic construct
  misc_feature 1..22: note = Synthetic Construct
  source 1..22: mol_type = other DNA
tggacactgccgtaaggtgaag

SEQ ID NO: 23769 - DNA, 22 bp, synthetic construct
  misc_feature 1..22: note = Synthetic Construct
  source 1..22: mol_type = other DNA
gcctttccacctcgatgtcttc

SEQ ID NO: 23770 - DNA, 20 bp, synthetic construct
  misc_feature 1..20: note = Synthetic Construct
  source 1..20: mol_type = other DNA
ttcccatggcagatgctgtt

SEQ ID NO: 23771 - DNA, 24 bp, synthetic construct
  misc_feature 1..24: note = Synthetic Construct
  source 1..24: mol_type = other DNA
ggggataaatgtcacaagctggat

SEQ ID NO: 23772 - DNA, 26 bp, synthetic construct
  misc_feature 1..26: note = Synthetic Construct
  source 1..26: mol_type = other DNA
ggcttactatgcctgctaaacattac

SEQ ID NO: 23773 - DNA, 23 bp, synthetic construct
  misc_feature 1..23: note = Synthetic Construct
  source 1..23: mol_type = other DNA
tggtacctgatatgcagccattg

SEQ ID NO: 23774 - DNA, 21 bp, synthetic construct
  misc_feature 1..21: note = Synthetic Construct
  source 1..21: mol_type = other DNA
aggcagggcaaatggtgtatc

SEQ ID NO: 23775 - DNA, 24 bp, synthetic construct
  misc_feature 1..24: note = Synthetic Construct
  source 1..24: mol_type = other DNA
gcagacctactgacccctttggtt

SEQ ID NO: 23776 - DNA, 25 bp, synthetic construct
  misc_feature 1..25: note = Synthetic Construct
  source 1..25: mol_type = other DNA
cagtactgagtcccttgtgtttttg

SEQ ID NO: 23777 - DNA, 21 bp, synthetic construct
  misc_feature 1..21: note = Synthetic Construct
  source 1..21: mol_type = other DNA
catcactcccctctgctgcta

SEQ ID NO: 23778 - DNA, 20 bp, synthetic construct
  misc_feature 1..20: note = Synthetic Construct
  source 1..20: mol_type = other DNA
aggccactgccttctacctt

SEQ ID NO: 23779 - DNA, 18 bp, synthetic construct
  misc_feature 1..18: note = Synthetic Construct
  source 1..18: mol_type = other DNA
acgagggctggcacgaaa

SEQ ID NO: 23780 - DNA, 24 bp, synthetic construct
  misc_feature 1..24: note = Synthetic Construct
  source 1..24: mol_type = other DNA
gacagcttgcagtcaagaccttct

SEQ ID NO: 23781 - DNA, 23 bp, synthetic construct
  misc_feature 1..23: note = Synthetic Construct
  source 1..23: mol_type = other DNA
catggggaatgggtcagtacagt

SEQ ID NO: 23782 - DNA, 24 bp, synthetic construct
  misc_feature 1..24: note = Synthetic Construct
  source 1..24: mol_type = other DNA
gccagtggaggtagtagcatttac

SEQ ID NO: 23783 - DNA, 23 bp, synthetic construct
  misc_feature 1..23: note = Synthetic Construct
  source 1..23: mol_type = other DNA
gttacagcatcaagtgcaacagt

SEQ ID NO: 23784 - DNA, 22 bp, synthetic construct
  misc_feature 1..22: note = Synthetic Construct
  source 1..22: mol_type = other DNA
tgaggatttcctgggacacaga

SEQ ID NO: 23785 - DNA, 20 bp, synthetic construct
  misc_feature 1..20: note = Synthetic Construct
  source 1..20: mol_type = other DNA
agcggctgtgtgcagaatca

SEQ ID NO: 23786 - DNA, 22 bp, synthetic construct
  misc_feature 1..22: note = Synthetic Construct
  source 1..22: mol_type = other DNA
actgcctccaatgacccaggat

SEQ ID NO: 23787 - DNA, 20 bp, synthetic construct
  misc_feature 1..20: note = Synthetic Construct
  source 1..20: mol_type = other DNA
tccctgcgttgcttctcact

SEQ ID NO: 23788 - DNA, 21 bp, synthetic construct
  misc_feature 1..21: note = Synthetic Construct
  source 1..21: mol_type = other DNA
ttggactccagtgctttgcat

SEQ ID NO: 23789 - DNA, 24 bp, synthetic construct
  misc_feature 1..24: note = Synthetic Construct
  source 1..24: mol_type = other DNA
tcttttggcactacgagctatgaa

SEQ ID NO: 23790 - DNA, 23 bp, synthetic construct
  misc_feature 1..23: note = Synthetic Construct
  source 1..23: mol_type = other DNA
ccaaagcacattagcctgtgatg

SEQ ID NO: 23791 - DNA, 19 bp, synthetic construct
  misc_feature 1..19: note = Synthetic Construct
  source 1..19: mol_type = other DNA
tggcccaggtccattctct

SEQ ID NO: 23792 - DNA, 25 bp, synthetic construct
  misc_feature 1..25: note = Synthetic Construct
  source 1..25: mol_type = other DNA
ggaaaacaacttgtccctcactttg

SEQ ID NO: 23793 - DNA, 21 bp, synthetic construct
  misc_feature 1..21: note = Synthetic Construct
  source 1..21: mol_type = other DNA
aggagggtacctccgtctcta

SEQ ID NO: 23794 - DNA, 24 bp, synthetic construct
  misc_feature 1..24: note = Synthetic Construct
  source 1..24: mol_type = other DNA
gtaggcttccaatgccaagaaatg

SEQ ID NO: 23795 - DNA, 23 bp, synthetic construct
  misc_feature 1..23: note = Synthetic Construct
  source 1..23: mol_type = other DNA
ctcaggcatggacacctatcttc

SEQ ID NO: 23796 - DNA, 20 bp, synthetic construct
  misc_feature 1..20: note = Synthetic Construct
  source 1..20: mol_type = other DNA
agctcccactccaactcaga

SEQ ID NO: 23797 - DNA, 20 bp, synthetic construct
  misc_feature 1..20: note = Synthetic Construct
  source 1..20: mol_type = other DNA
gcaggcgagactccccaaac

SEQ ID NO: 23798 - DNA, 20 bp, synthetic construct
  misc_feature 1..20: note = Synthetic Construct
  source 1..20: mol_type = other DNA
tgcactcttgcggaggaaaa

SEQ ID NO: 23799 - DNA, 19 bp, synthetic construct
  misc_feature 1..19: note = Synthetic Construct
  source 1..19: mol_type = other DNA
gctcaggctggcttgaaca

SEQ ID NO: 23800 - DNA, 22 bp, synthetic construct
  misc_feature 1..22: note = Synthetic Construct
  source 1..22: mol_type = other DNA
ggctggacagttggttgctgat

SEQ ID NO: 23801 - DNA, 20 bp, synthetic construct
  misc_feature 1..20: note = Synthetic Construct
  source 1..20: mol_type = other DNA
agatcagcgaccctgaggaa

SEQ ID NO: 23802 - DNA, 20 bp, synthetic construct
  misc_feature 1..20: note = Synthetic Construct
  source 1..20: mol_type = other DNA
aggcaccccttactgtgaga

SEQ ID NO: 23803 - DNA, 23 bp, synthetic construct
  misc_feature 1..23: note = Synthetic Construct
  source 1..23: mol_type = other DNA
ccaggatggagaatgcagacaca

SEQ ID NO: 23804 - DNA, 23 bp, synthetic construct
  misc_feature 1..23: note = Synthetic Construct
  source 1..23: mol_type = other DNA
agaccagaatggatggaggtgta

SEQ ID NO: 23805 - DNA, 22 bp, synthetic construct
  misc_feature 1..22: note = Synthetic Construct
  source 1..22: mol_type = other DNA
cgctacctcctcaagccagaaa

SEQ ID NO: 23806 - DNA, 20 bp, synthetic construct
  misc_feature 1..20: note = Synthetic Construct
  source 1..20: mol_type = other DNA
tggcagccctccaccatttt

SEQ ID NO: 23807 - DNA, 22 bp, synthetic construct
  misc_feature 1..22: note = Synthetic Construct
  source 1..22: mol_type = other DNA
tggcaggtgacaaggtgaattt

SEQ ID NO: 23808 - DNA, 24 bp, synthetic construct
  misc_feature 1..24: note = Synthetic Construct
  source 1..24: mol_type = other DNA
aattccctacggagtgaaacacaa

SEQ ID NO: 23809 - DNA, 25 bp, synthetic construct
  misc_feature 1..25: note = Synthetic Construct
  source 1..25: mol_type = other DNA
tgtgtaagggcaggataaaacaact

SEQ ID NO: 23810 - DNA, 22 bp, synthetic construct
  misc_feature 1..22: note = Synthetic Construct
  source 1..22: mol_type = other DNA
acctcaacctctgtgtgtgttc

SEQ ID NO: 23811 - DNA, 23 bp, synthetic construct
  misc_feature 1..23: note = Synthetic Construct
  source 1..23: mol_type = other DNA
ccacagtgagggtgaacaatcat

SEQ ID NO: 23812 - DNA, 20 bp, synthetic construct
  misc_feature 1..20: note = Synthetic Construct
  source 1..20: mol_type = other DNA
cctcactcccctcctgtctt

SEQ ID NO: 23813 - DNA, 27 bp, synthetic construct
  misc_feature 1..27: note = Synthetic Construct
  source 1..27: mol_type = other DNA
acagctagtctggataaaacctagaga

SEQ ID NO: 23814 - DNA, 25 bp, synthetic construct
  misc_feature 1..25: note = Synthetic Construct
  source 1..25: mol_type = other DNA
cattctctgtacattggagggaact

SEQ ID NO: 23815 - DNA, 23 bp, synthetic construct
  misc_feature 1..23: note = Synthetic Construct
  source 1..23: mol_type = other DNA
ggtgggacgagtcaatcactaag

SEQ ID NO: 23816 - DNA, 19 bp, synthetic construct
  misc_feature 1..19: note = Synthetic Construct
  source 1..19: mol_type = other DNA
caccgtgcccagcctgtaa

SEQ ID NO: 23817 - DNA, 23 bp, synthetic construct
  misc_feature 1..23: note = Synthetic Construct
  source 1..23: mol_type = other DNA
ggcatgttagcgagcattttaca

SEQ ID NO: 23818 - DNA, 23 bp, synthetic construct
  misc_feature 1..23: note = Synthetic Construct
  source 1..23: mol_type = other DNA
gttctcgttcagacagtggttct

SEQ ID NO: 23819 - DNA, 25 bp, synthetic construct
  misc_feature 1..25: note = Synthetic Construct
  source 1..25: mol_type = other DNA
caggaacctcatcctgagttgattt

SEQ ID NO: 23820 - DNA, 21 bp, synthetic construct
  misc_feature 1..21: note = Synthetic Construct
  source 1..21: mol_type = other DNA
tcttgctggaccagagtgtga

SEQ ID NO: 23821 - DNA, 21 bp, synthetic construct
  misc_feature 1..21: note = Synthetic Construct
  source 1..21: mol_type = other DNA
aggcccgagggagtttgtttg

SEQ ID NO: 23822 - DNA, 22 bp, synthetic construct
  misc_feature 1..22: note = Synthetic Construct
  source 1..22: mol_type = other DNA
ggccctcaaagtggtgaagagt

SEQ ID NO: 23823 - DNA, 22 bp, synthetic construct
  misc_feature 1..22: note = Synthetic Construct
  source 1..22: mol_type = other DNA
ccttgcctgagctggtatttct

SEQ ID NO: 23824 - DNA, 21 bp, synthetic construct
  misc_feature 1..21: note = Synthetic Construct
  source 1..21: mol_type = other DNA
tgtggctacaactcaggcaaa

SEQ ID NO: 23825 - DNA, 23 bp, synthetic construct
  misc_feature 1..23: note = Synthetic Construct
  source 1..23: mol_type = other DNA
gacattgcttgacttgggtgtgt

SEQ ID NO: 23826 - DNA, 23 bp, synthetic construct
  misc_feature 1..23: note = Synthetic Construct
  source 1..23: mol_type = other DNA
ctcaccgctcccatgaatgaatc

SEQ ID NO: 23827 - DNA, 21 bp, synthetic construct
  misc_feature 1..21: note = Synthetic Construct
  source 1..21: mol_type = other DNA
tgtgtgctgacaggtttgtga

SEQ ID NO: 23828 - DNA, 22 bp, synthetic construct
  misc_feature 1..22: note = Synthetic Construct
  source 1..22: mol_type = other DNA
gcaacaggagctacttgccaaa

SEQ ID NO: 23829 - DNA, 20 bp, synthetic construct
  misc_feature 1..20: note = Synthetic Construct
  source 1..20: mol_type = other DNA
gcccctgttgttgtgctgat

SEQ ID NO: 23830 - DNA, 22 bp, synthetic construct
  misc_feature 1..22: note = Synthetic Construct
  source 1..22: mol_type = other DNA
ggctgcagcataaggaatgtga

SEQ ID NO: 23831 - DNA, 24 bp, synthetic construct
  misc_feature 1..24: note = Synthetic Construct
  source 1..24: mol_type = other DNA
gcagaccattgcttggaggagata

SEQ ID NO: 23832 - DNA, 22 bp, synthetic construct
  misc_feature 1..22: note = Synthetic Construct
  source 1..22: mol_type = other DNA
ctgagctgggaagactcaaact

SEQ ID NO: 23833 - DNA, 22 bp, synthetic construct
  misc_feature 1..22: note = Synthetic Construct
  source 1..22: mol_type = other DNA
gcaactttaggccagctgagtt

SEQ ID NO: 23834 - DNA, 22 bp, synthetic construct
  misc_feature 1..22: note = Synthetic Construct
  source 1..22: mol_type = other DNA
aagacagggtgggagatgtagt

SEQ ID NO: 23835 - DNA, 22 bp, synthetic construct
  misc_feature 1..22: note = Synthetic Construct
  source 1..22: mol_type = other DNA
cctggatttgggcatacgtgaa

SEQ ID NO: 23836 - DNA, 22 bp, synthetic construct
  misc_feature 1..22: note = Synthetic Construct
  source 1..22: mol_type = other DNA
ttccctgaactcttgctggttt

SEQ ID NO: 23837 - DNA, 23 bp, synthetic construct
  misc_feature 1..23: note = Synthetic Construct
  source 1..23: mol_type = other DNA
gggttgaaactggaggcttgttc

SEQ ID NO: 23838 - DNA, 24 bp, synthetic construct
  misc_feature 1..24: note = Synthetic Construct
  source 1..24: mol_type = other DNA
actctgtaccgggtatttcacact

SEQ ID NO: 23839 - DNA, 23 bp, synthetic construct
  misc_feature 1..23: note = Synthetic Construct
  source 1..23: mol_type = other DNA
gcccatccagacccttctaattg

SEQ ID NO: 23840 - DNA, 19 bp, synthetic construct
  misc_feature 1..19: note = Synthetic Construct
  source 1..19: mol_type = other DNA
cagcctcgtgcagcagttg

SEQ ID NO: 23841 - DNA, 24 bp, synthetic construct
  misc_feature 1..24: note = Synthetic Construct
  source 1..24: mol_type = other DNA
agaaccccatacctgcattacaaa

SEQ ID NO: 23842 - DNA, 21 bp, synthetic construct
  misc_feature 1..21: note = Synthetic Construct
  source 1..21: mol_type = other DNA
tcccctggaacctccaaaact

SEQ ID NO: 23843 - DNA, 19 bp, synthetic construct
  misc_feature 1..19: note = Synthetic Construct
  source 1..19: mol_type = other DNA
gcgggtcgggacatgttga

SEQ ID NO: 23844 - DNA, 20 bp, synthetic construct
  misc_feature 1..20: note = Synthetic Construct
  source 1..20: mol_type = other DNA
aacgccaccccgcctgaaag

SEQ ID NO: 23845 - DNA, 22 bp, synthetic construct
  misc_feature 1..22: note = Synthetic Construct
  source 1..22: mol_type = other DNA
gtttgtggcagagacgctattg

SEQ ID NO: 23846 - DNA, 28 bp, synthetic construct
  misc_feature 1..28: note = Synthetic Construct
  source 1..28: mol_type = other DNA
ctggtgctgtttatagtgagttccaaca

SEQ ID NO: 23847 - DNA, 19 bp, synthetic construct
  misc_feature 1..19: note = Synthetic Construct
  source 1..19: mol_type = other DNA
ggagtgcttacggcagctt

SEQ ID NO: 23848 - DNA, 22 bp, synthetic construct
  misc_feature 1..22: note = Synthetic Construct
  source 1..22: mol_type = other DNA
gagcaaaggaactcctggtgaa

SEQ ID NO: 23849 - DNA, 20 bp, synthetic construct
  misc_feature 1..20: note = Synthetic Construct
  source 1..20: mol_type = other DNA
cagggcaaagccacgaagtt

SEQ ID NO: 23850 - DNA, 22 bp, synthetic construct
  misc_feature 1..22: note = Synthetic Construct
  source 1..22: mol_type = other DNA
tgggcagaaccctcctgctaaa

SEQ ID NO: 23851 - DNA, 21 bp, synthetic construct
  misc_feature 1..21: note = Synthetic Construct
  source 1..21: mol_type = other DNA
gccaggttgctgtggtaaaac

SEQ ID NO: 23852 - DNA, 24 bp, synthetic construct
  misc_feature 1..24: note = Synthetic Construct
  source 1..24: mol_type = other DNA
gcaaaaccacctgaagtagtcgtt

SEQ ID NO: 23853 - DNA, 21 bp, synthetic construct
  misc_feature 1..21: note = Synthetic Construct
  source 1..21: mol_type = other DNA
gcttccagcagcaaacagaga

SEQ ID NO: 23854 - DNA, 26 bp, synthetic construct
  misc_feature 1..26: note = Synthetic Construct
  source 1..26: mol_type = other DNA
cctgctgttcaaggatttctgagcta

SEQ ID NO: 23855 - DNA, 22 bp, synthetic construct
  misc_feature 1..22: note = Synthetic Construct
  source 1..22: mol_type = other DNA
ctccagtgcttactccgtcagt

SEQ ID NO: 23856 - DNA, 22 bp, synthetic construct
  misc_feature 1..22: note = Synthetic Construct
  source 1..22: mol_type = other DNA
ggcacaaccaacagtggaccaa

SEQ ID NO: 23857 - DNA, 22 bp, synthetic construct
  misc_feature 1..22: note = Synthetic Construct
  source 1..22: mol_type = other DNA
agggcaagcttcccattaaact

SEQ ID NO: 23858 - DNA, 20 bp, synthetic construct
  misc_feature 1..20: note = Synthetic Construct
  source 1..20: mol_type = other DNA
agccaccacacctgatccat

SEQ ID NO: 23859 - DNA, 20 bp, synthetic construct
  misc_feature 1..20: note = Synthetic Construct
  source 1..20: mol_type = other DNA
ggggcctgtgtggactgtag

SEQ ID NO: 23860 - DNA, 20 bp, synthetic construct
  misc_feature 1..20: note = Synthetic Construct
  source 1..20: mol_type = other DNA
cctcctggcttgcctggttt

SEQ ID NO: 23861 - DNA, 22 bp, synthetic construct
  misc_feature 1..22: note = Synthetic Construct
  source 1..22: mol_type = other DNA
ctgatccatttgcccacacaca

SEQ ID NO: 23862 - DNA, 23 bp, synthetic construct
  misc_feature 1..23: note = Synthetic Construct
  source 1..23: mol_type = other DNA
gtccttagctggacgcatagttg

SEQ ID NO: 23863 - DNA, 23 bp, synthetic construct
  misc_feature 1..23: note = Synthetic Construct
  source 1..23: mol_type = other DNA
gggacttggaaaaggcctcatag

SEQ ID NO: 23864 - DNA, 23 bp, synthetic construct
  misc_feature 1..23: note = Synthetic Construct
  source 1..23: mol_type = other DNA
ccttggtcctggtaccctgttct

SEQ ID NO: 23865 - DNA, 28 bp, synthetic construct
  misc_feature 1..28: note = Synthetic Construct
  source 1..28: mol_type = other DNA
cctgggagccaaagaagaaagttaatga

SEQ ID NO: 23866 - DNA, 24 bp, synthetic construct
  misc_feature 1..24: note = Synthetic Construct
  source 1..24: mol_type = other DNA
caggtttttgagtagcaggaggaa

SEQ ID NO: 23867 - DNA, 20 bp, synthetic construct
  misc_feature 1..20: note = Synthetic Construct
  source 1..20: mol_type = other DNA
tgggaaccactggaccttca

SEQ ID NO: 23868 - DNA, 20 bp, synthetic construct
  misc_feature 1..20: note = Synthetic Construct
  source 1..20: mol_type = other DNA
gtcacagtgggaagggcatt

SEQ ID NO: 23869 - DNA, 19 bp, synthetic construct
  misc_feature 1..19: note = Synthetic Construct
  source 1..19: mol_type = other DNA
acttcggggcccacgtcta

SEQ ID NO: 23870 - DNA, 22 bp, synthetic construct
  misc_feature 1..22: note = Synthetic Construct
  source 1..22: mol_type = other DNA
ccagccactctgacctctgtga

SEQ ID NO: 23871 - DNA, 20 bp, synthetic construct
  misc_feature 1..20: note = Synthetic Construct
  source 1..20: mol_type = other DNA
tgccattgggcctggttgat

SEQ ID NO: 23872 - DNA, 21 bp, synthetic construct
  misc_feature 1..21: note = Synthetic Construct
  source 1..21: mol_type = other DNA
cagtcctgcctgggatagcaa

SEQ ID NO: 23873 - DNA, 20 bp, synthetic construct
  misc_feature 1..20: note = Synthetic Construct
  source 1..20: mol_type = other DNA
cccctggaaggggacagcat

SEQ ID NO: 23874 - DNA, 18 bp, synthetic construct
  misc_feature 1..18: note = Synthetic Construct
  source 1..18: mol_type = other DNA
gagccgtccttgcacaca

SEQ ID NO: 23875 - DNA, 23 bp, synthetic construct
  misc_feature 1..23: note = Synthetic Construct
  source 1..23: mol_type = other DNA
aagaaaagctggcccttttgatg

SEQ ID NO: 23876 - DNA, 21 bp, synthetic construct
  misc_feature 1..21: note = Synthetic Construct
  source 1..21: mol_type = other DNA
gcagtggggacccaatcattc

SEQ ID NO: 23877 - DNA, 22 bp, synthetic construct
  misc_feature 1..22: note = Synthetic Construct
  source 1..22: mol_type = other DNA
caggcaaggaagggagcttgaa

SEQ ID NO: 23878 - DNA, 20 bp, synthetic construct
  misc_feature 1..20: note = Synthetic Construct
  source 1..20: mol_type = other DNA
gacctggctctgtcctgagt

SEQ ID NO: 23879 - DNA, 22 bp, synthetic construct
  misc_feature 1..22: note = Synthetic Construct
  source 1..22: mol_type = other DNA
gcaacagaagcaatgcaagaca

SEQ ID NO: 23880 - DNA, 20 bp, synthetic construct
  misc_feature 1..20: note = Synthetic Construct
  source 1..20: mol_type = other DNA
tgggaaccggtctggaagaa

SEQ ID NO: 23881 - DNA, 24 bp, synthetic construct
  misc_feature 1..24: note = Synthetic Construct
  source 1..24: mol_type = other DNA
ccaaactgcaaaggaggtgggtaa

SEQ ID NO: 23882 - DNA, 21 bp, synthetic construct
  misc_feature 1..21: note = Synthetic Construct
  source 1..21: mol_type = other DNA
caacggcaatgctgacagaag

SEQ ID NO: 23883 - DNA, 22 bp, synthetic construct
  misc_feature 1..22: note = Synthetic Construct
  source 1..22: mol_type = other DNA
acaggggcacaccctatcttga

SEQ ID NO: 23884 - DNA, 23 bp, synthetic construct
  misc_feature 1..23: note = Synthetic Construct
  source 1..23: mol_type = other DNA
ggatcacacaggaatgggatgaa

SEQ ID NO: 23885 - DNA, 23 bp, synthetic construct
  misc_feature 1..23: note = Synthetic Construct
  source 1..23: mol_type = other DNA
ctccctgggaactctggcttaga

SEQ ID NO: 23886 - DNA, 25 bp, synthetic construct
  misc_feature 1..25: note = Synthetic Construct
  source 1..25: mol_type = other DNA
agaatgctgagtttagggaatccaa

SEQ ID NO: 23887 - DNA, 23 bp, synthetic construct
  misc_feature 1..23: note = Synthetic Construct
  source 1..23: mol_type = other DNA
aatcataaggccacgtcacttct

SEQ ID NO: 23888 - DNA, 20 bp, synthetic construct
  misc_feature 1..20: note = Synthetic Construct
  source 1..20: mol_type = other DNA
agtcactggcttggccttgt

SEQ ID NO: 23889 - DNA, 22 bp, synthetic construct
  misc_feature 1..22: note = Synthetic Construct
  source 1..22: mol_type = other DNA
cagtccaggggtgagataggat

SEQ ID NO: 23890 - DNA, 22 bp, synthetic construct
  misc_feature 1..22: note = Synthetic Construct
  source 1..22: mol_type = other DNA
ttccctgctacctggagtgtca

SEQ ID NO: 23891 - DNA, 22 bp, synthetic construct
  misc_feature 1..22: note = Synthetic Construct
  source 1..22: mol_type = other DNA
ctgatcccctgaacaccagaag

SEQ ID NO: 23892 - DNA, 21 bp, synthetic construct
  misc_feature 1..21: note = Synthetic Construct
  source 1..21: mol_type = other DNA
ttctgtcccaggggaatctca

SEQ ID NO: 23893 - DNA, 23 bp, synthetic construct
  misc_feature 1..23: note = Synthetic Construct
  source 1..23: mol_type = other DNA
tctccctctgtggggaagacttg

SEQ ID NO: 23894 - DNA, 20 bp, synthetic construct
  misc_feature 1..20: note = Synthetic Construct
  source 1..20: mol_type = other DNA
aggaggaggcaagcgaagat

SEQ ID NO: 23895 - DNA, 23 bp, synthetic construct
  misc_feature 1..23: note = Synthetic Construct
  source 1..23: mol_type = other DNA
ggacaggctgactacaggagaag

SEQ ID NO: 23896 - DNA, 22 bp, synthetic construct
  misc_feature 1..22: note = Synthetic Construct
  source 1..22: mol_type = other DNA
tgagtatggctgagtggtggat

SEQ ID NO: 23897 - DNA, 24 bp, synthetic construct
  misc_feature 1..24: note = Synthetic Construct
  source 1..24: mol_type = other DNA
acgggaattgaagcttagagaagt

SEQ ID NO: 23898 - DNA, 20 bp, synthetic construct
  misc_feature 1..20: note = Synthetic Construct
  source 1..20: mol_type = other DNA
tcccatgcagcgggtgaaga

SEQ ID NO: 23899 - DNA, 22 bp, synthetic construct
  misc_feature 1..22: note = Synthetic Construct
  source 1..22: mol_type = other DNA
cacgaagctgttgtctggtaga

SEQ ID NO: 23900 - DNA, 20 bp, synthetic construct
  misc_feature 1..20: note = Synthetic Construct
  source 1..20: mol_type = other DNA
gcacatggaggcactgttct

SEQ ID NO: 23901 - DNA, 20 bp, synthetic construct
  misc_feature 1..20: note = Synthetic Construct
  source 1..20: mol_type = other DNA
gccatggcttttgtgcaact

SEQ ID NO: 23902 - DNA, 20 bp, synthetic construct
  misc_feature 1..20: note = Synthetic Construct
  source 1..20: mol_type = other DNA
gctaggctcactctgtgcaa

SEQ ID NO: 23903 - DNA, 21 bp, synthetic construct
  misc_feature 1..21: note = Synthetic Construct
  source 1..21: mol_type = other DNA
aggagtgacccctggtgtgat

SEQ ID NO: 23904 - DNA, 19 bp, synthetic construct
  misc_feature 1..19: note = Synthetic Construct
  source 1..19: mol_type = other DNA
gggctgctgagtgcctgaa

SEQ ID NO: 23905 - DNA, 22 bp, synthetic construct
  misc_feature 1..22: note = Synthetic Construct
  source 1..22: mol_type = other DNA
gaggggtttccatgctgctact

SEQ ID NO: 23906 - DNA, 22 bp, synthetic construct
  misc_feature 1..22: note = Synthetic Construct
  source 1..22: mol_type = other DNA
ggcagctgaggtagagcagaaa

SEQ ID NO: 23907 - DNA, 21 bp, synthetic construct
  misc_feature 1..21: note = Synthetic Construct
  source 1..21: mol_type = other DNA
gccaccatgcccagccattta

SEQ ID NO: 23908 - DNA, 22 bp, synthetic construct
  misc_feature 1..22: note = Synthetic Construct
  source 1..22: mol_type = other DNA
gccagtgagatggaggtaggaa

SEQ ID NO: 23909 - DNA, 22 bp, synthetic construct
  misc_feature 1..22: note = Synthetic Construct
  source 1..22: mol_type = other DNA
cccattactctctccccgtttc

SEQ ID NO: 23910 - DNA, 28 bp, synthetic construct
  misc_feature 1..28: note = Synthetic Construct
  source 1..28: mol_type = other DNA
gcagacaatttctgggagaatgtagttg

SEQ ID NO: 23911 - DNA, 22 bp, synthetic construct
  misc_feature 1..22: note = Synthetic Construct
  source 1..22: mol_type = other DNA
ccccaaggccaagagcaactta

SEQ ID NO: 23912 - DNA, 22 bp, synthetic construct
  misc_feature 1..22: note = Synthetic Construct
  source 1..22: mol_type = other DNA
gtcttctgtctcccagggattg

SEQ ID NO: 23913 - DNA, 25 bp, synthetic construct
  misc_feature 1..25: note = Synthetic Construct
  source 1..25: mol_type = other DNA
cacttctcaaactcgaggactccaa

SEQ ID NO: 23914 - DNA, 23 bp, synthetic construct
  misc_feature 1..23: note = Synthetic Construct
  source 1..23: mol_type = other DNA
tgtgagcaagtggagaggtatca

SEQ ID NO: 23915 - DNA, 22 bp, synthetic construct
  misc_feature 1..22: note = Synthetic Construct
  source 1..22: mol_type = other DNA
ggctggagaccccacatataca

SEQ ID NO: 23916 - DNA, 24 bp, synthetic construct
  misc_feature 1..24: note = Synthetic Construct
  source 1..24: mol_type = other DNA
gaaaatgttccctggacgcttaaa

SEQ ID NO: 23917 - DNA, 23 bp, synthetic construct
  misc_feature 1..23: note = Synthetic Construct
  source 1..23: mol_type = other DNA
gggttcctagggaggtaaactgt

SEQ ID NO: 23918 - DNA, 26 bp, synthetic construct
  misc_feature 1..26: note = Synthetic Construct
  source 1..26: mol_type = other DNA
gctgtggaaaacaggaagacctaatg

SEQ ID NO: 23919 - DNA, 18 bp, synthetic construct
  misc_feature 1..18: note = Synthetic Construct
  source 1..18: mol_type = other DNA
ggcgcgagccaagtcttt

SEQ ID NO: 23920 - DNA, 23 bp, synthetic construct
  misc_feature 1..23: note = Synthetic Construct
  source 1..23: mol_type = other DNA
ttcacagtggacccattcattca

SEQ ID NO: 23921 - DNA, 23 bp, synthetic construct
  misc_feature 1..23: note = Synthetic Construct
  source 1..23: mol_type = other DNA
ctacagggaagtttcgtccaagt

SEQ ID NO: 23922 - DNA, 20 bp, synthetic construct
  misc_feature 1..20: note = Synthetic Construct
  source 1..20: mol_type = other DNA
ccagtcctggcgcaataaca

SEQ ID NO: 23923 - DNA, 27 bp, synthetic construct
  misc_feature 1..27: note = Synthetic Construct
  source 1..27: mol_type = other DNA
ggtgctcttatttccccattaggatca

SEQ ID NO: 23924 - DNA, 23 bp, synthetic construct
  misc_feature 1..23: note = Synthetic Construct
  source 1..23: mol_type = other DNA
tcattggtccttcaaccttgctt

SEQ ID NO: 23925 - DNA, 21 bp, synthetic construct
  misc_feature 1..21: note = Synthetic Construct
  source 1..21: mol_type = other DNA
agggcctcactgctggtttca

SEQ ID NO: 23926 - DNA, 24 bp, synthetic construct
  misc_feature 1..24: note = Synthetic Construct
  source 1..24: mol_type = other DNA
ccatcaggagaaaaagccctcaac

SEQ ID NO: 23927 - DNA, 24 bp, synthetic construct
  misc_feature 1..24: note = Synthetic Construct
  source 1..24: mol_type = other DNA
cctaccagaccacagtgcatttct

SEQ ID NO: 23928 - DNA, 24 bp, synthetic construct
  misc_feature 1..24: note = Synthetic Construct
  source 1..24: mol_type = other DNA
gaggggagttcccatggtctaaca

SEQ ID NO: 23929 - DNA, 23 bp, synthetic construct
  misc_feature 1..23: note = Synthetic Construct
  source 1..23: mol_type = other DNA
cctttctttcctggtgtgcagaa

SEQ ID NO: 23930 - DNA, 25 bp, synthetic construct
  misc_feature 1..25: note = Synthetic Construct
  source 1..25: mol_type = other DNA
gtgtcatcttgaccagaagccaagt

SEQ ID NO: 23931 - DNA, 20 bp, synthetic construct
  misc_feature 1..20: note = Synthetic Construct
  source 1..20: mol_type = other DNA
ccaagcaggtcgacccagaa

SEQ ID NO: 23932 - DNA, 21 bp, synthetic construct
  misc_feature 1..21: note = Synthetic Construct
  source 1..21: mol_type = other DNA
gccccaaaacccagacatagt

SEQ ID NO: 23933 - DNA, 23 bp, synthetic construct
  misc_feature 1..23: note = Synthetic Construct
  source 1..23: mol_type = other DNA
ggaggctatttcagaggcagtag

SEQ ID NO: 23934 - DNA, 26 bp, synthetic construct
  misc_feature 1..26: note = Synthetic Construct
  source 1..26: mol_type = other DNA
agaatgccaactgagtgactagattc

SEQ ID NO: 23935 - DNA, 25 bp, synthetic construct
  misc_feature 1..25: note = Synthetic Construct
  source 1..25: mol_type = other DNA
tggtgtctgtatgttcacccatatc

SEQ ID NO: 23936 - DNA, 22 bp, synthetic construct
  misc_feature 1..22: note = Synthetic Construct
  source 1..22: mol_type = other DNA
gccaacggactgcgagtgaaaa

SEQ ID NO: 23937 - DNA, 22 bp, synthetic construct
  misc_feature 1..22: note = Synthetic Construct
  source 1..22: mol_type = other DNA
ccctccgtttgtccacgtaact

SEQ ID NO: 23938 - DNA, 23 bp, synthetic construct
  misc_feature 1..23: note = Synthetic Construct
  source 1..23: mol_type = other DNA
gactgagagactctgggacatga

SEQ ID NO: 23939 - DNA, 20 bp, synthetic construct
  misc_feature 1..20: note = Synthetic Construct
  source 1..20: mol_type = other DNA
tgggcccagacctggagact

SEQ ID NO: 23940 - DNA, 24 bp, synthetic construct
  misc_feature 1..24: note = Synthetic Construct
  source 1..24: mol_type = other DNA
agagttccaccggagaccagatac

SEQ ID NO: 23941 - DNA, 25 bp, synthetic construct
  misc_feature 1..25: note = Synthetic Construct
  source 1..25: mol_type = other DNA
actcagcatcagtaggaagtagtgt

SEQ ID NO: 23942 - DNA, 24 bp, synthetic construct
  misc_feature 1..24: note = Synthetic Construct
  source 1..24: mol_type = other DNA
ctccttcctcagggtctttgtact

SEQ ID NO: 23943 - DNA, 20 bp, synthetic construct
  misc_feature 1..20: note = Synthetic Construct
  source 1..20: mol_type = other DNA
gtggcccactttgtcctcat

SEQ ID NO: 23944 - DNA, 21 bp, synthetic construct
  misc_feature 1..21: note = Synthetic Construct
  source 1..21: mol_type = other DNA
caggcagccatcactcagtct

SEQ ID NO: 23945 - DNA, 18 bp, synthetic construct
  misc_feature 1..18: note = Synthetic Construct
  source 1..18: mol_type = other DNA
tgcaggcagctgtgttga

SEQ ID NO: 23946 - DNA, 24 bp, synthetic construct
  misc_feature 1..24: note = Synthetic Construct
  source 1..24: mol_type = other DNA
attagggctgacttttggcatttc

SEQ ID NO: 23947 - DNA, 22 bp, synthetic construct
  misc_feature 1..22: note = Synthetic Construct
  source 1..22: mol_type = other DNA
gcctgtgctcagcaacttttga

SEQ ID NO: 23948 - DNA, 20 bp, synthetic construct
  misc_feature 1..20: note = Synthetic Construct
  source 1..20: mol_type = other DNA
gcgggctcctctgccataag

SEQ ID NO: 23949 - DNA, 22 bp, synthetic construct
  misc_feature 1..22: note = Synthetic Construct
  source 1..22: mol_type = other DNA
agctagacagcacctgaggtat

SEQ ID NO: 23950 - DNA, 21 bp, synthetic construct
  misc_feature 1..21: note = Synthetic Construct
  source 1..21: mol_type = other DNA
gagacttcccctagcctgtca

SEQ ID NO: 23951 - DNA, 22 bp, synthetic construct
  misc_feature 1..22: note = Synthetic Construct
  source 1..22: mol_type = other DNA
gcactgccaagtggtcaaggaa

SEQ ID NO: 23952 - DNA, 21 bp, synthetic construct
  misc_feature 1..21: note = Synthetic Construct
  source 1..21: mol_type = other DNA
ggtgcagcttaacagggtttg

SEQ ID NO: 23953 - DNA, 23 bp, synthetic construct
  misc_feature 1..23: note = Synthetic Construct
  source 1..23: mol_type = other DNA
gctgatgttctgcctgacactac

SEQ ID NO: 23954 - DNA, 22 bp, synthetic construct
  misc_feature 1..22: note = Synthetic Construct
  source 1..22: mol_type = other DNA
tccaggcacctgctgacacata

SEQ ID NO: 23955 - DNA, 22 bp, synthetic construct
  misc_feature 1..22: note = Synthetic Construct
  source 1..22: mol_type = other DNA
tggcagttgccacagtatgtaa

SEQ ID NO: 23956 - DNA, 20 bp, synthetic construct
  misc_feature 1..20: note = Synthetic Construct
  source 1..20: mol_type = other DNA
ggctgaggagaggcaaggta

SEQ ID NO: 23957 - DNA, 22 bp, synthetic construct
  misc_feature 1..22: note = Synthetic Construct
  source 1..22: mol_type = other DNA
acatgacccgcagagccatact

SEQ ID NO: 23958 - DNA, 24 bp, synthetic construct
  misc_feature 1..24: note = Synthetic Construct
  source 1..24: mol_type = other DNA
gcagttcacttggggtctgaattg

SEQ ID NO: 23959 - DNA, 23 bp, synthetic construct
  misc_feature 1..23: note = Synthetic Construct
  source 1..23: mol_type = other DNA
ggtcggggagttaataagcatca

SEQ ID NO: 23960 - DNA, 20 bp, synthetic construct
  misc_feature 1..20: note = Synthetic Construct
  source 1..20: mol_type = other DNA
agccaccaagggtgagttgt

SEQ ID NO: 23961 - DNA, 19 bp, synthetic construct
  misc_feature 1..19: note = Synthetic Construct
  source 1..19: mol_type = other DNA
cgcctgctcggcatgagaa

SEQ ID NO: 23962 - DNA, 22 bp, synthetic construct
  misc_feature 1..22: note = Synthetic Construct
  source 1..22: mol_type = other DNA
tgggacatctgggcttcctttg

SEQ ID NO: 23963 - DNA, 19 bp, synthetic construct
  misc_feature 1..19: note = Synthetic Construct
  source 1..19: mol_type = other DNA
tgacgatgcccgtcaggta

SEQ ID NO: 23964 - DNA, 24 bp, synthetic construct
  misc_feature 1..24: note = Synthetic Construct
  source 1..24: mol_type = other DNA
gggtcctagagctggagtgaaaca

SEQ ID NO: 23965 - DNA, 23 bp, synthetic construct
  misc_feature 1..23: note = Synthetic Construct
  source 1..23: mol_type = other DNA
caggcagggtggtattcacagaa

SEQ ID NO: 23966 - DNA, 20 bp, synthetic construct
  misc_feature 1..20: note = Synthetic Construct
  source 1..20: mol_type = other DNA
ccacagccacaggtcagtag

SEQ ID NO: 23967 - DNA, 23 bp, synthetic construct
  misc_feature 1..23: note = Synthetic Construct
  source 1..23: mol_type = other DNA
ggcagctaattgcactcggttgt

SEQ ID NO: 23968 - DNA, 22 bp, synthetic construct
  misc_feature 1..22: note = Synthetic Construct
  source 1..22: mol_type = other DNA
ccatgcagcccgtgattgaagt

SEQ ID NO: 23969 - DNA, 20 bp, synthetic construct
  misc_feature 1..20: note = Synthetic Construct
  source 1..20: mol_type = other DNA
ccaggggttgccgaaacact

SEQ ID NO: 23970 - DNA, 22 bp, synthetic construct
  misc_feature 1..22: note = Synthetic Construct
  source 1..22: mol_type = other DNA
ttgggaggcacaggatccacta

SEQ ID NO: 23971 - DNA, 24 bp, synthetic construct
  misc_feature 1..24: note = Synthetic Construct
  source 1..24: mol_type = other DNA
ttgaccacaagattcctcttccaa

SEQ ID NO: 23972 - DNA, 27 bp, synthetic construct
  misc_feature 1..27: note = Synthetic Construct
  source 1..27: mol_type = other DNA
ccctacctgacacctagtaaaatacaa

SEQ ID NO: 23973 - DNA, 24 bp, synthetic construct
  misc_feature 1..24: note = Synthetic Construct
  source 1..24: mol_type = other DNA
cagtggcattcaccatgtatctgt

SEQ ID NO: 23974 - DNA, 22 bp, synthetic construct
  misc_feature 1..22: note = Synthetic Construct
  source 1..22: mol_type = other DNA
gccagtggttcatcctccagat

SEQ ID NO: 23975 - DNA, 22 bp, synthetic construct
  misc_feature 1..22: note = Synthetic Construct
  source 1..22: mol_type = other DNA
gcagaacaacctcaggcagaaa

SEQ ID NO: 23976 - DNA, 20 bp, synthetic construct
  misc_feature 1..20: note = Synthetic Construct
  source 1..20: mol_type = other DNA
gcaggcagaaccctctgagt

SEQ ID NO: 23977 - DNA, 20 bp, synthetic construct
  misc_feature 1..20: note = Synthetic Construct
  source 1..20: mol_type = other DNA
caagcggaggctatcaccaa

SEQ ID NO: 23978 - DNA, 24 bp, synthetic construct
  misc_feature 1..24: note = Synthetic Construct
  source 1..24: mol_type = other DNA
gcatctgcatctttacggcagttc

SEQ ID NO: 23979 - DNA, 24 bp, synthetic construct
  misc_feature 1..24: note = Synthetic Construct
  source 1..24: mol_type = other DNA
ggaagtccttccagcataggaaac

SEQ ID NO: 23980 - DNA, 24 bp, synthetic construct
  misc_feature 1..24: note = Synthetic Construct
  source 1..24: mol_type = other DNA
ggaatgcctctcactgtgttcttc

SEQ ID NO: 23981 - DNA, 21 bp, synthetic construct
  misc_feature 1..21: note = Synthetic Construct
  source 1..21: mol_type = other DNA
acacacagcacagaactgtca

SEQ ID NO: 23982 - DNA, 22 bp, synthetic construct
  misc_feature 1..22: note = Synthetic Construct
  source 1..22: mol_type = other DNA
gcctagcactgagctgaccatt

SEQ ID NO: 23983 - DNA, 23 bp, synthetic construct
  misc_feature 1..23: note = Synthetic Construct
  source 1..23: mol_type = other DNA
gtgggcttccctggtttcatttc

SEQ ID NO: 23984 - DNA, 19 bp, synthetic construct
  misc_feature 1..19: note = Synthetic Construct
  source 1..19: mol_type = other DNA
aggcaggtggcctgcacaa

SEQ ID NO: 23985 - DNA, 20 bp, synthetic construct
  misc_feature 1..20: note = Synthetic Construct
  source 1..20: mol_type = other DNA
gggaggccagattgcgaaca

SEQ ID NO: 23986 - DNA, 20 bp, synthetic construct
  misc_feature 1..20: note = Synthetic Construct
  source 1..20: mol_type = other DNA
tccctgccttgctgggaact

SEQ ID NO: 23987 - DNA, 20 bp, synthetic construct
  misc_feature 1..20: note = Synthetic Construct
  source 1..20: mol_type = other DNA
gacatggggcattcgcatct

SEQ ID NO: 23988 - DNA, 21 bp, synthetic construct
  misc_feature 1..21: note = Synthetic Construct
  source 1..21: mol_type = other DNA
accctgccatcctggtgtttc

SEQ ID NO: 23989 - DNA, 20 bp, synthetic construct
  misc_feature 1..20: note = Synthetic Construct
  source 1..20: mol_type = other DNA
aggtggcacagggctctttt

SEQ ID NO: 23990 - DNA, 21 bp, synthetic construct
  misc_feature 1..21: note = Synthetic Construct
  source 1..21: mol_type = other DNA
ccaaagggtggatgggacagt

SEQ ID NO: 23991 - DNA, 23 bp, synthetic construct
  misc_feature 1..23: note = Synthetic Construct
  source 1..23: mol_type = other DNA
agcaccccatcctgtgaaataac

SEQ ID NO: 23992 - DNA, 25 bp, synthetic construct
  misc_feature 1..25: note = Synthetic Construct
  source 1..25: mol_type = other DNA
gctactctttcagtggccctacgat

SEQ ID NO: 23993 - DNA, 22 bp, synthetic construct
  misc_feature 1..22: note = Synthetic Construct
  source 1..22: mol_type = other DNA
ctcacctgctgggtttctcttt

SEQ ID NO: 23994 - DNA, 21 bp, synthetic construct
  misc_feature 1..21: note = Synthetic Construct
  source 1..21: mol_type = other DNA
ggggctgagtctgtgttgttg

SEQ ID NO: 23995 - DNA, 18 bp, synthetic construct
  misc_feature 1..18: note = Synthetic Construct
  source 1..18: mol_type = other DNA
aagcgggccttggaggaa

SEQ ID NO: 23996 - DNA, 24 bp, synthetic construct
  misc_feature 1..24: note = Synthetic Construct
  source 1..24: mol_type = other DNA
agaggcagggtatatgcaagtttc

SEQ ID NO: 23997 - DNA, 24 bp, synthetic construct
  misc_feature 1..24: note = Synthetic Construct
  source 1..24: mol_type = other DNA
accaatggatcgttgtcttgtagt

SEQ ID NO: 23998 - DNA, 20 bp, synthetic construct
  misc_feature 1..20: note = Synthetic Construct
  source 1..20: mol_type = other DNA
agcagcctcgggacaaaaca

SEQ ID NO: 23999 - DNA, 19 bp, synthetic construct
  misc_feature 1..19: note = Synthetic Construct
  source 1..19: mol_type = other DNA
caccgcacccggcctataa

SEQ ID NO: 24000 - DNA, 22 bp, synthetic construct
  misc_feature 1..22: note = Synthetic Construct
  source 1..22: mol_type = other DNA
acggtgttaggacagcatcaaa

SEQ ID NO: 24001 - DNA, 21 bp, synthetic construct
  misc_feature 1..21: note = Synthetic Construct
  source 1..21: mol_type = other DNA
gaacctgtgtgccactgacat

SEQ ID NO: 24002 - DNA, 26 bp, synthetic construct
  misc_feature 1..26: note = Synthetic Construct
  source 1..26: mol_type = other DNA
ggactatgggaagtcatttctgttca

SEQ ID NO: 24003 - DNA, 23 bp, synthetic construct
  misc_feature 1..23: note = Synthetic Construct
  source 1..23: mol_type = other DNA
gctctgtgccaaatcttttgtga

SEQ ID NO: 24004 - DNA, 24 bp, synthetic construct
  misc_feature 1..24: note = Synthetic Construct
  source 1..24: mol_type = other DNA
gctcccagtccatctgcctttatc

SEQ ID NO: 24005 - DNA, 23 bp, synthetic construct
  misc_feature 1..23: note = Synthetic Construct
  source 1..23: mol_type = other DNA
gatcacagcgtacctcttcatgt

SEQ ID NO: 24006 - DNA, 22 bp, synthetic construct
  misc_feature 1..22: note = Synthetic Construct
  source 1..22: mol_type = other DNA
gtgccagatgagagtcaggttt

SEQ ID NO: 24007 - DNA, 21 bp, synthetic construct
  misc_feature 1..21: note = Synthetic Construct
  source 1..21: mol_type = other DNA
ccaactgtgtcgagcttcaga

SEQ ID NO: 24008 - DNA, 22 bp, synthetic construct
  misc_feature 1..22: note = Synthetic Construct
  source 1..22: mol_type = other DNA
ccctcttcaccccattctttgt

SEQ ID NO: 24009 - DNA, 24 bp, synthetic construct
  misc_feature 1..24: note = Synthetic Construct
  source 1..24: mol_type = other DNA
gtttcctctagctgctttgcattg

SEQ ID NO: 24010 - DNA, 21 bp, synthetic construct
  misc_feature 1..21: note = Synthetic Construct
  source 1..21: mol_type = other DNA
gtggcttctctccatcagcat

SEQ ID NO: 24011 - DNA, 25 bp, synthetic construct
  misc_feature 1..25: note = Synthetic Construct
  source 1..25: mol_type = other DNA
ctctgaaaggggttgaagcaaatgt

SEQ ID NO: 24012 - DNA, 21 bp, synthetic construct
  misc_feature 1..21: note = Synthetic Construct
  source 1..21: mol_type = other DNA
caggtctttgcacgtggatct

SEQ ID NO: 24013 - DNA, 20 bp, synthetic construct
  misc_feature 1..20: note = Synthetic Construct
  source 1..20: mol_type = other DNA
gccttgggacaggcatgtgt

SEQ ID NO: 24014 - DNA, 22 bp, synthetic construct
  misc_feature 1..22: note = Synthetic Construct
  source 1..22: mol_type = other DNA
ccaaagccgctcgtactcacat

SEQ ID NO: 24015 - DNA, 22 bp, synthetic construct
  misc_feature 1..22: note = Synthetic Construct
  source 1..22: mol_type = other DNA
gttcctcttccctgtgctgtag

SEQ ID NO: 24016 - DNA, 24 bp, synthetic construct
  misc_feature 1..24: note = Synthetic Construct
  source 1..24: mol_type = other DNA
gcataacagtgtgggcttttcaga

SEQ ID NO: 24017 - DNA, 23 bp, synthetic construct
  misc_feature 1..23: note = Synthetic Construct
  source 1..23: mol_type = other DNA
ggggacccatactttctctgaac

SEQ ID NO: 24018 - DNA, 23 bp, synthetic construct
  misc_feature 1..23: note = Synthetic Construct
  source 1..23: mol_type = other DNA
gcttggaaaaccttggtgaggaa

SEQ ID NO: 24019 - DNA, 20 bp, synthetic construct
  misc_feature 1..20: note = Synthetic Construct
  source 1..20: mol_type = other DNA
tcagcacccagtgccaatga

SEQ ID NO: 24020 - DNA, 22 bp, synthetic construct
  misc_feature 1..22: note = Synthetic Construct
  source 1..22: mol_type = other DNA
ggtgtctgaagagccccaattc

SEQ ID NO: 24021 - DNA, 24 bp, synthetic construct
  misc_feature 1..24: note = Synthetic Construct
  source 1..24: mol_type = other DNA
gaggagggtctgagcttctgatgt

SEQ ID NO: 24022 - DNA, 23 bp, synthetic construct
  misc_feature 1..23: note = Synthetic Construct
  source 1..23: mol_type = other DNA
cagccctgtgtttaagcaggtaa

SEQ ID NO: 24023 - DNA, 26 bp, synthetic construct
  misc_feature 1..26: note = Synthetic Construct
  source 1..26: mol_type = other DNA
cctgcattaactggcttctacttact

SEQ ID NO: 24024 - DNA, 27 bp, synthetic construct
  misc_feature 1..27: note = Synthetic Construct
  source 1..27: mol_type = other DNA
gtctctcactgtagacaaggaaagcaa

SEQ ID NO: 24025 - DNA, 20 bp, synthetic construct
  misc_feature 1..20: note = Synthetic Construct
  source 1..20: mol_type = other DNA
catgtgtcagagcccgaact

SEQ ID NO: 24026 - DNA, 26 bp, synthetic construct
  misc_feature 1..26: note = Synthetic Construct
  source 1..26: mol_type = other DNA
caacatctgggaaaaggtacttccaa

SEQ ID NO: 24027 - DNA, 20 bp, synthetic construct
  misc_feature 1..20: note = Synthetic Construct
  source 1..20: mol_type = other DNA
tgcagccgaggaggaatagt

SEQ ID NO: 24028 - DNA, 22 bp, synthetic construct
  misc_feature 1..22: note = Synthetic Construct
  source 1..22: mol_type = other DNA
tgacgtccccggtgcagtaata

SEQ ID NO: 24029 - DNA, 22 bp, synthetic construct
  misc_feature 1..22: note = Synthetic Construct
  source 1..22: mol_type = other DNA
gtaggctgggatttccctgatg

SEQ ID NO: 24030 - DNA, 19 bp, synthetic construct
  misc_feature 1..19: note = Synthetic Construct
  source 1..19: mol_type = other DNA
aggagggaccttggagcaa

SEQ ID NO: 24031 - DNA, 22 bp, synthetic construct
  misc_feature 1..22: note = Synthetic Construct
  source 1..22: mol_type = other DNA
ccgaggtggctgtgtattaact

SEQ ID NO: 24032 - DNA, 24 bp, synthetic construct
  misc_feature 1..24: note = Synthetic Construct
  source 1..24: mol_type = other DNA
gtggttttctcagctgtcaagatg

SEQ ID NO: 24033 - DNA, 22 bp, synthetic construct
  misc_feature 1..22: note = Synthetic Construct
  source 1..22: mol_type = other DNA
cagccaagaatccttccactgt

SEQ ID NO: 24034 - DNA, 21 bp, synthetic construct
  misc_feature 1..21: note = Synthetic Construct
  source 1..21: mol_type = other DNA
gcgaggacaccaactctttct

SEQ ID NO: 24035 - DNA, 20 bp, synthetic construct
  misc_feature 1..20: note = Synthetic Construct
  source 1..20: mol_type = other DNA
gtgactgcactccgggatga

SEQ ID NO: 24036 - DNA, 24 bp, synthetic construct
  misc_feature 1..24: note = Synthetic Construct
  source 1..24: mol_type = other DNA
gtgtgacgggaaaaactccaggat

SEQ ID NO: 24037 - DNA, 22 bp, synthetic construct
  misc_feature 1..22: note = Synthetic Construct
  source 1..22: mol_type = other DNA
gctcaggccaccaaaccatcta

SEQ ID NO: 24038 - DNA, 24 bp, synthetic construct
  misc_feature 1..24: note = Synthetic Construct
  source 1..24: mol_type = other DNA
ggataaaagcgagcattctggaaa

SEQ ID NO: 24039 - DNA, 20 bp, synthetic construct
  misc_feature 1..20: note = Synthetic Construct
  source 1..20: mol_type = other DNA
tcaggtgggtcacggcagtt

SEQ ID NO: 24040 - DNA, 22 bp, synthetic construct
  misc_feature 1..22: note = Synthetic Construct
  source 1..22: mol_type = other DNA
gaccgtgggttcaaggaagcat

SEQ ID NO: 24041 - DNA, 25 bp, synthetic construct
  misc_feature 1..25: note = Synthetic Construct
  source 1..25: mol_type = other DNA
gctgctgtagcccataatatactca

SEQ ID NO: 24042 - DNA, 21 bp, synthetic construct
  misc_feature 1..21: note = Synthetic Construct
  source 1..21: mol_type = other DNA
cggggtagagacaaccgtgaa

SEQ ID NO: 24043 - DNA, 20 bp, synthetic construct
  misc_feature 1..20: note = Synthetic Construct
  source 1..20: mol_type = other DNA
tttcctgcccaccctgctat

SEQ ID NO: 24044 - DNA, 23 bp, synthetic construct
  misc_feature 1..23: note = Synthetic Construct
  source 1..23: mol_type = other DNA
tgggtacgactatttccggttga

SEQ ID NO: 24045 - DNA, 22 bp, synthetic construct
  misc_feature 1..22: note = Synthetic Construct
  source 1..22: mol_type = other DNA
ccccatcagggtcaggtctctt

SEQ ID NO: 24046 - DNA, 21 bp, synthetic construct
  misc_feature 1..21: note = Synthetic Construct
  source 1..21: mol_type = other DNA
gggcaaaagatctgcctcagt

SEQ ID NO: 24047 - DNA, 19 bp, synthetic construct
  misc_feature 1..19: note = Synthetic Construct
  source 1..19: mol_type = other DNA
tgggaggcagagggaccaa

SEQ ID NO: 24048 - DNA, 21 bp, synthetic construct
  misc_feature 1..21: note = Synthetic Construct
  source 1..21: mol_type = other DNA
ccacaaacaccgaccctgttc

SEQ ID NO: 24049 - DNA, 21 bp, synthetic construct
  misc_feature 1..21: note = Synthetic Construct
  source 1..21: mol_type = other DNA
tcaggagccactggggtgaaa

SEQ ID NO: 24050 - DNA, 21 bp, synthetic construct
  misc_feature 1..21: note = Synthetic Construct
  source 1..21: mol_type = other DNA
ctgtgcaaagggcatggaagt

SEQ ID NO: 24051 - DNA, 22 bp, synthetic construct
  misc_feature 1..22: note = Synthetic Construct
  source 1..22: mol_type = other DNA
actctccccaggaaggaagtca

SEQ ID NO: 24052 - DNA, 22 bp, synthetic construct
  misc_feature 1..22: note = Synthetic Construct
  source 1..22: mol_type = other DNA
cctgctcccctgtccttataga

SEQ ID NO: 24053 - DNA, 23 bp, synthetic construct
  misc_feature 1..23: note = Synthetic Construct
  source 1..23: mol_type = other DNA
tgctcttcccctcactcaatttt

SEQ ID NO: 24054 - DNA, 21 bp, synthetic construct
  misc_feature 1..21: note = Synthetic Construct
  source 1..21: mol_type = other DNA
gtgaggccagtgcttgtggat

SEQ ID NO: 24055 - DNA, 22 bp, synthetic construct
  misc_feature 1..22: note = Synthetic Construct
  source 1..22: mol_type = other DNA
gccgctgaaaaccacgacattc

SEQ ID NO: 24056 - DNA, 22 bp, synthetic construct
  misc_feature 1..22: note = Synthetic Construct
  source 1..22: mol_type = other DNA
gcagttggagccttagcagtca

SEQ ID NO: 24057 - DNA, 24 bp, synthetic construct
  misc_feature 1..24: note = Synthetic Construct
  source 1..24: mol_type = other DNA
gcaagagggaaatggcttaagatg

SEQ ID NO: 24058 - DNA, 21 bp, synthetic construct
  misc_feature 1..21: note = Synthetic Construct
  source 1..21: mol_type = other DNA
ccagttcagttggggcttgtt

SEQ ID NO: 24059 - DNA, 21 bp, synthetic construct
  misc_feature 1..21: note = Synthetic Construct
  source 1..21: mol_type = other DNA
cctcttacacctggtggcaat

SEQ ID NO: 24060 - DNA, 20 bp, synthetic construct
  misc_feature 1..20: note = Synthetic Construct
  source 1..20: mol_type = other DNA
tcatggacggcctccgtatg

SEQ ID NO: 24061 - DNA, 22 bp, synthetic construct
  misc_feature 1..22: note = Synthetic Construct
  source 1..22: mol_type = other DNA
agcgaacttcggcaaaactttc

SEQ ID NO: 24062 - DNA, 23 bp, synthetic construct
  misc_feature 1..23: note = Synthetic Construct
  source 1..23: mol_type = other DNA
tgcctcttccaattgaggtgaaa

SEQ ID NO: 24063 - DNA, 20 bp, synthetic construct
  misc_feature 1..20: note = Synthetic Construct
  source 1..20: mol_type = other DNA
cacacacacgctctgtcctt

SEQ ID NO: 24064 - DNA, 22 bp, synthetic construct
  misc_feature 1..22: note = Synthetic Construct
  source 1..22: mol_type = other DNA
ggccaggggaagtacaggtaga

SEQ ID NO: 24065 - DNA, 23 bp, synthetic construct
  misc_feature 1..23: note = Synthetic Construct
  source 1..23: mol_type = other DNA
gctgccaatgtcctgaagccata

SEQ ID NO: 24066 - DNA, 21 bp, synthetic construct
  misc_feature 1..21: note = Synthetic Construct
  source 1..21: mol_type = other DNA
cctgctagaagccgtggctaa

SEQ ID NO: 24067 - DNA, 24 bp, synthetic construct
  misc_feature 1..24: note = Synthetic Construct
  source 1..24: mol_type = other DNA
gtagttttccttgtggagggctaa

SEQ ID NO: 24068 - DNA, 24 bp, synthetic construct
  misc_feature 1..24: note = Synthetic Construct
  source 1..24: mol_type = other DNA
gagcacacccctaccaaaaggaaa

SEQ ID NO: 24069 - DNA, 21 bp, synthetic construct
  misc_feature 1..21: note = Synthetic Construct
  source 1..21: mol_type = other DNA
tccctgaagagggccaaggat

SEQ ID NO: 24070 - DNA, 26 bp, synthetic construct
  misc_feature 1..26: note = Synthetic Construct
  source 1..26: mol_type = other DNA
ggaaataaatggcctgttaggctgaa

SEQ ID NO: 24071 - DNA, 23 bp, synthetic construct
  misc_feature 1..23: note = Synthetic Construct
  source 1..23: mol_type = other DNA
gctccgtgtttccacagaacctt

SEQ ID NO: 24072 - DNA, 20 bp, synthetic construct
  misc_feature 1..20: note = Synthetic Construct
  source 1..20: mol_type = other DNA
ggcagcaacgtcagggaaaa

SEQ ID NO: 24073 - DNA, 23 bp, synthetic construct
  misc_feature 1..23: note = Synthetic Construct
  source 1..23: mol_type = other DNA
tgccagtacagtgcaattggaaa

SEQ ID NO: 24074 - DNA, 24 bp, synthetic construct
  misc_feature 1..24: note = Synthetic Construct
  source 1..24: mol_type = other DNA
gacgtgaagttgcccatagctaca

SEQ ID NO: 24075 - DNA, 23 bp, synthetic construct
  misc_feature 1..23: note = Synthetic Construct
  source 1..23: mol_type = other DNA
ggcgaagaaggaatggagtgtga

SEQ ID NO: 24076 - DNA, 22 bp, synthetic construct
  misc_feature 1..22: note = Synthetic Construct
  source 1..22: mol_type = other DNA
ccagctcacagactcctgtaac

SEQ ID NO: 24077 - DNA, 25 bp, synthetic construct
  misc_feature 1..25: note = Synthetic Construct
  source 1..25: mol_type = other DNA
caaggtaggatcttccctcttgtgt

SEQ ID NO: 24078 - DNA, 20 bp, synthetic construct
  misc_feature 1..20: note = Synthetic Construct
  source 1..20: mol_type = other DNA
tcttgcttccccacctcagt

SEQ ID NO: 24079 - DNA, 22 bp, synthetic construct
  misc_feature 1..22: note = Synthetic Construct
  source 1..22: mol_type = other DNA
cggagcagtggcaatggaaatc

SEQ ID NO: 24080 - DNA, 22 bp, synthetic construct
  misc_feature 1..22: note = Synthetic Construct
  source 1..22: mol_type = other DNA
cctccttggggaaccacaaact

SEQ ID NO: 24081 - DNA, 22 bp, synthetic construct
  misc_feature 1..22: note = Synthetic Construct
  source 1..22: mol_type = other DNA
ggggctgacaacatgactgctt

SEQ ID NO: 24082 - DNA, 23 bp, synthetic construct
  misc_feature 1..23: note = Synthetic Construct
  source 1..23: mol_type = other DNA
ctatggacctgttccaaccacat

SEQ ID NO: 24083 - DNA, 22 bp, synthetic construct
  misc_feature 1..22: note = Synthetic Construct
  source 1..22: mol_type = other DNA
gcaggactaaagccacaggtaa

SEQ ID NO: 24084 - DNA, 23 bp, synthetic construct
  misc_feature 1..23: note = Synthetic Construct
  source 1..23: mol_type = other DNA
cagataagtgtgctcagctctca

SEQ ID NO: 24085 - DNA, 22 bp, synthetic construct
  misc_feature 1..22: note = Synthetic Construct
  source 1..22: mol_type = other DNA
gtgccagccagtgtgctaaatc

SEQ ID NO: 24086 - DNA, 21 bp, synthetic construct
  misc_feature 1..21: note = Synthetic Construct
  source 1..21: mol_type = other DNA
cctaagcaacaggcagctctt

SEQ ID NO: 24087 - DNA, 19 bp, synthetic construct
  misc_feature 1..19: note = Synthetic Construct
  source 1..19: mol_type = other DNA
aggctgctgcctccacact

SEQ ID NO: 24088 - DNA, 25 bp, synthetic construct
  misc_feature 1..25: note = Synthetic Construct
  source 1..25: mol_type = other DNA
aggagggaagaggattatgcttcta

SEQ ID NO: 24089 - DNA, 26 bp, synthetic construct
  misc_feature 1..26: note = Synthetic Construct
  source 1..26: mol_type = other DNA
gtggaggtattttcaagctcaacttc

SEQ ID NO: 24090 - DNA, 26 bp, synthetic construct
  misc_feature 1..26: note = Synthetic Construct
  source 1..26: mol_type = other DNA
ccagacatctaagcgattttggaagt

SEQ ID NO: 24091 - DNA, 23 bp, synthetic construct
  misc_feature 1..23: note = Synthetic Construct
  source 1..23: mol_type = other DNA
gtgtggttctggaaaggagtgat

SEQ ID NO: 24092 - DNA, 23 bp, synthetic construct
  misc_feature 1..23: note = Synthetic Construct
  source 1..23: mol_type = other DNA
tgttgactccaggtgcaaaatct

SEQ ID NO: 24093 - DNA, 20 bp, synthetic construct
  misc_feature 1..20: note = Synthetic Construct
  source 1..20: mol_type = other DNA
acccgtgtggctggagaaac

SEQ ID NO: 24094 - DNA, 24 bp, synthetic construct
  misc_feature 1..24: note = Synthetic Construct
  source 1..24: mol_type = other DNA
tcttgccttcatgcagctcaaata

SEQ ID NO: 24095 - DNA, 24 bp, synthetic construct
  misc_feature 1..24: note = Synthetic Construct
  source 1..24: mol_type = other DNA
cagcagcatccaatccaaccatca

SEQ ID NO: 24096 - DNA, 25 bp, synthetic construct
  misc_feature 1..25: note = Synthetic Construct
  source 1..25: mol_type = other DNA
gaattggctcactaggctagaatgt

SEQ ID NO: 24097 - DNA, 22 bp, synthetic construct
  misc_feature 1..22: note = Synthetic Construct
  source 1..22: mol_type = other DNA
gtcctcgtcctgagcagatgtt

SEQ ID NO: 24098 - DNA, 22 bp, synthetic construct
  misc_feature 1..22: note = Synthetic Construct
  source 1..22: mol_type = other DNA
tgccaaaagttatggggtgcta

SEQ ID NO: 24099 - DNA, 21 bp, synthetic construct
  misc_feature 1..21: note = Synthetic Construct
  source 1..21: mol_type = other DNA
ccaccatccagtgcctgttga

SEQ ID NO: 24100 - DNA, 21 bp, synthetic construct
  misc_feature 1..21: note = Synthetic Construct
  source 1..21: mol_type = other DNA
ggccatgctggatgatagcaa

SEQ ID NO: 24101 - DNA, 24 bp, synthetic construct
  misc_feature 1..24: note = Synthetic Construct
  source 1..24: mol_type = other DNA
tccacgtttcagattgtcgagtta

SEQ ID NO: 24102 - DNA, 24 bp, synthetic construct
  misc_feature 1..24: note = Synthetic Construct
  source 1..24: mol_type = other DNA
gctgtgtacgtggagctttgacta

SEQ ID NO: 24103 - DNA, 22 bp, synthetic construct
  misc_feature 1..22: note = Synthetic Construct
  source 1..22: mol_type = other DNA
tccgggatggaacaatggtact

SEQ ID NO: 24104 - DNA, 22 bp, synthetic construct
  misc_feature 1..22: note = Synthetic Construct
  source 1..22: mol_type = other DNA
cgtccctcacacttcacagcat

SEQ ID NO: 24105 - DNA, 23 bp, synthetic construct
  misc_feature 1..23: note = Synthetic Construct
  source 1..23: mol_type = other DNA
ccctgtgccctctaagcctacaa

SEQ ID NO: 24106 - DNA, 22 bp, synthetic construct
  misc_feature 1..22: note = Synthetic Construct
  source 1..22: mol_type = other DNA
ctgcccactgtaacgcattttc

SEQ ID NO: 24107 - DNA, 24 bp, synthetic construct
  misc_feature 1..24: note = Synthetic Construct
  source 1..24: mol_type = other DNA
cgagaaacctttgcaagtgagtga

SEQ ID NO: 24108 - DNA, 20 bp, synthetic construct
  misc_feature 1..20: note = Synthetic Construct
  source 1..20: mol_type = other DNA
ccacctccacagcctcatct

SEQ ID NO: 24109 - DNA, 22 bp, synthetic construct
  misc_feature 1..22: note = Synthetic Construct
  source 1..22: mol_type = other DNA
cccatggccagcattacctctt

SEQ ID NO: 24110 - DNA, 22 bp, synthetic construct
  misc_feature 1..22: note = Synthetic Construct
  source 1..22: mol_type = other DNA
cagcccagattccatgcctgtt

SEQ ID NO: 24111 - DNA, 22 bp, synthetic construct
  misc_feature 1..22: note = Synthetic Construct
  source 1..22: mol_type = other DNA
cagtggtcaaagctggggaaac

SEQ ID NO: 24112 - DNA, 20 bp, synthetic construct
  misc_feature 1..20: note = Synthetic Construct
  source 1..20: mol_type = other DNA
tggccctcctgctcctggat

SEQ ID NO: 24113 - DNA, 23 bp, synthetic construct
  misc_feature 1..23: note = Synthetic Construct
  source 1..23: mol_type = other DNA
gttgccctgggactcaaagatag

SEQ ID NO: 24114 - DNA, 26 bp, synthetic construct
  misc_feature 1..26: note = Synthetic Construct
  source 1..26: mol_type = other DNA
gtgcaggaaccccatctatatgtgaa

SEQ ID NO: 24115 - DNA, 22 bp, synthetic construct
  misc_feature 1..22: note = Synthetic Construct
  source 1..22: mol_type = other DNA
tccagagggttgacaggtcagt

SEQ ID NO: 24116 - DNA, 25 bp, synthetic construct
  misc_feature 1..25: note = Synthetic Construct
  source 1..25: mol_type = other DNA
gctgcatgtttactcactttccttt

SEQ ID NO: 24117 - DNA, 22 bp, synthetic construct
  misc_feature 1..22: note = Synthetic Construct
  source 1..22: mol_type = other DNA
aatttcgtggagcctcaggttt

SEQ ID NO: 24118 - DNA, 20 bp, synthetic construct
  misc_feature 1..20: note = Synthetic Construct
  source 1..20: mol_type = other DNA
caagtgctcgctctgcattg

SEQ ID NO: 24119 - DNA, 21 bp, synthetic construct
  misc_feature 1..21: note = Synthetic Construct
  source 1..21: mol_type = other DNA
tccaacacagcgtgtttctca

SEQ ID NO: 24120 - DNA, 20 bp, synthetic construct
  misc_feature 1..20: note = Synthetic Construct
  source 1..20: mol_type = other DNA
ggggtggggcatgagagatt

SEQ ID NO: 24121 - DNA, 21 bp, synthetic construct
  misc_feature 1..21: note = Synthetic Construct
  source 1..21: mol_type = other DNA
acaggggtaaagggaggctaa

SEQ ID NO: 24122 - DNA, 24 bp, synthetic construct
  misc_feature 1..24: note = Synthetic Construct
  source 1..24: mol_type = other DNA
gcccaaaacacagtgtgacaagta

SEQ ID NO: 24123 - DNA, 21 bp, synthetic construct
  misc_feature 1..21: note = Synthetic Construct
  source 1..21: mol_type = other DNA
tgtttgcctcagcgactcttg

SEQ ID NO: 24124 - DNA, 23 bp, synthetic construct
  misc_feature 1..23: note = Synthetic Construct
  source 1..23: mol_type = other DNA
tgctcaatgtctatgccagaact

SEQ ID NO: 24125 - DNA, 22 bp, synthetic construct
  misc_feature 1..22: note = Synthetic Construct
  source 1..22: mol_type = other DNA
gtccctggggacataggtgaca

SEQ ID NO: 24126 - DNA, 22 bp, synthetic construct
  misc_feature 1..22: note = Synthetic Construct
  source 1..22: mol_type = other DNA
ctggagagagaggcccttggaa

SEQ ID NO: 24127 - DNA, 21 bp, synthetic construct
  misc_feature 1..21: note = Synthetic Construct
  source 1..21: mol_type = other DNA
caccctgagatcatggcactt

SEQ ID NO: 24128 - DNA, 23 bp, synthetic construct
  misc_feature 1..23: note = Synthetic Construct
  source 1..23: mol_type = other DNA
aggtcagaggagccatctttttg

SEQ ID NO: 24129 - DNA, 24 bp, synthetic construct
  misc_feature 1..24: note = Synthetic Construct
  source 1..24: mol_type = other DNA
cttgactgacagccattccctatg

SEQ ID NO: 24130 - DNA, 21 bp, synthetic construct
  misc_feature 1..21: note = Synthetic Construct
  source 1..21: mol_type = other DNA
ggttgcatgcctcacatccat

SEQ ID NO: 24131 - DNA, 22 bp, synthetic construct
  misc_feature 1..22: note = Synthetic Construct
  source 1..22: mol_type = other DNA
tggagaggagttgcaagggtaa

SEQ ID NO: 24132 - DNA, 24 bp, synthetic construct
  misc_feature 1..24: note = Synthetic Construct
  source 1..24: mol_type = other DNA
ctgcttcttcatctaagcgggaaa

SEQ ID NO: 24133 - DNA, 20 bp, synthetic construct
  misc_feature 1..20: note = Synthetic Construct
  source 1..20: mol_type = other DNA
acaaggacgcttcgcggaaa

SEQ ID NO: 24134 - DNA, 25 bp, synthetic construct
  misc_feature 1..25: note = Synthetic Construct
  source 1..25: mol_type = other DNA
gcaggaatgtcatggaggttactct

SEQ ID NO: 24135 - DNA, 24 bp, synthetic construct
  misc_feature 1..24: note = Synthetic Construct
  source 1..24: mol_type = other DNA
cagcctgataacattggggtgtag

SEQ ID NO: 24136 - DNA, 19 bp, synthetic construct
  misc_feature 1..19: note = Synthetic Construct
  source 1..19: mol_type = other DNA
gcttgggacccaggtgaga

SEQ ID NO: 24137 - DNA, 23 bp, synthetic construct
  misc_feature 1..23: note = Synthetic Construct
  source 1..23: mol_type = other DNA
cggcaatttaggacccaaaacaa

SEQ ID NO: 24138 - DNA, 25 bp, synthetic construct
  misc_feature 1..25: note = Synthetic Construct
  source 1..25: mol_type = other DNA
gcgtgagatgtctggatgtgaccta

SEQ ID NO: 24139 - DNA, 27 bp, synthetic construct
  misc_feature 1..27: note = Synthetic Construct
  source 1..27: mol_type = other DNA
gtgggttctataggactaagccagatg

SEQ ID NO: 24140 - DNA, 27 bp, synthetic construct
  misc_feature 1..27: note = Synthetic Construct
  source 1..27: mol_type = other DNA
actaaagaccttgtgaaggaggtaatg

SEQ ID NO: 24141 - DNA, 22 bp, synthetic construct
  misc_feature 1..22: note = Synthetic Construct
  source 1..22: mol_type = other DNA
tgccttctgtggctgtagtgta

SEQ ID NO: 24142 - DNA, 20 bp, synthetic construct
  misc_feature 1..20: note = Synthetic Construct
  source 1..20: mol_type = other DNA
acccgtggcttcaccatttg

SEQ ID NO: 24143 - DNA, 20 bp, synthetic construct
  misc_feature 1..20: note = Synthetic Construct
  source 1..20: mol_type = other DNA
ttatcaccgccccgcaaaag

SEQ ID NO: 24144 - DNA, 20 bp, synthetic construct
  misc_feature 1..20: note = Synthetic Construct
  source 1..20: mol_type = other DNA
accgcaagcagtcctacaac

SEQ ID NO: 24145 - DNA, 21 bp, synthetic construct
  misc_feature 1..21: note = Synthetic Construct
  source 1..21: mol_type = other DNA
agtggcctagcttccttgtga

SEQ ID NO: 24146 - DNA, 18 bp, synthetic construct
  misc_feature 1..18: note = Synthetic Construct
  source 1..18: mol_type = other DNA
aacccggccctgctttga

SEQ ID NO: 24147 - DNA, 22 bp, synthetic construct
  misc_feature 1..22: note = Synthetic Construct
  source 1..22: mol_type = other DNA
ctaaggtgcacgggattaggtt

SEQ ID NO: 24148 - DNA, 27 bp, synthetic construct
  misc_feature 1..27: note = Synthetic Construct
  source 1..27: mol_type = other DNA
ggcaacagctactatttttccctcaac

SEQ ID NO: 24149 - DNA, 20 bp, synthetic construct
  misc_feature 1..20: note = Synthetic Construct
  source 1..20: mol_type = other DNA
ctggaggcactttcccaaca

SEQ ID NO: 24150 - DNA, 22 bp, synthetic construct
  misc_feature 1..22: note = Synthetic Construct
  source 1..22: mol_type = other DNA
cgtgcttcctcctccctttctt

SEQ ID NO: 24151 - DNA, 19 bp, synthetic construct
  misc_feature 1..19: note = Synthetic Construct
  source 1..19: mol_type = other DNA
cagcagtgcgctgggaaac

SEQ ID NO: 24152 - DNA, 20 bp, synthetic construct
  misc_feature 1..20: note = Synthetic Construct
  source 1..20: mol_type = other DNA
cacctgggtccagcctcaag

SEQ ID NO: 24153 - DNA, 20 bp, synthetic construct
  misc_feature 1..20: note = Synthetic Construct
  source 1..20: mol_type = other DNA
cctctggcctggaagacact

SEQ ID NO: 24154 - DNA, 19 bp, synthetic construct
  misc_feature 1..19: note = Synthetic Construct
  source 1..19: mol_type = other DNA
ccctccagccttcgccttt

SEQ ID NO: 24155 - DNA, 23 bp, synthetic construct
  misc_feature 1..23: note = Synthetic Construct
  source 1..23: mol_type = other DNA
cctccccagccagaagatcacat

SEQ ID NO: 24156 - DNA, 20 bp, synthetic construct
  misc_feature 1..20: note = Synthetic Construct
  source 1..20: mol_type = other DNA
tgtgcatgccatctcctgtt

SEQ ID NO: 24157 - DNA, 20 bp, synthetic construct
  misc_feature 1..20: note = Synthetic Construct
  source 1..20: mol_type = other DNA
aaaccgatggacggcgcatt

SEQ ID NO: 24158 - DNA, 18 bp, synthetic construct
  misc_feature 1..18: note = Synthetic Construct
  source 1..18: mol_type = other DNA
tcccagggtgctgtcctt

SEQ ID NO: 24159 - DNA, 24 bp, synthetic construct
  misc_feature 1..24: note = Synthetic Construct
  source 1..24: mol_type = other DNA
ccctagcctccttttctcaaagtt

SEQ ID NO: 24160 - DNA, 22 bp, synthetic construct
  misc_feature 1..22: note = Synthetic Construct
  source 1..22: mol_type = other DNA
tcttgtgtgtaagcccctcctt

SEQ ID NO: 24161 - DNA, 21 bp, synthetic construct
  misc_feature 1..21: note = Synthetic Construct
  source 1..21: mol_type = other DNA
tggggagctgaggaggcattt

SEQ ID NO: 24162 - DNA, 20 bp, synthetic construct
  misc_feature 1..20: note = Synthetic Construct
  source 1..20: mol_type = other DNA
tcaggccactctcccaaaga

SEQ ID NO: 24163 - DNA, 19 bp, synthetic construct
  misc_feature 1..19: note = Synthetic Construct
  source 1..19: mol_type = other DNA
ccagctgccacagaactga

SEQ ID NO: 24164 - DNA, 20 bp, synthetic construct
  misc_feature 1..20: note = Synthetic Construct
  source 1..20: mol_type = other DNA
actctgtgccgtctgtcaac

SEQ ID NO: 24165 - DNA, 23 bp, synthetic construct
  misc_feature 1..23: note = Synthetic Construct
  source 1..23: mol_type = other DNA
gcagatcctctccacctagagtt

SEQ ID NO: 24166 - DNA, 23 bp, synthetic construct
  misc_feature 1..23: note = Synthetic Construct
  source 1..23: mol_type = other DNA
ctcattgcccctgttgctgattc

SEQ ID NO: 24167 - DNA, 23 bp, synthetic construct
  misc_feature 1..23: note = Synthetic Construct
  source 1..23: mol_type = other DNA
gcccaggtcaggtaagtagagat

SEQ ID NO: 24168 - DNA, 23 bp, synthetic construct
  misc_feature 1..23: note = Synthetic Construct
  source 1..23: mol_type = other DNA
acacccaattccttgttcctcaa

SEQ ID NO: 24169 - DNA, 25 bp, synthetic construct
  misc_feature 1..25: note = Synthetic Construct
  source 1..25: mol_type = other DNA
gaagaaatgctgtgccattgaactt

SEQ ID NO: 24170 - DNA, 21 bp, synthetic construct
  misc_feature 1..21: note = Synthetic Construct
  source 1..21: mol_type = other DNA
ccggtaccagctggaatcaat

SEQ ID NO: 24171 - DNA, 22 bp, synthetic construct
  misc_feature 1..22: note = Synthetic Construct
  source 1..22: mol_type = other DNA
gtgaggaccccactcgtttatg

SEQ ID NO: 24172 - DNA, 21 bp, synthetic construct
  misc_feature 1..21: note = Synthetic Construct
  source 1..21: mol_type = other DNA
agccagctgctaagttgctaa

SEQ ID NO: 24173 - DNA, 24 bp, synthetic construct
  misc_feature 1..24: note = Synthetic Construct
  source 1..24: mol_type = other DNA
gatctgggcctgatgaagaagcta

SEQ ID NO: 24174 - DNA, 22 bp, synthetic construct
  misc_feature 1..22: note = Synthetic Construct
  source 1..22: mol_type = other DNA
gccagtgtggctagagagcaat

SEQ ID NO: 24175 - DNA, 21 bp, synthetic construct
  misc_feature 1..21: note = Synthetic Construct
  source 1..21: mol_type = other DNA
ccttggcattgacgaccttct

SEQ ID NO: 24176 - DNA, 24 bp, synthetic construct
  misc_feature 1..24: note = Synthetic Construct
  source 1..24: mol_type = other DNA
ttgtgtgacctcaagctaatcact

SEQ ID NO: 24177 - DNA, 23 bp, synthetic construct
  misc_feature 1..23: note = Synthetic Construct
  source 1..23: mol_type = other DNA
tgccttggtccgtaacaattaca

SEQ ID NO: 24178 - DNA, 20 bp, synthetic construct
  misc_feature 1..20: note = Synthetic Construct
  source 1..20: mol_type = other DNA
tggatggacagagggtgtgt

SEQ ID NO: 24179 - DNA, 18 bp, synthetic construct
  misc_feature 1..18: note = Synthetic Construct
  source 1..18: mol_type = other DNA
tgtcgggtgccacaccat

SEQ ID NO: 24180 - DNA, 21 bp, synthetic construct
  misc_feature 1..21: note = Synthetic Construct
  source 1..21: mol_type = other DNA
atgttcatgccgtcagactgt

SEQ ID NO: 24181 - DNA, 28 bp, synthetic construct
  misc_feature 1..28: note = Synthetic Construct
  source 1..28: mol_type = other DNA
gagtaagtgggctcatcaaactatgctt

SEQ ID NO: 24182 - DNA, 25 bp, synthetic construct
  misc_feature 1..25: note = Synthetic Construct
  source 1..25: mol_type = other DNA
ggtatgaatcccaccgttgaacaca

SEQ ID NO: 24183 - DNA, 21 bp, synthetic construct
  misc_feature 1..21: note = Synthetic Construct
  source 1..21: mol_type = other DNA
ctagttccctcagcccagttg

SEQ ID NO: 24184 - DNA, 22 bp, synthetic construct
  misc_feature 1..22: note = Synthetic Construct
  source 1..22: mol_type = other DNA
ggagtttagagcccctgccaaa

SEQ ID NO: 24185 - DNA, 20 bp, synthetic construct
  misc_feature 1..20: note = Synthetic Construct
  source 1..20: mol_type = other DNA
tggagctacagcgtccatct

SEQ ID NO: 24186 - DNA, 24 bp, synthetic construct
  misc_feature 1..24: note = Synthetic Construct
  source 1..24: mol_type = other DNA
cctggcttccttgtatcctgatct

SEQ ID NO: 24187 - DNA, 21 bp, synthetic construct
  misc_feature 1..21: note = Synthetic Construct
  source 1..21: mol_type = other DNA
agcagcacatggctttcatct

SEQ ID NO: 24188 - DNA, 21 bp, synthetic construct
  misc_feature 1..21: note = Synthetic Construct
  source 1..21: mol_type = other DNA
acgctgagcacacagttcatc

SEQ ID NO: 24189 - DNA, 21 bp, synthetic construct
  misc_feature 1..21: note = Synthetic Construct
  source 1..21: mol_type = other DNA
gccagccgtgctactgatgtt

SEQ ID NO: 24190 - DNA, 21 bp, synthetic construct
  misc_feature 1..21: note = Synthetic Construct
  source 1..21: mol_type = other DNA
ggggtgttggtgttgtaggaa

SEQ ID NO: 24191 - DNA, 25 bp, synthetic construct
  misc_feature 1..25: note = Synthetic Construct
  source 1..25: mol_type = other DNA
gtgtcagctaccagactcctttttc

SEQ ID NO: 24192 - DNA, 21 bp, synthetic construct
  misc_feature 1..21: note = Synthetic Construct
  source 1..21: mol_type = other DNA
gctgctaccctgcaagtcagt

SEQ ID NO: 24193 - DNA, 22 bp, synthetic construct
  misc_feature 1..22: note = Synthetic Construct
  source 1..22: mol_type = other DNA
ggaaagggtgctagctttgaca

SEQ ID NO: 24194 - DNA, 27 bp, synthetic construct
  misc_feature 1..27: note = Synthetic Construct
  source 1..27: mol_type = other DNA
catccagcttcactgactcagaatctt

SEQ ID NO: 24195 - DNA, 26 bp, synthetic construct
  misc_feature 1..26: note = Synthetic Construct
  source 1..26: mol_type = other DNA
gcaatgtgcttggacttatgttggat

SEQ ID NO: 24196 - DNA, 21 bp, synthetic construct
  misc_feature 1..21: note = Synthetic Construct
  source 1..21: mol_type = other DNA
tgaggaagtgggcgtctcttg

SEQ ID NO: 24197 - DNA, 21 bp, synthetic construct
  misc_feature 1..21: note = Synthetic Construct
  source 1..21: mol_type = other DNA
acaatggggctagatgcacaa

SEQ ID NO: 24198 - DNA, 24 bp, synthetic construct
  misc_feature 1..24: note = Synthetic Construct
  source 1..24: mol_type = other DNA
agacttcccagtgacaaccataga

SEQ ID NO: 24199 - DNA, 23 bp, synthetic construct
  misc_feature 1..23: note = Synthetic Construct
  source 1..23: mol_type = other DNA
cctggaactgggtttctttgaac

SEQ ID NO: 24200 - DNA, 24 bp, synthetic construct
  misc_feature 1..24: note = Synthetic Construct
  source 1..24: mol_type = other DNA
agcctagtagccactgaaactaga

SEQ ID NO: 24201 - DNA, 21 bp, synthetic construct
  misc_feature 1..21: note = Synthetic Construct
  source 1..21: mol_type = other DNA
tctggcacatgttgagtgctt

SEQ ID NO: 24202 - DNA, 22 bp, synthetic construct
  misc_feature 1..22: note = Synthetic Construct
  source 1..22: mol_type = other DNA
cagatcttctcctgccccaaca

SEQ ID NO: 24203 - DNA, 20 bp, synthetic construct
  misc_feature 1..20: note = Synthetic Construct
  source 1..20: mol_type = other DNA
gggctggggttggagagaag

SEQ ID NO: 24204 - DNA, 24 bp, synthetic construct
  misc_feature 1..24: note = Synthetic Construct
  source 1..24: mol_type = other DNA
cctttgacgtctagcatcctatgt

SEQ ID NO: 24205 - DNA, 22 bp, synthetic construct
  misc_feature 1..22: note = Synthetic Construct
  source 1..22: mol_type = other DNA
ccccaacaccctagagcctttt

SEQ ID NO: 24206 - DNA, 22 bp, synthetic construct
  misc_feature 1..22: note = Synthetic Construct
  source 1..22: mol_type = other DNA
gcaggtggggtaaggtctctga

SEQ ID NO: 24207 - DNA, 18 bp, synthetic construct
  misc_feature 1..18: note = Synthetic Construct
  source 1..18: mol_type = other DNA
ttgcccctcctggtgagt

SEQ ID NO: 24208 - DNA, 21 bp, synthetic construct
  misc_feature 1..21: note = Synthetic Construct
  source 1..21: mol_type = other DNA
ttctcctgaggctgactggaa

SEQ ID NO: 24209 - DNA, 21 bp, synthetic construct
  misc_feature 1..21: note = Synthetic Construct
  source 1..21: mol_type = other DNA
cccctcttgcctgggaataca

SEQ ID NO: 24210 - DNA, 22 bp, synthetic construct
  misc_feature 1..22: note = Synthetic Construct
  source 1..22: mol_type = other DNA
gccaaggattgggtctgtgtga

SEQ ID NO: 24211 - DNA, 21 bp, synthetic construct
  misc_feature 1..21: note = Synthetic Construct
  source 1..21: mol_type = other DNA
agcagccctcaacctggaaga

SEQ ID NO: 24212 - DNA, 26 bp, synthetic construct
  misc_feature 1..26: note = Synthetic Construct
  source 1..26: mol_type = other DNA
ctcttttctcttgggctgatcagttt

SEQ ID NO: 24213 - DNA, 22 bp, synthetic construct
  misc_feature 1..22: note = Synthetic Construct
  source 1..22: mol_type = other DNA
agagtctgacctccctttcaca

SEQ ID NO: 24214 - DNA, 24 bp, synthetic construct
  misc_feature 1..24: note = Synthetic Construct
  source 1..24: mol_type = other DNA
cccatggggcttaactttgactga

SEQ ID NO: 24215 - DNA, 23 bp, synthetic construct
  misc_feature 1..23: note = Synthetic Construct
  source 1..23: mol_type = other DNA
cacaagctgactgaagagtcctt

SEQ ID NO: 24216 - DNA, 22 bp, synthetic construct
  misc_feature 1..22: note = Synthetic Construct
  source 1..22: mol_type = other DNA
ccctgtcatgcgcaaggtgtta

SEQ ID NO: 24217 - DNA, 20 bp, synthetic construct
  misc_feature 1..20: note = Synthetic Construct
  source 1..20: mol_type = other DNA
aggaacctgggcccttgaat

SEQ ID NO: 24218 - DNA, 22 bp, synthetic construct
  misc_feature 1..22: note = Synthetic Construct
  source 1..22: mol_type = other DNA
gctatggggtgggaagacaagt

SEQ ID NO: 24219 - DNA, 19 bp, synthetic construct
  misc_feature 1..19: note = Synthetic Construct
  source 1..19: mol_type = other DNA
ggcccaggtcctgaacgaa

SEQ ID NO: 24220 - DNA, 23 bp, synthetic construct
  misc_feature 1..23: note = Synthetic Construct
  source 1..23: mol_type = other DNA
actgacaggttttgctgatggat

SEQ ID NO: 24221 - DNA, 20 bp, synthetic construct
  misc_feature 1..20: note = Synthetic Construct
  source 1..20: mol_type = other DNA
acgtggttgcaagctactga

SEQ ID NO: 24222 - DNA, 20 bp, synthetic construct
  misc_feature 1..20: note = Synthetic Construct
  source 1..20: mol_type = other DNA
agcgctgggtgtaggatgtt

SEQ ID NO: 24223 - DNA, 20 bp, synthetic construct
  misc_feature 1..20: note = Synthetic Construct
  source 1..20: mol_type = other DNA
ctgcctcaccgaagcattca

SEQ ID NO: 24224 - DNA, 23 bp, synthetic construct
  misc_feature 1..23: note = Synthetic Construct
  source 1..23: mol_type = other DNA
gcatgttccctgaattgccttac

SEQ ID NO: 24225 - DNA, 19 bp, synthetic construct
  misc_feature 1..19: note = Synthetic Construct
  source 1..19: mol_type = other DNA
tgaggctgagggtgcaaca

SEQ ID NO: 24226 - DNA, 25 bp, synthetic construct
  misc_feature 1..25: note = Synthetic Construct
  source 1..25: mol_type = other DNA
gagctacaaaatggaaggagactga

SEQ ID NO: 24227 - DNA, 21 bp, synthetic construct
  misc_feature 1..21: note = Synthetic Construct
  source 1..21: mol_type = other DNA
accagggaggaggcttgtgtt

SEQ ID NO: 24228 - DNA, 25 bp, synthetic construct
  misc_feature 1..25: note = Synthetic Construct
  source 1..25: mol_type = other DNA
gcccacagttatccttgactctctt

SEQ ID NO: 24229 - DNA, 25 bp, synthetic construct
  misc_feature 1..25: note = Synthetic Construct
  source 1..25: mol_type = other DNA
ggctgaccattaggttttactgtga

SEQ ID NO: 24230 - DNA, 19 bp, synthetic construct
  misc_feature 1..19: note = Synthetic Construct
  source 1..19: mol_type = other DNA
agcacgggcagcagcagaa

SEQ ID NO: 24231 - DNA, 23 bp, synthetic construct
  misc_feature 1..23: note = Synthetic Construct
  source 1..23: mol_type = other DNA
cctggtgcacactaggaataaca

SEQ ID NO: 24232 - DNA, 22 bp, synthetic construct
  misc_feature 1..22: note = Synthetic Construct
  source 1..22: mol_type = other DNA
ccctcagctacatgccgagaaa

SEQ ID NO: 24233 - DNA, 20 bp, synthetic construct
  misc_feature 1..20: note = Synthetic Construct
  source 1..20: mol_type = other DNA
agcaggcggatgtcaaggaa

SEQ ID NO: 24234 - DNA, 19 bp, synthetic construct
  misc_feature 1..19: note = Synthetic Construct
  source 1..19: mol_type = other DNA
tgggtctctggcctcactt

SEQ ID NO: 24235 - DNA, 21 bp, synthetic construct
  misc_feature 1..21: note = Synthetic Construct
  source 1..21: mol_type = other DNA
ggtcacctgtgcctaggagtt

SEQ ID NO: 24236 - DNA, 24 bp, synthetic construct
  misc_feature 1..24: note = Synthetic Construct
  source 1..24: mol_type = other DNA
gtctaggggcggttaggatacact

SEQ ID NO: 24237 - DNA, 22 bp, synthetic construct
  misc_feature 1..22: note = Synthetic Construct
  source 1..22: mol_type = other DNA
ggaacggggtggaactttcctt

SEQ ID NO: 24238 - DNA, 20 bp, synthetic construct
  misc_feature 1..20: note = Synthetic Construct
  source 1..20: mol_type = other DNA
agccaggcagcaagcatgaa

SEQ ID NO: 24239 - DNA, 21 bp, synthetic construct
  misc_feature 1..21: note = Synthetic Construct
  source 1..21: mol_type = other DNA
ggcatagcgtggtgaatgact

SEQ ID NO: 24240 - DNA, 24 bp, synthetic construct
  misc_feature 1..24: note = Synthetic Construct
  source 1..24: mol_type = other DNA
gagcaactcagactcatggagcaa

SEQ ID NO: 24241 - DNA, 20 bp, synthetic construct
  misc_feature 1..20: note = Synthetic Construct
  source 1..20: mol_type = other DNA
caccagcgggagcatcatta

SEQ ID NO: 24242 - DNA, 20 bp, synthetic construct
  misc_feature 1..20: note = Synthetic Construct
  source 1..20: mol_type = other DNA
cccggcaaagcctccctaat

SEQ ID NO: 24243 - DNA, 24 bp, synthetic construct
  misc_feature 1..24: note = Synthetic Construct
  source 1..24: mol_type = other DNA
gagtctgagccaaaatccttcact

SEQ ID NO: 24244 - DNA, 24 bp, synthetic construct
  misc_feature 1..24: note = Synthetic Construct
  source 1..24: mol_type = other DNA
actgaaaaggcggttgcttataga

SEQ ID NO: 24245 - DNA, 22 bp, synthetic construct
  misc_feature 1..22: note = Synthetic Construct
  source 1..22: mol_type = other DNA
tgtaggcagggtggtcgtgata

SEQ ID NO: 24246 - DNA, 24 bp, synthetic construct
  misc_feature 1..24: note = Synthetic Construct
  source 1..24: mol_type = other DNA
gcacaatcgataggcacaccacat

SEQ ID NO: 24247 - DNA, 22 bp, synthetic construct
  misc_feature 1..22: note = Synthetic Construct
  source 1..22: mol_type = other DNA
gcgtctgtgggactaacctctt

SEQ ID NO: 24248 - DNA, 20 bp, synthetic construct
  misc_feature 1..20: note = Synthetic Construct
  source 1..20: mol_type = other DNA
acatgaggggcagcttcact

SEQ ID NO: 24249 - DNA, 20 bp, synthetic construct
  misc_feature 1..20: note = Synthetic Construct
  source 1..20: mol_type = other DNA
agggtatgcctgagcacaca

SEQ ID NO: 24250 - DNA, 20 bp, synthetic construct
  misc_feature 1..20: note = Synthetic Construct
  source 1..20: mol_type = other DNA
gccctccagctccccatatc

SEQ ID NO: 24251 - DNA, 23 bp, synthetic construct
  misc_feature 1..23: note = Synthetic Construct
  source 1..23: mol_type = other DNA
ggcttccacacaggaaatagtgt

SEQ ID NO: 24252 - DNA, 24 bp, synthetic construct
  misc_feature 1..24: note = Synthetic Construct
  source 1..24: mol_type = other DNA
gggtgaggttgtgggaagcataag

SEQ ID NO: 24253 - DNA, 22 bp, synthetic construct
  misc_feature 1..22: note = Synthetic Construct
  source 1..22: mol_type = other DNA
gctcgcaggcaccctttattga

SEQ ID NO: 24254 - DNA, 23 bp, synthetic construct
  misc_feature 1..23: note = Synthetic Construct
  source 1..23: mol_type = other DNA
cctgctcccggatacacagaaac

SEQ ID NO: 24255 - DNA, 25 bp, synthetic construct
  misc_feature 1..25: note = Synthetic Construct
  source 1..25: mol_type = other DNA
gggattcttcctgaaattggctttg

SEQ ID NO: 24256 - DNA, 22 bp, synthetic construct
  misc_feature 1..22: note = Synthetic Construct
  source 1..22: mol_type = other DNA
ggcagaagccgagtcaatctct

SEQ ID NO: 24257 - DNA, 19 bp, synthetic construct
  misc_feature 1..19: note = Synthetic Construct
  source 1..19: mol_type = other DNA
acatgcggcttcgggtgtt

SEQ ID NO: 24258 - DNA, 20 bp, synthetic construct
  misc_feature 1..20: note = Synthetic Construct
  source 1..20: mol_type = other DNA
agacagcggccaggttgaat

SEQ ID NO: 24259 - DNA, 24 bp, synthetic construct
  misc_feature 1..24: note = Synthetic Construct
  source 1..24: mol_type = other DNA
ccaggaagcttctcaaagtcaaga

SEQ ID NO: 24260 - DNA, 18 bp, synthetic construct
  misc_feature 1..18: note = Synthetic Construct
  source 1..18: mol_type = other DNA
tgcttccttgcgcacaca

SEQ ID NO: 24261 - DNA, 24 bp, synthetic construct
  misc_feature 1..24: note = Synthetic Construct
  source 1..24: mol_type = other DNA
cctaagacatgtccccaggaaaaa

SEQ ID NO: 24262 - DNA, 21 bp, synthetic construct
  misc_feature 1..21: note = Synthetic Construct
  source 1..21: mol_type = other DNA
acagcctggagaccctgaaca

SEQ ID NO: 24263 - DNA, 23 bp, synthetic construct
  misc_feature 1..23: note = Synthetic Construct
  source 1..23: mol_type = other DNA
ccttcgaaacccagacgatctca

SEQ ID NO: 24264 - DNA, 25 bp, synthetic construct
  misc_feature 1..25: note = Synthetic Construct
  source 1..25: mol_type = other DNA
gactaggacctctgctaggattgta

SEQ ID NO: 24265 - DNA, 20 bp, synthetic construct
  misc_feature 1..20: note = Synthetic Construct
  source 1..20: mol_type = other DNA
ttccctccggggtcatggtt

SEQ ID NO: 24266 - DNA, 20 bp, synthetic construct
  misc_feature 1..20: note = Synthetic Construct
  source 1..20: mol_type = other DNA
ctgcacccagcccaaatgat

SEQ ID NO: 24267 - DNA, 23 bp, synthetic construct
  misc_feature 1..23: note = Synthetic Construct
  source 1..23: mol_type = other DNA
gctgggcaattcacgaggttttc

SEQ ID NO: 24268 - DNA, 24 bp, synthetic construct
  misc_feature 1..24: note = Synthetic Construct
  source 1..24: mol_type = other DNA
gtgatttttaaggccagcaccaat

SEQ ID NO: 24269 - DNA, 23 bp, synthetic construct
  misc_feature 1..23: note = Synthetic Construct
  source 1..23: mol_type = other DNA
ggcagatagtgccaagagaggtt

SEQ ID NO: 24270 - DNA, 24 bp, synthetic construct
  misc_feature 1..24: note = Synthetic Construct
  source 1..24: mol_type = other DNA
atgttagtgtgctgtttccagaga

SEQ ID NO: 24271 - DNA, 21 bp, synthetic construct
  misc_feature 1..21: note = Synthetic Construct
  source 1..21: mol_type = other DNA
tccagggccttctggtcatgt

SEQ ID NO: 24272 - DNA, 20 bp, synthetic construct
  misc_feature 1..20: note = Synthetic Construct
  source 1..20: mol_type = other DNA
tgctgctggggcatgaataa

SEQ ID NO: 24273 - DNA, 26 bp, synthetic construct
  misc_feature 1..26: note = Synthetic Construct
  source 1..26: mol_type = other DNA
gtgtcctcggtgtcaatacataacat

SEQ ID NO: 24274 - DNA, 20 bp, synthetic construct
  misc_feature 1..20: note = Synthetic Construct
  source 1..20: mol_type = other DNA
aagcgccagccgacactgat

SEQ ID NO: 24275 - DNA, 25 bp, synthetic construct
  misc_feature 1..25: note = Synthetic Construct
  source 1..25: mol_type = other DNA
ggggaggaaagagtgagctgtaaaa

SEQ ID NO: 24276 - DNA, 22 bp, synthetic construct
  misc_feature 1..22: note = Synthetic Construct
  source 1..22: mol_type = other DNA
cctgccatacagcactgacaga

SEQ ID NO: 24277 - DNA, 19 bp, synthetic construct
  misc_feature 1..19: note = Synthetic Construct
  source 1..19: mol_type = other DNA
tgcagagcccaggacaaag

SEQ ID NO: 24278 - DNA, 21 bp, synthetic construct
  misc_feature 1..21: note = Synthetic Construct
  source 1..21: mol_type = other DNA
ccctccagcactttggaggaa

SEQ ID NO: 24279 - DNA, 21 bp, synthetic construct
  misc_feature 1..21: note = Synthetic Construct
  source 1..21: mol_type = other DNA
aggagacagtggccctattca

SEQ ID NO: 24280 - DNA, 22 bp, synthetic construct
  misc_feature 1..22: note = Synthetic Construct
  source 1..22: mol_type = other DNA
ccttctcaaggccactgagcta

SEQ ID NO: 24281 - DNA, 21 bp, synthetic construct
  misc_feature 1..21: note = Synthetic Construct
  source 1..21: mol_type = other DNA
tcccacatctggggacagcat

SEQ ID NO: 24282 - DNA, 22 bp, synthetic construct
  misc_feature 1..22: note = Synthetic Construct
  source 1..22: mol_type = other DNA
cccaagctcctcctccttgaaa

SEQ ID NO: 24283 - DNA, 22 bp, synthetic construct
  misc_feature 1..22: note = Synthetic Construct
  source 1..22: mol_type = other DNA
cctctgcttctctccagcttca

SEQ ID NO: 24284 - DNA, 22 bp, synthetic construct
  misc_feature 1..22: note = Synthetic Construct
  source 1..22: mol_type = other DNA
gggagaaggggtggatcaagaa

SEQ ID NO: 24285 - DNA, 22 bp, synthetic construct
  misc_feature 1..22: note = Synthetic Construct
  source 1..22: mol_type = other DNA
gtctttcagctcagccacaatg

SEQ ID NO: 24286 - DNA, 19 bp, synthetic construct
  misc_feature 1..19: note = Synthetic Construct
  source 1..19: mol_type = other DNA
tggaggcgtacccaactgt

SEQ ID NO: 24287 - DNA, 20 bp, synthetic construct
  misc_feature 1..20: note = Synthetic Construct
  source 1..20: mol_type = other DNA
gcctgcctaccagtctgtct

SEQ ID NO: 24288 - DNA, 24 bp, synthetic construct
  misc_feature 1..24: note = Synthetic Construct
  source 1..24: mol_type = other DNA
gtgacttgtaggcattggtgtcaa

SEQ ID NO: 24289 - DNA, 26 bp, synthetic construct
  misc_feature 1..26: note = Synthetic Construct
  source 1..26: mol_type = other DNA
cctttgtataccagttccttctgcat

SEQ ID NO: 24290 - DNA, 20 bp, synthetic construct
  misc_feature 1..20: note = Synthetic Construct
  source 1..20: mol_type = other DNA
actcagcctcacaggtgttg

SEQ ID NO: 24291 - DNA, 21 bp, synthetic construct
  misc_feature 1..21: note = Synthetic Construct
  source 1..21: mol_type = other DNA
ccagcagatcctgccatcctt

SEQ ID NO: 24292 - DNA, 27 bp, synthetic construct
  misc_feature 1..27: note = Synthetic Construct
  source 1..27: mol_type = other DNA
aggagctaaaacactctttaccagatg

SEQ ID NO: 24293 - DNA, 20 bp, synthetic construct
  misc_feature 1..20: note = Synthetic Construct
  source 1..20: mol_type = other DNA
actgcaacaagggcaaggaa

SEQ ID NO: 24294 - DNA, 23 bp, synthetic construct
  misc_feature 1..23: note = Synthetic Construct
  source 1..23: mol_type = other DNA
gcatgaatcacgcttgttgtact

SEQ ID NO: 24295 - DNA, 19 bp, synthetic construct
  misc_feature 1..19: note = Synthetic Construct
  source 1..19: mol_type = other DNA
agccagctgcagttccaaa

SEQ ID NO: 24296 - DNA, 25 bp, synthetic construct
  misc_feature 1..25: note = Synthetic Construct
  source 1..25: mol_type = other DNA
caggctacagaaagcatttacaaca

SEQ ID NO: 24297 - DNA, 24 bp, synthetic construct
  misc_feature 1..24: note = Synthetic Construct
  source 1..24: mol_type = other DNA
ggcaagtgggcacttatccagtag

SEQ ID NO: 24298 - DNA, 22 bp, synthetic construct
  misc_feature 1..22: note = Synthetic Construct
  source 1..22: mol_type = other DNA
cccctaagggtgaatgcagaat

SEQ ID NO: 24299 - DNA, 25 bp, synthetic construct
  misc_feature 1..25: note = Synthetic Construct
  source 1..25: mol_type = other DNA
ccactaaacccacagaacccagaga

SEQ ID NO: 24300 - DNA, 23 bp, synthetic construct
  misc_feature 1..23: note = Synthetic Construct
  source 1..23: mol_type = other DNA
cagccagaccatctgtggaacaa

SEQ ID NO: 24301 - DNA, 25 bp, synthetic construct
  misc_feature 1..25: note = Synthetic Construct
  source 1..25: mol_type = other DNA
caggtgtgcatggagatgtttgaag

SEQ ID NO: 24302 - DNA, 22 bp, synthetic construct
  misc_feature 1..22: note = Synthetic Construct
  source 1..22: mol_type = other DNA
gaggatggggcaggtcaaagaa

SEQ ID NO: 24303 - DNA, 18 bp, synthetic construct
  misc_feature 1..18: note = Synthetic Construct
  source 1..18: mol_type = other DNA
atcacgtggctgctgctt

SEQ ID NO: 24304 - DNA, 22 bp, synthetic construct
  misc_feature 1..22: note = Synthetic Construct
  source 1..22: mol_type = other DNA
ccaccctccaggtgtttgcttt

SEQ ID NO: 24305 - DNA, 21 bp, synthetic construct
  misc_feature 1..21: note = Synthetic Construct
  source 1..21: mol_type = other DNA
atcagtgttggcgtctccttt

SEQ ID NO: 24306 - DNA, 22 bp, synthetic construct
  misc_feature 1..22: note = Synthetic Construct
  source 1..22: mol_type = other DNA
gaggcctgagaaactcgtgatg

SEQ ID NO: 24307 - DNA, 21 bp, synthetic construct
  misc_feature 1..21: note = Synthetic Construct
  source 1..21: mol_type = other DNA
gcctcatgtgaggggcttttc

SEQ ID NO: 24308 - DNA, 23 bp, synthetic construct
  misc_feature 1..23: note = Synthetic Construct
  source 1..23: mol_type = other DNA
tctactgctcccaccttagtcaa

SEQ ID NO: 24309 - DNA, 21 bp, synthetic construct
  misc_feature 1..21: note = Synthetic Construct
  source 1..21: mol_type = other DNA
gcagccactgatgcgaagaac

SEQ ID NO: 24310 - DNA, 22 bp, synthetic construct
  misc_feature 1..22: note = Synthetic Construct
  source 1..22: mol_type = other DNA
cccttcaggtggtcctgttttg

SEQ ID NO: 24311 - DNA, 19 bp, synthetic construct
  misc_feature 1..19: note = Synthetic Construct
  source 1..19: mol_type = other DNA
ggctggggttcaggccata

SEQ ID NO: 24312 - DNA, 20 bp, synthetic construct
  misc_feature 1..20: note = Synthetic Construct
  source 1..20: mol_type = other DNA
aggcccggaaaaagcacagt

SEQ ID NO: 24313 - DNA, 20 bp, synthetic construct
  misc_feature 1..20: note = Synthetic Construct
  source 1..20: mol_type = other DNA
tgagtgcccaacggcaagaa

SEQ ID NO: 24314 - DNA, 22 bp, synthetic construct
  misc_feature 1..22: note = Synthetic Construct
  source 1..22: mol_type = other DNA
tggggactgccctataatgtct

SEQ ID NO: 24315 - DNA, 22 bp, synthetic construct
  misc_feature 1..22: note = Synthetic Construct
  source 1..22: mol_type = other DNA
ggctggaacagcaagtctgcta

SEQ ID NO: 24316 - DNA, 23 bp, synthetic construct
  misc_feature 1..23: note = Synthetic Construct
  source 1..23: mol_type = other DNA
accaccaatcctaggcaacttac

SEQ ID NO: 24317 - DNA, 22 bp, synthetic construct
  misc_feature 1..22: note = Synthetic Construct
  source 1..22: mol_type = other DNA
cacaggggaggtttcctggtta

SEQ ID NO: 24318 - DNA, 21 bp, synthetic construct
  misc_feature 1..21: note = Synthetic Construct
  source 1..21: mol_type = other DNA
ccctctcaccagctcctctct

SEQ ID NO: 24319 - DNA, 20 bp, synthetic construct
  misc_feature 1..20: note = Synthetic Construct
  source 1..20: mol_type = other DNA
caccacagagcccaagaaca

SEQ ID NO: 24320 - DNA, 21 bp, synthetic construct
  misc_feature 1..21: note = Synthetic Construct
  source 1..21: mol_type = other DNA
gtggaaattgcctgcgtgtct

SEQ ID NO: 24321 - DNA, 20 bp, synthetic construct
  misc_feature 1..20: note = Synthetic Construct
  source 1..20: mol_type = other DNA
tcatgttggccggtggaaat

SEQ ID NO: 24322 - DNA, 22 bp, synthetic construct
  misc_feature 1..22: note = Synthetic Construct
  source 1..22: mol_type = other DNA
gtgcagccacagtaatgctttt

SEQ ID NO: 24323 - DNA, 20 bp, synthetic construct
  misc_feature 1..20: note = Synthetic Construct
  source 1..20: mol_type = other DNA
aacgggtcctgagaccaaac

SEQ ID NO: 24324 - DNA, 25 bp, synthetic construct
  misc_feature 1..25: note = Synthetic Construct
  source 1..25: mol_type = other DNA
cctgagcaattcccaacctcctctt

SEQ ID NO: 24325 - DNA, 23 bp, synthetic construct
  misc_feature 1..23: note = Synthetic Construct
  source 1..23: mol_type = other DNA
ttcactctccctcctgtgtagaa

SEQ ID NO: 24326 - DNA, 20 bp, synthetic construct
  misc_feature 1..20: note = Synthetic Construct
  source 1..20: mol_type = other DNA
ggtccctggcacgtacttct

SEQ ID NO: 24327 - DNA, 22 bp, synthetic construct
  misc_feature 1..22: note = Synthetic Construct
  source 1..22: mol_type = other DNA
tagcaggaacagtggcgtgtca

SEQ ID NO: 24328 - DNA, 22 bp, synthetic construct
  misc_feature 1..22: note = Synthetic Construct
  source 1..22: mol_type = other DNA
ggcttaggtgggaggatcactt

SEQ ID NO: 24329 - DNA, 22 bp, synthetic construct
  misc_feature 1..22: note = Synthetic Construct
  source 1..22: mol_type = other DNA
acgcagagacccacagcaatac

SEQ ID NO: 24330 - DNA, 25 bp, synthetic construct
  misc_feature 1..25: note = Synthetic Construct
  source 1..25: mol_type = other DNA
tgcttctcccattttccatttcctt

SEQ ID NO: 24331 - DNA, 21 bp, synthetic construct
  misc_feature 1..21: note = Synthetic Construct
  source 1..21: mol_type = other DNA
gttcccagaactggtgtggtt

SEQ ID NO: 24332 - DNA, 25 bp, synthetic construct
  misc_feature 1..25: note = Synthetic Construct
  source 1..25: mol_type = other DNA
tctgaagctcacatggattccttag

SEQ ID NO: 24333 - DNA, 24 bp, synthetic construct
  misc_feature 1..24: note = Synthetic Construct
  source 1..24: mol_type = other DNA
agttttgtcagaggtgttgagtga

SEQ ID NO: 24334 - DNA, 20 bp, synthetic construct
  misc_feature 1..20: note = Synthetic Construct
  source 1..20: mol_type = other DNA
gcagcagggactaacgacaa

SEQ ID NO: 24335 - DNA, 18 bp, synthetic construct
  misc_feature 1..18: note = Synthetic Construct
  source 1..18: mol_type = other DNA
tcgcactgcaacggctaa

SEQ ID NO: 24336 - DNA, 22 bp, synthetic construct
  misc_feature 1..22: note = Synthetic Construct
  source 1..22: mol_type = other DNA
caggtggcacataggagctgaa

SEQ ID NO: 24337 - DNA, 22 bp, synthetic construct
  misc_feature 1..22: note = Synthetic Construct
  source 1..22: mol_type = other DNA
ctgcctgttcccaatccaggaa

SEQ ID NO: 24338 - DNA, 22 bp, synthetic construct
  misc_feature 1..22: note = Synthetic Construct
  source 1..22: mol_type = other DNA
ggggtctgaacccagctccata

SEQ ID NO: 24339 - DNA, 22 bp, synthetic construct
  misc_feature 1..22: note = Synthetic Construct
  source 1..22: mol_type = other DNA
agcacctctacttggtcacaga

SEQ ID NO: 24340 - DNA, 22 bp, synthetic construct
  misc_feature 1..22: note = Synthetic Construct
  source 1..22: mol_type = other DNA
ggtttccccaatacccagttca

SEQ ID NO: 24341 - DNA, 21 bp, synthetic construct
  misc_feature 1..21: note = Synthetic Construct
  source 1..21: mol_type = other DNA
cctctgacgtgccatttgtgt

SEQ ID NO: 24342 - DNA, 19 bp, synthetic construct
  misc_feature 1..19: note = Synthetic Construct
  source 1..19: mol_type = other DNA
ggcctgcattcccgaaact

SEQ ID NO: 24343 - DNA, 19 bp, synthetic construct
  misc_feature 1..19: note = Synthetic Construct
  source 1..19: mol_type = other DNA
tagcaaggcctgccctcaa

SEQ ID NO: 24344 - DNA, 23 bp, synthetic construct
  misc_feature 1..23: note = Synthetic Construct
  source 1..23: mol_type = other DNA
ggctcagaaggaactcatgcaaa

SEQ ID NO: 24345 - DNA, 24 bp, synthetic construct
  misc_feature 1..24: note = Synthetic Construct
  source 1..24: mol_type = other DNA
gcaaggaggaacaaaagtttccat

SEQ ID NO: 24346 - DNA, 26 bp, synthetic construct
  misc_feature 1..26: note = Synthetic Construct
  source 1..26: mol_type = other DNA
cactcctattcccaagcttccagttc

SEQ ID NO: 24347 - DNA, 21 bp, synthetic construct
  misc_feature 1..21: note = Synthetic Construct
  source 1..21: mol_type = other DNA
accacacctgggcagaataag

SEQ ID NO: 24348 - DNA, 20 bp, synthetic construct
  misc_feature 1..20: note = Synthetic Construct
  source 1..20: mol_type = other DNA
gccgccatgaactctactca

SEQ ID NO: 24349 - DNA, 21 bp, synthetic construct
  misc_feature 1..21: note = Synthetic Construct
  source 1..21: mol_type = other DNA
ccccagtcaggggcttataca

SEQ ID NO: 24350 - DNA, 26 bp, synthetic construct
  misc_feature 1..26: note = Synthetic Construct
  source 1..26: mol_type = other DNA
tgcctctcctaatctgtctttctact

SEQ ID NO: 24351 - DNA, 26 bp, synthetic construct
  misc_feature 1..26: note = Synthetic Construct
  source 1..26: mol_type = other DNA
ctgacctaggatctgactctctctga

SEQ ID NO: 24352 - DNA, 23 bp, synthetic construct
  misc_feature 1..23: note = Synthetic Construct
  source 1..23: mol_type = other DNA
gccaccagagacgtctttccttt

SEQ ID NO: 24353 - DNA, 24 bp, synthetic construct
  misc_feature 1..24: note = Synthetic Construct
  source 1..24: mol_type = other DNA
gtctcaggatctgcagttgacaag

SEQ ID NO: 24354 - DNA, 21 bp, synthetic construct
  misc_feature 1..21: note = Synthetic Construct
  source 1..21: mol_type = other DNA
accatcaccctatcccacagt

SEQ ID NO: 24355 - DNA, 25 bp, synthetic construct
  misc_feature 1..25: note = Synthetic Construct
  source 1..25: mol_type = other DNA
cgccagtatccttcaaggtggagtt

SEQ ID NO: 24356 - DNA, 21 bp, synthetic construct
  misc_feature 1..21: note = Synthetic Construct
  source 1..21: mol_type = other DNA
ggagctagggaagtggaggat

SEQ ID NO: 24357 - DNA, 20 bp, synthetic construct
  misc_feature 1..20: note = Synthetic Construct
  source 1..20: mol_type = other DNA
ggaggcagctgcggtaactt

SEQ ID NO: 24358 - DNA, 20 bp, synthetic construct
  misc_feature 1..20: note = Synthetic Construct
  source 1..20: mol_type = other DNA
ggcacagacaggaactcaca

SEQ ID NO: 24359 - DNA, 19 bp, synthetic construct
  misc_feature 1..19: note = Synthetic Construct
  source 1..19: mol_type = other DNA
ggggctcctctgctgtgat

SEQ ID NO: 24360 - DNA, 22 bp, synthetic construct
  misc_feature 1..22: note = Synthetic Construct
  source 1..22: mol_type = other DNA
caaacagagcaggtccgtggta

SEQ ID NO: 24361 - DNA, 23 bp, synthetic construct
  misc_feature 1..23: note = Synthetic Construct
  source 1..23: mol_type = other DNA
aggcagcagagagtagtggttta

SEQ ID NO: 24362 - DNA, 21 bp, synthetic construct
  misc_feature 1..21: note = Synthetic Construct
  source 1..21: mol_type = other DNA
taggcccatgccactgcagaa

SEQ ID NO: 24363 - DNA, 22 bp, synthetic construct
  misc_feature 1..22: note = Synthetic Construct
  source 1..22: mol_type = other DNA
gtcttctgagtggtgcaaggaa

SEQ ID NO: 24364 - DNA, 21 bp, synthetic construct
  misc_feature 1..21: note = Synthetic Construct
  source 1..21: mol_type = other DNA
gtcatagctggctgcagactt

SEQ ID NO: 24365 - DNA, 19 bp, synthetic construct
  misc_feature 1..19: note = Synthetic Construct
  source 1..19: mol_type = other DNA
ccactccctgcccatctgt

SEQ ID NO: 24366 - DNA, 22 bp, synthetic construct
  misc_feature 1..22: note = Synthetic Construct
  source 1..22: mol_type = other DNA
tgccttccaggagcacagagtt

SEQ ID NO: 24367 - DNA, 22 bp, synthetic construct
  misc_feature 1..22: note = Synthetic Construct
  source 1..22: mol_type = other DNA
ggcaacccttcccttcaacctt

SEQ ID NO: 24368 - DNA, 22 bp, synthetic construct
  misc_feature 1..22: note = Synthetic Construct
  source 1..22: mol_type = other DNA
tcaagccagtgaccggaggtta

SEQ ID NO: 24369 - DNA, 25 bp, synthetic construct
  misc_feature 1..25: note = Synthetic Construct
  source 1..25: mol_type = other DNA
ccaaacctttcacactgtctttcaa

SEQ ID NO: 24370 - DNA, 24 bp, synthetic construct
  misc_feature 1..24: note = Synthetic Construct
  source 1..24: mol_type = other DNA
ccttgagcagatccatccccatga

SEQ ID NO: 24371 - DNA, 22 bp, synthetic construct
  misc_feature 1..22: note = Synthetic Construct
  source 1..22: mol_type = other DNA
ggatgctcttccaactggttca

SEQ ID NO: 24372 - DNA, 23 bp, synthetic construct
  misc_feature 1..23: note = Synthetic Construct
  source 1..23: mol_type = other DNA
gcccagtatccctagctccatac

SEQ ID NO: 24373 - DNA, 26 bp, synthetic construct
  misc_feature 1..26: note = Synthetic Construct
  source 1..26: mol_type = other DNA
tcctagtggaatcttctgatgcattg

SEQ ID NO: 24374 - DNA, 19 bp, synthetic construct
  misc_feature 1..19: note = Synthetic Construct
  source 1..19: mol_type = other DNA
caggtccagggcccctttt

SEQ ID NO: 24375 - DNA, 22 bp, synthetic construct
  misc_feature 1..22: note = Synthetic Construct
  source 1..22: mol_type = other DNA
ggcttcccattgccttccattg

SEQ ID NO: 24376 - DNA, 20 bp, synthetic construct
  misc_feature 1..20: note = Synthetic Construct
  source 1..20: mol_type = other DNA
gcagggtctctgctcaactt

SEQ ID NO: 24377 - DNA, 23 bp, synthetic construct
  misc_feature 1..23: note = Synthetic Construct
  source 1..23: mol_type = other DNA
ggagagtagttgcaaagctcgaa

SEQ ID NO: 24378 - DNA, 19 bp, synthetic construct
  misc_feature 1..19: note = Synthetic Construct
  source 1..19: mol_type = other DNA
agccctgctgctgcttctt

SEQ ID NO: 24379 - DNA, 22 bp, synthetic construct
  misc_feature 1..22: note = Synthetic Construct
  source 1..22: mol_type = other DNA
atgggcctacctgagtgacctt

SEQ ID NO: 24380 - DNA, 19 bp, synthetic construct
  misc_feature 1..19: note = Synthetic Construct
  source 1..19: mol_type = other DNA
ctgacccggtgaccgaatg

SEQ ID NO: 24381 - DNA, 21 bp, synthetic construct
  misc_feature 1..21: note = Synthetic Construct
  source 1..21: mol_type = other DNA
gctcaggcctgctttcttcaa

SEQ ID NO: 24382 - DNA, 20 bp, synthetic construct
  misc_feature 1..20: note = Synthetic Construct
  source 1..20: mol_type = other DNA
tgcccggccggtacattttt

SEQ ID NO: 24383 - DNA, 20 bp, synthetic construct
  misc_feature 1..20: note = Synthetic Construct
  source 1..20: mol_type = other DNA
aaggtaagggctcgggaact

SEQ ID NO: 24384 - DNA, 23 bp, synthetic construct
  misc_feature 1..23: note = Synthetic Construct
  source 1..23: mol_type = other DNA
agcctccctatcattgtggatga

SEQ ID NO: 24385 - DNA, 22 bp, synthetic construct
  misc_feature 1..22: note = Synthetic Construct
  source 1..22: mol_type = other DNA
gcagggcaaacgtcctgaagaa

SEQ ID NO: 24386 - DNA, 21 bp, synthetic construct
  misc_feature 1..21: note = Synthetic Construct
  source 1..21: mol_type = other DNA
actcagagggactcccggtat

SEQ ID NO: 24387 - DNA, 20 bp, synthetic construct
  misc_feature 1..20: note = Synthetic Construct
  source 1..20: mol_type = other DNA
tctcctgctgccccaccaaa

SEQ ID NO: 24388 - DNA, 21 bp, synthetic construct
  misc_feature 1..21: note = Synthetic Construct
  source 1..21: mol_type = other DNA
tggggtgaaaacgtgaagtga

SEQ ID NO: 24389 - DNA, 21 bp, synthetic construct
  misc_feature 1..21: note = Synthetic Construct
  source 1..21: mol_type = other DNA
agccgtggagtccatcctctt

SEQ ID NO: 24390 - DNA, 23 bp, synthetic construct
  misc_feature 1..23: note = Synthetic Construct
  source 1..23: mol_type = other DNA
agctctcatggaagcctgtattg

SEQ ID NO: 24391 - DNA, 22 bp, synthetic construct
  misc_feature 1..22: note = Synthetic Construct
  source 1..22: mol_type = other DNA
gcacccagacagacagaactga

SEQ ID NO: 24392 - DNA, 22 bp, synthetic construct
  misc_feature 1..22: note = Synthetic Construct
  source 1..22: mol_type = other DNA
aagccccactaggttggtgatg

SEQ ID NO: 24393 - DNA, 21 bp, synthetic construct
  misc_feature 1..21: note = Synthetic Construct
  source 1..21: mol_type = other DNA
gccaggagggtgcaaggattt

SEQ ID NO: 24394 - DNA, 22 bp, synthetic construct
  misc_feature 1..22: note = Synthetic Construct
  source 1..22: mol_type = other DNA
agggagggctgctcctttagat

SEQ ID NO: 24395 - DNA, 22 bp, synthetic construct
  misc_feature 1..22: note = Synthetic Construct
  source 1..22: mol_type = other DNA
gggcagactcaggatgggtttt

SEQ ID NO: 24396 - DNA, 20 bp, synthetic construct
  misc_feature 1..20: note = Synthetic Construct
  source 1..20: mol_type = other DNA
agtggcaggtcaaggcatct

SEQ ID NO: 24397 - DNA, 19 bp, synthetic construct
  misc_feature 1..19: note = Synthetic Construct
  source 1..19: mol_type = other DNA
tggcggctgctcagtcttg

SEQ ID NO: 24398 - DNA, 20 bp, synthetic construct
  misc_feature 1..20: note = Synthetic Construct
  source 1..20: mol_type = other DNA
gggaatgaagcggggagtga

SEQ ID NO: 24399 - DNA, 23 bp, synthetic construct
  misc_feature 1..23: note = Synthetic Construct
  source 1..23: mol_type = other DNA
cctcatcctgcagaggagcaaac

SEQ ID NO: 24400 - DNA, 26 bp, synthetic construct
  misc_feature 1..26: note = Synthetic Construct
  source 1..26: mol_type = other DNA
gggagggatgttgaagataattggat

SEQ ID NO: 24401 - DNA, 20 bp, synthetic construct
  misc_feature 1..20: note = Synthetic Construct
  source 1..20: mol_type = other DNA
aaccgggcccagaggttaag

SEQ ID NO: 24402 - DNA, 22 bp, synthetic construct
  misc_feature 1..22: note = Synthetic Construct
  source 1..22: mol_type = other DNA
gcatagcttggcagtgaacttg

SEQ ID NO: 24403 - DNA, 25 bp, synthetic construct
  misc_feature 1..25: note = Synthetic Construct
  source 1..25: mol_type = other DNA
gctgaatggatcacggaaatgatct

SEQ ID NO: 24404 - DNA, 22 bp, synthetic construct
  misc_feature 1..22: note = Synthetic Construct
  source 1..22: mol_type = other DNA
gacagggtcagtatcccagtca

SEQ ID NO: 24405 - DNA, 20 bp, synthetic construct
  misc_feature 1..20: note = Synthetic Construct
  source 1..20: mol_type = other DNA
agtgggaaggtgggaagcat

SEQ ID NO: 24406 - DNA, 23 bp, synthetic construct
  misc_feature 1..23: note = Synthetic Construct
  source 1..23: mol_type = other DNA
ggatccccagacagaggattcaa

SEQ ID NO: 24407 - DNA, 23 bp, synthetic construct
  misc_feature 1..23: note = Synthetic Construct
  source 1..23: mol_type = other DNA
cctctcaccttgagctcctgata

SEQ ID NO: 24408 - DNA, 21 bp, synthetic construct
  misc_feature 1..21: note = Synthetic Construct
  source 1..21: mol_type = other DNA
gcctgggcaacccacattttg

SEQ ID NO: 24409 - DNA, 22 bp, synthetic construct
  misc_feature 1..22: note = Synthetic Construct
  source 1..22: mol_type = other DNA
acacaggtggagcagaccagtt

SEQ ID NO: 24410 - DNA, 22 bp, synthetic construct
  misc_feature 1..22: note = Synthetic Construct
  source 1..22: mol_type = other DNA
ctcatgggcacctttgacttga

SEQ ID NO: 24411 - DNA, 23 bp, synthetic construct
  misc_feature 1..23: note = Synthetic Construct
  source 1..23: mol_type = other DNA
ccttgcaaagcgatccagacctt

SEQ ID NO: 24412 - DNA, 22 bp, synthetic construct
  misc_feature 1..22: note = Synthetic Construct
  source 1..22: mol_type = other DNA
ggagtcaaagctccggcttcat

SEQ ID NO: 24413 - DNA, 23 bp, synthetic construct
  misc_feature 1..23: note = Synthetic Construct
  source 1..23: mol_type = other DNA
gtgcagccaccaaactttactga

SEQ ID NO: 24414 - DNA, 22 bp, synthetic construct
  misc_feature 1..22: note = Synthetic Construct
  source 1..22: mol_type = other DNA
ggtggcctttgttcccttgcta

SEQ ID NO: 24415 - DNA, 24 bp, synthetic construct
  misc_feature 1..24: note = Synthetic Construct
  source 1..24: mol_type = other DNA
ctgtgaccagaatgagacatgagt

SEQ ID NO: 24416 - DNA, 25 bp, synthetic construct
  misc_feature 1..25: note = Synthetic Construct
  source 1..25: mol_type = other DNA
caccaccttcttaggtttaccagat

SEQ ID NO: 24417 - DNA, 24 bp, synthetic construct
  misc_feature 1..24: note = Synthetic Construct
  source 1..24: mol_type = other DNA
ggcattgcagatggagaattgact

SEQ ID NO: 24418 - DNA, 24 bp, synthetic construct
  misc_feature 1..24: note = Synthetic Construct
  source 1..24: mol_type = other DNA
gcacccctaggttgaaccattttc

SEQ ID NO: 24419 - DNA, 22 bp, synthetic construct
  misc_feature 1..22: note = Synthetic Construct
  source 1..22: mol_type = other DNA
ggcagaagtcaccacatcagtt

SEQ ID NO: 24420 - DNA, 20 bp, synthetic construct
  misc_feature 1..20: note = Synthetic Construct
  source 1..20: mol_type = other DNA
tggcaattgtccaggcaaga

SEQ ID NO: 24421 - DNA, 20 bp, synthetic construct
  misc_feature 1..20: note = Synthetic Construct
  source 1..20: mol_type = other DNA
tgtggccttcgagcatgtga

SEQ ID NO: 24422 - DNA, 24 bp, synthetic construct
  misc_feature 1..24: note = Synthetic Construct
  source 1..24: mol_type = other DNA
acctaacatgagcagaggctctaa

SEQ ID NO: 24423 - DNA, 24 bp, synthetic construct
  misc_feature 1..24: note = Synthetic Construct
  source 1..24: mol_type = other DNA
cgatgaaggcaccctagagctatt

SEQ ID NO: 24424 - DNA, 21 bp, synthetic construct
  misc_feature 1..21: note = Synthetic Construct
  source 1..21: mol_type = other DNA
cagggccaagaaacacagcat

SEQ ID NO: 24425 - DNA, 20 bp, synthetic construct
  misc_feature 1..20: note = Synthetic Construct
  source 1..20: mol_type = other DNA
agcccaacccaccagcctaa

SEQ ID NO: 24426 - DNA, 24 bp, synthetic construct
  misc_feature 1..24: note = Synthetic Construct
  source 1..24: mol_type = other DNA
gcaggaatggaagatgaggcacaa

SEQ ID NO: 24427 - DNA, 24 bp, synthetic construct
  misc_feature 1..24: note = Synthetic Construct
  source 1..24: mol_type = other DNA
gctaggatgaccatatccctgtga

SEQ ID NO: 24428 - DNA, 22 bp, synthetic construct
  misc_feature 1..22: note = Synthetic Construct
  source 1..22: mol_type = other DNA
atcctctaggcccaccttcttc

SEQ ID NO: 24429 - DNA, 20 bp, synthetic construct
  misc_feature 1..20: note = Synthetic Construct
  source 1..20: mol_type = other DNA
aaggggcatgtgcccagtaa

SEQ ID NO: 24430 - DNA, 20 bp, synthetic construct
  misc_feature 1..20: note = Synthetic Construct
  source 1..20: mol_type = other DNA
cccctggactgtgtgcttca

SEQ ID NO: 24431 - DNA, 21 bp, synthetic construct
  misc_feature 1..21: note = Synthetic Construct
  source 1..21: mol_type = other DNA
tcctgagacactggcctaact

SEQ ID NO: 24432 - DNA, 22 bp, synthetic construct
  misc_feature 1..22: note = Synthetic Construct
  source 1..22: mol_type = other DNA
aagtgatggctaagtgccttgt

SEQ ID NO: 24433 - DNA, 21 bp, synthetic construct
  misc_feature 1..21: note = Synthetic Construct
  source 1..21: mol_type = other DNA
ccacgctactgtcccgcttag

SEQ ID NO: 24434 - DNA, 21 bp, synthetic construct
  misc_feature 1..21: note = Synthetic Construct
  source 1..21: mol_type = other DNA
tttcctgcccacccagtgaca

SEQ ID NO: 24435 - DNA, 19 bp, synthetic construct
  misc_feature 1..19: note = Synthetic Construct
  source 1..19: mol_type = other DNA
gcgtgggcctggatgttca

SEQ ID NO: 24436 - DNA, 22 bp, synthetic construct
  misc_feature 1..22: note = Synthetic Construct
  source 1..22: mol_type = other DNA
ggagccacagggacatgaatag

SEQ ID NO: 24437 - DNA, 22 bp, synthetic construct
  misc_feature 1..22: note = Synthetic Construct
  source 1..22: mol_type = other DNA
tagcagcatggagtggctgagt

SEQ ID NO: 24438 - DNA, 22 bp, synthetic construct
  misc_feature 1..22: note = Synthetic Construct
  source 1..22: mol_type = other DNA
gtgctgctaccgttactgaaca

SEQ ID NO: 24439 - DNA, 24 bp, synthetic construct
  misc_feature 1..24: note = Synthetic Construct
  source 1..24: mol_type = other DNA
ctgtggtagaagcaggaggacact

SEQ ID NO: 24440 - DNA, 21 bp, synthetic construct
  misc_feature 1..21: note = Synthetic Construct
  source 1..21: mol_type = other DNA
agaagcagtgttggggagcta

SEQ ID NO: 24441 - DNA, 19 bp, synthetic construct
  misc_feature 1..19: note = Synthetic Construct
  source 1..19: mol_type = other DNA
ggcacagggctgcaacgta

SEQ ID NO: 24442 - DNA, 26 bp, synthetic construct
  misc_feature 1..26: note = Synthetic Construct
  source 1..26: mol_type = other DNA
actcaaggtcctagtgctttacaatc

SEQ ID NO: 24443 - DNA, 21 bp, synthetic construct
  misc_feature 1..21: note = Synthetic Construct
  source 1..21: mol_type = other DNA
gctcagcgctcagtagtctct

SEQ ID NO: 24444 - DNA, 21 bp, synthetic construct
  misc_feature 1..21: note = Synthetic Construct
  source 1..21: mol_type = other DNA
aaggccctccagggactcaca

SEQ ID NO: 24445 - DNA, 24 bp, synthetic construct
  misc_feature 1..24: note = Synthetic Construct
  source 1..24: mol_type = other DNA
ccagcctgtcaataaagctgagat

SEQ ID NO: 24446 - DNA, 23 bp, synthetic construct
  misc_feature 1..23: note = Synthetic Construct
  source 1..23: mol_type = other DNA
ccccaaaacaactcagggacata

SEQ ID NO: 24447 - DNA, 23 bp, synthetic construct
  misc_feature 1..23: note = Synthetic Construct
  source 1..23: mol_type = other DNA
ggccacgtgactcatagatgctt

SEQ ID NO: 24448 - DNA, 21 bp, synthetic construct
  misc_feature 1..21: note = Synthetic Construct
  source 1..21: mol_type = other DNA
cacgaagctccacacactaca

SEQ ID NO: 24449 - DNA, 22 bp, synthetic construct
  misc_feature 1..22: note = Synthetic Construct
  source 1..22: mol_type = other DNA
gcacaggagctgcagagtgaaa

SEQ ID NO: 24450 - DNA, 22 bp, synthetic construct
  misc_feature 1..22: note = Synthetic Construct
  source 1..22: mol_type = other DNA
gggtcagagggaaaagctccat

SEQ ID NO: 24451 - DNA, 23 bp, synthetic construct
  misc_feature 1..23: note = Synthetic Construct
  source 1..23: mol_type = other DNA
acagcgttacaatgacacacttg

SEQ ID NO: 24452 - DNA, 20 bp, synthetic construct
  misc_feature 1..20: note = Synthetic Construct
  source 1..20: mol_type = other DNA
agagacggctgcctcgttga

SEQ ID NO: 24453 - DNA, 19 bp, synthetic construct
  misc_feature 1..19: note = Synthetic Construct
  source 1..19: mol_type = other DNA
cccggtgaaccgcactcaa

SEQ ID NO: 24454 - DNA, 22 bp, synthetic construct
  misc_feature 1..22: note = Synthetic Construct
  source 1..22: mol_type = other DNA
cctgtgtgcctcaatcttccaa

SEQ ID NO: 24455 - DNA, 23 bp, synthetic construct
  misc_feature 1..23: note = Synthetic Construct
  source 1..23: mol_type = other DNA
cagaaacaggccctcaaccatga

SEQ ID NO: 24456 - DNA, 21 bp, synthetic construct
  misc_feature 1..21: note = Synthetic Construct
  source 1..21: mol_type = other DNA
cagggcgattcttgctcatca

SEQ ID NO: 24457 - DNA, 21 bp, synthetic construct
  misc_feature 1..21: note = Synthetic Construct
  source 1..21: mol_type = other DNA
cagggctttaggactgccatt

SEQ ID NO: 24458 - DNA, 24 bp, synthetic construct
  misc_feature 1..24: note = Synthetic Construct
  source 1..24: mol_type = other DNA
gttccagggatttgacccttttca

SEQ ID NO: 24459 - DNA, 20 bp, synthetic construct
  misc_feature 1..20: note = Synthetic Construct
  source 1..20: mol_type = other DNA
gccatccagcaccacagctt

SEQ ID NO: 24460 - DNA, 21 bp, synthetic construct
  misc_feature 1..21: note = Synthetic Construct
  source 1..21: mol_type = other DNA
tcgctcctgactctgcacctt

SEQ ID NO: 24461 - DNA, 23 bp, synthetic construct
  misc_feature 1..23: note = Synthetic Construct
  source 1..23: mol_type = other DNA
tctcacctcactgtcatctctgt

SEQ ID NO: 24462 - DNA, 21 bp, synthetic construct
  misc_feature 1..21: note = Synthetic Construct
  source 1..21: mol_type = other DNA
tggagtggggactgagttcat

SEQ ID NO: 24463 - DNA, 20 bp, synthetic construct
  misc_feature 1..20: note = Synthetic Construct
  source 1..20: mol_type = other DNA
gcaagtccccacctgtctgt

SEQ ID NO: 24464 - DNA, 20 bp, synthetic construct
  misc_feature 1..20: note = Synthetic Construct
  source 1..20: mol_type = other DNA
tgagccaagcaccgtcctaa

SEQ ID NO: 24465 - DNA, 28 bp, synthetic construct
  misc_feature 1..28: note = Synthetic Construct
  source 1..28: mol_type = other DNA
gctggaaagggtttgattcaatggatgt

SEQ ID NO: 24466 - DNA, 22 bp, synthetic construct
  misc_feature 1..22: note = Synthetic Construct
  source 1..22: mol_type = other DNA
gattgcaggcctccatgcaaag

SEQ ID NO: 24467 - DNA, 20 bp, synthetic construct
  misc_feature 1..20: note = Synthetic Construct
  source 1..20: mol_type = other DNA
attcctgctgccctcgcatt

SEQ ID NO: 24468 - DNA, 22 bp, synthetic construct
  misc_feature 1..22: note = Synthetic Construct
  source 1..22: mol_type = other DNA
cagcctcaggggtgagaaatga

SEQ ID NO: 24469 - DNA, 23 bp, synthetic construct
  misc_feature 1..23: note = Synthetic Construct
  source 1..23: mol_type = other DNA
ttgcctgaagtctctgctctaag

SEQ ID NO: 24470 - DNA, 21 bp, synthetic construct
  misc_feature 1..21: note = Synthetic Construct
  source 1..21: mol_type = other DNA
ccagctaggacatggcagttc

SEQ ID NO: 24471 - DNA, 24 bp, synthetic construct
  misc_feature 1..24: note = Synthetic Construct
  source 1..24: mol_type = other DNA
gcccaaatcctaccctttgtttac

SEQ ID NO: 24472 - DNA, 21 bp, synthetic construct
  misc_feature 1..21: note = Synthetic Construct
  source 1..21: mol_type = other DNA
cccctttgccagagcacatct

SEQ ID NO: 24473 - DNA, 18 bp, synthetic construct
  misc_feature 1..18: note = Synthetic Construct
  source 1..18: mol_type = other DNA
gcagctgggcacacagaa

SEQ ID NO: 24474 - DNA, 19 bp, synthetic construct
  misc_feature 1..19: note = Synthetic Construct
  source 1..19: mol_type = other DNA
agagcgctccgcctgtact

SEQ ID NO: 24475 - DNA, 20 bp, synthetic construct
  misc_feature 1..20: note = Synthetic Construct
  source 1..20: mol_type = other DNA
cacgtctgcgtgagtactgt

SEQ ID NO: 24476 - DNA, 23 bp, synthetic construct
  misc_feature 1..23: note = Synthetic Construct
  source 1..23: mol_type = other DNA
ccagtcaaactggtctcttcagt

SEQ ID NO: 24477 - DNA, 23 bp, synthetic construct
  misc_feature 1..23: note = Synthetic Construct
  source 1..23: mol_type = other DNA
agctcttcctcaagccaaaatct

SEQ ID NO: 24478 - DNA, 24 bp, synthetic construct
  misc_feature 1..24: note = Synthetic Construct
  source 1..24: mol_type = other DNA
gcggtagtgtttccctctctgtag

SEQ ID NO: 24479 - DNA, 23 bp, synthetic construct
  misc_feature 1..23: note = Synthetic Construct
  source 1..23: mol_type = other DNA
ttgcagggaaaggagagtacaag

SEQ ID NO: 24480 - DNA, 22 bp, synthetic construct
  misc_feature 1..22: note = Synthetic Construct
  source 1..22: mol_type = other DNA
gagggagaacacctgccttgaa

SEQ ID NO: 24481 - DNA, 21 bp, synthetic construct
  misc_feature 1..21: note = Synthetic Construct
  source 1..21: mol_type = other DNA
gtcatttcaggccacgtgcaa

SEQ ID NO: 24482 - DNA, 22 bp, synthetic construct
  misc_feature 1..22: note = Synthetic Construct
  source 1..22: mol_type = other DNA
gcaatcccgagcttggttgaca

SEQ ID NO: 24483 - DNA, 20 bp, synthetic construct
  misc_feature 1..20: note = Synthetic Construct
  source 1..20: mol_type = other DNA
actgcaacccgaggaagcat

SEQ ID NO: 24484 - DNA, 23 bp, synthetic construct
  misc_feature 1..23: note = Synthetic Construct
  source 1..23: mol_type = other DNA
aatacatgcctggattgctctgt

SEQ ID NO: 24485 - DNA, 20 bp, synthetic construct
  misc_feature 1..20: note = Synthetic Construct
  source 1..20: mol_type = other DNA
tctgctgggtgggaccattc

SEQ ID NO: 24486 - DNA, 22 bp, synthetic construct
  misc_feature 1..22: note = Synthetic Construct
  source 1..22: mol_type = other DNA
accatggccttggagagagatg

SEQ ID NO: 24487 - DNA, 20 bp, synthetic construct
  misc_feature 1..20: note = Synthetic Construct
  source 1..20: mol_type = other DNA
ccggatgggagcggagaatc

SEQ ID NO: 24488 - DNA, 23 bp, synthetic construct
  misc_feature 1..23: note = Synthetic Construct
  source 1..23: mol_type = other DNA
ggatcgggatgctgaagcaatag

SEQ ID NO: 24489 - DNA, 22 bp, synthetic construct
  misc_feature 1..22: note = Synthetic Construct
  source 1..22: mol_type = other DNA
gcatcccatcttttgccactct

SEQ ID NO: 24490 - DNA, 23 bp, synthetic construct
  misc_feature 1..23: note = Synthetic Construct
  source 1..23: mol_type = other DNA
cacatcatggagcagctatgtct

SEQ ID NO: 24491 - DNA, 24 bp, synthetic construct
  misc_feature 1..24: note = Synthetic Construct
  source 1..24: mol_type = other DNA
cccaatctcctttgaatggcaaac

SEQ ID NO: 24492 - DNA, 21 bp, synthetic construct
  misc_feature 1..21: note = Synthetic Construct
  source 1..21: mol_type = other DNA
gcatcacgaggagccagtgtt

SEQ ID NO: 24493 - DNA, 20 bp, synthetic construct
  misc_feature 1..20: note = Synthetic Construct
  source 1..20: mol_type = other DNA
ccggggccattcactggtaa

SEQ ID NO: 24494 - DNA, 23 bp, synthetic construct
  misc_feature 1..23: note = Synthetic Construct
  source 1..23: mol_type = other DNA
cagagcctcacacaagcaatgaa

SEQ ID NO: 24495 - DNA, 22 bp, synthetic construct
  misc_feature 1..22: note = Synthetic Construct
  source 1..22: mol_type = other DNA
ggcaaggaaggagtgcttggat

SEQ ID NO: 24496 - DNA, 20 bp, synthetic construct
  misc_feature 1..20: note = Synthetic Construct
  source 1..20: mol_type = other DNA
tgagggagctgcaaggaaga

SEQ ID NO: 24497 - DNA, 22 bp, synthetic construct
  misc_feature 1..22: note = Synthetic Construct
  source 1..22: mol_type = other DNA
gccatggctgacaagtctatca

SEQ ID NO: 24498 - DNA, 23 bp, synthetic construct
  misc_feature 1..23: note = Synthetic Construct
  source 1..23: mol_type = other DNA
tgcatcgaatttgagaggcaatg

SEQ ID NO: 24499 - DNA, 21 bp, synthetic construct
  misc_feature 1..21: note = Synthetic Construct
  source 1..21: mol_type = other DNA
aacaaccctcgtgcccctaga

SEQ ID NO: 24500 - DNA, 20 bp, synthetic construct
  misc_feature 1..20: note = Synthetic Construct
  source 1..20: mol_type = other DNA
ccgccttggagtccctgaaa

SEQ ID NO: 24501 - DNA, 21 bp, synthetic construct
  misc_feature 1..21: note = Synthetic Construct
  source 1..21: mol_type = other DNA
gagttccgccaggatttcact

SEQ ID NO: 24502 - DNA, 19 bp, synthetic construct
  misc_feature 1..19: note = Synthetic Construct
  source 1..19: mol_type = other DNA
ctggggctggctgagatgt

SEQ ID NO: 24503 - DNA, 22 bp, synthetic construct
  misc_feature 1..22: note = Synthetic Construct
  source 1..22: mol_type = other DNA
gccaggtctcgcttttggtgtt

SEQ ID NO: 24504 - DNA, 24 bp, synthetic construct
  misc_feature 1..24: note = Synthetic Construct
  source 1..24: mol_type = other DNA
ggcaggataaaagcccctaagaag

SEQ ID NO: 24505 - DNA, 22 bp, synthetic construct
  misc_feature 1..22: note = Synthetic Construct
  source 1..22: mol_type = other DNA
ggaggaagcccagcatcaagaa

SEQ ID NO: 24506 - DNA, 23 bp, synthetic construct
  misc_feature 1..23: note = Synthetic Construct
  source 1..23: mol_type = other DNA
aaggagaacagatcatggtgcat

SEQ ID NO: 24507 - DNA, 21 bp, synthetic construct
  misc_feature 1..21: note = Synthetic Construct
  source 1..21: mol_type = other DNA
gcacatccctgccttccctat

SEQ ID NO: 24508 - DNA, 22 bp, synthetic construct
  misc_feature 1..22: note = Synthetic Construct
  source 1..22: mol_type = other DNA
aaaagcagacacagacccaact

SEQ ID NO: 24509 - DNA, 25 bp, synthetic construct
  misc_feature 1..25: note = Synthetic Construct
  source 1..25: mol_type = other DNA
cgatgcgagttaccgagtagaaaat

SEQ ID NO: 24510 - DNA, 22 bp, synthetic construct
  misc_feature 1..22: note = Synthetic Construct
  source 1..22: mol_type = other DNA
gccacgggaatgtttactctgt

SEQ ID NO: 24511 - DNA, 20 bp, synthetic construct
  misc_feature 1..20: note = Synthetic Construct
  source 1..20: mol_type = other DNA
agctttgacgccaccgcttt

SEQ ID NO: 24512 - DNA, 21 bp, synthetic construct
  misc_feature 1..21: note = Synthetic Construct
  source 1..21: mol_type = other DNA
ggtagcaccatgtgccactga

SEQ ID NO: 24513 - DNA, 22 bp, synthetic construct
  misc_feature 1..22: note = Synthetic Construct
  source 1..22: mol_type = other DNA
cacctggcagtagccttcgatt

SEQ ID NO: 24514 - DNA, 21 bp, synthetic construct
  misc_feature 1..21: note = Synthetic Construct
  source 1..21: mol_type = other DNA
gctgctggaaccccaagtgat

SEQ ID NO: 24515 - DNA, 23 bp, synthetic construct
  misc_feature 1..23: note = Synthetic Construct
  source 1..23: mol_type = other DNA
ggctctagtgaagtgtggtgaac

SEQ ID NO: 24516 - DNA, 23 bp, synthetic construct
  misc_feature 1..23: note = Synthetic Construct
  source 1..23: mol_type = other DNA
ggcctcaggaacttgagtccttt

SEQ ID NO: 24517 - DNA, 19 bp, synthetic construct
  misc_feature 1..19: note = Synthetic Construct
  source 1..19: mol_type = other DNA
ccccaccgtgccacctttt

SEQ ID NO: 24518 - DNA, 22 bp, synthetic construct
  misc_feature 1..22: note = Synthetic Construct
  source 1..22: mol_type = other DNA
gcttggcctgggaattgggttt

SEQ ID NO: 24519 - DNA, 22 bp, synthetic construct
  misc_feature 1..22: note = Synthetic Construct
  source 1..22: mol_type = other DNA
cagggcaggtcagactgagaag

SEQ ID NO: 24520 - DNA, 19 bp, synthetic construct
  misc_feature 1..19: note = Synthetic Construct
  source 1..19: mol_type = other DNA
acagcagcaccgcactgta

SEQ ID NO: 24521 - DNA, 21 bp, synthetic construct
  misc_feature 1..21: note = Synthetic Construct
  source 1..21: mol_type = other DNA
gtcaggcgtctgcctacttct

SEQ ID NO: 24522 - DNA, 26 bp, synthetic construct
  misc_feature 1..26: note = Synthetic Construct
  source 1..26: mol_type = other DNA
cactttccaagtgcctggtaatggtt

SEQ ID NO: 24523 - DNA, 21 bp, synthetic construct
  misc_feature 1..21: note = Synthetic Construct
  source 1..21: mol_type = other DNA
aggtgggagctgacacgtatt

SEQ ID NO: 24524 - DNA, 24 bp, synthetic construct
  misc_feature 1..24: note = Synthetic Construct
  source 1..24: mol_type = other DNA
gccctgaatcccaaggaaacaatc

SEQ ID NO: 24525 - DNA, 24 bp, synthetic construct
  misc_feature 1..24: note = Synthetic Construct
  source 1..24: mol_type = other DNA
ggcttctcatccaactcagtacaa

SEQ ID NO: 24526 - DNA, 22 bp, synthetic construct
  misc_feature 1..22: note = Synthetic Construct
  source 1..22: mol_type = other DNA
cccaagcctacgtgacaccaaa

SEQ ID NO: 24527 - DNA, 22 bp, synthetic construct
  misc_feature 1..22: note = Synthetic Construct
  source 1..22: mol_type = other DNA
gcccagtactgagaccaagaaa

SEQ ID NO: 24528 - DNA, 22 bp, synthetic construct
  misc_feature 1..22: note = Synthetic Construct
  source 1..22: mol_type = other DNA
gcgcttatccaagctaggttct

SEQ ID NO: 24529 - DNA, 24 bp, synthetic construct
  misc_feature 1..24: note = Synthetic Construct
  source 1..24: mol_type = other DNA
cacatggtttccctcctccttttt

SEQ ID NO: 24530 - DNA, 20 bp, synthetic construct
  misc_feature 1..20: note = Synthetic Construct
  source 1..20: mol_type = other DNA
tcgtggcaccatctcacaaa

SEQ ID NO: 24531 - DNA, 19 bp, synthetic construct
  misc_feature 1..19: note = Synthetic Construct
  source 1..19: mol_type = other DNA
gccagggagcagcacaaag

SEQ ID NO: 24532 - DNA, 22 bp, synthetic construct
  misc_feature 1..22: note = Synthetic Construct
  source 1..22: mol_type = other DNA
caccctcctgtcaccttcattc

SEQ ID NO: 24533 - DNA, 21 bp, synthetic construct
  misc_feature 1..21: note = Synthetic Construct
  source 1..21: mol_type = other DNA
cccctgctcccatgacacaat

SEQ ID NO: 24534 - DNA, 21 bp, synthetic construct
  misc_feature 1..21: note = Synthetic Construct
  source 1..21: mol_type = other DNA
gcagtgagtggcagctattgt

SEQ ID NO: 24535 - DNA, 24 bp, synthetic construct
  misc_feature 1..24: note = Synthetic Construct
  source 1..24: mol_type = other DNA
gttcttacctctagacctgtgcaa

SEQ ID NO: 24536 - DNA, 22 bp, synthetic construct
  misc_feature 1..22: note = Synthetic Construct
  source 1..22: mol_type = other DNA
ttgggcatggagggaggtaaca

SEQ ID NO: 24537 - DNA, 22 bp, synthetic construct
  misc_feature 1..22: note = Synthetic Construct
  source 1..22: mol_type = other DNA
ctgggaagtgcaaggggtcaaa

SEQ ID NO: 24538 - DNA, 22 bp, synthetic construct
  misc_feature 1..22: note = Synthetic Construct
  source 1..22: mol_type = other DNA
tgctaagaaggctatgctgcaa

SEQ ID NO: 24539 - DNA, 20 bp, synthetic construct
  misc_feature 1..20: note = Synthetic Construct
  source 1..20: mol_type = other DNA
acctgaaggagggagtgtgt

SEQ ID NO: 24540 - DNA, 23 bp, synthetic construct
  misc_feature 1..23: note = Synthetic Construct
  source 1..23: mol_type = other DNA
gcccagattcctgagggctttag

SEQ ID NO: 24541 - DNA, 25 bp, synthetic construct
  misc_feature 1..25: note = Synthetic Construct
  source 1..25: mol_type = other DNA
ggctctttggtggttagctggacta

SEQ ID NO: 24542 - DNA, 20 bp, synthetic construct
  misc_feature 1..20: note = Synthetic Construct
  source 1..20: mol_type = other DNA
ggcccctctgcaaataccaa

SEQ ID NO: 24543 - DNA, 23 bp, synthetic construct
  misc_feature 1..23: note = Synthetic Construct
  source 1..23: mol_type = other DNA
caccagatgctcctaggtgtaga

SEQ ID NO: 24544 - DNA, 23 bp, synthetic construct
  misc_feature 1..23: note = Synthetic Construct
  source 1..23: mol_type = other DNA
gaaccgtctccttctccaagttc

SEQ ID NO: 24545 - DNA, 22 bp, synthetic construct
  misc_feature 1..22: note = Synthetic Construct
  source 1..22: mol_type = other DNA
gccctgtgaagccagtctctat

SEQ ID NO: 24546 - DNA, 22 bp, synthetic construct
  misc_feature 1..22: note = Synthetic Construct
  source 1..22: mol_type = other DNA
acacctgagagaccctcgcttt

SEQ ID NO: 24547 - DNA, 22 bp, synthetic construct
  misc_feature 1..22: note = Synthetic Construct
  source 1..22: mol_type = other DNA
ccgtcaccccagtctcacctat

SEQ ID NO: 24548 - DNA, 22 bp, synthetic construct
  misc_feature 1..22: note = Synthetic Construct
  source 1..22: mol_type = other DNA
gggaagctgtagttgcagtgat

SEQ ID NO: 24549 - DNA, 22 bp, synthetic construct
  misc_feature 1..22: note = Synthetic Construct
  source 1..22: mol_type = other DNA
gccctctgctgacagtgtgaaa

SEQ ID NO: 24550 - DNA, 26 bp, synthetic construct
  misc_feature 1..26: note = Synthetic Construct
  source 1..26: mol_type = other DNA
gaagtaaagtggaccttgacatctga

SEQ ID NO: 24551 - DNA, 22 bp, synthetic construct
  misc_feature 1..22: note = Synthetic Construct
  source 1..22: mol_type = other DNA
cctggtggctcaaaccgttagt

SEQ ID NO: 24552 - DNA, 23 bp, synthetic construct
  misc_feature 1..23: note = Synthetic Construct
  source 1..23: mol_type = other DNA
cacagagtgtgactcaggtcaag

SEQ ID NO: 24553 - DNA, 20 bp, synthetic construct
  misc_feature 1..20: note = Synthetic Construct
  source 1..20: mol_type = other DNA
ggccgtggggagtagggtta

SEQ ID NO: 24554 - DNA, 22 bp, synthetic construct
  misc_feature 1..22: note = Synthetic Construct
  source 1..22: mol_type = other DNA
caaggtccagaagccaaagcta

SEQ ID NO: 24555 - DNA, 25 bp, synthetic construct
  misc_feature 1..25: note = Synthetic Construct
  source 1..25: mol_type = other DNA
ccctggctgatttatgagaaaggta

SEQ ID NO: 24556 - DNA, 21 bp, synthetic construct
  misc_feature 1..21: note = Synthetic Construct
  source 1..21: mol_type = other DNA
tgatgggtggcttccctaact

SEQ ID NO: 24557 - DNA, 24 bp, synthetic construct
  misc_feature 1..24: note = Synthetic Construct
  source 1..24: mol_type = other DNA
tctcggttaactgcaaaaggacaa

SEQ ID NO: 24558 - DNA, 20 bp, synthetic construct
  misc_feature 1..20: note = Synthetic Construct
  source 1..20: mol_type = other DNA
tctggccttccggtcttttg

SEQ ID NO: 24559 - DNA, 24 bp, synthetic construct
  misc_feature 1..24: note = Synthetic Construct
  source 1..24: mol_type = other DNA
gccagaagtcacaaaccaaagaca

SEQ ID NO: 24560 - DNA, 22 bp, synthetic construct
  misc_feature 1..22: note = Synthetic Construct
  source 1..22: mol_type = other DNA
gcaagagtggtagcctcaagat

SEQ ID NO: 24561 - DNA, 25 bp, synthetic construct
  misc_feature 1..25: note = Synthetic Construct
  source 1..25: mol_type = other DNA
cacaggagggtgatgttatctgtct

SEQ ID NO: 24562 - DNA, 24 bp, synthetic construct
  misc_feature 1..24: note = Synthetic Construct
  source 1..24: mol_type = other DNA
gctgacattggtggtctgtagctt

SEQ ID NO: 24563 - DNA, 23 bp, synthetic construct
  misc_feature 1..23: note = Synthetic Construct
  source 1..23: mol_type = other DNA
ctggcatgtgaattgctgtggat

SEQ ID NO: 24564 - DNA, 23 bp, synthetic construct
  misc_feature 1..23: note = Synthetic Construct
  source 1..23: mol_type = other DNA
gtaggccaaggttgccttaaaac

SEQ ID NO: 24565 - DNA, 21 bp, synthetic construct
  misc_feature 1..21: note = Synthetic Construct
  source 1..21: mol_type = other DNA
ccatcagcagcctgaatgctt

SEQ ID NO: 24566 - DNA, 24 bp, synthetic construct
  misc_feature 1..24: note = Synthetic Construct
  source 1..24: mol_type = other DNA
tgatgagcacgtgaaagtttgaga

SEQ ID NO: 24567 - DNA, 22 bp, synthetic construct
  misc_feature 1..22: note = Synthetic Construct
  source 1..22: mol_type = other DNA
gcgtgaagccaggacttcctaa

SEQ ID NO: 24568 - DNA, 24 bp, synthetic construct
  misc_feature 1..24: note = Synthetic Construct
  source 1..24: mol_type = other DNA
cgcaaagcccctttaactgctgat

SEQ ID NO: 24569 - DNA, 21 bp, synthetic construct
  misc_feature 1..21: note = Synthetic Construct
  source 1..21: mol_type = other DNA
cctccctcaccagtgggtctt

SEQ ID NO: 24570 - DNA, 22 bp, synthetic construct
  misc_feature 1..22: note = Synthetic Construct
  source 1..22: mol_type = other DNA
ccctgcaagactggttgtgtga

SEQ ID NO: 24571 - DNA, 25 bp, synthetic construct
  misc_feature 1..25: note = Synthetic Construct
  source 1..25: mol_type = other DNA
gccttagccacagaatccattcaca

SEQ ID NO: 24572 - DNA, 22 bp, synthetic construct
  misc_feature 1..22: note = Synthetic Construct
  source 1..22: mol_type = other DNA
accactgggatgaactccaaca

SEQ ID NO: 24573 - DNA, 22 bp, synthetic construct
  misc_feature 1..22: note = Synthetic Construct
  source 1..22: mol_type = other DNA
tcaggcaagctggaaatgagtt

SEQ ID NO: 24574 - DNA, 25 bp, synthetic construct
  misc_feature 1..25: note = Synthetic Construct
  source 1..25: mol_type = other DNA
ctcagtgggatctggttacttgttc

SEQ ID NO: 24575 - DNA, 23 bp, synthetic construct
  misc_feature 1..23: note = Synthetic Construct
  source 1..23: mol_type = other DNA
gccctaatgatgggcacaaggtt

SEQ ID NO: 24576 - DNA, 21 bp, synthetic construct
  misc_feature 1..21: note = Synthetic Construct
  source 1..21: mol_type = other DNA
tgccttctgagaccggcaaga

SEQ ID NO: 24577 - DNA, 22 bp, synthetic construct
  misc_feature 1..22: note = Synthetic Construct
  source 1..22: mol_type = other DNA
ccagtgctcactgtccagttca

SEQ ID NO: 24578 - DNA, 22 bp, synthetic construct
  misc_feature 1..22: note = Synthetic Construct
  source 1..22: mol_type = other DNA
gcacatggcctggaagagatga

SEQ ID NO: 24579 - DNA, 22 bp, synthetic construct
  misc_feature 1..22: note = Synthetic Construct
  source 1..22: mol_type = other DNA
cctcctgatttcgcctctcttc

SEQ ID NO: 24580 - DNA, 22 bp, synthetic construct
  misc_feature 1..22: note = Synthetic Construct
  source 1..22: mol_type = other DNA
taatgcagcccactggccttac

SEQ ID NO: 24581 - DNA, 22 bp, synthetic construct
  misc_feature 1..22: note = Synthetic Construct
  source 1..22: mol_type = other DNA
aggagtgaccaatgccatgaat

SEQ ID NO: 24582 - DNA, 19 bp, synthetic construct
  misc_feature 1..19: note = Synthetic Construct
  source 1..19: mol_type = other DNA
gcagacggccctgagacaa

SEQ ID NO: 24583 - DNA, 20 bp, synthetic construct
  misc_feature 1..20: note = Synthetic Construct
  source 1..20: mol_type = other DNA
gcttccaggctccattgtgt

SEQ ID NO: 24584 - DNA, 24 bp, synthetic construct
  misc_feature 1..24: note = Synthetic Construct
  source 1..24: mol_type = other DNA
catcaaccatgtgagggacactct

SEQ ID NO: 24585 - DNA, 22 bp, synthetic construct
  misc_feature 1..22: note = Synthetic Construct
  source 1..22: mol_type = other DNA
acccagcttccagagactgctt

SEQ ID NO: 24586 - DNA, 21 bp, synthetic construct
  misc_feature 1..21: note = Synthetic Construct
  source 1..21: mol_type = other DNA
gcaatgaaggccatggagaca

SEQ ID NO: 24587 - DNA, 21 bp, synthetic construct
  misc_feature 1..21: note = Synthetic Construct
  source 1..21: mol_type = other DNA
accccggagacaatgttcatc

SEQ ID NO: 24588 - DNA, 22 bp, synthetic construct
  misc_feature 1..22: note = Synthetic Construct
  source 1..22: mol_type = other DNA
ttggtaggcttgggtctagtca

SEQ ID NO: 24589 - DNA, 20 bp, synthetic construct
  misc_feature 1..20: note = Synthetic Construct
  source 1..20: mol_type = other DNA
aggcaccaggcaagagtttg

SEQ ID NO: 24590 - DNA, 22 bp, synthetic construct
  misc_feature 1..22: note = Synthetic Construct
  source 1..22: mol_type = other DNA
ccctctgcttcctcctggtgat

SEQ ID NO: 24591 - DNA, 24 bp, synthetic construct
  misc_feature 1..24: note = Synthetic Construct
  source 1..24: mol_type = other DNA
tgaatgcctttgcttatggctcta

SEQ ID NO: 24592 - DNA, 19 bp, synthetic construct
  misc_feature 1..19: note = Synthetic Construct
  source 1..19: mol_type = other DNA
gccagacgagctgcacact

SEQ ID NO: 24593 - DNA, 20 bp, synthetic construct
  misc_feature 1..20: note = Synthetic Construct
  source 1..20: mol_type = other DNA
tgcgggacaccagactgatt

SEQ ID NO: 24594 - DNA, 25 bp, synthetic construct
  misc_feature 1..25: note = Synthetic Construct
  source 1..25: mol_type = other DNA
ggaatcccgtcacttacaagtacaa

SEQ ID NO: 24595 - DNA, 21 bp, synthetic construct
  misc_feature 1..21: note = Synthetic Construct
  source 1..21: mol_type = other DNA
acaaggggagtggcattttgt

SEQ ID NO: 24596 - DNA, 22 bp, synthetic construct
  misc_feature 1..22: note = Synthetic Construct
  source 1..22: mol_type = other DNA
aaccatgcccctagtccacagt

SEQ ID NO: 24597 - DNA, 23 bp, synthetic construct
  misc_feature 1..23: note = Synthetic Construct
  source 1..23: mol_type = other DNA
acaggtgatcagctctggatctt

SEQ ID NO: 24598 - DNA, 22 bp, synthetic construct
  misc_feature 1..22: note = Synthetic Construct
  source 1..22: mol_type = other DNA
agtggggagggtgttacagaga

SEQ ID NO: 24599 - DNA, 18 bp, synthetic construct
  misc_feature 1..18: note = Synthetic Construct
  source 1..18: mol_type = other DNA
accccagctcccagcaaa

SEQ ID NO: 24600 - DNA, 22 bp, synthetic construct
  misc_feature 1..22: note = Synthetic Construct
  source 1..22: mol_type = other DNA
cgcatggtcatagcatcgcatt

SEQ ID NO: 24601 - DNA, 20 bp, synthetic construct
  misc_feature 1..20: note = Synthetic Construct
  source 1..20: mol_type = other DNA
agggtgggtgctggagtaca

SEQ ID NO: 24602 - DNA, 27 bp, synthetic construct
  misc_feature 1..27: note = Synthetic Construct
  source 1..27: mol_type = other DNA
gggaaaagtcggtacatcaagatgaga

SEQ ID NO: 24603 - DNA, 18 bp, synthetic construct
  misc_feature 1..18: note = Synthetic Construct
  source 1..18: mol_type = other DNA
agagcagccccaggttct

SEQ ID NO: 24604 - DNA, 25 bp, synthetic construct
  misc_feature 1..25: note = Synthetic Construct
  source 1..25: mol_type = other DNA
gcactgaagatgacaagtaccacaa

SEQ ID NO: 24605 - DNA, 21 bp, synthetic construct
  misc_feature 1..21: note = Synthetic Construct
  source 1..21: mol_type = other DNA
gcatggggccttttcccacaa

SEQ ID NO: 24606 - DNA, 22 bp, synthetic construct
  misc_feature 1..22: note = Synthetic Construct
  source 1..22: mol_type = other DNA
caggctcaggccctccttttat

SEQ ID NO: 24607 - DNA, 19 bp, synthetic construct
  misc_feature 1..19: note = Synthetic Construct
  source 1..19: mol_type = other DNA
tcccctgcagaaccacaga

SEQ ID NO: 24608 - DNA, 23 bp, synthetic construct
  misc_feature 1..23: note = Synthetic Construct
  source 1..23: mol_type = other DNA
ctgggttcaaatcactgggagat

SEQ ID NO: 24609 - DNA, 20 bp, synthetic construct
  misc_feature 1..20: note = Synthetic Construct
  source 1..20: mol_type = other DNA
tccgcgcagaggaaagttgt

SEQ ID NO: 24610 - DNA, 26 bp, synthetic construct
  misc_feature 1..26: note = Synthetic Construct
  source 1..26: mol_type = other DNA
gccaatactatagcaccagcttttga

SEQ ID NO: 24611 - DNA, 22 bp, synthetic construct
  misc_feature 1..22: note = Synthetic Construct
  source 1..22: mol_type = other DNA
gccactcaggggtggatctttt

SEQ ID NO: 24612 - DNA, 25 bp, synthetic construct
  misc_feature 1..25: note = Synthetic Construct
  source 1..25: mol_type = other DNA
aatgtcttcaggagatgagatgcaa

SEQ ID NO: 24613 - DNA, 22 bp, synthetic construct
  misc_feature 1..22: note = Synthetic Construct
  source 1..22: mol_type = other DNA
gtgtgtggctggatgctcagaa

SEQ ID NO: 24614 - DNA, 22 bp, synthetic construct
  misc_feature 1..22: note = Synthetic Construct
  source 1..22: mol_type = other DNA
cgtagaagggctgcgggaaaat

SEQ ID NO: 24615 - DNA, 22 bp, synthetic construct
  misc_feature 1..22: note = Synthetic Construct
  source 1..22: mol_type = other DNA
aggcgctaaaaagctgacaaag

SEQ ID NO: 24616 - DNA, 21 bp, synthetic construct
  misc_feature 1..21: note = Synthetic Construct
  source 1..21: mol_type = other DNA
gcacctgtgttcacgcatttc

SEQ ID NO: 24617 - DNA, 23 bp, synthetic construct
  misc_feature 1..23: note = Synthetic Construct
  source 1..23: mol_type = other DNA
gggctcattcactaggagtgttg

SEQ ID NO: 24618 - DNA, 22 bp, synthetic construct
  misc_feature 1..22: note = Synthetic Construct
  source 1..22: mol_type = other DNA
gttagggcttaggggtctgaac

SEQ ID NO: 24619 - DNA, 20 bp, synthetic construct
  misc_feature 1..20: note = Synthetic Construct
  source 1..20: mol_type = other DNA
agcagccaggaaggctgatg

SEQ ID NO: 24620 - DNA, 22 bp, synthetic construct
  misc_feature 1..22: note = Synthetic Construct
  source 1..22: mol_type = other DNA
gcttagctgcaccggacatctt

SEQ ID NO: 24621 - DNA, 25 bp, synthetic construct
  misc_feature 1..25: note = Synthetic Construct
  source 1..25: mol_type = other DNA
cataggcacttgatcatcctgtact

SEQ ID NO: 24622 - DNA, 23 bp, synthetic construct
  misc_feature 1..23: note = Synthetic Construct
  source 1..23: mol_type = other DNA
ggagttgtccgtggtactgattg

SEQ ID NO: 24623 - DNA, 21 bp, synthetic construct
  misc_feature 1..21: note = Synthetic Construct
  source 1..21: mol_type = other DNA
acacgtccctcctggagtttc

SEQ ID NO: 24624 - DNA, 22 bp, synthetic construct
  misc_feature 1..22: note = Synthetic Construct
  source 1..22: mol_type = other DNA
ccacacgttttggcaacgtaga

SEQ ID NO: 24625 - DNA, 24 bp, synthetic construct
  misc_feature 1..24: note = Synthetic Construct
  source 1..24: mol_type = other DNA
gcttccccactgctacttcctatg

SEQ ID NO: 24626 - DNA, 22 bp, synthetic construct
  misc_feature 1..22: note = Synthetic Construct
  source 1..22: mol_type = other DNA
gaggcggtacataagtcagcaa

SEQ ID NO: 24627 - DNA, 18 bp, synthetic construct
  misc_feature 1..18: note = Synthetic Construct
  source 1..18: mol_type = other DNA
tgcaggctgtcgcgtact

SEQ ID NO: 24628 - DNA, 21 bp, synthetic construct
  misc_feature 1..21: note = Synthetic Construct
  source 1..21: mol_type = other DNA
ccaactgccactgaccaaaag

SEQ ID NO: 24629 - DNA, 23 bp, synthetic construct
  misc_feature 1..23: note = Synthetic Construct
  source 1..23: mol_type = other DNA
gctcacttgccagaacagttaag

SEQ ID NO: 24630 - DNA, 20 bp, synthetic construct
  misc_feature 1..20: note = Synthetic Construct
  source 1..20: mol_type = other DNA
agcagctggactgcttgact

SEQ ID NO: 24631 - DNA, 23 bp, synthetic construct
  misc_feature 1..23: note = Synthetic Construct
  source 1..23: mol_type = other DNA
caaaggagccacaatggtaggta

SEQ ID NO: 24632 - DNA, 25 bp, synthetic construct
  misc_feature 1..25: note = Synthetic Construct
  source 1..25: mol_type = other DNA
gcatttgtgtaccctgtttcctttc

SEQ ID NO: 24633 - DNA, 25 bp, synthetic construct
  misc_feature 1..25: note = Synthetic Construct
  source 1..25: mol_type = other DNA
tgtgtgattttcagggctaagaagt

SEQ ID NO: 24634 - DNA, 22 bp, synthetic construct
  misc_feature 1..22: note = Synthetic Construct
  source 1..22: mol_type = other DNA
tctaggccccatgactgaagtt

SEQ ID NO: 24635 - DNA, 22 bp, synthetic construct
  misc_feature 1..22: note = Synthetic Construct
  source 1..22: mol_type = other DNA
gttgcttgcccaaagtcagaag

SEQ ID NO: 24636 - DNA, 24 bp, synthetic construct
  misc_feature 1..24: note = Synthetic Construct
  source 1..24: mol_type = other DNA
gcccaagtttagtcagcaggtcaa

SEQ ID NO: 24637 - DNA, 22 bp, synthetic construct
  misc_feature 1..22: note = Synthetic Construct
  source 1..22: mol_type = other DNA
ggcctcagctttggaaatggat

SEQ ID NO: 24638 - DNA, 22 bp, synthetic construct
  misc_feature 1..22: note = Synthetic Construct
  source 1..22: mol_type = other DNA
ggactggctctcctctccagtt

SEQ ID NO: 24639 - DNA, 21 bp, synthetic construct
  misc_feature 1..21: note = Synthetic Construct
  source 1..21: mol_type = other DNA
agccaaaagttgtgccactga

SEQ ID NO: 24640 - DNA, 24 bp, synthetic construct
  misc_feature 1..24: note = Synthetic Construct
  source 1..24: mol_type = other DNA
caggcatatagaactcctgccatt

SEQ ID NO: 24641 - DNA, 22 bp, synthetic construct
  misc_feature 1..22: note = Synthetic Construct
  source 1..22: mol_type = other DNA
tgggtggaagagagccttgagt

SEQ ID NO: 24642 - DNA, 22 bp, synthetic construct
  misc_feature 1..22: note = Synthetic Construct
  source 1..22: mol_type = other DNA
aaggactgcccctcctcagaaa

SEQ ID NO: 24643 - DNA, 19 bp, synthetic construct
  misc_feature 1..19: note = Synthetic Construct
  source 1..19: mol_type = other DNA
tggcatgccggcacattga

SEQ ID NO: 24644 - DNA, 19 bp, synthetic construct
  misc_feature 1..19: note = Synthetic Construct
  source 1..19: mol_type = other DNA
gcaccaccatggcgacaca

SEQ ID NO: 24645 - DNA, 25 bp, synthetic construct
  misc_feature 1..25: note = Synthetic Construct
  source 1..25: mol_type = other DNA
ggagaaaaacccttctcacgcatca

SEQ ID NO: 24646 - DNA, 24 bp, synthetic construct
  misc_feature 1..24: note = Synthetic Construct
  source 1..24: mol_type = other DNA
ggggatcaatgcaaactctgtagt

SEQ ID NO: 24647 - DNA, 21 bp, synthetic construct
  misc_feature 1..21: note = Synthetic Construct
  source 1..21: mol_type = other DNA
tgcctaccttgggagggttca

SEQ ID NO: 24648 - DNA, 21 bp, synthetic construct
  misc_feature 1..21: note = Synthetic Construct
  source 1..21: mol_type = other DNA
caccacacctctcccttctga

SEQ ID NO: 24649 - DNA, 22 bp, synthetic construct
  misc_feature 1..22: note = Synthetic Construct
  source 1..22: mol_type = other DNA
ccactttcgatgaccgccttgt

SEQ ID NO: 24650 - DNA, 22 bp, synthetic construct
  misc_feature 1..22: note = Synthetic Construct
  source 1..22: mol_type = other DNA
tgtggcacctcacagctatttt

SEQ ID NO: 24651 - DNA, 23 bp, synthetic construct
  misc_feature 1..23: note = Synthetic Construct
  source 1..23: mol_type = other DNA
gcccgagcaagtcatatccaaac

SEQ ID NO: 24652 - DNA, 18 bp, synthetic construct
  misc_feature 1..18: note = Synthetic Construct
  source 1..18: mol_type = other DNA
tgcccctggccttcatgt

SEQ ID NO: 24653 - DNA, 22 bp, synthetic construct
  misc_feature 1..22: note = Synthetic Construct
  source 1..22: mol_type = other DNA
ctgcctcactccagatctcaca

SEQ ID NO: 24654 - DNA, 23 bp, synthetic construct
  misc_feature 1..23: note = Synthetic Construct
  source 1..23: mol_type = other DNA
gaggaaggacacctcttctgttg

SEQ ID NO: 24655 - DNA, 20 bp, synthetic construct
  misc_feature 1..20: note = Synthetic Construct
  source 1..20: mol_type = other DNA
ccggggttcagaaggagcat

SEQ ID NO: 24656 - DNA, 20 bp, synthetic construct
  misc_feature 1..20: note = Synthetic Construct
  source 1..20: mol_type = other DNA
agccaccgtgggaggaagaa

SEQ ID NO: 24657 - DNA, 25 bp, synthetic construct
  misc_feature 1..25: note = Synthetic Construct
  source 1..25: mol_type = other DNA
aaaatcagctgactgtatggagact

SEQ ID NO: 24658 - DNA, 25 bp, synthetic construct
  misc_feature 1..25: note = Synthetic Construct
  source 1..25: mol_type = other DNA
gttgccatttattcctggtgaatgt

SEQ ID NO: 24659 - DNA, 22 bp, synthetic construct
  misc_feature 1..22: note = Synthetic Construct
  source 1..22: mol_type = other DNA
gcaggcaagggcttcagaaaga

SEQ ID NO: 24660 - DNA, 19 bp, synthetic construct
  misc_feature 1..19: note = Synthetic Construct
  source 1..19: mol_type = other DNA
tgcagcctgggtgggtttt

SEQ ID NO: 24661 - DNA, 20 bp, synthetic construct
  misc_feature 1..20: note = Synthetic Construct
  source 1..20: mol_type = other DNA
aggccccagctgcactaact

SEQ ID NO: 24662 - DNA, 19 bp, synthetic construct
  misc_feature 1..19: note = Synthetic Construct
  source 1..19: mol_type = other DNA
aggagcccctggactgttc

SEQ ID NO: 24663 - DNA, 23 bp, synthetic construct
  misc_feature 1..23: note = Synthetic Construct
  source 1..23: mol_type = other DNA
gttacttgttcctgctgccttga

SEQ ID NO: 24664 - DNA, 24 bp, synthetic construct
  misc_feature 1..24: note = Synthetic Construct
  source 1..24: mol_type = other DNA
ctccctgtatccaaacgaggcatt

SEQ ID NO: 24665 - DNA, 24 bp, synthetic construct
  misc_feature 1..24: note = Synthetic Construct
  source 1..24: mol_type = other DNA
ggggcactgtacacctaccttaga

SEQ ID NO: 24666 - DNA, 23 bp, synthetic construct
  misc_feature 1..23: note = Synthetic Construct
  source 1..23: mol_type = other DNA
gtctactgtgtcacgctgtgctt

SEQ ID NO: 24667 - DNA, 24 bp, synthetic construct
  misc_feature 1..24: note = Synthetic Construct
  source 1..24: mol_type = other DNA
gggttgctgaggacagatgcaaac

SEQ ID NO: 24668 - DNA, 21 bp, synthetic construct
  misc_feature 1..21: note = Synthetic Construct
  source 1..21: mol_type = other DNA
gctcctggcctgagttagcaa

SEQ ID NO: 24669 - DNA, 25 bp, synthetic construct
  misc_feature 1..25: note = Synthetic Construct
  source 1..25: mol_type = other DNA
ccatggatactcggtccatttcaag

SEQ ID NO: 24670 - DNA, 22 bp, synthetic construct
  misc_feature 1..22: note = Synthetic Construct
  source 1..22: mol_type = other DNA
ggagcgtgagaatgaaccatga

SEQ ID NO: 24671 - DNA, 22 bp, synthetic construct
  misc_feature 1..22: note = Synthetic Construct
  source 1..22: mol_type = other DNA
ggtgtgacttttccaggctagt

SEQ ID NO: 24672 - DNA, 22 bp, synthetic construct
  misc_feature 1..22: note = Synthetic Construct
  source 1..22: mol_type = other DNA
ggcctttcgtgtctggaatttg

SEQ ID NO: 24673 - DNA, 23 bp, synthetic construct
  misc_feature 1..23: note = Synthetic Construct
  source 1..23: mol_type = other DNA
gaatatctgagccacctgctctt

SEQ ID NO: 24674 - DNA, 20 bp, synthetic construct
  misc_feature 1..20: note = Synthetic Construct
  source 1..20: mol_type = other DNA
ggactgcgacagttgtgaga

SEQ ID NO: 24675 - DNA, 22 bp, synthetic construct
  misc_feature 1..22: note = Synthetic Construct
  source 1..22: mol_type = other DNA
gagatctccctgtgcctgagat

SEQ ID NO: 24676 - DNA, 20 bp, synthetic construct
  misc_feature 1..20: note = Synthetic Construct
  source 1..20: mol_type = other DNA
tgccacctcctcaaccttgt

SEQ ID NO: 24677 - DNA, 22 bp, synthetic construct
  misc_feature 1..22: note = Synthetic Construct
  source 1..22: mol_type = other DNA
caccacctttcttgtccagctt

SEQ ID NO: 24678 - DNA, 25 bp, synthetic construct
  misc_feature 1..25: note = Synthetic Construct
  source 1..25: mol_type = other DNA
agtaagtaaagcaggaacagagcat

SEQ ID NO: 24679 - DNA, 20 bp, synthetic construct
  misc_feature 1..20: note = Synthetic Construct
  source 1..20: mol_type = other DNA
aggccgctgagaggattgtt

SEQ ID NO: 24680 - DNA, 21 bp, synthetic construct
  misc_feature 1..21: note = Synthetic Construct
  source 1..21: mol_type = other DNA
ccagccttgccctgttgtttg

SEQ ID NO: 24681 - DNA, 24 bp, synthetic construct
  misc_feature 1..24: note = Synthetic Construct
  source 1..24: mol_type = other DNA
ctccggaaaatctgagccatgttc

SEQ ID NO: 24682 - DNA, 23 bp, synthetic construct
  misc_feature 1..23: note = Synthetic Construct
  source 1..23: mol_type = other DNA
gggattgctaatgccacgtcaga

SEQ ID NO: 24683 - DNA, 22 bp, synthetic construct
  misc_feature 1..22: note = Synthetic Construct
  source 1..22: mol_type = other DNA
cagaaggaatcgggccatgtgt

SEQ ID NO: 24684 - DNA, 22 bp, synthetic construct
  misc_feature 1..22: note = Synthetic Construct
  source 1..22: mol_type = other DNA
cagataaggcaggtgaggcatt

SEQ ID NO: 24685 - DNA, 23 bp, synthetic construct
  misc_feature 1..23: note = Synthetic Construct
  source 1..23: mol_type = other DNA
accagatgtctggcattcattgt

SEQ ID NO: 24686 - DNA, 20 bp, synthetic construct
  misc_feature 1..20: note = Synthetic Construct
  source 1..20: mol_type = other DNA
ggctcattccagccctttct

SEQ ID NO: 24687 - DNA, 21 bp, synthetic construct
  misc_feature 1..21: note = Synthetic Construct
  source 1..21: mol_type = other DNA
taggagagccgaggtcagact

SEQ ID NO: 24688 - DNA, 26 bp, synthetic construct
  misc_feature 1..26: note = Synthetic Construct
  source 1..26: mol_type = other DNA
ccaggggaagatatttaactccagaa

SEQ ID NO: 24689 - DNA, 22 bp, synthetic construct
  misc_feature 1..22: note = Synthetic Construct
  source 1..22: mol_type = other DNA
ccactttctagcccagggattc

SEQ ID NO: 24690 - DNA, 24 bp, synthetic construct
  misc_feature 1..24: note = Synthetic Construct
  source 1..24: mol_type = other DNA
ccagcgagagaagttcagttgtga

SEQ ID NO: 24691 - DNA, 21 bp, synthetic construct
  misc_feature 1..21: note = Synthetic Construct
  source 1..21: mol_type = other DNA
ctgggatgccaaggggttatt

SEQ ID NO: 24692 - DNA, 21 bp, synthetic construct
  misc_feature 1..21: note = Synthetic Construct
  source 1..21: mol_type = other DNA
gaaacagcacaacccctgact

SEQ ID NO: 24693 - DNA, 19 bp, synthetic construct
  misc_feature 1..19: note = Synthetic Construct
  source 1..19: mol_type = other DNA
gggcagagggacggaagat

SEQ ID NO: 24694 - DNA, 21 bp, synthetic construct
  misc_feature 1..21: note = Synthetic Construct
  source 1..21: mol_type = other DNA
caggatccggggcactacttc

SEQ ID NO: 24695 - DNA, 23 bp, synthetic construct
  misc_feature 1..23: note = Synthetic Construct
  source 1..23: mol_type = other DNA
gtcaaaggaagctgccctaggta

SEQ ID NO: 24696 - DNA, 22 bp, synthetic construct
  misc_feature 1..22: note = Synthetic Construct
  source 1..22: mol_type = other DNA
gactggagagtgtgggcttctt

SEQ ID NO: 24697 - DNA, 22 bp, synthetic construct
  misc_feature 1..22: note = Synthetic Construct
  source 1..22: mol_type = other DNA
ccactgaagcaaaggctgtcaa

SEQ ID NO: 24698 - DNA, 21 bp, synthetic construct
  misc_feature 1..21: note = Synthetic Construct
  source 1..21: mol_type = other DNA
tgttggcaccaccattggttt

SEQ ID NO: 24699 - DNA, 21 bp, synthetic construct
  misc_feature 1..21: note = Synthetic Construct
  source 1..21: mol_type = other DNA
tgtcttccccagacctccttt

SEQ ID NO: 24700 - DNA, 21 bp, synthetic construct
  misc_feature 1..21: note = Synthetic Construct
  source 1..21: mol_type = other DNA
tgagtgcttcagttgccagtt

SEQ ID NO: 24701 - DNA, 23 bp, synthetic construct
  misc_feature 1..23: note = Synthetic Construct
  source 1..23: mol_type = other DNA
gatgccacagagagtcaccacta

SEQ ID NO: 24702 - DNA, 23 bp, synthetic construct
  misc_feature 1..23: note = Synthetic Construct
  source 1..23: mol_type = other DNA
gctaggagatttctctggcaaca

SEQ ID NO: 24703 - DNA, 21 bp, synthetic construct
  misc_feature 1..21: note = Synthetic Construct
  source 1..21: mol_type = other DNA
gcccaaggacgttggtcagaa

SEQ ID NO: 24704 - DNA, 19 bp, synthetic construct
  misc_feature 1..19: note = Synthetic Construct
  source 1..19: mol_type = other DNA
tgcagggctgccagtgctt

SEQ ID NO: 24705 - DNA, 22 bp, synthetic construct
  misc_feature 1..22: note = Synthetic Construct
  source 1..22: mol_type = other DNA
cctccctacccaagtggctaca

SEQ ID NO: 24706 - DNA, 20 bp, synthetic construct
  misc_feature 1..20: note = Synthetic Construct
  source 1..20: mol_type = other DNA
aggaagcgccccatatgctt

SEQ ID NO: 24707 - DNA, 22 bp, synthetic construct
  misc_feature 1..22: note = Synthetic Construct
  source 1..22: mol_type = other DNA
ggtatggttgtgagtgctggtt

SEQ ID NO: 24708 - DNA, 26 bp, synthetic construct
  misc_feature 1..26: note = Synthetic Construct
  source 1..26: mol_type = other DNA
gtgctgtgatcagactgctttacatt

SEQ ID NO: 24709 - DNA, 20 bp, synthetic construct
  misc_feature 1..20: note = Synthetic Construct
  source 1..20: mol_type = other DNA
cttggctgagcctcctttga

SEQ ID NO: 24710 - DNA, 20 bp, synthetic construct
  misc_feature 1..20: note = Synthetic Construct
  source 1..20: mol_type = other DNA
caccggatcctgctgtcttt

SEQ ID NO: 24711 - DNA, 23 bp, synthetic construct
  misc_feature 1..23: note = Synthetic Construct
  source 1..23: mol_type = other DNA
gtgaggccctctctcaaaaagaa

SEQ ID NO: 24712 - DNA, 20 bp, synthetic construct
  misc_feature 1..20: note = Synthetic Construct
  source 1..20: mol_type = other DNA
tgggcaaagcagtgtgatga

SEQ ID NO: 24713 - DNA, 21 bp, synthetic construct
  misc_feature 1..21: note = Synthetic Construct
  source 1..21: mol_type = other DNA
ctgcacgtccatcacatcctt

SEQ ID NO: 24714 - DNA, 25 bp, synthetic construct
  misc_feature 1..25: note = Synthetic Construct
  source 1..25: mol_type = other DNA
tgataaattcctggaggcctagaac

SEQ ID NO: 24715 - DNA, 24 bp, synthetic construct
  misc_feature 1..24: note = Synthetic Construct
  source 1..24: mol_type = other DNA
cctcagtgcaactgaaaccctgaa

SEQ ID NO: 24716 - DNA, 24 bp, synthetic construct
  misc_feature 1..24: note = Synthetic Construct
  source 1..24: mol_type = other DNA
gagatgtgggtaggtggagagaag

SEQ ID NO: 24717 - DNA, 20 bp, synthetic construct
  misc_feature 1..20: note = Synthetic Construct
  source 1..20: mol_type = other DNA
gggtgcagacacatgggtaa

SEQ ID NO: 24718 - DNA, 24 bp, synthetic construct
  misc_feature 1..24: note = Synthetic Construct
  source 1..24: mol_type = other DNA
aggggatcaagatgtggcttttag

SEQ ID NO: 24719 - DNA, 22 bp, synthetic construct
  misc_feature 1..22: note = Synthetic Construct
  source 1..22: mol_type = other DNA
ctgaatgccacgacacctcact

SEQ ID NO: 24720 - DNA, 26 bp, synthetic construct
  misc_feature 1..26: note = Synthetic Construct
  source 1..26: mol_type = other DNA
cagagcagagatgcttcagaaacaaa

SEQ ID NO: 24721 - DNA, 21 bp, synthetic construct
  misc_feature 1..21: note = Synthetic Construct
  source 1..21: mol_type = other DNA
ggacacgtctctccgtttgaa

SEQ ID NO: 24722 - DNA, 23 bp, synthetic construct
  misc_feature 1..23: note = Synthetic Construct
  source 1..23: mol_type = other DNA
ggacaacttaacgctgccactct

SEQ ID NO: 24723 - DNA, 24 bp, synthetic construct
  misc_feature 1..24: note = Synthetic Construct
  source 1..24: mol_type = other DNA
cacggagtctctaccactgtcatc

SEQ ID NO: 24724 - DNA, 19 bp, synthetic construct
  misc_feature 1..19: note = Synthetic Construct
  source 1..19: mol_type = other DNA
gtgccagggtgtccagcaa

SEQ ID NO: 24725 - DNA, 22 bp, synthetic construct
  misc_feature 1..22: note = Synthetic Construct
  source 1..22: mol_type = other DNA
ctgggattcctcacctcacctt

SEQ ID NO: 24726 - DNA, 24 bp, synthetic construct
  misc_feature 1..24: note = Synthetic Construct
  source 1..24: mol_type = other DNA
acttctgaccaacaagcagtctac

SEQ ID NO: 24727 - DNA, 23 bp, synthetic construct
  misc_feature 1..23: note = Synthetic Construct
  source 1..23: mol_type = other DNA
ctcacagcacagaagtgggatga

SEQ ID NO: 24728 - DNA, 20 bp, synthetic construct
  misc_feature 1..20: note = Synthetic Construct
  source 1..20: mol_type = other DNA
acggggaagtgggtgaagaa

SEQ ID NO: 24729 - DNA, 20 bp, synthetic construct
  misc_feature 1..20: note = Synthetic Construct
  source 1..20: mol_type = other DNA
tgctgccttctcggcattga

SEQ ID NO: 24730 - DNA, 19 bp, synthetic construct
  misc_feature 1..19: note = Synthetic Construct
  source 1..19: mol_type = other DNA
agctgcaccggacgtttgt

SEQ ID NO: 24731 - DNA, 20 bp, synthetic construct
  misc_feature 1..20: note = Synthetic Construct
  source 1..20: mol_type = other DNA
ggagcaaagccctcgtgcat

SEQ ID NO: 24732 - DNA, 22 bp, synthetic construct
  misc_feature 1..22: note = Synthetic Construct
  source 1..22: mol_type = other DNA
cagggctcactgcttcagacaa

SEQ ID NO: 24733 - DNA, 20 bp, synthetic construct
  misc_feature 1..20: note = Synthetic Construct
  source 1..20: mol_type = other DNA
ctggaggggctgacaaccta

SEQ ID NO: 24734 - DNA, 20 bp, synthetic construct
  misc_feature 1..20: note = Synthetic Construct
  source 1..20: mol_type = other DNA
agcagccgctccatgttact

SEQ ID NO: 24735 - DNA, 22 bp, synthetic construct
  misc_feature 1..22: note = Synthetic Construct
  source 1..22: mol_type = other DNA
ccaggacagaggcagatgcaat

SEQ ID NO: 24736 - DNA, 23 bp, synthetic construct
  misc_feature 1..23: note = Synthetic Construct
  source 1..23: mol_type = other DNA
ctgcagctcaagtcttcctcact

SEQ ID NO: 24737 - DNA, 26 bp, synthetic construct
  misc_feature 1..26: note = Synthetic Construct
  source 1..26: mol_type = other DNA
gcaacccatatgcaatgagaccaagt

SEQ ID NO: 24738 - DNA, 21 bp, synthetic construct
  misc_feature 1..21: note = Synthetic Construct
  source 1..21: mol_type = other DNA
acagtgccttgaggaggaagt

SEQ ID NO: 24739 - DNA, 20 bp, synthetic construct
  misc_feature 1..20: note = Synthetic Construct
  source 1..20: mol_type = other DNA
gccagcacttcaagcacgtt

SEQ ID NO: 24740 - DNA, 21 bp, synthetic construct
  misc_feature 1..21: note = Synthetic Construct
  source 1..21: mol_type = other DNA
gtcctccagggcatcatctgt

SEQ ID NO: 24741 - DNA, 22 bp, synthetic construct
  misc_feature 1..22: note = Synthetic Construct
  source 1..22: mol_type = other DNA
cccgcctttcccatctcctact

SEQ ID NO: 24742 - DNA, 19 bp, synthetic construct
  misc_feature 1..19: note = Synthetic Construct
  source 1..19: mol_type = other DNA
tcgtggaggtccggggaaa

SEQ ID NO: 24743 - DNA, 22 bp, synthetic construct
  misc_feature 1..22: note = Synthetic Construct
  source 1..22: mol_type = other DNA
tgcaccactcagtcggaatcta

SEQ ID NO: 24744 - DNA, 22 bp, synthetic construct
  misc_feature 1..22: note = Synthetic Construct
  source 1..22: mol_type = other DNA
agaggtgctcctcctccatctt

SEQ ID NO: 24745 - DNA, 22 bp, synthetic construct
  misc_feature 1..22: note = Synthetic Construct
  source 1..22: mol_type = other DNA
gggccctcctgatgaccttctt

SEQ ID NO: 24746 - DNA, 23 bp, synthetic construct
  misc_feature 1..23: note = Synthetic Construct
  source 1..23: mol_type = other DNA
ctggggtctagacaagtgaccat

SEQ ID NO: 24747 - DNA, 22 bp, synthetic construct
  misc_feature 1..22: note = Synthetic Construct
  source 1..22: mol_type = other DNA
caagaggcgtagaagtgcagta

SEQ ID NO: 24748 - DNA, 21 bp, synthetic construct
  misc_feature 1..21: note = Synthetic Construct
  source 1..21: mol_type = other DNA
tgtcccctgcccaaacactga

SEQ ID NO: 24749 - DNA, 24 bp, synthetic construct
  misc_feature 1..24: note = Synthetic Construct
  source 1..24: mol_type = other DNA
ctggtaagtcaccctcttggtctt

SEQ ID NO: 24750 - DNA, 22 bp, synthetic construct
  misc_feature 1..22: note = Synthetic Construct
  source 1..22: mol_type = other DNA
ctgactgtggccaatccacttg

SEQ ID NO: 24751 - DNA, 23 bp, synthetic construct
  misc_feature 1..23: note = Synthetic Construct
  source 1..23: mol_type = other DNA
aaagcagaagtacaggctcatca

SEQ ID NO: 24752 - DNA, 24 bp, synthetic construct
  misc_feature 1..24: note = Synthetic Construct
  source 1..24: mol_type = other DNA
cgaaacttccaatggacaccagaa

SEQ ID NO: 24753 - DNA, 22 bp, synthetic construct
  misc_feature 1..22: note = Synthetic Construct
  source 1..22: mol_type = other DNA
aagatggccagagcccctgtag

SEQ ID NO: 24754 - DNA, 22 bp, synthetic construct
  misc_feature 1..22: note = Synthetic Construct
  source 1..22: mol_type = other DNA
ccagaggagctcagggatgtat

SEQ ID NO: 24755 - DNA, 23 bp, synthetic construct
  misc_feature 1..23: note = Synthetic Construct
  source 1..23: mol_type = other DNA
ctgaggcccataagcctatcagt

SEQ ID NO: 24756 - DNA, 23 bp, synthetic construct
  misc_feature 1..23: note = Synthetic Construct
  source 1..23: mol_type = other DNA
atgtcagccgattctccttttct

SEQ ID NO: 24757 - DNA, 20 bp, synthetic construct
  misc_feature 1..20: note = Synthetic Construct
  source 1..20: mol_type = other DNA
cctgccactccccaagagat

SEQ ID NO: 24758 - DNA, 24 bp, synthetic construct
  misc_feature 1..24: note = Synthetic Construct
  source 1..24: mol_type = other DNA
gagtggagttcggtccttctctga

SEQ ID NO: 24759 - DNA, 21 bp, synthetic construct
  misc_feature 1..21: note = Synthetic Construct
  source 1..21: mol_type = other DNA
cccagtccgggaggttgttac

SEQ ID NO: 24760 - DNA, 24 bp, synthetic construct
  misc_feature 1..24: note = Synthetic Construct
  source 1..24: mol_type = other DNA
gcggagggagactcagaattgcat

SEQ ID NO: 24761 - DNA, 22 bp, synthetic construct
  misc_feature 1..22: note = Synthetic Construct
  source 1..22: mol_type = other DNA
gcagctacctccctgcagtttt

SEQ ID NO: 24762 - DNA, 22 bp, synthetic construct
  misc_feature 1..22: note = Synthetic Construct
  source 1..22: mol_type = other DNA
gccaatgcccacctaacacact

SEQ ID NO: 24763 - DNA, 22 bp, synthetic construct
  misc_feature 1..22: note = Synthetic Construct
  source 1..22: mol_type = other DNA
tgacagacaggcatgaatcaca

SEQ ID NO: 24764 - DNA, 20 bp, synthetic construct
  misc_feature 1..20: note = Synthetic Construct
  source 1..20: mol_type = other DNA
ggccgttttgcccaaagtag

SEQ ID NO: 24765 - DNA, 20 bp, synthetic construct
  misc_feature 1..20: note = Synthetic Construct
  source 1..20: mol_type = other DNA
ttccggagccacttgcatca

SEQ ID NO: 24766 - DNA, 23 bp, synthetic construct
  misc_feature 1..23: note = Synthetic Construct
  source 1..23: mol_type = other DNA
cactgttccagagcacattcact

SEQ ID NO: 24767 - DNA, 21 bp, synthetic construct
  misc_feature 1..21: note = Synthetic Construct
  source 1..21: mol_type = other DNA
gcttgcagctgaggagtgagt

SEQ ID NO: 24768 - DNA, 22 bp, synthetic construct
  misc_feature 1..22: note = Synthetic Construct
  source 1..22: mol_type = other DNA
cccctgagttcatgggcttgat

SEQ ID NO: 24769 - DNA, 19 bp, synthetic construct
  misc_feature 1..19: note = Synthetic Construct
  source 1..19: mol_type = other DNA
tgcagagaggcccgtgatg

SEQ ID NO: 24770 - DNA, 26 bp, synthetic construct
  misc_feature 1..26: note = Synthetic Construct
  source 1..26: mol_type = other DNA
gcagttaagagggtactctgctgttg

SEQ ID NO: 24771 - DNA, 22 bp, synthetic construct
  misc_feature 1..22: note = Synthetic Construct
  source 1..22: mol_type = other DNA
ggccacacacgaacatttacaa

SEQ ID NO: 24772 - DNA, 26 bp, synthetic construct
  misc_feature 1..26: note = Synthetic Construct
  source 1..26: mol_type = other DNA
gggaaacacacatgtactttgagcat

SEQ ID NO: 24773 - DNA, 21 bp, synthetic construct
  misc_feature 1..21: note = Synthetic Construct
  source 1..21: mol_type = other DNA
gctcatggctctctgcacttc

SEQ ID NO: 24774 - DNA, 23 bp, synthetic construct
  misc_feature 1..23: note = Synthetic Construct
  source 1..23: mol_type = other DNA
ccttatccttgaactgccggtaa

SEQ ID NO: 24775 - DNA, 20 bp, synthetic construct
  misc_feature 1..20: note = Synthetic Construct
  source 1..20: mol_type = other DNA
accgctgcacttctgtgact

SEQ ID NO: 24776 - DNA, 24 bp, synthetic construct
  misc_feature 1..24: note = Synthetic Construct
  source 1..24: mol_type = other DNA
acaacagacgagttcatgtgaaga

SEQ ID NO: 24777 - DNA, 22 bp, synthetic construct
  misc_feature 1..22: note = Synthetic Construct
  source 1..22: mol_type = other DNA
gtcagaaacaactggggcatca

SEQ ID NO: 24778 - DNA, 22 bp, synthetic construct
  misc_feature 1..22: note = Synthetic Construct
  source 1..22: mol_type = other DNA
ggttggctcttgaggacattga

SEQ ID NO: 24779 - DNA, 20 bp, synthetic construct
  misc_feature 1..20: note = Synthetic Construct
  source 1..20: mol_type = other DNA
tccatgaggcacagcgaagt

SEQ ID NO: 24780 - DNA, 21 bp, synthetic construct
  misc_feature 1..21: note = Synthetic Construct
  source 1..21: mol_type = other DNA
cgtggaggacctaggctgaag

SEQ ID NO: 24781 - DNA, 21 bp, synthetic construct
  misc_feature 1..21: note = Synthetic Construct
  source 1..21: mol_type = other DNA
aggcaccacgtacagaagcta

SEQ ID NO: 24782 - DNA, 23 bp, synthetic construct
  misc_feature 1..23: note = Synthetic Construct
  source 1..23: mol_type = other DNA
ctcagtgtctgtgtctcatggtt

SEQ ID NO: 24783 - DNA, 27 bp, synthetic construct
  misc_feature 1..27: note = Synthetic Construct
  source 1..27: mol_type = other DNA
gatccaagcattcctgctgataataga

SEQ ID NO: 24784 - DNA, 22 bp, synthetic construct
  misc_feature 1..22: note = Synthetic Construct
  source 1..22: mol_type = other DNA
acctcatgccatctccccactt

SEQ ID NO: 24785 - DNA, 24 bp, synthetic construct
  misc_feature 1..24: note = Synthetic Construct
  source 1..24: mol_type = other DNA
gcagaggcagttaagcaggaggta

SEQ ID NO: 24786 - DNA, 24 bp, synthetic construct
  misc_feature 1..24: note = Synthetic Construct
  source 1..24: mol_type = other DNA
ccactgttccttagctatgtgagt

SEQ ID NO: 24787 - DNA, 20 bp, synthetic construct
  misc_feature 1..20: note = Synthetic Construct
  source 1..20: mol_type = other DNA
tggctcagcctcccctttca

SEQ ID NO: 24788 - DNA, 22 bp, synthetic construct
  misc_feature 1..22: note = Synthetic Construct
  source 1..22: mol_type = other DNA
aagccagggaggtctgcagcta

SEQ ID NO: 24789 - DNA, 22 bp, synthetic construct
  misc_feature 1..22: note = Synthetic Construct
  source 1..22: mol_type = other DNA
gaaatctgcccagcaccagaca

SEQ ID NO: 24790 - DNA, 20 bp, synthetic construct
  misc_feature 1..20: note = Synthetic Construct
  source 1..20: mol_type = other DNA
cccagcactgaactgacaca

SEQ ID NO: 24791 - DNA, 21 bp, synthetic construct
  misc_feature 1..21: note = Synthetic Construct
  source 1..21: mol_type = other DNA
cgcccactctgaaccacgtaa

SEQ ID NO: 24792 - DNA, 21 bp, synthetic construct
  misc_feature 1..21: note = Synthetic Construct
  source 1..21: mol_type = other DNA
actggagaagccgccatgtag

SEQ ID NO: 24793 - DNA, 22 bp, synthetic construct
  misc_feature 1..22: note = Synthetic Construct
  source 1..22: mol_type = other DNA
gctgtctccttttctgccaaga

SEQ ID NO: 24794 - DNA, 20 bp, synthetic construct
  misc_feature 1..20: note = Synthetic Construct
  source 1..20: mol_type = other DNA
gggaagcaggtagggagctt

SEQ ID NO: 24795 - DNA, 22 bp, synthetic construct
  misc_feature 1..22: note = Synthetic Construct
  source 1..22: mol_type = other DNA
ggctgtgagaagcattgggaaa

SEQ ID NO: 24796 - DNA, 21 bp, synthetic construct
  misc_feature 1..21: note = Synthetic Construct
  source 1..21: mol_type = other DNA
ggggctgggcaagtcttagaa

SEQ ID NO: 24797 - DNA, 19 bp, synthetic construct
  misc_feature 1..19: note = Synthetic Construct
  source 1..19: mol_type = other DNA
ccccagaacgtggcctttg

SEQ ID NO: 24798 - DNA, 21 bp, synthetic construct
  misc_feature 1..21: note = Synthetic Construct
  source 1..21: mol_type = other DNA
tgtccaaacctgccctgaaag

SEQ ID NO: 24799 - DNA, 19 bp, synthetic construct
  misc_feature 1..19: note = Synthetic Construct
  source 1..19: mol_type = other DNA
tgggaggccagtgtgaagt

SEQ ID NO: 24800 - DNA, 25 bp, synthetic construct
  misc_feature 1..25: note = Synthetic Construct
  source 1..25: mol_type = other DNA
cctcactcttcagggacaatagact

SEQ ID NO: 24801 - DNA, 23 bp, synthetic construct
  misc_feature 1..23: note = Synthetic Construct
  source 1..23: mol_type = other DNA
ctgtagcgaagcctttggattct

SEQ ID NO: 24802 - DNA, 23 bp, synthetic construct
  misc_feature 1..23: note = Synthetic Construct
  source 1..23: mol_type = other DNA
ctgaccaaggaactcacttcaca

SEQ ID NO: 24803 - DNA, 20 bp, synthetic construct
  misc_feature 1..20: note = Synthetic Construct
  source 1..20: mol_type = other DNA
tgctgagccactgggataca

SEQ ID NO: 24804 - DNA, 25 bp, synthetic construct
  misc_feature 1..25: note = Synthetic Construct
  source 1..25: mol_type = other DNA
gaagagtaagcagagagcaggttga

SEQ ID NO: 24805 - DNA, 21 bp, synthetic construct
  misc_feature 1..21: note = Synthetic Construct
  source 1..21: mol_type = other DNA
gggaccacgaacgacacaact

SEQ ID NO: 24806 - DNA, 22 bp, synthetic construct
  misc_feature 1..22: note = Synthetic Construct
  source 1..22: mol_type = other DNA
gcaggattgccaaactctgtgt

SEQ ID NO: 24807 - DNA, 21 bp, synthetic construct
  misc_feature 1..21: note = Synthetic Construct
  source 1..21: mol_type = other DNA
cggcctggttccaacttctga

SEQ ID NO: 24808 - DNA, 22 bp, synthetic construct
  misc_feature 1..22: note = Synthetic Construct
  source 1..22: mol_type = other DNA
gcaggtggcatgactggacttt

SEQ ID NO: 24809 - DNA, 24 bp, synthetic construct
  misc_feature 1..24: note = Synthetic Construct
  source 1..24: mol_type = other DNA
ctttgttcaaaccctgagcccata

SEQ ID NO: 24810 - DNA, 22 bp, synthetic construct
  misc_feature 1..22: note = Synthetic Construct
  source 1..22: mol_type = other DNA
tctgctatgctgctttctccaa

SEQ ID NO: 24811 - DNA, 24 bp, synthetic construct
  misc_feature 1..24: note = Synthetic Construct
  source 1..24: mol_type = other DNA
gcccaatgaggaggaatgggatca

SEQ ID NO: 24812 - DNA, 19 bp, synthetic construct
  misc_feature 1..19: note = Synthetic Construct
  source 1..19: mol_type = other DNA
aatgccgtgctgagtggaa

SEQ ID NO: 24813 - DNA, 21 bp, synthetic construct
  misc_feature 1..21: note = Synthetic Construct
  source 1..21: mol_type = other DNA
gtgtgtgcttctggtctcgat

SEQ ID NO: 24814 - DNA, 23 bp, synthetic construct
  misc_feature 1..23: note = Synthetic Construct
  source 1..23: mol_type = other DNA
ggaccctgagagtacctgcactt

SEQ ID NO: 24815 - DNA, 22 bp, synthetic construct
  misc_feature 1..22: note = Synthetic Construct
  source 1..22: mol_type = other DNA
ctcgggtgcaattgggtctgaa

SEQ ID NO: 24816 - DNA, 23 bp, synthetic construct
  misc_feature 1..23: note = Synthetic Construct
  source 1..23: mol_type = other DNA
gcactaaaaatgcctccttgcat

SEQ ID NO: 24817 - DNA, 20 bp, synthetic construct
  misc_feature 1..20: note = Synthetic Construct
  source 1..20: mol_type = other DNA
tgggagggtaggagcgtgta

SEQ ID NO: 24818 - DNA, 22 bp, synthetic construct
  misc_feature 1..22: note = Synthetic Construct
  source 1..22: mol_type = other DNA
agcttcaccagagtcacgtttc

SEQ ID NO: 24819 - DNA, 20 bp, synthetic construct
  misc_feature 1..20: note = Synthetic Construct
  source 1..20: mol_type = other DNA
acaccagccatgcgcctaat

SEQ ID NO: 24820 - DNA, 22 bp, synthetic construct
  misc_feature 1..22: note = Synthetic Construct
  source 1..22: mol_type = other DNA
cctacatgctacaagccaccat

SEQ ID NO: 24821 - DNA, 21 bp, synthetic construct
  misc_feature 1..21: note = Synthetic Construct
  source 1..21: mol_type = other DNA
gctgtttacgtggctctgcat

SEQ ID NO: 24822 - DNA, 22 bp, synthetic construct
  misc_feature 1..22: note = Synthetic Construct
  source 1..22: mol_type = other DNA
ggagtcacagctggtcctaatg

SEQ ID NO: 24823 - DNA, 19 bp, synthetic construct
  misc_feature 1..19: note = Synthetic Construct
  source 1..19: mol_type = other DNA
ttcctggccagtgctgtgt

SEQ ID NO: 24824 - DNA, 20 bp, synthetic construct
  misc_feature 1..20: note = Synthetic Construct
  source 1..20: mol_type = other DNA
cataggtcgggtgggtggaa

SEQ ID NO: 24825 - DNA, 22 bp, synthetic construct
  misc_feature 1..22: note = Synthetic Construct
  source 1..22: mol_type = other DNA
ggcccctttccctgctcttatt

SEQ ID NO: 24826 - DNA, 19 bp, synthetic construct
  misc_feature 1..19: note = Synthetic Construct
  source 1..19: mol_type = other DNA
ggccagtgggcctgtttga

SEQ ID NO: 24827 - DNA, 22 bp, synthetic construct
  misc_feature 1..22: note = Synthetic Construct
  source 1..22: mol_type = other DNA
gcaagaaacaggttggttgtgt

SEQ ID NO: 24828 - DNA, 23 bp, synthetic construct
  misc_feature 1..23: note = Synthetic Construct
  source 1..23: mol_type = other DNA
agagaagccattcacaagctgat

SEQ ID NO: 24829 - DNA, 22 bp, synthetic construct
  misc_feature 1..22: note = Synthetic Construct
  source 1..22: mol_type = other DNA
ggccagacaaaggcaggacatt

SEQ ID NO: 24830 - DNA, 22 bp, synthetic construct
  misc_feature 1..22: note = Synthetic Construct
  source 1..22: mol_type = other DNA
cagccttgccctgtgtcatact

SEQ ID NO: 24831 - DNA, 22 bp, synthetic construct
  misc_feature 1..22: note = Synthetic Construct
  source 1..22: mol_type = other DNA
cccagagtggttcagagagcta

SEQ ID NO: 24832 - DNA, 23 bp, synthetic construct
  misc_feature 1..23: note = Synthetic Construct
  source 1..23: mol_type = other DNA
gaagccaggaaatgacgtaggat

SEQ ID NO: 24833 - DNA, 20 bp, synthetic construct
  misc_feature 1..20: note = Synthetic Construct
  source 1..20: mol_type = other DNA
cacacggtggatcagccttt

SEQ ID NO: 24834 - DNA, 21 bp, synthetic construct
  misc_feature 1..21: note = Synthetic Construct
  source 1..21: mol_type = other DNA
gcgctccagggattttgattg

SEQ ID NO: 24835 - DNA, 20 bp, synthetic construct
  misc_feature 1..20: note = Synthetic Construct
  source 1..20: mol_type = other DNA
atctgggccccttcttctga

SEQ ID NO: 24836 - DNA, 23 bp, synthetic construct
  misc_feature 1..23: note = Synthetic Construct
  source 1..23: mol_type = other DNA
ttcctgctacctcttctcctcaa

SEQ ID NO: 24837 - DNA, 22 bp, synthetic construct
  misc_feature 1..22: note = Synthetic Construct
  source 1..22: mol_type = other DNA
cctcctgatggactgccaggta

SEQ ID NO: 24838 - DNA, 22 bp, synthetic construct
  misc_feature 1..22: note = Synthetic Construct
  source 1..22: mol_type = other DNA
gacgggcgtttgttctccttga

SEQ ID NO: 24839 - DNA, 21 bp, synthetic construct
  misc_feature 1..21: note = Synthetic Construct
  source 1..21: mol_type = other DNA
tgcagtactggagaggtgcat

SEQ ID NO: 24840 - DNA, 18 bp, synthetic construct
  misc_feature 1..18: note = Synthetic Construct
  source 1..18: mol_type = other DNA
tgctggtgcgaggagaga

SEQ ID NO: 24841 - DNA, 22 bp, synthetic construct
  misc_feature 1..22: note = Synthetic Construct
  source 1..22: mol_type = other DNA
gacagccccaacacttcactct

SEQ ID NO: 24842 - DNA, 22 bp, synthetic construct
  misc_feature 1..22: note = Synthetic Construct
  source 1..22: mol_type = other DNA
atccatctcctgctcccgtttc

SEQ ID NO: 24843 - DNA, 24 bp, synthetic construct
  misc_feature 1..24: note = Synthetic Construct
  source 1..24: mol_type = other DNA
gcttggtgtgttactgaacctcta

SEQ ID NO: 24844 - DNA, 23 bp, synthetic construct
  misc_feature 1..23: note = Synthetic Construct
  source 1..23: mol_type = other DNA
caagttccttcagtgaggccatt

SEQ ID NO: 24845 - DNA, 22 bp, synthetic construct
  misc_feature 1..22: note = Synthetic Construct
  source 1..22: mol_type = other DNA
gctgcaagcaagagaccatttc

SEQ ID NO: 24846 - DNA, 20 bp, synthetic construct
  misc_feature 1..20: note = Synthetic Construct
  source 1..20: mol_type = other DNA
tggcttccccagaaggacaa

SEQ ID NO: 24847 - DNA, 23 bp, synthetic construct
  misc_feature 1..23: note = Synthetic Construct
  source 1..23: mol_type = other DNA
ggaaatgtgtgtctcccaaccat

SEQ ID NO: 24848 - DNA, 22 bp, synthetic construct
  misc_feature 1..22: note = Synthetic Construct
  source 1..22: mol_type = other DNA
cctctcctgttccggagtgttc

SEQ ID NO: 24849 - DNA, 22 bp, synthetic construct
  misc_feature 1..22: note = Synthetic Construct
  source 1..22: mol_type = other DNA
gcagtagcgacttacccacagt

SEQ ID NO: 24850 - DNA, 23 bp, synthetic construct
  misc_feature 1..23: note = Synthetic Construct
  source 1..23: mol_type = other DNA
cctccttgcaatcagctttggta

SEQ ID NO: 24851 - DNA, 25 bp, synthetic construct
  misc_feature 1..25: note = Synthetic Construct
  source 1..25: mol_type = other DNA
gtagacttactctgaagtccacgtt

SEQ ID NO: 24852 - DNA, 24 bp, synthetic construct
  misc_feature 1..24: note = Synthetic Construct
  source 1..24: mol_type = other DNA
gatgaatgggatggtgacctttct

SEQ ID NO: 24853 - DNA, 21 bp, synthetic construct
  misc_feature 1..21: note = Synthetic Construct
  source 1..21: mol_type = other DNA
cggaggcccctctaagtcagt

SEQ ID NO: 24854 - DNA, 20 bp, synthetic construct
  misc_feature 1..20: note = Synthetic Construct
  source 1..20: mol_type = other DNA
agtggtcacctggggcagat

SEQ ID NO: 24855 - DNA, 23 bp, synthetic construct
  misc_feature 1..23: note = Synthetic Construct
  source 1..23: mol_type = other DNA
tgggacatagagtgacaggactt

SEQ ID NO: 24856 - DNA, 20 bp, synthetic construct
  misc_feature 1..20: note = Synthetic Construct
  source 1..20: mol_type = other DNA
acaggagccaaaccggtact

SEQ ID NO: 24857 - DNA, 27 bp, synthetic construct
  misc_feature 1..27: note = Synthetic Construct
  source 1..27: mol_type = other DNA
gaccaccaatttcagtagggttttatg

SEQ ID NO: 24858 - DNA, 22 bp, synthetic construct
  misc_feature 1..22: note = Synthetic Construct
  source 1..22: mol_type = other DNA
caggaaggaagcgatgaactga

SEQ ID NO: 24859 - DNA, 20 bp, synthetic construct
  misc_feature 1..20: note = Synthetic Construct
  source 1..20: mol_type = other DNA
agcagggattggcgaagaca

SEQ ID NO: 24860 - DNA, 22 bp, synthetic construct
  misc_feature 1..22: note = Synthetic Construct
  source 1..22: mol_type = other DNA
ggccagttgctttcaccaatgt

SEQ ID NO: 24861 - DNA, 24 bp, synthetic construct
  misc_feature 1..24: note = Synthetic Construct
  source 1..24: mol_type = other DNA
gtgctccctttgaagaactggatt

SEQ ID NO: 24862 - DNA, 21 bp, synthetic construct
  misc_feature 1..21: note = Synthetic Construct
  source 1..21: mol_type = other DNA
tgtggagaaggggtcctcatt

SEQ ID NO: 24863 - DNA, 24 bp, synthetic construct
  misc_feature 1..24: note = Synthetic Construct
  source 1..24: mol_type = other DNA
gctgccatcagcttttctgtcgat

SEQ ID NO: 24864 - DNA, 22 bp, synthetic construct
  misc_feature 1..22: note = Synthetic Construct
  source 1..22: mol_type = other DNA
ggatcagcatggagacaaccaa

SEQ ID NO: 24865 - DNA, 20 bp, synthetic construct
  misc_feature 1..20: note = Synthetic Construct
  source 1..20: mol_type = other DNA
cagtgggctcaccgtagctt

SEQ ID NO: 24866 - DNA, 26 bp, synthetic construct
  misc_feature 1..26: note = Synthetic Construct
  source 1..26: mol_type = other DNA
cggattgttttccaggtacaaagtgt

SEQ ID NO: 24867 - DNA, 25 bp, synthetic construct
  misc_feature 1..25: note = Synthetic Construct
  source 1..25: mol_type = other DNA
gttccttttgagcaggcttgtctat

SEQ ID NO: 24868 - DNA, 22 bp, synthetic construct
  misc_feature 1..22: note = Synthetic Construct
  source 1..22: mol_type = other DNA
cagatggggagaactgctcaca

SEQ ID NO: 24869 - DNA, 24 bp, synthetic construct
  misc_feature 1..24: note = Synthetic Construct
  source 1..24: mol_type = other DNA
gcaaggagcaatgaacagctacta

SEQ ID NO: 24870 - DNA, 22 bp, synthetic construct
  misc_feature 1..22: note = Synthetic Construct
  source 1..22: mol_type = other DNA
ttcacagggaggactggagtta

SEQ ID NO: 24871 - DNA, 24 bp, synthetic construct
  misc_feature 1..24: note = Synthetic Construct
  source 1..24: mol_type = other DNA
agacagtagccagcttcaaaaact

SEQ ID NO: 24872 - DNA, 26 bp, synthetic construct
  misc_feature 1..26: note = Synthetic Construct
  source 1..26: mol_type = other DNA
cacaacatcactgcatctgcattcta

SEQ ID NO: 24873 - DNA, 21 bp, synthetic construct
  misc_feature 1..21: note = Synthetic Construct
  source 1..21: mol_type = other DNA
aagccaccctgggaaccacat

SEQ ID NO: 24874 - DNA, 23 bp, synthetic construct
  misc_feature 1..23: note = Synthetic Construct
  source 1..23: mol_type = other DNA
tggggtaggaggaggacacagta

SEQ ID NO: 24875 - DNA, 21 bp, synthetic construct
  misc_feature 1..21: note = Synthetic Construct
  source 1..21: mol_type = other DNA
ggaagccatcagcatgtggaa

SEQ ID NO: 24876 - DNA, 20 bp, synthetic construct
  misc_feature 1..20: note = Synthetic Construct
  source 1..20: mol_type = other DNA
ccccaaccaacctgcacaca

SEQ ID NO: 24877 - DNA, 21 bp, synthetic construct
  misc_feature 1..21: note = Synthetic Construct
  source 1..21: mol_type = other DNA
agccccagttcactgttgatg

SEQ ID NO: 24878 - DNA, 21 bp, synthetic construct
  misc_feature 1..21: note = Synthetic Construct
  source 1..21: mol_type = other DNA
gaatcacccatgcagctggta

SEQ ID NO: 24879 - DNA, 22 bp, synthetic construct
  misc_feature 1..22: note = Synthetic Construct
  source 1..22: mol_type = other DNA
ccctattgtgccccagatttga

SEQ ID NO: 24880 - DNA, 22 bp, synthetic construct
  misc_feature 1..22: note = Synthetic Construct
  source 1..22: mol_type = other DNA
ctccttgcacagaagggctcat

SEQ ID NO: 24881 - DNA, 22 bp, synthetic construct
  misc_feature 1..22: note = Synthetic Construct
  source 1..22: mol_type = other DNA
gcgtgctacatctccactgaca

SEQ ID NO: 24882 - DNA, 22 bp, synthetic construct
  misc_feature 1..22: note = Synthetic Construct
  source 1..22: mol_type = other DNA
gaacatcctggggtgcacaaag

SEQ ID NO: 24883 - DNA, 21 bp, synthetic construct
  misc_feature 1..21: note = Synthetic Construct
  source 1..21: mol_type = other DNA
ccttcagggtcctgcagttca

SEQ ID NO: 24884 - DNA, 21 bp, synthetic construct
  misc_feature 1..21: note = Synthetic Construct
  source 1..21: mol_type = other DNA
accatgcagggacacacaatg

SEQ ID NO: 24885 - DNA, 22 bp, synthetic construct
  misc_feature 1..22: note = Synthetic Construct
  source 1..22: mol_type = other DNA
cacagaagcgcatcaaggttac

SEQ ID NO: 24886 - DNA, 20 bp, synthetic construct
  misc_feature 1..20: note = Synthetic Construct
  source 1..20: mol_type = other DNA
cctgccagaaggcgtaagaa

SEQ ID NO: 24887 - DNA, 25 bp, synthetic construct
  misc_feature 1..25: note = Synthetic Construct
  source 1..25: mol_type = other DNA
gagtaagccccatttaggctttcaa

SEQ ID NO: 24888 - DNA, 21 bp, synthetic construct
  misc_feature 1..21: note = Synthetic Construct
  source 1..21: mol_type = other DNA
agatgcagccaggtagagact

SEQ ID NO: 24889 - DNA, 21 bp, synthetic construct
  misc_feature 1..21: note = Synthetic Construct
  source 1..21: mol_type = other DNA
cccgggtgtctgtcgagtaac

SEQ ID NO: 24890 - DNA, 20 bp, synthetic construct
  misc_feature 1..20: note = Synthetic Construct
  source 1..20: mol_type = other DNA
gcagtggggcattgtgaatc

SEQ ID NO: 24891 - DNA, 22 bp, synthetic construct
  misc_feature 1..22: note = Synthetic Construct
  source 1..22: mol_type = other DNA
gggttcctgcgttggggtattt

SEQ ID NO: 24892 - DNA, 20 bp, synthetic construct
  misc_feature 1..20: note = Synthetic Construct
  source 1..20: mol_type = other DNA
tgccagaagccagtgccaat

SEQ ID NO: 24893 - DNA, 21 bp, synthetic construct
  misc_feature 1..21: note = Synthetic Construct
  source 1..21: mol_type = other DNA
gcagcaagccaggaaagacaa

SEQ ID NO: 24894 - DNA, 20 bp, synthetic construct
  misc_feature 1..20: note = Synthetic Construct
  source 1..20: mol_type = other DNA
agccacctgcaagtcaggaa

SEQ ID NO: 24895 - DNA, 24 bp, synthetic construct
  misc_feature 1..24: note = Synthetic Construct
  source 1..24: mol_type = other DNA
ttagtcttctctctgccaggaaac

SEQ ID NO: 24896 - DNA, 20 bp, synthetic construct
  misc_feature 1..20: note = Synthetic Construct
  source 1..20: mol_type = other DNA
ggtttgcaccctgggaatga

SEQ ID NO: 24897 - DNA, 24 bp, synthetic construct
  misc_feature 1..24: note = Synthetic Construct
  source 1..24: mol_type = other DNA
tggggagaaagtcagtatccaact

SEQ ID NO: 24898 - DNA, 25 bp, synthetic construct
  misc_feature 1..25: note = Synthetic Construct
  source 1..25: mol_type = other DNA
caggacttctcacagcctttaatgt

SEQ ID NO: 24899 - DNA, 24 bp, synthetic construct
  misc_feature 1..24: note = Synthetic Construct
  source 1..24: mol_type = other DNA
ggtatcagtgctgcttagccattg

SEQ ID NO: 24900 - DNA, 22 bp, synthetic construct
  misc_feature 1..22: note = Synthetic Construct
  source 1..22: mol_type = other DNA
ctgtcagaaccagcaagcatgt

SEQ ID NO: 24901 - DNA, 19 bp, synthetic construct
  misc_feature 1..19: note = Synthetic Construct
  source 1..19: mol_type = other DNA
tccccagctccaggcagta

SEQ ID NO: 24902 - DNA, 22 bp, synthetic construct
  misc_feature 1..22: note = Synthetic Construct
  source 1..22: mol_type = other DNA
catgggctgagctgaagataca

SEQ ID NO: 24903 - DNA, 22 bp, synthetic construct
  misc_feature 1..22: note = Synthetic Construct
  source 1..22: mol_type = other DNA
gggaagtagaaaccgccaatct

SEQ ID NO: 24904 - DNA, 22 bp, synthetic construct
  misc_feature 1..22: note = Synthetic Construct
  source 1..22: mol_type = other DNA
cggattgtggctctctgtgact

SEQ ID NO: 24905 - DNA, 22 bp, synthetic construct
  misc_feature 1..22: note = Synthetic Construct
  source 1..22: mol_type = other DNA
caccgactcctcgccattatct

SEQ ID NO: 24906 - DNA, 21 bp, synthetic construct
  misc_feature 1..21: note = Synthetic Construct
  source 1..21: mol_type = other DNA
tacctggtccagcctgacttc

SEQ ID NO: 24907 - DNA, 22 bp, synthetic construct
  misc_feature 1..22: note = Synthetic Construct
  source 1..22: mol_type = other DNA
cccgttggactcagaagtgaag

SEQ ID NO: 24908 - DNA, 20 bp, synthetic construct
  misc_feature 1..20: note = Synthetic Construct
  source 1..20: mol_type = other DNA
cctgcccactctcagcagat

SEQ ID NO: 24909 - DNA, 22 bp, synthetic construct
  misc_feature 1..22: note = Synthetic Construct
  source 1..22: mol_type = other DNA
cagctaccctttgcctctgcat

SEQ ID NO: 24910 - DNA, 23 bp, synthetic construct
  misc_feature 1..23: note = Synthetic Construct
  source 1..23: mol_type = other DNA
gacttcccctcaggtcttttcaa

SEQ ID NO: 24911 - DNA, 24 bp, synthetic construct
  misc_feature 1..24: note = Synthetic Construct
  source 1..24: mol_type = other DNA
gcctggatacagggacacctattc

SEQ ID NO: 24912 - DNA, 24 bp, synthetic construct
  misc_feature 1..24: note = Synthetic Construct
  source 1..24: mol_type = other DNA
gaagctgatgaaacagtcctctca

SEQ ID NO: 24913 - DNA, 21 bp, synthetic construct
  misc_feature 1..21: note = Synthetic Construct
  source 1..21: mol_type = other DNA
actaccctgaggctgatccaa

SEQ ID NO: 24914 - DNA, 21 bp, synthetic construct
  misc_feature 1..21: note = Synthetic Construct
  source 1..21: mol_type = other DNA
gtggaacctggtggactcctt

SEQ ID NO: 24915 - DNA, 23 bp, synthetic construct
  misc_feature 1..23: note = Synthetic Construct
  source 1..23: mol_type = other DNA
gacattgagcgggtcacttaaac

SEQ ID NO: 24916 - DNA, 25 bp, synthetic construct
  misc_feature 1..25: note = Synthetic Construct
  source 1..25: mol_type = other DNA
tggttgctccagaaactacctaaat

SEQ ID NO: 24917 - DNA, 21 bp, synthetic construct
  misc_feature 1..21: note = Synthetic Construct
  source 1..21: mol_type = other DNA
aagactggggacgggatactt

SEQ ID NO: 24918 - DNA, 19 bp, synthetic construct
  misc_feature 1..19: note = Synthetic Construct
  source 1..19: mol_type = other DNA
gccgagactgccagacctt

SEQ ID NO: 24919 - DNA, 24 bp, synthetic construct
  misc_feature 1..24: note = Synthetic Construct
  source 1..24: mol_type = other DNA
gtgtccgaggaagtgtgacaaatg

SEQ ID NO: 24920 - DNA, 24 bp, synthetic construct
  misc_feature 1..24: note = Synthetic Construct
  source 1..24: mol_type = other DNA
gtgattcctatgggcttcccactt

SEQ ID NO: 24921 - DNA, 19 bp, synthetic construct
  misc_feature 1..19: note = Synthetic Construct
  source 1..19: mol_type = other DNA
gcccaccctcccacattac

SEQ ID NO: 24922 - DNA, 20 bp, synthetic construct
  misc_feature 1..20: note = Synthetic Construct
  source 1..20: mol_type = other DNA
ggaacaccctctggcactct

SEQ ID NO: 24923 - DNA, 22 bp, synthetic construct
  misc_feature 1..22: note = Synthetic Construct
  source 1..22: mol_type = other DNA
agtggaacagttgcctgagatg

SEQ ID NO: 24924 - DNA, 25 bp, synthetic construct
  misc_feature 1..25: note = Synthetic Construct
  source 1..25: mol_type = other DNA
cacgtgtgtaagtgcagactctttg

SEQ ID NO: 24925 - DNA, 23 bp, synthetic construct
  misc_feature 1..23: note = Synthetic Construct
  source 1..23: mol_type = other DNA
cccaaggcaatgacaaatgctta

SEQ ID NO: 24926 - DNA, 20 bp, synthetic construct
  misc_feature 1..20: note = Synthetic Construct
  source 1..20: mol_type = other DNA
tgaaggctcaggcacagaca

SEQ ID NO: 24927 - DNA, 21 bp, synthetic construct
  misc_feature 1..21: note = Synthetic Construct
  source 1..21: mol_type = other DNA
tgcccctcaactctgcatttc

SEQ ID NO: 24928 - DNA, 20 bp, synthetic construct
  misc_feature 1..20: note = Synthetic Construct
  source 1..20: mol_type = other DNA
tggcagctctctcagcatca

SEQ ID NO: 24929 - DNA, 20 bp, synthetic construct
  misc_feature 1..20: note = Synthetic Construct
  source 1..20: mol_type = other DNA
tctcgccaaatgccgtggaa

SEQ ID NO: 24930 - DNA, 20 bp, synthetic construct
  misc_feature 1..20: note = Synthetic Construct
  source 1..20: mol_type = other DNA
gccattggccagcattgact

SEQ ID NO: 24931 - DNA, 26 bp, synthetic construct
  misc_feature 1..26: note = Synthetic Construct
  source 1..26: mol_type = other DNA
ggctgactatatgcttctgctgaact

SEQ ID NO: 24932 - DNA, 20 bp, synthetic construct
  misc_feature 1..20: note = Synthetic Construct
  source 1..20: mol_type = other DNA
ggcaggagcccctcttcttg

SEQ ID NO: 24933 - DNA, 23 bp, synthetic construct
  misc_feature 1..23: note = Synthetic Construct
  source 1..23: mol_type = other DNA
caaggtaacaccccaagatgtga

SEQ ID NO: 24934 - DNA, 28 bp, synthetic construct
  misc_feature 1..28: note = Synthetic Construct
  source 1..28: mol_type = other DNA
cctaagcgtcctaaatgaggtaagaatg

SEQ ID NO: 24935 - DNA, 27 bp, synthetic construct
  misc_feature 1..27: note = Synthetic Construct
  source 1..27: mol_type = other DNA
gccatctgaaaactgtgatggagttag

SEQ ID NO: 24936 - DNA, 24 bp, synthetic construct
  misc_feature 1..24: note = Synthetic Construct
  source 1..24: mol_type = other DNA
cggtctctgatgttctcggacgtt

SEQ ID NO: 24937 - DNA, 20 bp, synthetic construct
  misc_feature 1..20: note = Synthetic Construct
  source 1..20: mol_type = other DNA
accatgacacgcccttgact

SEQ ID NO: 24938 - DNA, 23 bp, synthetic construct
  misc_feature 1..23: note = Synthetic Construct
  source 1..23: mol_type = other DNA
cctggctgggcataagtttttgt

SEQ ID NO: 24939 - DNA, 24 bp, synthetic construct
  misc_feature 1..24: note = Synthetic Construct
  source 1..24: mol_type = other DNA
ctgaaaggaagaagccacagtcaa

SEQ ID NO: 24940 - DNA, 20 bp, synthetic construct
  misc_feature 1..20: note = Synthetic Construct
  source 1..20: mol_type = other DNA
cccagtgcttgtggactctt

SEQ ID NO: 24941 - DNA, 21 bp, synthetic construct
  misc_feature 1..21: note = Synthetic Construct
  source 1..21: mol_type = other DNA
ggtgccttctggcatcagcat

SEQ ID NO: 24942 - DNA, 21 bp, synthetic construct
  misc_feature 1..21: note = Synthetic Construct
  source 1..21: mol_type = other DNA
catgggcctccaggacctact

SEQ ID NO: 24943 - DNA, 20 bp, synthetic construct
  misc_feature 1..20: note = Synthetic Construct
  source 1..20: mol_type = other DNA
cacctgccttccccatgagt

SEQ ID NO: 24944 - DNA, 22 bp, synthetic construct
  misc_feature 1..22: note = Synthetic Construct
  source 1..22: mol_type = other DNA
caaggaggaccctggcttttca

SEQ ID NO: 24945 - DNA, 22 bp, synthetic construct
  misc_feature 1..22: note = Synthetic Construct
  source 1..22: mol_type = other DNA
cctcccgcaactcttctgctta

SEQ ID NO: 24946 - DNA, 24 bp, synthetic construct
  misc_feature 1..24: note = Synthetic Construct
  source 1..24: mol_type = other DNA
ggatctcagggctcacctgtgaaa

SEQ ID NO: 24947 - DNA, 21 bp, synthetic construct
  misc_feature 1..21: note = Synthetic Construct
  source 1..21: mol_type = other DNA
gcacttcccctcacagtcaga

SEQ ID NO: 24948 - DNA, 19 bp, synthetic construct
  misc_feature 1..19: note = Synthetic Construct
  source 1..19: mol_type = other DNA
gccgcacaggatggggaaa

SEQ ID NO: 24949 - DNA, 22 bp, synthetic construct
  misc_feature 1..22: note = Synthetic Construct
  source 1..22: mol_type = other DNA
accacaggctacctttccaatc

SEQ ID NO: 24950 - DNA, 21 bp, synthetic construct
  misc_feature 1..21: note = Synthetic Construct
  source 1..21: mol_type = other DNA
cactatgcagccagaccatca

SEQ ID NO: 24951 - DNA, 23 bp, synthetic construct
  misc_feature 1..23: note = Synthetic Construct
  source 1..23: mol_type = other DNA
ccccaggcattggtccttaatgt

SEQ ID NO: 24952 - DNA, 21 bp, synthetic construct
  misc_feature 1..21: note = Synthetic Construct
  source 1..21: mol_type = other DNA
atcacgtgaccacccctcgta

SEQ ID NO: 24953 - DNA, 25 bp, synthetic construct
  misc_feature 1..25: note = Synthetic Construct
  source 1..25: mol_type = other DNA
gctgtgttaatggagctacaatgtt

SEQ ID NO: 24954 - DNA, 22 bp, synthetic construct
  misc_feature 1..22: note = Synthetic Construct
  source 1..22: mol_type = other DNA
gcagaaaaccctggcacacaga

SEQ ID NO: 24955 - DNA, 19 bp, synthetic construct
  misc_feature 1..19: note = Synthetic Construct
  source 1..19: mol_type = other DNA
gtctggctcgggaccactt

SEQ ID NO: 24956 - DNA, 21 bp, synthetic construct
  misc_feature 1..21: note = Synthetic Construct
  source 1..21: mol_type = other DNA
gcctccgagttgtttgagagt

SEQ ID NO: 24957 - DNA, 22 bp, synthetic construct
  misc_feature 1..22: note = Synthetic Construct
  source 1..22: mol_type = other DNA
tctaggacgtggtctccacctt

SEQ ID NO: 24958 - DNA, 21 bp, synthetic construct
  misc_feature 1..21: note = Synthetic Construct
  source 1..21: mol_type = other DNA
tggccatatgccgagctaaaa

SEQ ID NO: 24959 - DNA, 24 bp, synthetic construct
  misc_feature 1..24: note = Synthetic Construct
  source 1..24: mol_type = other DNA
cagagcctgaatgatttccacact

SEQ ID NO: 24960 - DNA, 19 bp, synthetic construct
  misc_feature 1..19: note = Synthetic Construct
  source 1..19: mol_type = other DNA
gccatcagtggctcagctt

SEQ ID NO: 24961 - DNA, 26 bp, synthetic construct
  misc_feature 1..26: note = Synthetic Construct
  source 1..26: mol_type = other DNA
tgctaactgacttacccaatccatag

SEQ ID NO: 24962 - DNA, 24 bp, synthetic construct
  misc_feature 1..24: note = Synthetic Construct
  source 1..24: mol_type = other DNA
tgggctcttgtctcagtgtattct

SEQ ID NO: 24963 - DNA, 24 bp, synthetic construct
  misc_feature 1..24: note = Synthetic Construct
  source 1..24: mol_type = other DNA
gcctccatcccttttctcagagtt

SEQ ID NO: 24964 - DNA, 23 bp, synthetic construct
  misc_feature 1..23: note = Synthetic Construct
  source 1..23: mol_type = other DNA
ctacacttgtggagctgtctgaa

SEQ ID NO: 24965 - DNA, 24 bp, synthetic construct
  misc_feature 1..24: note = Synthetic Construct
  source 1..24: mol_type = other DNA
cacacccacagattcgagaaggat

SEQ ID NO: 24966 - DNA, 22 bp, synthetic construct
  misc_feature 1..22: note = Synthetic Construct
  source 1..22: mol_type = other DNA
aggcactgagacgaggacaagt

SEQ ID NO: 24967 - DNA, 20 bp, synthetic construct
  misc_feature 1..20: note = Synthetic Construct
  source 1..20: mol_type = other DNA
gtccgtcaccttgggagtca

SEQ ID NO: 24968 - DNA, 20 bp, synthetic construct
  misc_feature 1..20: note = Synthetic Construct
  source 1..20: mol_type = other DNA
aaggccggtggtctcttcaa

SEQ ID NO: 24969 - DNA, 25 bp, synthetic construct
  misc_feature 1..25: note = Synthetic Construct
  source 1..25: mol_type = other DNA
caactgcagagagcagagttcacta

SEQ ID NO: 24970 - DNA, 20 bp, synthetic construct
  misc_feature 1..20: note = Synthetic Construct
  source 1..20: mol_type = other DNA
atccaggtcaggccacagtt

SEQ ID NO: 24971 - DNA, 20 bp, synthetic construct
  misc_feature 1..20: note = Synthetic Construct
  source 1..20: mol_type = other DNA
tccagcaacgtgaccaaaca

SEQ ID NO: 24972 - DNA, 21 bp, synthetic construct
  misc_feature 1..21: note = Synthetic Construct
  source 1..21: mol_type = other DNA
gcctggaggtgaggtgtgttt

SEQ ID NO: 24973 - DNA, 20 bp, synthetic construct
  misc_feature 1..20: note = Synthetic Construct
  source 1..20: mol_type = other DNA
agttgccctgaagcgtggat

SEQ ID NO: 24974 - DNA, 21 bp, synthetic construct
  misc_feature 1..21: note = Synthetic Construct
  source 1..21: mol_type = other DNA
tcagggtgccaacctatgcta

SEQ ID NO: 24975 - DNA, 26 bp, synthetic construct
  misc_feature 1..26: note = Synthetic Construct
  source 1..26: mol_type = other DNA
ggttagccagtcagaactttgtttac

SEQ ID NO: 24976 - DNA, 21 bp, synthetic construct
  misc_feature 1..21: note = Synthetic Construct
  source 1..21: mol_type = other DNA
cacagtaccaaaggccagaca

SEQ ID NO: 24977 - DNA, 22 bp, synthetic construct
  misc_feature 1..22: note = Synthetic Construct
  source 1..22: mol_type = other DNA
ctgccctggaagactggaaaga

SEQ ID NO: 24978 - DNA, 20 bp, synthetic construct
  misc_feature 1..20: note = Synthetic Construct
  source 1..20: mol_type = other DNA
tgcaccaatgaagccacaca

SEQ ID NO: 24979 - DNA, 23 bp, synthetic construct
  misc_feature 1..23: note = Synthetic Construct
  source 1..23: mol_type = other DNA
gaggctggccagatgttttctca

SEQ ID NO: 24980 - DNA, 21 bp, synthetic construct
  misc_feature 1..21: note = Synthetic Construct
  source 1..21: mol_type = other DNA
atccctgcagccagaggttca

SEQ ID NO: 24981 - DNA, 24 bp, synthetic construct
  misc_feature 1..24: note = Synthetic Construct
  source 1..24: mol_type = other DNA
tggtggagaggggaatacactaac

SEQ ID NO: 24982 - DNA, 23 bp, synthetic construct
  misc_feature 1..23: note = Synthetic Construct
  source 1..23: mol_type = other DNA
tggatctgacttggagagcattg

SEQ ID NO: 24983 - DNA, 27 bp, synthetic construct
  misc_feature 1..27: note = Synthetic Construct
  source 1..27: mol_type = other DNA
actcatgggtacagaggattataggaa

SEQ ID NO: 24984 - DNA, 19 bp, synthetic construct
  misc_feature 1..19: note = Synthetic Construct
  source 1..19: mol_type = other DNA
cccctctgcttgccacagt

SEQ ID NO: 24985 - DNA, 23 bp, synthetic construct
  misc_feature 1..23: note = Synthetic Construct
  source 1..23: mol_type = other DNA
ctctgcggtcccatttctgaaca

SEQ ID NO: 24986 - DNA, 20 bp, synthetic construct
  misc_feature 1..20: note = Synthetic Construct
  source 1..20: mol_type = other DNA
cacttccccaaccccactct

SEQ ID NO: 24987 - DNA, 21 bp, synthetic construct
  misc_feature 1..21: note = Synthetic Construct
  source 1..21: mol_type = other DNA
ggggccaagtgactaagttgt

SEQ ID NO: 24988 - DNA, 20 bp, synthetic construct
  misc_feature 1..20: note = Synthetic Construct
  source 1..20: mol_type = other DNA
ttgctgggcccctctgtttg

SEQ ID NO: 24989 - DNA, 23 bp, synthetic construct
  misc_feature 1..23: note = Synthetic Construct
  source 1..23: mol_type = other DNA
ccacaccttccttctccttccaa

SEQ ID NO: 24990 - DNA, 22 bp, synthetic construct
  misc_feature 1..22: note = Synthetic Construct
  source 1..22: mol_type = other DNA
ctcacaggctgcctctctaatc

SEQ ID NO: 24991 - DNA, 24 bp, synthetic construct
  misc_feature 1..24: note = Synthetic Construct
  source 1..24: mol_type = other DNA
ggaaggaggtcgctttcaaaatca

SEQ ID NO: 24992 - DNA, 22 bp, synthetic construct
  misc_feature 1..22: note = Synthetic Construct
  source 1..22: mol_type = other DNA
cccacttgcagaagaggtgcat

SEQ ID NO: 24993 - DNA, 21 bp, synthetic construct
  misc_feature 1..21: note = Synthetic Construct
  source 1..21: mol_type = other DNA
ggacaggggctctgagacaca

SEQ ID NO: 24994 - DNA, 24 bp, synthetic construct
  misc_feature 1..24: note = Synthetic Construct
  source 1..24: mol_type = other DNA
gagaaatgcaaggactccacaaaa

SEQ ID NO: 24995 - DNA, 26 bp, synthetic construct
  misc_feature 1..26: note = Synthetic Construct
  source 1..26: mol_type = other DNA
gttgatcctatagtgcgaacctgaca

SEQ ID NO: 24996 - DNA, 24 bp, synthetic construct
  misc_feature 1..24: note = Synthetic Construct
  source 1..24: mol_type = other DNA
cgcaatgacagctccattactaac

SEQ ID NO: 24997 - DNA, 23 bp, synthetic construct
  misc_feature 1..23: note = Synthetic Construct
  source 1..23: mol_type = other DNA
ccttctctgcaagtgtggtgtca

SEQ ID NO: 24998 - DNA, 22 bp, synthetic construct
  misc_feature 1..22: note = Synthetic Construct
  source 1..22: mol_type = other DNA
cccagtgggatgatgctagatg

SEQ ID NO: 24999 - DNA, 21 bp, synthetic construct
  misc_feature 1..21: note = Synthetic Construct
  source 1..21: mol_type = other DNA
gaggcctggcaatttctgctt

SEQ ID NO: 25000 - DNA, 23 bp, synthetic construct
  misc_feature 1..23: note = Synthetic Construct
  source 1..23: mol_type = other DNA
tccaaaagctcttgatgctgaca

SEQ ID NO: 25001 - DNA, 24 bp, synthetic construct
  misc_feature 1..24: note = Synthetic Construct
  source 1..24: mol_type = other DNA
ctctgttctatctgccacaaggtt

SEQ ID NO: 25002 - DNA, 23 bp, synthetic construct
  misc_feature 1..23: note = Synthetic Construct
  source 1..23: mol_type = other DNA
gacaccagttcaccccagttatc

SEQ ID NO: 25003 - DNA, 20 bp, synthetic construct
  misc_feature 1..20: note = Synthetic Construct
  source 1..20: mol_type = other DNA
gggcaatgcctggagctagt

SEQ ID NO: 25004 - DNA, 19 bp, synthetic construct
  misc_feature 1..19: note = Synthetic Construct
  source 1..19: mol_type = other DNA
gcagcagctcctgtctgat

SEQ ID NO: 25005 - DNA, 20 bp, synthetic construct
  misc_feature 1..20: note = Synthetic Construct
  source 1..20: mol_type = other DNA
gccctcgctgtggcttatga

SEQ ID NO: 25006 - DNA, 22 bp, synthetic construct
  misc_feature 1..22: note = Synthetic Construct
  source 1..22: mol_type = other DNA
ggtggacaaggtggaaaagtct

SEQ ID NO: 25007 - DNA, 19 bp, synthetic construct
  misc_feature 1..19: note = Synthetic Construct
  source 1..19: mol_type = other DNA
aacagaggcaccgccaagt

SEQ ID NO: 25008 - DNA, 23 bp, synthetic construct
  misc_feature 1..23: note = Synthetic Construct
  source 1..23: mol_type = other DNA
gggttcctccatccccttcacat

SEQ ID NO: 25009 - DNA, 24 bp, synthetic construct
  misc_feature 1..24: note = Synthetic Construct
  source 1..24: mol_type = other DNA
tcacccatcccacctatttacttg

SEQ ID NO: 25010 - DNA, 23 bp, synthetic construct
  misc_feature 1..23: note = Synthetic Construct
  source 1..23: mol_type = other DNA
gttacagtctcggtcacgtcttg

SEQ ID NO: 25011 - DNA, 23 bp, synthetic construct
  misc_feature 1..23: note = Synthetic Construct
  source 1..23: mol_type = other DNA
cacagtgcacatgaaccccttct

SEQ ID NO: 25012 - DNA, 20 bp, synthetic construct
  misc_feature 1..20: note = Synthetic Construct
  source 1..20: mol_type = other DNA
accccacagctgggctttag

SEQ ID NO: 25013 - DNA, 22 bp, synthetic construct
  misc_feature 1..22: note = Synthetic Construct
  source 1..22: mol_type = other DNA
ggggtgcgcttgaagcttatgt

SEQ ID NO: 25014 - DNA, 24 bp, synthetic construct
  misc_feature 1..24: note = Synthetic Construct
  source 1..24: mol_type = other DNA
gccttggagaatccttccttaact

SEQ ID NO: 25015 - DNA, 22 bp, synthetic construct
  misc_feature 1..22: note = Synthetic Construct
  source 1..22: mol_type = other DNA
ccaagagcctggtgagtacgtt

SEQ ID NO: 25016 - DNA, 24 bp, synthetic construct
  misc_feature 1..24: note = Synthetic Construct
  source 1..24: mol_type = other DNA
gaagttctactctgtgctggtgaa

SEQ ID NO: 25017 - DNA, 25 bp, synthetic construct
  misc_feature 1..25: note = Synthetic Construct
  source 1..25: mol_type = other DNA
gagaactgccggatcaaacagaaag

SEQ ID NO: 25018 - DNA, 21 bp, synthetic construct
  misc_feature 1..21: note = Synthetic Construct
  source 1..21: mol_type = other DNA
cggtagtgcaggggattgtca

SEQ ID NO: 25019 - DNA, 25 bp, synthetic construct
  misc_feature 1..25: note = Synthetic Construct
  source 1..25: mol_type = other DNA
ggagaacaccagggagaacacatag

SEQ ID NO: 25020 - DNA, 26 bp, synthetic construct
  misc_feature 1..26: note = Synthetic Construct
  source 1..26: mol_type = other DNA
gagtagatcagtggctgttacctgaa

SEQ ID NO: 25021 - DNA, 22 bp, synthetic construct
  misc_feature 1..22: note = Synthetic Construct
  source 1..22: mol_type = other DNA
aggcaccaggagagagtgtatt

SEQ ID NO: 25022 - DNA, 20 bp, synthetic construct
  misc_feature 1..20: note = Synthetic Construct
  source 1..20: mol_type = other DNA
aagtcggagttggcgtcctt

SEQ ID NO: 25023 - DNA, 20 bp, synthetic construct
  misc_feature 1..20: note = Synthetic Construct
  source 1..20: mol_type = other DNA
acacctccctgaccctgcat

SEQ ID NO: 25024 - DNA, 24 bp, synthetic construct
  misc_feature 1..24: note = Synthetic Construct
  source 1..24: mol_type = other DNA
agagggtaagggctatttgaggaa

SEQ ID NO: 25025 - DNA, 22 bp, synthetic construct
  misc_feature 1..22: note = Synthetic Construct
  source 1..22: mol_type = other DNA
caaccagctctaagctctgaca

SEQ ID NO: 25026 - DNA, 23 bp, synthetic construct
  misc_feature 1..23: note = Synthetic Construct
  source 1..23: mol_type = other DNA
tcctgttccatcactgattcgtt

SEQ ID NO: 25027 - DNA, 21 bp, synthetic construct
  misc_feature 1..21: note = Synthetic Construct
  source 1..21: mol_type = other DNA
gggtgacagcaaagaggttga

SEQ ID NO: 25028 - DNA, 22 bp, synthetic construct
  misc_feature 1..22: note = Synthetic Construct
  source 1..22: mol_type = other DNA
tggcagacagatgaggtagtgt

SEQ ID NO: 25029 - DNA, 20 bp, synthetic construct
  misc_feature 1..20: note = Synthetic Construct
  source 1..20: mol_type = other DNA
ggggtcctaggcagcactga

SEQ ID NO: 25030 - DNA, 19 bp, synthetic construct
  misc_feature 1..19: note = Synthetic Construct
  source 1..19: mol_type = other DNA
tccccaccccatgcaggta

SEQ ID NO: 25031 - DNA, 24 bp, synthetic construct
  misc_feature 1..24: note = Synthetic Construct
  source 1..24: mol_type = other DNA
gcagggtggagagataccactctt

SEQ ID NO: 25032 - DNA, 22 bp, synthetic construct
  misc_feature 1..22: note = Synthetic Construct
  source 1..22: mol_type = other DNA
cttcctccccacctcctaagaa

SEQ ID NO: 25033 - DNA, 23 bp, synthetic construct
  misc_feature 1..23: note = Synthetic Construct
  source 1..23: mol_type = other DNA
aatgaggctgggacaatcaagaa

SEQ ID NO: 25034 - DNA, 23 bp, synthetic construct
  misc_feature 1..23: note = Synthetic Construct
  source 1..23: mol_type = other DNA
gctgcataaagggcattgcttca

SEQ ID NO: 25035 - DNA, 25 bp, synthetic construct
  misc_feature 1..25: note = Synthetic Construct
  source 1..25: mol_type = other DNA
ccccaggagagcgaataatcacaag

SEQ ID NO: 25036 - DNA, 22 bp, synthetic construct
  misc_feature 1..22: note = Synthetic Construct
  source 1..22: mol_type = other DNA
tccctgattccccaaggcttct

SEQ ID NO: 25037 - DNA, 23 bp, synthetic construct
  misc_feature 1..23: note = Synthetic Construct
  source 1..23: mol_type = other DNA
gcctgggagatggctgttagtag

SEQ ID NO: 25038 - DNA, 20 bp, synthetic construct
  misc_feature 1..20: note = Synthetic Construct
  source 1..20: mol_type = other DNA
catggcctcagcacagtgaa

SEQ ID NO: 25039 - DNA, 21 bp, synthetic construct
  misc_feature 1..21: note = Synthetic Construct
  source 1..21: mol_type = other DNA
cctcatgccggatgctcttct

SEQ ID NO: 25040 - DNA, 23 bp, synthetic construct
  misc_feature 1..23: note = Synthetic Construct
  source 1..23: mol_type = other DNA
gtgggccatgggtagttatggaa

SEQ ID NO: 25041 - DNA, 22 bp, synthetic construct
  misc_feature 1..22: note = Synthetic Construct
  source 1..22: mol_type = other DNA
ctgccttctggccccatctaat

SEQ ID NO: 25042 - DNA, 21 bp, synthetic construct
  misc_feature 1..21: note = Synthetic Construct
  source 1..21: mol_type = other DNA
agggatttgcgggactaccat

SEQ ID NO: 25043 - DNA, 22 bp, synthetic construct
  misc_feature 1..22: note = Synthetic Construct
  source 1..22: mol_type = other DNA
caaagtggagggcctaggcaaa

SEQ ID NO: 25044 - DNA, 26 bp, synthetic construct
  misc_feature 1..26: note = Synthetic Construct
  source 1..26: mol_type = other DNA
ctgcgtaagggagaaggataatttgt

SEQ ID NO: 25045 - DNA, 20 bp, synthetic construct
  misc_feature 1..20: note = Synthetic Construct
  source 1..20: mol_type = other DNA
agagagcctggcctcagaca

SEQ ID NO: 25046 - DNA, 21 bp, synthetic construct
  misc_feature 1..21: note = Synthetic Construct
  source 1..21: mol_type = other DNA
ctccttcaccgttagcagcaa

SEQ ID NO: 25047 - DNA, 25 bp, synthetic construct
  misc_feature 1..25: note = Synthetic Construct
  source 1..25: mol_type = other DNA
ggatcaggaggttcaatgctaccaa

SEQ ID NO: 25048 - DNA, 20 bp, synthetic construct
  misc_feature 1..20: note = Synthetic Construct
  source 1..20: mol_type = other DNA
ctgttgccttggccatcagt

SEQ ID NO: 25049 - DNA, 22 bp, synthetic construct
  misc_feature 1..22: note = Synthetic Construct
  source 1..22: mol_type = other DNA
gggaatgtctgcgattggctat

SEQ ID NO: 25050 - DNA, 21 bp, synthetic construct
  misc_feature 1..21: note = Synthetic Construct
  source 1..21: mol_type = other DNA
ggtcccgaatgctttctgtct

SEQ ID NO: 25051 - DNA, 21 bp, synthetic construct
  misc_feature 1..21: note = Synthetic Construct
  source 1..21: mol_type = other DNA
ggccggaaaaggctacagtga

SEQ ID NO: 25052 - DNA, 23 bp, synthetic construct
  misc_feature 1..23: note = Synthetic Construct
  source 1..23: mol_type = other DNA
gctcagcagaatcatgcctaaac

SEQ ID NO: 25053 - DNA, 22 bp, synthetic construct
  misc_feature 1..22: note = Synthetic Construct
  source 1..22: mol_type = other DNA
cttggagcactgaagcatctca

SEQ ID NO: 25054 - DNA, 22 bp, synthetic construct
  misc_feature 1..22: note = Synthetic Construct
  source 1..22: mol_type = other DNA
gaactgtcactgacccggttgt

SEQ ID NO: 25055 - DNA, 21 bp, synthetic construct
  misc_feature 1..21: note = Synthetic Construct
  source 1..21: mol_type = other DNA
caccaggtgagggaagtcaca

SEQ ID NO: 25056 - DNA, 20 bp, synthetic construct
  misc_feature 1..20: note = Synthetic Construct
  source 1..20: mol_type = other DNA
ttcccaggggctgtatgcaa

SEQ ID NO: 25057 - DNA, 19 bp, synthetic construct
  misc_feature 1..19: note = Synthetic Construct
  source 1..19: mol_type = other DNA
tggccgtgcttggcttgtt

SEQ ID NO: 25058 - DNA, 24 bp, synthetic construct
  misc_feature 1..24: note = Synthetic Construct
  source 1..24: mol_type = other DNA
gaggggaagacacatgccatcaaa

SEQ ID NO: 25059 - DNA, 23 bp, synthetic construct
  misc_feature 1..23: note = Synthetic Construct
  source 1..23: mol_type = other DNA
caggtgacccgctaggatctatg

SEQ ID NO: 25060 - DNA, 20 bp, synthetic construct
  misc_feature 1..20: note = Synthetic Construct
  source 1..20: mol_type = other DNA
gtggcatctggacacccatt

SEQ ID NO: 25061 - DNA, 22 bp, synthetic construct
  misc_feature 1..22: note = Synthetic Construct
  source 1..22: mol_type = other DNA
ggggagccttgactgtaggaaa

SEQ ID NO: 25062 - DNA, 22 bp, synthetic construct
  misc_feature 1..22: note = Synthetic Construct
  source 1..22: mol_type = other DNA
cacagcggtctaggctcatatt

SEQ ID NO: 25063 - DNA, 22 bp, synthetic construct
  misc_feature 1..22: note = Synthetic Construct
  source 1..22: mol_type = other DNA
gcacaggagtcatcttgcatgt

SEQ ID NO: 25064 - DNA, 25 bp, synthetic construct
  misc_feature 1..25: note = Synthetic Construct
  source 1..25: mol_type = other DNA
tgcttggttgtaatctgagagtgaa

SEQ ID NO: 25065 - DNA, 22 bp, synthetic construct
  misc_feature 1..22: note = Synthetic Construct
  source 1..22: mol_type = other DNA
accatgggtccagtgggtaaag

SEQ ID NO: 25066 - DNA, 21 bp, synthetic construct
  misc_feature 1..21: note = Synthetic Construct
  source 1..21: mol_type = other DNA
gcagcaggactctcaccttga

SEQ ID NO: 25067 - DNA, 23 bp, synthetic construct
  misc_feature 1..23: note = Synthetic Construct
  source 1..23: mol_type = other DNA
cccttaccttccaagagctgtca

SEQ ID NO: 25068 - DNA, 24 bp, synthetic construct
  misc_feature 1..24: note = Synthetic Construct
  source 1..24: mol_type = other DNA
gaacaacccaggctctgttatagt

SEQ ID NO: 25069 - DNA, 21 bp, synthetic construct
  misc_feature 1..21: note = Synthetic Construct
  source 1..21: mol_type = other DNA
gttttgcccctagcaccaagt

SEQ ID NO: 25070 - DNA, 20 bp, synthetic construct
  misc_feature 1..20: note = Synthetic Construct
  source 1..20: mol_type = other DNA
atggtggcactggactggaa

SEQ ID NO: 25071 - DNA, 19 bp, synthetic construct
  misc_feature 1..19: note = Synthetic Construct
  source 1..19: mol_type = other DNA
caggcctgcacgtcacaga

SEQ ID NO: 25072 - DNA, 24 bp, synthetic construct
  misc_feature 1..24: note = Synthetic Construct
  source 1..24: mol_type = other DNA
ttacctccagtggccctaattttt

SEQ ID NO: 25073 - DNA, 22 bp, synthetic construct
  misc_feature 1..22: note = Synthetic Construct
  source 1..22: mol_type = other DNA
cccatcccaccttcctgtgata

SEQ ID NO: 25074 - DNA, 27 bp, synthetic construct
  misc_feature 1..27: note = Synthetic Construct
  source 1..27: mol_type = other DNA
ggatttttgtccaggaggaagatgtca

SEQ ID NO: 25075 - DNA, 21 bp, synthetic construct
  misc_feature 1..21: note = Synthetic Construct
  source 1..21: mol_type = other DNA
cttccccgaccactgctattc

SEQ ID NO: 25076 - DNA, 22 bp, synthetic construct
  misc_feature 1..22: note = Synthetic Construct
  source 1..22: mol_type = other DNA
aaatcagcgtcctctcttgctt

SEQ ID NO: 25077 - DNA, 22 bp, synthetic construct
  misc_feature 1..22: note = Synthetic Construct
  source 1..22: mol_type = other DNA
gtccctgtttcatgctgacctt

SEQ ID NO: 25078 - DNA, 21 bp, synthetic construct
  misc_feature 1..21: note = Synthetic Construct
  source 1..21: mol_type = other DNA
ggagccagaagattgctcctt

SEQ ID NO: 25079 - DNA, 18 bp, synthetic construct
  misc_feature 1..18: note = Synthetic Construct
  source 1..18: mol_type = other DNA
aaagccaggcacgccatt

SEQ ID NO: 25080 - DNA, 24 bp, synthetic construct
  misc_feature 1..24: note = Synthetic Construct
  source 1..24: mol_type = other DNA
ggataatggacatcctgggaacaa

SEQ ID NO: 25081 - DNA, 20 bp, synthetic construct
  misc_feature 1..20: note = Synthetic Construct
  source 1..20: mol_type = other DNA
aatattgccccggcttccaa

SEQ ID NO: 25082 - DNA, 22 bp, synthetic construct
  misc_feature 1..22: note = Synthetic Construct
  source 1..22: mol_type = other DNA
cgatcccactgccaactcttct

SEQ ID NO: 25083 - DNA, 23 bp, synthetic construct
  misc_feature 1..23: note = Synthetic Construct
  source 1..23: mol_type = other DNA
ggtatcagccccacattctctct

SEQ ID NO: 25084 - DNA, 24 bp, synthetic construct
  misc_feature 1..24: note = Synthetic Construct
  source 1..24: mol_type = other DNA
ggagggtttggggaaatgacttct

SEQ ID NO: 25085 - DNA, 22 bp, synthetic construct
  misc_feature 1..22: note = Synthetic Construct
  source 1..22: mol_type = other DNA
acccatctgccttatggtgact

SEQ ID NO: 25086 - DNA, 23 bp, synthetic construct
  misc_feature 1..23: note = Synthetic Construct
  source 1..23: mol_type = other DNA
ggagtagccctgtatgagacttg

SEQ ID NO: 25087 - DNA, 22 bp, synthetic construct
  misc_feature 1..22: note = Synthetic Construct
  source 1..22: mol_type = other DNA
gcagggtaggctgtggagatac

SEQ ID NO: 25088 - DNA, 22 bp, synthetic construct
  misc_feature 1..22: note = Synthetic Construct
  source 1..22: mol_type = other DNA
ctgccacttgggtggtatactt

SEQ ID NO: 25089 - DNA, 23 bp, synthetic construct
  misc_feature 1..23: note = Synthetic Construct
  source 1..23: mol_type = other DNA
gggcccatcccatcaaaaaggat

SEQ ID NO: 25090 - DNA, 20 bp, synthetic construct
  misc_feature 1..20: note = Synthetic Construct
  source 1..20: mol_type = other DNA
aacagggaagccccttgttg

SEQ ID NO: 25091 - DNA, 20 bp, synthetic construct
  misc_feature 1..20: note = Synthetic Construct
  source 1..20: mol_type = other DNA
cctggcttccccttctcaag

SEQ ID NO: 25092 - DNA, 19 bp, synthetic construct
  misc_feature 1..19: note = Synthetic Construct
  source 1..19: mol_type = other DNA
cccctgcctacgctactct

SEQ ID NO: 25093 - DNA, 23 bp, synthetic construct
  misc_feature 1..23: note = Synthetic Construct
  source 1..23: mol_type = other DNA
ctctgatcagcgtccctagtttg

SEQ ID NO: 25094 - DNA, 21 bp, synthetic construct
  misc_feature 1..21: note = Synthetic Construct
  source 1..21: mol_type = other DNA
ccaggtcgccattggcagtat

SEQ ID NO: 25095 - DNA, 24 bp, synthetic construct
  misc_feature 1..24: note = Synthetic Construct
  source 1..24: mol_type = other DNA
gagagactcaaaccgctagacctt

SEQ ID NO: 25096 - DNA, 23 bp, synthetic construct
  misc_feature 1..23: note = Synthetic Construct
  source 1..23: mol_type = other DNA
ccctccccatctcctcttcttac

SEQ ID NO: 25097 - DNA, 21 bp, synthetic construct
  misc_feature 1..21: note = Synthetic Construct
  source 1..21: mol_type = other DNA
aaggccggatggtggagattg

SEQ ID NO: 25098 - DNA, 19 bp, synthetic construct
  misc_feature 1..19: note = Synthetic Construct
  source 1..19: mol_type = other DNA
cacacgtgcatgggtgttc

SEQ ID NO: 25099 - DNA, 23 bp, synthetic construct
  misc_feature 1..23: note = Synthetic Construct
  source 1..23: mol_type = other DNA
ggggtcagaaagctgagagtcta

SEQ ID NO: 25100 - DNA, 26 bp, synthetic construct
  misc_feature 1..26: note = Synthetic Construct
  source 1..26: mol_type = other DNA
gggttctacagtttccaccattaaac

SEQ ID NO: 25101 - DNA, 22 bp, synthetic construct
  misc_feature 1..22: note = Synthetic Construct
  source 1..22: mol_type = other DNA
ccagccaggattactgctgttc

SEQ ID NO: 25102 - DNA, 24 bp, synthetic construct
  misc_feature 1..24: note = Synthetic Construct
  source 1..24: mol_type = other DNA
gagcaactggcagagtatgacaag

SEQ ID NO: 25103 - DNA, 20 bp, synthetic construct
  misc_feature 1..20: note = Synthetic Construct
  source 1..20: mol_type = other DNA
ggcaaggggcttgctctgat

SEQ ID NO: 25104 - DNA, 20 bp, synthetic construct
  misc_feature 1..20: note = Synthetic Construct
  source 1..20: mol_type = other DNA
agcagcagcccacgggaaga

SEQ ID NO: 25105 - DNA, 24 bp, synthetic construct
  misc_feature 1..24: note = Synthetic Construct
  source 1..24: mol_type = other DNA
ctctgcagtctccacatcaggttt

SEQ ID NO: 25106 - DNA, 26 bp, synthetic construct
  misc_feature 1..26: note = Synthetic Construct
  source 1..26: mol_type = other DNA
ccctatcttgcagctctcattccatt

SEQ ID NO: 25107 - DNA, 21 bp, synthetic construct
  misc_feature 1..21: note = Synthetic Construct
  source 1..21: mol_type = other DNA
actttggccccatttctccaa

SEQ ID NO: 25108 - DNA, 19 bp, synthetic construct
  misc_feature 1..19: note = Synthetic Construct
  source 1..19: mol_type = other DNA
agggtgctgcttgggttgt

SEQ ID NO: 25109 - DNA, 25 bp, synthetic construct
  misc_feature 1..25: note = Synthetic Construct
  source 1..25: mol_type = other DNA
cagtatcatgcggtcacctagtctt

SEQ ID NO: 25110 - DNA, 22 bp, synthetic construct
  misc_feature 1..22: note = Synthetic Construct
  source 1..22: mol_type = other DNA
tcaagctgtctggggaggtttc

SEQ ID NO: 25111 - DNA, 25 bp, synthetic construct
  misc_feature 1..25: note = Synthetic Construct
  source 1..25: mol_type = other DNA
agacagggaagttgtgggtatatga

SEQ ID NO: 25112 - DNA, 20 bp, synthetic construct
  misc_feature 1..20: note = Synthetic Construct
  source 1..20: mol_type = other DNA
tggccgccttacaccaaaac

SEQ ID NO: 25113 - DNA, 19 bp, synthetic construct
  misc_feature 1..19: note = Synthetic Construct
  source 1..19: mol_type = other DNA
caggcccggaaccctttct

SEQ ID NO: 25114 - DNA, 21 bp, synthetic construct
  misc_feature 1..21: note = Synthetic Construct
  source 1..21: mol_type = other DNA
actgtcacacgcttcctgaat

SEQ ID NO: 25115 - DNA, 20 bp, synthetic construct
  misc_feature 1..20: note = Synthetic Construct
  source 1..20: mol_type = other DNA
cctggccgctgttacagact

SEQ ID NO: 25116 - DNA, 23 bp, synthetic construct
  misc_feature 1..23: note = Synthetic Construct
  source 1..23: mol_type = other DNA
cctaggagtgtccagctctgttc

SEQ ID NO: 25117 - DNA, 20 bp, synthetic construct
  misc_feature 1..20: note = Synthetic Construct
  source 1..20: mol_type = other DNA
tgactcgctgtgtcctgtga

SEQ ID NO: 25118 - DNA, 22 bp, synthetic construct
  misc_feature 1..22: note = Synthetic Construct
  source 1..22: mol_type = other DNA
aggccacagtgttgctctgttc

SEQ ID NO: 25119 - DNA, 20 bp, synthetic construct
  misc_feature 1..20: note = Synthetic Construct
  source 1..20: mol_type = other DNA
ttgctctgaggccctacact

SEQ ID NO: 25120 - DNA, 24 bp, synthetic construct
  misc_feature 1..24: note = Synthetic Construct
  source 1..24: mol_type = other DNA
gtacctggctgggatatgtgtttt

SEQ ID NO: 25121 - DNA, 21 bp, synthetic construct
  misc_feature 1..21: note = Synthetic Construct
  source 1..21: mol_type = other DNA
aggagaacccatcctgcatct

SEQ ID NO: 25122 - DNA, 26 bp, synthetic construct
  misc_feature 1..26: note = Synthetic Construct
  source 1..26: mol_type = other DNA
ggctactggggaatttaatacagtct

SEQ ID NO: 25123 - DNA, 22 bp, synthetic construct
  misc_feature 1..22: note = Synthetic Construct
  source 1..22: mol_type = other DNA
ccttcagcagtgcctgacaaac

SEQ ID NO: 25124 - DNA, 23 bp, synthetic construct
  misc_feature 1..23: note = Synthetic Construct
  source 1..23: mol_type = other DNA
ccaaagcataggctgttgtgagt

SEQ ID NO: 25125 - DNA, 24 bp, synthetic construct
  misc_feature 1..24: note = Synthetic Construct
  source 1..24: mol_type = other DNA
gtccaggacgtgctcctagtatct

SEQ ID NO: 25126 - DNA, 22 bp, synthetic construct
  misc_feature 1..22: note = Synthetic Construct
  source 1..22: mol_type = other DNA
cagggccagtgttcttccaaac

SEQ ID NO: 25127 - DNA, 23 bp, synthetic construct
  misc_feature 1..23: note = Synthetic Construct
  source 1..23: mol_type = other DNA
ggttactgttggggctcaggaaa

SEQ ID NO: 25128 - DNA, 20 bp, synthetic construct
  misc_feature 1..20: note = Synthetic Construct
  source 1..20: mol_type = other DNA
gtgccttccgagagctgtga

SEQ ID NO: 25129 - DNA, 22 bp, synthetic construct
  misc_feature 1..22: note = Synthetic Construct
  source 1..22: mol_type = other DNA
ttgaacacctctgctcaacaca

SEQ ID NO: 25130 - DNA, 20 bp, synthetic construct
  misc_feature 1..20: note = Synthetic Construct
  source 1..20: mol_type = other DNA
accaggcccaccccagtaaa

SEQ ID NO: 25131 - DNA, 21 bp, synthetic construct
  misc_feature 1..21: note = Synthetic Construct
  source 1..21: mol_type = other DNA
cagcccataccctccctgcta

SEQ ID NO: 25132 - DNA, 22 bp, synthetic construct
  misc_feature 1..22: note = Synthetic Construct
  source 1..22: mol_type = other DNA
gcctgtggtaccctgggaaaga

SEQ ID NO: 25133 - DNA, 22 bp, synthetic construct
  misc_feature 1..22: note = Synthetic Construct
  source 1..22: mol_type = other DNA
gggtgccaggtacagaacaagt

SEQ ID NO: 25134 - DNA, 25 bp, synthetic construct
  misc_feature 1..25: note = Synthetic Construct
  source 1..25: mol_type = other DNA
ctgtggaatttctccctggggtatg

SEQ ID NO: 25135 - DNA, 22 bp, synthetic construct
  misc_feature 1..22: note = Synthetic Construct
  source 1..22: mol_type = other DNA
acctcaggctaatgtccacttg

SEQ ID NO: 25136 - DNA, 22 bp, synthetic construct
  misc_feature 1..22: note = Synthetic Construct
  source 1..22: mol_type = other DNA
gtggatcaggataggggctcaa

SEQ ID NO: 25137 - DNA, 24 bp, synthetic construct
  misc_feature 1..24: note = Synthetic Construct
  source 1..24: mol_type = other DNA
ggtctatccgggtctatccagcat

SEQ ID NO: 25138 - DNA, 20 bp, synthetic construct
  misc_feature 1..20: note = Synthetic Construct
  source 1..20: mol_type = other DNA
tctgccctctgtgcttcagt

SEQ ID NO: 25139 - DNA, 22 bp, synthetic construct
  misc_feature 1..22: note = Synthetic Construct
  source 1..22: mol_type = other DNA
ggtttgccctctgcctgtttct

SEQ ID NO: 25140 - DNA, 19 bp, synthetic construct
  misc_feature 1..19: note = Synthetic Construct
  source 1..19: mol_type = other DNA
ttccgcccatgcccctaca

SEQ ID NO: 25141 - DNA, 26 bp, synthetic construct
  misc_feature 1..26: note = Synthetic Construct
  source 1..26: mol_type = other DNA
gacgtcaccatgttttcctgtagttg

SEQ ID NO: 25142 - DNA, 24 bp, synthetic construct
  misc_feature 1..24: note = Synthetic Construct
  source 1..24: mol_type = other DNA
ctcccaatgaatcctcctccttca

SEQ ID NO: 25143 - DNA, 22 bp, synthetic construct
  misc_feature 1..22: note = Synthetic Construct
  source 1..22: mol_type = other DNA
aggtagggttcttccccagttc

SEQ ID NO: 25144 - DNA, 22 bp, synthetic construct
  misc_feature 1..22: note = Synthetic Construct
  source 1..22: mol_type = other DNA
ggctttcctcactgtggtgttc

SEQ ID NO: 25145 - DNA, 24 bp, synthetic construct
  misc_feature 1..24: note = Synthetic Construct
  source 1..24: mol_type = other DNA
cctcaaccccttcatctacagctt

SEQ ID NO: 25146 - DNA, 22 bp, synthetic construct
  misc_feature 1..22: note = Synthetic Construct
  source 1..22: mol_type = other DNA
tcggtctctgcctgtagactgt

SEQ ID NO: 25147 - DNA, 20 bp, synthetic construct
  misc_feature 1..20: note = Synthetic Construct
  source 1..20: mol_type = other DNA
ggccggtggaggtttttgat

SEQ ID NO: 25148 - DNA, 22 bp, synthetic construct
  misc_feature 1..22: note = Synthetic Construct
  source 1..22: mol_type = other DNA
caggcctagcagtggtaaatca

SEQ ID NO: 25149 - DNA, 22 bp, synthetic construct
  misc_feature 1..22: note = Synthetic Construct
  source 1..22: mol_type = other DNA
ccatgcctggccctttgaaaca

SEQ ID NO: 25150 - DNA, 22 bp, synthetic construct
  misc_feature 1..22: note = Synthetic Construct
  source 1..22: mol_type = other DNA
cccagggccatctgtgatacaa

SEQ ID NO: 25151 - DNA, 19 bp, synthetic construct
  misc_feature 1..19: note = Synthetic Construct
  source 1..19: mol_type = other DNA
tcgcctgcctctcctcaca

SEQ ID NO: 25152 - DNA, 21 bp, synthetic construct
  misc_feature 1..21: note = Synthetic Construct
  source 1..21: mol_type = other DNA
tgggaggatggcgctttggat

SEQ ID NO: 25153 - DNA, 20 bp, synthetic construct
  misc_feature 1..20: note = Synthetic Construct
  source 1..20: mol_type = other DNA
tgggcccaccagtcacttct

SEQ ID NO: 25154 - DNA, 21 bp, synthetic construct
  misc_feature 1..21: note = Synthetic Construct
  source 1..21: mol_type = other DNA
tggttagtgcacaagcagtgt

SEQ ID NO: 25155 - DNA, 20 bp, synthetic construct
  misc_feature 1..20: note = Synthetic Construct
  source 1..20: mol_type = other DNA
gcaaatctgggcgactctga

SEQ ID NO: 25156 - DNA, 20 bp, synthetic construct
  misc_feature 1..20: note = Synthetic Construct
  source 1..20: mol_type = other DNA
gcctccagctcccagactca

SEQ ID NO: 25157 - DNA, 22 bp, synthetic construct
  misc_feature 1..22: note = Synthetic Construct
  source 1..22: mol_type = other DNA
tctaaggccacggggataggaa

SEQ ID NO: 25158 - DNA, 23 bp, synthetic construct
  misc_feature 1..23: note = Synthetic Construct
  source 1..23: mol_type = other DNA
tgaaacaaggtgacaaggtgact

SEQ ID NO: 25159 - DNA, 25 bp, synthetic construct
  misc_feature 1..25: note = Synthetic Construct
  source 1..25: mol_type = other DNA
ccaggacatgatcaaaactggattg

SEQ ID NO: 25160 - DNA, 21 bp, synthetic construct
  misc_feature 1..21: note = Synthetic Construct
  source 1..21: mol_type = other DNA
ggagcttggcaggaggtgtaa

SEQ ID NO: 25161 - DNA, 21 bp, synthetic construct
  misc_feature 1..21: note = Synthetic Construct
  source 1..21: mol_type = other DNA
gagcctgaggagccattttga

SEQ ID NO: 25162 - DNA, 20 bp, synthetic construct
  misc_feature 1..20: note = Synthetic Construct
  source 1..20: mol_type = other DNA
tccgtcggagggtgcttttt

SEQ ID NO: 25163 - DNA, 22 bp, synthetic construct
  misc_feature 1..22: note = Synthetic Construct
  source 1..22: mol_type = other DNA
gggagctgtccatagaggcaat

SEQ ID NO: 25164 - DNA, 21 bp, synthetic construct
  misc_feature 1..21: note = Synthetic Construct
  source 1..21: mol_type = other DNA
tggatgcctcttgccagaaaa

SEQ ID NO: 25165 - DNA, 21 bp, synthetic construct
  misc_feature 1..21: note = Synthetic Construct
  source 1..21: mol_type = other DNA
gaagatggagccttggcatgt

SEQ ID NO: 25166 - DNA, 20 bp, synthetic construct
  misc_feature 1..20: note = Synthetic Construct
  source 1..20: mol_type = other DNA
gcaaagggccagagagtcaa

SEQ ID NO: 25167 - DNA, 22 bp, synthetic construct
  misc_feature 1..22: note = Synthetic Construct
  source 1..22: mol_type = other DNA
ggcaggatggatttgggccatt

SEQ ID NO: 25168 - DNA, 24 bp, synthetic construct
  misc_feature 1..24: note = Synthetic Construct
  source 1..24: mol_type = other DNA
ggtcctcatgagcttcaggttatt

SEQ ID NO: 25169 - DNA, 19 bp, synthetic construct
  misc_feature 1..19: note = Synthetic Construct
  source 1..19: mol_type = other DNA
gtcggccagcccttcagat

SEQ ID NO: 25170 - DNA, 23 bp, synthetic construct
  misc_feature 1..23: note = Synthetic Construct
  source 1..23: mol_type = other DNA
gggctacgaaggacatttagcat

SEQ ID NO: 25171 - DNA, 20 bp, synthetic construct
  misc_feature 1..20: note = Synthetic Construct
  source 1..20: mol_type = other DNA
ctgtttgggtctgcgtcagt

SEQ ID NO: 25172 - DNA, 26 bp, synthetic construct
  misc_feature 1..26: note = Synthetic Construct
  source 1..26: mol_type = other DNA
gggccattataacaggaacgggaaac

SEQ ID NO: 25173 - DNA, 20 bp, synthetic construct
  misc_feature 1..20: note = Synthetic Construct
  source 1..20: mol_type = other DNA
agaatctggcagcccctaca

SEQ ID NO: 25174 - DNA, 22 bp, synthetic construct
  misc_feature 1..22: note = Synthetic Construct
  source 1..22: mol_type = other DNA
tccagcccagctgtcactaact

SEQ ID NO: 25175 - DNA, 23 bp, synthetic construct
  misc_feature 1..23: note = Synthetic Construct
  source 1..23: mol_type = other DNA
ctgaagtctgcacctgagtgagt

SEQ ID NO: 25176 - DNA, 21 bp, synthetic construct
  misc_feature 1..21: note = Synthetic Construct
  source 1..21: mol_type = other DNA
agagggaccacaccctggaat

SEQ ID NO: 25177 - DNA, 22 bp, synthetic construct
  misc_feature 1..22: note = Synthetic Construct
  source 1..22: mol_type = other DNA
accctgccaggacacatgagat

SEQ ID NO: 25178 - DNA, 24 bp, synthetic construct
  misc_feature 1..24: note = Synthetic Construct
  source 1..24: mol_type = other DNA
gccacagagctgaaggctaggata

SEQ ID NO: 25179 - DNA, 21 bp, synthetic construct
  misc_feature 1..21: note = Synthetic Construct
  source 1..21: mol_type = other DNA
gctgccccatgctgaagagat

SEQ ID NO: 25180 - DNA, 25 bp, synthetic construct
  misc_feature 1..25: note = Synthetic Construct
  source 1..25: mol_type = other DNA
ggtttggaccctgctcatatcttga

SEQ ID NO: 25181 - DNA, 20 bp, synthetic construct
  misc_feature 1..20: note = Synthetic Construct
  source 1..20: mol_type = other DNA
aaacggcccagggtggattc

SEQ ID NO: 25182 - DNA, 23 bp, synthetic construct
  misc_feature 1..23: note = Synthetic Construct
  source 1..23: mol_type = other DNA
gccagtccatctgttcaggcttt

SEQ ID NO: 25183 - DNA, 21 bp, synthetic construct
  misc_feature 1..21: note = Synthetic Construct
  source 1..21: mol_type = other DNA
caggcttagccccaattgact

SEQ ID NO: 25184 - DNA, 22 bp, synthetic construct
  misc_feature 1..22: note = Synthetic Construct
  source 1..22: mol_type = other DNA
gtgtctggcccaaggttataca

SEQ ID NO: 25185 - DNA, 25 bp, synthetic construct
  misc_feature 1..25: note = Synthetic Construct
  source 1..25: mol_type = other DNA
ccctaagtggaatcctgagtgaaat

SEQ ID NO: 25186 - DNA, 22 bp, synthetic construct
  misc_feature 1..22: note = Synthetic Construct
  source 1..22: mol_type = other DNA
gagccggaagaactcaggatgt

SEQ ID NO: 25187 - DNA, 22 bp, synthetic construct
  misc_feature 1..22: note = Synthetic Construct
  source 1..22: mol_type = other DNA
gggatttgcccaggagtgtctt

SEQ ID NO: 25188 - DNA, 21 bp, synthetic construct
  misc_feature 1..21: note = Synthetic Construct
  source 1..21: mol_type = other DNA
cagcccttggggtgtagcttt

SEQ ID NO: 25189 - DNA, 20 bp, synthetic construct
  misc_feature 1..20: note = Synthetic Construct
  source 1..20: mol_type = other DNA
gctgggtgtggctatgtgtt

SEQ ID NO: 25190 - DNA, 22 bp, synthetic construct
  misc_feature 1..22: note = Synthetic Construct
  source 1..22: mol_type = other DNA
gcctgcaccctaaggacacttt

SEQ ID NO: 25191 - DNA, 22 bp, synthetic construct
  misc_feature 1..22: note = Synthetic Construct
  source 1..22: mol_type = other DNA
gggtgtcacctccatctacaca

SEQ ID NO: 25192 - DNA, 24 bp, synthetic construct
  misc_feature 1..24: note = Synthetic Construct
  source 1..24: mol_type = other DNA
ccaaggccgtccttcaatactttg

SEQ ID NO: 25193 - DNA, 25 bp, synthetic construct
  misc_feature 1..25: note = Synthetic Construct
  source 1..25: mol_type = other DNA
ggggaaagaaaagctggaaaacaac

SEQ ID NO: 25194 - DNA, 20 bp, synthetic construct
  misc_feature 1..20: note = Synthetic Construct
  source 1..20: mol_type = other DNA
actaggccctgctgctagat

SEQ ID NO: 25195 - DNA, 22 bp, synthetic construct
  misc_feature 1..22: note = Synthetic Construct
  source 1..22: mol_type = other DNA
ggcaggcaggaaataggaggtt

SEQ ID NO: 25196 - DNA, 24 bp, synthetic construct
  misc_feature 1..24: note = Synthetic Construct
  source 1..24: mol_type = other DNA
aatcttcctggggttcattctgtt

SEQ ID NO: 25197 - DNA, 26 bp, synthetic construct
  misc_feature 1..26: note = Synthetic Construct
  source 1..26: mol_type = other DNA
gtgtcacagggtatggaagtcacaac

SEQ ID NO: 25198 - DNA, 20 bp, synthetic construct
  misc_feature 1..20: note = Synthetic Construct
  source 1..20: mol_type = other DNA
tgaccctggagggagccttt

SEQ ID NO: 25199 - DNA, 22 bp, synthetic construct
  misc_feature 1..22: note = Synthetic Construct
  source 1..22: mol_type = other DNA
gaggacagcagatcctccgtaa

SEQ ID NO: 25200 - DNA, 25 bp, synthetic construct
  misc_feature 1..25: note = Synthetic Construct
  source 1..25: mol_type = other DNA
catttccaagggcagtagaaagtct

SEQ ID NO: 25201 - DNA, 25 bp, synthetic construct
  misc_feature 1..25: note = Synthetic Construct
  source 1..25: mol_type = other DNA
agtgggagtccagatgatagagatt

SEQ ID NO: 25202 - DNA, 21 bp, synthetic construct
  misc_feature 1..21: note = Synthetic Construct
  source 1..21: mol_type = other DNA
caacagcgagggaccatgtct

SEQ ID NO: 25203 - DNA, 21 bp, synthetic construct
  misc_feature 1..21: note = Synthetic Construct
  source 1..21: mol_type = other DNA
ccacctccccacttcccgata

SEQ ID NO: 25204 - DNA, 22 bp, synthetic construct
  misc_feature 1..22: note = Synthetic Construct
  source 1..22: mol_type = other DNA
gcaacttggggtaggtggtgaa

SEQ ID NO: 25205 - DNA, 21 bp, synthetic construct
  misc_feature 1..21: note = Synthetic Construct
  source 1..21: mol_type = other DNA
cgcagcccatgccaatctttc

SEQ ID NO: 25206 - DNA, 22 bp, synthetic construct
  misc_feature 1..22: note = Synthetic Construct
  source 1..22: mol_type = other DNA
cgagactgaggcccactgtttt

SEQ ID NO: 25207 - DNA, 22 bp, synthetic construct
  misc_feature 1..22: note = Synthetic Construct
  source 1..22: mol_type = other DNA
tggcaaagcctgacctggaatc

SEQ ID NO: 25208 - DNA, 23 bp, synthetic construct
  misc_feature 1..23: note = Synthetic Construct
  source 1..23: mol_type = other DNA
gaccgggattgaaacctccacaa

SEQ ID NO: 25209 - DNA, 26 bp, synthetic construct
  misc_feature 1..26: note = Synthetic Construct
  source 1..26: mol_type = other DNA
catttctcccaggaaagaggaagaac

SEQ ID NO: 25210 - DNA, 20 bp, synthetic construct
  misc_feature 1..20: note = Synthetic Construct
  source 1..20: mol_type = other DNA
tggctgcgccatcgaaaaca

SEQ ID NO: 25211 - DNA, 21 bp, synthetic construct
  misc_feature 1..21: note = Synthetic Construct
  source 1..21: mol_type = other DNA
tgtcccgcttgccttcctaga

SEQ ID NO: 25212 - DNA, 18 bp, synthetic construct
  misc_feature 1..18: note = Synthetic Construct
  source 1..18: mol_type = other DNA
tcccggcttcctggagtt

SEQ ID NO: 25213 - DNA, 22 bp, synthetic construct
  misc_feature 1..22: note = Synthetic Construct
  source 1..22: mol_type = other DNA
gctgttccctgcacttggaatc

SEQ ID NO: 25214 - DNA, 22 bp, synthetic construct
  misc_feature 1..22: note = Synthetic Construct
  source 1..22: mol_type = other DNA
aaggcaaggggtgaggaagttg

SEQ ID NO: 25215 - DNA, 18 bp, synthetic construct
  misc_feature 1..18: note = Synthetic Construct
  source 1..18: mol_type = other DNA
acagcagacggcgagaag

SEQ ID NO: 25216 - DNA, 26 bp, synthetic construct
  misc_feature 1..26: note = Synthetic Construct
  source 1..26: mol_type = other DNA
ccgaaacactaagggaggaagtgtat

SEQ ID NO: 25217 - DNA, 24 bp, synthetic construct
  misc_feature 1..24: note = Synthetic Construct
  source 1..24: mol_type = other DNA
tggatccttgaaagctctctgact

SEQ ID NO: 25218 - DNA, 23 bp, synthetic construct
  misc_feature 1..23: note = Synthetic Construct
  source 1..23: mol_type = other DNA
gaggtgatctgagcttgggcata

SEQ ID NO: 25219 - DNA, 20 bp, synthetic construct
  misc_feature 1..20: note = Synthetic Construct
  source 1..20: mol_type = other DNA
cagcgggcctgttacagagt

SEQ ID NO: 25220 - DNA, 23 bp, synthetic construct
  misc_feature 1..23: note = Synthetic Construct
  source 1..23: mol_type = other DNA
ggggacaatcactggagggttct

SEQ ID NO: 25221 - DNA, 22 bp, synthetic construct
  misc_feature 1..22: note = Synthetic Construct
  source 1..22: mol_type = other DNA
tctggggtgtggaccctaggaa

SEQ ID NO: 25222 - DNA, 20 bp, synthetic construct
  misc_feature 1..20: note = Synthetic Construct
  source 1..20: mol_type = other DNA
tcccaccagctcttcgtgat

SEQ ID NO: 25223 - DNA, 22 bp, synthetic construct
  misc_feature 1..22: note = Synthetic Construct
  source 1..22: mol_type = other DNA
tgtcctttcccctgctctttac

SEQ ID NO: 25224 - DNA, 23 bp, synthetic construct
  misc_feature 1..23: note = Synthetic Construct
  source 1..23: mol_type = other DNA
ccaggctcctattgctcctattg

SEQ ID NO: 25225 - DNA, 23 bp, synthetic construct
  misc_feature 1..23: note = Synthetic Construct
  source 1..23: mol_type = other DNA
gaagctctgacctccatttcagt

SEQ ID NO: 25226 - DNA, 22 bp, synthetic construct
  misc_feature 1..22: note = Synthetic Construct
  source 1..22: mol_type = other DNA
actggtacagccctgatgaaca

SEQ ID NO: 25227 - DNA, 21 bp, synthetic construct
  misc_feature 1..21: note = Synthetic Construct
  source 1..21: mol_type = other DNA
accacccctccatgcttgtct

SEQ ID NO: 25228 - DNA, 21 bp, synthetic construct
  misc_feature 1..21: note = Synthetic Construct
  source 1..21: mol_type = other DNA
gcagccagatttcaggtccaa

SEQ ID NO: 25229 - DNA, 22 bp, synthetic construct
  misc_feature 1..22: note = Synthetic Construct
  source 1..22: mol_type = other DNA
ggccccagcctcaaagaatgta

SEQ ID NO: 25230 - DNA, 18 bp, synthetic construct
  misc_feature 1..18: note = Synthetic Construct
  source 1..18: mol_type = other DNA
tgagcctcgggcagctaa

SEQ ID NO: 25231 - DNA, 23 bp, synthetic construct
  misc_feature 1..23: note = Synthetic Construct
  source 1..23: mol_type = other DNA
gtgcgcctgacaaggaaatgact

SEQ ID NO: 25232 - DNA, 20 bp, synthetic construct
  misc_feature 1..20: note = Synthetic Construct
  source 1..20: mol_type = other DNA
cccgctgtcagccaagtgta

SEQ ID NO: 25233 - DNA, 23 bp, synthetic construct
  misc_feature 1..23: note = Synthetic Construct
  source 1..23: mol_type = other DNA
caggctcagaggacctatgtttg

SEQ ID NO: 25234 - DNA, 20 bp, synthetic construct
  misc_feature 1..20: note = Synthetic Construct
  source 1..20: mol_type = other DNA
gcctgcagccctcatacagt

SEQ ID NO: 25235 - DNA, 22 bp, synthetic construct
  misc_feature 1..22: note = Synthetic Construct
  source 1..22: mol_type = other DNA
ccaagtggccagggaaaaccta

SEQ ID NO: 25236 - DNA, 21 bp, synthetic construct
  misc_feature 1..21: note = Synthetic Construct
  source 1..21: mol_type = other DNA
tgagccactgagcctagtgaa

SEQ ID NO: 25237 - DNA, 24 bp, synthetic construct
  misc_feature 1..24: note = Synthetic Construct
  source 1..24: mol_type = other DNA
ggcctcagcctctaactgaggata

SEQ ID NO: 25238 - DNA, 21 bp, synthetic construct
  misc_feature 1..21: note = Synthetic Construct
  source 1..21: mol_type = other DNA
ccccgataggctgaaaacaca

SEQ ID NO: 25239 - DNA, 23 bp, synthetic construct
  misc_feature 1..23: note = Synthetic Construct
  source 1..23: mol_type = other DNA
gctgacatgtggagtcaaccatt

SEQ ID NO: 25240 - DNA, 20 bp, synthetic construct
  misc_feature 1..20: note = Synthetic Construct
  source 1..20: mol_type = other DNA
ggcacacgacccacctatct

SEQ ID NO: 25241 - DNA, 23 bp, synthetic construct
  misc_feature 1..23: note = Synthetic Construct
  source 1..23: mol_type = other DNA
ggaagggcatagagagaccatct

SEQ ID NO: 25242 - DNA, 24 bp, synthetic construct
  misc_feature 1..24: note = Synthetic Construct
  source 1..24: mol_type = other DNA
actaatggtgacattggtggaaca

SEQ ID NO: 25243 - DNA, 21 bp, synthetic construct
  misc_feature 1..21: note = Synthetic Construct
  source 1..21: mol_type = other DNA
gtgccacaccatcctcaccta

SEQ ID NO: 25244 - DNA, 20 bp, synthetic construct
  misc_feature 1..20: note = Synthetic Construct
  source 1..20: mol_type = other DNA
ggccagtcccttcaatgtca

SEQ ID NO: 25245 - DNA, 21 bp, synthetic construct
  misc_feature 1..21: note = Synthetic Construct
  source 1..21: mol_type = other DNA
ttccctgcccttccacctttc

SEQ ID NO: 25246 - DNA, 24 bp, synthetic construct
  misc_feature 1..24: note = Synthetic Construct
  source 1..24: mol_type = other DNA
agaattcaaccaccattggcagat

SEQ ID NO: 25247 - DNA, 21 bp, synthetic construct
  misc_feature 1..21: note = Synthetic Construct
  source 1..21: mol_type = other DNA
gctggtccctggaaggggata

SEQ ID NO: 25248 - DNA, 22 bp, synthetic construct
  misc_feature 1..22: note = Synthetic Construct
  source 1..22: mol_type = other DNA
ccatccctgcaggagaggagat

SEQ ID NO: 25249 - DNA, 20 bp, synthetic construct
  misc_feature 1..20: note = Synthetic Construct
  source 1..20: mol_type = other DNA
ttccctccccaaagccacaa

SEQ ID NO: 25250 - DNA, 22 bp, synthetic construct
  misc_feature 1..22: note = Synthetic Construct
  source 1..22: mol_type = other DNA
ctcctcagcaggaggagtttgt

SEQ ID NO: 25251 - DNA, 19 bp, synthetic construct
  misc_feature 1..19: note = Synthetic Construct
  source 1..19: mol_type = other DNA
agcacagggctcacagcta

SEQ ID NO: 25252 - DNA, 20 bp, synthetic construct
  misc_feature 1..20: note = Synthetic Construct
  source 1..20: mol_type = other DNA
gctgcctgagaacgtcttga

SEQ ID NO: 25253 - DNA, 22 bp, synthetic construct
  misc_feature 1..22: note = Synthetic Construct
  source 1..22: mol_type = other DNA
cgaaagagcacagccaaacaca

SEQ ID NO: 25254 - DNA, 22 bp, synthetic construct
  misc_feature 1..22: note = Synthetic Construct
  source 1..22: mol_type = other DNA
acagagctcctggaggcaagat

SEQ ID NO: 25255 - DNA, 20 bp, synthetic construct
  misc_feature 1..20: note = Synthetic Construct
  source 1..20: mol_type = other DNA
ggctgctcagcttgcctgta

SEQ ID NO: 25256 - DNA, 19 bp, synthetic construct
  misc_feature 1..19: note = Synthetic Construct
  source 1..19: mol_type = other DNA
ccccggtggagacaaggaa

SEQ ID NO: 25257 - DNA, 20 bp, synthetic construct
  misc_feature 1..20: note = Synthetic Construct
  source 1..20: mol_type = other DNA
cactgccagggtggtcaatc

SEQ ID NO: 25258 - DNA, 20 bp, synthetic construct
  misc_feature 1..20: note = Synthetic Construct
  source 1..20: mol_type = other DNA
tggagaccgttctcggctat

SEQ ID NO: 25259 - DNA, 23 bp, synthetic construct
  misc_feature 1..23: note = Synthetic Construct
  source 1..23: mol_type = other DNA
gggctagggagtgtttctcaaag

SEQ ID NO: 25260 - DNA, 22 bp, synthetic construct
  misc_feature 1..22: note = Synthetic Construct
  source 1..22: mol_type = other DNA
gatgctaccctgaggcttgaaa

SEQ ID NO: 25261 - DNA, 21 bp, synthetic construct
  misc_feature 1..21: note = Synthetic Construct
  source 1..21: mol_type = other DNA
ccagccagcaagcatcctgaa

SEQ ID NO: 25262 - DNA, 24 bp, synthetic construct
  misc_feature 1..24: note = Synthetic Construct
  source 1..24: mol_type = other DNA
ggggtgacttgtaaaccatcttgt

SEQ ID NO: 25263 - DNA, 24 bp, synthetic construct
  misc_feature 1..24: note = Synthetic Construct
  source 1..24: mol_type = other DNA
aaaactggctacgcactttgtaag

SEQ ID NO: 25264 - DNA, 19 bp, synthetic construct
  misc_feature 1..19: note = Synthetic Construct
  source 1..19: mol_type = other DNA
ccctgccatgagcccttca

SEQ ID NO: 25265 - DNA, 20 bp, synthetic construct
  misc_feature 1..20: note = Synthetic Construct
  source 1..20: mol_type = other DNA
gcccctctgctcttctcaca

SEQ ID NO: 25266 - DNA, 23 bp, synthetic construct
  misc_feature 1..23: note = Synthetic Construct
  source 1..23: mol_type = other DNA
caatcctagcatagggtgcttca

SEQ ID NO: 25267 - DNA, 20 bp, synthetic construct
  misc_feature 1..20: note = Synthetic Construct
  source 1..20: mol_type = other DNA
cgtgtcgctgccagacagat

SEQ ID NO: 25268 - DNA, 25 bp, synthetic construct
  misc_feature 1..25: note = Synthetic Construct
  source 1..25: mol_type = other DNA
gcttaaacctcagctccaccactta

SEQ ID NO: 25269 - DNA, 20 bp, synthetic construct
  misc_feature 1..20: note = Synthetic Construct
  source 1..20: mol_type = other DNA
tgtggccctctctctccaat

SEQ ID NO: 25270 - DNA, 22 bp, synthetic construct
  misc_feature 1..22: note = Synthetic Construct
  source 1..22: mol_type = other DNA
tgaactgctgtccagggtcgat

SEQ ID NO: 25271 - DNA, 18 bp, synthetic construct
  misc_feature 1..18: note = Synthetic Construct
  source 1..18: mol_type = other DNA
gcatcgcgtcgagaggaa

SEQ ID NO: 25272 - DNA, 20 bp, synthetic construct
  misc_feature 1..20: note = Synthetic Construct
  source 1..20: mol_type = other DNA
tctgcccaccatctgactgt

SEQ ID NO: 25273 - DNA, 22 bp, synthetic construct
  misc_feature 1..22: note = Synthetic Construct
  source 1..22: mol_type = other DNA
atgctaattgctgggccctatt

SEQ ID NO: 25274 - DNA, 26 bp, synthetic construct
  misc_feature 1..26: note = Synthetic Construct
  source 1..26: mol_type = other DNA
cctggaacacaaaaccagaagtcaga

SEQ ID NO: 25275 - DNA, 18 bp, synthetic construct
  misc_feature 1..18: note = Synthetic Construct
  source 1..18: mol_type = other DNA
tcccaggctcccacactt

SEQ ID NO: 25276 - DNA, 22 bp, synthetic construct
  misc_feature 1..22: note = Synthetic Construct
  source 1..22: mol_type = other DNA
tctccacacctttgccagaatg

SEQ ID NO: 25277 - DNA, 19 bp, synthetic construct
  misc_feature 1..19: note = Synthetic Construct
  source 1..19: mol_type = other DNA
tgagcctcgctgcaccttt

SEQ ID NO: 25278 - DNA, 22 bp, synthetic construct
  misc_feature 1..22: note = Synthetic Construct
  source 1..22: mol_type = other DNA
tgggctcctcccctgaaaatac

SEQ ID NO: 25279 - DNA, 23 bp, synthetic construct
  misc_feature 1..23: note = Synthetic Construct
  source 1..23: mol_type = other DNA
gcaacatggctggtacacatttc

SEQ ID NO: 25280 - DNA, 22 bp, synthetic construct
  misc_feature 1..22: note = Synthetic Construct
  source 1..22: mol_type = other DNA
gcagggtttgccttctgctcta

SEQ ID NO: 25281 - DNA, 21 bp, synthetic construct
  misc_feature 1..21: note = Synthetic Construct
  source 1..21: mol_type = other DNA
ggaaacaggcccaaggtgcat

SEQ ID NO: 25282 - DNA, 24 bp, synthetic construct
  misc_feature 1..24: note = Synthetic Construct
  source 1..24: mol_type = other DNA
tgctagacaacctgggtagtaaca

SEQ ID NO: 25283 - DNA, 22 bp, synthetic construct
  misc_feature 1..22: note = Synthetic Construct
  source 1..22: mol_type = other DNA
tgctcctcctccgaggtaaaga

SEQ ID NO: 25284 - DNA, 20 bp, synthetic construct
  misc_feature 1..20: note = Synthetic Construct
  source 1..20: mol_type = other DNA
cacaggcaacctctgctcat

SEQ ID NO: 25285 - DNA, 20 bp, synthetic construct
  misc_feature 1..20: note = Synthetic Construct
  source 1..20: mol_type = other DNA
cacggacgcgcatgaaagaa

SEQ ID NO: 25286 - DNA, 19 bp, synthetic construct
  misc_feature 1..19: note = Synthetic Construct
  source 1..19: mol_type = other DNA
tgtgtcctcggcggtgtgt

SEQ ID NO: 25287 - DNA, 20 bp, synthetic construct
  misc_feature 1..20: note = Synthetic Construct
  source 1..20: mol_type = other DNA
gggagatctgggctcacgtt

SEQ ID NO: 25288 - DNA, 22 bp, synthetic construct
  misc_feature 1..22: note = Synthetic Construct
  source 1..22: mol_type = other DNA
gacctccaacttgtggcagaca

SEQ ID NO: 25289 - DNA, 23 bp, synthetic construct
  misc_feature 1..23: note = Synthetic Construct
  source 1..23: mol_type = other DNA
gggcacaaaacctctggatgcaa

SEQ ID NO: 25290 - DNA, 18 bp, synthetic construct
  misc_feature 1..18: note = Synthetic Construct
  source 1..18: mol_type = other DNA
agccgtggctgtccacat

SEQ ID NO: 25291 - DNA, 21 bp, synthetic construct
  misc_feature 1..21: note = Synthetic Construct
  source 1..21: mol_type = other DNA
tcctggttcctcccactgcat

SEQ ID NO: 25292 - DNA, 21 bp, synthetic construct
  misc_feature 1..21: note = Synthetic Construct
  source 1..21: mol_type = other DNA
cagttttgtggggctctgtct

SEQ ID NO: 25293 - DNA, 24 bp, synthetic construct
  misc_feature 1..24: note = Synthetic Construct
  source 1..24: mol_type = other DNA
gccatccatctcctctttcctaca

SEQ ID NO: 25294 - DNA, 22 bp, synthetic construct
  misc_feature 1..22: note = Synthetic Construct
  source 1..22: mol_type = other DNA
tgggcacctcaaacttaacaca

SEQ ID NO: 25295 - DNA, 20 bp, synthetic construct
  misc_feature 1..20: note = Synthetic Construct
  source 1..20: mol_type = other DNA
ttgggccaactcccactctt

SEQ ID NO: 25296 - DNA, 25 bp, synthetic construct
  misc_feature 1..25: note = Synthetic Construct
  source 1..25: mol_type = other DNA
tcctgtatccctgacttgactagaa

SEQ ID NO: 25297 - DNA, 24 bp, synthetic construct
  misc_feature 1..24: note = Synthetic Construct
  source 1..24: mol_type = other DNA
gagatatggacgggaagcagaaac

SEQ ID NO: 25298 - DNA, 25 bp, synthetic construct
  misc_feature 1..25: note = Synthetic Construct
  source 1..25: mol_type = other DNA
tcgactcataaatggctgtgaaaca

SEQ ID NO: 25299 - DNA, 23 bp, synthetic construct
  misc_feature 1..23: note = Synthetic Construct
  source 1..23: mol_type = other DNA
gggcttcatttgccatactgaga

SEQ ID NO: 25300 - DNA, 23 bp, synthetic construct
  misc_feature 1..23: note = Synthetic Construct
  source 1..23: mol_type = other DNA
aggccacaaaatgcttcaagttc

SEQ ID NO: 25301 - DNA, 24 bp, synthetic construct
  misc_feature 1..24: note = Synthetic Construct
  source 1..24: mol_type = other DNA
ggacatggagcaggtagttagcaa

SEQ ID NO: 25302 - DNA, 19 bp, synthetic construct
  misc_feature 1..19: note = Synthetic Construct
  source 1..19: mol_type = other DNA
gcagccagacccactctga

SEQ ID NO: 25303 - DNA, 26 bp, synthetic construct
  misc_feature 1..26: note = Synthetic Construct
  source 1..26: mol_type = other DNA
cccaatgttttagtctgaacctgaag

SEQ ID NO: 25304 - DNA, 21 bp, synthetic construct
  misc_feature 1..21: note = Synthetic Construct
  source 1..21: mol_type = other DNA
gtggaagccactgcctgtttg

SEQ ID NO: 25305 - DNA, 20 bp, synthetic construct
  misc_feature 1..20: note = Synthetic Construct
  source 1..20: mol_type = other DNA
aggcccacgctgtcttccta

SEQ ID NO: 25306 - DNA, 20 bp, synthetic construct
  misc_feature 1..20: note = Synthetic Construct
  source 1..20: mol_type = other DNA
cccggccctaagagtcacat

SEQ ID NO: 25307 - DNA, 24 bp, synthetic construct
  misc_feature 1..24: note = Synthetic Construct
  source 1..24: mol_type = other DNA
gtgtattttggcaatggcatcctt

SEQ ID NO: 25308 - DNA, 21 bp, synthetic construct
  misc_feature 1..21: note = Synthetic Construct
  source 1..21: mol_type = other DNA
gagcccttcgtgttgatgaga

SEQ ID NO: 25309 - DNA, 24 bp, synthetic construct
  misc_feature 1..24: note = Synthetic Construct
  source 1..24: mol_type = other DNA
gcagcaccggcaaactaatacaat

SEQ ID NO: 25310 - DNA, 22 bp, synthetic construct
  misc_feature 1..22: note = Synthetic Construct
  source 1..22: mol_type = other DNA
ccccttgcctagagtcatcaga

SEQ ID NO: 25311 - DNA, 21 bp, synthetic construct
  misc_feature 1..21: note = Synthetic Construct
  source 1..21: mol_type = other DNA
gctgcctgccatgaccttgat

SEQ ID NO: 25312 - DNA, 23 bp, synthetic construct
  misc_feature 1..23: note = Synthetic Construct
  source 1..23: mol_type = other DNA
acctgggtttaggctgatgagat

SEQ ID NO: 25313 - DNA, 22 bp, synthetic construct
  misc_feature 1..22: note = Synthetic Construct
  source 1..22: mol_type = other DNA
ctggcctagggtcttagtggtt

SEQ ID NO: 25314 - DNA, 22 bp, synthetic construct
  misc_feature 1..22: note = Synthetic Construct
  source 1..22: mol_type = other DNA
ggacttccccaccagcgttttt

SEQ ID NO: 25315 - DNA, 25 bp, synthetic construct
  misc_feature 1..25: note = Synthetic Construct
  source 1..25: mol_type = other DNA
tcttccatggagctctttccaaatc

SEQ ID NO: 25316 - DNA, 24 bp, synthetic construct
  misc_feature 1..24: note = Synthetic Construct
  source 1..24: mol_type = other DNA
gaaacaggttccagtgggtaaaga

SEQ ID NO: 25317 - DNA, 25 bp, synthetic construct
  misc_feature 1..25: note = Synthetic Construct
  source 1..25: mol_type = other DNA
caagcaaggcttgggatcaataaag

SEQ ID NO: 25318 - DNA, 21 bp, synthetic construct
  misc_feature 1..21: note = Synthetic Construct
  source 1..21: mol_type = other DNA
actggaaaagcaccaccacat

SEQ ID NO: 25319 - DNA, 22 bp, synthetic construct
  misc_feature 1..22: note = Synthetic Construct
  source 1..22: mol_type = other DNA
gctcaccatccatgaggaaaca

SEQ ID NO: 25320 - DNA, 26 bp, synthetic construct
  misc_feature 1..26: note = Synthetic Construct
  source 1..26: mol_type = other DNA
ctccatggggataaaacagtggtaac

SEQ ID NO: 25321 - DNA, 22 bp, synthetic construct
  misc_feature 1..22: note = Synthetic Construct
  source 1..22: mol_type = other DNA
cgaggcccagttccaagaaaga

SEQ ID NO: 25322 - DNA, 24 bp, synthetic construct
  misc_feature 1..24: note = Synthetic Construct
  source 1..24: mol_type = other DNA
gcagctggggaggaaaaagtgtag

SEQ ID NO: 25323 - DNA, 24 bp, synthetic construct
  misc_feature 1..24: note = Synthetic Construct
  source 1..24: mol_type = other DNA
ccatggctcaactctttccacgaa

SEQ ID NO: 25324 - DNA, 23 bp, synthetic construct
  misc_feature 1..23: note = Synthetic Construct
  source 1..23: mol_type = other DNA
ggcatcacctgattgctgatagt

SEQ ID NO: 25325 - DNA, 22 bp, synthetic construct
  misc_feature 1..22: note = Synthetic Construct
  source 1..22: mol_type = other DNA
cttccagcttcctgttctcctt

SEQ ID NO: 25326 - DNA, 21 bp, synthetic construct
  misc_feature 1..21: note = Synthetic Construct
  source 1..21: mol_type = other DNA
aagagggcaggtcagggattg

SEQ ID NO: 25327 - DNA, 25 bp, synthetic construct
  misc_feature 1..25: note = Synthetic Construct
  source 1..25: mol_type = other DNA
gctggatgagggaacacctgatttt

SEQ ID NO: 25328 - DNA, 23 bp, synthetic construct
  misc_feature 1..23: note = Synthetic Construct
  source 1..23: mol_type = other DNA
gagggagagttagggaggccata

SEQ ID NO: 25329 - DNA, 20 bp, synthetic construct
  misc_feature 1..20: note = Synthetic Construct
  source 1..20: mol_type = other DNA
tgctgtccagctctcctgtt

SEQ ID NO: 25330 - DNA, 21 bp, synthetic construct
  misc_feature 1..21: note = Synthetic Construct
  source 1..21: mol_type = other DNA
atggacccacggggacctaat

SEQ ID NO: 25331 - DNA, 23 bp, synthetic construct
  misc_feature 1..23: note = Synthetic Construct
  source 1..23: mol_type = other DNA
ttgtgccctagaggatgtctact

SEQ ID NO: 25332 - DNA, 23 bp, synthetic construct
  misc_feature 1..23: note = Synthetic Construct
  source 1..23: mol_type = other DNA
tgtttttgtccccactgacatct

SEQ ID NO: 25333 - DNA, 24 bp, synthetic construct
  misc_feature 1..24: note = Synthetic Construct
  source 1..24: mol_type = other DNA
ccacagggacccctatcacttatg

SEQ ID NO: 25334 - DNA, 19 bp, synthetic construct
  misc_feature 1..19: note = Synthetic Construct
  source 1..19: mol_type = other DNA
aggttgcaggcgggattga

SEQ ID NO: 25335 - DNA, 22 bp, synthetic construct
  misc_feature 1..22: note = Synthetic Construct
  source 1..22: mol_type = other DNA
ggcagagggagtgccataaaca

SEQ ID NO: 25336 - DNA, 20 bp, synthetic construct
  misc_feature 1..20: note = Synthetic Construct
  source 1..20: mol_type = other DNA
gcctgccatccctgtacact

SEQ ID NO: 25337 - DNA, 21 bp, synthetic construct
  misc_feature 1..21: note = Synthetic Construct
  source 1..21: mol_type = other DNA
gtgggagcaggtagagtgaga

SEQ ID NO: 25338 - DNA, 24 bp, synthetic construct
  misc_feature 1..24: note = Synthetic Construct
  source 1..24: mol_type = other DNA
gtctatatggtcttggcagctgaa

SEQ ID NO: 25339 - DNA, 19 bp, synthetic construct
  misc_feature 1..19: note = Synthetic Construct
  source 1..19: mol_type = other DNA
gtgagcagtggcggtgact

SEQ ID NO: 25340 - DNA, 27 bp, synthetic construct
  misc_feature 1..27: note = Synthetic Construct
  source 1..27: mol_type = other DNA
ctgtggataaagccaatggatactgtt

SEQ ID NO: 25341 - DNA, 22 bp, synthetic construct
  misc_feature 1..22: note = Synthetic Construct
  source 1..22: mol_type = other DNA
ggctgtcagtgttcagttgtgt

SEQ ID NO: 25342 - DNA, 20 bp, synthetic construct
  misc_feature 1..20: note = Synthetic Construct
  source 1..20: mol_type = other DNA
tttgggctggagacctcgtt

SEQ ID NO: 25343 - DNA, 24 bp, synthetic construct
  misc_feature 1..24: note = Synthetic Construct
  source 1..24: mol_type = other DNA
aacctacctcctgctggtatatct

SEQ ID NO: 25344 - DNA, 20 bp, synthetic construct
  misc_feature 1..20: note = Synthetic Construct
  source 1..20: mol_type = other DNA
cgaggctcgagctgttgtga

SEQ ID NO: 25345 - DNA, 21 bp, synthetic construct
  misc_feature 1..21: note = Synthetic Construct
  source 1..21: mol_type = other DNA
ccccgtgactcattggctcat

SEQ ID NO: 25346 - DNA, 24 bp, synthetic construct
  misc_feature 1..24: note = Synthetic Construct
  source 1..24: mol_type = other DNA
gacatgtggtgtagacacgaggta

SEQ ID NO: 25347 - DNA, 21 bp, synthetic construct
  misc_feature 1..21: note = Synthetic Construct
  source 1..21: mol_type = other DNA
aggagagcaggcacacccata

SEQ ID NO: 25348 - DNA, 25 bp, synthetic construct
  misc_feature 1..25: note = Synthetic Construct
  source 1..25: mol_type = other DNA
ctgcctcagtgaatccagactgatg

SEQ ID NO: 25349 - DNA, 20 bp, synthetic construct
  misc_feature 1..20: note = Synthetic Construct
  source 1..20: mol_type = other DNA
actgtgtgccacagcaaact

SEQ ID NO: 25350 - DNA, 21 bp, synthetic construct
  misc_feature 1..21: note = Synthetic Construct
  source 1..21: mol_type = other DNA
agtcccttcctgggagtcaaa

SEQ ID NO: 25351 - DNA, 23 bp, synthetic construct
  misc_feature 1..23: note = Synthetic Construct
  source 1..23: mol_type = other DNA
ctcaagtcccttcaaccttcctt

SEQ ID NO: 25352 - DNA, 24 bp, synthetic construct
  misc_feature 1..24: note = Synthetic Construct
  source 1..24: mol_type = other DNA
ggacctagaacctgtgtcccttgt

SEQ ID NO: 25353 - DNA, 20 bp, synthetic construct
  misc_feature 1..20: note = Synthetic Construct
  source 1..20: mol_type = other DNA
gggaatggctcgctcacgtt

SEQ ID NO: 25354 - DNA, 22 bp, synthetic construct
  misc_feature 1..22: note = Synthetic Construct
  source 1..22: mol_type = other DNA
gggacatggcagagctgaacta

SEQ ID NO: 25355 - DNA, 24 bp, synthetic construct
  misc_feature 1..24: note = Synthetic Construct
  source 1..24: mol_type = other DNA
ttggagaccaccaaagaatcaaga

SEQ ID NO: 25356 - DNA, 25 bp, synthetic construct
  misc_feature 1..25: note = Synthetic Construct
  source 1..25: mol_type = other DNA
catgaagaaagacgggtatctggaa

SEQ ID NO: 25357 - DNA, 25 bp, synthetic construct
  misc_feature 1..25: note = Synthetic Construct
  source 1..25: mol_type = other DNA
gcttgaatcttgcattcatctgctt

SEQ ID NO: 25358 - DNA, 18 bp, synthetic construct
  misc_feature 1..18: note = Synthetic Construct
  source 1..18: mol_type = other DNA
cgccaccgagtgctttct

SEQ ID NO: 25359 - DNA, 21 bp, synthetic construct
  misc_feature 1..21: note = Synthetic Construct
  source 1..21: mol_type = other DNA
ggctagcaaagctcccacaca

SEQ ID NO: 25360 - DNA, 23 bp, synthetic construct
  misc_feature 1..23: note = Synthetic Construct
  source 1..23: mol_type = other DNA
gctggagatactacagcaagcaa

SEQ ID NO: 25361 - DNA, 22 bp, synthetic construct
  misc_feature 1..22: note = Synthetic Construct
  source 1..22: mol_type = other DNA
ctgctgctccccaatcctaact

SEQ ID NO: 25362 - DNA, 23 bp, synthetic construct
  misc_feature 1..23: note = Synthetic Construct
  source 1..23: mol_type = other DNA
ggaactgggcctcattcaccatt

SEQ ID NO: 25363 - DNA, 22 bp, synthetic construct
  misc_feature 1..22: note = Synthetic Construct
  source 1..22: mol_type = other DNA
tgacaaccaccacgctattaca

SEQ ID NO: 25364 - DNA, 19 bp, synthetic construct
  misc_feature 1..19: note = Synthetic Construct
  source 1..19: mol_type = other DNA
atgcgccacagtgggtaca

SEQ ID NO: 25365 - DNA, 21 bp, synthetic construct
  misc_feature 1..21: note = Synthetic Construct
  source 1..21: mol_type = other DNA
cccctttgccacatcttggtt

SEQ ID NO: 25366 - DNA, 22 bp, synthetic construct
  misc_feature 1..22: note = Synthetic Construct
  source 1..22: mol_type = other DNA
ccctgtcatccatgggagctta

SEQ ID NO: 25367 - DNA, 24 bp, synthetic construct
  misc_feature 1..24: note = Synthetic Construct
  source 1..24: mol_type = other DNA
caagagcatgaagcaaagtgacat

SEQ ID NO: 25368 - DNA, 22 bp, synthetic construct
  misc_feature 1..22: note = Synthetic Construct
  source 1..22: mol_type = other DNA
ccccagaactcagagtcagctt

SEQ ID NO: 25369 - DNA, 24 bp, synthetic construct
  misc_feature 1..24: note = Synthetic Construct
  source 1..24: mol_type = other DNA
gctttcttgggaaccagagcagtt

SEQ ID NO: 25370 - DNA, 19 bp, synthetic construct
  misc_feature 1..19: note = Synthetic Construct
  source 1..19: mol_type = other DNA
aacagcagctgcgctccat

SEQ ID NO: 25371 - DNA, 24 bp, synthetic construct
  misc_feature 1..24: note = Synthetic Construct
  source 1..24: mol_type = other DNA
ggggcacaaaggaggagacaatta

SEQ ID NO: 25372 - DNA, 25 bp, synthetic construct
  misc_feature 1..25: note = Synthetic Construct
  source 1..25: mol_type = other DNA
aggaagaccctgtctctacaaaatc

SEQ ID NO: 25373 - DNA, 21 bp, synthetic construct
  misc_feature 1..21: note = Synthetic Construct
  source 1..21: mol_type = other DNA
cgtttcccacctgtcgagtct

SEQ ID NO: 25374 - DNA, 24 bp, synthetic construct
  misc_feature 1..24: note = Synthetic Construct
  source 1..24: mol_type = other DNA
tgggaaggaatggcatctaactct

SEQ ID NO: 25375 - DNA, 26 bp, synthetic construct
  misc_feature 1..26: note = Synthetic Construct
  source 1..26: mol_type = other DNA
cccaatcagacgtgaagttttcttgt

SEQ ID NO: 25376 - DNA, 22 bp, synthetic construct
  misc_feature 1..22: note = Synthetic Construct
  source 1..22: mol_type = other DNA
ccttctcaggtgcaggaaaagt

SEQ ID NO: 25377 - DNA, 19 bp, synthetic construct
  misc_feature 1..19: note = Synthetic Construct
  source 1..19: mol_type = other DNA
agcaggccactgctcaagt

SEQ ID NO: 25378 - DNA, 23 bp, synthetic construct
  misc_feature 1..23: note = Synthetic Construct
  source 1..23: mol_type = other DNA
ctgagacagccacattctggtaa

SEQ ID NO: 25379 - DNA, 22 bp, synthetic construct
  misc_feature 1..22: note = Synthetic Construct
  source 1..22: mol_type = other DNA
ctgcttccaaatcccaccttct

SEQ ID NO: 25380 - DNA, 24 bp, synthetic construct
  misc_feature 1..24: note = Synthetic Construct
  source 1..24: mol_type = other DNA
gaagacctgtgtgagaagcaatga

SEQ ID NO: 25381 - DNA, 20 bp, synthetic construct
  misc_feature 1..20: note = Synthetic Construct
  source 1..20: mol_type = other DNA
tagaggcacacccaccatgt

SEQ ID NO: 25382 - DNA, 19 bp, synthetic construct
  misc_feature 1..19: note = Synthetic Construct
  source 1..19: mol_type = other DNA
agcatctccgtgcgtggaa

SEQ ID NO: 25383 - DNA, 22 bp, synthetic construct
  misc_feature 1..22: note = Synthetic Construct
  source 1..22: mol_type = other DNA
ctgccacagaagttcaccagat

SEQ ID NO: 25384 - DNA, 23 bp, synthetic construct
  misc_feature 1..23: note = Synthetic Construct
  source 1..23: mol_type = other DNA
gtggctttagctgaagtgctgaa

SEQ ID NO: 25385 - DNA, 22 bp, synthetic construct
  misc_feature 1..22: note = Synthetic Construct
  source 1..22: mol_type = other DNA
tgagcatgtcagccattaccat

SEQ ID NO: 25386 - DNA, 23 bp, synthetic construct
  misc_feature 1..23: note = Synthetic Construct
  source 1..23: mol_type = other DNA
ggctacaggaactgaatgtggat

SEQ ID NO: 25387 - DNA, 19 bp, synthetic construct
  misc_feature 1..19: note = Synthetic Construct
  source 1..19: mol_type = other DNA
tgagggctgcccactgtag

SEQ ID NO: 25388 - DNA, 23 bp, synthetic construct
  misc_feature 1..23: note = Synthetic Construct
  source 1..23: mol_type = other DNA
gccatctcaacctctctgtcttc

SEQ ID NO: 25389 - DNA, 21 bp, synthetic construct
  misc_feature 1..21: note = Synthetic Construct
  source 1..21: mol_type = other DNA
gcccaaggtcactcgtttact

SEQ ID NO: 25390 - DNA, 24 bp, synthetic construct
  misc_feature 1..24: note = Synthetic Construct
  source 1..24: mol_type = other DNA
aggactttttctctcagcacaact

SEQ ID NO: 25391 - DNA, 26 bp, synthetic construct
  misc_feature 1..26: note = Synthetic Construct
  source 1..26: mol_type = other DNA
gactacatagtacgtctccagtgaca

SEQ ID NO: 25392 - DNA, 22 bp, synthetic construct
  misc_feature 1..22: note = Synthetic Construct
  source 1..22: mol_type = other DNA
tgggtggtgacttgtcctgcta

SEQ ID NO: 25393 - DNA, 23 bp, synthetic construct
  misc_feature 1..23: note = Synthetic Construct
  source 1..23: mol_type = other DNA
cctgactcctttgctaggcactt

SEQ ID NO: 25394 - DNA, 24 bp, synthetic construct
  misc_feature 1..24: note = Synthetic Construct
  source 1..24: mol_type = other DNA
gctggtccagaggagaaatgatga

SEQ ID NO: 25395 - DNA, 19 bp, synthetic construct
  misc_feature 1..19: note = Synthetic Construct
  source 1..19: mol_type = other DNA
ccccagcacaggcagatgt

SEQ ID NO: 25396 - DNA, 24 bp, synthetic construct
  misc_feature 1..24: note = Synthetic Construct
  source 1..24: mol_type = other DNA
gactccccaagggataggagtatg

SEQ ID NO: 25397 - DNA, 22 bp, synthetic construct
  misc_feature 1..22: note = Synthetic Construct
  source 1..22: mol_type = other DNA
gtgacttgagggcagaaactga

SEQ ID NO: 25398 - DNA, 25 bp, synthetic construct
  misc_feature 1..25: note = Synthetic Construct
  source 1..25: mol_type = other DNA
cgagaagactctcccacatgtgttt

SEQ ID NO: 25399 - DNA, 24 bp, synthetic construct
  misc_feature 1..24: note = Synthetic Construct
  source 1..24: mol_type = other DNA
cgccagagtagtgtgtctgctatt

SEQ ID NO: 25400 - DNA, 21 bp, synthetic construct
  misc_feature 1..21: note = Synthetic Construct
  source 1..21: mol_type = other DNA
cattactggaagccgcagaga

SEQ ID NO: 25401 - DNA, 22 bp, synthetic construct
  misc_feature 1..22: note = Synthetic Construct
  source 1..22: mol_type = other DNA
catgatgtgctgtcagcctgtt

SEQ ID NO: 25402 - DNA, 19 bp, synthetic construct
  misc_feature 1..19: note = Synthetic Construct
  source 1..19: mol_type = other DNA
gccaacccaccgacaccat

SEQ ID NO: 25403 - DNA, 22 bp, synthetic construct
  misc_feature 1..22: note = Synthetic Construct
  source 1..22: mol_type = other DNA
aggacctgtcaggccacataga

SEQ ID NO: 25404 - DNA, 23 bp, synthetic construct
  misc_feature 1..23: note = Synthetic Construct
  source 1..23: mol_type = other DNA
ctggggttcaaaccctggtcttt

SEQ ID NO: 25405 - DNA, 20 bp, synthetic construct
  misc_feature 1..20: note = Synthetic Construct
  source 1..20: mol_type = other DNA
ggctccacacatgtggcatt

SEQ ID NO: 25406 - DNA, 22 bp, synthetic construct
  misc_feature 1..22: note = Synthetic Construct
  source 1..22: mol_type = other DNA
gaccaaggccccaagttgaagt

SEQ ID NO: 25407 - DNA, 26 bp, synthetic construct
  misc_feature 1..26: note = Synthetic Construct
  source 1..26: mol_type = other DNA
aaaagaccccaggatggactattatg

SEQ ID NO: 25408 - DNA, 23 bp, synthetic construct
  misc_feature 1..23: note = Synthetic Construct
  source 1..23: mol_type = other DNA
acgtacatccttgcctcttctga

SEQ ID NO: 25409 - DNA, 25 bp, synthetic construct
  misc_feature 1..25: note = Synthetic Construct
  source 1..25: mol_type = other DNA
gctcacttgttttagctccttccta

SEQ ID NO: 25410 - DNA, 23 bp, synthetic construct
  misc_feature 1..23: note = Synthetic Construct
  source 1..23: mol_type = other DNA
gttttgctccaggactgttttgt

SEQ ID NO: 25411 - DNA, 21 bp, synthetic construct
  misc_feature 1..21: note = Synthetic Construct
  source 1..21: mol_type = other DNA
agcccacaagactcacctttc

SEQ ID NO: 25412 - DNA, 22 bp, synthetic construct
  misc_feature 1..22: note = Synthetic Construct
  source 1..22: mol_type = other DNA
ctgcaggggctgagaaatgtag

SEQ ID NO: 25413 - DNA, 18 bp, synthetic construct
  misc_feature 1..18: note = Synthetic Construct
  source 1..18: mol_type = other DNA
agcaggcacggtcagctt

SEQ ID NO: 25414 - DNA, 20 bp, synthetic construct
  misc_feature 1..20: note = Synthetic Construct
  source 1..20: mol_type = other DNA
gcgccaaagagctggaaatg

SEQ ID NO: 25415 - DNA, 20 bp, synthetic construct
  misc_feature 1..20: note = Synthetic Construct
  source 1..20: mol_type = other DNA
acctgggaccctctgttgaa

SEQ ID NO: 25416 - DNA, 23 bp, synthetic construct
  misc_feature 1..23: note = Synthetic Construct
  source 1..23: mol_type = other DNA
cccatccgtatttccagacttca

SEQ ID NO: 25417 - DNA, 22 bp, synthetic construct
  misc_feature 1..22: note = Synthetic Construct
  source 1..22: mol_type = other DNA
ggttgtggacacgtctgagttc

SEQ ID NO: 25418 - DNA, 20 bp, synthetic construct
  misc_feature 1..20: note = Synthetic Construct
  source 1..20: mol_type = other DNA
gggcctacttccccgactct

SEQ ID NO: 25419 - DNA, 22 bp, synthetic construct
  misc_feature 1..22: note = Synthetic Construct
  source 1..22: mol_type = other DNA
agcacagggttccctagagttg

SEQ ID NO: 25420 - DNA, 22 bp, synthetic construct
  misc_feature 1..22: note = Synthetic Construct
  source 1..22: mol_type = other DNA
acaggctctggccaagggtaaa

SEQ ID NO: 25421 - DNA, 18 bp, synthetic construct
  misc_feature 1..18: note = Synthetic Construct
  source 1..18: mol_type = other DNA
tgccagccgaggcaaaat

SEQ ID NO: 25422 - DNA, 26 bp, synthetic construct
  misc_feature 1..26: note = Synthetic Construct
  source 1..26: mol_type = other DNA
gaggggattgagtcagacagatttag

SEQ ID NO: 25423 - DNA, 23 bp, synthetic construct
  misc_feature 1..23: note = Synthetic Construct
  source 1..23: mol_type = other DNA
gcatcattcatgccacgccattg

SEQ ID NO: 25424 - DNA, 22 bp, synthetic construct
  misc_feature 1..22: note = Synthetic Construct
  source 1..22: mol_type = other DNA
gtccaggcttggtggatgttca

SEQ ID NO: 25425 - DNA, 23 bp, synthetic construct
  misc_feature 1..23: note = Synthetic Construct
  source 1..23: mol_type = other DNA
gaccaaaagaggcggaacacatc

SEQ ID NO: 25426 - DNA, 19 bp, synthetic construct
  misc_feature 1..19: note = Synthetic Construct
  source 1..19: mol_type = other DNA
ggggctgggcaaattccaa

SEQ ID NO: 25427 - DNA, 24 bp, synthetic construct
  misc_feature 1..24: note = Synthetic Construct
  source 1..24: mol_type = other DNA
cctgtcctgaatcagtgggaattt

SEQ ID NO: 25428 - DNA, 21 bp, synthetic construct
  misc_feature 1..21: note = Synthetic Construct
  source 1..21: mol_type = other DNA
tccttgcaacgttccctgaat

SEQ ID NO: 25429 - DNA, 23 bp, synthetic construct
  misc_feature 1..23: note = Synthetic Construct
  source 1..23: mol_type = other DNA
gttcagccactctctgctaggat

SEQ ID NO: 25430 - DNA, 20 bp, synthetic construct
  misc_feature 1..20: note = Synthetic Construct
  source 1..20: mol_type = other DNA
tcgtcaacacggccttcact

SEQ ID NO: 25431 - DNA, 21 bp, synthetic construct
  misc_feature 1..21: note = Synthetic Construct
  source 1..21: mol_type = other DNA
gcaagggaccaagtccacagt

SEQ ID NO: 25432 - DNA, 21 bp, synthetic construct
  misc_feature 1..21: note = Synthetic Construct
  source 1..21: mol_type = other DNA
ttcccggggacgtgctcatct

SEQ ID NO: 25433 - DNA, 21 bp, synthetic construct
  misc_feature 1..21: note = Synthetic Construct
  source 1..21: mol_type = other DNA
ccaggactgcctttggccttt

SEQ ID NO: 25434 - DNA, 19 bp, synthetic construct
  misc_feature 1..19: note = Synthetic Construct
  source 1..19: mol_type = other DNA
tccctgcaagaccccttgt

SEQ ID NO: 25435 - DNA, 22 bp, synthetic construct
  misc_feature 1..22: note = Synthetic Construct
  source 1..22: mol_type = other DNA
tgggctctggtaagcctcagtt

SEQ ID NO: 25436 - DNA, 23 bp, synthetic construct
  misc_feature 1..23: note = Synthetic Construct
  source 1..23: mol_type = other DNA
ctccgacatctacctgtcctttc

SEQ ID NO: 25437 - DNA, 22 bp, synthetic construct
  misc_feature 1..22: note = Synthetic Construct
  source 1..22: mol_type = other DNA
cagcaaaccagtgcaactcaac

SEQ ID NO: 25438 - DNA, 20 bp, synthetic construct
  misc_feature 1..20: note = Synthetic Construct
  source 1..20: mol_type = other DNA
actgaccacggagtgtctga

SEQ ID NO: 25439 - DNA, 22 bp, synthetic construct
  misc_feature 1..22: note = Synthetic Construct
  source 1..22: mol_type = other DNA
ggaaattggggccctgcattct

SEQ ID NO: 25440 - DNA, 20 bp, synthetic construct
  misc_feature 1..20: note = Synthetic Construct
  source 1..20: mol_type = other DNA
ggtattgcagtggccaggaa

SEQ ID NO: 25441 - DNA, 22 bp, synthetic construct
  misc_feature 1..22: note = Synthetic Construct
  source 1..22: mol_type = other DNA
gagacccagagctagagtcctt

SEQ ID NO: 25442 - DNA, 25 bp, synthetic construct
  misc_feature 1..25: note = Synthetic Construct
  source 1..25: mol_type = other DNA
ggaaaccagattctctgagggaaaa

SEQ ID NO: 25443 - DNA, 19 bp, synthetic construct
  misc_feature 1..19: note = Synthetic Construct
  source 1..19: mol_type = other DNA
agcagtgcgagccagtgaa

SEQ ID NO: 25444 - DNA, 23 bp, synthetic construct
  misc_feature 1..23: note = Synthetic Construct
  source 1..23: mol_type = other DNA
ctggggcaaactacagaggatag

SEQ ID NO: 25445 - DNA, 22 bp, synthetic construct
  misc_feature 1..22: note = Synthetic Construct
  source 1..22: mol_type = other DNA
gagaccctgtcttgcagcttag

SEQ ID NO: 25446 - DNA, 24 bp, synthetic construct
  misc_feature 1..24: note = Synthetic Construct
  source 1..24: mol_type = other DNA
gtggacacaggggaagtaggtgaa

SEQ ID NO: 25447 - DNA, 20 bp, synthetic construct
  misc_feature 1..20: note = Synthetic Construct
  source 1..20: mol_type = other DNA
tggccccagcagtaggtctt

SEQ ID NO: 25448 - DNA, 20 bp, synthetic construct
  misc_feature 1..20: note = Synthetic Construct
  source 1..20: mol_type = other DNA
ggaggcagccagtgatcttt

SEQ ID NO: 25449 - DNA, 21 bp, synthetic construct
  misc_feature 1..21: note = Synthetic Construct
  source 1..21: mol_type = other DNA
gcacagtgcttgcttctcagt

SEQ ID NO: 25450 - DNA, 20 bp, synthetic construct
  misc_feature 1..20: note = Synthetic Construct
  source 1..20: mol_type = other DNA
atgaggcctagcagcactct

SEQ ID NO: 25451 - DNA, 24 bp, synthetic construct
  misc_feature 1..24: note = Synthetic Construct
  source 1..24: mol_type = other DNA
gactgttggcctgtgcttaagagt

SEQ ID NO: 25452 - DNA, 20 bp, synthetic construct
  misc_feature 1..20: note = Synthetic Construct
  source 1..20: mol_type = other DNA
tctttggccctctgcacttc

SEQ ID NO: 25453 - DNA, 20 bp, synthetic construct
  misc_feature 1..20: note = Synthetic Construct
  source 1..20: mol_type = other DNA
cctagaccgggccgtagaag

SEQ ID NO: 25454 - DNA, 24 bp, synthetic construct
  misc_feature 1..24: note = Synthetic Construct
  source 1..24: mol_type = other DNA
acttctcttttggcctgtttgtca

SEQ ID NO: 25455 - DNA, 20 bp, synthetic construct
  misc_feature 1..20: note = Synthetic Construct
  source 1..20: mol_type = other DNA
gctccggtcaaaagggaagt

SEQ ID NO: 25456 - DNA, 21 bp, synthetic construct
  misc_feature 1..21: note = Synthetic Construct
  source 1..21: mol_type = other DNA
tgtctagcgaggagcgtgtga

SEQ ID NO: 25457 - DNA, 21 bp, synthetic construct
  misc_feature 1..21: note = Synthetic Construct
  source 1..21: mol_type = other DNA
acagtctggccacagtctctt

SEQ ID NO: 25458 - DNA, 22 bp, synthetic construct
  misc_feature 1..22: note = Synthetic Construct
  source 1..22: mol_type = other DNA
ggtggcacagacttggagatgt

SEQ ID NO: 25459 - DNA, 22 bp, synthetic construct
  misc_feature 1..22: note = Synthetic Construct
  source 1..22: mol_type = other DNA
ggggagttagcctgggaccaat

SEQ ID NO: 25460 - DNA, 22 bp, synthetic construct
  misc_feature 1..22: note = Synthetic Construct
  source 1..22: mol_type = other DNA
ggcagggattcccaggagctat

SEQ ID NO: 25461 - DNA, 19 bp, synthetic construct
  misc_feature 1..19: note = Synthetic Construct
  source 1..19: mol_type = other DNA
gctgccctccatggtctgt

SEQ ID NO: 25462 - DNA, 23 bp, synthetic construct
  misc_feature 1..23: note = Synthetic Construct
  source 1..23: mol_type = other DNA
gcttgagaaaccctgccctagta

SEQ ID NO: 25463 - DNA, 21 bp, synthetic construct
  misc_feature 1..21: note = Synthetic Construct
  source 1..21: mol_type = other DNA
aggggagcgcttggactatac

SEQ ID NO: 25464 - DNA, 21 bp, synthetic construct
  misc_feature 1..21: note = Synthetic Construct
  source 1..21: mol_type = other DNA
cccggctggtagctctcagaa

SEQ ID NO: 25465 - DNA, 22 bp, synthetic construct
  misc_feature 1..22: note = Synthetic Construct
  source 1..22: mol_type = other DNA
acctgcaagttactggagcttt

SEQ ID NO: 25466 - DNA, 19 bp, synthetic construct
  misc_feature 1..19: note = Synthetic Construct
  source 1..19: mol_type = other DNA
aagctgcggctccttgtgt

SEQ ID NO: 25467 - DNA, 24 bp, synthetic construct
  misc_feature 1..24: note = Synthetic Construct
  source 1..24: mol_type = other DNA
cagaacctccttcttggcaatgat

SEQ ID NO: 25468 - DNA, 22 bp, synthetic construct
  misc_feature 1..22: note = Synthetic Construct
  source 1..22: mol_type = other DNA
cagcggcctcactcacagtatt

SEQ ID NO: 25469 - DNA, 22 bp, synthetic construct
  misc_feature 1..22: note = Synthetic Construct
  source 1..22: mol_type = other DNA
ccctagaactgcaccgagtcat

SEQ ID NO: 25470 - DNA, 19 bp, synthetic construct
  misc_feature 1..19: note = Synthetic Construct
  source 1..19: mol_type = other DNA
ggggtacgtcggtgtcatc

SEQ ID NO: 25471 - DNA, 24 bp, synthetic construct
  misc_feature 1..24: note = Synthetic Construct
  source 1..24: mol_type = other DNA
ccagttttccccacagaacacgat

SEQ ID NO: 25472 - DNA, 20 bp, synthetic construct
  misc_feature 1..20: note = Synthetic Construct
  source 1..20: mol_type = other DNA
gggaagccacagagagcaat

SEQ ID NO: 25473 - DNA, 20 bp, synthetic construct
  misc_feature 1..20: note = Synthetic Construct
  source 1..20: mol_type = other DNA
ctgccttcctagggctgaca

SEQ ID NO: 25474 - DNA, 21 bp, synthetic construct
  misc_feature 1..21: note = Synthetic Construct
  source 1..21: mol_type = other DNA
tgcagatgcaactgtgtccaa

SEQ ID NO: 25475 - DNA, 23 bp, synthetic construct
  misc_feature 1..23: note = Synthetic Construct
  source 1..23: mol_type = other DNA
ggggttgcagcctagcttaactt

SEQ ID NO: 25476 - DNA, 21 bp, synthetic construct
  misc_feature 1..21: note = Synthetic Construct
  source 1..21: mol_type = other DNA
aggaggaccgcagaatcttca

SEQ ID NO: 25477 - DNA, 20 bp, synthetic construct
  misc_feature 1..20: note = Synthetic Construct
  source 1..20: mol_type = other DNA
ctcacactggcgggttttca

SEQ ID NO: 25478 - DNA, 20 bp, synthetic construct
  misc_feature 1..20: note = Synthetic Construct
  source 1..20: mol_type = other DNA
gccggccagtatgccctatt

SEQ ID NO: 25479 - DNA, 23 bp, synthetic construct
  misc_feature 1..23: note = Synthetic Construct
  source 1..23: mol_type = other DNA
ctctctctcccatttgcagaagt

SEQ ID NO: 25480 - DNA, 24 bp, synthetic construct
  misc_feature 1..24: note = Synthetic Construct
  source 1..24: mol_type = other DNA
ggtggttgtcgatgtcaggagact

SEQ ID NO: 25481 - DNA, 27 bp, synthetic construct
  misc_feature 1..27: note = Synthetic Construct
  source 1..27: mol_type = other DNA
ggtttctccacgtaagtaacaaagtct

SEQ ID NO: 25482 - DNA, 25 bp, synthetic construct
  misc_feature 1..25: note = Synthetic Construct
  source 1..25: mol_type = other DNA
gggacacaattcacccataacatct

SEQ ID NO: 25483 - DNA, 25 bp, synthetic construct
  misc_feature 1..25: note = Synthetic Construct
  source 1..25: mol_type = other DNA
ggaatctgcttcattccttgctctt

SEQ ID NO: 25484 - DNA, 20 bp, synthetic construct
  misc_feature 1..20: note = Synthetic Construct
  source 1..20: mol_type = other DNA
acatcctgctcgaccccaaa

SEQ ID NO: 25485 - DNA, 25 bp, synthetic construct
  misc_feature 1..25: note = Synthetic Construct
  source 1..25: mol_type = other DNA
gcagctccaaagagcagaggagata

SEQ ID NO: 25486 - DNA, 23 bp, synthetic construct
  misc_feature 1..23: note = Synthetic Construct
  source 1..23: mol_type = other DNA
tgattaagctgcatcgtgcattg

SEQ ID NO: 25487 - DNA, 25 bp, synthetic construct
  misc_feature 1..25: note = Synthetic Construct
  source 1..25: mol_type = other DNA
gcccaagaactccattgctaagttc

SEQ ID NO: 25488 - DNA, 24 bp, synthetic construct
  misc_feature 1..24: note = Synthetic Construct
  source 1..24: mol_type = other DNA
acccaattcaaggagcattagcat

SEQ ID NO: 25489 - DNA, 21 bp, synthetic construct
  misc_feature 1..21: note = Synthetic Construct
  source 1..21: mol_type = other DNA
gggtcccaatactgcaactga

SEQ ID NO: 25490 - DNA, 21 bp, synthetic construct
  misc_feature 1..21: note = Synthetic Construct
  source 1..21: mol_type = other DNA
gatgcaccctccactggaaaa

SEQ ID NO: 25491 - DNA, 24 bp, synthetic construct
  misc_feature 1..24: note = Synthetic Construct
  source 1..24: mol_type = other DNA
tgtgtttctgcactttgaggagtt

SEQ ID NO: 25492 - DNA, 20 bp, synthetic construct
  misc_feature 1..20: note = Synthetic Construct
  source 1..20: mol_type = other DNA
caggtggcaggagcagacaa

SEQ ID NO: 25493 - DNA, 22 bp, synthetic construct
  misc_feature 1..22: note = Synthetic Construct
  source 1..22: mol_type = other DNA
ggaggaagggttctgagcattc

SEQ ID NO: 25494 - DNA, 23 bp, synthetic construct
  misc_feature 1..23: note = Synthetic Construct
  source 1..23: mol_type = other DNA
actaggtctgggagcctctcctt

SEQ ID NO: 25495 - DNA, 22 bp, synthetic construct
  misc_feature 1..22: note = Synthetic Construct
  source 1..22: mol_type = other DNA
tacctgtggcagcccttcttca

SEQ ID NO: 25496 - DNA, 20 bp, synthetic construct
  misc_feature 1..20: note = Synthetic Construct
  source 1..20: mol_type = other DNA
tctccagcactggtctgtct

SEQ ID NO: 25497 - DNA, 21 bp, synthetic construct
  misc_feature 1..21: note = Synthetic Construct
  source 1..21: mol_type = other DNA
agagacgtggcactttgttga

SEQ ID NO: 25498 - DNA, 22 bp, synthetic construct
  misc_feature 1..22: note = Synthetic Construct
  source 1..22: mol_type = other DNA
caggccagcctggtaacctaac

SEQ ID NO: 25499 - DNA, 20 bp, synthetic construct
  misc_feature 1..20: note = Synthetic Construct
  source 1..20: mol_type = other DNA
gccacttgtcagggcatcaa

SEQ ID NO: 25500 - DNA, 21 bp, synthetic construct
  misc_feature 1..21: note = Synthetic Construct
  source 1..21: mol_type = other DNA
aggggcctgtttgggacaatg

SEQ ID NO: 25501 - DNA, 25 bp, synthetic construct
  misc_feature 1..25: note = Synthetic Construct
  source 1..25: mol_type = other DNA
gacagccaggtgaatgttctacaca

SEQ ID NO: 25502 - DNA, 20 bp, synthetic construct
  misc_feature 1..20: note = Synthetic Construct
  source 1..20: mol_type = other DNA
ttgcccactcctgacctagt

SEQ ID NO: 25503 - DNA, 22 bp, synthetic construct
  misc_feature 1..22: note = Synthetic Construct
  source 1..22: mol_type = other DNA
gcagggaccatacagactccaa

SEQ ID NO: 25504 - DNA, 23 bp, synthetic construct
  misc_feature 1..23: note = Synthetic Construct
  source 1..23: mol_type = other DNA
cctccactccctatggtgcttag

SEQ ID NO: 25505 - DNA, 20 bp, synthetic construct
  misc_feature 1..20: note = Synthetic Construct
  source 1..20: mol_type = other DNA
gcttgggattgcacggatca

SEQ ID NO: 25506 - DNA, 20 bp, synthetic construct
  misc_feature 1..20: note = Synthetic Construct
  source 1..20: mol_type = other DNA
agcaggagggtgaagactgt

SEQ ID NO: 25507 - DNA, 18 bp, synthetic construct
  misc_feature 1..18: note = Synthetic Construct
  source 1..18: mol_type = other DNA
aggccacgatggccacta

SEQ ID NO: 25508 - DNA, 21 bp, synthetic construct
  misc_feature 1..21: note = Synthetic Construct
  source 1..21: mol_type = other DNA
ccatccatcctccaggtgttc

SEQ ID NO: 25509 - DNA, 26 bp, synthetic construct
  misc_feature 1..26: note = Synthetic Construct
  source 1..26: mol_type = other DNA
cgtgaactctgactccttttctggat

SEQ ID NO: 25510 - DNA, 24 bp, synthetic construct
  misc_feature 1..24: note = Synthetic Construct
  source 1..24: mol_type = other DNA
tctcaccagcttgtccctaaattc

SEQ ID NO: 25511 - DNA, 21 bp, synthetic construct
  misc_feature 1..21: note = Synthetic Construct
  source 1..21: mol_type = other DNA
aggggaagacgtttggggtaa

SEQ ID NO: 25512 - DNA, 19 bp, synthetic construct
  misc_feature 1..19: note = Synthetic Construct
  source 1..19: mol_type = other DNA
ccagggagcctgcacacat

SEQ ID NO: 25513 - DNA, 21 bp, synthetic construct
  misc_feature 1..21: note = Synthetic Construct
  source 1..21: mol_type = other DNA
gtggcataggctgtcctgcat

SEQ ID NO: 25514 - DNA, 22 bp, synthetic construct
  misc_feature 1..22: note = Synthetic Construct
  source 1..22: mol_type = other DNA
ctctctagcatgcggtgggtaa

SEQ ID NO: 25515 - DNA, 22 bp, synthetic construct
  misc_feature 1..22: note = Synthetic Construct
  source 1..22: mol_type = other DNA
ggaaggcagtggacggtaattg

SEQ ID NO: 25516 - DNA, 24 bp, synthetic construct
  misc_feature 1..24: note = Synthetic Construct
  source 1..24: mol_type = other DNA
gccttcccctactttactgtcgaa

SEQ ID NO: 25517 - DNA, 21 bp, synthetic construct
  misc_feature 1..21: note = Synthetic Construct
  source 1..21: mol_type = other DNA
ggaaggagccacgcttaccaa

SEQ ID NO: 25518 - DNA, 23 bp, synthetic construct
  misc_feature 1..23: note = Synthetic Construct
  source 1..23: mol_type = other DNA
aggaggaatactcacccctgttc

SEQ ID NO: 25519 - DNA, 25 bp, synthetic construct
  misc_feature 1..25: note = Synthetic Construct
  source 1..25: mol_type = other DNA
tggaatggaggacaaattcctgaaa

SEQ ID NO: 25520 - DNA, 20 bp, synthetic construct
  misc_feature 1..20: note = Synthetic Construct
  source 1..20: mol_type = other DNA
tgcctctccgccagtgtatg

SEQ ID NO: 25521 - DNA, 20 bp, synthetic construct
  misc_feature 1..20: note = Synthetic Construct
  source 1..20: mol_type = other DNA
gagggctggacaaggtggaa

SEQ ID NO: 25522 - DNA, 24 bp, synthetic construct
  misc_feature 1..24: note = Synthetic Construct
  source 1..24: mol_type = other DNA
ctgtggatgtgctgtgaatgttga

SEQ ID NO: 25523 - DNA, 22 bp, synthetic construct
  misc_feature 1..22: note = Synthetic Construct
  source 1..22: mol_type = other DNA
gagttgctgggtcacggagttt

SEQ ID NO: 25524 - DNA, 24 bp, synthetic construct
  misc_feature 1..24: note = Synthetic Construct
  source 1..24: mol_type = other DNA
ccccgagaaaacctttcagcacaa

SEQ ID NO: 25525 - DNA, 20 bp, synthetic construct
  misc_feature 1..20: note = Synthetic Construct
  source 1..20: mol_type = other DNA
agcatcgccatcccaacaca

SEQ ID NO: 25526 - DNA, 21 bp, synthetic construct
  misc_feature 1..21: note = Synthetic Construct
  source 1..21: mol_type = other DNA
acaggctttgccctcctatct

SEQ ID NO: 25527 - DNA, 23 bp, synthetic construct
  misc_feature 1..23: note = Synthetic Construct
  source 1..23: mol_type = other DNA
tagccacccttcctccactgcta

SEQ ID NO: 25528 - DNA, 20 bp, synthetic construct
  misc_feature 1..20: note = Synthetic Construct
  source 1..20: mol_type = other DNA
ttgggcctgtgaacctgtgt

SEQ ID NO: 25529 - DNA, 20 bp, synthetic construct
  misc_feature 1..20: note = Synthetic Construct
  source 1..20: mol_type = other DNA
gggttcctccacgcacttgt

SEQ ID NO: 25530 - DNA, 21 bp, synthetic construct
  misc_feature 1..21: note = Synthetic Construct
  source 1..21: mol_type = other DNA
ggtgcctctgggctcagtttt

SEQ ID NO: 25531 - DNA, 19 bp, synthetic construct
  misc_feature 1..19: note = Synthetic Construct
  source 1..19: mol_type = other DNA
cgtgtccccagagcccaat

SEQ ID NO: 25532 - DNA, 19 bp, synthetic construct
  misc_feature 1..19: note = Synthetic Construct
  source 1..19: mol_type = other DNA
tggccattcgccctactgt

SEQ ID NO: 25533 - DNA, 24 bp, synthetic construct
  misc_feature 1..24: note = Synthetic Construct
  source 1..24: mol_type = other DNA
gtgttaggtcaaaggcagggttct

SEQ ID NO: 25534 - DNA, 24 bp, synthetic construct
  misc_feature 1..24: note = Synthetic Construct
  source 1..24: mol_type = other DNA
gtgtagtgggttggcttaggcatt

SEQ ID NO: 25535 - DNA, 20 bp, synthetic construct
  misc_feature 1..20: note = Synthetic Construct
  source 1..20: mol_type = other DNA
accatccagtccgagtgctt

SEQ ID NO: 25536 - DNA, 19 bp, synthetic construct
  misc_feature 1..19: note = Synthetic Construct
  source 1..19: mol_type = other DNA
ggacgggcaatgtccatgt

SEQ ID NO: 25537 - DNA, 22 bp, synthetic construct
  misc_feature 1..22: note = Synthetic Construct
  source 1..22: mol_type = other DNA
caggccacacacccctttatct

SEQ ID NO: 25538 - DNA, 22 bp, synthetic construct
  misc_feature 1..22: note = Synthetic Construct
  source 1..22: mol_type = other DNA
ccggaatccctcagcaaagtct

SEQ ID NO: 25539 - DNA, 22 bp, synthetic construct
  misc_feature 1..22: note = Synthetic Construct
  source 1..22: mol_type = other DNA
ggcatagcagacactgccgatt

SEQ ID NO: 25540 - DNA, 25 bp, synthetic construct
  misc_feature 1..25: note = Synthetic Construct
  source 1..25: mol_type = other DNA
cccctgcatctatccattcctattc

SEQ ID NO: 25541 - DNA, 22 bp, synthetic construct
  misc_feature 1..22: note = Synthetic Construct
  source 1..22: mol_type = other DNA
atctcctctgctgcgtgacaag

SEQ ID NO: 25542 - DNA, 22 bp, synthetic construct
  misc_feature 1..22: note = Synthetic Construct
  source 1..22: mol_type = other DNA
ctgtacatgtggctggaacaga

SEQ ID NO: 25543 - DNA, 20 bp, synthetic construct
  misc_feature 1..20: note = Synthetic Construct
  source 1..20: mol_type = other DNA
tccaggacgtggcacaaagt

SEQ ID NO: 25544 - DNA, 23 bp, synthetic construct
  misc_feature 1..23: note = Synthetic Construct
  source 1..23: mol_type = other DNA
ctcttccgtctcctcctgcaaac

SEQ ID NO: 25545 - DNA, 21 bp, synthetic construct
  misc_feature 1..21: note = Synthetic Construct
  source 1..21: mol_type = other DNA
tccaatcgcctgtctgtgttc

SEQ ID NO: 25546 - DNA, 22 bp, synthetic construct
  misc_feature 1..22: note = Synthetic Construct
  source 1..22: mol_type = other DNA
cctcacattgccatccaagcat

SEQ ID NO: 25547 - DNA, 25 bp, synthetic construct
  misc_feature 1..25: note = Synthetic Construct
  source 1..25: mol_type = other DNA
gtccacgtgggtttaaattcagcta

SEQ ID NO: 25548 - DNA, 22 bp, synthetic construct
  misc_feature 1..22: note = Synthetic Construct
  source 1..22: mol_type = other DNA
cacagacacagccccaaacaca

SEQ ID NO: 25549 - DNA, 21 bp, synthetic construct
  misc_feature 1..21: note = Synthetic Construct
  source 1..21: mol_type = other DNA
ttggccaaggggacccaagaa

SEQ ID NO: 25550 - DNA, 21 bp, synthetic construct
  misc_feature 1..21: note = Synthetic Construct
  source 1..21: mol_type = other DNA
agtgttggcgtggaggtctct

SEQ ID NO: 25551 - DNA, 19 bp, synthetic construct
  misc_feature 1..19: note = Synthetic Construct
  source 1..19: mol_type = other DNA
caggcaggctgcacacaaa

SEQ ID NO: 25552 - DNA, 18 bp, synthetic construct
  misc_feature 1..18: note = Synthetic Construct
  source 1..18: mol_type = other DNA
cagcgccacatgcacagt

SEQ ID NO: 25553 - DNA, 19 bp, synthetic construct
  misc_feature 1..19: note = Synthetic Construct
  source 1..19: mol_type = other DNA
tgtgcgtgcactccgtgat

SEQ ID NO: 25554 - DNA, 19 bp, synthetic construct
  misc_feature 1..19: note = Synthetic Construct
  source 1..19: mol_type = other DNA
accctgccctgctggacta

SEQ ID NO: 25555 - DNA, 22 bp, synthetic construct
  misc_feature 1..22: note = Synthetic Construct
  source 1..22: mol_type = other DNA
gggtcctcttgccattcgttca

SEQ ID NO: 25556 - DNA, 20 bp, synthetic construct
  misc_feature 1..20: note = Synthetic Construct
  source 1..20: mol_type = other DNA
tccactccctgcgcctcaca

SEQ ID NO: 25557 - DNA, 19 bp, synthetic construct
  misc_feature 1..19: note = Synthetic Construct
  source 1..19: mol_type = other DNA
ctgcgtccgggagtcatgt

SEQ ID NO: 25558 - DNA, 20 bp, synthetic construct
  misc_feature 1..20: note = Synthetic Construct
  source 1..20: mol_type = other DNA
tgcgcgatgctgcaagatgt

SEQ ID NO: 25559 - DNA, 20 bp, synthetic construct
  misc_feature 1..20: note = Synthetic Construct
  source 1..20: mol_type = other DNA
acatggaggcgagagtcaga

SEQ ID NO: 25560 - DNA, 21 bp, synthetic construct
  misc_feature 1..21: note = Synthetic Construct
  source 1..21: mol_type = other DNA
aggccttcctgaggcttcgat

SEQ ID NO: 25561 - DNA, 20 bp, synthetic construct
  misc_feature 1..20: note = Synthetic Construct
  source 1..20: mol_type = other DNA
gcccagtccggaagggttct

SEQ ID NO: 25562 - DNA, 22 bp, synthetic construct
  misc_feature 1..22: note = Synthetic Construct
  source 1..22: mol_type = other DNA
ggtgcacttggagtcacagaca

SEQ ID NO: 25563 - DNA, 21 bp, synthetic construct
  misc_feature 1..21: note = Synthetic Construct
  source 1..21: mol_type = other DNA
gccaccacgccaagaaaggaa

SEQ ID NO: 25564 - DNA, 21 bp, synthetic construct
  misc_feature 1..21: note = Synthetic Construct
  source 1..21: mol_type = other DNA
ggcaacccagtgctgaggaat

SEQ ID NO: 25565 - DNA, 18 bp, synthetic construct
  misc_feature 1..18: note = Synthetic Construct
  source 1..18: mol_type = other DNA
tgctcggcgtgtctgcaa

SEQ ID NO: 25566 - DNA, 20 bp, synthetic construct
  misc_feature 1..20: note = Synthetic Construct
  source 1..20: mol_type = other DNA
gtgcttccctgccggactac

SEQ ID NO: 25567 - DNA, 21 bp, synthetic construct
  misc_feature 1..21: note = Synthetic Construct
  source 1..21: mol_type = other DNA
aggggtctggctgagcatatc

SEQ ID NO: 25568 - DNA, 22 bp, synthetic construct
  misc_feature 1..22: note = Synthetic Construct
  source 1..22: mol_type = other DNA
ggaggtccttccttgcctcaat

SEQ ID NO: 25569 - DNA, 23 bp, synthetic construct
  misc_feature 1..23: note = Synthetic Construct
  source 1..23: mol_type = other DNA
gtgggccctttattgaccaggtt

SEQ ID NO: 25570 - DNA, 18 bp, synthetic construct
  misc_feature 1..18: note = Synthetic Construct
  source 1..18: mol_type = other DNA
gcggcctcaggaaacctt

SEQ ID NO: 25571 - DNA, 20 bp, synthetic construct
  misc_feature 1..20: note = Synthetic Construct
  source 1..20: mol_type = other DNA
atgctcccctccctgtccat

SEQ ID NO: 25572 - DNA, 20 bp, synthetic construct
  misc_feature 1..20: note = Synthetic Construct
  source 1..20: mol_type = other DNA
gcgagtcccatctgctcttc

SEQ ID NO: 25573 - DNA, 18 bp, synthetic construct
  misc_feature 1..18: note = Synthetic Construct
  source 1..18: mol_type = other DNA
aggctctgggctccttgt

SEQ ID NO: 25574 - DNA, 22 bp, synthetic construct
  misc_feature 1..22: note = Synthetic Construct
  source 1..22: mol_type = other DNA
gacttcagggcctccaaccatt

SEQ ID NO: 25575 - DNA, 22 bp, synthetic construct
  misc_feature 1..22: note = Synthetic Construct
  source 1..22: mol_type = other DNA
tcccctgcaccacttctcagat

SEQ ID NO: 25576 - DNA, 19 bp, synthetic construct
  misc_feature 1..19: note = Synthetic Construct
  source 1..19: mol_type = other DNA
tgggtgctgggtgcacagt

SEQ ID NO: 25577 - DNA, 18 bp, synthetic construct
  misc_feature 1..18: note = Synthetic Construct
  source 1..18: mol_type = other DNA
ggaacggccctgccaaat

SEQ ID NO: 25578 - DNA, 18 bp, synthetic construct
  misc_feature 1..18: note = Synthetic Construct
  source 1..18: mol_type = other DNA
agtgagcgtcccgtggtt

SEQ ID NO: 25579 - DNA, 22 bp, synthetic construct
  misc_feature 1..22: note = Synthetic Construct
  source 1..22: mol_type = other DNA
gtggcaaggacaagctgtatct

SEQ ID NO: 25580 - DNA, 19 bp, synthetic construct
  misc_feature 1..19: note = Synthetic Construct
  source 1..19: mol_type = other DNA
agccacccgtgctctcaac

SEQ ID NO: 25581 - DNA, 24 bp, synthetic construct
  misc_feature 1..24: note = Synthetic Construct
  source 1..24: mol_type = other DNA
cctgtggctcctctggactttatc

SEQ ID NO: 25582 - DNA, 20 bp, synthetic construct
  misc_feature 1..20: note = Synthetic Construct
  source 1..20: mol_type = other DNA
ggcttgagcttgcagtcttg

SEQ ID NO: 25583 - DNA, 21 bp, synthetic construct
  misc_feature 1..21: note = Synthetic Construct
  source 1..21: mol_type = other DNA
gctccctgaagggcagtgaag

SEQ ID NO: 25584 - DNA, 23 bp, synthetic construct
  misc_feature 1..23: note = Synthetic Construct
  source 1..23: mol_type = other DNA
gctcttgtggagaaggagacaga

SEQ ID NO: 25585 - DNA, 18 bp, synthetic construct
  misc_feature 1..18: note = Synthetic Construct
  source 1..18: mol_type = other DNA
tgctggggcaacctcgat

SEQ ID NO: 25586 - DNA, 21 bp, synthetic construct
  misc_feature 1..21: note = Synthetic Construct
  source 1..21: mol_type = other DNA
tgcactgccctagagctgcat

SEQ ID NO: 25587 - DNA, 20 bp, synthetic construct
  misc_feature 1..20: note = Synthetic Construct
  source 1..20: mol_type = other DNA
accccgcctcactcggatgt

SEQ ID NO: 25588 - DNA, 24 bp, synthetic construct
  misc_feature 1..24: note = Synthetic Construct
  source 1..24: mol_type = other DNA
tcctctctcctctgtggagtttta

SEQ ID NO: 25589 - DNA, 20 bp, synthetic construct
  misc_feature 1..20: note = Synthetic Construct
  source 1..20: mol_type = other DNA
tcgcacgtccctgctacaag

SEQ ID NO: 25590 - DNA, 21 bp, synthetic construct
  misc_feature 1..21: note = Synthetic Construct
  source 1..21: mol_type = other DNA
cacagtggcagttccggatga

SEQ ID NO: 25591 - DNA, 27 bp, synthetic construct
  misc_feature 1..27: note = Synthetic Construct
  source 1..27: mol_type = other DNA
tgacgaatcagagaatatgacctgtag

SEQ ID NO: 25592 - DNA, 24 bp, synthetic construct
  misc_feature 1..24: note = Synthetic Construct
  source 1..24: mol_type = other DNA
gccaggctcagactcatcatcttg

SEQ ID NO: 25593 - DNA, 20 bp, synthetic construct
  misc_feature 1..20: note = Synthetic Construct
  source 1..20: mol_type = other DNA
tggatgaggccctgttctgt

SEQ ID NO: 25594 - DNA, 22 bp, synthetic construct
  misc_feature 1..22: note = Synthetic Construct
  source 1..22: mol_type = other DNA
tccagcttcctcaaggcagtca

SEQ ID NO: 25595 - DNA, 20 bp, synthetic construct
  misc_feature 1..20: note = Synthetic Construct
  source 1..20: mol_type = other DNA
ccagccaagaagcagcaaca

SEQ ID NO: 25596 - DNA, 21 bp, synthetic construct
  misc_feature 1..21: note = Synthetic Construct
  source 1..21: mol_type = other DNA
cacggccttgctttcctgaga

SEQ ID NO: 25597 - DNA, 20 bp, synthetic construct
  misc_feature 1..20: note = Synthetic Construct
  source 1..20: mol_type = other DNA
aggccccggagggaaaagaa

SEQ ID NO: 25598 - DNA, 21 bp, synthetic construct
  misc_feature 1..21: note = Synthetic Construct
  source 1..21: mol_type = other DNA
gaggactgtgccagggaagta

SEQ ID NO: 25599 - DNA, 20 bp, synthetic construct
  misc_feature 1..20: note = Synthetic Construct
  source 1..20: mol_type = other DNA
tgctggacagacgcccagtt

SEQ ID NO: 25600 - DNA, 23 bp, synthetic construct
  misc_feature 1..23: note = Synthetic Construct
  source 1..23: mol_type = other DNA
gtcctcaggtcccagtggtagta

SEQ ID NO: 25601 - DNA, 22 bp, synthetic construct
  misc_feature 1..22: note = Synthetic Construct
  source 1..22: mol_type = other DNA
gtgcttccctttttgccctcta

SEQ ID NO: 25602 - DNA, 21 bp, synthetic construct
  misc_feature 1..21: note = Synthetic Construct
  source 1..21: mol_type = other DNA
ggagaggggcttgggaagtga

SEQ ID NO: 25603 - DNA, 22 bp, synthetic construct
  misc_feature 1..22: note = Synthetic Construct
  source 1..22: mol_type = other DNA
ctgccagcacacctatgtgata

SEQ ID NO: 25604 - DNA, 22 bp, synthetic construct
  misc_feature 1..22: note = Synthetic Construct
  source 1..22: mol_type = other DNA
gaagttccccagtgctcaccaa

SEQ ID NO: 25605 - DNA, 22 bp, synthetic construct
  misc_feature 1..22: note = Synthetic Construct
  source 1..22: mol_type = other DNA
cctcaccagctcccaacgtttt

SEQ ID NO: 25606 - DNA, 18 bp, synthetic construct
  misc_feature 1..18: note = Synthetic Construct
  source 1..18: mol_type = other DNA
tccacaccggcccatcat

SEQ ID NO: 25607 - DNA, 21 bp, synthetic construct
  misc_feature 1..21: note = Synthetic Construct
  source 1..21: mol_type = other DNA
tgaagcacaggtgggaagaag

SEQ ID NO: 25608 - DNA, 24 bp, synthetic construct
  misc_feature 1..24: note = Synthetic Construct
  source 1..24: mol_type = other DNA
agagaatggaagagaagggactgt

SEQ ID NO: 25609 - DNA, 21 bp, synthetic construct
  misc_feature 1..21: note = Synthetic Construct
  source 1..21: mol_type = other DNA
agaggctccacccgtcttctt

SEQ ID NO: 25610 - DNA, 25 bp, synthetic construct
  misc_feature 1..25: note = Synthetic Construct
  source 1..25: mol_type = other DNA
tgaacagatggctacgaatgtatga

SEQ ID NO: 25611 - DNA, 22 bp, synthetic construct
  misc_feature 1..22: note = Synthetic Construct
  source 1..22: mol_type = other DNA
accctggtcaagagggaagtca

SEQ ID NO: 25612 - DNA, 19 bp, synthetic construct
  misc_feature 1..19: note = Synthetic Construct
  source 1..19: mol_type = other DNA
cagcctggcttgcccaaag

SEQ ID NO: 25613 - DNA, 21 bp, synthetic construct
  misc_feature 1..21: note = Synthetic Construct
  source 1..21: mol_type = other DNA
tggcaggttctgggcttcatc

SEQ ID NO: 25614 - DNA, 22 bp, synthetic construct
  misc_feature 1..22: note = Synthetic Construct
  source 1..22: mol_type = other DNA
aggggatggcctcttgaacaca

SEQ ID NO: 25615 - DNA, 23 bp, synthetic construct
  misc_feature 1..23: note = Synthetic Construct
  source 1..23: mol_type = other DNA
tggagctgtttctcctagtgtct

SEQ ID NO: 25616 - DNA, 20 bp, synthetic construct
  misc_feature 1..20: note = Synthetic Construct
  source 1..20: mol_type = other DNA
gcctgtcagcaggcagactt

SEQ ID NO: 25617 - DNA, 23 bp, synthetic construct
  misc_feature 1..23: note = Synthetic Construct
  source 1..23: mol_type = other DNA
cctttggctgtgtaggcttcgat

SEQ ID NO: 25618 - DNA, 22 bp, synthetic construct
  misc_feature 1..22: note = Synthetic Construct
  source 1..22: mol_type = other DNA
ggtgggtctccaggtcactgaa

SEQ ID NO: 25619 - DNA, 22 bp, synthetic construct
  misc_feature 1..22: note = Synthetic Construct
  source 1..22: mol_type = other DNA
tgaagacagcctcccactctct

SEQ ID NO: 25620 - DNA, 21 bp, synthetic construct
  misc_feature 1..21: note = Synthetic Construct
  source 1..21: mol_type = other DNA
gccggggccaactatttgcta

SEQ ID NO: 25621 - DNA, 21 bp, synthetic construct
  misc_feature 1..21: note = Synthetic Construct
  source 1..21: mol_type = other DNA
gcagggagcagggaaggaagt

SEQ ID NO: 25622 - DNA, 22 bp, synthetic construct
  misc_feature 1..22: note = Synthetic Construct
  source 1..22: mol_type = other DNA
ctggggcagctgaggaatactt

SEQ ID NO: 25623 - DNA, 23 bp, synthetic construct
  misc_feature 1..23: note = Synthetic Construct
  source 1..23: mol_type = other DNA
catgaacctgcaatttggctgat

SEQ ID NO: 25624 - DNA, 22 bp, synthetic construct
  misc_feature 1..22: note = Synthetic Construct
  source 1..22: mol_type = other DNA
ccagcccaggtttgctgaatgt

SEQ ID NO: 25625 - DNA, 24 bp, synthetic construct
  misc_feature 1..24: note = Synthetic Construct
  source 1..24: mol_type = other DNA
tcagtcctgagctggaaataccta

SEQ ID NO: 25626 - DNA, 22 bp, synthetic construct
  misc_feature 1..22: note = Synthetic Construct
  source 1..22: mol_type = other DNA
cccacacccatcttgggtcttt

SEQ ID NO: 25627 - DNA, 19 bp, synthetic construct
  misc_feature 1..19: note = Synthetic Construct
  source 1..19: mol_type = other DNA
aaggcccagcagggaggaa

SEQ ID NO: 25628 - DNA, 22 bp, synthetic construct
  misc_feature 1..22: note = Synthetic Construct
  source 1..22: mol_type = other DNA
ggcatgtttgtcgtggggatgt

SEQ ID NO: 25629 - DNA, 24 bp, synthetic construct
  misc_feature 1..24: note = Synthetic Construct
  source 1..24: mol_type = other DNA
tctcaaactgagcattagctcctt

SEQ ID NO: 25630 - DNA, 22 bp, synthetic construct
  misc_feature 1..22: note = Synthetic Construct
  source 1..22: mol_type = other DNA
accacaggactggatgggaaaa

SEQ ID NO: 25631 - DNA, 23 bp, synthetic construct
  misc_feature 1..23: note = Synthetic Construct
  source 1..23: mol_type = other DNA
ggaggaatgatggggaagtctgt

SEQ ID NO: 25632 - DNA, 20 bp, synthetic construct
  misc_feature 1..20: note = Synthetic Construct
  source 1..20: mol_type = other DNA
ccctgtggcgagatccacat

SEQ ID NO: 25633 - DNA, 22 bp, synthetic construct
  misc_feature 1..22: note = Synthetic Construct
  source 1..22: mol_type = other DNA
ggatccttggggtgtcgtttca

SEQ ID NO: 25634 - DNA, 24 bp, synthetic construct
  misc_feature 1..24: note = Synthetic Construct
  source 1..24: mol_type = other DNA
gctcctgttgttactgggtaggtt

SEQ ID NO: 25635 - DNA, 25 bp, synthetic construct
  misc_feature 1..25: note = Synthetic Construct
  source 1..25: mol_type = other DNA
cctctcctctttgtggtccttcaac

SEQ ID NO: 25636 - DNA, 24 bp, synthetic construct
  misc_feature 1..24: note = Synthetic Construct
  source 1..24: mol_type = other DNA
cagtgtgataggtttccgtgaact

SEQ ID NO: 25637 - DNA, 21 bp, synthetic construct
  misc_feature 1..21: note = Synthetic Construct
  source 1..21: mol_type = other DNA
tcagccccttcacccaactaa

SEQ ID NO: 25638 - DNA, 23 bp, synthetic construct
  misc_feature 1..23: note = Synthetic Construct
  source 1..23: mol_type = other DNA
ggtgaccacccctgaataaccat

SEQ ID NO: 25639 - DNA, 25 bp, synthetic construct
  misc_feature 1..25: note = Synthetic Construct
  source 1..25: mol_type = other DNA
agctctttcaggtacaagagtgaaa

SEQ ID NO: 25640 - DNA, 20 bp, synthetic construct
  misc_feature 1..20: note = Synthetic Construct
  source 1..20: mol_type = other DNA
agcagcagcctcttgctagt

SEQ ID NO: 25641 - DNA, 22 bp, synthetic construct
  misc_feature 1..22: note = Synthetic Construct
  source 1..22: mol_type = other DNA
gccccatcagcgatgtggaata

SEQ ID NO: 25642 - DNA, 23 bp, synthetic construct
  misc_feature 1..23: note = Synthetic Construct
  source 1..23: mol_type = other DNA
ctctgaaacctggggaaatgcaa

SEQ ID NO: 25643 - DNA, 22 bp, synthetic construct
  misc_feature 1..22: note = Synthetic Construct
  source 1..22: mol_type = other DNA
ctgccagttttgttgccctttt

SEQ ID NO: 25644 - DNA, 24 bp, synthetic construct
  misc_feature 1..24: note = Synthetic Construct
  source 1..24: mol_type = other DNA
caggtcaatggacggttaggtaca

SEQ ID NO: 25645 - DNA, 23 bp, synthetic construct
  misc_feature 1..23: note = Synthetic Construct
  source 1..23: mol_type = other DNA
caaaggcagagacttccctgatg

SEQ ID NO: 25646 - DNA, 23 bp, synthetic construct
  misc_feature 1..23: note = Synthetic Construct
  source 1..23: mol_type = other DNA
acctcctccttcccgattaaact

SEQ ID NO: 25647 - DNA, 20 bp, synthetic construct
  misc_feature 1..20: note = Synthetic Construct
  source 1..20: mol_type = other DNA
ggagaccgcagctccagtta

SEQ ID NO: 25648 - DNA, 20 bp, synthetic construct
  misc_feature 1..20: note = Synthetic Construct
  source 1..20: mol_type = other DNA
ggtctcgggaagccaacaat

SEQ ID NO: 25649 - DNA, 20 bp, synthetic construct
  misc_feature 1..20: note = Synthetic Construct
  source 1..20: mol_type = other DNA
aggccagcagccagaagttt

SEQ ID NO: 25650 - DNA, 24 bp, synthetic construct
  misc_feature 1..24: note = Synthetic Construct
  source 1..24: mol_type = other DNA
cccctagaaacagacccactaatc

SEQ ID NO: 25651 - DNA, 23 bp, synthetic construct
  misc_feature 1..23: note = Synthetic Construct
  source 1..23: mol_type = other DNA
tgacttccacggtacacatctga

SEQ ID NO: 25652 - DNA, 21 bp, synthetic construct
  misc_feature 1..21: note = Synthetic Construct
  source 1..21: mol_type = other DNA
accgctgcaaataggcactac

SEQ ID NO: 25653 - DNA, 23 bp, synthetic construct
  misc_feature 1..23: note = Synthetic Construct
  source 1..23: mol_type = other DNA
cctaggagaatggcactggctta

SEQ ID NO: 25654 - DNA, 24 bp, synthetic construct
  misc_feature 1..24: note = Synthetic Construct
  source 1..24: mol_type = other DNA
gtatggtagtcacgcaacacaaaa

SEQ ID NO: 25655 - DNA, 20 bp, synthetic construct
  misc_feature 1..20: note = Synthetic Construct
  source 1..20: mol_type = other DNA
acacggagggcatcgtgttg

SEQ ID NO: 25656 - DNA, 21 bp, synthetic construct
  misc_feature 1..21: note = Synthetic Construct
  source 1..21: mol_type = other DNA
ccctgctctccctgtcccata

SEQ ID NO: 25657 - DNA, 24 bp, synthetic construct
  misc_feature 1..24: note = Synthetic Construct
  source 1..24: mol_type = other DNA
gtgcaggtgacataccaagctgtt

SEQ ID NO: 25658 - DNA, 19 bp, synthetic construct
  misc_feature 1..19: note = Synthetic Construct
  source 1..19: mol_type = other DNA
gtgtggccccaagggtgtt

SEQ ID NO: 25659 - DNA, 20 bp, synthetic construct
  misc_feature 1..20: note = Synthetic Construct
  source 1..20: mol_type = other DNA
ctgctctgcccacacaaaca

SEQ ID NO: 25660 - DNA, 22 bp, synthetic construct
  misc_feature 1..22: note = Synthetic Construct
  source 1..22: mol_type = other DNA
caggaacctgaggcatggaatc

SEQ ID NO: 25661 - DNA, 20 bp, synthetic construct
  misc_feature 1..20: note = Synthetic Construct
  source 1..20: mol_type = other DNA
gtgcatggaagctgggcttt

SEQ ID NO: 25662 - DNA, 20 bp, synthetic construct
  misc_feature 1..20: note = Synthetic Construct
  source 1..20: mol_type = other DNA
cccaactgctccccttgctt

SEQ ID NO: 25663 - DNA, 22 bp, synthetic construct
  misc_feature 1..22: note = Synthetic Construct
  source 1..22: mol_type = other DNA
acctcttggtggaagtggacat

SEQ ID NO: 25664 - DNA, 20 bp, synthetic construct
  misc_feature 1..20: note = Synthetic Construct
  source 1..20: mol_type = other DNA
aggtgagagccagctggaaa

SEQ ID NO: 25665 - DNA, 25 bp, synthetic construct
  misc_feature 1..25: note = Synthetic Construct
  source 1..25: mol_type = other DNA
gactttgagatcgctgactgattct

SEQ ID NO: 25666 - DNA, 20 bp, synthetic construct
  misc_feature 1..20: note = Synthetic Construct
  source 1..20: mol_type = other DNA
ggcaaaaccctggctctact

SEQ ID NO: 25667 - DNA, 19 bp, synthetic construct
  misc_feature 1..19: note = Synthetic Construct
  source 1..19: mol_type = other DNA
agcccctgctcccaaggta

SEQ ID NO: 25668 - DNA, 23 bp, synthetic construct
  misc_feature 1..23: note = Synthetic Construct
  source 1..23: mol_type = other DNA
tgaagccactgaaggtagctttt

SEQ ID NO: 25669 - DNA, 20 bp, synthetic construct
  misc_feature 1..20: note = Synthetic Construct
  source 1..20: mol_type = other DNA
tcaggtgccagctccagaaa

SEQ ID NO: 25670 - DNA, 26 bp, synthetic construct
  misc_feature 1..26: note = Synthetic Construct
  source 1..26: mol_type = other DNA
tcttgggatcctgaactgtcttaatc

SEQ ID NO: 25671 - DNA, 27 bp, synthetic construct
  misc_feature 1..27: note = Synthetic Construct
  source 1..27: mol_type = other DNA
cagtatcctcaccttggtctagacttt

SEQ ID NO: 25672 - DNA, 24 bp, synthetic construct
  misc_feature 1..24: note = Synthetic Construct
  source 1..24: mol_type = other DNA
ccaaattgacccactaggtgttgt

SEQ ID NO: 25673 - DNA, 22 bp, synthetic construct
  misc_feature 1..22: note = Synthetic Construct
  source 1..22: mol_type = other DNA
tccactggaagtggcagaaaat

SEQ ID NO: 25674 - DNA, 20 bp, synthetic construct
  misc_feature 1..20: note = Synthetic Construct
  source 1..20: mol_type = other DNA
agggccaggtaggccctcat

SEQ ID NO: 25675 - DNA, 20 bp, synthetic construct
  misc_feature 1..20: note = Synthetic Construct
  source 1..20: mol_type = other DNA
ggcagatagcctgccccaaa

SEQ ID NO: 25676 - DNA, 27 bp, synthetic construct
  misc_feature 1..27: note = Synthetic Construct
  source 1..27: mol_type = other DNA
cattttactggggaagaaatggagact

SEQ ID NO: 25677 - DNA, 22 bp, synthetic construct
  misc_feature 1..22: note = Synthetic Construct
  source 1..22: mol_type = other DNA
cccaatgcctggctcctaattc

SEQ ID NO: 25678 - DNA, 22 bp, synthetic construct
  misc_feature 1..22: note = Synthetic Construct
  source 1..22: mol_type = other DNA
tacagcgactgctgccaggtat

SEQ ID NO: 25679 - DNA, 24 bp, synthetic construct
  misc_feature 1..24: note = Synthetic Construct
  source 1..24: mol_type = other DNA
gctggacagtgttgaaagccatag

SEQ ID NO: 25680 - DNA, 21 bp, synthetic construct
  misc_feature 1..21: note = Synthetic Construct
  source 1..21: mol_type = other DNA
acctcctcctgccacaggatt

SEQ ID NO: 25681 - DNA, 24 bp, synthetic construct
  misc_feature 1..24: note = Synthetic Construct
  source 1..24: mol_type = other DNA
cagggaaagtgacacactccagaa

SEQ ID NO: 25682 - DNA, 24 bp, synthetic construct
  misc_feature 1..24: note = Synthetic Construct
  source 1..24: mol_type = other DNA
gctgggattgccttcttgttttca

SEQ ID NO: 25683 - DNA, 26 bp, synthetic construct
  misc_feature 1..26: note = Synthetic Construct
  source 1..26: mol_type = other DNA
cgatagacagatccccactttacatc

SEQ ID NO: 25684 - DNA, 25 bp, synthetic construct
  misc_feature 1..25: note = Synthetic Construct
  source 1..25: mol_type = other DNA
gcagaaactgtcagactcctacttc

SEQ ID NO: 25685 - DNA, 22 bp, synthetic construct
  misc_feature 1..22: note = Synthetic Construct
  source 1..22: mol_type = other DNA
gtgttgcaaaccaacccacaga

SEQ ID NO: 25686 - DNA, 20 bp, synthetic construct
  misc_feature 1..20: note = Synthetic Construct
  source 1..20: mol_type = other DNA
gcctgggctagacacacact

SEQ ID NO: 25687 - DNA, 20 bp, synthetic construct
  misc_feature 1..20: note = Synthetic Construct
  source 1..20: mol_type = other DNA
gctggctgctgttactgaga

SEQ ID NO: 25688 - DNA, 24 bp, synthetic construct
  misc_feature 1..24: note = Synthetic Construct
  source 1..24: mol_type = other DNA
tcatagggctttgcattcagtgat

SEQ ID NO: 25689 - DNA, 22 bp, synthetic construct
  misc_feature 1..22: note = Synthetic Construct
  source 1..22: mol_type = other DNA
cacaggggtcacacttcgatct

SEQ ID NO: 25690 - DNA, 22 bp, synthetic construct
  misc_feature 1..22: note = Synthetic Construct
  source 1..22: mol_type = other DNA
ccctctgtctcagcgtttccta

SEQ ID NO: 25691 - DNA, 22 bp, synthetic construct
  misc_feature 1..22: note = Synthetic Construct
  source 1..22: mol_type = other DNA
ggttgggttccttgctctctct

SEQ ID NO: 25692 - DNA, 23 bp, synthetic construct
  misc_feature 1..23: note = Synthetic Construct
  source 1..23: mol_type = other DNA
gatgttaggttgggttgcagaca

SEQ ID NO: 25693 - DNA, 20 bp, synthetic construct
  misc_feature 1..20: note = Synthetic Construct
  source 1..20: mol_type = other DNA
agtgccctttgaggcaggat

SEQ ID NO: 25694 - DNA, 20 bp, synthetic construct
  misc_feature 1..20: note = Synthetic Construct
  source 1..20: mol_type = other DNA
agccccacatcctgcgtaag

SEQ ID NO: 25695 - DNA, 20 bp, synthetic construct
  misc_feature 1..20: note = Synthetic Construct
  source 1..20: mol_type = other DNA
ttccgcaccacgtccacaac

SEQ ID NO: 25696 - DNA, 18 bp, synthetic construct
  misc_feature 1..18: note = Synthetic Construct
  source 1..18: mol_type = other DNA
tccgacaggacgcacaca

SEQ ID NO: 25697 - DNA, 20 bp, synthetic construct
  misc_feature 1..20: note = Synthetic Construct
  source 1..20: mol_type = other DNA
ccggagagcagggtgtgatg

SEQ ID NO: 25698 - DNA, 21 bp, synthetic construct
  misc_feature 1..21: note = Synthetic Construct
  source 1..21: mol_type = other DNA
tggagggcctctggtcacttc

SEQ ID NO: 25699 - DNA, 24 bp, synthetic construct
  misc_feature 1..24: note = Synthetic Construct
  source 1..24: mol_type = other DNA
gcagagattagtgccaccatcaag

SEQ ID NO: 25700 - DNA, 22 bp, synthetic construct
  misc_feature 1..22: note = Synthetic Construct
  source 1..22: mol_type = other DNA
agtgactgtgcattgtgggaaa

SEQ ID NO: 25701 - DNA, 25 bp, synthetic construct
  misc_feature 1..25: note = Synthetic Construct
  source 1..25: mol_type = other DNA
caaatccagaccaattgagcaaaga

SEQ ID NO: 25702 - DNA, 26 bp, synthetic construct
  misc_feature 1..26: note = Synthetic Construct
  source 1..26: mol_type = other DNA
gggaggaaggagggaaagagattttg

SEQ ID NO: 25703 - DNA, 22 bp, synthetic construct
  misc_feature 1..22: note = Synthetic Construct
  source 1..22: mol_type = other DNA
gcatagctgggcctatttctct

SEQ ID NO: 25704 - DNA, 22 bp, synthetic construct
  misc_feature 1..22: note = Synthetic Construct
  source 1..22: mol_type = other DNA
gcgggatggagtgagagtgttt

SEQ ID NO: 25705 - DNA, 19 bp, synthetic construct
  misc_feature 1..19: note = Synthetic Construct
  source 1..19: mol_type = other DNA
ggcacagcagctccagaat

SEQ ID NO: 25706 - DNA, 20 bp, synthetic construct
  misc_feature 1..20: note = Synthetic Construct
  source 1..20: mol_type = other DNA
ttcccaccgccgacttccaa

SEQ ID NO: 25707 - DNA, 22 bp, synthetic construct
  misc_feature 1..22: note = Synthetic Construct
  source 1..22: mol_type = other DNA
ccaagtagcagggctggctaaa

SEQ ID NO: 25708 - DNA, 20 bp, synthetic construct
  misc_feature 1..20: note = Synthetic Construct
  source 1..20: mol_type = other DNA
agcccaggctgactggtttg

SEQ ID NO: 25709 - DNA, 21 bp, synthetic construct
  misc_feature 1..21: note = Synthetic Construct
  source 1..21: mol_type = other DNA
aagctggggtggactccgtta

SEQ ID NO: 25710 - DNA, 18 bp, synthetic construct
  misc_feature 1..18: note = Synthetic Construct
  source 1..18: mol_type = other DNA
aggcaggctggctgcaaa

SEQ ID NO: 25711 - DNA, 22 bp, synthetic construct
  misc_feature 1..22: note = Synthetic Construct
  source 1..22: mol_type = other DNA
ggacagcaaccgttcagagact

SEQ ID NO: 25712 - DNA, 20 bp, synthetic construct
  misc_feature 1..20: note = Synthetic Construct
  source 1..20: mol_type = other DNA
tggtggtggctggcacagta

SEQ ID NO: 25713 - DNA, 21 bp, synthetic construct
  misc_feature 1..21: note = Synthetic Construct
  source 1..21: mol_type = other DNA
agccatcgtggggtctcttac

SEQ ID NO: 25714 - DNA, 22 bp, synthetic construct
  misc_feature 1..22: note = Synthetic Construct
  source 1..22: mol_type = other DNA
gtctttccatttgcctggcatt

SEQ ID NO: 25715 - DNA, 21 bp, synthetic construct
  misc_feature 1..21: note = Synthetic Construct
  source 1..21: mol_type = other DNA
agctccgcctcttaaccctaa

SEQ ID NO: 25716 - DNA, 20 bp, synthetic construct
  misc_feature 1..20: note = Synthetic Construct
  source 1..20: mol_type = other DNA
cagtggcattgcagggcttt

SEQ ID NO: 25717 - DNA, 21 bp, synthetic construct
  misc_feature 1..21: note = Synthetic Construct
  source 1..21: mol_type = other DNA
aggaaaaggccatcccaggaa

SEQ ID NO: 25718 - DNA, 20 bp, synthetic construct
  misc_feature 1..20: note = Synthetic Construct
  source 1..20: mol_type = other DNA
tggagggaagaggtgtgtgt

SEQ ID NO: 25719 - DNA, 18 bp, synthetic construct
  misc_feature 1..18: note = Synthetic Construct
  source 1..18: mol_type = other DNA
ggggccacagcaaagcat

SEQ ID NO: 25720 - DNA, 20 bp, synthetic construct
  misc_feature 1..20: note = Synthetic Construct
  source 1..20: mol_type = other DNA
accttcctgtgcacccacaa

SEQ ID NO: 25721 - DNA, 24 bp, synthetic construct
  misc_feature 1..24: note = Synthetic Construct
  source 1..24: mol_type = other DNA
cagagatgacctcagagccttttg

SEQ ID NO: 25722 - DNA, 20 bp, synthetic construct
  misc_feature 1..20: note = Synthetic Construct
  source 1..20: mol_type = other DNA
gcacaggcactgggctaaac

SEQ ID NO: 25723 - DNA, 18 bp, synthetic construct
  misc_feature 1..18: note = Synthetic Construct
  source 1..18: mol_type = other DNA
ttggtggcgcctcagatg

SEQ ID NO: 25724 - DNA, 19 bp, synthetic construct
  misc_feature 1..19: note = Synthetic Construct
  source 1..19: mol_type = other DNA
actgcctggctcagtgaca

SEQ ID NO: 25725 - DNA, 26 bp, synthetic construct
  misc_feature 1..26: note = Synthetic Construct
  source 1..26: mol_type = other DNA
gggagggcagcaataataacctctga

SEQ ID NO: 25726 - DNA, 25 bp, synthetic construct
  misc_feature 1..25: note = Synthetic Construct
  source 1..25: mol_type = other DNA
cagatccacaaacctagggagtgtt

SEQ ID NO: 25727 - DNA, 23 bp, synthetic construct
  misc_feature 1..23: note = Synthetic Construct
  source 1..23: mol_type = other DNA
agggtgtatgtgtgtctgacaag

SEQ ID NO: 25728 - DNA, 22 bp, synthetic construct
  misc_feature 1..22: note = Synthetic Construct
  source 1..22: mol_type = other DNA
cactgggtaggggagcgatact

SEQ ID NO: 25729 - DNA, 24 bp, synthetic construct
  misc_feature 1..24: note = Synthetic Construct
  source 1..24: mol_type = other DNA
gactatgaaaatctgccgctggat

SEQ ID NO: 25730 - DNA, 21 bp, synthetic construct
  misc_feature 1..21: note = Synthetic Construct
  source 1..21: mol_type = other DNA
tggactgaccacgtgcaggat

SEQ ID NO: 25731 - DNA, 20 bp, synthetic construct
  misc_feature 1..20: note = Synthetic Construct
  source 1..20: mol_type = other DNA
tcctctgcgccccatctgaa

SEQ ID NO: 25732 - DNA, 20 bp, synthetic construct
  misc_feature 1..20: note = Synthetic Construct
  source 1..20: mol_type = other DNA
ctcggggaaccatgggctaa

SEQ ID NO: 25733 - DNA, 23 bp, synthetic construct
  misc_feature 1..23: note = Synthetic Construct
  source 1..23: mol_type = other DNA
tttgccctgagaactgagagttt

SEQ ID NO: 25734 - DNA, 23 bp, synthetic construct
  misc_feature 1..23: note = Synthetic Construct
  source 1..23: mol_type = other DNA
cccggaagcagcacatgagataa

SEQ ID NO: 25735 - DNA, 22 bp, synthetic construct
  misc_feature 1..22: note = Synthetic Construct
  source 1..22: mol_type = other DNA
ctgcctgagggtagctttggta

SEQ ID NO: 25736 - DNA, 23 bp, synthetic construct
  misc_feature 1..23: note = Synthetic Construct
  source 1..23: mol_type = other DNA
catgtcctagcacaggtctctct

SEQ ID NO: 25737 - DNA, 20 bp, synthetic construct
  misc_feature 1..20: note = Synthetic Construct
  source 1..20: mol_type = other DNA
agtgccgagacctggaagtt

SEQ ID NO: 25738 - DNA, 19 bp, synthetic construct
  misc_feature 1..19: note = Synthetic Construct
  source 1..19: mol_type = other DNA
cggacggctcgggtacttt

SEQ ID NO: 25739 - DNA, 20 bp, synthetic construct
  misc_feature 1..20: note = Synthetic Construct
  source 1..20: mol_type = other DNA
ggggctcccaggagacatca

SEQ ID NO: 25740 - DNA, 25 bp, synthetic construct
  misc_feature 1..25: note = Synthetic Construct
  source 1..25: mol_type = other DNA
tgtctgaagtttcctacccatttgt

SEQ ID NO: 25741 - DNA, 22 bp, synthetic construct
  misc_feature 1..22: note = Synthetic Construct
  source 1..22: mol_type = other DNA
agtgagtcacaccgacttctga

SEQ ID NO: 25742 - DNA, 19 bp, synthetic construct
  misc_feature 1..19: note = Synthetic Construct
  source 1..19: mol_type = other DNA
gcacggccgagctcattca

SEQ ID NO: 25743 - DNA, 20 bp, synthetic construct
  misc_feature 1..20: note = Synthetic Construct
  source 1..20: mol_type = other DNA
actcccggctggtgctcaca

SEQ ID NO: 25744 - DNA, 23 bp, synthetic construct
  misc_feature 1..23: note = Synthetic Construct
  source 1..23: mol_type = other DNA
tcacccagctaggaaggattttg

SEQ ID NO: 25745 - DNA, 21 bp, synthetic construct
  misc_feature 1..21: note = Synthetic Construct
  source 1..21: mol_type = other DNA
gggtttctccaggcggtaaag

SEQ ID NO: 25746 - DNA, 21 bp, synthetic construct
  misc_feature 1..21: note = Synthetic Construct
  source 1..21: mol_type = other DNA
ggcgagttccactcatagcaa

SEQ ID NO: 25747 - DNA, 20 bp, synthetic construct
  misc_feature 1..20: note = Synthetic Construct
  source 1..20: mol_type = other DNA
cgctggccttgtgctttaga

SEQ ID NO: 25748 - DNA, 20 bp, synthetic construct
  misc_feature 1..20: note = Synthetic Construct
  source 1..20: mol_type = other DNA
ttgggctgtgcgcattcact

SEQ ID NO: 25749 - DNA, 20 bp, synthetic construct
  misc_feature 1..20: note = Synthetic Construct
  source 1..20: mol_type = other DNA
ggtgcccatggcatgactgt

SEQ ID NO: 25750 - DNA, 18 bp, synthetic construct
  misc_feature 1..18: note = Synthetic Construct
  source 1..18: mol_type = other DNA
ggtgggtgtgtgcgtgta

SEQ ID NO: 25751 - DNA, 24 bp, synthetic construct
  misc_feature 1..24: note = Synthetic Construct
  source 1..24: mol_type = other DNA
ggcagattctatccccatgtcact

SEQ ID NO: 25752 - DNA, 24 bp, synthetic construct
  misc_feature 1..24: note = Synthetic Construct
  source 1..24: mol_type = other DNA
cagccactgttatgtcagcaggaa

SEQ ID NO: 25753 - DNA, 19 bp, synthetic construct
  misc_feature 1..19: note = Synthetic Construct
  source 1..19: mol_type = other DNA
aaggctgtgcgctggtttg

SEQ ID NO: 25754 - DNA, 18 bp, synthetic construct
  misc_feature 1..18: note = Synthetic Construct
  source 1..18: mol_type = other DNA
tgcaccgggcacaaatga

SEQ ID NO: 25755 - DNA, 23 bp, synthetic construct
  misc_feature 1..23: note = Synthetic Construct
  source 1..23: mol_type = other DNA
gtcagttctgcttcacgggtttc

SEQ ID NO: 25756 - DNA, 24 bp, synthetic construct
  misc_feature 1..24: note = Synthetic Construct
  source 1..24: mol_type = other DNA
agatgacatcaaggtggctagttc

SEQ ID NO: 25757 - DNA, 23 bp, synthetic construct
  misc_feature 1..23: note = Synthetic Construct
  source 1..23: mol_type = other DNA
cggacagcatagacctgttgagt

SEQ ID NO: 25758 - DNA, 23 bp, synthetic construct
  misc_feature 1..23: note = Synthetic Construct
  source 1..23: mol_type = other DNA
aatgggaccagagggtctaagaa

SEQ ID NO: 25759 - DNA, 25 bp, synthetic construct
  misc_feature 1..25: note = Synthetic Construct
  source 1..25: mol_type = other DNA
cgggtaagaactgggtgaagataag

SEQ ID NO: 25760 - DNA, 22 bp, synthetic construct
  misc_feature 1..22: note = Synthetic Construct
  source 1..22: mol_type = other DNA
ccagtgcctacagtcccagcta

SEQ ID NO: 25761 - DNA, 21 bp, synthetic construct
  misc_feature 1..21: note = Synthetic Construct
  source 1..21: mol_type = other DNA
tcgggaagtagcaggaactga

SEQ ID NO: 25762 - DNA, 20 bp, synthetic construct
  misc_feature 1..20: note = Synthetic Construct
  source 1..20: mol_type = other DNA
cactgtgaggggagcgtaca

SEQ ID NO: 25763 - DNA, 22 bp, synthetic construct
  misc_feature 1..22: note = Synthetic Construct
  source 1..22: mol_type = other DNA
tctctgaggtgggtgctggaaa

SEQ ID NO: 25764 - DNA, 25 bp, synthetic construct
  misc_feature 1..25: note = Synthetic Construct
  source 1..25: mol_type = other DNA
ggaggactctatgcatctggggtta

SEQ ID NO: 25765 - DNA, 20 bp, synthetic construct
  misc_feature 1..20: note = Synthetic Construct
  source 1..20: mol_type = other DNA
tgaaagccctggcccaatga

SEQ ID NO: 25766 - DNA, 25 bp, synthetic construct
  misc_feature 1..25: note = Synthetic Construct
  source 1..25: mol_type = other DNA
aacccatctcagcttccttgttaat

SEQ ID NO: 25767 - DNA, 22 bp, synthetic construct
  misc_feature 1..22: note = Synthetic Construct
  source 1..22: mol_type = other DNA
ggcacatccgcaatcagtgcat

SEQ ID NO: 25768 - DNA, 18 bp, synthetic construct
  misc_feature 1..18: note = Synthetic Construct
  source 1..18: mol_type = other DNA
agtgcctgcctggcgaat

SEQ ID NO: 25769 - DNA, 26 bp, synthetic construct
  misc_feature 1..26: note = Synthetic Construct
  source 1..26: mol_type = other DNA
gaagggtgtaggtaaaagcctagttg

SEQ ID NO: 25770 - DNA, 19 bp, synthetic construct
  misc_feature 1..19: note = Synthetic Construct
  source 1..19: mol_type = other DNA
tgcagcaggaagtggcaaa

SEQ ID NO: 25771 - DNA, 23 bp, synthetic construct
  misc_feature 1..23: note = Synthetic Construct
  source 1..23: mol_type = other DNA
agtgcttcacatcgaggaagatg

SEQ ID NO: 25772 - DNA, 19 bp, synthetic construct
  misc_feature 1..19: note = Synthetic Construct
  source 1..19: mol_type = other DNA
aggggaagctgccgagttc

SEQ ID NO: 25773 - DNA, 22 bp, synthetic construct
  misc_feature 1..22: note = Synthetic Construct
  source 1..22: mol_type = other DNA
ccagggaaccccagaatcatca

SEQ ID NO: 25774 - DNA, 25 bp, synthetic construct
  misc_feature 1..25: note = Synthetic Construct
  source 1..25: mol_type = other DNA
tgcaaagacaaaggtaagtgtgttg

SEQ ID NO: 25775 - DNA, 23 bp, synthetic construct
  misc_feature 1..23: note = Synthetic Construct
  source 1..23: mol_type = other DNA
gggtgtgtgcactctacgtttct

SEQ ID NO: 25776 - DNA, 19 bp, synthetic construct
  misc_feature 1..19: note = Synthetic Construct
  source 1..19: mol_type = other DNA
tgggcggtgacctggcttt

SEQ ID NO: 25777 - DNA, 21 bp, synthetic construct
  misc_feature 1..21: note = Synthetic Construct
  source 1..21: mol_type = other DNA
tgcctggagagctgctgtcat

SEQ ID NO: 25778 - DNA, 20 bp, synthetic construct
  misc_feature 1..20: note = Synthetic Construct
  source 1..20: mol_type = other DNA
caggccctgtgggtctgttg

SEQ ID NO: 25779 - DNA, 19 bp, synthetic construct
  misc_feature 1..19: note = Synthetic Construct
  source 1..19: mol_type = other DNA
tgccgtggtgtggggatct

SEQ ID NO: 25780 - DNA, 23 bp, synthetic construct
  misc_feature 1..23: note = Synthetic Construct
  source 1..23: mol_type = other DNA
tttccccatcacactttcgttct

SEQ ID NO: 25781 - DNA, 23 bp, synthetic construct
  misc_feature 1..23: note = Synthetic Construct
  source 1..23: mol_type = other DNA
ggctgtgggacttgttacagtga

SEQ ID NO: 25782 - DNA, 21 bp, synthetic construct
  misc_feature 1..21: note = Synthetic Construct
  source 1..21: mol_type = other DNA
gcttgccagctccacatccaa

SEQ ID NO: 25783 - DNA, 19 bp, synthetic construct
  misc_feature 1..19: note = Synthetic Construct
  source 1..19: mol_type = other DNA
tccgcccacaggcctcttt

SEQ ID NO: 25784 - DNA, 21 bp, synthetic construct
  misc_feature 1..21: note = Synthetic Construct
  source 1..21: mol_type = other DNA
gccgggcagagagtagaggat

SEQ ID NO: 25785 - DNA, 22 bp, synthetic construct
  misc_feature 1..22: note = Synthetic Construct
  source 1..22: mol_type = other DNA
gggagctgcagagacgagtttt

SEQ ID NO: 25786 - DNA, 23 bp, synthetic construct
  misc_feature 1..23: note = Synthetic Construct
  source 1..23: mol_type = other DNA
ggcatcgtaaaggctgccagtag

SEQ ID NO: 25787 - DNA, 20 bp, synthetic construct
  misc_feature 1..20: note = Synthetic Construct
  source 1..20: mol_type = other DNA
actggcacagctggtagact

SEQ ID NO: 25788 - DNA, 24 bp, synthetic construct
  misc_feature 1..24: note = Synthetic Construct
  source 1..24: mol_type = other DNA
ccctcaacccgtttccttaagtgt

SEQ ID NO: 25789 - DNA, 20 bp, synthetic construct
  misc_feature 1..20: note = Synthetic Construct
  source 1..20: mol_type = other DNA
taggagcatggacgcaggaa

SEQ ID NO: 25790 - DNA, 20 bp, synthetic construct
  misc_feature 1..20: note = Synthetic Construct
  source 1..20: mol_type = other DNA
ggctgaagggtccccacaaa

SEQ ID NO: 25791 - DNA, 20 bp, synthetic construct
  misc_feature 1..20: note = Synthetic Construct
  source 1..20: mol_type = other DNA
tgccaccatcttgcccttgt

SEQ ID NO: 25792 - DNA, 21 bp, synthetic construct
  misc_feature 1..21: note = Synthetic Construct
  source 1..21: mol_type = other DNA
gttgggcgaactgtactccat

SEQ ID NO: 25793 - DNA, 20 bp, synthetic construct
  misc_feature 1..20: note = Synthetic Construct
  source 1..20: mol_type = other DNA
ctgccacaacagggacaaga

SEQ ID NO: 25794 - DNA, 22 bp, synthetic construct
  misc_feature 1..22: note = Synthetic Construct
  source 1..22: mol_type = other DNA
agtaaaacaggcaggcaacaga

SEQ ID NO: 25795 - DNA, 25 bp, synthetic construct
  misc_feature 1..25: note = Synthetic Construct
  source 1..25: mol_type = other DNA
gttgagcccttgttatgtgtgtaga

SEQ ID NO: 25796 - DNA, 21 bp, synthetic construct
  misc_feature 1..21: note = Synthetic Construct
  source 1..21: mol_type = other DNA
agggtaggcagaggtgcttca

SEQ ID NO: 25797 - DNA, 18 bp, synthetic construct
  misc_feature 1..18: note = Synthetic Construct
  source 1..18: mol_type = other DNA
cgtgtgaccaggctgcaa

SEQ ID NO: 25798 - DNA, 20 bp, synthetic construct
  misc_feature 1..20: note = Synthetic Construct
  source 1..20: mol_type = other DNA
gggatgacgtcggtcaccat

SEQ ID NO: 25799 - DNA, 22 bp, synthetic construct
  misc_feature 1..22: note = Synthetic Construct
  source 1..22: mol_type = other DNA
gcaccacatggcagtggaacat

SEQ ID NO: 25800 - DNA, 20 bp, synthetic construct
  misc_feature 1..20: note = Synthetic Construct
  source 1..20: mol_type = other DNA
ccgtggcacccttgaagaga

SEQ ID NO: 25801 - DNA, 18 bp, synthetic construct
  misc_feature 1..18: note = Synthetic Construct
  source 1..18: mol_type = other DNA
tggcactggcaggcatca

SEQ ID NO: 25802 - DNA, 20 bp, synthetic construct
  misc_feature 1..20: note = Synthetic Construct
  source 1..20: mol_type = other DNA
aggggacgtgggctcagaca

SEQ ID NO: 25803 - DNA, 24 bp, synthetic construct
  misc_feature 1..24: note = Synthetic Construct
  source 1..24: mol_type = other DNA
caccaagtcctgcttgtgttttag

SEQ ID NO: 25804 - DNA, 19 bp, synthetic construct
  misc_feature 1..19: note = Synthetic Construct
  source 1..19: mol_type = other DNA
cgccatccctgctcagctt

SEQ ID NO: 25805 - DNA, 19 bp, synthetic construct
  misc_feature 1..19: note = Synthetic Construct
  source 1..19: mol_type = other DNA
tccgggcctgacctcatca

SEQ ID NO: 25806 - DNA, 19 bp, synthetic construct
  misc_feature 1..19: note = Synthetic Construct
  source 1..19: mol_type = other DNA
ggagtctggccccagcttt

SEQ ID NO: 25807 - DNA, 22 bp, synthetic construct
  misc_feature 1..22: note = Synthetic Construct
  source 1..22: mol_type = other DNA
ggctctgccttcacatttctgt

SEQ ID NO: 25808 - DNA, 22 bp, synthetic construct
  misc_feature 1..22: note = Synthetic Construct
  source 1..22: mol_type = other DNA
gtggagcaacatcccagccata

SEQ ID NO: 25809 - DNA, 19 bp, synthetic construct
  misc_feature 1..19: note = Synthetic Construct
  source 1..19: mol_type = other DNA
tccacccggccagagacaa

SEQ ID NO: 25810 - DNA, 21 bp, synthetic construct
  misc_feature 1..21: note = Synthetic Construct
  source 1..21: mol_type = other DNA
tgggccctgtggtcttagtga

SEQ ID NO: 25811 - DNA, 21 bp, synthetic construct
  misc_feature 1..21: note = Synthetic Construct
  source 1..21: mol_type = other DNA
ggcccctttgcctcttaggat

SEQ ID NO: 25812 - DNA, 20 bp, synthetic construct
  misc_feature 1..20: note = Synthetic Construct
  source 1..20: mol_type = other DNA
tggatggcccactgcaggat

SEQ ID NO: 25813 - DNA, 20 bp, synthetic construct
  misc_feature 1..20: note = Synthetic Construct
  source 1..20: mol_type = other DNA
tggtgggcgaggagcttgta

SEQ ID NO: 25814 - DNA, 19 bp, synthetic construct
  misc_feature 1..19: note = Synthetic Construct
  source 1..19: mol_type = other DNA
aggagccccgtacctccat

SEQ ID NO: 25815 - DNA, 20 bp, synthetic construct
  misc_feature 1..20: note = Synthetic Construct
  source 1..20: mol_type = other DNA
agctcagtgacggggctgaa

SEQ ID NO: 25816 - DNA, 20 bp, synthetic construct
  misc_feature 1..20: note = Synthetic Construct
  source 1..20: mol_type = other DNA
gccagagaacgtctcagctt

SEQ ID NO: 25817 - DNA, 20 bp, synthetic construct
  misc_feature 1..20: note = Synthetic Construct
  source 1..20: mol_type = other DNA
cgtcctgccggggaaaacta

SEQ ID NO: 25818 - DNA, 20 bp, synthetic construct
  misc_feature 1..20: note = Synthetic Construct
  source 1..20: mol_type = other DNA
tgtggtgaggtgggagtcaa

SEQ ID NO: 25819 - DNA, 20 bp, synthetic construct
  misc_feature 1..20: note = Synthetic Construct
  source 1..20: mol_type = other DNA
tggacacacaacacccaaca

SEQ ID NO: 25820 - DNA, 23 bp, synthetic construct
  misc_feature 1..23: note = Synthetic Construct
  source 1..23: mol_type = other DNA
gggtaggcattgttccacactct

SEQ ID NO: 25821 - DNA, 23 bp, synthetic construct
  misc_feature 1..23: note = Synthetic Construct
  source 1..23: mol_type = other DNA
ggtcaagtcatcaggtggagtca

SEQ ID NO: 25822 - DNA, 25 bp, synthetic construct
  misc_feature 1..25: note = Synthetic Construct
  source 1..25: mol_type = other DNA
ggaaaacgtatcacctttcccagat

SEQ ID NO: 25823 - DNA, 23 bp, synthetic construct
  misc_feature 1..23: note = Synthetic Construct
  source 1..23: mol_type = other DNA
agtaggctttgcagaagtgaagt

SEQ ID NO: 25824 - DNA, 22 bp, synthetic construct
  misc_feature 1..22: note = Synthetic Construct
  source 1..22: mol_type = other DNA
cacggctcacttgttgactttg

SEQ ID NO: 25825 - DNA, 24 bp, synthetic construct
  misc_feature 1..24: note = Synthetic Construct
  source 1..24: mol_type = other DNA
tgccttggatgatgagttgagaag

SEQ ID NO: 25826 - DNA, 20 bp, synthetic construct
  misc_feature 1..20: note = Synthetic Construct
  source 1..20: mol_type = other DNA
gcctgtttgcgcaggtctga

SEQ ID NO: 25827 - DNA, 22 bp, synthetic construct
  misc_feature 1..22: note = Synthetic Construct
  source 1..22: mol_type = other DNA
gacgtccctgcattcccaatct

SEQ ID NO: 25828 - DNA, 19 bp, synthetic construct
  misc_feature 1..19: note = Synthetic Construct
  source 1..19: mol_type = other DNA
acccacccagcgacaggtt

SEQ ID NO: 25829 - DNA, 24 bp, synthetic construct
  misc_feature 1..24: note = Synthetic Construct
  source 1..24: mol_type = other DNA
gactgatgagtctgggttcacatc

SEQ ID NO: 25830 - DNA, 20 bp, synthetic construct
  misc_feature 1..20: note = Synthetic Construct
  source 1..20: mol_type = other DNA
ggctgccaaccaccactaga

SEQ ID NO: 25831 - DNA, 23 bp, synthetic construct
  misc_feature 1..23: note = Synthetic Construct
  source 1..23: mol_type = other DNA
cacctctcaacactggtctttct

SEQ ID NO: 25832 - DNA, 21 bp, synthetic construct
  misc_feature 1..21: note = Synthetic Construct
  source 1..21: mol_type = other DNA
agagatctgggccagccaaag

SEQ ID NO: 25833 - DNA, 20 bp, synthetic construct
  misc_feature 1..20: note = Synthetic Construct
  source 1..20: mol_type = other DNA
taggcactgcagccctttca

SEQ ID NO: 25834 - DNA, 19 bp, synthetic construct
  misc_feature 1..19: note = Synthetic Construct
  source 1..19: mol_type = other DNA
ttgccacgcaaggctactt

SEQ ID NO: 25835 - DNA, 20 bp, synthetic construct
  misc_feature 1..20: note = Synthetic Construct
  source 1..20: mol_type = other DNA
atggctggctgcccaggtaa

SEQ ID NO: 25836 - DNA, 23 bp, synthetic construct
  misc_feature 1..23: note = Synthetic Construct
  source 1..23: mol_type = other DNA
ctctgctggtaggggtgattgat

SEQ ID NO: 25837 - DNA, 25 bp, synthetic construct
  misc_feature 1..25: note = Synthetic Construct
  source 1..25: mol_type = other DNA
ggttgtcaaatcccaagtccagtct

SEQ ID NO: 25838 - DNA, 26 bp, synthetic construct
  misc_feature 1..26: note = Synthetic Construct
  source 1..26: mol_type = other DNA
gcctttcaaatccagtggtgacaaac

SEQ ID NO: 25839 - DNA, 22 bp, synthetic construct
  misc_feature 1..22: note = Synthetic Construct
  source 1..22: mol_type = other DNA
ggacccagcctacatcacattc

SEQ ID NO: 25840 - DNA, 20 bp, synthetic construct
  misc_feature 1..20: note = Synthetic Construct
  source 1..20: mol_type = other DNA
ttggggacactgtggagcaa

SEQ ID NO: 25841 - DNA, 23 bp, synthetic construct
  misc_feature 1..23: note = Synthetic Construct
  source 1..23: mol_type = other DNA
cctacacaaggagggaagagtga

SEQ ID NO: 25842 - DNA, 24 bp, synthetic construct
  misc_feature 1..24: note = Synthetic Construct
  source 1..24: mol_type = other DNA
gaattcccaggttgaggaaaccta

SEQ ID NO: 25843 - DNA, 19 bp, synthetic construct
  misc_feature 1..19: note = Synthetic Construct
  source 1..19: mol_type = other DNA
aagccccagcccactggat

SEQ ID NO: 25844 - DNA, 22 bp, synthetic construct
  misc_feature 1..22: note = Synthetic Construct
  source 1..22: mol_type = other DNA
gtctacagcacctttccacaca

SEQ ID NO: 25845 - DNA, 21 bp, synthetic construct
  misc_feature 1..21: note = Synthetic Construct
  source 1..21: mol_type = other DNA
tccacccaaggtgccttctta

SEQ ID NO: 25846 - DNA, 20 bp, synthetic construct
  misc_feature 1..20: note = Synthetic Construct
  source 1..20: mol_type = other DNA
gccttcacagccaacactga

SEQ ID NO: 25847 - DNA, 22 bp, synthetic construct
  misc_feature 1..22: note = Synthetic Construct
  source 1..22: mol_type = other DNA
tcctgctaatctggctttcgtt

SEQ ID NO: 25848 - DNA, 24 bp, synthetic construct
  misc_feature 1..24: note = Synthetic Construct
  source 1..24: mol_type = other DNA
cccacaggaactgtccatccaatc

SEQ ID NO: 25849 - DNA, 22 bp, synthetic construct
  misc_feature 1..22: note = Synthetic Construct
  source 1..22: mol_type = other DNA
cctgtccccaggacattgaagt

SEQ ID NO: 25850 - DNA, 22 bp, synthetic construct
  misc_feature 1..22: note = Synthetic Construct
  source 1..22: mol_type = other DNA
cccaaagaaagcccgtgtggtt

SEQ ID NO: 25851 - DNA, 24 bp, synthetic construct
  misc_feature 1..24: note = Synthetic Construct
  source 1..24: mol_type = other DNA
ccaccaccagatgggaaaggtact

SEQ ID NO: 25852 - DNA, 21 bp, synthetic construct
  misc_feature 1..21: note = Synthetic Construct
  source 1..21: mol_type = other DNA
atgtcccctaggcaggcagat

SEQ ID NO: 25853 - DNA, 20 bp, synthetic construct
  misc_feature 1..20: note = Synthetic Construct
  source 1..20: mol_type = other DNA
ctctgcccctggacactgaa

SEQ ID NO: 25854 - DNA, 19 bp, synthetic construct
  misc_feature 1..19: note = Synthetic Construct
  source 1..19: mol_type = other DNA
tttcccacggctgctcact

SEQ ID NO: 25855 - DNA, 26 bp, synthetic construct
  misc_feature 1..26: note = Synthetic Construct
  source 1..26: mol_type = other DNA
cagtacagaaagtcctgtgggaacta

SEQ ID NO: 25856 - DNA, 22 bp, synthetic construct
  misc_feature 1..22: note = Synthetic Construct
  source 1..22: mol_type = other DNA
cagggctcgtagccttgttcta

SEQ ID NO: 25857 - DNA, 23 bp, synthetic construct
  misc_feature 1..23: note = Synthetic Construct
  source 1..23: mol_type = other DNA
agggcagattgctgactttttga

SEQ ID NO: 25858 - DNA, 19 bp, synthetic construct
  misc_feature 1..19: note = Synthetic Construct
  source 1..19: mol_type = other DNA
gctccacactgccgcaaca

SEQ ID NO: 25859 - DNA, 19 bp, synthetic construct
  misc_feature 1..19: note = Synthetic Construct
  source 1..19: mol_type = other DNA
acagccacccttggcaaac

SEQ ID NO: 25860 - DNA, 23 bp, synthetic construct
  misc_feature 1..23: note = Synthetic Construct
  source 1..23: mol_type = other DNA
acaacattgacggctttggtatg

SEQ ID NO: 25861 - DNA, 22 bp, synthetic construct
  misc_feature 1..22: note = Synthetic Construct
  source 1..22: mol_type = other DNA
gccatggtccctcccaagttac

SEQ ID NO: 25862 - DNA, 20 bp, synthetic construct
  misc_feature 1..20: note = Synthetic Construct
  source 1..20: mol_type = other DNA
agactgaccagcccggaaaa

SEQ ID NO: 25863 - DNA, 22 bp, synthetic construct
  misc_feature 1..22: note = Synthetic Construct
  source 1..22: mol_type = other DNA
ccactgcacctggcctgttttt

SEQ ID NO: 25864 - DNA, 21 bp, synthetic construct
  misc_feature 1..21: note = Synthetic Construct
  source 1..21: mol_type = other DNA
gcctctggttcccctttctgt

SEQ ID NO: 25865 - DNA, 20 bp, synthetic construct
  misc_feature 1..20: note = Synthetic Construct
  source 1..20: mol_type = other DNA
ggaacacagccatgcccatt

SEQ ID NO: 25866 - DNA, 20 bp, synthetic construct
  misc_feature 1..20: note = Synthetic Construct
  source 1..20: mol_type = other DNA
gctgcccagcgttcaatatc

SEQ ID NO: 25867 - DNA, 24 bp, synthetic construct
  misc_feature 1..24: note = Synthetic Construct
  source 1..24: mol_type = other DNA
cggaaggcatagggtaagcactga

SEQ ID NO: 25868 - DNA, 22 bp, synthetic construct
  misc_feature 1..22: note = Synthetic Construct
  source 1..22: mol_type = other DNA
cagggatcaagctgtggcttag

SEQ ID NO: 25869 - DNA, 22 bp, synthetic construct
  misc_feature 1..22: note = Synthetic Construct
  source 1..22: mol_type = other DNA
agggaggcagtagtaggtttga

SEQ ID NO: 25870 - DNA, 20 bp, synthetic construct
  misc_feature 1..20: note = Synthetic Construct
  source 1..20: mol_type = other DNA
aagggctttccccgcttttg

SEQ ID NO: 25871 - DNA, 22 bp, synthetic construct
  misc_feature 1..22: note = Synthetic Construct
  source 1..22: mol_type = other DNA
tccccgctacccaggagtctaa

SEQ ID NO: 25872 - DNA, 24 bp, synthetic construct
  misc_feature 1..24: note = Synthetic Construct
  source 1..24: mol_type = other DNA
ggtaatttctgggctgacaaggtt

SEQ ID NO: 25873 - DNA, 22 bp, synthetic construct
  misc_feature 1..22: note = Synthetic Construct
  source 1..22: mol_type = other DNA
ccacagggcattgcaggtttac

SEQ ID NO: 25874 - DNA, 20 bp, synthetic construct
  misc_feature 1..20: note = Synthetic Construct
  source 1..20: mol_type = other DNA
cccctgcccagtttccaaat

SEQ ID NO: 25875 - DNA, 26 bp, synthetic construct
  misc_feature 1..26: note = Synthetic Construct
  source 1..26: mol_type = other DNA
gcaactttgactcacctcactgacaa

SEQ ID NO: 25876 - DNA, 25 bp, synthetic construct
  misc_feature 1..25: note = Synthetic Construct
  source 1..25: mol_type = other DNA
cgatgaggacacttcctctttctga

SEQ ID NO: 25877 - DNA, 20 bp, synthetic construct
  misc_feature 1..20: note = Synthetic Construct
  source 1..20: mol_type = other DNA
gggtcctgcagacaaacctt

SEQ ID NO: 25878 - DNA, 30 bp, synthetic construct
  misc_feature 1..30: note = Synthetic Construct
  source 1..30: mol_type = other DNA
ctcccaactgagatttgcgatataatcttc

SEQ ID NO: 25879 - DNA, 20 bp, synthetic construct
  misc_feature 1..20: note = Synthetic Construct
  source 1..20: mol_type = other DNA
cacctgtggtcccagcaact

SEQ ID NO: 25880 - DNA, 22 bp, synthetic construct
  misc_feature 1..22: note = Synthetic Construct
  source 1..22: mol_type = other DNA
ccacctccaggcctaagaaatc

SEQ ID NO: 25881 - DNA, 22 bp, synthetic construct
  misc_feature 1..22: note = Synthetic Construct
  source 1..22: mol_type = other DNA
acttcctccctggtcctgatgt

SEQ ID NO: 25882 - DNA, 22 bp, synthetic construct
  misc_feature 1..22: note = Synthetic Construct
  source 1..22: mol_type = other DNA
cacccatgctccttccatcaga

SEQ ID NO: 25883 - DNA, 24 bp, synthetic construct
  misc_feature 1..24: note = Synthetic Construct
  source 1..24: mol_type = other DNA
gctgaaagctgtggtttggttttg

SEQ ID NO: 25884 - DNA, 22 bp, synthetic construct
  misc_feature 1..22: note = Synthetic Construct
  source 1..22: mol_type = other DNA
agccccagttccccacaactaa

SEQ ID NO: 25885 - DNA, 23 bp, synthetic construct
  misc_feature 1..23: note = Synthetic Construct
  source 1..23: mol_type = other DNA
tgctgttggaactggaaagagtt

SEQ ID NO: 25886 - DNA, 19 bp, synthetic construct
  misc_feature 1..19: note = Synthetic Construct
  source 1..19: mol_type = other DNA
ccatccccgctccaactca

SEQ ID NO: 25887 - DNA, 24 bp, synthetic construct
  misc_feature 1..24: note = Synthetic Construct
  source 1..24: mol_type = other DNA
ccctctggaagcttgtgtctagtt

SEQ ID NO: 25888 - DNA, 23 bp, synthetic construct
  misc_feature 1..23: note = Synthetic Construct
  source 1..23: mol_type = other DNA
tgtatctgcggctgaattgagaa

SEQ ID NO: 25889 - DNA, 22 bp, synthetic construct
  misc_feature 1..22: note = Synthetic Construct
  source 1..22: mol_type = other DNA
ggtttggtctgtggctgcatag

SEQ ID NO: 25890 - DNA, 24 bp, synthetic construct
  misc_feature 1..24: note = Synthetic Construct
  source 1..24: mol_type = other DNA
cagttaaagtccgaggaggtgatg

SEQ ID NO: 25891 - DNA, 20 bp, synthetic construct
  misc_feature 1..20: note = Synthetic Construct
  source 1..20: mol_type = other DNA
gcaactgagcatcggagact

SEQ ID NO: 25892 - DNA, 25 bp, synthetic construct
  misc_feature 1..25: note = Synthetic Construct
  source 1..25: mol_type = other DNA
ccttcagcaactgtagctcctctac

SEQ ID NO: 25893 - DNA, 23 bp, synthetic construct
  misc_feature 1..23: note = Synthetic Construct
  source 1..23: mol_type = other DNA
cggttgcctctctctttactgat

SEQ ID NO: 25894 - DNA, 19 bp, synthetic construct
  misc_feature 1..19: note = Synthetic Construct
  source 1..19: mol_type = other DNA
ggtgcgaggaggggtttgt

SEQ ID NO: 25895 - DNA, 20 bp, synthetic construct
  misc_feature 1..20: note = Synthetic Construct
  source 1..20: mol_type = other DNA
gaagttccccgttgcacaga

SEQ ID NO: 25896 - DNA, 20 bp, synthetic construct
  misc_feature 1..20: note = Synthetic Construct
  source 1..20: mol_type = other DNA
gcttgccagccaacctgtta

SEQ ID NO: 25897 - DNA, 22 bp, synthetic construct
  misc_feature 1..22: note = Synthetic Construct
  source 1..22: mol_type = other DNA
ccagttggtccatgggcagtta

SEQ ID NO: 25898 - DNA, 22 bp, synthetic construct
  misc_feature 1..22: note = Synthetic Construct
  source 1..22: mol_type = other DNA
gggtgggccattaagacagttc

SEQ ID NO: 25899 - DNA, 24 bp, synthetic construct
  misc_feature 1..24: note = Synthetic Construct
  source 1..24: mol_type = other DNA
ggaggagagaagccttgggatttg

SEQ ID NO: 25900 - DNA, 25 bp, synthetic construct
  misc_feature 1..25: note = Synthetic Construct
  source 1..25: mol_type = other DNA
ccaggaagctgcaatatggaagtga

SEQ ID NO: 25901 - DNA, 20 bp, synthetic construct
  misc_feature 1..20: note = Synthetic Construct
  source 1..20: mol_type = other DNA
gccgtggctgtccaaatgtt

SEQ ID NO: 25902 - DNA, 22 bp, synthetic construct
  misc_feature 1..22: note = Synthetic Construct
  source 1..22: mol_type = other DNA
tgagttctgtgagtccgtgaag

SEQ ID NO: 25903 - DNA, 22 bp, synthetic construct
  misc_feature 1..22: note = Synthetic Construct
  source 1..22: mol_type = other DNA
aacaccatcgtccgtcatgatt

SEQ ID NO: 25904 - DNA, 25 bp, synthetic construct
  misc_feature 1..25: note = Synthetic Construct
  source 1..25: mol_type = other DNA
cccacatccaggatacttggctttt

SEQ ID NO: 25905 - DNA, 20 bp, synthetic construct
  misc_feature 1..20: note = Synthetic Construct
  source 1..20: mol_type = other DNA
tccgacccttctcccacatt

SEQ ID NO: 25906 - DNA, 19 bp, synthetic construct
  misc_feature 1..19: note = Synthetic Construct
  source 1..19: mol_type = other DNA
gtctgcgtggagggagaga

SEQ ID NO: 25907 - DNA, 20 bp, synthetic construct
  misc_feature 1..20: note = Synthetic Construct
  source 1..20: mol_type = other DNA
tcccgtctcccatcacacat

SEQ ID NO: 25908 - DNA, 22 bp, synthetic construct
  misc_feature 1..22: note = Synthetic Construct
  source 1..22: mol_type = other DNA
ggttacattgccggtgatcaag

SEQ ID NO: 25909 - DNA, 20 bp, synthetic construct
  misc_feature 1..20: note = Synthetic Construct
  source 1..20: mol_type = other DNA
ccgcttggctctcattctct

SEQ ID NO: 25910 - DNA, 19 bp, synthetic construct
  misc_feature 1..19: note = Synthetic Construct
  source 1..19: mol_type = other DNA
gagcctggggagaggatca

SEQ ID NO: 25911 - DNA, 26 bp, synthetic construct
  misc_feature 1..26: note = Synthetic Construct
  source 1..26: mol_type = other DNA
gtatgtgaagatggttgcttggaatc

SEQ ID NO: 25912 - DNA, 25 bp, synthetic construct
  misc_feature 1..25: note = Synthetic Construct
  source 1..25: mol_type = other DNA
cccaaagcactagagactgggtcat

SEQ ID NO: 25913 - DNA, 21 bp, synthetic construct
  misc_feature 1..21: note = Synthetic Construct
  source 1..21: mol_type = other DNA
aggcctgggttgccttgtaac

SEQ ID NO: 25914 - DNA, 20 bp, synthetic construct
  misc_feature 1..20: note = Synthetic Construct
  source 1..20: mol_type = other DNA
ggccaagcaaggtggaatct

SEQ ID NO: 25915 - DNA, 22 bp, synthetic construct
  misc_feature 1..22: note = Synthetic Construct
  source 1..22: mol_type = other DNA
tgtggacagcagcgtctctaag

SEQ ID NO: 25916 - DNA, 27 bp, synthetic construct
  misc_feature 1..27: note = Synthetic Construct
  source 1..27: mol_type = other DNA
ggtcatgaacatggaaggaacaagatt

SEQ ID NO: 25917 - DNA, 22 bp, synthetic construct
  misc_feature 1..22: note = Synthetic Construct
  source 1..22: mol_type = other DNA
ctgaagtccaacaggcatctca

SEQ ID NO: 25918 - DNA, 26 bp, synthetic construct
  misc_feature 1..26: note = Synthetic Construct
  source 1..26: mol_type = other DNA
gacttcctttctaccttgttgctgat

SEQ ID NO: 25919 - DNA, 25 bp, synthetic construct
  misc_feature 1..25: note = Synthetic Construct
  source 1..25: mol_type = other DNA
caccatgaagttcagtccatagtca

SEQ ID NO: 25920 - DNA, 20 bp, synthetic construct
  misc_feature 1..20: note = Synthetic Construct
  source 1..20: mol_type = other DNA
cccaccgtcctgcatactca

SEQ ID NO: 25921 - DNA, 24 bp, synthetic construct
  misc_feature 1..24: note = Synthetic Construct
  source 1..24: mol_type = other DNA
acgtaagtgaatgaggggagaact

SEQ ID NO: 25922 - DNA, 22 bp, synthetic construct
  misc_feature 1..22: note = Synthetic Construct
  source 1..22: mol_type = other DNA
tcactgcaccattttccccaat

SEQ ID NO: 25923 - DNA, 22 bp, synthetic construct
  misc_feature 1..22: note = Synthetic Construct
  source 1..22: mol_type = other DNA
tcctcagggccttgggaaacat

SEQ ID NO: 25924 - DNA, 23 bp, synthetic construct
  misc_feature 1..23: note = Synthetic Construct
  source 1..23: mol_type = other DNA
agcctgcctcacattatcctttc

SEQ ID NO: 25925 - DNA, 21 bp, synthetic construct
  misc_feature 1..21: note = Synthetic Construct
  source 1..21: mol_type = other DNA
ggcagggaggtcctgactgaa

SEQ ID NO: 25926 - DNA, 25 bp, synthetic construct
  misc_feature 1..25: note = Synthetic Construct
  source 1..25: mol_type = other DNA
ctgggacaggaccaaatccaactac

SEQ ID NO: 25927 - DNA, 25 bp, synthetic construct
  misc_feature 1..25: note = Synthetic Construct
  source 1..25: mol_type = other DNA
gctaactctgacaggctaagtgcta

SEQ ID NO: 25928 - DNA, 24 bp, synthetic construct
  misc_feature 1..24: note = Synthetic Construct
  source 1..24: mol_type = other DNA
actggaaacccatgaagactccta

SEQ ID NO: 25929 - DNA, 20 bp, synthetic construct
  misc_feature 1..20: note = Synthetic Construct
  source 1..20: mol_type = other DNA
gccagatggtgcttggttca

SEQ ID NO: 25930 - DNA, 23 bp, synthetic construct
  misc_feature 1..23: note = Synthetic Construct
  source 1..23: mol_type = other DNA
gggcaatgcctgagaaaatggta

SEQ ID NO: 25931 - DNA, 22 bp, synthetic construct
  misc_feature 1..22: note = Synthetic Construct
  source 1..22: mol_type = other DNA
tccaactggcctttttggaaca

SEQ ID NO: 25932 - DNA, 22 bp, synthetic construct
  misc_feature 1..22: note = Synthetic Construct
  source 1..22: mol_type = other DNA
tcagaggcatgttaccctctct

SEQ ID NO: 25933 - DNA, 23 bp, synthetic construct
  misc_feature 1..23: note = Synthetic Construct
  source 1..23: mol_type = other DNA
gatggcacagagagatgctgaga

SEQ ID NO: 25934 - DNA, 22 bp, synthetic construct
  misc_feature 1..22: note = Synthetic Construct
  source 1..22: mol_type = other DNA
gggccttttggccacagactaa

SEQ ID NO: 25935 - DNA, 23 bp, synthetic construct
  misc_feature 1..23: note = Synthetic Construct
  source 1..23: mol_type = other DNA
aggttctgtcccatacggttttg

SEQ ID NO: 25936 - DNA, 22 bp, synthetic construct
  misc_feature 1..22: note = Synthetic Construct
  source 1..22: mol_type = other DNA
cgctcagcagcagctgtaacta

SEQ ID NO: 25937 - DNA, 19 bp, synthetic construct
  misc_feature 1..19: note = Synthetic Construct
  source 1..19: mol_type = other DNA
agctgcaggttgcagttca

SEQ ID NO: 25938 - DNA, 24 bp, synthetic construct
  misc_feature 1..24: note = Synthetic Construct
  source 1..24: mol_type = other DNA
acgcatccttagtaccttatgcaa

SEQ ID NO: 25939 - DNA, 26 bp, synthetic construct
  misc_feature 1..26: note = Synthetic Construct
  source 1..26: mol_type = other DNA
gtaaggtacggtcagtagtgtagaag

SEQ ID NO: 25940 - DNA, 21 bp, synthetic construct
  misc_feature 1..21: note = Synthetic Construct
  source 1..21: mol_type = other DNA
tcagaggcccttggctgatct

SEQ ID NO: 25941 - DNA, 22 bp, synthetic construct
  misc_feature 1..22: note = Synthetic Construct
  source 1..22: mol_type = other DNA
tccttctgcctgagaaaagcaa

SEQ ID NO: 25942 - DNA, 23 bp, synthetic construct
  misc_feature 1..23: note = Synthetic Construct
  source 1..23: mol_type = other DNA
agagccctagggagctcatggta

SEQ ID NO: 25943 - DNA, 21 bp, synthetic construct
  misc_feature 1..21: note = Synthetic Construct
  source 1..21: mol_type = other DNA
tcactgatccagaccccaaga

SEQ ID NO: 25944 - DNA, 20 bp, synthetic construct
  misc_feature 1..20: note = Synthetic Construct
  source 1..20: mol_type = other DNA
tgccagtccaaccagcatag

SEQ ID NO: 25945 - DNA, 20 bp, synthetic construct
  misc_feature 1..20: note = Synthetic Construct
  source 1..20: mol_type = other DNA
cccagtgggcagaactttga

SEQ ID NO: 25946 - DNA, 23 bp, synthetic construct
  misc_feature 1..23: note = Synthetic Construct
  source 1..23: mol_type = other DNA
gggctcaagtgatcctcccatct

SEQ ID NO: 25947 - DNA, 25 bp, synthetic construct
  misc_feature 1..25: note = Synthetic Construct
  source 1..25: mol_type = other DNA
tgccctagagcaaagggtatatttc

SEQ ID NO: 25948 - DNA, 20 bp, synthetic construct
  misc_feature 1..20: note = Synthetic Construct
  source 1..20: mol_type = other DNA
gttccaggcaacaggagtga

SEQ ID NO: 25949 - DNA, 21 bp, synthetic construct
  misc_feature 1..21: note = Synthetic Construct
  source 1..21: mol_type = other DNA
tctgctgctccctgctccatt

SEQ ID NO: 25950 - DNA, 23 bp, synthetic construct
  misc_feature 1..23: note = Synthetic Construct
  source 1..23: mol_type = other DNA
gggcactttgcccgtgtaattct

SEQ ID NO: 25951 - DNA, 21 bp, synthetic construct
  misc_feature 1..21: note = Synthetic Construct
  source 1..21: mol_type = other DNA
gccactagcctccatgtcaag

SEQ ID NO: 25952 - DNA, 21 bp, synthetic construct
  misc_feature 1..21: note = Synthetic Construct
  source 1..21: mol_type = other DNA
ctgtgggcacaggaatcatct

SEQ ID NO: 25953 - DNA, 22 bp, synthetic construct
  misc_feature 1..22: note = Synthetic Construct
  source 1..22: mol_type = other DNA
aggacaggaggcaggttcaagt

SEQ ID NO: 25954 - DNA, 22 bp, synthetic construct
  misc_feature 1..22: note = Synthetic Construct
  source 1..22: mol_type = other DNA
cctctgtgtgttgtgcttggaa

SEQ ID NO: 25955 - DNA, 20 bp, synthetic construct
  misc_feature 1..20: note = Synthetic Construct
  source 1..20: mol_type = other DNA
gccaagctccgtgctggtaa

SEQ ID NO: 25956 - DNA, 24 bp, synthetic construct
  misc_feature 1..24: note = Synthetic Construct
  source 1..24: mol_type = other DNA
caaaccgaagcagacatagtgaag

SEQ ID NO: 25957 - DNA, 23 bp, synthetic construct
  misc_feature 1..23: note = Synthetic Construct
  source 1..23: mol_type = other DNA
gcaagattgtgtctggaggttca

SEQ ID NO: 25958 - DNA, 23 bp, synthetic construct
  misc_feature 1..23: note = Synthetic Construct
  source 1..23: mol_type = other DNA
cggtgaggctttggagagttttg

SEQ ID NO: 25959 - DNA, 20 bp, synthetic construct
  misc_feature 1..20: note = Synthetic Construct
  source 1..20: mol_type = other DNA
tcctgccttgggacatggaa

SEQ ID NO: 25960 - DNA, 19 bp, synthetic construct
  misc_feature 1..19: note = Synthetic Construct
  source 1..19: mol_type = other DNA
acagcggggcattcacaga

SEQ ID NO: 25961 - DNA, 22 bp, synthetic construct
  misc_feature 1..22: note = Synthetic Construct
  source 1..22: mol_type = other DNA
gatggagagcatctgggtcctt

SEQ ID NO: 25962 - DNA, 22 bp, synthetic construct
  misc_feature 1..22: note = Synthetic Construct
  source 1..22: mol_type = other DNA
tgggtccacactggtggaatga

SEQ ID NO: 25963 - DNA, 22 bp, synthetic construct
  misc_feature 1..22: note = Synthetic Construct
  source 1..22: mol_type = other DNA
tcttggggtggattggggactt

SEQ ID NO: 25964 - DNA, 23 bp, synthetic construct
  misc_feature 1..23: note = Synthetic Construct
  source 1..23: mol_type = other DNA
acagtcaagcaaggggtgttatg

SEQ ID NO: 25965 - DNA, 22 bp, synthetic construct
  misc_feature 1..22: note = Synthetic Construct
  source 1..22: mol_type = other DNA
ctgcccactgtcactactgcat

SEQ ID NO: 25966 - DNA, 25 bp, synthetic construct
  misc_feature 1..25: note = Synthetic Construct
  source 1..25: mol_type = other DNA
caggatggagtcacaccgataactt

SEQ ID NO: 25967 - DNA, 20 bp, synthetic construct
  misc_feature 1..20: note = Synthetic Construct
  source 1..20: mol_type = other DNA
ccagccaccacagtccatca

SEQ ID NO: 25968 - DNA, 22 bp, synthetic construct
  misc_feature 1..22: note = Synthetic Construct
  source 1..22: mol_type = other DNA
ccttccggaggcaaaggaaaca

SEQ ID NO: 25969 - DNA, 23 bp, synthetic construct
  misc_feature 1..23: note = Synthetic Construct
  source 1..23: mol_type = other DNA
gtcttgacaagtggctcgcagtt

SEQ ID NO: 25970 - DNA, 25 bp, synthetic construct
  misc_feature 1..25: note = Synthetic Construct
  source 1..25: mol_type = other DNA
gcattgccccgtaatacctatcttg

SEQ ID NO: 25971 - DNA, 24 bp, synthetic construct
  misc_feature 1..24: note = Synthetic Construct
  source 1..24: mol_type = other DNA
ggctttgcatgttggtgggatact

SEQ ID NO: 25972 - DNA, 22 bp, synthetic construct
  misc_feature 1..22: note = Synthetic Construct
  source 1..22: mol_type = other DNA
catgtaatgcctgctccctttg

SEQ ID NO: 25973 - DNA, 22 bp, synthetic construct
  misc_feature 1..22: note = Synthetic Construct
  source 1..22: mol_type = other DNA
gatttgcttggccctggtaagt

SEQ ID NO: 25974 - DNA, 21 bp, synthetic construct
  misc_feature 1..21: note = Synthetic Construct
  source 1..21: mol_type = other DNA
ggagctgaatgctgcctggat

SEQ ID NO: 25975 - DNA, 24 bp, synthetic construct
  misc_feature 1..24: note = Synthetic Construct
  source 1..24: mol_type = other DNA
ggtggtactgatgctttggtctga

SEQ ID NO: 25976 - DNA, 21 bp, synthetic construct
  misc_feature 1..21: note = Synthetic Construct
  source 1..21: mol_type = other DNA
ccctgtagctttgggctcctt

SEQ ID NO: 25977 - DNA, 21 bp, synthetic construct
  misc_feature 1..21: note = Synthetic Construct
  source 1..21: mol_type = other DNA
ccccatggtctcaggctcaag

SEQ ID NO: 25978 - DNA, 19 bp, synthetic construct
  misc_feature 1..19: note = Synthetic Construct
  source 1..19: mol_type = other DNA
cgcggacacccttggaaca

SEQ ID NO: 25979 - DNA, 22 bp, synthetic construct
  misc_feature 1..22: note = Synthetic Construct
  source 1..22: mol_type = other DNA
gagccagtccaatggtctcctt

SEQ ID NO: 25980 - DNA, 20 bp, synthetic construct
  misc_feature 1..20: note = Synthetic Construct
  source 1..20: mol_type = other DNA
cagcaccgacagcaacgaaa

SEQ ID NO: 25981 - DNA, 22 bp, synthetic construct
  misc_feature 1..22: note = Synthetic Construct
  source 1..22: mol_type = other DNA
cggttctgaaacagggagtctt

SEQ ID NO: 25982 - DNA, 20 bp, synthetic construct
  misc_feature 1..20: note = Synthetic Construct
  source 1..20: mol_type = other DNA
tgctgtggtcccagctactt

SEQ ID NO: 25983 - DNA, 25 bp, synthetic construct
  misc_feature 1..25: note = Synthetic Construct
  source 1..25: mol_type = other DNA
tgtcagcagaaaatgtacagtgcta

SEQ ID NO: 25984 - DNA, 21 bp, synthetic construct
  misc_feature 1..21: note = Synthetic Construct
  source 1..21: mol_type = other DNA
tggccacctgtccatctccaa

SEQ ID NO: 25985 - DNA, 22 bp, synthetic construct
  misc_feature 1..22: note = Synthetic Construct
  source 1..22: mol_type = other DNA
gcctctggccagccttcaaaat

SEQ ID NO: 25986 - DNA, 23 bp, synthetic construct
  misc_feature 1..23: note = Synthetic Construct
  source 1..23: mol_type = other DNA
gggcacagaaactcactgttcaa

SEQ ID NO: 25987 - DNA, 22 bp, synthetic construct
  misc_feature 1..22: note = Synthetic Construct
  source 1..22: mol_type = other DNA
tgagcctggtcctcagacaagt

SEQ ID NO: 25988 - DNA, 22 bp, synthetic construct
  misc_feature 1..22: note = Synthetic Construct
  source 1..22: mol_type = other DNA
caatgagcttcccgtcccactt

SEQ ID NO: 25989 - DNA, 22 bp, synthetic construct
  misc_feature 1..22: note = Synthetic Construct
  source 1..22: mol_type = other DNA
ccaggccagggctgttaggata

SEQ ID NO: 25990 - DNA, 23 bp, synthetic construct
  misc_feature 1..23: note = Synthetic Construct
  source 1..23: mol_type = other DNA
gagcccagtaagaagtggagaca

SEQ ID NO: 25991 - DNA, 23 bp, synthetic construct
  misc_feature 1..23: note = Synthetic Construct
  source 1..23: mol_type = other DNA
cagagcggaagaagagtgaagtt

SEQ ID NO: 25992 - DNA, 30 bp, synthetic construct
  misc_feature 1..30: note = Synthetic Construct
  source 1..30: mol_type = other DNA
ggtggcaaagcagattcatttttctcctaa

SEQ ID NO: 25993 - DNA, 23 bp, synthetic construct
  misc_feature 1..23: note = Synthetic Construct
  source 1..23: mol_type = other DNA
accatgaggaagaattggccttt

SEQ ID NO: 25994 - DNA, 21 bp, synthetic construct
  misc_feature 1..21: note = Synthetic Construct
  source 1..21: mol_type = other DNA
gcatagcatcctgctccagtt

SEQ ID NO: 25995 - DNA, 23 bp, synthetic construct
  misc_feature 1..23: note = Synthetic Construct
  source 1..23: mol_type = other DNA
ggactagggagccatgtggaagt

SEQ ID NO: 25996 - DNA, 24 bp, synthetic construct
  misc_feature 1..24: note = Synthetic Construct
  source 1..24: mol_type = other DNA
tccagtctcattttgcactgttct

SEQ ID NO: 25997 - DNA, 25 bp, synthetic construct
  misc_feature 1..25: note = Synthetic Construct
  source 1..25: mol_type = other DNA
gcttccctggttggtaatactctgt

SEQ ID NO: 25998 - DNA, 20 bp, synthetic construct
  misc_feature 1..20: note = Synthetic Construct
  source 1..20: mol_type = other DNA
gtagcggttgctgcttgatg

SEQ ID NO: 25999 - DNA, 22 bp, synthetic construct
  misc_feature 1..22: note = Synthetic Construct
  source 1..22: mol_type = other DNA
ccaacgtaggtctggactgatg

SEQ ID NO: 26000 - DNA, 20 bp, synthetic construct
  misc_feature 1..20: note = Synthetic Construct
  source 1..20: mol_type = other DNA
tgatgcgaacatggctcact

SEQ ID NO: 26001 - DNA, 22 bp, synthetic construct
  misc_feature 1..22: note = Synthetic Construct
  source 1..22: mol_type = other DNA
ctggggcagagcaagtggaaaa

SEQ ID NO: 26002 - DNA, 23 bp, synthetic construct
  misc_feature 1..23: note = Synthetic Construct
  source 1..23: mol_type = other DNA
ggctcctaaccactaagaacaca

SEQ ID NO: 26003 - DNA, 23 bp, synthetic construct
  misc_feature 1..23: note = Synthetic Construct
  source 1..23: mol_type = other DNA
gggaggggacaagaactgtgaga

SEQ ID NO: 26004 - DNA, 26 bp, synthetic construct
  misc_feature 1..26: note = Synthetic Construct
  source 1..26: mol_type = other DNA
gtttgagatggtgctactgacttaac

SEQ ID NO: 26005 - DNA, 19 bp, synthetic construct
  misc_feature 1..19: note = Synthetic Construct
  source 1..19: mol_type = other DNA
tgctcccagagtgctcaca

SEQ ID NO: 26006 - DNA, 22 bp, synthetic construct
  misc_feature 1..22: note = Synthetic Construct
  source 1..22: mol_type = other DNA
cccaaggaacacagaccctagt

SEQ ID NO: 26007 - DNA, 20 bp, synthetic construct
  misc_feature 1..20: note = Synthetic Construct
  source 1..20: mol_type = other DNA
gcccggctgaaagcaaccat

SEQ ID NO: 26008 - DNA, 22 bp, synthetic construct
  misc_feature 1..22: note = Synthetic Construct
  source 1..22: mol_type = other DNA
cttttctgcatgtggcttccaa

SEQ ID NO: 26009 - DNA, 22 bp, synthetic construct
  misc_feature 1..22: note = Synthetic Construct
  source 1..22: mol_type = other DNA
agagaccgactgggaggataga

SEQ ID NO: 26010 - DNA, 24 bp, synthetic construct
  misc_feature 1..24: note = Synthetic Construct
  source 1..24: mol_type = other DNA
gagctgctgagatgctcctctttc

SEQ ID NO: 26011 - DNA, 20 bp, synthetic construct
  misc_feature 1..20: note = Synthetic Construct
  source 1..20: mol_type = other DNA
cacgctccagcaacaagaag

SEQ ID NO: 26012 - DNA, 23 bp, synthetic construct
  misc_feature 1..23: note = Synthetic Construct
  source 1..23: mol_type = other DNA
gactggtttcatctcacctgtgt

SEQ ID NO: 26013 - DNA, 22 bp, synthetic construct
  misc_feature 1..22: note = Synthetic Construct
  source 1..22: mol_type = other DNA
caccactgactcacccttgaat

SEQ ID NO: 26014 - DNA, 22 bp, synthetic construct
  misc_feature 1..22: note = Synthetic Construct
  source 1..22: mol_type = other DNA
cccctcgggtctcaaggatttt

SEQ ID NO: 26015 - DNA, 19 bp, synthetic construct
  misc_feature 1..19: note = Synthetic Construct
  source 1..19: mol_type = other DNA
tcgagccaggaaggcaagt

SEQ ID NO: 26016 - DNA, 22 bp, synthetic construct
  misc_feature 1..22: note = Synthetic Construct
  source 1..22: mol_type = other DNA
ctcaaagccatatcgggagcat

SEQ ID NO: 26017 - DNA, 21 bp, synthetic construct
  misc_feature 1..21: note = Synthetic Construct
  source 1..21: mol_type = other DNA
agctctgggttgaccgtggaa

SEQ ID NO: 26018 - DNA, 24 bp, synthetic construct
  misc_feature 1..24: note = Synthetic Construct
  source 1..24: mol_type = other DNA
cactgccaaccaagatccttatgt

SEQ ID NO: 26019 - DNA, 24 bp, synthetic construct
  misc_feature 1..24: note = Synthetic Construct
  source 1..24: mol_type = other DNA
ctgatccataggccgaagtgacaa

SEQ ID NO: 26020 - DNA, 20 bp, synthetic construct
  misc_feature 1..20: note = Synthetic Construct
  source 1..20: mol_type = other DNA
gctgtggtcacgctgtgaaa

SEQ ID NO: 26021 - DNA, 22 bp, synthetic construct
  misc_feature 1..22: note = Synthetic Construct
  source 1..22: mol_type = other DNA
tcacaggcttgggaatgtcaat

SEQ ID NO: 26022 - DNA, 22 bp, synthetic construct
  misc_feature 1..22: note = Synthetic Construct
  source 1..22: mol_type = other DNA
cccacttttgaccctggcctta

SEQ ID NO: 26023 - DNA, 22 bp, synthetic construct
  misc_feature 1..22: note = Synthetic Construct
  source 1..22: mol_type = other DNA
ggcctgagcaggtgttttagta

SEQ ID NO: 26024 - DNA, 22 bp, synthetic construct
  misc_feature 1..22: note = Synthetic Construct
  source 1..22: mol_type = other DNA
cttgccaagctggcatctaagt

SEQ ID NO: 26025 - DNA, 21 bp, synthetic construct
  misc_feature 1..21: note = Synthetic Construct
  source 1..21: mol_type = other DNA
cagtgactgcccaatgtggta

SEQ ID NO: 26026 - DNA, 25 bp, synthetic construct
  misc_feature 1..25: note = Synthetic Construct
  source 1..25: mol_type = other DNA
gcactggtcaacctaggagtgctaa

SEQ ID NO: 26027 - DNA, 18 bp, synthetic construct
  misc_feature 1..18: note = Synthetic Construct
  source 1..18: mol_type = other DNA
tcagcagcctcccacact

SEQ ID NO: 26028 - DNA, 21 bp, synthetic construct
  misc_feature 1..21: note = Synthetic Construct
  source 1..21: mol_type = other DNA
gcacctgcatccagcgataag

SEQ ID NO: 26029 - DNA, 26 bp, synthetic construct
  misc_feature 1..26: note = Synthetic Construct
  source 1..26: mol_type = other DNA
caagatgttccaaggtagaagagaga

SEQ ID NO: 26030 - DNA, 24 bp, synthetic construct
  misc_feature 1..24: note = Synthetic Construct
  source 1..24: mol_type = other DNA
ggtaagtttgctcccctactcact

SEQ ID NO: 26031 - DNA, 23 bp, synthetic construct
  misc_feature 1..23: note = Synthetic Construct
  source 1..23: mol_type = other DNA
gaggctctggaagaccattcctt

SEQ ID NO: 26032 - DNA, 20 bp, synthetic construct
  misc_feature 1..20: note = Synthetic Construct
  source 1..20: mol_type = other DNA
ggtccctgagccagggctat

SEQ ID NO: 26033 - DNA, 20 bp, synthetic construct
  misc_feature 1..20: note = Synthetic Construct
  source 1..20: mol_type = other DNA
gggctttggaccttcagcat

SEQ ID NO: 26034 - DNA, 20 bp, synthetic construct
  misc_feature 1..20: note = Synthetic Construct
  source 1..20: mol_type = other DNA
aggatggggctcggaaaaac

SEQ ID NO: 26035 - DNA, 24 bp, synthetic construct
  misc_feature 1..24: note = Synthetic Construct
  source 1..24: mol_type = other DNA
ccgtgcccggcatattattttagt

SEQ ID NO: 26036 - DNA, 21 bp, synthetic construct
  misc_feature 1..21: note = Synthetic Construct
  source 1..21: mol_type = other DNA
cctctctgtggaggggattct

SEQ ID NO: 26037 - DNA, 20 bp, synthetic construct
  misc_feature 1..20: note = Synthetic Construct
  source 1..20: mol_type = other DNA
ggttgcttctgcacctggat

SEQ ID NO: 26038 - DNA, 25 bp, synthetic construct
  misc_feature 1..25: note = Synthetic Construct
  source 1..25: mol_type = other DNA
gcctttagtttgggccagaagaact

SEQ ID NO: 26039 - DNA, 21 bp, synthetic construct
  misc_feature 1..21: note = Synthetic Construct
  source 1..21: mol_type = other DNA
cggccttggctcctgtagttt

SEQ ID NO: 26040 - DNA, 25 bp, synthetic construct
  misc_feature 1..25: note = Synthetic Construct
  source 1..25: mol_type = other DNA
ccatgatccctgtaaacagctcaga

SEQ ID NO: 26041 - DNA, 23 bp, synthetic construct
  misc_feature 1..23: note = Synthetic Construct
  source 1..23: mol_type = other DNA
cacacactgagactgaggaaaga

SEQ ID NO: 26042 - DNA, 21 bp, synthetic construct
  misc_feature 1..21: note = Synthetic Construct
  source 1..21: mol_type = other DNA
cgaccaagggccttcaaggaa

SEQ ID NO: 26043 - DNA, 25 bp, synthetic construct
  misc_feature 1..25: note = Synthetic Construct
  source 1..25: mol_type = other DNA
tgacacaaactgagaacaaccaatc

SEQ ID NO: 26044 - DNA, 19 bp, synthetic construct
  misc_feature 1..19: note = Synthetic Construct
  source 1..19: mol_type = other DNA
tgtgcctgccagccaagtt

SEQ ID NO: 26045 - DNA, 24 bp, synthetic construct
  misc_feature 1..24: note = Synthetic Construct
  source 1..24: mol_type = other DNA
gaccttcgctctattccctctcaa

SEQ ID NO: 26046 - DNA, 24 bp, synthetic construct
  misc_feature 1..24: note = Synthetic Construct
  source 1..24: mol_type = other DNA
gtcaatttgctctgggagatggaa

SEQ ID NO: 26047 - DNA, 19 bp, synthetic construct
  misc_feature 1..19: note = Synthetic Construct
  source 1..19: mol_type = other DNA
aaccagcgaggcacccatt

SEQ ID NO: 26048 - DNA, 18 bp, synthetic construct
  misc_feature 1..18: note = Synthetic Construct
  source 1..18: mol_type = other DNA
tgcctccttggccagttg

SEQ ID NO: 26049 - DNA, 21 bp, synthetic construct
  misc_feature 1..21: note = Synthetic Construct
  source 1..21: mol_type = other DNA
ggcagaggaggcagggagtta

SEQ ID NO: 26050 - DNA, 23 bp, synthetic construct
  misc_feature 1..23: note = Synthetic Construct
  source 1..23: mol_type = other DNA
gcagctctacagagaggcagaca

SEQ ID NO: 26051 - DNA, 25 bp, synthetic construct
  misc_feature 1..25: note = Synthetic Construct
  source 1..25: mol_type = other DNA
ttccaaagccataacaacgagtaac

SEQ ID NO: 26052 - DNA, 24 bp, synthetic construct
  misc_feature 1..24: note = Synthetic Construct
  source 1..24: mol_type = other DNA
gtcttccagagcattcatcgttca

SEQ ID NO: 26053 - DNA, 23 bp, synthetic construct
  misc_feature 1..23: note = Synthetic Construct
  source 1..23: mol_type = other DNA
gtcctcctgtggttccagacttc

SEQ ID NO: 26054 - DNA, 20 bp, synthetic construct
  misc_feature 1..20: note = Synthetic Construct
  source 1..20: mol_type = other DNA
gatgtgctgggagtcagctt

SEQ ID NO: 26055 - DNA, 19 bp, synthetic construct
  misc_feature 1..19: note = Synthetic Construct
  source 1..19: mol_type = other DNA
agctggaccaggccattca

SEQ ID NO: 26056 - DNA, 19 bp, synthetic construct
  misc_feature 1..19: note = Synthetic Construct
  source 1..19: mol_type = other DNA
tggcccttccttgccctta

SEQ ID NO: 26057 - DNA, 24 bp, synthetic construct
  misc_feature 1..24: note = Synthetic Construct
  source 1..24: mol_type = other DNA
agttggtcatctgtcaatctgcat

SEQ ID NO: 26058 - DNA, 28 bp, synthetic construct
  misc_feature 1..28: note = Synthetic Construct
  source 1..28: mol_type = other DNA
ccattcttggcctatgtctgctctttag

SEQ ID NO: 26059 - DNA, 21 bp, synthetic construct
  misc_feature 1..21: note = Synthetic Construct
  source 1..21: mol_type = other DNA
gatagggcccagaggggtatc

SEQ ID NO: 26060 - DNA, 23 bp, synthetic construct
  misc_feature 1..23: note = Synthetic Construct
  source 1..23: mol_type = other DNA
gtgcacaggtgggcattattaag

SEQ ID NO: 26061 - DNA, 23 bp, synthetic construct
  misc_feature 1..23: note = Synthetic Construct
  source 1..23: mol_type = other DNA
gggcatgtgaaacatcacttgtt

SEQ ID NO: 26062 - DNA, 23 bp, synthetic construct
  misc_feature 1..23: note = Synthetic Construct
  source 1..23: mol_type = other DNA
ccaagccaagctttcaagacaca

SEQ ID NO: 26063 - DNA, 23 bp, synthetic construct
  misc_feature 1..23: note = Synthetic Construct
  source 1..23: mol_type = other DNA
gctaggccacaggagtcacagat

SEQ ID NO: 26064 - DNA, 19 bp, synthetic construct
  misc_feature 1..19: note = Synthetic Construct
  source 1..19: mol_type = other DNA
gcccctgcgtcttggagtt

SEQ ID NO: 26065 - DNA, 20 bp, synthetic construct
  misc_feature 1..20: note = Synthetic Construct
  source 1..20: mol_type = other DNA
ctttcacccagcaccacgta

SEQ ID NO: 26066 - DNA, 23 bp, synthetic construct
  misc_feature 1..23: note = Synthetic Construct
  source 1..23: mol_type = other DNA
cggctcggaaccgttttatttac

SEQ ID NO: 26067 - DNA, 22 bp, synthetic construct
  misc_feature 1..22: note = Synthetic Construct
  source 1..22: mol_type = other DNA
tgctggatgagggtgccttttg

SEQ ID NO: 26068 - DNA, 24 bp, synthetic construct
  misc_feature 1..24: note = Synthetic Construct
  source 1..24: mol_type = other DNA
caagcgtctgggataagtgaacaa

SEQ ID NO: 26069 - DNA, 22 bp, synthetic construct
  misc_feature 1..22: note = Synthetic Construct
  source 1..22: mol_type = other DNA
tgcatctccctacctggcatga

SEQ ID NO: 26070 - DNA, 20 bp, synthetic construct
  misc_feature 1..20: note = Synthetic Construct
  source 1..20: mol_type = other DNA
agcagccaagggcttctgat

SEQ ID NO: 26071 - DNA, 20 bp, synthetic construct
  misc_feature 1..20: note = Synthetic Construct
  source 1..20: mol_type = other DNA
ggctccccaagcactagaca

SEQ ID NO: 26072 - DNA, 21 bp, synthetic construct
  misc_feature 1..21: note = Synthetic Construct
  source 1..21: mol_type = other DNA
agtggggctgattccaacaag

SEQ ID NO: 26073 - DNA, 19 bp, synthetic construct
  misc_feature 1..19: note = Synthetic Construct
  source 1..19: mol_type = other DNA
tcagcagcaggccatgaac

SEQ ID NO: 26074 - DNA, 22 bp, synthetic construct
  misc_feature 1..22: note = Synthetic Construct
  source 1..22: mol_type = other DNA
agttaggagtaggccggtgtct

SEQ ID NO: 26075 - DNA, 18 bp, synthetic construct
  misc_feature 1..18: note = Synthetic Construct
  source 1..18: mol_type = other DNA
gccctgggccgaacattt

SEQ ID NO: 26076 - DNA, 24 bp, synthetic construct
  misc_feature 1..24: note = Synthetic Construct
  source 1..24: mol_type = other DNA
gggaacgtgttctgccattctgat

SEQ ID NO: 26077 - DNA, 23 bp, synthetic construct
  misc_feature 1..23: note = Synthetic Construct
  source 1..23: mol_type = other DNA
aagacagaaagtccgttggaact

SEQ ID NO: 26078 - DNA, 24 bp, synthetic construct
  misc_feature 1..24: note = Synthetic Construct
  source 1..24: mol_type = other DNA
gccttcagccccaggaatgaaatg

SEQ ID NO: 26079 - DNA, 20 bp, synthetic construct
  misc_feature 1..20: note = Synthetic Construct
  source 1..20: mol_type = other DNA
gggctctgccctttcagcta

SEQ ID NO: 26080 - DNA, 20 bp, synthetic construct
  misc_feature 1..20: note = Synthetic Construct
  source 1..20: mol_type = other DNA
tgcagcaagaactgccacat

SEQ ID NO: 26081 - DNA, 23 bp, synthetic construct
  misc_feature 1..23: note = Synthetic Construct
  source 1..23: mol_type = other DNA
cctgggaacagtgatacttgcat

SEQ ID NO: 26082 - DNA, 20 bp, synthetic construct
  misc_feature 1..20: note = Synthetic Construct
  source 1..20: mol_type = other DNA
aagggaacatgggcgtgatt

SEQ ID NO: 26083 - DNA, 23 bp, synthetic construct
  misc_feature 1..23: note = Synthetic Construct
  source 1..23: mol_type = other DNA
agaatcggagactcactggttga

SEQ ID NO: 26084 - DNA, 23 bp, synthetic construct
  misc_feature 1..23: note = Synthetic Construct
  source 1..23: mol_type = other DNA
ttatgacacacctccgtgtgatt

SEQ ID NO: 26085 - DNA, 20 bp, synthetic construct
  misc_feature 1..20: note = Synthetic Construct
  source 1..20: mol_type = other DNA
ggcctgcctttccactcaat

SEQ ID NO: 26086 - DNA, 22 bp, synthetic construct
  misc_feature 1..22: note = Synthetic Construct
  source 1..22: mol_type = other DNA
gcaagccatccaccctcactaa

SEQ ID NO: 26087 - DNA, 22 bp, synthetic construct
  misc_feature 1..22: note = Synthetic Construct
  source 1..22: mol_type = other DNA
acctgacccctcatgggacttt

SEQ ID NO: 26088 - DNA, 23 bp, synthetic construct
  misc_feature 1..23: note = Synthetic Construct
  source 1..23: mol_type = other DNA
acgttgtccctacactgacattt

SEQ ID NO: 26089 - DNA, 21 bp, synthetic construct
  misc_feature 1..21: note = Synthetic Construct
  source 1..21: mol_type = other DNA
ccacacacgctgtgcagaaag

SEQ ID NO: 26090 - DNA, 25 bp, synthetic construct
  misc_feature 1..25: note = Synthetic Construct
  source 1..25: mol_type = other DNA
ggagattcgggtgtctgatgcctaa

SEQ ID NO: 26091 - DNA, 19 bp, synthetic construct
  misc_feature 1..19: note = Synthetic Construct
  source 1..19: mol_type = other DNA
acctcaggtgtcccgtgtt

SEQ ID NO: 26092 - DNA, 20 bp, synthetic construct
  misc_feature 1..20: note = Synthetic Construct
  source 1..20: mol_type = other DNA
ggccccaggtctctcagctt

SEQ ID NO: 26093 - DNA, 26 bp, synthetic construct
  misc_feature 1..26: note = Synthetic Construct
  source 1..26: mol_type = other DNA
tgagtaagtgggtctttccttaggtt

SEQ ID NO: 26094 - DNA, 20 bp, synthetic construct
  misc_feature 1..20: note = Synthetic Construct
  source 1..20: mol_type = other DNA
cagcagctcccagtgacttc

SEQ ID NO: 26095 - DNA, 21 bp, synthetic construct
  misc_feature 1..21: note = Synthetic Construct
  source 1..21: mol_type = other DNA
cccctgcatgacctctccatt

SEQ ID NO: 26096 - DNA, 23 bp, synthetic construct
  misc_feature 1..23: note = Synthetic Construct
  source 1..23: mol_type = other DNA
cacgtccccacccttcttgtatg

SEQ ID NO: 26097 - DNA, 21 bp, synthetic construct
  misc_feature 1..21: note = Synthetic Construct
  source 1..21: mol_type = other DNA
tttgggtgctggacccctttg

SEQ ID NO: 26098 - DNA, 23 bp, synthetic construct
  misc_feature 1..23: note = Synthetic Construct
  source 1..23: mol_type = other DNA
ccagatggactggtgaggatttc

SEQ ID NO: 26099 - DNA, 26 bp, synthetic construct
  misc_feature 1..26: note = Synthetic Construct
  source 1..26: mol_type = other DNA
ccttgtatcagagcctctcagtatct

SEQ ID NO: 26100 - DNA, 23 bp, synthetic construct
  misc_feature 1..23: note = Synthetic Construct
  source 1..23: mol_type = other DNA
caccacaaaactacaccgcttga

SEQ ID NO: 26101 - DNA, 20 bp, synthetic construct
  misc_feature 1..20: note = Synthetic Construct
  source 1..20: mol_type = other DNA
tgggccaaggggcaaaaact

SEQ ID NO: 26102 - DNA, 19 bp, synthetic construct
  misc_feature 1..19: note = Synthetic Construct
  source 1..19: mol_type = other DNA
agcagccccaaacctcact

SEQ ID NO: 26103 - DNA, 24 bp, synthetic construct
  misc_feature 1..24: note = Synthetic Construct
  source 1..24: mol_type = other DNA
gacttagaggcccttgggtgtaac

SEQ ID NO: 26104 - DNA, 21 bp, synthetic construct
  misc_feature 1..21: note = Synthetic Construct
  source 1..21: mol_type = other DNA
caccacaccctggcagacatt

SEQ ID NO: 26105 - DNA, 21 bp, synthetic construct
  misc_feature 1..21: note = Synthetic Construct
  source 1..21: mol_type = other DNA
aaagggcaggcagctgaggta

SEQ ID NO: 26106 - DNA, 18 bp, synthetic construct
  misc_feature 1..18: note = Synthetic Construct
  source 1..18: mol_type = other DNA
agtggctggcctgcatgt

SEQ ID NO: 26107 - DNA, 24 bp, synthetic construct
  misc_feature 1..24: note = Synthetic Construct
  source 1..24: mol_type = other DNA
gggaaaaagtccccaaacctgttc

SEQ ID NO: 26108 - DNA, 20 bp, synthetic construct
  misc_feature 1..20: note = Synthetic Construct
  source 1..20: mol_type = other DNA
caggtgtggcctgtgtgagt

SEQ ID NO: 26109 - DNA, 23 bp, synthetic construct
  misc_feature 1..23: note = Synthetic Construct
  source 1..23: mol_type = other DNA
gacaactccctgcttggagtaac

SEQ ID NO: 26110 - DNA, 21 bp, synthetic construct
  misc_feature 1..21: note = Synthetic Construct
  source 1..21: mol_type = other DNA
cctgggtggtctggagaggaa

SEQ ID NO: 26111 - DNA, 21 bp, synthetic construct
  misc_feature 1..21: note = Synthetic Construct
  source 1..21: mol_type = other DNA
atgacccacctctggcaccta

SEQ ID NO: 26112 - DNA, 22 bp, synthetic construct
  misc_feature 1..22: note = Synthetic Construct
  source 1..22: mol_type = other DNA
acacaccccaggtcacttcaga

SEQ ID NO: 26113 - DNA, 21 bp, synthetic construct
  misc_feature 1..21: note = Synthetic Construct
  source 1..21: mol_type = other DNA
tcccacatagagcgggcatca

SEQ ID NO: 26114 - DNA, 24 bp, synthetic construct
  misc_feature 1..24: note = Synthetic Construct
  source 1..24: mol_type = other DNA
ctgcctgacagccattcattcctt

SEQ ID NO: 26115 - DNA, 19 bp, synthetic construct
  misc_feature 1..19: note = Synthetic Construct
  source 1..19: mol_type = other DNA
agcttgccctggggctttg

SEQ ID NO: 26116 - DNA, 20 bp, synthetic construct
  misc_feature 1..20: note = Synthetic Construct
  source 1..20: mol_type = other DNA
tgtgggcatttgggcacctt

SEQ ID NO: 26117 - DNA, 20 bp, synthetic construct
  misc_feature 1..20: note = Synthetic Construct
  source 1..20: mol_type = other DNA
cagggtgtggggcattgtga

SEQ ID NO: 26118 - DNA, 19 bp, synthetic construct
  misc_feature 1..19: note = Synthetic Construct
  source 1..19: mol_type = other DNA
cggggagtgtgggatggaa

SEQ ID NO: 26119 - DNA, 19 bp, synthetic construct
  misc_feature 1..19: note = Synthetic Construct
  source 1..19: mol_type = other DNA
agcacgcaggaggccaaga

SEQ ID NO: 26120 - DNA, 20 bp, synthetic construct
  misc_feature 1..20: note = Synthetic Construct
  source 1..20: mol_type = other DNA
agcactaaccgccagtgatg

SEQ ID NO: 26121 - DNA, 21 bp, synthetic construct
  misc_feature 1..21: note = Synthetic Construct
  source 1..21: mol_type = other DNA
attgatcccctctcccaccat

SEQ ID NO: 26122 - DNA, 22 bp, synthetic construct
  misc_feature 1..22: note = Synthetic Construct
  source 1..22: mol_type = other DNA
cttccttgacgggtcccttttc

SEQ ID NO: 26123 - DNA, 21 bp, synthetic construct
  misc_feature 1..21: note = Synthetic Construct
  source 1..21: mol_type = other DNA
cccctgccaggtgttgaattt

SEQ ID NO: 26124 - DNA, 21 bp, synthetic construct
  misc_feature 1..21: note = Synthetic Construct
  source 1..21: mol_type = other DNA
cactgaggctgtcaggatgtt

SEQ ID NO: 26125 - DNA, 21 bp, synthetic construct
  misc_feature 1..21: note = Synthetic Construct
  source 1..21: mol_type = other DNA
ggggaagagtgaggagactga

SEQ ID NO: 26126 - DNA, 21 bp, synthetic construct
  misc_feature 1..21: note = Synthetic Construct
  source 1..21: mol_type = other DNA
agaggggcacctgttggaaga

SEQ ID NO: 26127 - DNA, 21 bp, synthetic construct
  misc_feature 1..21: note = Synthetic Construct
  source 1..21: mol_type = other DNA
caacaatggcaaggcctgatg

SEQ ID NO: 26128 - DNA, 22 bp, synthetic construct
  misc_feature 1..22: note = Synthetic Construct
  source 1..22: mol_type = other DNA
ggggtggaatgcacacaaggtt

SEQ ID NO: 26129 - DNA, 27 bp, synthetic construct
  misc_feature 1..27: note = Synthetic Construct
  source 1..27: mol_type = other DNA
ctggatctagaaggcagagatacatga

SEQ ID NO: 26130 - DNA, 23 bp, synthetic construct
  misc_feature 1..23: note = Synthetic Construct
  source 1..23: mol_type = other DNA
cctcagctgctcctgtggtctaa

SEQ ID NO: 26131 - DNA, 19 bp, synthetic construct
  misc_feature 1..19: note = Synthetic Construct
  source 1..19: mol_type = other DNA
gcacacaaaggccccaaga

SEQ ID NO: 26132 - DNA, 20 bp, synthetic construct
  misc_feature 1..20: note = Synthetic Construct
  source 1..20: mol_type = other DNA
aggacagcctccagccaata

SEQ ID NO: 26133 - DNA, 22 bp, synthetic construct
  misc_feature 1..22: note = Synthetic Construct
  source 1..22: mol_type = other DNA
gcagcacctgagagaagacact

SEQ ID NO: 26134 - DNA, 22 bp, synthetic construct
  misc_feature 1..22: note = Synthetic Construct
  source 1..22: mol_type = other DNA
caaccaggaccacagaccttca

SEQ ID NO: 26135 - DNA, 21 bp, synthetic construct
  misc_feature 1..21: note = Synthetic Construct
  source 1..21: mol_type = other DNA
cgaattggctgcagcatggtt

SEQ ID NO: 26136 - DNA, 20 bp, synthetic construct
  misc_feature 1..20: note = Synthetic Construct
  source 1..20: mol_type = other DNA
tcactgctgccacctgcata

SEQ ID NO: 26137 - DNA, 21 bp, synthetic construct
  misc_feature 1..21: note = Synthetic Construct
  source 1..21: mol_type = other DNA
actgggactggagcccagatt

SEQ ID NO: 26138 - DNA, 23 bp, synthetic construct
  misc_feature 1..23: note = Synthetic Construct
  source 1..23: mol_type = other DNA
tgaaagaacctcccaacaggttt

SEQ ID NO: 26139 - DNA, 20 bp, synthetic construct
  misc_feature 1..20: note = Synthetic Construct
  source 1..20: mol_type = other DNA
caacccacctcctcccatct

SEQ ID NO: 26140 - DNA, 21 bp, synthetic construct
  misc_feature 1..21: note = Synthetic Construct
  source 1..21: mol_type = other DNA
tggttaggcctggctctgtct

SEQ ID NO: 26141 - DNA, 24 bp, synthetic construct
  misc_feature 1..24: note = Synthetic Construct
  source 1..24: mol_type = other DNA
gccagaatactcaccccagactga

SEQ ID NO: 26142 - DNA, 25 bp, synthetic construct
  misc_feature 1..25: note = Synthetic Construct
  source 1..25: mol_type = other DNA
cctagtatgtgttggcactgacact

SEQ ID NO: 26143 - DNA, 25 bp, synthetic construct
  misc_feature 1..25: note = Synthetic Construct
  source 1..25: mol_type = other DNA
ggctaagccagatgctgttaagtag

SEQ ID NO: 26144 - DNA, 20 bp, synthetic construct
  misc_feature 1..20: note = Synthetic Construct
  source 1..20: mol_type = other DNA
agtgccactgtgtgcaggta

SEQ ID NO: 26145 - DNA, 21 bp, synthetic construct
  misc_feature 1..21: note = Synthetic Construct
  source 1..21: mol_type = other DNA
accaggcacaaggactcatca

SEQ ID NO: 26146 - DNA, 26 bp, synthetic construct
  misc_feature 1..26: note = Synthetic Construct
  source 1..26: mol_type = other DNA
ccacctacattgcctaatttgaggat

SEQ ID NO: 26147 - DNA, 18 bp, synthetic construct
  misc_feature 1..18: note = Synthetic Construct
  source 1..18: mol_type = other DNA
tgcagccagcactgcaaa

SEQ ID NO: 26148 - DNA, 25 bp, synthetic construct
  misc_feature 1..25: note = Synthetic Construct
  source 1..25: mol_type = other DNA
cggagcatgtttaggtgatgtgctt

SEQ ID NO: 26149 - DNA, 22 bp, synthetic construct
  misc_feature 1..22: note = Synthetic Construct
  source 1..22: mol_type = other DNA
catcttggcctttgctctctga

SEQ ID NO: 26150 - DNA, 20 bp, synthetic construct
  misc_feature 1..20: note = Synthetic Construct
  source 1..20: mol_type = other DNA
cccctagggctggagagaca

SEQ ID NO: 26151 - DNA, 19 bp, synthetic construct
  misc_feature 1..19: note = Synthetic Construct
  source 1..19: mol_type = other DNA
gcctctgggtggaagcaat

SEQ ID NO: 26152 - DNA, 19 bp, synthetic construct
  misc_feature 1..19: note = Synthetic Construct
  source 1..19: mol_type = other DNA
aaggccggtgctggctact

SEQ ID NO: 26153 - DNA, 19 bp, synthetic construct
  misc_feature 1..19: note = Synthetic Construct
  source 1..19: mol_type = other DNA
gctccctgccctctctagt

SEQ ID NO: 26154 - DNA, 21 bp, synthetic construct
  misc_feature 1..21: note = Synthetic Construct
  source 1..21: mol_type = other DNA
ccacccagctctcggtgaatg

SEQ ID NO: 26155 - DNA, 20 bp, synthetic construct
  misc_feature 1..20: note = Synthetic Construct
  source 1..20: mol_type = other DNA
tgagctccttgagggcaaag

SEQ ID NO: 26156 - DNA, 20 bp, synthetic construct
  misc_feature 1..20: note = Synthetic Construct
  source 1..20: mol_type = other DNA
gaggcaacagcgactggaat

SEQ ID NO: 26157 - DNA, 18 bp, synthetic construct
  misc_feature 1..18: note = Synthetic Construct
  source 1..18: mol_type = other DNA
tgcctggctaccgctgat

SEQ ID NO: 26158 - DNA, 21 bp, synthetic construct
  misc_feature 1..21: note = Synthetic Construct
  source 1..21: mol_type = other DNA
accgagctgcttttcttccaa

SEQ ID NO: 26159 - DNA, 19 bp, synthetic construct
  misc_feature 1..19: note = Synthetic Construct
  source 1..19: mol_type = other DNA
aacccggaggggaggagaa

SEQ ID NO: 26160 - DNA, 21 bp, synthetic construct
  misc_feature 1..21: note = Synthetic Construct
  source 1..21: mol_type = other DNA
tccccttaggctcctgcgttt

SEQ ID NO: 26161 - DNA, 20 bp, synthetic construct
  misc_feature 1..20: note = Synthetic Construct
  source 1..20: mol_type = other DNA
agaaaggagaggcccctgaa

SEQ ID NO: 26162 - DNA, 22 bp, synthetic construct
  misc_feature 1..22: note = Synthetic Construct
  source 1..22: mol_type = other DNA
ggtgaggtgtgagagggacaga

SEQ ID NO: 26163 - DNA, 19 bp, synthetic construct
  misc_feature 1..19: note = Synthetic Construct
  source 1..19: mol_type = other DNA
ggcctcttgcccagccaat

SEQ ID NO: 26164 - DNA, 21 bp, synthetic construct
  misc_feature 1..21: note = Synthetic Construct
  source 1..21: mol_type = other DNA
ggccagtgctgcctttactga

SEQ ID NO: 26165 - DNA, 20 bp, synthetic construct
  misc_feature 1..20: note = Synthetic Construct
  source 1..20: mol_type = other DNA
cccatcctgcctgcacagaa

SEQ ID NO: 26166 - DNA, 20 bp, synthetic construct
  misc_feature 1..20: note = Synthetic Construct
  source 1..20: mol_type = other DNA
cagggcgccccttctctatg

SEQ ID NO: 26167 - DNA, 20 bp, synthetic construct
  misc_feature 1..20: note = Synthetic Construct
  source 1..20: mol_type = other DNA
ccctcagctctggcatcttg

SEQ ID NO: 26168 - DNA, 20 bp, synthetic construct
  misc_feature 1..20: note = Synthetic Construct
  source 1..20: mol_type = other DNA
tcacagtggcgaggcttgaa

SEQ ID NO: 26169 - DNA, 21 bp, synthetic construct
  misc_feature 1..21: note = Synthetic Construct
  source 1..21: mol_type = other DNA
cccaggggccaggattaacat

SEQ ID NO: 26170 - DNA, 20 bp, synthetic construct
  misc_feature 1..20: note = Synthetic Construct
  source 1..20: mol_type = other DNA
tgggcagcagagcactcaaa

SEQ ID NO: 26171 - DNA, 23 bp, synthetic construct
  misc_feature 1..23: note = Synthetic Construct
  source 1..23: mol_type = other DNA
ggacagctccagggaacaagaaa

SEQ ID NO: 26172 - DNA, 21 bp, synthetic construct
  misc_feature 1..21: note = Synthetic Construct
  source 1..21: mol_type = other DNA
ttctccgggcagcaattacat

SEQ ID NO: 26173 - DNA, 21 bp, synthetic construct
  misc_feature 1..21: note = Synthetic Construct
  source 1..21: mol_type = other DNA
tgggctatggccttcagtttg

SEQ ID NO: 26174 - DNA, 20 bp, synthetic construct
  misc_feature 1..20: note = Synthetic Construct
  source 1..20: mol_type = other DNA
tgcccagttcccagcacact

SEQ ID NO: 26175 - DNA, 20 bp, synthetic construct
  misc_feature 1..20: note = Synthetic Construct
  source 1..20: mol_type = other DNA
gctggacccagaccctctga

SEQ ID NO: 26176 - DNA, 20 bp, synthetic construct
  misc_feature 1..20: note = Synthetic Construct
  source 1..20: mol_type = other DNA
cgaaggtgtctgggctgcaa

SEQ ID NO: 26177 - DNA, 22 bp, synthetic construct
  misc_feature 1..22: note = Synthetic Construct
  source 1..22: mol_type = other DNA
tgacgatgagtggtggtaggtt

SEQ ID NO: 26178 - DNA, 21 bp, synthetic construct
  misc_feature 1..21: note = Synthetic Construct
  source 1..21: mol_type = other DNA
caagcacttcctcacctggat

SEQ ID NO: 26179 - DNA, 19 bp, synthetic construct
  misc_feature 1..19: note = Synthetic Construct
  source 1..19: mol_type = other DNA
tgggccaaaggccccaaga

SEQ ID NO: 26180 - DNA, 22 bp, synthetic construct
  misc_feature 1..22: note = Synthetic Construct
  source 1..22: mol_type = other DNA
aacatttcagccagagggaaca

SEQ ID NO: 26181 - DNA, 20 bp, synthetic construct
  misc_feature 1..20: note = Synthetic Construct
  source 1..20: mol_type = other DNA
ccagcctgggaggctacaga

SEQ ID NO: 26182 - DNA, 26 bp, synthetic construct
  misc_feature 1..26: note = Synthetic Construct
  source 1..26: mol_type = other DNA
cgcgaggagtacaaaataggggagtt

SEQ ID NO: 26183 - DNA, 20 bp, synthetic construct
  misc_feature 1..20: note = Synthetic Construct
  source 1..20: mol_type = other DNA
ggcaaatggaaggggtcaca

SEQ ID NO: 26184 - DNA, 27 bp, synthetic construct
  misc_feature 1..27: note = Synthetic Construct
  source 1..27: mol_type = other DNA
ccaaggtgtagctaacttttcctgtag

SEQ ID NO: 26185 - DNA, 24 bp, synthetic construct
  misc_feature 1..24: note = Synthetic Construct
  source 1..24: mol_type = other DNA
tgacatcctcctgagttgctgcta

SEQ ID NO: 26186 - DNA, 19 bp, synthetic construct
  misc_feature 1..19: note = Synthetic Construct
  source 1..19: mol_type = other DNA
acggaggtgggagcaggtt

SEQ ID NO: 26187 - DNA, 23 bp, synthetic construct
  misc_feature 1..23: note = Synthetic Construct
  source 1..23: mol_type = other DNA
cacatccaacgagctgcagtaga

SEQ ID NO: 26188 - DNA, 21 bp, synthetic construct
  misc_feature 1..21: note = Synthetic Construct
  source 1..21: mol_type = other DNA
tcactccgccactaggagttg

SEQ ID NO: 26189 - DNA, 21 bp, synthetic construct
  misc_feature 1..21: note = Synthetic Construct
  source 1..21: mol_type = other DNA
ccgtgggaagggattgtcatc

SEQ ID NO: 26190 - DNA, 20 bp, synthetic construct
  misc_feature 1..20: note = Synthetic Construct
  source 1..20: mol_type = other DNA
cctggcaatggcaaggaaga

SEQ ID NO: 26191 - DNA, 22 bp, synthetic construct
  misc_feature 1..22: note = Synthetic Construct
  source 1..22: mol_type = other DNA
gcatccacagaatccgttcact

SEQ ID NO: 26192 - DNA, 21 bp, synthetic construct
  misc_feature 1..21: note = Synthetic Construct
  source 1..21: mol_type = other DNA
acagagcaggagctggagcat

SEQ ID NO: 26193 - DNA, 22 bp, synthetic construct
  misc_feature 1..22: note = Synthetic Construct
  source 1..22: mol_type = other DNA
ccagctcagccattcacgcata

SEQ ID NO: 26194 - DNA, 21 bp, synthetic construct
  misc_feature 1..21: note = Synthetic Construct
  source 1..21: mol_type = other DNA
cctttccctctccccttctca

SEQ ID NO: 26195 - DNA, 24 bp, synthetic construct
  misc_feature 1..24: note = Synthetic Construct
  source 1..24: mol_type = other DNA
cctgacagacacctcccatacctt

SEQ ID NO: 26196 - DNA, 22 bp, synthetic construct
  misc_feature 1..22: note = Synthetic Construct
  source 1..22: mol_type = other DNA
gtgccaccaccctcatctaaac

SEQ ID NO: 26197 - DNA, 22 bp, synthetic construct
  misc_feature 1..22: note = Synthetic Construct
  source 1..22: mol_type = other DNA
ggtatcagctaggaggctgtga

SEQ ID NO: 26198 - DNA, 21 bp, synthetic construct
  misc_feature 1..21: note = Synthetic Construct
  source 1..21: mol_type = other DNA
ggcactgggactcgtcaaaac

SEQ ID NO: 26199 - DNA, 20 bp, synthetic construct
  misc_feature 1..20: note = Synthetic Construct
  source 1..20: mol_type = other DNA
gcggttctgcagcatgacaa

SEQ ID NO: 26200 - DNA, 19 bp, synthetic construct
  misc_feature 1..19: note = Synthetic Construct
  source 1..19: mol_type = other DNA
tggcccagccgcagtctaa

SEQ ID NO: 26201 - DNA, 22 bp, synthetic construct
  misc_feature 1..22: note = Synthetic Construct
  source 1..22: mol_type = other DNA
tccagtgaacgactctgtggta

SEQ ID NO: 26202 - DNA, 28 bp, synthetic construct
  misc_feature 1..28: note = Synthetic Construct
  source 1..28: mol_type = other DNA
cagctaatgtgggaggaatttctagact

SEQ ID NO: 26203 - DNA, 22 bp, synthetic construct
  misc_feature 1..22: note = Synthetic Construct
  source 1..22: mol_type = other DNA
agactgagctgtgggaccttct

SEQ ID NO: 26204 - DNA, 19 bp, synthetic construct
  misc_feature 1..19: note = Synthetic Construct
  source 1..19: mol_type = other DNA
tgggatggggccgtagcaa

SEQ ID NO: 26205 - DNA, 22 bp, synthetic construct
  misc_feature 1..22: note = Synthetic Construct
  source 1..22: mol_type = other DNA
accctgagagggtgctacaatg

SEQ ID NO: 26206 - DNA, 21 bp, synthetic construct
  misc_feature 1..21: note = Synthetic Construct
  source 1..21: mol_type = other DNA
gcctctctcgggctcttgact

SEQ ID NO: 26207 - DNA, 21 bp, synthetic construct
  misc_feature 1..21: note = Synthetic Construct
  source 1..21: mol_type = other DNA
agagcacatcccacctgaaga

SEQ ID NO: 26208 - DNA, 21 bp, synthetic construct
  misc_feature 1..21: note = Synthetic Construct
  source 1..21: mol_type = other DNA
agagcctgctctgttctctgt

SEQ ID NO: 26209 - DNA, 20 bp, synthetic construct
  misc_feature 1..20: note = Synthetic Construct
  source 1..20: mol_type = other DNA
tagggcccttggacctgcat

SEQ ID NO: 26210 - DNA, 20 bp, synthetic construct
  misc_feature 1..20: note = Synthetic Construct
  source 1..20: mol_type = other DNA
aatgccgagctggactggtt

SEQ ID NO: 26211 - DNA, 23 bp, synthetic construct
  misc_feature 1..23: note = Synthetic Construct
  source 1..23: mol_type = other DNA
acctggatgtcctgaaactcaac

SEQ ID NO: 26212 - DNA, 21 bp, synthetic construct
  misc_feature 1..21: note = Synthetic Construct
  source 1..21: mol_type = other DNA
agtgccagctcagccctaaga

SEQ ID NO: 26213 - DNA, 22 bp, synthetic construct
  misc_feature 1..22: note = Synthetic Construct
  source 1..22: mol_type = other DNA
gttcgtttgcggaaatgcaaaa

SEQ ID NO: 26214 - DNA, 21 bp, synthetic construct
  misc_feature 1..21: note = Synthetic Construct
  source 1..21: mol_type = other DNA
cagggctggagagacaaactt

SEQ ID NO: 26215 - DNA, 22 bp, synthetic construct
  misc_feature 1..22: note = Synthetic Construct
  source 1..22: mol_type = other DNA
ctgttaaccgcttctcctcctt

SEQ ID NO: 26216 - DNA, 23 bp, synthetic construct
  misc_feature 1..23: note = Synthetic Construct
  source 1..23: mol_type = other DNA
ccctacccagtctcactgctcaa

SEQ ID NO: 26217 - DNA, 20 bp, synthetic construct
  misc_feature 1..20: note = Synthetic Construct
  source 1..20: mol_type = other DNA
tgcacaggcgtgtcacatac

SEQ ID NO: 26218 - DNA, 20 bp, synthetic construct
  misc_feature 1..20: note = Synthetic Construct
  source 1..20: mol_type = other DNA
acctcacctggagggacaag

SEQ ID NO: 26219 - DNA, 23 bp, synthetic construct
  misc_feature 1..23: note = Synthetic Construct
  source 1..23: mol_type = other DNA
gctatgcaggccaaacaggctat

SEQ ID NO: 26220 - DNA, 23 bp, synthetic construct
  misc_feature 1..23: note = Synthetic Construct
  source 1..23: mol_type = other DNA
ggtacctagggtgcaaggcaaag

SEQ ID NO: 26221 - DNA, 20 bp, synthetic construct
  misc_feature 1..20: note = Synthetic Construct
  source 1..20: mol_type = other DNA
gcaagggaaagcggctgact

SEQ ID NO: 26222 - DNA, 22 bp, synthetic construct
  misc_feature 1..22: note = Synthetic Construct
  source 1..22: mol_type = other DNA
gggagaggcgtgaaggaattga

SEQ ID NO: 26223 - DNA, 22 bp, synthetic construct
  misc_feature 1..22: note = Synthetic Construct
  source 1..22: mol_type = other DNA
agatggatcacaggaggcgtaa

SEQ ID NO: 26224 - DNA, 22 bp, synthetic construct
  misc_feature 1..22: note = Synthetic Construct
  source 1..22: mol_type = other DNA
cccaggagtgggagggaatttt

SEQ ID NO: 26225 - DNA, 22 bp, synthetic construct
  misc_feature 1..22: note = Synthetic Construct
  source 1..22: mol_type = other DNA
tccacccattcaacaagggttt

SEQ ID NO: 26226 - DNA, 24 bp, synthetic construct
  misc_feature 1..24: note = Synthetic Construct
  source 1..24: mol_type = other DNA
cgtgaggaacattggccattcaga

SEQ ID NO: 26227 - DNA, 21 bp, synthetic construct
  misc_feature 1..21: note = Synthetic Construct
  source 1..21: mol_type = other DNA
gtgatctggggccttcacttc

SEQ ID NO: 26228 - DNA, 26 bp, synthetic construct
  misc_feature 1..26: note = Synthetic Construct
  source 1..26: mol_type = other DNA
cctgacctgtgcgaagagattaattg

SEQ ID NO: 26229 - DNA, 25 bp, synthetic construct
  misc_feature 1..25: note = Synthetic Construct
  source 1..25: mol_type = other DNA
ccactttgttaggcctgggatcctt

SEQ ID NO: 26230 - DNA, 21 bp, synthetic construct
  misc_feature 1..21: note = Synthetic Construct
  source 1..21: mol_type = other DNA
cttgtgctgagagacctggtt

SEQ ID NO: 26231 - DNA, 20 bp, synthetic construct
  misc_feature 1..20: note = Synthetic Construct
  source 1..20: mol_type = other DNA
gtccctgtctggcgtgtttt

SEQ ID NO: 26232 - DNA, 21 bp, synthetic construct
  misc_feature 1..21: note = Synthetic Construct
  source 1..21: mol_type = other DNA
accccaccctgactccagaag

SEQ ID NO: 26233 - DNA, 19 bp, synthetic construct
  misc_feature 1..19: note = Synthetic Construct
  source 1..19: mol_type = other DNA
agcggaggtctgcttgtct

SEQ ID NO: 26234 - DNA, 26 bp, synthetic construct
  misc_feature 1..26: note = Synthetic Construct
  source 1..26: mol_type = other DNA
ggagtaagaatggacagcaagaagat

SEQ ID NO: 26235 - DNA, 23 bp, synthetic construct
  misc_feature 1..23: note = Synthetic Construct
  source 1..23: mol_type = other DNA
gaaacatcgtgggactcttgtca

SEQ ID NO: 26236 - DNA, 20 bp, synthetic construct
  misc_feature 1..20: note = Synthetic Construct
  source 1..20: mol_type = other DNA
ggtggaagggacgcttgaga

SEQ ID NO: 26237 - DNA, 22 bp, synthetic construct
  misc_feature 1..22: note = Synthetic Construct
  source 1..22: mol_type = other DNA
ccctctaagctaacacggcaat

SEQ ID NO: 26238 - DNA, 23 bp, synthetic construct
  misc_feature 1..23: note = Synthetic Construct
  source 1..23: mol_type = other DNA
agcacctggcacttctaaataca

SEQ ID NO: 26239 - DNA, 23 bp, synthetic construct
  misc_feature 1..23: note = Synthetic Construct
  source 1..23: mol_type = other DNA
cctaggacagaacctctcccata

SEQ ID NO: 26240 - DNA, 19 bp, synthetic construct
  misc_feature 1..19: note = Synthetic Construct
  source 1..19: mol_type = other DNA
tctggcccggcatactcaa

SEQ ID NO: 26241 - DNA, 22 bp, synthetic construct
  misc_feature 1..22: note = Synthetic Construct
  source 1..22: mol_type = other DNA
ggccaagcagtttagggaatga

SEQ ID NO: 26242 - DNA, 22 bp, synthetic construct
  misc_feature 1..22: note = Synthetic Construct
  source 1..22: mol_type = other DNA
gcctccagcaatacctccttgt

SEQ ID NO: 26243 - DNA, 23 bp, synthetic construct
  misc_feature 1..23: note = Synthetic Construct
  source 1..23: mol_type = other DNA
tgacagtttggggccaataagtt

SEQ ID NO: 26244 - DNA, 20 bp, synthetic construct
  misc_feature 1..20: note = Synthetic Construct
  source 1..20: mol_type = other DNA
atccccagcccttcaaccat

SEQ ID NO: 26245 - DNA, 24 bp, synthetic construct
  misc_feature 1..24: note = Synthetic Construct
  source 1..24: mol_type = other DNA
tcagtagctgagctcaaaatgctt

SEQ ID NO: 26246 - DNA, 19 bp, synthetic construct
  misc_feature 1..19: note = Synthetic Construct
  source 1..19: mol_type = other DNA
tggcagggtctcccttgat

SEQ ID NO: 26247 - DNA, 23 bp, synthetic construct
  misc_feature 1..23: note = Synthetic Construct
  source 1..23: mol_type = other DNA
cagaaaggcagcaatttggacat

SEQ ID NO: 26248 - DNA, 19 bp, synthetic construct
  misc_feature 1..19: note = Synthetic Construct
  source 1..19: mol_type = other DNA
ttgtgtccggcgccttgta

SEQ ID NO: 26249 - DNA, 21 bp, synthetic construct
  misc_feature 1..21: note = Synthetic Construct
  source 1..21: mol_type = other DNA
ccagcctccctgagccctaat

SEQ ID NO: 26250 - DNA, 22 bp, synthetic construct
  misc_feature 1..22: note = Synthetic Construct
  source 1..22: mol_type = other DNA
ggccttgggtccaaagcaaaga

SEQ ID NO: 26251 - DNA, 23 bp, synthetic construct
  misc_feature 1..23: note = Synthetic Construct
  source 1..23: mol_type = other DNA
gggttcttctgctcaacggattg

SEQ ID NO: 26252 - DNA, 23 bp, synthetic construct
  misc_feature 1..23: note = Synthetic Construct
  source 1..23: mol_type = other DNA
ggactcttgccctgcttccaaat

SEQ ID NO: 26253 - DNA, 22 bp, synthetic construct
  misc_feature 1..22: note = Synthetic Construct
  source 1..22: mol_type = other DNA
ctcgggtgcatgctatttgtct

SEQ ID NO: 26254 - DNA, 22 bp, synthetic construct
  misc_feature 1..22: note = Synthetic Construct
  source 1..22: mol_type = other DNA
tgaagtggagggagctgatagt

SEQ ID NO: 26255 - DNA, 23 bp, synthetic construct
  misc_feature 1..23: note = Synthetic Construct
  source 1..23: mol_type = other DNA
gcaattgtgtaggtggagacaga

SEQ ID NO: 26256 - DNA, 21 bp, synthetic construct
  misc_feature 1..21: note = Synthetic Construct
  source 1..21: mol_type = other DNA
aagggccacctctccttggaa

SEQ ID NO: 26257 - DNA, 21 bp, synthetic construct
  misc_feature 1..21: note = Synthetic Construct
  source 1..21: mol_type = other DNA
caccatgctccacagatcctt

SEQ ID NO: 26258 - DNA, 20 bp, synthetic construct
  misc_feature 1..20: note = Synthetic Construct
  source 1..20: mol_type = other DNA
gccattctgtgtggctccaa

SEQ ID NO: 26259 - DNA, 27 bp, synthetic construct
  misc_feature 1..27: note = Synthetic Construct
  source 1..27: mol_type = other DNA
gtcaggtaaaaggctgagacttaattg

SEQ ID NO: 26260 - DNA, 22 bp, synthetic construct
  misc_feature 1..22: note = Synthetic Construct
  source 1..22: mol_type = other DNA
gtcctgctgcaagaaccagctt

SEQ ID NO: 26261 - DNA, 25 bp, synthetic construct
  misc_feature 1..25: note = Synthetic Construct
  source 1..25: mol_type = other DNA
cgtggttagccttgattctgttttc

SEQ ID NO: 26262 - DNA, 22 bp, synthetic construct
  misc_feature 1..22: note = Synthetic Construct
  source 1..22: mol_type = other DNA
gtcacccacctacactggcaaa

SEQ ID NO: 26263 - DNA, 24 bp, synthetic construct
  misc_feature 1..24: note = Synthetic Construct
  source 1..24: mol_type = other DNA
tctctcctttcctcaagctgaatg

SEQ ID NO: 26264 - DNA, 24 bp, synthetic construct
  misc_feature 1..24: note = Synthetic Construct
  source 1..24: mol_type = other DNA
ccctggaaggtcctaggttgcttt

SEQ ID NO: 26265 - DNA, 20 bp, synthetic construct
  misc_feature 1..20: note = Synthetic Construct
  source 1..20: mol_type = other DNA
ccatgcagttcggccatgat

SEQ ID NO: 26266 - DNA, 23 bp, synthetic construct
  misc_feature 1..23: note = Synthetic Construct
  source 1..23: mol_type = other DNA
ttgaaagcatggacctcgtaagt

SEQ ID NO: 26267 - DNA, 22 bp, synthetic construct
  misc_feature 1..22: note = Synthetic Construct
  source 1..22: mol_type = other DNA
ggtctccaaaagtggtcactca

SEQ ID NO: 26268 - DNA, 22 bp, synthetic construct
  misc_feature 1..22: note = Synthetic Construct
  source 1..22: mol_type = other DNA
ggcccctatatggcccattgaa

SEQ ID NO: 26269 - DNA, 20 bp, synthetic construct
  misc_feature 1..20: note = Synthetic Construct
  source 1..20: mol_type = other DNA
accgccgcctagactaaaag

SEQ ID NO: 26270 - DNA, 20 bp, synthetic construct
  misc_feature 1..20: note = Synthetic Construct
  source 1..20: mol_type = other DNA
ccccactggatctgcaccat

SEQ ID NO: 26271 - DNA, 23 bp, synthetic construct
  misc_feature 1..23: note = Synthetic Construct
  source 1..23: mol_type = other DNA
ctgggtgcccctacattcatttg

SEQ ID NO: 26272 - DNA, 21 bp, synthetic construct
  misc_feature 1..21: note = Synthetic Construct
  source 1..21: mol_type = other DNA
cacaccactgtcctggtcatc

SEQ ID NO: 26273 - DNA, 20 bp, synthetic construct
  misc_feature 1..20: note = Synthetic Construct
  source 1..20: mol_type = other DNA
ggcagaagccagaacagtca

SEQ ID NO: 26274 - DNA, 21 bp, synthetic construct
  misc_feature 1..21: note = Synthetic Construct
  source 1..21: mol_type = other DNA
ccagtgggagttagcctgatg

SEQ ID NO: 26275 - DNA, 22 bp, synthetic construct
  misc_feature 1..22: note = Synthetic Construct
  source 1..22: mol_type = other DNA
tggaggtggccttgacctttga

SEQ ID NO: 26276 - DNA, 21 bp, synthetic construct
  misc_feature 1..21: note = Synthetic Construct
  source 1..21: mol_type = other DNA
agaagccacgccatggataaa

SEQ ID NO: 26277 - DNA, 22 bp, synthetic construct
  misc_feature 1..22: note = Synthetic Construct
  source 1..22: mol_type = other DNA
gggcatacagaagcaccaatca

SEQ ID NO: 26278 - DNA, 23 bp, synthetic construct
  misc_feature 1..23: note = Synthetic Construct
  source 1..23: mol_type = other DNA
cttgaggacggcaaatgctgtat

SEQ ID NO: 26279 - DNA, 23 bp, synthetic construct
  misc_feature 1..23: note = Synthetic Construct
  source 1..23: mol_type = other DNA
cctgggctagtacagaacacatc

SEQ ID NO: 26280 - DNA, 22 bp, synthetic construct
  misc_feature 1..22: note = Synthetic Construct
  source 1..22: mol_type = other DNA
gaatctcggggctcttctgtct

SEQ ID NO: 26281 - DNA, 24 bp, synthetic construct
  misc_feature 1..24: note = Synthetic Construct
  source 1..24: mol_type = other DNA
cccctggaagaagtttggggctat

SEQ ID NO: 26282 - DNA, 24 bp, synthetic construct
  misc_feature 1..24: note = Synthetic Construct
  source 1..24: mol_type = other DNA
atcttcctggtgtttcactccttt

SEQ ID NO: 26283 - DNA, 26 bp, synthetic construct
  misc_feature 1..26: note = Synthetic Construct
  source 1..26: mol_type = other DNA
caatcaacctagttcaggagtacagt

SEQ ID NO: 26284 - DNA, 21 bp, synthetic construct
  misc_feature 1..21: note = Synthetic Construct
  source 1..21: mol_type = other DNA
ttctggcctcacaagcaaagt

SEQ ID NO: 26285 - DNA, 21 bp, synthetic construct
  misc_feature 1..21: note = Synthetic Construct
  source 1..21: mol_type = other DNA
cctgatcgctggctgtcagat

SEQ ID NO: 26286 - DNA, 20 bp, synthetic construct
  misc_feature 1..20: note = Synthetic Construct
  source 1..20: mol_type = other DNA
tggggccagcatttggtgtt

SEQ ID NO: 26287 - DNA, 25 bp, synthetic construct
  misc_feature 1..25: note = Synthetic Construct
  source 1..25: mol_type = other DNA
gtacctttatccccagtggtcttca

SEQ ID NO: 26288 - DNA, 21 bp, synthetic construct
  misc_feature 1..21: note = Synthetic Construct
  source 1..21: mol_type = other DNA
agccctgtgagcctcagattc

SEQ ID NO: 26289 - DNA, 23 bp, synthetic construct
  misc_feature 1..23: note = Synthetic Construct
  source 1..23: mol_type = other DNA
gtgtgcccatattaggtccttga

SEQ ID NO: 26290 - DNA, 23 bp, synthetic construct
  misc_feature 1..23: note = Synthetic Construct
  source 1..23: mol_type = other DNA
gactatgccacctgcttgctgta

SEQ ID NO: 26291 - DNA, 24 bp, synthetic construct
  misc_feature 1..24: note = Synthetic Construct
  source 1..24: mol_type = other DNA
cagggcatcatgatcagtttggaa

SEQ ID NO: 26292 - DNA, 24 bp, synthetic construct
  misc_feature 1..24: note = Synthetic Construct
  source 1..24: mol_type = other DNA
caggacacacgttaaagccacaga

SEQ ID NO: 26293 - DNA, 23 bp, synthetic construct
  misc_feature 1..23: note = Synthetic Construct
  source 1..23: mol_type = other DNA
catgccagaaccattctcgtctt

SEQ ID NO: 26294 - DNA, 20 bp, synthetic construct
  misc_feature 1..20: note = Synthetic Construct
  source 1..20: mol_type = other DNA
ggccagcaactgggtctcta

SEQ ID NO: 26295 - DNA, 23 bp, synthetic construct
  misc_feature 1..23: note = Synthetic Construct
  source 1..23: mol_type = other DNA
tcaggatatctgctcccttccat

SEQ ID NO: 26296 - DNA, 26 bp, synthetic construct
  misc_feature 1..26: note = Synthetic Construct
  source 1..26: mol_type = other DNA
ccatctgctgtagcgaatatgtgaag

SEQ ID NO: 26297 - DNA, 24 bp, synthetic construct
  misc_feature 1..24: note = Synthetic Construct
  source 1..24: mol_type = other DNA
catacctaagcaatttggctgcaa

SEQ ID NO: 26298 - DNA, 20 bp, synthetic construct
  misc_feature 1..20: note = Synthetic Construct
  source 1..20: mol_type = other DNA
ccagctcagaggaccagcta

SEQ ID NO: 26299 - DNA, 19 bp, synthetic construct
  misc_feature 1..19: note = Synthetic Construct
  source 1..19: mol_type = other DNA
ttggctggggcgagggtat

SEQ ID NO: 26300 - DNA, 23 bp, synthetic construct
  misc_feature 1..23: note = Synthetic Construct
  source 1..23: mol_type = other DNA
tcatggttccttctggggaaatg

SEQ ID NO: 26301 - DNA, 24 bp, synthetic construct
  misc_feature 1..24: note = Synthetic Construct
  source 1..24: mol_type = other DNA
cttccatgtccaacagatctgaca

SEQ ID NO: 26302 - DNA, 20 bp, synthetic construct
  misc_feature 1..20: note = Synthetic Construct
  source 1..20: mol_type = other DNA
cagcaaggccatgtgtcaac

SEQ ID NO: 26303 - DNA, 20 bp, synthetic construct
  misc_feature 1..20: note = Synthetic Construct
  source 1..20: mol_type = other DNA
gcagtgacaggaccgcatga

SEQ ID NO: 26304 - DNA, 26 bp, synthetic construct
  misc_feature 1..26: note = Synthetic Construct
  source 1..26: mol_type = other DNA
cagtagtaccaccctaaccacctttg

SEQ ID NO: 26305 - DNA, 24 bp, synthetic construct
  misc_feature 1..24: note = Synthetic Construct
  source 1..24: mol_type = other DNA
ctcaatggggtgattggcctcata

SEQ ID NO: 26306 - DNA, 20 bp, synthetic construct
  misc_feature 1..20: note = Synthetic Construct
  source 1..20: mol_type = other DNA
ctttgtccagccccaacact

SEQ ID NO: 26307 - DNA, 27 bp, synthetic construct
  misc_feature 1..27: note = Synthetic Construct
  source 1..27: mol_type = other DNA
gttgacccaaaccaatcagatacttca

SEQ ID NO: 26308 - DNA, 24 bp, synthetic construct
  misc_feature 1..24: note = Synthetic Construct
  source 1..24: mol_type = other DNA
gggttggtgtctattcctgtcaag

SEQ ID NO: 26309 - DNA, 23 bp, synthetic construct
  misc_feature 1..23: note = Synthetic Construct
  source 1..23: mol_type = other DNA
cacctctctgagttgcactttct

SEQ ID NO: 26310 - DNA, 20 bp, synthetic construct
  misc_feature 1..20: note = Synthetic Construct
  source 1..20: mol_type = other DNA
agttcgccaacctccaaaca

SEQ ID NO: 26311 - DNA, 22 bp, synthetic construct
  misc_feature 1..22: note = Synthetic Construct
  source 1..22: mol_type = other DNA
gcctcacgtcttttagctctgt

SEQ ID NO: 26312 - DNA, 20 bp, synthetic construct
  misc_feature 1..20: note = Synthetic Construct
  source 1..20: mol_type = other DNA
ccgcatccagcgaccaaagt

SEQ ID NO: 26313 - DNA, 22 bp, synthetic construct
  misc_feature 1..22: note = Synthetic Construct
  source 1..22: mol_type = other DNA
gtgtggcagcagcagagtaagt

SEQ ID NO: 26314 - DNA, 20 bp, synthetic construct
  misc_feature 1..20: note = Synthetic Construct
  source 1..20: mol_type = other DNA
tcactgcctctccctcaact

SEQ ID NO: 26315 - DNA, 20 bp, synthetic construct
  misc_feature 1..20: note = Synthetic Construct
  source 1..20: mol_type = other DNA
ccacaaagcgggctggaaaa

SEQ ID NO: 26316 - DNA, 21 bp, synthetic construct
  misc_feature 1..21: note = Synthetic Construct
  source 1..21: mol_type = other DNA
aaacggcaggaggctctgtca

SEQ ID NO: 26317 - DNA, 19 bp, synthetic construct
  misc_feature 1..19: note = Synthetic Construct
  source 1..19: mol_type = other DNA
tgagactgggaggcagcaa

SEQ ID NO: 26318 - DNA, 26 bp, synthetic construct
  misc_feature 1..26: note = Synthetic Construct
  source 1..26: mol_type = other DNA
gtttcggttgagtagagttacctgat

SEQ ID NO: 26319 - DNA, 22 bp, synthetic construct
  misc_feature 1..22: note = Synthetic Construct
  source 1..22: mol_type = other DNA
ggcatgggtgtgtagctgtttg

SEQ ID NO: 26320 - DNA, 22 bp, synthetic construct
  misc_feature 1..22: note = Synthetic Construct
  source 1..22: mol_type = other DNA
cgttcatcaaccagcggagtct

SEQ ID NO: 26321 - DNA, 22 bp, synthetic construct
  misc_feature 1..22: note = Synthetic Construct
  source 1..22: mol_type = other DNA
ccaacacttggcactgaactga

SEQ ID NO: 26322 - DNA, 20 bp, synthetic construct
  misc_feature 1..20: note = Synthetic Construct
  source 1..20: mol_type = other DNA
ttctgctgcctgggaacttg

SEQ ID NO: 26323 - DNA, 22 bp, synthetic construct
  misc_feature 1..22: note = Synthetic Construct
  source 1..22: mol_type = other DNA
caacctccttggctttgacaga

SEQ ID NO: 26324 - DNA, 23 bp, synthetic construct
  misc_feature 1..23: note = Synthetic Construct
  source 1..23: mol_type = other DNA
tgcacactgattgtcaccattct

SEQ ID NO: 26325 - DNA, 23 bp, synthetic construct
  misc_feature 1..23: note = Synthetic Construct
  source 1..23: mol_type = other DNA
ttcaggctcccctggtaccatac

SEQ ID NO: 26326 - DNA, 19 bp, synthetic construct
  misc_feature 1..19: note = Synthetic Construct
  source 1..19: mol_type = other DNA
agcccagggtcctgtgtca

SEQ ID NO: 26327 - DNA, 23 bp, synthetic construct
  misc_feature 1..23: note = Synthetic Construct
  source 1..23: mol_type = other DNA
cttctccatgctcactctgcatt

SEQ ID NO: 26328 - DNA, 25 bp, synthetic construct
  misc_feature 1..25: note = Synthetic Construct
  source 1..25: mol_type = other DNA
aggcaatttaaagttggagccagta

SEQ ID NO: 26329 - DNA, 23 bp, synthetic construct
  misc_feature 1..23: note = Synthetic Construct
  source 1..23: mol_type = other DNA
ggacctgaacggggactcttttg

SEQ ID NO: 26330 - DNA, 21 bp, synthetic construct
  misc_feature 1..21: note = Synthetic Construct
  source 1..21: mol_type = other DNA
cagctaccccacagcgaacta

SEQ ID NO: 26331 - DNA, 23 bp, synthetic construct
  misc_feature 1..23: note = Synthetic Construct
  source 1..23: mol_type = other DNA
caagtagctggactaggctgcat

SEQ ID NO: 26332 - DNA, 21 bp, synthetic construct
  misc_feature 1..21: note = Synthetic Construct
  source 1..21: mol_type = other DNA
aagcacagtggtcatggttga

SEQ ID NO: 26333 - DNA, 23 bp, synthetic construct
  misc_feature 1..23: note = Synthetic Construct
  source 1..23: mol_type = other DNA
cctgcctatgttaccctttccat

SEQ ID NO: 26334 - DNA, 27 bp, synthetic construct
  misc_feature 1..27: note = Synthetic Construct
  source 1..27: mol_type = other DNA
gcaccagagaattaatcagatcgtttg

SEQ ID NO: 26335 - DNA, 22 bp, synthetic construct
  misc_feature 1..22: note = Synthetic Construct
  source 1..22: mol_type = other DNA
ggacaagcactgcccacatagt

SEQ ID NO: 26336 - DNA, 20 bp, synthetic construct
  misc_feature 1..20: note = Synthetic Construct
  source 1..20: mol_type = other DNA
gtggcggtcactgcttaact

SEQ ID NO: 26337 - DNA, 20 bp, synthetic construct
  misc_feature 1..20: note = Synthetic Construct
  source 1..20: mol_type = other DNA
ggcctggccaagggtaggat

SEQ ID NO: 26338 - DNA, 23 bp, synthetic construct
  misc_feature 1..23: note = Synthetic Construct
  source 1..23: mol_type = other DNA
ggccagtccagtccaagggaata

SEQ ID NO: 26339 - DNA, 21 bp, synthetic construct
  misc_feature 1..21: note = Synthetic Construct
  source 1..21: mol_type = other DNA
tcttgggctatgcagcaactt

SEQ ID NO: 26340 - DNA, 20 bp, synthetic construct
  misc_feature 1..20: note = Synthetic Construct
  source 1..20: mol_type = other DNA
cacatgccccacttcaggat

SEQ ID NO: 26341 - DNA, 22 bp, synthetic construct
  misc_feature 1..22: note = Synthetic Construct
  source 1..22: mol_type = other DNA
cagtgttcccagaggcaacttc

SEQ ID NO: 26342 - DNA, 25 bp, synthetic construct
  misc_feature 1..25: note = Synthetic Construct
  source 1..25: mol_type = other DNA
ggacaagagaagtatgccaaagatg

SEQ ID NO: 26343 - DNA, 24 bp, synthetic construct
  misc_feature 1..24: note = Synthetic Construct
  source 1..24: mol_type = other DNA
cctagagattacgggcagtccaaa

SEQ ID NO: 26344 - DNA, 20 bp, synthetic construct
  misc_feature 1..20: note = Synthetic Construct
  source 1..20: mol_type = other DNA
agcgccttgactcctcttca

SEQ ID NO: 26345 - DNA, 22 bp, synthetic construct
  misc_feature 1..22: note = Synthetic Construct
  source 1..22: mol_type = other DNA
attggccattgccaggcacaga

SEQ ID NO: 26346 - DNA, 18 bp, synthetic construct
  misc_feature 1..18: note = Synthetic Construct
  source 1..18: mol_type = other DNA
aggccctcagcgaacctt

SEQ ID NO: 26347 - DNA, 20 bp, synthetic construct
  misc_feature 1..20: note = Synthetic Construct
  source 1..20: mol_type = other DNA
tgctccaacccctgatcaac

SEQ ID NO: 26348 - DNA, 22 bp, synthetic construct
  misc_feature 1..22: note = Synthetic Construct
  source 1..22: mol_type = other DNA
accctgactacaactgcactga

SEQ ID NO: 26349 - DNA, 22 bp, synthetic construct
  misc_feature 1..22: note = Synthetic Construct
  source 1..22: mol_type = other DNA
ggcctgggaaaaggagcaagat

SEQ ID NO: 26350 - DNA, 25 bp, synthetic construct
  misc_feature 1..25: note = Synthetic Construct
  source 1..25: mol_type = other DNA
gtcgtcctctatgtggagaatgaga

SEQ ID NO: 26351 - DNA, 20 bp, synthetic construct
  misc_feature 1..20: note = Synthetic Construct
  source 1..20: mol_type = other DNA
acccaggatgagtgcagaga

SEQ ID NO: 26352 - DNA, 22 bp, synthetic construct
  misc_feature 1..22: note = Synthetic Construct
  source 1..22: mol_type = other DNA
cccctcaaacagaccacacata

SEQ ID NO: 26353 - DNA, 22 bp, synthetic construct
  misc_feature 1..22: note = Synthetic Construct
  source 1..22: mol_type = other DNA
agggagccctttggcttctaca

SEQ ID NO: 26354 - DNA, 21 bp, synthetic construct
  misc_feature 1..21: note = Synthetic Construct
  source 1..21: mol_type = other DNA
ggccagtttctggtcttcctt

SEQ ID NO: 26355 - DNA, 20 bp, synthetic construct
  misc_feature 1..20: note = Synthetic Construct
  source 1..20: mol_type = other DNA
cttcctggggcagctagtgt

SEQ ID NO: 26356 - DNA, 24 bp, synthetic construct
  misc_feature 1..24: note = Synthetic Construct
  source 1..24: mol_type = other DNA
gttccagtagcccatcttgctatg

SEQ ID NO: 26357 - DNA, 20 bp, synthetic construct
  misc_feature 1..20: note = Synthetic Construct
  source 1..20: mol_type = other DNA
tagccttcccgagctgaaga

SEQ ID NO: 26358 - DNA, 20 bp, synthetic construct
  misc_feature 1..20: note = Synthetic Construct
  source 1..20: mol_type = other DNA
gggacggaagtggcctgaga

SEQ ID NO: 26359 - DNA, 20 bp, synthetic construct
  misc_feature 1..20: note = Synthetic Construct
  source 1..20: mol_type = other DNA
ctccctgaggctggcctttc

SEQ ID NO: 26360 - DNA, 21 bp, synthetic construct
  misc_feature 1..21: note = Synthetic Construct
  source 1..21: mol_type = other DNA
ggagcacccagcttcagtgtt

SEQ ID NO: 26361 - DNA, 20 bp, synthetic construct
  misc_feature 1..20: note = Synthetic Construct
  source 1..20: mol_type = other DNA
aacgaggaaggccggtgatt

SEQ ID NO: 26362 - DNA, 21 bp, synthetic construct
  misc_feature 1..21: note = Synthetic Construct
  source 1..21: mol_type = other DNA
tgatgacggtgatggcagaca

SEQ ID NO: 26363 - DNA, 23 bp, synthetic construct
  misc_feature 1..23: note = Synthetic Construct
  source 1..23: mol_type = other DNA
tccgcaggtacttcatagaggat

SEQ ID NO: 26364 - DNA, 22 bp, synthetic construct
  misc_feature 1..22: note = Synthetic Construct
  source 1..22: mol_type = other DNA
ccacctgatgcattcccactca

SEQ ID NO: 26365 - DNA, 24 bp, synthetic construct
  misc_feature 1..24: note = Synthetic Construct
  source 1..24: mol_type = other DNA
tgagggatcttgcacagtaacttc

SEQ ID NO: 26366 - DNA, 21 bp, synthetic construct
  misc_feature 1..21: note = Synthetic Construct
  source 1..21: mol_type = other DNA
aggtgctaggcactcctcaca

SEQ ID NO: 26367 - DNA, 21 bp, synthetic construct
  misc_feature 1..21: note = Synthetic Construct
  source 1..21: mol_type = other DNA
gcaccaggctcttcagggttt

SEQ ID NO: 26368 - DNA, 25 bp, synthetic construct
  misc_feature 1..25: note = Synthetic Construct
  source 1..25: mol_type = other DNA
gcaggccaaattgaggactatggtt

SEQ ID NO: 26369 - DNA, 26 bp, synthetic construct
  misc_feature 1..26: note = Synthetic Construct
  source 1..26: mol_type = other DNA
cttctcttccctatttcgtcttcgtt

SEQ ID NO: 26370 - DNA, 22 bp, synthetic construct
  misc_feature 1..22: note = Synthetic Construct
  source 1..22: mol_type = other DNA
ggtgggagtaatggcagtctga

SEQ ID NO: 26371 - DNA, 23 bp, synthetic construct
  misc_feature 1..23: note = Synthetic Construct
  source 1..23: mol_type = other DNA
gcagagaggacactcacccatct

SEQ ID NO: 26372 - DNA, 21 bp, synthetic construct
  misc_feature 1..21: note = Synthetic Construct
  source 1..21: mol_type = other DNA
tgggtccttgcctagttgaga

SEQ ID NO: 26373 - DNA, 19 bp, synthetic construct
  misc_feature 1..19: note = Synthetic Construct
  source 1..19: mol_type = other DNA
ttccgcggacagtgcagat

SEQ ID NO: 26374 - DNA, 23 bp, synthetic construct
  misc_feature 1..23: note = Synthetic Construct
  source 1..23: mol_type = other DNA
cacagctctgctctccaccatag

SEQ ID NO: 26375 - DNA, 20 bp, synthetic construct
  misc_feature 1..20: note = Synthetic Construct
  source 1..20: mol_type = other DNA
aaacgagtcgaggccagtca

SEQ ID NO: 26376 - DNA, 23 bp, synthetic construct
  misc_feature 1..23: note = Synthetic Construct
  source 1..23: mol_type = other DNA
cgtgaggtcatgtttgagctgta

SEQ ID NO: 26377 - DNA, 20 bp, synthetic construct
  misc_feature 1..20: note = Synthetic Construct
  source 1..20: mol_type = other DNA
tgaggtgctggctgggatgt

SEQ ID NO: 26378 - DNA, 22 bp, synthetic construct
  misc_feature 1..22: note = Synthetic Construct
  source 1..22: mol_type = other DNA
gccaggctcacgcacataatca

SEQ ID NO: 26379 - DNA, 24 bp, synthetic construct
  misc_feature 1..24: note = Synthetic Construct
  source 1..24: mol_type = other DNA
ggggtggtatccatctttcactgt

SEQ ID NO: 26380 - DNA, 23 bp, synthetic construct
  misc_feature 1..23: note = Synthetic Construct
  source 1..23: mol_type = other DNA
ttagccgagtccttagcatcatc

SEQ ID NO: 26381 - DNA, 20 bp, synthetic construct
  misc_feature 1..20: note = Synthetic Construct
  source 1..20: mol_type = other DNA
tggaggtcccagggctctaa

SEQ ID NO: 26382 - DNA, 24 bp, synthetic construct
  misc_feature 1..24: note = Synthetic Construct
  source 1..24: mol_type = other DNA
cctgtgattactgcagcaggtgtt

SEQ ID NO: 26383 - DNA, 20 bp, synthetic construct
  misc_feature 1..20: note = Synthetic Construct
  source 1..20: mol_type = other DNA
tgttgggcccctcaacatca

SEQ ID NO: 26384 - DNA, 25 bp, synthetic construct
  misc_feature 1..25: note = Synthetic Construct
  source 1..25: mol_type = other DNA
ccccaacttaggctcgaagtaccat

SEQ ID NO: 26385 - DNA, 24 bp, synthetic construct
  misc_feature 1..24: note = Synthetic Construct
  source 1..24: mol_type = other DNA
gcccagaccagaaattccaagatg

SEQ ID NO: 26386 - DNA, 22 bp, synthetic construct
  misc_feature 1..22: note = Synthetic Construct
  source 1..22: mol_type = other DNA
aggtcgtggagtctgataccaa

SEQ ID NO: 26387 - DNA, 23 bp, synthetic construct
  misc_feature 1..23: note = Synthetic Construct
  source 1..23: mol_type = other DNA
gcaagagtggccataatcacttg

SEQ ID NO: 26388 - DNA, 22 bp, synthetic construct
  misc_feature 1..22: note = Synthetic Construct
  source 1..22: mol_type = other DNA
ccagcttggccacagaaaggta

SEQ ID NO: 26389 - DNA, 26 bp, synthetic construct
  misc_feature 1..26: note = Synthetic Construct
  source 1..26: mol_type = other DNA
ggaaagttttaagtaggaggcagtga

SEQ ID NO: 26390 - DNA, 19 bp, synthetic construct
  misc_feature 1..19: note = Synthetic Construct
  source 1..19: mol_type = other DNA
cctgcagagccgagtggat

SEQ ID NO: 26391 - DNA, 21 bp, synthetic construct
  misc_feature 1..21: note = Synthetic Construct
  source 1..21: mol_type = other DNA
ttgttctgcagctcaccagat

SEQ ID NO: 26392 - DNA, 19 bp, synthetic construct
  misc_feature 1..19: note = Synthetic Construct
  source 1..19: mol_type = other DNA
caaccagccacctgtgtgt

SEQ ID NO: 26393 - DNA, 19 bp, synthetic construct
  misc_feature 1..19: note = Synthetic Construct
  source 1..19: mol_type = other DNA
tctgcctgggctcctgctt

SEQ ID NO: 26394 - DNA, 22 bp, synthetic construct
  misc_feature 1..22: note = Synthetic Construct
  source 1..22: mol_type = other DNA
ggagccacaacagtgattccat

SEQ ID NO: 26395 - DNA, 22 bp, synthetic construct
  misc_feature 1..22: note = Synthetic Construct
  source 1..22: mol_type = other DNA
cccgaagcacatctctggtcat

SEQ ID NO: 26396 - DNA, 24 bp, synthetic construct
  misc_feature 1..24: note = Synthetic Construct
  source 1..24: mol_type = other DNA
cctgcaaaggcagctgagctaaag

SEQ ID NO: 26397 - DNA, 22 bp, synthetic construct
  misc_feature 1..22: note = Synthetic Construct
  source 1..22: mol_type = other DNA
tcacataggccacatcccttca

SEQ ID NO: 26398 - DNA, 20 bp, synthetic construct
  misc_feature 1..20: note = Synthetic Construct
  source 1..20: mol_type = other DNA
aggaaagtggcctgctgtga

SEQ ID NO: 26399 - DNA, 23 bp, synthetic construct
  misc_feature 1..23: note = Synthetic Construct
  source 1..23: mol_type = other DNA
ctaagggactcacccttcacttc

SEQ ID NO: 26400 - DNA, 21 bp, synthetic construct
  misc_feature 1..21: note = Synthetic Construct
  source 1..21: mol_type = other DNA
tccctggaacccaacttcaga

SEQ ID NO: 26401 - DNA, 22 bp, synthetic construct
  misc_feature 1..22: note = Synthetic Construct
  source 1..22: mol_type = other DNA
gggaaaagagggctctggaaca

SEQ ID NO: 26402 - DNA, 21 bp, synthetic construct
  misc_feature 1..21: note = Synthetic Construct
  source 1..21: mol_type = other DNA
aggcggtttcacatcttctgt

SEQ ID NO: 26403 - DNA, 20 bp, synthetic construct
  misc_feature 1..20: note = Synthetic Construct
  source 1..20: mol_type = other DNA
gaagccttgcagctgctttc

SEQ ID NO: 26404 - DNA, 22 bp, synthetic construct
  misc_feature 1..22: note = Synthetic Construct
  source 1..22: mol_type = other DNA
gtcataccagctggcccaacaa

SEQ ID NO: 26405 - DNA, 20 bp, synthetic construct
  misc_feature 1..20: note = Synthetic Construct
  source 1..20: mol_type = other DNA
ggtgctggggatgcagtttc

SEQ ID NO: 26406 - DNA, 20 bp, synthetic construct
  misc_feature 1..20: note = Synthetic Construct
  source 1..20: mol_type = other DNA
agaccccattcaggcactct

SEQ ID NO: 26407 - DNA, 22 bp, synthetic construct
  misc_feature 1..22: note = Synthetic Construct
  source 1..22: mol_type = other DNA
tgccctcctactgctggactaa

SEQ ID NO: 26408 - DNA, 22 bp, synthetic construct
  misc_feature 1..22: note = Synthetic Construct
  source 1..22: mol_type = other DNA
gctggagtgagtgaggcagact

SEQ ID NO: 26409 - DNA, 22 bp, synthetic construct
  misc_feature 1..22: note = Synthetic Construct
  source 1..22: mol_type = other DNA
ggaatccaaacaggcacagtga

SEQ ID NO: 26410 - DNA, 26 bp, synthetic construct
  misc_feature 1..26: note = Synthetic Construct
  source 1..26: mol_type = other DNA
ggaagggaatttgagcaagctgtttc

SEQ ID NO: 26411 - DNA, 22 bp, synthetic construct
  misc_feature 1..22: note = Synthetic Construct
  source 1..22: mol_type = other DNA
tggaaggctgtaccctcggttt

SEQ ID NO: 26412 - DNA, 19 bp, synthetic construct
  misc_feature 1..19: note = Synthetic Construct
  source 1..19: mol_type = other DNA
tgggaagctggcctcactt

SEQ ID NO: 26413 - DNA, 20 bp, synthetic construct
  misc_feature 1..20: note = Synthetic Construct
  source 1..20: mol_type = other DNA
acttcctggcaccctgaaac

SEQ ID NO: 26414 - DNA, 22 bp, synthetic construct
  misc_feature 1..22: note = Synthetic Construct
  source 1..22: mol_type = other DNA
agaacagagggcaggtcacact

SEQ ID NO: 26415 - DNA, 23 bp, synthetic construct
  misc_feature 1..23: note = Synthetic Construct
  source 1..23: mol_type = other DNA
gcatccttaacaagcaccaacat

SEQ ID NO: 26416 - DNA, 19 bp, synthetic construct
  misc_feature 1..19: note = Synthetic Construct
  source 1..19: mol_type = other DNA
cccagggctcagccgaaat

SEQ ID NO: 26417 - DNA, 24 bp, synthetic construct
  misc_feature 1..24: note = Synthetic Construct
  source 1..24: mol_type = other DNA
cctcagtggtgaggagactgtttg

SEQ ID NO: 26418 - DNA, 19 bp, synthetic construct
  misc_feature 1..19: note = Synthetic Construct
  source 1..19: mol_type = other DNA
ggcatggtggcgccttttg

SEQ ID NO: 26419 - DNA, 24 bp, synthetic construct
  misc_feature 1..24: note = Synthetic Construct
  source 1..24: mol_type = other DNA
gaatctgcccactttcaccattct

SEQ ID NO: 26420 - DNA, 22 bp, synthetic construct
  misc_feature 1..22: note = Synthetic Construct
  source 1..22: mol_type = other DNA
ggtgggcagtaaaaaggggatt

SEQ ID NO: 26421 - DNA, 22 bp, synthetic construct
  misc_feature 1..22: note = Synthetic Construct
  source 1..22: mol_type = other DNA
aggagaaagagcctgggcttca

SEQ ID NO: 26422 - DNA, 21 bp, synthetic construct
  misc_feature 1..21: note = Synthetic Construct
  source 1..21: mol_type = other DNA
gcttccttctggcccactgtt

SEQ ID NO: 26423 - DNA, 22 bp, synthetic construct
  misc_feature 1..22: note = Synthetic Construct
  source 1..22: mol_type = other DNA
tctggcctgtggctctctacaa

SEQ ID NO: 26424 - DNA, 20 bp, synthetic construct
  misc_feature 1..20: note = Synthetic Construct
  source 1..20: mol_type = other DNA
accgtgggaaagtgcaggaa

SEQ ID NO: 26425 - DNA, 24 bp, synthetic construct
  misc_feature 1..24: note = Synthetic Construct
  source 1..24: mol_type = other DNA
cacgaagacgaatgtatgcacaac

SEQ ID NO: 26426 - DNA, 18 bp, synthetic construct
  misc_feature 1..18: note = Synthetic Construct
  source 1..18: mol_type = other DNA
gcagctggctggctttca

SEQ ID NO: 26427 - DNA, 19 bp, synthetic construct
  misc_feature 1..19: note = Synthetic Construct
  source 1..19: mol_type = other DNA
acccagcacctggaaggat

SEQ ID NO: 26428 - DNA, 20 bp, synthetic construct
  misc_feature 1..20: note = Synthetic Construct
  source 1..20: mol_type = other DNA
accacaggctggctgatttc

SEQ ID NO: 26429 - DNA, 21 bp, synthetic construct
  misc_feature 1..21: note = Synthetic Construct
  source 1..21: mol_type = other DNA
ggcaaagggactgcctcttct

SEQ ID NO: 26430 - DNA, 27 bp, synthetic construct
  misc_feature 1..27: note = Synthetic Construct
  source 1..27: mol_type = other DNA
ctacatatacctgagcatcccatcaac

SEQ ID NO: 26431 - DNA, 21 bp, synthetic construct
  misc_feature 1..21: note = Synthetic Construct
  source 1..21: mol_type = other DNA
gctgcggaagcagaggaactt

SEQ ID NO: 26432 - DNA, 27 bp, synthetic construct
  misc_feature 1..27: note = Synthetic Construct
  source 1..27: mol_type = other DNA
gcaagtggtattttgggaggtgacata

SEQ ID NO: 26433 - DNA, 20 bp, synthetic construct
  misc_feature 1..20: note = Synthetic Construct
  source 1..20: mol_type = other DNA
aagcagctggggtgcagtgt

SEQ ID NO: 26434 - DNA, 22 bp, synthetic construct
  misc_feature 1..22: note = Synthetic Construct
  source 1..22: mol_type = other DNA
ccagcatcctcccaatttccat

SEQ ID NO: 26435 - DNA, 27 bp, synthetic construct
  misc_feature 1..27: note = Synthetic Construct
  source 1..27: mol_type = other DNA
caccctctgtgactcacttttccatta

SEQ ID NO: 26436 - DNA, 22 bp, synthetic construct
  misc_feature 1..22: note = Synthetic Construct
  source 1..22: mol_type = other DNA
ccacaggtttgggacagtgtaa

SEQ ID NO: 26437 - DNA, 22 bp, synthetic construct
  misc_feature 1..22: note = Synthetic Construct
  source 1..22: mol_type = other DNA
ctgggccattgtctggcctatt

SEQ ID NO: 26438 - DNA, 19 bp, synthetic construct
  misc_feature 1..19: note = Synthetic Construct
  source 1..19: mol_type = other DNA
ccatgcctggggtgactga

SEQ ID NO: 26439 - DNA, 20 bp, synthetic construct
  misc_feature 1..20: note = Synthetic Construct
  source 1..20: mol_type = other DNA
aggtgcttgtggcgtgtttg

SEQ ID NO: 26440 - DNA, 19 bp, synthetic construct
  misc_feature 1..19: note = Synthetic Construct
  source 1..19: mol_type = other DNA
tggaggcccaagggtgtca

SEQ ID NO: 26441 - DNA, 19 bp, synthetic construct
  misc_feature 1..19: note = Synthetic Construct
  source 1..19: mol_type = other DNA
accctaggccccagcatca

SEQ ID NO: 26442 - DNA, 19 bp, synthetic construct
  misc_feature 1..19: note = Synthetic Construct
  source 1..19: mol_type = other DNA
cctcctgcaaggcgtggaa

SEQ ID NO: 26443 - DNA, 25 bp, synthetic construct
  misc_feature 1..25: note = Synthetic Construct
  source 1..25: mol_type = other DNA
tgctttgagtttctgggactagttt

SEQ ID NO: 26444 - DNA, 22 bp, synthetic construct
  misc_feature 1..22: note = Synthetic Construct
  source 1..22: mol_type = other DNA
gaggctgtaaggcagccacttt

SEQ ID NO: 26445 - DNA, 21 bp, synthetic construct
  misc_feature 1..21: note = Synthetic Construct
  source 1..21: mol_type = other DNA
gacatggggccaagtgatctt

SEQ ID NO: 26446 - DNA, 24 bp, synthetic construct
  misc_feature 1..24: note = Synthetic Construct
  source 1..24: mol_type = other DNA
gatcatcctcttgacagggagttg

SEQ ID NO: 26447 - DNA, 22 bp, synthetic construct
  misc_feature 1..22: note = Synthetic Construct
  source 1..22: mol_type = other DNA
tgcctggcctggttgtacttct

SEQ ID NO: 26448 - DNA, 22 bp, synthetic construct
  misc_feature 1..22: note = Synthetic Construct
  source 1..22: mol_type = other DNA
ggatcgcgggtttcatccagaa

SEQ ID NO: 26449 - DNA, 22 bp, synthetic construct
  misc_feature 1..22: note = Synthetic Construct
  source 1..22: mol_type = other DNA
ctgcaccggccaaaatgaggat

SEQ ID NO: 26450 - DNA, 26 bp, synthetic construct
  misc_feature 1..26: note = Synthetic Construct
  source 1..26: mol_type = other DNA
acagaagcccagtttggtatatgtag

SEQ ID NO: 26451 - DNA, 27 bp, synthetic construct
  misc_feature 1..27: note = Synthetic Construct
  source 1..27: mol_type = other DNA
gtggattcctgttttgttctcaacttc

SEQ ID NO: 26452 - DNA, 22 bp, synthetic construct
  misc_feature 1..22: note = Synthetic Construct
  source 1..22: mol_type = other DNA
tgcccagaagtgcctagaaaac

SEQ ID NO: 26453 - DNA, 22 bp, synthetic construct
  misc_feature 1..22: note = Synthetic Construct
  source 1..22: mol_type = other DNA
ccagcaagaagacagagtgtca

SEQ ID NO: 26454 - DNA, 21 bp, synthetic construct
  misc_feature 1..21: note = Synthetic Construct
  source 1..21: mol_type = other DNA
ctgtctgctggggtagagttg

SEQ ID NO: 26455 - DNA, 22 bp, synthetic construct
  misc_feature 1..22: note = Synthetic Construct
  source 1..22: mol_type = other DNA
tcatccctacagctgggaccat

SEQ ID NO: 26456 - DNA, 24 bp, synthetic construct
  misc_feature 1..24: note = Synthetic Construct
  source 1..24: mol_type = other DNA
caggcactctacaccaggagaaat

SEQ ID NO: 26457 - DNA, 21 bp, synthetic construct
  misc_feature 1..21: note = Synthetic Construct
  source 1..21: mol_type = other DNA
gaggcagctctgagcatacaa

SEQ ID NO: 26458 - DNA, 23 bp, synthetic construct
  misc_feature 1..23: note = Synthetic Construct
  source 1..23: mol_type = other DNA
cccaagtgaggcatagtggtttc

SEQ ID NO: 26459 - DNA, 22 bp, synthetic construct
  misc_feature 1..22: note = Synthetic Construct
  source 1..22: mol_type = other DNA
cgccccgactttgtctttgact

SEQ ID NO: 26460 - DNA, 23 bp, synthetic construct
  misc_feature 1..23: note = Synthetic Construct
  source 1..23: mol_type = other DNA
gtctgttggatgttgctgtttca

SEQ ID NO: 26461 - DNA, 22 bp, synthetic construct
  misc_feature 1..22: note = Synthetic Construct
  source 1..22: mol_type = other DNA
gggcataatcagggagccagaa

SEQ ID NO: 26462 - DNA, 24 bp, synthetic construct
  misc_feature 1..24: note = Synthetic Construct
  source 1..24: mol_type = other DNA
ggagaccattggcctgcttcatag

SEQ ID NO: 26463 - DNA, 22 bp, synthetic construct
  misc_feature 1..22: note = Synthetic Construct
  source 1..22: mol_type = other DNA
acactttgaacgtccaggcaaa

SEQ ID NO: 26464 - DNA, 24 bp, synthetic construct
  misc_feature 1..24: note = Synthetic Construct
  source 1..24: mol_type = other DNA
gagtcctgggatgtgaaccatcta

SEQ ID NO: 26465 - DNA, 20 bp, synthetic construct
  misc_feature 1..20: note = Synthetic Construct
  source 1..20: mol_type = other DNA
ttcaggactggtgcctgctt

SEQ ID NO: 26466 - DNA, 21 bp, synthetic construct
  misc_feature 1..21: note = Synthetic Construct
  source 1..21: mol_type = other DNA
tgaggccacctcccagataaa

SEQ ID NO: 26467 - DNA, 19 bp, synthetic construct
  misc_feature 1..19: note = Synthetic Construct
  source 1..19: mol_type = other DNA
gcacagcaggttgctctca

SEQ ID NO: 26468 - DNA, 22 bp, synthetic construct
  misc_feature 1..22: note = Synthetic Construct
  source 1..22: mol_type = other DNA
tgaagaggtttgctgcacacta

SEQ ID NO: 26469 - DNA, 20 bp, synthetic construct
  misc_feature 1..20: note = Synthetic Construct
  source 1..20: mol_type = other DNA
agcccctcatcactgtggta

SEQ ID NO: 26470 - DNA, 20 bp, synthetic construct
  misc_feature 1..20: note = Synthetic Construct
  source 1..20: mol_type = other DNA
ctttcgggttgtgcctgcat

SEQ ID NO: 26471 - DNA, 19 bp, synthetic construct
  misc_feature 1..19: note = Synthetic Construct
  source 1..19: mol_type = other DNA
acctggcacgttccgtaca

SEQ ID NO: 26472 - DNA, 24 bp, synthetic construct
  misc_feature 1..24: note = Synthetic Construct
  source 1..24: mol_type = other DNA
ggcttccacccacatactaagaca

SEQ ID NO: 26473 - DNA, 23 bp, synthetic construct
  misc_feature 1..23: note = Synthetic Construct
  source 1..23: mol_type = other DNA
ctggggtctgaaggcagagagta

SEQ ID NO: 26474 - DNA, 20 bp, synthetic construct
  misc_feature 1..20: note = Synthetic Construct
  source 1..20: mol_type = other DNA
tgggacgcctctcccctctt

SEQ ID NO: 26475 - DNA, 20 bp, synthetic construct
  misc_feature 1..20: note = Synthetic Construct
  source 1..20: mol_type = other DNA
tccatgacaggcagcacagt

SEQ ID NO: 26476 - DNA, 22 bp, synthetic construct
  misc_feature 1..22: note = Synthetic Construct
  source 1..22: mol_type = other DNA
gagcatagagcgtgcagggaaa

SEQ ID NO: 26477 - DNA, 20 bp, synthetic construct
  misc_feature 1..20: note = Synthetic Construct
  source 1..20: mol_type = other DNA
atgccagggtgccaaagtct

SEQ ID NO: 26478 - DNA, 21 bp, synthetic construct
  misc_feature 1..21: note = Synthetic Construct
  source 1..21: mol_type = other DNA
cagggcttgtggagaaagcat

SEQ ID NO: 26479 - DNA, 22 bp, synthetic construct
  misc_feature 1..22: note = Synthetic Construct
  source 1..22: mol_type = other DNA
agtgctggctgttgcctctttc

SEQ ID NO: 26480 - DNA, 22 bp, synthetic construct
  misc_feature 1..22: note = Synthetic Construct
  source 1..22: mol_type = other DNA
ggggaagcatggtggaagtagt

SEQ ID NO: 26481 - DNA, 19 bp, synthetic construct
  misc_feature 1..19: note = Synthetic Construct
  source 1..19: mol_type = other DNA
tcggctccctgccagcaaa

SEQ ID NO: 26482 - DNA, 20 bp, synthetic construct
  misc_feature 1..20: note = Synthetic Construct
  source 1..20: mol_type = other DNA
ggaagcatccggctctgact

SEQ ID NO: 26483 - DNA, 20 bp, synthetic construct
  misc_feature 1..20: note = Synthetic Construct
  source 1..20: mol_type = other DNA
ttgccaggggcacagcaaaa

SEQ ID NO: 26484 - DNA, 20 bp, synthetic construct
  misc_feature 1..20: note = Synthetic Construct
  source 1..20: mol_type = other DNA
gtgcatgccagcctgatttc

SEQ ID NO: 26485 - DNA, 19 bp, synthetic construct
  misc_feature 1..19: note = Synthetic Construct
  source 1..19: mol_type = other DNA
aggcctgctctggcatgtt

SEQ ID NO: 26486 - DNA, 20 bp, synthetic construct
  misc_feature 1..20: note = Synthetic Construct
  source 1..20: mol_type = other DNA
agcaaggggtggggtttgaa

SEQ ID NO: 26487 - DNA, 22 bp, synthetic construct
  misc_feature 1..22: note = Synthetic Construct
  source 1..22: mol_type = other DNA
tgtagaggggcctgactgttct

SEQ ID NO: 26488 - DNA, 25 bp, synthetic construct
  misc_feature 1..25: note = Synthetic Construct
  source 1..25: mol_type = other DNA
cactttgtctcttggtggagagtgt

SEQ ID NO: 26489 - DNA, 20 bp, synthetic construct
  misc_feature 1..20: note = Synthetic Construct
  source 1..20: mol_type = other DNA
accgtgcctggctgattgtt

SEQ ID NO: 26490 - DNA, 21 bp, synthetic construct
  misc_feature 1..21: note = Synthetic Construct
  source 1..21: mol_type = other DNA
ggccatggcagaaatgcaaga

SEQ ID NO: 26491 - DNA, 21 bp, synthetic construct
  misc_feature 1..21: note = Synthetic Construct
  source 1..21: mol_type = other DNA
caggccctagctcctggatga

SEQ ID NO: 26492 - DNA, 22 bp, synthetic construct
  misc_feature 1..22: note = Synthetic Construct
  source 1..22: mol_type = other DNA
gaccaagggcaggttacagaga

SEQ ID NO: 26493 - DNA, 26 bp, synthetic construct
  misc_feature 1..26: note = Synthetic Construct
  source 1..26: mol_type = other DNA
tcccagaataagaggtatgtggatca

SEQ ID NO: 26494 - DNA, 21 bp, synthetic construct
  misc_feature 1..21: note = Synthetic Construct
  source 1..21: mol_type = other DNA
tgtgcatggcccatcctatct

SEQ ID NO: 26495 - DNA, 20 bp, synthetic construct
  misc_feature 1..20: note = Synthetic Construct
  source 1..20: mol_type = other DNA
aacagggcaggcaggcagtt

SEQ ID NO: 26496 - DNA, 22 bp, synthetic construct
  misc_feature 1..22: note = Synthetic Construct
  source 1..22: mol_type = other DNA
gaggcccatttccacacagtga

SEQ ID NO: 26497 - DNA, 20 bp, synthetic construct
  misc_feature 1..20: note = Synthetic Construct
  source 1..20: mol_type = other DNA
gccccattgtccacgtcata

SEQ ID NO: 26498 - DNA, 20 bp, synthetic construct
  misc_feature 1..20: note = Synthetic Construct
  source 1..20: mol_type = other DNA
caccatgcccagccagaact

SEQ ID NO: 26499 - DNA, 20 bp, synthetic construct
  misc_feature 1..20: note = Synthetic Construct
  source 1..20: mol_type = other DNA
ggcagagagggtcctgttgt

SEQ ID NO: 26500 - DNA, 21 bp, synthetic construct
  misc_feature 1..21: note = Synthetic Construct
  source 1..21: mol_type = other DNA
gcccaagagagacacgctgat

SEQ ID NO: 26501 - DNA, 22 bp, synthetic construct
  misc_feature 1..22: note = Synthetic Construct
  source 1..22: mol_type = other DNA
accaccaccctctctccacaaa

SEQ ID NO: 26502 - DNA, 24 bp, synthetic construct
  misc_feature 1..24: note = Synthetic Construct
  source 1..24: mol_type = other DNA
gaattcataggtagggtggtggtt

SEQ ID NO: 26503 - DNA, 23 bp, synthetic construct
  misc_feature 1..23: note = Synthetic Construct
  source 1..23: mol_type = other DNA
ggctgatggtactcgttctccaa

SEQ ID NO: 26504 - DNA, 22 bp, synthetic construct
  misc_feature 1..22: note = Synthetic Construct
  source 1..22: mol_type = other DNA
tcccgctgctaaactgctgaag

SEQ ID NO: 26505 - DNA, 22 bp, synthetic construct
  misc_feature 1..22: note = Synthetic Construct
  source 1..22: mol_type = other DNA
gccagtgccagtctgaaagcat

SEQ ID NO: 26506 - DNA, 24 bp, synthetic construct
  misc_feature 1..24: note = Synthetic Construct
  source 1..24: mol_type = other DNA
cctaggtgggaaccactgaaggta

SEQ ID NO: 26507 - DNA, 20 bp, synthetic construct
  misc_feature 1..20: note = Synthetic Construct
  source 1..20: mol_type = other DNA
ttcagggaaggccctactgt

SEQ ID NO: 26508 - DNA, 19 bp, synthetic construct
  misc_feature 1..19: note = Synthetic Construct
  source 1..19: mol_type = other DNA
gcatgggctgcagtggaaa

SEQ ID NO: 26509 - DNA, 22 bp, synthetic construct
  misc_feature 1..22: note = Synthetic Construct
  source 1..22: mol_type = other DNA
cctcagcaggggaaagaagcaa

SEQ ID NO: 26510 - DNA, 20 bp, synthetic construct
  misc_feature 1..20: note = Synthetic Construct
  source 1..20: mol_type = other DNA
cgcaccacagtggcaaatct

SEQ ID NO: 26511 - DNA, 20 bp, synthetic construct
  misc_feature 1..20: note = Synthetic Construct
  source 1..20: mol_type = other DNA
gcagtacctgcggtgagcat

SEQ ID NO: 26512 - DNA, 24 bp, synthetic construct
  misc_feature 1..24: note = Synthetic Construct
  source 1..24: mol_type = other DNA
cccaaatttcttcggcttcacgat

SEQ ID NO: 26513 - DNA, 21 bp, synthetic construct
  misc_feature 1..21: note = Synthetic Construct
  source 1..21: mol_type = other DNA
agggttggaaggggagactga

SEQ ID NO: 26514 - DNA, 22 bp, synthetic construct
  misc_feature 1..22: note = Synthetic Construct
  source 1..22: mol_type = other DNA
gcttcagctgggatggtggtta

SEQ ID NO: 26515 - DNA, 21 bp, synthetic construct
  misc_feature 1..21: note = Synthetic Construct
  source 1..21: mol_type = other DNA
cccagggtgagaacccaagtt

SEQ ID NO: 26516 - DNA, 22 bp, synthetic construct
  misc_feature 1..22: note = Synthetic Construct
  source 1..22: mol_type = other DNA
ccttgccttgttcccatctttg

SEQ ID NO: 26517 - DNA, 22 bp, synthetic construct
  misc_feature 1..22: note = Synthetic Construct
  source 1..22: mol_type = other DNA
ttctgggccctttcttgctatc

SEQ ID NO: 26518 - DNA, 21 bp, synthetic construct
  misc_feature 1..21: note = Synthetic Construct
  source 1..21: mol_type = other DNA
ggacaaaacctgcacccattg

SEQ ID NO: 26519 - DNA, 22 bp, synthetic construct
  misc_feature 1..22: note = Synthetic Construct
  source 1..22: mol_type = other DNA
gccagtacatgtcaggcactta

SEQ ID NO: 26520 - DNA, 21 bp, synthetic construct
  misc_feature 1..21: note = Synthetic Construct
  source 1..21: mol_type = other DNA
agtgctgtgccattcaggaaa

SEQ ID NO: 26521 - DNA, 21 bp, synthetic construct
  misc_feature 1..21: note = Synthetic Construct
  source 1..21: mol_type = other DNA
gcccagtgtggaaacatggaa

SEQ ID NO: 26522 - DNA, 26 bp, synthetic construct
  misc_feature 1..26: note = Synthetic Construct
  source 1..26: mol_type = other DNA
ctgagagatgcagagacgatgagatg

SEQ ID NO: 26523 - DNA, 19 bp, synthetic construct
  misc_feature 1..19: note = Synthetic Construct
  source 1..19: mol_type = other DNA
cccagacagccctgcacaa

SEQ ID NO: 26524 - DNA, 20 bp, synthetic construct
  misc_feature 1..20: note = Synthetic Construct
  source 1..20: mol_type = other DNA
tggggcagtttcccagtagt

SEQ ID NO: 26525 - DNA, 20 bp, synthetic construct
  misc_feature 1..20: note = Synthetic Construct
  source 1..20: mol_type = other DNA
ttggaagcgagcagccatac

SEQ ID NO: 26526 - DNA, 23 bp, synthetic construct
  misc_feature 1..23: note = Synthetic Construct
  source 1..23: mol_type = other DNA
ccacctagtcctgggctctttag

SEQ ID NO: 26527 - DNA, 23 bp, synthetic construct
  misc_feature 1..23: note = Synthetic Construct
  source 1..23: mol_type = other DNA
gccaggaagcaatctccgtaatc

SEQ ID NO: 26528 - DNA, 24 bp, synthetic construct
  misc_feature 1..24: note = Synthetic Construct
  source 1..24: mol_type = other DNA
gcgcattatcaccactcagacttc

SEQ ID NO: 26529 - DNA, 19 bp, synthetic construct
  misc_feature 1..19: note = Synthetic Construct
  source 1..19: mol_type = other DNA
gccgtccaggcagtagttc

SEQ ID NO: 26530 - DNA, 20 bp, synthetic construct
  misc_feature 1..20: note = Synthetic Construct
  source 1..20: mol_type = other DNA
gctgctagactgcgggtttc

SEQ ID NO: 26531 - DNA, 19 bp, synthetic construct
  misc_feature 1..19: note = Synthetic Construct
  source 1..19: mol_type = other DNA
tgcatcgcccctccaccaa

SEQ ID NO: 26532 - DNA, 22 bp, synthetic construct
  misc_feature 1..22: note = Synthetic Construct
  source 1..22: mol_type = other DNA
actctgagtggaggtggccttt

SEQ ID NO: 26533 - DNA, 23 bp, synthetic construct
  misc_feature 1..23: note = Synthetic Construct
  source 1..23: mol_type = other DNA
ctccccaccaccactgagaataa

SEQ ID NO: 26534 - DNA, 24 bp, synthetic construct
  misc_feature 1..24: note = Synthetic Construct
  source 1..24: mol_type = other DNA
gtagactgctggggtttagagact

SEQ ID NO: 26535 - DNA, 22 bp, synthetic construct
  misc_feature 1..22: note = Synthetic Construct
  source 1..22: mol_type = other DNA
ggctcaccagtgttaccaggat

SEQ ID NO: 26536 - DNA, 18 bp, synthetic construct
  misc_feature 1..18: note = Synthetic Construct
  source 1..18: mol_type = other DNA
agggcctgtgagggttga

SEQ ID NO: 26537 - DNA, 21 bp, synthetic construct
  misc_feature 1..21: note = Synthetic Construct
  source 1..21: mol_type = other DNA
ggtggagtcagtggagccaaa

SEQ ID NO: 26538 - DNA, 21 bp, synthetic construct
  misc_feature 1..21: note = Synthetic Construct
  source 1..21: mol_type = other DNA
cggccaaagaggtttcgttct

SEQ ID NO: 26539 - DNA, 20 bp, synthetic construct
  misc_feature 1..20: note = Synthetic Construct
  source 1..20: mol_type = other DNA
gtggcccttgctgaccatta

SEQ ID NO: 26540 - DNA, 25 bp, synthetic construct
  misc_feature 1..25: note = Synthetic Construct
  source 1..25: mol_type = other DNA
cttccaccaagagatacaacagtga

SEQ ID NO: 26541 - DNA, 20 bp, synthetic construct
  misc_feature 1..20: note = Synthetic Construct
  source 1..20: mol_type = other DNA
attctgggctgggtcccaaa

SEQ ID NO: 26542 - DNA, 26 bp, synthetic construct
  misc_feature 1..26: note = Synthetic Construct
  source 1..26: mol_type = other DNA
cttttccccttcccatcatctgattc

SEQ ID NO: 26543 - DNA, 24 bp, synthetic construct
  misc_feature 1..24: note = Synthetic Construct
  source 1..24: mol_type = other DNA
cacatggtagcagggattgcaaga

SEQ ID NO: 26544 - DNA, 21 bp, synthetic construct
  misc_feature 1..21: note = Synthetic Construct
  source 1..21: mol_type = other DNA
ggggtgtccacctcgcttatg

SEQ ID NO: 26545 - DNA, 21 bp, synthetic construct
  misc_feature 1..21: note = Synthetic Construct
  source 1..21: mol_type = other DNA
ctggcagcaagaatccacctt

SEQ ID NO: 26546 - DNA, 22 bp, synthetic construct
  misc_feature 1..22: note = Synthetic Construct
  source 1..22: mol_type = other DNA
ccatcccacttgaccccaatca

SEQ ID NO: 26547 - DNA, 20 bp, synthetic construct
  misc_feature 1..20: note = Synthetic Construct
  source 1..20: mol_type = other DNA
acgtgccaagcacccaacaa

SEQ ID NO: 26548 - DNA, 19 bp, synthetic construct
  misc_feature 1..19: note = Synthetic Construct
  source 1..19: mol_type = other DNA
cagaaccggaggcaacagt

SEQ ID NO: 26549 - DNA, 24 bp, synthetic construct
  misc_feature 1..24: note = Synthetic Construct
  source 1..24: mol_type = other DNA
aggcacaactacctactcacaaag

SEQ ID NO: 26550 - DNA, 23 bp, synthetic construct
  misc_feature 1..23: note = Synthetic Construct
  source 1..23: mol_type = other DNA
ccagagcaaactcaggtgacaac

SEQ ID NO: 26551 - DNA, 27 bp, synthetic construct
  misc_feature 1..27: note = Synthetic Construct
  source 1..27: mol_type = other DNA
gggattacaggctacttttctagtctt

SEQ ID NO: 26552 - DNA, 22 bp, synthetic construct
  misc_feature 1..22: note = Synthetic Construct
  source 1..22: mol_type = other DNA
gtaaccactccctggctactgt

SEQ ID NO: 26553 - DNA, 22 bp, synthetic construct
  misc_feature 1..22: note = Synthetic Construct
  source 1..22: mol_type = other DNA
ctctgagctcttgcgtttctga

SEQ ID NO: 26554 - DNA, 23 bp, synthetic construct
  misc_feature 1..23: note = Synthetic Construct
  source 1..23: mol_type = other DNA
tgtgctctcagcactttttgtga

SEQ ID NO: 26555 - DNA, 20 bp, synthetic construct
  misc_feature 1..20: note = Synthetic Construct
  source 1..20: mol_type = other DNA
acctccaggcttgtgctact

SEQ ID NO: 26556 - DNA, 23 bp, synthetic construct
  misc_feature 1..23: note = Synthetic Construct
  source 1..23: mol_type = other DNA
acggtggaggctaaacaaaacat

SEQ ID NO: 26557 - DNA, 22 bp, synthetic construct
  misc_feature 1..22: note = Synthetic Construct
  source 1..22: mol_type = other DNA
ggtctgaccaccctactgaaga

SEQ ID NO: 26558 - DNA, 24 bp, synthetic construct
  misc_feature 1..24: note = Synthetic Construct
  source 1..24: mol_type = other DNA
gacaatgtcccctgactggaattt

SEQ ID NO: 26559 - DNA, 22 bp, synthetic construct
  misc_feature 1..22: note = Synthetic Construct
  source 1..22: mol_type = other DNA
cctcagggagcttgtagtctct

SEQ ID NO: 26560 - DNA, 24 bp, synthetic construct
  misc_feature 1..24: note = Synthetic Construct
  source 1..24: mol_type = other DNA
ggggttaagctttcaggagctaag

SEQ ID NO: 26561 - DNA, 22 bp, synthetic construct
  misc_feature 1..22: note = Synthetic Construct
  source 1..22: mol_type = other DNA
gggcttcagctggaagttgttg

SEQ ID NO: 26562 - DNA, 23 bp, synthetic construct
  misc_feature 1..23: note = Synthetic Construct
  source 1..23: mol_type = other DNA
gccccaaatttgcaatgcagtag

SEQ ID NO: 26563 - DNA, 24 bp, synthetic construct
  misc_feature 1..24: note = Synthetic Construct
  source 1..24: mol_type = other DNA
ctctacggaaatatgggcctgatg

SEQ ID NO: 26564 - DNA, 20 bp, synthetic construct
  misc_feature 1..20: note = Synthetic Construct
  source 1..20: mol_type = other DNA
ggaagccaagcagtgacagt

SEQ ID NO: 26565 - DNA, 24 bp, synthetic construct
  misc_feature 1..24: note = Synthetic Construct
  source 1..24: mol_type = other DNA
gtgtgatccagagcaagtcttcta

SEQ ID NO: 26566 - DNA, 20 bp, synthetic construct
  misc_feature 1..20: note = Synthetic Construct
  source 1..20: mol_type = other DNA
ctgcatcccacgttggcttt

SEQ ID NO: 26567 - DNA, 24 bp, synthetic construct
  misc_feature 1..24: note = Synthetic Construct
  source 1..24: mol_type = other DNA
ccacagaaccagagggacttgaac

SEQ ID NO: 26568 - DNA, 25 bp, synthetic construct
  misc_feature 1..25: note = Synthetic Construct
  source 1..25: mol_type = other DNA
ccaagcagggattagaaaagtctga

SEQ ID NO: 26569 - DNA, 22 bp, synthetic construct
  misc_feature 1..22: note = Synthetic Construct
  source 1..22: mol_type = other DNA
aggctagacctaggctttggat

SEQ ID NO: 26570 - DNA, 21 bp, synthetic construct
  misc_feature 1..21: note = Synthetic Construct
  source 1..21: mol_type = other DNA
gcccagggaaatcctctctgt

SEQ ID NO: 26571 - DNA, 20 bp, synthetic construct
  misc_feature 1..20: note = Synthetic Construct
  source 1..20: mol_type = other DNA
catgtcaagggcctgtcagt

SEQ ID NO: 26572 - DNA, 20 bp, synthetic construct
  misc_feature 1..20: note = Synthetic Construct
  source 1..20: mol_type = other DNA
cccacaagccaagccaacaa

SEQ ID NO: 26573 - DNA, 23 bp, synthetic construct
  misc_feature 1..23: note = Synthetic Construct
  source 1..23: mol_type = other DNA
cgatttttgcctcctggaacgaa

SEQ ID NO: 26574 - DNA, 22 bp, synthetic construct
  misc_feature 1..22: note = Synthetic Construct
  source 1..22: mol_type = other DNA
gagttgggtgtggggtgatgta

SEQ ID NO: 26575 - DNA, 23 bp, synthetic construct
  misc_feature 1..23: note = Synthetic Construct
  source 1..23: mol_type = other DNA
gaaagaccagctgttccatccaa

SEQ ID NO: 26576 - DNA, 24 bp, synthetic construct
  misc_feature 1..24: note = Synthetic Construct
  source 1..24: mol_type = other DNA
agagtgtgggataatggtggaaga

SEQ ID NO: 26577 - DNA, 24 bp, synthetic construct
  misc_feature 1..24: note = Synthetic Construct
  source 1..24: mol_type = other DNA
caggttctcacattgggactgact

SEQ ID NO: 26578 - DNA, 23 bp, synthetic construct
  misc_feature 1..23: note = Synthetic Construct
  source 1..23: mol_type = other DNA
acaggagtgttccagctaacatc

SEQ ID NO: 26579 - DNA, 24 bp, synthetic construct
  misc_feature 1..24: note = Synthetic Construct
  source 1..24: mol_type = other DNA
gcgcccagccagatttctgaatta

SEQ ID NO: 26580 - DNA, 22 bp, synthetic construct
  misc_feature 1..22: note = Synthetic Construct
  source 1..22: mol_type = other DNA
ggaaaacatgcccacccgagaa

SEQ ID NO: 26581 - DNA, 24 bp, synthetic construct
  misc_feature 1..24: note = Synthetic Construct
  source 1..24: mol_type = other DNA
gtccactcacaggtggagatgagt

SEQ ID NO: 26582 - DNA, 21 bp, synthetic construct
  misc_feature 1..21: note = Synthetic Construct
  source 1..21: mol_type = other DNA
tgccatccgctttgtttccta

SEQ ID NO: 26583 - DNA, 20 bp, synthetic construct
  misc_feature 1..20: note = Synthetic Construct
  source 1..20: mol_type = other DNA
caggcaggtggaggaactca

SEQ ID NO: 26584 - DNA, 20 bp, synthetic construct
  misc_feature 1..20: note = Synthetic Construct
  source 1..20: mol_type = other DNA
ttcgccagccacgaggaaat

SEQ ID NO: 26585 - DNA, 19 bp, synthetic construct
  misc_feature 1..19: note = Synthetic Construct
  source 1..19: mol_type = other DNA
gccccagcttggacagatg

SEQ ID NO: 26586 - DNA, 23 bp, synthetic construct
  misc_feature 1..23: note = Synthetic Construct
  source 1..23: mol_type = other DNA
gaaggaggccctagggaggattt

SEQ ID NO: 26587 - DNA, 20 bp, synthetic construct
  misc_feature 1..20: note = Synthetic Construct
  source 1..20: mol_type = other DNA
tcactcagactggggtgcaa

SEQ ID NO: 26588 - DNA, 22 bp, synthetic construct
  misc_feature 1..22: note = Synthetic Construct
  source 1..22: mol_type = other DNA
ggtccgctgacctctcaatctt

SEQ ID NO: 26589 - DNA, 21 bp, synthetic construct
  misc_feature 1..21: note = Synthetic Construct
  source 1..21: mol_type = other DNA
aggaactggaagccgctctct

SEQ ID NO: 26590 - DNA, 20 bp, synthetic construct
  misc_feature 1..20: note = Synthetic Construct
  source 1..20: mol_type = other DNA
gcacagtgagccactcttct

SEQ ID NO: 26591 - DNA, 22 bp, synthetic construct
  misc_feature 1..22: note = Synthetic Construct
  source 1..22: mol_type = other DNA
gggtggaggggtgtctaaaatg

SEQ ID NO: 26592 - DNA, 23 bp, synthetic construct
  misc_feature 1..23: note = Synthetic Construct
  source 1..23: mol_type = other DNA
gagtctacacgggtgtgagtaag

SEQ ID NO: 26593 - DNA, 23 bp, synthetic construct
  misc_feature 1..23: note = Synthetic Construct
  source 1..23: mol_type = other DNA
agggttagtgcggtaaatcaagt

SEQ ID NO: 26594 - DNA, 20 bp, synthetic construct
  misc_feature 1..20: note = Synthetic Construct
  source 1..20: mol_type = other DNA
ccgctgttgccttcggtgat

SEQ ID NO: 26595 - DNA, 22 bp, synthetic construct
  misc_feature 1..22: note = Synthetic Construct
  source 1..22: mol_type = other DNA
gtgggaagaggctgactttcaa

SEQ ID NO: 26596 - DNA, 21 bp, synthetic construct
  misc_feature 1..21: note = Synthetic Construct
  source 1..21: mol_type = other DNA
gcccagtgcctcacacttgta

SEQ ID NO: 26597 - DNA, 21 bp, synthetic construct
  misc_feature 1..21: note = Synthetic Construct
  source 1..21: mol_type = other DNA
aggcgggtgtctgtggaagat

SEQ ID NO: 26598 - DNA, 23 bp, synthetic construct
  misc_feature 1..23: note = Synthetic Construct
  source 1..23: mol_type = other DNA
tgccagctcagtatgtggaaatg

SEQ ID NO: 26599 - DNA, 27 bp, synthetic construct
  misc_feature 1..27: note = Synthetic Construct
  source 1..27: mol_type = other DNA
gtgcatctaatgaccaggagaagtcaa

SEQ ID NO: 26600 - DNA, 22 bp, synthetic construct
  misc_feature 1..22: note = Synthetic Construct
  source 1..22: mol_type = other DNA
tccccgcaaattctttcctctt

SEQ ID NO: 26601 - DNA, 20 bp, synthetic construct
  misc_feature 1..20: note = Synthetic Construct
  source 1..20: mol_type = other DNA
actggggctccagaatgtca

SEQ ID NO: 26602 - DNA, 20 bp, synthetic construct
  misc_feature 1..20: note = Synthetic Construct
  source 1..20: mol_type = other DNA
ggctgtgcatctgcatctct

SEQ ID NO: 26603 - DNA, 23 bp, synthetic construct
  misc_feature 1..23: note = Synthetic Construct
  source 1..23: mol_type = other DNA
agccccttacgagaagggcttag

SEQ ID NO: 26604 - DNA, 21 bp, synthetic construct
  misc_feature 1..21: note = Synthetic Construct
  source 1..21: mol_type = other DNA
tcggggttactggcagagcaa

SEQ ID NO: 26605 - DNA, 20 bp, synthetic construct
  misc_feature 1..20: note = Synthetic Construct
  source 1..20: mol_type = other DNA
acccgaacaagctggcatca

SEQ ID NO: 26606 - DNA, 26 bp, synthetic construct
  misc_feature 1..26: note = Synthetic Construct
  source 1..26: mol_type = other DNA
gggagctctatcctagggagttatag

SEQ ID NO: 26607 - DNA, 21 bp, synthetic construct
  misc_feature 1..21: note = Synthetic Construct
  source 1..21: mol_type = other DNA
ccgcgagaaagagaagagtca

SEQ ID NO: 26608 - DNA, 22 bp, synthetic construct
  misc_feature 1..22: note = Synthetic Construct
  source 1..22: mol_type = other DNA
gggttcagtcgggaaagtcaca

SEQ ID NO: 26609 - DNA, 22 bp, synthetic construct
  misc_feature 1..22: note = Synthetic Construct
  source 1..22: mol_type = other DNA
ctgggctttgaccagtgaggat

SEQ ID NO: 26610 - DNA, 23 bp, synthetic construct
  misc_feature 1..23: note = Synthetic Construct
  source 1..23: mol_type = other DNA
cacaccttttcccaggagctcta

SEQ ID NO: 26611 - DNA, 25 bp, synthetic construct
  misc_feature 1..25: note = Synthetic Construct
  source 1..25: mol_type = other DNA
ggtccagagtgtgtctaaaatgtca

SEQ ID NO: 26612 - DNA, 20 bp, synthetic construct
  misc_feature 1..20: note = Synthetic Construct
  source 1..20: mol_type = other DNA
cgtggaaatggcagccttca

SEQ ID NO: 26613 - DNA, 22 bp, synthetic construct
  misc_feature 1..22: note = Synthetic Construct
  source 1..22: mol_type = other DNA
tccatgcttagcacgccttaaa

SEQ ID NO: 26614 - DNA, 22 bp, synthetic construct
  misc_feature 1..22: note = Synthetic Construct
  source 1..22: mol_type = other DNA
gagcccaaaagtctggcactac

SEQ ID NO: 26615 - DNA, 19 bp, synthetic construct
  misc_feature 1..19: note = Synthetic Construct
  source 1..19: mol_type = other DNA
ggccggccacagtgagaaa

SEQ ID NO: 26616 - DNA, 20 bp, synthetic construct
  misc_feature 1..20: note = Synthetic Construct
  source 1..20: mol_type = other DNA
tggggcattgggatcctttg

SEQ ID NO: 26617 - DNA, 24 bp, synthetic construct
  misc_feature 1..24: note = Synthetic Construct
  source 1..24: mol_type = other DNA
aggtcgctgaagaatggtagattt

SEQ ID NO: 26618 - DNA, 23 bp, synthetic construct
  misc_feature 1..23: note = Synthetic Construct
  source 1..23: mol_type = other DNA
actactgtcacccgagtctttct

SEQ ID NO: 26619 - DNA, 21 bp, synthetic construct
  misc_feature 1..21: note = Synthetic Construct
  source 1..21: mol_type = other DNA
aaacgcaggctggctctggat

SEQ ID NO: 26620 - DNA, 24 bp, synthetic construct
  misc_feature 1..24: note = Synthetic Construct
  source 1..24: mol_type = other DNA
gaagtgcaatggggagaaaagaga

SEQ ID NO: 26621 - DNA, 23 bp, synthetic construct
  misc_feature 1..23: note = Synthetic Construct
  source 1..23: mol_type = other DNA
ccttggcccagttatgttcttga

SEQ ID NO: 26622 - DNA, 20 bp, synthetic construct
  misc_feature 1..20: note = Synthetic Construct
  source 1..20: mol_type = other DNA
ccccaagtgctgatggtgtt

SEQ ID NO: 26623 - DNA, 21 bp, synthetic construct
  misc_feature 1..21: note = Synthetic Construct
  source 1..21: mol_type = other DNA
atgcctagcacagggtagact

SEQ ID NO: 26624 - DNA, 22 bp, synthetic construct
  misc_feature 1..22: note = Synthetic Construct
  source 1..22: mol_type = other DNA
ccccagtaagctgtgactgaac

SEQ ID NO: 26625 - DNA, 23 bp, synthetic construct
  misc_feature 1..23: note = Synthetic Construct
  source 1..23: mol_type = other DNA
gagggaccctagatccagaggaa

SEQ ID NO: 26626 - DNA, 18 bp, synthetic construct
  misc_feature 1..18: note = Synthetic Construct
  source 1..18: mol_type = other DNA
tggcccacagctccacat

SEQ ID NO: 26627 - DNA, 21 bp, synthetic construct
  misc_feature 1..21: note = Synthetic Construct
  source 1..21: mol_type = other DNA
caaaggtgcaccaggctctct

SEQ ID NO: 26628 - DNA, 21 bp, synthetic construct
  misc_feature 1..21: note = Synthetic Construct
  source 1..21: mol_type = other DNA
gcgctggctacaatccgtgaa

SEQ ID NO: 26629 - DNA, 22 bp, synthetic construct
  misc_feature 1..22: note = Synthetic Construct
  source 1..22: mol_type = other DNA
acttccctcagccctacctcta

SEQ ID NO: 26630 - DNA, 23 bp, synthetic construct
  misc_feature 1..23: note = Synthetic Construct
  source 1..23: mol_type = other DNA
ggaagggtgtcctcagaccacat

SEQ ID NO: 26631 - DNA, 24 bp, synthetic construct
  misc_feature 1..24: note = Synthetic Construct
  source 1..24: mol_type = other DNA
cctcctctcacctcctactctttt

SEQ ID NO: 26632 - DNA, 24 bp, synthetic construct
  misc_feature 1..24: note = Synthetic Construct
  source 1..24: mol_type = other DNA
acatctgtccatcctttggagttt

SEQ ID NO: 26633 - DNA, 22 bp, synthetic construct
  misc_feature 1..22: note = Synthetic Construct
  source 1..22: mol_type = other DNA
ggggtggtcaacctgagaacat

SEQ ID NO: 26634 - DNA, 27 bp, synthetic construct
  misc_feature 1..27: note = Synthetic Construct
  source 1..27: mol_type = other DNA
actaacactttatctcctcagcctaga

SEQ ID NO: 26635 - DNA, 22 bp, synthetic construct
  misc_feature 1..22: note = Synthetic Construct
  source 1..22: mol_type = other DNA
accaacctacagcgacagaaag

SEQ ID NO: 26636 - DNA, 22 bp, synthetic construct
  misc_feature 1..22: note = Synthetic Construct
  source 1..22: mol_type = other DNA
gtgctgggtgctgaaggtaaag

SEQ ID NO: 26637 - DNA, 24 bp, synthetic construct
  misc_feature 1..24: note = Synthetic Construct
  source 1..24: mol_type = other DNA
ctgggaaattgcccctctatttct

SEQ ID NO: 26638 - DNA, 22 bp, synthetic construct
  misc_feature 1..22: note = Synthetic Construct
  source 1..22: mol_type = other DNA
gctctgaaattgtcccctgcaa

SEQ ID NO: 26639 - DNA, 22 bp, synthetic construct
  misc_feature 1..22: note = Synthetic Construct
  source 1..22: mol_type = other DNA
agtagggagccatggtagtgaa

SEQ ID NO: 26640 - DNA, 22 bp, synthetic construct
  misc_feature 1..22: note = Synthetic Construct
  source 1..22: mol_type = other DNA
cagcccgaggacacattagtca

SEQ ID NO: 26641 - DNA, 25 bp, synthetic construct
  misc_feature 1..25: note = Synthetic Construct
  source 1..25: mol_type = other DNA
gtctccaatgccttccgaaatgtgt

SEQ ID NO: 26642 - DNA, 23 bp, synthetic construct
  misc_feature 1..23: note = Synthetic Construct
  source 1..23: mol_type = other DNA
aagaagagccacactgagttgtt

SEQ ID NO: 26643 - DNA, 26 bp, synthetic construct
  misc_feature 1..26: note = Synthetic Construct
  source 1..26: mol_type = other DNA
caggagcctattcattttccccagaa

SEQ ID NO: 26644 - DNA, 24 bp, synthetic construct
  misc_feature 1..24: note = Synthetic Construct
  source 1..24: mol_type = other DNA
tcctgttgtggttcgatggtttag

SEQ ID NO: 26645 - DNA, 20 bp, synthetic construct
  misc_feature 1..20: note = Synthetic Construct
  source 1..20: mol_type = other DNA
gctggcgggaagtcacacaa

SEQ ID NO: 26646 - DNA, 24 bp, synthetic construct
  misc_feature 1..24: note = Synthetic Construct
  source 1..24: mol_type = other DNA
ccacaaaagaagatacccctgctt

SEQ ID NO: 26647 - DNA, 19 bp, synthetic construct
  misc_feature 1..19: note = Synthetic Construct
  source 1..19: mol_type = other DNA
ggctttcctcgtggcttga

SEQ ID NO: 26648 - DNA, 24 bp, synthetic construct
  misc_feature 1..24: note = Synthetic Construct
  source 1..24: mol_type = other DNA
gtcccagtttcaccctgaaggatt

SEQ ID NO: 26649 - DNA, 23 bp, synthetic construct
  misc_feature 1..23: note = Synthetic Construct
  source 1..23: mol_type = other DNA
cctgggaaaggtgagatcagaca

SEQ ID NO: 26650 - DNA, 22 bp, synthetic construct
  misc_feature 1..22: note = Synthetic Construct
  source 1..22: mol_type = other DNA
gagcaattggctggcaatgagt

SEQ ID NO: 26651 - DNA, 20 bp, synthetic construct
  misc_feature 1..20: note = Synthetic Construct
  source 1..20: mol_type = other DNA
agcaccaccaaaaggcaact

SEQ ID NO: 26652 - DNA, 20 bp, synthetic construct
  misc_feature 1..20: note = Synthetic Construct
  source 1..20: mol_type = other DNA
aatgcaccctctccctgctt

SEQ ID NO: 26653 - DNA, 20 bp, synthetic construct
  misc_feature 1..20: note = Synthetic Construct
  source 1..20: mol_type = other DNA
catgggtgcacctgttctca

SEQ ID NO: 26654 - DNA, 20 bp, synthetic construct
  misc_feature 1..20: note = Synthetic Construct
  source 1..20: mol_type = other DNA
acctgggcctgcctgtatga

SEQ ID NO: 26655 - DNA, 20 bp, synthetic construct
  misc_feature 1..20: note = Synthetic Construct
  source 1..20: mol_type = other DNA
tcaggcccactccccggtta

SEQ ID NO: 26656 - DNA, 22 bp, synthetic construct
  misc_feature 1..22: note = Synthetic Construct
  source 1..22: mol_type = other DNA
tgctgtgggaagcatgagtaac

SEQ ID NO: 26657 - DNA, 21 bp, synthetic construct
  misc_feature 1..21: note = Synthetic Construct
  source 1..21: mol_type = other DNA
gctggagctggtagcaacact

SEQ ID NO: 26658 - DNA, 23 bp, synthetic construct
  misc_feature 1..23: note = Synthetic Construct
  source 1..23: mol_type = other DNA
gcaagtctgcttgcagaaagaaa

SEQ ID NO: 26659 - DNA, 24 bp, synthetic construct
  misc_feature 1..24: note = Synthetic Construct
  source 1..24: mol_type = other DNA
aagcagtgagtttgcttgtgatac

SEQ ID NO: 26660 - DNA, 19 bp, synthetic construct
  misc_feature 1..19: note = Synthetic Construct
  source 1..19: mol_type = other DNA
gggcggcccttcgttcaaa

SEQ ID NO: 26661 - DNA, 24 bp, synthetic construct
  misc_feature 1..24: note = Synthetic Construct
  source 1..24: mol_type = other DNA
gggatagactgagggtcagggaaa

SEQ ID NO: 26662 - DNA, 22 bp, synthetic construct
  misc_feature 1..22: note = Synthetic Construct
  source 1..22: mol_type = other DNA
agggaagagcccagagacatca

SEQ ID NO: 26663 - DNA, 19 bp, synthetic construct
  misc_feature 1..19: note = Synthetic Construct
  source 1..19: mol_type = other DNA
ccttcggccttggctctac

SEQ ID NO: 26664 - DNA, 22 bp, synthetic construct
  misc_feature 1..22: note = Synthetic Construct
  source 1..22: mol_type = other DNA
ggggtgggacacatggaaatca

SEQ ID NO: 26665 - DNA, 23 bp, synthetic construct
  misc_feature 1..23: note = Synthetic Construct
  source 1..23: mol_type = other DNA
ccacagctatgcccttcttctct

SEQ ID NO: 26666 - DNA, 21 bp, synthetic construct
  misc_feature 1..21: note = Synthetic Construct
  source 1..21: mol_type = other DNA
gtctccagtgctgtggtgaag

SEQ ID NO: 26667 - DNA, 20 bp, synthetic construct
  misc_feature 1..20: note = Synthetic Construct
  source 1..20: mol_type = other DNA
tgtggcaacggcgaactgat

SEQ ID NO: 26668 - DNA, 21 bp, synthetic construct
  misc_feature 1..21: note = Synthetic Construct
  source 1..21: mol_type = other DNA
agagagcgtcacctgcttatg

SEQ ID NO: 26669 - DNA, 22 bp, synthetic construct
  misc_feature 1..22: note = Synthetic Construct
  source 1..22: mol_type = other DNA
gcacgtgcaccaggaacaacaa

SEQ ID NO: 26670 - DNA, 21 bp, synthetic construct
  misc_feature 1..21: note = Synthetic Construct
  source 1..21: mol_type = other DNA
ccaggagtcagatggccgatt

SEQ ID NO: 26671 - DNA, 22 bp, synthetic construct
  misc_feature 1..22: note = Synthetic Construct
  source 1..22: mol_type = other DNA
cccactcggaagaacaggttac

SEQ ID NO: 26672 - DNA, 24 bp, synthetic construct
  misc_feature 1..24: note = Synthetic Construct
  source 1..24: mol_type = other DNA
gctagagaagagctcccattgttc

SEQ ID NO: 26673 - DNA, 23 bp, synthetic construct
  misc_feature 1..23: note = Synthetic Construct
  source 1..23: mol_type = other DNA
cttcctaacagctgggtgaatga

SEQ ID NO: 26674 - DNA, 23 bp, synthetic construct
  misc_feature 1..23: note = Synthetic Construct
  source 1..23: mol_type = other DNA
ggtctactgcgtgtgtttagttg

SEQ ID NO: 26675 - DNA, 24 bp, synthetic construct
  misc_feature 1..24: note = Synthetic Construct
  source 1..24: mol_type = other DNA
gcttacccaggtagatgctctagt

SEQ ID NO: 26676 - DNA, 20 bp, synthetic construct
  misc_feature 1..20: note = Synthetic Construct
  source 1..20: mol_type = other DNA
aggctgccatgcaagtcttc

SEQ ID NO: 26677 - DNA, 20 bp, synthetic construct
  misc_feature 1..20: note = Synthetic Construct
  source 1..20: mol_type = other DNA
cgtgcaacactgccttcctt

SEQ ID NO: 26678 - DNA, 23 bp, synthetic construct
  misc_feature 1..23: note = Synthetic Construct
  source 1..23: mol_type = other DNA
ccactgtacacaaagaggacgat

SEQ ID NO: 26679 - DNA, 25 bp, synthetic construct
  misc_feature 1..25: note = Synthetic Construct
  source 1..25: mol_type = other DNA
tttggtcttcccggagatagttatg

SEQ ID NO: 26680 - DNA, 18 bp, synthetic construct
  misc_feature 1..18: note = Synthetic Construct
  source 1..18: mol_type = other DNA
acgtgcagaaggcagcaa

SEQ ID NO: 26681 - DNA, 21 bp, synthetic construct
  misc_feature 1..21: note = Synthetic Construct
  source 1..21: mol_type = other DNA
gtaccccagccattgtgacat

SEQ ID NO: 26682 - DNA, 22 bp, synthetic construct
  misc_feature 1..22: note = Synthetic Construct
  source 1..22: mol_type = other DNA
tgtccctcctctgcactgctat

SEQ ID NO: 26683 - DNA, 27 bp, synthetic construct
  misc_feature 1..27: note = Synthetic Construct
  source 1..27: mol_type = other DNA
ctgaagacagagttctcaagacacctt

SEQ ID NO: 26684 - DNA, 26 bp, synthetic construct
  misc_feature 1..26: note = Synthetic Construct
  source 1..26: mol_type = other DNA
cagagtgtgttggggaaagtttggta

SEQ ID NO: 26685 - DNA, 20 bp, synthetic construct
  misc_feature 1..20: note = Synthetic Construct
  source 1..20: mol_type = other DNA
gcctgagcctccctttctca

SEQ ID NO: 26686 - DNA, 21 bp, synthetic construct
  misc_feature 1..21: note = Synthetic Construct
  source 1..21: mol_type = other DNA
tgtgtcctggggacattgaca

SEQ ID NO: 26687 - DNA, 23 bp, synthetic construct
  misc_feature 1..23: note = Synthetic Construct
  source 1..23: mol_type = other DNA
gatgaagggccctgattttccat

SEQ ID NO: 26688 - DNA, 19 bp, synthetic construct
  misc_feature 1..19: note = Synthetic Construct
  source 1..19: mol_type = other DNA
attgggctgcccggtgtta

SEQ ID NO: 26689 - DNA, 24 bp, synthetic construct
  misc_feature 1..24: note = Synthetic Construct
  source 1..24: mol_type = other DNA
gacctagcaactcttgaggaaaca

SEQ ID NO: 26690 - DNA, 21 bp, synthetic construct
  misc_feature 1..21: note = Synthetic Construct
  source 1..21: mol_type = other DNA
cagccgagctcacacttgtct

SEQ ID NO: 26691 - DNA, 22 bp, synthetic construct
  misc_feature 1..22: note = Synthetic Construct
  source 1..22: mol_type = other DNA
gccatggaagggaacagtccaa

SEQ ID NO: 26692 - DNA, 23 bp, synthetic construct
  misc_feature 1..23: note = Synthetic Construct
  source 1..23: mol_type = other DNA
cttgcaggataagaccaccatgt

SEQ ID NO: 26693 - DNA, 21 bp, synthetic construct
  misc_feature 1..21: note = Synthetic Construct
  source 1..21: mol_type = other DNA
gcgaggttccccttgatgctt

SEQ ID NO: 26694 - DNA, 22 bp, synthetic construct
  misc_feature 1..22: note = Synthetic Construct
  source 1..22: mol_type = other DNA
ccttcctccctgctggtttgta

SEQ ID NO: 26695 - DNA, 25 bp, synthetic construct
  misc_feature 1..25: note = Synthetic Construct
  source 1..25: mol_type = other DNA
gtcttgaactccttgttgaggatca

SEQ ID NO: 26696 - DNA, 20 bp, synthetic construct
  misc_feature 1..20: note = Synthetic Construct
  source 1..20: mol_type = other DNA
ttcccggtggggctctcttc

SEQ ID NO: 26697 - DNA, 20 bp, synthetic construct
  misc_feature 1..20: note = Synthetic Construct
  source 1..20: mol_type = other DNA
ccctgcccctcctctcatgt

SEQ ID NO: 26698 - DNA, 23 bp, synthetic construct
  misc_feature 1..23: note = Synthetic Construct
  source 1..23: mol_type = other DNA
aaaaagctgtggctctcttctct

SEQ ID NO: 26699 - DNA, 25 bp, synthetic construct
  misc_feature 1..25: note = Synthetic Construct
  source 1..25: mol_type = other DNA
ctgggaaaaataaggctgggaatca

SEQ ID NO: 26700 - DNA, 22 bp, synthetic construct
  misc_feature 1..22: note = Synthetic Construct
  source 1..22: mol_type = other DNA
tgagggccaccaagctaggaaa

SEQ ID NO: 26701 - DNA, 22 bp, synthetic construct
  misc_feature 1..22: note = Synthetic Construct
  source 1..22: mol_type = other DNA
tgaaatgccctcctcttggttt

SEQ ID NO: 26702 - DNA, 26 bp, synthetic construct
  misc_feature 1..26: note = Synthetic Construct
  source 1..26: mol_type = other DNA
cttgtatgccagtctacatctgtttc

SEQ ID NO: 26703 - DNA, 23 bp, synthetic construct
  misc_feature 1..23: note = Synthetic Construct
  source 1..23: mol_type = other DNA
cccagcctaaaatccctgagcta

SEQ ID NO: 26704 - DNA, 23 bp, synthetic construct
  misc_feature 1..23: note = Synthetic Construct
  source 1..23: mol_type = other DNA
ccctgagaaccctggaagctact

SEQ ID NO: 26705 - DNA, 22 bp, synthetic construct
  misc_feature 1..22: note = Synthetic Construct
  source 1..22: mol_type = other DNA
cgcccctgcctaaatggaaatg

SEQ ID NO: 26706 - DNA, 24 bp, synthetic construct
  misc_feature 1..24: note = Synthetic Construct
  source 1..24: mol_type = other DNA
tgagggaggatcagtaaaccatgt

SEQ ID NO: 26707 - DNA, 22 bp, synthetic construct
  misc_feature 1..22: note = Synthetic Construct
  source 1..22: mol_type = other DNA
cgcccagcctgacttgaatctt

SEQ ID NO: 26708 - DNA, 22 bp, synthetic construct
  misc_feature 1..22: note = Synthetic Construct
  source 1..22: mol_type = other DNA
gggacctgacgcacgacaataa

SEQ ID NO: 26709 - DNA, 22 bp, synthetic construct
  misc_feature 1..22: note = Synthetic Construct
  source 1..22: mol_type = other DNA
acctccaggctccaggaatttg

SEQ ID NO: 26710 - DNA, 22 bp, synthetic construct
  misc_feature 1..22: note = Synthetic Construct
  source 1..22: mol_type = other DNA
gctgacagatttgtccctctgt

SEQ ID NO: 26711 - DNA, 22 bp, synthetic construct
  misc_feature 1..22: note = Synthetic Construct
  source 1..22: mol_type = other DNA
gtaacgtttgcctggtccatct

SEQ ID NO: 26712 - DNA, 19 bp, synthetic construct
  misc_feature 1..19: note = Synthetic Construct
  source 1..19: mol_type = other DNA
tgccctccacctggctttc

SEQ ID NO: 26713 - DNA, 23 bp, synthetic construct
  misc_feature 1..23: note = Synthetic Construct
  source 1..23: mol_type = other DNA
agagtggaattaccagggagtct

SEQ ID NO: 26714 - DNA, 20 bp, synthetic construct
  misc_feature 1..20: note = Synthetic Construct
  source 1..20: mol_type = other DNA
gcagggtccggccctaatga

SEQ ID NO: 26715 - DNA, 24 bp, synthetic construct
  misc_feature 1..24: note = Synthetic Construct
  source 1..24: mol_type = other DNA
gccttcctctaccagggttctact

SEQ ID NO: 26716 - DNA, 20 bp, synthetic construct
  misc_feature 1..20: note = Synthetic Construct
  source 1..20: mol_type = other DNA
ctgtggtcggattcgtggaa

SEQ ID NO: 26717 - DNA, 22 bp, synthetic construct
  misc_feature 1..22: note = Synthetic Construct
  source 1..22: mol_type = other DNA
agtggccagggaggaagaacta

SEQ ID NO: 26718 - DNA, 19 bp, synthetic construct
  misc_feature 1..19: note = Synthetic Construct
  source 1..19: mol_type = other DNA
cgtgacctccacccctagt

SEQ ID NO: 26719 - DNA, 21 bp, synthetic construct
  misc_feature 1..21: note = Synthetic Construct
  source 1..21: mol_type = other DNA
tgttgggtccagccagtctca

SEQ ID NO: 26720 - DNA, 22 bp, synthetic construct
  misc_feature 1..22: note = Synthetic Construct
  source 1..22: mol_type = other DNA
cctgctgtgtgcagtggttgaa

SEQ ID NO: 26721 - DNA, 24 bp, synthetic construct
  misc_feature 1..24: note = Synthetic Construct
  source 1..24: mol_type = other DNA
tgtgaaaatccctgttgctcttca

SEQ ID NO: 26722 - DNA, 24 bp, synthetic construct
  misc_feature 1..24: note = Synthetic Construct
  source 1..24: mol_type = other DNA
gagaagagaggtgataggggacat

SEQ ID NO: 26723 - DNA, 21 bp, synthetic construct
  misc_feature 1..21: note = Synthetic Construct
  source 1..21: mol_type = other DNA
gcgcttgcccatagaaagtga

SEQ ID NO: 26724 - DNA, 23 bp, synthetic construct
  misc_feature 1..23: note = Synthetic Construct
  source 1..23: mol_type = other DNA
tggacgaccttttgccatttttg

SEQ ID NO: 26725 - DNA, 20 bp, synthetic construct
  misc_feature 1..20: note = Synthetic Construct
  source 1..20: mol_type = other DNA
aggcagcagagaggtccaaa

SEQ ID NO: 26726 - DNA, 25 bp, synthetic construct
  misc_feature 1..25: note = Synthetic Construct
  source 1..25: mol_type = other DNA
gggcttgaacctcagctctatcatc

SEQ ID NO: 26727 - DNA, 24 bp, synthetic construct
  misc_feature 1..24: note = Synthetic Construct
  source 1..24: mol_type = other DNA
ctgaccagagagattgggccttct

SEQ ID NO: 26728 - DNA, 23 bp, synthetic construct
  misc_feature 1..23: note = Synthetic Construct
  source 1..23: mol_type = other DNA
actgttcagctaacggtgtcaag

SEQ ID NO: 26729 - DNA, 22 bp, synthetic construct
  misc_feature 1..22: note = Synthetic Construct
  source 1..22: mol_type = other DNA
gaaagcctgagaaggtgccaat

SEQ ID NO: 26730 - DNA, 19 bp, synthetic construct
  misc_feature 1..19: note = Synthetic Construct
  source 1..19: mol_type = other DNA
cgacgggcagctgtcaaga

SEQ ID NO: 26731 - DNA, 22 bp, synthetic construct
  misc_feature 1..22: note = Synthetic Construct
  source 1..22: mol_type = other DNA
tgcctccttttctcagggtctt

SEQ ID NO: 26732 - DNA, 24 bp, synthetic construct
  misc_feature 1..24: note = Synthetic Construct
  source 1..24: mol_type = other DNA
gccttgaatgtcaggcgaaataac

SEQ ID NO: 26733 - DNA, 20 bp, synthetic construct
  misc_feature 1..20: note = Synthetic Construct
  source 1..20: mol_type = other DNA
aagaatgccctgcactgtgt

SEQ ID NO: 26734 - DNA, 23 bp, synthetic construct
  misc_feature 1..23: note = Synthetic Construct
  source 1..23: mol_type = other DNA
gggagaggtatgccaggctctaa

SEQ ID NO: 26735 - DNA, 23 bp, synthetic construct
  misc_feature 1..23: note = Synthetic Construct
  source 1..23: mol_type = other DNA
tgactgttgtccctgtcagtttg

SEQ ID NO: 26736 - DNA, 22 bp, synthetic construct
  misc_feature 1..22: note = Synthetic Construct
  source 1..22: mol_type = other DNA
acaggtcccttgggcccttatt

SEQ ID NO: 26737 - DNA, 19 bp, synthetic construct
  misc_feature 1..19: note = Synthetic Construct
  source 1..19: mol_type = other DNA
aggcagcccctgctcactt

SEQ ID NO: 26738 - DNA, 20 bp, synthetic construct
  misc_feature 1..20: note = Synthetic Construct
  source 1..20: mol_type = other DNA
cacggacgtgcatgacacta

SEQ ID NO: 26739 - DNA, 23 bp, synthetic construct
  misc_feature 1..23: note = Synthetic Construct
  source 1..23: mol_type = other DNA
caggagcaggggtgtattgaaag

SEQ ID NO: 26740 - DNA, 20 bp, synthetic construct
  misc_feature 1..20: note = Synthetic Construct
  source 1..20: mol_type = other DNA
tcacccacagccatctcaca

SEQ ID NO: 26741 - DNA, 22 bp, synthetic construct
  misc_feature 1..22: note = Synthetic Construct
  source 1..22: mol_type = other DNA
agggctgtctcctctcctgttt

SEQ ID NO: 26742 - DNA, 22 bp, synthetic construct
  misc_feature 1..22: note = Synthetic Construct
  source 1..22: mol_type = other DNA
ctgccccaccatatctgagaag

SEQ ID NO: 26743 - DNA, 25 bp, synthetic construct
  misc_feature 1..25: note = Synthetic Construct
  source 1..25: mol_type = other DNA
tctttaccgcatggttctaacacaa

SEQ ID NO: 26744 - DNA, 22 bp, synthetic construct
  misc_feature 1..22: note = Synthetic Construct
  source 1..22: mol_type = other DNA
cagccttccacgatggagaaac

SEQ ID NO: 26745 - DNA, 24 bp, synthetic construct
  misc_feature 1..24: note = Synthetic Construct
  source 1..24: mol_type = other DNA
gataccacaaacttggagcaaaca

SEQ ID NO: 26746 - DNA, 22 bp, synthetic construct
  misc_feature 1..22: note = Synthetic Construct
  source 1..22: mol_type = other DNA
gctggaaccacagagacgaaca

SEQ ID NO: 26747 - DNA, 24 bp, synthetic construct
  misc_feature 1..24: note = Synthetic Construct
  source 1..24: mol_type = other DNA
gagctactggagtccaaatcactt

SEQ ID NO: 26748 - DNA, 24 bp, synthetic construct
  misc_feature 1..24: note = Synthetic Construct
  source 1..24: mol_type = other DNA
gcatggtgcacaggtgcatattct

SEQ ID NO: 26749 - DNA, 22 bp, synthetic construct
  misc_feature 1..22: note = Synthetic Construct
  source 1..22: mol_type = other DNA
ggccatctagggtggtgaacaa

SEQ ID NO: 26750 - DNA, 26 bp, synthetic construct
  misc_feature 1..26: note = Synthetic Construct
  source 1..26: mol_type = other DNA
gtaaacattcaccaggagcttccata

SEQ ID NO: 26751 - DNA, 25 bp, synthetic construct
  misc_feature 1..25: note = Synthetic Construct
  source 1..25: mol_type = other DNA
gggttatgaagactggcttcgacat

SEQ ID NO: 26752 - DNA, 22 bp, synthetic construct
  misc_feature 1..22: note = Synthetic Construct
  source 1..22: mol_type = other DNA
tccagaaaaatggagccacaca

SEQ ID NO: 26753 - DNA, 23 bp, synthetic construct
  misc_feature 1..23: note = Synthetic Construct
  source 1..23: mol_type = other DNA
gacatcagggtgctgtcttctca

SEQ ID NO: 26754 - DNA, 20 bp, synthetic construct
  misc_feature 1..20: note = Synthetic Construct
  source 1..20: mol_type = other DNA
agtgtgcgtcaggactgaga

SEQ ID NO: 26755 - DNA, 21 bp, synthetic construct
  misc_feature 1..21: note = Synthetic Construct
  source 1..21: mol_type = other DNA
ttcgggaccgtttccccaaca

SEQ ID NO: 26756 - DNA, 25 bp, synthetic construct
  misc_feature 1..25: note = Synthetic Construct
  source 1..25: mol_type = other DNA
gatgacaccttctatgtcctcaagt

SEQ ID NO: 26757 - DNA, 25 bp, synthetic construct
  misc_feature 1..25: note = Synthetic Construct
  source 1..25: mol_type = other DNA
tgacctggacacacaggatatatga

SEQ ID NO: 26758 - DNA, 22 bp, synthetic construct
  misc_feature 1..22: note = Synthetic Construct
  source 1..22: mol_type = other DNA
tgaaagcccaccttcattgtca

SEQ ID NO: 26759 - DNA, 20 bp, synthetic construct
  misc_feature 1..20: note = Synthetic Construct
  source 1..20: mol_type = other DNA
ggcccagcactacgtcaact

SEQ ID NO: 26760 - DNA, 22 bp, synthetic construct
  misc_feature 1..22: note = Synthetic Construct
  source 1..22: mol_type = other DNA
gacccaaggggagtttgcattc

SEQ ID NO: 26761 - DNA, 22 bp, synthetic construct
  misc_feature 1..22: note = Synthetic Construct
  source 1..22: mol_type = other DNA
ccaccaggtctcccttttgtga

SEQ ID NO: 26762 - DNA, 22 bp, synthetic construct
  misc_feature 1..22: note = Synthetic Construct
  source 1..22: mol_type = other DNA
cacctctcccctcccagaacat

SEQ ID NO: 26763 - DNA, 26 bp, synthetic construct
  misc_feature 1..26: note = Synthetic Construct
  source 1..26: mol_type = other DNA
cacccttcaagacccagtacgagtaa

SEQ ID NO: 26764 - DNA, 26 bp, synthetic construct
  misc_feature 1..26: note = Synthetic Construct
  source 1..26: mol_type = other DNA
ggtgtcccctgaacaatgtctgtttc

SEQ ID NO: 26765 - DNA, 18 bp, synthetic construct
  misc_feature 1..18: note = Synthetic Construct
  source 1..18: mol_type = other DNA
agcacccctggagcttgt

SEQ ID NO: 26766 - DNA, 21 bp, synthetic construct
  misc_feature 1..21: note = Synthetic Construct
  source 1..21: mol_type = other DNA
atgcagaggcggaggcagata

SEQ ID NO: 26767 - DNA, 23 bp, synthetic construct
  misc_feature 1..23: note = Synthetic Construct
  source 1..23: mol_type = other DNA
cctagaaaccctgagcagcaaca

SEQ ID NO: 26768 - DNA, 22 bp, synthetic construct
  misc_feature 1..22: note = Synthetic Construct
  source 1..22: mol_type = other DNA
ttcctggagtgagccagtctgt

SEQ ID NO: 26769 - DNA, 22 bp, synthetic construct
  misc_feature 1..22: note = Synthetic Construct
  source 1..22: mol_type = other DNA
gacaagcatctcgaagggcata

SEQ ID NO: 26770 - DNA, 24 bp, synthetic construct
  misc_feature 1..24: note = Synthetic Construct
  source 1..24: mol_type = other DNA
caatttccaggaggccatgatact

SEQ ID NO: 26771 - DNA, 21 bp, synthetic construct
  misc_feature 1..21: note = Synthetic Construct
  source 1..21: mol_type = other DNA
gggtgaagtgggtgcatctaa

SEQ ID NO: 26772 - DNA, 22 bp, synthetic construct
  misc_feature 1..22: note = Synthetic Construct
  source 1..22: mol_type = other DNA
gcaggtcgtgcctcggtttatt

SEQ ID NO: 26773 - DNA, 24 bp, synthetic construct
  misc_feature 1..24: note = Synthetic Construct
  source 1..24: mol_type = other DNA
gccctgcaggaacatttattgtct

SEQ ID NO: 26774 - DNA, 24 bp, synthetic construct
  misc_feature 1..24: note = Synthetic Construct
  source 1..24: mol_type = other DNA
gtctcctagtacctgtgggtccat

SEQ ID NO: 26775 - DNA, 21 bp, synthetic construct
  misc_feature 1..21: note = Synthetic Construct
  source 1..21: mol_type = other DNA
agtggggatcgtacagctctt

SEQ ID NO: 26776 - DNA, 20 bp, synthetic construct
  misc_feature 1..20: note = Synthetic Construct
  source 1..20: mol_type = other DNA
tggccacccaggagtgatac

SEQ ID NO: 26777 - DNA, 24 bp, synthetic construct
  misc_feature 1..24: note = Synthetic Construct
  source 1..24: mol_type = other DNA
agacgtgggtaggtaagtatggaa

SEQ ID NO: 26778 - DNA, 23 bp, synthetic construct
  misc_feature 1..23: note = Synthetic Construct
  source 1..23: mol_type = other DNA
cagctgaaggaccttggtgagat

SEQ ID NO: 26779 - DNA, 22 bp, synthetic construct
  misc_feature 1..22: note = Synthetic Construct
  source 1..22: mol_type = other DNA
tctcaggcttggtagcctatgt

SEQ ID NO: 26780 - DNA, 22 bp, synthetic construct
  misc_feature 1..22: note = Synthetic Construct
  source 1..22: mol_type = other DNA
gccgaggaaggagacagtgaca

SEQ ID NO: 26781 - DNA, 20 bp, synthetic construct
  misc_feature 1..20: note = Synthetic Construct
  source 1..20: mol_type = other DNA
ccccagcagcatttcagcaa

SEQ ID NO: 26782 - DNA, 21 bp, synthetic construct
  misc_feature 1..21: note = Synthetic Construct
  source 1..21: mol_type = other DNA
ccactcccaccactgcacaat

SEQ ID NO: 26783 - DNA, 21 bp, synthetic construct
  misc_feature 1..21: note = Synthetic Construct
  source 1..21: mol_type = other DNA
ggcaatacacacacggctcaa

SEQ ID NO: 26784 - DNA, 23 bp, synthetic construct
  misc_feature 1..23: note = Synthetic Construct
  source 1..23: mol_type = other DNA
cctagggtgagccagttcctaga

SEQ ID NO: 26785 - DNA, 21 bp, synthetic construct
  misc_feature 1..21: note = Synthetic Construct
  source 1..21: mol_type = other DNA
cctcacagctgagccatgaaa

SEQ ID NO: 26786 - DNA, 21 bp, synthetic construct
  misc_feature 1..21: note = Synthetic Construct
  source 1..21: mol_type = other DNA
acagtactgggccagatggaa

SEQ ID NO: 26787 - DNA, 25 bp, synthetic construct
  misc_feature 1..25: note = Synthetic Construct
  source 1..25: mol_type = other DNA
cactaagtctgggcatggactttac

SEQ ID NO: 26788 - DNA, 24 bp, synthetic construct
  misc_feature 1..24: note = Synthetic Construct
  source 1..24: mol_type = other DNA
agtggaagagccttgagaagtttt

SEQ ID NO: 26789 - DNA, 20 bp, synthetic construct
  misc_feature 1..20: note = Synthetic Construct
  source 1..20: mol_type = other DNA
acccagcctgcaggagaaag

SEQ ID NO: 26790 - DNA, 19 bp, synthetic construct
  misc_feature 1..19: note = Synthetic Construct
  source 1..19: mol_type = other DNA
agcccagcccgagacattt

SEQ ID NO: 26791 - DNA, 23 bp, synthetic construct
  misc_feature 1..23: note = Synthetic Construct
  source 1..23: mol_type = other DNA
ctggaccagccagtcaatggtta

SEQ ID NO: 26792 - DNA, 23 bp, synthetic construct
  misc_feature 1..23: note = Synthetic Construct
  source 1..23: mol_type = other DNA
cgttgctcagttcctggaaagtt

SEQ ID NO: 26793 - DNA, 21 bp, synthetic construct
  misc_feature 1..21: note = Synthetic Construct
  source 1..21: mol_type = other DNA
gcttccggatgtctacaccaa

SEQ ID NO: 26794 - DNA, 23 bp, synthetic construct
  misc_feature 1..23: note = Synthetic Construct
  source 1..23: mol_type = other DNA
tcttcctaagcctggtaggagtt

SEQ ID NO: 26795 - DNA, 20 bp, synthetic construct
  misc_feature 1..20: note = Synthetic Construct
  source 1..20: mol_type = other DNA
ttcccaaccctcgggacact

SEQ ID NO: 26796 - DNA, 20 bp, synthetic construct
  misc_feature 1..20: note = Synthetic Construct
  source 1..20: mol_type = other DNA
ccaatcaggccagtgtcagt

SEQ ID NO: 26797 - DNA, 20 bp, synthetic construct
  misc_feature 1..20: note = Synthetic Construct
  source 1..20: mol_type = other DNA
gagaggaaccggtgggacta

SEQ ID NO: 26798 - DNA, 22 bp, synthetic construct
  misc_feature 1..22: note = Synthetic Construct
  source 1..22: mol_type = other DNA
ggaggctgaggtggaaggatct

SEQ ID NO: 26799 - DNA, 19 bp, synthetic construct
  misc_feature 1..19: note = Synthetic Construct
  source 1..19: mol_type = other DNA
cagccaccaggagggtgaa

SEQ ID NO: 26800 - DNA, 20 bp, synthetic construct
  misc_feature 1..20: note = Synthetic Construct
  source 1..20: mol_type = other DNA
ggccctccgtatccaaggtt

SEQ ID NO: 26801 - DNA, 24 bp, synthetic construct
  misc_feature 1..24: note = Synthetic Construct
  source 1..24: mol_type = other DNA
ttgtataacacgctgcaggaaaag

SEQ ID NO: 26802 - DNA, 26 bp, synthetic construct
  misc_feature 1..26: note = Synthetic Construct
  source 1..26: mol_type = other DNA
ctagtggcttgctcaattcctatttg

SEQ ID NO: 26803 - DNA, 23 bp, synthetic construct
  misc_feature 1..23: note = Synthetic Construct
  source 1..23: mol_type = other DNA
gctggcttctccagtaacaatga

SEQ ID NO: 26804 - DNA, 25 bp, synthetic construct
  misc_feature 1..25: note = Synthetic Construct
  source 1..25: mol_type = other DNA
tcctcacaagaaatggacaatggat

SEQ ID NO: 26805 - DNA, 22 bp, synthetic construct
  misc_feature 1..22: note = Synthetic Construct
  source 1..22: mol_type = other DNA
cctggccgtgcctgatatttct

SEQ ID NO: 26806 - DNA, 23 bp, synthetic construct
  misc_feature 1..23: note = Synthetic Construct
  source 1..23: mol_type = other DNA
aggagagacacagagggacattt

SEQ ID NO: 26807 - DNA, 24 bp, synthetic construct
  misc_feature 1..24: note = Synthetic Construct
  source 1..24: mol_type = other DNA
gtttctctggccatttaggactca

SEQ ID NO: 26808 - DNA, 25 bp, synthetic construct
  misc_feature 1..25: note = Synthetic Construct
  source 1..25: mol_type = other DNA
gacctttcttcctttctctcaccaa

SEQ ID NO: 26809 - DNA, 20 bp, synthetic construct
  misc_feature 1..20: note = Synthetic Construct
  source 1..20: mol_type = other DNA
tagggtcctgtcccctctct

SEQ ID NO: 26810 - DNA, 27 bp, synthetic construct
  misc_feature 1..27: note = Synthetic Construct
  source 1..27: mol_type = other DNA
cccaaagcagctaatgagcattgcata

SEQ ID NO: 26811 - DNA, 25 bp, synthetic construct
  misc_feature 1..25: note = Synthetic Construct
  source 1..25: mol_type = other DNA
tgtgtgttaccaatgccaaacaatc

SEQ ID NO: 26812 - DNA, 23 bp, synthetic construct
  misc_feature 1..23: note = Synthetic Construct
  source 1..23: mol_type = other DNA
tctcaagaaaacctgtggcaagt

SEQ ID NO: 26813 - DNA, 23 bp, synthetic construct
  misc_feature 1..23: note = Synthetic Construct
  source 1..23: mol_type = other DNA
ggctgggagggccttcaaatatc

SEQ ID NO: 26814 - DNA, 25 bp, synthetic construct
  misc_feature 1..25: note = Synthetic Construct
  source 1..25: mol_type = other DNA
gaaaccttgtttcctgcagatgatg

SEQ ID NO: 26815 - DNA, 23 bp, synthetic construct
  misc_feature 1..23: note = Synthetic Construct
  source 1..23: mol_type = other DNA
ctgctgacctgactgtgagtgaa

SEQ ID NO: 26816 - DNA, 24 bp, synthetic construct
  misc_feature 1..24: note = Synthetic Construct
  source 1..24: mol_type = other DNA
caggtccaccaacaaatcatcatc

SEQ ID NO: 26817 - DNA, 20 bp, synthetic construct
  misc_feature 1..20: note = Synthetic Construct
  source 1..20: mol_type = other DNA
gcagacatgtgggtgacaga

SEQ ID NO: 26818 - DNA, 20 bp, synthetic construct
  misc_feature 1..20: note = Synthetic Construct
  source 1..20: mol_type = other DNA
gctgcgggcagcattttaag

SEQ ID NO: 26819 - DNA, 21 bp, synthetic construct
  misc_feature 1..21: note = Synthetic Construct
  source 1..21: mol_type = other DNA
caccctggagcctcaatccat

SEQ ID NO: 26820 - DNA, 18 bp, synthetic construct
  misc_feature 1..18: note = Synthetic Construct
  source 1..18: mol_type = other DNA
agccttgcaggccctact

SEQ ID NO: 26821 - DNA, 23 bp, synthetic construct
  misc_feature 1..23: note = Synthetic Construct
  source 1..23: mol_type = other DNA
acaagtgattctcatggccactt

SEQ ID NO: 26822 - DNA, 25 bp, synthetic construct
  misc_feature 1..25: note = Synthetic Construct
  source 1..25: mol_type = other DNA
ccctcaaccatgtgcagaaaacttg

SEQ ID NO: 26823 - DNA, 22 bp, synthetic construct
  misc_feature 1..22: note = Synthetic Construct
  source 1..22: mol_type = other DNA
ggggaagcagctttcactctct

SEQ ID NO: 26824 - DNA, 21 bp, synthetic construct
  misc_feature 1..21: note = Synthetic Construct
  source 1..21: mol_type = other DNA
cgccagggaggctgttagaaa

SEQ ID NO: 26825 - DNA, 24 bp, synthetic construct
  misc_feature 1..24: note = Synthetic Construct
  source 1..24: mol_type = other DNA
cctattgttcttggcccctttagt

SEQ ID NO: 26826 - DNA, 20 bp, synthetic construct
  misc_feature 1..20: note = Synthetic Construct
  source 1..20: mol_type = other DNA
actgcattgtgcgtgaccat

SEQ ID NO: 26827 - DNA, 20 bp, synthetic construct
  misc_feature 1..20: note = Synthetic Construct
  source 1..20: mol_type = other DNA
tcctgagcgtggtggagatg

SEQ ID NO: 26828 - DNA, 24 bp, synthetic construct
  misc_feature 1..24: note = Synthetic Construct
  source 1..24: mol_type = other DNA
cacgtgaaatgaattgccttctgt

SEQ ID NO: 26829 - DNA, 21 bp, synthetic construct
  misc_feature 1..21: note = Synthetic Construct
  source 1..21: mol_type = other DNA
ggagcagcagccatactccaa

SEQ ID NO: 26830 - DNA, 26 bp, synthetic construct
  misc_feature 1..26: note = Synthetic Construct
  source 1..26: mol_type = other DNA
ctcatgactggttgtttctccttgaa

SEQ ID NO: 26831 - DNA, 20 bp, synthetic construct
  misc_feature 1..20: note = Synthetic Construct
  source 1..20: mol_type = other DNA
tcctcctgctcctgggtcat

SEQ ID NO: 26832 - DNA, 22 bp, synthetic construct
  misc_feature 1..22: note = Synthetic Construct
  source 1..22: mol_type = other DNA
tgtggtctctgagcctgctgtt

SEQ ID NO: 26833 - DNA, 22 bp, synthetic construct
  misc_feature 1..22: note = Synthetic Construct
  source 1..22: mol_type = other DNA
catgtggctctagagggaggaa

SEQ ID NO: 26834 - DNA, 22 bp, synthetic construct
  misc_feature 1..22: note = Synthetic Construct
  source 1..22: mol_type = other DNA
ggaggctgccagaagtcagaac

SEQ ID NO: 26835 - DNA, 26 bp, synthetic construct
  misc_feature 1..26: note = Synthetic Construct
  source 1..26: mol_type = other DNA
gagttgtctctgcctttttggggata

SEQ ID NO: 26836 - DNA, 22 bp, synthetic construct
  misc_feature 1..22: note = Synthetic Construct
  source 1..22: mol_type = other DNA
acttcccctgtaggcactgtca

SEQ ID NO: 26837 - DNA, 19 bp, synthetic construct
  misc_feature 1..19: note = Synthetic Construct
  source 1..19: mol_type = other DNA
tagcgcgcgcgacaaacta

SEQ ID NO: 26838 - DNA, 23 bp, synthetic construct
  misc_feature 1..23: note = Synthetic Construct
  source 1..23: mol_type = other DNA
gtccacaacgcattactgctcat

SEQ ID NO: 26839 - DNA, 22 bp, synthetic construct
  misc_feature 1..22: note = Synthetic Construct
  source 1..22: mol_type = other DNA
gacctccagggtgcatgtcaaa

SEQ ID NO: 26840 - DNA, 20 bp, synthetic construct
  misc_feature 1..20: note = Synthetic Construct
  source 1..20: mol_type = other DNA
tgctgccagccactttgtgt

SEQ ID NO: 26841 - DNA, 22 bp, synthetic construct
  misc_feature 1..22: note = Synthetic Construct
  source 1..22: mol_type = other DNA
ctgcctccactgtgtcttctgt

SEQ ID NO: 26842 - DNA, 24 bp, synthetic construct
  misc_feature 1..24: note = Synthetic Construct
  source 1..24: mol_type = other DNA
tctcatggttgggtaatgcaaaga

SEQ ID NO: 26843 - DNA, 22 bp, synthetic construct
  misc_feature 1..22: note = Synthetic Construct
  source 1..22: mol_type = other DNA
gtgttggggcagaccttcagta

SEQ ID NO: 26844 - DNA, 20 bp, synthetic construct
  misc_feature 1..20: note = Synthetic Construct
  source 1..20: mol_type = other DNA
ctccacctgccacactctct

SEQ ID NO: 26845 - DNA, 20 bp, synthetic construct
  misc_feature 1..20: note = Synthetic Construct
  source 1..20: mol_type = other DNA
ggctcagggcccaaggatct

SEQ ID NO: 26846 - DNA, 22 bp, synthetic construct
  misc_feature 1..22: note = Synthetic Construct
  source 1..22: mol_type = other DNA
gcctttattccctgccccaatc

SEQ ID NO: 26847 - DNA, 22 bp, synthetic construct
  misc_feature 1..22: note = Synthetic Construct
  source 1..22: mol_type = other DNA
ctctgattctgcccctggaaca

SEQ ID NO: 26848 - DNA, 23 bp, synthetic construct
  misc_feature 1..23: note = Synthetic Construct
  source 1..23: mol_type = other DNA
gcctgcactctcccacaactatg

SEQ ID NO: 26849 - DNA, 22 bp, synthetic construct
  misc_feature 1..22: note = Synthetic Construct
  source 1..22: mol_type = other DNA
ctcccaccagcatccaaacaca

SEQ ID NO: 26850 - DNA, 21 bp, synthetic construct
  misc_feature 1..21: note = Synthetic Construct
  source 1..21: mol_type = other DNA
cagcaagcaggctcaggtact

SEQ ID NO: 26851 - DNA, 26 bp, synthetic construct
  misc_feature 1..26: note = Synthetic Construct
  source 1..26: mol_type = other DNA
gcatcagcatcactaacgaggtcttc

SEQ ID NO: 26852 - DNA, 24 bp, synthetic construct
  misc_feature 1..24: note = Synthetic Construct
  source 1..24: mol_type = other DNA
ggtgtacaagaacgtctcagttgt

SEQ ID NO: 26853 - DNA, 18 bp, synthetic construct
  misc_feature 1..18: note = Synthetic Construct
  source 1..18: mol_type = other DNA
gtcacaggggcacagctt

SEQ ID NO: 26854 - DNA, 21 bp, synthetic construct
  misc_feature 1..21: note = Synthetic Construct
  source 1..21: mol_type = other DNA
ccaacgctcagccttcgtctt

SEQ ID NO: 26855 - DNA, 22 bp, synthetic construct
  misc_feature 1..22: note = Synthetic Construct
  source 1..22: mol_type = other DNA
ccgtgtcttggcagaagctcta

SEQ ID NO: 26856 - DNA, 19 bp, synthetic construct
  misc_feature 1..19: note = Synthetic Construct
  source 1..19: mol_type = other DNA
ggcacgagcctcggaagat

SEQ ID NO: 26857 - DNA, 20 bp, synthetic construct
  misc_feature 1..20: note = Synthetic Construct
  source 1..20: mol_type = other DNA
gatggcgctgaatggagtct

SEQ ID NO: 26858 - DNA, 18 bp, synthetic construct
  misc_feature 1..18: note = Synthetic Construct
  source 1..18: mol_type = other DNA
gcaagctcggggtggttt

SEQ ID NO: 26859 - DNA, 26 bp, synthetic construct
  misc_feature 1..26: note = Synthetic Construct
  source 1..26: mol_type = other DNA
ggaatatacagacccttccttcaact

SEQ ID NO: 26860 - DNA, 21 bp, synthetic construct
  misc_feature 1..21: note = Synthetic Construct
  source 1..21: mol_type = other DNA
tccctggcctccagtgatttg

SEQ ID NO: 26861 - DNA, 20 bp, synthetic construct
  misc_feature 1..20: note = Synthetic Construct
  source 1..20: mol_type = other DNA
cccagaggtgcctgtgacat

SEQ ID NO: 26862 - DNA, 20 bp, synthetic construct
  misc_feature 1..20: note = Synthetic Construct
  source 1..20: mol_type = other DNA
tcccgctgcgtgttagtttc

SEQ ID NO: 26863 - DNA, 21 bp, synthetic construct
  misc_feature 1..21: note = Synthetic Construct
  source 1..21: mol_type = other DNA
gcaggaagccacacagaagtt

SEQ ID NO: 26864 - DNA, 20 bp, synthetic construct
  misc_feature 1..20: note = Synthetic Construct
  source 1..20: mol_type = other DNA
tccgttgtgtgccaatgcta

SEQ ID NO: 26865 - DNA, 23 bp, synthetic construct
  misc_feature 1..23: note = Synthetic Construct
  source 1..23: mol_type = other DNA
tggcagtttctgagtgggatttg

SEQ ID NO: 26866 - DNA, 21 bp, synthetic construct
  misc_feature 1..21: note = Synthetic Construct
  source 1..21: mol_type = other DNA
cacagctccaggggcatcata

SEQ ID NO: 26867 - DNA, 22 bp, synthetic construct
  misc_feature 1..22: note = Synthetic Construct
  source 1..22: mol_type = other DNA
agtgtacaggagtggcttcagt

SEQ ID NO: 26868 - DNA, 21 bp, synthetic construct
  misc_feature 1..21: note = Synthetic Construct
  source 1..21: mol_type = other DNA
gcctcttcgggtccctgttct

SEQ ID NO: 26869 - DNA, 23 bp, synthetic construct
  misc_feature 1..23: note = Synthetic Construct
  source 1..23: mol_type = other DNA
ctgaacaaggcgctgaaggaaga

SEQ ID NO: 26870 - DNA, 22 bp, synthetic construct
  misc_feature 1..22: note = Synthetic Construct
  source 1..22: mol_type = other DNA
agtgcagagaatacccgagaca

SEQ ID NO: 26871 - DNA, 22 bp, synthetic construct
  misc_feature 1..22: note = Synthetic Construct
  source 1..22: mol_type = other DNA
ggggctgacttatttggtggtt

SEQ ID NO: 26872 - DNA, 22 bp, synthetic construct
  misc_feature 1..22: note = Synthetic Construct
  source 1..22: mol_type = other DNA
gcccaggtgaagcagaactttg

SEQ ID NO: 26873 - DNA, 25 bp, synthetic construct
  misc_feature 1..25: note = Synthetic Construct
  source 1..25: mol_type = other DNA
ggactcacagaatgtgaccagatag

SEQ ID NO: 26874 - DNA, 22 bp, synthetic construct
  misc_feature 1..22: note = Synthetic Construct
  source 1..22: mol_type = other DNA
gggaagccccactttaggagtt

SEQ ID NO: 26875 - DNA, 21 bp, synthetic construct
  misc_feature 1..21: note = Synthetic Construct
  source 1..21: mol_type = other DNA
ccttttcctccccaggacttc

SEQ ID NO: 26876 - DNA, 22 bp, synthetic construct
  misc_feature 1..22: note = Synthetic Construct
  source 1..22: mol_type = other DNA
aggcccatgtggctgatgttag

SEQ ID NO: 26877 - DNA, 23 bp, synthetic construct
  misc_feature 1..23: note = Synthetic Construct
  source 1..23: mol_type = other DNA
gtcccctgtccataggagagact

SEQ ID NO: 26878 - DNA, 24 bp, synthetic construct
  misc_feature 1..24: note = Synthetic Construct
  source 1..24: mol_type = other DNA
tgtgatctaccagcagccattatt

SEQ ID NO: 26879 - DNA, 19 bp, synthetic construct
  misc_feature 1..19: note = Synthetic Construct
  source 1..19: mol_type = other DNA
gcacctgcgaaacgtggaa

SEQ ID NO: 26880 - DNA, 22 bp, synthetic construct
  misc_feature 1..22: note = Synthetic Construct
  source 1..22: mol_type = other DNA
tgttacaggcagaagtgcaagt

SEQ ID NO: 26881 - DNA, 19 bp, synthetic construct
  misc_feature 1..19: note = Synthetic Construct
  source 1..19: mol_type = other DNA
tggcacagcccacccgaaa

SEQ ID NO: 26882 - DNA, 25 bp, synthetic construct
  misc_feature 1..25: note = Synthetic Construct
  source 1..25: mol_type = other DNA
ctctcccactaagttcaagttctgt

SEQ ID NO: 26883 - DNA, 21 bp, synthetic construct
  misc_feature 1..21: note = Synthetic Construct
  source 1..21: mol_type = other DNA
tcagcagagcctgaagcaatg

SEQ ID NO: 26884 - DNA, 20 bp, synthetic construct
  misc_feature 1..20: note = Synthetic Construct
  source 1..20: mol_type = other DNA
agcctcagagccgcatgaag

SEQ ID NO: 26885 - DNA, 19 bp, synthetic construct
  misc_feature 1..19: note = Synthetic Construct
  source 1..19: mol_type = other DNA
gcctggcctgcactgagtt

SEQ ID NO: 26886 - DNA, 22 bp, synthetic construct
  misc_feature 1..22: note = Synthetic Construct
  source 1..22: mol_type = other DNA
ggctataacaccctgctgacat

SEQ ID NO: 26887 - DNA, 21 bp, synthetic construct
  misc_feature 1..21: note = Synthetic Construct
  source 1..21: mol_type = other DNA
caaacagggcacgtcccaaag

SEQ ID NO: 26888 - DNA, 24 bp, synthetic construct
  misc_feature 1..24: note = Synthetic Construct
  source 1..24: mol_type = other DNA
tgaggactagaaagaggcactgat

SEQ ID NO: 26889 - DNA, 27 bp, synthetic construct
  misc_feature 1..27: note = Synthetic Construct
  source 1..27: mol_type = other DNA
catgaagtgctactacgactcttaact

SEQ ID NO: 26890 - DNA, 22 bp, synthetic construct
  misc_feature 1..22: note = Synthetic Construct
  source 1..22: mol_type = other DNA
gtggacaacccgtctcagattc

SEQ ID NO: 26891 - DNA, 19 bp, synthetic construct
  misc_feature 1..19: note = Synthetic Construct
  source 1..19: mol_type = other DNA
cgccggactgtccactgat

SEQ ID NO: 26892 - DNA, 21 bp, synthetic construct
  misc_feature 1..21: note = Synthetic Construct
  source 1..21: mol_type = other DNA
cctcctgctgcacatctttct

SEQ ID NO: 26893 - DNA, 22 bp, synthetic construct
  misc_feature 1..22: note = Synthetic Construct
  source 1..22: mol_type = other DNA
tcagctccctgaggcatgtttg

SEQ ID NO: 26894 - DNA, 21 bp, synthetic construct
  misc_feature 1..21: note = Synthetic Construct
  source 1..21: mol_type = other DNA
ttgaggatgcgtgggatgtag

SEQ ID NO: 26895 - DNA, 21 bp, synthetic construct
  misc_feature 1..21: note = Synthetic Construct
  source 1..21: mol_type = other DNA
tgggcctcgtcaggcctttat

SEQ ID NO: 26896 - DNA, 21 bp, synthetic construct
  misc_feature 1..21: note = Synthetic Construct
  source 1..21: mol_type = other DNA
cagcagcaaccatgctgcaaa

SEQ ID NO: 26897 - DNA, 20 bp, synthetic construct
  misc_feature 1..20: note = Synthetic Construct
  source 1..20: mol_type = other DNA
acagcggagaaggtggtgaa

SEQ ID NO: 26898 - DNA, 22 bp, synthetic construct
  misc_feature 1..22: note = Synthetic Construct
  source 1..22: mol_type = other DNA
gtcccatggatgagtggctttg

SEQ ID NO: 26899 - DNA, 22 bp, synthetic construct
  misc_feature 1..22: note = Synthetic Construct
  source 1..22: mol_type = other DNA
aggctaggcaggcttaggattg

SEQ ID NO: 26900 - DNA, 20 bp, synthetic construct
  misc_feature 1..20: note = Synthetic Construct
  source 1..20: mol_type = other DNA
ctcgcagagcagaacctcat

SEQ ID NO: 26901 - DNA, 22 bp, synthetic construct
  misc_feature 1..22: note = Synthetic Construct
  source 1..22: mol_type = other DNA
agctcagggaggcggaagtatt

SEQ ID NO: 26902 - DNA, 20 bp, synthetic construct
  misc_feature 1..20: note = Synthetic Construct
  source 1..20: mol_type = other DNA
cccactaggccaccctccat

SEQ ID NO: 26903 - DNA, 28 bp, synthetic construct
  misc_feature 1..28: note = Synthetic Construct
  source 1..28: mol_type = other DNA
gacacagatctctggtaattcagagcaa

SEQ ID NO: 26904 - DNA, 21 bp, synthetic construct
  misc_feature 1..21: note = Synthetic Construct
  source 1..21: mol_type = other DNA
ccaacagcaggtaggcaaatg

SEQ ID NO: 26905 - DNA, 23 bp, synthetic construct
  misc_feature 1..23: note = Synthetic Construct
  source 1..23: mol_type = other DNA
gtaccactcagaccaggaaaaca

SEQ ID NO: 26906 - DNA, 20 bp, synthetic construct
  misc_feature 1..20: note = Synthetic Construct
  source 1..20: mol_type = other DNA
ctccccaccttcgtctctga

SEQ ID NO: 26907 - DNA, 24 bp, synthetic construct
  misc_feature 1..24: note = Synthetic Construct
  source 1..24: mol_type = other DNA
agatagcaatgctgcaacgtaaga

SEQ ID NO: 26908 - DNA, 23 bp, synthetic construct
  misc_feature 1..23: note = Synthetic Construct
  source 1..23: mol_type = other DNA
gtgcaagttgctgttgtctcact

SEQ ID NO: 26909 - DNA, 23 bp, synthetic construct
  misc_feature 1..23: note = Synthetic Construct
  source 1..23: mol_type = other DNA
tcaggaaccgtgactctttttca

SEQ ID NO: 26910 - DNA, 22 bp, synthetic construct
  misc_feature 1..22: note = Synthetic Construct
  source 1..22: mol_type = other DNA
gctgccatcttgccactttgta

SEQ ID NO: 26911 - DNA, 22 bp, synthetic construct
  misc_feature 1..22: note = Synthetic Construct
  source 1..22: mol_type = other DNA
cagtgcccacagccttcattgt

SEQ ID NO: 26912 - DNA, 21 bp, synthetic construct
  misc_feature 1..21: note = Synthetic Construct
  source 1..21: mol_type = other DNA
ccaccgcagcagctattatgt

SEQ ID NO: 26913 - DNA, 21 bp, synthetic construct
  misc_feature 1..21: note = Synthetic Construct
  source 1..21: mol_type = other DNA
tgtctgtcccggcaaccatag

SEQ ID NO: 26914 - DNA, 26 bp, synthetic construct
  misc_feature 1..26: note = Synthetic Construct
  source 1..26: mol_type = other DNA
gctctccattatgccgtttatagtga

SEQ ID NO: 26915 - DNA, 22 bp, synthetic construct
  misc_feature 1..22: note = Synthetic Construct
  source 1..22: mol_type = other DNA
cccctttccatactgtgctctt

SEQ ID NO: 26916 - DNA, 20 bp, synthetic construct
  misc_feature 1..20: note = Synthetic Construct
  source 1..20: mol_type = other DNA
ggagcccagaccccaacaag

SEQ ID NO: 26917 - DNA, 19 bp, synthetic construct
  misc_feature 1..19: note = Synthetic Construct
  source 1..19: mol_type = other DNA
caccacacccagcctctgt

SEQ ID NO: 26918 - DNA, 21 bp, synthetic construct
  misc_feature 1..21: note = Synthetic Construct
  source 1..21: mol_type = other DNA
ccctaggggctgcaaggttac

SEQ ID NO: 26919 - DNA, 19 bp, synthetic construct
  misc_feature 1..19: note = Synthetic Construct
  source 1..19: mol_type = other DNA
tcctgcttcagccgccaat

SEQ ID NO: 26920 - DNA, 19 bp, synthetic construct
  misc_feature 1..19: note = Synthetic Construct
  source 1..19: mol_type = other DNA
tgtccccagcatcggatca

SEQ ID NO: 26921 - DNA, 22 bp, synthetic construct
  misc_feature 1..22: note = Synthetic Construct
  source 1..22: mol_type = other DNA
gcactgtcctgtcctggttgaa

SEQ ID NO: 26922 - DNA, 20 bp, synthetic construct
  misc_feature 1..20: note = Synthetic Construct
  source 1..20: mol_type = other DNA
ggtccagggatctggacaca

SEQ ID NO: 26923 - DNA, 20 bp, synthetic construct
  misc_feature 1..20: note = Synthetic Construct
  source 1..20: mol_type = other DNA
gctgcacaccactgaccaat

SEQ ID NO: 26924 - DNA, 24 bp, synthetic construct
  misc_feature 1..24: note = Synthetic Construct
  source 1..24: mol_type = other DNA
gagggaaggagccgcatgtataag

SEQ ID NO: 26925 - DNA, 22 bp, synthetic construct
  misc_feature 1..22: note = Synthetic Construct
  source 1..22: mol_type = other DNA
gccctgtaacagtagccaaagt

SEQ ID NO: 26926 - DNA, 24 bp, synthetic construct
  misc_feature 1..24: note = Synthetic Construct
  source 1..24: mol_type = other DNA
agagagagccttctttcccttaga

SEQ ID NO: 26927 - DNA, 23 bp, synthetic construct
  misc_feature 1..23: note = Synthetic Construct
  source 1..23: mol_type = other DNA
caaagcatgccactactgtgtgt

SEQ ID NO: 26928 - DNA, 23 bp, synthetic construct
  misc_feature 1..23: note = Synthetic Construct
  source 1..23: mol_type = other DNA
gtccctgtgaactcctgatcact

SEQ ID NO: 26929 - DNA, 20 bp, synthetic construct
  misc_feature 1..20: note = Synthetic Construct
  source 1..20: mol_type = other DNA
acagggccttggtcttgctt

SEQ ID NO: 26930 - DNA, 21 bp, synthetic construct
  misc_feature 1..21: note = Synthetic Construct
  source 1..21: mol_type = other DNA
tgcagtctgaacagcatggat

SEQ ID NO: 26931 - DNA, 22 bp, synthetic construct
  misc_feature 1..22: note = Synthetic Construct
  source 1..22: mol_type = other DNA
ccaggcccactcaaagcacaaa

SEQ ID NO: 26932 - DNA, 21 bp, synthetic construct
  misc_feature 1..21: note = Synthetic Construct
  source 1..21: mol_type = other DNA
ttccatgcctgcatagtgctt

SEQ ID NO: 26933 - DNA, 23 bp, synthetic construct
  misc_feature 1..23: note = Synthetic Construct
  source 1..23: mol_type = other DNA
ctgagctgcctcctaaccacaag

SEQ ID NO: 26934 - DNA, 21 bp, synthetic construct
  misc_feature 1..21: note = Synthetic Construct
  source 1..21: mol_type = other DNA
tcccaccaggtcctctgagat

SEQ ID NO: 26935 - DNA, 24 bp, synthetic construct
  misc_feature 1..24: note = Synthetic Construct
  source 1..24: mol_type = other DNA
cacctctgctctttggtagtggat

SEQ ID NO: 26936 - DNA, 22 bp, synthetic construct
  misc_feature 1..22: note = Synthetic Construct
  source 1..22: mol_type = other DNA
gtccatctccttgggagtgatg

SEQ ID NO: 26937 - DNA, 20 bp, synthetic construct
  misc_feature 1..20: note = Synthetic Construct
  source 1..20: mol_type = other DNA
gcccaggggttctgggactt

SEQ ID NO: 26938 - DNA, 21 bp, synthetic construct
  misc_feature 1..21: note = Synthetic Construct
  source 1..21: mol_type = other DNA
gttcctcctgcccatgcatta

SEQ ID NO: 26939 - DNA, 21 bp, synthetic construct
  misc_feature 1..21: note = Synthetic Construct
  source 1..21: mol_type = other DNA
tcaatgcgctccctggtattt

SEQ ID NO: 26940 - DNA, 28 bp, synthetic construct
  misc_feature 1..28: note = Synthetic Construct
  source 1..28: mol_type = other DNA
ggcagactttatttcccatttgctctac

SEQ ID NO: 26941 - DNA, 22 bp, synthetic construct
  misc_feature 1..22: note = Synthetic Construct
  source 1..22: mol_type = other DNA
agatgctggcaaggaaggaaat

SEQ ID NO: 26942 - DNA, 20 bp, synthetic construct
  misc_feature 1..20: note = Synthetic Construct
  source 1..20: mol_type = other DNA
agcggctcaggcacaaagaa

SEQ ID NO: 26943 - DNA, 20 bp, synthetic construct
  misc_feature 1..20: note = Synthetic Construct
  source 1..20: mol_type = other DNA
agcaagagcacagggtggaa

SEQ ID NO: 26944 - DNA, 26 bp, synthetic construct
  misc_feature 1..26: note = Synthetic Construct
  source 1..26: mol_type = other DNA
ttgccaccaatatcaggagtgtatag

SEQ ID NO: 26945 - DNA, 19 bp, synthetic construct
  misc_feature 1..19: note = Synthetic Construct
  source 1..19: mol_type = other DNA
aggctcgggagaccggaaa

SEQ ID NO: 26946 - DNA, 20 bp, synthetic construct
  misc_feature 1..20: note = Synthetic Construct
  source 1..20: mol_type = other DNA
agagcgtcagctccgaggtt

SEQ ID NO: 26947 - DNA, 20 bp, synthetic construct
  misc_feature 1..20: note = Synthetic Construct
  source 1..20: mol_type = other DNA
aaggccacttagggcagaga

SEQ ID NO: 26948 - DNA, 19 bp, synthetic construct
  misc_feature 1..19: note = Synthetic Construct
  source 1..19: mol_type = other DNA
tggctgcacaaccccagtt

SEQ ID NO: 26949 - DNA, 25 bp, synthetic construct
  misc_feature 1..25: note = Synthetic Construct
  source 1..25: mol_type = other DNA
agcttcctggaaatctacattgtgt

SEQ ID NO: 26950 - DNA, 21 bp, synthetic construct
  misc_feature 1..21: note = Synthetic Construct
  source 1..21: mol_type = other DNA
caatgccagttgcctctcaca

SEQ ID NO: 26951 - DNA, 22 bp, synthetic construct
  misc_feature 1..22: note = Synthetic Construct
  source 1..22: mol_type = other DNA
agcatctggtggtgttttcgat

SEQ ID NO: 26952 - DNA, 21 bp, synthetic construct
  misc_feature 1..21: note = Synthetic Construct
  source 1..21: mol_type = other DNA
gcagccggaggcattcactta

SEQ ID NO: 26953 - DNA, 20 bp, synthetic construct
  misc_feature 1..20: note = Synthetic Construct
  source 1..20: mol_type = other DNA
tctgggccacctgatggtat

SEQ ID NO: 26954 - DNA, 20 bp, synthetic construct
  misc_feature 1..20: note = Synthetic Construct
  source 1..20: mol_type = other DNA
ggcctttggccacagactga

SEQ ID NO: 26955 - DNA, 21 bp, synthetic construct
  misc_feature 1..21: note = Synthetic Construct
  source 1..21: mol_type = other DNA
gcccagagaaatggagcacat

SEQ ID NO: 26956 - DNA, 24 bp, synthetic construct
  misc_feature 1..24: note = Synthetic Construct
  source 1..24: mol_type = other DNA
cccaaaccatttccctatgcctta

SEQ ID NO: 26957 - DNA, 24 bp, synthetic construct
  misc_feature 1..24: note = Synthetic Construct
  source 1..24: mol_type = other DNA
gcctgtctctgtcgtcactaggat

SEQ ID NO: 26958 - DNA, 22 bp, synthetic construct
  misc_feature 1..22: note = Synthetic Construct
  source 1..22: mol_type = other DNA
ggtgtaaggagcaatgggatgt

SEQ ID NO: 26959 - DNA, 20 bp, synthetic construct
  misc_feature 1..20: note = Synthetic Construct
  source 1..20: mol_type = other DNA
gggtgaaaacgcacccaaca

SEQ ID NO: 26960 - DNA, 21 bp, synthetic construct
  misc_feature 1..21: note = Synthetic Construct
  source 1..21: mol_type = other DNA
ggtgtggtcaatggtgtcaga

SEQ ID NO: 26961 - DNA, 20 bp, synthetic construct
  misc_feature 1..20: note = Synthetic Construct
  source 1..20: mol_type = other DNA
tgccgggcaatccagagaga

SEQ ID NO: 26962 - DNA, 19 bp, synthetic construct
  misc_feature 1..19: note = Synthetic Construct
  source 1..19: mol_type = other DNA
gtgtgcctcgcctctttct

SEQ ID NO: 26963 - DNA, 25 bp, synthetic construct
  misc_feature 1..25: note = Synthetic Construct
  source 1..25: mol_type = other DNA
ccagctttgctcttcataacagctt

SEQ ID NO: 26964 - DNA, 24 bp, synthetic construct
  misc_feature 1..24: note = Synthetic Construct
  source 1..24: mol_type = other DNA
gagtgatagcactgagccagtaaa

SEQ ID NO: 26965 - DNA, 20 bp, synthetic construct
  misc_feature 1..20: note = Synthetic Construct
  source 1..20: mol_type = other DNA
gctccgggtgcaggaatcaa

SEQ ID NO: 26966 - DNA, 23 bp, synthetic construct
  misc_feature 1..23: note = Synthetic Construct
  source 1..23: mol_type = other DNA
aaatgcaacctatgccaggtact

SEQ ID NO: 26967 - DNA, 26 bp, synthetic construct
  misc_feature 1..26: note = Synthetic Construct
  source 1..26: mol_type = other DNA
agtcacctccagctatgtttgaatac

SEQ ID NO: 26968 - DNA, 18 bp, synthetic construct
  misc_feature 1..18: note = Synthetic Construct
  source 1..18: mol_type = other DNA
tgaggctgcgtgctctga

SEQ ID NO: 26969 - DNA, 24 bp, synthetic construct
  misc_feature 1..24: note = Synthetic Construct
  source 1..24: mol_type = other DNA
ccttgtgctagacatgaagcaaga

SEQ ID NO: 26970 - DNA, 24 bp, synthetic construct
  misc_feature 1..24: note = Synthetic Construct
  source 1..24: mol_type = other DNA
cccatagtcccatcctccctgaat

SEQ ID NO: 26971 - DNA, 18 bp, synthetic construct
  misc_feature 1..18: note = Synthetic Construct
  source 1..18: mol_type = other DNA
aggcaggctctcgcatct

SEQ ID NO: 26972 - DNA, 22 bp, synthetic construct
  misc_feature 1..22: note = Synthetic Construct
  source 1..22: mol_type = other DNA
ccgaccctgctgcaacaaatga

SEQ ID NO: 26973 - DNA, 25 bp, synthetic construct
  misc_feature 1..25: note = Synthetic Construct
  source 1..25: mol_type = other DNA
tgactgcttttccaaaactggtact

SEQ ID NO: 26974 - DNA, 20 bp, synthetic construct
  misc_feature 1..20: note = Synthetic Construct
  source 1..20: mol_type = other DNA
aagggccacctgtcagaagt

SEQ ID NO: 26975 - DNA, 24 bp, synthetic construct
  misc_feature 1..24: note = Synthetic Construct
  source 1..24: mol_type = other DNA
gtggctggttcctatggtatgaga

SEQ ID NO: 26976 - DNA, 24 bp, synthetic construct
  misc_feature 1..24: note = Synthetic Construct
  source 1..24: mol_type = other DNA
ggctcatcgcatgcatctttgatt

SEQ ID NO: 26977 - DNA, 22 bp, synthetic construct
  misc_feature 1..22: note = Synthetic Construct
  source 1..22: mol_type = other DNA
caatctcaagccctgggcaaag

SEQ ID NO: 26978 - DNA, 21 bp, synthetic construct
  misc_feature 1..21: note = Synthetic Construct
  source 1..21: mol_type = other DNA
accctgtagcaggagctgtgt

SEQ ID NO: 26979 - DNA, 24 bp, synthetic construct
  misc_feature 1..24: note = Synthetic Construct
  source 1..24: mol_type = other DNA
tggcttatatggcctcacctatct

SEQ ID NO: 26980 - DNA, 21 bp, synthetic construct
  misc_feature 1..21: note = Synthetic Construct
  source 1..21: mol_type = other DNA
aggactggggtggtgaaggaa

SEQ ID NO: 26981 - DNA, 21 bp, synthetic construct
  misc_feature 1..21: note = Synthetic Construct
  source 1..21: mol_type = other DNA
gggtgcagggaatgcacagat

SEQ ID NO: 26982 - DNA, 24 bp, synthetic construct
  misc_feature 1..24: note = Synthetic Construct
  source 1..24: mol_type = other DNA
cctcaaatgagggcagggacattc

SEQ ID NO: 26983 - DNA, 24 bp, synthetic construct
  misc_feature 1..24: note = Synthetic Construct
  source 1..24: mol_type = other DNA
tgtcgtatcccagggttgtatttc

SEQ ID NO: 26984 - DNA, 20 bp, synthetic construct
  misc_feature 1..20: note = Synthetic Construct
  source 1..20: mol_type = other DNA
ggggccagagagctttcact

SEQ ID NO: 26985 - DNA, 24 bp, synthetic construct
  misc_feature 1..24: note = Synthetic Construct
  source 1..24: mol_type = other DNA
ccatctcgacgcagagagaacctt

SEQ ID NO: 26986 - DNA, 21 bp, synthetic construct
  misc_feature 1..21: note = Synthetic Construct
  source 1..21: mol_type = other DNA
ggaaacagacgggcgtccata

SEQ ID NO: 26987 - DNA, 22 bp, synthetic construct
  misc_feature 1..22: note = Synthetic Construct
  source 1..22: mol_type = other DNA
aggatcacctgagcctgggatt

SEQ ID NO: 26988 - DNA, 23 bp, synthetic construct
  misc_feature 1..23: note = Synthetic Construct
  source 1..23: mol_type = other DNA
cactgggctgctcatagaataca

SEQ ID NO: 26989 - DNA, 20 bp, synthetic construct
  misc_feature 1..20: note = Synthetic Construct
  source 1..20: mol_type = other DNA
tggcccagcccagaaaaact

SEQ ID NO: 26990 - DNA, 22 bp, synthetic construct
  misc_feature 1..22: note = Synthetic Construct
  source 1..22: mol_type = other DNA
gtgagcctccagatgtttcctt

SEQ ID NO: 26991 - DNA, 19 bp, synthetic construct
  misc_feature 1..19: note = Synthetic Construct
  source 1..19: mol_type = other DNA
gagaccgctgccacagtca

SEQ ID NO: 26992 - DNA, 22 bp, synthetic construct
  misc_feature 1..22: note = Synthetic Construct
  source 1..22: mol_type = other DNA
accaaaccccttaggcccacta

SEQ ID NO: 26993 - DNA, 25 bp, synthetic construct
  misc_feature 1..25: note = Synthetic Construct
  source 1..25: mol_type = other DNA
cattgatcagggtactgaagtggta

SEQ ID NO: 26994 - DNA, 20 bp, synthetic construct
  misc_feature 1..20: note = Synthetic Construct
  source 1..20: mol_type = other DNA
ggagacagagctcccgattg

SEQ ID NO: 26995 - DNA, 23 bp, synthetic construct
  misc_feature 1..23: note = Synthetic Construct
  source 1..23: mol_type = other DNA
caagcagataggaggcgatcaga

SEQ ID NO: 26996 - DNA, 23 bp, synthetic construct
  misc_feature 1..23: note = Synthetic Construct
  source 1..23: mol_type = other DNA
gctcatcacactcaccccagcta

SEQ ID NO: 26997 - DNA, 18 bp, synthetic construct
  misc_feature 1..18: note = Synthetic Construct
  source 1..18: mol_type = other DNA
tgagggtggcagcgtcat

SEQ ID NO: 26998 - DNA, 20 bp, synthetic construct
  misc_feature 1..20: note = Synthetic Construct
  source 1..20: mol_type = other DNA
gcacagcactctgcccttca

SEQ ID NO: 26999 - DNA, 24 bp, synthetic construct
  misc_feature 1..24: note = Synthetic Construct
  source 1..24: mol_type = other DNA
ggtctgggccttaagaggcattga

SEQ ID NO: 27000 - DNA, 21 bp, synthetic construct
  misc_feature 1..21: note = Synthetic Construct
  source 1..21: mol_type = other DNA
tgccctggggcgaggttatta

SEQ ID NO: 27001 - DNA, 20 bp, synthetic construct
  misc_feature 1..20: note = Synthetic Construct
  source 1..20: mol_type = other DNA
caccaggacaagtgctgtct

SEQ ID NO: 27002 - DNA, 22 bp, synthetic construct
  misc_feature 1..22: note = Synthetic Construct
  source 1..22: mol_type = other DNA
ggagcatcgctcagctcttctt

SEQ ID NO: 27003 - DNA, 20 bp, synthetic construct
  misc_feature 1..20: note = Synthetic Construct
  source 1..20: mol_type = other DNA
ccgccttgacagcaggaagt

SEQ ID NO: 27004 - DNA, 24 bp, synthetic construct
  misc_feature 1..24: note = Synthetic Construct
  source 1..24: mol_type = other DNA
atgcaacttccctgaaaggagtaa

SEQ ID NO: 27005 - DNA, 23 bp, synthetic construct
  misc_feature 1..23: note = Synthetic Construct
  source 1..23: mol_type = other DNA
ctgccttgctggatggcaaaatg

SEQ ID NO: 27006 - DNA, 21 bp, synthetic construct
  misc_feature 1..21: note = Synthetic Construct
  source 1..21: mol_type = other DNA
catttgggagccatggtggta

SEQ ID NO: 27007 - DNA, 23 bp, synthetic construct
  misc_feature 1..23: note = Synthetic Construct
  source 1..23: mol_type = other DNA
gggctaggagcccaatatcattt

SEQ ID NO: 27008 - DNA, 23 bp, synthetic construct
  misc_feature 1..23: note = Synthetic Construct
  source 1..23: mol_type = other DNA
cccatctcccttcccatctgtct

SEQ ID NO: 27009 - DNA, 22 bp, synthetic construct
  misc_feature 1..22: note = Synthetic Construct
  source 1..22: mol_type = other DNA
caggaagctccacacaaacaca

SEQ ID NO: 27010 - DNA, 19 bp, synthetic construct
  misc_feature 1..19: note = Synthetic Construct
  source 1..19: mol_type = other DNA
cagtgccctccagccaaag

SEQ ID NO: 27011 - DNA, 20 bp, synthetic construct
  misc_feature 1..20: note = Synthetic Construct
  source 1..20: mol_type = other DNA
gtcaccgacaccctgtggat

SEQ ID NO: 27012 - DNA, 23 bp, synthetic construct
  misc_feature 1..23: note = Synthetic Construct
  source 1..23: mol_type = other DNA
acaagaggccctagaatccaagt

SEQ ID NO: 27013 - DNA, 19 bp, synthetic construct
  misc_feature 1..19: note = Synthetic Construct
  source 1..19: mol_type = other DNA
ggcggactccacctgaaga

SEQ ID NO: 27014 - DNA, 23 bp, synthetic construct
  misc_feature 1..23: note = Synthetic Construct
  source 1..23: mol_type = other DNA
ccattctcgtggtccatttgtct

SEQ ID NO: 27015 - DNA, 22 bp, synthetic construct
  misc_feature 1..22: note = Synthetic Construct
  source 1..22: mol_type = other DNA
gatcaggttgcagtctcagcat

SEQ ID NO: 27016 - DNA, 23 bp, synthetic construct
  misc_feature 1..23: note = Synthetic Construct
  source 1..23: mol_type = other DNA
ggcagtagagaagggtctaggat

SEQ ID NO: 27017 - DNA, 23 bp, synthetic construct
  misc_feature 1..23: note = Synthetic Construct
  source 1..23: mol_type = other DNA
tcaccagatggcatttgtcttca

SEQ ID NO: 27018 - DNA, 25 bp, synthetic construct
  misc_feature 1..25: note = Synthetic Construct
  source 1..25: mol_type = other DNA
actgaactacctggacatctgtttt

SEQ ID NO: 27019 - DNA, 20 bp, synthetic construct
  misc_feature 1..20: note = Synthetic Construct
  source 1..20: mol_type = other DNA
gcaggcacacggaatgcaaa

SEQ ID NO: 27020 - DNA, 20 bp, synthetic construct
  misc_feature 1..20: note = Synthetic Construct
  source 1..20: mol_type = other DNA
acagccctcccggctgactt

SEQ ID NO: 27021 - DNA, 21 bp, synthetic construct
  misc_feature 1..21: note = Synthetic Construct
  source 1..21: mol_type = other DNA
cagtggtgacctgtgggaaag

SEQ ID NO: 27022 - DNA, 22 bp, synthetic construct
  misc_feature 1..22: note = Synthetic Construct
  source 1..22: mol_type = other DNA
cccgacccctgatacttcacaa

SEQ ID NO: 27023 - DNA, 22 bp, synthetic construct
  misc_feature 1..22: note = Synthetic Construct
  source 1..22: mol_type = other DNA
gaggcagttctggccataggat

SEQ ID NO: 27024 - DNA, 23 bp, synthetic construct
  misc_feature 1..23: note = Synthetic Construct
  source 1..23: mol_type = other DNA
tgccatcttcttcattgcagttg

SEQ ID NO: 27025 - DNA, 21 bp, synthetic construct
  misc_feature 1..21: note = Synthetic Construct
  source 1..21: mol_type = other DNA
gcacaggcaacatcacagttg

SEQ ID NO: 27026 - DNA, 22 bp, synthetic construct
  misc_feature 1..22: note = Synthetic Construct
  source 1..22: mol_type = other DNA
ggagacccaactgtgaacaaga

SEQ ID NO: 27027 - DNA, 24 bp, synthetic construct
  misc_feature 1..24: note = Synthetic Construct
  source 1..24: mol_type = other DNA
tcatgcctgggaccaaattctaag

SEQ ID NO: 27028 - DNA, 21 bp, synthetic construct
  misc_feature 1..21: note = Synthetic Construct
  source 1..21: mol_type = other DNA
gcagctgcctctgagtgtttg

SEQ ID NO: 27029 - DNA, 20 bp, synthetic construct
  misc_feature 1..20: note = Synthetic Construct
  source 1..20: mol_type = other DNA
tccctggctccgtggtgctt

SEQ ID NO: 27030 - DNA, 21 bp, synthetic construct
  misc_feature 1..21: note = Synthetic Construct
  source 1..21: mol_type = other DNA
tgccgttgtttggaagcacta

SEQ ID NO: 27031 - DNA, 25 bp, synthetic construct
  misc_feature 1..25: note = Synthetic Construct
  source 1..25: mol_type = other DNA
aggttacaaccttgaaaacccaaac

SEQ ID NO: 27032 - DNA, 21 bp, synthetic construct
  misc_feature 1..21: note = Synthetic Construct
  source 1..21: mol_type = other DNA
gggagggatggggtcgaaatc

SEQ ID NO: 27033 - DNA, 20 bp, synthetic construct
  misc_feature 1..20: note = Synthetic Construct
  source 1..20: mol_type = other DNA
aagggtcggcggggttcaga

SEQ ID NO: 27034 - DNA, 23 bp, synthetic construct
  misc_feature 1..23: note = Synthetic Construct
  source 1..23: mol_type = other DNA
gctgattaggtgactctgtccaa

SEQ ID NO: 27035 - DNA, 18 bp, synthetic construct
  misc_feature 1..18: note = Synthetic Construct
  source 1..18: mol_type = other DNA
tggcagcactgggcacat

SEQ ID NO: 27036 - DNA, 20 bp, synthetic construct
  misc_feature 1..20: note = Synthetic Construct
  source 1..20: mol_type = other DNA
tcctggagcacagccttcat

SEQ ID NO: 27037 - DNA, 22 bp, synthetic construct
  misc_feature 1..22: note = Synthetic Construct
  source 1..22: mol_type = other DNA
gggacctgagcctctgttttga

SEQ ID NO: 27038 - DNA, 20 bp, synthetic construct
  misc_feature 1..20: note = Synthetic Construct
  source 1..20: mol_type = other DNA
ccaccacaaccactccagtt

SEQ ID NO: 27039 - DNA, 20 bp, synthetic construct
  misc_feature 1..20: note = Synthetic Construct
  source 1..20: mol_type = other DNA
tgccctgaggtttgcgtagt

SEQ ID NO: 27040 - DNA, 22 bp, synthetic construct
  misc_feature 1..22: note = Synthetic Construct
  source 1..22: mol_type = other DNA
gattctgcagcaaggtgctatg

SEQ ID NO: 27041 - DNA, 18 bp, synthetic construct
  misc_feature 1..18: note = Synthetic Construct
  source 1..18: mol_type = other DNA
tggaaggggcgagggaat

SEQ ID NO: 27042 - DNA, 21 bp, synthetic construct
  misc_feature 1..21: note = Synthetic Construct
  source 1..21: mol_type = other DNA
actgggctgattcgtctcact

SEQ ID NO: 27043 - DNA, 20 bp, synthetic construct
  misc_feature 1..20: note = Synthetic Construct
  source 1..20: mol_type = other DNA
ggcaggcctaacagttccat

SEQ ID NO: 27044 - DNA, 20 bp, synthetic construct
  misc_feature 1..20: note = Synthetic Construct
  source 1..20: mol_type = other DNA
acgagcttttggctgtgcaa

SEQ ID NO: 27045 - DNA, 25 bp, synthetic construct
  misc_feature 1..25: note = Synthetic Construct
  source 1..25: mol_type = other DNA
ccatcctggtgactgtttcctttca

SEQ ID NO: 27046 - DNA, 21 bp, synthetic construct
  misc_feature 1..21: note = Synthetic Construct
  source 1..21: mol_type = other DNA
gagccgaacaagcgtttctgt

SEQ ID NO: 27047 - DNA, 22 bp, synthetic construct
  misc_feature 1..22: note = Synthetic Construct
  source 1..22: mol_type = other DNA
tgtggcagtggggaaggtgtaa

SEQ ID NO: 27048 - DNA, 23 bp, synthetic construct
  misc_feature 1..23: note = Synthetic Construct
  source 1..23: mol_type = other DNA
gtgctgttttcctcccaccttct

SEQ ID NO: 27049 - DNA, 20 bp, synthetic construct
  misc_feature 1..20: note = Synthetic Construct
  source 1..20: mol_type = other DNA
aagccctgcccacccactga

SEQ ID NO: 27050 - DNA, 23 bp, synthetic construct
  misc_feature 1..23: note = Synthetic Construct
  source 1..23: mol_type = other DNA
gctgccttgggaatagacgttca

SEQ ID NO: 27051 - DNA, 23 bp, synthetic construct
  misc_feature 1..23: note = Synthetic Construct
  source 1..23: mol_type = other DNA
agatgctctgtcctggatgatgt

SEQ ID NO: 27052 - DNA, 22 bp, synthetic construct
  misc_feature 1..22: note = Synthetic Construct
  source 1..22: mol_type = other DNA
ctccctgacaacgtctggaatg

SEQ ID NO: 27053 - DNA, 25 bp, synthetic construct
  misc_feature 1..25: note = Synthetic Construct
  source 1..25: mol_type = other DNA
gctctcatcacactttggaccttga

SEQ ID NO: 27054 - DNA, 23 bp, synthetic construct
  misc_feature 1..23: note = Synthetic Construct
  source 1..23: mol_type = other DNA
tgtagggtggggttgagagattt

SEQ ID NO: 27055 - DNA, 20 bp, synthetic construct
  misc_feature 1..20: note = Synthetic Construct
  source 1..20: mol_type = other DNA
gcggttggtgctcctcctaa

SEQ ID NO: 27056 - DNA, 21 bp, synthetic construct
  misc_feature 1..21: note = Synthetic Construct
  source 1..21: mol_type = other DNA
gcactgtgctcctgctgtttg

SEQ ID NO: 27057 - DNA, 19 bp, synthetic construct
  misc_feature 1..19: note = Synthetic Construct
  source 1..19: mol_type = other DNA
tgccaagccaccacagaaa

SEQ ID NO: 27058 - DNA, 21 bp, synthetic construct
  misc_feature 1..21: note = Synthetic Construct
  source 1..21: mol_type = other DNA
tccccatgcacacaccctcta

SEQ ID NO: 27059 - DNA, 21 bp, synthetic construct
  misc_feature 1..21: note = Synthetic Construct
  source 1..21: mol_type = other DNA
aggaaggcagatggtgtcaac

SEQ ID NO: 27060 - DNA, 21 bp, synthetic construct
  misc_feature 1..21: note = Synthetic Construct
  source 1..21: mol_type = other DNA
gggccttgcctcccagaaaat

SEQ ID NO: 27061 - DNA, 25 bp, synthetic construct
  misc_feature 1..25: note = Synthetic Construct
  source 1..25: mol_type = other DNA
tttccatttctccctcgcttattct

SEQ ID NO: 27062 - DNA, 20 bp, synthetic construct
  misc_feature 1..20: note = Synthetic Construct
  source 1..20: mol_type = other DNA
aactgttcctgcagcccttt

SEQ ID NO: 27063 - DNA, 20 bp, synthetic construct
  misc_feature 1..20: note = Synthetic Construct
  source 1..20: mol_type = other DNA
tcccagcacaatgcctgtct

SEQ ID NO: 27064 - DNA, 24 bp, synthetic construct
  misc_feature 1..24: note = Synthetic Construct
  source 1..24: mol_type = other DNA
gccttcagtatgtcttgcgtcttg

SEQ ID NO: 27065 - DNA, 22 bp, synthetic construct
  misc_feature 1..22: note = Synthetic Construct
  source 1..22: mol_type = other DNA
ggagggcagtggcacaatcata

SEQ ID NO: 27066 - DNA, 21 bp, synthetic construct
  misc_feature 1..21: note = Synthetic Construct
  source 1..21: mol_type = other DNA
aagggtggcaccgaagtcaga

SEQ ID NO: 27067 - DNA, 23 bp, synthetic construct
  misc_feature 1..23: note = Synthetic Construct
  source 1..23: mol_type = other DNA
ggccaaggtggaaggattgctta

SEQ ID NO: 27068 - DNA, 20 bp, synthetic construct
  misc_feature 1..20: note = Synthetic Construct
  source 1..20: mol_type = other DNA
aggtgaagctgagccacttg

SEQ ID NO: 27069 - DNA, 22 bp, synthetic construct
  misc_feature 1..22: note = Synthetic Construct
  source 1..22: mol_type = other DNA
ctaccaagtctgctgtcccaaa

SEQ ID NO: 27070 - DNA, 24 bp, synthetic construct
  misc_feature 1..24: note = Synthetic Construct
  source 1..24: mol_type = other DNA
cccacgctgattaatgctcctttg

SEQ ID NO: 27071 - DNA, 22 bp, synthetic construct
  misc_feature 1..22: note = Synthetic Construct
  source 1..22: mol_type = other DNA
gagaggctttgaggcattgaga

SEQ ID NO: 27072 - DNA, 22 bp, synthetic construct
  misc_feature 1..22: note = Synthetic Construct
  source 1..22: mol_type = other DNA
ggcagttggggaggaaaggtat

SEQ ID NO: 27073 - DNA, 21 bp, synthetic construct
  misc_feature 1..21: note = Synthetic Construct
  source 1..21: mol_type = other DNA
gcaaggctggaccaggaatgt

SEQ ID NO: 27074 - DNA, 21 bp, synthetic construct
  misc_feature 1..21: note = Synthetic Construct
  source 1..21: mol_type = other DNA
agacaaagtcctccccactct

SEQ ID NO: 27075 - DNA, 19 bp, synthetic construct
  misc_feature 1..19: note = Synthetic Construct
  source 1..19: mol_type = other DNA
acacaggcagcgtttgctt

SEQ ID NO: 27076 - DNA, 22 bp, synthetic construct
  misc_feature 1..22: note = Synthetic Construct
  source 1..22: mol_type = other DNA
attaagccccatgggtggtatg

SEQ ID NO: 27077 - DNA, 20 bp, synthetic construct
  misc_feature 1..20: note = Synthetic Construct
  source 1..20: mol_type = other DNA
caaagtcggcccgtctcact

SEQ ID NO: 27078 - DNA, 23 bp, synthetic construct
  misc_feature 1..23: note = Synthetic Construct
  source 1..23: mol_type = other DNA
cctcatccagagattgcaaggtt

SEQ ID NO: 27079 - DNA, 22 bp, synthetic construct
  misc_feature 1..22: note = Synthetic Construct
  source 1..22: mol_type = other DNA
ctacctgcctgcactgtagatg

SEQ ID NO: 27080 - DNA, 21 bp, synthetic construct
  misc_feature 1..21: note = Synthetic Construct
  source 1..21: mol_type = other DNA
agcctgctgatgcaggagttg

SEQ ID NO: 27081 - DNA, 25 bp, synthetic construct
  misc_feature 1..25: note = Synthetic Construct
  source 1..25: mol_type = other DNA
gcgagactgattacagactgagcta

SEQ ID NO: 27082 - DNA, 22 bp, synthetic construct
  misc_feature 1..22: note = Synthetic Construct
  source 1..22: mol_type = other DNA
gcgctgaagtgttgcattctgt

SEQ ID NO: 27083 - DNA, 20 bp, synthetic construct
  misc_feature 1..20: note = Synthetic Construct
  source 1..20: mol_type = other DNA
tggccgaggctgtgaaggta

SEQ ID NO: 27084 - DNA, 21 bp, synthetic construct
  misc_feature 1..21: note = Synthetic Construct
  source 1..21: mol_type = other DNA
ccagctccccttgtggttaaa

SEQ ID NO: 27085 - DNA, 20 bp, synthetic construct
  misc_feature 1..20: note = Synthetic Construct
  source 1..20: mol_type = other DNA
ggcatgcctttccacctagt

SEQ ID NO: 27086 - DNA, 21 bp, synthetic construct
  misc_feature 1..21: note = Synthetic Construct
  source 1..21: mol_type = other DNA
agcctccactcccctccttct

SEQ ID NO: 27087 - DNA, 21 bp, synthetic construct
  misc_feature 1..21: note = Synthetic Construct
  source 1..21: mol_type = other DNA
gctccccgaggctgtgagtaa

SEQ ID NO: 27088 - DNA, 21 bp, synthetic construct
  misc_feature 1..21: note = Synthetic Construct
  source 1..21: mol_type = other DNA
gggtccacagtgtccgtgttt

SEQ ID NO: 27089 - DNA, 19 bp, synthetic construct
  misc_feature 1..19: note = Synthetic Construct
  source 1..19: mol_type = other DNA
agccccagctctcccatgt

SEQ ID NO: 27090 - DNA, 21 bp, synthetic construct
  misc_feature 1..21: note = Synthetic Construct
  source 1..21: mol_type = other DNA
tcgactgctctgtgcccatct

SEQ ID NO: 27091 - DNA, 21 bp, synthetic construct
  misc_feature 1..21: note = Synthetic Construct
  source 1..21: mol_type = other DNA
ggtgaaggcaaagtcctcctt

SEQ ID NO: 27092 - DNA, 18 bp, synthetic construct
  misc_feature 1..18: note = Synthetic Construct
  source 1..18: mol_type = other DNA
acagccctgctgctgctt

SEQ ID NO: 27093 - DNA, 22 bp, synthetic construct
  misc_feature 1..22: note = Synthetic Construct
  source 1..22: mol_type = other DNA
cacacacagtcctaggccatac

SEQ ID NO: 27094 - DNA, 20 bp, synthetic construct
  misc_feature 1..20: note = Synthetic Construct
  source 1..20: mol_type = other DNA
tctgggtcgcgtaactccat

SEQ ID NO: 27095 - DNA, 19 bp, synthetic construct
  misc_feature 1..19: note = Synthetic Construct
  source 1..19: mol_type = other DNA
gctggcggagcagttcgta

SEQ ID NO: 27096 - DNA, 18 bp, synthetic construct
  misc_feature 1..18: note = Synthetic Construct
  source 1..18: mol_type = other DNA
aggcagcctggccttaca

SEQ ID NO: 27097 - DNA, 19 bp, synthetic construct
  misc_feature 1..19: note = Synthetic Construct
  source 1..19: mol_type = other DNA
aggcttggcaaggccatca

SEQ ID NO: 27098 - DNA, 19 bp, synthetic construct
  misc_feature 1..19: note = Synthetic Construct
  source 1..19: mol_type = other DNA
agtcgtgggctgtgtgcat

SEQ ID NO: 27099 - DNA, 22 bp, synthetic construct
  misc_feature 1..22: note = Synthetic Construct
  source 1..22: mol_type = other DNA
tgcctgttatgcacaagcacta

SEQ ID NO: 27100 - DNA, 20 bp, synthetic construct
  misc_feature 1..20: note = Synthetic Construct
  source 1..20: mol_type = other DNA
ggggcagctggagactggat

SEQ ID NO: 27101 - DNA, 25 bp, synthetic construct
  misc_feature 1..25: note = Synthetic Construct
  source 1..25: mol_type = other DNA
agggaatggggaatattgaatgctt

SEQ ID NO: 27102 - DNA, 19 bp, synthetic construct
  misc_feature 1..19: note = Synthetic Construct
  source 1..19: mol_type = other DNA
gggtggggctcagtgttga

SEQ ID NO: 27103 - DNA, 19 bp, synthetic construct
  misc_feature 1..19: note = Synthetic Construct
  source 1..19: mol_type = other DNA
gcagagcagggtgaacagt

SEQ ID NO: 27104 - DNA, 20 bp, synthetic construct
  misc_feature 1..20: note = Synthetic Construct
  source 1..20: mol_type = other DNA
tgcccaggcttcttggtgtt

SEQ ID NO: 27105 - DNA, 21 bp, synthetic construct
  misc_feature 1..21: note = Synthetic Construct
  source 1..21: mol_type = other DNA
aggaggatggggacgaaggat

SEQ ID NO: 27106 - DNA, 21 bp, synthetic construct
  misc_feature 1..21: note = Synthetic Construct
  source 1..21: mol_type = other DNA
gttgctgacaggtcagtgtct

SEQ ID NO: 27107 - DNA, 19 bp, synthetic construct
  misc_feature 1..19: note = Synthetic Construct
  source 1..19: mol_type = other DNA
ccctaggccactgcagcaa

SEQ ID NO: 27108 - DNA, 20 bp, synthetic construct
  misc_feature 1..20: note = Synthetic Construct
  source 1..20: mol_type = other DNA
gacaagcctggggaaactgt

SEQ ID NO: 27109 - DNA, 20 bp, synthetic construct
  misc_feature 1..20: note = Synthetic Construct
  source 1..20: mol_type = other DNA
acgcagcacccagaggtaat

SEQ ID NO: 27110 - DNA, 21 bp, synthetic construct
  misc_feature 1..21: note = Synthetic Construct
  source 1..21: mol_type = other DNA
tgtgggccacctctttttgaa

SEQ ID NO: 27111 - DNA, 23 bp, synthetic construct
  misc_feature 1..23: note = Synthetic Construct
  source 1..23: mol_type = other DNA
gccttttgtgcagtggtcagcat

SEQ ID NO: 27112 - DNA, 20 bp, synthetic construct
  misc_feature 1..20: note = Synthetic Construct
  source 1..20: mol_type = other DNA
ttaggccccactgcagatca

SEQ ID NO: 27113 - DNA, 22 bp, synthetic construct
  misc_feature 1..22: note = Synthetic Construct
  source 1..22: mol_type = other DNA
ggggaaccacccaaggttcttt

SEQ ID NO: 27114 - DNA, 20 bp, synthetic construct
  misc_feature 1..20: note = Synthetic Construct
  source 1..20: mol_type = other DNA
agtggcacttccacctgtga

SEQ ID NO: 27115 - DNA, 22 bp, synthetic construct
  misc_feature 1..22: note = Synthetic Construct
  source 1..22: mol_type = other DNA
agacctcagaacggagttgttc

SEQ ID NO: 27116 - DNA, 20 bp, synthetic construct
  misc_feature 1..20: note = Synthetic Construct
  source 1..20: mol_type = other DNA
agacggccagaagtgactgt

SEQ ID NO: 27117 - DNA, 18 bp, synthetic construct
  misc_feature 1..18: note = Synthetic Construct
  source 1..18: mol_type = other DNA
cacgagcaccaggcatca

SEQ ID NO: 27118 - DNA, 23 bp, synthetic construct
  misc_feature 1..23: note = Synthetic Construct
  source 1..23: mol_type = other DNA
gggcaaagctcttgagaccagaa

SEQ ID NO: 27119 - DNA, 21 bp, synthetic construct
  misc_feature 1..21: note = Synthetic Construct
  source 1..21: mol_type = other DNA
agtgaacgctgtgggtttgtt

SEQ ID NO: 27120 - DNA, 22 bp, synthetic construct
  misc_feature 1..22: note = Synthetic Construct
  source 1..22: mol_type = other DNA
cgagagcctggggtagtttttg

SEQ ID NO: 27121 - DNA, 20 bp, synthetic construct
  misc_feature 1..20: note = Synthetic Construct
  source 1..20: mol_type = other DNA
agtgttccgcttggctggta

SEQ ID NO: 27122 - DNA, 26 bp, synthetic construct
  misc_feature 1..26: note = Synthetic Construct
  source 1..26: mol_type = other DNA
gagagaacggacaacttttcccaaca

SEQ ID NO: 27123 - DNA, 20 bp, synthetic construct
  misc_feature 1..20: note = Synthetic Construct
  source 1..20: mol_type = other DNA
gcagcctccacagagaacat

SEQ ID NO: 27124 - DNA, 22 bp, synthetic construct
  misc_feature 1..22: note = Synthetic Construct
  source 1..22: mol_type = other DNA
cctgcagccaagtgcttactct

SEQ ID NO: 27125 - DNA, 24 bp, synthetic construct
  misc_feature 1..24: note = Synthetic Construct
  source 1..24: mol_type = other DNA
ttgagcagctaccatattcacaca

SEQ ID NO: 27126 - DNA, 23 bp, synthetic construct
  misc_feature 1..23: note = Synthetic Construct
  source 1..23: mol_type = other DNA
cacatgcacacacactggataga

SEQ ID NO: 27127 - DNA, 22 bp, synthetic construct
  misc_feature 1..22: note = Synthetic Construct
  source 1..22: mol_type = other DNA
attttgccccagaagctacagt

SEQ ID NO: 27128 - DNA, 22 bp, synthetic construct
  misc_feature 1..22: note = Synthetic Construct
  source 1..22: mol_type = other DNA
gctcagacccttgtgcttctct

SEQ ID NO: 27129 - DNA, 21 bp, synthetic construct
  misc_feature 1..21: note = Synthetic Construct
  source 1..21: mol_type = other DNA
gagactgcattggcgtactga

SEQ ID NO: 27130 - DNA, 21 bp, synthetic construct
  misc_feature 1..21: note = Synthetic Construct
  source 1..21: mol_type = other DNA
gccacctttcctctgcaagtt

SEQ ID NO: 27131 - DNA, 20 bp, synthetic construct
  misc_feature 1..20: note = Synthetic Construct
  source 1..20: mol_type = other DNA
tggcagcaagaggactgaca

SEQ ID NO: 27132 - DNA, 24 bp, synthetic construct
  misc_feature 1..24: note = Synthetic Construct
  source 1..24: mol_type = other DNA
ggataggacagtagccatggagtt

SEQ ID NO: 27133 - DNA, 27 bp, synthetic construct
  misc_feature 1..27: note = Synthetic Construct
  source 1..27: mol_type = other DNA
gctttttgtaggagtaagaagggagaa

SEQ ID NO: 27134 - DNA, 21 bp, synthetic construct
  misc_feature 1..21: note = Synthetic Construct
  source 1..21: mol_type = other DNA
ggacacccgagacctgtgcta

SEQ ID NO: 27135 - DNA, 19 bp, synthetic construct
  misc_feature 1..19: note = Synthetic Construct
  source 1..19: mol_type = other DNA
ccaccagctgcttggcata

SEQ ID NO: 27136 - DNA, 20 bp, synthetic construct
  misc_feature 1..20: note = Synthetic Construct
  source 1..20: mol_type = other DNA
cctgagcctggcctgagatg

SEQ ID NO: 27137 - DNA, 22 bp, synthetic construct
  misc_feature 1..22: note = Synthetic Construct
  source 1..22: mol_type = other DNA
ggtccacgtccgtgcctttatt

SEQ ID NO: 27138 - DNA, 22 bp, synthetic construct
  misc_feature 1..22: note = Synthetic Construct
  source 1..22: mol_type = other DNA
gggaaaagcacgtttgttcagt

SEQ ID NO: 27139 - DNA, 22 bp, synthetic construct
  misc_feature 1..22: note = Synthetic Construct
  source 1..22: mol_type = other DNA
gcttctctttcctctccgaaca

SEQ ID NO: 27140 - DNA, 22 bp, synthetic construct
  misc_feature 1..22: note = Synthetic Construct
  source 1..22: mol_type = other DNA
aggctcagggaggttaggatac

SEQ ID NO: 27141 - DNA, 22 bp, synthetic construct
  misc_feature 1..22: note = Synthetic Construct
  source 1..22: mol_type = other DNA
ccatgtccctggcactctgttt

SEQ ID NO: 27142 - DNA, 23 bp, synthetic construct
  misc_feature 1..23: note = Synthetic Construct
  source 1..23: mol_type = other DNA
actttgggattctggaggacaga

SEQ ID NO: 27143 - DNA, 24 bp, synthetic construct
  misc_feature 1..24: note = Synthetic Construct
  source 1..24: mol_type = other DNA
aaaatgcctctgcttctaggatga

SEQ ID NO: 27144 - DNA, 22 bp, synthetic construct
  misc_feature 1..22: note = Synthetic Construct
  source 1..22: mol_type = other DNA
aacgtgacaggaaggacacttt

SEQ ID NO: 27145 - DNA, 24 bp, synthetic construct
  misc_feature 1..24: note = Synthetic Construct
  source 1..24: mol_type = other DNA
gctacttggataggccttgctttg

SEQ ID NO: 27146 - DNA, 18 bp, synthetic construct
  misc_feature 1..18: note = Synthetic Construct
  source 1..18: mol_type = other DNA
accgtgcccagccttgtt

SEQ ID NO: 27147 - DNA, 18 bp, synthetic construct
  misc_feature 1..18: note = Synthetic Construct
  source 1..18: mol_type = other DNA
tgtgcagctggcgtgaat

SEQ ID NO: 27148 - DNA, 20 bp, synthetic construct
  misc_feature 1..20: note = Synthetic Construct
  source 1..20: mol_type = other DNA
aggccccacttcttgggatt

SEQ ID NO: 27149 - DNA, 22 bp, synthetic construct
  misc_feature 1..22: note = Synthetic Construct
  source 1..22: mol_type = other DNA
aaacacactggaagcctgaaga

SEQ ID NO: 27150 - DNA, 20 bp, synthetic construct
  misc_feature 1..20: note = Synthetic Construct
  source 1..20: mol_type = other DNA
acgcggcaggtgcctaggat

SEQ ID NO: 27151 - DNA, 22 bp, synthetic construct
  misc_feature 1..22: note = Synthetic Construct
  source 1..22: mol_type = other DNA
ggagtccacctcaccgacttac

SEQ ID NO: 27152 - DNA, 19 bp, synthetic construct
  misc_feature 1..19: note = Synthetic Construct
  source 1..19: mol_type = other DNA
tggacagcctctgctgcat

SEQ ID NO: 27153 - DNA, 23 bp, synthetic construct
  misc_feature 1..23: note = Synthetic Construct
  source 1..23: mol_type = other DNA
tcaaattcctgcatagggcaaca

SEQ ID NO: 27154 - DNA, 22 bp, synthetic construct
  misc_feature 1..22: note = Synthetic Construct
  source 1..22: mol_type = other DNA
ccctggtgggcacttcaacatt

SEQ ID NO: 27155 - DNA, 21 bp, synthetic construct
  misc_feature 1..21: note = Synthetic Construct
  source 1..21: mol_type = other DNA
ttccccagcagagacggtgaa

SEQ ID NO: 27156 - DNA, 24 bp, synthetic construct
  misc_feature 1..24: note = Synthetic Construct
  source 1..24: mol_type = other DNA
tttccagaaattcaggccactttg

SEQ ID NO: 27157 - DNA, 22 bp, synthetic construct
  misc_feature 1..22: note = Synthetic Construct
  source 1..22: mol_type = other DNA
cctcgggttccagagtctgttg

SEQ ID NO: 27158 - DNA, 23 bp, synthetic construct
  misc_feature 1..23: note = Synthetic Construct
  source 1..23: mol_type = other DNA
ctcacttgacagggacaagaagt

SEQ ID NO: 27159 - DNA, 21 bp, synthetic construct
  misc_feature 1..21: note = Synthetic Construct
  source 1..21: mol_type = other DNA
aggcaccgcataccctgaagt

SEQ ID NO: 27160 - DNA, 21 bp, synthetic construct
  misc_feature 1..21: note = Synthetic Construct
  source 1..21: mol_type = other DNA
tgctgagctgatgggttgtag

SEQ ID NO: 27161 - DNA, 23 bp, synthetic construct
  misc_feature 1..23: note = Synthetic Construct
  source 1..23: mol_type = other DNA
gggaacatgctggaaggattcta

SEQ ID NO: 27162 - DNA, 20 bp, synthetic construct
  misc_feature 1..20: note = Synthetic Construct
  source 1..20: mol_type = other DNA
atggtccccagttccctctt

SEQ ID NO: 27163 - DNA, 19 bp, synthetic construct
  misc_feature 1..19: note = Synthetic Construct
  source 1..19: mol_type = other DNA
aggcgcagcccttcctcaa

SEQ ID NO: 27164 - DNA, 21 bp, synthetic construct
  misc_feature 1..21: note = Synthetic Construct
  source 1..21: mol_type = other DNA
gctttgaagagcgaggtcaca

SEQ ID NO: 27165 - DNA, 21 bp, synthetic construct
  misc_feature 1..21: note = Synthetic Construct
  source 1..21: mol_type = other DNA
ccaagaggcaggcattaccat

SEQ ID NO: 27166 - DNA, 20 bp, synthetic construct
  misc_feature 1..20: note = Synthetic Construct
  source 1..20: mol_type = other DNA
gctttttggggcatgcagtt

SEQ ID NO: 27167 - DNA, 20 bp, synthetic construct
  misc_feature 1..20: note = Synthetic Construct
  source 1..20: mol_type = other DNA
gcaatgccagagaggcaaga

SEQ ID NO: 27168 - DNA, 25 bp, synthetic construct
  misc_feature 1..25: note = Synthetic Construct
  source 1..25: mol_type = other DNA
ggaaagttgtgccaaggcaaagaga

SEQ ID NO: 27169 - DNA, 21 bp, synthetic construct
  misc_feature 1..21: note = Synthetic Construct
  source 1..21: mol_type = other DNA
acagtcccagcctgacagttc

SEQ ID NO: 27170 - DNA, 18 bp, synthetic construct
  misc_feature 1..18: note = Synthetic Construct
  source 1..18: mol_type = other DNA
cgggcatgcttgctctgt

SEQ ID NO: 27171 - DNA, 22 bp, synthetic construct
  misc_feature 1..22: note = Synthetic Construct
  source 1..22: mol_type = other DNA
ccctccctagccaatgcttaac

SEQ ID NO: 27172 - DNA, 21 bp, synthetic construct
  misc_feature 1..21: note = Synthetic Construct
  source 1..21: mol_type = other DNA
gtggcccatgttggagaatga

SEQ ID NO: 27173 - DNA, 24 bp, synthetic construct
  misc_feature 1..24: note = Synthetic Construct
  source 1..24: mol_type = other DNA
gcctccaggtactcatccacttgt

SEQ ID NO: 27174 - DNA, 26 bp, synthetic construct
  misc_feature 1..26: note = Synthetic Construct
  source 1..26: mol_type = other DNA
ggaaagaaggctagtggtaagagaca

SEQ ID NO: 27175 - DNA, 21 bp, synthetic construct
  misc_feature 1..21: note = Synthetic Construct
  source 1..21: mol_type = other DNA
cgttgagggcaggagggaaat

SEQ ID NO: 27176 - DNA, 22 bp, synthetic construct
  misc_feature 1..22: note = Synthetic Construct
  source 1..22: mol_type = other DNA
caactgtgccaggggtcctaaa

SEQ ID NO: 27177 - DNA, 20 bp, synthetic construct
  misc_feature 1..20: note = Synthetic Construct
  source 1..20: mol_type = other DNA
cagccccttgctgggaatca

SEQ ID NO: 27178 - DNA, 20 bp, synthetic construct
  misc_feature 1..20: note = Synthetic Construct
  source 1..20: mol_type = other DNA
gcctccttgccagtcaccta

SEQ ID NO: 27179 - DNA, 21 bp, synthetic construct
  misc_feature 1..21: note = Synthetic Construct
  source 1..21: mol_type = other DNA
ccacactgtgttggccaatgt

SEQ ID NO: 27180 - DNA, 19 bp, synthetic construct
  misc_feature 1..19: note = Synthetic Construct
  source 1..19: mol_type = other DNA
cgccactggaaccagaact

SEQ ID NO: 27181 - DNA, 20 bp, synthetic construct
  misc_feature 1..20: note = Synthetic Construct
  source 1..20: mol_type = other DNA
tggcttgggtgtgggttcaa

SEQ ID NO: 27182 - DNA, 20 bp, synthetic construct
  misc_feature 1..20: note = Synthetic Construct
  source 1..20: mol_type = other DNA
caggtgctccaggctgtgat

SEQ ID NO: 27183 - DNA, 23 bp, synthetic construct
  misc_feature 1..23: note = Synthetic Construct
  source 1..23: mol_type = other DNA
gtgcttttggaccactccctttg

SEQ ID NO: 27184 - DNA, 21 bp, synthetic construct
  misc_feature 1..21: note = Synthetic Construct
  source 1..21: mol_type = other DNA
aaggtccagggagtggacaca

SEQ ID NO: 27185 - DNA, 21 bp, synthetic construct
  misc_feature 1..21: note = Synthetic Construct
  source 1..21: mol_type = other DNA
gcgacgggaggagttgagttg

SEQ ID NO: 27186 - DNA, 23 bp, synthetic construct
  misc_feature 1..23: note = Synthetic Construct
  source 1..23: mol_type = other DNA
gcaaagggaagtccagaggaaac

SEQ ID NO: 27187 - DNA, 23 bp, synthetic construct
  misc_feature 1..23: note = Synthetic Construct
  source 1..23: mol_type = other DNA
ctaggacaatctcaccccacaag

SEQ ID NO: 27188 - DNA, 19 bp, synthetic construct
  misc_feature 1..19: note = Synthetic Construct
  source 1..19: mol_type = other DNA
ccatgcagcaagggcctat

SEQ ID NO: 27189 - DNA, 20 bp, synthetic construct
  misc_feature 1..20: note = Synthetic Construct
  source 1..20: mol_type = other DNA
cagcagcctctggtctcttc

SEQ ID NO: 27190 - DNA, 20 bp, synthetic construct
  misc_feature 1..20: note = Synthetic Construct
  source 1..20: mol_type = other DNA
tggcagggttggggagagat

SEQ ID NO: 27191 - DNA, 19 bp, synthetic construct
  misc_feature 1..19: note = Synthetic Construct
  source 1..19: mol_type = other DNA
agccactgcactgggctta

SEQ ID NO: 27192 - DNA, 22 bp, synthetic construct
  misc_feature 1..22: note = Synthetic Construct
  source 1..22: mol_type = other DNA
cctggcccagagtaggtgttta

SEQ ID NO: 27193 - DNA, 21 bp, synthetic construct
  misc_feature 1..21: note = Synthetic Construct
  source 1..21: mol_type = other DNA
tgggagaggcatgtggaatga

SEQ ID NO: 27194 - DNA, 22 bp, synthetic construct
  misc_feature 1..22: note = Synthetic Construct
  source 1..22: mol_type = other DNA
ggatgcagggacatcagctaag

SEQ ID NO: 27195 - DNA, 24 bp, synthetic construct
  misc_feature 1..24: note = Synthetic Construct
  source 1..24: mol_type = other DNA
tcccctaccccaaccctaattaaa

SEQ ID NO: 27196 - DNA, 20 bp, synthetic construct
  misc_feature 1..20: note = Synthetic Construct
  source 1..20: mol_type = other DNA
aatgggcacagccacaggtt

SEQ ID NO: 27197 - DNA, 22 bp, synthetic construct
  misc_feature 1..22: note = Synthetic Construct
  source 1..22: mol_type = other DNA
gcccagccaggctaaatgactt

SEQ ID NO: 27198 - DNA, 22 bp, synthetic construct
  misc_feature 1..22: note = Synthetic Construct
  source 1..22: mol_type = other DNA
cctgaagcaggtttggaagact

SEQ ID NO: 27199 - DNA, 20 bp, synthetic construct
  misc_feature 1..20: note = Synthetic Construct
  source 1..20: mol_type = other DNA
tggggccacctacctggata

SEQ ID NO: 27200 - DNA, 22 bp, synthetic construct
  misc_feature 1..22: note = Synthetic Construct
  source 1..22: mol_type = other DNA
gagcctggcactcaaaaactga

SEQ ID NO: 27201 - DNA, 22 bp, synthetic construct
  misc_feature 1..22: note = Synthetic Construct
  source 1..22: mol_type = other DNA
ggtgtggggagacctctatgtt

SEQ ID NO: 27202 - DNA, 20 bp, synthetic construct
  misc_feature 1..20: note = Synthetic Construct
  source 1..20: mol_type = other DNA
ggggcattccaggccctatt

SEQ ID NO: 27203 - DNA, 22 bp, synthetic construct
  misc_feature 1..22: note = Synthetic Construct
  source 1..22: mol_type = other DNA
ccacatgggctgaagggttcat

SEQ ID NO: 27204 - DNA, 20 bp, synthetic construct
  misc_feature 1..20: note = Synthetic Construct
  source 1..20: mol_type = other DNA
accccaaggaggaaccaagt

SEQ ID NO: 27205 - DNA, 21 bp, synthetic construct
  misc_feature 1..21: note = Synthetic Construct
  source 1..21: mol_type = other DNA
gtcgcggtatgagggaggatt

SEQ ID NO: 27206 - DNA, 23 bp, synthetic construct
  misc_feature 1..23: note = Synthetic Construct
  source 1..23: mol_type = other DNA
tgagtgcttgatgtttcccttca

SEQ ID NO: 27207 - DNA, 19 bp, synthetic construct
  misc_feature 1..19: note = Synthetic Construct
  source 1..19: mol_type = other DNA
tctggcagctggcttcttg

SEQ ID NO: 27208 - DNA, 20 bp, synthetic construct
  misc_feature 1..20: note = Synthetic Construct
  source 1..20: mol_type = other DNA
ctgtcccaggccttttgtgt

SEQ ID NO: 27209 - DNA, 26 bp, synthetic construct
  misc_feature 1..26: note = Synthetic Construct
  source 1..26: mol_type = other DNA
gagttgagtttcgagtgcaaaacttg

SEQ ID NO: 27210 - DNA, 24 bp, synthetic construct
  misc_feature 1..24: note = Synthetic Construct
  source 1..24: mol_type = other DNA
gtggttttgtcccattccctcttt

SEQ ID NO: 27211 - DNA, 21 bp, synthetic construct
  misc_feature 1..21: note = Synthetic Construct
  source 1..21: mol_type = other DNA
tggctgaccaggggcatcttt

SEQ ID NO: 27212 - DNA, 23 bp, synthetic construct
  misc_feature 1..23: note = Synthetic Construct
  source 1..23: mol_type = other DNA
gccatgtccctgggatctgtcta

SEQ ID NO: 27213 - DNA, 19 bp, synthetic construct
  misc_feature 1..19: note = Synthetic Construct
  source 1..19: mol_type = other DNA
tgggttcggggcccaacaa

SEQ ID NO: 27214 - DNA, 23 bp, synthetic construct
  misc_feature 1..23: note = Synthetic Construct
  source 1..23: mol_type = other DNA
gcatttctgtggtgggatagtgt

SEQ ID NO: 27215 - DNA, 22 bp, synthetic construct
  misc_feature 1..22: note = Synthetic Construct
  source 1..22: mol_type = other DNA
gtctgcctcactagtggcctat

SEQ ID NO: 27216 - DNA, 22 bp, synthetic construct
  misc_feature 1..22: note = Synthetic Construct
  source 1..22: mol_type = other DNA
gggaaacaagcacagactccaa

SEQ ID NO: 27217 - DNA, 22 bp, synthetic construct
  misc_feature 1..22: note = Synthetic Construct
  source 1..22: mol_type = other DNA
gggtcacttcctccttggattc

SEQ ID NO: 27218 - DNA, 24 bp, synthetic construct
  misc_feature 1..24: note = Synthetic Construct
  source 1..24: mol_type = other DNA
gggagtcgctatttaccgagcttt

SEQ ID NO: 27219 - DNA, 19 bp, synthetic construct
  misc_feature 1..19: note = Synthetic Construct
  source 1..19: mol_type = other DNA
accctgggcaagacactct

SEQ ID NO: 27220 - DNA, 20 bp, synthetic construct
  misc_feature 1..20: note = Synthetic Construct
  source 1..20: mol_type = other DNA
gcgctcagccatttgcatca

SEQ ID NO: 27221 - DNA, 19 bp, synthetic construct
  misc_feature 1..19: note = Synthetic Construct
  source 1..19: mol_type = other DNA
accgccccaggaagcttag

SEQ ID NO: 27222 - DNA, 22 bp, synthetic construct
  misc_feature 1..22: note = Synthetic Construct
  source 1..22: mol_type = other DNA
gctgcagaggctcaaagctaga

SEQ ID NO: 27223 - DNA, 23 bp, synthetic construct
  misc_feature 1..23: note = Synthetic Construct
  source 1..23: mol_type = other DNA
aggaaaccagatctgtgcacttg

SEQ ID NO: 27224 - DNA, 20 bp, synthetic construct
  misc_feature 1..20: note = Synthetic Construct
  source 1..20: mol_type = other DNA
tgggtgaggctactgtgagt

SEQ ID NO: 27225 - DNA, 22 bp, synthetic construct
  misc_feature 1..22: note = Synthetic Construct
  source 1..22: mol_type = other DNA
gtcaaaggggaagcatgcaaag

SEQ ID NO: 27226 - DNA, 24 bp, synthetic construct
  misc_feature 1..24: note = Synthetic Construct
  source 1..24: mol_type = other DNA
tccaagaagaggtgtgcaaaatga

SEQ ID NO: 27227 - DNA, 25 bp, synthetic construct
  misc_feature 1..25: note = Synthetic Construct
  source 1..25: mol_type = other DNA
cagtacctggcccataaaaggtagt

SEQ ID NO: 27228 - DNA, 21 bp, synthetic construct
  misc_feature 1..21: note = Synthetic Construct
  source 1..21: mol_type = other DNA
ttcagctgtttccaccacagt

SEQ ID NO: 27229 - DNA, 22 bp, synthetic construct
  misc_feature 1..22: note = Synthetic Construct
  source 1..22: mol_type = other DNA
aggagagaggcggaaggaacaa

SEQ ID NO: 27230 - DNA, 19 bp, synthetic construct
  misc_feature 1..19: note = Synthetic Construct
  source 1..19: mol_type = other DNA
cagcccagcaagcctccaa

SEQ ID NO: 27231 - DNA, 22 bp, synthetic construct
  misc_feature 1..22: note = Synthetic Construct
  source 1..22: mol_type = other DNA
tggaggtcaggtactgaagaca

SEQ ID NO: 27232 - DNA, 22 bp, synthetic construct
  misc_feature 1..22: note = Synthetic Construct
  source 1..22: mol_type = other DNA
actggactcctctccccacatt

SEQ ID NO: 27233 - DNA, 20 bp, synthetic construct
  misc_feature 1..20: note = Synthetic Construct
  source 1..20: mol_type = other DNA
gcccaagaggcaggcatcaa

SEQ ID NO: 27234 - DNA, 24 bp, synthetic construct
  misc_feature 1..24: note = Synthetic Construct
  source 1..24: mol_type = other DNA
gcagctgtttcagcgaatagttct

SEQ ID NO: 27235 - DNA, 24 bp, synthetic construct
  misc_feature 1..24: note = Synthetic Construct
  source 1..24: mol_type = other DNA
acttgtgatgacaaagggaaggaa

SEQ ID NO: 27236 - DNA, 20 bp, synthetic construct
  misc_feature 1..20: note = Synthetic Construct
  source 1..20: mol_type = other DNA
acagacggtggcgtcatcaa

SEQ ID NO: 27237 - DNA, 24 bp, synthetic construct
  misc_feature 1..24: note = Synthetic Construct
  source 1..24: mol_type = other DNA
ctgggtgtgtagtgcagtcagttc

SEQ ID NO: 27238 - DNA, 21 bp, synthetic construct
  misc_feature 1..21: note = Synthetic Construct
  source 1..21: mol_type = other DNA
tccctccagagcttcacagaa

SEQ ID NO: 27239 - DNA, 23 bp, synthetic construct
  misc_feature 1..23: note = Synthetic Construct
  source 1..23: mol_type = other DNA
tgaggctcagacagatgatgttg

SEQ ID NO: 27240 - DNA, 21 bp, synthetic construct
  misc_feature 1..21: note = Synthetic Construct
  source 1..21: mol_type = other DNA
agggacccgtttcagttcatc

SEQ ID NO: 27241 - DNA, 24 bp, synthetic construct
  misc_feature 1..24: note = Synthetic Construct
  source 1..24: mol_type = other DNA
cccctttgatgccacagttatttc

SEQ ID NO: 27242 - DNA, 24 bp, synthetic construct
  misc_feature 1..24: note = Synthetic Construct
  source 1..24: mol_type = other DNA
ccagactatgccacagggctaatg

SEQ ID NO: 27243 - DNA, 19 bp, synthetic construct
  misc_feature 1..19: note = Synthetic Construct
  source 1..19: mol_type = other DNA
ttgcctttgcccgcacatc

SEQ ID NO: 27244 - DNA, 20 bp, synthetic construct
  misc_feature 1..20: note = Synthetic Construct
  source 1..20: mol_type = other DNA
aggaccacgggctgcaggta

SEQ ID NO: 27245 - DNA, 20 bp, synthetic construct
  misc_feature 1..20: note = Synthetic Construct
  source 1..20: mol_type = other DNA
tgtgcccagggttgcacata

SEQ ID NO: 27246 - DNA, 22 bp, synthetic construct
  misc_feature 1..22: note = Synthetic Construct
  source 1..22: mol_type = other DNA
ccttgctgatccaggcaaaatg

SEQ ID NO: 27247 - DNA, 22 bp, synthetic construct
  misc_feature 1..22: note = Synthetic Construct
  source 1..22: mol_type = other DNA
ccttcactcctgggtgaggaat

SEQ ID NO: 27248 - DNA, 25 bp, synthetic construct
  misc_feature 1..25: note = Synthetic Construct
  source 1..25: mol_type = other DNA
gtagattagcatgagtgggaactga

SEQ ID NO: 27249 - DNA, 21 bp, synthetic construct
  misc_feature 1..21: note = Synthetic Construct
  source 1..21: mol_type = other DNA
agttcctccaggaaggtgcta

SEQ ID NO: 27250 - DNA, 21 bp, synthetic construct
  misc_feature 1..21: note = Synthetic Construct
  source 1..21: mol_type = other DNA
atgccggtggggtttatgaat

SEQ ID NO: 27251 - DNA, 21 bp, synthetic construct
  misc_feature 1..21: note = Synthetic Construct
  source 1..21: mol_type = other DNA
cggagcaccaccaggattgtt

SEQ ID NO: 27252 - DNA, 22 bp, synthetic construct
  misc_feature 1..22: note = Synthetic Construct
  source 1..22: mol_type = other DNA
cttgccatgtgccaagttctga

SEQ ID NO: 27253 - DNA, 21 bp, synthetic construct
  misc_feature 1..21: note = Synthetic Construct
  source 1..21: mol_type = other DNA
tctcgcccactgtcaccatga

SEQ ID NO: 27254 - DNA, 22 bp, synthetic construct
  misc_feature 1..22: note = Synthetic Construct
  source 1..22: mol_type = other DNA
caccaggcccttgtactcagat

SEQ ID NO: 27255 - DNA, 22 bp, synthetic construct
  misc_feature 1..22: note = Synthetic Construct
  source 1..22: mol_type = other DNA
cacattgggacccaggactaag

SEQ ID NO: 27256 - DNA, 22 bp, synthetic construct
  misc_feature 1..22: note = Synthetic Construct
  source 1..22: mol_type = other DNA
gtacagccccaaacatgactct

SEQ ID NO: 27257 - DNA, 21 bp, synthetic construct
  misc_feature 1..21: note = Synthetic Construct
  source 1..21: mol_type = other DNA
gcgtagtccaggccctagaga

SEQ ID NO: 27258 - DNA, 22 bp, synthetic construct
  misc_feature 1..22: note = Synthetic Construct
  source 1..22: mol_type = other DNA
ccccagcctaaggtttgtcctt

SEQ ID NO: 27259 - DNA, 21 bp, synthetic construct
  misc_feature 1..21: note = Synthetic Construct
  source 1..21: mol_type = other DNA
ccctacccacaccacacaaaa

SEQ ID NO: 27260 - DNA, 22 bp, synthetic construct
  misc_feature 1..22: note = Synthetic Construct
  source 1..22: mol_type = other DNA
ccctccgcaaggggaaatgaaa

SEQ ID NO: 27261 - DNA, 23 bp, synthetic construct
  misc_feature 1..23: note = Synthetic Construct
  source 1..23: mol_type = other DNA
ccagatgagctcccaggactttg

SEQ ID NO: 27262 - DNA, 22 bp, synthetic construct
  misc_feature 1..22: note = Synthetic Construct
  source 1..22: mol_type = other DNA
tggtggacaggagtgggaagtt

SEQ ID NO: 27263 - DNA, 25 bp, synthetic construct
  misc_feature 1..25: note = Synthetic Construct
  source 1..25: mol_type = other DNA
gttttcctccaccccttttctcttc

SEQ ID NO: 27264 - DNA, 22 bp, synthetic construct
  misc_feature 1..22: note = Synthetic Construct
  source 1..22: mol_type = other DNA
cctgcctctcgccatactcatc

SEQ ID NO: 27265 - DNA, 22 bp, synthetic construct
  misc_feature 1..22: note = Synthetic Construct
  source 1..22: mol_type = other DNA
cgcacaccctattgggaaggaa

SEQ ID NO: 27266 - DNA, 24 bp, synthetic construct
  misc_feature 1..24: note = Synthetic Construct
  source 1..24: mol_type = other DNA
cctctgctagtctcctgaatgttg

SEQ ID NO: 27267 - DNA, 19 bp, synthetic construct
  misc_feature 1..19: note = Synthetic Construct
  source 1..19: mol_type = other DNA
gccgcagtggctgatccat

SEQ ID NO: 27268 - DNA, 24 bp, synthetic construct
  misc_feature 1..24: note = Synthetic Construct
  source 1..24: mol_type = other DNA
agttgagaagcagggacttgaatc

SEQ ID NO: 27269 - DNA, 23 bp, synthetic construct
  misc_feature 1..23: note = Synthetic Construct
  source 1..23: mol_type = other DNA
tgattttcccagggtctgtgtct

SEQ ID NO: 27270 - DNA, 22 bp, synthetic construct
  misc_feature 1..22: note = Synthetic Construct
  source 1..22: mol_type = other DNA
cagccactcactgaccttgaca

SEQ ID NO: 27271 - DNA, 19 bp, synthetic construct
  misc_feature 1..19: note = Synthetic Construct
  source 1..19: mol_type = other DNA
aaagccggccaccccaaca

SEQ ID NO: 27272 - DNA, 21 bp, synthetic construct
  misc_feature 1..21: note = Synthetic Construct
  source 1..21: mol_type = other DNA
agctcagccactccagacaag

SEQ ID NO: 27273 - DNA, 23 bp, synthetic construct
  misc_feature 1..23: note = Synthetic Construct
  source 1..23: mol_type = other DNA
aatcaccatgttaccaccaccat

SEQ ID NO: 27274 - DNA, 20 bp, synthetic construct
  misc_feature 1..20: note = Synthetic Construct
  source 1..20: mol_type = other DNA
gcgtgggccagaaatcttca

SEQ ID NO: 27275 - DNA, 23 bp, synthetic construct
  misc_feature 1..23: note = Synthetic Construct
  source 1..23: mol_type = other DNA
tcagagattggatttcggtcgtt

SEQ ID NO: 27276 - DNA, 23 bp, synthetic construct
  misc_feature 1..23: note = Synthetic Construct
  source 1..23: mol_type = other DNA
ggaggttgcctcctcttcctaag

SEQ ID NO: 27277 - DNA, 20 bp, synthetic construct
  misc_feature 1..20: note = Synthetic Construct
  source 1..20: mol_type = other DNA
acagggcggtgctagcttga

SEQ ID NO: 27278 - DNA, 23 bp, synthetic construct
  misc_feature 1..23: note = Synthetic Construct
  source 1..23: mol_type = other DNA
ccacccagtgcctgaaagtaaag

SEQ ID NO: 27279 - DNA, 20 bp, synthetic construct
  misc_feature 1..20: note = Synthetic Construct
  source 1..20: mol_type = other DNA
cccatggctaccctcactct

SEQ ID NO: 27280 - DNA, 22 bp, synthetic construct
  misc_feature 1..22: note = Synthetic Construct
  source 1..22: mol_type = other DNA
tgttgagatgaagccagcaaca

SEQ ID NO: 27281 - DNA, 20 bp, synthetic construct
  misc_feature 1..20: note = Synthetic Construct
  source 1..20: mol_type = other DNA
aaggatggcaggaccagtgt

SEQ ID NO: 27282 - DNA, 24 bp, synthetic construct
  misc_feature 1..24: note = Synthetic Construct
  source 1..24: mol_type = other DNA
caatgtaagccagtgacaaactgt

SEQ ID NO: 27283 - DNA, 20 bp, synthetic construct
  misc_feature 1..20: note = Synthetic Construct
  source 1..20: mol_type = other DNA
ccggagctcagcagatttca

SEQ ID NO: 27284 - DNA, 21 bp, synthetic construct
  misc_feature 1..21: note = Synthetic Construct
  source 1..21: mol_type = other DNA
gggacaggctgcgacactatg

SEQ ID NO: 27285 - DNA, 20 bp, synthetic construct
  misc_feature 1..20: note = Synthetic Construct
  source 1..20: mol_type = other DNA
acgtgggtgacaccagatga

SEQ ID NO: 27286 - DNA, 21 bp, synthetic construct
  misc_feature 1..21: note = Synthetic Construct
  source 1..21: mol_type = other DNA
aagccaccgaggcctaactct

SEQ ID NO: 27287 - DNA, 21 bp, synthetic construct
  misc_feature 1..21: note = Synthetic Construct
  source 1..21: mol_type = other DNA
ggccaactccctctccctaca

SEQ ID NO: 27288 - DNA, 20 bp, synthetic construct
  misc_feature 1..20: note = Synthetic Construct
  source 1..20: mol_type = other DNA
aggcccaggcaagaaggaaa

SEQ ID NO: 27289 - DNA, 19 bp, synthetic construct
  misc_feature 1..19: note = Synthetic Construct
  source 1..19: mol_type = other DNA
agcccacgatctgcaggaa

SEQ ID NO: 27290 - DNA, 21 bp, synthetic construct
  misc_feature 1..21: note = Synthetic Construct
  source 1..21: mol_type = other DNA
ggtgccaccccagaaatcaca

SEQ ID NO: 27291 - DNA, 22 bp, synthetic construct
  misc_feature 1..22: note = Synthetic Construct
  source 1..22: mol_type = other DNA
gccatccttacagcaggcttag

SEQ ID NO: 27292 - DNA, 21 bp, synthetic construct
  misc_feature 1..21: note = Synthetic Construct
  source 1..21: mol_type = other DNA
tcctgcacacctcctggacaa

SEQ ID NO: 27293 - DNA, 26 bp, synthetic construct
  misc_feature 1..26: note = Synthetic Construct
  source 1..26: mol_type = other DNA
gaatcataccttggctttgaggtaga

SEQ ID NO: 27294 - DNA, 19 bp, synthetic construct
  misc_feature 1..19: note = Synthetic Construct
  source 1..19: mol_type = other DNA
tccctgcatgcccgaattt

SEQ ID NO: 27295 - DNA, 20 bp, synthetic construct
  misc_feature 1..20: note = Synthetic Construct
  source 1..20: mol_type = other DNA
accatggcgcctgcaaaaag

SEQ ID NO: 27296 - DNA, 22 bp, synthetic construct
  misc_feature 1..22: note = Synthetic Construct
  source 1..22: mol_type = other DNA
agagggactcaggcatctggaa

SEQ ID NO: 27297 - DNA, 19 bp, synthetic construct
  misc_feature 1..19: note = Synthetic Construct
  source 1..19: mol_type = other DNA
cagccagcccttcaacagt

SEQ ID NO: 27298 - DNA, 23 bp, synthetic construct
  misc_feature 1..23: note = Synthetic Construct
  source 1..23: mol_type = other DNA
ctgaccagggctgttttctgaag

SEQ ID NO: 27299 - DNA, 23 bp, synthetic construct
  misc_feature 1..23: note = Synthetic Construct
  source 1..23: mol_type = other DNA
agagaataaacgcatgcggaaga

SEQ ID NO: 27300 - DNA, 20 bp, synthetic construct
  misc_feature 1..20: note = Synthetic Construct
  source 1..20: mol_type = other DNA
tggagttcctccacgcattg

SEQ ID NO: 27301 - DNA, 21 bp, synthetic construct
  misc_feature 1..21: note = Synthetic Construct
  source 1..21: mol_type = other DNA
cgtggcccaaccacagagatt

SEQ ID NO: 27302 - DNA, 22 bp, synthetic construct
  misc_feature 1..22: note = Synthetic Construct
  source 1..22: mol_type = other DNA
cttcctgtccaccagcttcttc

SEQ ID NO: 27303 - DNA, 20 bp, synthetic construct
  misc_feature 1..20: note = Synthetic Construct
  source 1..20: mol_type = other DNA
accgcgccttgctgtatcat

SEQ ID NO: 27304 - DNA, 22 bp, synthetic construct
  misc_feature 1..22: note = Synthetic Construct
  source 1..22: mol_type = other DNA
cagaattcccggacagcacaga

SEQ ID NO: 27305 - DNA, 23 bp, synthetic construct
  misc_feature 1..23: note = Synthetic Construct
  source 1..23: mol_type = other DNA
cattcctcaacctctcagaccaa

SEQ ID NO: 27306 - DNA, 27 bp, synthetic construct
  misc_feature 1..27: note = Synthetic Construct
  source 1..27: mol_type = other DNA
gagttagagatcaagtggggagattac

SEQ ID NO: 27307 - DNA, 23 bp, synthetic construct
  misc_feature 1..23: note = Synthetic Construct
  source 1..23: mol_type = other DNA
aagatgtgacggttggtacagtt

SEQ ID NO: 27308 - DNA, 24 bp, synthetic construct
  misc_feature 1..24: note = Synthetic Construct
  source 1..24: mol_type = other DNA
ccaaattccaacctgaccctggta

SEQ ID NO: 27309 - DNA, 20 bp, synthetic construct
  misc_feature 1..20: note = Synthetic Construct
  source 1..20: mol_type = other DNA
tgcccaaatccaggctgaag

SEQ ID NO: 27310 - DNA, 24 bp, synthetic construct
  misc_feature 1..24: note = Synthetic Construct
  source 1..24: mol_type = other DNA
tcctctaaggtgaaatcgctcaaa

SEQ ID NO: 27311 - DNA, 20 bp, synthetic construct
  misc_feature 1..20: note = Synthetic Construct
  source 1..20: mol_type = other DNA
aatggcctggggcaaagatg

SEQ ID NO: 27312 - DNA, 25 bp, synthetic construct
  misc_feature 1..25: note = Synthetic Construct
  source 1..25: mol_type = other DNA
gaagctgaataatttgcccatcctt

SEQ ID NO: 27313 - DNA, 30 bp, synthetic construct
  misc_feature 1..30: note = Synthetic Construct
  source 1..30: mol_type = other DNA
caggtcttttaccaagagagttttgctttc

SEQ ID NO: 27314 - DNA, 22 bp, synthetic construct
  misc_feature 1..22: note = Synthetic Construct
  source 1..22: mol_type = other DNA
actgacagagctggatgcaaac

SEQ ID NO: 27315 - DNA, 21 bp, synthetic construct
  misc_feature 1..21: note = Synthetic Construct
  source 1..21: mol_type = other DNA
acagccttaagcgccaagaag

SEQ ID NO: 27316 - DNA, 22 bp, synthetic construct
  misc_feature 1..22: note = Synthetic Construct
  source 1..22: mol_type = other DNA
ggcaggagctgtgtcttgaatc

SEQ ID NO: 27317 - DNA, 21 bp, synthetic construct
  misc_feature 1..21: note = Synthetic Construct
  source 1..21: mol_type = other DNA
ggccaacctggctggatttga

SEQ ID NO: 27318 - DNA, 19 bp, synthetic construct
  misc_feature 1..19: note = Synthetic Construct
  source 1..19: mol_type = other DNA
tcacggtgcagaggagaca

SEQ ID NO: 27319 - DNA, 22 bp, synthetic construct
  misc_feature 1..22: note = Synthetic Construct
  source 1..22: mol_type = other DNA
acaatggccacaattcctcaca

SEQ ID NO: 27320 - DNA, 22 bp, synthetic construct
  misc_feature 1..22: note = Synthetic Construct
  source 1..22: mol_type = other DNA
gcctaggttttcactggaccat

SEQ ID NO: 27321 - DNA, 21 bp, synthetic construct
  misc_feature 1..21: note = Synthetic Construct
  source 1..21: mol_type = other DNA
gctagggaccctcccgtatga

SEQ ID NO: 27322 - DNA, 19 bp, synthetic construct
  misc_feature 1..19: note = Synthetic Construct
  source 1..19: mol_type = other DNA
agcctgggcctgtttctca

SEQ ID NO: 27323 - DNA, 22 bp, synthetic construct
  misc_feature 1..22: note = Synthetic Construct
  source 1..22: mol_type = other DNA
gagcaaacccttggctcctagt

SEQ ID NO: 27324 - DNA, 22 bp, synthetic construct
  misc_feature 1..22: note = Synthetic Construct
  source 1..22: mol_type = other DNA
ctcctcattccaccaccctctt

SEQ ID NO: 27325 - DNA, 22 bp, synthetic construct
  misc_feature 1..22: note = Synthetic Construct
  source 1..22: mol_type = other DNA
gccctgtccaatgagtgacctt

SEQ ID NO: 27326 - DNA, 20 bp, synthetic construct
  misc_feature 1..20: note = Synthetic Construct
  source 1..20: mol_type = other DNA
ccacagctccctgtcactca

SEQ ID NO: 27327 - DNA, 23 bp, synthetic construct
  misc_feature 1..23: note = Synthetic Construct
  source 1..23: mol_type = other DNA
tgcaaataccccatagccagatg

SEQ ID NO: 27328 - DNA, 22 bp, synthetic construct
  misc_feature 1..22: note = Synthetic Construct
  source 1..22: mol_type = other DNA
gcaagatctgcctccgctaaag

SEQ ID NO: 27329 - DNA, 24 bp, synthetic construct
  misc_feature 1..24: note = Synthetic Construct
  source 1..24: mol_type = other DNA
ccccttcagtatcggccaaggtaa

SEQ ID NO: 27330 - DNA, 19 bp, synthetic construct
  misc_feature 1..19: note = Synthetic Construct
  source 1..19: mol_type = other DNA
cagcctggaccctgtggat

SEQ ID NO: 27331 - DNA, 24 bp, synthetic construct
  misc_feature 1..24: note = Synthetic Construct
  source 1..24: mol_type = other DNA
cagtcactgggagtttgactcatc

SEQ ID NO: 27332 - DNA, 21 bp, synthetic construct
  misc_feature 1..21: note = Synthetic Construct
  source 1..21: mol_type = other DNA
tctgaggagctcaccttcctt

SEQ ID NO: 27333 - DNA, 23 bp, synthetic construct
  misc_feature 1..23: note = Synthetic Construct
  source 1..23: mol_type = other DNA
gggttggacacctttctgctgtt

SEQ ID NO: 27334 - DNA, 22 bp, synthetic construct
  misc_feature 1..22: note = Synthetic Construct
  source 1..22: mol_type = other DNA
tggggccatacctgtcttgtga

SEQ ID NO: 27335 - DNA, 21 bp, synthetic construct
  misc_feature 1..21: note = Synthetic Construct
  source 1..21: mol_type = other DNA
ccaagtgcgtcgctcctttac

SEQ ID NO: 27336 - DNA, 21 bp, synthetic construct
  misc_feature 1..21: note = Synthetic Construct
  source 1..21: mol_type = other DNA
gcacctgggcttcgtggtaat

SEQ ID NO: 27337 - DNA, 25 bp, synthetic construct
  misc_feature 1..25: note = Synthetic Construct
  source 1..25: mol_type = other DNA
gttacacagtgcagggagatttaga

SEQ ID NO: 27338 - DNA, 25 bp, synthetic construct
  misc_feature 1..25: note = Synthetic Construct
  source 1..25: mol_type = other DNA
gttctggaaaaatctggccttcttc

SEQ ID NO: 27339 - DNA, 20 bp, synthetic construct
  misc_feature 1..20: note = Synthetic Construct
  source 1..20: mol_type = other DNA
agacggtgacaatgcccaat

SEQ ID NO: 27340 - DNA, 21 bp, synthetic construct
  misc_feature 1..21: note = Synthetic Construct
  source 1..21: mol_type = other DNA
tgcctcgcctaactgggagat

SEQ ID NO: 27341 - DNA, 23 bp, synthetic construct
  misc_feature 1..23: note = Synthetic Construct
  source 1..23: mol_type = other DNA
atggaggcagtggttacttttca

SEQ ID NO: 27342 - DNA, 20 bp, synthetic construct
  misc_feature 1..20: note = Synthetic Construct
  source 1..20: mol_type = other DNA
gtgctgtgggtgagcacagt

SEQ ID NO: 27343 - DNA, 21 bp, synthetic construct
  misc_feature 1..21: note = Synthetic Construct
  source 1..21: mol_type = other DNA
tggatgtgtcatgcccagttc

SEQ ID NO: 27344 - DNA, 19 bp, synthetic construct
  misc_feature 1..19: note = Synthetic Construct
  source 1..19: mol_type = other DNA
tggcccaggatcgaccaat

SEQ ID NO: 27345 - DNA, 21 bp, synthetic construct
  misc_feature 1..21: note = Synthetic Construct
  source 1..21: mol_type = other DNA
gtcaacccaggcgagacattc

SEQ ID NO: 27346 - DNA, 21 bp, synthetic construct
  misc_feature 1..21: note = Synthetic Construct
  source 1..21: mol_type = other DNA
ggtgattgggtggcccttaga

SEQ ID NO: 27347 - DNA, 22 bp, synthetic construct
  misc_feature 1..22: note = Synthetic Construct
  source 1..22: mol_type = other DNA
ggcagctgtgagaagtgatgat

SEQ ID NO: 27348 - DNA, 20 bp, synthetic construct
  misc_feature 1..20: note = Synthetic Construct
  source 1..20: mol_type = other DNA
cccagcagcacctcaaggat

SEQ ID NO: 27349 - DNA, 21 bp, synthetic construct
  misc_feature 1..21: note = Synthetic Construct
  source 1..21: mol_type = other DNA
aggggctcctgctaacaccat

SEQ ID NO: 27350 - DNA, 19 bp, synthetic construct
  misc_feature 1..19: note = Synthetic Construct
  source 1..19: mol_type = other DNA
ccgccccgcatttccctaa

SEQ ID NO: 27351 - DNA, 22 bp, synthetic construct
  misc_feature 1..22: note = Synthetic Construct
  source 1..22: mol_type = other DNA
ggttgaaaggggctctctaaca

SEQ ID NO: 27352 - DNA, 22 bp, synthetic construct
  misc_feature 1..22: note = Synthetic Construct
  source 1..22: mol_type = other DNA
tggtgcacctgatgaacaaaca

SEQ ID NO: 27353 - DNA, 23 bp, synthetic construct
  misc_feature 1..23: note = Synthetic Construct
  source 1..23: mol_type = other DNA
gccaaagctgtgaatgggtcttc

SEQ ID NO: 27354 - DNA, 19 bp, synthetic construct
  misc_feature 1..19: note = Synthetic Construct
  source 1..19: mol_type = other DNA
gagaggccgcttgctcagt

SEQ ID NO: 27355 - DNA, 25 bp, synthetic construct
  misc_feature 1..25: note = Synthetic Construct
  source 1..25: mol_type = other DNA
gatgaaatgagctgctttactcgtt

SEQ ID NO: 27356 - DNA, 18 bp, synthetic construct
  misc_feature 1..18: note = Synthetic Construct
  source 1..18: mol_type = other DNA
agccctgtggcccatttg

SEQ ID NO: 27357 - DNA, 20 bp, synthetic construct
  misc_feature 1..20: note = Synthetic Construct
  source 1..20: mol_type = other DNA
tggtctcccacttggactga

SEQ ID NO: 27358 - DNA, 24 bp, synthetic construct
  misc_feature 1..24: note = Synthetic Construct
  source 1..24: mol_type = other DNA
gagggatccacttccagagtgaac

SEQ ID NO: 27359 - DNA, 24 bp, synthetic construct
  misc_feature 1..24: note = Synthetic Construct
  source 1..24: mol_type = other DNA
agaaccacagcgatgatgatgtta

SEQ ID NO: 27360 - DNA, 19 bp, synthetic construct
  misc_feature 1..19: note = Synthetic Construct
  source 1..19: mol_type = other DNA
agggagggctggcttaact

SEQ ID NO: 27361 - DNA, 19 bp, synthetic construct
  misc_feature 1..19: note = Synthetic Construct
  source 1..19: mol_type = other DNA
ccaggcggggaagacaact

SEQ ID NO: 27362 - DNA, 22 bp, synthetic construct
  misc_feature 1..22: note = Synthetic Construct
  source 1..22: mol_type = other DNA
gcctatggtagtctccccacat

SEQ ID NO: 27363 - DNA, 22 bp, synthetic construct
  misc_feature 1..22: note = Synthetic Construct
  source 1..22: mol_type = other DNA
gcgagagctcctgcaaccttat

SEQ ID NO: 27364 - DNA, 20 bp, synthetic construct
  misc_feature 1..20: note = Synthetic Construct
  source 1..20: mol_type = other DNA
ggacgtggcaccatgagttg

SEQ ID NO: 27365 - DNA, 22 bp, synthetic construct
  misc_feature 1..22: note = Synthetic Construct
  source 1..22: mol_type = other DNA
tacgccccgacgtgctagaaaa

SEQ ID NO: 27366 - DNA, 22 bp, synthetic construct
  misc_feature 1..22: note = Synthetic Construct
  source 1..22: mol_type = other DNA
agtagggccatgtgactgagtt

SEQ ID NO: 27367 - DNA, 22 bp, synthetic construct
  misc_feature 1..22: note = Synthetic Construct
  source 1..22: mol_type = other DNA
catcaagcctgaacgaagcaaa

SEQ ID NO: 27368 - DNA, 20 bp, synthetic construct
  misc_feature 1..20: note = Synthetic Construct
  source 1..20: mol_type = other DNA
ctctgcacagcacagggaat

SEQ ID NO: 27369 - DNA, 28 bp, synthetic construct
  misc_feature 1..28: note = Synthetic Construct
  source 1..28: mol_type = other DNA
cgaagcctatccatttccacttagtagt

SEQ ID NO: 27370 - DNA, 20 bp, synthetic construct
  misc_feature 1..20: note = Synthetic Construct
  source 1..20: mol_type = other DNA
cgggatgcgactcgacgaaa

SEQ ID NO: 27371 - DNA, 20 bp, synthetic construct
  misc_feature 1..20: note = Synthetic Construct
  source 1..20: mol_type = other DNA
tggctaggcagtgactcaga

SEQ ID NO: 27372 - DNA, 20 bp, synthetic construct
  misc_feature 1..20: note = Synthetic Construct
  source 1..20: mol_type = other DNA
tgccgtacctgggaatccat

SEQ ID NO: 27373 - DNA, 25 bp, synthetic construct
  misc_feature 1..25: note = Synthetic Construct
  source 1..25: mol_type = other DNA
gagtcagaaaggatgacctggagta

SEQ ID NO: 27374 - DNA, 25 bp, synthetic construct
  misc_feature 1..25: note = Synthetic Construct
  source 1..25: mol_type = other DNA
ctgctctgaatggaacaggaaggaa

SEQ ID NO: 27375 - DNA, 22 bp, synthetic construct
  misc_feature 1..22: note = Synthetic Construct
  source 1..22: mol_type = other DNA
ggagggaaggctttgcttctca

SEQ ID NO: 27376 - DNA, 19 bp, synthetic construct
  misc_feature 1..19: note = Synthetic Construct
  source 1..19: mol_type = other DNA
gtgcccatctgccggatct

SEQ ID NO: 27377 - DNA, 21 bp, synthetic construct
  misc_feature 1..21: note = Synthetic Construct
  source 1..21: mol_type = other DNA
ccctagccaggtgctgtttgt

SEQ ID NO: 27378 - DNA, 20 bp, synthetic construct
  misc_feature 1..20: note = Synthetic Construct
  source 1..20: mol_type = other DNA
tggtgctggagtgggagtga

SEQ ID NO: 27379 - DNA, 22 bp, synthetic construct
  misc_feature 1..22: note = Synthetic Construct
  source 1..22: mol_type = other DNA
cagctcagtctgaagtgcaaga

SEQ ID NO: 27380 - DNA, 21 bp, synthetic construct
  misc_feature 1..21: note = Synthetic Construct
  source 1..21: mol_type = other DNA
aaggagcagggacctaaggaa

SEQ ID NO: 27381 - DNA, 19 bp, synthetic construct
  misc_feature 1..19: note = Synthetic Construct
  source 1..19: mol_type = other DNA
aggcctggctcctgcatca

SEQ ID NO: 27382 - DNA, 21 bp, synthetic construct
  misc_feature 1..21: note = Synthetic Construct
  source 1..21: mol_type = other DNA
ttggagtgggtctggaaggat

SEQ ID NO: 27383 - DNA, 19 bp, synthetic construct
  misc_feature 1..19: note = Synthetic Construct
  source 1..19: mol_type = other DNA
caggccagacagcctttgt

SEQ ID NO: 27384 - DNA, 21 bp, synthetic construct
  misc_feature 1..21: note = Synthetic Construct
  source 1..21: mol_type = other DNA
tgctggccaaggagacagatg

SEQ ID NO: 27385 - DNA, 24 bp, synthetic construct
  misc_feature 1..24: note = Synthetic Construct
  source 1..24: mol_type = other DNA
gcattcgaccttaggtttggaaag

SEQ ID NO: 27386 - DNA, 23 bp, synthetic construct
  misc_feature 1..23: note = Synthetic Construct
  source 1..23: mol_type = other DNA
ggtgccagtggactatctctaca

SEQ ID NO: 27387 - DNA, 21 bp, synthetic construct
  misc_feature 1..21: note = Synthetic Construct
  source 1..21: mol_type = other DNA
gcctcacacttgggacacaaa

SEQ ID NO: 27388 - DNA, 19 bp, synthetic construct
  misc_feature 1..19: note = Synthetic Construct
  source 1..19: mol_type = other DNA
aagccttcgcactcagctt

SEQ ID NO: 27389 - DNA, 23 bp, synthetic construct
  misc_feature 1..23: note = Synthetic Construct
  source 1..23: mol_type = other DNA
cgttccatgagccagactcttct

SEQ ID NO: 27390 - DNA, 21 bp, synthetic construct
  misc_feature 1..21: note = Synthetic Construct
  source 1..21: mol_type = other DNA
cttgccacctagcccaaatgt

SEQ ID NO: 27391 - DNA, 21 bp, synthetic construct
  misc_feature 1..21: note = Synthetic Construct
  source 1..21: mol_type = other DNA
cagccccgaacagagttttga

SEQ ID NO: 27392 - DNA, 22 bp, synthetic construct
  misc_feature 1..22: note = Synthetic Construct
  source 1..22: mol_type = other DNA
gcactactgtcaggctgcaatc

SEQ ID NO: 27393 - DNA, 20 bp, synthetic construct
  misc_feature 1..20: note = Synthetic Construct
  source 1..20: mol_type = other DNA
tccagcggaccctgaaggaa

SEQ ID NO: 27394 - DNA, 22 bp, synthetic construct
  misc_feature 1..22: note = Synthetic Construct
  source 1..22: mol_type = other DNA
ccctcccatggcctttctatca

SEQ ID NO: 27395 - DNA, 21 bp, synthetic construct
  misc_feature 1..21: note = Synthetic Construct
  source 1..21: mol_type = other DNA
gccatcctcaggagcgtgaat

SEQ ID NO: 27396 - DNA, 25 bp, synthetic construct
  misc_feature 1..25: note = Synthetic Construct
  source 1..25: mol_type = other DNA
gcaaggacagcttagtgattaggta

SEQ ID NO: 27397 - DNA, 20 bp, synthetic construct
  misc_feature 1..20: note = Synthetic Construct
  source 1..20: mol_type = other DNA
aggcccctgtctccaactca

SEQ ID NO: 27398 - DNA, 25 bp, synthetic construct
  misc_feature 1..25: note = Synthetic Construct
  source 1..25: mol_type = other DNA
ggaagtcagcatcaaacccttgact

SEQ ID NO: 27399 - DNA, 22 bp, synthetic construct
  misc_feature 1..22: note = Synthetic Construct
  source 1..22: mol_type = other DNA
ggccagccctagtgaagaaaac

SEQ ID NO: 27400 - DNA, 22 bp, synthetic construct
  misc_feature 1..22: note = Synthetic Construct
  source 1..22: mol_type = other DNA
tctgcatcaggccctctaagat

SEQ ID NO: 27401 - DNA, 22 bp, synthetic construct
  misc_feature 1..22: note = Synthetic Construct
  source 1..22: mol_type = other DNA
tccctgcctgaatgttggaaac

SEQ ID NO: 27402 - DNA, 19 bp, synthetic construct
  misc_feature 1..19: note = Synthetic Construct
  source 1..19: mol_type = other DNA
cgcagcgacagcagtcaga

SEQ ID NO: 27403 - DNA, 20 bp, synthetic construct
  misc_feature 1..20: note = Synthetic Construct
  source 1..20: mol_type = other DNA
tgaagtgccgagccctgtga

SEQ ID NO: 27404 - DNA, 22 bp, synthetic construct
  misc_feature 1..22: note = Synthetic Construct
  source 1..22: mol_type = other DNA
tgtgcacaccatgtcaccatag

SEQ ID NO: 27405 - DNA, 19 bp, synthetic construct
  misc_feature 1..19: note = Synthetic Construct
  source 1..19: mol_type = other DNA
ttccctctcccggcaacat

SEQ ID NO: 27406 - DNA, 22 bp, synthetic construct
  misc_feature 1..22: note = Synthetic Construct
  source 1..22: mol_type = other DNA
gaggtggagaacgtgagacact

SEQ ID NO: 27407 - DNA, 20 bp, synthetic construct
  misc_feature 1..20: note = Synthetic Construct
  source 1..20: mol_type = other DNA
ggtagggctggctggaggaa

SEQ ID NO: 27408 - DNA, 23 bp, synthetic construct
  misc_feature 1..23: note = Synthetic Construct
  source 1..23: mol_type = other DNA
agtagtgcctctgtcttctgtga

SEQ ID NO: 27409 - DNA, 26 bp, synthetic construct
  misc_feature 1..26: note = Synthetic Construct
  source 1..26: mol_type = other DNA
ctggaggagaggtaaagagaggtaaa

SEQ ID NO: 27410 - DNA, 21 bp, synthetic construct
  misc_feature 1..21: note = Synthetic Construct
  source 1..21: mol_type = other DNA
ccagagcaccattccccatag

SEQ ID NO: 27411 - DNA, 24 bp, synthetic construct
  misc_feature 1..24: note = Synthetic Construct
  source 1..24: mol_type = other DNA
gctgtcatgccttgcttcagattg

SEQ ID NO: 27412 - DNA, 22 bp, synthetic construct
  misc_feature 1..22: note = Synthetic Construct
  source 1..22: mol_type = other DNA
ggatgggctcgggacttcctaa

SEQ ID NO: 27413 - DNA, 24 bp, synthetic construct
  misc_feature 1..24: note = Synthetic Construct
  source 1..24: mol_type = other DNA
gccagtgtcaggacttgttcattc

SEQ ID NO: 27414 - DNA, 20 bp, synthetic construct
  misc_feature 1..20: note = Synthetic Construct
  source 1..20: mol_type = other DNA
ggcacacggccaaattcaga

SEQ ID NO: 27415 - DNA, 21 bp, synthetic construct
  misc_feature 1..21: note = Synthetic Construct
  source 1..21: mol_type = other DNA
cgacggatgaggcaggtgttt

SEQ ID NO: 27416 - DNA, 20 bp, synthetic construct
  misc_feature 1..20: note = Synthetic Construct
  source 1..20: mol_type = other DNA
tggcagcaccctttgggttt

SEQ ID NO: 27417 - DNA, 21 bp, synthetic construct
  misc_feature 1..21: note = Synthetic Construct
  source 1..21: mol_type = other DNA
ccctcgttccctgcaatgtca

SEQ ID NO: 27418 - DNA, 20 bp, synthetic construct
  misc_feature 1..20: note = Synthetic Construct
  source 1..20: mol_type = other DNA
gccaggaggtggaggtatga

SEQ ID NO: 27419 - DNA, 25 bp, synthetic construct
  misc_feature 1..25: note = Synthetic Construct
  source 1..25: mol_type = other DNA
cccagtagttgaggtcttccacaat

SEQ ID NO: 27420 - DNA, 25 bp, synthetic construct
  misc_feature 1..25: note = Synthetic Construct
  source 1..25: mol_type = other DNA
acaaaaccctgaagaatcccagtat

SEQ ID NO: 27421 - DNA, 22 bp, synthetic construct
  misc_feature 1..22: note = Synthetic Construct
  source 1..22: mol_type = other DNA
gtaggcctcctggagtgggtat

SEQ ID NO: 27422 - DNA, 22 bp, synthetic construct
  misc_feature 1..22: note = Synthetic Construct
  source 1..22: mol_type = other DNA
ctgattaggtcctgccgtcctt

SEQ ID NO: 27423 - DNA, 23 bp, synthetic construct
  misc_feature 1..23: note = Synthetic Construct
  source 1..23: mol_type = other DNA
cccattggctgaaataggggaaa

SEQ ID NO: 27424 - DNA, 20 bp, synthetic construct
  misc_feature 1..20: note = Synthetic Construct
  source 1..20: mol_type = other DNA
gccctcctggtgtttgtgaa

SEQ ID NO: 27425 - DNA, 21 bp, synthetic construct
  misc_feature 1..21: note = Synthetic Construct
  source 1..21: mol_type = other DNA
ccaagcccttcagccagttca

SEQ ID NO: 27426 - DNA, 20 bp, synthetic construct
  misc_feature 1..20: note = Synthetic Construct
  source 1..20: mol_type = other DNA
tcctcacacccttggctgat

SEQ ID NO: 27427 - DNA, 22 bp, synthetic construct
  misc_feature 1..22: note = Synthetic Construct
  source 1..22: mol_type = other DNA
tgttcccagaggacagggacaa

SEQ ID NO: 27428 - DNA, 22 bp, synthetic construct
  misc_feature 1..22: note = Synthetic Construct
  source 1..22: mol_type = other DNA
ggccaagcccttacctgaagat

SEQ ID NO: 27429 - DNA, 24 bp, synthetic construct
  misc_feature 1..24: note = Synthetic Construct
  source 1..24: mol_type = other DNA
ctcacccttccgaactcttaacat

SEQ ID NO: 27430 - DNA, 21 bp, synthetic construct
  misc_feature 1..21: note = Synthetic Construct
  source 1..21: mol_type = other DNA
aatcgacacgcccattactgt

SEQ ID NO: 27431 - DNA, 20 bp, synthetic construct
  misc_feature 1..20: note = Synthetic Construct
  source 1..20: mol_type = other DNA
tccacagggctcccgtgaca

SEQ ID NO: 27432 - DNA, 24 bp, synthetic construct
  misc_feature 1..24: note = Synthetic Construct
  source 1..24: mol_type = other DNA
tgtcctttctaggctgtctctgtt

SEQ ID NO: 27433 - DNA, 21 bp, synthetic construct
  misc_feature 1..21: note = Synthetic Construct
  source 1..21: mol_type = other DNA
tggccccactcccaacaaaag

SEQ ID NO: 27434 - DNA, 20 bp, synthetic construct
  misc_feature 1..20: note = Synthetic Construct
  source 1..20: mol_type = other DNA
tgcggtcagacgggctcaga

SEQ ID NO: 27435 - DNA, 21 bp, synthetic construct
  misc_feature 1..21: note = Synthetic Construct
  source 1..21: mol_type = other DNA
agttcccctgggttgcagagt

SEQ ID NO: 27436 - DNA, 21 bp, synthetic construct
  misc_feature 1..21: note = Synthetic Construct
  source 1..21: mol_type = other DNA
catccactgctgcgctttttg

SEQ ID NO: 27437 - DNA, 21 bp, synthetic construct
  misc_feature 1..21: note = Synthetic Construct
  source 1..21: mol_type = other DNA
gcaaggctggtctctctgctt

SEQ ID NO: 27438 - DNA, 23 bp, synthetic construct
  misc_feature 1..23: note = Synthetic Construct
  source 1..23: mol_type = other DNA
cgtcccaggaggtggaaatcatc

SEQ ID NO: 27439 - DNA, 21 bp, synthetic construct
  misc_feature 1..21: note = Synthetic Construct
  source 1..21: mol_type = other DNA
gcaatcttcccacctcagctt

SEQ ID NO: 27440 - DNA, 19 bp, synthetic construct
  misc_feature 1..19: note = Synthetic Construct
  source 1..19: mol_type = other DNA
gggcgctgccatctccttt

SEQ ID NO: 27441 - DNA, 23 bp, synthetic construct
  misc_feature 1..23: note = Synthetic Construct
  source 1..23: mol_type = other DNA
acactggtcaggtatggatcact

SEQ ID NO: 27442 - DNA, 22 bp, synthetic construct
  misc_feature 1..22: note = Synthetic Construct
  source 1..22: mol_type = other DNA
ccagagccacctggagtaggta

SEQ ID NO: 27443 - DNA, 23 bp, synthetic construct
  misc_feature 1..23: note = Synthetic Construct
  source 1..23: mol_type = other DNA
catcgctaagtcatggtgtcact

SEQ ID NO: 27444 - DNA, 21 bp, synthetic construct
  misc_feature 1..21: note = Synthetic Construct
  source 1..21: mol_type = other DNA
agggtggagcctcctcgtttt

SEQ ID NO: 27445 - DNA, 20 bp, synthetic construct
  misc_feature 1..20: note = Synthetic Construct
  source 1..20: mol_type = other DNA
gaggacctcccctcctctga

SEQ ID NO: 27446 - DNA, 22 bp, synthetic construct
  misc_feature 1..22: note = Synthetic Construct
  source 1..22: mol_type = other DNA
tggcttctctccccactgtgat

SEQ ID NO: 27447 - DNA, 26 bp, synthetic construct
  misc_feature 1..26: note = Synthetic Construct
  source 1..26: mol_type = other DNA
gcctctaagtccattctttggatttg

SEQ ID NO: 27448 - DNA, 22 bp, synthetic construct
  misc_feature 1..22: note = Synthetic Construct
  source 1..22: mol_type = other DNA
ggctgggcatggctgcttaata

SEQ ID NO: 27449 - DNA, 23 bp, synthetic construct
  misc_feature 1..23: note = Synthetic Construct
  source 1..23: mol_type = other DNA
cctcagtcctcacagggagattc

SEQ ID NO: 27450 - DNA, 21 bp, synthetic construct
  misc_feature 1..21: note = Synthetic Construct
  source 1..21: mol_type = other DNA
gtttgtctcctctcgccttca

SEQ ID NO: 27451 - DNA, 21 bp, synthetic construct
  misc_feature 1..21: note = Synthetic Construct
  source 1..21: mol_type = other DNA
ccctgacctgtcctgggtcat

SEQ ID NO: 27452 - DNA, 19 bp, synthetic construct
  misc_feature 1..19: note = Synthetic Construct
  source 1..19: mol_type = other DNA
gggcgtgcacccgaatgaa

SEQ ID NO: 27453 - DNA, 22 bp, synthetic construct
  misc_feature 1..22: note = Synthetic Construct
  source 1..22: mol_type = other DNA
ctctgggagcagtgaaggttct

SEQ ID NO: 27454 - DNA, 22 bp, synthetic construct
  misc_feature 1..22: note = Synthetic Construct
  source 1..22: mol_type = other DNA
aggaatggcctgggagcttttg

SEQ ID NO: 27455 - DNA, 21 bp, synthetic construct
  misc_feature 1..21: note = Synthetic Construct
  source 1..21: mol_type = other DNA
tccgtcaccacagtggggttt

SEQ ID NO: 27456 - DNA, 19 bp, synthetic construct
  misc_feature 1..19: note = Synthetic Construct
  source 1..19: mol_type = other DNA
agtgcagcgcagccctcta

SEQ ID NO: 27457 - DNA, 22 bp, synthetic construct
  misc_feature 1..22: note = Synthetic Construct
  source 1..22: mol_type = other DNA
tgtcagggccttgtgggattct

SEQ ID NO: 27458 - DNA, 25 bp, synthetic construct
  misc_feature 1..25: note = Synthetic Construct
  source 1..25: mol_type = other DNA
cgacgaaaccaagagcaaagtgaac

SEQ ID NO: 27459 - DNA, 20 bp, synthetic construct
  misc_feature 1..20: note = Synthetic Construct
  source 1..20: mol_type = other DNA
gcagcagcccctggaatgta

SEQ ID NO: 27460 - DNA, 21 bp, synthetic construct
  misc_feature 1..21: note = Synthetic Construct
  source 1..21: mol_type = other DNA
aagtgccccagcaagctgtca

SEQ ID NO: 27461 - DNA, 22 bp, synthetic construct
  misc_feature 1..22: note = Synthetic Construct
  source 1..22: mol_type = other DNA
tcccagtggtctcttggcttga

SEQ ID NO: 27462 - DNA, 21 bp, synthetic construct
  misc_feature 1..21: note = Synthetic Construct
  source 1..21: mol_type = other DNA
tcacagggtcacacggagtca

SEQ ID NO: 27463 - DNA, 20 bp, synthetic construct
  misc_feature 1..20: note = Synthetic Construct
  source 1..20: mol_type = other DNA
ggtcgcatgtcaccctgtgt

SEQ ID NO: 27464 - DNA, 25 bp, synthetic construct
  misc_feature 1..25: note = Synthetic Construct
  source 1..25: mol_type = other DNA
ggtaccaaccgatgtctctttgcat

SEQ ID NO: 27465 - DNA, 22 bp, synthetic construct
  misc_feature 1..22: note = Synthetic Construct
  source 1..22: mol_type = other DNA
gtcacatgcccacccacaatac

SEQ ID NO: 27466 - DNA, 21 bp, synthetic construct
  misc_feature 1..21: note = Synthetic Construct
  source 1..21: mol_type = other DNA
tcgttcccgactgtggtgagt

SEQ ID NO: 27467 - DNA, 21 bp, synthetic construct
  misc_feature 1..21: note = Synthetic Construct
  source 1..21: mol_type = other DNA
gctgctgggaagctctgtttg

SEQ ID NO: 27468 - DNA, 20 bp, synthetic construct
  misc_feature 1..20: note = Synthetic Construct
  source 1..20: mol_type = other DNA
tggagctgctgccctgttag

SEQ ID NO: 27469 - DNA, 22 bp, synthetic construct
  misc_feature 1..22: note = Synthetic Construct
  source 1..22: mol_type = other DNA
ccaaccagcctgatggtctctt

SEQ ID NO: 27470 - DNA, 22 bp, synthetic construct
  misc_feature 1..22: note = Synthetic Construct
  source 1..22: mol_type = other DNA
catatggattcgctgccggtaa

SEQ ID NO: 27471 - DNA, 22 bp, synthetic construct
  misc_feature 1..22: note = Synthetic Construct
  source 1..22: mol_type = other DNA
gcatcaaaccaaaccagacaca

SEQ ID NO: 27472 - DNA, 22 bp, synthetic construct
  misc_feature 1..22: note = Synthetic Construct
  source 1..22: mol_type = other DNA
gaggcagggccagataaattct

SEQ ID NO: 27473 - DNA, 21 bp, synthetic construct
  misc_feature 1..21: note = Synthetic Construct
  source 1..21: mol_type = other DNA
aggctgtccaagagtccaaga

SEQ ID NO: 27474 - DNA, 19 bp, synthetic construct
  misc_feature 1..19: note = Synthetic Construct
  source 1..19: mol_type = other DNA
gcacaggcctggagagcaa

SEQ ID NO: 27475 - DNA, 22 bp, synthetic construct
  misc_feature 1..22: note = Synthetic Construct
  source 1..22: mol_type = other DNA
ggttggttgcctcttgttccat

SEQ ID NO: 27476 - DNA, 20 bp, synthetic construct
  misc_feature 1..20: note = Synthetic Construct
  source 1..20: mol_type = other DNA
gagcagtgtgtgctgtggat

SEQ ID NO: 27477 - DNA, 22 bp, synthetic construct
  misc_feature 1..22: note = Synthetic Construct
  source 1..22: mol_type = other DNA
cggcatccaatctgctcttagt

SEQ ID NO: 27478 - DNA, 23 bp, synthetic construct
  misc_feature 1..23: note = Synthetic Construct
  source 1..23: mol_type = other DNA
atgaagaagagcgggaaaaggat

SEQ ID NO: 27479 - DNA, 21 bp, synthetic construct
  misc_feature 1..21: note = Synthetic Construct
  source 1..21: mol_type = other DNA
cccaaggtcgtcgctacttgt

SEQ ID NO: 27480 - DNA, 19 bp, synthetic construct
  misc_feature 1..19: note = Synthetic Construct
  source 1..19: mol_type = other DNA
tgggcagcgctctgcttct

SEQ ID NO: 27481 - DNA, 22 bp, synthetic construct
  misc_feature 1..22: note = Synthetic Construct
  source 1..22: mol_type = other DNA
tcccctcccagctacagaaact

SEQ ID NO: 27482 - DNA, 24 bp, synthetic construct
  misc_feature 1..24: note = Synthetic Construct
  source 1..24: mol_type = other DNA
cctagaagtacgtacccaccaaca

SEQ ID NO: 27483 - DNA, 22 bp, synthetic construct
  misc_feature 1..22: note = Synthetic Construct
  source 1..22: mol_type = other DNA
tggaggagaaggtggctgtttg

SEQ ID NO: 27484 - DNA, 22 bp, synthetic construct
  misc_feature 1..22: note = Synthetic Construct
  source 1..22: mol_type = other DNA
gggaacggtagtgaggatgaag

SEQ ID NO: 27485 - DNA, 21 bp, synthetic construct
  misc_feature 1..21: note = Synthetic Construct
  source 1..21: mol_type = other DNA
ctttcccagcctcgattgcat

SEQ ID NO: 27486 - DNA, 22 bp, synthetic construct
  misc_feature 1..22: note = Synthetic Construct
  source 1..22: mol_type = other DNA
cacagtggcaggcacctgtaat

SEQ ID NO: 27487 - DNA, 21 bp, synthetic construct
  misc_feature 1..21: note = Synthetic Construct
  source 1..21: mol_type = other DNA
gcagggagaagctcccctaga

SEQ ID NO: 27488 - DNA, 22 bp, synthetic construct
  misc_feature 1..22: note = Synthetic Construct
  source 1..22: mol_type = other DNA
actgagggaatgaggactggat

SEQ ID NO: 27489 - DNA, 19 bp, synthetic construct
  misc_feature 1..19: note = Synthetic Construct
  source 1..19: mol_type = other DNA
ggcaacgcaggcaaagtgt

SEQ ID NO: 27490 - DNA, 21 bp, synthetic construct
  misc_feature 1..21: note = Synthetic Construct
  source 1..21: mol_type = other DNA
ggctcccctctcagagcaaaa

SEQ ID NO: 27491 - DNA, 23 bp, synthetic construct
  misc_feature 1..23: note = Synthetic Construct
  source 1..23: mol_type = other DNA
ggactggagtctgttgggagaga

SEQ ID NO: 27492 - DNA, 22 bp, synthetic construct
  misc_feature 1..22: note = Synthetic Construct
  source 1..22: mol_type = other DNA
gacggctccgtctgttgagaaa

SEQ ID NO: 27493 - DNA, 24 bp, synthetic construct
  misc_feature 1..24: note = Synthetic Construct
  source 1..24: mol_type = other DNA
gcacctttgccttaagcatcattg

SEQ ID NO: 27494 - DNA, 25 bp, synthetic construct
  misc_feature 1..25: note = Synthetic Construct
  source 1..25: mol_type = other DNA
agggataacatgtctcgttcaactt

SEQ ID NO: 27495 - DNA, 21 bp, synthetic construct
  misc_feature 1..21: note = Synthetic Construct
  source 1..21: mol_type = other DNA
cagcgtgcactgtctgagtct

SEQ ID NO: 27496 - DNA, 20 bp, synthetic construct
  misc_feature 1..20: note = Synthetic Construct
  source 1..20: mol_type = other DNA
agctgtgggtttccgtgtgt

SEQ ID NO: 27497 - DNA, 23 bp, synthetic construct
  misc_feature 1..23: note = Synthetic Construct
  source 1..23: mol_type = other DNA
gagggaagcccagcattatgaag

SEQ ID NO: 27498 - DNA, 23 bp, synthetic construct
  misc_feature 1..23: note = Synthetic Construct
  source 1..23: mol_type = other DNA
cctctcctgtcttcgtagtgaga

SEQ ID NO: 27499 - DNA, 23 bp, synthetic construct
  misc_feature 1..23: note = Synthetic Construct
  source 1..23: mol_type = other DNA
gcttgagctgggttattgtgttc

SEQ ID NO: 27500 - DNA, 21 bp, synthetic construct
  misc_feature 1..21: note = Synthetic Construct
  source 1..21: mol_type = other DNA
tcttccttgggcgtgggaatg

SEQ ID NO: 27501 - DNA, 21 bp, synthetic construct
  misc_feature 1..21: note = Synthetic Construct
  source 1..21: mol_type = other DNA
ggctgagcctcacagtaacaa

SEQ ID NO: 27502 - DNA, 22 bp, synthetic construct
  misc_feature 1..22: note = Synthetic Construct
  source 1..22: mol_type = other DNA
cagggacacaaaaccccgatca

SEQ ID NO: 27503 - DNA, 20 bp, synthetic construct
  misc_feature 1..20: note = Synthetic Construct
  source 1..20: mol_type = other DNA
tgggcctaggaaggttcagt

SEQ ID NO: 27504 - DNA, 20 bp, synthetic construct
  misc_feature 1..20: note = Synthetic Construct
  source 1..20: mol_type = other DNA
cgcgatgacatggaggtgaa

SEQ ID NO: 27505 - DNA, 23 bp, synthetic construct
  misc_feature 1..23: note = Synthetic Construct
  source 1..23: mol_type = other DNA
acatcctcaatcacagactgctt

SEQ ID NO: 27506 - DNA, 21 bp, synthetic construct
  misc_feature 1..21: note = Synthetic Construct
  source 1..21: mol_type = other DNA
tctccacagggtcctgctcaa

SEQ ID NO: 27507 - DNA, 22 bp, synthetic construct
  misc_feature 1..22: note = Synthetic Construct
  source 1..22: mol_type = other DNA
cagactctctgcacctcagtgt

SEQ ID NO: 27508 - DNA, 24 bp, synthetic construct
  misc_feature 1..24: note = Synthetic Construct
  source 1..24: mol_type = other DNA
gctgcttccacattacgtttgaga

SEQ ID NO: 27509 - DNA, 20 bp, synthetic construct
  misc_feature 1..20: note = Synthetic Construct
  source 1..20: mol_type = other DNA
ctggtccagcctgggagttg

SEQ ID NO: 27510 - DNA, 19 bp, synthetic construct
  misc_feature 1..19: note = Synthetic Construct
  source 1..19: mol_type = other DNA
tgcggtggacaagggaagt

SEQ ID NO: 27511 - DNA, 22 bp, synthetic construct
  misc_feature 1..22: note = Synthetic Construct
  source 1..22: mol_type = other DNA
ccggcctggagggatattcttg

SEQ ID NO: 27512 - DNA, 19 bp, synthetic construct
  misc_feature 1..19: note = Synthetic Construct
  source 1..19: mol_type = other DNA
tcctgcagccaagctcaca

SEQ ID NO: 27513 - DNA, 21 bp, synthetic construct
  misc_feature 1..21: note = Synthetic Construct
  source 1..21: mol_type = other DNA
gcctccaggactttgaaccaa

SEQ ID NO: 27514 - DNA, 24 bp, synthetic construct
  misc_feature 1..24: note = Synthetic Construct
  source 1..24: mol_type = other DNA
gatggcaagatcctgtctctacaa

SEQ ID NO: 27515 - DNA, 21 bp, synthetic construct
  misc_feature 1..21: note = Synthetic Construct
  source 1..21: mol_type = other DNA
acacacagggagaggccgttt

SEQ ID NO: 27516 - DNA, 20 bp, synthetic construct
  misc_feature 1..20: note = Synthetic Construct
  source 1..20: mol_type = other DNA
tgagcgcagaccttcctgat

SEQ ID NO: 27517 - DNA, 18 bp, synthetic construct
  misc_feature 1..18: note = Synthetic Construct
  source 1..18: mol_type = other DNA
gcgtccctcggcttgtaa

SEQ ID NO: 27518 - DNA, 20 bp, synthetic construct
  misc_feature 1..20: note = Synthetic Construct
  source 1..20: mol_type = other DNA
tcccgcaggtgaagcctcta

SEQ ID NO: 27519 - DNA, 20 bp, synthetic construct
  misc_feature 1..20: note = Synthetic Construct
  source 1..20: mol_type = other DNA
ggcctgaagcccgggatatt

SEQ ID NO: 27520 - DNA, 20 bp, synthetic construct
  misc_feature 1..20: note = Synthetic Construct
  source 1..20: mol_type = other DNA
acgcgatgtcctggaaaaca

SEQ ID NO: 27521 - DNA, 24 bp, synthetic construct
  misc_feature 1..24: note = Synthetic Construct
  source 1..24: mol_type = other DNA
cagtcacctgagtgaaagctaagt

SEQ ID NO: 27522 - DNA, 19 bp, synthetic construct
  misc_feature 1..19: note = Synthetic Construct
  source 1..19: mol_type = other DNA
cccaatcccgcagctctca

SEQ ID NO: 27523 - DNA, 23 bp, synthetic construct
  misc_feature 1..23: note = Synthetic Construct
  source 1..23: mol_type = other DNA
gccaacagcagagagagaacaga

SEQ ID NO: 27524 - DNA, 20 bp, synthetic construct
  misc_feature 1..20: note = Synthetic Construct
  source 1..20: mol_type = other DNA
tctgcctgtccccagtcttg

SEQ ID NO: 27525 - DNA, 22 bp, synthetic construct
  misc_feature 1..22: note = Synthetic Construct
  source 1..22: mol_type = other DNA
atgcctgggtctcttcctgaga

SEQ ID NO: 27526 - DNA, 20 bp, synthetic construct
  misc_feature 1..20: note = Synthetic Construct
  source 1..20: mol_type = other DNA
ccctgtgggctcctggtaca

SEQ ID NO: 27527 - DNA, 21 bp, synthetic construct
  misc_feature 1..21: note = Synthetic Construct
  source 1..21: mol_type = other DNA
ccaaacagctggccagtgaag

SEQ ID NO: 27528 - DNA, 20 bp, synthetic construct
  misc_feature 1..20: note = Synthetic Construct
  source 1..20: mol_type = other DNA
tgggttcccatgtggtgtga

SEQ ID NO: 27529 - DNA, 20 bp, synthetic construct
  misc_feature 1..20: note = Synthetic Construct
  source 1..20: mol_type = other DNA
aggagtggccagcagtgaaa

SEQ ID NO: 27530 - DNA, 22 bp, synthetic construct
  misc_feature 1..22: note = Synthetic Construct
  source 1..22: mol_type = other DNA
gaggatgagtgcctgactgtgt

SEQ ID NO: 27531 - DNA, 20 bp, synthetic construct
  misc_feature 1..20: note = Synthetic Construct
  source 1..20: mol_type = other DNA
ccgaacccacttgcccattg

SEQ ID NO: 27532 - DNA, 22 bp, synthetic construct
  misc_feature 1..22: note = Synthetic Construct
  source 1..22: mol_type = other DNA
gtgcgctcggaaggttgaatag

SEQ ID NO: 27533 - DNA, 18 bp, synthetic construct
  misc_feature 1..18: note = Synthetic Construct
  source 1..18: mol_type = other DNA
cacggctcactgcagctt

SEQ ID NO: 27534 - DNA, 23 bp, synthetic construct
  misc_feature 1..23: note = Synthetic Construct
  source 1..23: mol_type = other DNA
ggctcttcagagtgatgggacat

SEQ ID NO: 27535 - DNA, 22 bp, synthetic construct
  misc_feature 1..22: note = Synthetic Construct
  source 1..22: mol_type = other DNA
ttgtggagccccagtctctgaa

SEQ ID NO: 27536 - DNA, 24 bp, synthetic construct
  misc_feature 1..24: note = Synthetic Construct
  source 1..24: mol_type = other DNA
gtcttactttctccgtcccagtag

SEQ ID NO: 27537 - DNA, 23 bp, synthetic construct
  misc_feature 1..23: note = Synthetic Construct
  source 1..23: mol_type = other DNA
gtggtgacagaaagcagcacatc

SEQ ID NO: 27538 - DNA, 20 bp, synthetic construct
  misc_feature 1..20: note = Synthetic Construct
  source 1..20: mol_type = other DNA
tcctccgagccactgctcat

SEQ ID NO: 27539 - DNA, 18 bp, synthetic construct
  misc_feature 1..18: note = Synthetic Construct
  source 1..18: mol_type = other DNA
gccacaagcccgaccttt

SEQ ID NO: 27540 - DNA, 19 bp, synthetic construct
  misc_feature 1..19: note = Synthetic Construct
  source 1..19: mol_type = other DNA
gccaccctacgtcctgtgt

SEQ ID NO: 27541 - DNA, 23 bp, synthetic construct
  misc_feature 1..23: note = Synthetic Construct
  source 1..23: mol_type = other DNA
ggagtctgttgaaaaggctggtt

SEQ ID NO: 27542 - DNA, 22 bp, synthetic construct
  misc_feature 1..22: note = Synthetic Construct
  source 1..22: mol_type = other DNA
gtccccagggaaaagccattgt

SEQ ID NO: 27543 - DNA, 20 bp, synthetic construct
  misc_feature 1..20: note = Synthetic Construct
  source 1..20: mol_type = other DNA
aggggagatgcctgtgatga

SEQ ID NO: 27544 - DNA, 20 bp, synthetic construct
  misc_feature 1..20: note = Synthetic Construct
  source 1..20: mol_type = other DNA
aggcaccagtgagctgatgt

SEQ ID NO: 27545 - DNA, 18 bp, synthetic construct
  misc_feature 1..18: note = Synthetic Construct
  source 1..18: mol_type = other DNA
agaggtgggcagcactga

SEQ ID NO: 27546 - DNA, 19 bp, synthetic construct
  misc_feature 1..19: note = Synthetic Construct
  source 1..19: mol_type = other DNA
cccggctgagagcagacaa

SEQ ID NO: 27547 - DNA, 20 bp, synthetic construct
  misc_feature 1..20: note = Synthetic Construct
  source 1..20: mol_type = other DNA
cagctctcacctgcgttttg

SEQ ID NO: 27548 - DNA, 20 bp, synthetic construct
  misc_feature 1..20: note = Synthetic Construct
  source 1..20: mol_type = other DNA
acagccgccttcccaaaaca

SEQ ID NO: 27549 - DNA, 24 bp, synthetic construct
  misc_feature 1..24: note = Synthetic Construct
  source 1..24: mol_type = other DNA
cggtcactaggcaccatctaattc

SEQ ID NO: 27550 - DNA, 19 bp, synthetic construct
  misc_feature 1..19: note = Synthetic Construct
  source 1..19: mol_type = other DNA
tggcacggccacgaacatc

SEQ ID NO: 27551 - DNA, 22 bp, synthetic construct
  misc_feature 1..22: note = Synthetic Construct
  source 1..22: mol_type = other DNA
ggagtaaaccacctgcctctct

SEQ ID NO: 27552 - DNA, 24 bp, synthetic construct
  misc_feature 1..24: note = Synthetic Construct
  source 1..24: mol_type = other DNA
ccaaccccaacagaacaagaccaa

SEQ ID NO: 27553 - DNA, 22 bp, synthetic construct
  misc_feature 1..22: note = Synthetic Construct
  source 1..22: mol_type = other DNA
acaaacagccttccgtctcttc

SEQ ID NO: 27554 - DNA, 20 bp, synthetic construct
  misc_feature 1..20: note = Synthetic Construct
  source 1..20: mol_type = other DNA
aaccacctggccctctgtag

SEQ ID NO: 27555 - DNA, 22 bp, synthetic construct
  misc_feature 1..22: note = Synthetic Construct
  source 1..22: mol_type = other DNA
gggagagtgccctgtttgttgt

SEQ ID NO: 27556 - DNA, 22 bp, synthetic construct
  misc_feature 1..22: note = Synthetic Construct
  source 1..22: mol_type = other DNA
gcgtttgcactgggagatgaag

SEQ ID NO: 27557 - DNA, 20 bp, synthetic construct
  misc_feature 1..20: note = Synthetic Construct
  source 1..20: mol_type = other DNA
gcccacctgcatttggcttt

SEQ ID NO: 27558 - DNA, 19 bp, synthetic construct
  misc_feature 1..19: note = Synthetic Construct
  source 1..19: mol_type = other DNA
cccaggtgccaggtgtcat

SEQ ID NO: 27559 - DNA, 22 bp, synthetic construct
  misc_feature 1..22: note = Synthetic Construct
  source 1..22: mol_type = other DNA
cccgcctgattctgggagtttt

SEQ ID NO: 27560 - DNA, 19 bp, synthetic construct
  misc_feature 1..19: note = Synthetic Construct
  source 1..19: mol_type = other DNA
ttgcggggtgtgcggagat

SEQ ID NO: 27561 - DNA, 19 bp, synthetic construct
  misc_feature 1..19: note = Synthetic Construct
  source 1..19: mol_type = other DNA
cgggagctgctgcttgttg

SEQ ID NO: 27562 - DNA, 18 bp, synthetic construct
  misc_feature 1..18: note = Synthetic Construct
  source 1..18: mol_type = other DNA
tcctgctccctggcacat

SEQ ID NO: 27563 - DNA, 22 bp, synthetic construct
  misc_feature 1..22: note = Synthetic Construct
  source 1..22: mol_type = other DNA
ggtatggggagaggaccctgaa

SEQ ID NO: 27564 - DNA, 21 bp, synthetic construct
  misc_feature 1..21: note = Synthetic Construct
  source 1..21: mol_type = other DNA
gcttgctggttggatgtcagt

SEQ ID NO: 27565 - DNA, 21 bp, synthetic construct
  misc_feature 1..21: note = Synthetic Construct
  source 1..21: mol_type = other DNA
tgctctgtgggtgtcacattc

SEQ ID NO: 27566 - DNA, 22 bp, synthetic construct
  misc_feature 1..22: note = Synthetic Construct
  source 1..22: mol_type = other DNA
gcccagagctccatttcactgt

SEQ ID NO: 27567 - DNA, 21 bp, synthetic construct
  misc_feature 1..21: note = Synthetic Construct
  source 1..21: mol_type = other DNA
tgttcatggccaaaggtgtga

SEQ ID NO: 27568 - DNA, 22 bp, synthetic construct
  misc_feature 1..22: note = Synthetic Construct
  source 1..22: mol_type = other DNA
cggccaggagaaccagaatctt

SEQ ID NO: 27569 - DNA, 20 bp, synthetic construct
  misc_feature 1..20: note = Synthetic Construct
  source 1..20: mol_type = other DNA
gtgcgtgtgtggtgttctct

SEQ ID NO: 27570 - DNA, 23 bp, synthetic construct
  misc_feature 1..23: note = Synthetic Construct
  source 1..23: mol_type = other DNA
gtacaagaattccgaccccaaga

SEQ ID NO: 27571 - DNA, 21 bp, synthetic construct
  misc_feature 1..21: note = Synthetic Construct
  source 1..21: mol_type = other DNA
gtggttgggtgggcagataga

SEQ ID NO: 27572 - DNA, 21 bp, synthetic construct
  misc_feature 1..21: note = Synthetic Construct
  source 1..21: mol_type = other DNA
cctactgcttgctgctagtgt

SEQ ID NO: 27573 - DNA, 22 bp, synthetic construct
  misc_feature 1..22: note = Synthetic Construct
  source 1..22: mol_type = other DNA
caacggtaagactgaccagaca

SEQ ID NO: 27574 - DNA, 26 bp, synthetic construct
  misc_feature 1..26: note = Synthetic Construct
  source 1..26: mol_type = other DNA
gtcttaggctagctagggcaatgtag

SEQ ID NO: 27575 - DNA, 22 bp, synthetic construct
  misc_feature 1..22: note = Synthetic Construct
  source 1..22: mol_type = other DNA
gtgggatgccctttacacatca

SEQ ID NO: 27576 - DNA, 21 bp, synthetic construct
  misc_feature 1..21: note = Synthetic Construct
  source 1..21: mol_type = other DNA
agcgcagtctgaatcaacagt

SEQ ID NO: 27577 - DNA, 21 bp, synthetic construct
  misc_feature 1..21: note = Synthetic Construct
  source 1..21: mol_type = other DNA
tcttggctcccactcacaaac

SEQ ID NO: 27578 - DNA, 22 bp, synthetic construct
  misc_feature 1..22: note = Synthetic Construct
  source 1..22: mol_type = other DNA
cccagcacttccctaagcagta

SEQ ID NO: 27579 - DNA, 20 bp, synthetic construct
  misc_feature 1..20: note = Synthetic Construct
  source 1..20: mol_type = other DNA
gcctggcctctctcttctgt

SEQ ID NO: 27580 - DNA, 24 bp, synthetic construct
  misc_feature 1..24: note = Synthetic Construct
  source 1..24: mol_type = other DNA
gagctctggaagcagcatctaagt

SEQ ID NO: 27581 - DNA, 24 bp, synthetic construct
  misc_feature 1..24: note = Synthetic Construct
  source 1..24: mol_type = other DNA
tgatgcaaaacagaggaaggaaca

SEQ ID NO: 27582 - DNA, 22 bp, synthetic construct
  misc_feature 1..22: note = Synthetic Construct
  source 1..22: mol_type = other DNA
gagtcagcgtcctgttcgttag

SEQ ID NO: 27583 - DNA, 23 bp, synthetic construct
  misc_feature 1..23: note = Synthetic Construct
  source 1..23: mol_type = other DNA
gacgaaggttgggagtcagaaac

SEQ ID NO: 27584 - DNA, 25 bp, synthetic construct
  misc_feature 1..25: note = Synthetic Construct
  source 1..25: mol_type = other DNA
cacaaggtaaaacaggcacttcctt

SEQ ID NO: 27585 - DNA, 24 bp, synthetic construct
  misc_feature 1..24: note = Synthetic Construct
  source 1..24: mol_type = other DNA
gacagacccaaatttctgccacat

SEQ ID NO: 27586 - DNA, 20 bp, synthetic construct
  misc_feature 1..20: note = Synthetic Construct
  source 1..20: mol_type = other DNA
ccaccgtgcccagtcacata

SEQ ID NO: 27587 - DNA, 24 bp, synthetic construct
  misc_feature 1..24: note = Synthetic Construct
  source 1..24: mol_type = other DNA
ggaagagaaggtctaagcggaagt

SEQ ID NO: 27588 - DNA, 18 bp, synthetic construct
  misc_feature 1..18: note = Synthetic Construct
  source 1..18: mol_type = other DNA
ctcgcagaccgtgcaact

SEQ ID NO: 27589 - DNA, 24 bp, synthetic construct
  misc_feature 1..24: note = Synthetic Construct
  source 1..24: mol_type = other DNA
tgacttgcagctcatggaattttg

SEQ ID NO: 27590 - DNA, 20 bp, synthetic construct
  misc_feature 1..20: note = Synthetic Construct
  source 1..20: mol_type = other DNA
atcgtggagactggctggat

SEQ ID NO: 27591 - DNA, 20 bp, synthetic construct
  misc_feature 1..20: note = Synthetic Construct
  source 1..20: mol_type = other DNA
ctgaccgctagccctgttag

SEQ ID NO: 27592 - DNA, 20 bp, synthetic construct
  misc_feature 1..20: note = Synthetic Construct
  source 1..20: mol_type = other DNA
gctgccaccatgacttctct

SEQ ID NO: 27593 - DNA, 20 bp, synthetic construct
  misc_feature 1..20: note = Synthetic Construct
  source 1..20: mol_type = other DNA
ccccaggcagagccatatct

SEQ ID NO: 27594 - DNA, 24 bp, synthetic construct
  misc_feature 1..24: note = Synthetic Construct
  source 1..24: mol_type = other DNA
cctctgtccatgcaatcccaagaa

SEQ ID NO: 27595 - DNA, 21 bp, synthetic construct
  misc_feature 1..21: note = Synthetic Construct
  source 1..21: mol_type = other DNA
tggtggagccaacggatagat

SEQ ID NO: 27596 - DNA, 22 bp, synthetic construct
  misc_feature 1..22: note = Synthetic Construct
  source 1..22: mol_type = other DNA
cccagctgccttctctcaactt

SEQ ID NO: 27597 - DNA, 23 bp, synthetic construct
  misc_feature 1..23: note = Synthetic Construct
  source 1..23: mol_type = other DNA
gggtgcacatattccaggtcaac

SEQ ID NO: 27598 - DNA, 24 bp, synthetic construct
  misc_feature 1..24: note = Synthetic Construct
  source 1..24: mol_type = other DNA
caggtaggaggtgttctggtcaag

SEQ ID NO: 27599 - DNA, 22 bp, synthetic construct
  misc_feature 1..22: note = Synthetic Construct
  source 1..22: mol_type = other DNA
gggcctgacctgagacctaata

SEQ ID NO: 27600 - DNA, 20 bp, synthetic construct
  misc_feature 1..20: note = Synthetic Construct
  source 1..20: mol_type = other DNA
cctggtgcagtggtatgcaa

SEQ ID NO: 27601 - DNA, 27 bp, synthetic construct
  misc_feature 1..27: note = Synthetic Construct
  source 1..27: mol_type = other DNA
gactctaaccacttatcacctccattg

SEQ ID NO: 27602 - DNA, 23 bp, synthetic construct
  misc_feature 1..23: note = Synthetic Construct
  source 1..23: mol_type = other DNA
gggaggatggaattcagccttgt

SEQ ID NO: 27603 - DNA, 21 bp, synthetic construct
  misc_feature 1..21: note = Synthetic Construct
  source 1..21: mol_type = other DNA
ggttggagcagggaaatcagt

SEQ ID NO: 27604 - DNA, 19 bp, synthetic construct
  misc_feature 1..19: note = Synthetic Construct
  source 1..19: mol_type = other DNA
accccaagccaccctccat

SEQ ID NO: 27605 - DNA, 20 bp, synthetic construct
  misc_feature 1..20: note = Synthetic Construct
  source 1..20: mol_type = other DNA
actggagcagccttgagaca

SEQ ID NO: 27606 - DNA, 19 bp, synthetic construct
  misc_feature 1..19: note = Synthetic Construct
  source 1..19: mol_type = other DNA
tcacaggcccagagtgtca

SEQ ID NO: 27607 - DNA, 21 bp, synthetic construct
  misc_feature 1..21: note = Synthetic Construct
  source 1..21: mol_type = other DNA
ccacaaggccgcatctcatgt

SEQ ID NO: 27608 - DNA, 20 bp, synthetic construct
  misc_feature 1..20: note = Synthetic Construct
  source 1..20: mol_type = other DNA
gctgcacctgttgacccatt

SEQ ID NO: 27609 - DNA, 20 bp, synthetic construct
  misc_feature 1..20: note = Synthetic Construct
  source 1..20: mol_type = other DNA
acaccccaggacacaccaat

SEQ ID NO: 27610 - DNA, 20 bp, synthetic construct
  misc_feature 1..20: note = Synthetic Construct
  source 1..20: mol_type = other DNA
gtgggctttgatgggactca

SEQ ID NO: 27611 - DNA, 21 bp, synthetic construct
  misc_feature 1..21: note = Synthetic Construct
  source 1..21: mol_type = other DNA
gcgacaacggcccctcattta

SEQ ID NO: 27612 - DNA, 25 bp, synthetic construct
  misc_feature 1..25: note = Synthetic Construct
  source 1..25: mol_type = other DNA
cttgagtccctgcacctttaattct

SEQ ID NO: 27613 - DNA, 23 bp, synthetic construct
  misc_feature 1..23: note = Synthetic Construct
  source 1..23: mol_type = other DNA
gcccatgaacaaagtagccatga

SEQ ID NO: 27614 - DNA, 20 bp, synthetic construct
  misc_feature 1..20: note = Synthetic Construct
  source 1..20: mol_type = other DNA
gattgcatggcacccagtct

SEQ ID NO: 27615 - DNA, 22 bp, synthetic construct
  misc_feature 1..22: note = Synthetic Construct
  source 1..22: mol_type = other DNA
gagggaagggaagagagcctta

SEQ ID NO: 27616 - DNA, 22 bp, synthetic construct
  misc_feature 1..22: note = Synthetic Construct
  source 1..22: mol_type = other DNA
ccttgacatcccaggctcaagt

SEQ ID NO: 27617 - DNA, 24 bp, synthetic construct
  misc_feature 1..24: note = Synthetic Construct
  source 1..24: mol_type = other DNA
cgaagccgaaaaatggaagctatg

SEQ ID NO: 27618 - DNA, 20 bp, synthetic construct
  misc_feature 1..20: note = Synthetic Construct
  source 1..20: mol_type = other DNA
cctggccaagaggccaacaa

SEQ ID NO: 27619 - DNA, 22 bp, synthetic construct
  misc_feature 1..22: note = Synthetic Construct
  source 1..22: mol_type = other DNA
aggcccacagagaaggtgacat

SEQ ID NO: 27620 - DNA, 22 bp, synthetic construct
  misc_feature 1..22: note = Synthetic Construct
  source 1..22: mol_type = other DNA
ccagaagtcctgctctgcttca

SEQ ID NO: 27621 - DNA, 25 bp, synthetic construct
  misc_feature 1..25: note = Synthetic Construct
  source 1..25: mol_type = other DNA
ggctgggagtcaaaattagggtatc

SEQ ID NO: 27622 - DNA, 23 bp, synthetic construct
  misc_feature 1..23: note = Synthetic Construct
  source 1..23: mol_type = other DNA
ggactgaagtcctcagaagcaaa

SEQ ID NO: 27623 - DNA, 22 bp, synthetic construct
  misc_feature 1..22: note = Synthetic Construct
  source 1..22: mol_type = other DNA
gccctgggatccagaattccta

SEQ ID NO: 27624 - DNA, 22 bp, synthetic construct
  misc_feature 1..22: note = Synthetic Construct
  source 1..22: mol_type = other DNA
caggagtccaccccactttaca

SEQ ID NO: 27625 - DNA, 21 bp, synthetic construct
  misc_feature 1..21: note = Synthetic Construct
  source 1..21: mol_type = other DNA
cagggctggtccacaaaggaa

SEQ ID NO: 27626 - DNA, 22 bp, synthetic construct
  misc_feature 1..22: note = Synthetic Construct
  source 1..22: mol_type = other DNA
ggacaaccagcacccaaaggaa

SEQ ID NO: 27627 - DNA, 22 bp, synthetic construct
  misc_feature 1..22: note = Synthetic Construct
  source 1..22: mol_type = other DNA
gacaatgacgtggctccaccat

SEQ ID NO: 27628 - DNA, 20 bp, synthetic construct
  misc_feature 1..20: note = Synthetic Construct
  source 1..20: mol_type = other DNA
accaggccaggcactaggaa

SEQ ID NO: 27629 - DNA, 21 bp, synthetic construct
  misc_feature 1..21: note = Synthetic Construct
  source 1..21: mol_type = other DNA
agcaggggagcccattgatgt

SEQ ID NO: 27630 - DNA, 20 bp, synthetic construct
  misc_feature 1..20: note = Synthetic Construct
  source 1..20: mol_type = other DNA
ccccgacctcccaagctact

SEQ ID NO: 27631 - DNA, 24 bp, synthetic construct
  misc_feature 1..24: note = Synthetic Construct
  source 1..24: mol_type = other DNA
ggagaagttacttagccacactga

SEQ ID NO: 27632 - DNA, 22 bp, synthetic construct
  misc_feature 1..22: note = Synthetic Construct
  source 1..22: mol_type = other DNA
acatgcgtggtgtctctaacat

SEQ ID NO: 27633 - DNA, 22 bp, synthetic construct
  misc_feature 1..22: note = Synthetic Construct
  source 1..22: mol_type = other DNA
gcagctgttgcactgttttgtt

SEQ ID NO: 27634 - DNA, 21 bp, synthetic construct
  misc_feature 1..21: note = Synthetic Construct
  source 1..21: mol_type = other DNA
cctcgaggaagcctcccctta

SEQ ID NO: 27635 - DNA, 25 bp, synthetic construct
  misc_feature 1..25: note = Synthetic Construct
  source 1..25: mol_type = other DNA
gctttatttcctgcacatccaggtt

SEQ ID NO: 27636 - DNA, 22 bp, synthetic construct
  misc_feature 1..22: note = Synthetic Construct
  source 1..22: mol_type = other DNA
gcttagaagctccacagcttga

SEQ ID NO: 27637 - DNA, 22 bp, synthetic construct
  misc_feature 1..22: note = Synthetic Construct
  source 1..22: mol_type = other DNA
agtagggactgtggaggacaca

SEQ ID NO: 27638 - DNA, 26 bp, synthetic construct
  misc_feature 1..26: note = Synthetic Construct
  source 1..26: mol_type = other DNA
cactgtgcaagaacagatggttcaga

SEQ ID NO: 27639 - DNA, 22 bp, synthetic construct
  misc_feature 1..22: note = Synthetic Construct
  source 1..22: mol_type = other DNA
gccaaggttccaagagagagaa

SEQ ID NO: 27640 - DNA, 22 bp, synthetic construct
  misc_feature 1..22: note = Synthetic Construct
  source 1..22: mol_type = other DNA
gaaacacggtctcactctgtca

SEQ ID NO: 27641 - DNA, 21 bp, synthetic construct
  misc_feature 1..21: note = Synthetic Construct
  source 1..21: mol_type = other DNA
gcggttgcagctgtactctga

SEQ ID NO: 27642 - DNA, 20 bp, synthetic construct
  misc_feature 1..20: note = Synthetic Construct
  source 1..20: mol_type = other DNA
tcgcccctccattgtcttct

SEQ ID NO: 27643 - DNA, 20 bp, synthetic construct
  misc_feature 1..20: note = Synthetic Construct
  source 1..20: mol_type = other DNA
ggaggggcagtgacattcaa

SEQ ID NO: 27644 - DNA, 21 bp, synthetic construct
  misc_feature 1..21: note = Synthetic Construct
  source 1..21: mol_type = other DNA
gcccaaagagagggtgctagt

SEQ ID NO: 27645 - DNA, 21 bp, synthetic construct
  misc_feature 1..21: note = Synthetic Construct
  source 1..21: mol_type = other DNA
tgatttgtggggccagagaga

SEQ ID NO: 27646 - DNA, 20 bp, synthetic construct
  misc_feature 1..20: note = Synthetic Construct
  source 1..20: mol_type = other DNA
tggccttggttggacacact

SEQ ID NO: 27647 - DNA, 25 bp, synthetic construct
  misc_feature 1..25: note = Synthetic Construct
  source 1..25: mol_type = other DNA
gtgtagggtgttagttgtccacagt

SEQ ID NO: 27648 - DNA, 20 bp, synthetic construct
  misc_feature 1..20: note = Synthetic Construct
  source 1..20: mol_type = other DNA
cccagcaactgtagcactga

SEQ ID NO: 27649 - DNA, 20 bp, synthetic construct
  misc_feature 1..20: note = Synthetic Construct
  source 1..20: mol_type = other DNA
tgagccagggaatgcctgaa

SEQ ID NO: 27650 - DNA, 20 bp, synthetic construct
  misc_feature 1..20: note = Synthetic Construct
  source 1..20: mol_type = other DNA
agggcatggtgacacacaac

SEQ ID NO: 27651 - DNA, 26 bp, synthetic construct
  misc_feature 1..26: note = Synthetic Construct
  source 1..26: mol_type = other DNA
gaaggtcatctttcagggattacaga

SEQ ID NO: 27652 - DNA, 19 bp, synthetic construct
  misc_feature 1..19: note = Synthetic Construct
  source 1..19: mol_type = other DNA
ccagcctgtccgcctctaa

SEQ ID NO: 27653 - DNA, 22 bp, synthetic construct
  misc_feature 1..22: note = Synthetic Construct
  source 1..22: mol_type = other DNA
gttgtggaggcgagagtctgaa

SEQ ID NO: 27654 - DNA, 25 bp, synthetic construct
  misc_feature 1..25: note = Synthetic Construct
  source 1..25: mol_type = other DNA
gttggcaacagttattttccaccta

SEQ ID NO: 27655 - DNA, 26 bp, synthetic construct
  misc_feature 1..26: note = Synthetic Construct
  source 1..26: mol_type = other DNA
tccctcaatcctagcatacaacaatc

SEQ ID NO: 27656 - DNA, 23 bp, synthetic construct
  misc_feature 1..23: note = Synthetic Construct
  source 1..23: mol_type = other DNA
gcttcaccaagcgtttcccttgt

SEQ ID NO: 27657 - DNA, 20 bp, synthetic construct
  misc_feature 1..20: note = Synthetic Construct
  source 1..20: mol_type = other DNA
agcgtctgcctcacctcttg

SEQ ID NO: 27658 - DNA, 23 bp, synthetic construct
  misc_feature 1..23: note = Synthetic Construct
  source 1..23: mol_type = other DNA
ccgcagactcagcaaactattct

SEQ ID NO: 27659 - DNA, 23 bp, synthetic construct
  misc_feature 1..23: note = Synthetic Construct
  source 1..23: mol_type = other DNA
acactctgcatagctcagaacaa

SEQ ID NO: 27660 - DNA, 24 bp, synthetic construct
  misc_feature 1..24: note = Synthetic Construct
  source 1..24: mol_type = other DNA
ctggaagaaaacggctctgataac

SEQ ID NO: 27661 - DNA, 23 bp, synthetic construct
  misc_feature 1..23: note = Synthetic Construct
  source 1..23: mol_type = other DNA
ccactagtagccgtgtgaaagat

SEQ ID NO: 27662 - DNA, 24 bp, synthetic construct
  misc_feature 1..24: note = Synthetic Construct
  source 1..24: mol_type = other DNA
gcctcaacgtcccctatcaagact

SEQ ID NO: 27663 - DNA, 19 bp, synthetic construct
  misc_feature 1..19: note = Synthetic Construct
  source 1..19: mol_type = other DNA
aacccgccaccgtttgtct

SEQ ID NO: 27664 - DNA, 21 bp, synthetic construct
  misc_feature 1..21: note = Synthetic Construct
  source 1..21: mol_type = other DNA
agggcctgcagaacacacatc

SEQ ID NO: 27665 - DNA, 22 bp, synthetic construct
  misc_feature 1..22: note = Synthetic Construct
  source 1..22: mol_type = other DNA
gtgggtgtctcaccattgaaga

SEQ ID NO: 27666 - DNA, 24 bp, synthetic construct
  misc_feature 1..24: note = Synthetic Construct
  source 1..24: mol_type = other DNA
ccatcagatgagtgccttagttct

SEQ ID NO: 27667 - DNA, 21 bp, synthetic construct
  misc_feature 1..21: note = Synthetic Construct
  source 1..21: mol_type = other DNA
gaaacagcaaggtgtgtgcat

SEQ ID NO: 27668 - DNA, 23 bp, synthetic construct
  misc_feature 1..23: note = Synthetic Construct
  source 1..23: mol_type = other DNA
cccatagccagcatgtttagaga

SEQ ID NO: 27669 - DNA, 21 bp, synthetic construct
  misc_feature 1..21: note = Synthetic Construct
  source 1..21: mol_type = other DNA
gcagccagcactttgtgtttc

SEQ ID NO: 27670 - DNA, 20 bp, synthetic construct
  misc_feature 1..20: note = Synthetic Construct
  source 1..20: mol_type = other DNA
cccactccaagcaccaaaca

SEQ ID NO: 27671 - DNA, 20 bp, synthetic construct
  misc_feature 1..20: note = Synthetic Construct
  source 1..20: mol_type = other DNA
tgcaggtggcctgaggtttc

SEQ ID NO: 27672 - DNA, 21 bp, synthetic construct
  misc_feature 1..21: note = Synthetic Construct
  source 1..21: mol_type = other DNA
ttggccccaggggtgagcata

SEQ ID NO: 27673 - DNA, 23 bp, synthetic construct
  misc_feature 1..23: note = Synthetic Construct
  source 1..23: mol_type = other DNA
gaaaatccacccacactccagaa

SEQ ID NO: 27674 - DNA, 26 bp, synthetic construct
  misc_feature 1..26: note = Synthetic Construct
  source 1..26: mol_type = other DNA
cgaagctgctttcacacactgtgatt

SEQ ID NO: 27675 - DNA, 25 bp, synthetic construct
  misc_feature 1..25: note = Synthetic Construct
  source 1..25: mol_type = other DNA
gtgcaacgagttactgccgataatg

SEQ ID NO: 27676 - DNA, 21 bp, synthetic construct
  misc_feature 1..21: note = Synthetic Construct
  source 1..21: mol_type = other DNA
ccccaagggtctaaccacaga

SEQ ID NO: 27677 - DNA, 20 bp, synthetic construct
  misc_feature 1..20: note = Synthetic Construct
  source 1..20: mol_type = other DNA
tgggagtgacgtgccacaaa

SEQ ID NO: 27678 - DNA, 23 bp, synthetic construct
  misc_feature 1..23: note = Synthetic Construct
  source 1..23: mol_type = other DNA
gggagtgaagtgcagtcctgaaa

SEQ ID NO: 27679 - DNA, 25 bp, synthetic construct
  misc_feature 1..25: note = Synthetic Construct
  source 1..25: mol_type = other DNA
ccatatcttctctcaggccctatct

SEQ ID NO: 27680 - DNA, 21 bp, synthetic construct
  misc_feature 1..21: note = Synthetic Construct
  source 1..21: mol_type = other DNA
tgggtgccacgtgtgatggta

SEQ ID NO: 27681 - DNA, 24 bp, synthetic construct
  misc_feature 1..24: note = Synthetic Construct
  source 1..24: mol_type = other DNA
agtggaagagctttgtgtggtaag

SEQ ID NO: 27682 - DNA, 22 bp, synthetic construct
  misc_feature 1..22: note = Synthetic Construct
  source 1..22: mol_type = other DNA
gtggacagccaggaaacagtca

SEQ ID NO: 27683 - DNA, 22 bp, synthetic construct
  misc_feature 1..22: note = Synthetic Construct
  source 1..22: mol_type = other DNA
ctgagaagccgtctgcatccta

SEQ ID NO: 27684 - DNA, 24 bp, synthetic construct
  misc_feature 1..24: note = Synthetic Construct
  source 1..24: mol_type = other DNA
agaggaaaagtatctcgcccaaaa

SEQ ID NO: 27685 - DNA, 22 bp, synthetic construct
  misc_feature 1..22: note = Synthetic Construct
  source 1..22: mol_type = other DNA
tgccccgcaggggaattaaaac

SEQ ID NO: 27686 - DNA, 20 bp, synthetic construct
  misc_feature 1..20: note = Synthetic Construct
  source 1..20: mol_type = other DNA
agggccagggctccaaaatc

SEQ ID NO: 27687 - DNA, 19 bp, synthetic construct
  misc_feature 1..19: note = Synthetic Construct
  source 1..19: mol_type = other DNA
accatgaaggcgccactgt

SEQ ID NO: 27688 - DNA, 18 bp, synthetic construct
  misc_feature 1..18: note = Synthetic Construct
  source 1..18: mol_type = other DNA
ttgcccagtgcgtagcaa

SEQ ID NO: 27689 - DNA, 21 bp, synthetic construct
  misc_feature 1..21: note = Synthetic Construct
  source 1..21: mol_type = other DNA
gaaaagcaggagaggctcact

SEQ ID NO: 27690 - DNA, 22 bp, synthetic construct
  misc_feature 1..22: note = Synthetic Construct
  source 1..22: mol_type = other DNA
cactgcaccccgcttcgattta

SEQ ID NO: 27691 - DNA, 22 bp, synthetic construct
  misc_feature 1..22: note = Synthetic Construct
  source 1..22: mol_type = other DNA
gtggggactgggctctcaaaat

SEQ ID NO: 27692 - DNA, 21 bp, synthetic construct
  misc_feature 1..21: note = Synthetic Construct
  source 1..21: mol_type = other DNA
acctcattcctcctggacaca

SEQ ID NO: 27693 - DNA, 24 bp, synthetic construct
  misc_feature 1..24: note = Synthetic Construct
  source 1..24: mol_type = other DNA
ctgacacacagagggaaaatccta

SEQ ID NO: 27694 - DNA, 22 bp, synthetic construct
  misc_feature 1..22: note = Synthetic Construct
  source 1..22: mol_type = other DNA
gggatgcttagagcaggcagtt

SEQ ID NO: 27695 - DNA, 21 bp, synthetic construct
  misc_feature 1..21: note = Synthetic Construct
  source 1..21: mol_type = other DNA
cttacgcacgtggcagaaatc

SEQ ID NO: 27696 - DNA, 22 bp, synthetic construct
  misc_feature 1..22: note = Synthetic Construct
  source 1..22: mol_type = other DNA
gggcaggtgtgcactgtctaaa

SEQ ID NO: 27697 - DNA, 21 bp, synthetic construct
  misc_feature 1..21: note = Synthetic Construct
  source 1..21: mol_type = other DNA
gggaggtgcagtgcaggaaat

SEQ ID NO: 27698 - DNA, 22 bp, synthetic construct
  misc_feature 1..22: note = Synthetic Construct
  source 1..22: mol_type = other DNA
ctggactttgggttggcacatt

SEQ ID NO: 27699 - DNA, 22 bp, synthetic construct
  misc_feature 1..22: note = Synthetic Construct
  source 1..22: mol_type = other DNA
ctctcctgctcctccaaagcat

SEQ ID NO: 27700 - DNA, 20 bp, synthetic construct
  misc_feature 1..20: note = Synthetic Construct
  source 1..20: mol_type = other DNA
ttcccacccaccaaccagat

SEQ ID NO: 27701 - DNA, 22 bp, synthetic construct
  misc_feature 1..22: note = Synthetic Construct
  source 1..22: mol_type = other DNA
ccaggaatgttccggccgttag

SEQ ID NO: 27702 - DNA, 22 bp, synthetic construct
  misc_feature 1..22: note = Synthetic Construct
  source 1..22: mol_type = other DNA
atgggaaggcctgggaggtaat

SEQ ID NO: 27703 - DNA, 19 bp, synthetic construct
  misc_feature 1..19: note = Synthetic Construct
  source 1..19: mol_type = other DNA
cgccgcaccaggacttgat

SEQ ID NO: 27704 - DNA, 24 bp, synthetic construct
  misc_feature 1..24: note = Synthetic Construct
  source 1..24: mol_type = other DNA
ggtgaagagcagctgaagtgctta

SEQ ID NO: 27705 - DNA, 21 bp, synthetic construct
  misc_feature 1..21: note = Synthetic Construct
  source 1..21: mol_type = other DNA
tggtgggacgtcagccttcta

SEQ ID NO: 27706 - DNA, 23 bp, synthetic construct
  misc_feature 1..23: note = Synthetic Construct
  source 1..23: mol_type = other DNA
gcctgacaggagtttctgtggaa

SEQ ID NO: 27707 - DNA, 22 bp, synthetic construct
  misc_feature 1..22: note = Synthetic Construct
  source 1..22: mol_type = other DNA
ggttgtccaggccagttcacta

SEQ ID NO: 27708 - DNA, 20 bp, synthetic construct
  misc_feature 1..20: note = Synthetic Construct
  source 1..20: mol_type = other DNA
tgttgagggcagggctctaa

SEQ ID NO: 27709 - DNA, 21 bp, synthetic construct
  misc_feature 1..21: note = Synthetic Construct
  source 1..21: mol_type = other DNA
tgaggtggaagccaggtctct

SEQ ID NO: 27710 - DNA, 20 bp, synthetic construct
  misc_feature 1..20: note = Synthetic Construct
  source 1..20: mol_type = other DNA
acctggtcacctgtgtgctt

SEQ ID NO: 27711 - DNA, 21 bp, synthetic construct
  misc_feature 1..21: note = Synthetic Construct
  source 1..21: mol_type = other DNA
agactcccagggacccaaact

SEQ ID NO: 27712 - DNA, 21 bp, synthetic construct
  misc_feature 1..21: note = Synthetic Construct
  source 1..21: mol_type = other DNA
ggcagggctgtcacaatgact

SEQ ID NO: 27713 - DNA, 22 bp, synthetic construct
  misc_feature 1..22: note = Synthetic Construct
  source 1..22: mol_type = other DNA
acacaacttagtgcaggccaaa

SEQ ID NO: 27714 - DNA, 20 bp, synthetic construct
  misc_feature 1..20: note = Synthetic Construct
  source 1..20: mol_type = other DNA
ccaacacccaggcagctgaa

SEQ ID NO: 27715 - DNA, 20 bp, synthetic construct
  misc_feature 1..20: note = Synthetic Construct
  source 1..20: mol_type = other DNA
gctgcctttgcccctgtctt

SEQ ID NO: 27716 - DNA, 20 bp, synthetic construct
  misc_feature 1..20: note = Synthetic Construct
  source 1..20: mol_type = other DNA
tccaccctcgcctctccatt

SEQ ID NO: 27717 - DNA, 25 bp, synthetic construct
  misc_feature 1..25: note = Synthetic Construct
  source 1..25: mol_type = other DNA
gagggctaccagtaagaaccagaga

SEQ ID NO: 27718 - DNA, 19 bp, synthetic construct
  misc_feature 1..19: note = Synthetic Construct
  source 1..19: mol_type = other DNA
cctggggccagacaactga

SEQ ID NO: 27719 - DNA, 21 bp, synthetic construct
  misc_feature 1..21: note = Synthetic Construct
  source 1..21: mol_type = other DNA
cccaaatgcactgagctgtca

SEQ ID NO: 27720 - DNA, 23 bp, synthetic construct
  misc_feature 1..23: note = Synthetic Construct
  source 1..23: mol_type = other DNA
ttcttgggccagtgaagagaaaa

SEQ ID NO: 27721 - DNA, 25 bp, synthetic construct
  misc_feature 1..25: note = Synthetic Construct
  source 1..25: mol_type = other DNA
accagaatcttcacagagtttgtct

SEQ ID NO: 27722 - DNA, 22 bp, synthetic construct
  misc_feature 1..22: note = Synthetic Construct
  source 1..22: mol_type = other DNA
cagtgcaatgctttcaccatgt

SEQ ID NO: 27723 - DNA, 21 bp, synthetic construct
  misc_feature 1..21: note = Synthetic Construct
  source 1..21: mol_type = other DNA
tttctgtgccagctggttttg

SEQ ID NO: 27724 - DNA, 22 bp, synthetic construct
  misc_feature 1..22: note = Synthetic Construct
  source 1..22: mol_type = other DNA
cctccctgaagttgccttctca

SEQ ID NO: 27725 - DNA, 25 bp, synthetic construct
  misc_feature 1..25: note = Synthetic Construct
  source 1..25: mol_type = other DNA
tgaagggattccattttctggcttt

SEQ ID NO: 27726 - DNA, 20 bp, synthetic construct
  misc_feature 1..20: note = Synthetic Construct
  source 1..20: mol_type = other DNA
tcagtccctggccccgtgat

SEQ ID NO: 27727 - DNA, 23 bp, synthetic construct
  misc_feature 1..23: note = Synthetic Construct
  source 1..23: mol_type = other DNA
gcagatctctctaggctttgtgt

SEQ ID NO: 27728 - DNA, 20 bp, synthetic construct
  misc_feature 1..20: note = Synthetic Construct
  source 1..20: mol_type = other DNA
accactctagtgcccctgaa

SEQ ID NO: 27729 - DNA, 18 bp, synthetic construct
  misc_feature 1..18: note = Synthetic Construct
  source 1..18: mol_type = other DNA
gaaggcgagcagcagtca

SEQ ID NO: 27730 - DNA, 20 bp, synthetic construct
  misc_feature 1..20: note = Synthetic Construct
  source 1..20: mol_type = other DNA
acagagcgtccacccgtctt

SEQ ID NO: 27731 - DNA, 21 bp, synthetic construct
  misc_feature 1..21: note = Synthetic Construct
  source 1..21: mol_type = other DNA
ccctgggaagtgacagctcaa

SEQ ID NO: 27732 - DNA, 22 bp, synthetic construct
  misc_feature 1..22: note = Synthetic Construct
  source 1..22: mol_type = other DNA
agagggtgctcaggtgtttaga

SEQ ID NO: 27733 - DNA, 21 bp, synthetic construct
  misc_feature 1..21: note = Synthetic Construct
  source 1..21: mol_type = other DNA
ctcggaactcctgccaagaag

SEQ ID NO: 27734 - DNA, 24 bp, synthetic construct
  misc_feature 1..24: note = Synthetic Construct
  source 1..24: mol_type = other DNA
ctcaggttcaaaatcaggcaggtt

SEQ ID NO: 27735 - DNA, 20 bp, synthetic construct
  misc_feature 1..20: note = Synthetic Construct
  source 1..20: mol_type = other DNA
gctgcctcactgtctgatgt

SEQ ID NO: 27736 - DNA, 20 bp, synthetic construct
  misc_feature 1..20: note = Synthetic Construct
  source 1..20: mol_type = other DNA
ggccctgttcgaagcagttt

SEQ ID NO: 27737 - DNA, 21 bp, synthetic construct
  misc_feature 1..21: note = Synthetic Construct
  source 1..21: mol_type = other DNA
gactgggagctctttgctcat

SEQ ID NO: 27738 - DNA, 19 bp, synthetic construct
  misc_feature 1..19: note = Synthetic Construct
  source 1..19: mol_type = other DNA
agcagtgcggtcgggaaga

SEQ ID NO: 27739 - DNA, 22 bp, synthetic construct
  misc_feature 1..22: note = Synthetic Construct
  source 1..22: mol_type = other DNA
ggaaatggcacactggttctca

SEQ ID NO: 27740 - DNA, 20 bp, synthetic construct
  misc_feature 1..20: note = Synthetic Construct
  source 1..20: mol_type = other DNA
gctgagcgttggaagccatt

SEQ ID NO: 27741 - DNA, 22 bp, synthetic construct
  misc_feature 1..22: note = Synthetic Construct
  source 1..22: mol_type = other DNA
cacccctgacatgtgtggtaca

SEQ ID NO: 27742 - DNA, 23 bp, synthetic construct
  misc_feature 1..23: note = Synthetic Construct
  source 1..23: mol_type = other DNA
ggacaagtagcgatccactgaca

SEQ ID NO: 27743 - DNA, 22 bp, synthetic construct
  misc_feature 1..22: note = Synthetic Construct
  source 1..22: mol_type = other DNA
ttccacctggctcctatctctt

SEQ ID NO: 27744 - DNA, 22 bp, synthetic construct
  misc_feature 1..22: note = Synthetic Construct
  source 1..22: mol_type = other DNA
catgtatcttgcgcagggtttc

SEQ ID NO: 27745 - DNA, 20 bp, synthetic construct
  misc_feature 1..20: note = Synthetic Construct
  source 1..20: mol_type = other DNA
tggggtcctgggagccaaat

SEQ ID NO: 27746 - DNA, 22 bp, synthetic construct
  misc_feature 1..22: note = Synthetic Construct
  source 1..22: mol_type = other DNA
ccggagtggaagggcaacaata

SEQ ID NO: 27747 - DNA, 23 bp, synthetic construct
  misc_feature 1..23: note = Synthetic Construct
  source 1..23: mol_type = other DNA
ctgatgccaaggccgtatatcat

SEQ ID NO: 27748 - DNA, 20 bp, synthetic construct
  misc_feature 1..20: note = Synthetic Construct
  source 1..20: mol_type = other DNA
cagatgcctgctgcttctgt

SEQ ID NO: 27749 - DNA, 23 bp, synthetic construct
  misc_feature 1..23: note = Synthetic Construct
  source 1..23: mol_type = other DNA
gagacagggtttgcaggaaggaa

SEQ ID NO: 27750 - DNA, 24 bp, synthetic construct
  misc_feature 1..24: note = Synthetic Construct
  source 1..24: mol_type = other DNA
ggctggggtcactgtactttcctt

SEQ ID NO: 27751 - DNA, 23 bp, synthetic construct
  misc_feature 1..23: note = Synthetic Construct
  source 1..23: mol_type = other DNA
cttcttccccacagaccacattg

SEQ ID NO: 27752 - DNA, 21 bp, synthetic construct
  misc_feature 1..21: note = Synthetic Construct
  source 1..21: mol_type = other DNA
agctggggaaccaggatgaac

SEQ ID NO: 27753 - DNA, 21 bp, synthetic construct
  misc_feature 1..21: note = Synthetic Construct
  source 1..21: mol_type = other DNA
ggttgtgacaagacgcacaca

SEQ ID NO: 27754 - DNA, 23 bp, synthetic construct
  misc_feature 1..23: note = Synthetic Construct
  source 1..23: mol_type = other DNA
cacttcttagggcttccggtttc

SEQ ID NO: 27755 - DNA, 18 bp, synthetic construct
  misc_feature 1..18: note = Synthetic Construct
  source 1..18: mol_type = other DNA
ccggggcccttcaaacat

SEQ ID NO: 27756 - DNA, 22 bp, synthetic construct
  misc_feature 1..22: note = Synthetic Construct
  source 1..22: mol_type = other DNA
cacccacccttgccaaccataa

SEQ ID NO: 27757 - DNA, 26 bp, synthetic construct
  misc_feature 1..26: note = Synthetic Construct
  source 1..26: mol_type = other DNA
ccaaaatgatggcaagcagctaccta

SEQ ID NO: 27758 - DNA, 20 bp, synthetic construct
  misc_feature 1..20: note = Synthetic Construct
  source 1..20: mol_type = other DNA
gtgctcaccagccacattct

SEQ ID NO: 27759 - DNA, 20 bp, synthetic construct
  misc_feature 1..20: note = Synthetic Construct
  source 1..20: mol_type = other DNA
caacaagtgccaccctcaga

SEQ ID NO: 27760 - DNA, 22 bp, synthetic construct
  misc_feature 1..22: note = Synthetic Construct
  source 1..22: mol_type = other DNA
gcaatggtcatggatggagctt

SEQ ID NO: 27761 - DNA, 20 bp, synthetic construct
  misc_feature 1..20: note = Synthetic Construct
  source 1..20: mol_type = other DNA
gtgcggggcctctgaacata

SEQ ID NO: 27762 - DNA, 22 bp, synthetic construct
  misc_feature 1..22: note = Synthetic Construct
  source 1..22: mol_type = other DNA
gctccaagaccagccataccta

SEQ ID NO: 27763 - DNA, 22 bp, synthetic construct
  misc_feature 1..22: note = Synthetic Construct
  source 1..22: mol_type = other DNA
ctttgctgctaggttgggatca

SEQ ID NO: 27764 - DNA, 19 bp, synthetic construct
  misc_feature 1..19: note = Synthetic Construct
  source 1..19: mol_type = other DNA
agggacagctgcccaggtt

SEQ ID NO: 27765 - DNA, 22 bp, synthetic construct
  misc_feature 1..22: note = Synthetic Construct
  source 1..22: mol_type = other DNA
gcgtgcacagctgagaatcctt

SEQ ID NO: 27766 - DNA, 21 bp, synthetic construct
  misc_feature 1..21: note = Synthetic Construct
  source 1..21: mol_type = other DNA
tcggtccgatggtcccttaga

SEQ ID NO: 27767 - DNA, 23 bp, synthetic construct
  misc_feature 1..23: note = Synthetic Construct
  source 1..23: mol_type = other DNA
cccaggtctgagccacttactct

SEQ ID NO: 27768 - DNA, 22 bp, synthetic construct
  misc_feature 1..22: note = Synthetic Construct
  source 1..22: mol_type = other DNA
gccccatgcctataacctgcta

SEQ ID NO: 27769 - DNA, 23 bp, synthetic construct
  misc_feature 1..23: note = Synthetic Construct
  source 1..23: mol_type = other DNA
ctatgaaggcagggacttctgtt

SEQ ID NO: 27770 - DNA, 23 bp, synthetic construct
  misc_feature 1..23: note = Synthetic Construct
  source 1..23: mol_type = other DNA
gtggtggagggaagagaaacttg

SEQ ID NO: 27771 - DNA, 21 bp, synthetic construct
  misc_feature 1..21: note = Synthetic Construct
  source 1..21: mol_type = other DNA
tcccttggccaactcccttct

SEQ ID NO: 27772 - DNA, 23 bp, synthetic construct
  misc_feature 1..23: note = Synthetic Construct
  source 1..23: mol_type = other DNA
cccctctctgaccatccatatct

SEQ ID NO: 27773 - DNA, 22 bp, synthetic construct
  misc_feature 1..22: note = Synthetic Construct
  source 1..22: mol_type = other DNA
ccttgggctgagtgtggttaag

SEQ ID NO: 27774 - DNA, 22 bp, synthetic construct
  misc_feature 1..22: note = Synthetic Construct
  source 1..22: mol_type = other DNA
aaagattggctgaggcttctgt

SEQ ID NO: 27775 - DNA, 20 bp, synthetic construct
  misc_feature 1..20: note = Synthetic Construct
  source 1..20: mol_type = other DNA
acgttttcctccgtgccaaa

SEQ ID NO: 27776 - DNA, 22 bp, synthetic construct
  misc_feature 1..22: note = Synthetic Construct
  source 1..22: mol_type = other DNA
cagagcacatgacccaaagact

SEQ ID NO: 27777 - DNA, 23 bp, synthetic construct
  misc_feature 1..23: note = Synthetic Construct
  source 1..23: mol_type = other DNA
tcatcatggtgggtctctgagta

SEQ ID NO: 27778 - DNA, 23 bp, synthetic construct
  misc_feature 1..23: note = Synthetic Construct
  source 1..23: mol_type = other DNA
caaatacagccccaggttactgt

SEQ ID NO: 27779 - DNA, 26 bp, synthetic construct
  misc_feature 1..26: note = Synthetic Construct
  source 1..26: mol_type = other DNA
gcacaaaggttcatggacaggaaaga

SEQ ID NO: 27780 - DNA, 23 bp, synthetic construct
  misc_feature 1..23: note = Synthetic Construct
  source 1..23: mol_type = other DNA
ccagccaggcagtcatagacaga

SEQ ID NO: 27781 - DNA, 22 bp, synthetic construct
  misc_feature 1..22: note = Synthetic Construct
  source 1..22: mol_type = other DNA
taggggacggggacagttgtag

SEQ ID NO: 27782 - DNA, 23 bp, synthetic construct
  misc_feature 1..23: note = Synthetic Construct
  source 1..23: mol_type = other DNA
gcatgctcacgtcaaactcgata

SEQ ID NO: 27783 - DNA, 24 bp, synthetic construct
  misc_feature 1..24: note = Synthetic Construct
  source 1..24: mol_type = other DNA
tgaggccaaagaggaaatgattct

SEQ ID NO: 27784 - DNA, 22 bp, synthetic construct
  misc_feature 1..22: note = Synthetic Construct
  source 1..22: mol_type = other DNA
gctgctccatcttgtccagaac

SEQ ID NO: 27785 - DNA, 23 bp, synthetic construct
  misc_feature 1..23: note = Synthetic Construct
  source 1..23: mol_type = other DNA
tggatgcacacatgcaagaaaga

SEQ ID NO: 27786 - DNA, 21 bp, synthetic construct
  misc_feature 1..21: note = Synthetic Construct
  source 1..21: mol_type = other DNA
ggcagaggacaggctaaaact

SEQ ID NO: 27787 - DNA, 21 bp, synthetic construct
  misc_feature 1..21: note = Synthetic Construct
  source 1..21: mol_type = other DNA
ccccaaccagggatgttgctt

SEQ ID NO: 27788 - DNA, 23 bp, synthetic construct
  misc_feature 1..23: note = Synthetic Construct
  source 1..23: mol_type = other DNA
aggagttcttcccactctgttgt

SEQ ID NO: 27789 - DNA, 24 bp, synthetic construct
  misc_feature 1..24: note = Synthetic Construct
  source 1..24: mol_type = other DNA
agctgtgtccctccataaagaaag

SEQ ID NO: 27790 - DNA, 20 bp, synthetic construct
  misc_feature 1..20: note = Synthetic Construct
  source 1..20: mol_type = other DNA
aggcaccagtgcaagtcaag

SEQ ID NO: 27791 - DNA, 25 bp, synthetic construct
  misc_feature 1..25: note = Synthetic Construct
  source 1..25: mol_type = other DNA
ctctcaattgctctcgaacttgttg

SEQ ID NO: 27792 - DNA, 22 bp, synthetic construct
  misc_feature 1..22: note = Synthetic Construct
  source 1..22: mol_type = other DNA
cctccttgcggtggagaaatga

SEQ ID NO: 27793 - DNA, 22 bp, synthetic construct
  misc_feature 1..22: note = Synthetic Construct
  source 1..22: mol_type = other DNA
ccctggaccctgctgattgttt

SEQ ID NO: 27794 - DNA, 22 bp, synthetic construct
  misc_feature 1..22: note = Synthetic Construct
  source 1..22: mol_type = other DNA
ggcccagacattgaaggcatag

SEQ ID NO: 27795 - DNA, 22 bp, synthetic construct
  misc_feature 1..22: note = Synthetic Construct
  source 1..22: mol_type = other DNA
aggcctgcatctgatggtatct

SEQ ID NO: 27796 - DNA, 21 bp, synthetic construct
  misc_feature 1..21: note = Synthetic Construct
  source 1..21: mol_type = other DNA
aggagggctgtgtccttgaga

SEQ ID NO: 27797 - DNA, 25 bp, synthetic construct
  misc_feature 1..25: note = Synthetic Construct
  source 1..25: mol_type = other DNA
gccaagaattagaccttgcatcctt

SEQ ID NO: 27798 - DNA, 20 bp, synthetic construct
  misc_feature 1..20: note = Synthetic Construct
  source 1..20: mol_type = other DNA
gcctcctgcctttccctctt

SEQ ID NO: 27799 - DNA, 24 bp, synthetic construct
  misc_feature 1..24: note = Synthetic Construct
  source 1..24: mol_type = other DNA
ccagcagccgaatgagattggata

SEQ ID NO: 27800 - DNA, 22 bp, synthetic construct
  misc_feature 1..22: note = Synthetic Construct
  source 1..22: mol_type = other DNA
tcagtaccgagaggcgatggaa

SEQ ID NO: 27801 - DNA, 21 bp, synthetic construct
  misc_feature 1..21: note = Synthetic Construct
  source 1..21: mol_type = other DNA
atctctggcctaggtggttca

SEQ ID NO: 27802 - DNA, 26 bp, synthetic construct
  misc_feature 1..26: note = Synthetic Construct
  source 1..26: mol_type = other DNA
ctctggcagaagtgtgaagaagtaat

SEQ ID NO: 27803 - DNA, 20 bp, synthetic construct
  misc_feature 1..20: note = Synthetic Construct
  source 1..20: mol_type = other DNA
ttgggccctctggctctaaa

SEQ ID NO: 27804 - DNA, 22 bp, synthetic construct
  misc_feature 1..22: note = Synthetic Construct
  source 1..22: mol_type = other DNA
cgcacatgttggtgacaacttt

SEQ ID NO: 27805 - DNA, 22 bp, synthetic construct
  misc_feature 1..22: note = Synthetic Construct
  source 1..22: mol_type = other DNA
gggagtagctggaatgggtgat

SEQ ID NO: 27806 - DNA, 19 bp, synthetic construct
  misc_feature 1..19: note = Synthetic Construct
  source 1..19: mol_type = other DNA
ttgccctcaggccttctca

SEQ ID NO: 27807 - DNA, 23 bp, synthetic construct
  misc_feature 1..23: note = Synthetic Construct
  source 1..23: mol_type = other DNA
ccaaccggagagcaaaagggaaa

SEQ ID NO: 27808 - DNA, 21 bp, synthetic construct
  misc_feature 1..21: note = Synthetic Construct
  source 1..21: mol_type = other DNA
cgtgacggtgtgggtttccaa

SEQ ID NO: 27809 - DNA, 20 bp, synthetic construct
  misc_feature 1..20: note = Synthetic Construct
  source 1..20: mol_type = other DNA
tcccgggcttccagaacaac

SEQ ID NO: 27810 - DNA, 23 bp, synthetic construct
  misc_feature 1..23: note = Synthetic Construct
  source 1..23: mol_type = other DNA
ctcagcagagaggaggccttaga

SEQ ID NO: 27811 - DNA, 22 bp, synthetic construct
  misc_feature 1..22: note = Synthetic Construct
  source 1..22: mol_type = other DNA
caggcctgtggtgggtttttgt

SEQ ID NO: 27812 - DNA, 22 bp, synthetic construct
  misc_feature 1..22: note = Synthetic Construct
  source 1..22: mol_type = other DNA
ccatggctcccattctgcatgt

SEQ ID NO: 27813 - DNA, 20 bp, synthetic construct
  misc_feature 1..20: note = Synthetic Construct
  source 1..20: mol_type = other DNA
aggcaggcgtagggcagtta

SEQ ID NO: 27814 - DNA, 20 bp, synthetic construct
  misc_feature 1..20: note = Synthetic Construct
  source 1..20: mol_type = other DNA
ctcccctctcacccatgctt

SEQ ID NO: 27815 - DNA, 20 bp, synthetic construct
  misc_feature 1..20: note = Synthetic Construct
  source 1..20: mol_type = other DNA
acccagttcagagcctcctt

SEQ ID NO: 27816 - DNA, 25 bp, synthetic construct
  misc_feature 1..25: note = Synthetic Construct
  source 1..25: mol_type = other DNA
tttctatagactttcgccagtggaa

SEQ ID NO: 27817 - DNA, 21 bp, synthetic construct
  misc_feature 1..21: note = Synthetic Construct
  source 1..21: mol_type = other DNA
gcagatgggtgtggagagcaa

SEQ ID NO: 27818 - DNA, 24 bp, synthetic construct
  misc_feature 1..24: note = Synthetic Construct
  source 1..24: mol_type = other DNA
gactcatgcctgtatcctcagcta

SEQ ID NO: 27819 - DNA, 20 bp, synthetic construct
  misc_feature 1..20: note = Synthetic Construct
  source 1..20: mol_type = other DNA
caacttgtgggtgcgggtat

SEQ ID NO: 27820 - DNA, 21 bp, synthetic construct
  misc_feature 1..21: note = Synthetic Construct
  source 1..21: mol_type = other DNA
gaaggctggaaccatcgaagt

SEQ ID NO: 27821 - DNA, 21 bp, synthetic construct
  misc_feature 1..21: note = Synthetic Construct
  source 1..21: mol_type = other DNA
cttgttccaacgggtcagcat

SEQ ID NO: 27822 - DNA, 21 bp, synthetic construct
  misc_feature 1..21: note = Synthetic Construct
  source 1..21: mol_type = other DNA
tgggtgctggagaccttgtca

SEQ ID NO: 27823 - DNA, 19 bp, synthetic construct
  misc_feature 1..19: note = Synthetic Construct
  source 1..19: mol_type = other DNA
ggctcctgggaagcacctt

SEQ ID NO: 27824 - DNA, 22 bp, synthetic construct
  misc_feature 1..22: note = Synthetic Construct
  source 1..22: mol_type = other DNA
gcttcaggccagcttcagtagt

SEQ ID NO: 27825 - DNA, 20 bp, synthetic construct
  misc_feature 1..20: note = Synthetic Construct
  source 1..20: mol_type = other DNA
ccaggttccaggcacgactt

SEQ ID NO: 27826 - DNA, 20 bp, synthetic construct
  misc_feature 1..20: note = Synthetic Construct
  source 1..20: mol_type = other DNA
accagcagccagaggagtca

SEQ ID NO: 27827 - DNA, 21 bp, synthetic construct
  misc_feature 1..21: note = Synthetic Construct
  source 1..21: mol_type = other DNA
ggctctcccaccccagtttac

SEQ ID NO: 27828 - DNA, 21 bp, synthetic construct
  misc_feature 1..21: note = Synthetic Construct
  source 1..21: mol_type = other DNA
tcactggctgagggagagaca

SEQ ID NO: 27829 - DNA, 24 bp, synthetic construct
  misc_feature 1..24: note = Synthetic Construct
  source 1..24: mol_type = other DNA
aagaatccctgaggcagtaacatc

SEQ ID NO: 27830 - DNA, 22 bp, synthetic construct
  misc_feature 1..22: note = Synthetic Construct
  source 1..22: mol_type = other DNA
ccttctgcctatgtgcagttct

SEQ ID NO: 27831 - DNA, 21 bp, synthetic construct
  misc_feature 1..21: note = Synthetic Construct
  source 1..21: mol_type = other DNA
ccacccagctctccttcactt

SEQ ID NO: 27832 - DNA, 20 bp, synthetic construct
  misc_feature 1..20: note = Synthetic Construct
  source 1..20: mol_type = other DNA
gccagccactgtgccactat

SEQ ID NO: 27833 - DNA, 20 bp, synthetic construct
  misc_feature 1..20: note = Synthetic Construct
  source 1..20: mol_type = other DNA
gcacccaagccacaagacaa

SEQ ID NO: 27834 - DNA, 21 bp, synthetic construct
  misc_feature 1..21: note = Synthetic Construct
  source 1..21: mol_type = other DNA
tggcacaggcatctggtgtag

SEQ ID NO: 27835 - DNA, 20 bp, synthetic construct
  misc_feature 1..20: note = Synthetic Construct
  source 1..20: mol_type = other DNA
tcctctgggtgccaaacagt

SEQ ID NO: 27836 - DNA, 22 bp, synthetic construct
  misc_feature 1..22: note = Synthetic Construct
  source 1..22: mol_type = other DNA
gccctcggggaagaaatcaaga

SEQ ID NO: 27837 - DNA, 23 bp, synthetic construct
  misc_feature 1..23: note = Synthetic Construct
  source 1..23: mol_type = other DNA
cggggtgacattattgcctaagt

SEQ ID NO: 27838 - DNA, 21 bp, synthetic construct
  misc_feature 1..21: note = Synthetic Construct
  source 1..21: mol_type = other DNA
gcatgctggctgctgacatag

SEQ ID NO: 27839 - DNA, 22 bp, synthetic construct
  misc_feature 1..22: note = Synthetic Construct
  source 1..22: mol_type = other DNA
gtgcacaggcctcctggattta

SEQ ID NO: 27840 - DNA, 19 bp, synthetic construct
  misc_feature 1..19: note = Synthetic Construct
  source 1..19: mol_type = other DNA
cggcaggcaggatgggaat

SEQ ID NO: 27841 - DNA, 21 bp, synthetic construct
  misc_feature 1..21: note = Synthetic Construct
  source 1..21: mol_type = other DNA
ttggcaggtggctgccattga

SEQ ID NO: 27842 - DNA, 20 bp, synthetic construct
  misc_feature 1..20: note = Synthetic Construct
  source 1..20: mol_type = other DNA
agccatcatgcccagtgcaa

SEQ ID NO: 27843 - DNA, 27 bp, synthetic construct
  misc_feature 1..27: note = Synthetic Construct
  source 1..27: mol_type = other DNA
gtctcaagagactcatatgccctggat

SEQ ID NO: 27844 - DNA, 22 bp, synthetic construct
  misc_feature 1..22: note = Synthetic Construct
  source 1..22: mol_type = other DNA
ggcctgaattcacacaggcatt

SEQ ID NO: 27845 - DNA, 20 bp, synthetic construct
  misc_feature 1..20: note = Synthetic Construct
  source 1..20: mol_type = other DNA
cagtggcccaccaacctcat

SEQ ID NO: 27846 - DNA, 23 bp, synthetic construct
  misc_feature 1..23: note = Synthetic Construct
  source 1..23: mol_type = other DNA
ccaaaaggcatggggtagggatt

SEQ ID NO: 27847 - DNA, 22 bp, synthetic construct
  misc_feature 1..22: note = Synthetic Construct
  source 1..22: mol_type = other DNA
tcccctggctgctctgagaaat

SEQ ID NO: 27848 - DNA, 20 bp, synthetic construct
  misc_feature 1..20: note = Synthetic Construct
  source 1..20: mol_type = other DNA
atgcgcttggtcccttcctt

SEQ ID NO: 27849 - DNA, 19 bp, synthetic construct
  misc_feature 1..19: note = Synthetic Construct
  source 1..19: mol_type = other DNA
tgggccatccacagctttc

SEQ ID NO: 27850 - DNA, 21 bp, synthetic construct
  misc_feature 1..21: note = Synthetic Construct
  source 1..21: mol_type = other DNA
ggccggaaggagaccagacta

SEQ ID NO: 27851 - DNA, 20 bp, synthetic construct
  misc_feature 1..20: note = Synthetic Construct
  source 1..20: mol_type = other DNA
ttttgccccagctggactct

SEQ ID NO: 27852 - DNA, 22 bp, synthetic construct
  misc_feature 1..22: note = Synthetic Construct
  source 1..22: mol_type = other DNA
tggctggcatcagccagatttc

SEQ ID NO: 27853 - DNA, 23 bp, synthetic construct
  misc_feature 1..23: note = Synthetic Construct
  source 1..23: mol_type = other DNA
cctgtcctgacaccatccagtaa

SEQ ID NO: 27854 - DNA, 24 bp, synthetic construct
  misc_feature 1..24: note = Synthetic Construct
  source 1..24: mol_type = other DNA
catcagagcagagaagcagttgat

SEQ ID NO: 27855 - DNA, 24 bp, synthetic construct
  misc_feature 1..24: note = Synthetic Construct
  source 1..24: mol_type = other DNA
cacagtgttgatggcattgtctct

SEQ ID NO: 27856 - DNA, 21 bp, synthetic construct
  misc_feature 1..21: note = Synthetic Construct
  source 1..21: mol_type = other DNA
gcccatgcctcttctgcttgt

SEQ ID NO: 27857 - DNA, 21 bp, synthetic construct
  misc_feature 1..21: note = Synthetic Construct
  source 1..21: mol_type = other DNA
tgagccagcccagagttcagt

SEQ ID NO: 27858 - DNA, 20 bp, synthetic construct
  misc_feature 1..20: note = Synthetic Construct
  source 1..20: mol_type = other DNA
tttggcgccaggagtagctt

SEQ ID NO: 27859 - DNA, 19 bp, synthetic construct
  misc_feature 1..19: note = Synthetic Construct
  source 1..19: mol_type = other DNA
tgccctgctcagcctcatt

SEQ ID NO: 27860 - DNA, 20 bp, synthetic construct
  misc_feature 1..20: note = Synthetic Construct
  source 1..20: mol_type = other DNA
gcaacagacaccagcacatc

SEQ ID NO: 27861 - DNA, 26 bp, synthetic construct
  misc_feature 1..26: note = Synthetic Construct
  source 1..26: mol_type = other DNA
ggactaaaagagagatccaggctaac

SEQ ID NO: 27862 - DNA, 21 bp, synthetic construct
  misc_feature 1..21: note = Synthetic Construct
  source 1..21: mol_type = other DNA
gcccaggcacctccactcata

SEQ ID NO: 27863 - DNA, 20 bp, synthetic construct
  misc_feature 1..20: note = Synthetic Construct
  source 1..20: mol_type = other DNA
tgccgtcagccctggaaaaa

SEQ ID NO: 27864 - DNA, 19 bp, synthetic construct
  misc_feature 1..19: note = Synthetic Construct
  source 1..19: mol_type = other DNA
gctggccggaactcagctt

SEQ ID NO: 27865 - DNA, 21 bp, synthetic construct
  misc_feature 1..21: note = Synthetic Construct
  source 1..21: mol_type = other DNA
gaggagggccagagcaatatc

SEQ ID NO: 27866 - DNA, 24 bp, synthetic construct
  misc_feature 1..24: note = Synthetic Construct
  source 1..24: mol_type = other DNA
aggcaaacaacctcaccatttagt

SEQ ID NO: 27867 - DNA, 20 bp, synthetic construct
  misc_feature 1..20: note = Synthetic Construct
  source 1..20: mol_type = other DNA
gctttgggaggtgtggcata

SEQ ID NO: 27868 - DNA, 20 bp, synthetic construct
  misc_feature 1..20: note = Synthetic Construct
  source 1..20: mol_type = other DNA
tgggtaggcccacagcatct

SEQ ID NO: 27869 - DNA, 22 bp, synthetic construct
  misc_feature 1..22: note = Synthetic Construct
  source 1..22: mol_type = other DNA
gccaggaaagggacatcaaagt

SEQ ID NO: 27870 - DNA, 20 bp, synthetic construct
  misc_feature 1..20: note = Synthetic Construct
  source 1..20: mol_type = other DNA
cagaagcggcatgccttgat

SEQ ID NO: 27871 - DNA, 19 bp, synthetic construct
  misc_feature 1..19: note = Synthetic Construct
  source 1..19: mol_type = other DNA
agcacccagccctcacact

SEQ ID NO: 27872 - DNA, 23 bp, synthetic construct
  misc_feature 1..23: note = Synthetic Construct
  source 1..23: mol_type = other DNA
catgtgctacccatggtgttact

SEQ ID NO: 27873 - DNA, 23 bp, synthetic construct
  misc_feature 1..23: note = Synthetic Construct
  source 1..23: mol_type = other DNA
ggctgcctataaccaagcaatca

SEQ ID NO: 27874 - DNA, 22 bp, synthetic construct
  misc_feature 1..22: note = Synthetic Construct
  source 1..22: mol_type = other DNA
ctggccggcaccactcttttat

SEQ ID NO: 27875 - DNA, 21 bp, synthetic construct
  misc_feature 1..21: note = Synthetic Construct
  source 1..21: mol_type = other DNA
ggggtccagctgaacttctga

SEQ ID NO: 27876 - DNA, 21 bp, synthetic construct
  misc_feature 1..21: note = Synthetic Construct
  source 1..21: mol_type = other DNA
gtgaaacctgctggagggatt

SEQ ID NO: 27877 - DNA, 24 bp, synthetic construct
  misc_feature 1..24: note = Synthetic Construct
  source 1..24: mol_type = other DNA
gctttgtccctggctcaaaacctt

SEQ ID NO: 27878 - DNA, 23 bp, synthetic construct
  misc_feature 1..23: note = Synthetic Construct
  source 1..23: mol_type = other DNA
ccatatatcccagccaggctctt

SEQ ID NO: 27879 - DNA, 23 bp, synthetic construct
  misc_feature 1..23: note = Synthetic Construct
  source 1..23: mol_type = other DNA
cctgtgtccttttgcaaatcagt

SEQ ID NO: 27880 - DNA, 20 bp, synthetic construct
  misc_feature 1..20: note = Synthetic Construct
  source 1..20: mol_type = other DNA
ggggcctccaaaaacacaac

SEQ ID NO: 27881 - DNA, 28 bp, synthetic construct
  misc_feature 1..28: note = Synthetic Construct
  source 1..28: mol_type = other DNA
cctcaggatgacagtgaatacaactgaa

SEQ ID NO: 27882 - DNA, 21 bp, synthetic construct
  misc_feature 1..21: note = Synthetic Construct
  source 1..21: mol_type = other DNA
tcctcttgctgcagtgtgatt

SEQ ID NO: 27883 - DNA, 22 bp, synthetic construct
  misc_feature 1..22: note = Synthetic Construct
  source 1..22: mol_type = other DNA
cttctaagcccaccccaacact

SEQ ID NO: 27884 - DNA, 24 bp, synthetic construct
  misc_feature 1..24: note = Synthetic Construct
  source 1..24: mol_type = other DNA
ctgtgttagcagggatcaggtcta

SEQ ID NO: 27885 - DNA, 19 bp, synthetic construct
  misc_feature 1..19: note = Synthetic Construct
  source 1..19: mol_type = other DNA
agcgctggcaggcaggaat

SEQ ID NO: 27886 - DNA, 24 bp, synthetic construct
  misc_feature 1..24: note = Synthetic Construct
  source 1..24: mol_type = other DNA
actgaaaatagctcaggtgcaaca

SEQ ID NO: 27887 - DNA, 25 bp, synthetic construct
  misc_feature 1..25: note = Synthetic Construct
  source 1..25: mol_type = other DNA
cagtaggactcttaggcctgtggtt

SEQ ID NO: 27888 - DNA, 22 bp, synthetic construct
  misc_feature 1..22: note = Synthetic Construct
  source 1..22: mol_type = other DNA
ggaggaggctggtgttcataag

SEQ ID NO: 27889 - DNA, 20 bp, synthetic construct
  misc_feature 1..20: note = Synthetic Construct
  source 1..20: mol_type = other DNA
gtggccacagcagtgatgat

SEQ ID NO: 27890 - DNA, 21 bp, synthetic construct
  misc_feature 1..21: note = Synthetic Construct
  source 1..21: mol_type = other DNA
tcttgccctcctcatggctaa

SEQ ID NO: 27891 - DNA, 23 bp, synthetic construct
  misc_feature 1..23: note = Synthetic Construct
  source 1..23: mol_type = other DNA
gtcccctcactgttcctggaatg

SEQ ID NO: 27892 - DNA, 23 bp, synthetic construct
  misc_feature 1..23: note = Synthetic Construct
  source 1..23: mol_type = other DNA
gtcccagtggcatgagaaagttg

SEQ ID NO: 27893 - DNA, 22 bp, synthetic construct
  misc_feature 1..22: note = Synthetic Construct
  source 1..22: mol_type = other DNA
agggcagaccaggagaagtgtt

SEQ ID NO: 27894 - DNA, 23 bp, synthetic construct
  misc_feature 1..23: note = Synthetic Construct
  source 1..23: mol_type = other DNA
tgtggtattgagactggcctgat

SEQ ID NO: 27895 - DNA, 20 bp, synthetic construct
  misc_feature 1..20: note = Synthetic Construct
  source 1..20: mol_type = other DNA
aagaggcaccactcctcctt

SEQ ID NO: 27896 - DNA, 22 bp, synthetic construct
  misc_feature 1..22: note = Synthetic Construct
  source 1..22: mol_type = other DNA
tgggatggcagcctgagttgta

SEQ ID NO: 27897 - DNA, 21 bp, synthetic construct
  misc_feature 1..21: note = Synthetic Construct
  source 1..21: mol_type = other DNA
acccctcccctcctgaaatct

SEQ ID NO: 27898 - DNA, 19 bp, synthetic construct
  misc_feature 1..19: note = Synthetic Construct
  source 1..19: mol_type = other DNA
cacctgatccggccagctt

SEQ ID NO: 27899 - DNA, 20 bp, synthetic construct
  misc_feature 1..20: note = Synthetic Construct
  source 1..20: mol_type = other DNA
ttctgcaccctaccctgtct

SEQ ID NO: 27900 - DNA, 22 bp, synthetic construct
  misc_feature 1..22: note = Synthetic Construct
  source 1..22: mol_type = other DNA
ctcccaccccacacacatttca

SEQ ID NO: 27901 - DNA, 20 bp, synthetic construct
  misc_feature 1..20: note = Synthetic Construct
  source 1..20: mol_type = other DNA
agcgggaagctcctactcaa

SEQ ID NO: 27902 - DNA, 25 bp, synthetic construct
  misc_feature 1..25: note = Synthetic Construct
  source 1..25: mol_type = other DNA
gaggcagtttaacaagcacttgact

SEQ ID NO: 27903 - DNA, 20 bp, synthetic construct
  misc_feature 1..20: note = Synthetic Construct
  source 1..20: mol_type = other DNA
cctccccgcatcctttctca

SEQ ID NO: 27904 - DNA, 22 bp, synthetic construct
  misc_feature 1..22: note = Synthetic Construct
  source 1..22: mol_type = other DNA
aggacaaccagaggtcactctt

SEQ ID NO: 27905 - DNA, 23 bp, synthetic construct
  misc_feature 1..23: note = Synthetic Construct
  source 1..23: mol_type = other DNA
cactccctgccagcaaaacattg

SEQ ID NO: 27906 - DNA, 19 bp, synthetic construct
  misc_feature 1..19: note = Synthetic Construct
  source 1..19: mol_type = other DNA
tgcgggcactcggaaacat

SEQ ID NO: 27907 - DNA, 24 bp, synthetic construct
  misc_feature 1..24: note = Synthetic Construct
  source 1..24: mol_type = other DNA
ggatgaacagcagtctcagtggtt

SEQ ID NO: 27908 - DNA, 19 bp, synthetic construct
  misc_feature 1..19: note = Synthetic Construct
  source 1..19: mol_type = other DNA
gaggctgctctcccagtca

SEQ ID NO: 27909 - DNA, 20 bp, synthetic construct
  misc_feature 1..20: note = Synthetic Construct
  source 1..20: mol_type = other DNA
atgggagcccgggttgtaag

SEQ ID NO: 27910 - DNA, 21 bp, synthetic construct
  misc_feature 1..21: note = Synthetic Construct
  source 1..21: mol_type = other DNA
gccaggccacacaacatgata

SEQ ID NO: 27911 - DNA, 21 bp, synthetic construct
  misc_feature 1..21: note = Synthetic Construct
  source 1..21: mol_type = other DNA
cgcaacagagcagtcacatct

SEQ ID NO: 27912 - DNA, 21 bp, synthetic construct
  misc_feature 1..21: note = Synthetic Construct
  source 1..21: mol_type = other DNA
gcctttggacgcgaggagtaa

SEQ ID NO: 27913 - DNA, 21 bp, synthetic construct
  misc_feature 1..21: note = Synthetic Construct
  source 1..21: mol_type = other DNA
tcttgctctcacaaggccaaa

SEQ ID NO: 27914 - DNA, 22 bp, synthetic construct
  misc_feature 1..22: note = Synthetic Construct
  source 1..22: mol_type = other DNA
cacacatgcaccagctcaaaca

SEQ ID NO: 27915 - DNA, 20 bp, synthetic construct
  misc_feature 1..20: note = Synthetic Construct
  source 1..20: mol_type = other DNA
agccaacagcctacccaaac

SEQ ID NO: 27916 - DNA, 22 bp, synthetic construct
  misc_feature 1..22: note = Synthetic Construct
  source 1..22: mol_type = other DNA
acacacctgtggtccaagtatc

SEQ ID NO: 27917 - DNA, 22 bp, synthetic construct
  misc_feature 1..22: note = Synthetic Construct
  source 1..22: mol_type = other DNA
gtgccattccctttcccagttt

SEQ ID NO: 27918 - DNA, 20 bp, synthetic construct
  misc_feature 1..20: note = Synthetic Construct
  source 1..20: mol_type = other DNA
aggccatcagcctgggaaga

SEQ ID NO: 27919 - DNA, 27 bp, synthetic construct
  misc_feature 1..27: note = Synthetic Construct
  source 1..27: mol_type = other DNA
gtctatgaatgcctcacaaccagatag

SEQ ID NO: 27920 - DNA, 22 bp, synthetic construct
  misc_feature 1..22: note = Synthetic Construct
  source 1..22: mol_type = other DNA
ttgtggaaagccctgaaagtct

SEQ ID NO: 27921 - DNA, 20 bp, synthetic construct
  misc_feature 1..20: note = Synthetic Construct
  source 1..20: mol_type = other DNA
actgcagcgcctgtaagttg

SEQ ID NO: 27922 - DNA, 22 bp, synthetic construct
  misc_feature 1..22: note = Synthetic Construct
  source 1..22: mol_type = other DNA
cggagggactcctcacactaac

SEQ ID NO: 27923 - DNA, 23 bp, synthetic construct
  misc_feature 1..23: note = Synthetic Construct
  source 1..23: mol_type = other DNA
agatgccgttattggtggaagaa

SEQ ID NO: 27924 - DNA, 22 bp, synthetic construct
  misc_feature 1..22: note = Synthetic Construct
  source 1..22: mol_type = other DNA
atgggccaggcactctgctatc

SEQ ID NO: 27925 - DNA, 21 bp, synthetic construct
  misc_feature 1..21: note = Synthetic Construct
  source 1..21: mol_type = other DNA
gcactggacgactgctggttt

SEQ ID NO: 27926 - DNA, 21 bp, synthetic construct
  misc_feature 1..21: note = Synthetic Construct
  source 1..21: mol_type = other DNA
ggctcctggcttttggcttct

SEQ ID NO: 27927 - DNA, 21 bp, synthetic construct
  misc_feature 1..21: note = Synthetic Construct
  source 1..21: mol_type = other DNA
ggctcaagggcaagcatgttc

SEQ ID NO: 27928 - DNA, 20 bp, synthetic construct
  misc_feature 1..20: note = Synthetic Construct
  source 1..20: mol_type = other DNA
cagagggcacgggtgtttgt

SEQ ID NO: 27929 - DNA, 24 bp, synthetic construct
  misc_feature 1..24: note = Synthetic Construct
  source 1..24: mol_type = other DNA
gagccaattagcagtgagagaaca

SEQ ID NO: 27930 - DNA, 23 bp, synthetic construct
  misc_feature 1..23: note = Synthetic Construct
  source 1..23: mol_type = other DNA
cccatccacaggtcactgaggta

SEQ ID NO: 27931 - DNA, 22 bp, synthetic construct
  misc_feature 1..22: note = Synthetic Construct
  source 1..22: mol_type = other DNA
ggagggccactgtttaccgaat

SEQ ID NO: 27932 - DNA, 22 bp, synthetic construct
  misc_feature 1..22: note = Synthetic Construct
  source 1..22: mol_type = other DNA
acactgcctagcacatgaaaga

SEQ ID NO: 27933 - DNA, 21 bp, synthetic construct
  misc_feature 1..21: note = Synthetic Construct
  source 1..21: mol_type = other DNA
ctggtcaggcaaggagaaagt

SEQ ID NO: 27934 - DNA, 24 bp, synthetic construct
  misc_feature 1..24: note = Synthetic Construct
  source 1..24: mol_type = other DNA
gccaagtggaaacaggatatgaga

SEQ ID NO: 27935 - DNA, 21 bp, synthetic construct
  misc_feature 1..21: note = Synthetic Construct
  source 1..21: mol_type = other DNA
ccctgcagctcacacagcaat

SEQ ID NO: 27936 - DNA, 22 bp, synthetic construct
  misc_feature 1..22: note = Synthetic Construct
  source 1..22: mol_type = other DNA
ggcatacacccacaccatccaa

SEQ ID NO: 27937 - DNA, 24 bp, synthetic construct
  misc_feature 1..24: note = Synthetic Construct
  source 1..24: mol_type = other DNA
cccataccaactccatctcctatg

SEQ ID NO: 27938 - DNA, 19 bp, synthetic construct
  misc_feature 1..19: note = Synthetic Construct
  source 1..19: mol_type = other DNA
gcgaacacccgtccttcat

SEQ ID NO: 27939 - DNA, 19 bp, synthetic construct
  misc_feature 1..19: note = Synthetic Construct
  source 1..19: mol_type = other DNA
cctgcccggttggatgtca

SEQ ID NO: 27940 - DNA, 22 bp, synthetic construct
  misc_feature 1..22: note = Synthetic Construct
  source 1..22: mol_type = other DNA
gatctggggacgaggtcctaaa

SEQ ID NO: 27941 - DNA, 19 bp, synthetic construct
  misc_feature 1..19: note = Synthetic Construct
  source 1..19: mol_type = other DNA
tcccatggccgggattcat

SEQ ID NO: 27942 - DNA, 18 bp, synthetic construct
  misc_feature 1..18: note = Synthetic Construct
  source 1..18: mol_type = other DNA
cgcgcacacatgcacaca

SEQ ID NO: 27943 - DNA, 23 bp, synthetic construct
  misc_feature 1..23: note = Synthetic Construct
  source 1..23: mol_type = other DNA
gacctgacttgccatctggagaa

SEQ ID NO: 27944 - DNA, 24 bp, synthetic construct
  misc_feature 1..24: note = Synthetic Construct
  source 1..24: mol_type = other DNA
ctcagcctcctacttctgcttttg

SEQ ID NO: 27945 - DNA, 20 bp, synthetic construct
  misc_feature 1..20: note = Synthetic Construct
  source 1..20: mol_type = other DNA
gctgggcttaagaggctgaa

SEQ ID NO: 27946 - DNA, 22 bp, synthetic construct
  misc_feature 1..22: note = Synthetic Construct
  source 1..22: mol_type = other DNA
cagaggcaggtcatctggtgta

SEQ ID NO: 27947 - DNA, 25 bp, synthetic construct
  misc_feature 1..25: note = Synthetic Construct
  source 1..25: mol_type = other DNA
gggcaaaatgtgtagacggcactac

SEQ ID NO: 27948 - DNA, 20 bp, synthetic construct
  misc_feature 1..20: note = Synthetic Construct
  source 1..20: mol_type = other DNA
tgtgggaccagggtttctct

SEQ ID NO: 27949 - DNA, 23 bp, synthetic construct
  misc_feature 1..23: note = Synthetic Construct
  source 1..23: mol_type = other DNA
gcagcacctcgcatgtaacaaac

SEQ ID NO: 27950 - DNA, 24 bp, synthetic construct
  misc_feature 1..24: note = Synthetic Construct
  source 1..24: mol_type = other DNA
gtcataagccattgtctgctctgt

SEQ ID NO: 27951 - DNA, 23 bp, synthetic construct
  misc_feature 1..23: note = Synthetic Construct
  source 1..23: mol_type = other DNA
gctactcctctgggatgtagagt

SEQ ID NO: 27952 - DNA, 26 bp, synthetic construct
  misc_feature 1..26: note = Synthetic Construct
  source 1..26: mol_type = other DNA
catctcctcaaggctatctgttttga

SEQ ID NO: 27953 - DNA, 22 bp, synthetic construct
  misc_feature 1..22: note = Synthetic Construct
  source 1..22: mol_type = other DNA
tccctccacctggcactcattt

SEQ ID NO: 27954 - DNA, 26 bp, synthetic construct
  misc_feature 1..26: note = Synthetic Construct
  source 1..26: mol_type = other DNA
cagttggtctacggccttttaatttc

SEQ ID NO: 27955 - DNA, 21 bp, synthetic construct
  misc_feature 1..21: note = Synthetic Construct
  source 1..21: mol_type = other DNA
tctcagagcctccctttgcat

SEQ ID NO: 27956 - DNA, 20 bp, synthetic construct
  misc_feature 1..20: note = Synthetic Construct
  source 1..20: mol_type = other DNA
gccaccttgtgagcgtgaaa

SEQ ID NO: 27957 - DNA, 20 bp, synthetic construct
  misc_feature 1..20: note = Synthetic Construct
  source 1..20: mol_type = other DNA
gagtcctttgagccgtgtgt

SEQ ID NO: 27958 - DNA, 22 bp, synthetic construct
  misc_feature 1..22: note = Synthetic Construct
  source 1..22: mol_type = other DNA
tggtacctgagggcactaccat

SEQ ID NO: 27959 - DNA, 25 bp, synthetic construct
  misc_feature 1..25: note = Synthetic Construct
  source 1..25: mol_type = other DNA
ccaacaggacgtgcaaataaagtca

SEQ ID NO: 27960 - DNA, 20 bp, synthetic construct
  misc_feature 1..20: note = Synthetic Construct
  source 1..20: mol_type = other DNA
gcccaaaggccgctcaattt

SEQ ID NO: 27961 - DNA, 21 bp, synthetic construct
  misc_feature 1..21: note = Synthetic Construct
  source 1..21: mol_type = other DNA
tgggtctagcctccctactgt

SEQ ID NO: 27962 - DNA, 25 bp, synthetic construct
  misc_feature 1..25: note = Synthetic Construct
  source 1..25: mol_type = other DNA
gtacctgaaaagttccagcaaaact

SEQ ID NO: 27963 - DNA, 24 bp, synthetic construct
  misc_feature 1..24: note = Synthetic Construct
  source 1..24: mol_type = other DNA
gcagctagagaagctatccggttt

SEQ ID NO: 27964 - DNA, 22 bp, synthetic construct
  misc_feature 1..22: note = Synthetic Construct
  source 1..22: mol_type = other DNA
cgctgggaccttgcgtaaagaa

SEQ ID NO: 27965 - DNA, 20 bp, synthetic construct
  misc_feature 1..20: note = Synthetic Construct
  source 1..20: mol_type = other DNA
cccaggcctgttgagagcta

SEQ ID NO: 27966 - DNA, 22 bp, synthetic construct
  misc_feature 1..22: note = Synthetic Construct
  source 1..22: mol_type = other DNA
ctgctggcatctccagcttcat

SEQ ID NO: 27967 - DNA, 26 bp, synthetic construct
  misc_feature 1..26: note = Synthetic Construct
  source 1..26: mol_type = other DNA
cacctaaaagcactcacacagctaca

SEQ ID NO: 27968 - DNA, 20 bp, synthetic construct
  misc_feature 1..20: note = Synthetic Construct
  source 1..20: mol_type = other DNA
gttgtcggcgcctagtggaa

SEQ ID NO: 27969 - DNA, 21 bp, synthetic construct
  misc_feature 1..21: note = Synthetic Construct
  source 1..21: mol_type = other DNA
caaatctgcgggaggggtatg

SEQ ID NO: 27970 - DNA, 24 bp, synthetic construct
  misc_feature 1..24: note = Synthetic Construct
  source 1..24: mol_type = other DNA
ctcaatttgctaacgtcactgtgt

SEQ ID NO: 27971 - DNA, 20 bp, synthetic construct
  misc_feature 1..20: note = Synthetic Construct
  source 1..20: mol_type = other DNA
gccaccacactggccaataa

SEQ ID NO: 27972 - DNA, 22 bp, synthetic construct
  misc_feature 1..22: note = Synthetic Construct
  source 1..22: mol_type = other DNA
gggaaacacgtctgcagctcaa

SEQ ID NO: 27973 - DNA, 22 bp, synthetic construct
  misc_feature 1..22: note = Synthetic Construct
  source 1..22: mol_type = other DNA
cccttcctccaacccctcttca

SEQ ID NO: 27974 - DNA, 19 bp, synthetic construct
  misc_feature 1..19: note = Synthetic Construct
  source 1..19: mol_type = other DNA
acagggagcaaccctgtgt

SEQ ID NO: 27975 - DNA, 20 bp, synthetic construct
  misc_feature 1..20: note = Synthetic Construct
  source 1..20: mol_type = other DNA
gggctgtccctctggtctga

SEQ ID NO: 27976 - DNA, 23 bp, synthetic construct
  misc_feature 1..23: note = Synthetic Construct
  source 1..23: mol_type = other DNA
ggatgtgtgctgtagtgatgtgt

SEQ ID NO: 27977 - DNA, 23 bp, synthetic construct
  misc_feature 1..23: note = Synthetic Construct
  source 1..23: mol_type = other DNA
ggaatggacccatcacagacact

SEQ ID NO: 27978 - DNA, 21 bp, synthetic construct
  misc_feature 1..21: note = Synthetic Construct
  source 1..21: mol_type = other DNA
gccaggtgcagtatgggaaag

SEQ ID NO: 27979 - DNA, 23 bp, synthetic construct
  misc_feature 1..23: note = Synthetic Construct
  source 1..23: mol_type = other DNA
acctgctgcagaattttgtgaga

SEQ ID NO: 27980 - DNA, 23 bp, synthetic construct
  misc_feature 1..23: note = Synthetic Construct
  source 1..23: mol_type = other DNA
caaggagacctggactctgcttt

SEQ ID NO: 27981 - DNA, 22 bp, synthetic construct
  misc_feature 1..22: note = Synthetic Construct
  source 1..22: mol_type = other DNA
tgctgttttcctgtagcaccat

SEQ ID NO: 27982 - DNA, 25 bp, synthetic construct
  misc_feature 1..25: note = Synthetic Construct
  source 1..25: mol_type = other DNA
ctctgatgtgcttgggaattcattt

SEQ ID NO: 27983 - DNA, 23 bp, synthetic construct
  misc_feature 1..23: note = Synthetic Construct
  source 1..23: mol_type = other DNA
agatggaatggcaggtgaaatct

SEQ ID NO: 27984 - DNA, 26 bp, synthetic construct
  misc_feature 1..26: note = Synthetic Construct
  source 1..26: mol_type = other DNA
cttgtgcccagttttagagaacaaag

SEQ ID NO: 27985 - DNA, 22 bp, synthetic construct
  misc_feature 1..22: note = Synthetic Construct
  source 1..22: mol_type = other DNA
gcatgcccaggttttggtcttg

SEQ ID NO: 27986 - DNA, 20 bp, synthetic construct
  misc_feature 1..20: note = Synthetic Construct
  source 1..20: mol_type = other DNA
atgaccctccccgaccaaga

SEQ ID NO: 27987 - DNA, 19 bp, synthetic construct
  misc_feature 1..19: note = Synthetic Construct
  source 1..19: mol_type = other DNA
aggctggagggctcacctt

SEQ ID NO: 27988 - DNA, 19 bp, synthetic construct
  misc_feature 1..19: note = Synthetic Construct
  source 1..19: mol_type = other DNA
tgctgcccagaagcactga

SEQ ID NO: 27989 - DNA, 21 bp, synthetic construct
  misc_feature 1..21: note = Synthetic Construct
  source 1..21: mol_type = other DNA
gtcagggacccaggttgaaaa

SEQ ID NO: 27990 - DNA, 20 bp, synthetic construct
  misc_feature 1..20: note = Synthetic Construct
  source 1..20: mol_type = other DNA
taccctgcctggcccaaata

SEQ ID NO: 27991 - DNA, 22 bp, synthetic construct
  misc_feature 1..22: note = Synthetic Construct
  source 1..22: mol_type = other DNA
ggttgccagtctgattgtggta

SEQ ID NO: 27992 - DNA, 22 bp, synthetic construct
  misc_feature 1..22: note = Synthetic Construct
  source 1..22: mol_type = other DNA
caagcaccctggaggagatgaa

SEQ ID NO: 27993 - DNA, 22 bp, synthetic construct
  misc_feature 1..22: note = Synthetic Construct
  source 1..22: mol_type = other DNA
gtccacctcaccacaactctga

SEQ ID NO: 27994 - DNA, 26 bp, synthetic construct
  misc_feature 1..26: note = Synthetic Construct
  source 1..26: mol_type = other DNA
ctcatcctagagcttgagcactcatc

SEQ ID NO: 27995 - DNA, 24 bp, synthetic construct
  misc_feature 1..24: note = Synthetic Construct
  source 1..24: mol_type = other DNA
gcaacagggcctttataagggaat

SEQ ID NO: 27996 - DNA, 23 bp, synthetic construct
  misc_feature 1..23: note = Synthetic Construct
  source 1..23: mol_type = other DNA
cagagtaatgcatgcagggaaga

SEQ ID NO: 27997 - DNA, 21 bp, synthetic construct
  misc_feature 1..21: note = Synthetic Construct
  source 1..21: mol_type = other DNA
cccagtcacaggtggggagtt

SEQ ID NO: 27998 - DNA, 25 bp, synthetic construct
  misc_feature 1..25: note = Synthetic Construct
  source 1..25: mol_type = other DNA
cataggtagtgccatttgagctgat

SEQ ID NO: 27999 - DNA, 24 bp, synthetic construct
  misc_feature 1..24: note = Synthetic Construct
  source 1..24: mol_type = other DNA
cctgaaatcccatcgtgtggctta

SEQ ID NO: 28000 - DNA, 25 bp, synthetic construct
  misc_feature 1..25: note = Synthetic Construct
  source 1..25: mol_type = other DNA
ggtcccatgtggagtctgttacttc

SEQ ID NO: 28001 - DNA, 22 bp, synthetic construct
  misc_feature 1..22: note = Synthetic Construct
  source 1..22: mol_type = other DNA
cacttggcctggcttgatgtga

SEQ ID NO: 28002 - DNA, 20 bp, synthetic construct
  misc_feature 1..20: note = Synthetic Construct
  source 1..20: mol_type = other DNA
gactgggcacagtgttggta

SEQ ID NO: 28003 - DNA, 22 bp, synthetic construct
  misc_feature 1..22: note = Synthetic Construct
  source 1..22: mol_type = other DNA
tgtagagggcctttctctcact

SEQ ID NO: 28004 - DNA, 22 bp, synthetic construct
  misc_feature 1..22: note = Synthetic Construct
  source 1..22: mol_type = other DNA
cagttctgggcggaaacagtga

SEQ ID NO: 28005 - DNA, 21 bp, synthetic construct
  misc_feature 1..21: note = Synthetic Construct
  source 1..21: mol_type = other DNA
aaaacgcgccatttcaaggaa

SEQ ID NO: 28006 - DNA, 20 bp, synthetic construct
  misc_feature 1..20: note = Synthetic Construct
  source 1..20: mol_type = other DNA
ggagcccagtgagcttcatc

SEQ ID NO: 28007 - DNA, 19 bp, synthetic construct
  misc_feature 1..19: note = Synthetic Construct
  source 1..19: mol_type = other DNA
caggaggcttgccctgtgt

SEQ ID NO: 28008 - DNA, 23 bp, synthetic construct
  misc_feature 1..23: note = Synthetic Construct
  source 1..23: mol_type = other DNA
ccttttctcctctgcctgtggta

SEQ ID NO: 28009 - DNA, 27 bp, synthetic construct
  misc_feature 1..27: note = Synthetic Construct
  source 1..27: mol_type = other DNA
gaccttgtttgtctgtatctgagctat

SEQ ID NO: 28010 - DNA, 25 bp, synthetic construct
  misc_feature 1..25: note = Synthetic Construct
  source 1..25: mol_type = other DNA
gcacagcatgttaaacgctaatttc

SEQ ID NO: 28011 - DNA, 23 bp, synthetic construct
  misc_feature 1..23: note = Synthetic Construct
  source 1..23: mol_type = other DNA
ctcaggcagattgacaggtgtgt

SEQ ID NO: 28012 - DNA, 23 bp, synthetic construct
  misc_feature 1..23: note = Synthetic Construct
  source 1..23: mol_type = other DNA
gcccattcccaccattggatttg

SEQ ID NO: 28013 - DNA, 20 bp, synthetic construct
  misc_feature 1..20: note = Synthetic Construct
  source 1..20: mol_type = other DNA
tgaggtgtggggcaacttgt

SEQ ID NO: 28014 - DNA, 24 bp, synthetic construct
  misc_feature 1..24: note = Synthetic Construct
  source 1..24: mol_type = other DNA
caaccccaagtcagactcatcaac

SEQ ID NO: 28015 - DNA, 24 bp, synthetic construct
  misc_feature 1..24: note = Synthetic Construct
  source 1..24: mol_type = other DNA
ccagggaggatggcttctgaattg

SEQ ID NO: 28016 - DNA, 24 bp, synthetic construct
  misc_feature 1..24: note = Synthetic Construct
  source 1..24: mol_type = other DNA
ggtacaggtgtgcaaagcagtgat

SEQ ID NO: 28017 - DNA, 20 bp, synthetic construct
  misc_feature 1..20: note = Synthetic Construct
  source 1..20: mol_type = other DNA
ggggcacagcaccagtttca

SEQ ID NO: 28018 - DNA, 21 bp, synthetic construct
  misc_feature 1..21: note = Synthetic Construct
  source 1..21: mol_type = other DNA
ccaggctggtgacagacaaac

SEQ ID NO: 28019 - DNA, 22 bp, synthetic construct
  misc_feature 1..22: note = Synthetic Construct
  source 1..22: mol_type = other DNA
tgccttgttcaccctccacttg

SEQ ID NO: 28020 - DNA, 20 bp, synthetic construct
  misc_feature 1..20: note = Synthetic Construct
  source 1..20: mol_type = other DNA
ccgtctggcaggaccgtatc

SEQ ID NO: 28021 - DNA, 21 bp, synthetic construct
  misc_feature 1..21: note = Synthetic Construct
  source 1..21: mol_type = other DNA
gggagaggcagaattcggaaa

SEQ ID NO: 28022 - DNA, 20 bp, synthetic construct
  misc_feature 1..20: note = Synthetic Construct
  source 1..20: mol_type = other DNA
tgctgttccagccggacctt

SEQ ID NO: 28023 - DNA, 20 bp, synthetic construct
  misc_feature 1..20: note = Synthetic Construct
  source 1..20: mol_type = other DNA
gagcacaaggaggccgtttt

SEQ ID NO: 28024 - DNA, 19 bp, synthetic construct
  misc_feature 1..19: note = Synthetic Construct
  source 1..19: mol_type = other DNA
tggtcccggctccatcaga

SEQ ID NO: 28025 - DNA, 21 bp, synthetic construct
  misc_feature 1..21: note = Synthetic Construct
  source 1..21: mol_type = other DNA
accctgatggtttgcaccttt

SEQ ID NO: 28026 - DNA, 20 bp, synthetic construct
  misc_feature 1..20: note = Synthetic Construct
  source 1..20: mol_type = other DNA
gtctggctgccctggtcaaa

SEQ ID NO: 28027 - DNA, 23 bp, synthetic construct
  misc_feature 1..23: note = Synthetic Construct
  source 1..23: mol_type = other DNA
caccggcccacttactctcttac

SEQ ID NO: 28028 - DNA, 23 bp, synthetic construct
  misc_feature 1..23: note = Synthetic Construct
  source 1..23: mol_type = other DNA
ctgggtcctggaattctgatgtt

SEQ ID NO: 28029 - DNA, 24 bp, synthetic construct
  misc_feature 1..24: note = Synthetic Construct
  source 1..24: mol_type = other DNA
acctgtgggactacctgaggtcta

SEQ ID NO: 28030 - DNA, 19 bp, synthetic construct
  misc_feature 1..19: note = Synthetic Construct
  source 1..19: mol_type = other DNA
gcggcaggtgaatgagtgt

SEQ ID NO: 28031 - DNA, 25 bp, synthetic construct
  misc_feature 1..25: note = Synthetic Construct
  source 1..25: mol_type = other DNA
ggcctcataaattagaaccctggat

SEQ ID NO: 28032 - DNA, 20 bp, synthetic construct
  misc_feature 1..20: note = Synthetic Construct
  source 1..20: mol_type = other DNA
cagagggcagagcgctgaat

SEQ ID NO: 28033 - DNA, 21 bp, synthetic construct
  misc_feature 1..21: note = Synthetic Construct
  source 1..21: mol_type = other DNA
agtcatcctccccaccaccat

SEQ ID NO: 28034 - DNA, 24 bp, synthetic construct
  misc_feature 1..24: note = Synthetic Construct
  source 1..24: mol_type = other DNA
cctgagccatcctggaagctttac

SEQ ID NO: 28035 - DNA, 23 bp, synthetic construct
  misc_feature 1..23: note = Synthetic Construct
  source 1..23: mol_type = other DNA
gcacgggctagaactctcacttc

SEQ ID NO: 28036 - DNA, 22 bp, synthetic construct
  misc_feature 1..22: note = Synthetic Construct
  source 1..22: mol_type = other DNA
gagcaggaagcctgagtcttga

SEQ ID NO: 28037 - DNA, 23 bp, synthetic construct
  misc_feature 1..23: note = Synthetic Construct
  source 1..23: mol_type = other DNA
ctcctctgttcccttttgtggat

SEQ ID NO: 28038 - DNA, 23 bp, synthetic construct
  misc_feature 1..23: note = Synthetic Construct
  source 1..23: mol_type = other DNA
aggacaatgccctagaagcaaat

SEQ ID NO: 28039 - DNA, 22 bp, synthetic construct
  misc_feature 1..22: note = Synthetic Construct
  source 1..22: mol_type = other DNA
gcagggtctggtttgcatttga

SEQ ID NO: 28040 - DNA, 23 bp, synthetic construct
  misc_feature 1..23: note = Synthetic Construct
  source 1..23: mol_type = other DNA
tgcctccactccaacttctttag

SEQ ID NO: 28041 - DNA, 22 bp, synthetic construct
  misc_feature 1..22: note = Synthetic Construct
  source 1..22: mol_type = other DNA
ctcctgcagtgtcaccttgttg

SEQ ID NO: 28042 - DNA, 23 bp, synthetic construct
  misc_feature 1..23: note = Synthetic Construct
  source 1..23: mol_type = other DNA
ggccaatgcacgtactattgctt

SEQ ID NO: 28043 - DNA, 20 bp, synthetic construct
  misc_feature 1..20: note = Synthetic Construct
  source 1..20: mol_type = other DNA
aacctgcacacctgccaatc

SEQ ID NO: 28044 - DNA, 22 bp, synthetic construct
  misc_feature 1..22: note = Synthetic Construct
  source 1..22: mol_type = other DNA
tggagcgaagtcatgtcagtct

SEQ ID NO: 28045 - DNA, 22 bp, synthetic construct
  misc_feature 1..22: note = Synthetic Construct
  source 1..22: mol_type = other DNA
ggaggggctactagaagcaaac

SEQ ID NO: 28046 - DNA, 24 bp, synthetic construct
  misc_feature 1..24: note = Synthetic Construct
  source 1..24: mol_type = other DNA
tgcctggcaatgttagataaggat

SEQ ID NO: 28047 - DNA, 19 bp, synthetic construct
  misc_feature 1..19: note = Synthetic Construct
  source 1..19: mol_type = other DNA
ccgccctctctcaccatgt

SEQ ID NO: 28048 - DNA, 21 bp, synthetic construct
  misc_feature 1..21: note = Synthetic Construct
  source 1..21: mol_type = other DNA
tggcatcgccatccaccctaa

SEQ ID NO: 28049 - DNA, 21 bp, synthetic construct
  misc_feature 1..21: note = Synthetic Construct
  source 1..21: mol_type = other DNA
cccctgtgtttgtcgggtgat

SEQ ID NO: 28050 - DNA, 21 bp, synthetic construct
  misc_feature 1..21: note = Synthetic Construct
  source 1..21: mol_type = other DNA
ggttgccaaactgtcccaact

SEQ ID NO: 28051 - DNA, 25 bp, synthetic construct
  misc_feature 1..25: note = Synthetic Construct
  source 1..25: mol_type = other DNA
ggcacagattctggttagaatggaa

SEQ ID NO: 28052 - DNA, 21 bp, synthetic construct
  misc_feature 1..21: note = Synthetic Construct
  source 1..21: mol_type = other DNA
catttccgctcacaagccatt

SEQ ID NO: 28053 - DNA, 20 bp, synthetic construct
  misc_feature 1..20: note = Synthetic Construct
  source 1..20: mol_type = other DNA
gactcagcccggaattcgtt

SEQ ID NO: 28054 - DNA, 22 bp, synthetic construct
  misc_feature 1..22: note = Synthetic Construct
  source 1..22: mol_type = other DNA
ccaaggtatggcaggagtttgt

SEQ ID NO: 28055 - DNA, 20 bp, synthetic construct
  misc_feature 1..20: note = Synthetic Construct
  source 1..20: mol_type = other DNA
tgcagtgctgctccatgtgt

SEQ ID NO: 28056 - DNA, 21 bp, synthetic construct
  misc_feature 1..21: note = Synthetic Construct
  source 1..21: mol_type = other DNA
atcctagggccccgtaagtca

SEQ ID NO: 28057 - DNA, 25 bp, synthetic construct
  misc_feature 1..25: note = Synthetic Construct
  source 1..25: mol_type = other DNA
cgtggcttggaagagatacatttca

SEQ ID NO: 28058 - DNA, 21 bp, synthetic construct
  misc_feature 1..21: note = Synthetic Construct
  source 1..21: mol_type = other DNA
tcaaaccccaccaaccctaca

SEQ ID NO: 28059 - DNA, 19 bp, synthetic construct
  misc_feature 1..19: note = Synthetic Construct
  source 1..19: mol_type = other DNA
cccagggttggggttcctt

SEQ ID NO: 28060 - DNA, 22 bp, synthetic construct
  misc_feature 1..22: note = Synthetic Construct
  source 1..22: mol_type = other DNA
cccatcttttctccaggcactt

SEQ ID NO: 28061 - DNA, 20 bp, synthetic construct
  misc_feature 1..20: note = Synthetic Construct
  source 1..20: mol_type = other DNA
ctgccagccttgaactctgt

SEQ ID NO: 28062 - DNA, 21 bp, synthetic construct
  misc_feature 1..21: note = Synthetic Construct
  source 1..21: mol_type = other DNA
cccacagcatcgatgacaaac

SEQ ID NO: 28063 - DNA, 19 bp, synthetic construct
  misc_feature 1..19: note = Synthetic Construct
  source 1..19: mol_type = other DNA
accaggcagctccatgttg

SEQ ID NO: 28064 - DNA, 25 bp, synthetic construct
  misc_feature 1..25: note = Synthetic Construct
  source 1..25: mol_type = other DNA
caggacccaatagaagtcgggaata

SEQ ID NO: 28065 - DNA, 22 bp, synthetic construct
  misc_feature 1..22: note = Synthetic Construct
  source 1..22: mol_type = other DNA
ggtgcacccaagcataaggttt

SEQ ID NO: 28066 - DNA, 23 bp, synthetic construct
  misc_feature 1..23: note = Synthetic Construct
  source 1..23: mol_type = other DNA
agatgtgggaggaaaggatgttc

SEQ ID NO: 28067 - DNA, 22 bp, synthetic construct
  misc_feature 1..22: note = Synthetic Construct
  source 1..22: mol_type = other DNA
ggtgcctctggagttgtgaagt

SEQ ID NO: 28068 - DNA, 24 bp, synthetic construct
  misc_feature 1..24: note = Synthetic Construct
  source 1..24: mol_type = other DNA
gccaagtttcccagagaatgaatc

SEQ ID NO: 28069 - DNA, 20 bp, synthetic construct
  misc_feature 1..20: note = Synthetic Construct
  source 1..20: mol_type = other DNA
gccagataagggccgagttc

SEQ ID NO: 28070 - DNA, 24 bp, synthetic construct
  misc_feature 1..24: note = Synthetic Construct
  source 1..24: mol_type = other DNA
aggacaaaatgcattcaggacact

SEQ ID NO: 28071 - DNA, 23 bp, synthetic construct
  misc_feature 1..23: note = Synthetic Construct
  source 1..23: mol_type = other DNA
ccagtttgttagcctcaaagcaa

SEQ ID NO: 28072 - DNA, 20 bp, synthetic construct
  misc_feature 1..20: note = Synthetic Construct
  source 1..20: mol_type = other DNA
tcggcttgacctacctgctt

SEQ ID NO: 28073 - DNA, 21 bp, synthetic construct
  misc_feature 1..21: note = Synthetic Construct
  source 1..21: mol_type = other DNA
aacctgtcaccctgggactca

SEQ ID NO: 28074 - DNA, 23 bp, synthetic construct
  misc_feature 1..23: note = Synthetic Construct
  source 1..23: mol_type = other DNA
ggtttgaccaggcatgtcactca

SEQ ID NO: 28075 - DNA, 19 bp, synthetic construct
  misc_feature 1..19: note = Synthetic Construct
  source 1..19: mol_type = other DNA
tgactggctgcacgctcaa

SEQ ID NO: 28076 - DNA, 19 bp, synthetic construct
  misc_feature 1..19: note = Synthetic Construct
  source 1..19: mol_type = other DNA
atggcctccgtgcctcatc

SEQ ID NO: 28077 - DNA, 24 bp, synthetic construct
  misc_feature 1..24: note = Synthetic Construct
  source 1..24: mol_type = other DNA
cccaggaaactctagaggaggatt

SEQ ID NO: 28078 - DNA, 20 bp, synthetic construct
  misc_feature 1..20: note = Synthetic Construct
  source 1..20: mol_type = other DNA
tcatgcagggccactctttg

SEQ ID NO: 28079 - DNA, 26 bp, synthetic construct
  misc_feature 1..26: note = Synthetic Construct
  source 1..26: mol_type = other DNA
ctctttggcaactagagacacaactt

SEQ ID NO: 28080 - DNA, 24 bp, synthetic construct
  misc_feature 1..24: note = Synthetic Construct
  source 1..24: mol_type = other DNA
ggaatattggctcaggtccaagaa

SEQ ID NO: 28081 - DNA, 21 bp, synthetic construct
  misc_feature 1..21: note = Synthetic Construct
  source 1..21: mol_type = other DNA
cccggccttgaagtggtcttt

SEQ ID NO: 28082 - DNA, 21 bp, synthetic construct
  misc_feature 1..21: note = Synthetic Construct
  source 1..21: mol_type = other DNA
aggatggaccccactgacact

SEQ ID NO: 28083 - DNA, 22 bp, synthetic construct
  misc_feature 1..22: note = Synthetic Construct
  source 1..22: mol_type = other DNA
gagggcccctaatgtctctctt

SEQ ID NO: 28084 - DNA, 27 bp, synthetic construct
  misc_feature 1..27: note = Synthetic Construct
  source 1..27: mol_type = other DNA
gctgtatctcaatcttttccaggaagt

SEQ ID NO: 28085 - DNA, 22 bp, synthetic construct
  misc_feature 1..22: note = Synthetic Construct
  source 1..22: mol_type = other DNA
gcctcctcccagacaaatccaa

SEQ ID NO: 28086 - DNA, 22 bp, synthetic construct
  misc_feature 1..22: note = Synthetic Construct
  source 1..22: mol_type = other DNA
gtgcctggatgaaccctgtttg

SEQ ID NO: 28087 - DNA, 20 bp, synthetic construct
  misc_feature 1..20: note = Synthetic Construct
  source 1..20: mol_type = other DNA
tgagctgctgttgggactga

SEQ ID NO: 28088 - DNA, 20 bp, synthetic construct
  misc_feature 1..20: note = Synthetic Construct
  source 1..20: mol_type = other DNA
actgcgcatgctcgaaatct

SEQ ID NO: 28089 - DNA, 22 bp, synthetic construct
  misc_feature 1..22: note = Synthetic Construct
  source 1..22: mol_type = other DNA
cctcacctcatgcacacccttt

SEQ ID NO: 28090 - DNA, 22 bp, synthetic construct
  misc_feature 1..22: note = Synthetic Construct
  source 1..22: mol_type = other DNA
cctggggatgagtagcaaccaa

SEQ ID NO: 28091 - DNA, 20 bp, synthetic construct
  misc_feature 1..20: note = Synthetic Construct
  source 1..20: mol_type = other DNA
attgaccccacggtgtcttc

SEQ ID NO: 28092 - DNA, 23 bp, synthetic construct
  misc_feature 1..23: note = Synthetic Construct
  source 1..23: mol_type = other DNA
gtggaggtctacgtcctcagttg

SEQ ID NO: 28093 - DNA, 23 bp, synthetic construct
  misc_feature 1..23: note = Synthetic Construct
  source 1..23: mol_type = other DNA
ctgtgcaaaatccttccgtcttg

SEQ ID NO: 28094 - DNA, 25 bp, synthetic construct
  misc_feature 1..25: note = Synthetic Construct
  source 1..25: mol_type = other DNA
gccagaataccgaggtcttggttag

SEQ ID NO: 28095 - DNA, 23 bp, synthetic construct
  misc_feature 1..23: note = Synthetic Construct
  source 1..23: mol_type = other DNA
ccatagtacgtgaaggccccatt

SEQ ID NO: 28096 - DNA, 23 bp, synthetic construct
  misc_feature 1..23: note = Synthetic Construct
  source 1..23: mol_type = other DNA
aggagaaaatggtgcttgtggaa

SEQ ID NO: 28097 - DNA, 20 bp, synthetic construct
  misc_feature 1..20: note = Synthetic Construct
  source 1..20: mol_type = other DNA
caccagccccaaagcacaaa

SEQ ID NO: 28098 - DNA, 22 bp, synthetic construct
  misc_feature 1..22: note = Synthetic Construct
  source 1..22: mol_type = other DNA
agcaggaggaaagcaggtcttg

SEQ ID NO: 28099 - DNA, 23 bp, synthetic construct
  misc_feature 1..23: note = Synthetic Construct
  source 1..23: mol_type = other DNA
tgattggcaacactgtaggtgat

SEQ ID NO: 28100 - DNA, 22 bp, synthetic construct
  misc_feature 1..22: note = Synthetic Construct
  source 1..22: mol_type = other DNA
agtctgagcatcccttgtctga

SEQ ID NO: 28101 - DNA, 19 bp, synthetic construct
  misc_feature 1..19: note = Synthetic Construct
  source 1..19: mol_type = other DNA
tgcaagtccagtgctgctt

SEQ ID NO: 28102 - DNA, 22 bp, synthetic construct
  misc_feature 1..22: note = Synthetic Construct
  source 1..22: mol_type = other DNA
tcctccccagtccccacatttt

SEQ ID NO: 28103 - DNA, 23 bp, synthetic construct
  misc_feature 1..23: note = Synthetic Construct
  source 1..23: mol_type = other DNA
gtgggagaggcaggtacttcaga

SEQ ID NO: 28104 - DNA, 22 bp, synthetic construct
  misc_feature 1..22: note = Synthetic Construct
  source 1..22: mol_type = other DNA
gctcccaagccactggtaaagt

SEQ ID NO: 28105 - DNA, 22 bp, synthetic construct
  misc_feature 1..22: note = Synthetic Construct
  source 1..22: mol_type = other DNA
ggcttggagaaagggctgagaa

SEQ ID NO: 28106 - DNA, 20 bp, synthetic construct
  misc_feature 1..20: note = Synthetic Construct
  source 1..20: mol_type = other DNA
accagccccagagagacatt

SEQ ID NO: 28107 - DNA, 22 bp, synthetic construct
  misc_feature 1..22: note = Synthetic Construct
  source 1..22: mol_type = other DNA
gcacctggaaaagggagtgtga

SEQ ID NO: 28108 - DNA, 22 bp, synthetic construct
  misc_feature 1..22: note = Synthetic Construct
  source 1..22: mol_type = other DNA
acagggtccccatggtcatcaa

SEQ ID NO: 28109 - DNA, 21 bp, synthetic construct
  misc_feature 1..21: note = Synthetic Construct
  source 1..21: mol_type = other DNA
ccagtgcccctgcacagtatt

SEQ ID NO: 28110 - DNA, 21 bp, synthetic construct
  misc_feature 1..21: note = Synthetic Construct
  source 1..21: mol_type = other DNA
cagcacggtgtgactgaaatg

SEQ ID NO: 28111 - DNA, 23 bp, synthetic construct
  misc_feature 1..23: note = Synthetic Construct
  source 1..23: mol_type = other DNA
ggtccagaacccttcaacaccta

SEQ ID NO: 28112 - DNA, 20 bp, synthetic construct
  misc_feature 1..20: note = Synthetic Construct
  source 1..20: mol_type = other DNA
ctttggcagggaggcagaaa

SEQ ID NO: 28113 - DNA, 20 bp, synthetic construct
  misc_feature 1..20: note = Synthetic Construct
  source 1..20: mol_type = other DNA
agggtgagttggggactgaa

SEQ ID NO: 28114 - DNA, 20 bp, synthetic construct
  misc_feature 1..20: note = Synthetic Construct
  source 1..20: mol_type = other DNA
cacgctgcaggcacaaaact

SEQ ID NO: 28115 - DNA, 25 bp, synthetic construct
  misc_feature 1..25: note = Synthetic Construct
  source 1..25: mol_type = other DNA
aggggaaaggtgaaagctaagtaag

SEQ ID NO: 28116 - DNA, 24 bp, synthetic construct
  misc_feature 1..24: note = Synthetic Construct
  source 1..24: mol_type = other DNA
gcacttaagagctgagccttgtga

SEQ ID NO: 28117 - DNA, 21 bp, synthetic construct
  misc_feature 1..21: note = Synthetic Construct
  source 1..21: mol_type = other DNA
ggagcagctacgttcatgtct

SEQ ID NO: 28118 - DNA, 23 bp, synthetic construct
  misc_feature 1..23: note = Synthetic Construct
  source 1..23: mol_type = other DNA
tccacatgcctcaaaaagacaca

SEQ ID NO: 28119 - DNA, 24 bp, synthetic construct
  misc_feature 1..24: note = Synthetic Construct
  source 1..24: mol_type = other DNA
ggatgtgtttgtgagccgaacaag

SEQ ID NO: 28120 - DNA, 20 bp, synthetic construct
  misc_feature 1..20: note = Synthetic Construct
  source 1..20: mol_type = other DNA
acccctcggaggacgtgtca

SEQ ID NO: 28121 - DNA, 21 bp, synthetic construct
  misc_feature 1..21: note = Synthetic Construct
  source 1..21: mol_type = other DNA
cccaacactgtcacccatcat

SEQ ID NO: 28122 - DNA, 21 bp, synthetic construct
  misc_feature 1..21: note = Synthetic Construct
  source 1..21: mol_type = other DNA
gaggacaagggaatgcacgta

SEQ ID NO: 28123 - DNA, 22 bp, synthetic construct
  misc_feature 1..22: note = Synthetic Construct
  source 1..22: mol_type = other DNA
tgacagacccactgaggtgact

SEQ ID NO: 28124 - DNA, 23 bp, synthetic construct
  misc_feature 1..23: note = Synthetic Construct
  source 1..23: mol_type = other DNA
gcttggcagtaggacagaccaaa

SEQ ID NO: 28125 - DNA, 21 bp, synthetic construct
  misc_feature 1..21: note = Synthetic Construct
  source 1..21: mol_type = other DNA
aactggcctcactctggaaag

SEQ ID NO: 28126 - DNA, 25 bp, synthetic construct
  misc_feature 1..25: note = Synthetic Construct
  source 1..25: mol_type = other DNA
gttccctttctcctctacctagcat

SEQ ID NO: 28127 - DNA, 22 bp, synthetic construct
  misc_feature 1..22: note = Synthetic Construct
  source 1..22: mol_type = other DNA
gctgagctcaagccctctatct

SEQ ID NO: 28128 - DNA, 20 bp, synthetic construct
  misc_feature 1..20: note = Synthetic Construct
  source 1..20: mol_type = other DNA
aggaaggggatgagcaggaa

SEQ ID NO: 28129 - DNA, 22 bp, synthetic construct
  misc_feature 1..22: note = Synthetic Construct
  source 1..22: mol_type = other DNA
tgaggacttcccctaccactct

SEQ ID NO: 28130 - DNA, 21 bp, synthetic construct
  misc_feature 1..21: note = Synthetic Construct
  source 1..21: mol_type = other DNA
tcaggtccaccagtgtgaaac

SEQ ID NO: 28131 - DNA, 21 bp, synthetic construct
  misc_feature 1..21: note = Synthetic Construct
  source 1..21: mol_type = other DNA
gggatgtcgaggtgctaggtt

SEQ ID NO: 28132 - DNA, 24 bp, synthetic construct
  misc_feature 1..24: note = Synthetic Construct
  source 1..24: mol_type = other DNA
gggaccatccctgactcttacatt

SEQ ID NO: 28133 - DNA, 20 bp, synthetic construct
  misc_feature 1..20: note = Synthetic Construct
  source 1..20: mol_type = other DNA
acccggccatctttggtaca

SEQ ID NO: 28134 - DNA, 23 bp, synthetic construct
  misc_feature 1..23: note = Synthetic Construct
  source 1..23: mol_type = other DNA
gctatagagccgtctgcatccaa

SEQ ID NO: 28135 - DNA, 22 bp, synthetic construct
  misc_feature 1..22: note = Synthetic Construct
  source 1..22: mol_type = other DNA
ccatggtgccagaaggtcttga

SEQ ID NO: 28136 - DNA, 22 bp, synthetic construct
  misc_feature 1..22: note = Synthetic Construct
  source 1..22: mol_type = other DNA
ggctggacacgttcaagcttac

SEQ ID NO: 28137 - DNA, 24 bp, synthetic construct
  misc_feature 1..24: note = Synthetic Construct
  source 1..24: mol_type = other DNA
aggtagatggcaaaatctgtggaa

SEQ ID NO: 28138 - DNA, 23 bp, synthetic construct
  misc_feature 1..23: note = Synthetic Construct
  source 1..23: mol_type = other DNA
gatggagcctgaggcattaaaca

SEQ ID NO: 28139 - DNA, 20 bp, synthetic construct
  misc_feature 1..20: note = Synthetic Construct
  source 1..20: mol_type = other DNA
ggccatgggacagcatttct

SEQ ID NO: 28140 - DNA, 22 bp, synthetic construct
  misc_feature 1..22: note = Synthetic Construct
  source 1..22: mol_type = other DNA
cagagcagaaccccatgctttg

SEQ ID NO: 28141 - DNA, 23 bp, synthetic construct
  misc_feature 1..23: note = Synthetic Construct
  source 1..23: mol_type = other DNA
gaagtccttgctgctggagaaga

SEQ ID NO: 28142 - DNA, 25 bp, synthetic construct
  misc_feature 1..25: note = Synthetic Construct
  source 1..25: mol_type = other DNA
acaatctagggaaggcaatttgtca

SEQ ID NO: 28143 - DNA, 23 bp, synthetic construct
  misc_feature 1..23: note = Synthetic Construct
  source 1..23: mol_type = other DNA
ccactgtctcccttccttgaatg

SEQ ID NO: 28144 - DNA, 22 bp, synthetic construct
  misc_feature 1..22: note = Synthetic Construct
  source 1..22: mol_type = other DNA
gaacttggctgggaaccaggat

SEQ ID NO: 28145 - DNA, 22 bp, synthetic construct
  misc_feature 1..22: note = Synthetic Construct
  source 1..22: mol_type = other DNA
atggagccccactaccgaagta

SEQ ID NO: 28146 - DNA, 21 bp, synthetic construct
  misc_feature 1..21: note = Synthetic Construct
  source 1..21: mol_type = other DNA
caaccaaagtggcaacgaact

SEQ ID NO: 28147 - DNA, 21 bp, synthetic construct
  misc_feature 1..21: note = Synthetic Construct
  source 1..21: mol_type = other DNA
gggcatggtggaaaagcttga

SEQ ID NO: 28148 - DNA, 21 bp, synthetic construct
  misc_feature 1..21: note = Synthetic Construct
  source 1..21: mol_type = other DNA
gcatgggagccaacagtcagt

SEQ ID NO: 28149 - DNA, 21 bp, synthetic construct
  misc_feature 1..21: note = Synthetic Construct
  source 1..21: mol_type = other DNA
gccaccgcacctggactattt

SEQ ID NO: 28150 - DNA, 24 bp, synthetic construct
  misc_feature 1..24: note = Synthetic Construct
  source 1..24: mol_type = other DNA
ctttattgggcaccatctcacatc

SEQ ID NO: 28151 - DNA, 25 bp, synthetic construct
  misc_feature 1..25: note = Synthetic Construct
  source 1..25: mol_type = other DNA
cgttccctctctctccaacttttag

SEQ ID NO: 28152 - DNA, 18 bp, synthetic construct
  misc_feature 1..18: note = Synthetic Construct
  source 1..18: mol_type = other DNA
tgtcgcgatgccgaagaa

SEQ ID NO: 28153 - DNA, 23 bp, synthetic construct
  misc_feature 1..23: note = Synthetic Construct
  source 1..23: mol_type = other DNA
gccccattgcctaccttttcaga

SEQ ID NO: 28154 - DNA, 20 bp, synthetic construct
  misc_feature 1..20: note = Synthetic Construct
  source 1..20: mol_type = other DNA
tggctccaggtccagcatca

SEQ ID NO: 28155 - DNA, 20 bp, synthetic construct
  misc_feature 1..20: note = Synthetic Construct
  source 1..20: mol_type = other DNA
tccagcaggtgcctgacaca

SEQ ID NO: 28156 - DNA, 22 bp, synthetic construct
  misc_feature 1..22: note = Synthetic Construct
  source 1..22: mol_type = other DNA
acctccacatcctgctgtcaga

SEQ ID NO: 28157 - DNA, 21 bp, synthetic construct
  misc_feature 1..21: note = Synthetic Construct
  source 1..21: mol_type = other DNA
gtgtgggccaaaggttgtaga

SEQ ID NO: 28158 - DNA, 25 bp, synthetic construct
  misc_feature 1..25: note = Synthetic Construct
  source 1..25: mol_type = other DNA
ccaagaaaatcacgtttgggaaaga

SEQ ID NO: 28159 - DNA, 19 bp, synthetic construct
  misc_feature 1..19: note = Synthetic Construct
  source 1..19: mol_type = other DNA
ccaccagccatccgtgtgt

SEQ ID NO: 28160 - DNA, 20 bp, synthetic construct
  misc_feature 1..20: note = Synthetic Construct
  source 1..20: mol_type = other DNA
gtctgcagggcagaaagtga

SEQ ID NO: 28161 - DNA, 20 bp, synthetic construct
  misc_feature 1..20: note = Synthetic Construct
  source 1..20: mol_type = other DNA
gtggtgtgcagtgagtggat

SEQ ID NO: 28162 - DNA, 18 bp, synthetic construct
  misc_feature 1..18: note = Synthetic Construct
  source 1..18: mol_type = other DNA
gcacccacagcaccacat

SEQ ID NO: 28163 - DNA, 22 bp, synthetic construct
  misc_feature 1..22: note = Synthetic Construct
  source 1..22: mol_type = other DNA
gcaccaactagctgacctgtga

SEQ ID NO: 28164 - DNA, 22 bp, synthetic construct
  misc_feature 1..22: note = Synthetic Construct
  source 1..22: mol_type = other DNA
gggagggtggaaggaaaagaca

SEQ ID NO: 28165 - DNA, 23 bp, synthetic construct
  misc_feature 1..23: note = Synthetic Construct
  source 1..23: mol_type = other DNA
gggcaccagtaatccaaactcaa

SEQ ID NO: 28166 - DNA, 21 bp, synthetic construct
  misc_feature 1..21: note = Synthetic Construct
  source 1..21: mol_type = other DNA
ccacccagtcctgaagccatt

SEQ ID NO: 28167 - DNA, 22 bp, synthetic construct
  misc_feature 1..22: note = Synthetic Construct
  source 1..22: mol_type = other DNA
actcggctcctatcgagtgcaa

SEQ ID NO: 28168 - DNA, 21 bp, synthetic construct
  misc_feature 1..21: note = Synthetic Construct
  source 1..21: mol_type = other DNA
gggagcactgccatcctttgt

SEQ ID NO: 28169 - DNA, 22 bp, synthetic construct
  misc_feature 1..22: note = Synthetic Construct
  source 1..22: mol_type = other DNA
caggcttgtggagaggatgtca

SEQ ID NO: 28170 - DNA, 22 bp, synthetic construct
  misc_feature 1..22: note = Synthetic Construct
  source 1..22: mol_type = other DNA
atgccaggccagtcctgtacta

SEQ ID NO: 28171 - DNA, 23 bp, synthetic construct
  misc_feature 1..23: note = Synthetic Construct
  source 1..23: mol_type = other DNA
cccaatggaaaccctagaacaca

SEQ ID NO: 28172 - DNA, 21 bp, synthetic construct
  misc_feature 1..21: note = Synthetic Construct
  source 1..21: mol_type = other DNA
gctgggtcaacagctctttca

SEQ ID NO: 28173 - DNA, 20 bp, synthetic construct
  misc_feature 1..20: note = Synthetic Construct
  source 1..20: mol_type = other DNA
ggcctccaggaagaaagcaa

SEQ ID NO: 28174 - DNA, 20 bp, synthetic construct
  misc_feature 1..20: note = Synthetic Construct
  source 1..20: mol_type = other DNA
tgtccccaggctgtctctca

SEQ ID NO: 28175 - DNA, 24 bp, synthetic construct
  misc_feature 1..24: note = Synthetic Construct
  source 1..24: mol_type = other DNA
ggcatcctacaaacttcccttgta

SEQ ID NO: 28176 - DNA, 19 bp, synthetic construct
  misc_feature 1..19: note = Synthetic Construct
  source 1..19: mol_type = other DNA
acacccagccagtgtctca

SEQ ID NO: 28177 - DNA, 20 bp, synthetic construct
  misc_feature 1..20: note = Synthetic Construct
  source 1..20: mol_type = other DNA
gcccgggtccaggttacttc

SEQ ID NO: 28178 - DNA, 22 bp, synthetic construct
  misc_feature 1..22: note = Synthetic Construct
  source 1..22: mol_type = other DNA
gggcatggctgtgttccagtaa

SEQ ID NO: 28179 - DNA, 22 bp, synthetic construct
  misc_feature 1..22: note = Synthetic Construct
  source 1..22: mol_type = other DNA
gaagaccaccaggaccatgatt

SEQ ID NO: 28180 - DNA, 20 bp, synthetic construct
  misc_feature 1..20: note = Synthetic Construct
  source 1..20: mol_type = other DNA
tctcccggcttccaaccaaa

SEQ ID NO: 28181 - DNA, 21 bp, synthetic construct
  misc_feature 1..21: note = Synthetic Construct
  source 1..21: mol_type = other DNA
gccacctcctcttccccttag

SEQ ID NO: 28182 - DNA, 21 bp, synthetic construct
  misc_feature 1..21: note = Synthetic Construct
  source 1..21: mol_type = other DNA
ggaagcgagcttggaacttct

SEQ ID NO: 28183 - DNA, 24 bp, synthetic construct
  misc_feature 1..24: note = Synthetic Construct
  source 1..24: mol_type = other DNA
ctgtggctgtcccagcagataaag

SEQ ID NO: 28184 - DNA, 20 bp, synthetic construct
  misc_feature 1..20: note = Synthetic Construct
  source 1..20: mol_type = other DNA
ggctggaatgcagtggtaca

SEQ ID NO: 28185 - DNA, 22 bp, synthetic construct
  misc_feature 1..22: note = Synthetic Construct
  source 1..22: mol_type = other DNA
gacagcaaggcaagctgagaac

SEQ ID NO: 28186 - DNA, 26 bp, synthetic construct
  misc_feature 1..26: note = Synthetic Construct
  source 1..26: mol_type = other DNA
gtaatcccagcagatcacactttctt

SEQ ID NO: 28187 - DNA, 22 bp, synthetic construct
  misc_feature 1..22: note = Synthetic Construct
  source 1..22: mol_type = other DNA
gtcagatggcctctgcacctta

SEQ ID NO: 28188 - DNA, 25 bp, synthetic construct
  misc_feature 1..25: note = Synthetic Construct
  source 1..25: mol_type = other DNA
agttctctcaaacattggccctatt

SEQ ID NO: 28189 - DNA, 23 bp, synthetic construct
  misc_feature 1..23: note = Synthetic Construct
  source 1..23: mol_type = other DNA
agagacctgctctcaaggcatta

SEQ ID NO: 28190 - DNA, 20 bp, synthetic construct
  misc_feature 1..20: note = Synthetic Construct
  source 1..20: mol_type = other DNA
tgccttggctgacctacaac

SEQ ID NO: 28191 - DNA, 21 bp, synthetic construct
  misc_feature 1..21: note = Synthetic Construct
  source 1..21: mol_type = other DNA
agaggctggcagagacctact

SEQ ID NO: 28192 - DNA, 19 bp, synthetic construct
  misc_feature 1..19: note = Synthetic Construct
  source 1..19: mol_type = other DNA
gcccgaccttcaagccaaa

SEQ ID NO: 28193 - DNA, 20 bp, synthetic construct
  misc_feature 1..20: note = Synthetic Construct
  source 1..20: mol_type = other DNA
tggcacacaccccaaagcta

SEQ ID NO: 28194 - DNA, 20 bp, synthetic construct
  misc_feature 1..20: note = Synthetic Construct
  source 1..20: mol_type = other DNA
gaagtccagtgcccctccaa

SEQ ID NO: 28195 - DNA, 22 bp, synthetic construct
  misc_feature 1..22: note = Synthetic Construct
  source 1..22: mol_type = other DNA
ccctgcaggtaggagggactat

SEQ ID NO: 28196 - DNA, 22 bp, synthetic construct
  misc_feature 1..22: note = Synthetic Construct
  source 1..22: mol_type = other DNA
tgtgaagatggcttgtcccttt

SEQ ID NO: 28197 - DNA, 19 bp, synthetic construct
  misc_feature 1..19: note = Synthetic Construct
  source 1..19: mol_type = other DNA
agctccaacctcgctgagt

SEQ ID NO: 28198 - DNA, 22 bp, synthetic construct
  misc_feature 1..22: note = Synthetic Construct
  source 1..22: mol_type = other DNA
tgctggtgaccctgagtcaatg

SEQ ID NO: 28199 - DNA, 20 bp, synthetic construct
  misc_feature 1..20: note = Synthetic Construct
  source 1..20: mol_type = other DNA
tttcgggccttcccgctaaa

SEQ ID NO: 28200 - DNA, 22 bp, synthetic construct
  misc_feature 1..22: note = Synthetic Construct
  source 1..22: mol_type = other DNA
caaaggctgcagacagatgaag

SEQ ID NO: 28201 - DNA, 20 bp, synthetic construct
  misc_feature 1..20: note = Synthetic Construct
  source 1..20: mol_type = other DNA
ggcacagaggctacacacat

SEQ ID NO: 28202 - DNA, 24 bp, synthetic construct
  misc_feature 1..24: note = Synthetic Construct
  source 1..24: mol_type = other DNA
ccccaggtgaatactgtgccttca

SEQ ID NO: 28203 - DNA, 22 bp, synthetic construct
  misc_feature 1..22: note = Synthetic Construct
  source 1..22: mol_type = other DNA
ggaggaaatcccagcactggtt

SEQ ID NO: 28204 - DNA, 23 bp, synthetic construct
  misc_feature 1..23: note = Synthetic Construct
  source 1..23: mol_type = other DNA
tctatggagactgccaaccgtta

SEQ ID NO: 28205 - DNA, 20 bp, synthetic construct
  misc_feature 1..20: note = Synthetic Construct
  source 1..20: mol_type = other DNA
cccaccccatgcttgtcaac

SEQ ID NO: 28206 - DNA, 25 bp, synthetic construct
  misc_feature 1..25: note = Synthetic Construct
  source 1..25: mol_type = other DNA
tttctcccttctccattccactatg

SEQ ID NO: 28207 - DNA, 20 bp, synthetic construct
  misc_feature 1..20: note = Synthetic Construct
  source 1..20: mol_type = other DNA
actggcctggagaagctgat

SEQ ID NO: 28208 - DNA, 25 bp, synthetic construct
  misc_feature 1..25: note = Synthetic Construct
  source 1..25: mol_type = other DNA
cacaaccagagaacttagcacatga

SEQ ID NO: 28209 - DNA, 24 bp, synthetic construct
  misc_feature 1..24: note = Synthetic Construct
  source 1..24: mol_type = other DNA
tggagtgtttgaagagcaaagcta

SEQ ID NO: 28210 - DNA, 23 bp, synthetic construct
  misc_feature 1..23: note = Synthetic Construct
  source 1..23: mol_type = other DNA
gcctcccctctgtcagacttttc

SEQ ID NO: 28211 - DNA, 19 bp, synthetic construct
  misc_feature 1..19: note = Synthetic Construct
  source 1..19: mol_type = other DNA
tcggccagcactccacaga

SEQ ID NO: 28212 - DNA, 25 bp, synthetic construct
  misc_feature 1..25: note = Synthetic Construct
  source 1..25: mol_type = other DNA
gaccctaaggaagtcatagcccata

SEQ ID NO: 28213 - DNA, 19 bp, synthetic construct
  misc_feature 1..19: note = Synthetic Construct
  source 1..19: mol_type = other DNA
tggctgggtagggctgcat

SEQ ID NO: 28214 - DNA, 21 bp, synthetic construct
  misc_feature 1..21: note = Synthetic Construct
  source 1..21: mol_type = other DNA
gcagtcacacttcctccaaca

SEQ ID NO: 28215 - DNA, 22 bp, synthetic construct
  misc_feature 1..22: note = Synthetic Construct
  source 1..22: mol_type = other DNA
ctgaaggatgctggaagtggaa

SEQ ID NO: 28216 - DNA, 23 bp, synthetic construct
  misc_feature 1..23: note = Synthetic Construct
  source 1..23: mol_type = other DNA
cttcaaagccagagctccatttc

SEQ ID NO: 28217 - DNA, 20 bp, synthetic construct
  misc_feature 1..20: note = Synthetic Construct
  source 1..20: mol_type = other DNA
tggatcagccggtgcttgaa

SEQ ID NO: 28218 - DNA, 24 bp, synthetic construct
  misc_feature 1..24: note = Synthetic Construct
  source 1..24: mol_type = other DNA
cacagtgagacacaatgaacacaa

SEQ ID NO: 28219 - DNA, 22 bp, synthetic construct
  misc_feature 1..22: note = Synthetic Construct
  source 1..22: mol_type = other DNA
cttgggtaggcctaggtgttga

SEQ ID NO: 28220 - DNA, 20 bp, synthetic construct
  misc_feature 1..20: note = Synthetic Construct
  source 1..20: mol_type = other DNA
gcagacacggcattgagaca

SEQ ID NO: 28221 - DNA, 20 bp, synthetic construct
  misc_feature 1..20: note = Synthetic Construct
  source 1..20: mol_type = other DNA
acaccccacctcatcagtct

SEQ ID NO: 28222 - DNA, 19 bp, synthetic construct
  misc_feature 1..19: note = Synthetic Construct
  source 1..19: mol_type = other DNA
ggcagcgggtagcttgtgt

SEQ ID NO: 28223 - DNA, 20 bp, synthetic construct
  misc_feature 1..20: note = Synthetic Construct
  source 1..20: mol_type = other DNA
gcagggaccggagcctttat

SEQ ID NO: 28224 - DNA, 21 bp, synthetic construct
  misc_feature 1..21: note = Synthetic Construct
  source 1..21: mol_type = other DNA
ccaccaagcctgccaaaattc

SEQ ID NO: 28225 - DNA, 20 bp, synthetic construct
  misc_feature 1..20: note = Synthetic Construct
  source 1..20: mol_type = other DNA
tgctgtggccaggggaatgt

SEQ ID NO: 28226 - DNA, 26 bp, synthetic construct
  misc_feature 1..26: note = Synthetic Construct
  source 1..26: mol_type = other DNA
cacatactctgtgcttctcactttct

SEQ ID NO: 28227 - DNA, 20 bp, synthetic construct
  misc_feature 1..20: note = Synthetic Construct
  source 1..20: mol_type = other DNA
tctgaaccgcgctgcatttg

SEQ ID NO: 28228 - DNA, 21 bp, synthetic construct
  misc_feature 1..21: note = Synthetic Construct
  source 1..21: mol_type = other DNA
tcttggcaggcagagttccta

SEQ ID NO: 28229 - DNA, 23 bp, synthetic construct
  misc_feature 1..23: note = Synthetic Construct
  source 1..23: mol_type = other DNA
cctgcacccagtcctttctttac

SEQ ID NO: 28230 - DNA, 28 bp, synthetic construct
  misc_feature 1..28: note = Synthetic Construct
  source 1..28: mol_type = other DNA
ctctggtccatgaactcatttccatttg

SEQ ID NO: 28231 - DNA, 22 bp, synthetic construct
  misc_feature 1..22: note = Synthetic Construct
  source 1..22: mol_type = other DNA
gcagtgtggatcagcctgtact

SEQ ID NO: 28232 - DNA, 26 bp, synthetic construct
  misc_feature 1..26: note = Synthetic Construct
  source 1..26: mol_type = other DNA
ctcagcaagaatcagtgactttccaa

SEQ ID NO: 28233 - DNA, 21 bp, synthetic construct
  misc_feature 1..21: note = Synthetic Construct
  source 1..21: mol_type = other DNA
ccattccacagccagcacaga

SEQ ID NO: 28234 - DNA, 25 bp, synthetic construct
  misc_feature 1..25: note = Synthetic Construct
  source 1..25: mol_type = other DNA
ggagacttagacccattggggaaca

SEQ ID NO: 28235 - DNA, 21 bp, synthetic construct
  misc_feature 1..21: note = Synthetic Construct
  source 1..21: mol_type = other DNA
cagctgtctctgcttccaaca

SEQ ID NO: 28236 - DNA, 22 bp, synthetic construct
  misc_feature 1..22: note = Synthetic Construct
  source 1..22: mol_type = other DNA
gtgagaattggcctgcacaaac

SEQ ID NO: 28237 - DNA, 23 bp, synthetic construct
  misc_feature 1..23: note = Synthetic Construct
  source 1..23: mol_type = other DNA
cagtgcataggtttcaccaggaa

SEQ ID NO: 28238 - DNA, 25 bp, synthetic construct
  misc_feature 1..25: note = Synthetic Construct
  source 1..25: mol_type = other DNA
ggatgggagatcacacagaccctat

SEQ ID NO: 28239 - DNA, 25 bp, synthetic construct
  misc_feature 1..25: note = Synthetic Construct
  source 1..25: mol_type = other DNA
cggagcactcaccattctagacctt

SEQ ID NO: 28240 - DNA, 23 bp, synthetic construct
  misc_feature 1..23: note = Synthetic Construct
  source 1..23: mol_type = other DNA
cccctgtctcttggttgttcctt

SEQ ID NO: 28241 - DNA, 27 bp, synthetic construct
  misc_feature 1..27: note = Synthetic Construct
  source 1..27: mol_type = other DNA
ccagcttactgacttgtaaggatggtt

SEQ ID NO: 28242 - DNA, 23 bp, synthetic construct
  misc_feature 1..23: note = Synthetic Construct
  source 1..23: mol_type = other DNA
tgtgaagggaagctttggaatca

SEQ ID NO: 28243 - DNA, 26 bp, synthetic construct
  misc_feature 1..26: note = Synthetic Construct
  source 1..26: mol_type = other DNA
cacatggatagttcagtctccacaca

SEQ ID NO: 28244 - DNA, 23 bp, synthetic construct
  misc_feature 1..23: note = Synthetic Construct
  source 1..23: mol_type = other DNA
gtctgcttccatgaacgtacaga

SEQ ID NO: 28245 - DNA, 26 bp, synthetic construct
  misc_feature 1..26: note = Synthetic Construct
  source 1..26: mol_type = other DNA
gagaccttgttccctttatgcatctt

SEQ ID NO: 28246 - DNA, 25 bp, synthetic construct
  misc_feature 1..25: note = Synthetic Construct
  source 1..25: mol_type = other DNA
gaggcataatcccaaatctctctgt

SEQ ID NO: 28247 - DNA, 25 bp, synthetic construct
  misc_feature 1..25: note = Synthetic Construct
  source 1..25: mol_type = other DNA
gtgttatgtgtcaagccttctgttc

SEQ ID NO: 28248 - DNA, 30 bp, synthetic construct
  misc_feature 1..30: note = Synthetic Construct
  source 1..30: mol_type = other DNA
gtctgtgagagaaacattccgtgaatcaat

SEQ ID NO: 28249 - DNA, 23 bp, synthetic construct
  misc_feature 1..23: note = Synthetic Construct
  source 1..23: mol_type = other DNA
cctggttcacatgctgtggtgta

SEQ ID NO: 28250 - DNA, 21 bp, synthetic construct
  misc_feature 1..21: note = Synthetic Construct
  source 1..21: mol_type = other DNA
gccaaggtgggtgtgcatctt

SEQ ID NO: 28251 - DNA, 21 bp, synthetic construct
  misc_feature 1..21: note = Synthetic Construct
  source 1..21: mol_type = other DNA
agacagcctcggttctggaat

SEQ ID NO: 28252 - DNA, 27 bp, synthetic construct
  misc_feature 1..27: note = Synthetic Construct
  source 1..27: mol_type = other DNA
ctctaggccagggactttaattacaca

SEQ ID NO: 28253 - DNA, 20 bp, synthetic construct
  misc_feature 1..20: note = Synthetic Construct
  source 1..20: mol_type = other DNA
ggggtgttgcatctgtgcat

SEQ ID NO: 28254 - DNA, 25 bp, synthetic construct
  misc_feature 1..25: note = Synthetic Construct
  source 1..25: mol_type = other DNA
gcaggaaataaagcaaggggatttg

SEQ ID NO: 28255 - DNA, 23 bp, synthetic construct
  misc_feature 1..23: note = Synthetic Construct
  source 1..23: mol_type = other DNA
gctcattggcttccttactgtga

SEQ ID NO: 28256 - DNA, 22 bp, synthetic construct
  misc_feature 1..22: note = Synthetic Construct
  source 1..22: mol_type = other DNA
cctgaagcactagcctgctcaa

SEQ ID NO: 28257 - DNA, 25 bp, synthetic construct
  misc_feature 1..25: note = Synthetic Construct
  source 1..25: mol_type = other DNA
tgcattgcctggtatgaggaattag

SEQ ID NO: 28258 - DNA, 24 bp, synthetic construct
  misc_feature 1..24: note = Synthetic Construct
  source 1..24: mol_type = other DNA
ctggtttccgctagagtcttgttc

SEQ ID NO: 28259 - DNA, 25 bp, synthetic construct
  misc_feature 1..25: note = Synthetic Construct
  source 1..25: mol_type = other DNA
gcacggaaaagcaaaagctgataac

SEQ ID NO: 28260 - DNA, 21 bp, synthetic construct
  misc_feature 1..21: note = Synthetic Construct
  source 1..21: mol_type = other DNA
tcagagaacggcaccggagat

SEQ ID NO: 28261 - DNA, 22 bp, synthetic construct
  misc_feature 1..22: note = Synthetic Construct
  source 1..22: mol_type = other DNA
gagagcctgatgaccacaggaa

SEQ ID NO: 28262 - DNA, 26 bp, synthetic construct
  misc_feature 1..26: note = Synthetic Construct
  source 1..26: mol_type = other DNA
gaacctgaaaggcattgaacgtaaca

SEQ ID NO: 28263 - DNA, 26 bp, synthetic construct
  misc_feature 1..26: note = Synthetic Construct
  source 1..26: mol_type = other DNA
gtcaatatgcatgaccaggacctaga

SEQ ID NO: 28264 - DNA, 22 bp, synthetic construct
  misc_feature 1..22: note = Synthetic Construct
  source 1..22: mol_type = other DNA
caggtggctagagtagctgcat

SEQ ID NO: 28265 - DNA, 22 bp, synthetic construct
  misc_feature 1..22: note = Synthetic Construct
  source 1..22: mol_type = other DNA
ccttccttggcgtgcagtagat

SEQ ID NO: 28266 - DNA, 21 bp, synthetic construct
  misc_feature 1..21: note = Synthetic Construct
  source 1..21: mol_type = other DNA
cccctgtcgccaatgatccta

SEQ ID NO: 28267 - DNA, 26 bp, synthetic construct
  misc_feature 1..26: note = Synthetic Construct
  source 1..26: mol_type = other DNA
gattggcctactgcataattccctat

SEQ ID NO: 28268 - DNA, 26 bp, synthetic construct
  misc_feature 1..26: note = Synthetic Construct
  source 1..26: mol_type = other DNA
ggtggaactttccttacagtcagaca

SEQ ID NO: 28269 - DNA, 22 bp, synthetic construct
  misc_feature 1..22: note = Synthetic Construct
  source 1..22: mol_type = other DNA
gcaggagggagatttgtggaaa

SEQ ID NO: 28270 - DNA, 25 bp, synthetic construct
  misc_feature 1..25: note = Synthetic Construct
  source 1..25: mol_type = other DNA
tgtgaactgttaggaagctgtcttt

SEQ ID NO: 28271 - DNA, 19 bp, synthetic construct
  misc_feature 1..19: note = Synthetic Construct
  source 1..19: mol_type = other DNA
cccggccacaatggcatct

SEQ ID NO: 28272 - DNA, 20 bp, synthetic construct
  misc_feature 1..20: note = Synthetic Construct
  source 1..20: mol_type = other DNA
gcaactggctccccttctct

SEQ ID NO: 28273 - DNA, 22 bp, synthetic construct
  misc_feature 1..22: note = Synthetic Construct
  source 1..22: mol_type = other DNA
gctttgtcctccacctcctaag

SEQ ID NO: 28274 - DNA, 19 bp, synthetic construct
  misc_feature 1..19: note = Synthetic Construct
  source 1..19: mol_type = other DNA
gcagcagcttctggtgcaa

SEQ ID NO: 28275 - DNA, 28 bp, synthetic construct
  misc_feature 1..28: note = Synthetic Construct
  source 1..28: mol_type = other DNA
ggttggagataaaacacgtgtaggattg

SEQ ID NO: 28276 - DNA, 24 bp, synthetic construct
  misc_feature 1..24: note = Synthetic Construct
  source 1..24: mol_type = other DNA
acaggcggaatgtaatatcgttct

SEQ ID NO: 28277 - DNA, 22 bp, synthetic construct
  misc_feature 1..22: note = Synthetic Construct
  source 1..22: mol_type = other DNA
gcccagccagtgagcttatttc

SEQ ID NO: 28278 - DNA, 25 bp, synthetic construct
  misc_feature 1..25: note = Synthetic Construct
  source 1..25: mol_type = other DNA
gccgcttggaaatcaatacactttg

SEQ ID NO: 28279 - DNA, 25 bp, synthetic construct
  misc_feature 1..25: note = Synthetic Construct
  source 1..25: mol_type = other DNA
acccaggaattcatcacaaaactgt

SEQ ID NO: 28280 - DNA, 24 bp, synthetic construct
  misc_feature 1..24: note = Synthetic Construct
  source 1..24: mol_type = other DNA
ccctgactgagaaccaaggactga

SEQ ID NO: 28281 - DNA, 25 bp, synthetic construct
  misc_feature 1..25: note = Synthetic Construct
  source 1..25: mol_type = other DNA
acagaaggtaacagtctttcacagt

SEQ ID NO: 28282 - DNA, 21 bp, synthetic construct
  misc_feature 1..21: note = Synthetic Construct
  source 1..21: mol_type = other DNA
ccagctggtggatggcagata

SEQ ID NO: 28283 - DNA, 21 bp, synthetic construct
  misc_feature 1..21: note = Synthetic Construct
  source 1..21: mol_type = other DNA
ggcctcccctttctgcttctt

SEQ ID NO: 28284 - DNA, 21 bp, synthetic construct
  misc_feature 1..21: note = Synthetic Construct
  source 1..21: mol_type = other DNA
agctcccagctgtgcagtcta

SEQ ID NO: 28285 - DNA, 23 bp, synthetic construct
  misc_feature 1..23: note = Synthetic Construct
  source 1..23: mol_type = other DNA
gtggcagattgattccctcagat

SEQ ID NO: 28286 - DNA, 23 bp, synthetic construct
  misc_feature 1..23: note = Synthetic Construct
  source 1..23: mol_type = other DNA
gaaccctccactgtccttgttag

SEQ ID NO: 28287 - DNA, 24 bp, synthetic construct
  misc_feature 1..24: note = Synthetic Construct
  source 1..24: mol_type = other DNA
gtgaggatgaccagaggtctcttt

SEQ ID NO: 28288 - DNA, 19 bp, synthetic construct
  misc_feature 1..19: note = Synthetic Construct
  source 1..19: mol_type = other DNA
cgcgggaaatgcgggaaat

SEQ ID NO: 28289 - DNA, 30 bp, synthetic construct
  misc_feature 1..30: note = Synthetic Construct
  source 1..30: mol_type = other DNA
gactgaccactgatacttcctgttaaatca

SEQ ID NO: 28290 - DNA, 24 bp, synthetic construct
  misc_feature 1..24: note = Synthetic Construct
  source 1..24: mol_type = other DNA
tgcaactttgcaggtaaagaggat

SEQ ID NO: 28291 - DNA, 23 bp, synthetic construct
  misc_feature 1..23: note = Synthetic Construct
  source 1..23: mol_type = other DNA
gggataggcgaagagtagacaga

SEQ ID NO: 28292 - DNA, 22 bp, synthetic construct
  misc_feature 1..22: note = Synthetic Construct
  source 1..22: mol_type = other DNA
caggtggattgcaagacaggaa

SEQ ID NO: 28293 - DNA, 22 bp, synthetic construct
  misc_feature 1..22: note = Synthetic Construct
  source 1..22: mol_type = other DNA
tggggcttttgtaaagcgacat

SEQ ID NO: 28294 - DNA, 22 bp, synthetic construct
  misc_feature 1..22: note = Synthetic Construct
  source 1..22: mol_type = other DNA
aggatagagaggggccaaatgt

SEQ ID NO: 28295 - DNA, 22 bp, synthetic construct
  misc_feature 1..22: note = Synthetic Construct
  source 1..22: mol_type = other DNA
agggaaggactcccagggaaaa

SEQ ID NO: 28296 - DNA, 24 bp, synthetic construct
  misc_feature 1..24: note = Synthetic Construct
  source 1..24: mol_type = other DNA
gaaagtgcggatggaatggaattg

SEQ ID NO: 28297 - DNA, 25 bp, synthetic construct
  misc_feature 1..25: note = Synthetic Construct
  source 1..25: mol_type = other DNA
ctgttgagatgaaaagggagtggat

SEQ ID NO: 28298 - DNA, 21 bp, synthetic construct
  misc_feature 1..21: note = Synthetic Construct
  source 1..21: mol_type = other DNA
ctttgggcagacctagagcaa

SEQ ID NO: 28299 - DNA, 21 bp, synthetic construct
  misc_feature 1..21: note = Synthetic Construct
  source 1..21: mol_type = other DNA
ggaagccacagaccctcaaat

SEQ ID NO: 28300 - DNA, 27 bp, synthetic construct
  misc_feature 1..27: note = Synthetic Construct
  source 1..27: mol_type = other DNA
gctagaacatcatacatcgaggcatac

SEQ ID NO: 28301 - DNA, 24 bp, synthetic construct
  misc_feature 1..24: note = Synthetic Construct
  source 1..24: mol_type = other DNA
gcctgagctgcattcagacatagt

SEQ ID NO: 28302 - DNA, 26 bp, synthetic construct
  misc_feature 1..26: note = Synthetic Construct
  source 1..26: mol_type = other DNA
gcctggggaattataaggaagggatt

SEQ ID NO: 28303 - DNA, 21 bp, synthetic construct
  misc_feature 1..21: note = Synthetic Construct
  source 1..21: mol_type = other DNA
actaaccctcccctccagtgt

SEQ ID NO: 28304 - DNA, 21 bp, synthetic construct
  misc_feature 1..21: note = Synthetic Construct
  source 1..21: mol_type = other DNA
cgcaagtctgcattccaacaa

SEQ ID NO: 28305 - DNA, 26 bp, synthetic construct
  misc_feature 1..26: note = Synthetic Construct
  source 1..26: mol_type = other DNA
ctgggaatctagttagagaggctgta

SEQ ID NO: 28306 - DNA, 26 bp, synthetic construct
  misc_feature 1..26: note = Synthetic Construct
  source 1..26: mol_type = other DNA
cgacttcaccatcttccttcgtctct

SEQ ID NO: 28307 - DNA, 28 bp, synthetic construct
  misc_feature 1..28: note = Synthetic Construct
  source 1..28: mol_type = other DNA
ccattcagagctcttgactcaatgatac

SEQ ID NO: 28308 - DNA, 27 bp, synthetic construct
  misc_feature 1..27: note = Synthetic Construct
  source 1..27: mol_type = other DNA
gagcagagaagacacctcatatagctt

SEQ ID NO: 28309 - DNA, 20 bp, synthetic construct
  misc_feature 1..20: note = Synthetic Construct
  source 1..20: mol_type = other DNA
tagtggcgaggaggcgagtt

SEQ ID NO: 28310 - DNA, 26 bp, synthetic construct
  misc_feature 1..26: note = Synthetic Construct
  source 1..26: mol_type = other DNA
gagtctgaagcccacaactattttca

SEQ ID NO: 28311 - DNA, 20 bp, synthetic construct
  misc_feature 1..20: note = Synthetic Construct
  source 1..20: mol_type = other DNA
gcaagcagctggcagttgaa

SEQ ID NO: 28312 - DNA, 22 bp, synthetic construct
  misc_feature 1..22: note = Synthetic Construct
  source 1..22: mol_type = other DNA
tgcctggttacctcccatttac

SEQ ID NO: 28313 - DNA, 24 bp, synthetic construct
  misc_feature 1..24: note = Synthetic Construct
  source 1..24: mol_type = other DNA
gcacagaccaaccttggtagtaac

SEQ ID NO: 28314 - DNA, 24 bp, synthetic construct
  misc_feature 1..24: note = Synthetic Construct
  source 1..24: mol_type = other DNA
tcagagggtgaagaggaagttttc

SEQ ID NO: 28315 - DNA, 23 bp, synthetic construct
  misc_feature 1..23: note = Synthetic Construct
  source 1..23: mol_type = other DNA
gtgatgggctgatggtacctctt

SEQ ID NO: 28316 - DNA, 22 bp, synthetic construct
  misc_feature 1..22: note = Synthetic Construct
  source 1..22: mol_type = other DNA
tgatcccaggacaaacacgatt

SEQ ID NO: 28317 - DNA, 22 bp, synthetic construct
  misc_feature 1..22: note = Synthetic Construct
  source 1..22: mol_type = other DNA
ccacaccacggtcttgtcttag

SEQ ID NO: 28318 - DNA, 20 bp, synthetic construct
  misc_feature 1..20: note = Synthetic Construct
  source 1..20: mol_type = other DNA
tgaggcactcccgcctttga

SEQ ID NO: 28319 - DNA, 25 bp, synthetic construct
  misc_feature 1..25: note = Synthetic Construct
  source 1..25: mol_type = other DNA
ctgagaggacatttgatgggtctaa

SEQ ID NO: 28320 - DNA, 22 bp, synthetic construct
  misc_feature 1..22: note = Synthetic Construct
  source 1..22: mol_type = other DNA
gtggcggtgaatgcctgtaatc

SEQ ID NO: 28321 - DNA, 27 bp, synthetic construct
  misc_feature 1..27: note = Synthetic Construct
  source 1..27: mol_type = other DNA
caagtatctggacaagctgataaggaa

SEQ ID NO: 28322 - DNA, 20 bp, synthetic construct
  misc_feature 1..20: note = Synthetic Construct
  source 1..20: mol_type = other DNA
gccagtggattctgcgtcaa

SEQ ID NO: 28323 - DNA, 24 bp, synthetic construct
  misc_feature 1..24: note = Synthetic Construct
  source 1..24: mol_type = other DNA
gcattccaggatgggaaaaccata

SEQ ID NO: 28324 - DNA, 27 bp, synthetic construct
  misc_feature 1..27: note = Synthetic Construct
  source 1..27: mol_type = other DNA
gtctttccaaagtttcatccacacatc

SEQ ID NO: 28325 - DNA, 29 bp, synthetic construct
  misc_feature 1..29: note = Synthetic Construct
  source 1..29: mol_type = other DNA
ccccacatactctctgtgttattgagatg

SEQ ID NO: 28326 - DNA, 25 bp, synthetic construct
  misc_feature 1..25: note = Synthetic Construct
  source 1..25: mol_type = other DNA
ccagtgtgacatgactaggatgttg

SEQ ID NO: 28327 - DNA, 23 bp, synthetic construct
  misc_feature 1..23: note = Synthetic Construct
  source 1..23: mol_type = other DNA
tctgacactgagttgggaaggaa

SEQ ID NO: 28328 - DNA, 26 bp, synthetic construct
  misc_feature 1..26: note = Synthetic Construct
  source 1..26: mol_type = other DNA
ctggttctgctaacattggtgtcaac

SEQ ID NO: 28329 - DNA, 22 bp, synthetic construct
  misc_feature 1..22: note = Synthetic Construct
  source 1..22: mol_type = other DNA
ggggcaagggctgcaaaagtaa

SEQ ID NO: 28330 - DNA, 25 bp, synthetic construct
  misc_feature 1..25: note = Synthetic Construct
  source 1..25: mol_type = other DNA
ggtgcctaccctatgtgatttctga

SEQ ID NO: 28331 - DNA, 20 bp, synthetic construct
  misc_feature 1..20: note = Synthetic Construct
  source 1..20: mol_type = other DNA
actgccctgtgacactggaa

SEQ ID NO: 28332 - DNA, 30 bp, synthetic construct
  misc_feature 1..30: note = Synthetic Construct
  source 1..30: mol_type = other DNA
gagctaaagtctgaggaggttctgttttta

SEQ ID NO: 28333 - DNA, 21 bp, synthetic construct
  misc_feature 1..21: note = Synthetic Construct
  source 1..21: mol_type = other DNA
tggaatggtgtagcccagtga

SEQ ID NO: 28334 - DNA, 24 bp, synthetic construct
  misc_feature 1..24: note = Synthetic Construct
  source 1..24: mol_type = other DNA
gacctgctcaatgcttctggtaag

SEQ ID NO: 28335 - DNA, 23 bp, synthetic construct
  misc_feature 1..23: note = Synthetic Construct
  source 1..23: mol_type = other DNA
ggggacagctttgattccctatg

SEQ ID NO: 28336 - DNA, 23 bp, synthetic construct
  misc_feature 1..23: note = Synthetic Construct
  source 1..23: mol_type = other DNA
cacagcgtaggcaatgattcttc

SEQ ID NO: 28337 - DNA, 22 bp, synthetic construct
  misc_feature 1..22: note = Synthetic Construct
  source 1..22: mol_type = other DNA
gcctggtggaactggctattgt

SEQ ID NO: 28338 - DNA, 24 bp, synthetic construct
  misc_feature 1..24: note = Synthetic Construct
  source 1..24: mol_type = other DNA
ctgtatcccaccagagttggttag

SEQ ID NO: 28339 - DNA, 22 bp, synthetic construct
  misc_feature 1..22: note = Synthetic Construct
  source 1..22: mol_type = other DNA
tctgccccttctagctctgctt

SEQ ID NO: 28340 - DNA, 23 bp, synthetic construct
  misc_feature 1..23: note = Synthetic Construct
  source 1..23: mol_type = other DNA
ccccagctcttctcttcctagat

SEQ ID NO: 28341 - DNA, 26 bp, synthetic construct
  misc_feature 1..26: note = Synthetic Construct
  source 1..26: mol_type = other DNA
ccacttagtcctttcagcagccaaat

SEQ ID NO: 28342 - DNA, 21 bp, synthetic construct
  misc_feature 1..21: note = Synthetic Construct
  source 1..21: mol_type = other DNA
gcagttggcaagctggagact

SEQ ID NO: 28343 - DNA, 25 bp, synthetic construct
  misc_feature 1..25: note = Synthetic Construct
  source 1..25: mol_type = other DNA
gaaagagacacacaacaaggctatg

SEQ ID NO: 28344 - DNA, 23 bp, synthetic construct
  misc_feature 1..23: note = Synthetic Construct
  source 1..23: mol_type = other DNA
gggtggagtgaagccaattccaa

SEQ ID NO: 28345 - DNA, 20 bp, synthetic construct
  misc_feature 1..20: note = Synthetic Construct
  source 1..20: mol_type = other DNA
agtgggtgtgcagtttgctt

SEQ ID NO: 28346 - DNA, 23 bp, synthetic construct
  misc_feature 1..23: note = Synthetic Construct
  source 1..23: mol_type = other DNA
ggtggtagagcagagtccagtgt

SEQ ID NO: 28347 - DNA, 27 bp, synthetic construct
  misc_feature 1..27: note = Synthetic Construct
  source 1..27: mol_type = other DNA
cttcaaaagttatgctgtggtggtaga

SEQ ID NO: 28348 - DNA, 26 bp, synthetic construct
  misc_feature 1..26: note = Synthetic Construct
  source 1..26: mol_type = other DNA
gctgtctttgtggtctagattgcttt

SEQ ID NO: 28349 - DNA, 20 bp, synthetic construct
  misc_feature 1..20: note = Synthetic Construct
  source 1..20: mol_type = other DNA
tttcctctggccctgaccat

SEQ ID NO: 28350 - DNA, 26 bp, synthetic construct
  misc_feature 1..26: note = Synthetic Construct
  source 1..26: mol_type = other DNA
gggaaacaaagtcaatcctccatttc

SEQ ID NO: 28351 - DNA, 27 bp, synthetic construct
  misc_feature 1..27: note = Synthetic Construct
  source 1..27: mol_type = other DNA
ggggagttaatcagatttgctttgaga

SEQ ID NO: 28352 - DNA, 24 bp, synthetic construct
  misc_feature 1..24: note = Synthetic Construct
  source 1..24: mol_type = other DNA
gtggtgagacttggaaaggggttt

SEQ ID NO: 28353 - DNA, 25 bp, synthetic construct
  misc_feature 1..25: note = Synthetic Construct
  source 1..25: mol_type = other DNA
gtggttaatggaaaacagggcatag

SEQ ID NO: 28354 - DNA, 26 bp, synthetic construct
  misc_feature 1..26: note = Synthetic Construct
  source 1..26: mol_type = other DNA
cacctggatatttcagaagcccttga

SEQ ID NO: 28355 - DNA, 23 bp, synthetic construct
  misc_feature 1..23: note = Synthetic Construct
  source 1..23: mol_type = other DNA
cctaagtcactccacaggacaca

SEQ ID NO: 28356 - DNA, 24 bp, synthetic construct
  misc_feature 1..24: note = Synthetic Construct
  source 1..24: mol_type = other DNA
ctgagctaggtagcctgctctaaa

SEQ ID NO: 28357 - DNA, 24 bp, synthetic construct
  misc_feature 1..24: note = Synthetic Construct
  source 1..24: mol_type = other DNA
ggactacttgcgttttgattgcta

SEQ ID NO: 28358 - DNA, 25 bp, synthetic construct
  misc_feature 1..25: note = Synthetic Construct
  source 1..25: mol_type = other DNA
gaagtcacgcattgaatcagagtag

SEQ ID NO: 28359 - DNA, 27 bp, synthetic construct
  misc_feature 1..27: note = Synthetic Construct
  source 1..27: mol_type = other DNA
ctctttgagcttggagtctctaataca

SEQ ID NO: 28360 - DNA, 24 bp, synthetic construct
  misc_feature 1..24: note = Synthetic Construct
  source 1..24: mol_type = other DNA
gtgttcagcctctgcctatttttc

SEQ ID NO: 28361 - DNA, 24 bp, synthetic construct
  misc_feature 1..24: note = Synthetic Construct
  source 1..24: mol_type = other DNA
gggcctttttacatgttccagaag

SEQ ID NO: 28362 - DNA, 24 bp, synthetic construct
  misc_feature 1..24: note = Synthetic Construct
  source 1..24: mol_type = other DNA
gtgagtcatgccaagatgagattg

SEQ ID NO: 28363 - DNA, 24 bp, synthetic construct
  misc_feature 1..24: note = Synthetic Construct
  source 1..24: mol_type = other DNA
cagtacacggaagctgatgtaaga

SEQ ID NO: 28364 - DNA, 22 bp, synthetic construct
  misc_feature 1..22: note = Synthetic Construct
  source 1..22: mol_type = other DNA
gagaacagcaccaagcctctca

SEQ ID NO: 28365 - DNA, 25 bp, synthetic construct
  misc_feature 1..25: note = Synthetic Construct
  source 1..25: mol_type = other DNA
ggactgagacaggggttttaactga

SEQ ID NO: 28366 - DNA, 18 bp, synthetic construct
  misc_feature 1..18: note = Synthetic Construct
  source 1..18: mol_type = other DNA
agacacacggggcctttg

SEQ ID NO: 28367 - DNA, 23 bp, synthetic construct
  misc_feature 1..23: note = Synthetic Construct
  source 1..23: mol_type = other DNA
ggagcattttgacgtgggtgatt

SEQ ID NO: 28368 - DNA, 23 bp, synthetic construct
  misc_feature 1..23: note = Synthetic Construct
  source 1..23: mol_type = other DNA
tggtttgggttctgaatgacaca

SEQ ID NO: 28369 - DNA, 28 bp, synthetic construct
  misc_feature 1..28: note = Synthetic Construct
  source 1..28: mol_type = other DNA
ctgtcttaggaataaggcgaggttgaag

SEQ ID NO: 28370 - DNA, 23 bp, synthetic construct
  misc_feature 1..23: note = Synthetic Construct
  source 1..23: mol_type = other DNA
gtgccactacagctggaaaggat

SEQ ID NO: 28371 - DNA, 20 bp, synthetic construct
  misc_feature 1..20: note = Synthetic Construct
  source 1..20: mol_type = other DNA
caccaaggccaatcccttca

SEQ ID NO: 28372 - DNA, 25 bp, synthetic construct
  misc_feature 1..25: note = Synthetic Construct
  source 1..25: mol_type = other DNA
gtgggtgagctacttttctcaggat

SEQ ID NO: 28373 - DNA, 24 bp, synthetic construct
  misc_feature 1..24: note = Synthetic Construct
  source 1..24: mol_type = other DNA
cccattgtagaccatttgctctct

SEQ ID NO: 28374 - DNA, 24 bp, synthetic construct
  misc_feature 1..24: note = Synthetic Construct
  source 1..24: mol_type = other DNA
ggccctgccattcaaaatcacctt

SEQ ID NO: 28375 - DNA, 24 bp, synthetic construct
  misc_feature 1..24: note = Synthetic Construct
  source 1..24: mol_type = other DNA
ccataccatgcaggcttactcaag

SEQ ID NO: 28376 - DNA, 21 bp, synthetic construct
  misc_feature 1..21: note = Synthetic Construct
  source 1..21: mol_type = other DNA
caccatggctactgacccatt

SEQ ID NO: 28377 - DNA, 20 bp, synthetic construct
  misc_feature 1..20: note = Synthetic Construct
  source 1..20: mol_type = other DNA
ttggggctcggaaggaacat

SEQ ID NO: 28378 - DNA, 26 bp, synthetic construct
  misc_feature 1..26: note = Synthetic Construct
  source 1..26: mol_type = other DNA
gggagtgtgactgtagagaatgttag

SEQ ID NO: 28379 - DNA, 23 bp, synthetic construct
  misc_feature 1..23: note = Synthetic Construct
  source 1..23: mol_type = other DNA
ggcagagcaggagactaggaaca

SEQ ID NO: 28380 - DNA, 22 bp, synthetic construct
  misc_feature 1..22: note = Synthetic Construct
  source 1..22: mol_type = other DNA
tggctgaggggtcagttttatg

SEQ ID NO: 28381 - DNA, 23 bp, synthetic construct
  misc_feature 1..23: note = Synthetic Construct
  source 1..23: mol_type = other DNA
ctgtgaacacaggaagtccaaga

SEQ ID NO: 28382 - DNA, 24 bp, synthetic construct
  misc_feature 1..24: note = Synthetic Construct
  source 1..24: mol_type = other DNA
caacgccagacctttcttatttgt

SEQ ID NO: 28383 - DNA, 26 bp, synthetic construct
  misc_feature 1..26: note = Synthetic Construct
  source 1..26: mol_type = other DNA
gttcttaggatcctgtcctgctttac

SEQ ID NO: 28384 - DNA, 24 bp, synthetic construct
  misc_feature 1..24: note = Synthetic Construct
  source 1..24: mol_type = other DNA
ctgccctggtaaatatccaactga

SEQ ID NO: 28385 - DNA, 27 bp, synthetic construct
  misc_feature 1..27: note = Synthetic Construct
  source 1..27: mol_type = other DNA
gtgggactagagaacatatctgtgaga

SEQ ID NO: 28386 - DNA, 24 bp, synthetic construct
  misc_feature 1..24: note = Synthetic Construct
  source 1..24: mol_type = other DNA
tgttttgcctgacatcttgagtga

SEQ ID NO: 28387 - DNA, 23 bp, synthetic construct
  misc_feature 1..23: note = Synthetic Construct
  source 1..23: mol_type = other DNA
tcttgttgctcttgaaggcattg

SEQ ID NO: 28388 - DNA, 24 bp, synthetic construct
  misc_feature 1..24: note = Synthetic Construct
  source 1..24: mol_type = other DNA
gttgctttgcattccaagcctttc

SEQ ID NO: 28389 - DNA, 22 bp, synthetic construct
  misc_feature 1..22: note = Synthetic Construct
  source 1..22: mol_type = other DNA
ggagggaaaatgcactgagaca

SEQ ID NO: 28390 - DNA, 21 bp, synthetic construct
  misc_feature 1..21: note = Synthetic Construct
  source 1..21: mol_type = other DNA
ccgatgggatgtggaggtgat

SEQ ID NO: 28391 - DNA, 24 bp, synthetic construct
  misc_feature 1..24: note = Synthetic Construct
  source 1..24: mol_type = other DNA
tctggtcttaggctggagattagt

SEQ ID NO: 28392 - DNA, 24 bp, synthetic construct
  misc_feature 1..24: note = Synthetic Construct
  source 1..24: mol_type = other DNA
ggtgagtgccatgttgtttactgt

SEQ ID NO: 28393 - DNA, 22 bp, synthetic construct
  misc_feature 1..22: note = Synthetic Construct
  source 1..22: mol_type = other DNA
tgtgccagccttctgtatcttg

SEQ ID NO: 28394 - DNA, 22 bp, synthetic construct
  misc_feature 1..22: note = Synthetic Construct
  source 1..22: mol_type = other DNA
gatccttcccactcgaggaaac

SEQ ID NO: 28395 - DNA, 22 bp, synthetic construct
  misc_feature 1..22: note = Synthetic Construct
  source 1..22: mol_type = other DNA
aggatcccaatcctagctgtca

SEQ ID NO: 28396 - DNA, 22 bp, synthetic construct
  misc_feature 1..22: note = Synthetic Construct
  source 1..22: mol_type = other DNA
tggttgggagacacacggagat

SEQ ID NO: 28397 - DNA, 20 bp, synthetic construct
  misc_feature 1..20: note = Synthetic Construct
  source 1..20: mol_type = other DNA
tgggcagagtgcttggaaag

SEQ ID NO: 28398 - DNA, 26 bp, synthetic construct
  misc_feature 1..26: note = Synthetic Construct
  source 1..26: mol_type = other DNA
accaaccagtaaagtccagtaaccta

SEQ ID NO: 28399 - DNA, 22 bp, synthetic construct
  misc_feature 1..22: note = Synthetic Construct
  source 1..22: mol_type = other DNA
agctccccaggcaattcaggta

SEQ ID NO: 28400 - DNA, 22 bp, synthetic construct
  misc_feature 1..22: note = Synthetic Construct
  source 1..22: mol_type = other DNA
gtgcccttttccctgtccagaa

SEQ ID NO: 28401 - DNA, 20 bp, synthetic construct
  misc_feature 1..20: note = Synthetic Construct
  source 1..20: mol_type = other DNA
aggcctccaggacagggaaa

SEQ ID NO: 28402 - DNA, 28 bp, synthetic construct
  misc_feature 1..28: note = Synthetic Construct
  source 1..28: mol_type = other DNA
ggtgcaaatagggtgtgattagaaggaa

SEQ ID NO: 28403 - DNA, 26 bp, synthetic construct
  misc_feature 1..26: note = Synthetic Construct
  source 1..26: mol_type = other DNA
cagaagcttgatgacttcccaagaac

SEQ ID NO: 28404 - DNA, 23 bp, synthetic construct
  misc_feature 1..23: note = Synthetic Construct
  source 1..23: mol_type = other DNA
gagaaaccaaaacccaggtctgt

SEQ ID NO: 28405 - DNA, 23 bp, synthetic construct
  misc_feature 1..23: note = Synthetic Construct
  source 1..23: mol_type = other DNA
gtgccctaacttggtgcttctct

SEQ ID NO: 28406 - DNA, 21 bp, synthetic construct
  misc_feature 1..21: note = Synthetic Construct
  source 1..21: mol_type = other DNA
ggaggtgtgtctggcttgcat

SEQ ID NO: 28407 - DNA, 22 bp, synthetic construct
  misc_feature 1..22: note = Synthetic Construct
  source 1..22: mol_type = other DNA
ccaaccggacacctctcataca

SEQ ID NO: 28408 - DNA, 22 bp, synthetic construct
  misc_feature 1..22: note = Synthetic Construct
  source 1..22: mol_type = other DNA
ctcctggggtccctttttctct

SEQ ID NO: 28409 - DNA, 24 bp, synthetic construct
  misc_feature 1..24: note = Synthetic Construct
  source 1..24: mol_type = other DNA
ggcctttatttgttcctggtcagt

SEQ ID NO: 28410 - DNA, 27 bp, synthetic construct
  misc_feature 1..27: note = Synthetic Construct
  source 1..27: mol_type = other DNA
gacttaagtttaaaacccaggctgttc

SEQ ID NO: 28411 - DNA, 23 bp, synthetic construct
  misc_feature 1..23: note = Synthetic Construct
  source 1..23: mol_type = other DNA
ccagtggagatgcctgcaaatca

SEQ ID NO: 28412 - DNA, 20 bp, synthetic construct
  misc_feature 1..20: note = Synthetic Construct
  source 1..20: mol_type = other DNA
ggagccctatgggccatcaa

SEQ ID NO: 28413 - DNA, 21 bp, synthetic construct
  misc_feature 1..21: note = Synthetic Construct
  source 1..21: mol_type = other DNA
gggctggaaccaatggctagt

SEQ ID NO: 28414 - DNA, 24 bp, synthetic construct
  misc_feature 1..24: note = Synthetic Construct
  source 1..24: mol_type = other DNA
ggaaaccacttggaatctggtagt

SEQ ID NO: 28415 - DNA, 24 bp, synthetic construct
  misc_feature 1..24: note = Synthetic Construct
  source 1..24: mol_type = other DNA
gggagcagaaagaggagatcttag

SEQ ID NO: 28416 - DNA, 22 bp, synthetic construct
  misc_feature 1..22: note = Synthetic Construct
  source 1..22: mol_type = other DNA
cctggttttcagggagggaaga

SEQ ID NO: 28417 - DNA, 18 bp, synthetic construct
  misc_feature 1..18: note = Synthetic Construct
  source 1..18: mol_type = other DNA
tcgctgagggctgtctct

SEQ ID NO: 28418 - DNA, 22 bp, synthetic construct
  misc_feature 1..22: note = Synthetic Construct
  source 1..22: mol_type = other DNA
tggcggggaagactaacgtttc

SEQ ID NO: 28419 - DNA, 28 bp, synthetic construct
  misc_feature 1..28: note = Synthetic Construct
  source 1..28: mol_type = other DNA
gcttcctaccttcagtagtatcagtagt

SEQ ID NO: 28420 - DNA, 21 bp, synthetic construct
  misc_feature 1..21: note = Synthetic Construct
  source 1..21: mol_type = other DNA
tggggatcacaaggacgaaag

SEQ ID NO: 28421 - DNA, 22 bp, synthetic construct
  misc_feature 1..22: note = Synthetic Construct
  source 1..22: mol_type = other DNA
agccctcaccccatttctggat

SEQ ID NO: 28422 - DNA, 24 bp, synthetic construct
  misc_feature 1..24: note = Synthetic Construct
  source 1..24: mol_type = other DNA
cccactgctaacactgacatagaa

SEQ ID NO: 28423 - DNA, 24 bp, synthetic construct
  misc_feature 1..24: note = Synthetic Construct
  source 1..24: mol_type = other DNA
gcaagctcagagggcttattcaag

SEQ ID NO: 28424 - DNA, 27 bp, synthetic construct
  misc_feature 1..27: note = Synthetic Construct
  source 1..27: mol_type = other DNA
ggaaggaaatgatagagagaggcattg

SEQ ID NO: 28425 - DNA, 22 bp, synthetic construct
  misc_feature 1..22: note = Synthetic Construct
  source 1..22: mol_type = other DNA
gagggtaagtggctcagagagt

SEQ ID NO: 28426 - DNA, 22 bp, synthetic construct
  misc_feature 1..22: note = Synthetic Construct
  source 1..22: mol_type = other DNA
gctttctatcaggctcccagtt

SEQ ID NO: 28427 - DNA, 22 bp, synthetic construct
  misc_feature 1..22: note = Synthetic Construct
  source 1..22: mol_type = other DNA
ggctgggcctctaccttttgaa

SEQ ID NO: 28428 - DNA, 27 bp, synthetic construct
  misc_feature 1..27: note = Synthetic Construct
  source 1..27: mol_type = other DNA
gctcgggttaaagtttcactgaatatg

SEQ ID NO: 28429 - DNA, 26 bp, synthetic construct
  misc_feature 1..26: note = Synthetic Construct
  source 1..26: mol_type = other DNA
cggtcctatccattagaagggagtct

SEQ ID NO: 28430 - DNA, 23 bp, synthetic construct
  misc_feature 1..23: note = Synthetic Construct
  source 1..23: mol_type = other DNA
gtgctgaaaagtctgtgcctaag

SEQ ID NO: 28431 - DNA, 21 bp, synthetic construct
  misc_feature 1..21: note = Synthetic Construct
  source 1..21: mol_type = other DNA
ggtgtgccctgcttggatact

SEQ ID NO: 28432 - DNA, 26 bp, synthetic construct
  misc_feature 1..26: note = Synthetic Construct
  source 1..26: mol_type = other DNA
ctgcatgcatactttaggcacatatc

SEQ ID NO: 28433 - DNA, 22 bp, synthetic construct
  misc_feature 1..22: note = Synthetic Construct
  source 1..22: mol_type = other DNA
aggtaggttgaggccagattgt

SEQ ID NO: 28434 - DNA, 22 bp, synthetic construct
  misc_feature 1..22: note = Synthetic Construct
  source 1..22: mol_type = other DNA
cccattcagccacacgcattac

SEQ ID NO: 28435 - DNA, 27 bp, synthetic construct
  misc_feature 1..27: note = Synthetic Construct
  source 1..27: mol_type = other DNA
caaggtggtttaatcttcactggatgt

SEQ ID NO: 28436 - DNA, 20 bp, synthetic construct
  misc_feature 1..20: note = Synthetic Construct
  source 1..20: mol_type = other DNA
tggtaggcatagcggcagtt

SEQ ID NO: 28437 - DNA, 22 bp, synthetic construct
  misc_feature 1..22: note = Synthetic Construct
  source 1..22: mol_type = other DNA
caccctggggataggaaggtaa

SEQ ID NO: 28438 - DNA, 22 bp, synthetic construct
  misc_feature 1..22: note = Synthetic Construct
  source 1..22: mol_type = other DNA
tgccttcatcctccctgtctct

SEQ ID NO: 28439 - DNA, 21 bp, synthetic construct
  misc_feature 1..21: note = Synthetic Construct
  source 1..21: mol_type = other DNA
ggggcatgttgcctcagtttc

SEQ ID NO: 28440 - DNA, 25 bp, synthetic construct
  misc_feature 1..25: note = Synthetic Construct
  source 1..25: mol_type = other DNA
ccatgatctccaaaagaccttgctt

SEQ ID NO: 28441 - DNA, 24 bp, synthetic construct
  misc_feature 1..24: note = Synthetic Construct
  source 1..24: mol_type = other DNA
tgaatgccattacctctctgtgtt

SEQ ID NO: 28442 - DNA, 26 bp, synthetic construct
  misc_feature 1..26: note = Synthetic Construct
  source 1..26: mol_type = other DNA
ggacagcaatttctgggttaaaggat

SEQ ID NO: 28443 - DNA, 24 bp, synthetic construct
  misc_feature 1..24: note = Synthetic Construct
  source 1..24: mol_type = other DNA
gcttctgtaccaggagtggcttac

SEQ ID NO: 28444 - DNA, 24 bp, synthetic construct
  misc_feature 1..24: note = Synthetic Construct
  source 1..24: mol_type = other DNA
ttcccctccaatctcaaggtttac

SEQ ID NO: 28445 - DNA, 24 bp, synthetic construct
  misc_feature 1..24: note = Synthetic Construct
  source 1..24: mol_type = other DNA
gcaagtaaagggctcagtggctat

SEQ ID NO: 28446 - DNA, 22 bp, synthetic construct
  misc_feature 1..22: note = Synthetic Construct
  source 1..22: mol_type = other DNA
agatctaggccctctggtttca

SEQ ID NO: 28447 - DNA, 20 bp, synthetic construct
  misc_feature 1..20: note = Synthetic Construct
  source 1..20: mol_type = other DNA
tccctgagcttcccctccaa

SEQ ID NO: 28448 - DNA, 25 bp, synthetic construct
  misc_feature 1..25: note = Synthetic Construct
  source 1..25: mol_type = other DNA
ccccagatttgtaccacagaaatca

SEQ ID NO: 28449 - DNA, 23 bp, synthetic construct
  misc_feature 1..23: note = Synthetic Construct
  source 1..23: mol_type = other DNA
cctgtaggagaaaagcagtcagt

SEQ ID NO: 28450 - DNA, 23 bp, synthetic construct
  misc_feature 1..23: note = Synthetic Construct
  source 1..23: mol_type = other DNA
cagctgaatgcatgagggtgaca

SEQ ID NO: 28451 - DNA, 24 bp, synthetic construct
  misc_feature 1..24: note = Synthetic Construct
  source 1..24: mol_type = other DNA
ctctttgtgagccaagctgctaaa

SEQ ID NO: 28452 - DNA, 25 bp, synthetic construct
  misc_feature 1..25: note = Synthetic Construct
  source 1..25: mol_type = other DNA
cagcaggagaaattcttgcctaaca

SEQ ID NO: 28453 - DNA, 23 bp, synthetic construct
  misc_feature 1..23: note = Synthetic Construct
  source 1..23: mol_type = other DNA
ggttattggcaattgctgtggat

SEQ ID NO: 28454 - DNA, 26 bp, synthetic construct
  misc_feature 1..26: note = Synthetic Construct
  source 1..26: mol_type = other DNA
cggactaatacactcagacagacttc

SEQ ID NO: 28455 - DNA, 22 bp, synthetic construct
  misc_feature 1..22: note = Synthetic Construct
  source 1..22: mol_type = other DNA
cctgttccctcttgcagtgctt

SEQ ID NO: 28456 - DNA, 24 bp, synthetic construct
  misc_feature 1..24: note = Synthetic Construct
  source 1..24: mol_type = other DNA
ccctgtaagcactcatcacacgtt

SEQ ID NO: 28457 - DNA, 26 bp, synthetic construct
  misc_feature 1..26: note = Synthetic Construct
  source 1..26: mol_type = other DNA
ccccaatacacagactctccatgtca

SEQ ID NO: 28458 - DNA, 22 bp, synthetic construct
  misc_feature 1..22: note = Synthetic Construct
  source 1..22: mol_type = other DNA
agctaagcagagctggggattc

SEQ ID NO: 28459 - DNA, 30 bp, synthetic construct
  misc_feature 1..30: note = Synthetic Construct
  source 1..30: mol_type = other DNA
ctgcttacaaattactgggctagttgatct

SEQ ID NO: 28460 - DNA, 22 bp, synthetic construct
  misc_feature 1..22: note = Synthetic Construct
  source 1..22: mol_type = other DNA
gcctcctgtaaggatgttggaa

SEQ ID NO: 28461 - DNA, 24 bp, synthetic construct
  misc_feature 1..24: note = Synthetic Construct
  source 1..24: mol_type = other DNA
tgagctgagtttagcttggtacat

SEQ ID NO: 28462 - DNA, 24 bp, synthetic construct
  misc_feature 1..24: note = Synthetic Construct
  source 1..24: mol_type = other DNA
caagtgaagacttggttgctgaca

SEQ ID NO: 28463 - DNA, 24 bp, synthetic construct
  misc_feature 1..24: note = Synthetic Construct
  source 1..24: mol_type = other DNA
tcctaactgcactggtgtgataag

SEQ ID NO: 28464 - DNA, 20 bp, synthetic construct
  misc_feature 1..20: note = Synthetic Construct
  source 1..20: mol_type = other DNA
gctgccttgcagggtttctt

SEQ ID NO: 28465 - DNA, 25 bp, synthetic construct
  misc_feature 1..25: note = Synthetic Construct
  source 1..25: mol_type = other DNA
cagtacacttaaacccaggcaagaa

SEQ ID NO: 28466 - DNA, 23 bp, synthetic construct
  misc_feature 1..23: note = Synthetic Construct
  source 1..23: mol_type = other DNA
tgagtcattaggcaagggctcta

SEQ ID NO: 28467 - DNA, 19 bp, synthetic construct
  misc_feature 1..19: note = Synthetic Construct
  source 1..19: mol_type = other DNA
gcactggggcaaggcagaa

SEQ ID NO: 28468 - DNA, 25 bp, synthetic construct
  misc_feature 1..25: note = Synthetic Construct
  source 1..25: mol_type = other DNA
ggcttgacacacctttaatgacact

SEQ ID NO: 28469 - DNA, 23 bp, synthetic construct
  misc_feature 1..23: note = Synthetic Construct
  source 1..23: mol_type = other DNA
tgcaagagaggaggagagatgaa

SEQ ID NO: 28470 - DNA, 22 bp, synthetic construct
  misc_feature 1..22: note = Synthetic Construct
  source 1..22: mol_type = other DNA
caaaaaggcactgcacttggaa

SEQ ID NO: 28471 - DNA, 24 bp, synthetic construct
  misc_feature 1..24: note = Synthetic Construct
  source 1..24: mol_type = other DNA
ggtaggtatgaagtcaggggaaag

SEQ ID NO: 28472 - DNA, 20 bp, synthetic construct
  misc_feature 1..20: note = Synthetic Construct
  source 1..20: mol_type = other DNA
gggtagctccagagggcaat

SEQ ID NO: 28473 - DNA, 20 bp, synthetic construct
  misc_feature 1..20: note = Synthetic Construct
  source 1..20: mol_type = other DNA
ccatgaccctgggaccgttt

SEQ ID NO: 28474 - DNA, 24 bp, synthetic construct
  misc_feature 1..24: note = Synthetic Construct
  source 1..24: mol_type = other DNA
gacaacattcccaagttcccaaac

SEQ ID NO: 28475 - DNA, 24 bp, synthetic construct
  misc_feature 1..24: note = Synthetic Construct
  source 1..24: mol_type = other DNA
gatttccactgtgttgctctgaaa

SEQ ID NO: 28476 - DNA, 23 bp, synthetic construct
  misc_feature 1..23: note = Synthetic Construct
  source 1..23: mol_type = other DNA
gggatactcagtctgcattgctt

SEQ ID NO: 28477 - DNA, 22 bp, synthetic construct
  misc_feature 1..22: note = Synthetic Construct
  source 1..22: mol_type = other DNA
ggcctgggctgactttcataag

SEQ ID NO: 28478 - DNA, 20 bp, synthetic construct
  misc_feature 1..20: note = Synthetic Construct
  source 1..20: mol_type = other DNA
tgtgcgagggctggtacata

SEQ ID NO: 28479 - DNA, 22 bp, synthetic construct
  misc_feature 1..22: note = Synthetic Construct
  source 1..22: mol_type = other DNA
caggagaggttgggatgcttag

SEQ ID NO: 28480 - DNA, 23 bp, synthetic construct
  misc_feature 1..23: note = Synthetic Construct
  source 1..23: mol_type = other DNA
gcctacagcttagtggggaaaga

SEQ ID NO: 28481 - DNA, 24 bp, synthetic construct
  misc_feature 1..24: note = Synthetic Construct
  source 1..24: mol_type = other DNA
gagaacaaacgggtctgaatgaca

SEQ ID NO: 28482 - DNA, 20 bp, synthetic construct
  misc_feature 1..20: note = Synthetic Construct
  source 1..20: mol_type = other DNA
gagaactgaacggccacact

SEQ ID NO: 28483 - DNA, 24 bp, synthetic construct
  misc_feature 1..24: note = Synthetic Construct
  source 1..24: mol_type = other DNA
cgggcacttgcttctctgagatta

SEQ ID NO: 28484 - DNA, 23 bp, synthetic construct
  misc_feature 1..23: note = Synthetic Construct
  source 1..23: mol_type = other DNA
ggctttgcaggaaatggcatcta

SEQ ID NO: 28485 - DNA, 25 bp, synthetic construct
  misc_feature 1..25: note = Synthetic Construct
  source 1..25: mol_type = other DNA
aggctcagctagagaaaaccattag

SEQ ID NO: 28486 - DNA, 25 bp, synthetic construct
  misc_feature 1..25: note = Synthetic Construct
  source 1..25: mol_type = other DNA
ggctgcagtaatgaagggtaagcta

SEQ ID NO: 28487 - DNA, 24 bp, synthetic construct
  misc_feature 1..24: note = Synthetic Construct
  source 1..24: mol_type = other DNA
ggggaaccccttgacttgtagttg

SEQ ID NO: 28488 - DNA, 20 bp, synthetic construct
  misc_feature 1..20: note = Synthetic Construct
  source 1..20: mol_type = other DNA
gctcacagaagctgcacgta

SEQ ID NO: 28489 - DNA, 22 bp, synthetic construct
  misc_feature 1..22: note = Synthetic Construct
  source 1..22: mol_type = other DNA
cttctcactcaccatgccagat

SEQ ID NO: 28490 - DNA, 22 bp, synthetic construct
  misc_feature 1..22: note = Synthetic Construct
  source 1..22: mol_type = other DNA
ttcgcacttcctctcggaaaat

SEQ ID NO: 28491 - DNA, 24 bp, synthetic construct
  misc_feature 1..24: note = Synthetic Construct
  source 1..24: mol_type = other DNA
cagatctcatttctggcacagttc

SEQ ID NO: 28492 - DNA, 25 bp, synthetic construct
  misc_feature 1..25: note = Synthetic Construct
  source 1..25: mol_type = other DNA
ggccattaagatggcatgctgatac

SEQ ID NO: 28493 - DNA, 24 bp, synthetic construct
  misc_feature 1..24: note = Synthetic Construct
  source 1..24: mol_type = other DNA
tctcaggatcacaatccaccacta

SEQ ID NO: 28494 - DNA, 26 bp, synthetic construct
  misc_feature 1..26: note = Synthetic Construct
  source 1..26: mol_type = other DNA
ctgatggtgaaaagccaggtatagtt

SEQ ID NO: 28495 - DNA, 22 bp, synthetic construct
  misc_feature 1..22: note = Synthetic Construct
  source 1..22: mol_type = other DNA
caggataccaggctgcacttca

SEQ ID NO: 28496 - DNA, 22 bp, synthetic construct
  misc_feature 1..22: note = Synthetic Construct
  source 1..22: mol_type = other DNA
gccaagatctgcgggacctttt

SEQ ID NO: 28497 - DNA, 22 bp, synthetic construct
  misc_feature 1..22: note = Synthetic Construct
  source 1..22: mol_type = other DNA
aggcttcccacaccctgagtta

SEQ ID NO: 28498 - DNA, 21 bp, synthetic construct
  misc_feature 1..21: note = Synthetic Construct
  source 1..21: mol_type = other DNA
agacatgagagtggcgctttg

SEQ ID NO: 28499 - DNA, 22 bp, synthetic construct
  misc_feature 1..22: note = Synthetic Construct
  source 1..22: mol_type = other DNA
ccctccaaatcctgccacacaa

SEQ ID NO: 28500 - DNA, 23 bp, synthetic construct
  misc_feature 1..23: note = Synthetic Construct
  source 1..23: mol_type = other DNA
gagtccatcctttggggtgtttg

SEQ ID NO: 28501 - DNA, 23 bp, synthetic construct
  misc_feature 1..23: note = Synthetic Construct
  source 1..23: mol_type = other DNA
aagtgcaaccttggagagtaaca

SEQ ID NO: 28502 - DNA, 25 bp, synthetic construct
  misc_feature 1..25: note = Synthetic Construct
  source 1..25: mol_type = other DNA
gcaacttgtccaagcatagttcaca

SEQ ID NO: 28503 - DNA, 26 bp, synthetic construct
  misc_feature 1..26: note = Synthetic Construct
  source 1..26: mol_type = other DNA
gtccaagatcaaggcaccatttttgt

SEQ ID NO: 28504 - DNA, 22 bp, synthetic construct
  misc_feature 1..22: note = Synthetic Construct
  source 1..22: mol_type = other DNA
gtttctggcttcagtgcttgtt

SEQ ID NO: 28505 - DNA, 19 bp, synthetic construct
  misc_feature 1..19: note = Synthetic Construct
  source 1..19: mol_type = other DNA
gcaggggatgaggctctgt

SEQ ID NO: 28506 - DNA, 26 bp, synthetic construct
  misc_feature 1..26: note = Synthetic Construct
  source 1..26: mol_type = other DNA
ccgatttggcatcagttgaaccctta

SEQ ID NO: 28507 - DNA, 22 bp, synthetic construct
  misc_feature 1..22: note = Synthetic Construct
  source 1..22: mol_type = other DNA
ttccgcaactggagagatttga

SEQ ID NO: 28508 - DNA, 22 bp, synthetic construct
  misc_feature 1..22: note = Synthetic Construct
  source 1..22: mol_type = other DNA
ctgggctgagtgggtggaataa

SEQ ID NO: 28509 - DNA, 24 bp, synthetic construct
  misc_feature 1..24: note = Synthetic Construct
  source 1..24: mol_type = other DNA
agcatttcctcgtgctatgttagt

SEQ ID NO: 28510 - DNA, 25 bp, synthetic construct
  misc_feature 1..25: note = Synthetic Construct
  source 1..25: mol_type = other DNA
ggggctcaggaacttttaagtgaca

SEQ ID NO: 28511 - DNA, 22 bp, synthetic construct
  misc_feature 1..22: note = Synthetic Construct
  source 1..22: mol_type = other DNA
agtgtgacagcgcattctatga

SEQ ID NO: 28512 - DNA, 27 bp, synthetic construct
  misc_feature 1..27: note = Synthetic Construct
  source 1..27: mol_type = other DNA
tctgagtcatgtacccttatctagctt

SEQ ID NO: 28513 - DNA, 25 bp, synthetic construct
  misc_feature 1..25: note = Synthetic Construct
  source 1..25: mol_type = other DNA
cacaaggagccacatttgatgtact

SEQ ID NO: 28514 - DNA, 22 bp, synthetic construct
  misc_feature 1..22: note = Synthetic Construct
  source 1..22: mol_type = other DNA
ggacgtatcttccaccgtgctt

SEQ ID NO: 28515 - DNA, 20 bp, synthetic construct
  misc_feature 1..20: note = Synthetic Construct
  source 1..20: mol_type = other DNA
gcaactgcctcaaccagcat

SEQ ID NO: 28516 - DNA, 21 bp, synthetic construct
  misc_feature 1..21: note = Synthetic Construct
  source 1..21: mol_type = other DNA
tggggcctggaattctcttgt

SEQ ID NO: 28517 - DNA, 27 bp, synthetic construct
  misc_feature 1..27: note = Synthetic Construct
  source 1..27: mol_type = other DNA
gggagccaaactcaaattctactaaga

SEQ ID NO: 28518 - DNA, 25 bp, synthetic construct
  misc_feature 1..25: note = Synthetic Construct
  source 1..25: mol_type = other DNA
ggctctttggagtccattcttctct

SEQ ID NO: 28519 - DNA, 24 bp, synthetic construct
  misc_feature 1..24: note = Synthetic Construct
  source 1..24: mol_type = other DNA
tcccaggaaagttcatggtttaca

SEQ ID NO: 28520 - DNA, 22 bp, synthetic construct
  misc_feature 1..22: note = Synthetic Construct
  source 1..22: mol_type = other DNA
gcaggcacagccttttacattg

SEQ ID NO: 28521 - DNA, 24 bp, synthetic construct
  misc_feature 1..24: note = Synthetic Construct
  source 1..24: mol_type = other DNA
ctcatgtcatttcactcccacact

SEQ ID NO: 28522 - DNA, 25 bp, synthetic construct
  misc_feature 1..25: note = Synthetic Construct
  source 1..25: mol_type = other DNA
ggaagcatggtccttcctagtggat

SEQ ID NO: 28523 - DNA, 24 bp, synthetic construct
  misc_feature 1..24: note = Synthetic Construct
  source 1..24: mol_type = other DNA
ggataaggaggcccaagtcctaga

SEQ ID NO: 28524 - DNA, 24 bp, synthetic construct
  misc_feature 1..24: note = Synthetic Construct
  source 1..24: mol_type = other DNA
acgtgatttcatctgcgtcttaca

SEQ ID NO: 28525 - DNA, 23 bp, synthetic construct
  misc_feature 1..23: note = Synthetic Construct
  source 1..23: mol_type = other DNA
gtgggaatagcagggaagcagat

SEQ ID NO: 28526 - DNA, 20 bp, synthetic construct
  misc_feature 1..20: note = Synthetic Construct
  source 1..20: mol_type = other DNA
tggtgctggcttgccattct

SEQ ID NO: 28527 - DNA, 24 bp, synthetic construct
  misc_feature 1..24: note = Synthetic Construct
  source 1..24: mol_type = other DNA
tcttaggctttccacacctcaatg

SEQ ID NO: 28528 - DNA, 20 bp, synthetic construct
  misc_feature 1..20: note = Synthetic Construct
  source 1..20: mol_type = other DNA
cgtggagtcaccccaagact

SEQ ID NO: 28529 - DNA, 23 bp, synthetic construct
  misc_feature 1..23: note = Synthetic Construct
  source 1..23: mol_type = other DNA
gtccccaagctccctgttgttta

SEQ ID NO: 28530 - DNA, 22 bp, synthetic construct
  misc_feature 1..22: note = Synthetic Construct
  source 1..22: mol_type = other DNA
ctgctcccttcctgagttcatc

SEQ ID NO: 28531 - DNA, 24 bp, synthetic construct
  misc_feature 1..24: note = Synthetic Construct
  source 1..24: mol_type = other DNA
catattgtcagcggctacttttgt

SEQ ID NO: 28532 - DNA, 26 bp, synthetic construct
  misc_feature 1..26: note = Synthetic Construct
  source 1..26: mol_type = other DNA
gggactcagtagttttggagccctta

SEQ ID NO: 28533 - DNA, 22 bp, synthetic construct
  misc_feature 1..22: note = Synthetic Construct
  source 1..22: mol_type = other DNA
gcagtcaatactctggggtgaa

SEQ ID NO: 28534 - DNA, 24 bp, synthetic construct
  misc_feature 1..24: note = Synthetic Construct
  source 1..24: mol_type = other DNA
aatagagtggcacccatactcttg

SEQ ID NO: 28535 - DNA, 21 bp, synthetic construct
  misc_feature 1..21: note = Synthetic Construct
  source 1..21: mol_type = other DNA
tccagatggggacaccctact

SEQ ID NO: 28536 - DNA, 27 bp, synthetic construct
  misc_feature 1..27: note = Synthetic Construct
  source 1..27: mol_type = other DNA
ccgatgtcacctaatttcagaggcaaa

SEQ ID NO: 28537 - DNA, 21 bp, synthetic construct
  misc_feature 1..21: note = Synthetic Construct
  source 1..21: mol_type = other DNA
ccactcccaccatcaccttgt

SEQ ID NO: 28538 - DNA, 23 bp, synthetic construct
  misc_feature 1..23: note = Synthetic Construct
  source 1..23: mol_type = other DNA
gccaggtgcctacctaaaagcta

SEQ ID NO: 28539 - DNA, 22 bp, synthetic construct
  misc_feature 1..22: note = Synthetic Construct
  source 1..22: mol_type = other DNA
gagcacttccctcttcccatca

SEQ ID NO: 28540 - DNA, 21 bp, synthetic construct
  misc_feature 1..21: note = Synthetic Construct
  source 1..21: mol_type = other DNA
cctgcaaaggcaggtcaccat

SEQ ID NO: 28541 - DNA, 27 bp, synthetic construct
  misc_feature 1..27: note = Synthetic Construct
  source 1..27: mol_type = other DNA
cagggaaccttaatgtagcaatacaga

SEQ ID NO: 28542 - DNA, 23 bp, synthetic construct
  misc_feature 1..23: note = Synthetic Construct
  source 1..23: mol_type = other DNA
ctgagtgtctcaggtggatgctt

SEQ ID NO: 28543 - DNA, 18 bp, synthetic construct
  misc_feature 1..18: note = Synthetic Construct
  source 1..18: mol_type = other DNA
agcacagcctggcacaca

SEQ ID NO: 28544 - DNA, 25 bp, synthetic construct
  misc_feature 1..25: note = Synthetic Construct
  source 1..25: mol_type = other DNA
cagccctggtgaaaaggaacattag

SEQ ID NO: 28545 - DNA, 19 bp, synthetic construct
  misc_feature 1..19: note = Synthetic Construct
  source 1..19: mol_type = other DNA
ggaggctctctgcctgcta

SEQ ID NO: 28546 - DNA, 24 bp, synthetic construct
  misc_feature 1..24: note = Synthetic Construct
  source 1..24: mol_type = other DNA
gtgtccagtgtgctttacacttca

SEQ ID NO: 28547 - DNA, 30 bp, synthetic construct
  misc_feature 1..30: note = Synthetic Construct
  source 1..30: mol_type = other DNA
gtgtgctgaacattgtacttgctcatgtta

SEQ ID NO: 28548 - DNA, 23 bp, synthetic construct
  misc_feature 1..23: note = Synthetic Construct
  source 1..23: mol_type = other DNA
gaccttaaatgccctggacttct

SEQ ID NO: 28549 - DNA, 27 bp, synthetic construct
  misc_feature 1..27: note = Synthetic Construct
  source 1..27: mol_type = other DNA
ctggttgtattgcagtcaaacactcaa

SEQ ID NO: 28550 - DNA, 20 bp, synthetic construct
  misc_feature 1..20: note = Synthetic Construct
  source 1..20: mol_type = other DNA
tgctggtgcacccaagcatt

SEQ ID NO: 28551 - DNA, 23 bp, synthetic construct
  misc_feature 1..23: note = Synthetic Construct
  source 1..23: mol_type = other DNA
aatgacaccaccacccactaaat

SEQ ID NO: 28552 - DNA, 23 bp, synthetic construct
  misc_feature 1..23: note = Synthetic Construct
  source 1..23: mol_type = other DNA
tcacagctgcttcatatgcttga

SEQ ID NO: 28553 - DNA, 26 bp, synthetic construct
  misc_feature 1..26: note = Synthetic Construct
  source 1..26: mol_type = other DNA
ggtatggaactatggagcttgcagtt

SEQ ID NO: 28554 - DNA, 21 bp, synthetic construct
  misc_feature 1..21: note = Synthetic Construct
  source 1..21: mol_type = other DNA
gaacatacaagcgcaggcaat

SEQ ID NO: 28555 - DNA, 24 bp, synthetic construct
  misc_feature 1..24: note = Synthetic Construct
  source 1..24: mol_type = other DNA
tcacctgctttccctcttgaaaaa

SEQ ID NO: 28556 - DNA, 25 bp, synthetic construct
  misc_feature 1..25: note = Synthetic Construct
  source 1..25: mol_type = other DNA
ccagtttcatgtgtttgcctgcttt

SEQ ID NO: 28557 - DNA, 23 bp, synthetic construct
  misc_feature 1..23: note = Synthetic Construct
  source 1..23: mol_type = other DNA
ccagtcctaacctctggctctct

SEQ ID NO: 28558 - DNA, 25 bp, synthetic construct
  misc_feature 1..25: note = Synthetic Construct
  source 1..25: mol_type = other DNA
gttcacagaaatggcttgcctttag

SEQ ID NO: 28559 - DNA, 23 bp, synthetic construct
  misc_feature 1..23: note = Synthetic Construct
  source 1..23: mol_type = other DNA
caggatgacactggagttagctt

SEQ ID NO: 28560 - DNA, 21 bp, synthetic construct
  misc_feature 1..21: note = Synthetic Construct
  source 1..21: mol_type = other DNA
gggtccccagtcagaccatct

SEQ ID NO: 28561 - DNA, 25 bp, synthetic construct
  misc_feature 1..25: note = Synthetic Construct
  source 1..25: mol_type = other DNA
agaggaaacattcaactggaagtga

SEQ ID NO: 28562 - DNA, 24 bp, synthetic construct
  misc_feature 1..24: note = Synthetic Construct
  source 1..24: mol_type = other DNA
gcctgaaggttctttcgtcacttc

SEQ ID NO: 28563 - DNA, 26 bp, synthetic construct
  misc_feature 1..26: note = Synthetic Construct
  source 1..26: mol_type = other DNA
ggcacctgtatcatgttactgctctt

SEQ ID NO: 28564 - DNA, 25 bp, synthetic construct
  misc_feature 1..25: note = Synthetic Construct
  source 1..25: mol_type = other DNA
cctccagaaaacgagaagcaatgat

SEQ ID NO: 28565 - DNA, 25 bp, synthetic construct
  misc_feature 1..25: note = Synthetic Construct
  source 1..25: mol_type = other DNA
gtggagctcactgctttaattgtga

SEQ ID NO: 28566 - DNA, 21 bp, synthetic construct
  misc_feature 1..21: note = Synthetic Construct
  source 1..21: mol_type = other DNA
ggaggctgtccctgtggtttc

SEQ ID NO: 28567 - DNA, 24 bp, synthetic construct
  misc_feature 1..24: note = Synthetic Construct
  source 1..24: mol_type = other DNA
cgcttggttcatacaaaaccaact

SEQ ID NO: 28568 - DNA, 24 bp, synthetic construct
  misc_feature 1..24: note = Synthetic Construct
  source 1..24: mol_type = other DNA
cacgtcccactaggggttaagttc

SEQ ID NO: 28569 - DNA, 25 bp, synthetic construct
  misc_feature 1..25: note = Synthetic Construct
  source 1..25: mol_type = other DNA
gtgtgtttcaagacagcaaggaaag

SEQ ID NO: 28570 - DNA, 24 bp, synthetic construct
  misc_feature 1..24: note = Synthetic Construct
  source 1..24: mol_type = other DNA
cccagttaactcctagagccaaac

SEQ ID NO: 28571 - DNA, 24 bp, synthetic construct
  misc_feature 1..24: note = Synthetic Construct
  source 1..24: mol_type = other DNA
ggcaacatccctcacagctttctt

SEQ ID NO: 28572 - DNA, 23 bp, synthetic construct
  misc_feature 1..23: note = Synthetic Construct
  source 1..23: mol_type = other DNA
gcgtgggatcttgtttgccttga

SEQ ID NO: 28573 - DNA, 24 bp, synthetic construct
  misc_feature 1..24: note = Synthetic Construct
  source 1..24: mol_type = other DNA
gcagttggaaatcgagcagtaaag

SEQ ID NO: 28574 - DNA, 22 bp, synthetic construct
  misc_feature 1..22: note = Synthetic Construct
  source 1..22: mol_type = other DNA
tctcaggagccggtttgttatg

SEQ ID NO: 28575 - DNA, 24 bp, synthetic construct
  misc_feature 1..24: note = Synthetic Construct
  source 1..24: mol_type = other DNA
tgagtgtgtttgtaagtgcaggat

SEQ ID NO: 28576 - DNA, 20 bp, synthetic construct
  misc_feature 1..20: note = Synthetic Construct
  source 1..20: mol_type = other DNA
tgcccacacattcagctgtt

SEQ ID NO: 28577 - DNA, 20 bp, synthetic construct
  misc_feature 1..20: note = Synthetic Construct
  source 1..20: mol_type = other DNA
acaccagtgaggaggccata

SEQ ID NO: 28578 - DNA, 29 bp, synthetic construct
  misc_feature 1..29: note = Synthetic Construct
  source 1..29: mol_type = other DNA
ggtctgagatgtttacttggtttcccaaa

SEQ ID NO: 28579 - DNA, 20 bp, synthetic construct
  misc_feature 1..20: note = Synthetic Construct
  source 1..20: mol_type = other DNA
aactgccgggactgtaccat

SEQ ID NO: 28580 - DNA, 24 bp, synthetic construct
  misc_feature 1..24: note = Synthetic Construct
  source 1..24: mol_type = other DNA
ggagaccaaatgcctttcctcctt

SEQ ID NO: 28581 - DNA, 23 bp, synthetic construct
  misc_feature 1..23: note = Synthetic Construct
  source 1..23: mol_type = other DNA
gagtgagcacagacaaagcaagt

SEQ ID NO: 28582 - DNA, 20 bp, synthetic construct
  misc_feature 1..20: note = Synthetic Construct
  source 1..20: mol_type = other DNA
tctggggctgtcgggtgtct

SEQ ID NO: 28583 - DNA, 22 bp, synthetic construct
  misc_feature 1..22: note = Synthetic Construct
  source 1..22: mol_type = other DNA
gggtgcattgcattgtctcttc

SEQ ID NO: 28584 - DNA, 26 bp, synthetic construct
  misc_feature 1..26: note = Synthetic Construct
  source 1..26: mol_type = other DNA
tgtgttctctctacctagcacaaatg

SEQ ID NO: 28585 - DNA, 22 bp, synthetic construct
  misc_feature 1..22: note = Synthetic Construct
  source 1..22: mol_type = other DNA
ccccagctgccagcctttattt

SEQ ID NO: 28586 - DNA, 23 bp, synthetic construct
  misc_feature 1..23: note = Synthetic Construct
  source 1..23: mol_type = other DNA
ctgtttcctgccgaggttcaact

SEQ ID NO: 28587 - DNA, 20 bp, synthetic construct
  misc_feature 1..20: note = Synthetic Construct
  source 1..20: mol_type = other DNA
agcccaccaaacccctaaga

SEQ ID NO: 28588 - DNA, 19 bp, synthetic construct
  misc_feature 1..19: note = Synthetic Construct
  source 1..19: mol_type = other DNA
gcctgagtgacctgtgcat

SEQ ID NO: 28589 - DNA, 29 bp, synthetic construct
  misc_feature 1..29: note = Synthetic Construct
  source 1..29: mol_type = other DNA
gggaagggttacaaatatgtctacagaag

SEQ ID NO: 28590 - DNA, 27 bp, synthetic construct
  misc_feature 1..27: note = Synthetic Construct
  source 1..27: mol_type = other DNA
gggctagtaagacagattcaggagaag

SEQ ID NO: 28591 - DNA, 25 bp, synthetic construct
  misc_feature 1..25: note = Synthetic Construct
  source 1..25: mol_type = other DNA
ccctaaactgttttcccactctact

SEQ ID NO: 28592 - DNA, 25 bp, synthetic construct
  misc_feature 1..25: note = Synthetic Construct
  source 1..25: mol_type = other DNA
aagtcccattgcatgatagttgaga

SEQ ID NO: 28593 - DNA, 22 bp, synthetic construct
  misc_feature 1..22: note = Synthetic Construct
  source 1..22: mol_type = other DNA
gctccactgcacctggttagtt

SEQ ID NO: 28594 - DNA, 22 bp, synthetic construct
  misc_feature 1..22: note = Synthetic Construct
  source 1..22: mol_type = other DNA
gtgaaactggcatgtccagaga

SEQ ID NO: 28595 - DNA, 23 bp, synthetic construct
  misc_feature 1..23: note = Synthetic Construct
  source 1..23: mol_type = other DNA
tgagcagtttcaaagtcgtgtca

SEQ ID NO: 28596 - DNA, 22 bp, synthetic construct
  misc_feature 1..22: note = Synthetic Construct
  source 1..22: mol_type = other DNA
ggaagcatcccaagcttcttga

SEQ ID NO: 28597 - DNA, 22 bp, synthetic construct
  misc_feature 1..22: note = Synthetic Construct
  source 1..22: mol_type = other DNA
ccctccttcatcagccagaatc

SEQ ID NO: 28598 - DNA, 24 bp, synthetic construct
  misc_feature 1..24: note = Synthetic Construct
  source 1..24: mol_type = other DNA
ggagggaaaagattcagctgtgtt

SEQ ID NO: 28599 - DNA, 25 bp, synthetic construct
  misc_feature 1..25: note = Synthetic Construct
  source 1..25: mol_type = other DNA
ctgaaaaccatcgtgcacaaaattc

SEQ ID NO: 28600 - DNA, 20 bp, synthetic construct
  misc_feature 1..20: note = Synthetic Construct
  source 1..20: mol_type = other DNA
ctgccttgctctgcatctct

SEQ ID NO: 28601 - DNA, 24 bp, synthetic construct
  misc_feature 1..24: note = Synthetic Construct
  source 1..24: mol_type = other DNA
cttccagaaagtaggcacagtttg

SEQ ID NO: 28602 - DNA, 23 bp, synthetic construct
  misc_feature 1..23: note = Synthetic Construct
  source 1..23: mol_type = other DNA
ctgttgatcccctttgcacatct

SEQ ID NO: 28603 - DNA, 24 bp, synthetic construct
  misc_feature 1..24: note = Synthetic Construct
  source 1..24: mol_type = other DNA
cactggaaaccatgccatgcataa

SEQ ID NO: 28604 - DNA, 26 bp, synthetic construct
  misc_feature 1..26: note = Synthetic Construct
  source 1..26: mol_type = other DNA
ccctgtagttgaagctgccataactt

SEQ ID NO: 28605 - DNA, 27 bp, synthetic construct
  misc_feature 1..27: note = Synthetic Construct
  source 1..27: mol_type = other DNA
cctctcctcattttgctagagaaggta

SEQ ID NO: 28606 - DNA, 26 bp, synthetic construct
  misc_feature 1..26: note = Synthetic Construct
  source 1..26: mol_type = other DNA
ctgcaactgcttttctccacaactac

SEQ ID NO: 28607 - DNA, 25 bp, synthetic construct
  misc_feature 1..25: note = Synthetic Construct
  source 1..25: mol_type = other DNA
ctcttttgcacaagcctttcctttg

SEQ ID NO: 28608 - DNA, 27 bp, synthetic construct
  misc_feature 1..27: note = Synthetic Construct
  source 1..27: mol_type = other DNA
ccagatcggtaatacctggaaatggta

SEQ ID NO: 28609 - DNA, 21 bp, synthetic construct
  misc_feature 1..21: note = Synthetic Construct
  source 1..21: mol_type = other DNA
caagcacttgtggctgtctga

SEQ ID NO: 28610 - DNA, 23 bp, synthetic construct
  misc_feature 1..23: note = Synthetic Construct
  source 1..23: mol_type = other DNA
ggacggaacaacacactgggatt

SEQ ID NO: 28611 - DNA, 21 bp, synthetic construct
  misc_feature 1..21: note = Synthetic Construct
  source 1..21: mol_type = other DNA
cgtgcacacgactttttggaa

SEQ ID NO: 28612 - DNA, 21 bp, synthetic construct
  misc_feature 1..21: note = Synthetic Construct
  source 1..21: mol_type = other DNA
agtgagcaggaccttgcaaat

SEQ ID NO: 28613 - DNA, 24 bp, synthetic construct
  misc_feature 1..24: note = Synthetic Construct
  source 1..24: mol_type = other DNA
gagctgtgggaattccatctctca

SEQ ID NO: 28614 - DNA, 21 bp, synthetic construct
  misc_feature 1..21: note = Synthetic Construct
  source 1..21: mol_type = other DNA
gccccttgcatggtgtggtta

SEQ ID NO: 28615 - DNA, 25 bp, synthetic construct
  misc_feature 1..25: note = Synthetic Construct
  source 1..25: mol_type = other DNA
gatgcagggatgtttaactccaatc

SEQ ID NO: 28616 - DNA, 24 bp, synthetic construct
  misc_feature 1..24: note = Synthetic Construct
  source 1..24: mol_type = other DNA
gggttctgtaatcagggccataca

SEQ ID NO: 28617 - DNA, 22 bp, synthetic construct
  misc_feature 1..22: note = Synthetic Construct
  source 1..22: mol_type = other DNA
gggttttggggttcaccacatt

SEQ ID NO: 28618 - DNA, 20 bp, synthetic construct
  misc_feature 1..20: note = Synthetic Construct
  source 1..20: mol_type = other DNA
gcagctgccaagcagatgtt

SEQ ID NO: 28619 - DNA, 27 bp, synthetic construct
  misc_feature 1..27: note = Synthetic Construct
  source 1..27: mol_type = other DNA
cacattaaccttccactggtgccatta

SEQ ID NO: 28620 - DNA, 27 bp, synthetic construct
  misc_feature 1..27: note = Synthetic Construct
  source 1..27: mol_type = other DNA
caattttgggtggagttagagagaaca

SEQ ID NO: 28621 - DNA, 25 bp, synthetic construct
  misc_feature 1..25: note = Synthetic Construct
  source 1..25: mol_type = other DNA
tcctgtgaccctattatctcccatt

SEQ ID NO: 28622 - DNA, 24 bp, synthetic construct
  misc_feature 1..24: note = Synthetic Construct
  source 1..24: mol_type = other DNA
caaggtctgctctcagaagaaact

SEQ ID NO: 28623 - DNA, 22 bp, synthetic construct
  misc_feature 1..22: note = Synthetic Construct
  source 1..22: mol_type = other DNA
ctgtctgcatttggctccttgt

SEQ ID NO: 28624 - DNA, 24 bp, synthetic construct
  misc_feature 1..24: note = Synthetic Construct
  source 1..24: mol_type = other DNA
ggtgagttggaagcacatgtggaa

SEQ ID NO: 28625 - DNA, 22 bp, synthetic construct
  misc_feature 1..22: note = Synthetic Construct
  source 1..22: mol_type = other DNA
ggcctgggcattaggtagcatt

SEQ ID NO: 28626 - DNA, 24 bp, synthetic construct
  misc_feature 1..24: note = Synthetic Construct
  source 1..24: mol_type = other DNA
ccatcaagaggtacaggggtcttc

SEQ ID NO: 28627 - DNA, 21 bp, synthetic construct
  misc_feature 1..21: note = Synthetic Construct
  source 1..21: mol_type = other DNA
ggccctttgggttcagagctt

SEQ ID NO: 28628 - DNA, 23 bp, synthetic construct
  misc_feature 1..23: note = Synthetic Construct
  source 1..23: mol_type = other DNA
cagcctcttcccctttacctttg

SEQ ID NO: 28629 - DNA, 25 bp, synthetic construct
  misc_feature 1..25: note = Synthetic Construct
  source 1..25: mol_type = other DNA
agtacctgccaatgtctatcagtct

SEQ ID NO: 28630 - DNA, 24 bp, synthetic construct
  misc_feature 1..24: note = Synthetic Construct
  source 1..24: mol_type = other DNA
aatcacctgtggcacttgtttaag

SEQ ID NO: 28631 - DNA, 25 bp, synthetic construct
  misc_feature 1..25: note = Synthetic Construct
  source 1..25: mol_type = other DNA
gctaatagctggcatctaggggaaa

SEQ ID NO: 28632 - DNA, 24 bp, synthetic construct
  misc_feature 1..24: note = Synthetic Construct
  source 1..24: mol_type = other DNA
gcagatgcatcctcagagcattac

SEQ ID NO: 28633 - DNA, 25 bp, synthetic construct
  misc_feature 1..25: note = Synthetic Construct
  source 1..25: mol_type = other DNA
aactctgatggagtgatttgcctta

SEQ ID NO: 28634 - DNA, 26 bp, synthetic construct
  misc_feature 1..26: note = Synthetic Construct
  source 1..26: mol_type = other DNA
gctgctgatcacaacagaatgaaaac

SEQ ID NO: 28635 - DNA, 22 bp, synthetic construct
  misc_feature 1..22: note = Synthetic Construct
  source 1..22: mol_type = other DNA
gctctttggactctgccatttc

SEQ ID NO: 28636 - DNA, 25 bp, synthetic construct
  misc_feature 1..25: note = Synthetic Construct
  source 1..25: mol_type = other DNA
actgtggtttttactggaggaaagt

SEQ ID NO: 28637 - DNA, 24 bp, synthetic construct
  misc_feature 1..24: note = Synthetic Construct
  source 1..24: mol_type = other DNA
ggggactgagggacttacttcaac

SEQ ID NO: 28638 - DNA, 23 bp, synthetic construct
  misc_feature 1..23: note = Synthetic Construct
  source 1..23: mol_type = other DNA
caaggatgctgagtccaggttca

SEQ ID NO: 28639 - DNA, 25 bp, synthetic construct
  misc_feature 1..25: note = Synthetic Construct
  source 1..25: mol_type = other DNA
ggcagaaagaaaacccttcgagatg

SEQ ID NO: 28640 - DNA, 19 bp, synthetic construct
  misc_feature 1..19: note = Synthetic Construct
  source 1..19: mol_type = other DNA
agcagtgagcagcctcctt

SEQ ID NO: 28641 - DNA, 21 bp, synthetic construct
  misc_feature 1..21: note = Synthetic Construct
  source 1..21: mol_type = other DNA
gccacaaagccaagtgcaaag

SEQ ID NO: 28642 - DNA, 20 bp, synthetic construct
  misc_feature 1..20: note = Synthetic Construct
  source 1..20: mol_type = other DNA
gaagccctgcagctttctgt

SEQ ID NO: 28643 - DNA, 27 bp, synthetic construct
  misc_feature 1..27: note = Synthetic Construct
  source 1..27: mol_type = other DNA
ccttcagcccaagagaagaatttatca

SEQ ID NO: 28644 - DNA, 24 bp, synthetic construct
  misc_feature 1..24: note = Synthetic Construct
  source 1..24: mol_type = other DNA
gctgtgtggggtacagtagacact

SEQ ID NO: 28645 - DNA, 26 bp, synthetic construct
  misc_feature 1..26: note = Synthetic Construct
  source 1..26: mol_type = other DNA
gacttggactagagacatggaatctt

SEQ ID NO: 28646 - DNA, 28 bp, synthetic construct
  misc_feature 1..28: note = Synthetic Construct
  source 1..28: mol_type = other DNA
ggggatggttcagtaatacctactctgt

SEQ ID NO: 28647 - DNA, 22 bp, synthetic construct
  misc_feature 1..22: note = Synthetic Construct
  source 1..22: mol_type = other DNA
cacactgatggagacccagagt

SEQ ID NO: 28648 - DNA, 26 bp, synthetic construct
  misc_feature 1..26: note = Synthetic Construct
  source 1..26: mol_type = other DNA
ccaagtaactgctgcaagaaaacaca

SEQ ID NO: 28649 - DNA, 29 bp, synthetic construct
  misc_feature 1..29: note = Synthetic Construct
  source 1..29: mol_type = other DNA
ggatctcataaaacgtaactcctctgaca

SEQ ID NO: 28650 - DNA, 30 bp, synthetic construct
  misc_feature 1..30: note = Synthetic Construct
  source 1..30: mol_type = other DNA
gcaccatatttagagggtatcgatttctga

SEQ ID NO: 28651 - DNA, 27 bp, synthetic construct
  misc_feature 1..27: note = Synthetic Construct
  source 1..27: mol_type = other DNA
cagtgcatctagctatcaagtcccaaa

SEQ ID NO: 28652 - DNA, 25 bp, synthetic construct
  misc_feature 1..25: note = Synthetic Construct
  source 1..25: mol_type = other DNA
caagagaggaaaagctctactggaa

SEQ ID NO: 28653 - DNA, 24 bp, synthetic construct
  misc_feature 1..24: note = Synthetic Construct
  source 1..24: mol_type = other DNA
ccatgcctggcctagaaaatgtta

SEQ ID NO: 28654 - DNA, 20 bp, synthetic construct
  misc_feature 1..20: note = Synthetic Construct
  source 1..20: mol_type = other DNA
acctgctgggaacaggatga

SEQ ID NO: 28655 - DNA, 24 bp, synthetic construct
  misc_feature 1..24: note = Synthetic Construct
  source 1..24: mol_type = other DNA
gactgcgtcaatcctcctcctatc

SEQ ID NO: 28656 - DNA, 22 bp, synthetic construct
  misc_feature 1..22: note = Synthetic Construct
  source 1..22: mol_type = other DNA
tcctacttgggctactgcaaag

SEQ ID NO: 28657 - DNA, 19 bp, synthetic construct
  misc_feature 1..19: note = Synthetic Construct
  source 1..19: mol_type = other DNA
agcctccacccttgtccat

SEQ ID NO: 28658 - DNA, 22 bp, synthetic construct
  misc_feature 1..22: note = Synthetic Construct
  source 1..22: mol_type = other DNA
gctggtaggtcactgtgcatgt

SEQ ID NO: 28659 - DNA, 24 bp, synthetic construct
  misc_feature 1..24: note = Synthetic Construct
  source 1..24: mol_type = other DNA
ggaaatcacctcgctaggaacttg

SEQ ID NO: 28660 - DNA, 24 bp, synthetic construct
  misc_feature 1..24: note = Synthetic Construct
  source 1..24: mol_type = other DNA
ggccatccctaaccttgacctatg

SEQ ID NO: 28661 - DNA, 24 bp, synthetic construct
  misc_feature 1..24: note = Synthetic Construct
  source 1..24: mol_type = other DNA
caaagtttgtgcaaagagggaaga

SEQ ID NO: 28662 - DNA, 21 bp, synthetic construct
  misc_feature 1..21: note = Synthetic Construct
  source 1..21: mol_type = other DNA
cgctccagtcaatggcaatgt

SEQ ID NO: 28663 - DNA, 25 bp, synthetic construct
  misc_feature 1..25: note = Synthetic Construct
  source 1..25: mol_type = other DNA
accaaaaggtccttgaatgtagtga

SEQ ID NO: 28664 - DNA, 23 bp, synthetic construct
  misc_feature 1..23: note = Synthetic Construct
  source 1..23: mol_type = other DNA
ctgcatgactggaagagccaaac

SEQ ID NO: 28665 - DNA, 20 bp, synthetic construct
  misc_feature 1..20: note = Synthetic Construct
  source 1..20: mol_type = other DNA
ggtcctgcacactggcaata

SEQ ID NO: 28666 - DNA, 25 bp, synthetic construct
  misc_feature 1..25: note = Synthetic Construct
  source 1..25: mol_type = other DNA
gaaaccacacaaagcaagaggaatc

SEQ ID NO: 28667 - DNA, 24 bp, synthetic construct
  misc_feature 1..24: note = Synthetic Construct
  source 1..24: mol_type = other DNA
ggaggtgagactcagagacataca

SEQ ID NO: 28668 - DNA, 20 bp, synthetic construct
  misc_feature 1..20: note = Synthetic Construct
  source 1..20: mol_type = other DNA
gccagccacagtgtaacaga

SEQ ID NO: 28669 - DNA, 24 bp, synthetic construct
  misc_feature 1..24: note = Synthetic Construct
  source 1..24: mol_type = other DNA
acttcctttacctgatccctctca

SEQ ID NO: 28670 - DNA, 22 bp, synthetic construct
  misc_feature 1..22: note = Synthetic Construct
  source 1..22: mol_type = other DNA
ggcgcgcaaacttgagttactt

SEQ ID NO: 28671 - DNA, 29 bp, synthetic construct
  misc_feature 1..29: note = Synthetic Construct
  source 1..29: mol_type = other DNA
gagaaaccctgagttagaggagatgaaaa

SEQ ID NO: 28672 - DNA, 25 bp, synthetic construct
  misc_feature 1..25: note = Synthetic Construct
  source 1..25: mol_type = other DNA
tgaaacccttacacctgagttcttg

SEQ ID NO: 28673 - DNA, 26 bp, synthetic construct
  misc_feature 1..26: note = Synthetic Construct
  source 1..26: mol_type = other DNA
ggcaggtcattgaaggaaatgaatgt

SEQ ID NO: 28674 - DNA, 22 bp, synthetic construct
  misc_feature 1..22: note = Synthetic Construct
  source 1..22: mol_type = other DNA
ccacagcaccttccttgtgtat

SEQ ID NO: 28675 - DNA, 22 bp, synthetic construct
  misc_feature 1..22: note = Synthetic Construct
  source 1..22: mol_type = other DNA
ctacagccggtttctctgaaca

SEQ ID NO: 28676 - DNA, 20 bp, synthetic construct
  misc_feature 1..20: note = Synthetic Construct
  source 1..20: mol_type = other DNA
cggacaggggagacctcagt

SEQ ID NO: 28677 - DNA, 24 bp, synthetic construct
  misc_feature 1..24: note = Synthetic Construct
  source 1..24: mol_type = other DNA
tctctgtgcttcatgctgtgtaaa

SEQ ID NO: 28678 - DNA, 22 bp, synthetic construct
  misc_feature 1..22: note = Synthetic Construct
  source 1..22: mol_type = other DNA
cccagtgcacagccatatccat

SEQ ID NO: 28679 - DNA, 22 bp, synthetic construct
  misc_feature 1..22: note = Synthetic Construct
  source 1..22: mol_type = other DNA
ccaagcctcagcaatggtggat

SEQ ID NO: 28680 - DNA, 26 bp, synthetic construct
  misc_feature 1..26: note = Synthetic Construct
  source 1..26: mol_type = other DNA
gactaagcctgtatctaccaccactt

SEQ ID NO: 28681 - DNA, 23 bp, synthetic construct
  misc_feature 1..23: note = Synthetic Construct
  source 1..23: mol_type = other DNA
ccagtcttgcctctccaaaccta

SEQ ID NO: 28682 - DNA, 22 bp, synthetic construct
  misc_feature 1..22: note = Synthetic Construct
  source 1..22: mol_type = other DNA
cgcccatgaaaacacagccaat

SEQ ID NO: 28683 - DNA, 23 bp, synthetic construct
  misc_feature 1..23: note = Synthetic Construct
  source 1..23: mol_type = other DNA
cagcctttcttcagctcctccaa

SEQ ID NO: 28684 - DNA, 24 bp, synthetic construct
  misc_feature 1..24: note = Synthetic Construct
  source 1..24: mol_type = other DNA
agattcccattgcctttcttggat

SEQ ID NO: 28685 - DNA, 23 bp, synthetic construct
  misc_feature 1..23: note = Synthetic Construct
  source 1..23: mol_type = other DNA
cagacacagtcacccacgaagat

SEQ ID NO: 28686 - DNA, 22 bp, synthetic construct
  misc_feature 1..22: note = Synthetic Construct
  source 1..22: mol_type = other DNA
ggcttccaccagcttagccaaa

SEQ ID NO: 28687 - DNA, 25 bp, synthetic construct
  misc_feature 1..25: note = Synthetic Construct
  source 1..25: mol_type = other DNA
gtttttgcagagacacccagttttc

SEQ ID NO: 28688 - DNA, 22 bp, synthetic construct
  misc_feature 1..22: note = Synthetic Construct
  source 1..22: mol_type = other DNA
cgtggtgtggacaatgggtatg

SEQ ID NO: 28689 - DNA, 23 bp, synthetic construct
  misc_feature 1..23: note = Synthetic Construct
  source 1..23: mol_type = other DNA
gaggtagaagacccaggaacaag

SEQ ID NO: 28690 - DNA, 20 bp, synthetic construct
  misc_feature 1..20: note = Synthetic Construct
  source 1..20: mol_type = other DNA
aggcagcctagccctaaagt

SEQ ID NO: 28691 - DNA, 26 bp, synthetic construct
  misc_feature 1..26: note = Synthetic Construct
  source 1..26: mol_type = other DNA
gagtcagcctatgcagctattgaatc

SEQ ID NO: 28692 - DNA, 23 bp, synthetic construct
  misc_feature 1..23: note = Synthetic Construct
  source 1..23: mol_type = other DNA
gctcaggcagtgttttgttggat

SEQ ID NO: 28693 - DNA, 22 bp, synthetic construct
  misc_feature 1..22: note = Synthetic Construct
  source 1..22: mol_type = other DNA
tgaacaccactgtgaggacttc

SEQ ID NO: 28694 - DNA, 25 bp, synthetic construct
  misc_feature 1..25: note = Synthetic Construct
  source 1..25: mol_type = other DNA
tgtttttcaaggctacagggtttct

SEQ ID NO: 28695 - DNA, 27 bp, synthetic construct
  misc_feature 1..27: note = Synthetic Construct
  source 1..27: mol_type = other DNA
actgtagctaatctagctctgtctctt

SEQ ID NO: 28696 - DNA, 24 bp, synthetic construct
  misc_feature 1..24: note = Synthetic Construct
  source 1..24: mol_type = other DNA
cagagaccttccttcctggagtag

SEQ ID NO: 28697 - DNA, 23 bp, synthetic construct
  misc_feature 1..23: note = Synthetic Construct
  source 1..23: mol_type = other DNA
ggggctgttagagattggtgaac

SEQ ID NO: 28698 - DNA, 20 bp, synthetic construct
  misc_feature 1..20: note = Synthetic Construct
  source 1..20: mol_type = other DNA
gggcagagatggcacctgtt

SEQ ID NO: 28699 - DNA, 23 bp, synthetic construct
  misc_feature 1..23: note = Synthetic Construct
  source 1..23: mol_type = other DNA
ggggcaattgtgaaacagtggat

SEQ ID NO: 28700 - DNA, 23 bp, synthetic construct
  misc_feature 1..23: note = Synthetic Construct
  source 1..23: mol_type = other DNA
cacaggcttcaggtgaaaagaag

SEQ ID NO: 28701 - DNA, 25 bp, synthetic construct
  misc_feature 1..25: note = Synthetic Construct
  source 1..25: mol_type = other DNA
ggggacaaactttcctagtcagctt

SEQ ID NO: 28702 - DNA, 22 bp, synthetic construct
  misc_feature 1..22: note = Synthetic Construct
  source 1..22: mol_type = other DNA
ccccatgttccatagggcaaac

SEQ ID NO: 28703 - DNA, 26 bp, synthetic construct
  misc_feature 1..26: note = Synthetic Construct
  source 1..26: mol_type = other DNA
gatgttcctcttctgtagggtgaaag

SEQ ID NO: 28704 - DNA, 25 bp, synthetic construct
  misc_feature 1..25: note = Synthetic Construct
  source 1..25: mol_type = other DNA
gtaccaatgtgcaggtatgagtaca

SEQ ID NO: 28705 - DNA, 22 bp, synthetic construct
  misc_feature 1..22: note = Synthetic Construct
  source 1..22: mol_type = other DNA
ctggcagagggacttctgcatt

SEQ ID NO: 28706 - DNA, 21 bp, synthetic construct
  misc_feature 1..21: note = Synthetic Construct
  source 1..21: mol_type = other DNA
ggagcggctcatctcccaaat

SEQ ID NO: 28707 - DNA, 23 bp, synthetic construct
  misc_feature 1..23: note = Synthetic Construct
  source 1..23: mol_type = other DNA
gcagagctgcctaagagaagaaa

SEQ ID NO: 28708 - DNA, 24 bp, synthetic construct
  misc_feature 1..24: note = Synthetic Construct
  source 1..24: mol_type = other DNA
gggagtggtccacatattgtcctt

SEQ ID NO: 28709 - DNA, 25 bp, synthetic construct
  misc_feature 1..25: note = Synthetic Construct
  source 1..25: mol_type = other DNA
gcccttaaaacctccatcccagttc

SEQ ID NO: 28710 - DNA, 22 bp, synthetic construct
  misc_feature 1..22: note = Synthetic Construct
  source 1..22: mol_type = other DNA
acccaagtccatctgcacaaag

SEQ ID NO: 28711 - DNA, 24 bp, synthetic construct
  misc_feature 1..24: note = Synthetic Construct
  source 1..24: mol_type = other DNA
tcctgggacttaaaagcttgactt

SEQ ID NO: 28712 - DNA, 23 bp, synthetic construct
  misc_feature 1..23: note = Synthetic Construct
  source 1..23: mol_type = other DNA
ccgctgataacccattcctggtt

SEQ ID NO: 28713 - DNA, 20 bp, synthetic construct
  misc_feature 1..20: note = Synthetic Construct
  source 1..20: mol_type = other DNA
tgtcccctaaggccatctgt

SEQ ID NO: 28714 - DNA, 20 bp, synthetic construct
  misc_feature 1..20: note = Synthetic Construct
  source 1..20: mol_type = other DNA
tcatcccctgtcctgtgtgt

SEQ ID NO: 28715 - DNA, 27 bp, synthetic construct
  misc_feature 1..27: note = Synthetic Construct
  source 1..27: mol_type = other DNA
gagtgaaggactgagttaagtggaaga

SEQ ID NO: 28716 - DNA, 21 bp, synthetic construct
  misc_feature 1..21: note = Synthetic Construct
  source 1..21: mol_type = other DNA
ggcacagcactagttcacctt

SEQ ID NO: 28717 - DNA, 24 bp, synthetic construct
  misc_feature 1..24: note = Synthetic Construct
  source 1..24: mol_type = other DNA
cccggctttgtcagagtagagaca

SEQ ID NO: 28718 - DNA, 24 bp, synthetic construct
  misc_feature 1..24: note = Synthetic Construct
  source 1..24: mol_type = other DNA
tttctctggccctgtttactttga

SEQ ID NO: 28719 - DNA, 20 bp, synthetic construct
  misc_feature 1..20: note = Synthetic Construct
  source 1..20: mol_type = other DNA
ccaagtcctgcctcttgctt

SEQ ID NO: 28720 - DNA, 22 bp, synthetic construct
  misc_feature 1..22: note = Synthetic Construct
  source 1..22: mol_type = other DNA
gagggtcagcaccaacccataa

SEQ ID NO: 28721 - DNA, 20 bp, synthetic construct
  misc_feature 1..20: note = Synthetic Construct
  source 1..20: mol_type = other DNA
gccagtgccttttgccttct

SEQ ID NO: 28722 - DNA, 22 bp, synthetic construct
  misc_feature 1..22: note = Synthetic Construct
  source 1..22: mol_type = other DNA
caggggcagaagatggaagact

SEQ ID NO: 28723 - DNA, 29 bp, synthetic construct
  misc_feature 1..29: note = Synthetic Construct
  source 1..29: mol_type = other DNA
gccagaaataggatatactgtcccctaaa

SEQ ID NO: 28724 - DNA, 23 bp, synthetic construct
  misc_feature 1..23: note = Synthetic Construct
  source 1..23: mol_type = other DNA
ccccatgaggactgttacctact

SEQ ID NO: 28725 - DNA, 24 bp, synthetic construct
  misc_feature 1..24: note = Synthetic Construct
  source 1..24: mol_type = other DNA
ccttgactttgccatgaccttttc

SEQ ID NO: 28726 - DNA, 25 bp, synthetic construct
  misc_feature 1..25: note = Synthetic Construct
  source 1..25: mol_type = other DNA
tctctgtctctctcccatcaattct

SEQ ID NO: 28727 - DNA, 23 bp, synthetic construct
  misc_feature 1..23: note = Synthetic Construct
  source 1..23: mol_type = other DNA
gggccggtaatcacagtctgttc

SEQ ID NO: 28728 - DNA, 23 bp, synthetic construct
  misc_feature 1..23: note = Synthetic Construct
  source 1..23: mol_type = other DNA
ctgtacctccacctcctcatact

SEQ ID NO: 28729 - DNA, 27 bp, synthetic construct
  misc_feature 1..27: note = Synthetic Construct
  source 1..27: mol_type = other DNA
tgagaggagagtagagttgcagttaat

SEQ ID NO: 28730 - DNA, 22 bp, synthetic construct
  misc_feature 1..22: note = Synthetic Construct
  source 1..22: mol_type = other DNA
ggtaggtggtacgggacaggtt

SEQ ID NO: 28731 - DNA, 30 bp, synthetic construct
  misc_feature 1..30: note = Synthetic Construct
  source 1..30: mol_type = other DNA
gagaaagggatactggaggaatgattgaag

SEQ ID NO: 28732 - DNA, 25 bp, synthetic construct
  misc_feature 1..25: note = Synthetic Construct
  source 1..25: mol_type = other DNA
ggaatttgaggcagccaagattcaa

SEQ ID NO: 28733 - DNA, 20 bp, synthetic construct
  misc_feature 1..20: note = Synthetic Construct
  source 1..20: mol_type = other DNA
ggcctaggttgccttcaaca

SEQ ID NO: 28734 - DNA, 22 bp, synthetic construct
  misc_feature 1..22: note = Synthetic Construct
  source 1..22: mol_type = other DNA
gaagggatcacccgcatttact

SEQ ID NO: 28735 - DNA, 28 bp, synthetic construct
  misc_feature 1..28: note = Synthetic Construct
  source 1..28: mol_type = other DNA
gccttatcctctttgtctcttgcttgtt

SEQ ID NO: 28736 - DNA, 25 bp, synthetic construct
  misc_feature 1..25: note = Synthetic Construct
  source 1..25: mol_type = other DNA
gcctatagacaccaactctgacttt

SEQ ID NO: 28737 - DNA, 29 bp, synthetic construct
  misc_feature 1..29: note = Synthetic Construct
  source 1..29: mol_type = other DNA
gccatcctctggatctcagaagtaatgtt

SEQ ID NO: 28738 - DNA, 24 bp, synthetic construct
  misc_feature 1..24: note = Synthetic Construct
  source 1..24: mol_type = other DNA
tgggtgatgagaaactgagctttg

SEQ ID NO: 28739 - DNA, 22 bp, synthetic construct
  misc_feature 1..22: note = Synthetic Construct
  source 1..22: mol_type = other DNA
gtgcacagtgaggagagtctgt

SEQ ID NO: 28740 - DNA, 23 bp, synthetic construct
  misc_feature 1..23: note = Synthetic Construct
  source 1..23: mol_type = other DNA
caggataggctgaggcatgattg

SEQ ID NO: 28741 - DNA, 20 bp, synthetic construct
  misc_feature 1..20: note = Synthetic Construct
  source 1..20: mol_type = other DNA
tggaagccccagctgtctaa

SEQ ID NO: 28742 - DNA, 26 bp, synthetic construct
  misc_feature 1..26: note = Synthetic Construct
  source 1..26: mol_type = other DNA
cagctcaaaggttctgaagctcattc

SEQ ID NO: 28743 - DNA, 25 bp, synthetic construct
  misc_feature 1..25: note = Synthetic Construct
  source 1..25: mol_type = other DNA
gttgggactacccaaataggaactt

SEQ ID NO: 28744 - DNA, 22 bp, synthetic construct
  misc_feature 1..22: note = Synthetic Construct
  source 1..22: mol_type = other DNA
gccaggggcctttactcacttt

SEQ ID NO: 28745 - DNA, 24 bp, synthetic construct
  misc_feature 1..24: note = Synthetic Construct
  source 1..24: mol_type = other DNA
gggctttaacacacggaagcagaa

SEQ ID NO: 28746 - DNA, 21 bp, synthetic construct
  misc_feature 1..21: note = Synthetic Construct
  source 1..21: mol_type = other DNA
ttccgtttctcccctctgtct

SEQ ID NO: 28747 - DNA, 24 bp, synthetic construct
  misc_feature 1..24: note = Synthetic Construct
  source 1..24: mol_type = other DNA
gggcttttaacatccttcgggtta

SEQ ID NO: 28748 - DNA, 21 bp, synthetic construct
  misc_feature 1..21: note = Synthetic Construct
  source 1..21: mol_type = other DNA
gcattgcccagtcccactgat

SEQ ID NO: 28749 - DNA, 23 bp, synthetic construct
  misc_feature 1..23: note = Synthetic Construct
  source 1..23: mol_type = other DNA
cggaggaggtgttaggagctaca

SEQ ID NO: 28750 - DNA, 23 bp, synthetic construct
  misc_feature 1..23: note = Synthetic Construct
  source 1..23: mol_type = other DNA
gccacctgtgtagaaggtagaac

SEQ ID NO: 28751 - DNA, 23 bp, synthetic construct
  misc_feature 1..23: note = Synthetic Construct
  source 1..23: mol_type = other DNA
ggggagctgagggaggttagaat

SEQ ID NO: 28752 - DNA, 24 bp, synthetic construct
  misc_feature 1..24: note = Synthetic Construct
  source 1..24: mol_type = other DNA
cagaatcaaacctgcgtgtgacaa

SEQ ID NO: 28753 - DNA, 20 bp, synthetic construct
  misc_feature 1..20: note = Synthetic Construct
  source 1..20: mol_type = other DNA
agctggagtgcttcccaatg

SEQ ID NO: 28754 - DNA, 21 bp, synthetic construct
  misc_feature 1..21: note = Synthetic Construct
  source 1..21: mol_type = other DNA
gctcaggctttcaccttggtt

SEQ ID NO: 28755 - DNA, 24 bp, synthetic construct
  misc_feature 1..24: note = Synthetic Construct
  source 1..24: mol_type = other DNA
gtcacacatctgtgtctcaacctt

SEQ ID NO: 28756 - DNA, 22 bp, synthetic construct
  misc_feature 1..22: note = Synthetic Construct
  source 1..22: mol_type = other DNA
cctcaggctgtcttgctaggat

SEQ ID NO: 28757 - DNA, 22 bp, synthetic construct
  misc_feature 1..22: note = Synthetic Construct
  source 1..22: mol_type = other DNA
cccatgggttgatgcaatctgt

SEQ ID NO: 28758 - DNA, 23 bp, synthetic construct
  misc_feature 1..23: note = Synthetic Construct
  source 1..23: mol_type = other DNA
ctgcaggactctagcagacgata

SEQ ID NO: 28759 - DNA, 23 bp, synthetic construct
  misc_feature 1..23: note = Synthetic Construct
  source 1..23: mol_type = other DNA
cctgtgtacaggctactgtgtga

SEQ ID NO: 28760 - DNA, 23 bp, synthetic construct
  misc_feature 1..23: note = Synthetic Construct
  source 1..23: mol_type = other DNA
gccctgacacttggaaagttgtt

SEQ ID NO: 28761 - DNA, 25 bp, synthetic construct
  misc_feature 1..25: note = Synthetic Construct
  source 1..25: mol_type = other DNA
ccaagtacaagtgcagcagttttgt

SEQ ID NO: 28762 - DNA, 21 bp, synthetic construct
  misc_feature 1..21: note = Synthetic Construct
  source 1..21: mol_type = other DNA
gcgctgacactgacacagact

SEQ ID NO: 28763 - DNA, 24 bp, synthetic construct
  misc_feature 1..24: note = Synthetic Construct
  source 1..24: mol_type = other DNA
agaggcacatttgaccctctttac

SEQ ID NO: 28764 - DNA, 26 bp, synthetic construct
  misc_feature 1..26: note = Synthetic Construct
  source 1..26: mol_type = other DNA
ggtaggcaaactcgtagtgaaataag

SEQ ID NO: 28765 - DNA, 21 bp, synthetic construct
  misc_feature 1..21: note = Synthetic Construct
  source 1..21: mol_type = other DNA
tgagtcaacatcgcaccagtt

SEQ ID NO: 28766 - DNA, 26 bp, synthetic construct
  misc_feature 1..26: note = Synthetic Construct
  source 1..26: mol_type = other DNA
gaggctactattcagaaactggagaa

SEQ ID NO: 28767 - DNA, 22 bp, synthetic construct
  misc_feature 1..22: note = Synthetic Construct
  source 1..22: mol_type = other DNA
aactcctcactcagggcacaag

SEQ ID NO: 28768 - DNA, 24 bp, synthetic construct
  misc_feature 1..24: note = Synthetic Construct
  source 1..24: mol_type = other DNA
tgctctaggagaaattgccaggta

SEQ ID NO: 28769 - DNA, 24 bp, synthetic construct
  misc_feature 1..24: note = Synthetic Construct
  source 1..24: mol_type = other DNA
ggcaggtaaagtaactgggagaca

SEQ ID NO: 28770 - DNA, 23 bp, synthetic construct
  misc_feature 1..23: note = Synthetic Construct
  source 1..23: mol_type = other DNA
cccctgtggtaaagggacttaga

SEQ ID NO: 28771 - DNA, 22 bp, synthetic construct
  misc_feature 1..22: note = Synthetic Construct
  source 1..22: mol_type = other DNA
caagtgtggcctactgatccat

SEQ ID NO: 28772 - DNA, 25 bp, synthetic construct
  misc_feature 1..25: note = Synthetic Construct
  source 1..25: mol_type = other DNA
agacttcctaaagtggaggagttga

SEQ ID NO: 28773 - DNA, 21 bp, synthetic construct
  misc_feature 1..21: note = Synthetic Construct
  source 1..21: mol_type = other DNA
ttttccttggcttggctgact

SEQ ID NO: 28774 - DNA, 22 bp, synthetic construct
  misc_feature 1..22: note = Synthetic Construct
  source 1..22: mol_type = other DNA
gctgggagtggaaaggaaatca

SEQ ID NO: 28775 - DNA, 22 bp, synthetic construct
  misc_feature 1..22: note = Synthetic Construct
  source 1..22: mol_type = other DNA
caggcccttaggcttcctgatt

SEQ ID NO: 28776 - DNA, 22 bp, synthetic construct
  misc_feature 1..22: note = Synthetic Construct
  source 1..22: mol_type = other DNA
ctgcaggacaacttgcctttct

SEQ ID NO: 28777 - DNA, 23 bp, synthetic construct
  misc_feature 1..23: note = Synthetic Construct
  source 1..23: mol_type = other DNA
gcccatatccgacattgaagcat

SEQ ID NO: 28778 - DNA, 27 bp, synthetic construct
  misc_feature 1..27: note = Synthetic Construct
  source 1..27: mol_type = other DNA
gggcttctcaccacagttagaataaaa

SEQ ID NO: 28779 - DNA, 22 bp, synthetic construct
  misc_feature 1..22: note = Synthetic Construct
  source 1..22: mol_type = other DNA
tctcctcccacactctctgttg

SEQ ID NO: 28780 - DNA, 27 bp, synthetic construct
  misc_feature 1..27: note = Synthetic Construct
  source 1..27: mol_type = other DNA
gcgtagaatatgtacccagggctatac

SEQ ID NO: 28781 - DNA, 22 bp, synthetic construct
  misc_feature 1..22: note = Synthetic Construct
  source 1..22: mol_type = other DNA
gaggtaaaagcaggaccagtgt

SEQ ID NO: 28782 - DNA, 22 bp, synthetic construct
  misc_feature 1..22: note = Synthetic Construct
  source 1..22: mol_type = other DNA
acaggaaggacagggtgtctca

SEQ ID NO: 28783 - DNA, 22 bp, synthetic construct
  misc_feature 1..22: note = Synthetic Construct
  source 1..22: mol_type = other DNA
tcagcccctgcaggatagtaac

SEQ ID NO: 28784 - DNA, 30 bp, synthetic construct
  misc_feature 1..30: note = Synthetic Construct
  source 1..30: mol_type = other DNA
gctttgacatcactaaaacgatcctgagtt

SEQ ID NO: 28785 - DNA, 25 bp, synthetic construct
  misc_feature 1..25: note = Synthetic Construct
  source 1..25: mol_type = other DNA
gtcccaattctgcaactaactctgt

SEQ ID NO: 28786 - DNA, 20 bp, synthetic construct
  misc_feature 1..20: note = Synthetic Construct
  source 1..20: mol_type = other DNA
gccactggggccacaaacat

SEQ ID NO: 28787 - DNA, 24 bp, synthetic construct
  misc_feature 1..24: note = Synthetic Construct
  source 1..24: mol_type = other DNA
ctaagctaaggctgactgagacaa

SEQ ID NO: 28788 - DNA, 27 bp, synthetic construct
  misc_feature 1..27: note = Synthetic Construct
  source 1..27: mol_type = other DNA
cacatttgagagtggtaagggtataga

SEQ ID NO: 28789 - DNA, 23 bp, synthetic construct
  misc_feature 1..23: note = Synthetic Construct
  source 1..23: mol_type = other DNA
tgcaattctctggaaaggcagta

SEQ ID NO: 28790 - DNA, 23 bp, synthetic construct
  misc_feature 1..23: note = Synthetic Construct
  source 1..23: mol_type = other DNA
tgcaaaagtcctgtgaaggtaca

SEQ ID NO: 28791 - DNA, 20 bp, synthetic construct
  misc_feature 1..20: note = Synthetic Construct
  source 1..20: mol_type = other DNA
tgttgcatgtgtgggtgtga

SEQ ID NO: 28792 - DNA, 24 bp, synthetic construct
  misc_feature 1..24: note = Synthetic Construct
  source 1..24: mol_type = other DNA
catctaaggctgtaaggaccttgt

SEQ ID NO: 28793 - DNA, 27 bp, synthetic construct
  misc_feature 1..27: note = Synthetic Construct
  source 1..27: mol_type = other DNA
ccttcgaagtacgggaatagttaaaca

SEQ ID NO: 28794 - DNA, 24 bp, synthetic construct
  misc_feature 1..24: note = Synthetic Construct
  source 1..24: mol_type = other DNA
aagcagttatgtatgcctggaact

SEQ ID NO: 28795 - DNA, 24 bp, synthetic construct
  misc_feature 1..24: note = Synthetic Construct
  source 1..24: mol_type = other DNA
cctggaaactggtgcttcgacatc

SEQ ID NO: 28796 - DNA, 26 bp, synthetic construct
  misc_feature 1..26: note = Synthetic Construct
  source 1..26: mol_type = other DNA
tgtgagggaatgaacttgaggaaatc

SEQ ID NO: 28797 - DNA, 26 bp, synthetic construct
  misc_feature 1..26: note = Synthetic Construct
  source 1..26: mol_type = other DNA
ccagtggggaaaaactcagaattcaa

SEQ ID NO: 28798 - DNA, 23 bp, synthetic construct
  misc_feature 1..23: note = Synthetic Construct
  source 1..23: mol_type = other DNA
ctcagtgaactacacacccttgt

SEQ ID NO: 28799 - DNA, 21 bp, synthetic construct
  misc_feature 1..21: note = Synthetic Construct
  source 1..21: mol_type = other DNA
tgccctcagagtgggatcgtt

SEQ ID NO: 28800 - DNA, 25 bp, synthetic construct
  misc_feature 1..25: note = Synthetic Construct
  source 1..25: mol_type = other DNA
gggagagaggatgagatgtgaggaa

SEQ ID NO: 28801 - DNA, 23 bp, synthetic construct
  misc_feature 1..23: note = Synthetic Construct
  source 1..23: mol_type = other DNA
tggaatcatgttcatggggttca

SEQ ID NO: 28802 - DNA, 26 bp, synthetic construct
  misc_feature 1..26: note = Synthetic Construct
  source 1..26: mol_type = other DNA
gaggtgctaaatggatggttgagaga

SEQ ID NO: 28803 - DNA, 25 bp, synthetic construct
  misc_feature 1..25: note = Synthetic Construct
  source 1..25: mol_type = other DNA
tggaaaagccaaaggtgttttgatg

SEQ ID NO: 28804 - DNA, 23 bp, synthetic construct
  misc_feature 1..23: note = Synthetic Construct
  source 1..23: mol_type = other DNA
ggaggctcccatgagcctagaaa

SEQ ID NO: 28805 - DNA, 21 bp, synthetic construct
  misc_feature 1..21: note = Synthetic Construct
  source 1..21: mol_type = other DNA
tgtccccacgtcaggtcaact

SEQ ID NO: 28806 - DNA, 30 bp, synthetic construct
  misc_feature 1..30: note = Synthetic Construct
  source 1..30: mol_type = other DNA
ctgatggtgtcaaatgggctatttttcttc

SEQ ID NO: 28807 - DNA, 26 bp, synthetic construct
  misc_feature 1..26: note = Synthetic Construct
  source 1..26: mol_type = other DNA
caagggaagctgtgtcttagacttac

SEQ ID NO: 28808 - DNA, 27 bp, synthetic construct
  misc_feature 1..27: note = Synthetic Construct
  source 1..27: mol_type = other DNA
gagaaaaggcatctccaaatgtgctaa

SEQ ID NO: 28809 - DNA, 24 bp, synthetic construct
  misc_feature 1..24: note = Synthetic Construct
  source 1..24: mol_type = other DNA
gctgaaataggactctaggcagtt

SEQ ID NO: 28810 - DNA, 25 bp, synthetic construct
  misc_feature 1..25: note = Synthetic Construct
  source 1..25: mol_type = other DNA
ctgctgcctctgaaacagaaagttg

SEQ ID NO: 28811 - DNA, 20 bp, synthetic construct
  misc_feature 1..20: note = Synthetic Construct
  source 1..20: mol_type = other DNA
cctgctgcttcctgctgtta

SEQ ID NO: 28812 - DNA, 24 bp, synthetic construct
  misc_feature 1..24: note = Synthetic Construct
  source 1..24: mol_type = other DNA
ggcagatgctcagaggcattaaca

SEQ ID NO: 28813 - DNA, 25 bp, synthetic construct
  misc_feature 1..25: note = Synthetic Construct
  source 1..25: mol_type = other DNA
gagagcatgaatgtgtcatctgtgt

SEQ ID NO: 28814 - DNA, 26 bp, synthetic construct
  misc_feature 1..26: note = Synthetic Construct
  source 1..26: mol_type = other DNA
gggctatgaatttagctctgcatttg

SEQ ID NO: 28815 - DNA, 22 bp, synthetic construct
  misc_feature 1..22: note = Synthetic Construct
  source 1..22: mol_type = other DNA
ggatgctgggagcaatcagttc

SEQ ID NO: 28816 - DNA, 27 bp, synthetic construct
  misc_feature 1..27: note = Synthetic Construct
  source 1..27: mol_type = other DNA
ctcatccattgattccgttcagtaaag

SEQ ID NO: 28817 - DNA, 30 bp, synthetic construct
  misc_feature 1..30: note = Synthetic Construct
  source 1..30: mol_type = other DNA
ctggtttgtaaatttctgaaggcagtggtt

SEQ ID NO: 28818 - DNA, 27 bp, synthetic construct
  misc_feature 1..27: note = Synthetic Construct
  source 1..27: mol_type = other DNA
ctgctcagatgccataaatgtttgaga

SEQ ID NO: 28819 - DNA, 22 bp, synthetic construct
  misc_feature 1..22: note = Synthetic Construct
  source 1..22: mol_type = other DNA
ctgcagcatggctttccatttc

SEQ ID NO: 28820 - DNA, 30 bp, synthetic construct
  misc_feature 1..30: note = Synthetic Construct
  source 1..30: mol_type = other DNA
ctgatcttacaagtattgctttccctgact

SEQ ID NO: 28821 - DNA, 20 bp, synthetic construct
  misc_feature 1..20: note = Synthetic Construct
  source 1..20: mol_type = other DNA
aagggccgatccggaaactt

SEQ ID NO: 28822 - DNA, 22 bp, synthetic construct
  misc_feature 1..22: note = Synthetic Construct
  source 1..22: mol_type = other DNA
cagcagttgcaaaagcacattc

SEQ ID NO: 28823 - DNA, 20 bp, synthetic construct
  misc_feature 1..20: note = Synthetic Construct
  source 1..20: mol_type = other DNA
aagctggtggtggtcactgt

SEQ ID NO: 28824 - DNA, 23 bp, synthetic construct
  misc_feature 1..23: note = Synthetic Construct
  source 1..23: mol_type = other DNA
gccagtttgtaacagcggctttg

SEQ ID NO: 28825 - DNA, 25 bp, synthetic construct
  misc_feature 1..25: note = Synthetic Construct
  source 1..25: mol_type = other DNA
gcttgtatgttgctctttccgtatg

SEQ ID NO: 28826 - DNA, 25 bp, synthetic construct
  misc_feature 1..25: note = Synthetic Construct
  source 1..25: mol_type = other DNA
gcatgggcatttggaatcaaaagat

SEQ ID NO: 28827 - DNA, 27 bp, synthetic construct
  misc_feature 1..27: note = Synthetic Construct
  source 1..27: mol_type = other DNA
agtaagtagaggagtaatggagtgtga

SEQ ID NO: 28828 - DNA, 25 bp, synthetic construct
  misc_feature 1..25: note = Synthetic Construct
  source 1..25: mol_type = other DNA
actgttgagggaatggttcttttct

SEQ ID NO: 28829 - DNA, 23 bp, synthetic construct
  misc_feature 1..23: note = Synthetic Construct
  source 1..23: mol_type = other DNA
ccacttgtgaggacacagcattc

SEQ ID NO: 28830 - DNA, 26 bp, synthetic construct
  misc_feature 1..26: note = Synthetic Construct
  source 1..26: mol_type = other DNA
gagaaccagagcctgtgtcttcatag

SEQ ID NO: 28831 - DNA, 25 bp, synthetic construct
  misc_feature 1..25: note = Synthetic Construct
  source 1..25: mol_type = other DNA
tggactgggaaaagaagacactaga

SEQ ID NO: 28832 - DNA, 26 bp, synthetic construct
  misc_feature 1..26: note = Synthetic Construct
  source 1..26: mol_type = other DNA
ggaggacaacttgttgtttgtggaat

SEQ ID NO: 28833 - DNA, 22 bp, synthetic construct
  misc_feature 1..22: note = Synthetic Construct
  source 1..22: mol_type = other DNA
gggagccttgtggaccagaaat

SEQ ID NO: 28834 - DNA, 25 bp, synthetic construct
  misc_feature 1..25: note = Synthetic Construct
  source 1..25: mol_type = other DNA
ggcctagagttgcaaccttacgaat

SEQ ID NO: 28835 - DNA, 25 bp, synthetic construct
  misc_feature 1..25: note = Synthetic Construct
  source 1..25: mol_type = other DNA
ctgtctacccaaggatctacccaaa

SEQ ID NO: 28836 - DNA, 22 bp, synthetic construct
  misc_feature 1..22: note = Synthetic Construct
  source 1..22: mol_type = other DNA
ggcgtgctacacatgtccacaa

SEQ ID NO: 28837 - DNA, 25 bp, synthetic construct
  misc_feature 1..25: note = Synthetic Construct
  source 1..25: mol_type = other DNA
cttggttctgtcatcctcagacttc

SEQ ID NO: 28838 - DNA, 23 bp, synthetic construct
  misc_feature 1..23: note = Synthetic Construct
  source 1..23: mol_type = other DNA
ggagctcaatcaaggaccacagt

SEQ ID NO: 28839 - DNA, 23 bp, synthetic construct
  misc_feature 1..23: note = Synthetic Construct
  source 1..23: mol_type = other DNA
gcaatgagatcacgctcttgttt

SEQ ID NO: 28840 - DNA, 20 bp, synthetic construct
  misc_feature 1..20: note = Synthetic Construct
  source 1..20: mol_type = other DNA
cagcagcacgtgaagtcaac

SEQ ID NO: 28841 - DNA, 24 bp, synthetic construct
  misc_feature 1..24: note = Synthetic Construct
  source 1..24: mol_type = other DNA
ctggagctgcatccatacccatac

SEQ ID NO: 28842 - DNA, 27 bp, synthetic construct
  misc_feature 1..27: note = Synthetic Construct
  source 1..27: mol_type = other DNA
ctggagaagggtccttttaaagtgcaa

SEQ ID NO: 28843 - DNA, 19 bp, synthetic construct
  misc_feature 1..19: note = Synthetic Construct
  source 1..19: mol_type = other DNA
gcacgtcaggggacactct

SEQ ID NO: 28844 - DNA, 23 bp, synthetic construct
  misc_feature 1..23: note = Synthetic Construct
  source 1..23: mol_type = other DNA
ggggtcattgaatcatggactgt

SEQ ID NO: 28845 - DNA, 23 bp, synthetic construct
  misc_feature 1..23: note = Synthetic Construct
  source 1..23: mol_type = other DNA
cgcatggagattgtgctgctaac

SEQ ID NO: 28846 - DNA, 21 bp, synthetic construct
  misc_feature 1..21: note = Synthetic Construct
  source 1..21: mol_type = other DNA
aaacccactccaacagccttt

SEQ ID NO: 28847 - DNA, 26 bp, synthetic construct
  misc_feature 1..26: note = Synthetic Construct
  source 1..26: mol_type = other DNA
gagccctgattctgaagacaatgaga

SEQ ID NO: 28848 - DNA, 26 bp, synthetic construct
  misc_feature 1..26: note = Synthetic Construct
  source 1..26: mol_type = other DNA
catagattctcacccagtttggttct

SEQ ID NO: 28849 - DNA, 29 bp, synthetic construct
  misc_feature 1..29: note = Synthetic Construct
  source 1..29: mol_type = other DNA
gagacttatgggaagatggagcagtataa

SEQ ID NO: 28850 - DNA, 24 bp, synthetic construct
  misc_feature 1..24: note = Synthetic Construct
  source 1..24: mol_type = other DNA
tgcaaactaagccagtctagtcaa

SEQ ID NO: 28851 - DNA, 23 bp, synthetic construct
  misc_feature 1..23: note = Synthetic Construct
  source 1..23: mol_type = other DNA
ctgctttagctccaggcattaca

SEQ ID NO: 28852 - DNA, 24 bp, synthetic construct
  misc_feature 1..24: note = Synthetic Construct
  source 1..24: mol_type = other DNA
gctgttctcactgggtaactttct

SEQ ID NO: 28853 - DNA, 22 bp, synthetic construct
  misc_feature 1..22: note = Synthetic Construct
  source 1..22: mol_type = other DNA
ctgggccctaaataggcattca

SEQ ID NO: 28854 - DNA, 24 bp, synthetic construct
  misc_feature 1..24: note = Synthetic Construct
  source 1..24: mol_type = other DNA
ggctgtcaggccctgtatacttga

SEQ ID NO: 28855 - DNA, 19 bp, synthetic construct
  misc_feature 1..19: note = Synthetic Construct
  source 1..19: mol_type = other DNA
agggacacttgggcctctt

SEQ ID NO: 28856 - DNA, 28 bp, synthetic construct
  misc_feature 1..28: note = Synthetic Construct
  source 1..28: mol_type = other DNA
gagtcctcagtgagattaagtccagttg

SEQ ID NO: 28857 - DNA, 24 bp, synthetic construct
  misc_feature 1..24: note = Synthetic Construct
  source 1..24: mol_type = other DNA
gagcacacagatggacaggtatag

SEQ ID NO: 28858 - DNA, 22 bp, synthetic construct
  misc_feature 1..22: note = Synthetic Construct
  source 1..22: mol_type = other DNA
gtccacactaagcttccagcaa

SEQ ID NO: 28859 - DNA, 20 bp, synthetic construct
  misc_feature 1..20: note = Synthetic Construct
  source 1..20: mol_type = other DNA
acaggcgggagctcggatca

SEQ ID NO: 28860 - DNA, 25 bp, synthetic construct
  misc_feature 1..25: note = Synthetic Construct
  source 1..25: mol_type = other DNA
gcagcagaaggataaaaacgcaaat

SEQ ID NO: 28861 - DNA, 25 bp, synthetic construct
  misc_feature 1..25: note = Synthetic Construct
  source 1..25: mol_type = other DNA
ccctgtggaagctaaagtgttggaa

SEQ ID NO: 28862 - DNA, 24 bp, synthetic construct
  misc_feature 1..24: note = Synthetic Construct
  source 1..24: mol_type = other DNA
ggttcacatgcagttgtgagaaac

SEQ ID NO: 28863 - DNA, 24 bp, synthetic construct
  misc_feature 1..24: note = Synthetic Construct
  source 1..24: mol_type = other DNA
tgtctgtggtggcaaagaaataga

SEQ ID NO: 28864 - DNA, 25 bp, synthetic construct
  misc_feature 1..25: note = Synthetic Construct
  source 1..25: mol_type = other DNA
ttatcaaggcccatttcaggtatca

SEQ ID NO: 28865 - DNA, 24 bp, synthetic construct
  misc_feature 1..24: note = Synthetic Construct
  source 1..24: mol_type = other DNA
atcagtgggtcattttgtggtact

SEQ ID NO: 28866 - DNA, 21 bp, synthetic construct
  misc_feature 1..21: note = Synthetic Construct
  source 1..21: mol_type = other DNA
cagaaacaacccaggctcaca

SEQ ID NO: 28867 - DNA, 26 bp, synthetic construct
  misc_feature 1..26: note = Synthetic Construct
  source 1..26: mol_type = other DNA
ggccaataactcagctttgcaagaag

SEQ ID NO: 28868 - DNA, 28 bp, synthetic construct
  misc_feature 1..28: note = Synthetic Construct
  source 1..28: mol_type = other DNA
cacatttcaacaggtgcctcttatcctt

SEQ ID NO: 28869 - DNA, 27 bp, synthetic construct
  misc_feature 1..27: note = Synthetic Construct
  source 1..27: mol_type = other DNA
gcctctttatctagagtcagccagatg

SEQ ID NO: 28870 - DNA, 21 bp, synthetic construct
  misc_feature 1..21: note = Synthetic Construct
  source 1..21: mol_type = other DNA
gggtggcagaagccccataat

SEQ ID NO: 28871 - DNA, 25 bp, synthetic construct
  misc_feature 1..25: note = Synthetic Construct
  source 1..25: mol_type = other DNA
acttttgatctaaactcggcccata

SEQ ID NO: 28872 - DNA, 24 bp, synthetic construct
  misc_feature 1..24: note = Synthetic Construct
  source 1..24: mol_type = other DNA
ctcctgctacggttctttcccttt

SEQ ID NO: 28873 - DNA, 22 bp, synthetic construct
  misc_feature 1..22: note = Synthetic Construct
  source 1..22: mol_type = other DNA
gctggaatggaagccagcttag

SEQ ID NO: 28874 - DNA, 24 bp, synthetic construct
  misc_feature 1..24: note = Synthetic Construct
  source 1..24: mol_type = other DNA
tgagagaatgggagagaagtggtt

SEQ ID NO: 28875 - DNA, 30 bp, synthetic construct
  misc_feature 1..30: note = Synthetic Construct
  source 1..30: mol_type = other DNA
gtcctctccacatgaagtagtaaatagttg

SEQ ID NO: 28876 - DNA, 26 bp, synthetic construct
  misc_feature 1..26: note = Synthetic Construct
  source 1..26: mol_type = other DNA
gccaacagcagatctaatgggatgta

SEQ ID NO: 28877 - DNA, 27 bp, synthetic construct
  misc_feature 1..27: note = Synthetic Construct
  source 1..27: mol_type = other DNA
gtcacatataggctgcccattctctaa

SEQ ID NO: 28878 - DNA, 22 bp, synthetic construct
  misc_feature 1..22: note = Synthetic Construct
  source 1..22: mol_type = other DNA
ctgctacccaggccacatttca

SEQ ID NO: 28879 - DNA, 27 bp, synthetic construct
  misc_feature 1..27: note = Synthetic Construct
  source 1..27: mol_type = other DNA
ccccttcttagcttgatcatctgcttt

SEQ ID NO: 28880 - DNA, 25 bp, synthetic construct
  misc_feature 1..25: note = Synthetic Construct
  source 1..25: mol_type = other DNA
ccagatgtcatgcccaataatgact

SEQ ID NO: 28881 - DNA, 20 bp, synthetic construct
  misc_feature 1..20: note = Synthetic Construct
  source 1..20: mol_type = other DNA
tgaggagagcaggggacttg

SEQ ID NO: 28882 - DNA, 24 bp, synthetic construct
  misc_feature 1..24: note = Synthetic Construct
  source 1..24: mol_type = other DNA
gctggtgtccagttttacatcact

SEQ ID NO: 28883 - DNA, 22 bp, synthetic construct
  misc_feature 1..22: note = Synthetic Construct
  source 1..22: mol_type = other DNA
gcttccctggacttccttcttt

SEQ ID NO: 28884 - DNA, 20 bp, synthetic construct
  misc_feature 1..20: note = Synthetic Construct
  source 1..20: mol_type = other DNA
agagctgggcacaagcaaag

SEQ ID NO: 28885 - DNA, 22 bp, synthetic construct
  misc_feature 1..22: note = Synthetic Construct
  source 1..22: mol_type = other DNA
gactggtgatttggggcttaca

SEQ ID NO: 28886 - DNA, 23 bp, synthetic construct
  misc_feature 1..23: note = Synthetic Construct
  source 1..23: mol_type = other DNA
ggttgtggcagatccactaatca

SEQ ID NO: 28887 - DNA, 28 bp, synthetic construct
  misc_feature 1..28: note = Synthetic Construct
  source 1..28: mol_type = other DNA
gggtatctcacatctaagactcaacatc

SEQ ID NO: 28888 - DNA, 22 bp, synthetic construct
  misc_feature 1..22: note = Synthetic Construct
  source 1..22: mol_type = other DNA
tccctggccctatacaagatgt

SEQ ID NO: 28889 - DNA, 23 bp, synthetic construct
  misc_feature 1..23: note = Synthetic Construct
  source 1..23: mol_type = other DNA
ctgcaagcaggaaaggctattca

SEQ ID NO: 28890 - DNA, 23 bp, synthetic construct
  misc_feature 1..23: note = Synthetic Construct
  source 1..23: mol_type = other DNA
tctgactttcaggagcctacact

SEQ ID NO: 28891 - DNA, 20 bp, synthetic construct
  misc_feature 1..20: note = Synthetic Construct
  source 1..20: mol_type = other DNA
gcagcctgagccaattctga

SEQ ID NO: 28892 - DNA, 21 bp, synthetic construct
  misc_feature 1..21: note = Synthetic Construct
  source 1..21: mol_type = other DNA
ggggtaagagctcctctgcat

SEQ ID NO: 28893 - DNA, 23 bp, synthetic construct
  misc_feature 1..23: note = Synthetic Construct
  source 1..23: mol_type = other DNA
ctaacatccctgccatcttcgta

SEQ ID NO: 28894 - DNA, 22 bp, synthetic construct
  misc_feature 1..22: note = Synthetic Construct
  source 1..22: mol_type = other DNA
ccttggcccacttgtgacattt

SEQ ID NO: 28895 - DNA, 23 bp, synthetic construct
  misc_feature 1..23: note = Synthetic Construct
  source 1..23: mol_type = other DNA
ccttggcccatgatttcttccat

SEQ ID NO: 28896 - DNA, 25 bp, synthetic construct
  misc_feature 1..25: note = Synthetic Construct
  source 1..25: mol_type = other DNA
cccatttatgtcaccctccaaccta

SEQ ID NO: 28897 - DNA, 21 bp, synthetic construct
  misc_feature 1..21: note = Synthetic Construct
  source 1..21: mol_type = other DNA
aggcacaaagcagttcacaca

SEQ ID NO: 28898 - DNA, 26 bp, synthetic construct
  misc_feature 1..26: note = Synthetic Construct
  source 1..26: mol_type = other DNA
gagatttcatgacaatggtcctcagt

SEQ ID NO: 28899 - DNA, 24 bp, synthetic construct
  misc_feature 1..24: note = Synthetic Construct
  source 1..24: mol_type = other DNA
gccaaatacagcaactcctcttca

SEQ ID NO: 28900 - DNA, 25 bp, synthetic construct
  misc_feature 1..25: note = Synthetic Construct
  source 1..25: mol_type = other DNA
ctcccaggattgagcacattcttac

SEQ ID NO: 28901 - DNA, 22 bp, synthetic construct
  misc_feature 1..22: note = Synthetic Construct
  source 1..22: mol_type = other DNA
ggtgtggctgcaactatagaca

SEQ ID NO: 28902 - DNA, 26 bp, synthetic construct
  misc_feature 1..26: note = Synthetic Construct
  source 1..26: mol_type = other DNA
gcagtaagctatgattacaccactgt

SEQ ID NO: 28903 - DNA, 21 bp, synthetic construct
  misc_feature 1..21: note = Synthetic Construct
  source 1..21: mol_type = other DNA
ctgcccatagaccatgcaagt

SEQ ID NO: 28904 - DNA, 25 bp, synthetic construct
  misc_feature 1..25: note = Synthetic Construct
  source 1..25: mol_type = other DNA
gtcaatacagccaaggtcagaaatg

SEQ ID NO: 28905 - DNA, 25 bp, synthetic construct
  misc_feature 1..25: note = Synthetic Construct
  source 1..25: mol_type = other DNA
cagacgaatctggacacacttggaa

SEQ ID NO: 28906 - DNA, 26 bp, synthetic construct
  misc_feature 1..26: note = Synthetic Construct
  source 1..26: mol_type = other DNA
ccatctgtattggaaagtgtggttca

SEQ ID NO: 28907 - DNA, 22 bp, synthetic construct
  misc_feature 1..22: note = Synthetic Construct
  source 1..22: mol_type = other DNA
tgctctcctcacctttcagtgt

SEQ ID NO: 28908 - DNA, 23 bp, synthetic construct
  misc_feature 1..23: note = Synthetic Construct
  source 1..23: mol_type = other DNA
tgggttacacatgggacttcctt

SEQ ID NO: 28909 - DNA, 25 bp, synthetic construct
  misc_feature 1..25: note = Synthetic Construct
  source 1..25: mol_type = other DNA
ctcctgcaccaagatatctgcaaag

SEQ ID NO: 28910 - DNA, 22 bp, synthetic construct
  misc_feature 1..22: note = Synthetic Construct
  source 1..22: mol_type = other DNA
gccacaaagagacatggaggaa

SEQ ID NO: 28911 - DNA, 24 bp, synthetic construct
  misc_feature 1..24: note = Synthetic Construct
  source 1..24: mol_type = other DNA
ccaccttttgtccttgggatacat

SEQ ID NO: 28912 - DNA, 26 bp, synthetic construct
  misc_feature 1..26: note = Synthetic Construct
  source 1..26: mol_type = other DNA
gctctgtgatattgtgctgtcaggta

SEQ ID NO: 28913 - DNA, 26 bp, synthetic construct
  misc_feature 1..26: note = Synthetic Construct
  source 1..26: mol_type = other DNA
ggtgcacagtattagcattagcaagt

SEQ ID NO: 28914 - DNA, 22 bp, synthetic construct
  misc_feature 1..22: note = Synthetic Construct
  source 1..22: mol_type = other DNA
ggaaatgctacggaggctgtgt

SEQ ID NO: 28915 - DNA, 25 bp, synthetic construct
  misc_feature 1..25: note = Synthetic Construct
  source 1..25: mol_type = other DNA
actctttaggtgaggacttctctga

SEQ ID NO: 28916 - DNA, 20 bp, synthetic construct
  misc_feature 1..20: note = Synthetic Construct
  source 1..20: mol_type = other DNA
cgaactttgggctgccttca

SEQ ID NO: 28917 - DNA, 24 bp, synthetic construct
  misc_feature 1..24: note = Synthetic Construct
  source 1..24: mol_type = other DNA
catcaggtgatacggctacattca

SEQ ID NO: 28918 - DNA, 21 bp, synthetic construct
  misc_feature 1..21: note = Synthetic Construct
  source 1..21: mol_type = other DNA
tgacaaatgcctctgcctgtt

SEQ ID NO: 28919 - DNA, 22 bp, synthetic construct
  misc_feature 1..22: note = Synthetic Construct
  source 1..22: mol_type = other DNA
gattggtccaagcctgatctga

SEQ ID NO: 28920 - DNA, 22 bp, synthetic construct
  misc_feature 1..22: note = Synthetic Construct
  source 1..22: mol_type = other DNA
ggcacagctgaaaggcaaaaca

SEQ ID NO: 28921 - DNA, 22 bp, synthetic construct
  misc_feature 1..22: note = Synthetic Construct
  source 1..22: mol_type = other DNA
cccaactctcaccatggcttat

SEQ ID NO: 28922 - DNA, 27 bp, synthetic construct
  misc_feature 1..27: note = Synthetic Construct
  source 1..27: mol_type = other DNA
gccttacaatttctaccctggaaaaga

SEQ ID NO: 28923 - DNA, 25 bp, synthetic construct
  misc_feature 1..25: note = Synthetic Construct
  source 1..25: mol_type = other DNA
ccagggcctattggaaaccctaaac

SEQ ID NO: 28924 - DNA, 26 bp, synthetic construct
  misc_feature 1..26: note = Synthetic Construct
  source 1..26: mol_type = other DNA
cagctttctgcccctttttcttttag

SEQ ID NO: 28925 - DNA, 26 bp, synthetic construct
  misc_feature 1..26: note = Synthetic Construct
  source 1..26: mol_type = other DNA
tccatctccttccatctgtttagact

SEQ ID NO: 28926 - DNA, 22 bp, synthetic construct
  misc_feature 1..22: note = Synthetic Construct
  source 1..22: mol_type = other DNA
accaggtgcacgtaacttgtaa

SEQ ID NO: 28927 - DNA, 22 bp, synthetic construct
  misc_feature 1..22: note = Synthetic Construct
  source 1..22: mol_type = other DNA
acatccacaatggcagttctca

SEQ ID NO: 28928 - DNA, 27 bp, synthetic construct
  misc_feature 1..27: note = Synthetic Construct
  source 1..27: mol_type = other DNA
ccagacagaaggtgttgtcctaaccta

SEQ ID NO: 28929 - DNA, 20 bp, synthetic construct
  misc_feature 1..20: note = Synthetic Construct
  source 1..20: mol_type = other DNA
gggaccagctcctcacatca

SEQ ID NO: 28930 - DNA, 23 bp, synthetic construct
  misc_feature 1..23: note = Synthetic Construct
  source 1..23: mol_type = other DNA
gctgatccctggagacacctgtt

SEQ ID NO: 28931 - DNA, 20 bp, synthetic construct
  misc_feature 1..20: note = Synthetic Construct
  source 1..20: mol_type = other DNA
tcccacacccattccaccaa

SEQ ID NO: 28932 - DNA, 24 bp, synthetic construct
  misc_feature 1..24: note = Synthetic Construct
  source 1..24: mol_type = other DNA
ggcttatggctcaaatccaagcaa

SEQ ID NO: 28933 - DNA, 24 bp, synthetic construct
  misc_feature 1..24: note = Synthetic Construct
  source 1..24: mol_type = other DNA
caagcccagtcctatgtacccatt

SEQ ID NO: 28934 - DNA, 23 bp, synthetic construct
  misc_feature 1..23: note = Synthetic Construct
  source 1..23: mol_type = other DNA
cccttaccatgaacccgtaagaa

SEQ ID NO: 28935 - DNA, 22 bp, synthetic construct
  misc_feature 1..22: note = Synthetic Construct
  source 1..22: mol_type = other DNA
gaccttcagcgtcaggagaaca

SEQ ID NO: 28936 - DNA, 27 bp, synthetic construct
  misc_feature 1..27: note = Synthetic Construct
  source 1..27: mol_type = other DNA
cagacttcagctctttcttctccttca

SEQ ID NO: 28937 - DNA, 24 bp, synthetic construct
  misc_feature 1..24: note = Synthetic Construct
  source 1..24: mol_type = other DNA
ggggatagagccatgctttcattg

SEQ ID NO: 28938 - DNA, 24 bp, synthetic construct
  misc_feature 1..24: note = Synthetic Construct
  source 1..24: mol_type = other DNA
ggacttgcttaaggctgggaataa

SEQ ID NO: 28939 - DNA, 27 bp, synthetic construct
  misc_feature 1..27: note = Synthetic Construct
  source 1..27: mol_type = other DNA
cagttgattgtgagtagcagtcacgta

SEQ ID NO: 28940 - DNA, 22 bp, synthetic construct
  misc_feature 1..22: note = Synthetic Construct
  source 1..22: mol_type = other DNA
gaccaagcgaggcagaaggaaa

SEQ ID NO: 28941 - DNA, 30 bp, synthetic construct
  misc_feature 1..30: note = Synthetic Construct
  source 1..30: mol_type = other DNA
ctgaagtctttcaacagaggagtaagatca

SEQ ID NO: 28942 - DNA, 30 bp, synthetic construct
  misc_feature 1..30: note = Synthetic Construct
  source 1..30: mol_type = other DNA
cttttatgactccattagaggtaggggata

SEQ ID NO: 28943 - DNA, 28 bp, synthetic construct
  misc_feature 1..28: note = Synthetic Construct
  source 1..28: mol_type = other DNA
cctgaactcttggatcatcagtcagata

SEQ ID NO: 28944 - DNA, 25 bp, synthetic construct
  misc_feature 1..25: note = Synthetic Construct
  source 1..25: mol_type = other DNA
aaaagtgtcccatgtgtctcaaaac

SEQ ID NO: 28945 - DNA, 24 bp, synthetic construct
  misc_feature 1..24: note = Synthetic Construct
  source 1..24: mol_type = other DNA
cagtaactctcctctctgctttgt

SEQ ID NO: 28946 - DNA, 24 bp, synthetic construct
  misc_feature 1..24: note = Synthetic Construct
  source 1..24: mol_type = other DNA
aggtacacttccatgccaagaaaa

SEQ ID NO: 28947 - DNA, 26 bp, synthetic construct
  misc_feature 1..26: note = Synthetic Construct
  source 1..26: mol_type = other DNA
ccagctctaacccttacccattcttc

SEQ ID NO: 28948 - DNA, 22 bp, synthetic construct
  misc_feature 1..22: note = Synthetic Construct
  source 1..22: mol_type = other DNA
ggaggctgtggccatgattaac

SEQ ID NO: 28949 - DNA, 21 bp, synthetic construct
  misc_feature 1..21: note = Synthetic Construct
  source 1..21: mol_type = other DNA
tcgctggactagatggctact

SEQ ID NO: 28950 - DNA, 24 bp, synthetic construct
  misc_feature 1..24: note = Synthetic Construct
  source 1..24: mol_type = other DNA
ccttctggtttccacccaaagaag

SEQ ID NO: 28951 - DNA, 22 bp, synthetic construct
  misc_feature 1..22: note = Synthetic Construct
  source 1..22: mol_type = other DNA
gggcccttctggagcttttaac

SEQ ID NO: 28952 - DNA, 20 bp, synthetic construct
  misc_feature 1..20: note = Synthetic Construct
  source 1..20: mol_type = other DNA
acagctccctgtcctgcaaa

SEQ ID NO: 28953 - DNA, 24 bp, synthetic construct
  misc_feature 1..24: note = Synthetic Construct
  source 1..24: mol_type = other DNA
cctgtcccgaatttccctctctct

SEQ ID NO: 28954 - DNA, 20 bp, synthetic construct
  misc_feature 1..20: note = Synthetic Construct
  source 1..20: mol_type = other DNA
gtggttggccaggcaatgaa

SEQ ID NO: 28955 - DNA, 25 bp, synthetic construct
  misc_feature 1..25: note = Synthetic Construct
  source 1..25: mol_type = other DNA
gcctgaaagtgtacatgcctcttct

SEQ ID NO: 28956 - DNA, 25 bp, synthetic construct
  misc_feature 1..25: note = Synthetic Construct
  source 1..25: mol_type = other DNA
gggaacataccacagcattcgctta

SEQ ID NO: 28957 - DNA, 25 bp, synthetic construct
  misc_feature 1..25: note = Synthetic Construct
  source 1..25: mol_type = other DNA
agtcaagatgaggagaatccagttc

SEQ ID NO: 28958 - DNA, 23 bp, synthetic construct
  misc_feature 1..23: note = Synthetic Construct
  source 1..23: mol_type = other DNA
gccactggaaggaccaattctga

SEQ ID NO: 28959 - DNA, 25 bp, synthetic construct
  misc_feature 1..25: note = Synthetic Construct
  source 1..25: mol_type = other DNA
ggctagaaaaggaactccactgctt

SEQ ID NO: 28960 - DNA, 22 bp, synthetic construct
  misc_feature 1..22: note = Synthetic Construct
  source 1..22: mol_type = other DNA
ggcacagagaggttcaatccat

SEQ ID NO: 28961 - DNA, 18 bp, synthetic construct
  misc_feature 1..18: note = Synthetic Construct
  source 1..18: mol_type = other DNA
ttgcagcgccactgcttt

SEQ ID NO: 28962 - DNA, 22 bp, synthetic construct
  misc_feature 1..22: note = Synthetic Construct
  source 1..22: mol_type = other DNA
gtcacccattgttgctgagaga

SEQ ID NO: 28963 - DNA, 22 bp, synthetic construct
  misc_feature 1..22: note = Synthetic Construct
  source 1..22: mol_type = other DNA
ccggtcagttgtggacttttgt

SEQ ID NO: 28964 - DNA, 24 bp, synthetic construct
  misc_feature 1..24: note = Synthetic Construct
  source 1..24: mol_type = other DNA
gaggtcaagaaagacctccatgat

SEQ ID NO: 28965 - DNA, 22 bp, synthetic construct
  misc_feature 1..22: note = Synthetic Construct
  source 1..22: mol_type = other DNA
actcagaccctccctcgtgttt

SEQ ID NO: 28966 - DNA, 22 bp, synthetic construct
  misc_feature 1..22: note = Synthetic Construct
  source 1..22: mol_type = other DNA
gctgccttgtcatccttgtttc

SEQ ID NO: 28967 - DNA, 19 bp, synthetic construct
  misc_feature 1..19: note = Synthetic Construct
  source 1..19: mol_type = other DNA
tgggccttcccctcacact

SEQ ID NO: 28968 - DNA, 21 bp, synthetic construct
  misc_feature 1..21: note = Synthetic Construct
  source 1..21: mol_type = other DNA
tgaaggccccagccacattac

SEQ ID NO: 28969 - DNA, 22 bp, synthetic construct
  misc_feature 1..22: note = Synthetic Construct
  source 1..22: mol_type = other DNA
cgacaccaccactgtcatctgt

SEQ ID NO: 28970 - DNA, 22 bp, synthetic construct
  misc_feature 1..22: note = Synthetic Construct
  source 1..22: mol_type = other DNA
ggcagcaagagtgaatgtgttg

SEQ ID NO: 28971 - DNA, 24 bp, synthetic construct
  misc_feature 1..24: note = Synthetic Construct
  source 1..24: mol_type = other DNA
cccagtaccaccacagaataaact

SEQ ID NO: 28972 - DNA, 22 bp, synthetic construct
  misc_feature 1..22: note = Synthetic Construct
  source 1..22: mol_type = other DNA
cttcactgtgtctcacccttga

SEQ ID NO: 28973 - DNA, 27 bp, synthetic construct
  misc_feature 1..27: note = Synthetic Construct
  source 1..27: mol_type = other DNA
ccagaccaaaatcaaactcaagagcaa

SEQ ID NO: 28974 - DNA, 22 bp, synthetic construct
  misc_feature 1..22: note = Synthetic Construct
  source 1..22: mol_type = other DNA
ggagtgtcctcaaactcccaaa

SEQ ID NO: 28975 - DNA, 24 bp, synthetic construct
  misc_feature 1..24: note = Synthetic Construct
  source 1..24: mol_type = other DNA
ccgcattaggcctagtctctgttc

SEQ ID NO: 28976 - DNA, 23 bp, synthetic construct
  misc_feature 1..23: note = Synthetic Construct
  source 1..23: mol_type = other DNA
gctcttaggtctgggctccctaa

SEQ ID NO: 28977 - DNA, 22 bp, synthetic construct
  misc_feature 1..22: note = Synthetic Construct
  source 1..22: mol_type = other DNA
gcctgcctggaaatctcagtct

SEQ ID NO: 28978 - DNA, 25 bp, synthetic construct
  misc_feature 1..25: note = Synthetic Construct
  source 1..25: mol_type = other DNA
cctgtgtttgctttgacttttcctt

SEQ ID NO: 28979 - DNA, 24 bp, synthetic construct
  misc_feature 1..24: note = Synthetic Construct
  source 1..24: mol_type = other DNA
tcaggaaggtctgctcaatgtaag

SEQ ID NO: 28980 - DNA, 24 bp, synthetic construct
  misc_feature 1..24: note = Synthetic Construct
  source 1..24: mol_type = other DNA
gggatgccaaagtggacatacgaa

SEQ ID NO: 28981 - DNA, 26 bp, synthetic construct
  misc_feature 1..26: note = Synthetic Construct
  source 1..26: mol_type = other DNA
cgtatatctttcccgccataggttga

SEQ ID NO: 28982 - DNA, 25 bp, synthetic construct
  misc_feature 1..25: note = Synthetic Construct
  source 1..25: mol_type = other DNA
cccctttacgcaaatctaccttgta

SEQ ID NO: 28983 - DNA, 22 bp, synthetic construct
  misc_feature 1..22: note = Synthetic Construct
  source 1..22: mol_type = other DNA
tgagtggggctgtcaggaaaac

SEQ ID NO: 28984 - DNA, 23 bp, synthetic construct
  misc_feature 1..23: note = Synthetic Construct
  source 1..23: mol_type = other DNA
ggaagggtgaggggagatactga

SEQ ID NO: 28985 - DNA, 20 bp, synthetic construct
  misc_feature 1..20: note = Synthetic Construct
  source 1..20: mol_type = other DNA
gcagggagtagcagcaagtt

SEQ ID NO: 28986 - DNA, 22 bp, synthetic construct
  misc_feature 1..22: note = Synthetic Construct
  source 1..22: mol_type = other DNA
aggggccactcccgtagataaa

SEQ ID NO: 28987 - DNA, 22 bp, synthetic construct
  misc_feature 1..22: note = Synthetic Construct
  source 1..22: mol_type = other DNA
ggccagctggtctgcaaataac

SEQ ID NO: 28988 - DNA, 24 bp, synthetic construct
  misc_feature 1..24: note = Synthetic Construct
  source 1..24: mol_type = other DNA
ttggaaacttagggaaacccaaca

SEQ ID NO: 28989 - DNA, 21 bp, synthetic construct
  misc_feature 1..21: note = Synthetic Construct
  source 1..21: mol_type = other DNA
ggtcacagcagtcagcacaat

SEQ ID NO: 28990 - DNA, 22 bp, synthetic construct
  misc_feature 1..22: note = Synthetic Construct
  source 1..22: mol_type = other DNA
tgatggggacaatcacctcaca

SEQ ID NO: 28991 - DNA, 23 bp, synthetic construct
  misc_feature 1..23: note = Synthetic Construct
  source 1..23: mol_type = other DNA
catcagcgcaatcaggttgaaag

SEQ ID NO: 28992 - DNA, 22 bp, synthetic construct
  misc_feature 1..22: note = Synthetic Construct
  source 1..22: mol_type = other DNA
gccgatccaagttgccatcctt

SEQ ID NO: 28993 - DNA, 22 bp, synthetic construct
  misc_feature 1..22: note = Synthetic Construct
  source 1..22: mol_type = other DNA
ggggaagacaggtgtctgaatg

SEQ ID NO: 28994 - DNA, 22 bp, synthetic construct
  misc_feature 1..22: note = Synthetic Construct
  source 1..22: mol_type = other DNA
cctcggttgctggttcaggatt

SEQ ID NO: 28995 - DNA, 24 bp, synthetic construct
  misc_feature 1..24: note = Synthetic Construct
  source 1..24: mol_type = other DNA
catgacactgcaggactgaagaag

SEQ ID NO: 28996 - DNA, 25 bp, synthetic construct
  misc_feature 1..25: note = Synthetic Construct
  source 1..25: mol_type = other DNA
ggaggtacacactttcccgaaaaac

SEQ ID NO: 28997 - DNA, 21 bp, synthetic construct
  misc_feature 1..21: note = Synthetic Construct
  source 1..21: mol_type = other DNA
cctgctggcttctgagctctt

SEQ ID NO: 28998 - DNA, 22 bp, synthetic construct
  misc_feature 1..22: note = Synthetic Construct
  source 1..22: mol_type = other DNA
gagcccagtgaagcaggaaatg

SEQ ID NO: 28999 - DNA, 23 bp, synthetic construct
  misc_feature 1..23: note = Synthetic Construct
  source 1..23: mol_type = other DNA
ccagcgctcattgacaattcaaa

SEQ ID NO: 29000 - DNA, 22 bp, synthetic construct
  misc_feature 1..22: note = Synthetic Construct
  source 1..22: mol_type = other DNA
aaaccccttccatccgagaatc

SEQ ID NO: 29001 - DNA, 22 bp, synthetic construct
  misc_feature 1..22: note = Synthetic Construct
  source 1..22: mol_type = other DNA
acccatttccaaggtccaggta

SEQ ID NO: 29002 - DNA, 24 bp, synthetic construct
  misc_feature 1..24: note = Synthetic Construct
  source 1..24: mol_type = other DNA
cctctgcccatttgtaacctccta

SEQ ID NO: 29003 - DNA, 25 bp, synthetic construct
  misc_feature 1..25: note = Synthetic Construct
  source 1..25: mol_type = other DNA
cccaacagaagcaggaggataggat

SEQ ID NO: 29004 - DNA, 20 bp, synthetic construct
  misc_feature 1..20: note = Synthetic Construct
  source 1..20: mol_type = other DNA
tgcagctgcctcctttcgtt

SEQ ID NO: 29005 - DNA, 24 bp, synthetic construct
  misc_feature 1..24: note = Synthetic Construct
  source 1..24: mol_type = other DNA
ctgatggtcacacagctctcatag

SEQ ID NO: 29006 - DNA, 26 bp, synthetic construct
  misc_feature 1..26: note = Synthetic Construct
  source 1..26: mol_type = other DNA
ccaaagcttttgcctttgaagctact

SEQ ID NO: 29007 - DNA, 28 bp, synthetic construct
  misc_feature 1..28: note = Synthetic Construct
  source 1..28: mol_type = other DNA
cccaagacagattgacaagtagcttaac

SEQ ID NO: 29008 - DNA, 19 bp, synthetic construct
  misc_feature 1..19: note = Synthetic Construct
  source 1..19: mol_type = other DNA
gccacgcttctgccgttag

SEQ ID NO: 29009 - DNA, 20 bp, synthetic construct
  misc_feature 1..20: note = Synthetic Construct
  source 1..20: mol_type = other DNA
ggaccagccttggggaaatg

SEQ ID NO: 29010 - DNA, 24 bp, synthetic construct
  misc_feature 1..24: note = Synthetic Construct
  source 1..24: mol_type = other DNA
gatgtacacacccacatgtagcaa

SEQ ID NO: 29011 - DNA, 26 bp, synthetic construct
  misc_feature 1..26: note = Synthetic Construct
  source 1..26: mol_type = other DNA
ctgcgtccaatatgtgtactgcttct

SEQ ID NO: 29012 - DNA, 23 bp, synthetic construct
  misc_feature 1..23: note = Synthetic Construct
  source 1..23: mol_type = other DNA
tcctttgcaactctgagctttgt

SEQ ID NO: 29013 - DNA, 26 bp, synthetic construct
  misc_feature 1..26: note = Synthetic Construct
  source 1..26: mol_type = other DNA
gactggtcaatacttgttgagtggtt

SEQ ID NO: 29014 - DNA, 23 bp, synthetic construct
  misc_feature 1..23: note = Synthetic Construct
  source 1..23: mol_type = other DNA
gcagcttcttccacaaagctaga

SEQ ID NO: 29015 - DNA, 22 bp, synthetic construct
  misc_feature 1..22: note = Synthetic Construct
  source 1..22: mol_type = other DNA
aacattcggtgcagctatggta

SEQ ID NO: 29016 - DNA, 20 bp, synthetic construct
  misc_feature 1..20: note = Synthetic Construct
  source 1..20: mol_type = other DNA
acctcccattgccactcgat

SEQ ID NO: 29017 - DNA, 23 bp, synthetic construct
  misc_feature 1..23: note = Synthetic Construct
  source 1..23: mol_type = other DNA
gactaggaagtgtcctcctctga

SEQ ID NO: 29018 - DNA, 24 bp, synthetic construct
  misc_feature 1..24: note = Synthetic Construct
  source 1..24: mol_type = other DNA
tcttggacaaggcatgttttgatg

SEQ ID NO: 29019 - DNA, 25 bp, synthetic construct
  misc_feature 1..25: note = Synthetic Construct
  source 1..25: mol_type = other DNA
cctgaccacatgccttcatatctca

SEQ ID NO: 29020 - DNA, 27 bp, synthetic construct
  misc_feature 1..27: note = Synthetic Construct
  source 1..27: mol_type = other DNA
gactgtttgttcagcctaagtcctaga

SEQ ID NO: 29021 - DNA, 21 bp, synthetic construct
  misc_feature 1..21: note = Synthetic Construct
  source 1..21: mol_type = other DNA
ggctgacctctctcctgtgtt

SEQ ID NO: 29022 - DNA, 25 bp, synthetic construct
  misc_feature 1..25: note = Synthetic Construct
  source 1..25: mol_type = other DNA
agctcatcaaaattcacctgtgtct

SEQ ID NO: 29023 - DNA, 26 bp, synthetic construct
  misc_feature 1..26: note = Synthetic Construct
  source 1..26: mol_type = other DNA
agtcatgagacctattgctaccctta

SEQ ID NO: 29024 - DNA, 20 bp, synthetic construct
  misc_feature 1..20: note = Synthetic Construct
  source 1..20: mol_type = other DNA
tgcctagcctggagcatgaa

SEQ ID NO: 29025 - DNA, 22 bp, synthetic construct
  misc_feature 1..22: note = Synthetic Construct
  source 1..22: mol_type = other DNA
gcttgggctgtggttttctcta

SEQ ID NO: 29026 - DNA, 23 bp, synthetic construct
  misc_feature 1..23: note = Synthetic Construct
  source 1..23: mol_type = other DNA
ccactcaccacctctcaccagat

SEQ ID NO: 29027 - DNA, 25 bp, synthetic construct
  misc_feature 1..25: note = Synthetic Construct
  source 1..25: mol_type = other DNA
tcacccattatcttggacccttttc

SEQ ID NO: 29028 - DNA, 19 bp, synthetic construct
  misc_feature 1..19: note = Synthetic Construct
  source 1..19: mol_type = other DNA
cgcgttttgccgggagatg

SEQ ID NO: 29029 - DNA, 28 bp, synthetic construct
  misc_feature 1..28: note = Synthetic Construct
  source 1..28: mol_type = other DNA
gggatatgaattgccttcttcccacata

SEQ ID NO: 29030 - DNA, 24 bp, synthetic construct
  misc_feature 1..24: note = Synthetic Construct
  source 1..24: mol_type = other DNA
ggaaacttttgcatgactctcaca

SEQ ID NO: 29031 - DNA, 24 bp, synthetic construct
  misc_feature 1..24: note = Synthetic Construct
  source 1..24: mol_type = other DNA
ggagaagcagtttccaagacatga

SEQ ID NO: 29032 - DNA, 25 bp, synthetic construct
  misc_feature 1..25: note = Synthetic Construct
  source 1..25: mol_type = other DNA
aggaagaggactttgtctttcaact

SEQ ID NO: 29033 - DNA, 25 bp, synthetic construct
  misc_feature 1..25: note = Synthetic Construct
  source 1..25: mol_type = other DNA
gctacaagctctactccactcagat

SEQ ID NO: 29034 - DNA, 24 bp, synthetic construct
  misc_feature 1..24: note = Synthetic Construct
  source 1..24: mol_type = other DNA
ccagaaggccatgtatgctctgaa

SEQ ID NO: 29035 - DNA, 26 bp, synthetic construct
  misc_feature 1..26: note = Synthetic Construct
  source 1..26: mol_type = other DNA
gagggaaaagggaacatttcaggtat

SEQ ID NO: 29036 - DNA, 21 bp, synthetic construct
  misc_feature 1..21: note = Synthetic Construct
  source 1..21: mol_type = other DNA
actcaaggccctgggttcaag

SEQ ID NO: 29037 - DNA, 21 bp, synthetic construct
  misc_feature 1..21: note = Synthetic Construct
  source 1..21: mol_type = other DNA
gcccaaaggcagaccactcta

SEQ ID NO: 29038 - DNA, 24 bp, synthetic construct
  misc_feature 1..24: note = Synthetic Construct
  source 1..24: mol_type = other DNA
ggctgaggttcagagaagagaaaa

SEQ ID NO: 29039 - DNA, 25 bp, synthetic construct
  misc_feature 1..25: note = Synthetic Construct
  source 1..25: mol_type = other DNA
ggtgaagaagacttaggagtgacat

SEQ ID NO: 29040 - DNA, 25 bp, synthetic construct
  misc_feature 1..25: note = Synthetic Construct
  source 1..25: mol_type = other DNA
ctctatctcagctttggaggcaaca

SEQ ID NO: 29041 - DNA, 25 bp, synthetic construct
  misc_feature 1..25: note = Synthetic Construct
  source 1..25: mol_type = other DNA
tgaagccaagtctataaggacgttt

SEQ ID NO: 29042 - DNA, 26 bp, synthetic construct
  misc_feature 1..26: note = Synthetic Construct
  source 1..26: mol_type = other DNA
ccctggtgaatctgttttccatcaaa

SEQ ID NO: 29043 - DNA, 21 bp, synthetic construct
  misc_feature 1..21: note = Synthetic Construct
  source 1..21: mol_type = other DNA
ccccaccagctgtttctgaca

SEQ ID NO: 29044 - DNA, 30 bp, synthetic construct
  misc_feature 1..30: note = Synthetic Construct
  source 1..30: mol_type = other DNA
ctcagaatctgttgggaatgatttctccat

SEQ ID NO: 29045 - DNA, 24 bp, synthetic construct
  misc_feature 1..24: note = Synthetic Construct
  source 1..24: mol_type = other DNA
gtcactcaggaaatgggttgaaca

SEQ ID NO: 29046 - DNA, 22 bp, synthetic construct
  misc_feature 1..22: note = Synthetic Construct
  source 1..22: mol_type = other DNA
ccagcctggtccattcaacagt

SEQ ID NO: 29047 - DNA, 24 bp, synthetic construct
  misc_feature 1..24: note = Synthetic Construct
  source 1..24: mol_type = other DNA
ggaaaaagtcacctggcagttttg

SEQ ID NO: 29048 - DNA, 25 bp, synthetic construct
  misc_feature 1..25: note = Synthetic Construct
  source 1..25: mol_type = other DNA
ggtgggaacagatatttctggtgaa

SEQ ID NO: 29049 - DNA, 27 bp, synthetic construct
  misc_feature 1..27: note = Synthetic Construct
  source 1..27: mol_type = other DNA
cagtaagcactgtaaacacccttccta

SEQ ID NO: 29050 - DNA, 26 bp, synthetic construct
  misc_feature 1..26: note = Synthetic Construct
  source 1..26: mol_type = other DNA
gtagctcctaaacacacaagtaccat

SEQ ID NO: 29051 - DNA, 25 bp, synthetic construct
  misc_feature 1..25: note = Synthetic Construct
  source 1..25: mol_type = other DNA
cctcacaccatagtcctttcctcta

SEQ ID NO: 29052 - DNA, 25 bp, synthetic construct
  misc_feature 1..25: note = Synthetic Construct
  source 1..25: mol_type = other DNA
ttgtggtcccaaacagggtatattt

SEQ ID NO: 29053 - DNA, 23 bp, synthetic construct
  misc_feature 1..23: note = Synthetic Construct
  source 1..23: mol_type = other DNA
cccagccacctcctaatggacta

SEQ ID NO: 29054 - DNA, 25 bp, synthetic construct
  misc_feature 1..25: note = Synthetic Construct
  source 1..25: mol_type = other DNA
gtggaaagtcctcaagccctcttag

SEQ ID NO: 29055 - DNA, 22 bp, synthetic construct
  misc_feature 1..22: note = Synthetic Construct
  source 1..22: mol_type = other DNA
gtgcctagccaaggaatacact

SEQ ID NO: 29056 - DNA, 24 bp, synthetic construct
  misc_feature 1..24: note = Synthetic Construct
  source 1..24: mol_type = other DNA
tcaggaagccatggtttttgagat

SEQ ID NO: 29057 - DNA, 27 bp, synthetic construct
  misc_feature 1..27: note = Synthetic Construct
  source 1..27: mol_type = other DNA
gtgtttaggattcagaaagagctgagt

SEQ ID NO: 29058 - DNA, 25 bp, synthetic construct
  misc_feature 1..25: note = Synthetic Construct
  source 1..25: mol_type = other DNA
ggctgcagagatgatacctgagctt

SEQ ID NO: 29059 - DNA, 24 bp, synthetic construct
  misc_feature 1..24: note = Synthetic Construct
  source 1..24: mol_type = other DNA
ccaggtgagattttccttgtcact

SEQ ID NO: 29060 - DNA, 20 bp, synthetic construct
  misc_feature 1..20: note = Synthetic Construct
  source 1..20: mol_type = other DNA
acttggtgtaggggctgagt

SEQ ID NO: 29061 - DNA, 25 bp, synthetic construct
  misc_feature 1..25: note = Synthetic Construct
  source 1..25: mol_type = other DNA
acaaaaggagaggtaaaccctgttc

SEQ ID NO: 29062 - DNA, 23 bp, synthetic construct
  misc_feature 1..23: note = Synthetic Construct
  source 1..23: mol_type = other DNA
aaccagtatagcctggcaaacaa

SEQ ID NO: 29063 - DNA, 25 bp, synthetic construct
  misc_feature 1..25: note = Synthetic Construct
  source 1..25: mol_type = other DNA
gttaccccatgacagcaaaatcaag

SEQ ID NO: 29064 - DNA, 22 bp, synthetic construct
  misc_feature 1..22: note = Synthetic Construct
  source 1..22: mol_type = other DNA
cgcccagccagacttattctca

SEQ ID NO: 29065 - DNA, 19 bp, synthetic construct
  misc_feature 1..19: note = Synthetic Construct
  source 1..19: mol_type = other DNA
tgctgcctggcttctctct

SEQ ID NO: 29066 - DNA, 25 bp, synthetic construct
  misc_feature 1..25: note = Synthetic Construct
  source 1..25: mol_type = other DNA
cataaacactcctttgcctcagtct

SEQ ID NO: 29067 - DNA, 21 bp, synthetic construct
  misc_feature 1..21: note = Synthetic Construct
  source 1..21: mol_type = other DNA
tggagacatccgcccatatca

SEQ ID NO: 29068 - DNA, 24 bp, synthetic construct
  misc_feature 1..24: note = Synthetic Construct
  source 1..24: mol_type = other DNA
ggttctgaggacctgggttttctt

SEQ ID NO: 29069 - DNA, 24 bp, synthetic construct
  misc_feature 1..24: note = Synthetic Construct
  source 1..24: mol_type = other DNA
caggaggtaaacaccatccctgat

SEQ ID NO: 29070 - DNA, 24 bp, synthetic construct
  misc_feature 1..24: note = Synthetic Construct
  source 1..24: mol_type = other DNA
ggggtgagacccatgagtgacatt

SEQ ID NO: 29071 - DNA, 26 bp, synthetic construct
  misc_feature 1..26: note = Synthetic Construct
  source 1..26: mol_type = other DNA
ccactagtttatcccacctgtgtaac

SEQ ID NO: 29072 - DNA, 23 bp, synthetic construct
  misc_feature 1..23: note = Synthetic Construct
  source 1..23: mol_type = other DNA
acccagacaacagtctcatctgt

SEQ ID NO: 29073 - DNA, 19 bp, synthetic construct
  misc_feature 1..19: note = Synthetic Construct
  source 1..19: mol_type = other DNA
tgcgagtggcagtgcttag

SEQ ID NO: 29074 - DNA, 24 bp, synthetic construct
  misc_feature 1..24: note = Synthetic Construct
  source 1..24: mol_type = other DNA
gcattagtgacagggatccaggaa

SEQ ID NO: 29075 - DNA, 20 bp, synthetic construct
  misc_feature 1..20: note = Synthetic Construct
  source 1..20: mol_type = other DNA
ccgatgcgtgacaggtttga

SEQ ID NO: 29076 - DNA, 27 bp, synthetic construct
  misc_feature 1..27: note = Synthetic Construct
  source 1..27: mol_type = other DNA
gtctagagacaatggttctcactgatg

SEQ ID NO: 29077 - DNA, 23 bp, synthetic construct
  misc_feature 1..23: note = Synthetic Construct
  source 1..23: mol_type = other DNA
ttggatgtgtggtgtgagagaag

SEQ ID NO: 29078 - DNA, 22 bp, synthetic construct
  misc_feature 1..22: note = Synthetic Construct
  source 1..22: mol_type = other DNA
ctgggcctccattgttttgtca

SEQ ID NO: 29079 - DNA, 25 bp, synthetic construct
  misc_feature 1..25: note = Synthetic Construct
  source 1..25: mol_type = other DNA
gtttcatccgtttttccctgtagtt

SEQ ID NO: 29080 - DNA, 22 bp, synthetic construct
  misc_feature 1..22: note = Synthetic Construct
  source 1..22: mol_type = other DNA
tggagggaccgtctttggagtt

SEQ ID NO: 29081 - DNA, 23 bp, synthetic construct
  misc_feature 1..23: note = Synthetic Construct
  source 1..23: mol_type = other DNA
ggactggtctgtgctggtgatac

SEQ ID NO: 29082 - DNA, 27 bp, synthetic construct
  misc_feature 1..27: note = Synthetic Construct
  source 1..27: mol_type = other DNA
gtaagtcgtgaagttaaggtacctagt

SEQ ID NO: 29083 - DNA, 24 bp, synthetic construct
  misc_feature 1..24: note = Synthetic Construct
  source 1..24: mol_type = other DNA
ctggaggaatcgcagacagtttca

SEQ ID NO: 29084 - DNA, 26 bp, synthetic construct
  misc_feature 1..26: note = Synthetic Construct
  source 1..26: mol_type = other DNA
ctcattaaagaggtgaggacaggtaa

SEQ ID NO: 29085 - DNA, 25 bp, synthetic construct
  misc_feature 1..25: note = Synthetic Construct
  source 1..25: mol_type = other DNA
gggtccaactgcttatttcttgttg

SEQ ID NO: 29086 - DNA, 27 bp, synthetic construct
  misc_feature 1..27: note = Synthetic Construct
  source 1..27: mol_type = other DNA
ctcatacatttagggctgtgttgttca

SEQ ID NO: 29087 - DNA, 22 bp, synthetic construct
  misc_feature 1..22: note = Synthetic Construct
  source 1..22: mol_type = other DNA
ctttcttggccttgtgggacta

SEQ ID NO: 29088 - DNA, 23 bp, synthetic construct
  misc_feature 1..23: note = Synthetic Construct
  source 1..23: mol_type = other DNA
gtgctcttcagggagggtgaatc

SEQ ID NO: 29089 - DNA, 21 bp, synthetic construct
  misc_feature 1..21: note = Synthetic Construct
  source 1..21: mol_type = other DNA
aggagactgcagtgggagaaa

SEQ ID NO: 29090 - DNA, 24 bp, synthetic construct
  misc_feature 1..24: note = Synthetic Construct
  source 1..24: mol_type = other DNA
tgttgctgatgggacattgagtat

SEQ ID NO: 29091 - DNA, 23 bp, synthetic construct
  misc_feature 1..23: note = Synthetic Construct
  source 1..23: mol_type = other DNA
ggaggctgaagtcactggttcaa

SEQ ID NO: 29092 - DNA, 21 bp, synthetic construct
  misc_feature 1..21: note = Synthetic Construct
  source 1..21: mol_type = other DNA
ggacgcggtacaacgaacttg

SEQ ID NO: 29093 - DNA, 25 bp, synthetic construct
  misc_feature 1..25: note = Synthetic Construct
  source 1..25: mol_type = other DNA
gaggacttaggtttagggtggaatg

SEQ ID NO: 29094 - DNA, 23 bp, synthetic construct
  misc_feature 1..23: note = Synthetic Construct
  source 1..23: mol_type = other DNA
cccactccttacagctggtcttc

SEQ ID NO: 29095 - DNA, 25 bp, synthetic construct
  misc_feature 1..25: note = Synthetic Construct
  source 1..25: mol_type = other DNA
ccagtcttctatgggtctcccagtt

SEQ ID NO: 29096 - DNA, 22 bp, synthetic construct
  misc_feature 1..22: note = Synthetic Construct
  source 1..22: mol_type = other DNA
ggacaccaccctgtaactctga

SEQ ID NO: 29097 - DNA, 23 bp, synthetic construct
  misc_feature 1..23: note = Synthetic Construct
  source 1..23: mol_type = other DNA
ggggtgatggtaaggaggtttac

SEQ ID NO: 29098 - DNA, 25 bp, synthetic construct
  misc_feature 1..25: note = Synthetic Construct
  source 1..25: mol_type = other DNA
ccccagaaactgcatgtcacattac

SEQ ID NO: 29099 - DNA, 24 bp, synthetic construct
  misc_feature 1..24: note = Synthetic Construct
  source 1..24: mol_type = other DNA
gggctggtttgtttagaggttcaa

SEQ ID NO: 29100 - DNA, 24 bp, synthetic construct
  misc_feature 1..24: note = Synthetic Construct
  source 1..24: mol_type = other DNA
ggagcaaacaggaatcatctggaa

SEQ ID NO: 29101 - DNA, 27 bp, synthetic construct
  misc_feature 1..27: note = Synthetic Construct
  source 1..27: mol_type = other DNA
gaacagtgggattcttcttcacatcaa

SEQ ID NO: 29102 - DNA, 21 bp, synthetic construct
  misc_feature 1..21: note = Synthetic Construct
  source 1..21: mol_type = other DNA
ggagcagagcagttggcttca

SEQ ID NO: 29103 - DNA, 24 bp, synthetic construct
  misc_feature 1..24: note = Synthetic Construct
  source 1..24: mol_type = other DNA
ccttccataggctccagtatccaa

SEQ ID NO: 29104 - DNA, 28 bp, synthetic construct
  misc_feature 1..28: note = Synthetic Construct
  source 1..28: mol_type = other DNA
ctgattagacctcgatggatacagatac

SEQ ID NO: 29105 - DNA, 25 bp, synthetic construct
  misc_feature 1..25: note = Synthetic Construct
  source 1..25: mol_type = other DNA
cccagaatctgagagggagatgaac

SEQ ID NO: 29106 - DNA, 25 bp, synthetic construct
  misc_feature 1..25: note = Synthetic Construct
  source 1..25: mol_type = other DNA
ccatgaaacacccactatacctaca

SEQ ID NO: 29107 - DNA, 24 bp, synthetic construct
  misc_feature 1..24: note = Synthetic Construct
  source 1..24: mol_type = other DNA
gggtggggatcaataagaggaaag

SEQ ID NO: 29108 - DNA, 21 bp, synthetic construct
  misc_feature 1..21: note = Synthetic Construct
  source 1..21: mol_type = other DNA
ctggcacaagcatcactgtca

SEQ ID NO: 29109 - DNA, 24 bp, synthetic construct
  misc_feature 1..24: note = Synthetic Construct
  source 1..24: mol_type = other DNA
cactgcttgtacttggtccctttg

SEQ ID NO: 29110 - DNA, 23 bp, synthetic construct
  misc_feature 1..23: note = Synthetic Construct
  source 1..23: mol_type = other DNA
cgaagattcagtgcgtgcattct

SEQ ID NO: 29111 - DNA, 22 bp, synthetic construct
  misc_feature 1..22: note = Synthetic Construct
  source 1..22: mol_type = other DNA
cagtcctgccttctttctcctt

SEQ ID NO: 29112 - DNA, 20 bp, synthetic construct
  misc_feature 1..20: note = Synthetic Construct
  source 1..20: mol_type = other DNA
gggacaccgctcatttggaa

SEQ ID NO: 29113 - DNA, 19 bp, synthetic construct
  misc_feature 1..19: note = Synthetic Construct
  source 1..19: mol_type = other DNA
tgccagccagactgcctaa

SEQ ID NO: 29114 - DNA, 28 bp, synthetic construct
  misc_feature 1..28: note = Synthetic Construct
  source 1..28: mol_type = other DNA
ccataattcaaatccagcctcaggaatg

SEQ ID NO: 29115 - DNA, 25 bp, synthetic construct
  misc_feature 1..25: note = Synthetic Construct
  source 1..25: mol_type = other DNA
cccatactgatgcagtgctagagat

SEQ ID NO: 29116 - DNA, 30 bp, synthetic construct
  misc_feature 1..30: note = Synthetic Construct
  source 1..30: mol_type = other DNA
cctggtgacacaattgggtaagaatgttag

SEQ ID NO: 29117 - DNA, 21 bp, synthetic construct
  misc_feature 1..21: note = Synthetic Construct
  source 1..21: mol_type = other DNA
agggccaaggctaccagtgaa

SEQ ID NO: 29118 - DNA, 24 bp, synthetic construct
  misc_feature 1..24: note = Synthetic Construct
  source 1..24: mol_type = other DNA
ggggactggaagtcatttctgatg

SEQ ID NO: 29119 - DNA, 20 bp, synthetic construct
  misc_feature 1..20: note = Synthetic Construct
  source 1..20: mol_type = other DNA
ggtgtcaatggtgcctcaca

SEQ ID NO: 29120 - DNA, 26 bp, synthetic construct
  misc_feature 1..26: note = Synthetic Construct
  source 1..26: mol_type = other DNA
ggtaccttcctttgaggattgctaca

SEQ ID NO: 29121 - DNA, 20 bp, synthetic construct
  misc_feature 1..20: note = Synthetic Construct
  source 1..20: mol_type = other DNA
cgtgtttccagcaggtgtgt

SEQ ID NO: 29122 - DNA, 24 bp, synthetic construct
  misc_feature 1..24: note = Synthetic Construct
  source 1..24: mol_type = other DNA
ggggacacaactactgatggatac

SEQ ID NO: 29123 - DNA, 20 bp, synthetic construct
  misc_feature 1..20: note = Synthetic Construct
  source 1..20: mol_type = other DNA
aggtgagaagcagggcaaag

SEQ ID NO: 29124 - DNA, 23 bp, synthetic construct
  misc_feature 1..23: note = Synthetic Construct
  source 1..23: mol_type = other DNA
cccatgcatgcagacactctttc

SEQ ID NO: 29125 - DNA, 25 bp, synthetic construct
  misc_feature 1..25: note = Synthetic Construct
  source 1..25: mol_type = other DNA
ctggagaaagacattgctcccatca

SEQ ID NO: 29126 - DNA, 25 bp, synthetic construct
  misc_feature 1..25: note = Synthetic Construct
  source 1..25: mol_type = other DNA
gacctggacataagaaggaagttct

SEQ ID NO: 29127 - DNA, 26 bp, synthetic construct
  misc_feature 1..26: note = Synthetic Construct
  source 1..26: mol_type = other DNA
ccaacaggaattagaaactccacatc

SEQ ID NO: 29128 - DNA, 22 bp, synthetic construct
  misc_feature 1..22: note = Synthetic Construct
  source 1..22: mol_type = other DNA
gagcatcacagtcccatgttca

SEQ ID NO: 29129 - DNA, 22 bp, synthetic construct
  misc_feature 1..22: note = Synthetic Construct
  source 1..22: mol_type = other DNA
gaccactgacaaatgcgtgaag

SEQ ID NO: 29130 - DNA, 23 bp, synthetic construct
  misc_feature 1..23: note = Synthetic Construct
  source 1..23: mol_type = other DNA
tccggtagtgctccctctgtatg

SEQ ID NO: 29131 - DNA, 20 bp, synthetic construct
  misc_feature 1..20: note = Synthetic Construct
  source 1..20: mol_type = other DNA
gggtgctccaaatgcctgaa

SEQ ID NO: 29132 - DNA, 25 bp, synthetic construct
  misc_feature 1..25: note = Synthetic Construct
  source 1..25: mol_type = other DNA
cctcagctgacattgtgtaatgcta

SEQ ID NO: 29133 - DNA, 20 bp, synthetic construct
  misc_feature 1..20: note = Synthetic Construct
  source 1..20: mol_type = other DNA
ccatgcccggcctgtttgta

SEQ ID NO: 29134 - DNA, 22 bp, synthetic construct
  misc_feature 1..22: note = Synthetic Construct
  source 1..22: mol_type = other DNA
cctttagggagcatcgggaatc

SEQ ID NO: 29135 - DNA, 22 bp, synthetic construct
  misc_feature 1..22: note = Synthetic Construct
  source 1..22: mol_type = other DNA
gcacaagcagcaacatttcctt

SEQ ID NO: 29136 - DNA, 22 bp, synthetic construct
  misc_feature 1..22: note = Synthetic Construct
  source 1..22: mol_type = other DNA
ttgtcataccatgccgttcgta

SEQ ID NO: 29137 - DNA, 24 bp, synthetic construct
  misc_feature 1..24: note = Synthetic Construct
  source 1..24: mol_type = other DNA
gcttggaaaaaggcaacctactct

SEQ ID NO: 29138 - DNA, 25 bp, synthetic construct
  misc_feature 1..25: note = Synthetic Construct
  source 1..25: mol_type = other DNA
ggacagcactgaaggacaaggagta

SEQ ID NO: 29139 - DNA, 26 bp, synthetic construct
  misc_feature 1..26: note = Synthetic Construct
  source 1..26: mol_type = other DNA
tgagatggtcacatcctgttctctaa

SEQ ID NO: 29140 - DNA, 25 bp, synthetic construct
  misc_feature 1..25: note = Synthetic Construct
  source 1..25: mol_type = other DNA
ctcccctgtcaaaacttcctcttga

SEQ ID NO: 29141 - DNA, 26 bp, synthetic construct
  misc_feature 1..26: note = Synthetic Construct
  source 1..26: mol_type = other DNA
gcctgacacctgaatttctaccttgt

SEQ ID NO: 29142 - DNA, 22 bp, synthetic construct
  misc_feature 1..22: note = Synthetic Construct
  source 1..22: mol_type = other DNA
ccttctggccctaacaggttct

SEQ ID NO: 29143 - DNA, 22 bp, synthetic construct
  misc_feature 1..22: note = Synthetic Construct
  source 1..22: mol_type = other DNA
ctgtcaccacaagccaccatca

SEQ ID NO: 29144 - DNA, 26 bp, synthetic construct
  misc_feature 1..26: note = Synthetic Construct
  source 1..26: mol_type = other DNA
cctaggagatgctttaaggatgatgt

SEQ ID NO: 29145 - DNA, 22 bp, synthetic construct
  misc_feature 1..22: note = Synthetic Construct
  source 1..22: mol_type = other DNA
ggctctggacaaggaagacaga

SEQ ID NO: 29146 - DNA, 23 bp, synthetic construct
  misc_feature 1..23: note = Synthetic Construct
  source 1..23: mol_type = other DNA
gaggctctgcagaatgttcctaa

SEQ ID NO: 29147 - DNA, 24 bp, synthetic construct
  misc_feature 1..24: note = Synthetic Construct
  source 1..24: mol_type = other DNA
gcggctgcacaattagagtagaga

SEQ ID NO: 29148 - DNA, 25 bp, synthetic construct
  misc_feature 1..25: note = Synthetic Construct
  source 1..25: mol_type = other DNA
ctcaaaggcccaggtctatctgatg

SEQ ID NO: 29149 - DNA, 27 bp, synthetic construct
  misc_feature 1..27: note = Synthetic Construct
  source 1..27: mol_type = other DNA
tcctctcctcaaacaagggatattttg

SEQ ID NO: 29150 - DNA, 26 bp, synthetic construct
  misc_feature 1..26: note = Synthetic Construct
  source 1..26: mol_type = other DNA
gggagactgcatgtatttctgtctgt

SEQ ID NO: 29151 - DNA, 26 bp, synthetic construct
  misc_feature 1..26: note = Synthetic Construct
  source 1..26: mol_type = other DNA
gtgatgggcctgaatccagtattatg

SEQ ID NO: 29152 - DNA, 21 bp, synthetic construct
  misc_feature 1..21: note = Synthetic Construct
  source 1..21: mol_type = other DNA
aggagcccatacatggggaat

SEQ ID NO: 29153 - DNA, 20 bp, synthetic construct
  misc_feature 1..20: note = Synthetic Construct
  source 1..20: mol_type = other DNA
cctgggcttgtggccatatt

SEQ ID NO: 29154 - DNA, 22 bp, synthetic construct
  misc_feature 1..22: note = Synthetic Construct
  source 1..22: mol_type = other DNA
gcagtgaatcccttgcaaaact

SEQ ID NO: 29155 - DNA, 22 bp, synthetic construct
  misc_feature 1..22: note = Synthetic Construct
  source 1..22: mol_type = other DNA
ctcatctggtccaagcttctgt

SEQ ID NO: 29156 - DNA, 22 bp, synthetic construct
  misc_feature 1..22: note = Synthetic Construct
  source 1..22: mol_type = other DNA
ggcatgtcacacactcctacat

SEQ ID NO: 29157 - DNA, 24 bp, synthetic construct
  misc_feature 1..24: note = Synthetic Construct
  source 1..24: mol_type = other DNA
ggttcaaatcctggctccactatc

SEQ ID NO: 29158 - DNA, 23 bp, synthetic construct
  misc_feature 1..23: note = Synthetic Construct
  source 1..23: mol_type = other DNA
cctcaagggacccaatttgaaga

SEQ ID NO: 29159 - DNA, 21 bp, synthetic construct
  misc_feature 1..21: note = Synthetic Construct
  source 1..21: mol_type = other DNA
tccgttttcagggctgggata

SEQ ID NO: 29160 - DNA, 24 bp, synthetic construct
  misc_feature 1..24: note = Synthetic Construct
  source 1..24: mol_type = other DNA
ggaggcgagagtcctttccttttg

SEQ ID NO: 29161 - DNA, 22 bp, synthetic construct
  misc_feature 1..22: note = Synthetic Construct
  source 1..22: mol_type = other DNA
ccctcctggtgtcttccagaaa

SEQ ID NO: 29162 - DNA, 24 bp, synthetic construct
  misc_feature 1..24: note = Synthetic Construct
  source 1..24: mol_type = other DNA
gactctgctttcacggatgggatt

SEQ ID NO: 29163 - DNA, 22 bp, synthetic construct
  misc_feature 1..22: note = Synthetic Construct
  source 1..22: mol_type = other DNA
aggctgaggactaggctctgat

SEQ ID NO: 29164 - DNA, 25 bp, synthetic construct
  misc_feature 1..25: note = Synthetic Construct
  source 1..25: mol_type = other DNA
tccctggtacacctttacacaaatc

SEQ ID NO: 29165 - DNA, 21 bp, synthetic construct
  misc_feature 1..21: note = Synthetic Construct
  source 1..21: mol_type = other DNA
acagctaggccctgggaagat

SEQ ID NO: 29166 - DNA, 22 bp, synthetic construct
  misc_feature 1..22: note = Synthetic Construct
  source 1..22: mol_type = other DNA
ggaggaggtggtggacacaaat

SEQ ID NO: 29167 - DNA, 21 bp, synthetic construct
  misc_feature 1..21: note = Synthetic Construct
  source 1..21: mol_type = other DNA
tggagctgagacctgctggat

SEQ ID NO: 29168 - DNA, 25 bp, synthetic construct
  misc_feature 1..25: note = Synthetic Construct
  source 1..25: mol_type = other DNA
gaggaaaaacacagggtgagggttt

SEQ ID NO: 29169 - DNA, 20 bp, synthetic construct
  misc_feature 1..20: note = Synthetic Construct
  source 1..20: mol_type = other DNA
gcaggactgcccaccacaag

SEQ ID NO: 29170 - DNA, 19 bp, synthetic construct
  misc_feature 1..19: note = Synthetic Construct
  source 1..19: mol_type = other DNA
tccaggcctccaggacttt

SEQ ID NO: 29171 - DNA, 26 bp, synthetic construct
  misc_feature 1..26: note = Synthetic Construct
  source 1..26: mol_type = other DNA
ggctactcactcaagacctctgtcaa

SEQ ID NO: 29172 - DNA, 22 bp, synthetic construct
  misc_feature 1..22: note = Synthetic Construct
  source 1..22: mol_type = other DNA
gggaacccatttccgtgtgttg

SEQ ID NO: 29173 - DNA, 24 bp, synthetic construct
  misc_feature 1..24: note = Synthetic Construct
  source 1..24: mol_type = other DNA
gcactcagaggaggggtgtgttat

SEQ ID NO: 29174 - DNA, 20 bp, synthetic construct
  misc_feature 1..20: note = Synthetic Construct
  source 1..20: mol_type = other DNA
acatggcaggctccttcact

SEQ ID NO: 29175 - DNA, 30 bp, synthetic construct
  misc_feature 1..30: note = Synthetic Construct
  source 1..30: mol_type = other DNA
gtgtgttagattcttccctgacattgtttc

SEQ ID NO: 29176 - DNA, 21 bp, synthetic construct
  misc_feature 1..21: note = Synthetic Construct
  source 1..21: mol_type = other DNA
agcactggtctggaagtgaga

SEQ ID NO: 29177 - DNA, 21 bp, synthetic construct
  misc_feature 1..21: note = Synthetic Construct
  source 1..21: mol_type = other DNA
gcattatgccaagctgacgtt

SEQ ID NO: 29178 - DNA, 18 bp, synthetic construct
  misc_feature 1..18: note = Synthetic Construct
  source 1..18: mol_type = other DNA
aggcacgcaccaccatga

SEQ ID NO: 29179 - DNA, 25 bp, synthetic construct
  misc_feature 1..25: note = Synthetic Construct
  source 1..25: mol_type = other DNA
caaaatacaccactggccataactt

SEQ ID NO: 29180 - DNA, 20 bp, synthetic construct
  misc_feature 1..20: note = Synthetic Construct
  source 1..20: mol_type = other DNA
gccaccacacccaatctcat

SEQ ID NO: 29181 - DNA, 25 bp, synthetic construct
  misc_feature 1..25: note = Synthetic Construct
  source 1..25: mol_type = other DNA
ggtgacaggttagtgatcgtgtgtt

SEQ ID NO: 29182 - DNA, 21 bp, synthetic construct
  misc_feature 1..21: note = Synthetic Construct
  source 1..21: mol_type = other DNA
gccaagagccaatggcaaaag

SEQ ID NO: 29183 - DNA, 24 bp, synthetic construct
  misc_feature 1..24: note = Synthetic Construct
  source 1..24: mol_type = other DNA
cgctagttcattcaccgccttctt

SEQ ID NO: 29184 - DNA, 21 bp, synthetic construct
  misc_feature 1..21: note = Synthetic Construct
  source 1..21: mol_type = other DNA
tccacaaccccatgctgttac

SEQ ID NO: 29185 - DNA, 27 bp, synthetic construct
  misc_feature 1..27: note = Synthetic Construct
  source 1..27: mol_type = other DNA
ccaaagcaaaagcctaaccttatgaac

SEQ ID NO: 29186 - DNA, 27 bp, synthetic construct
  misc_feature 1..27: note = Synthetic Construct
  source 1..27: mol_type = other DNA
ggattcctttccagtaaccaagacaat

SEQ ID NO: 29187 - DNA, 25 bp, synthetic construct
  misc_feature 1..25: note = Synthetic Construct
  source 1..25: mol_type = other DNA
caagttgtctttattgctgctgctt

SEQ ID NO: 29188 - DNA, 25 bp, synthetic construct
  misc_feature 1..25: note = Synthetic Construct
  source 1..25: mol_type = other DNA
aggttacttacagttggaggcttag

SEQ ID NO: 29189 - DNA, 22 bp, synthetic construct
  misc_feature 1..22: note = Synthetic Construct
  source 1..22: mol_type = other DNA
cgacacacgtccacgaacacaa

SEQ ID NO: 29190 - DNA, 20 bp, synthetic construct
  misc_feature 1..20: note = Synthetic Construct
  source 1..20: mol_type = other DNA
ggcagcagctgtcctgtgta

SEQ ID NO: 29191 - DNA, 22 bp, synthetic construct
  misc_feature 1..22: note = Synthetic Construct
  source 1..22: mol_type = other DNA
gggctgtgcatcttagggtcat

SEQ ID NO: 29192 - DNA, 26 bp, synthetic construct
  misc_feature 1..26: note = Synthetic Construct
  source 1..26: mol_type = other DNA
catgaccactgtgacaaaacaagact

SEQ ID NO: 29193 - DNA, 28 bp, synthetic construct
  misc_feature 1..28: note = Synthetic Construct
  source 1..28: mol_type = other DNA
gtgtgctctaaaagtggtctgtaagtga

SEQ ID NO: 29194 - DNA, 23 bp, synthetic construct
  misc_feature 1..23: note = Synthetic Construct
  source 1..23: mol_type = other DNA
gccccgaaaccctagtcctttct

SEQ ID NO: 29195 - DNA, 22 bp, synthetic construct
  misc_feature 1..22: note = Synthetic Construct
  source 1..22: mol_type = other DNA
caggaccagcaagtgggtttca

SEQ ID NO: 29196 - DNA, 24 bp, synthetic construct
  misc_feature 1..24: note = Synthetic Construct
  source 1..24: mol_type = other DNA
acagcagccttacataacctttca

SEQ ID NO: 29197 - DNA, 27 bp, synthetic construct
  misc_feature 1..27: note = Synthetic Construct
  source 1..27: mol_type = other DNA
ggttacaatatttgcaggaagccaaga

SEQ ID NO: 29198 - DNA, 22 bp, synthetic construct
  misc_feature 1..22: note = Synthetic Construct
  source 1..22: mol_type = other DNA
gccattgccttttgcctcagta

SEQ ID NO: 29199 - DNA, 25 bp, synthetic construct
  misc_feature 1..25: note = Synthetic Construct
  source 1..25: mol_type = other DNA
ctgttcatttggcccttttgtatga

SEQ ID NO: 29200 - DNA, 29 bp, synthetic construct
  misc_feature 1..29: note = Synthetic Construct
  source 1..29: mol_type = other DNA
gcaatatactgagagtgacttgggtgatt

SEQ ID NO: 29201 - DNA, 21 bp, synthetic construct
  misc_feature 1..21: note = Synthetic Construct
  source 1..21: mol_type = other DNA
ggggctgcttcccaggtttat

SEQ ID NO: 29202 - DNA, 25 bp, synthetic construct
  misc_feature 1..25: note = Synthetic Construct
  source 1..25: mol_type = other DNA
gaggtcctctccgtggattaaatag

SEQ ID NO: 29203 - DNA, 25 bp, synthetic construct
  misc_feature 1..25: note = Synthetic Construct
  source 1..25: mol_type = other DNA
gccaaggtctgatcacaaaaattca

SEQ ID NO: 29204 - DNA, 23 bp, synthetic construct
  misc_feature 1..23: note = Synthetic Construct
  source 1..23: mol_type = other DNA
agagctggacctaaaagcaaaca

SEQ ID NO: 29205 - DNA, 22 bp, synthetic construct
  misc_feature 1..22: note = Synthetic Construct
  source 1..22: mol_type = other DNA
gggtctgcatgatatgctggta

SEQ ID NO: 29206 - DNA, 21 bp, synthetic construct
  misc_feature 1..21: note = Synthetic Construct
  source 1..21: mol_type = other DNA
tcacagagactgggtcgatct

SEQ ID NO: 29207 - DNA, 27 bp, synthetic construct
  misc_feature 1..27: note = Synthetic Construct
  source 1..27: mol_type = other DNA
agcagagaacagagtaaatgacctatc

SEQ ID NO: 29208 - DNA, 24 bp, synthetic construct
  misc_feature 1..24: note = Synthetic Construct
  source 1..24: mol_type = other DNA
gatctctgggagttgagttgttga

SEQ ID NO: 29209 - DNA, 20 bp, synthetic construct
  misc_feature 1..20: note = Synthetic Construct
  source 1..20: mol_type = other DNA
accaggtggctgggtgacat

SEQ ID NO: 29210 - DNA, 22 bp, synthetic construct
  misc_feature 1..22: note = Synthetic Construct
  source 1..22: mol_type = other DNA
actgaccccaggagtttcatct

SEQ ID NO: 29211 - DNA, 21 bp, synthetic construct
  misc_feature 1..21: note = Synthetic Construct
  source 1..21: mol_type = other DNA
tggcctgactctcccgatttg

SEQ ID NO: 29212 - DNA, 22 bp, synthetic construct
  misc_feature 1..22: note = Synthetic Construct
  source 1..22: mol_type = other DNA
cctggggctgcatttgttgcta

SEQ ID NO: 29213 - DNA, 25 bp, synthetic construct
  misc_feature 1..25: note = Synthetic Construct
  source 1..25: mol_type = other DNA
cctcactcaggaagaatgtgtcctt

SEQ ID NO: 29214 - DNA, 25 bp, synthetic construct
  misc_feature 1..25: note = Synthetic Construct
  source 1..25: mol_type = other DNA
gaacgtttggtaaggcagacataca

SEQ ID NO: 29215 - DNA, 24 bp, synthetic construct
  misc_feature 1..24: note = Synthetic Construct
  source 1..24: mol_type = other DNA
ggtgggtagccatctaggcttttg

SEQ ID NO: 29216 - DNA, 24 bp, synthetic construct
  misc_feature 1..24: note = Synthetic Construct
  source 1..24: mol_type = other DNA
cccaggaacagtaaagcatcattc

SEQ ID NO: 29217 - DNA, 20 bp, synthetic construct
  misc_feature 1..20: note = Synthetic Construct
  source 1..20: mol_type = other DNA
ttctgggcctgcctttgact

SEQ ID NO: 29218 - DNA, 26 bp, synthetic construct
  misc_feature 1..26: note = Synthetic Construct
  source 1..26: mol_type = other DNA
gcatttcactagagatgtgggcttca

SEQ ID NO: 29219 - DNA, 22 bp, synthetic construct
  misc_feature 1..22: note = Synthetic Construct
  source 1..22: mol_type = other DNA
gcacggtgatcactaggctgtt

SEQ ID NO: 29220 - DNA, 22 bp, synthetic construct
  misc_feature 1..22: note = Synthetic Construct
  source 1..22: mol_type = other DNA
cacaccagtctgcctgagtaca

SEQ ID NO: 29221 - DNA, 24 bp, synthetic construct
  misc_feature 1..24: note = Synthetic Construct
  source 1..24: mol_type = other DNA
ccacagagctaggaaactcgtgaa

SEQ ID NO: 29222 - DNA, 22 bp, synthetic construct
  misc_feature 1..22: note = Synthetic Construct
  source 1..22: mol_type = other DNA
gccttccccagaggaatgttgt

SEQ ID NO: 29223 - DNA, 22 bp, synthetic construct
  misc_feature 1..22: note = Synthetic Construct
  source 1..22: mol_type = other DNA
cgaccagccccatcctgttttt

SEQ ID NO: 29224 - DNA, 20 bp, synthetic construct
  misc_feature 1..20: note = Synthetic Construct
  source 1..20: mol_type = other DNA
tgtaaggcgaggaggacgat

SEQ ID NO: 29225 - DNA, 26 bp, synthetic construct
  misc_feature 1..26: note = Synthetic Construct
  source 1..26: mol_type = other DNA
gcccttaaagattagggtgagcatgt

SEQ ID NO: 29226 - DNA, 24 bp, synthetic construct
  misc_feature 1..24: note = Synthetic Construct
  source 1..24: mol_type = other DNA
cagtcttcctttgctcctaaccaa

SEQ ID NO: 29227 - DNA, 25 bp, synthetic construct
  misc_feature 1..25: note = Synthetic Construct
  source 1..25: mol_type = other DNA
gaaattcccctgacgttctttccaa

SEQ ID NO: 29228 - DNA, 20 bp, synthetic construct
  misc_feature 1..20: note = Synthetic Construct
  source 1..20: mol_type = other DNA
gcttcccgtctccccaacaa

SEQ ID NO: 29229 - DNA, 24 bp, synthetic construct
  misc_feature 1..24: note = Synthetic Construct
  source 1..24: mol_type = other DNA
catgtgtctggacttgtcagatgt

SEQ ID NO: 29230 - DNA, 22 bp, synthetic construct
  misc_feature 1..22: note = Synthetic Construct
  source 1..22: mol_type = other DNA
agcgggtaggccatgatagaga

SEQ ID NO: 29231 - DNA, 24 bp, synthetic construct
  misc_feature 1..24: note = Synthetic Construct
  source 1..24: mol_type = other DNA
ggctgtaaacagaggcatttggta

SEQ ID NO: 29232 - DNA, 28 bp, synthetic construct
  misc_feature 1..28: note = Synthetic Construct
  source 1..28: mol_type = other DNA
ggaaagggtagtattgggattacagaca

SEQ ID NO: 29233 - DNA, 20 bp, synthetic construct
  misc_feature 1..20: note = Synthetic Construct
  source 1..20: mol_type = other DNA
gcaccggtgtaagagcaaac

SEQ ID NO: 29234 - DNA, 19 bp, synthetic construct
  misc_feature 1..19: note = Synthetic Construct
  source 1..19: mol_type = other DNA
tggggaggagccaggatct

SEQ ID NO: 29235 - DNA, 19 bp, synthetic construct
  misc_feature 1..19: note = Synthetic Construct
  source 1..19: mol_type = other DNA
agtcgtgctgtgggacagt

SEQ ID NO: 29236 - DNA, 24 bp, synthetic construct
  misc_feature 1..24: note = Synthetic Construct
  source 1..24: mol_type = other DNA
gctggaagattttctgccttttga

SEQ ID NO: 29237 - DNA, 23 bp, synthetic construct
  misc_feature 1..23: note = Synthetic Construct
  source 1..23: mol_type = other DNA
tctttttccctctctggggatca

SEQ ID NO: 29238 - DNA, 24 bp, synthetic construct
  misc_feature 1..24: note = Synthetic Construct
  source 1..24: mol_type = other DNA
agccttccaaggaaaagaaaggaa

SEQ ID NO: 29239 - DNA, 24 bp, synthetic construct
  misc_feature 1..24: note = Synthetic Construct
  source 1..24: mol_type = other DNA
gctggaacaaagaaagcaggagaa

SEQ ID NO: 29240 - DNA, 22 bp, synthetic construct
  misc_feature 1..22: note = Synthetic Construct
  source 1..22: mol_type = other DNA
gctgggtttccctctagctgtt

SEQ ID NO: 29241 - DNA, 21 bp, synthetic construct
  misc_feature 1..21: note = Synthetic Construct
  source 1..21: mol_type = other DNA
aatagccattgccctgagctt

SEQ ID NO: 29242 - DNA, 22 bp, synthetic construct
  misc_feature 1..22: note = Synthetic Construct
  source 1..22: mol_type = other DNA
tggagctcccagcctggtataa

SEQ ID NO: 29243 - DNA, 19 bp, synthetic construct
  misc_feature 1..19: note = Synthetic Construct
  source 1..19: mol_type = other DNA
gcctgcagctggctctcta

SEQ ID NO: 29244 - DNA, 26 bp, synthetic construct
  misc_feature 1..26: note = Synthetic Construct
  source 1..26: mol_type = other DNA
gcccttagagtatactgggctctttc

SEQ ID NO: 29245 - DNA, 25 bp, synthetic construct
  misc_feature 1..25: note = Synthetic Construct
  source 1..25: mol_type = other DNA
gtcaaagctgcaaaagggagataac

SEQ ID NO: 29246 - DNA, 25 bp, synthetic construct
  misc_feature 1..25: note = Synthetic Construct
  source 1..25: mol_type = other DNA
tgtaaggctttctgggataggagat

SEQ ID NO: 29247 - DNA, 24 bp, synthetic construct
  misc_feature 1..24: note = Synthetic Construct
  source 1..24: mol_type = other DNA
ccaccccaggatgtaaggtactca

SEQ ID NO: 29248 - DNA, 22 bp, synthetic construct
  misc_feature 1..22: note = Synthetic Construct
  source 1..22: mol_type = other DNA
gacgtcaggcatagtgatggat

SEQ ID NO: 29249 - DNA, 22 bp, synthetic construct
  misc_feature 1..22: note = Synthetic Construct
  source 1..22: mol_type = other DNA
gaggccagtgctgatcacctaa

SEQ ID NO: 29250 - DNA, 22 bp, synthetic construct
  misc_feature 1..22: note = Synthetic Construct
  source 1..22: mol_type = other DNA
aggcagacggaatgaactttct

SEQ ID NO: 29251 - DNA, 22 bp, synthetic construct
  misc_feature 1..22: note = Synthetic Construct
  source 1..22: mol_type = other DNA
aggtccccaggagaaaggatct

SEQ ID NO: 29252 - DNA, 22 bp, synthetic construct
  misc_feature 1..22: note = Synthetic Construct
  source 1..22: mol_type = other DNA
gcatgtgccaaggtcctgtaac

SEQ ID NO: 29253 - DNA, 20 bp, synthetic construct
  misc_feature 1..20: note = Synthetic Construct
  source 1..20: mol_type = other DNA
cacagcctgtcggcattcta

SEQ ID NO: 29254 - DNA, 23 bp, synthetic construct
  misc_feature 1..23: note = Synthetic Construct
  source 1..23: mol_type = other DNA
cctacagttgatgccaggtgttg

SEQ ID NO: 29255 - DNA, 24 bp, synthetic construct
  misc_feature 1..24: note = Synthetic Construct
  source 1..24: mol_type = other DNA
ctgtggaagggtatgcctcagaag

SEQ ID NO: 29256 - DNA, 22 bp, synthetic construct
  misc_feature 1..22: note = Synthetic Construct
  source 1..22: mol_type = other DNA
gggtgctttctatgggcaaaag

SEQ ID NO: 29257 - DNA, 27 bp, synthetic construct
  misc_feature 1..27: note = Synthetic Construct
  source 1..27: mol_type = other DNA
caaacgtatcaacctaaagtccagaag

SEQ ID NO: 29258 - DNA, 24 bp, synthetic construct
  misc_feature 1..24: note = Synthetic Construct
  source 1..24: mol_type = other DNA
cagcatagattgaggtggcatttc

SEQ ID NO: 29259 - DNA, 21 bp, synthetic construct
  misc_feature 1..21: note = Synthetic Construct
  source 1..21: mol_type = other DNA
ctcctgagttcctgcttcgtt

SEQ ID NO: 29260 - DNA, 25 bp, synthetic construct
  misc_feature 1..25: note = Synthetic Construct
  source 1..25: mol_type = other DNA
accagctgtctttttggtgtaaact

SEQ ID NO: 29261 - DNA, 22 bp, synthetic construct
  misc_feature 1..22: note = Synthetic Construct
  source 1..22: mol_type = other DNA
aagcaagactgggagagaggta

SEQ ID NO: 29262 - DNA, 22 bp, synthetic construct
  misc_feature 1..22: note = Synthetic Construct
  source 1..22: mol_type = other DNA
ctggctccaccaactcacctat

SEQ ID NO: 29263 - DNA, 23 bp, synthetic construct
  misc_feature 1..23: note = Synthetic Construct
  source 1..23: mol_type = other DNA
ccatttaagtgtgggccttgtgt

SEQ ID NO: 29264 - DNA, 19 bp, synthetic construct
  misc_feature 1..19: note = Synthetic Construct
  source 1..19: mol_type = other DNA
tgggacccttccacaccaa

SEQ ID NO: 29265 - DNA, 28 bp, synthetic construct
  misc_feature 1..28: note = Synthetic Construct
  source 1..28: mol_type = other DNA
caaccaaggttgagaactactgagtttg

SEQ ID NO: 29266 - DNA, 22 bp, synthetic construct
  misc_feature 1..22: note = Synthetic Construct
  source 1..22: mol_type = other DNA
gggaatgggaccttgagtttca

SEQ ID NO: 29267 - DNA, 24 bp, synthetic construct
  misc_feature 1..24: note = Synthetic Construct
  source 1..24: mol_type = other DNA
gggaatccgacgaatggatgaaag

SEQ ID NO: 29268 - DNA, 28 bp, synthetic construct
  misc_feature 1..28: note = Synthetic Construct
  source 1..28: mol_type = other DNA
gcaagtggaaaactaaagctcagagatg

SEQ ID NO: 29269 - DNA, 25 bp, synthetic construct
  misc_feature 1..25: note = Synthetic Construct
  source 1..25: mol_type = other DNA
ccagaatccactcaccagaaaaatg

SEQ ID NO: 29270 - DNA, 23 bp, synthetic construct
  misc_feature 1..23: note = Synthetic Construct
  source 1..23: mol_type = other DNA
ggtcccgttttgtgaaccaatag

SEQ ID NO: 29271 - DNA, 22 bp, synthetic construct
  misc_feature 1..22: note = Synthetic Construct
  source 1..22: mol_type = other DNA
gaccttaagggccaccctaact

SEQ ID NO: 29272 - DNA, 21 bp, synthetic construct
  misc_feature 1..21: note = Synthetic Construct
  source 1..21: mol_type = other DNA
accagagacaggcctggaaca

SEQ ID NO: 29273 - DNA, 27 bp, synthetic construct
  misc_feature 1..27: note = Synthetic Construct
  source 1..27: mol_type = other DNA
gaaggtgaagcaggagcaagtattaag

SEQ ID NO: 29274 - DNA, 24 bp, synthetic construct
  misc_feature 1..24: note = Synthetic Construct
  source 1..24: mol_type = other DNA
gtcaggcggtggaattttctgcta

SEQ ID NO: 29275 - DNA, 22 bp, synthetic construct
  misc_feature 1..22: note = Synthetic Construct
  source 1..22: mol_type = other DNA
agccgctctcagactcaggaat

SEQ ID NO: 29276 - DNA, 24 bp, synthetic construct
  misc_feature 1..24: note = Synthetic Construct
  source 1..24: mol_type = other DNA
gacctttgaacagcctgactgtag

SEQ ID NO: 29277 - DNA, 25 bp, synthetic construct
  misc_feature 1..25: note = Synthetic Construct
  source 1..25: mol_type = other DNA
gcctgcatccttgttaatgttggtt

SEQ ID NO: 29278 - DNA, 24 bp, synthetic construct
  misc_feature 1..24: note = Synthetic Construct
  source 1..24: mol_type = other DNA
ggcctgtttgaactgcaagaaaag

SEQ ID NO: 29279 - DNA, 24 bp, synthetic construct
  misc_feature 1..24: note = Synthetic Construct
  source 1..24: mol_type = other DNA
acctgcaaccaaaaagtcatgaga

SEQ ID NO: 29280 - DNA, 20 bp, synthetic construct
  misc_feature 1..20: note = Synthetic Construct
  source 1..20: mol_type = other DNA
caggctgccttttgcagaca

SEQ ID NO: 29281 - DNA, 22 bp, synthetic construct
  misc_feature 1..22: note = Synthetic Construct
  source 1..22: mol_type = other DNA
ccccagcttgttttcggagaga

SEQ ID NO: 29282 - DNA, 26 bp, synthetic construct
  misc_feature 1..26: note = Synthetic Construct
  source 1..26: mol_type = other DNA
caagagagtggacttcaagacaaaac

SEQ ID NO: 29283 - DNA, 22 bp, synthetic construct
  misc_feature 1..22: note = Synthetic Construct
  source 1..22: mol_type = other DNA
ccacagaatgcccacggtaact

SEQ ID NO: 29284 - DNA, 25 bp, synthetic construct
  misc_feature 1..25: note = Synthetic Construct
  source 1..25: mol_type = other DNA
acactagccattcccaaaggtaaaa

SEQ ID NO: 29285 - DNA, 21 bp, synthetic construct
  misc_feature 1..21: note = Synthetic Construct
  source 1..21: mol_type = other DNA
ccatgctgtgtgtgtctgcat

SEQ ID NO: 29286 - DNA, 25 bp, synthetic construct
  misc_feature 1..25: note = Synthetic Construct
  source 1..25: mol_type = other DNA
gcctcacaccactttctagaacaca

SEQ ID NO: 29287 - DNA, 24 bp, synthetic construct
  misc_feature 1..24: note = Synthetic Construct
  source 1..24: mol_type = other DNA
tccagggaattggggtaaatcaaa

SEQ ID NO: 29288 - DNA, 22 bp, synthetic construct
  misc_feature 1..22: note = Synthetic Construct
  source 1..22: mol_type = other DNA
caccactcctgcccatgaagaa

SEQ ID NO: 29289 - DNA, 18 bp, synthetic construct
  misc_feature 1..18: note = Synthetic Construct
  source 1..18: mol_type = other DNA
ttggggatgctgcgttgt

SEQ ID NO: 29290 - DNA, 27 bp, synthetic construct
  misc_feature 1..27: note = Synthetic Construct
  source 1..27: mol_type = other DNA
ggtgtaacctgagactgggaatacttg

SEQ ID NO: 29291 - DNA, 24 bp, synthetic construct
  misc_feature 1..24: note = Synthetic Construct
  source 1..24: mol_type = other DNA
cgtggggaaccagttgttgcataa

SEQ ID NO: 29292 - DNA, 20 bp, synthetic construct
  misc_feature 1..20: note = Synthetic Construct
  source 1..20: mol_type = other DNA
cccaggctgtgtgctttcaa

SEQ ID NO: 29293 - DNA, 20 bp, synthetic construct
  misc_feature 1..20: note = Synthetic Construct
  source 1..20: mol_type = other DNA
tctggcgatgggaagaccat

SEQ ID NO: 29294 - DNA, 24 bp, synthetic construct
  misc_feature 1..24: note = Synthetic Construct
  source 1..24: mol_type = other DNA
ctcagcctccgagtcctcatctat

SEQ ID NO: 29295 - DNA, 25 bp, synthetic construct
  misc_feature 1..25: note = Synthetic Construct
  source 1..25: mol_type = other DNA
gtggggttgatcatagcatctcctt

SEQ ID NO: 29296 - DNA, 19 bp, synthetic construct
  misc_feature 1..19: note = Synthetic Construct
  source 1..19: mol_type = other DNA
acgagcagagcacctgtga

SEQ ID NO: 29297 - DNA, 23 bp, synthetic construct
  misc_feature 1..23: note = Synthetic Construct
  source 1..23: mol_type = other DNA
accttcactgcagtttgctagtt

SEQ ID NO: 29298 - DNA, 23 bp, synthetic construct
  misc_feature 1..23: note = Synthetic Construct
  source 1..23: mol_type = other DNA
gcatgggccaagacatacacaag

SEQ ID NO: 29299 - DNA, 26 bp, synthetic construct
  misc_feature 1..26: note = Synthetic Construct
  source 1..26: mol_type = other DNA
cccctactactgagaacagaccgttt

SEQ ID NO: 29300 - DNA, 25 bp, synthetic construct
  misc_feature 1..25: note = Synthetic Construct
  source 1..25: mol_type = other DNA
cactactgcatctcagttcctgtca

SEQ ID NO: 29301 - DNA, 23 bp, synthetic construct
  misc_feature 1..23: note = Synthetic Construct
  source 1..23: mol_type = other DNA
ctcagcccatagacttcgtgtgt

SEQ ID NO: 29302 - DNA, 20 bp, synthetic construct
  misc_feature 1..20: note = Synthetic Construct
  source 1..20: mol_type = other DNA
tggtcagagggcagacgaat

SEQ ID NO: 29303 - DNA, 20 bp, synthetic construct
  misc_feature 1..20: note = Synthetic Construct
  source 1..20: mol_type = other DNA
tccagtgtcccaccttggta

SEQ ID NO: 29304 - DNA, 27 bp, synthetic construct
  misc_feature 1..27: note = Synthetic Construct
  source 1..27: mol_type = other DNA
gacagtttgccagtcattatccacttc

SEQ ID NO: 29305 - DNA, 22 bp, synthetic construct
  misc_feature 1..22: note = Synthetic Construct
  source 1..22: mol_type = other DNA
tggagtaggtgagcttgtggat

SEQ ID NO: 29306 - DNA, 26 bp, synthetic construct
  misc_feature 1..26: note = Synthetic Construct
  source 1..26: mol_type = other DNA
catggtctttttccacaggacatttg

SEQ ID NO: 29307 - DNA, 22 bp, synthetic construct
  misc_feature 1..22: note = Synthetic Construct
  source 1..22: mol_type = other DNA
cccttccacttggggcagaata

SEQ ID NO: 29308 - DNA, 25 bp, synthetic construct
  misc_feature 1..25: note = Synthetic Construct
  source 1..25: mol_type = other DNA
gcagagaagggatcagaaagactgt

SEQ ID NO: 29309 - DNA, 25 bp, synthetic construct
  misc_feature 1..25: note = Synthetic Construct
  source 1..25: mol_type = other DNA
gaaggcagtggctgataaagatttg

SEQ ID NO: 29310 - DNA, 24 bp, synthetic construct
  misc_feature 1..24: note = Synthetic Construct
  source 1..24: mol_type = other DNA
gtgctgtggacaaactttccatct

SEQ ID NO: 29311 - DNA, 23 bp, synthetic construct
  misc_feature 1..23: note = Synthetic Construct
  source 1..23: mol_type = other DNA
cccagctccagattctcctgaac

SEQ ID NO: 29312 - DNA, 24 bp, synthetic construct
  misc_feature 1..24: note = Synthetic Construct
  source 1..24: mol_type = other DNA
gtcagtttaacctgcccagaaagt

SEQ ID NO: 29313 - DNA, 27 bp, synthetic construct
  misc_feature 1..27: note = Synthetic Construct
  source 1..27: mol_type = other DNA
gttgtgaaagattggggattgtgacat

SEQ ID NO: 29314 - DNA, 22 bp, synthetic construct
  misc_feature 1..22: note = Synthetic Construct
  source 1..22: mol_type = other DNA
aggatgaaggcagagaggacat

SEQ ID NO: 29315 - DNA, 23 bp, synthetic construct
  misc_feature 1..23: note = Synthetic Construct
  source 1..23: mol_type = other DNA
ggtaccacctcctttctttccaa

SEQ ID NO: 29316 - DNA, 22 bp, synthetic construct
  misc_feature 1..22: note = Synthetic Construct
  source 1..22: mol_type = other DNA
gcatggggcatgtgggaattga

SEQ ID NO: 29317 - DNA, 27 bp, synthetic construct
  misc_feature 1..27: note = Synthetic Construct
  source 1..27: mol_type = other DNA
ccttcccatattgggtcagtgtctgta

SEQ ID NO: 29318 - DNA, 24 bp, synthetic construct
  misc_feature 1..24: note = Synthetic Construct
  source 1..24: mol_type = other DNA
ccagcatccctaccttcgagaaac

SEQ ID NO: 29319 - DNA, 24 bp, synthetic construct
  misc_feature 1..24: note = Synthetic Construct
  source 1..24: mol_type = other DNA
gcaagacaaagtccaccccacttt

SEQ ID NO: 29320 - DNA, 22 bp, synthetic construct
  misc_feature 1..22: note = Synthetic Construct
  source 1..22: mol_type = other DNA
ccccatgtttgcagtggagttc

SEQ ID NO: 29321 - DNA, 25 bp, synthetic construct
  misc_feature 1..25: note = Synthetic Construct
  source 1..25: mol_type = other DNA
cgaggaagctctccatctcattagt

SEQ ID NO: 29322 - DNA, 23 bp, synthetic construct
  misc_feature 1..23: note = Synthetic Construct
  source 1..23: mol_type = other DNA
gcaagcatctgtacttcctccat

SEQ ID NO: 29323 - DNA, 23 bp, synthetic construct
  misc_feature 1..23: note = Synthetic Construct
  source 1..23: mol_type = other DNA
cctgtttctgcatccttggtcat

SEQ ID NO: 29324 - DNA, 22 bp, synthetic construct
  misc_feature 1..22: note = Synthetic Construct
  source 1..22: mol_type = other DNA
ggaccaaggttcagcagcctat

SEQ ID NO: 29325 - DNA, 21 bp, synthetic construct
  misc_feature 1..21: note = Synthetic Construct
  source 1..21: mol_type = other DNA
ggcttgggagcatttgcagtt

SEQ ID NO: 29326 - DNA, 26 bp, synthetic construct
  misc_feature 1..26: note = Synthetic Construct
  source 1..26: mol_type = other DNA
ctgtgattcgtatgactttgggcttt

SEQ ID NO: 29327 - DNA, 20 bp, synthetic construct
  misc_feature 1..20: note = Synthetic Construct
  source 1..20: mol_type = other DNA
gagctgctcaggctgcttta

SEQ ID NO: 29328 - DNA, 24 bp, synthetic construct
  misc_feature 1..24: note = Synthetic Construct
  source 1..24: mol_type = other DNA
ccagctttgattccacactgattt

SEQ ID NO: 29329 - DNA, 22 bp, synthetic construct
  misc_feature 1..22: note = Synthetic Construct
  source 1..22: mol_type = other DNA
gaagcagctgaggttctaccaa

SEQ ID NO: 29330 - DNA, 23 bp, synthetic construct
  misc_feature 1..23: note = Synthetic Construct
  source 1..23: mol_type = other DNA
aagcaaacaccgtatcactctga

SEQ ID NO: 29331 - DNA, 21 bp, synthetic construct
  misc_feature 1..21: note = Synthetic Construct
  source 1..21: mol_type = other DNA
aggagccggtcctcactgtag

SEQ ID NO: 29332 - DNA, 24 bp, synthetic construct
  misc_feature 1..24: note = Synthetic Construct
  source 1..24: mol_type = other DNA
gtggatcccctcttcctgagtcat

SEQ ID NO: 29333 - DNA, 24 bp, synthetic construct
  misc_feature 1..24: note = Synthetic Construct
  source 1..24: mol_type = other DNA
gacctgattgtcctggtggaggta

SEQ ID NO: 29334 - DNA, 24 bp, synthetic construct
  misc_feature 1..24: note = Synthetic Construct
  source 1..24: mol_type = other DNA
ggcccaatcagatgctttggtcat

SEQ ID NO: 29335 - DNA, 25 bp, synthetic construct
  misc_feature 1..25: note = Synthetic Construct
  source 1..25: mol_type = other DNA
cacccttctaccttgccattagtat

SEQ ID NO: 29336 - DNA, 21 bp, synthetic construct
  misc_feature 1..21: note = Synthetic Construct
  source 1..21: mol_type = other DNA
ccaaacagtgtcgggtgttga

SEQ ID NO: 29337 - DNA, 20 bp, synthetic construct
  misc_feature 1..20: note = Synthetic Construct
  source 1..20: mol_type = other DNA
gccaaacgtgctgagtcttg

SEQ ID NO: 29338 - DNA, 22 bp, synthetic construct
  misc_feature 1..22: note = Synthetic Construct
  source 1..22: mol_type = other DNA
ggaaggggaggaaaaagggaaa

SEQ ID NO: 29339 - DNA, 27 bp, synthetic construct
  misc_feature 1..27: note = Synthetic Construct
  source 1..27: mol_type = other DNA
agatacgaggctcgacattttactaag

SEQ ID NO: 29340 - DNA, 22 bp, synthetic construct
  misc_feature 1..22: note = Synthetic Construct
  source 1..22: mol_type = other DNA
cagctggacgcttgattagtct

SEQ ID NO: 29341 - DNA, 19 bp, synthetic construct
  misc_feature 1..19: note = Synthetic Construct
  source 1..19: mol_type = other DNA
caggcagggcgtgatatgt

SEQ ID NO: 29342 - DNA, 20 bp, synthetic construct
  misc_feature 1..20: note = Synthetic Construct
  source 1..20: mol_type = other DNA
ccctgcatcggtggcaaaat

SEQ ID NO: 29343 - DNA, 24 bp, synthetic construct
  misc_feature 1..24: note = Synthetic Construct
  source 1..24: mol_type = other DNA
ggccagctttgagtgttacagaac

SEQ ID NO: 29344 - DNA, 22 bp, synthetic construct
  misc_feature 1..22: note = Synthetic Construct
  source 1..22: mol_type = other DNA
ccagcaaacacaccaaggaagt

SEQ ID NO: 29345 - DNA, 26 bp, synthetic construct
  misc_feature 1..26: note = Synthetic Construct
  source 1..26: mol_type = other DNA
cagggatcaataaggcacttggagta

SEQ ID NO: 29346 - DNA, 26 bp, synthetic construct
  misc_feature 1..26: note = Synthetic Construct
  source 1..26: mol_type = other DNA
gaagaaacagagagcaactgagactt

SEQ ID NO: 29347 - DNA, 22 bp, synthetic construct
  misc_feature 1..22: note = Synthetic Construct
  source 1..22: mol_type = other DNA
tgcccttaaaccatggcagatg

SEQ ID NO: 29348 - DNA, 26 bp, synthetic construct
  misc_feature 1..26: note = Synthetic Construct
  source 1..26: mol_type = other DNA
gagcagtttggaagaagtcctatcat

SEQ ID NO: 29349 - DNA, 27 bp, synthetic construct
  misc_feature 1..27: note = Synthetic Construct
  source 1..27: mol_type = other DNA
gtgaaagatttaccccttatggtccta

SEQ ID NO: 29350 - DNA, 20 bp, synthetic construct
  misc_feature 1..20: note = Synthetic Construct
  source 1..20: mol_type = other DNA
ggctgaggcagtcagagtgt

SEQ ID NO: 29351 - DNA, 23 bp, synthetic construct
  misc_feature 1..23: note = Synthetic Construct
  source 1..23: mol_type = other DNA
gggacctctaggtttcagcttct

SEQ ID NO: 29352 - DNA, 24 bp, synthetic construct
  misc_feature 1..24: note = Synthetic Construct
  source 1..24: mol_type = other DNA
agtgggaacttcagagctagactt

SEQ ID NO: 29353 - DNA, 26 bp, synthetic construct
  misc_feature 1..26: note = Synthetic Construct
  source 1..26: mol_type = other DNA
cgaattccttgtccttgtagcctttc

SEQ ID NO: 29354 - DNA, 30 bp, synthetic construct
  misc_feature 1..30: note = Synthetic Construct
  source 1..30: mol_type = other DNA
ctgagataggtcatctcttgaagacagagt

SEQ ID NO: 29355 - DNA, 23 bp, synthetic construct
  misc_feature 1..23: note = Synthetic Construct
  source 1..23: mol_type = other DNA
gctagcagagctcaggaaagttg

SEQ ID NO: 29356 - DNA, 24 bp, synthetic construct
  misc_feature 1..24: note = Synthetic Construct
  source 1..24: mol_type = other DNA
acacatgactgtagccaattcctt

SEQ ID NO: 29357 - DNA, 25 bp, synthetic construct
  misc_feature 1..25: note = Synthetic Construct
  source 1..25: mol_type = other DNA
tgctcttagaaaccaaaccaactct

SEQ ID NO: 29358 - DNA, 23 bp, synthetic construct
  misc_feature 1..23: note = Synthetic Construct
  source 1..23: mol_type = other DNA
aggagacatgggacaggtatgtt

SEQ ID NO: 29359 - DNA, 25 bp, synthetic construct
  misc_feature 1..25: note = Synthetic Construct
  source 1..25: mol_type = other DNA
ccagggctacacaatagaggtttct

SEQ ID NO: 29360 - DNA, 26 bp, synthetic construct
  misc_feature 1..26: note = Synthetic Construct
  source 1..26: mol_type = other DNA
ggaaggaagagagaagcctcagtatc

SEQ ID NO: 29361 - DNA, 21 bp, synthetic construct
  misc_feature 1..21: note = Synthetic Construct
  source 1..21: mol_type = other DNA
gctgaggacggctgcttgata

SEQ ID NO: 29362 - DNA, 22 bp, synthetic construct
  misc_feature 1..22: note = Synthetic Construct
  source 1..22: mol_type = other DNA
cacatgacccgttctgggtaac

SEQ ID NO: 29363 - DNA, 25 bp, synthetic construct
  misc_feature 1..25: note = Synthetic Construct
  source 1..25: mol_type = other DNA
gacccttgaaggaatgtaggcagta

SEQ ID NO: 29364 - DNA, 23 bp, synthetic construct
  misc_feature 1..23: note = Synthetic Construct
  source 1..23: mol_type = other DNA
gcatacatgcttcactgcacttc

SEQ ID NO: 29365 - DNA, 26 bp, synthetic construct
  misc_feature 1..26: note = Synthetic Construct
  source 1..26: mol_type = other DNA
cccctttgtcattgaggaaagagttt

SEQ ID NO: 29366 - DNA, 23 bp, synthetic construct
  misc_feature 1..23: note = Synthetic Construct
  source 1..23: mol_type = other DNA
gaaggtcactctggcttcattgt

SEQ ID NO: 29367 - DNA, 25 bp, synthetic construct
  misc_feature 1..25: note = Synthetic Construct
  source 1..25: mol_type = other DNA
cctgggttaattcccttcccactct

SEQ ID NO: 29368 - DNA, 26 bp, synthetic construct
  misc_feature 1..26: note = Synthetic Construct
  source 1..26: mol_type = other DNA
cacgttcatcatagcttgtcaacact

SEQ ID NO: 29369 - DNA, 22 bp, synthetic construct
  misc_feature 1..22: note = Synthetic Construct
  source 1..22: mol_type = other DNA
ggttccttcccatggctacact

SEQ ID NO: 29370 - DNA, 25 bp, synthetic construct
  misc_feature 1..25: note = Synthetic Construct
  source 1..25: mol_type = other DNA
gaggagttcccagtaatgcaactat

SEQ ID NO: 29371 - DNA, 30 bp, synthetic construct
  misc_feature 1..30: note = Synthetic Construct
  source 1..30: mol_type = other DNA
ccacttagagtgttgcttttaactcccatt

SEQ ID NO: 29372 - DNA, 26 bp, synthetic construct
  misc_feature 1..26: note = Synthetic Construct
  source 1..26: mol_type = other DNA
gtttacaccctcagtctacacaagaa

SEQ ID NO: 29373 - DNA, 21 bp, synthetic construct
  misc_feature 1..21: note = Synthetic Construct
  source 1..21: mol_type = other DNA
gatttcacggcagaggtgtgt

SEQ ID NO: 29374 - DNA, 27 bp, synthetic construct
  misc_feature 1..27: note = Synthetic Construct
  source 1..27: mol_type = other DNA
actagctggaatggtggtaaagaatac

SEQ ID NO: 29375 - DNA, 24 bp, synthetic construct
  misc_feature 1..24: note = Synthetic Construct
  source 1..24: mol_type = other DNA
tcttctgacagcagtgctactcta

SEQ ID NO: 29376 - DNA, 29 bp, synthetic construct
  misc_feature 1..29: note = Synthetic Construct
  source 1..29: mol_type = other DNA
ccctgagttagttcagtgaaggtgtattg

SEQ ID NO: 29377 - DNA, 24 bp, synthetic construct
  misc_feature 1..24: note = Synthetic Construct
  source 1..24: mol_type = other DNA
caggttactactgctggtgtgctt

SEQ ID NO: 29378 - DNA, 25 bp, synthetic construct
  misc_feature 1..25: note = Synthetic Construct
  source 1..25: mol_type = other DNA
ctggatgaatggctgtacacacaga

SEQ ID NO: 29379 - DNA, 22 bp, synthetic construct
  misc_feature 1..22: note = Synthetic Construct
  source 1..22: mol_type = other DNA
actgctgtttggggataagcat

SEQ ID NO: 29380 - DNA, 24 bp, synthetic construct
  misc_feature 1..24: note = Synthetic Construct
  source 1..24: mol_type = other DNA
gcaaaacatgggtctaagcctgta

SEQ ID NO: 29381 - DNA, 24 bp, synthetic construct
  misc_feature 1..24: note = Synthetic Construct
  source 1..24: mol_type = other DNA
ggctttccaaacacgtctggagtt

SEQ ID NO: 29382 - DNA, 22 bp, synthetic construct
  misc_feature 1..22: note = Synthetic Construct
  source 1..22: mol_type = other DNA
ctccctgcctgtgcctctattt

SEQ ID NO: 29383 - DNA, 27 bp, synthetic construct
  misc_feature 1..27: note = Synthetic Construct
  source 1..27: mol_type = other DNA
ccaatttagtctgtcaaggtccctttc

SEQ ID NO: 29384 - DNA, 24 bp, synthetic construct
  misc_feature 1..24: note = Synthetic Construct
  source 1..24: mol_type = other DNA
gggatggggaagaagggcttacta

SEQ ID NO: 29385 - DNA, 22 bp, synthetic construct
  misc_feature 1..22: note = Synthetic Construct
  source 1..22: mol_type = other DNA
tggacctggaggcagtaacttg

SEQ ID NO: 29386 - DNA, 22 bp, synthetic construct
  misc_feature 1..22: note = Synthetic Construct
  source 1..22: mol_type = other DNA
tgaggctgaacccatcagaaga

SEQ ID NO: 29387 - DNA, 19 bp, synthetic construct
  misc_feature 1..19: note = Synthetic Construct
  source 1..19: mol_type = other DNA
tccagacctcgtgctgctt

SEQ ID NO: 29388 - DNA, 27 bp, synthetic construct
  misc_feature 1..27: note = Synthetic Construct
  source 1..27: mol_type = other DNA
cgttcttcaaaaagcagactggaccaa

SEQ ID NO: 29389 - DNA, 22 bp, synthetic construct
  misc_feature 1..22: note = Synthetic Construct
  source 1..22: mol_type = other DNA
ggttttcaccaatgccccttca

SEQ ID NO: 29390 - DNA, 27 bp, synthetic construct
  misc_feature 1..27: note = Synthetic Construct
  source 1..27: mol_type = other DNA
ctcgcttaagatctcactttgagtaac

SEQ ID NO: 29391 - DNA, 22 bp, synthetic construct
  misc_feature 1..22: note = Synthetic Construct
  source 1..22: mol_type = other DNA
gtctgtgggtgatgaggaccat

SEQ ID NO: 29392 - DNA, 24 bp, synthetic construct
  misc_feature 1..24: note = Synthetic Construct
  source 1..24: mol_type = other DNA
gggagctgggatctgagtaagact

SEQ ID NO: 29393 - DNA, 25 bp, synthetic construct
  misc_feature 1..25: note = Synthetic Construct
  source 1..25: mol_type = other DNA
ggcatttctagacccaccttgtatc

SEQ ID NO: 29394 - DNA, 22 bp, synthetic construct
  misc_feature 1..22: note = Synthetic Construct
  source 1..22: mol_type = other DNA
cgctcccaggaaccaaggtatt

SEQ ID NO: 29395 - DNA, 29 bp, synthetic construct
  misc_feature 1..29: note = Synthetic Construct
  source 1..29: mol_type = other DNA
gtggtaggagtaaggaatttgcagaaaac

SEQ ID NO: 29396 - DNA, 25 bp, synthetic construct
  misc_feature 1..25: note = Synthetic Construct
  source 1..25: mol_type = other DNA
tctagctcatccccaatgttctttc

SEQ ID NO: 29397 - DNA, 22 bp, synthetic construct
  misc_feature 1..22: note = Synthetic Construct
  source 1..22: mol_type = other DNA
cccgggatttgttccctaaaca

SEQ ID NO: 29398 - DNA, 25 bp, synthetic construct
  misc_feature 1..25: note = Synthetic Construct
  source 1..25: mol_type = other DNA
gcctggggtaatgaattctgctgat

SEQ ID NO: 29399 - DNA, 20 bp, synthetic construct
  misc_feature 1..20: note = Synthetic Construct
  source 1..20: mol_type = other DNA
gcctcagaccctggcactca

SEQ ID NO: 29400 - DNA, 24 bp, synthetic construct
  misc_feature 1..24: note = Synthetic Construct
  source 1..24: mol_type = other DNA
cccaaccttaaccaaaggaagcaa

SEQ ID NO: 29401 - DNA, 23 bp, synthetic construct
  misc_feature 1..23: note = Synthetic Construct
  source 1..23: mol_type = other DNA
agcccctcaccggaagtcttatc

SEQ ID NO: 29402 - DNA, 25 bp, synthetic construct
  misc_feature 1..25: note = Synthetic Construct
  source 1..25: mol_type = other DNA
cctaggtggagtcttcattctctca

SEQ ID NO: 29403 - DNA, 25 bp, synthetic construct
  misc_feature 1..25: note = Synthetic Construct
  source 1..25: mol_type = other DNA
gtctgtgaatctcacactcctcaca

SEQ ID NO: 29404 - DNA, 25 bp, synthetic construct
  misc_feature 1..25: note = Synthetic Construct
  source 1..25: mol_type = other DNA
cagttagggctgcttgtcttagtct

SEQ ID NO: 29405 - DNA, 28 bp, synthetic construct
  misc_feature 1..28: note = Synthetic Construct
  source 1..28: mol_type = other DNA
gactctgtcacaatcaagagaaggaatg

SEQ ID NO: 29406 - DNA, 29 bp, synthetic construct
  misc_feature 1..29: note = Synthetic Construct
  source 1..29: mol_type = other DNA
ggctccccaactatcatgtatgtcaaatg

SEQ ID NO: 29407 - DNA, 24 bp, synthetic construct
  misc_feature 1..24: note = Synthetic Construct
  source 1..24: mol_type = other DNA
gactttgcaagccatacagcttct

SEQ ID NO: 29408 - DNA, 22 bp, synthetic construct
  misc_feature 1..22: note = Synthetic Construct
  source 1..22: mol_type = other DNA
gggctcacacaaagctgacttc

SEQ ID NO: 29409 - DNA, 21 bp, synthetic construct
  misc_feature 1..21: note = Synthetic Construct
  source 1..21: mol_type = other DNA
cccctggagctgctaatttga

SEQ ID NO: 29410 - DNA, 27 bp, synthetic construct
  misc_feature 1..27: note = Synthetic Construct
  source 1..27: mol_type = other DNA
ggaaaggagagaaattgaaggcatttg

SEQ ID NO: 29411 - DNA, 25 bp, synthetic construct
  misc_feature 1..25: note = Synthetic Construct
  source 1..25: mol_type = other DNA
tcaactgagattcagagccctaaga

SEQ ID NO: 29412 - DNA, 24 bp, synthetic construct
  misc_feature 1..24: note = Synthetic Construct
  source 1..24: mol_type = other DNA
gcaggagatcccctttacccagtt

SEQ ID NO: 29413 - DNA, 23 bp, synthetic construct
  misc_feature 1..23: note = Synthetic Construct
  source 1..23: mol_type = other DNA
gccaagttccagacaccatcaca

SEQ ID NO: 29414 - DNA, 27 bp, synthetic construct
  misc_feature 1..27: note = Synthetic Construct
  source 1..27: mol_type = other DNA
acatcatggataggctagaggttatga

SEQ ID NO: 29415 - DNA, 21 bp, synthetic construct
  misc_feature 1..21: note = Synthetic Construct
  source 1..21: mol_type = other DNA
acaaggcaggaggagcattac

SEQ ID NO: 29416 - DNA, 21 bp, synthetic construct
  misc_feature 1..21: note = Synthetic Construct
  source 1..21: mol_type = other DNA
gctgctccaagcacagaccta

SEQ ID NO: 29417 - DNA, 22 bp, synthetic construct
  misc_feature 1..22: note = Synthetic Construct
  source 1..22: mol_type = other DNA
cctctccacccttctgtactct

SEQ ID NO: 29418 - DNA, 23 bp, synthetic construct
  misc_feature 1..23: note = Synthetic Construct
  source 1..23: mol_type = other DNA
tggacaaattccaagtgctcaca

SEQ ID NO: 29419 - DNA, 22 bp, synthetic construct
  misc_feature 1..22: note = Synthetic Construct
  source 1..22: mol_type = other DNA
tggagcaggattccggtaggtt

SEQ ID NO: 29420 - DNA, 23 bp, synthetic construct
  misc_feature 1..23: note = Synthetic Construct
  source 1..23: mol_type = other DNA
cccagttcatttcctcgtgttct

SEQ ID NO: 29421 - DNA, 22 bp, synthetic construct
  misc_feature 1..22: note = Synthetic Construct
  source 1..22: mol_type = other DNA
gcatgggtactgacccgtttct

SEQ ID NO: 29422 - DNA, 22 bp, synthetic construct
  misc_feature 1..22: note = Synthetic Construct
  source 1..22: mol_type = other DNA
ccctggaactcgagagatgctt

SEQ ID NO: 29423 - DNA, 23 bp, synthetic construct
  misc_feature 1..23: note = Synthetic Construct
  source 1..23: mol_type = other DNA
ccttggatcctggaactgtgctt

SEQ ID NO: 29424 - DNA, 25 bp, synthetic construct
  misc_feature 1..25: note = Synthetic Construct
  source 1..25: mol_type = other DNA
gaggaaaggattacattccggagaa

SEQ ID NO: 29425 - DNA, 27 bp, synthetic construct
  misc_feature 1..27: note = Synthetic Construct
  source 1..27: mol_type = other DNA
gccaaagataacggattcaaggcaact

SEQ ID NO: 29426 - DNA, 20 bp, synthetic construct
  misc_feature 1..20: note = Synthetic Construct
  source 1..20: mol_type = other DNA
cagggactgggcagaaaaca

SEQ ID NO: 29427 - DNA, 22 bp, synthetic construct
  misc_feature 1..22: note = Synthetic Construct
  source 1..22: mol_type = other DNA
cccagacagctgcggctaataa

SEQ ID NO: 29428 - DNA, 30 bp, synthetic construct
  misc_feature 1..30: note = Synthetic Construct
  source 1..30: mol_type = other DNA
gggtcttcattttctgccgtacctataaac

SEQ ID NO: 29429 - DNA, 26 bp, synthetic construct
  misc_feature 1..26: note = Synthetic Construct
  source 1..26: mol_type = other DNA
cagcacagagttttatcctcctctac

SEQ ID NO: 29430 - DNA, 22 bp, synthetic construct
  misc_feature 1..22: note = Synthetic Construct
  source 1..22: mol_type = other DNA
ccccttactcacctggccaaag

SEQ ID NO: 29431 - DNA, 21 bp, synthetic construct
  misc_feature 1..21: note = Synthetic Construct
  source 1..21: mol_type = other DNA
tgcaccagttcctccgtgaga

SEQ ID NO: 29432 - DNA, 21 bp, synthetic construct
  misc_feature 1..21: note = Synthetic Construct
  source 1..21: mol_type = other DNA
ggagccactggtcagaagaca

SEQ ID NO: 29433 - DNA, 21 bp, synthetic construct
  misc_feature 1..21: note = Synthetic Construct
  source 1..21: mol_type = other DNA
gaaagcagaccctgagaccaa

SEQ ID NO: 29434 - DNA, 24 bp, synthetic construct
  misc_feature 1..24: note = Synthetic Construct
  source 1..24: mol_type = other DNA
acagagatcataggtggcatcctt

SEQ ID NO: 29435 - DNA, 24 bp, synthetic construct
  misc_feature 1..24: note = Synthetic Construct
  source 1..24: mol_type = other DNA
gcttccacctccacattcctgact

SEQ ID NO: 29436 - DNA, 24 bp, synthetic construct
  misc_feature 1..24: note = Synthetic Construct
  source 1..24: mol_type = other DNA
gaataaaatgcatccacgctcact

SEQ ID NO: 29437 - DNA, 21 bp, synthetic construct
  misc_feature 1..21: note = Synthetic Construct
  source 1..21: mol_type = other DNA
aatacgccccagcccttgtca

SEQ ID NO: 29438 - DNA, 23 bp, synthetic construct
  misc_feature 1..23: note = Synthetic Construct
  source 1..23: mol_type = other DNA
ctgtgtaccaagtggatggatga

SEQ ID NO: 29439 - DNA, 25 bp, synthetic construct
  misc_feature 1..25: note = Synthetic Construct
  source 1..25: mol_type = other DNA
gggcaaatttagccacccatgaaag

SEQ ID NO: 29440 - DNA, 20 bp, synthetic construct
  misc_feature 1..20: note = Synthetic Construct
  source 1..20: mol_type = other DNA
gcgtgaatgcgtgggaaaca

SEQ ID NO: 29441 - DNA, 22 bp, synthetic construct
  misc_feature 1..22: note = Synthetic Construct
  source 1..22: mol_type = other DNA
acacagccacataccacacatc

SEQ ID NO: 29442 - DNA, 22 bp, synthetic construct
  misc_feature 1..22: note = Synthetic Construct
  source 1..22: mol_type = other DNA
gggagtcaccagcagagtcata

SEQ ID NO: 29443 - DNA, 24 bp, synthetic construct
  misc_feature 1..24: note = Synthetic Construct
  source 1..24: mol_type = other DNA
ttgcaggatgacagaccaaagtta

SEQ ID NO: 29444 - DNA, 23 bp, synthetic construct
  misc_feature 1..23: note = Synthetic Construct
  source 1..23: mol_type = other DNA
ccgagcctatgctgaggtgtaag

SEQ ID NO: 29445 - DNA, 30 bp, synthetic construct
  misc_feature 1..30: note = Synthetic Construct
  source 1..30: mol_type = other DNA
cagaatcctatatgctaggctcataaccaa

SEQ ID NO: 29446 - DNA, 23 bp, synthetic construct
  misc_feature 1..23: note = Synthetic Construct
  source 1..23: mol_type = other DNA
gggaattctccaaccccatttct

SEQ ID NO: 29447 - DNA, 22 bp, synthetic construct
  misc_feature 1..22: note = Synthetic Construct
  source 1..22: mol_type = other DNA
tggccatagaggctgagagctt

SEQ ID NO: 29448 - DNA, 19 bp, synthetic construct
  misc_feature 1..19: note = Synthetic Construct
  source 1..19: mol_type = other DNA
tcccagtgcccacttcact

SEQ ID NO: 29449 - DNA, 25 bp, synthetic construct
  misc_feature 1..25: note = Synthetic Construct
  source 1..25: mol_type = other DNA
ggctgattatcggcagaatttggtt

SEQ ID NO: 29450 - DNA, 24 bp, synthetic construct
  misc_feature 1..24: note = Synthetic Construct
  source 1..24: mol_type = other DNA
ccacactaggaatgtgggacacaa

SEQ ID NO: 29451 - DNA, 26 bp, synthetic construct
  misc_feature 1..26: note = Synthetic Construct
  source 1..26: mol_type = other DNA
tcatatttctccatcccagctgttac

SEQ ID NO: 29452 - DNA, 26 bp, synthetic construct
  misc_feature 1..26: note = Synthetic Construct
  source 1..26: mol_type = other DNA
gctagatgatgatgtcctctaccaaa

SEQ ID NO: 29453 - DNA, 22 bp, synthetic construct
  misc_feature 1..22: note = Synthetic Construct
  source 1..22: mol_type = other DNA
catccagcgtcacattctgtct

SEQ ID NO: 29454 - DNA, 22 bp, synthetic construct
  misc_feature 1..22: note = Synthetic Construct
  source 1..22: mol_type = other DNA
ggtgtggggcaagacttgtttc

SEQ ID NO: 29455 - DNA, 25 bp, synthetic construct
  misc_feature 1..25: note = Synthetic Construct
  source 1..25: mol_type = other DNA
gctctgggctgattgagttgcattc

SEQ ID NO: 29456 - DNA, 22 bp, synthetic construct
  misc_feature 1..22: note = Synthetic Construct
  source 1..22: mol_type = other DNA
ccatcacccgaagcctcacttt

SEQ ID NO: 29457 - DNA, 23 bp, synthetic construct
  misc_feature 1..23: note = Synthetic Construct
  source 1..23: mol_type = other DNA
gccttaggccatgtacaatgtga

SEQ ID NO: 29458 - DNA, 24 bp, synthetic construct
  misc_feature 1..24: note = Synthetic Construct
  source 1..24: mol_type = other DNA
ggctgcacagaccactcaattatc

SEQ ID NO: 29459 - DNA, 28 bp, synthetic construct
  misc_feature 1..28: note = Synthetic Construct
  source 1..28: mol_type = other DNA
ctgtattatccatcacatgagggtcttg

SEQ ID NO: 29460 - DNA, 23 bp, synthetic construct
  misc_feature 1..23: note = Synthetic Construct
  source 1..23: mol_type = other DNA
ctcaccatacggttgtactcaca

SEQ ID NO: 29461 - DNA, 26 bp, synthetic construct
  misc_feature 1..26: note = Synthetic Construct
  source 1..26: mol_type = other DNA
catggaggatttcaaagcaaggaagt

SEQ ID NO: 29462 - DNA, 21 bp, synthetic construct
  misc_feature 1..21: note = Synthetic Construct
  source 1..21: mol_type = other DNA
gctgtcacagactgcatggaa

SEQ ID NO: 29463 - DNA, 26 bp, synthetic construct
  misc_feature 1..26: note = Synthetic Construct
  source 1..26: mol_type = other DNA
caccatcttggtcatctctttctttc

SEQ ID NO: 29464 - DNA, 24 bp, synthetic construct
  misc_feature 1..24: note = Synthetic Construct
  source 1..24: mol_type = other DNA
ggtgagtaccctagcaaccagaag

SEQ ID NO: 29465 - DNA, 20 bp, synthetic construct
  misc_feature 1..20: note = Synthetic Construct
  source 1..20: mol_type = other DNA
atggcccctggaactggaaa

SEQ ID NO: 29466 - DNA, 24 bp, synthetic construct
  misc_feature 1..24: note = Synthetic Construct
  source 1..24: mol_type = other DNA
catggctttctgcagaccattttt

SEQ ID NO: 29467 - DNA, 27 bp, synthetic construct
  misc_feature 1..27: note = Synthetic Construct
  source 1..27: mol_type = other DNA
gtgatatgtgtgcaggtttctctgttt

SEQ ID NO: 29468 - DNA, 24 bp, synthetic construct
  misc_feature 1..24: note = Synthetic Construct
  source 1..24: mol_type = other DNA
tgaatgctgcaagaggaaatggaa

SEQ ID NO: 29469 - DNA, 23 bp, synthetic construct
  misc_feature 1..23: note = Synthetic Construct
  source 1..23: mol_type = other DNA
gacgccatgtgctgtagattact

SEQ ID NO: 29470 - DNA, 26 bp, synthetic construct
  misc_feature 1..26: note = Synthetic Construct
  source 1..26: mol_type = other DNA
cccacagactgattcagagtcgttac

SEQ ID NO: 29471 - DNA, 20 bp, synthetic construct
  misc_feature 1..20: note = Synthetic Construct
  source 1..20: mol_type = other DNA
gaggccgagcagcatttgat

SEQ ID NO: 29472 - DNA, 21 bp, synthetic construct
  misc_feature 1..21: note = Synthetic Construct
  source 1..21: mol_type = other DNA
tcagtggtgcagcatgcttag

SEQ ID NO: 29473 - DNA, 24 bp, synthetic construct
  misc_feature 1..24: note = Synthetic Construct
  source 1..24: mol_type = other DNA
gggtggcacagatatgaggaaaca

SEQ ID NO: 29474 - DNA, 25 bp, synthetic construct
  misc_feature 1..25: note = Synthetic Construct
  source 1..25: mol_type = other DNA
gcacaaccatgtacctttggaaatc

SEQ ID NO: 29475 - DNA, 21 bp, synthetic construct
  misc_feature 1..21: note = Synthetic Construct
  source 1..21: mol_type = other DNA
tgcctcatacagacccgacat

SEQ ID NO: 29476 - DNA, 20 bp, synthetic construct
  misc_feature 1..20: note = Synthetic Construct
  source 1..20: mol_type = other DNA
acatttgccaacccctgctt

SEQ ID NO: 29477 - DNA, 27 bp, synthetic construct
  misc_feature 1..27: note = Synthetic Construct
  source 1..27: mol_type = other DNA
gaggcagtgccaaatatgaactgatac

SEQ ID NO: 29478 - DNA, 23 bp, synthetic construct
  misc_feature 1..23: note = Synthetic Construct
  source 1..23: mol_type = other DNA
gagatcccaaatgccctccaaca

SEQ ID NO: 29479 - DNA, 25 bp, synthetic construct
  misc_feature 1..25: note = Synthetic Construct
  source 1..25: mol_type = other DNA
gcttcttgaggctaggcttggaact

SEQ ID NO: 29480 - DNA, 23 bp, synthetic construct
  misc_feature 1..23: note = Synthetic Construct
  source 1..23: mol_type = other DNA
gtgtgttgcatctccagctaatg

SEQ ID NO: 29481 - DNA, 22 bp, synthetic construct
  misc_feature 1..22: note = Synthetic Construct
  source 1..22: mol_type = other DNA
cagcctccaagttgaacctagt

SEQ ID NO: 29482 - DNA, 22 bp, synthetic construct
  misc_feature 1..22: note = Synthetic Construct
  source 1..22: mol_type = other DNA
agggccacctctctgggtttta

SEQ ID NO: 29483 - DNA, 22 bp, synthetic construct
  misc_feature 1..22: note = Synthetic Construct
  source 1..22: mol_type = other DNA
gcattatggggttgtgggttgt

SEQ ID NO: 29484 - DNA, 22 bp, synthetic construct
  misc_feature 1..22: note = Synthetic Construct
  source 1..22: mol_type = other DNA
cccgaggaagcatttgctgtga

SEQ ID NO: 29485 - DNA, 24 bp, synthetic construct
  misc_feature 1..24: note = Synthetic Construct
  source 1..24: mol_type = other DNA
ggcatggttcttccaactccaagt

SEQ ID NO: 29486 - DNA, 20 bp, synthetic construct
  misc_feature 1..20: note = Synthetic Construct
  source 1..20: mol_type = other DNA
gcctggccacctatcattgt

SEQ ID NO: 29487 - DNA, 21 bp, synthetic construct
  misc_feature 1..21: note = Synthetic Construct
  source 1..21: mol_type = other DNA
tgtggcagtggaaatcccaaa

SEQ ID NO: 29488 - DNA, 22 bp, synthetic construct
  misc_feature 1..22: note = Synthetic Construct
  source 1..22: mol_type = other DNA
gccagcaccccacaaatgttac

SEQ ID NO: 29489 - DNA, 25 bp, synthetic construct
  misc_feature 1..25: note = Synthetic Construct
  source 1..25: mol_type = other DNA
tgcagttccatttccaatagtcaca

SEQ ID NO: 29490 - DNA, 26 bp, synthetic construct
  misc_feature 1..26: note = Synthetic Construct
  source 1..26: mol_type = other DNA
ccccaaactggatgtttttccctcat

SEQ ID NO: 29491 - DNA, 24 bp, synthetic construct
  misc_feature 1..24: note = Synthetic Construct
  source 1..24: mol_type = other DNA
cccacccatgtctgttctctattt

SEQ ID NO: 29492 - DNA, 22 bp, synthetic construct
  misc_feature 1..22: note = Synthetic Construct
  source 1..22: mol_type = other DNA
tgagggaactcccctgaccttt

SEQ ID NO: 29493 - DNA, 20 bp, synthetic construct
  misc_feature 1..20: note = Synthetic Construct
  source 1..20: mol_type = other DNA
ccacctgttcagggccacta

SEQ ID NO: 29494 - DNA, 27 bp, synthetic construct
  misc_feature 1..27: note = Synthetic Construct
  source 1..27: mol_type = other DNA
cttcaactctacatttctgagggtcat

SEQ ID NO: 29495 - DNA, 22 bp, synthetic construct
  misc_feature 1..22: note = Synthetic Construct
  source 1..22: mol_type = other DNA
cccctacacacccatacagaca

SEQ ID NO: 29496 - DNA, 29 bp, synthetic construct
  misc_feature 1..29: note = Synthetic Construct
  source 1..29: mol_type = other DNA
gcaatttgcttaaggacagggattgtatc

SEQ ID NO: 29497 - DNA, 23 bp, synthetic construct
  misc_feature 1..23: note = Synthetic Construct
  source 1..23: mol_type = other DNA
ctccctcaaaattccctggttct

SEQ ID NO: 29498 - DNA, 19 bp, synthetic construct
  misc_feature 1..19: note = Synthetic Construct
  source 1..19: mol_type = other DNA
gcctcagcctcccaaacaa

SEQ ID NO: 29499 - DNA, 26 bp, synthetic construct
  misc_feature 1..26: note = Synthetic Construct
  source 1..26: mol_type = other DNA
tccctggtgtggatcttattttcatc

SEQ ID NO: 29500 - DNA, 20 bp, synthetic construct
  misc_feature 1..20: note = Synthetic Construct
  source 1..20: mol_type = other DNA
gcttccctggagaccacagt

SEQ ID NO: 29501 - DNA, 25 bp, synthetic construct
  misc_feature 1..25: note = Synthetic Construct
  source 1..25: mol_type = other DNA
gggtcttcgacttagcatttagtct

SEQ ID NO: 29502 - DNA, 24 bp, synthetic construct
  misc_feature 1..24: note = Synthetic Construct
  source 1..24: mol_type = other DNA
gctagctcctgtttccatcagcat

SEQ ID NO: 29503 - DNA, 27 bp, synthetic construct
  misc_feature 1..27: note = Synthetic Construct
  source 1..27: mol_type = other DNA
gcttggtccaaaacctcattgatttac

SEQ ID NO: 29504 - DNA, 22 bp, synthetic construct
  misc_feature 1..22: note = Synthetic Construct
  source 1..22: mol_type = other DNA
acacggttgtacatgcgtaaga

SEQ ID NO: 29505 - DNA, 23 bp, synthetic construct
  misc_feature 1..23: note = Synthetic Construct
  source 1..23: mol_type = other DNA
gtgtggaggaaggggaagagttc

SEQ ID NO: 29506 - DNA, 24 bp, synthetic construct
  misc_feature 1..24: note = Synthetic Construct
  source 1..24: mol_type = other DNA
ccccttgctttcatggtaacactt

SEQ ID NO: 29507 - DNA, 25 bp, synthetic construct
  misc_feature 1..25: note = Synthetic Construct
  source 1..25: mol_type = other DNA
gtggctccttttcacatagttgttt

SEQ ID NO: 29508 - DNA, 24 bp, synthetic construct
  misc_feature 1..24: note = Synthetic Construct
  source 1..24: mol_type = other DNA
ggacatgggagcagattttacact

SEQ ID NO: 29509 - DNA, 22 bp, synthetic construct
  misc_feature 1..22: note = Synthetic Construct
  source 1..22: mol_type = other DNA
gcacacatgggttctcagtgat

SEQ ID NO: 29510 - DNA, 24 bp, synthetic construct
  misc_feature 1..24: note = Synthetic Construct
  source 1..24: mol_type = other DNA
cccctaaagccatttcggttcttc

SEQ ID NO: 29511 - DNA, 27 bp, synthetic construct
  misc_feature 1..27: note = Synthetic Construct
  source 1..27: mol_type = other DNA
acatggatagaaaggtctggcttaatg

SEQ ID NO: 29512 - DNA, 20 bp, synthetic construct
  misc_feature 1..20: note = Synthetic Construct
  source 1..20: mol_type = other DNA
cagtttggcccatgctgatg

SEQ ID NO: 29513 - DNA, 26 bp, synthetic construct
  misc_feature 1..26: note = Synthetic Construct
  source 1..26: mol_type = other DNA
cagaacccctcctgaataatggaagt

SEQ ID NO: 29514 - DNA, 20 bp, synthetic construct
  misc_feature 1..20: note = Synthetic Construct
  source 1..20: mol_type = other DNA
accaggccactcccttgtgt

SEQ ID NO: 29515 - DNA, 25 bp, synthetic construct
  misc_feature 1..25: note = Synthetic Construct
  source 1..25: mol_type = other DNA
ggctttcctggatggacaaacagat

SEQ ID NO: 29516 - DNA, 27 bp, synthetic construct
  misc_feature 1..27: note = Synthetic Construct
  source 1..27: mol_type = other DNA
agaatcctgtctatttacaggggtaga

SEQ ID NO: 29517 - DNA, 20 bp, synthetic construct
  misc_feature 1..20: note = Synthetic Construct
  source 1..20: mol_type = other DNA
cagttggcccagtcaaccaa

SEQ ID NO: 29518 - DNA, 24 bp, synthetic construct
  misc_feature 1..24: note = Synthetic Construct
  source 1..24: mol_type = other DNA
ctggcagtgatctctcttttctct

SEQ ID NO: 29519 - DNA, 24 bp, synthetic construct
  misc_feature 1..24: note = Synthetic Construct
  source 1..24: mol_type = other DNA
cccacaagacactacccactccat

SEQ ID NO: 29520 - DNA, 25 bp, synthetic construct
  misc_feature 1..25: note = Synthetic Construct
  source 1..25: mol_type = other DNA
ctcaggaactttggagcatagatca

SEQ ID NO: 29521 - DNA, 26 bp, synthetic construct
  misc_feature 1..26: note = Synthetic Construct
  source 1..26: mol_type = other DNA
catgacagttaaggggagaaggaaaa

SEQ ID NO: 29522 - DNA, 24 bp, synthetic construct
  misc_feature 1..24: note = Synthetic Construct
  source 1..24: mol_type = other DNA
ggcatgtttactccaccaacaaca

SEQ ID NO: 29523 - DNA, 22 bp, synthetic construct
  misc_feature 1..22: note = Synthetic Construct
  source 1..22: mol_type = other DNA
gcttgagaactgaggtgccaaa

SEQ ID NO: 29524 - DNA, 21 bp, synthetic construct
  misc_feature 1..21: note = Synthetic Construct
  source 1..21: mol_type = other DNA
gccatctgctgctgttagcat

SEQ ID NO: 29525 - DNA, 27 bp, synthetic construct
  misc_feature 1..27: note = Synthetic Construct
  source 1..27: mol_type = other DNA
gaccttaggcaaagaggtaacacaaac

SEQ ID NO: 29526 - DNA, 29 bp, synthetic construct
  misc_feature 1..29: note = Synthetic Construct
  source 1..29: mol_type = other DNA
gagagctgagtttaatgagagttgaggtt

SEQ ID NO: 29527 - DNA, 24 bp, synthetic construct
  misc_feature 1..24: note = Synthetic Construct
  source 1..24: mol_type = other DNA
tggagatacagtggttgtgtttga

SEQ ID NO: 29528 - DNA, 28 bp, synthetic construct
  misc_feature 1..28: note = Synthetic Construct
  source 1..28: mol_type = other DNA
gcttctaaaggatacggtgaaagtgtag

SEQ ID NO: 29529 - DNA, 25 bp, synthetic construct
  misc_feature 1..25: note = Synthetic Construct
  source 1..25: mol_type = other DNA
acagtggtagagatgcagaaagatg

SEQ ID NO: 29530 - DNA, 26 bp, synthetic construct
  misc_feature 1..26: note = Synthetic Construct
  source 1..26: mol_type = other DNA
gaggttcaaataaccaagtggagaag

SEQ ID NO: 29531 - DNA, 25 bp, synthetic construct
  misc_feature 1..25: note = Synthetic Construct
  source 1..25: mol_type = other DNA
cccagattcagtcctgtagtgtaac

SEQ ID NO: 29532 - DNA, 29 bp, synthetic construct
  misc_feature 1..29: note = Synthetic Construct
  source 1..29: mol_type = other DNA
gggtgagacaaacataggttctttacttg

SEQ ID NO: 29533 - DNA, 18 bp, synthetic construct
  misc_feature 1..18: note = Synthetic Construct
  source 1..18: mol_type = other DNA
tcgggaccagccatcact

SEQ ID NO: 29534 - DNA, 22 bp, synthetic construct
  misc_feature 1..22: note = Synthetic Construct
  source 1..22: mol_type = other DNA
gcactgttccaatgtccaggtt

SEQ ID NO: 29535 - DNA, 24 bp, synthetic construct
  misc_feature 1..24: note = Synthetic Construct
  source 1..24: mol_type = other DNA
ctgggagtaggcattaacccattg

SEQ ID NO: 29536 - DNA, 27 bp, synthetic construct
  misc_feature 1..27: note = Synthetic Construct
  source 1..27: mol_type = other DNA
tccagcccctacagaattctatttttc

SEQ ID NO: 29537 - DNA, 21 bp, synthetic construct
  misc_feature 1..21: note = Synthetic Construct
  source 1..21: mol_type = other DNA
gctcaagagccacacgaatct

SEQ ID NO: 29538 - DNA, 21 bp, synthetic construct
  misc_feature 1..21: note = Synthetic Construct
  source 1..21: mol_type = other DNA
gggctgtcacctcttctgtga

SEQ ID NO: 29539 - DNA, 22 bp, synthetic construct
  misc_feature 1..22: note = Synthetic Construct
  source 1..22: mol_type = other DNA
acgcttcattccctcagtctca

SEQ ID NO: 29540 - DNA, 20 bp, synthetic construct
  misc_feature 1..20: note = Synthetic Construct
  source 1..20: mol_type = other DNA
gtctggttgcgcagtgaaca

SEQ ID NO: 29541 - DNA, 22 bp, synthetic construct
  misc_feature 1..22: note = Synthetic Construct
  source 1..22: mol_type = other DNA
gccctgctacccctttcctatt

SEQ ID NO: 29542 - DNA, 20 bp, synthetic construct
  misc_feature 1..20: note = Synthetic Construct
  source 1..20: mol_type = other DNA
gcgatgccaggaacatctct

SEQ ID NO: 29543 - DNA, 19 bp, synthetic construct
  misc_feature 1..19: note = Synthetic Construct
  source 1..19: mol_type = other DNA
tggccacacagcctacctt

SEQ ID NO: 29544 - DNA, 30 bp, synthetic construct
  misc_feature 1..30: note = Synthetic Construct
  source 1..30: mol_type = other DNA
ctacctaaacctctaatcacctaagacttg

SEQ ID NO: 29545 - DNA, 25 bp, synthetic construct
  misc_feature 1..25: note = Synthetic Construct
  source 1..25: mol_type = other DNA
ccagagccatgagaggaaaaggatt

SEQ ID NO: 29546 - DNA, 26 bp, synthetic construct
  misc_feature 1..26: note = Synthetic Construct
  source 1..26: mol_type = other DNA
gggtgatgtgagattcccttaactct

SEQ ID NO: 29547 - DNA, 25 bp, synthetic construct
  misc_feature 1..25: note = Synthetic Construct
  source 1..25: mol_type = other DNA
gcactctcaaggcgtaagacctttt

SEQ ID NO: 29548 - DNA, 26 bp, synthetic construct
  misc_feature 1..26: note = Synthetic Construct
  source 1..26: mol_type = other DNA
acataagcccatgccaggataataag

SEQ ID NO: 29549 - DNA, 21 bp, synthetic construct
  misc_feature 1..21: note = Synthetic Construct
  source 1..21: mol_type = other DNA
ccaaccagccagtccaaaaag

SEQ ID NO: 29550 - DNA, 20 bp, synthetic construct
  misc_feature 1..20: note = Synthetic Construct
  source 1..20: mol_type = other DNA
gtcaggctgcgtcattgcta

SEQ ID NO: 29551 - DNA, 23 bp, synthetic construct
  misc_feature 1..23: note = Synthetic Construct
  source 1..23: mol_type = other DNA
cagaagaacgaggaaggaactgt

SEQ ID NO: 29552 - DNA, 24 bp, synthetic construct
  misc_feature 1..24: note = Synthetic Construct
  source 1..24: mol_type = other DNA
ggaggagctggtaagaactagtca

SEQ ID NO: 29553 - DNA, 23 bp, synthetic construct
  misc_feature 1..23: note = Synthetic Construct
  source 1..23: mol_type = other DNA
ccaccagacaactttctcctctt

SEQ ID NO: 29554 - DNA, 27 bp, synthetic construct
  misc_feature 1..27: note = Synthetic Construct
  source 1..27: mol_type = other DNA
gagcaaagaatgtgctataagggagat

SEQ ID NO: 29555 - DNA, 22 bp, synthetic construct
  misc_feature 1..22: note = Synthetic Construct
  source 1..22: mol_type = other DNA
gcatgtgggttttccagcaaat

SEQ ID NO: 29556 - DNA, 24 bp, synthetic construct
  misc_feature 1..24: note = Synthetic Construct
  source 1..24: mol_type = other DNA
actgtccttgctacttgagagact

SEQ ID NO: 29557 - DNA, 25 bp, synthetic construct
  misc_feature 1..25: note = Synthetic Construct
  source 1..25: mol_type = other DNA
acaggtttctttcaagcaggatttc

SEQ ID NO: 29558 - DNA, 22 bp, synthetic construct
  misc_feature 1..22: note = Synthetic Construct
  source 1..22: mol_type = other DNA
gccaagcacataagccatgcta

SEQ ID NO: 29559 - DNA, 23 bp, synthetic construct
  misc_feature 1..23: note = Synthetic Construct
  source 1..23: mol_type = other DNA
tcgctggatttctccaggattac

SEQ ID NO: 29560 - DNA, 21 bp, synthetic construct
  misc_feature 1..21: note = Synthetic Construct
  source 1..21: mol_type = other DNA
gcccagatggagacacagctt

SEQ ID NO: 29561 - DNA, 20 bp, synthetic construct
  misc_feature 1..20: note = Synthetic Construct
  source 1..20: mol_type = other DNA
gtcacagcctgcttgcctat

SEQ ID NO: 29562 - DNA, 28 bp, synthetic construct
  misc_feature 1..28: note = Synthetic Construct
  source 1..28: mol_type = other DNA
cagaaataggaccttttggggttcattc

SEQ ID NO: 29563 - DNA, 22 bp, synthetic construct
  misc_feature 1..22: note = Synthetic Construct
  source 1..22: mol_type = other DNA
gagtggacacagatcccacaca

SEQ ID NO: 29564 - DNA, 22 bp, synthetic construct
  misc_feature 1..22: note = Synthetic Construct
  source 1..22: mol_type = other DNA
gcctcctgtgtgaaggtcgaaa

SEQ ID NO: 29565 - DNA, 20 bp, synthetic construct
  misc_feature 1..20: note = Synthetic Construct
  source 1..20: mol_type = other DNA
cctgccccaaactccaaaga

SEQ ID NO: 29566 - DNA, 19 bp, synthetic construct
  misc_feature 1..19: note = Synthetic Construct
  source 1..19: mol_type = other DNA
taggtgcccgaggccaaac

SEQ ID NO: 29567 - DNA, 25 bp, synthetic construct
  misc_feature 1..25: note = Synthetic Construct
  source 1..25: mol_type = other DNA
ggaggacaaaaggagctctattcaa

SEQ ID NO: 29568 - DNA, 25 bp, synthetic construct
  misc_feature 1..25: note = Synthetic Construct
  source 1..25: mol_type = other DNA
cctggagtgtgggcaggtatttttc

SEQ ID NO: 29569 - DNA, 26 bp, synthetic construct
  misc_feature 1..26: note = Synthetic Construct
  source 1..26: mol_type = other DNA
ctggtgatcactttacccttctgtga

SEQ ID NO: 29570 - DNA, 24 bp, synthetic construct
  misc_feature 1..24: note = Synthetic Construct
  source 1..24: mol_type = other DNA
ttcagagtcccgtgagttatccta

SEQ ID NO: 29571 - DNA, 25 bp, synthetic construct
  misc_feature 1..25: note = Synthetic Construct
  source 1..25: mol_type = other DNA
cagttaagcctctttgatgggaatg

SEQ ID NO: 29572 - DNA, 21 bp, synthetic construct
  misc_feature 1..21: note = Synthetic Construct
  source 1..21: mol_type = other DNA
tcttaggggaggccagaccaa

SEQ ID NO: 29573 - DNA, 27 bp, synthetic construct
  misc_feature 1..27: note = Synthetic Construct
  source 1..27: mol_type = other DNA
ggtggaatgtctgtggaatgttagtga

SEQ ID NO: 29574 - DNA, 22 bp, synthetic construct
  misc_feature 1..22: note = Synthetic Construct
  source 1..22: mol_type = other DNA
atgagacaagcagctccgttta

SEQ ID NO: 29575 - DNA, 20 bp, synthetic construct
  misc_feature 1..20: note = Synthetic Construct
  source 1..20: mol_type = other DNA
caccagctgccctctaggaa

SEQ ID NO: 29576 - DNA, 26 bp, synthetic construct
  misc_feature 1..26: note = Synthetic Construct
  source 1..26: mol_type = other DNA
gacttgaaacattgctctcctaccta

SEQ ID NO: 29577 - DNA, 24 bp, synthetic construct
  misc_feature 1..24: note = Synthetic Construct
  source 1..24: mol_type = other DNA
ctgtttcaatcctggactgtctgt

SEQ ID NO: 29578 - DNA, 20 bp, synthetic construct
  misc_feature 1..20: note = Synthetic Construct
  source 1..20: mol_type = other DNA
accccttccctgcttcttgt

SEQ ID NO: 29579 - DNA, 24 bp, synthetic construct
  misc_feature 1..24: note = Synthetic Construct
  source 1..24: mol_type = other DNA
ggctctcaacatgcagaccttgat

SEQ ID NO: 29580 - DNA, 23 bp, synthetic construct
  misc_feature 1..23: note = Synthetic Construct
  source 1..23: mol_type = other DNA
gggaggaggtaggaggttgtaaa

SEQ ID NO: 29581 - DNA, 23 bp, synthetic construct
  misc_feature 1..23: note = Synthetic Construct
  source 1..23: mol_type = other DNA
gcccaggggactattttgtctgt

SEQ ID NO: 29582 - DNA, 23 bp, synthetic construct
  misc_feature 1..23: note = Synthetic Construct
  source 1..23: mol_type = other DNA
ccctaatggtccagccaacatac

SEQ ID NO: 29583 - DNA, 22 bp, synthetic construct
  misc_feature 1..22: note = Synthetic Construct
  source 1..22: mol_type = other DNA
agcgcctgtgaactcaggaatg

SEQ ID NO: 29584 - DNA, 27 bp, synthetic construct
  misc_feature 1..27: note = Synthetic Construct
  source 1..27: mol_type = other DNA
gtagtccaccatcctgataaggttaag

SEQ ID NO: 29585 - DNA, 22 bp, synthetic construct
  misc_feature 1..22: note = Synthetic Construct
  source 1..22: mol_type = other DNA
ccttataccccacctccacgaa

SEQ ID NO: 29586 - DNA, 23 bp, synthetic construct
  misc_feature 1..23: note = Synthetic Construct
  source 1..23: mol_type = other DNA
cgcaaaggattttgtccttcact

SEQ ID NO: 29587 - DNA, 23 bp, synthetic construct
  misc_feature 1..23: note = Synthetic Construct
  source 1..23: mol_type = other DNA
cagcagcagcaaacttgtctatt

SEQ ID NO: 29588 - DNA, 22 bp, synthetic construct
  misc_feature 1..22: note = Synthetic Construct
  source 1..22: mol_type = other DNA
caccggtgggtttgtagcagat

SEQ ID NO: 29589 - DNA, 22 bp, synthetic construct
  misc_feature 1..22: note = Synthetic Construct
  source 1..22: mol_type = other DNA
tgtccttgggaggagagctagt

SEQ ID NO: 29590 - DNA, 20 bp, synthetic construct
  misc_feature 1..20: note = Synthetic Construct
  source 1..20: mol_type = other DNA
agctacggcccatgacaaga

SEQ ID NO: 29591 - DNA, 27 bp, synthetic construct
  misc_feature 1..27: note = Synthetic Construct
  source 1..27: mol_type = other DNA
ccagcttagccctaaataaagcacagt

SEQ ID NO: 29592 - DNA, 23 bp, synthetic construct
  misc_feature 1..23: note = Synthetic Construct
  source 1..23: mol_type = other DNA
ggtgtgggaccatggagacaaat

SEQ ID NO: 29593 - DNA, 26 bp, synthetic construct
  misc_feature 1..26: note = Synthetic Construct
  source 1..26: mol_type = other DNA
caattgcagtaagggagaacacaaac

SEQ ID NO: 29594 - DNA, 29 bp, synthetic construct
  misc_feature 1..29: note = Synthetic Construct
  source 1..29: mol_type = other DNA
ggccttatcatgatctgaggatgaagttt

SEQ ID NO: 29595 - DNA, 26 bp, synthetic construct
  misc_feature 1..26: note = Synthetic Construct
  source 1..26: mol_type = other DNA
gttgcaatctagtggcagtttctaag

SEQ ID NO: 29596 - DNA, 27 bp, synthetic construct
  misc_feature 1..27: note = Synthetic Construct
  source 1..27: mol_type = other DNA
gatttgttgttaggtcactccaacttc

SEQ ID NO: 29597 - DNA, 24 bp, synthetic construct
  misc_feature 1..24: note = Synthetic Construct
  source 1..24: mol_type = other DNA
cgctctgagacagccatacatttg

SEQ ID NO: 29598 - DNA, 22 bp, synthetic construct
  misc_feature 1..22: note = Synthetic Construct
  source 1..22: mol_type = other DNA
ccaaggtcactgcctctcatgt

SEQ ID NO: 29599 - DNA, 24 bp, synthetic construct
  misc_feature 1..24: note = Synthetic Construct
  source 1..24: mol_type = other DNA
cagctccgtcctttcattcttaca

SEQ ID NO: 29600 - DNA, 21 bp, synthetic construct
  misc_feature 1..21: note = Synthetic Construct
  source 1..21: mol_type = other DNA
cttgtctgctgggctgttcta

SEQ ID NO: 29601 - DNA, 24 bp, synthetic construct
  misc_feature 1..24: note = Synthetic Construct
  source 1..24: mol_type = other DNA
cagggatcagacagagacattgtt

SEQ ID NO: 29602 - DNA, 25 bp, synthetic construct
  misc_feature 1..25: note = Synthetic Construct
  source 1..25: mol_type = other DNA
agtacaagactgtgagtcaggagat

SEQ ID NO: 29603 - DNA, 20 bp, synthetic construct
  misc_feature 1..20: note = Synthetic Construct
  source 1..20: mol_type = other DNA
gtgaagccagaggtgctctt

SEQ ID NO: 29604 - DNA, 26 bp, synthetic construct
  misc_feature 1..26: note = Synthetic Construct
  source 1..26: mol_type = other DNA
ctctgagcaacagaattcccacagat

SEQ ID NO: 29605 - DNA, 27 bp, synthetic construct
  misc_feature 1..27: note = Synthetic Construct
  source 1..27: mol_type = other DNA
ctgtgccaccgtctatgtaatttatgt

SEQ ID NO: 29606 - DNA, 24 bp, synthetic construct
  misc_feature 1..24: note = Synthetic Construct
  source 1..24: mol_type = other DNA
caacaagattcagtgccaggaaca

SEQ ID NO: 29607 - DNA, 23 bp, synthetic construct
  misc_feature 1..23: note = Synthetic Construct
  source 1..23: mol_type = other DNA
gaatatagcggccagagtgatga

SEQ ID NO: 29608 - DNA, 25 bp, synthetic construct
  misc_feature 1..25: note = Synthetic Construct
  source 1..25: mol_type = other DNA
agaggacgtggttatcttgtcaatg

SEQ ID NO: 29609 - DNA, 27 bp, synthetic construct
  misc_feature 1..27: note = Synthetic Construct
  source 1..27: mol_type = other DNA
ggcttcatagccatcttcaaggaccta

SEQ ID NO: 29610 - DNA, 27 bp, synthetic construct
  misc_feature 1..27: note = Synthetic Construct
  source 1..27: mol_type = other DNA
gcctacttctcacatcacagctctcta

SEQ ID NO: 29611 - DNA, 26 bp, synthetic construct
  misc_feature 1..26: note = Synthetic Construct
  source 1..26: mol_type = other DNA
catgtaagagccttcagatcctgtct

SEQ ID NO: 29612 - DNA, 22 bp, synthetic construct
  misc_feature 1..22: note = Synthetic Construct
  source 1..22: mol_type = other DNA
cgagtccatgtgcagaaagaac

SEQ ID NO: 29613 - DNA, 23 bp, synthetic construct
  misc_feature 1..23: note = Synthetic Construct
  source 1..23: mol_type = other DNA
ggcttgtcctgcttccaaacact

SEQ ID NO: 29614 - DNA, 25 bp, synthetic construct
  misc_feature 1..25: note = Synthetic Construct
  source 1..25: mol_type = other DNA
ggagaaatccctattctccctgttg

SEQ ID NO: 29615 - DNA, 24 bp, synthetic construct
  misc_feature 1..24: note = Synthetic Construct
  source 1..24: mol_type = other DNA
ctgtgtaagcaggatcaccgatct

SEQ ID NO: 29616 - DNA, 22 bp, synthetic construct
  misc_feature 1..22: note = Synthetic Construct
  source 1..22: mol_type = other DNA
gaaactggtccggaggatgaga

SEQ ID NO: 29617 - DNA, 27 bp, synthetic construct
  misc_feature 1..27: note = Synthetic Construct
  source 1..27: mol_type = other DNA
agggagaggcaaataagtatgtgtaac

SEQ ID NO: 29618 - DNA, 27 bp, synthetic construct
  misc_feature 1..27: note = Synthetic Construct
  source 1..27: mol_type = other DNA
agggagctagtatggtctttagagtaa

SEQ ID NO: 29619 - DNA, 24 bp, synthetic construct
  misc_feature 1..24: note = Synthetic Construct
  source 1..24: mol_type = other DNA
cctaaatcgtctgctggtgtccat

SEQ ID NO: 29620 - DNA, 22 bp, synthetic construct
  misc_feature 1..22: note = Synthetic Construct
  source 1..22: mol_type = other DNA
tcctcctcccacctccttaaaa

SEQ ID NO: 29621 - DNA, 26 bp, synthetic construct
  misc_feature 1..26: note = Synthetic Construct
  source 1..26: mol_type = other DNA
caccaccaaatcagagaattgccttt

SEQ ID NO: 29622 - DNA, 23 bp, synthetic construct
  misc_feature 1..23: note = Synthetic Construct
  source 1..23: mol_type = other DNA
tggagactggtcatgtacacaca

SEQ ID NO: 29623 - DNA, 24 bp, synthetic construct
  misc_feature 1..24: note = Synthetic Construct
  source 1..24: mol_type = other DNA
tggttttccatctgctcacttttc

SEQ ID NO: 29624 - DNA, 25 bp, synthetic construct
  misc_feature 1..25: note = Synthetic Construct
  source 1..25: mol_type = other DNA
gaatggtggaagggtaatgtcaatg

SEQ ID NO: 29625 - DNA, 25 bp, synthetic construct
  misc_feature 1..25: note = Synthetic Construct
  source 1..25: mol_type = other DNA
gtgataatctgctcctagctgaaca

SEQ ID NO: 29626 - DNA, 27 bp, synthetic construct
  misc_feature 1..27: note = Synthetic Construct
  source 1..27: mol_type = other DNA
ggacaggacagaggattcatgctaatg

SEQ ID NO: 29627 - DNA, 24 bp, synthetic construct
  misc_feature 1..24: note = Synthetic Construct
  source 1..24: mol_type = other DNA
agactggatgctgaaatccttgaa

SEQ ID NO: 29628 - DNA, 22 bp, synthetic construct
  misc_feature 1..22: note = Synthetic Construct
  source 1..22: mol_type = other DNA
tcatggctcccctcacttccta

SEQ ID NO: 29629 - DNA, 24 bp, synthetic construct
  misc_feature 1..24: note = Synthetic Construct
  source 1..24: mol_type = other DNA
ccaggccagttctgagaggaaaca

SEQ ID NO: 29630 - DNA, 23 bp, synthetic construct
  misc_feature 1..23: note = Synthetic Construct
  source 1..23: mol_type = other DNA
gggtgacagcttcttcctaatgt

SEQ ID NO: 29631 - DNA, 27 bp, synthetic construct
  misc_feature 1..27: note = Synthetic Construct
  source 1..27: mol_type = other DNA
gcatccagttatccagagagcatgagt

SEQ ID NO: 29632 - DNA, 27 bp, synthetic construct
  misc_feature 1..27: note = Synthetic Construct
  source 1..27: mol_type = other DNA
gtcaagggagactagtaagtgggtctt

SEQ ID NO: 29633 - DNA, 25 bp, synthetic construct
  misc_feature 1..25: note = Synthetic Construct
  source 1..25: mol_type = other DNA
cagagaagcaaaatgtgatctgtgt

SEQ ID NO: 29634 - DNA, 25 bp, synthetic construct
  misc_feature 1..25: note = Synthetic Construct
  source 1..25: mol_type = other DNA
caggcctgagagaaattcacagttg

SEQ ID NO: 29635 - DNA, 22 bp, synthetic construct
  misc_feature 1..22: note = Synthetic Construct
  source 1..22: mol_type = other DNA
tgcagaggacccactagtccaa

SEQ ID NO: 29636 - DNA, 25 bp, synthetic construct
  misc_feature 1..25: note = Synthetic Construct
  source 1..25: mol_type = other DNA
gtcgttaggcgatgcatgattgtaa

SEQ ID NO: 29637 - DNA, 26 bp, synthetic construct
  misc_feature 1..26: note = Synthetic Construct
  source 1..26: mol_type = other DNA
gcggtttgaggtataaatggaagtga

SEQ ID NO: 29638 - DNA, 30 bp, synthetic construct
  misc_feature 1..30: note = Synthetic Construct
  source 1..30: mol_type = other DNA
gacatgaagactcgctttgcaattgtattc

SEQ ID NO: 29639 - DNA, 26 bp, synthetic construct
  misc_feature 1..26: note = Synthetic Construct
  source 1..26: mol_type = other DNA
ggcactagaggcttaagcacaaactt

SEQ ID NO: 29640 - DNA, 24 bp, synthetic construct
  misc_feature 1..24: note = Synthetic Construct
  source 1..24: mol_type = other DNA
ggtttaggaagcctctctctccaa

SEQ ID NO: 29641 - DNA, 25 bp, synthetic construct
  misc_feature 1..25: note = Synthetic Construct
  source 1..25: mol_type = other DNA
gacagttttcactttgcaggaagta

SEQ ID NO: 29642 - DNA, 25 bp, synthetic construct
  misc_feature 1..25: note = Synthetic Construct
  source 1..25: mol_type = other DNA
ggccaaattatgggtgggttagcaa

SEQ ID NO: 29643 - DNA, 23 bp, synthetic construct
  misc_feature 1..23: note = Synthetic Construct
  source 1..23: mol_type = other DNA
ggtactgggcattgtacttgact

SEQ ID NO: 29644 - DNA, 24 bp, synthetic construct
  misc_feature 1..24: note = Synthetic Construct
  source 1..24: mol_type = other DNA
gcttccatgagctgtcctcaatct

SEQ ID NO: 29645 - DNA, 21 bp, synthetic construct
  misc_feature 1..21: note = Synthetic Construct
  source 1..21: mol_type = other DNA
accctctcccagccctgaaaa

SEQ ID NO: 29646 - DNA, 22 bp, synthetic construct
  misc_feature 1..22: note = Synthetic Construct
  source 1..22: mol_type = other DNA
gggctctctgagtgaaggatgt

SEQ ID NO: 29647 - DNA, 22 bp, synthetic construct
  misc_feature 1..22: note = Synthetic Construct
  source 1..22: mol_type = other DNA
gtggccttcctctgaatgaagt

SEQ ID NO: 29648 - DNA, 28 bp, synthetic construct
  misc_feature 1..28: note = Synthetic Construct
  source 1..28: mol_type = other DNA
gacagagcagaggtaatgggtatacttg

SEQ ID NO: 29649 - DNA, 24 bp, synthetic construct
  misc_feature 1..24: note = Synthetic Construct
  source 1..24: mol_type = other DNA
ccatccatgtcccaatccagagtt

SEQ ID NO: 29650 - DNA, 26 bp, synthetic construct
  misc_feature 1..26: note = Synthetic Construct
  source 1..26: mol_type = other DNA
gcacacaacactacccatttttctga

SEQ ID NO: 29651 - DNA, 26 bp, synthetic construct
  misc_feature 1..26: note = Synthetic Construct
  source 1..26: mol_type = other DNA
cgattgtattgcctttgctcctttgt

SEQ ID NO: 29652 - DNA, 24 bp, synthetic construct
  misc_feature 1..24: note = Synthetic Construct
  source 1..24: mol_type = other DNA
ggccagagatagcatcctctgaat

SEQ ID NO: 29653 - DNA, 19 bp, synthetic construct
  misc_feature 1..19: note = Synthetic Construct
  source 1..19: mol_type = other DNA
cgagcctgctccccttaca

SEQ ID NO: 29654 - DNA, 22 bp, synthetic construct
  misc_feature 1..22: note = Synthetic Construct
  source 1..22: mol_type = other DNA
gcctccaaagtgacaggagtga

SEQ ID NO: 29655 - DNA, 22 bp, synthetic construct
  misc_feature 1..22: note = Synthetic Construct
  source 1..22: mol_type = other DNA
ggtgggcaaggatgctactcaa

SEQ ID NO: 29656 - DNA, 22 bp, synthetic construct
  misc_feature 1..22: note = Synthetic Construct
  source 1..22: mol_type = other DNA
cctgggcagttcagcttgttgt

SEQ ID NO: 29657 - DNA, 21 bp, synthetic construct
  misc_feature 1..21: note = Synthetic Construct
  source 1..21: mol_type = other DNA
tctgcctagaaacgggtctga

SEQ ID NO: 29658 - DNA, 22 bp, synthetic construct
  misc_feature 1..22: note = Synthetic Construct
  source 1..22: mol_type = other DNA
gccctcaaagacctcacagatt

SEQ ID NO: 29659 - DNA, 25 bp, synthetic construct
  misc_feature 1..25: note = Synthetic Construct
  source 1..25: mol_type = other DNA
gctcctgacctcacaacaactttct

SEQ ID NO: 29660 - DNA, 23 bp, synthetic construct
  misc_feature 1..23: note = Synthetic Construct
  source 1..23: mol_type = other DNA
ggcacaaacctgagaacttgaac

SEQ ID NO: 29661 - DNA, 22 bp, synthetic construct
  misc_feature 1..22: note = Synthetic Construct
  source 1..22: mol_type = other DNA
cgctagccaggtttccgtttag

SEQ ID NO: 29662 - DNA, 22 bp, synthetic construct
  misc_feature 1..22: note = Synthetic Construct
  source 1..22: mol_type = other DNA
gcgaaggacgtcagcgatgtaa

SEQ ID NO: 29663 - DNA, 27 bp, synthetic construct
  misc_feature 1..27: note = Synthetic Construct
  source 1..27: mol_type = other DNA
gattgtggtataaggtgggtttagttg

SEQ ID NO: 29664 - DNA, 26 bp, synthetic construct
  misc_feature 1..26: note = Synthetic Construct
  source 1..26: mol_type = other DNA
ctctcaaaggcttttacctgggagta

SEQ ID NO: 29665 - DNA, 23 bp, synthetic construct
  misc_feature 1..23: note = Synthetic Construct
  source 1..23: mol_type = other DNA
ccaacctagccccactaatttct

SEQ ID NO: 29666 - DNA, 24 bp, synthetic construct
  misc_feature 1..24: note = Synthetic Construct
  source 1..24: mol_type = other DNA
cagaaagttcaccagagcacaatc

SEQ ID NO: 29667 - DNA, 22 bp, synthetic construct
  misc_feature 1..22: note = Synthetic Construct
  source 1..22: mol_type = other DNA
gggagtatgcccctttgctgtt

SEQ ID NO: 29668 - DNA, 22 bp, synthetic construct
  misc_feature 1..22: note = Synthetic Construct
  source 1..22: mol_type = other DNA
gtcagcaagaaccccttcaagt

SEQ ID NO: 29669 - DNA, 20 bp, synthetic construct
  misc_feature 1..20: note = Synthetic Construct
  source 1..20: mol_type = other DNA
gctgtggtgatcgtggttgt

SEQ ID NO: 29670 - DNA, 27 bp, synthetic construct
  misc_feature 1..27: note = Synthetic Construct
  source 1..27: mol_type = other DNA
tctttccccatctagaatgctcttttc

SEQ ID NO: 29671 - DNA, 20 bp, synthetic construct
  misc_feature 1..20: note = Synthetic Construct
  source 1..20: mol_type = other DNA
caggctgctcttgggaagtt

SEQ ID NO: 29672 - DNA, 28 bp, synthetic construct
  misc_feature 1..28: note = Synthetic Construct
  source 1..28: mol_type = other DNA
ctccctagagaatcctaagaccaaccaa

SEQ ID NO: 29673 - DNA, 22 bp, synthetic construct
  misc_feature 1..22: note = Synthetic Construct
  source 1..22: mol_type = other DNA
gcatggctgaagctgaatcttg

SEQ ID NO: 29674 - DNA, 22 bp, synthetic construct
  misc_feature 1..22: note = Synthetic Construct
  source 1..22: mol_type = other DNA
gcccacagtggttcagtcttag

SEQ ID NO: 29675 - DNA, 19 bp, synthetic construct
  misc_feature 1..19: note = Synthetic Construct
  source 1..19: mol_type = other DNA
gccggagagcaacgcacat

SEQ ID NO: 29676 - DNA, 26 bp, synthetic construct
  misc_feature 1..26: note = Synthetic Construct
  source 1..26: mol_type = other DNA
gcaggctaagattactcgtctaaaca

SEQ ID NO: 29677 - DNA, 27 bp, synthetic construct
  misc_feature 1..27: note = Synthetic Construct
  source 1..27: mol_type = other DNA
gaacttgaatctgaagggactatggat

SEQ ID NO: 29678 - DNA, 23 bp, synthetic construct
  misc_feature 1..23: note = Synthetic Construct
  source 1..23: mol_type = other DNA
gcaggctgtgagaccatgaaaac

SEQ ID NO: 29679 - DNA, 24 bp, synthetic construct
  misc_feature 1..24: note = Synthetic Construct
  source 1..24: mol_type = other DNA
caaggagacagatccttgggaaag

SEQ ID NO: 29680 - DNA, 22 bp, synthetic construct
  misc_feature 1..22: note = Synthetic Construct
  source 1..22: mol_type = other DNA
ggcaggaactcaggactcaaga

SEQ ID NO: 29681 - DNA, 22 bp, synthetic construct
  misc_feature 1..22: note = Synthetic Construct
  source 1..22: mol_type = other DNA
gccaccctccactacactccat

SEQ ID NO: 29682 - DNA, 24 bp, synthetic construct
  misc_feature 1..24: note = Synthetic Construct
  source 1..24: mol_type = other DNA
ccaagaggaactttttggcactga

SEQ ID NO: 29683 - DNA, 20 bp, synthetic construct
  misc_feature 1..20: note = Synthetic Construct
  source 1..20: mol_type = other DNA
gcccacctttggccttctct

SEQ ID NO: 29684 - DNA, 22 bp, synthetic construct
  misc_feature 1..22: note = Synthetic Construct
  source 1..22: mol_type = other DNA
ggggagaggcactgaatacctt

SEQ ID NO: 29685 - DNA, 22 bp, synthetic construct
  misc_feature 1..22: note = Synthetic Construct
  source 1..22: mol_type = other DNA
gcttacagtagatgcgggaaga

SEQ ID NO: 29686 - DNA, 23 bp, synthetic construct
  misc_feature 1..23: note = Synthetic Construct
  source 1..23: mol_type = other DNA
agctgagcatcggtaaattccaa

SEQ ID NO: 29687 - DNA, 23 bp, synthetic construct
  misc_feature 1..23: note = Synthetic Construct
  source 1..23: mol_type = other DNA
ccatggctgaccatgaactctac

SEQ ID NO: 29688 - DNA, 24 bp, synthetic construct
  misc_feature 1..24: note = Synthetic Construct
  source 1..24: mol_type = other DNA
caccagatggctgattgtctcttc

SEQ ID NO: 29689 - DNA, 24 bp, synthetic construct
  misc_feature 1..24: note = Synthetic Construct
  source 1..24: mol_type = other DNA
gcatgcctgggaggtaaagaattg

SEQ ID NO: 29690 - DNA, 22 bp, synthetic construct
  misc_feature 1..22: note = Synthetic Construct
  source 1..22: mol_type = other DNA
ctgctggggaaccagttgcata

SEQ ID NO: 29691 - DNA, 22 bp, synthetic construct
  misc_feature 1..22: note = Synthetic Construct
  source 1..22: mol_type = other DNA
ccacgcctctcagtggtagaat

SEQ ID NO: 29692 - DNA, 26 bp, synthetic construct
  misc_feature 1..26: note = Synthetic Construct
  source 1..26: mol_type = other DNA
ctggctcatatcctacgaatccatct

SEQ ID NO: 29693 - DNA, 26 bp, synthetic construct
  misc_feature 1..26: note = Synthetic Construct
  source 1..26: mol_type = other DNA
gtctacactgatttctggaacgatga

SEQ ID NO: 29694 - DNA, 30 bp, synthetic construct
  misc_feature 1..30: note = Synthetic Construct
  source 1..30: mol_type = other DNA
gcagttatcagaaacagacagagtaggtaa

SEQ ID NO: 29695 - DNA, 23 bp, synthetic construct
  misc_feature 1..23: note = Synthetic Construct
  source 1..23: mol_type = other DNA
cctgccgactcattctccctatg

SEQ ID NO: 29696 - DNA, 22 bp, synthetic construct
  misc_feature 1..22: note = Synthetic Construct
  source 1..22: mol_type = other DNA
gcccacaactcagtagccctaa

SEQ ID NO: 29697 - DNA, 23 bp, synthetic construct
  misc_feature 1..23: note = Synthetic Construct
  source 1..23: mol_type = other DNA
gcatgcaggaaagtcaaatccat

SEQ ID NO: 29698 - DNA, 22 bp, synthetic construct
  misc_feature 1..22: note = Synthetic Construct
  source 1..22: mol_type = other DNA
ccaaatttctggcctccacttg

SEQ ID NO: 29699 - DNA, 24 bp, synthetic construct
  misc_feature 1..24: note = Synthetic Construct
  source 1..24: mol_type = other DNA
tctctcacgacagcaattggttat

SEQ ID NO: 29700 - DNA, 23 bp, synthetic construct
  misc_feature 1..23: note = Synthetic Construct
  source 1..23: mol_type = other DNA
cagctgttgcccaagctttcatc

SEQ ID NO: 29701 - DNA, 23 bp, synthetic construct
  misc_feature 1..23: note = Synthetic Construct
  source 1..23: mol_type = other DNA
ggcctgtagtgggaagaagtgaa

SEQ ID NO: 29702 - DNA, 22 bp, synthetic construct
  misc_feature 1..22: note = Synthetic Construct
  source 1..22: mol_type = other DNA
ggtccaggtctgtgcaggaatc

SEQ ID NO: 29703 - DNA, 23 bp, synthetic construct
  misc_feature 1..23: note = Synthetic Construct
  source 1..23: mol_type = other DNA
ctcaacacaatgctcgtcacaca

SEQ ID NO: 29704 - DNA, 25 bp, synthetic construct
  misc_feature 1..25: note = Synthetic Construct
  source 1..25: mol_type = other DNA
cactgaatggcatggggagaaatgt

SEQ ID NO: 29705 - DNA, 20 bp, synthetic construct
  misc_feature 1..20: note = Synthetic Construct
  source 1..20: mol_type = other DNA
accacagcccctgctgactt

SEQ ID NO: 29706 - DNA, 24 bp, synthetic construct
  misc_feature 1..24: note = Synthetic Construct
  source 1..24: mol_type = other DNA
gttcagtgactctcacccacaagt

SEQ ID NO: 29707 - DNA, 24 bp, synthetic construct
  misc_feature 1..24: note = Synthetic Construct
  source 1..24: mol_type = other DNA
gccagtgactttgatgggagaaga

SEQ ID NO: 29708 - DNA, 22 bp, synthetic construct
  misc_feature 1..22: note = Synthetic Construct
  source 1..22: mol_type = other DNA
tccaaggccccttctagacttg

SEQ ID NO: 29709 - DNA, 20 bp, synthetic construct
  misc_feature 1..20: note = Synthetic Construct
  source 1..20: mol_type = other DNA
agcctcctgaggccagaaaa

SEQ ID NO: 29710 - DNA, 21 bp, synthetic construct
  misc_feature 1..21: note = Synthetic Construct
  source 1..21: mol_type = other DNA
tgtcctaagcccagtgcaaga

SEQ ID NO: 29711 - DNA, 23 bp, synthetic construct
  misc_feature 1..23: note = Synthetic Construct
  source 1..23: mol_type = other DNA
ctgcgatgtgccaagtatttgat

SEQ ID NO: 29712 - DNA, 23 bp, synthetic construct
  misc_feature 1..23: note = Synthetic Construct
  source 1..23: mol_type = other DNA
ccagtgaggaacattgcctggat

SEQ ID NO: 29713 - DNA, 20 bp, synthetic construct
  misc_feature 1..20: note = Synthetic Construct
  source 1..20: mol_type = other DNA
agccggcaggaggaggaaga

SEQ ID NO: 29714 - DNA, 24 bp, synthetic construct
  misc_feature 1..24: note = Synthetic Construct
  source 1..24: mol_type = other DNA
gacctggctgaaaagtctgtaagt

SEQ ID NO: 29715 - DNA, 21 bp, synthetic construct
  misc_feature 1..21: note = Synthetic Construct
  source 1..21: mol_type = other DNA
ggtcctaactgcccctgttca

SEQ ID NO: 29716 - DNA, 22 bp, synthetic construct
  misc_feature 1..22: note = Synthetic Construct
  source 1..22: mol_type = other DNA
gctggggaaagaggctgagtaa

SEQ ID NO: 29717 - DNA, 24 bp, synthetic construct
  misc_feature 1..24: note = Synthetic Construct
  source 1..24: mol_type = other DNA
cctttgcagtcaccaatgttttgt

SEQ ID NO: 29718 - DNA, 22 bp, synthetic construct
  misc_feature 1..22: note = Synthetic Construct
  source 1..22: mol_type = other DNA
gggttctggtgcttggggttta

SEQ ID NO: 29719 - DNA, 27 bp, synthetic construct
  misc_feature 1..27: note = Synthetic Construct
  source 1..27: mol_type = other DNA
caaggtgttaattgacctctctgttga

SEQ ID NO: 29720 - DNA, 23 bp, synthetic construct
  misc_feature 1..23: note = Synthetic Construct
  source 1..23: mol_type = other DNA
ccatgccctgggattaaggtcaa

SEQ ID NO: 29721 - DNA, 24 bp, synthetic construct
  misc_feature 1..24: note = Synthetic Construct
  source 1..24: mol_type = other DNA
ctgcaggtaacaatgcaacacaag

SEQ ID NO: 29722 - DNA, 22 bp, synthetic construct
  misc_feature 1..22: note = Synthetic Construct
  source 1..22: mol_type = other DNA
tgcaacgaactttctcctccat

SEQ ID NO: 29723 - DNA, 22 bp, synthetic construct
  misc_feature 1..22: note = Synthetic Construct
  source 1..22: mol_type = other DNA
ccttcctgggacatgaatgtga

SEQ ID NO: 29724 - DNA, 23 bp, synthetic construct
  misc_feature 1..23: note = Synthetic Construct
  source 1..23: mol_type = other DNA
cgggagggaaggggagaaattag

SEQ ID NO: 29725 - DNA, 24 bp, synthetic construct
  misc_feature 1..24: note = Synthetic Construct
  source 1..24: mol_type = other DNA
gtctctgaagtccaggctagtgat

SEQ ID NO: 29726 - DNA, 22 bp, synthetic construct
  misc_feature 1..22: note = Synthetic Construct
  source 1..22: mol_type = other DNA
gcagtgaggggcagaaattagt

SEQ ID NO: 29727 - DNA, 24 bp, synthetic construct
  misc_feature 1..24: note = Synthetic Construct
  source 1..24: mol_type = other DNA
cttcttctgactacagggcttgtt

SEQ ID NO: 29728 - DNA, 25 bp, synthetic construct
  misc_feature 1..25: note = Synthetic Construct
  source 1..25: mol_type = other DNA
tggcagactactcaaacacattttc

SEQ ID NO: 29729 - DNA, 21 bp, synthetic construct
  misc_feature 1..21: note = Synthetic Construct
  source 1..21: mol_type = other DNA
agggcccaacagtctggaaga

SEQ ID NO: 29730 - DNA, 26 bp, synthetic construct
  misc_feature 1..26: note = Synthetic Construct
  source 1..26: mol_type = other DNA
gagatgttcatgtatggcatggtttc

SEQ ID NO: 29731 - DNA, 20 bp, synthetic construct
  misc_feature 1..20: note = Synthetic Construct
  source 1..20: mol_type = other DNA
tggctgtggcaggctattct

SEQ ID NO: 29732 - DNA, 24 bp, synthetic construct
  misc_feature 1..24: note = Synthetic Construct
  source 1..24: mol_type = other DNA
ccctgaatctgaagagccaaatct

SEQ ID NO: 29733 - DNA, 21 bp, synthetic construct
  misc_feature 1..21: note = Synthetic Construct
  source 1..21: mol_type = other DNA
ggcgccctgccatacaataag

SEQ ID NO: 29734 - DNA, 22 bp, synthetic construct
  misc_feature 1..22: note = Synthetic Construct
  source 1..22: mol_type = other DNA
aacaggccgcttaagagttaca

SEQ ID NO: 29735 - DNA, 25 bp, synthetic construct
  misc_feature 1..25: note = Synthetic Construct
  source 1..25: mol_type = other DNA
ctcaaggtgacagctaattgcaaca

SEQ ID NO: 29736 - DNA, 20 bp, synthetic construct
  misc_feature 1..20: note = Synthetic Construct
  source 1..20: mol_type = other DNA
cctctcaatctgccctgcaa

SEQ ID NO: 29737 - DNA, 23 bp, synthetic construct
  misc_feature 1..23: note = Synthetic Construct
  source 1..23: mol_type = other DNA
cgggatcgtgagtaagagccaat

SEQ ID NO: 29738 - DNA, 24 bp, synthetic construct
  misc_feature 1..24: note = Synthetic Construct
  source 1..24: mol_type = other DNA
cctggccttagagaaattcacagt

SEQ ID NO: 29739 - DNA, 20 bp, synthetic construct
  misc_feature 1..20: note = Synthetic Construct
  source 1..20: mol_type = other DNA
gcgctgaagcccagcagtaa

SEQ ID NO: 29740 - DNA, 26 bp, synthetic construct
  misc_feature 1..26: note = Synthetic Construct
  source 1..26: mol_type = other DNA
gccagaatggcttgtaggttcctttg

SEQ ID NO: 29741 - DNA, 26 bp, synthetic construct
  misc_feature 1..26: note = Synthetic Construct
  source 1..26: mol_type = other DNA
gtcacttgcatccaagagtcttcatt

SEQ ID NO: 29742 - DNA, 23 bp, synthetic construct
  misc_feature 1..23: note = Synthetic Construct
  source 1..23: mol_type = other DNA
cgtctgtggtgagaagtgactgt

SEQ ID NO: 29743 - DNA, 24 bp, synthetic construct
  misc_feature 1..24: note = Synthetic Construct
  source 1..24: mol_type = other DNA
ggaagccaaatacgcacccctaac

SEQ ID NO: 29744 - DNA, 22 bp, synthetic construct
  misc_feature 1..22: note = Synthetic Construct
  source 1..22: mol_type = other DNA
gagagcatctctcaagccaaca

SEQ ID NO: 29745 - DNA, 21 bp, synthetic construct
  misc_feature 1..21: note = Synthetic Construct
  source 1..21: mol_type = other DNA
ctgcttctcccttgggaatgt

SEQ ID NO: 29746 - DNA, 22 bp, synthetic construct
  misc_feature 1..22: note = Synthetic Construct
  source 1..22: mol_type = other DNA
gcaccttgcagccttaggaact

SEQ ID NO: 29747 - DNA, 22 bp, synthetic construct
  misc_feature 1..22: note = Synthetic Construct
  source 1..22: mol_type = other DNA
actccattcccaaccctcttct

SEQ ID NO: 29748 - DNA, 23 bp, synthetic construct
  misc_feature 1..23: note = Synthetic Construct
  source 1..23: mol_type = other DNA
ggacacctgaagttccttgacat

SEQ ID NO: 29749 - DNA, 22 bp, synthetic construct
  misc_feature 1..22: note = Synthetic Construct
  source 1..22: mol_type = other DNA
gtgccaggtatgctggaagaca

SEQ ID NO: 29750 - DNA, 24 bp, synthetic construct
  misc_feature 1..24: note = Synthetic Construct
  source 1..24: mol_type = other DNA
gcttcagggtcagtgcaaggtaac

SEQ ID NO: 29751 - DNA, 25 bp, synthetic construct
  misc_feature 1..25: note = Synthetic Construct
  source 1..25: mol_type = other DNA
gcaagtccaacaattcgaagactac

SEQ ID NO: 29752 - DNA, 26 bp, synthetic construct
  misc_feature 1..26: note = Synthetic Construct
  source 1..26: mol_type = other DNA
tggaaatgctagtacctactgctcta

SEQ ID NO: 29753 - DNA, 23 bp, synthetic construct
  misc_feature 1..23: note = Synthetic Construct
  source 1..23: mol_type = other DNA
gtgggaattcagctccacataga

SEQ ID NO: 29754 - DNA, 26 bp, synthetic construct
  misc_feature 1..26: note = Synthetic Construct
  source 1..26: mol_type = other DNA
gggaagtgacatacttactgctctga

SEQ ID NO: 29755 - DNA, 22 bp, synthetic construct
  misc_feature 1..22: note = Synthetic Construct
  source 1..22: mol_type = other DNA
ccaaggtgacataggcggaaag

SEQ ID NO: 29756 - DNA, 24 bp, synthetic construct
  misc_feature 1..24: note = Synthetic Construct
  source 1..24: mol_type = other DNA
cacaaagggcaatgtcaaatgtgt

SEQ ID NO: 29757 - DNA, 25 bp, synthetic construct
  misc_feature 1..25: note = Synthetic Construct
  source 1..25: mol_type = other DNA
tgaacaatccagttgtcctcagttc

SEQ ID NO: 29758 - DNA, 24 bp, synthetic construct
  misc_feature 1..24: note = Synthetic Construct
  source 1..24: mol_type = other DNA
tgcatgatggacaaggaaggttag

SEQ ID NO: 29759 - DNA, 22 bp, synthetic construct
  misc_feature 1..22: note = Synthetic Construct
  source 1..22: mol_type = other DNA
gcccaacctggaaaggcttctt

SEQ ID NO: 29760 - DNA, 20 bp, synthetic construct
  misc_feature 1..20: note = Synthetic Construct
  source 1..20: mol_type = other DNA
gcaagcgctgaagcttggaa

SEQ ID NO: 29761 - DNA, 27 bp, synthetic construct
  misc_feature 1..27: note = Synthetic Construct
  source 1..27: mol_type = other DNA
cccaatagaagcaggtcagtacagttc

SEQ ID NO: 29762 - DNA, 24 bp, synthetic construct
  misc_feature 1..24: note = Synthetic Construct
  source 1..24: mol_type = other DNA
gcaggaatggacatgggttttagt

SEQ ID NO: 29763 - DNA, 22 bp, synthetic construct
  misc_feature 1..22: note = Synthetic Construct
  source 1..22: mol_type = other DNA
ggggagaccaaggaccactact

SEQ ID NO: 29764 - DNA, 25 bp, synthetic construct
  misc_feature 1..25: note = Synthetic Construct
  source 1..25: mol_type = other DNA
gtgatttttcccaaggtccctaaga

SEQ ID NO: 29765 - DNA, 27 bp, synthetic construct
  misc_feature 1..27: note = Synthetic Construct
  source 1..27: mol_type = other DNA
gcttatttaaggaaccaaacgggcttt

SEQ ID NO: 29766 - DNA, 22 bp, synthetic construct
  misc_feature 1..22: note = Synthetic Construct
  source 1..22: mol_type = other DNA
gtggctggcagtacagacacat

SEQ ID NO: 29767 - DNA, 25 bp, synthetic construct
  misc_feature 1..25: note = Synthetic Construct
  source 1..25: mol_type = other DNA
cagagacagaaggaaaaccagactt

SEQ ID NO: 29768 - DNA, 22 bp, synthetic construct
  misc_feature 1..22: note = Synthetic Construct
  source 1..22: mol_type = other DNA
gggaaggctcaggacatacttc

SEQ ID NO: 29769 - DNA, 26 bp, synthetic construct
  misc_feature 1..26: note = Synthetic Construct
  source 1..26: mol_type = other DNA
gagaaaggaggagctgcttatagagt

SEQ ID NO: 29770 - DNA, 26 bp, synthetic construct
  misc_feature 1..26: note = Synthetic Construct
  source 1..26: mol_type = other DNA
ctgtatcctctgaagttcccttgtgt

SEQ ID NO: 29771 - DNA, 24 bp, synthetic construct
  misc_feature 1..24: note = Synthetic Construct
  source 1..24: mol_type = other DNA
ggactcctttgaggtgtgggtctt

SEQ ID NO: 29772 - DNA, 24 bp, synthetic construct
  misc_feature 1..24: note = Synthetic Construct
  source 1..24: mol_type = other DNA
ccttgactgtgggaatgacattga

SEQ ID NO: 29773 - DNA, 22 bp, synthetic construct
  misc_feature 1..22: note = Synthetic Construct
  source 1..22: mol_type = other DNA
cctccagcacctcatcatccat

SEQ ID NO: 29774 - DNA, 23 bp, synthetic construct
  misc_feature 1..23: note = Synthetic Construct
  source 1..23: mol_type = other DNA
gtgacgtccacctgatgtcacaa

SEQ ID NO: 29775 - DNA, 24 bp, synthetic construct
  misc_feature 1..24: note = Synthetic Construct
  source 1..24: mol_type = other DNA
acagctgaggttaagctttgttca

SEQ ID NO: 29776 - DNA, 23 bp, synthetic construct
  misc_feature 1..23: note = Synthetic Construct
  source 1..23: mol_type = other DNA
ctgcctgaagctctgttcctttc

SEQ ID NO: 29777 - DNA, 22 bp, synthetic construct
  misc_feature 1..22: note = Synthetic Construct
  source 1..22: mol_type = other DNA
cctctccgactttcctgcatgt

SEQ ID NO: 29778 - DNA, 26 bp, synthetic construct
  misc_feature 1..26: note = Synthetic Construct
  source 1..26: mol_type = other DNA
gcactgggaatttgtggttaacattg

SEQ ID NO: 29779 - DNA, 25 bp, synthetic construct
  misc_feature 1..25: note = Synthetic Construct
  source 1..25: mol_type = other DNA
gggacactgtagatcagtggttaaa

SEQ ID NO: 29780 - DNA, 20 bp, synthetic construct
  misc_feature 1..20: note = Synthetic Construct
  source 1..20: mol_type = other DNA
atggcccatggggtcacagt

SEQ ID NO: 29781 - DNA, 22 bp, synthetic construct
  misc_feature 1..22: note = Synthetic Construct
  source 1..22: mol_type = other DNA
tcctgcaaggagactggaggaa

SEQ ID NO: 29782 - DNA, 25 bp, synthetic construct
  misc_feature 1..25: note = Synthetic Construct
  source 1..25: mol_type = other DNA
tgtggcaaaccatttatctggtaac

SEQ ID NO: 29783 - DNA, 26 bp, synthetic construct
  misc_feature 1..26: note = Synthetic Construct
  source 1..26: mol_type = other DNA
ccagagggtgacatattttctcatgt

SEQ ID NO: 29784 - DNA, 22 bp, synthetic construct
  misc_feature 1..22: note = Synthetic Construct
  source 1..22: mol_type = other DNA
cctttcagaggacaccctgatg

SEQ ID NO: 29785 - DNA, 23 bp, synthetic construct
  misc_feature 1..23: note = Synthetic Construct
  source 1..23: mol_type = other DNA
catggctaacagcctgggtattg

SEQ ID NO: 29786 - DNA, 26 bp, synthetic construct
  misc_feature 1..26: note = Synthetic Construct
  source 1..26: mol_type = other DNA
gactttcagtagggtaccccagattc

SEQ ID NO: 29787 - DNA, 27 bp, synthetic construct
  misc_feature 1..27: note = Synthetic Construct
  source 1..27: mol_type = other DNA
cagctgcttgctaaatactccatttgt

SEQ ID NO: 29788 - DNA, 23 bp, synthetic construct
  misc_feature 1..23: note = Synthetic Construct
  source 1..23: mol_type = other DNA
gtcctgcatctctcaccacttac

SEQ ID NO: 29789 - DNA, 26 bp, synthetic construct
  misc_feature 1..26: note = Synthetic Construct
  source 1..26: mol_type = other DNA
gtgtggaaaaggttaaggagacagaa

SEQ ID NO: 29790 - DNA, 23 bp, synthetic construct
  misc_feature 1..23: note = Synthetic Construct
  source 1..23: mol_type = other DNA
tgcctcccaagtaggatagaact

SEQ ID NO: 29791 - DNA, 22 bp, synthetic construct
  misc_feature 1..22: note = Synthetic Construct
  source 1..22: mol_type = other DNA
cccgctgaacaggttcttgagt

SEQ ID NO: 29792 - DNA, 30 bp, synthetic construct
  misc_feature 1..30: note = Synthetic Construct
  source 1..30: mol_type = other DNA
ccatctaaccatccacctcatttttcaaac

SEQ ID NO: 29793 - DNA, 24 bp, synthetic construct
  misc_feature 1..24: note = Synthetic Construct
  source 1..24: mol_type = other DNA
ccagagcactcctctcccaaaaag

SEQ ID NO: 29794 - DNA, 25 bp, synthetic construct
  misc_feature 1..25: note = Synthetic Construct
  source 1..25: mol_type = other DNA
cttctcagtctgtatgcctgactct

SEQ ID NO: 29795 - DNA, 24 bp, synthetic construct
  misc_feature 1..24: note = Synthetic Construct
  source 1..24: mol_type = other DNA
gtattaccgcaaagggagcaaatg

SEQ ID NO: 29796 - DNA, 28 bp, synthetic construct
  misc_feature 1..28: note = Synthetic Construct
  source 1..28: mol_type = other DNA
ccagtatccactctaacagtcaaaggaa

SEQ ID NO: 29797 - DNA, 23 bp, synthetic construct
  misc_feature 1..23: note = Synthetic Construct
  source 1..23: mol_type = other DNA
ctgcacactgttggcaatgactt

SEQ ID NO: 29798 - DNA, 22 bp, synthetic construct
  misc_feature 1..22: note = Synthetic Construct
  source 1..22: mol_type = other DNA
aacccaggagcctcagagatga

SEQ ID NO: 29799 - DNA, 29 bp, synthetic construct
  misc_feature 1..29: note = Synthetic Construct
  source 1..29: mol_type = other DNA
cagatccacaaaatcaggtctcacctatc

SEQ ID NO: 29800 - DNA, 23 bp, synthetic construct
  misc_feature 1..23: note = Synthetic Construct
  source 1..23: mol_type = other DNA
ggaaagaaaagggtgctctggat

SEQ ID NO: 29801 - DNA, 24 bp, synthetic construct
  misc_feature 1..24: note = Synthetic Construct
  source 1..24: mol_type = other DNA
ggacagatcctgcctgtaccattg

SEQ ID NO: 29802 - DNA, 24 bp, synthetic construct
  misc_feature 1..24: note = Synthetic Construct
  source 1..24: mol_type = other DNA
ctgtaactcccatcgtagccttct

SEQ ID NO: 29803 - DNA, 23 bp, synthetic construct
  misc_feature 1..23: note = Synthetic Construct
  source 1..23: mol_type = other DNA
ggggagaagaaagggaggacaaa

SEQ ID NO: 29804 - DNA, 23 bp, synthetic construct
  misc_feature 1..23: note = Synthetic Construct
  source 1..23: mol_type = other DNA
gtgatgcacaaaaacaggcacaa

SEQ ID NO: 29805 - DNA, 20 bp, synthetic construct
  misc_feature 1..20: note = Synthetic Construct
  source 1..20: mol_type = other DNA
cagggcctcctgacctgttc

SEQ ID NO: 29806 - DNA, 24 bp, synthetic construct
  misc_feature 1..24: note = Synthetic Construct
  source 1..24: mol_type = other DNA
acttcatccctcgagttgtgtatc

SEQ ID NO: 29807 - DNA, 18 bp, synthetic construct
  misc_feature 1..18: note = Synthetic Construct
  source 1..18: mol_type = other DNA
aacgtggccaggccttca

SEQ ID NO: 29808 - DNA, 28 bp, synthetic construct
  misc_feature 1..28: note = Synthetic Construct
  source 1..28: mol_type = other DNA
gcagcgtgaaaacggactaatacaaaac

SEQ ID NO: 29809 - DNA, 24 bp, synthetic construct
  misc_feature 1..24: note = Synthetic Construct
  source 1..24: mol_type = other DNA
ctgcattgtgaggacacagcattc

SEQ ID NO: 29810 - DNA, 26 bp, synthetic construct
  misc_feature 1..26: note = Synthetic Construct
  source 1..26: mol_type = other DNA
ggatatcagtttgtttcccaggcttt

SEQ ID NO: 29811 - DNA, 22 bp, synthetic construct
  misc_feature 1..22: note = Synthetic Construct
  source 1..22: mol_type = other DNA
tccttctcccctgtctgtgaag

SEQ ID NO: 29812 - DNA, 27 bp, synthetic construct
  misc_feature 1..27: note = Synthetic Construct
  source 1..27: mol_type = other DNA
ggagatgagactgaaaataggtaggtt

SEQ ID NO: 29813 - DNA, 25 bp, synthetic construct
  misc_feature 1..25: note = Synthetic Construct
  source 1..25: mol_type = other DNA
gcctaggattcttcgcaagcaggta

SEQ ID NO: 29814 - DNA, 21 bp, synthetic construct
  misc_feature 1..21: note = Synthetic Construct
  source 1..21: mol_type = other DNA
tcggtagctgtgggaggtaga

SEQ ID NO: 29815 - DNA, 22 bp, synthetic construct
  misc_feature 1..22: note = Synthetic Construct
  source 1..22: mol_type = other DNA
ccttggcacctccaaatactct

SEQ ID NO: 29816 - DNA, 26 bp, synthetic construct
  misc_feature 1..26: note = Synthetic Construct
  source 1..26: mol_type = other DNA
gaaatggagccattaggtaaggtgtt

SEQ ID NO: 29817 - DNA, 23 bp, synthetic construct
  misc_feature 1..23: note = Synthetic Construct
  source 1..23: mol_type = other DNA
gctggcataggtagccaggaaac

SEQ ID NO: 29818 - DNA, 22 bp, synthetic construct
  misc_feature 1..22: note = Synthetic Construct
  source 1..22: mol_type = other DNA
aggggacaggtgagccagaaat

SEQ ID NO: 29819 - DNA, 21 bp, synthetic construct
  misc_feature 1..21: note = Synthetic Construct
  source 1..21: mol_type = other DNA
ttgctgggctgtgggcacttc

SEQ ID NO: 29820 - DNA, 21 bp, synthetic construct
  misc_feature 1..21: note = Synthetic Construct
  source 1..21: mol_type = other DNA
ggggatccacatggtgaatgt

SEQ ID NO: 29821 - DNA, 22 bp, synthetic construct
  misc_feature 1..22: note = Synthetic Construct
  source 1..22: mol_type = other DNA
tccaccagtcagccaagactca

SEQ ID NO: 29822 - DNA, 21 bp, synthetic construct
  misc_feature 1..21: note = Synthetic Construct
  source 1..21: mol_type = other DNA
tcccaactgcttgttgaggtt

SEQ ID NO: 29823 - DNA, 23 bp, synthetic construct
  misc_feature 1..23: note = Synthetic Construct
  source 1..23: mol_type = other DNA
ggaagccatgactaggctacagt

SEQ ID NO: 29824 - DNA, 22 bp, synthetic construct
  misc_feature 1..22: note = Synthetic Construct
  source 1..22: mol_type = other DNA
cgcaggcatgtctccgttatag

SEQ ID NO: 29825 - DNA, 20 bp, synthetic construct
  misc_feature 1..20: note = Synthetic Construct
  source 1..20: mol_type = other DNA
ccaatgccagggacacttct

SEQ ID NO: 29826 - DNA, 25 bp, synthetic construct
  misc_feature 1..25: note = Synthetic Construct
  source 1..25: mol_type = other DNA
ctagctgttcctccaaagagtaagt

SEQ ID NO: 29827 - DNA, 25 bp, synthetic construct
  misc_feature 1..25: note = Synthetic Construct
  source 1..25: mol_type = other DNA
ggtgattgtatgggaagcggaatct

SEQ ID NO: 29828 - DNA, 23 bp, synthetic construct
  misc_feature 1..23: note = Synthetic Construct
  source 1..23: mol_type = other DNA
cacaattgcctctttggcagttc

SEQ ID NO: 29829 - DNA, 22 bp, synthetic construct
  misc_feature 1..22: note = Synthetic Construct
  source 1..22: mol_type = other DNA
ccaccttgcccagtgaagaagt

SEQ ID NO: 29830 - DNA, 21 bp, synthetic construct
  misc_feature 1..21: note = Synthetic Construct
  source 1..21: mol_type = other DNA
tgcaacctggtagctcagagt

SEQ ID NO: 29831 - DNA, 24 bp, synthetic construct
  misc_feature 1..24: note = Synthetic Construct
  source 1..24: mol_type = other DNA
ggtagatcagccttcactgtgtgt

SEQ ID NO: 29832 - DNA, 20 bp, synthetic construct
  misc_feature 1..20: note = Synthetic Construct
  source 1..20: mol_type = other DNA
gcaccatggcaggtccagaa

SEQ ID NO: 29833 - DNA, 20 bp, synthetic construct
  misc_feature 1..20: note = Synthetic Construct
  source 1..20: mol_type = other DNA
ggtggtgcaaactggtgcta

SEQ ID NO: 29834 - DNA, 22 bp, synthetic construct
  misc_feature 1..22: note = Synthetic Construct
  source 1..22: mol_type = other DNA
cctgcctttgccatgtccagat

SEQ ID NO: 29835 - DNA, 25 bp, synthetic construct
  misc_feature 1..25: note = Synthetic Construct
  source 1..25: mol_type = other DNA
gtgtttctcacaatgttcggtgctt

SEQ ID NO: 29836 - DNA, 23 bp, synthetic construct
  misc_feature 1..23: note = Synthetic Construct
  source 1..23: mol_type = other DNA
cccagtgcaaggaaagggtaatg

SEQ ID NO: 29837 - DNA, 23 bp, synthetic construct
  misc_feature 1..23: note = Synthetic Construct
  source 1..23: mol_type = other DNA
accttgcacatagttgcatgttg

SEQ ID NO: 29838 - DNA, 22 bp, synthetic construct
  misc_feature 1..22: note = Synthetic Construct
  source 1..22: mol_type = other DNA
gaggaagcaagggagctgtact

SEQ ID NO: 29839 - DNA, 25 bp, synthetic construct
  misc_feature 1..25: note = Synthetic Construct
  source 1..25: mol_type = other DNA
gctaggttactgtatgcccttgaac

SEQ ID NO: 29840 - DNA, 27 bp, synthetic construct
  misc_feature 1..27: note = Synthetic Construct
  source 1..27: mol_type = other DNA
gaccttttcactaacactggtgagact

SEQ ID NO: 29841 - DNA, 21 bp, synthetic construct
  misc_feature 1..21: note = Synthetic Construct
  source 1..21: mol_type = other DNA
gcctttccagctctctgttct

SEQ ID NO: 29842 - DNA, 23 bp, synthetic construct
  misc_feature 1..23: note = Synthetic Construct
  source 1..23: mol_type = other DNA
tgtgcagttagaagggagacaag

SEQ ID NO: 29843 - DNA, 24 bp, synthetic construct
  misc_feature 1..24: note = Synthetic Construct
  source 1..24: mol_type = other DNA
catcctgttttctccctccattca

SEQ ID NO: 29844 - DNA, 25 bp, synthetic construct
  misc_feature 1..25: note = Synthetic Construct
  source 1..25: mol_type = other DNA
tggtgaggtatagtggaagttcagt

SEQ ID NO: 29845 - DNA, 26 bp, synthetic construct
  misc_feature 1..26: note = Synthetic Construct
  source 1..26: mol_type = other DNA
ggtatctggagaatgacttgttccaa

SEQ ID NO: 29846 - DNA, 24 bp, synthetic construct
  misc_feature 1..24: note = Synthetic Construct
  source 1..24: mol_type = other DNA
gcttcggtaatgcttcaggtgtga

SEQ ID NO: 29847 - DNA, 20 bp, synthetic construct
  misc_feature 1..20: note = Synthetic Construct
  source 1..20: mol_type = other DNA
gcgccagggacaatttcaga

SEQ ID NO: 29848 - DNA, 21 bp, synthetic construct
  misc_feature 1..21: note = Synthetic Construct
  source 1..21: mol_type = other DNA
gcctgtcagtcacatgcttct

SEQ ID NO: 29849 - DNA, 25 bp, synthetic construct
  misc_feature 1..25: note = Synthetic Construct
  source 1..25: mol_type = other DNA
ggacaatgatggagaaatccctgta

SEQ ID NO: 29850 - DNA, 27 bp, synthetic construct
  misc_feature 1..27: note = Synthetic Construct
  source 1..27: mol_type = other DNA
ggcccaaataacaggaagtgccataat

SEQ ID NO: 29851 - DNA, 21 bp, synthetic construct
  misc_feature 1..21: note = Synthetic Construct
  source 1..21: mol_type = other DNA
ttgggctcgtggtctgcttct

SEQ ID NO: 29852 - DNA, 28 bp, synthetic construct
  misc_feature 1..28: note = Synthetic Construct
  source 1..28: mol_type = other DNA
ggctagtgacagaagtgttcctataatg

SEQ ID NO: 29853 - DNA, 25 bp, synthetic construct
  misc_feature 1..25: note = Synthetic Construct
  source 1..25: mol_type = other DNA
gagggttcaaactgacagcaggatt

SEQ ID NO: 29854 - DNA, 21 bp, synthetic construct
  misc_feature 1..21: note = Synthetic Construct
  source 1..21: mol_type = other DNA
gggctccaaaagcaacacact

SEQ ID NO: 29855 - DNA, 23 bp, synthetic construct
  misc_feature 1..23: note = Synthetic Construct
  source 1..23: mol_type = other DNA
tccacaggctaagggtagaagaa

SEQ ID NO: 29856 - DNA, 25 bp, synthetic construct
  misc_feature 1..25: note = Synthetic Construct
  source 1..25: mol_type = other DNA
ctgagcatcaagcttgtccttcttc

SEQ ID NO: 29857 - DNA, 25 bp, synthetic construct
  misc_feature 1..25: note = Synthetic Construct
  source 1..25: mol_type = other DNA
ccaggctgggacctaatttcagcta

SEQ ID NO: 29858 - DNA, 24 bp, synthetic construct
  misc_feature 1..24: note = Synthetic Construct
  source 1..24: mol_type = other DNA
gagagacctgagaaaccccgaatc

SEQ ID NO: 29859 - DNA, 21 bp, synthetic construct
  misc_feature 1..21: note = Synthetic Construct
  source 1..21: mol_type = other DNA
agctgagagcagtctctggat

SEQ ID NO: 29860 - DNA, 27 bp, synthetic construct
  misc_feature 1..27: note = Synthetic Construct
  source 1..27: mol_type = other DNA
ggttgtagtcatgataactgtgtgcat

SEQ ID NO: 29861 - DNA, 20 bp, synthetic construct
  misc_feature 1..20: note = Synthetic Construct
  source 1..20: mol_type = other DNA
aggagcaaggcgcaagcaat

SEQ ID NO: 29862 - DNA, 25 bp, synthetic construct
  misc_feature 1..25: note = Synthetic Construct
  source 1..25: mol_type = other DNA
ctcagagaataagaggtggctttca

SEQ ID NO: 29863 - DNA, 24 bp, synthetic construct
  misc_feature 1..24: note = Synthetic Construct
  source 1..24: mol_type = other DNA
ctctgacctcagacatgcaggatt

SEQ ID NO: 29864 - DNA, 26 bp, synthetic construct
  misc_feature 1..26: note = Synthetic Construct
  source 1..26: mol_type = other DNA
ggcagacaggatattttaacgcttgt

SEQ ID NO: 29865 - DNA, 23 bp, synthetic construct
  misc_feature 1..23: note = Synthetic Construct
  source 1..23: mol_type = other DNA
gcagaacccctacaaagaaggta

SEQ ID NO: 29866 - DNA, 28 bp, synthetic construct
  misc_feature 1..28: note = Synthetic Construct
  source 1..28: mol_type = other DNA
gctaatgactggacagagatttccttag

SEQ ID NO: 29867 - DNA, 23 bp, synthetic construct
  misc_feature 1..23: note = Synthetic Construct
  source 1..23: mol_type = other DNA
gcttagcgtggtttaggcgaatg

SEQ ID NO: 29868 - DNA, 23 bp, synthetic construct
  misc_feature 1..23: note = Synthetic Construct
  source 1..23: mol_type = other DNA
tccatggggagtgaagtgatctt

SEQ ID NO: 29869 - DNA, 26 bp, synthetic construct
  misc_feature 1..26: note = Synthetic Construct
  source 1..26: mol_type = other DNA
gatgaagtggggatggttgcaataaa

SEQ ID NO: 29870 - DNA, 25 bp, synthetic construct
  misc_feature 1..25: note = Synthetic Construct
  source 1..25: mol_type = other DNA
cccagtctctctgtctgttttcaag

SEQ ID NO: 29871 - DNA, 23 bp, synthetic construct
  misc_feature 1..23: note = Synthetic Construct
  source 1..23: mol_type = other DNA
ggtctgaaggccgtatcagttct

SEQ ID NO: 29872 - DNA, 26 bp, synthetic construct
  misc_feature 1..26: note = Synthetic Construct
  source 1..26: mol_type = other DNA
ccagcaagtttgcacaagacatttca

SEQ ID NO: 29873 - DNA, 22 bp, synthetic construct
  misc_feature 1..22: note = Synthetic Construct
  source 1..22: mol_type = other DNA
ccctctctagctccttcacaca

SEQ ID NO: 29874 - DNA, 24 bp, synthetic construct
  misc_feature 1..24: note = Synthetic Construct
  source 1..24: mol_type = other DNA
gagtgaaccttgccttacctttct

SEQ ID NO: 29875 - DNA, 22 bp, synthetic construct
  misc_feature 1..22: note = Synthetic Construct
  source 1..22: mol_type = other DNA
gagggcgaaggggaagttttgt

SEQ ID NO: 29876 - DNA, 22 bp, synthetic construct
  misc_feature 1..22: note = Synthetic Construct
  source 1..22: mol_type = other DNA
cagagtgccatgcattgtggta

SEQ ID NO: 29877 - DNA, 22 bp, synthetic construct
  misc_feature 1..22: note = Synthetic Construct
  source 1..22: mol_type = other DNA
gtccacctcccatgggtcataa

SEQ ID NO: 29878 - DNA, 25 bp, synthetic construct
  misc_feature 1..25: note = Synthetic Construct
  source 1..25: mol_type = other DNA
cctgaaagggttaatcagcttccat

SEQ ID NO: 29879 - DNA, 24 bp, synthetic construct
  misc_feature 1..24: note = Synthetic Construct
  source 1..24: mol_type = other DNA
ggactagcagatggaacaaacaca

SEQ ID NO: 29880 - DNA, 25 bp, synthetic construct
  misc_feature 1..25: note = Synthetic Construct
  source 1..25: mol_type = other DNA
ggtgattatgggcagccatacattg

SEQ ID NO: 29881 - DNA, 25 bp, synthetic construct
  misc_feature 1..25: note = Synthetic Construct
  source 1..25: mol_type = other DNA
agaatgtcacagaagagggagaaac

SEQ ID NO: 29882 - DNA, 26 bp, synthetic construct
  misc_feature 1..26: note = Synthetic Construct
  source 1..26: mol_type = other DNA
ctgtttccctcaaccaagacagaaca

SEQ ID NO: 29883 - DNA, 22 bp, synthetic construct
  misc_feature 1..22: note = Synthetic Construct
  source 1..22: mol_type = other DNA
tccaggtccctgttggagatgt

SEQ ID NO: 29884 - DNA, 22 bp, synthetic construct
  misc_feature 1..22: note = Synthetic Construct
  source 1..22: mol_type = other DNA
ccactgccccatttttcacatc

SEQ ID NO: 29885 - DNA, 22 bp, synthetic construct
  misc_feature 1..22: note = Synthetic Construct
  source 1..22: mol_type = other DNA
gcttgtcaacaaagccggaaca

SEQ ID NO: 29886 - DNA, 24 bp, synthetic construct
  misc_feature 1..24: note = Synthetic Construct
  source 1..24: mol_type = other DNA
tgtaacaagggccatgaagacaag

SEQ ID NO: 29887 - DNA, 22 bp, synthetic construct
  misc_feature 1..22: note = Synthetic Construct
  source 1..22: mol_type = other DNA
ccctccaccactggcatgtaaa

SEQ ID NO: 29888 - DNA, 22 bp, synthetic construct
  misc_feature 1..22: note = Synthetic Construct
  source 1..22: mol_type = other DNA
gccactggctctatcccctaga

SEQ ID NO: 29889 - DNA, 23 bp, synthetic construct
  misc_feature 1..23: note = Synthetic Construct
  source 1..23: mol_type = other DNA
caaatgtcagaccctggagaaca

SEQ ID NO: 29890 - DNA, 25 bp, synthetic construct
  misc_feature 1..25: note = Synthetic Construct
  source 1..25: mol_type = other DNA
gtcactaactacaggtgagcagcaa

SEQ ID NO: 29891 - DNA, 20 bp, synthetic construct
  misc_feature 1..20: note = Synthetic Construct
  source 1..20: mol_type = other DNA
gcatgcctgcaggagagatt

SEQ ID NO: 29892 - DNA, 27 bp, synthetic construct
  misc_feature 1..27: note = Synthetic Construct
  source 1..27: mol_type = other DNA
caagctctgctattagaggaatctgaa

SEQ ID NO: 29893 - DNA, 24 bp, synthetic construct
  misc_feature 1..24: note = Synthetic Construct
  source 1..24: mol_type = other DNA
ctctgggcagggaatctctgaaag

SEQ ID NO: 29894 - DNA, 24 bp, synthetic construct
  misc_feature 1..24: note = Synthetic Construct
  source 1..24: mol_type = other DNA
gcacggtaagaaaatgaggcttag

SEQ ID NO: 29895 - DNA, 27 bp, synthetic construct
  misc_feature 1..27: note = Synthetic Construct
  source 1..27: mol_type = other DNA
ccttggatttcaaagccttctgatctt

SEQ ID NO: 29896 - DNA, 24 bp, synthetic construct
  misc_feature 1..24: note = Synthetic Construct
  source 1..24: mol_type = other DNA
aggacacaggctaaaatcacaaca

SEQ ID NO: 29897 - DNA, 23 bp, synthetic construct
  misc_feature 1..23: note = Synthetic Construct
  source 1..23: mol_type = other DNA
gcttgagcgctgagtgcttcatt

SEQ ID NO: 29898 - DNA, 28 bp, synthetic construct
  misc_feature 1..28: note = Synthetic Construct
  source 1..28: mol_type = other DNA
cccatgtgtctggaaaccaatgacataa

SEQ ID NO: 29899 - DNA, 22 bp, synthetic construct
  misc_feature 1..22: note = Synthetic Construct
  source 1..22: mol_type = other DNA
ggaccacacaaatcctgtgact

SEQ ID NO: 29900 - DNA, 24 bp, synthetic construct
  misc_feature 1..24: note = Synthetic Construct
  source 1..24: mol_type = other DNA
aactagagcttcccaggagaaaag

SEQ ID NO: 29901 - DNA, 21 bp, synthetic construct
  misc_feature 1..21: note = Synthetic Construct
  source 1..21: mol_type = other DNA
agcctagtctcccaactgcaa

SEQ ID NO: 29902 - DNA, 21 bp, synthetic construct
  misc_feature 1..21: note = Synthetic Construct
  source 1..21: mol_type = other DNA
tgcctggaggggaggagtatc

SEQ ID NO: 29903 - DNA, 22 bp, synthetic construct
  misc_feature 1..22: note = Synthetic Construct
  source 1..22: mol_type = other DNA
ggccaccaagtccactgagaaa

SEQ ID NO: 29904 - DNA, 25 bp, synthetic construct
  misc_feature 1..25: note = Synthetic Construct
  source 1..25: mol_type = other DNA
caggtgttcagcaaattcctctttg

SEQ ID NO: 29905 - DNA, 22 bp, synthetic construct
  misc_feature 1..22: note = Synthetic Construct
  source 1..22: mol_type = other DNA
cctggcgtcgatatcacggttt

SEQ ID NO: 29906 - DNA, 24 bp, synthetic construct
  misc_feature 1..24: note = Synthetic Construct
  source 1..24: mol_type = other DNA
agaggctctgtagagttcagactt

SEQ ID NO: 29907 - DNA, 23 bp, synthetic construct
  misc_feature 1..23: note = Synthetic Construct
  source 1..23: mol_type = other DNA
agggtgaggtaccatctttccat

SEQ ID NO: 29908 - DNA, 23 bp, synthetic construct
  misc_feature 1..23: note = Synthetic Construct
  source 1..23: mol_type = other DNA
cctcatggccagtttttctcctt

SEQ ID NO: 29909 - DNA, 19 bp, synthetic construct
  misc_feature 1..19: note = Synthetic Construct
  source 1..19: mol_type = other DNA
gcaaggcgcctccgtaaga

SEQ ID NO: 29910 - DNA, 28 bp, synthetic construct
  misc_feature 1..28: note = Synthetic Construct
  source 1..28: mol_type = other DNA
gagatactccaaagctctttccttctac

SEQ ID NO: 29911 - DNA, 20 bp, synthetic construct
  misc_feature 1..20: note = Synthetic Construct
  source 1..20: mol_type = other DNA
agagcagcgtggagaagtga

SEQ ID NO: 29912 - DNA, 25 bp, synthetic construct
  misc_feature 1..25: note = Synthetic Construct
  source 1..25: mol_type = other DNA
agagaaacctgttgtgctcttactt

SEQ ID NO: 29913 - DNA, 25 bp, synthetic construct
  misc_feature 1..25: note = Synthetic Construct
  source 1..25: mol_type = other DNA
ggaatgctcccactgaatgatgaac

SEQ ID NO: 29914 - DNA, 21 bp, synthetic construct
  misc_feature 1..21: note = Synthetic Construct
  source 1..21: mol_type = other DNA
gccatccaagcagtcttgaca

SEQ ID NO: 29915 - DNA, 22 bp, synthetic construct
  misc_feature 1..22: note = Synthetic Construct
  source 1..22: mol_type = other DNA
gtggtgtgttccgctacctagt

SEQ ID NO: 29916 - DNA, 25 bp, synthetic construct
  misc_feature 1..25: note = Synthetic Construct
  source 1..25: mol_type = other DNA
gactacaggattcggagagggaaac

SEQ ID NO: 29917 - DNA, 24 bp, synthetic construct
  misc_feature 1..24: note = Synthetic Construct
  source 1..24: mol_type = other DNA
agaatcaaggtggcttcagacttc

SEQ ID NO: 29918 - DNA, 22 bp, synthetic construct
  misc_feature 1..22: note = Synthetic Construct
  source 1..22: mol_type = other DNA
ccagtgcctggctaagtgtcaa

SEQ ID NO: 29919 - DNA, 21 bp, synthetic construct
  misc_feature 1..21: note = Synthetic Construct
  source 1..21: mol_type = other DNA
tccttccctccacgggattct

SEQ ID NO: 29920 - DNA, 22 bp, synthetic construct
  misc_feature 1..22: note = Synthetic Construct
  source 1..22: mol_type = other DNA
ccccacaggtccctaagatgat

SEQ ID NO: 29921 - DNA, 22 bp, synthetic construct
  misc_feature 1..22: note = Synthetic Construct
  source 1..22: mol_type = other DNA
gggcctgtctgcaatctctttg

SEQ ID NO: 29922 - DNA, 22 bp, synthetic construct
  misc_feature 1..22: note = Synthetic Construct
  source 1..22: mol_type = other DNA
ccctgtcaccagcaggttcaaa

SEQ ID NO: 29923 - DNA, 22 bp, synthetic construct
  misc_feature 1..22: note = Synthetic Construct
  source 1..22: mol_type = other DNA
ctctgaggacagacacggtaag

SEQ ID NO: 29924 - DNA, 22 bp, synthetic construct
  misc_feature 1..22: note = Synthetic Construct
  source 1..22: mol_type = other DNA
cctgacagcctacgtgcaaaag

SEQ ID NO: 29925 - DNA, 24 bp, synthetic construct
  misc_feature 1..24: note = Synthetic Construct
  source 1..24: mol_type = other DNA
gctgagaaacctcgaccttctatg

SEQ ID NO: 29926 - DNA, 22 bp, synthetic construct
  misc_feature 1..22: note = Synthetic Construct
  source 1..22: mol_type = other DNA
ggtctatgcatgctaggcaact

SEQ ID NO: 29927 - DNA, 24 bp, synthetic construct
  misc_feature 1..24: note = Synthetic Construct
  source 1..24: mol_type = other DNA
gatgccaattgaacacggaagtct

SEQ ID NO: 29928 - DNA, 24 bp, synthetic construct
  misc_feature 1..24: note = Synthetic Construct
  source 1..24: mol_type = other DNA
ctgagagcagttaccttcctcttt

SEQ ID NO: 29929 - DNA, 21 bp, synthetic construct
  misc_feature 1..21: note = Synthetic Construct
  source 1..21: mol_type = other DNA
gacctcgccactttcttggat

SEQ ID NO: 29930 - DNA, 26 bp, synthetic construct
  misc_feature 1..26: note = Synthetic Construct
  source 1..26: mol_type = other DNA
cagtgtccatctgtgaacttctatct

SEQ ID NO: 29931 - DNA, 19 bp, synthetic construct
  misc_feature 1..19: note = Synthetic Construct
  source 1..19: mol_type = other DNA
ttgcttggtgcgcccatct

SEQ ID NO: 29932 - DNA, 26 bp, synthetic construct
  misc_feature 1..26: note = Synthetic Construct
  source 1..26: mol_type = other DNA
gttagagctggaacagactttagaga

SEQ ID NO: 29933 - DNA, 23 bp, synthetic construct
  misc_feature 1..23: note = Synthetic Construct
  source 1..23: mol_type = other DNA
cagcatcgactgtgatggtttac

SEQ ID NO: 29934 - DNA, 23 bp, synthetic construct
  misc_feature 1..23: note = Synthetic Construct
  source 1..23: mol_type = other DNA
gtcatttccttaggtgggtgcaa

SEQ ID NO: 29935 - DNA, 21 bp, synthetic construct
  misc_feature 1..21: note = Synthetic Construct
  source 1..21: mol_type = other DNA
cacgtgacccagtggaaaaac

SEQ ID NO: 29936 - DNA, 20 bp, synthetic construct
  misc_feature 1..20: note = Synthetic Construct
  source 1..20: mol_type = other DNA
aagcacggggctgagaagat

SEQ ID NO: 29937 - DNA, 24 bp, synthetic construct
  misc_feature 1..24: note = Synthetic Construct
  source 1..24: mol_type = other DNA
tgtgacaagaaacatgggtacagt

SEQ ID NO: 29938 - DNA, 26 bp, synthetic construct
  misc_feature 1..26: note = Synthetic Construct
  source 1..26: mol_type = other DNA
gggaagagctaggattttccccatct

SEQ ID NO: 29939 - DNA, 19 bp, synthetic construct
  misc_feature 1..19: note = Synthetic Construct
  source 1..19: mol_type = other DNA
gggcagccaccttgtgaac

SEQ ID NO: 29940 - DNA, 21 bp, synthetic construct
  misc_feature 1..21: note = Synthetic Construct
  source 1..21: mol_type = other DNA
acgtaggagctccacaaccta

SEQ ID NO: 29941 - DNA, 23 bp, synthetic construct
  misc_feature 1..23: note = Synthetic Construct
  source 1..23: mol_type = other DNA
tctcccagttcagaccaagttga

SEQ ID NO: 29942 - DNA, 26 bp, synthetic construct
  misc_feature 1..26: note = Synthetic Construct
  source 1..26: mol_type = other DNA
cagtcggagtaagtttcctcaacgat

SEQ ID NO: 29943 - DNA, 23 bp, synthetic construct
  misc_feature 1..23: note = Synthetic Construct
  source 1..23: mol_type = other DNA
caaaccagtccttccaagcctta

SEQ ID NO: 29944 - DNA, 24 bp, synthetic construct
  misc_feature 1..24: note = Synthetic Construct
  source 1..24: mol_type = other DNA
gtggctcaacacggtagatgtttg

SEQ ID NO: 29945 - DNA, 25 bp, synthetic construct
  misc_feature 1..25: note = Synthetic Construct
  source 1..25: mol_type = other DNA
ccccattcacatctctgctcttttc

SEQ ID NO: 29946 - DNA, 24 bp, synthetic construct
  misc_feature 1..24: note = Synthetic Construct
  source 1..24: mol_type = other DNA
ccgtgtgttgtgagcatgaaggtt

SEQ ID NO: 29947 - DNA, 21 bp, synthetic construct
  misc_feature 1..21: note = Synthetic Construct
  source 1..21: mol_type = other DNA
caggttactcacccacagcat

SEQ ID NO: 29948 - DNA, 21 bp, synthetic construct
  misc_feature 1..21: note = Synthetic Construct
  source 1..21: mol_type = other DNA
gtgaccacccacatcatcaca

SEQ ID NO: 29949 - DNA, 25 bp, synthetic construct
  misc_feature 1..25: note = Synthetic Construct
  source 1..25: mol_type = other DNA
cagtagaaggtacagtccccaaaag

SEQ ID NO: 29950 - DNA, 23 bp, synthetic construct
  misc_feature 1..23: note = Synthetic Construct
  source 1..23: mol_type = other DNA
ggagtgactgcttctgcttgaga

SEQ ID NO: 29951 - DNA, 23 bp, synthetic construct
  misc_feature 1..23: note = Synthetic Construct
  source 1..23: mol_type = other DNA
ggagagaagtaggagtgggacat

SEQ ID NO: 29952 - DNA, 24 bp, synthetic construct
  misc_feature 1..24: note = Synthetic Construct
  source 1..24: mol_type = other DNA
gctgtcaaaagtggatttcaccat

SEQ ID NO: 29953 - DNA, 21 bp, synthetic construct
  misc_feature 1..21: note = Synthetic Construct
  source 1..21: mol_type = other DNA
tccctggacaccacgatctca

SEQ ID NO: 29954 - DNA, 21 bp, synthetic construct
  misc_feature 1..21: note = Synthetic Construct
  source 1..21: mol_type = other DNA
ccaagccctcgttctgaaagt

SEQ ID NO: 29955 - DNA, 23 bp, synthetic construct
  misc_feature 1..23: note = Synthetic Construct
  source 1..23: mol_type = other DNA
gggttggttagtcttggggaaca

SEQ ID NO: 29956 - DNA, 25 bp, synthetic construct
  misc_feature 1..25: note = Synthetic Construct
  source 1..25: mol_type = other DNA
cacagaagagagggtatgaatgtga

SEQ ID NO: 29957 - DNA, 24 bp, synthetic construct
  misc_feature 1..24: note = Synthetic Construct
  source 1..24: mol_type = other DNA
ctttgcctttgctaatgtccatgt

SEQ ID NO: 29958 - DNA, 23 bp, synthetic construct
  misc_feature 1..23: note = Synthetic Construct
  source 1..23: mol_type = other DNA
tggacagtgcagctctacacata

SEQ ID NO: 29959 - DNA, 22 bp, synthetic construct
  misc_feature 1..22: note = Synthetic Construct
  source 1..22: mol_type = other DNA
cacacatcccgcgaggggaatc

SEQ ID NO: 29960 - DNA, 24 bp, synthetic construct
  misc_feature 1..24: note = Synthetic Construct
  source 1..24: mol_type = other DNA
gcattgaacaggctcttccctaga

SEQ ID NO: 29961 - DNA, 24 bp, synthetic construct
  misc_feature 1..24: note = Synthetic Construct
  source 1..24: mol_type = other DNA
gttgctgtgaacacctgcatgaaa

SEQ ID NO: 29962 - DNA, 27 bp, synthetic construct
  misc_feature 1..27: note = Synthetic Construct
  source 1..27: mol_type = other DNA
ggctgaaaatatttcctccatggtgtt

SEQ ID NO: 29963 - DNA, 21 bp, synthetic construct
  misc_feature 1..21: note = Synthetic Construct
  source 1..21: mol_type = other DNA
gcatctccacacctccactga

SEQ ID NO: 29964 - DNA, 24 bp, synthetic construct
  misc_feature 1..24: note = Synthetic Construct
  source 1..24: mol_type = other DNA
ggccatcatagaccattcatgcta

SEQ ID NO: 29965 - DNA, 22 bp, synthetic construct
  misc_feature 1..22: note = Synthetic Construct
  source 1..22: mol_type = other DNA
gcagatggacgtgatgggtaga

SEQ ID NO: 29966 - DNA, 22 bp, synthetic construct
  misc_feature 1..22: note = Synthetic Construct
  source 1..22: mol_type = other DNA
ccccacagcattcccagtctac

SEQ ID NO: 29967 - DNA, 23 bp, synthetic construct
  misc_feature 1..23: note = Synthetic Construct
  source 1..23: mol_type = other DNA
ggacagccctctgttgtttctaa

SEQ ID NO: 29968 - DNA, 24 bp, synthetic construct
  misc_feature 1..24: note = Synthetic Construct
  source 1..24: mol_type = other DNA
gcagaagtgggagaagtctgtgtt

SEQ ID NO: 29969 - DNA, 23 bp, synthetic construct
  misc_feature 1..23: note = Synthetic Construct
  source 1..23: mol_type = other DNA
ctgtcaacagggctttcaagcta

SEQ ID NO: 29970 - DNA, 26 bp, synthetic construct
  misc_feature 1..26: note = Synthetic Construct
  source 1..26: mol_type = other DNA
ccccaacacccatgtatttgtagtga

SEQ ID NO: 29971 - DNA, 24 bp, synthetic construct
  misc_feature 1..24: note = Synthetic Construct
  source 1..24: mol_type = other DNA
cgccagtccacatcagaacacatt

SEQ ID NO: 29972 - DNA, 26 bp, synthetic construct
  misc_feature 1..26: note = Synthetic Construct
  source 1..26: mol_type = other DNA
ccctagctaaaggacactccttatca

SEQ ID NO: 29973 - DNA, 25 bp, synthetic construct
  misc_feature 1..25: note = Synthetic Construct
  source 1..25: mol_type = other DNA
caaggaaggtcaagtcttcctcagt

SEQ ID NO: 29974 - DNA, 22 bp, synthetic construct
  misc_feature 1..22: note = Synthetic Construct
  source 1..22: mol_type = other DNA
ggctgggcagagccagataata

SEQ ID NO: 29975 - DNA, 25 bp, synthetic construct
  misc_feature 1..25: note = Synthetic Construct
  source 1..25: mol_type = other DNA
aggttctggcaagtggaaataaaag

SEQ ID NO: 29976 - DNA, 24 bp, synthetic construct
  misc_feature 1..24: note = Synthetic Construct
  source 1..24: mol_type = other DNA
gccagggtcggtaactgatgtatg

SEQ ID NO: 29977 - DNA, 21 bp, synthetic construct
  misc_feature 1..21: note = Synthetic Construct
  source 1..21: mol_type = other DNA
ggccccatgctgaacagaaaa

SEQ ID NO: 29978 - DNA, 23 bp, synthetic construct
  misc_feature 1..23: note = Synthetic Construct
  source 1..23: mol_type = other DNA
aggaccagctttagtgtctgatg

SEQ ID NO: 29979 - DNA, 26 bp, synthetic construct
  misc_feature 1..26: note = Synthetic Construct
  source 1..26: mol_type = other DNA
gctggtcaaaagcatcttgcaaaaca

SEQ ID NO: 29980 - DNA, 24 bp, synthetic construct
  misc_feature 1..24: note = Synthetic Construct
  source 1..24: mol_type = other DNA
gaggaaattagtctggctgaggtt

SEQ ID NO: 29981 - DNA, 24 bp, synthetic construct
  misc_feature 1..24: note = Synthetic Construct
  source 1..24: mol_type = other DNA
gctgtaagagcctggatacgagtt

SEQ ID NO: 29982 - DNA, 25 bp, synthetic construct
  misc_feature 1..25: note = Synthetic Construct
  source 1..25: mol_type = other DNA
catgttcctacatgtctcagagcaa

SEQ ID NO: 29983 - DNA, 29 bp, synthetic construct
  misc_feature 1..29: note = Synthetic Construct
  source 1..29: mol_type = other DNA
cccagaccaaagtcttaacattcccttta

SEQ ID NO: 29984 - DNA, 22 bp, synthetic construct
  misc_feature 1..22: note = Synthetic Construct
  source 1..22: mol_type = other DNA
ctgcaaaggggaccttccaagt

SEQ ID NO: 29985 - DNA, 22 bp, synthetic construct
  misc_feature 1..22: note = Synthetic Construct
  source 1..22: mol_type = other DNA
gcccaggtggatagtcaagaca

SEQ ID NO: 29986 - DNA, 30 bp, synthetic construct
  misc_feature 1..30: note = Synthetic Construct
  source 1..30: mol_type = other DNA
gactgaaaaagtttggaaagcatggctcta

SEQ ID NO: 29987 - DNA, 30 bp, synthetic construct
  misc_feature 1..30: note = Synthetic Construct
  source 1..30: mol_type = other DNA
gggcatctgtgtatatagttcccaagtcta

SEQ ID NO: 29988 - DNA, 24 bp, synthetic construct
  misc_feature 1..24: note = Synthetic Construct
  source 1..24: mol_type = other DNA
tctcacgggaatcaccatcatttt

SEQ ID NO: 29989 - DNA, 21 bp, synthetic construct
  misc_feature 1..21: note = Synthetic Construct
  source 1..21: mol_type = other DNA
gggctgaagcaaagaccatgt

SEQ ID NO: 29990 - DNA, 25 bp, synthetic construct
  misc_feature 1..25: note = Synthetic Construct
  source 1..25: mol_type = other DNA
cctggcttagcaagaatttgtttgt

SEQ ID NO: 29991 - DNA, 21 bp, synthetic construct
  misc_feature 1..21: note = Synthetic Construct
  source 1..21: mol_type = other DNA
tgggtgggagtgcctgtaaac

SEQ ID NO: 29992 - DNA, 24 bp, synthetic construct
  misc_feature 1..24: note = Synthetic Construct
  source 1..24: mol_type = other DNA
actaatgatgtgacccacccaatc

SEQ ID NO: 29993 - DNA, 22 bp, synthetic construct
  misc_feature 1..22: note = Synthetic Construct
  source 1..22: mol_type = other DNA
gaccccgttgcctactaacaga

SEQ ID NO: 29994 - DNA, 25 bp, synthetic construct
  misc_feature 1..25: note = Synthetic Construct
  source 1..25: mol_type = other DNA
ctgtccaccactacctcgtatctca

SEQ ID NO: 29995 - DNA, 22 bp, synthetic construct
  misc_feature 1..22: note = Synthetic Construct
  source 1..22: mol_type = other DNA
cagttacgctcactggatggat

SEQ ID NO: 29996 - DNA, 23 bp, synthetic construct
  misc_feature 1..23: note = Synthetic Construct
  source 1..23: mol_type = other DNA
aaaaatgaggctctgggaagtca

SEQ ID NO: 29997 - DNA, 25 bp, synthetic construct
  misc_feature 1..25: note = Synthetic Construct
  source 1..25: mol_type = other DNA
ccaccctttctgaacttaggcatgt

SEQ ID NO: 29998 - DNA, 23 bp, synthetic construct
  misc_feature 1..23: note = Synthetic Construct
  source 1..23: mol_type = other DNA
cataggaattgccggagacatga

SEQ ID NO: 29999 - DNA, 24 bp, synthetic construct
  misc_feature 1..24: note = Synthetic Construct
  source 1..24: mol_type = other DNA
gcatttgtggctctagggtaaaac

SEQ ID NO: 30000 - DNA, 20 bp, synthetic construct
  misc_feature 1..20: note = Synthetic Construct
  source 1..20: mol_type = other DNA
tccctggcaattccccttca

SEQ ID NO: 30001 - DNA, 22 bp, synthetic construct
  misc_feature 1..22: note = Synthetic Construct
  source 1..22: mol_type = other DNA
ggccacaggtttctctgcttca

SEQ ID NO: 30002 - DNA, 22 bp, synthetic construct
  misc_feature 1..22: note = Synthetic Construct
  source 1..22: mol_type = other DNA
gagtgggagcatggatggtgat

SEQ ID NO: 30003 - DNA, 27 bp, synthetic construct
  misc_feature 1..27: note = Synthetic Construct
  source 1..27: mol_type = other DNA
ggaaatcctgctacatttcgctagtta

SEQ ID NO: 30004 - DNA, 24 bp, synthetic construct
  misc_feature 1..24: note = Synthetic Construct
  source 1..24: mol_type = other DNA
gcagggacttaatgagggcaattt

SEQ ID NO: 30005 - DNA, 23 bp, synthetic construct
  misc_feature 1..23: note = Synthetic Construct
  source 1..23: mol_type = other DNA
actcctagtcacttgcacagtct

SEQ ID NO: 30006 - DNA, 24 bp, synthetic construct
  misc_feature 1..24: note = Synthetic Construct
  source 1..24: mol_type = other DNA
gactagtgtgtctgctttgcgttt

SEQ ID NO: 30007 - DNA, 26 bp, synthetic construct
  misc_feature 1..26: note = Synthetic Construct
  source 1..26: mol_type = other DNA
gttttagccagaggctctatatccat

SEQ ID NO: 30008 - DNA, 23 bp, synthetic construct
  misc_feature 1..23: note = Synthetic Construct
  source 1..23: mol_type = other DNA
ctgctacctacagccagacttca

SEQ ID NO: 30009 - DNA, 25 bp, synthetic construct
  misc_feature 1..25: note = Synthetic Construct
  source 1..25: mol_type = other DNA
gctgttattttagctcttgctggtt

SEQ ID NO: 30010 - DNA, 25 bp, synthetic construct
  misc_feature 1..25: note = Synthetic Construct
  source 1..25: mol_type = other DNA
ggtgaagcttgtgttaagggttcaa

SEQ ID NO: 30011 - DNA, 22 bp, synthetic construct
  misc_feature 1..22: note = Synthetic Construct
  source 1..22: mol_type = other DNA
aggggcctcctgaggaaatact

SEQ ID NO: 30012 - DNA, 21 bp, synthetic construct
  misc_feature 1..21: note = Synthetic Construct
  source 1..21: mol_type = other DNA
ggaacacccgagccattctga

SEQ ID NO: 30013 - DNA, 23 bp, synthetic construct
  misc_feature 1..23: note = Synthetic Construct
  source 1..23: mol_type = other DNA
gctacctgggctgtggtatcttc

SEQ ID NO: 30014 - DNA, 26 bp, synthetic construct
  misc_feature 1..26: note = Synthetic Construct
  source 1..26: mol_type = other DNA
tctccatgacttccctctgttatttc

SEQ ID NO: 30015 - DNA, 24 bp, synthetic construct
  misc_feature 1..24: note = Synthetic Construct
  source 1..24: mol_type = other DNA
cctctgctttgacttgcttcaaat

SEQ ID NO: 30016 - DNA, 27 bp, synthetic construct
  misc_feature 1..27: note = Synthetic Construct
  source 1..27: mol_type = other DNA
gcttctctaccacatagtgtaatggtt

SEQ ID NO: 30017 - DNA, 20 bp, synthetic construct
  misc_feature 1..20: note = Synthetic Construct
  source 1..20: mol_type = other DNA
aggaacctggccccttctct

SEQ ID NO: 30018 - DNA, 21 bp, synthetic construct
  misc_feature 1..21: note = Synthetic Construct
  source 1..21: mol_type = other DNA
tgaagccccagtcctacttga

SEQ ID NO: 30019 - DNA, 24 bp, synthetic construct
  misc_feature 1..24: note = Synthetic Construct
  source 1..24: mol_type = other DNA
aagctgagaaaaacagccatcttc

SEQ ID NO: 30020 - DNA, 26 bp, synthetic construct
  misc_feature 1..26: note = Synthetic Construct
  source 1..26: mol_type = other DNA
ggcgtacactatgggaaggtaagttg

SEQ ID NO: 30021 - DNA, 24 bp, synthetic construct
  misc_feature 1..24: note = Synthetic Construct
  source 1..24: mol_type = other DNA
cagggtggacctctctgagatatt

SEQ ID NO: 30022 - DNA, 22 bp, synthetic construct
  misc_feature 1..22: note = Synthetic Construct
  source 1..22: mol_type = other DNA
gctgctgctaattcaccctgta

SEQ ID NO: 30023 - DNA, 27 bp, synthetic construct
  misc_feature 1..27: note = Synthetic Construct
  source 1..27: mol_type = other DNA
ctcatgaaaattgtgccgattgctaag

SEQ ID NO: 30024 - DNA, 21 bp, synthetic construct
  misc_feature 1..21: note = Synthetic Construct
  source 1..21: mol_type = other DNA
cagtggtcagggacagctcta

SEQ ID NO: 30025 - DNA, 22 bp, synthetic construct
  misc_feature 1..22: note = Synthetic Construct
  source 1..22: mol_type = other DNA
ggcctggccactttagtactct

SEQ ID NO: 30026 - DNA, 22 bp, synthetic construct
  misc_feature 1..22: note = Synthetic Construct
  source 1..22: mol_type = other DNA
cctgagatgaggatgggagcat

SEQ ID NO: 30027 - DNA, 22 bp, synthetic construct
  misc_feature 1..22: note = Synthetic Construct
  source 1..22: mol_type = other DNA
gcagactgaccctgtgactttc

SEQ ID NO: 30028 - DNA, 24 bp, synthetic construct
  misc_feature 1..24: note = Synthetic Construct
  source 1..24: mol_type = other DNA
tgaagaaagcatctggcatgtgaa

SEQ ID NO: 30029 - DNA, 24 bp, synthetic construct
  misc_feature 1..24: note = Synthetic Construct
  source 1..24: mol_type = other DNA
ggggagagtgagtctaggttctgt

SEQ ID NO: 30030 - DNA, 30 bp, synthetic construct
  misc_feature 1..30: note = Synthetic Construct
  source 1..30: mol_type = other DNA
gcgatagacacttttatccagctttacaca

SEQ ID NO: 30031 - DNA, 23 bp, synthetic construct
  misc_feature 1..23: note = Synthetic Construct
  source 1..23: mol_type = other DNA
ggggttgagctggtttgatatgt

SEQ ID NO: 30032 - DNA, 25 bp, synthetic construct
  misc_feature 1..25: note = Synthetic Construct
  source 1..25: mol_type = other DNA
gctgtgtctaggctttttcgtgata

SEQ ID NO: 30033 - DNA, 19 bp, synthetic construct
  misc_feature 1..19: note = Synthetic Construct
  source 1..19: mol_type = other DNA
agacggactcccggcgttt

SEQ ID NO: 30034 - DNA, 23 bp, synthetic construct
  misc_feature 1..23: note = Synthetic Construct
  source 1..23: mol_type = other DNA
cagttcacctgtctgctgaggaa

SEQ ID NO: 30035 - DNA, 27 bp, synthetic construct
  misc_feature 1..27: note = Synthetic Construct
  source 1..27: mol_type = other DNA
ccagaagtctcagaaaaggaaccatac

SEQ ID NO: 30036 - DNA, 24 bp, synthetic construct
  misc_feature 1..24: note = Synthetic Construct
  source 1..24: mol_type = other DNA
ccacagtgggcagctattctccat

SEQ ID NO: 30037 - DNA, 25 bp, synthetic construct
  misc_feature 1..25: note = Synthetic Construct
  source 1..25: mol_type = other DNA
tccataaggtggtcccttgattaac

SEQ ID NO: 30038 - DNA, 26 bp, synthetic construct
  misc_feature 1..26: note = Synthetic Construct
  source 1..26: mol_type = other DNA
cagccaactcgtaggttcaaacaatg

SEQ ID NO: 30039 - DNA, 25 bp, synthetic construct
  misc_feature 1..25: note = Synthetic Construct
  source 1..25: mol_type = other DNA
cctcctgaagctcagaatacaccaa

SEQ ID NO: 30040 - DNA, 21 bp, synthetic construct
  misc_feature 1..21: note = Synthetic Construct
  source 1..21: mol_type = other DNA
ttcggaagctgtgcatgatga

SEQ ID NO: 30041 - DNA, 27 bp, synthetic construct
  misc_feature 1..27: note = Synthetic Construct
  source 1..27: mol_type = other DNA
cccctcagtaattttacctgggattag

SEQ ID NO: 30042 - DNA, 19 bp, synthetic construct
  misc_feature 1..19: note = Synthetic Construct
  source 1..19: mol_type = other DNA
cggggcgcaggctagaaaa

SEQ ID NO: 30043 - DNA, 25 bp, synthetic construct
  misc_feature 1..25: note = Synthetic Construct
  source 1..25: mol_type = other DNA
tccacggaatcagaggatagtaagt

SEQ ID NO: 30044 - DNA, 22 bp, synthetic construct
  misc_feature 1..22: note = Synthetic Construct
  source 1..22: mol_type = other DNA
ctgcaatgtgttggctgggaat

SEQ ID NO: 30045 - DNA, 25 bp, synthetic construct
  misc_feature 1..25: note = Synthetic Construct
  source 1..25: mol_type = other DNA
cagagccttgattggacaaccctta

SEQ ID NO: 30046 - DNA, 24 bp, synthetic construct
  misc_feature 1..24: note = Synthetic Construct
  source 1..24: mol_type = other DNA
cagaacccactgctctatgagtgt

SEQ ID NO: 30047 - DNA, 23 bp, synthetic construct
  misc_feature 1..23: note = Synthetic Construct
  source 1..23: mol_type = other DNA
agtccaccatcaggaacagtaga

SEQ ID NO: 30048 - DNA, 27 bp, synthetic construct
  misc_feature 1..27: note = Synthetic Construct
  source 1..27: mol_type = other DNA
ctatcgagatattggggaagagcttta

SEQ ID NO: 30049 - DNA, 29 bp, synthetic construct
  misc_feature 1..29: note = Synthetic Construct
  source 1..29: mol_type = other DNA
gcagctctggtagataaggccatacatta

SEQ ID NO: 30050 - DNA, 22 bp, synthetic construct
  misc_feature 1..22: note = Synthetic Construct
  source 1..22: mol_type = other DNA
ggagggaatgggcgttttcaac

SEQ ID NO: 30051 - DNA, 26 bp, synthetic construct
  misc_feature 1..26: note = Synthetic Construct
  source 1..26: mol_type = other DNA
acttctcaaggacaagtgttctcttc

SEQ ID NO: 30052 - DNA, 27 bp, synthetic construct
  misc_feature 1..27: note = Synthetic Construct
  source 1..27: mol_type = other DNA
ctcttgaccacatctggaagtagaaac

SEQ ID NO: 30053 - DNA, 25 bp, synthetic construct
  misc_feature 1..25: note = Synthetic Construct
  source 1..25: mol_type = other DNA
gaccaaggaaaggttggctaatagt

SEQ ID NO: 30054 - DNA, 23 bp, synthetic construct
  misc_feature 1..23: note = Synthetic Construct
  source 1..23: mol_type = other DNA
gcctccatttcttgctggttgtt

SEQ ID NO: 30055 - DNA, 22 bp, synthetic construct
  misc_feature 1..22: note = Synthetic Construct
  source 1..22: mol_type = other DNA
agcttctcccagatgccctact

SEQ ID NO: 30056 - DNA, 21 bp, synthetic construct
  misc_feature 1..21: note = Synthetic Construct
  source 1..21: mol_type = other DNA
tgtggcagggacagaggttct

SEQ ID NO: 30057 - DNA, 23 bp, synthetic construct
  misc_feature 1..23: note = Synthetic Construct
  source 1..23: mol_type = other DNA
ggctcctaggggtggtagattgt

SEQ ID NO: 30058 - DNA, 27 bp, synthetic construct
  misc_feature 1..27: note = Synthetic Construct
  source 1..27: mol_type = other DNA
cctcatccttagtggggagtaacagat

SEQ ID NO: 30059 - DNA, 22 bp, synthetic construct
  misc_feature 1..22: note = Synthetic Construct
  source 1..22: mol_type = other DNA
tctcatctcgagacacccagaa

SEQ ID NO: 30060 - DNA, 26 bp, synthetic construct
  misc_feature 1..26: note = Synthetic Construct
  source 1..26: mol_type = other DNA
gcatgtatacttgaagcccacacaga

SEQ ID NO: 30061 - DNA, 20 bp, synthetic construct
  misc_feature 1..20: note = Synthetic Construct
  source 1..20: mol_type = other DNA
aggccatggctcttctcctt

SEQ ID NO: 30062 - DNA, 26 bp, synthetic construct
  misc_feature 1..26: note = Synthetic Construct
  source 1..26: mol_type = other DNA
gtgagatggtatctaggtcactgctt

SEQ ID NO: 30063 - DNA, 27 bp, synthetic construct
  misc_feature 1..27: note = Synthetic Construct
  source 1..27: mol_type = other DNA
ccaattgctatagccaaaagccataca

SEQ ID NO: 30064 - DNA, 23 bp, synthetic construct
  misc_feature 1..23: note = Synthetic Construct
  source 1..23: mol_type = other DNA
gctctgttcttcaggtgggaaag

SEQ ID NO: 30065 - DNA, 22 bp, synthetic construct
  misc_feature 1..22: note = Synthetic Construct
  source 1..22: mol_type = other DNA
ccgtgatgctggatcagccaat

SEQ ID NO: 30066 - DNA, 20 bp, synthetic construct
  misc_feature 1..20: note = Synthetic Construct
  source 1..20: mol_type = other DNA
tctcagggccagccccactt

SEQ ID NO: 30067 - DNA, 23 bp, synthetic construct
  misc_feature 1..23: note = Synthetic Construct
  source 1..23: mol_type = other DNA
gactgacgagaactgcaatgtgt

SEQ ID NO: 30068 - DNA, 24 bp, synthetic construct
  misc_feature 1..24: note = Synthetic Construct
  source 1..24: mol_type = other DNA
ctggcttaagcaaaaggggaattt

SEQ ID NO: 30069 - DNA, 20 bp, synthetic construct
  misc_feature 1..20: note = Synthetic Construct
  source 1..20: mol_type = other DNA
agctccctcctcatgctaca

SEQ ID NO: 30070 - DNA, 25 bp, synthetic construct
  misc_feature 1..25: note = Synthetic Construct
  source 1..25: mol_type = other DNA
tctcgaagtaggaagatcccattct

SEQ ID NO: 30071 - DNA, 22 bp, synthetic construct
  misc_feature 1..22: note = Synthetic Construct
  source 1..22: mol_type = other DNA
ccgctatgcctggcttaacttc

SEQ ID NO: 30072 - DNA, 26 bp, synthetic construct
  misc_feature 1..26: note = Synthetic Construct
  source 1..26: mol_type = other DNA
cgtgtcatttagacagccctgttttc

SEQ ID NO: 30073 - DNA, 23 bp, synthetic construct
  misc_feature 1..23: note = Synthetic Construct
  source 1..23: mol_type = other DNA
aggtgaccctatcttcagtgcta

SEQ ID NO: 30074 - DNA, 22 bp, synthetic construct
  misc_feature 1..22: note = Synthetic Construct
  source 1..22: mol_type = other DNA
ccggtcagccaaaggtcttcta

SEQ ID NO: 30075 - DNA, 22 bp, synthetic construct
  misc_feature 1..22: note = Synthetic Construct
  source 1..22: mol_type = other DNA
gggtttgagggtgtgggtttgt

SEQ ID NO: 30076 - DNA, 22 bp, synthetic construct
  misc_feature 1..22: note = Synthetic Construct
  source 1..22: mol_type = other DNA
ccgcgtcggatgaacaagaaac

SEQ ID NO: 30077 - DNA, 21 bp, synthetic construct
  misc_feature 1..21: note = Synthetic Construct
  source 1..21: mol_type = other DNA
cctccctccctatggctactt

SEQ ID NO: 30078 - DNA, 24 bp, synthetic construct
  misc_feature 1..24: note = Synthetic Construct
  source 1..24: mol_type = other DNA
ggtgcatgatttgagaggaacgaa

SEQ ID NO: 30079 - DNA, 26 bp, synthetic construct
  misc_feature 1..26: note = Synthetic Construct
  source 1..26: mol_type = other DNA
caccttttagctcagaagatgcagat

SEQ ID NO: 30080 - DNA, 24 bp, synthetic construct
  misc_feature 1..24: note = Synthetic Construct
  source 1..24: mol_type = other DNA
caaggatatggaggaccaggattc

SEQ ID NO: 30081 - DNA, 23 bp, synthetic construct
  misc_feature 1..23: note = Synthetic Construct
  source 1..23: mol_type = other DNA
ggtccatggtgttgagggaattg

SEQ ID NO: 30082 - DNA, 27 bp, synthetic construct
  misc_feature 1..27: note = Synthetic Construct
  source 1..27: mol_type = other DNA
cagctaagggaaagtcaattcaggtta

SEQ ID NO: 30083 - DNA, 21 bp, synthetic construct
  misc_feature 1..21: note = Synthetic Construct
  source 1..21: mol_type = other DNA
tgcacggggaaactcacattc

SEQ ID NO: 30084 - DNA, 24 bp, synthetic construct
  misc_feature 1..24: note = Synthetic Construct
  source 1..24: mol_type = other DNA
tgaaacgataccgcccttaaaagt

SEQ ID NO: 30085 - DNA, 24 bp, synthetic construct
  misc_feature 1..24: note = Synthetic Construct
  source 1..24: mol_type = other DNA
tgtcaccaaactttctgtgcatct

SEQ ID NO: 30086 - DNA, 21 bp, synthetic construct
  misc_feature 1..21: note = Synthetic Construct
  source 1..21: mol_type = other DNA
ccaaaaggagcatggctgtct

SEQ ID NO: 30087 - DNA, 22 bp, synthetic construct
  misc_feature 1..22: note = Synthetic Construct
  source 1..22: mol_type = other DNA
aacgcctactttccctgtcttc

SEQ ID NO: 30088 - DNA, 20 bp, synthetic construct
  misc_feature 1..20: note = Synthetic Construct
  source 1..20: mol_type = other DNA
gacaacacggctgtccacaa

SEQ ID NO: 30089 - DNA, 23 bp, synthetic construct
  misc_feature 1..23: note = Synthetic Construct
  source 1..23: mol_type = other DNA
cgaatagtgctgggaatctctga

SEQ ID NO: 30090 - DNA, 29 bp, synthetic construct
  misc_feature 1..29: note = Synthetic Construct
  source 1..29: mol_type = other DNA
gcttctgatccttggaacatttggttcat

SEQ ID NO: 30091 - DNA, 29 bp, synthetic construct
  misc_feature 1..29: note = Synthetic Construct
  source 1..29: mol_type = other DNA
ccagtaaaccttttccatgaaagcctgaa

SEQ ID NO: 30092 - DNA, 24 bp, synthetic construct
  misc_feature 1..24: note = Synthetic Construct
  source 1..24: mol_type = other DNA
tgattggctcccagaagttgtaat

SEQ ID NO: 30093 - DNA, 26 bp, synthetic construct
  misc_feature 1..26: note = Synthetic Construct
  source 1..26: mol_type = other DNA
ctctgaaagatcgtgtcttcctttgt

SEQ ID NO: 30094 - DNA, 22 bp, synthetic construct
  misc_feature 1..22: note = Synthetic Construct
  source 1..22: mol_type = other DNA
tgtcagcactgccttcaaaatg

SEQ ID NO: 30095 - DNA, 27 bp, synthetic construct
  misc_feature 1..27: note = Synthetic Construct
  source 1..27: mol_type = other DNA
ccctaaaacatgcaacctttccttatc

SEQ ID NO: 30096 - DNA, 26 bp, synthetic construct
  misc_feature 1..26: note = Synthetic Construct
  source 1..26: mol_type = other DNA
aacaaaggatacctccgggtaatatg

SEQ ID NO: 30097 - DNA, 25 bp, synthetic construct
  misc_feature 1..25: note = Synthetic Construct
  source 1..25: mol_type = other DNA
gctcaaagaggattaggctgcttca

SEQ ID NO: 30098 - DNA, 21 bp, synthetic construct
  misc_feature 1..21: note = Synthetic Construct
  source 1..21: mol_type = other DNA
cacctgcagactagcacaaga

SEQ ID NO: 30099 - DNA, 21 bp, synthetic construct
  misc_feature 1..21: note = Synthetic Construct
  source 1..21: mol_type = other DNA
cttgcttcaggccaagcaaaa

SEQ ID NO: 30100 - DNA, 25 bp, synthetic construct
  misc_feature 1..25: note = Synthetic Construct
  source 1..25: mol_type = other DNA
gtccataagggcatatgggtgtttc

SEQ ID NO: 30101 - DNA, 20 bp, synthetic construct
  misc_feature 1..20: note = Synthetic Construct
  source 1..20: mol_type = other DNA
aaccgaggggagtcccagtt

SEQ ID NO: 30102 - DNA, 22 bp, synthetic construct
  misc_feature 1..22: note = Synthetic Construct
  source 1..22: mol_type = other DNA
gccaccctggttcctcatcatt

SEQ ID NO: 30103 - DNA, 25 bp, synthetic construct
  misc_feature 1..25: note = Synthetic Construct
  source 1..25: mol_type = other DNA
ggcaggtccttaagtgagtgactgt

SEQ ID NO: 30104 - DNA, 22 bp, synthetic construct
  misc_feature 1..22: note = Synthetic Construct
  source 1..22: mol_type = other DNA
cagctcctctcctgtcccattt

SEQ ID NO: 30105 - DNA, 22 bp, synthetic construct
  misc_feature 1..22: note = Synthetic Construct
  source 1..22: mol_type = other DNA
ggcgactcgacacctgaaaact

SEQ ID NO: 30106 - DNA, 22 bp, synthetic construct
  misc_feature 1..22: note = Synthetic Construct
  source 1..22: mol_type = other DNA
tggggaaccttagagagcttgt

SEQ ID NO: 30107 - DNA, 22 bp, synthetic construct
  misc_feature 1..22: note = Synthetic Construct
  source 1..22: mol_type = other DNA
gcaggtagacgtgattcagctt

SEQ ID NO: 30108 - DNA, 26 bp, synthetic construct
  misc_feature 1..26: note = Synthetic Construct
  source 1..26: mol_type = other DNA
caggatagctccctaaggctcaaatg

SEQ ID NO: 30109 - DNA, 22 bp, synthetic construct
  misc_feature 1..22: note = Synthetic Construct
  source 1..22: mol_type = other DNA
ctccagtgccatacccagttgt

SEQ ID NO: 30110 - DNA, 28 bp, synthetic construct
  misc_feature 1..28: note = Synthetic Construct
  source 1..28: mol_type = other DNA
gctaaacaatggtgtagtcttgggatct

SEQ ID NO: 30111 - DNA, 23 bp, synthetic construct
  misc_feature 1..23: note = Synthetic Construct
  source 1..23: mol_type = other DNA
gaggcaacagcagacatccatca

SEQ ID NO: 30112 - DNA, 25 bp, synthetic construct
  misc_feature 1..25: note = Synthetic Construct
  source 1..25: mol_type = other DNA
tcggattccttgttctagacctttc

SEQ ID NO: 30113 - DNA, 22 bp, synthetic construct
  misc_feature 1..22: note = Synthetic Construct
  source 1..22: mol_type = other DNA
aggctctgtccccatgacctaa

SEQ ID NO: 30114 - DNA, 21 bp, synthetic construct
  misc_feature 1..21: note = Synthetic Construct
  source 1..21: mol_type = other DNA
atccgtgacaggccacacaac

SEQ ID NO: 30115 - DNA, 24 bp, synthetic construct
  misc_feature 1..24: note = Synthetic Construct
  source 1..24: mol_type = other DNA
ccccagcagagaggagaccatatt

SEQ ID NO: 30116 - DNA, 26 bp, synthetic construct
  misc_feature 1..26: note = Synthetic Construct
  source 1..26: mol_type = other DNA
gagatcaggacagaacaggtctaaag

SEQ ID NO: 30117 - DNA, 26 bp, synthetic construct
  misc_feature 1..26: note = Synthetic Construct
  source 1..26: mol_type = other DNA
gagtacagtcagcctcttgtttcctt

SEQ ID NO: 30118 - DNA, 25 bp, synthetic construct
  misc_feature 1..25: note = Synthetic Construct
  source 1..25: mol_type = other DNA
ccttcctcatcatggtagcatctca

SEQ ID NO: 30119 - DNA, 21 bp, synthetic construct
  misc_feature 1..21: note = Synthetic Construct
  source 1..21: mol_type = other DNA
gcagagcagcattgacgaaca

SEQ ID NO: 30120 - DNA, 18 bp, synthetic construct
  misc_feature 1..18: note = Synthetic Construct
  source 1..18: mol_type = other DNA
tagcggcaccctgtgctt

SEQ ID NO: 30121 - DNA, 20 bp, synthetic construct
  misc_feature 1..20: note = Synthetic Construct
  source 1..20: mol_type = other DNA
agccatggtcccaggataca

SEQ ID NO: 30122 - DNA, 21 bp, synthetic construct
  misc_feature 1..21: note = Synthetic Construct
  source 1..21: mol_type = other DNA
cgtgcaatccgtggtgaggaa

SEQ ID NO: 30123 - DNA, 20 bp, synthetic construct
  misc_feature 1..20: note = Synthetic Construct
  source 1..20: mol_type = other DNA
agctggccgcattccagttt

SEQ ID NO: 30124 - DNA, 24 bp, synthetic construct
  misc_feature 1..24: note = Synthetic Construct
  source 1..24: mol_type = other DNA
actgagattctcgccctgaaaatg

SEQ ID NO: 30125 - DNA, 30 bp, synthetic construct
  misc_feature 1..30: note = Synthetic Construct
  source 1..30: mol_type = other DNA
gcagagaggttagttcactaatagaagcat

SEQ ID NO: 30126 - DNA, 22 bp, synthetic construct
  misc_feature 1..22: note = Synthetic Construct
  source 1..22: mol_type = other DNA
ggccttcaaaaggcaggactgt

SEQ ID NO: 30127 - DNA, 24 bp, synthetic construct
  misc_feature 1..24: note = Synthetic Construct
  source 1..24: mol_type = other DNA
ccttggaccagagactatgtggaa

SEQ ID NO: 30128 - DNA, 26 bp, synthetic construct
  misc_feature 1..26: note = Synthetic Construct
  source 1..26: mol_type = other DNA
tccctgtctacatgaagcagataaag

SEQ ID NO: 30129 - DNA, 23 bp, synthetic construct
  misc_feature 1..23: note = Synthetic Construct
  source 1..23: mol_type = other DNA
gccagaaatctgccctctaggtt

SEQ ID NO: 30130 - DNA, 23 bp, synthetic construct
  misc_feature 1..23: note = Synthetic Construct
  source 1..23: mol_type = other DNA
ggacaggctccagatgctaacaa

SEQ ID NO: 30131 - DNA, 22 bp, synthetic construct
  misc_feature 1..22: note = Synthetic Construct
  source 1..22: mol_type = other DNA
ctccccagacagagagaactga

SEQ ID NO: 30132 - DNA, 22 bp, synthetic construct
  misc_feature 1..22: note = Synthetic Construct
  source 1..22: mol_type = other DNA
gtcacacacaggcatggctaca

SEQ ID NO: 30133 - DNA, 20 bp, synthetic construct
  misc_feature 1..20: note = Synthetic Construct
  source 1..20: mol_type = other DNA
agggaggggcatctgcgtat

SEQ ID NO: 30134 - DNA, 24 bp, synthetic construct
  misc_feature 1..24: note = Synthetic Construct
  source 1..24: mol_type = other DNA
cctttgcttttagcaggacacttg

SEQ ID NO: 30135 - DNA, 24 bp, synthetic construct
  misc_feature 1..24: note = Synthetic Construct
  source 1..24: mol_type = other DNA
ctgggacaccagggaatgatgttc

SEQ ID NO: 30136 - DNA, 23 bp, synthetic construct
  misc_feature 1..23: note = Synthetic Construct
  source 1..23: mol_type = other DNA
gaccatgtggcttgtgcaaagtt

SEQ ID NO: 30137 - DNA, 23 bp, synthetic construct
  misc_feature 1..23: note = Synthetic Construct
  source 1..23: mol_type = other DNA
ggtcctgataggaaggcaaaagt

SEQ ID NO: 30138 - DNA, 21 bp, synthetic construct
  misc_feature 1..21: note = Synthetic Construct
  source 1..21: mol_type = other DNA
agtgcccctcagcacatgaag

SEQ ID NO: 30139 - DNA, 20 bp, synthetic construct
  misc_feature 1..20: note = Synthetic Construct
  source 1..20: mol_type = other DNA
ggtcgcctttggagcagaga

SEQ ID NO: 30140 - DNA, 22 bp, synthetic construct
  misc_feature 1..22: note = Synthetic Construct
  source 1..22: mol_type = other DNA
cagacacggcatcttcctggat

SEQ ID NO: 30141 - DNA, 20 bp, synthetic construct
  misc_feature 1..20: note = Synthetic Construct
  source 1..20: mol_type = other DNA
gctgcgtctttcctggatgt

SEQ ID NO: 30142 - DNA, 26 bp, synthetic construct
  misc_feature 1..26: note = Synthetic Construct
  source 1..26: mol_type = other DNA
gccccagttatcacctaatgaacaca

SEQ ID NO: 30143 - DNA, 25 bp, synthetic construct
  misc_feature 1..25: note = Synthetic Construct
  source 1..25: mol_type = other DNA
agtttgtctcccataagctctgtag

SEQ ID NO: 30144 - DNA, 27 bp, synthetic construct
  misc_feature 1..27: note = Synthetic Construct
  source 1..27: mol_type = other DNA
ccacccttaaaaactcctctcatcaac

SEQ ID NO: 30145 - DNA, 28 bp, synthetic construct
  misc_feature 1..28: note = Synthetic Construct
  source 1..28: mol_type = other DNA
ccacacttcaaggcttcaaatcatcctt

SEQ ID NO: 30146 - DNA, 22 bp, synthetic construct
  misc_feature 1..22: note = Synthetic Construct
  source 1..22: mol_type = other DNA
cccggccacaaactgctttcta

SEQ ID NO: 30147 - DNA, 23 bp, synthetic construct
  misc_feature 1..23: note = Synthetic Construct
  source 1..23: mol_type = other DNA
gatggagacccctctctccacta

SEQ ID NO: 30148 - DNA, 21 bp, synthetic construct
  misc_feature 1..21: note = Synthetic Construct
  source 1..21: mol_type = other DNA
cccatttcccacccacaggaa

SEQ ID NO: 30149 - DNA, 23 bp, synthetic construct
  misc_feature 1..23: note = Synthetic Construct
  source 1..23: mol_type = other DNA
ctcacagcctttctcagcctttc

SEQ ID NO: 30150 - DNA, 22 bp, synthetic construct
  misc_feature 1..22: note = Synthetic Construct
  source 1..22: mol_type = other DNA
gctaggcttggtctctgcaact

SEQ ID NO: 30151 - DNA, 24 bp, synthetic construct
  misc_feature 1..24: note = Synthetic Construct
  source 1..24: mol_type = other DNA
cacggttcatgtaaaagagcgaat

SEQ ID NO: 30152 - DNA, 20 bp, synthetic construct
  misc_feature 1..20: note = Synthetic Construct
  source 1..20: mol_type = other DNA
tgtggcggacgccattatca

SEQ ID NO: 30153 - DNA, 20 bp, synthetic construct
  misc_feature 1..20: note = Synthetic Construct
  source 1..20: mol_type = other DNA
gtttggtgctggctttggtt

SEQ ID NO: 30154 - DNA, 22 bp, synthetic construct
  misc_feature 1..22: note = Synthetic Construct
  source 1..22: mol_type = other DNA
cagctccaggctgagacattca

SEQ ID NO: 30155 - DNA, 22 bp, synthetic construct
  misc_feature 1..22: note = Synthetic Construct
  source 1..22: mol_type = other DNA
ccaggccaaccttagccatatt

SEQ ID NO: 30156 - DNA, 22 bp, synthetic construct
  misc_feature 1..22: note = Synthetic Construct
  source 1..22: mol_type = other DNA
ggagatggagggagctttgtga

SEQ ID NO: 30157 - DNA, 27 bp, synthetic construct
  misc_feature 1..27: note = Synthetic Construct
  source 1..27: mol_type = other DNA
gtcctgctttaggacttttgcacttac

SEQ ID NO: 30158 - DNA, 26 bp, synthetic construct
  misc_feature 1..26: note = Synthetic Construct
  source 1..26: mol_type = other DNA
gaatggggttgtccacaattagtatg

SEQ ID NO: 30159 - DNA, 22 bp, synthetic construct
  misc_feature 1..22: note = Synthetic Construct
  source 1..22: mol_type = other DNA
ccaccaacccgatcagtgcaaa

SEQ ID NO: 30160 - DNA, 25 bp, synthetic construct
  misc_feature 1..25: note = Synthetic Construct
  source 1..25: mol_type = other DNA
actttttcagcagctctcttcatct

SEQ ID NO: 30161 - DNA, 25 bp, synthetic construct
  misc_feature 1..25: note = Synthetic Construct
  source 1..25: mol_type = other DNA
tcttccattctccccttccaaaatg

SEQ ID NO: 30162 - DNA, 24 bp, synthetic construct
  misc_feature 1..24: note = Synthetic Construct
  source 1..24: mol_type = other DNA
gctgacagacttgctttcccagta

SEQ ID NO: 30163 - DNA, 20 bp, synthetic construct
  misc_feature 1..20: note = Synthetic Construct
  source 1..20: mol_type = other DNA
gcaccaggttggatgtgcta

SEQ ID NO: 30164 - DNA, 26 bp, synthetic construct
  misc_feature 1..26: note = Synthetic Construct
  source 1..26: mol_type = other DNA
tctgtgggtgtaaggaatacacaatg

SEQ ID NO: 30165 - DNA, 25 bp, synthetic construct
  misc_feature 1..25: note = Synthetic Construct
  source 1..25: mol_type = other DNA
ctgaggctaaagatcacccatggta

SEQ ID NO: 30166 - DNA, 22 bp, synthetic construct
  misc_feature 1..22: note = Synthetic Construct
  source 1..22: mol_type = other DNA
gctcctcacggatggtctgaaa

SEQ ID NO: 30167 - DNA, 24 bp, synthetic construct
  misc_feature 1..24: note = Synthetic Construct
  source 1..24: mol_type = other DNA
ctcaccagcctgagaaaaggaaac

SEQ ID NO: 30168 - DNA, 23 bp, synthetic construct
  misc_feature 1..23: note = Synthetic Construct
  source 1..23: mol_type = other DNA
cagggagtctgtcccttgcatac

SEQ ID NO: 30169 - DNA, 26 bp, synthetic construct
  misc_feature 1..26: note = Synthetic Construct
  source 1..26: mol_type = other DNA
gcatcttagtcacagggaccagaaac

SEQ ID NO: 30170 - DNA, 20 bp, synthetic construct
  misc_feature 1..20: note = Synthetic Construct
  source 1..20: mol_type = other DNA
tgggaagtggcgtgtgttca

SEQ ID NO: 30171 - DNA, 20 bp, synthetic construct
  misc_feature 1..20: note = Synthetic Construct
  source 1..20: mol_type = other DNA
ccagtccaggcccctggtta

SEQ ID NO: 30172 - DNA, 23 bp, synthetic construct
  misc_feature 1..23: note = Synthetic Construct
  source 1..23: mol_type = other DNA
gtggagggaatagccctttgaga

SEQ ID NO: 30173 - DNA, 22 bp, synthetic construct
  misc_feature 1..22: note = Synthetic Construct
  source 1..22: mol_type = other DNA
ggccagtccccactctttctta

SEQ ID NO: 30174 - DNA, 23 bp, synthetic construct
  misc_feature 1..23: note = Synthetic Construct
  source 1..23: mol_type = other DNA
gacagcagaatgcaagtgacctt

SEQ ID NO: 30175 - DNA, 25 bp, synthetic construct
  misc_feature 1..25: note = Synthetic Construct
  source 1..25: mol_type = other DNA
ctgtttcttcgctggctacagtttg

SEQ ID NO: 30176 - DNA, 26 bp, synthetic construct
  misc_feature 1..26: note = Synthetic Construct
  source 1..26: mol_type = other DNA
ctcccctggaaacaataagtcgatga

SEQ ID NO: 30177 - DNA, 25 bp, synthetic construct
  misc_feature 1..25: note = Synthetic Construct
  source 1..25: mol_type = other DNA
tgtgcccaagaagtaaattgggata

SEQ ID NO: 30178 - DNA, 22 bp, synthetic construct
  misc_feature 1..22: note = Synthetic Construct
  source 1..22: mol_type = other DNA
ggtgtggccttcacaggtaaga

SEQ ID NO: 30179 - DNA, 22 bp, synthetic construct
  misc_feature 1..22: note = Synthetic Construct
  source 1..22: mol_type = other DNA
cctcaagagcatgctacacact

SEQ ID NO: 30180 - DNA, 21 bp, synthetic construct
  misc_feature 1..21: note = Synthetic Construct
  source 1..21: mol_type = other DNA
tgctggacaccacagaacttt

SEQ ID NO: 30181 - DNA, 24 bp, synthetic construct
  misc_feature 1..24: note = Synthetic Construct
  source 1..24: mol_type = other DNA
gtcaacattcacactcaggacctt

SEQ ID NO: 30182 - DNA, 24 bp, synthetic construct
  misc_feature 1..24: note = Synthetic Construct
  source 1..24: mol_type = other DNA
tgtcttccattagctccagactca

SEQ ID NO: 30183 - DNA, 25 bp, synthetic construct
  misc_feature 1..25: note = Synthetic Construct
  source 1..25: mol_type = other DNA
ccatcctcttcacgcccatcagata

SEQ ID NO: 30184 - DNA, 23 bp, synthetic construct
  misc_feature 1..23: note = Synthetic Construct
  source 1..23: mol_type = other DNA
tgctcccttgctattgagacttg

SEQ ID NO: 30185 - DNA, 24 bp, synthetic construct
  misc_feature 1..24: note = Synthetic Construct
  source 1..24: mol_type = other DNA
cccacactcactcctctagtctgt

SEQ ID NO: 30186 - DNA, 25 bp, synthetic construct
  misc_feature 1..25: note = Synthetic Construct
  source 1..25: mol_type = other DNA
ggagaaaggttgagtctggggaatg

SEQ ID NO: 30187 - DNA, 26 bp, synthetic construct
  misc_feature 1..26: note = Synthetic Construct
  source 1..26: mol_type = other DNA
ccacataccaaggagagttgacagat

SEQ ID NO: 30188 - DNA, 22 bp, synthetic construct
  misc_feature 1..22: note = Synthetic Construct
  source 1..22: mol_type = other DNA
gacgtcatttagctcgggtgaa

SEQ ID NO: 30189 - DNA, 26 bp, synthetic construct
  misc_feature 1..26: note = Synthetic Construct
  source 1..26: mol_type = other DNA
gcaaaagatcctgctctgtagggaaa

SEQ ID NO: 30190 - DNA, 27 bp, synthetic construct
  misc_feature 1..27: note = Synthetic Construct
  source 1..27: mol_type = other DNA
ccctcgataaggcaatgtatactcaca

SEQ ID NO: 30191 - DNA, 28 bp, synthetic construct
  misc_feature 1..28: note = Synthetic Construct
  source 1..28: mol_type = other DNA
gccccagaatatgaaattggaacagaag

SEQ ID NO: 30192 - DNA, 21 bp, synthetic construct
  misc_feature 1..21: note = Synthetic Construct
  source 1..21: mol_type = other DNA
cagaatggatgcgtccgctaa

SEQ ID NO: 30193 - DNA, 24 bp, synthetic construct
  misc_feature 1..24: note = Synthetic Construct
  source 1..24: mol_type = other DNA
gttcagggttcttcttctctccaa

SEQ ID NO: 30194 - DNA, 25 bp, synthetic construct
  misc_feature 1..25: note = Synthetic Construct
  source 1..25: mol_type = other DNA
gatttcttaaagccggtttgtggat

SEQ ID NO: 30195 - DNA, 24 bp, synthetic construct
  misc_feature 1..24: note = Synthetic Construct
  source 1..24: mol_type = other DNA
ccctatggaaagacagcacccaaa

SEQ ID NO: 30196 - DNA, 27 bp, synthetic construct
  misc_feature 1..27: note = Synthetic Construct
  source 1..27: mol_type = other DNA
cctcctagttcctactcagcctctaac

SEQ ID NO: 30197 - DNA, 24 bp, synthetic construct
  misc_feature 1..24: note = Synthetic Construct
  source 1..24: mol_type = other DNA
catgcctgaggtaacacctactct

SEQ ID NO: 30198 - DNA, 26 bp, synthetic construct
  misc_feature 1..26: note = Synthetic Construct
  source 1..26: mol_type = other DNA
gtcttgtcattcctacccttcaaatg

SEQ ID NO: 30199 - DNA, 20 bp, synthetic construct
  misc_feature 1..20: note = Synthetic Construct
  source 1..20: mol_type = other DNA
gcttcatgcctgccatcctt

SEQ ID NO: 30200 - DNA, 25 bp, synthetic construct
  misc_feature 1..25: note = Synthetic Construct
  source 1..25: mol_type = other DNA
actggagcttcatcctttcatacaa

SEQ ID NO: 30201 - DNA, 28 bp, synthetic construct
  misc_feature 1..28: note = Synthetic Construct
  source 1..28: mol_type = other DNA
cagaaagtaacaggtcagctcagaacta

SEQ ID NO: 30202 - DNA, 20 bp, synthetic construct
  misc_feature 1..20: note = Synthetic Construct
  source 1..20: mol_type = other DNA
caggctcatggcagaactgt

SEQ ID NO: 30203 - DNA, 25 bp, synthetic construct
  misc_feature 1..25: note = Synthetic Construct
  source 1..25: mol_type = other DNA
ctcaaataggcccttggcagaaaag

SEQ ID NO: 30204 - DNA, 28 bp, synthetic construct
  misc_feature 1..28: note = Synthetic Construct
  source 1..28: mol_type = other DNA
ggtttgccatctagatcaatgcagactt

SEQ ID NO: 30205 - DNA, 27 bp, synthetic construct
  misc_feature 1..27: note = Synthetic Construct
  source 1..27: mol_type = other DNA
caatccctgttaaattaccccatccat

SEQ ID NO: 30206 - DNA, 22 bp, synthetic construct
  misc_feature 1..22: note = Synthetic Construct
  source 1..22: mol_type = other DNA
ctgaggaccctgtggttgagtt

SEQ ID NO: 30207 - DNA, 22 bp, synthetic construct
  misc_feature 1..22: note = Synthetic Construct
  source 1..22: mol_type = other DNA
ggctgcttgctaattccagaga

SEQ ID NO: 30208 - DNA, 22 bp, synthetic construct
  misc_feature 1..22: note = Synthetic Construct
  source 1..22: mol_type = other DNA
gcctctgtagagagcagcattc

SEQ ID NO: 30209 - DNA, 27 bp, synthetic construct
  misc_feature 1..27: note = Synthetic Construct
  source 1..27: mol_type = other DNA
gtcctggattgtacttagaggaagaac

SEQ ID NO: 30210 - DNA, 20 bp, synthetic construct
  misc_feature 1..20: note = Synthetic Construct
  source 1..20: mol_type = other DNA
acctcgagtcggaacctctt

SEQ ID NO: 30211 - DNA, 19 bp, synthetic construct
  misc_feature 1..19: note = Synthetic Construct
  source 1..19: mol_type = other DNA
acctttcgggccctgcatt

SEQ ID NO: 30212 - DNA, 21 bp, synthetic construct
  misc_feature 1..21: note = Synthetic Construct
  source 1..21: mol_type = other DNA
gcaacaggtctgtggcaaatg

SEQ ID NO: 30213 - DNA, 25 bp, synthetic construct
  misc_feature 1..25: note = Synthetic Construct
  source 1..25: mol_type = other DNA
gtttaggacccctttctggtaacat

SEQ ID NO: 30214 - DNA, 21 bp, synthetic construct
  misc_feature 1..21: note = Synthetic Construct
  source 1..21: mol_type = other DNA
accttctctggctgactgctt

SEQ ID NO: 30215 - DNA, 24 bp, synthetic construct
  misc_feature 1..24: note = Synthetic Construct
  source 1..24: mol_type = other DNA
accatggtaacattggaaggtgaa

SEQ ID NO: 30216 - DNA, 25 bp, synthetic construct
  misc_feature 1..25: note = Synthetic Construct
  source 1..25: mol_type = other DNA
ggcttgttcagtaaggttgtcagaa

SEQ ID NO: 30217 - DNA, 29 bp, synthetic construct
  misc_feature 1..29: note = Synthetic Construct
  source 1..29: mol_type = other DNA
ccccaaatcaccacttaaatggaatcaga

SEQ ID NO: 30218 - DNA, 24 bp, synthetic construct
  misc_feature 1..24: note = Synthetic Construct
  source 1..24: mol_type = other DNA
cgaggttccatcctagtcccaagt

SEQ ID NO: 30219 - DNA, 20 bp, synthetic construct
  misc_feature 1..20: note = Synthetic Construct
  source 1..20: mol_type = other DNA
tgcccagtggatgacggaat

SEQ ID NO: 30220 - DNA, 24 bp, synthetic construct
  misc_feature 1..24: note = Synthetic Construct
  source 1..24: mol_type = other DNA
cgaagcactgggaactgcagtaaa

SEQ ID NO: 30221 - DNA, 24 bp, synthetic construct
  misc_feature 1..24: note = Synthetic Construct
  source 1..24: mol_type = other DNA
tgtgtatgaacacacagacaggtt

SEQ ID NO: 30222 - DNA, 24 bp, synthetic construct
  misc_feature 1..24: note = Synthetic Construct
  source 1..24: mol_type = other DNA
acagcatggtgtaagcaagaaact

SEQ ID NO: 30223 - DNA, 26 bp, synthetic construct
  misc_feature 1..26: note = Synthetic Construct
  source 1..26: mol_type = other DNA
gcggagaagagagttcagttttcatc

SEQ ID NO: 30224 - DNA, 21 bp, synthetic construct
  misc_feature 1..21: note = Synthetic Construct
  source 1..21: mol_type = other DNA
ccatgcctgaaatgcggctaa

SEQ ID NO: 30225 - DNA, 24 bp, synthetic construct
  misc_feature 1..24: note = Synthetic Construct
  source 1..24: mol_type = other DNA
ccctagggttgttcccttctcagt

SEQ ID NO: 30226 - DNA, 21 bp, synthetic construct
  misc_feature 1..21: note = Synthetic Construct
  source 1..21: mol_type = other DNA
gtcaacgacaaccagcagaca

SEQ ID NO: 30227 - DNA, 23 bp, synthetic construct
  misc_feature 1..23: note = Synthetic Construct
  source 1..23: mol_type = other DNA
gcacacctttggaatcagctact

SEQ ID NO: 30228 - DNA, 29 bp, synthetic construct
  misc_feature 1..29: note = Synthetic Construct
  source 1..29: mol_type = other DNA
ggggtaaggaatgtgatgtagtttcattg

SEQ ID NO: 30229 - DNA, 23 bp, synthetic construct
  misc_feature 1..23: note = Synthetic Construct
  source 1..23: mol_type = other DNA
ggggaaaccttgagaactgagaa

SEQ ID NO: 30230 - DNA, 24 bp, synthetic construct
  misc_feature 1..24: note = Synthetic Construct
  source 1..24: mol_type = other DNA
aagctccctaaaagtcagcaaaga

SEQ ID NO: 30231 - DNA, 19 bp, synthetic construct
  misc_feature 1..19: note = Synthetic Construct
  source 1..19: mol_type = other DNA
cctgggcttcggagagaga

SEQ ID NO: 30232 - DNA, 22 bp, synthetic construct
  misc_feature 1..22: note = Synthetic Construct
  source 1..22: mol_type = other DNA
cagtcaccagagtgagcagtca

SEQ ID NO: 30233 - DNA, 21 bp, synthetic construct
  misc_feature 1..21: note = Synthetic Construct
  source 1..21: mol_type = other DNA
gccatggggaataagcactca

SEQ ID NO: 30234 - DNA, 22 bp, synthetic construct
  misc_feature 1..22: note = Synthetic Construct
  source 1..22: mol_type = other DNA
cacgccactcaagctgaaggaa

SEQ ID NO: 30235 - DNA, 20 bp, synthetic construct
  misc_feature 1..20: note = Synthetic Construct
  source 1..20: mol_type = other DNA
cctgtggccaaggaggaaag

SEQ ID NO: 30236 - DNA, 19 bp, synthetic construct
  misc_feature 1..19: note = Synthetic Construct
  source 1..19: mol_type = other DNA
tgccaggctgctcctgcat

SEQ ID NO: 30237 - DNA, 21 bp, synthetic construct
  misc_feature 1..21: note = Synthetic Construct
  source 1..21: mol_type = other DNA
cccaggtcctcccctaagcat

SEQ ID NO: 30238 - DNA, 24 bp, synthetic construct
  misc_feature 1..24: note = Synthetic Construct
  source 1..24: mol_type = other DNA
gacactgtccttgccaaccatttc

SEQ ID NO: 30239 - DNA, 22 bp, synthetic construct
  misc_feature 1..22: note = Synthetic Construct
  source 1..22: mol_type = other DNA
gaccttgaagccaggtcctatg

SEQ ID NO: 30240 - DNA, 24 bp, synthetic construct
  misc_feature 1..24: note = Synthetic Construct
  source 1..24: mol_type = other DNA
gactcccaggcaaagatctgagaa

SEQ ID NO: 30241 - DNA, 24 bp, synthetic construct
  misc_feature 1..24: note = Synthetic Construct
  source 1..24: mol_type = other DNA
ccacaacagaagcatggtgcatac

SEQ ID NO: 30242 - DNA, 23 bp, synthetic construct
  misc_feature 1..23: note = Synthetic Construct
  source 1..23: mol_type = other DNA
ctggagctgaagttgatggagat

SEQ ID NO: 30243 - DNA, 20 bp, synthetic construct
  misc_feature 1..20: note = Synthetic Construct
  source 1..20: mol_type = other DNA
cgcctccgttggcaaatcaa

SEQ ID NO: 30244 - DNA, 27 bp, synthetic construct
  misc_feature 1..27: note = Synthetic Construct
  source 1..27: mol_type = other DNA
gatggaaaccaacctttttcaccttct

SEQ ID NO: 30245 - DNA, 23 bp, synthetic construct
  misc_feature 1..23: note = Synthetic Construct
  source 1..23: mol_type = other DNA
agagtagggctccccattctttt

SEQ ID NO: 30246 - DNA, 22 bp, synthetic construct
  misc_feature 1..22: note = Synthetic Construct
  source 1..22: mol_type = other DNA
gtgaactttgggcatcctgtga

SEQ ID NO: 30247 - DNA, 20 bp, synthetic construct
  misc_feature 1..20: note = Synthetic Construct
  source 1..20: mol_type = other DNA
gaacaggctgcttccgatca

SEQ ID NO: 30248 - DNA, 27 bp, synthetic construct
  misc_feature 1..27: note = Synthetic Construct
  source 1..27: mol_type = other DNA
gggcttgagcatggattaaagggaaag

SEQ ID NO: 30249 - DNA, 24 bp, synthetic construct
  misc_feature 1..24: note = Synthetic Construct
  source 1..24: mol_type = other DNA
gatgagtgcagactggaaaccatt

SEQ ID NO: 30250 - DNA, 22 bp, synthetic construct
  misc_feature 1..22: note = Synthetic Construct
  source 1..22: mol_type = other DNA
gcctgaagaaactcggctctgt

SEQ ID NO: 30251 - DNA, 26 bp, synthetic construct
  misc_feature 1..26: note = Synthetic Construct
  source 1..26: mol_type = other DNA
ctgtgtgaaggaaggaggatgaaagt

SEQ ID NO: 30252 - DNA, 24 bp, synthetic construct
  misc_feature 1..24: note = Synthetic Construct
  source 1..24: mol_type = other DNA
ggcacatacagagttcagcctgtt

SEQ ID NO: 30253 - DNA, 19 bp, synthetic construct
  misc_feature 1..19: note = Synthetic Construct
  source 1..19: mol_type = other DNA
acgccggtgctgtcgtact

SEQ ID NO: 30254 - DNA, 25 bp, synthetic construct
  misc_feature 1..25: note = Synthetic Construct
  source 1..25: mol_type = other DNA
ctgactggttcctgtctccaagaag

SEQ ID NO: 30255 - DNA, 22 bp, synthetic construct
  misc_feature 1..22: note = Synthetic Construct
  source 1..22: mol_type = other DNA
ggagcagggaaggatgcaacta

SEQ ID NO: 30256 - DNA, 26 bp, synthetic construct
  misc_feature 1..26: note = Synthetic Construct
  source 1..26: mol_type = other DNA
caggatctagccctatgagcatgtta

SEQ ID NO: 30257 - DNA, 19 bp, synthetic construct
  misc_feature 1..19: note = Synthetic Construct
  source 1..19: mol_type = other DNA
ggagccgcgcaggtttaca

SEQ ID NO: 30258 - DNA, 23 bp, synthetic construct
  misc_feature 1..23: note = Synthetic Construct
  source 1..23: mol_type = other DNA
gtgagctctgtgaggatggagat

SEQ ID NO: 30259 - DNA, 27 bp, synthetic construct
  misc_feature 1..27: note = Synthetic Construct
  source 1..27: mol_type = other DNA
gtgataacaggaaggggatgtttctct

SEQ ID NO: 30260 - DNA, 22 bp, synthetic construct
  misc_feature 1..22: note = Synthetic Construct
  source 1..22: mol_type = other DNA
cactcagctggcactagtcttt

SEQ ID NO: 30261 - DNA, 23 bp, synthetic construct
  misc_feature 1..23: note = Synthetic Construct
  source 1..23: mol_type = other DNA
tgggtggttttgctgtctaagtt

SEQ ID NO: 30262 - DNA, 21 bp, synthetic construct
  misc_feature 1..21: note = Synthetic Construct
  source 1..21: mol_type = other DNA
ggggcaatgacactctctgtt

SEQ ID NO: 30263 - DNA, 25 bp, synthetic construct
  misc_feature 1..25: note = Synthetic Construct
  source 1..25: mol_type = other DNA
ctctgtcttagttgctctgcttgat

SEQ ID NO: 30264 - DNA, 20 bp, synthetic construct
  misc_feature 1..20: note = Synthetic Construct
  source 1..20: mol_type = other DNA
agctccagagcctagcactt

SEQ ID NO: 30265 - DNA, 24 bp, synthetic construct
  misc_feature 1..24: note = Synthetic Construct
  source 1..24: mol_type = other DNA
gagaccatttcctgacagctggtt

SEQ ID NO: 30266 - DNA, 24 bp, synthetic construct
  misc_feature 1..24: note = Synthetic Construct
  source 1..24: mol_type = other DNA
gggaagaatcctggacctcaccat

SEQ ID NO: 30267 - DNA, 27 bp, synthetic construct
  misc_feature 1..27: note = Synthetic Construct
  source 1..27: mol_type = other DNA
cttgcctttactttgtggagtcattct

SEQ ID NO: 30268 - DNA, 26 bp, synthetic construct
  misc_feature 1..26: note = Synthetic Construct
  source 1..26: mol_type = other DNA
ggaagtaacaccctacagaactggaa

SEQ ID NO: 30269 - DNA, 20 bp, synthetic construct
  misc_feature 1..20: note = Synthetic Construct
  source 1..20: mol_type = other DNA
acctgagcccgggaggttga

SEQ ID NO: 30270 - DNA, 25 bp, synthetic construct
  misc_feature 1..25: note = Synthetic Construct
  source 1..25: mol_type = other DNA
ccactcatgactgaaaacccatctt

SEQ ID NO: 30271 - DNA, 28 bp, synthetic construct
  misc_feature 1..28: note = Synthetic Construct
  source 1..28: mol_type = other DNA
ggacaagcttcaagagttaggttaggta

SEQ ID NO: 30272 - DNA, 27 bp, synthetic construct
  misc_feature 1..27: note = Synthetic Construct
  source 1..27: mol_type = other DNA
ggaaaatagccttccttcacagcctat

SEQ ID NO: 30273 - DNA, 22 bp, synthetic construct
  misc_feature 1..22: note = Synthetic Construct
  source 1..22: mol_type = other DNA
gctggcaggggtcaggatttta

SEQ ID NO: 30274 - DNA, 27 bp, synthetic construct
  misc_feature 1..27: note = Synthetic Construct
  source 1..27: mol_type = other DNA
cagttatgtcctaaagacccgtatcat

SEQ ID NO: 30275 - DNA, 22 bp, synthetic construct
  misc_feature 1..22: note = Synthetic Construct
  source 1..22: mol_type = other DNA
gtgaaccagggtgagcaaattc

SEQ ID NO: 30276 - DNA, 26 bp, synthetic construct
  misc_feature 1..26: note = Synthetic Construct
  source 1..26: mol_type = other DNA
cagcatcggggagtagtttaggtttc

SEQ ID NO: 30277 - DNA, 23 bp, synthetic construct
  misc_feature 1..23: note = Synthetic Construct
  source 1..23: mol_type = other DNA
ggaggcagagaaatccagtttgt

SEQ ID NO: 30278 - DNA, 20 bp, synthetic construct
  misc_feature 1..20: note = Synthetic Construct
  source 1..20: mol_type = other DNA
gcacccaagcctgcgagtaa

SEQ ID NO: 30279 - DNA, 26 bp, synthetic construct
  misc_feature 1..26: note = Synthetic Construct
  source 1..26: mol_type = other DNA
ccgtctgtctaggaaaggaagctcta

SEQ ID NO: 30280 - DNA, 24 bp, synthetic construct
  misc_feature 1..24: note = Synthetic Construct
  source 1..24: mol_type = other DNA
ctcacagagctataagcaggcaaa

SEQ ID NO: 30281 - DNA, 19 bp, synthetic construct
  misc_feature 1..19: note = Synthetic Construct
  source 1..19: mol_type = other DNA
cctggcagggcgtcttttc

SEQ ID NO: 30282 - DNA, 20 bp, synthetic construct
  misc_feature 1..20: note = Synthetic Construct
  source 1..20: mol_type = other DNA
gcgatcctccattgcaccat

SEQ ID NO: 30283 - DNA, 24 bp, synthetic construct
  misc_feature 1..24: note = Synthetic Construct
  source 1..24: mol_type = other DNA
gctcagcaaatgcctactaacttg

SEQ ID NO: 30284 - DNA, 24 bp, synthetic construct
  misc_feature 1..24: note = Synthetic Construct
  source 1..24: mol_type = other DNA
catgtctggaaactgcttcctgtt

SEQ ID NO: 30285 - DNA, 22 bp, synthetic construct
  misc_feature 1..22: note = Synthetic Construct
  source 1..22: mol_type = other DNA
tgggtgagttggtgaggtctac

SEQ ID NO: 30286 - DNA, 21 bp, synthetic construct
  misc_feature 1..21: note = Synthetic Construct
  source 1..21: mol_type = other DNA
gcctggctctgctccatttca

SEQ ID NO: 30287 - DNA, 24 bp, synthetic construct
  misc_feature 1..24: note = Synthetic Construct
  source 1..24: mol_type = other DNA
aatgaggtataaggcaagccactt

SEQ ID NO: 30288 - DNA, 27 bp, synthetic construct
  misc_feature 1..27: note = Synthetic Construct
  source 1..27: mol_type = other DNA
gcatcattacaggcagactttacaaac

SEQ ID NO: 30289 - DNA, 27 bp, synthetic construct
  misc_feature 1..27: note = Synthetic Construct
  source 1..27: mol_type = other DNA
gaagatcatctgaaatttgccggattg

SEQ ID NO: 30290 - DNA, 22 bp, synthetic construct
  misc_feature 1..22: note = Synthetic Construct
  source 1..22: mol_type = other DNA
gagaagccaaggtggctacaag

SEQ ID NO: 30291 - DNA, 24 bp, synthetic construct
  misc_feature 1..24: note = Synthetic Construct
  source 1..24: mol_type = other DNA
ggcaggcttatgtacccactgaaa

SEQ ID NO: 30292 - DNA, 22 bp, synthetic construct
  misc_feature 1..22: note = Synthetic Construct
  source 1..22: mol_type = other DNA
ggggtccttgctcatagagctt

SEQ ID NO: 30293 - DNA, 27 bp, synthetic construct
  misc_feature 1..27: note = Synthetic Construct
  source 1..27: mol_type = other DNA
gcactctaggttgaataggtgcctaga

SEQ ID NO: 30294 - DNA, 26 bp, synthetic construct
  misc_feature 1..26: note = Synthetic Construct
  source 1..26: mol_type = other DNA
ctgccaggaagtaggattcattcatt

SEQ ID NO: 30295 - DNA, 25 bp, synthetic construct
  misc_feature 1..25: note = Synthetic Construct
  source 1..25: mol_type = other DNA
gtcctctgccacttgaagtctctat

SEQ ID NO: 30296 - DNA, 25 bp, synthetic construct
  misc_feature 1..25: note = Synthetic Construct
  source 1..25: mol_type = other DNA
gagctggtgtagacagaggtgtttc

SEQ ID NO: 30297 - DNA, 23 bp, synthetic construct
  misc_feature 1..23: note = Synthetic Construct
  source 1..23: mol_type = other DNA
cctgcaagagaggaatgcaaaac

SEQ ID NO: 30298 - DNA, 27 bp, synthetic construct
  misc_feature 1..27: note = Synthetic Construct
  source 1..27: mol_type = other DNA
gcagttaactacttctcttagcagtga

SEQ ID NO: 30299 - DNA, 20 bp, synthetic construct
  misc_feature 1..20: note = Synthetic Construct
  source 1..20: mol_type = other DNA
tgccggttcctctctcttct

SEQ ID NO: 30300 - DNA, 26 bp, synthetic construct
  misc_feature 1..26: note = Synthetic Construct
  source 1..26: mol_type = other DNA
gaacatttgggttgcagaagtactga

SEQ ID NO: 30301 - DNA, 26 bp, synthetic construct
  misc_feature 1..26: note = Synthetic Construct
  source 1..26: mol_type = other DNA
ggaaaaaccgaaggaccaaaagatga

SEQ ID NO: 30302 - DNA, 28 bp, synthetic construct
  misc_feature 1..28: note = Synthetic Construct
  source 1..28: mol_type = other DNA
cgctgaagtggtatttacagtcatgaga

SEQ ID NO: 30303 - DNA, 24 bp, synthetic construct
  misc_feature 1..24: note = Synthetic Construct
  source 1..24: mol_type = other DNA
cctcttaggtgttggttggcagaa

SEQ ID NO: 30304 - DNA, 23 bp, synthetic construct
  misc_feature 1..23: note = Synthetic Construct
  source 1..23: mol_type = other DNA
cctccctggaaggctgtaaaatc

SEQ ID NO: 30305 - DNA, 22 bp, synthetic construct
  misc_feature 1..22: note = Synthetic Construct
  source 1..22: mol_type = other DNA
aaaccgtgtgtgaaacctgaac

SEQ ID NO: 30306 - DNA, 18 bp, synthetic construct
  misc_feature 1..18: note = Synthetic Construct
  source 1..18: mol_type = other DNA
tgggccttccccatgtct

SEQ ID NO: 30307 - DNA, 24 bp, synthetic construct
  misc_feature 1..24: note = Synthetic Construct
  source 1..24: mol_type = other DNA
gcaacatttggaggtcagggaagt

SEQ ID NO: 30308 - DNA, 20 bp, synthetic construct
  misc_feature 1..20: note = Synthetic Construct
  source 1..20: mol_type = other DNA
tgcgtgctgggagagctaag

SEQ ID NO: 30309 - DNA, 23 bp, synthetic construct
  misc_feature 1..23: note = Synthetic Construct
  source 1..23: mol_type = other DNA
gtgtgtgacgctgagagatccaa

SEQ ID NO: 30310 - DNA, 20 bp, synthetic construct
  misc_feature 1..20: note = Synthetic Construct
  source 1..20: mol_type = other DNA
tggaggctgaacgtgccttt

SEQ ID NO: 30311 - DNA, 26 bp, synthetic construct
  misc_feature 1..26: note = Synthetic Construct
  source 1..26: mol_type = other DNA
caccctaggatgatgggatgactgaa

SEQ ID NO: 30312 - DNA, 22 bp, synthetic construct
  misc_feature 1..22: note = Synthetic Construct
  source 1..22: mol_type = other DNA
tgaagaggaagtggcagagttg

SEQ ID NO: 30313 - DNA, 22 bp, synthetic construct
  misc_feature 1..22: note = Synthetic Construct
  source 1..22: mol_type = other DNA
caggaggctcacagaagcttta

SEQ ID NO: 30314 - DNA, 20 bp, synthetic construct
  misc_feature 1..20: note = Synthetic Construct
  source 1..20: mol_type = other DNA
gggagaggccaggtggaagt

SEQ ID NO: 30315 - DNA, 23 bp, synthetic construct
  misc_feature 1..23: note = Synthetic Construct
  source 1..23: mol_type = other DNA
gggctggaatgttgtgtgggaaa

SEQ ID NO: 30316 - DNA, 26 bp, synthetic construct
  misc_feature 1..26: note = Synthetic Construct
  source 1..26: mol_type = other DNA
caccaatatggaagagggttcagcat

SEQ ID NO: 30317 - DNA, 27 bp, synthetic construct
  misc_feature 1..27: note = Synthetic Construct
  source 1..27: mol_type = other DNA
gttgcagagggatttaaagaagctgtt

SEQ ID NO: 30318 - DNA, 21 bp, synthetic construct
  misc_feature 1..21: note = Synthetic Construct
  source 1..21: mol_type = other DNA
ttcagcgagacctgccctttc

SEQ ID NO: 30319 - DNA, 28 bp, synthetic construct
  misc_feature 1..28: note = Synthetic Construct
  source 1..28: mol_type = other DNA
gggaaaaatcctgggtaactacttcttc

SEQ ID NO: 30320 - DNA, 26 bp, synthetic construct
  misc_feature 1..26: note = Synthetic Construct
  source 1..26: mol_type = other DNA
gcacaaagacagacgtaagatgaaac

SEQ ID NO: 30321 - DNA, 26 bp, synthetic construct
  misc_feature 1..26: note = Synthetic Construct
  source 1..26: mol_type = other DNA
ccaagcaaacagtgtacttcagacaa

SEQ ID NO: 30322 - DNA, 21 bp, synthetic construct
  misc_feature 1..21: note = Synthetic Construct
  source 1..21: mol_type = other DNA
gcctccctgcttccttctgat

SEQ ID NO: 30323 - DNA, 22 bp, synthetic construct
  misc_feature 1..22: note = Synthetic Construct
  source 1..22: mol_type = other DNA
gaccctccttcaactcgtggta

SEQ ID NO: 30324 - DNA, 25 bp, synthetic construct
  misc_feature 1..25: note = Synthetic Construct
  source 1..25: mol_type = other DNA
gagtaaccacagctcatcctcatag

SEQ ID NO: 30325 - DNA, 26 bp, synthetic construct
  misc_feature 1..26: note = Synthetic Construct
  source 1..26: mol_type = other DNA
gatcaagcagaaaggtcccttgttta

SEQ ID NO: 30326 - DNA, 29 bp, synthetic construct
  misc_feature 1..29: note = Synthetic Construct
  source 1..29: mol_type = other DNA
cctggtatagcataaaggttgagagtgat

SEQ ID NO: 30327 - DNA, 24 bp, synthetic construct
  misc_feature 1..24: note = Synthetic Construct
  source 1..24: mol_type = other DNA
tcttcaatcccttgtgtgccaata

SEQ ID NO: 30328 - DNA, 25 bp, synthetic construct
  misc_feature 1..25: note = Synthetic Construct
  source 1..25: mol_type = other DNA
gcaattccatggggctgtagcatag

SEQ ID NO: 30329 - DNA, 24 bp, synthetic construct
  misc_feature 1..24: note = Synthetic Construct
  source 1..24: mol_type = other DNA
gaaggaagggatggccattaggaa

SEQ ID NO: 30330 - DNA, 22 bp, synthetic construct
  misc_feature 1..22: note = Synthetic Construct
  source 1..22: mol_type = other DNA
caccaccccaaccaatcccttt

SEQ ID NO: 30331 - DNA, 27 bp, synthetic construct
  misc_feature 1..27: note = Synthetic Construct
  source 1..27: mol_type = other DNA
cacagccaaaccatatcaataggtgaa

SEQ ID NO: 30332 - DNA, 23 bp, synthetic construct
  misc_feature 1..23: note = Synthetic Construct
  source 1..23: mol_type = other DNA
tgcttgaactccagatcagcaaa

SEQ ID NO: 30333 - DNA, 20 bp, synthetic construct
  misc_feature 1..20: note = Synthetic Construct
  source 1..20: mol_type = other DNA
ctgcactgcgtttccagcta

SEQ ID NO: 30334 - DNA, 25 bp, synthetic construct
  misc_feature 1..25: note = Synthetic Construct
  source 1..25: mol_type = other DNA
gtgcaatacactgggtttgctgtag

SEQ ID NO: 30335 - DNA, 24 bp, synthetic construct
  misc_feature 1..24: note = Synthetic Construct
  source 1..24: mol_type = other DNA
actgtgtgtagagagaccttgtga

SEQ ID NO: 30336 - DNA, 27 bp, synthetic construct
  misc_feature 1..27: note = Synthetic Construct
  source 1..27: mol_type = other DNA
ctagcacattgactgaaggagatagaa

SEQ ID NO: 30337 - DNA, 24 bp, synthetic construct
  misc_feature 1..24: note = Synthetic Construct
  source 1..24: mol_type = other DNA
gacagaatggagcaggtgctaaga

SEQ ID NO: 30338 - DNA, 30 bp, synthetic construct
  misc_feature 1..30: note = Synthetic Construct
  source 1..30: mol_type = other DNA
ctcagagtcaatataaccatcgctaaccaa

SEQ ID NO: 30339 - DNA, 22 bp, synthetic construct
  misc_feature 1..22: note = Synthetic Construct
  source 1..22: mol_type = other DNA
ccgccatgcagtttctctcttg

SEQ ID NO: 30340 - DNA, 26 bp, synthetic construct
  misc_feature 1..26: note = Synthetic Construct
  source 1..26: mol_type = other DNA
gctcagtggaattgatttgtcggtaa

SEQ ID NO: 30341 - DNA, 22 bp, synthetic construct
  misc_feature 1..22: note = Synthetic Construct
  source 1..22: mol_type = other DNA
agctgaaggggtttccacaatg

SEQ ID NO: 30342 - DNA, 19 bp, synthetic construct
  misc_feature 1..19: note = Synthetic Construct
  source 1..19: mol_type = other DNA
actccggcagagactcgaa

SEQ ID NO: 30343 - DNA, 25 bp, synthetic construct
  misc_feature 1..25: note = Synthetic Construct
  source 1..25: mol_type = other DNA
gaccaacacataggttagggtcttg

SEQ ID NO: 30344 - DNA, 26 bp, synthetic construct
  misc_feature 1..26: note = Synthetic Construct
  source 1..26: mol_type = other DNA
caggaacggcaggaaataagagattt

SEQ ID NO: 30345 - DNA, 27 bp, synthetic construct
  misc_feature 1..27: note = Synthetic Construct
  source 1..27: mol_type = other DNA
gaatagggaattgaggaggaatgttga

SEQ ID NO: 30346 - DNA, 30 bp, synthetic construct
  misc_feature 1..30: note = Synthetic Construct
  source 1..30: mol_type = other DNA
gagaaacctgcctaatacaaaatccctttc

SEQ ID NO: 30347 - DNA, 24 bp, synthetic construct
  misc_feature 1..24: note = Synthetic Construct
  source 1..24: mol_type = other DNA
cgtctgcttttggaggatctgaac

SEQ ID NO: 30348 - DNA, 22 bp, synthetic construct
  misc_feature 1..22: note = Synthetic Construct
  source 1..22: mol_type = other DNA
ggactccgaccagttcctctct

SEQ ID NO: 30349 - DNA, 23 bp, synthetic construct
  misc_feature 1..23: note = Synthetic Construct
  source 1..23: mol_type = other DNA
tgtcaggtaggattgggatggtt

SEQ ID NO: 30350 - DNA, 22 bp, synthetic construct
  misc_feature 1..22: note = Synthetic Construct
  source 1..22: mol_type = other DNA
gggaggcaggacaccttttctt

SEQ ID NO: 30351 - DNA, 19 bp, synthetic construct
  misc_feature 1..19: note = Synthetic Construct
  source 1..19: mol_type = other DNA
agggaggcatcccctgaag

SEQ ID NO: 30352 - DNA, 23 bp, synthetic construct
  misc_feature 1..23: note = Synthetic Construct
  source 1..23: mol_type = other DNA
cagccattagagaaccacagact

SEQ ID NO: 30353 - DNA, 23 bp, synthetic construct
  misc_feature 1..23: note = Synthetic Construct
  source 1..23: mol_type = other DNA
tgagaaagcgccctgttctaatg

SEQ ID NO: 30354 - DNA, 25 bp, synthetic construct
  misc_feature 1..25: note = Synthetic Construct
  source 1..25: mol_type = other DNA
tcagggagtggtaaataaggctaga

SEQ ID NO: 30355 - DNA, 22 bp, synthetic construct
  misc_feature 1..22: note = Synthetic Construct
  source 1..22: mol_type = other DNA
tggggtgcagggactccttaaa

SEQ ID NO: 30356 - DNA, 26 bp, synthetic construct
  misc_feature 1..26: note = Synthetic Construct
  source 1..26: mol_type = other DNA
cctctgatctcactccctgattcact

SEQ ID NO: 30357 - DNA, 19 bp, synthetic construct
  misc_feature 1..19: note = Synthetic Construct
  source 1..19: mol_type = other DNA
tcccggccttttgctggat

SEQ ID NO: 30358 - DNA, 23 bp, synthetic construct
  misc_feature 1..23: note = Synthetic Construct
  source 1..23: mol_type = other DNA
gaattactctggctcacgctctt

SEQ ID NO: 30359 - DNA, 24 bp, synthetic construct
  misc_feature 1..24: note = Synthetic Construct
  source 1..24: mol_type = other DNA
gcaggtacaggtttaggcttctct

SEQ ID NO: 30360 - DNA, 25 bp, synthetic construct
  misc_feature 1..25: note = Synthetic Construct
  source 1..25: mol_type = other DNA
gtctcttatccatccacagcaagaa

SEQ ID NO: 30361 - DNA, 24 bp, synthetic construct
  misc_feature 1..24: note = Synthetic Construct
  source 1..24: mol_type = other DNA
tccattctagggaccaatcgtact

SEQ ID NO: 30362 - DNA, 20 bp, synthetic construct
  misc_feature 1..20: note = Synthetic Construct
  source 1..20: mol_type = other DNA
cagccaagagctcgcattca

SEQ ID NO: 30363 - DNA, 22 bp, synthetic construct
  misc_feature 1..22: note = Synthetic Construct
  source 1..22: mol_type = other DNA
agcaagcagcaagccattttac

SEQ ID NO: 30364 - DNA, 26 bp, synthetic construct
  misc_feature 1..26: note = Synthetic Construct
  source 1..26: mol_type = other DNA
gggtcagttattgccaagagtgattt

SEQ ID NO: 30365 - DNA, 28 bp, synthetic construct
  misc_feature 1..28: note = Synthetic Construct
  source 1..28: mol_type = other DNA
ggactttcaaggagatgaatcccaaaga

SEQ ID NO: 30366 - DNA, 25 bp, synthetic construct
  misc_feature 1..25: note = Synthetic Construct
  source 1..25: mol_type = other DNA
cctgtttcttttcaagggaggctat

SEQ ID NO: 30367 - DNA, 27 bp, synthetic construct
  misc_feature 1..27: note = Synthetic Construct
  source 1..27: mol_type = other DNA
ctcaatagtatttgacacgctctctct

SEQ ID NO: 30368 - DNA, 22 bp, synthetic construct
  misc_feature 1..22: note = Synthetic Construct
  source 1..22: mol_type = other DNA
tctgggtggggctgtgagtaaa

SEQ ID NO: 30369 - DNA, 25 bp, synthetic construct
  misc_feature 1..25: note = Synthetic Construct
  source 1..25: mol_type = other DNA
gctcatctggggaaagatgtcacta

SEQ ID NO: 30370 - DNA, 28 bp, synthetic construct
  misc_feature 1..28: note = Synthetic Construct
  source 1..28: mol_type = other DNA
gtctcatggaaagcaagtgacattgttc

SEQ ID NO: 30371 - DNA, 26 bp, synthetic construct
  misc_feature 1..26: note = Synthetic Construct
  source 1..26: mol_type = other DNA
ggtgatttaagagcaagggttagctt

SEQ ID NO: 30372 - DNA, 22 bp, synthetic construct
  misc_feature 1..22: note = Synthetic Construct
  source 1..22: mol_type = other DNA
ttaagccccaggctgctgaatc

SEQ ID NO: 30373 - DNA, 22 bp, synthetic construct
  misc_feature 1..22: note = Synthetic Construct
  source 1..22: mol_type = other DNA
tgtgtgccatctgctttcacaa

SEQ ID NO: 30374 - DNA, 24 bp, synthetic construct
  misc_feature 1..24: note = Synthetic Construct
  source 1..24: mol_type = other DNA
ctctttgcttccaaggctgaaatc

SEQ ID NO: 30375 - DNA, 22 bp, synthetic construct
  misc_feature 1..22: note = Synthetic Construct
  source 1..22: mol_type = other DNA
ctggtcacagggctttctcctt

SEQ ID NO: 30376 - DNA, 23 bp, synthetic construct
  misc_feature 1..23: note = Synthetic Construct
  source 1..23: mol_type = other DNA
cctgcccgccttttagataatgt

SEQ ID NO: 30377 - DNA, 21 bp, synthetic construct
  misc_feature 1..21: note = Synthetic Construct
  source 1..21: mol_type = other DNA
ggccatgccctctccatgtat

SEQ ID NO: 30378 - DNA, 20 bp, synthetic construct
  misc_feature 1..20: note = Synthetic Construct
  source 1..20: mol_type = other DNA
aagggctgaccctcttcagt

SEQ ID NO: 30379 - DNA, 20 bp, synthetic construct
  misc_feature 1..20: note = Synthetic Construct
  source 1..20: mol_type = other DNA
agagcctcaggcggaccttt

SEQ ID NO: 30380 - DNA, 27 bp, synthetic construct
  misc_feature 1..27: note = Synthetic Construct
  source 1..27: mol_type = other DNA
cgattcttgttcgaatggaaggtaatg

SEQ ID NO: 30381 - DNA, 30 bp, synthetic construct
  misc_feature 1..30: note = Synthetic Construct
  source 1..30: mol_type = other DNA
caggtgttagtaaacatagtcctctccaaa

SEQ ID NO: 30382 - DNA, 22 bp, synthetic construct
  misc_feature 1..22: note = Synthetic Construct
  source 1..22: mol_type = other DNA
ctgaggtgggtttgctctctgt

SEQ ID NO: 30383 - DNA, 27 bp, synthetic construct
  misc_feature 1..27: note = Synthetic Construct
  source 1..27: mol_type = other DNA
ggagaaactgatcaggtccctatttct

SEQ ID NO: 30384 - DNA, 28 bp, synthetic construct
  misc_feature 1..28: note = Synthetic Construct
  source 1..28: mol_type = other DNA
gcgaatcaccaaaaggaaaacacacttg

SEQ ID NO: 30385 - DNA, 22 bp, synthetic construct
  misc_feature 1..22: note = Synthetic Construct
  source 1..22: mol_type = other DNA
caggtgaagtttcccggcatga

SEQ ID NO: 30386 - DNA, 21 bp, synthetic construct
  misc_feature 1..21: note = Synthetic Construct
  source 1..21: mol_type = other DNA
ccagacctgggaccaagaaca

SEQ ID NO: 30387 - DNA, 22 bp, synthetic construct
  misc_feature 1..22: note = Synthetic Construct
  source 1..22: mol_type = other DNA
caggggctaattggatgcagaa

SEQ ID NO: 30388 - DNA, 27 bp, synthetic construct
  misc_feature 1..27: note = Synthetic Construct
  source 1..27: mol_type = other DNA
ggctgagagtaaatggtgactttcaca

SEQ ID NO: 30389 - DNA, 20 bp, synthetic construct
  misc_feature 1..20: note = Synthetic Construct
  source 1..20: mol_type = other DNA
agtcctggatcccgttcagt

SEQ ID NO: 30390 - DNA, 24 bp, synthetic construct
  misc_feature 1..24: note = Synthetic Construct
  source 1..24: mol_type = other DNA
ccaaatctgatggggtaggcaaca

SEQ ID NO: 30391 - DNA, 22 bp, synthetic construct
  misc_feature 1..22: note = Synthetic Construct
  source 1..22: mol_type = other DNA
gcacagcacagatgctccacta

SEQ ID NO: 30392 - DNA, 20 bp, synthetic construct
  misc_feature 1..20: note = Synthetic Construct
  source 1..20: mol_type = other DNA
tgggcacgtttgtccaagat

SEQ ID NO: 30393 - DNA, 18 bp, synthetic construct
  misc_feature 1..18: note = Synthetic Construct
  source 1..18: mol_type = other DNA
aggagggacccaggcaaa

SEQ ID NO: 30394 - DNA, 23 bp, synthetic construct
  misc_feature 1..23: note = Synthetic Construct
  source 1..23: mol_type = other DNA
ggaccaggattcgaggagttaag

SEQ ID NO: 30395 - DNA, 28 bp, synthetic construct
  misc_feature 1..28: note = Synthetic Construct
  source 1..28: mol_type = other DNA
ccaggtttgtctttaaagggatggaatg

SEQ ID NO: 30396 - DNA, 27 bp, synthetic construct
  misc_feature 1..27: note = Synthetic Construct
  source 1..27: mol_type = other DNA
gtaagtgactttcagggagattgaatg

SEQ ID NO: 30397 - DNA, 26 bp, synthetic construct
  misc_feature 1..26: note = Synthetic Construct
  source 1..26: mol_type = other DNA
gcaaagacaatgaaagcaccatcatc

SEQ ID NO: 30398 - DNA, 22 bp, synthetic construct
  misc_feature 1..22: note = Synthetic Construct
  source 1..22: mol_type = other DNA
gcaactgcctagagagctgatt

SEQ ID NO: 30399 - DNA, 20 bp, synthetic construct
  misc_feature 1..20: note = Synthetic Construct
  source 1..20: mol_type = other DNA
tgcccgggacagacccagat

SEQ ID NO: 30400 - DNA, 19 bp, synthetic construct
  misc_feature 1..19: note = Synthetic Construct
  source 1..19: mol_type = other DNA
tgcagcagctggtggttgt

SEQ ID NO: 30401 - DNA, 21 bp, synthetic construct
  misc_feature 1..21: note = Synthetic Construct
  source 1..21: mol_type = other DNA
acggtgacacttgtgttgtga

SEQ ID NO: 30402 - DNA, 27 bp, synthetic construct
  misc_feature 1..27: note = Synthetic Construct
  source 1..27: mol_type = other DNA
tgaaggaataaccataccttcctcatc

SEQ ID NO: 30403 - DNA, 24 bp, synthetic construct
  misc_feature 1..24: note = Synthetic Construct
  source 1..24: mol_type = other DNA
gctgtcagaatggggtatgtgtgt

SEQ ID NO: 30404 - DNA, 21 bp, synthetic construct
  misc_feature 1..21: note = Synthetic Construct
  source 1..21: mol_type = other DNA
ggacacccctgccgtagacat

SEQ ID NO: 30405 - DNA, 26 bp, synthetic construct
  misc_feature 1..26: note = Synthetic Construct
  source 1..26: mol_type = other DNA
gacatgggcctttcattgaactctct

SEQ ID NO: 30406 - DNA, 26 bp, synthetic construct
  misc_feature 1..26: note = Synthetic Construct
  source 1..26: mol_type = other DNA
ctcttactggaaatgatggcttgtct

SEQ ID NO: 30407 - DNA, 20 bp, synthetic construct
  misc_feature 1..20: note = Synthetic Construct
  source 1..20: mol_type = other DNA
ggtttcacgggatgcctttg

SEQ ID NO: 30408 - DNA, 25 bp, synthetic construct
  misc_feature 1..25: note = Synthetic Construct
  source 1..25: mol_type = other DNA
aggggctttgctgaaatgatatgaa

SEQ ID NO: 30409 - DNA, 22 bp, synthetic construct
  misc_feature 1..22: note = Synthetic Construct
  source 1..22: mol_type = other DNA
gttgatgccactgtcagcagtt

SEQ ID NO: 30410 - DNA, 21 bp, synthetic construct
  misc_feature 1..21: note = Synthetic Construct
  source 1..21: mol_type = other DNA
tccttgcgagactttgtggtt

SEQ ID NO: 30411 - DNA, 20 bp, synthetic construct
  misc_feature 1..20: note = Synthetic Construct
  source 1..20: mol_type = other DNA
gggactgcagcaatgtggta

SEQ ID NO: 30412 - DNA, 28 bp, synthetic construct
  misc_feature 1..28: note = Synthetic Construct
  source 1..28: mol_type = other DNA
ctccattgatttagagctgatccactga

SEQ ID NO: 30413 - DNA, 22 bp, synthetic construct
  misc_feature 1..22: note = Synthetic Construct
  source 1..22: mol_type = other DNA
ccaatgtacaggcatggcttct

SEQ ID NO: 30414 - DNA, 22 bp, synthetic construct
  misc_feature 1..22: note = Synthetic Construct
  source 1..22: mol_type = other DNA
ccaagcagggtgctatttctca

SEQ ID NO: 30415 - DNA, 22 bp, synthetic construct
  misc_feature 1..22: note = Synthetic Construct
  source 1..22: mol_type = other DNA
ggggataggactgggtttcaga

SEQ ID NO: 30416 - DNA, 21 bp, synthetic construct
  misc_feature 1..21: note = Synthetic Construct
  source 1..21: mol_type = other DNA
gccttaaggagcagcgttttg

SEQ ID NO: 30417 - DNA, 24 bp, synthetic construct
  misc_feature 1..24: note = Synthetic Construct
  source 1..24: mol_type = other DNA
gcccttcattgctatcctgtggtt

SEQ ID NO: 30418 - DNA, 24 bp, synthetic construct
  misc_feature 1..24: note = Synthetic Construct
  source 1..24: mol_type = other DNA
gtatgttgccatctgtagccaatg

SEQ ID NO: 30419 - DNA, 20 bp, synthetic construct
  misc_feature 1..20: note = Synthetic Construct
  source 1..20: mol_type = other DNA
caggcacaccaccaatcgtt

SEQ ID NO: 30420 - DNA, 25 bp, synthetic construct
  misc_feature 1..25: note = Synthetic Construct
  source 1..25: mol_type = other DNA
gctgaaattagtcaccgaccaccaa

SEQ ID NO: 30421 - DNA, 26 bp, synthetic construct
  misc_feature 1..26: note = Synthetic Construct
  source 1..26: mol_type = other DNA
gctcttccaagaaaggcaagtgaaag

SEQ ID NO: 30422 - DNA, 20 bp, synthetic construct
  misc_feature 1..20: note = Synthetic Construct
  source 1..20: mol_type = other DNA
cagctttcacggctcagtgt

SEQ ID NO: 30423 - DNA, 25 bp, synthetic construct
  misc_feature 1..25: note = Synthetic Construct
  source 1..25: mol_type = other DNA
ccattaccacaatctgggctgtttc

SEQ ID NO: 30424 - DNA, 22 bp, synthetic construct
  misc_feature 1..22: note = Synthetic Construct
  source 1..22: mol_type = other DNA
tgcctggtacaggtgaggctta

SEQ ID NO: 30425 - DNA, 25 bp, synthetic construct
  misc_feature 1..25: note = Synthetic Construct
  source 1..25: mol_type = other DNA
gagacccaggagtcttccttgttac

SEQ ID NO: 30426 - DNA, 25 bp, synthetic construct
  misc_feature 1..25: note = Synthetic Construct
  source 1..25: mol_type = other DNA
gtcacaaagaagggagaggttcaca

SEQ ID NO: 30427 - DNA, 27 bp, synthetic construct
  misc_feature 1..27: note = Synthetic Construct
  source 1..27: mol_type = other DNA
cctccctttaaggtcctttccagaagt

SEQ ID NO: 30428 - DNA, 20 bp, synthetic construct
  misc_feature 1..20: note = Synthetic Construct
  source 1..20: mol_type = other DNA
acgtgcagcagtggatgcta

SEQ ID NO: 30429 - DNA, 25 bp, synthetic construct
  misc_feature 1..25: note = Synthetic Construct
  source 1..25: mol_type = other DNA
gccaggtgatcttagacctgcacta

SEQ ID NO: 30430 - DNA, 30 bp, synthetic construct
  misc_feature 1..30: note = Synthetic Construct
  source 1..30: mol_type = other DNA
gcattacttaccttgactcttagcttgttg

SEQ ID NO: 30431 - DNA, 29 bp, synthetic construct
  misc_feature 1..29: note = Synthetic Construct
  source 1..29: mol_type = other DNA
gtggagggcttataatgaggcttgtatag

SEQ ID NO: 30432 - DNA, 21 bp, synthetic construct
  misc_feature 1..21: note = Synthetic Construct
  source 1..21: mol_type = other DNA
cctagcagctgttggcagaag

SEQ ID NO: 30433 - DNA, 21 bp, synthetic construct
  misc_feature 1..21: note = Synthetic Construct
  source 1..21: mol_type = other DNA
gcctgatgtgatgctggaaac

SEQ ID NO: 30434 - DNA, 20 bp, synthetic construct
  misc_feature 1..20: note = Synthetic Construct
  source 1..20: mol_type = other DNA
gcatgacagcacaggctcat

SEQ ID NO: 30435 - DNA, 28 bp, synthetic construct
  misc_feature 1..28: note = Synthetic Construct
  source 1..28: mol_type = other DNA
ctgaagaggacttcttgactttggtaag

SEQ ID NO: 30436 - DNA, 24 bp, synthetic construct
  misc_feature 1..24: note = Synthetic Construct
  source 1..24: mol_type = other DNA
gacattggtgcatgtgatgtctgt

SEQ ID NO: 30437 - DNA, 22 bp, synthetic construct
  misc_feature 1..22: note = Synthetic Construct
  source 1..22: mol_type = other DNA
taacgcgcctgggctctccttt

SEQ ID NO: 30438 - DNA, 24 bp, synthetic construct
  misc_feature 1..24: note = Synthetic Construct
  source 1..24: mol_type = other DNA
gccgatgaactgggtttggaaatg

SEQ ID NO: 30439 - DNA, 25 bp, synthetic construct
  misc_feature 1..25: note = Synthetic Construct
  source 1..25: mol_type = other DNA
tgatcttctttcgtggcaacagatt

SEQ ID NO: 30440 - DNA, 23 bp, synthetic construct
  misc_feature 1..23: note = Synthetic Construct
  source 1..23: mol_type = other DNA
ggaaggataactccacccagtca

SEQ ID NO: 30441 - DNA, 21 bp, synthetic construct
  misc_feature 1..21: note = Synthetic Construct
  source 1..21: mol_type = other DNA
gctgcttttgcgctacagtga

SEQ ID NO: 30442 - DNA, 22 bp, synthetic construct
  misc_feature 1..22: note = Synthetic Construct
  source 1..22: mol_type = other DNA
gccctgcacctccatatgttct

SEQ ID NO: 30443 - DNA, 23 bp, synthetic construct
  misc_feature 1..23: note = Synthetic Construct
  source 1..23: mol_type = other DNA
tggtatggaggagtgttgtggat

SEQ ID NO: 30444 - DNA, 25 bp, synthetic construct
  misc_feature 1..25: note = Synthetic Construct
  source 1..25: mol_type = other DNA
actacgtggaacagagctgatagat

SEQ ID NO: 30445 - DNA, 24 bp, synthetic construct
  misc_feature 1..24: note = Synthetic Construct
  source 1..24: mol_type = other DNA
gctggaaggggagtctggtattct

SEQ ID NO: 30446 - DNA, 22 bp, synthetic construct
  misc_feature 1..22: note = Synthetic Construct
  source 1..22: mol_type = other DNA
cccatccttgtcagctccagat

SEQ ID NO: 30447 - DNA, 21 bp, synthetic construct
  misc_feature 1..21: note = Synthetic Construct
  source 1..21: mol_type = other DNA
gatggtgccaacatgctcaac

SEQ ID NO: 30448 - DNA, 23 bp, synthetic construct
  misc_feature 1..23: note = Synthetic Construct
  source 1..23: mol_type = other DNA
ggccccaaggaaatgatggattc

SEQ ID NO: 30449 - DNA, 24 bp, synthetic construct
  misc_feature 1..24: note = Synthetic Construct
  source 1..24: mol_type = other DNA
acatatgcctcagtagcaagttgt

SEQ ID NO: 30450 - DNA, 23 bp, synthetic construct
  misc_feature 1..23: note = Synthetic Construct
  source 1..23: mol_type = other DNA
gattcccacgtccgtgatttact

SEQ ID NO: 30451 - DNA, 28 bp, synthetic construct
  misc_feature 1..28: note = Synthetic Construct
  source 1..28: mol_type = other DNA
ggtgtgaaagcaatacacattcggtaga

SEQ ID NO: 30452 - DNA, 22 bp, synthetic construct
  misc_feature 1..22: note = Synthetic Construct
  source 1..22: mol_type = other DNA
tgttatctgtgcgtgcttgtct

SEQ ID NO: 30453 - DNA, 25 bp, synthetic construct
  misc_feature 1..25: note = Synthetic Construct
  source 1..25: mol_type = other DNA
gcacactgacaaagtaggggagttg

SEQ ID NO: 30454 - DNA, 22 bp, synthetic construct
  misc_feature 1..22: note = Synthetic Construct
  source 1..22: mol_type = other DNA
tggagtgagcaaagtgttgcat

SEQ ID NO: 30455 - DNA, 24 bp, synthetic construct
  misc_feature 1..24: note = Synthetic Construct
  source 1..24: mol_type = other DNA
cacagggagagaaaagcagggaaa

SEQ ID NO: 30456 - DNA, 23 bp, synthetic construct
  misc_feature 1..23: note = Synthetic Construct
  source 1..23: mol_type = other DNA
agttctcactttgagctgtggtt

SEQ ID NO: 30457 - DNA, 25 bp, synthetic construct
  misc_feature 1..25: note = Synthetic Construct
  source 1..25: mol_type = other DNA
gaacagttgctgatccttctgattc

SEQ ID NO: 30458 - DNA, 26 bp, synthetic construct
  misc_feature 1..26: note = Synthetic Construct
  source 1..26: mol_type = other DNA
gttggagtcacctattcaggtaaaga

SEQ ID NO: 30459 - DNA, 26 bp, synthetic construct
  misc_feature 1..26: note = Synthetic Construct
  source 1..26: mol_type = other DNA
gtttatgtcctggtgtccttacttgt

SEQ ID NO: 30460 - DNA, 27 bp, synthetic construct
  misc_feature 1..27: note = Synthetic Construct
  source 1..27: mol_type = other DNA
gacaaacagtcctacttggggagtttt

SEQ ID NO: 30461 - DNA, 24 bp, synthetic construct
  misc_feature 1..24: note = Synthetic Construct
  source 1..24: mol_type = other DNA
gcccagaaagagacctaagtgcat

SEQ ID NO: 30462 - DNA, 27 bp, synthetic construct
  misc_feature 1..27: note = Synthetic Construct
  source 1..27: mol_type = other DNA
cctaatttagctccttgagactcagat

SEQ ID NO: 30463 - DNA, 22 bp, synthetic construct
  misc_feature 1..22: note = Synthetic Construct
  source 1..22: mol_type = other DNA
agggactggtaacctgagtcaa

SEQ ID NO: 30464 - DNA, 25 bp, synthetic construct
  misc_feature 1..25: note = Synthetic Construct
  source 1..25: mol_type = other DNA
ggagtaggggtcagtatagggattg

SEQ ID NO: 30465 - DNA, 25 bp, synthetic construct
  misc_feature 1..25: note = Synthetic Construct
  source 1..25: mol_type = other DNA
gcacagcaagcaaggagtaaatgat

SEQ ID NO: 30466 - DNA, 27 bp, synthetic construct
  misc_feature 1..27: note = Synthetic Construct
  source 1..27: mol_type = other DNA
gcacagacatccatctagaaaaacaag

SEQ ID NO: 30467 - DNA, 23 bp, synthetic construct
  misc_feature 1..23: note = Synthetic Construct
  source 1..23: mol_type = other DNA
gattctgggaggacagatgcttt

SEQ ID NO: 30468 - DNA, 22 bp, synthetic construct
  misc_feature 1..22: note = Synthetic Construct
  source 1..22: mol_type = other DNA
cccaagtgaggcctctgaaatc

SEQ ID NO: 30469 - DNA, 25 bp, synthetic construct
  misc_feature 1..25: note = Synthetic Construct
  source 1..25: mol_type = other DNA
gcagcttaaccagcacaattggatt

SEQ ID NO: 30470 - DNA, 23 bp, synthetic construct
  misc_feature 1..23: note = Synthetic Construct
  source 1..23: mol_type = other DNA
tccagagaggtcacaccattctt

SEQ ID NO: 30471 - DNA, 22 bp, synthetic construct
  misc_feature 1..22: note = Synthetic Construct
  source 1..22: mol_type = other DNA
agcagctgggaagaagtacaga

SEQ ID NO: 30472 - DNA, 30 bp, synthetic construct
  misc_feature 1..30: note = Synthetic Construct
  source 1..30: mol_type = other DNA
cctcttgctaattgctatctccaagtgttt

SEQ ID NO: 30473 - DNA, 22 bp, synthetic construct
  misc_feature 1..22: note = Synthetic Construct
  source 1..22: mol_type = other DNA
ggaggtgtttcctgggagaaag

SEQ ID NO: 30474 - DNA, 23 bp, synthetic construct
  misc_feature 1..23: note = Synthetic Construct
  source 1..23: mol_type = other DNA
ttcagggacagagtctgagatgt

SEQ ID NO: 30475 - DNA, 24 bp, synthetic construct
  misc_feature 1..24: note = Synthetic Construct
  source 1..24: mol_type = other DNA
ggggtaataggctttgctgtgaag

SEQ ID NO: 30476 - DNA, 22 bp, synthetic construct
  misc_feature 1..22: note = Synthetic Construct
  source 1..22: mol_type = other DNA
cctccttgattcaccgctcagt

SEQ ID NO: 30477 - DNA, 23 bp, synthetic construct
  misc_feature 1..23: note = Synthetic Construct
  source 1..23: mol_type = other DNA
ctcactgttgctgtcggtattca

SEQ ID NO: 30478 - DNA, 27 bp, synthetic construct
  misc_feature 1..27: note = Synthetic Construct
  source 1..27: mol_type = other DNA
gcagaagaatcaaacttacccttgtgt

SEQ ID NO: 30479 - DNA, 27 bp, synthetic construct
  misc_feature 1..27: note = Synthetic Construct
  source 1..27: mol_type = other DNA
cagaaaagaaacgctttcctgcaaatg

SEQ ID NO: 30480 - DNA, 22 bp, synthetic construct
  misc_feature 1..22: note = Synthetic Construct
  source 1..22: mol_type = other DNA
ccttatccgcatccagttcagt

SEQ ID NO: 30481 - DNA, 21 bp, synthetic construct
  misc_feature 1..21: note = Synthetic Construct
  source 1..21: mol_type = other DNA
cacctttttcccctgctccaa

SEQ ID NO: 30482 - DNA, 21 bp, synthetic construct
  misc_feature 1..21: note = Synthetic Construct
  source 1..21: mol_type = other DNA
cgctgaccctcccatagtgtt

SEQ ID NO: 30483 - DNA, 24 bp, synthetic construct
  misc_feature 1..24: note = Synthetic Construct
  source 1..24: mol_type = other DNA
gcaagggttgaaaactacacatca

SEQ ID NO: 30484 - DNA, 25 bp, synthetic construct
  misc_feature 1..25: note = Synthetic Construct
  source 1..25: mol_type = other DNA
tcaagtcctcatcttatccccaagt

SEQ ID NO: 30485 - DNA, 22 bp, synthetic construct
  misc_feature 1..22: note = Synthetic Construct
  source 1..22: mol_type = other DNA
tgccctgtgcagtaaactttca

SEQ ID NO: 30486 - DNA, 20 bp, synthetic construct
  misc_feature 1..20: note = Synthetic Construct
  source 1..20: mol_type = other DNA
gccgtcttgggtggttcaca

SEQ ID NO: 30487 - DNA, 21 bp, synthetic construct
  misc_feature 1..21: note = Synthetic Construct
  source 1..21: mol_type = other DNA
gccacacaccacctcttgagt

SEQ ID NO: 30488 - DNA, 24 bp, synthetic construct
  misc_feature 1..24: note = Synthetic Construct
  source 1..24: mol_type = other DNA
tggcagtttttcactctccttact

SEQ ID NO: 30489 - DNA, 19 bp, synthetic construct
  misc_feature 1..19: note = Synthetic Construct
  source 1..19: mol_type = other DNA
tgccaggctgtccacatca

SEQ ID NO: 30490 - DNA, 24 bp, synthetic construct
  misc_feature 1..24: note = Synthetic Construct
  source 1..24: mol_type = other DNA
tcacagtggctacatcaaagtcat

SEQ ID NO: 30491 - DNA, 26 bp, synthetic construct
  misc_feature 1..26: note = Synthetic Construct
  source 1..26: mol_type = other DNA
ggggcaggcatataatacacaatcaa

SEQ ID NO: 30492 - DNA, 28 bp, synthetic construct
  misc_feature 1..28: note = Synthetic Construct
  source 1..28: mol_type = other DNA
ccagacattgtgttcagttctgtgtcta

SEQ ID NO: 30493 - DNA, 22 bp, synthetic construct
  misc_feature 1..22: note = Synthetic Construct
  source 1..22: mol_type = other DNA
tggccccattgggaagtaggat

SEQ ID NO: 30494 - DNA, 21 bp, synthetic construct
  misc_feature 1..21: note = Synthetic Construct
  source 1..21: mol_type = other DNA
tccacagcaggggctgttcta

SEQ ID NO: 30495 - DNA, 24 bp, synthetic construct
  misc_feature 1..24: note = Synthetic Construct
  source 1..24: mol_type = other DNA
cgcccagacacatactggaggatt

SEQ ID NO: 30496 - DNA, 25 bp, synthetic construct
  misc_feature 1..25: note = Synthetic Construct
  source 1..25: mol_type = other DNA
gctgacttccagcttgtaggatttg

SEQ ID NO: 30497 - DNA, 25 bp, synthetic construct
  misc_feature 1..25: note = Synthetic Construct
  source 1..25: mol_type = other DNA
catttgagacttccagaggagttga

SEQ ID NO: 30498 - DNA, 22 bp, synthetic construct
  misc_feature 1..22: note = Synthetic Construct
  source 1..22: mol_type = other DNA
gaagaagcaacgcactggatca

SEQ ID NO: 30499 - DNA, 23 bp, synthetic construct
  misc_feature 1..23: note = Synthetic Construct
  source 1..23: mol_type = other DNA
cacccacagcctatgtcacattt

SEQ ID NO: 30500 - DNA, 27 bp, synthetic construct
  misc_feature 1..27: note = Synthetic Construct
  source 1..27: mol_type = other DNA
gaaggcagatataggaattcagacgtt

SEQ ID NO: 30501 - DNA, 23 bp, synthetic construct
  misc_feature 1..23: note = Synthetic Construct
  source 1..23: mol_type = other DNA
ccaggaggacttgcatttcagta

SEQ ID NO: 30502 - DNA, 26 bp, synthetic construct
  misc_feature 1..26: note = Synthetic Construct
  source 1..26: mol_type = other DNA
cctgccctgattaccctaagccaata

SEQ ID NO: 30503 - DNA, 24 bp, synthetic construct
  misc_feature 1..24: note = Synthetic Construct
  source 1..24: mol_type = other DNA
aggggattcatgcagtttggataa

SEQ ID NO: 30504 - DNA, 23 bp, synthetic construct
  misc_feature 1..23: note = Synthetic Construct
  source 1..23: mol_type = other DNA
tcaccaccaatcacaaggaagaa

SEQ ID NO: 30505 - DNA, 30 bp, synthetic construct
  misc_feature 1..30: note = Synthetic Construct
  source 1..30: mol_type = other DNA
gttccatataggccttgttcttctacaaag

SEQ ID NO: 30506 - DNA, 22 bp, synthetic construct
  misc_feature 1..22: note = Synthetic Construct
  source 1..22: mol_type = other DNA
gcgtattcctagggcctgaagt

SEQ ID NO: 30507 - DNA, 24 bp, synthetic construct
  misc_feature 1..24: note = Synthetic Construct
  source 1..24: mol_type = other DNA
gaccaaatggaatgctcagctaca

SEQ ID NO: 30508 - DNA, 30 bp, synthetic construct
  misc_feature 1..30: note = Synthetic Construct
  source 1..30: mol_type = other DNA
ggaatgtgtaagaggttaagatcccatttc

SEQ ID NO: 30509 - DNA, 24 bp, synthetic construct
  misc_feature 1..24: note = Synthetic Construct
  source 1..24: mol_type = other DNA
aggatgttatgtggcaaggatgat

SEQ ID NO: 30510 - DNA, 24 bp, synthetic construct
  misc_feature 1..24: note = Synthetic Construct
  source 1..24: mol_type = other DNA
accacttgaaagcagggatagttg

SEQ ID NO: 30511 - DNA, 22 bp, synthetic construct
  misc_feature 1..22: note = Synthetic Construct
  source 1..22: mol_type = other DNA
ggcagaactcaaggggcaaaac

SEQ ID NO: 30512 - DNA, 25 bp, synthetic construct
  misc_feature 1..25: note = Synthetic Construct
  source 1..25: mol_type = other DNA
cctggcaaccttcatttaacccaaa

SEQ ID NO: 30513 - DNA, 21 bp, synthetic construct
  misc_feature 1..21: note = Synthetic Construct
  source 1..21: mol_type = other DNA
gctttgtgaaggggtgtccta

SEQ ID NO: 30514 - DNA, 28 bp, synthetic construct
  misc_feature 1..28: note = Synthetic Construct
  source 1..28: mol_type = other DNA
ggaaaaagaagtggactgacatcggaat

SEQ ID NO: 30515 - DNA, 22 bp, synthetic construct
  misc_feature 1..22: note = Synthetic Construct
  source 1..22: mol_type = other DNA
aatcccaaccctctgtgctttt

SEQ ID NO: 30516 - DNA, 26 bp, synthetic construct
  misc_feature 1..26: note = Synthetic Construct
  source 1..26: mol_type = other DNA
ctgcatctgctgtatctctagtgtct

SEQ ID NO: 30517 - DNA, 25 bp, synthetic construct
  misc_feature 1..25: note = Synthetic Construct
  source 1..25: mol_type = other DNA
gaaaaggaagggaatgtacccagta

SEQ ID NO: 30518 - DNA, 23 bp, synthetic construct
  misc_feature 1..23: note = Synthetic Construct
  source 1..23: mol_type = other DNA
ccccaggcctttggctgttatac

SEQ ID NO: 30519 - DNA, 29 bp, synthetic construct
  misc_feature 1..29: note = Synthetic Construct
  source 1..29: mol_type = other DNA
cctaagaatgcacaaggctattgaagatg

SEQ ID NO: 30520 - DNA, 22 bp, synthetic construct
  misc_feature 1..22: note = Synthetic Construct
  source 1..22: mol_type = other DNA
gccctgcatcagtgctactaag

SEQ ID NO: 30521 - DNA, 25 bp, synthetic construct
  misc_feature 1..25: note = Synthetic Construct
  source 1..25: mol_type = other DNA
gcccggccaagatcatgacttttat

SEQ ID NO: 30522 - DNA, 25 bp, synthetic construct
  misc_feature 1..25: note = Synthetic Construct
  source 1..25: mol_type = other DNA
ggaaggccgctatcatccttattca

SEQ ID NO: 30523 - DNA, 22 bp, synthetic construct
  misc_feature 1..22: note = Synthetic Construct
  source 1..22: mol_type = other DNA
gtggacagtgcctttctgagta

SEQ ID NO: 30524 - DNA, 27 bp, synthetic construct
  misc_feature 1..27: note = Synthetic Construct
  source 1..27: mol_type = other DNA
ggcattgccaacctttacagacctatc

SEQ ID NO: 30525 - DNA, 26 bp, synthetic construct
  misc_feature 1..26: note = Synthetic Construct
  source 1..26: mol_type = other DNA
ccctggagtcaacatcagagttttgt

SEQ ID NO: 30526 - DNA, 22 bp, synthetic construct
  misc_feature 1..22: note = Synthetic Construct
  source 1..22: mol_type = other DNA
gtggagtcactaggctgaccaa

SEQ ID NO: 30527 - DNA, 25 bp, synthetic construct
  misc_feature 1..25: note = Synthetic Construct
  source 1..25: mol_type = other DNA
ctcctttattccccagattggttga

SEQ ID NO: 30528 - DNA, 24 bp, synthetic construct
  misc_feature 1..24: note = Synthetic Construct
  source 1..24: mol_type = other DNA
gcagagtcatcaaaagccactttc

SEQ ID NO: 30529 - DNA, 26 bp, synthetic construct
  misc_feature 1..26: note = Synthetic Construct
  source 1..26: mol_type = other DNA
ggccctccaaacatcattagtccaaa

SEQ ID NO: 30530 - DNA, 23 bp, synthetic construct
  misc_feature 1..23: note = Synthetic Construct
  source 1..23: mol_type = other DNA
ggcctcccttgaagaatcgttgt

SEQ ID NO: 30531 - DNA, 23 bp, synthetic construct
  misc_feature 1..23: note = Synthetic Construct
  source 1..23: mol_type = other DNA
ggctcaccagaatcctagcaaaa

SEQ ID NO: 30532 - DNA, 25 bp, synthetic construct
  misc_feature 1..25: note = Synthetic Construct
  source 1..25: mol_type = other DNA
ttgctataaccactcagtcctttgt

SEQ ID NO: 30533 - DNA, 24 bp, synthetic construct
  misc_feature 1..24: note = Synthetic Construct
  source 1..24: mol_type = other DNA
gggaatgtcttccaggggatgttt

SEQ ID NO: 30534 - DNA, 24 bp, synthetic construct
  misc_feature 1..24: note = Synthetic Construct
  source 1..24: mol_type = other DNA
gcattaccatgccctgtgattaag

SEQ ID NO: 30535 - DNA, 27 bp, synthetic construct
  misc_feature 1..27: note = Synthetic Construct
  source 1..27: mol_type = other DNA
ggggactactaccagtgttaagtgaga

SEQ ID NO: 30536 - DNA, 23 bp, synthetic construct
  misc_feature 1..23: note = Synthetic Construct
  source 1..23: mol_type = other DNA
tccaggctgctatcatctcttct

SEQ ID NO: 30537 - DNA, 28 bp, synthetic construct
  misc_feature 1..28: note = Synthetic Construct
  source 1..28: mol_type = other DNA
cccttcagtgtcaaccttatggatcttc

SEQ ID NO: 30538 - DNA, 23 bp, synthetic construct
  misc_feature 1..23: note = Synthetic Construct
  source 1..23: mol_type = other DNA
gctcatcttccatcggagcaact

SEQ ID NO: 30539 - DNA, 22 bp, synthetic construct
  misc_feature 1..22: note = Synthetic Construct
  source 1..22: mol_type = other DNA
accaaaacgcctccagaaaagt

SEQ ID NO: 30540 - DNA, 21 bp, synthetic construct
  misc_feature 1..21: note = Synthetic Construct
  source 1..21: mol_type = other DNA
tcacaggcagagtagggcata

SEQ ID NO: 30541 - DNA, 22 bp, synthetic construct
  misc_feature 1..22: note = Synthetic Construct
  source 1..22: mol_type = other DNA
agagaggacatcaggggaacaa

SEQ ID NO: 30542 - DNA, 26 bp, synthetic construct
  misc_feature 1..26: note = Synthetic Construct
  source 1..26: mol_type = other DNA
ggccatggcaaataggaaaaggtttg

SEQ ID NO: 30543 - DNA, 22 bp, synthetic construct
  misc_feature 1..22: note = Synthetic Construct
  source 1..22: mol_type = other DNA
gcccagaaaccaggagatgatg

SEQ ID NO: 30544 - DNA, 21 bp, synthetic construct
  misc_feature 1..21: note = Synthetic Construct
  source 1..21: mol_type = other DNA
catgtacccacgcctgaatct

SEQ ID NO: 30545 - DNA, 24 bp, synthetic construct
  misc_feature 1..24: note = Synthetic Construct
  source 1..24: mol_type = other DNA
gcaaagattcaggcatcggaataa

SEQ ID NO: 30546 - DNA, 22 bp, synthetic construct
  misc_feature 1..22: note = Synthetic Construct
  source 1..22: mol_type = other DNA
tggaattggcagggtcttctct

SEQ ID NO: 30547 - DNA, 23 bp, synthetic construct
  misc_feature 1..23: note = Synthetic Construct
  source 1..23: mol_type = other DNA
cagacgcacctagagttgtccta

SEQ ID NO: 30548 - DNA, 27 bp, synthetic construct
  misc_feature 1..27: note = Synthetic Construct
  source 1..27: mol_type = other DNA
ccagagtcggtattttcaatcaccaaa

SEQ ID NO: 30549 - DNA, 26 bp, synthetic construct
  misc_feature 1..26: note = Synthetic Construct
  source 1..26: mol_type = other DNA
gtgtgtcatattctcccctaggactt

SEQ ID NO: 30550 - DNA, 22 bp, synthetic construct
  misc_feature 1..22: note = Synthetic Construct
  source 1..22: mol_type = other DNA
cccagacatgcccttgaccttt

SEQ ID NO: 30551 - DNA, 27 bp, synthetic construct
  misc_feature 1..27: note = Synthetic Construct
  source 1..27: mol_type = other DNA
ggctagaactgaaaaacagaggctgta

SEQ ID NO: 30552 - DNA, 22 bp, synthetic construct
  misc_feature 1..22: note = Synthetic Construct
  source 1..22: mol_type = other DNA
tgaccagggttcacacctcaga

SEQ ID NO: 30553 - DNA, 27 bp, synthetic construct
  misc_feature 1..27: note = Synthetic Construct
  source 1..27: mol_type = other DNA
gggctatcaccagtttgactattctgt

SEQ ID NO: 30554 - DNA, 30 bp, synthetic construct
  misc_feature 1..30: note = Synthetic Construct
  source 1..30: mol_type = other DNA
ccatgttagagggtttaagtcatggagttc

SEQ ID NO: 30555 - DNA, 26 bp, synthetic construct
  misc_feature 1..26: note = Synthetic Construct
  source 1..26: mol_type = other DNA
gtaggtaaattggtaacaggcagttg

SEQ ID NO: 30556 - DNA, 22 bp, synthetic construct
  misc_feature 1..22: note = Synthetic Construct
  source 1..22: mol_type = other DNA
tccagtggcgaaatgtttctgt

SEQ ID NO: 30557 - DNA, 29 bp, synthetic construct
  misc_feature 1..29: note = Synthetic Construct
  source 1..29: mol_type = other DNA
ccagactaagatgtcaaggagacttggtt

SEQ ID NO: 30558 - DNA, 22 bp, synthetic construct
  misc_feature 1..22: note = Synthetic Construct
  source 1..22: mol_type = other DNA
tgattgccacttccatgccatt

SEQ ID NO: 30559 - DNA, 23 bp, synthetic construct
  misc_feature 1..23: note = Synthetic Construct
  source 1..23: mol_type = other DNA
ccacgttgtaggctgtgttattc

SEQ ID NO: 30560 - DNA, 22 bp, synthetic construct
  misc_feature 1..22: note = Synthetic Construct
  source 1..22: mol_type = other DNA
gcccaaaacctctctctcagaa

SEQ ID NO: 30561 - DNA, 25 bp, synthetic construct
  misc_feature 1..25: note = Synthetic Construct
  source 1..25: mol_type = other DNA
tcaggattttgtgagtgttcggtta

SEQ ID NO: 30562 - DNA, 21 bp, synthetic construct
  misc_feature 1..21: note = Synthetic Construct
  source 1..21: mol_type = other DNA
aggcatggagcctcttcttga

SEQ ID NO: 30563 - DNA, 27 bp, synthetic construct
  misc_feature 1..27: note = Synthetic Construct
  source 1..27: mol_type = other DNA
ccttgtgtgagatccttaggccaaaac

SEQ ID NO: 30564 - DNA, 28 bp, synthetic construct
  misc_feature 1..28: note = Synthetic Construct
  source 1..28: mol_type = other DNA
gccctagatagtcaccccttatctgtct

SEQ ID NO: 30565 - DNA, 25 bp, synthetic construct
  misc_feature 1..25: note = Synthetic Construct
  source 1..25: mol_type = other DNA
ctgtcctagctcctggtaaaagttc

SEQ ID NO: 30566 - DNA, 24 bp, synthetic construct
  misc_feature 1..24: note = Synthetic Construct
  source 1..24: mol_type = other DNA
tttccctgaaatgatggcactaca

SEQ ID NO: 30567 - DNA, 21 bp, synthetic construct
  misc_feature 1..21: note = Synthetic Construct
  source 1..21: mol_type = other DNA
aaggctggcttcgggtagaga

SEQ ID NO: 30568 - DNA, 20 bp, synthetic construct
  misc_feature 1..20: note = Synthetic Construct
  source 1..20: mol_type = other DNA
ggtactgctaccgtgctgtt

SEQ ID NO: 30569 - DNA, 24 bp, synthetic construct
  misc_feature 1..24: note = Synthetic Construct
  source 1..24: mol_type = other DNA
agcacacttggcatgaaaagaaag

SEQ ID NO: 30570 - DNA, 21 bp, synthetic construct
  misc_feature 1..21: note = Synthetic Construct
  source 1..21: mol_type = other DNA
ggagcattgcttgaggagaca

SEQ ID NO: 30571 - DNA, 22 bp, synthetic construct
  misc_feature 1..22: note = Synthetic Construct
  source 1..22: mol_type = other DNA
ggaatgaagagggcttctcaca

SEQ ID NO: 30572 - DNA, 27 bp, synthetic construct
  misc_feature 1..27: note = Synthetic Construct
  source 1..27: mol_type = other DNA
gggcagcatgaatgacattgtatctct

SEQ ID NO: 30573 - DNA, 20 bp, synthetic construct
  misc_feature 1..20: note = Synthetic Construct
  source 1..20: mol_type = other DNA
ggatgccatggctgccaaac

SEQ ID NO: 30574 - DNA, 24 bp, synthetic construct
  misc_feature 1..24: note = Synthetic Construct
  source 1..24: mol_type = other DNA
ggaggagaagcagagagcatgaga

SEQ ID NO: 30575 - DNA, 23 bp, synthetic construct
  misc_feature 1..23: note = Synthetic Construct
  source 1..23: mol_type = other DNA
cctccttgctggctgaattgtga

SEQ ID NO: 30576 - DNA, 24 bp, synthetic construct
  misc_feature 1..24: note = Synthetic Construct
  source 1..24: mol_type = other DNA
cctggaaacagcttgcttgtgaag

SEQ ID NO: 30577 - DNA, 24 bp, synthetic construct
  misc_feature 1..24: note = Synthetic Construct
  source 1..24: mol_type = other DNA
tgccttttattcagtcctgaggtt

SEQ ID NO: 30578 - DNA, 22 bp, synthetic construct
  misc_feature 1..22: note = Synthetic Construct
  source 1..22: mol_type = other DNA
gtaaagcccgggtcctaacatt

SEQ ID NO: 30579 - DNA, 26 bp, synthetic construct
  misc_feature 1..26: note = Synthetic Construct
  source 1..26: mol_type = other DNA
cctgtaagatgtctgagtggacaatg

SEQ ID NO: 30580 - DNA, 20 bp, synthetic construct
  misc_feature 1..20: note = Synthetic Construct
  source 1..20: mol_type = other DNA
ggccagcaatctggctttca

SEQ ID NO: 30581 - DNA, 24 bp, synthetic construct
  misc_feature 1..24: note = Synthetic Construct
  source 1..24: mol_type = other DNA
acccaccttcctctgtaactatct

SEQ ID NO: 30582 - DNA, 25 bp, synthetic construct
  misc_feature 1..25: note = Synthetic Construct
  source 1..25: mol_type = other DNA
aaagcagtttcttaccctgtgagat

SEQ ID NO: 30583 - DNA, 22 bp, synthetic construct
  misc_feature 1..22: note = Synthetic Construct
  source 1..22: mol_type = other DNA
tgtgcaaaagggcttgcttatc

SEQ ID NO: 30584 - DNA, 24 bp, synthetic construct
  misc_feature 1..24: note = Synthetic Construct
  source 1..24: mol_type = other DNA
atgtggtctcaaatagctccaaca

SEQ ID NO: 30585 - DNA, 21 bp, synthetic construct
  misc_feature 1..21: note = Synthetic Construct
  source 1..21: mol_type = other DNA
ggccacatgcaggaacaaatg

SEQ ID NO: 30586 - DNA, 22 bp, synthetic construct
  misc_feature 1..22: note = Synthetic Construct
  source 1..22: mol_type = other DNA
cctcttcatctcctggctcaca

SEQ ID NO: 30587 - DNA, 21 bp, synthetic construct
  misc_feature 1..21: note = Synthetic Construct
  source 1..21: mol_type = other DNA
cttgctggagggtcactgtag

SEQ ID NO: 30588 - DNA, 26 bp, synthetic construct
  misc_feature 1..26: note = Synthetic Construct
  source 1..26: mol_type = other DNA
gagaatgcatctcccttggaaatagt

SEQ ID NO: 30589 - DNA, 25 bp, synthetic construct
  misc_feature 1..25: note = Synthetic Construct
  source 1..25: mol_type = other DNA
ccgtgtggttttaccatccttcaac

SEQ ID NO: 30590 - DNA, 27 bp, synthetic construct
  misc_feature 1..27: note = Synthetic Construct
  source 1..27: mol_type = other DNA
cactaaaaggtgtgacaggagtataga

SEQ ID NO: 30591 - DNA, 22 bp, synthetic construct
  misc_feature 1..22: note = Synthetic Construct
  source 1..22: mol_type = other DNA
tcccacccaccatgagaactac

SEQ ID NO: 30592 - DNA, 20 bp, synthetic construct
  misc_feature 1..20: note = Synthetic Construct
  source 1..20: mol_type = other DNA
gcagctacctctccgtctca

SEQ ID NO: 30593 - DNA, 27 bp, synthetic construct
  misc_feature 1..27: note = Synthetic Construct
  source 1..27: mol_type = other DNA
gctgttcttgtctacacagttttctac

SEQ ID NO: 30594 - DNA, 22 bp, synthetic construct
  misc_feature 1..22: note = Synthetic Construct
  source 1..22: mol_type = other DNA
gcggggaaaagagaaccatttg

SEQ ID NO: 30595 - DNA, 25 bp, synthetic construct
  misc_feature 1..25: note = Synthetic Construct
  source 1..25: mol_type = other DNA
tgctctattcaaagtgtgactgtct

SEQ ID NO: 30596 - DNA, 21 bp, synthetic construct
  misc_feature 1..21: note = Synthetic Construct
  source 1..21: mol_type = other DNA
gcccacctcactggagcaaaa

SEQ ID NO: 30597 - DNA, 26 bp, synthetic construct
  misc_feature 1..26: note = Synthetic Construct
  source 1..26: mol_type = other DNA
ccagacaggctgttcaaagaggatac

SEQ ID NO: 30598 - DNA, 22 bp, synthetic construct
  misc_feature 1..22: note = Synthetic Construct
  source 1..22: mol_type = other DNA
acccttgtcagggtacggtcaa

SEQ ID NO: 30599 - DNA, 20 bp, synthetic construct
  misc_feature 1..20: note = Synthetic Construct
  source 1..20: mol_type = other DNA
ataagagccggcccagaact

SEQ ID NO: 30600 - DNA, 21 bp, synthetic construct
  misc_feature 1..21: note = Synthetic Construct
  source 1..21: mol_type = other DNA
acatgtgcgcttctggagttc

SEQ ID NO: 30601 - DNA, 24 bp, synthetic construct
  misc_feature 1..24: note = Synthetic Construct
  source 1..24: mol_type = other DNA
ggactggacctcagtgttgctcta

SEQ ID NO: 30602 - DNA, 22 bp, synthetic construct
  misc_feature 1..22: note = Synthetic Construct
  source 1..22: mol_type = other DNA
gcgagaggggaattgctgaatg

SEQ ID NO: 30603 - DNA, 20 bp, synthetic construct
  misc_feature 1..20: note = Synthetic Construct
  source 1..20: mol_type = other DNA
ttgggaggtgggtcggctaa

SEQ ID NO: 30604 - DNA, 22 bp, synthetic construct
  misc_feature 1..22: note = Synthetic Construct
  source 1..22: mol_type = other DNA
ccagaggacaccaacgatcaga

SEQ ID NO: 30605 - DNA, 23 bp, synthetic construct
  misc_feature 1..23: note = Synthetic Construct
  source 1..23: mol_type = other DNA
tgtatatttgtgcgctccacgta

SEQ ID NO: 30606 - DNA, 25 bp, synthetic construct
  misc_feature 1..25: note = Synthetic Construct
  source 1..25: mol_type = other DNA
gcaatcaggtgtttctcactctaac

SEQ ID NO: 30607 - DNA, 19 bp, synthetic construct
  misc_feature 1..19: note = Synthetic Construct
  source 1..19: mol_type = other DNA
gcagtggggtgtccagcaa

SEQ ID NO: 30608 - DNA, 24 bp, synthetic construct
  misc_feature 1..24: note = Synthetic Construct
  source 1..24: mol_type = other DNA
tctctctagaccaacccacattct

SEQ ID NO: 30609 - DNA, 26 bp, synthetic construct
  misc_feature 1..26: note = Synthetic Construct
  source 1..26: mol_type = other DNA
ggactactgtttctcttcaccaacta

SEQ ID NO: 30610 - DNA, 25 bp, synthetic construct
  misc_feature 1..25: note = Synthetic Construct
  source 1..25: mol_type = other DNA
cccagagataagatcacgccatcaa

SEQ ID NO: 30611 - DNA, 25 bp, synthetic construct
  misc_feature 1..25: note = Synthetic Construct
  source 1..25: mol_type = other DNA
tggccgtggggttatataagtttag

SEQ ID NO: 30612 - DNA, 21 bp, synthetic construct
  misc_feature 1..21: note = Synthetic Construct
  source 1..21: mol_type = other DNA
tcaccccttgcaggaccctta

SEQ ID NO: 30613 - DNA, 24 bp, synthetic construct
  misc_feature 1..24: note = Synthetic Construct
  source 1..24: mol_type = other DNA
cactcctgtttagtctccaggttt

SEQ ID NO: 30614 - DNA, 27 bp, synthetic construct
  misc_feature 1..27: note = Synthetic Construct
  source 1..27: mol_type = other DNA
cctccattctctctgactgggatgaac

SEQ ID NO: 30615 - DNA, 25 bp, synthetic construct
  misc_feature 1..25: note = Synthetic Construct
  source 1..25: mol_type = other DNA
tgggtcaaagattaccaaacactga

SEQ ID NO: 30616 - DNA, 26 bp, synthetic construct
  misc_feature 1..26: note = Synthetic Construct
  source 1..26: mol_type = other DNA
ctccttactcacttgtctgactgaag

SEQ ID NO: 30617 - DNA, 21 bp, synthetic construct
  misc_feature 1..21: note = Synthetic Construct
  source 1..21: mol_type = other DNA
gctgaggcattttgggacaga

SEQ ID NO: 30618 - DNA, 22 bp, synthetic construct
  misc_feature 1..22: note = Synthetic Construct
  source 1..22: mol_type = other DNA
ggtgacccagagacccaagaaa

SEQ ID NO: 30619 - DNA, 30 bp, synthetic construct
  misc_feature 1..30: note = Synthetic Construct
  source 1..30: mol_type = other DNA
gactgagagcaagacaggatagatgatact

SEQ ID NO: 30620 - DNA, 19 bp, synthetic construct
  misc_feature 1..19: note = Synthetic Construct
  source 1..19: mol_type = other DNA
ggggcattgcctccttgaa

SEQ ID NO: 30621 - DNA, 26 bp, synthetic construct
  misc_feature 1..26: note = Synthetic Construct
  source 1..26: mol_type = other DNA
cacagaaaggcatggtcagaaaaatc

SEQ ID NO: 30622 - DNA, 24 bp, synthetic construct
  misc_feature 1..24: note = Synthetic Construct
  source 1..24: mol_type = other DNA
gcccctggtttcatgacagtgttc

SEQ ID NO: 30623 - DNA, 26 bp, synthetic construct
  misc_feature 1..26: note = Synthetic Construct
  source 1..26: mol_type = other DNA
cgaagtatcattttccccagtagtca

SEQ ID NO: 30624 - DNA, 21 bp, synthetic construct
  misc_feature 1..21: note = Synthetic Construct
  source 1..21: mol_type = other DNA
ctcttcatcgcaccagcaact

SEQ ID NO: 30625 - DNA, 26 bp, synthetic construct
  misc_feature 1..26: note = Synthetic Construct
  source 1..26: mol_type = other DNA
catgcagtaatccaggaaaccatttg

SEQ ID NO: 30626 - DNA, 21 bp, synthetic construct
  misc_feature 1..21: note = Synthetic Construct
  source 1..21: mol_type = other DNA
agccttttggggtccactttg

SEQ ID NO: 30627 - DNA, 23 bp, synthetic construct
  misc_feature 1..23: note = Synthetic Construct
  source 1..23: mol_type = other DNA
tcagcaaatggactcagacaact

SEQ ID NO: 30628 - DNA, 22 bp, synthetic construct
  misc_feature 1..22: note = Synthetic Construct
  source 1..22: mol_type = other DNA
ctaatccctccagcctctcctt

SEQ ID NO: 30629 - DNA, 20 bp, synthetic construct
  misc_feature 1..20: note = Synthetic Construct
  source 1..20: mol_type = other DNA
gggagctgctttgcatgagt

SEQ ID NO: 30630 - DNA, 21 bp, synthetic construct
  misc_feature 1..21: note = Synthetic Construct
  source 1..21: mol_type = other DNA
ggcaaacttctggagggacaa

SEQ ID NO: 30631 - DNA, 24 bp, synthetic construct
  misc_feature 1..24: note = Synthetic Construct
  source 1..24: mol_type = other DNA
tcctgttacagtagccaaaagcat

SEQ ID NO: 30632 - DNA, 23 bp, synthetic construct
  misc_feature 1..23: note = Synthetic Construct
  source 1..23: mol_type = other DNA
gagctaccaaccttctccacctt

SEQ ID NO: 30633 - DNA, 24 bp, synthetic construct
  misc_feature 1..24: note = Synthetic Construct
  source 1..24: mol_type = other DNA
gaaatcagctcacccattgctact

SEQ ID NO: 30634 - DNA, 24 bp, synthetic construct
  misc_feature 1..24: note = Synthetic Construct
  source 1..24: mol_type = other DNA
gaacttaaggagtcgatggtcgtt

SEQ ID NO: 30635 - DNA, 25 bp, synthetic construct
  misc_feature 1..25: note = Synthetic Construct
  source 1..25: mol_type = other DNA
gccacagacatcactaatgaacaca

SEQ ID NO: 30636 - DNA, 25 bp, synthetic construct
  misc_feature 1..25: note = Synthetic Construct
  source 1..25: mol_type = other DNA
gaggagcttgcataatggggagtag

SEQ ID NO: 30637 - DNA, 26 bp, synthetic construct
  misc_feature 1..26: note = Synthetic Construct
  source 1..26: mol_type = other DNA
ggtcactgttaggcaagaagccatac

SEQ ID NO: 30638 - DNA, 27 bp, synthetic construct
  misc_feature 1..27: note = Synthetic Construct
  source 1..27: mol_type = other DNA
cctatacatgcagcttaacatgtgact

SEQ ID NO: 30639 - DNA, 27 bp, synthetic construct
  misc_feature 1..27: note = Synthetic Construct
  source 1..27: mol_type = other DNA
ggtggcatagttttactaggttcaaca

SEQ ID NO: 30640 - DNA, 23 bp, synthetic construct
  misc_feature 1..23: note = Synthetic Construct
  source 1..23: mol_type = other DNA
cactcccctgtccatgctacttt

SEQ ID NO: 30641 - DNA, 22 bp, synthetic construct
  misc_feature 1..22: note = Synthetic Construct
  source 1..22: mol_type = other DNA
ggagaccgtcctgtgatactgt

SEQ ID NO: 30642 - DNA, 22 bp, synthetic construct
  misc_feature 1..22: note = Synthetic Construct
  source 1..22: mol_type = other DNA
ggtcagcaacaggagctcaaga

SEQ ID NO: 30643 - DNA, 21 bp, synthetic construct
  misc_feature 1..21: note = Synthetic Construct
  source 1..21: mol_type = other DNA
tgaatggaaacccgtgctgta

SEQ ID NO: 30644 - DNA, 24 bp, synthetic construct
  misc_feature 1..24: note = Synthetic Construct
  source 1..24: mol_type = other DNA
aatgcaggagacctcacattttct

SEQ ID NO: 30645 - DNA, 22 bp, synthetic construct
  misc_feature 1..22: note = Synthetic Construct
  source 1..22: mol_type = other DNA
ggtttcttccagcctgcaatgt

SEQ ID NO: 30646 - DNA, 19 bp, synthetic construct
  misc_feature 1..19: note = Synthetic Construct
  source 1..19: mol_type = other DNA
agggcactgacggctgctt

SEQ ID NO: 30647 - DNA, 21 bp, synthetic construct
  misc_feature 1..21: note = Synthetic Construct
  source 1..21: mol_type = other DNA
agcactgcacacaagacaagt

SEQ ID NO: 30648 - DNA, 24 bp, synthetic construct
  misc_feature 1..24: note = Synthetic Construct
  source 1..24: mol_type = other DNA
aagtgaatttcctggcaccttttc

SEQ ID NO: 30649 - DNA, 24 bp, synthetic construct
  misc_feature 1..24: note = Synthetic Construct
  source 1..24: mol_type = other DNA
cttcccatgtttaggatgggttgt

SEQ ID NO: 30650 - DNA, 19 bp, synthetic construct
  misc_feature 1..19: note = Synthetic Construct
  source 1..19: mol_type = other DNA
ccccacagggtcagcttct

SEQ ID NO: 30651 - DNA, 22 bp, synthetic construct
  misc_feature 1..22: note = Synthetic Construct
  source 1..22: mol_type = other DNA
ggaaggggcagtggttcagatg

SEQ ID NO: 30652 - DNA, 25 bp, synthetic construct
  misc_feature 1..25: note = Synthetic Construct
  source 1..25: mol_type = other DNA
aggtaagtgacagtttgctctttga

SEQ ID NO: 30653 - DNA, 22 bp, synthetic construct
  misc_feature 1..22: note = Synthetic Construct
  source 1..22: mol_type = other DNA
cagagccatttcctcagcgtaa

SEQ ID NO: 30654 - DNA, 23 bp, synthetic construct
  misc_feature 1..23: note = Synthetic Construct
  source 1..23: mol_type = other DNA
tgctctgagacaatgcaaagtga

SEQ ID NO: 30655 - DNA, 23 bp, synthetic construct
  misc_feature 1..23: note = Synthetic Construct
  source 1..23: mol_type = other DNA
gggcagtaggaggagacttatct

SEQ ID NO: 30656 - DNA, 23 bp, synthetic construct
  misc_feature 1..23: note = Synthetic Construct
  source 1..23: mol_type = other DNA
ggcctcacacaatgacaggaact

SEQ ID NO: 30657 - DNA, 23 bp, synthetic construct
  misc_feature 1..23: note = Synthetic Construct
  source 1..23: mol_type = other DNA
cgcccacaagtcatgaagcaaac

SEQ ID NO: 30658 - DNA, 24 bp, synthetic construct
  misc_feature 1..24: note = Synthetic Construct
  source 1..24: mol_type = other DNA
gccggaagactcagcaagtctagt

SEQ ID NO: 30659 - DNA, 24 bp, synthetic construct
  misc_feature 1..24: note = Synthetic Construct
  source 1..24: mol_type = other DNA
gactcctttctgaaggactgtgaa

SEQ ID NO: 30660 - DNA, 22 bp, synthetic construct
  misc_feature 1..22: note = Synthetic Construct
  source 1..22: mol_type = other DNA
ccaggaggcaagcaggtagttt

SEQ ID NO: 30661 - DNA, 22 bp, synthetic construct
  misc_feature 1..22: note = Synthetic Construct
  source 1..22: mol_type = other DNA
ctcccaggctctgagaatgaca

SEQ ID NO: 30662 - DNA, 25 bp, synthetic construct
  misc_feature 1..25: note = Synthetic Construct
  source 1..25: mol_type = other DNA
ggggtagaatccaggcattgggaat

SEQ ID NO: 30663 - DNA, 23 bp, synthetic construct
  misc_feature 1..23: note = Synthetic Construct
  source 1..23: mol_type = other DNA
acggtgtctaagaatgagcttgt

SEQ ID NO: 30664 - DNA, 22 bp, synthetic construct
  misc_feature 1..22: note = Synthetic Construct
  source 1..22: mol_type = other DNA
ggggcagattccgttccattca

SEQ ID NO: 30665 - DNA, 26 bp, synthetic construct
  misc_feature 1..26: note = Synthetic Construct
  source 1..26: mol_type = other DNA
cccttctctactcagaatggaacagt

SEQ ID NO: 30666 - DNA, 23 bp, synthetic construct
  misc_feature 1..23: note = Synthetic Construct
  source 1..23: mol_type = other DNA
ctaggcatggcatggtaaacaag

SEQ ID NO: 30667 - DNA, 23 bp, synthetic construct
  misc_feature 1..23: note = Synthetic Construct
  source 1..23: mol_type = other DNA
gcaaacagtaagcagctttgaga

SEQ ID NO: 30668 - DNA, 27 bp, synthetic construct
  misc_feature 1..27: note = Synthetic Construct
  source 1..27: mol_type = other DNA
cttgagattttctcaggctcttgaatc

SEQ ID NO: 30669 - DNA, 29 bp, synthetic construct
  misc_feature 1..29: note = Synthetic Construct
  source 1..29: mol_type = other DNA
ctccctaagtgtttttatgggtctctgaa

SEQ ID NO: 30670 - DNA, 26 bp, synthetic construct
  misc_feature 1..26: note = Synthetic Construct
  source 1..26: mol_type = other DNA
cttgaaagctttatgaccaggcttag

SEQ ID NO: 30671 - DNA, 22 bp, synthetic construct
  misc_feature 1..22: note = Synthetic Construct
  source 1..22: mol_type = other DNA
gggacactcactgcctttggtt

SEQ ID NO: 30672 - DNA, 24 bp, synthetic construct
  misc_feature 1..24: note = Synthetic Construct
  source 1..24: mol_type = other DNA
acctgcttcagatcctacaggaaa

SEQ ID NO: 30673 - DNA, 21 bp, synthetic construct
  misc_feature 1..21: note = Synthetic Construct
  source 1..21: mol_type = other DNA
ttggggcaccgagggatttgt

SEQ ID NO: 30674 - DNA, 23 bp, synthetic construct
  misc_feature 1..23: note = Synthetic Construct
  source 1..23: mol_type = other DNA
ttgtaaaccgtgagggagagatg

SEQ ID NO: 30675 - DNA, 21 bp, synthetic construct
  misc_feature 1..21: note = Synthetic Construct
  source 1..21: mol_type = other DNA
gttcatgctgatgcccgtttg

SEQ ID NO: 30676 - DNA, 19 bp, synthetic construct
  misc_feature 1..19: note = Synthetic Construct
  source 1..19: mol_type = other DNA
aggtggaggccaggaccat

SEQ ID NO: 30677 - DNA, 27 bp, synthetic construct
  misc_feature 1..27: note = Synthetic Construct
  source 1..27: mol_type = other DNA
tggtaggtaccaaataggaaagtcttg

SEQ ID NO: 30678 - DNA, 23 bp, synthetic construct
  misc_feature 1..23: note = Synthetic Construct
  source 1..23: mol_type = other DNA
gccatgtgaagtcagtcctgtga

SEQ ID NO: 30679 - DNA, 21 bp, synthetic construct
  misc_feature 1..21: note = Synthetic Construct
  source 1..21: mol_type = other DNA
ttccacggactgctcggagat

SEQ ID NO: 30680 - DNA, 24 bp, synthetic construct
  misc_feature 1..24: note = Synthetic Construct
  source 1..24: mol_type = other DNA
ggtctcaggcacctaaacctcttc

SEQ ID NO: 30681 - DNA, 22 bp, synthetic construct
  misc_feature 1..22: note = Synthetic Construct
  source 1..22: mol_type = other DNA
tgcagagactggcacctgtaac

SEQ ID NO: 30682 - DNA, 24 bp, synthetic construct
  misc_feature 1..24: note = Synthetic Construct
  source 1..24: mol_type = other DNA
ggtctacatcttggttgccacttc

SEQ ID NO: 30683 - DNA, 25 bp, synthetic construct
  misc_feature 1..25: note = Synthetic Construct
  source 1..25: mol_type = other DNA
ctggatcactgaagtcaggaggaaa

SEQ ID NO: 30684 - DNA, 25 bp, synthetic construct
  misc_feature 1..25: note = Synthetic Construct
  source 1..25: mol_type = other DNA
cagctatatgctgagggttgacagt

SEQ ID NO: 30685 - DNA, 29 bp, synthetic construct
  misc_feature 1..29: note = Synthetic Construct
  source 1..29: mol_type = other DNA
gcagctattttcaaagaccccttttcaag

SEQ ID NO: 30686 - DNA, 26 bp, synthetic construct
  misc_feature 1..26: note = Synthetic Construct
  source 1..26: mol_type = other DNA
gaggatcacatcagactgtgttagtt

SEQ ID NO: 30687 - DNA, 23 bp, synthetic construct
  misc_feature 1..23: note = Synthetic Construct
  source 1..23: mol_type = other DNA
gcctttgagctgcagatttcaca

SEQ ID NO: 30688 - DNA, 22 bp, synthetic construct
  misc_feature 1..22: note = Synthetic Construct
  source 1..22: mol_type = other DNA
tcatgacccaggctctctccta

SEQ ID NO: 30689 - DNA, 23 bp, synthetic construct
  misc_feature 1..23: note = Synthetic Construct
  source 1..23: mol_type = other DNA
ggcatttggtacctcacgtgctt

SEQ ID NO: 30690 - DNA, 22 bp, synthetic construct
  misc_feature 1..22: note = Synthetic Construct
  source 1..22: mol_type = other DNA
agggctaggagtgggtgtcatt

SEQ ID NO: 30691 - DNA, 21 bp, synthetic construct
  misc_feature 1..21: note = Synthetic Construct
  source 1..21: mol_type = other DNA
ggtgtcaccctcctcccaaga

SEQ ID NO: 30692 - DNA, 25 bp, synthetic construct
  misc_feature 1..25: note = Synthetic Construct
  source 1..25: mol_type = other DNA
tgagaatactacccacaagggtctt

SEQ ID NO: 30693 - DNA, 23 bp, synthetic construct
  misc_feature 1..23: note = Synthetic Construct
  source 1..23: mol_type = other DNA
gtcttgggaagacccgatcatct

SEQ ID NO: 30694 - DNA, 25 bp, synthetic construct
  misc_feature 1..25: note = Synthetic Construct
  source 1..25: mol_type = other DNA
gaactgggagctcctacaaatacat

SEQ ID NO: 30695 - DNA, 23 bp, synthetic construct
  misc_feature 1..23: note = Synthetic Construct
  source 1..23: mol_type = other DNA
agggatacctgggagctgtcatc

SEQ ID NO: 30696 - DNA, 23 bp, synthetic construct
  misc_feature 1..23: note = Synthetic Construct
  source 1..23: mol_type = other DNA
gccaagtctgcattccactgtgt

SEQ ID NO: 30697 - DNA, 24 bp, synthetic construct
  misc_feature 1..24: note = Synthetic Construct
  source 1..24: mol_type = other DNA
cctgtgtctcggtctcacctatca

SEQ ID NO: 30698 - DNA, 25 bp, synthetic construct
  misc_feature 1..25: note = Synthetic Construct
  source 1..25: mol_type = other DNA
cccacacttctagatcctgctgttg

SEQ ID NO: 30699 - DNA, 21 bp, synthetic construct
  misc_feature 1..21: note = Synthetic Construct
  source 1..21: mol_type = other DNA
gtcccctcccctaaggagtca

SEQ ID NO: 30700 - DNA, 21 bp, synthetic construct
  misc_feature 1..21: note = Synthetic Construct
  source 1..21: mol_type = other DNA
gcacgccaagttctcggatgt

SEQ ID NO: 30701 - DNA, 25 bp, synthetic construct
  misc_feature 1..25: note = Synthetic Construct
  source 1..25: mol_type = other DNA
ccatgggatggagccactacagaaa

SEQ ID NO: 30702 - DNA, 22 bp, synthetic construct
  misc_feature 1..22: note = Synthetic Construct
  source 1..22: mol_type = other DNA
gagccagggaggtggaagaaat

SEQ ID NO: 30703 - DNA, 27 bp, synthetic construct
  misc_feature 1..27: note = Synthetic Construct
  source 1..27: mol_type = other DNA
gaagtgaacagagagtttcatgtcaga

SEQ ID NO: 30704 - DNA, 26 bp, synthetic construct
  misc_feature 1..26: note = Synthetic Construct
  source 1..26: mol_type = other DNA
gaggggaggaggcttttattttcttg

SEQ ID NO: 30705 - DNA, 21 bp, synthetic construct
  misc_feature 1..21: note = Synthetic Construct
  source 1..21: mol_type = other DNA
accgttccccttctcccttgt

SEQ ID NO: 30706 - DNA, 23 bp, synthetic construct
  misc_feature 1..23: note = Synthetic Construct
  source 1..23: mol_type = other DNA
ccataggtaggtgggcaaacaca

SEQ ID NO: 30707 - DNA, 20 bp, synthetic construct
  misc_feature 1..20: note = Synthetic Construct
  source 1..20: mol_type = other DNA
gcagtgctgtggctgtgaag

SEQ ID NO: 30708 - DNA, 26 bp, synthetic construct
  misc_feature 1..26: note = Synthetic Construct
  source 1..26: mol_type = other DNA
gggcttagatgacgacattgttggtt

SEQ ID NO: 30709 - DNA, 25 bp, synthetic construct
  misc_feature 1..25: note = Synthetic Construct
  source 1..25: mol_type = other DNA
ccagagcactgggtaaaatgcttag

SEQ ID NO: 30710 - DNA, 21 bp, synthetic construct
  misc_feature 1..21: note = Synthetic Construct
  source 1..21: mol_type = other DNA
ttgggatgcctctccttggta

SEQ ID NO: 30711 - DNA, 25 bp, synthetic construct
  misc_feature 1..25: note = Synthetic Construct
  source 1..25: mol_type = other DNA
ccctcccattaagcagaggtgaact

SEQ ID NO: 30712 - DNA, 22 bp, synthetic construct
  misc_feature 1..22: note = Synthetic Construct
  source 1..22: mol_type = other DNA
tgcagtctccagtaggctgtga

SEQ ID NO: 30713 - DNA, 21 bp, synthetic construct
  misc_feature 1..21: note = Synthetic Construct
  source 1..21: mol_type = other DNA
cagtgctgaacacacctgaga

SEQ ID NO: 30714 - DNA, 22 bp, synthetic construct
  misc_feature 1..22: note = Synthetic Construct
  source 1..22: mol_type = other DNA
atcatgcccctcctctatcact

SEQ ID NO: 30715 - DNA, 21 bp, synthetic construct
  misc_feature 1..21: note = Synthetic Construct
  source 1..21: mol_type = other DNA
gccccggtaacgaggttttct

SEQ ID NO: 30716 - DNA, 27 bp, synthetic construct
  misc_feature 1..27: note = Synthetic Construct
  source 1..27: mol_type = other DNA
ggtcatacgttaaggacatgtttcact

SEQ ID NO: 30717 - DNA, 27 bp, synthetic construct
  misc_feature 1..27: note = Synthetic Construct
  source 1..27: mol_type = other DNA
cttcacattttcccagctagactgaat

SEQ ID NO: 30718 - DNA, 21 bp, synthetic construct
  misc_feature 1..21: note = Synthetic Construct
  source 1..21: mol_type = other DNA
ggtgcctccaaaagccttgta

SEQ ID NO: 30719 - DNA, 20 bp, synthetic construct
  misc_feature 1..20: note = Synthetic Construct
  source 1..20: mol_type = other DNA
gcccacctgatcacaaccat

SEQ ID NO: 30720 - DNA, 25 bp, synthetic construct
  misc_feature 1..25: note = Synthetic Construct
  source 1..25: mol_type = other DNA
gagttgtgtagctgactagacttca

SEQ ID NO: 30721 - DNA, 22 bp, synthetic construct
  misc_feature 1..22: note = Synthetic Construct
  source 1..22: mol_type = other DNA
gcacaatgccatgtgggaggaa

SEQ ID NO: 30722 - DNA, 21 bp, synthetic construct
  misc_feature 1..21: note = Synthetic Construct
  source 1..21: mol_type = other DNA
aaccaagcctgagtcctctct

SEQ ID NO: 30723 - DNA, 22 bp, synthetic construct
  misc_feature 1..22: note = Synthetic Construct
  source 1..22: mol_type = other DNA
aggcagaccactaactggagaa

SEQ ID NO: 30724 - DNA, 25 bp, synthetic construct
  misc_feature 1..25: note = Synthetic Construct
  source 1..25: mol_type = other DNA
ctggggcttactacagcttgaaaac

SEQ ID NO: 30725 - DNA, 23 bp, synthetic construct
  misc_feature 1..23: note = Synthetic Construct
  source 1..23: mol_type = other DNA
cattggacacactcaggtaggtt

SEQ ID NO: 30726 - DNA, 22 bp, synthetic construct
  misc_feature 1..22: note = Synthetic Construct
  source 1..22: mol_type = other DNA
agtgtgggccttctgtatcact

SEQ ID NO: 30727 - DNA, 23 bp, synthetic construct
  misc_feature 1..23: note = Synthetic Construct
  source 1..23: mol_type = other DNA
gccccactgagggaaatgttttg

SEQ ID NO: 30728 - DNA, 26 bp, synthetic construct
  misc_feature 1..26: note = Synthetic Construct
  source 1..26: mol_type = other DNA
tgtgttatggacctgtctatctctga

SEQ ID NO: 30729 - DNA, 28 bp, synthetic construct
  misc_feature 1..28: note = Synthetic Construct
  source 1..28: mol_type = other DNA
gtggtgtcctgattttcctattgggttt

SEQ ID NO: 30730 - DNA, 24 bp, synthetic construct
  misc_feature 1..24: note = Synthetic Construct
  source 1..24: mol_type = other DNA
ggctgtctccaaagcaaggtgaac

SEQ ID NO: 30731 - DNA, 20 bp, synthetic construct
  misc_feature 1..20: note = Synthetic Construct
  source 1..20: mol_type = other DNA
ggacaagacccactgtgcaa

SEQ ID NO: 30732 - DNA, 20 bp, synthetic construct
  misc_feature 1..20: note = Synthetic Construct
  source 1..20: mol_type = other DNA
ttgcccctctccatgctttc

SEQ ID NO: 30733 - DNA, 20 bp, synthetic construct
  misc_feature 1..20: note = Synthetic Construct
  source 1..20: mol_type = other DNA
gagcaccaagccccattagt

SEQ ID NO: 30734 - DNA, 21 bp, synthetic construct
  misc_feature 1..21: note = Synthetic Construct
  source 1..21: mol_type = other DNA
cctgctgtgaccaggaagtca

SEQ ID NO: 30735 - DNA, 26 bp, synthetic construct
  misc_feature 1..26: note = Synthetic Construct
  source 1..26: mol_type = other DNA
ccttttcctgtctctcaggcctattc

SEQ ID NO: 30736 - DNA, 20 bp, synthetic construct
  misc_feature 1..20: note = Synthetic Construct
  source 1..20: mol_type = other DNA
agcaggcccttctggactat

SEQ ID NO: 30737 - DNA, 25 bp, synthetic construct
  misc_feature 1..25: note = Synthetic Construct
  source 1..25: mol_type = other DNA
gaggggaatggtttaccttcgtcaa

SEQ ID NO: 30738 - DNA, 22 bp, synthetic construct
  misc_feature 1..22: note = Synthetic Construct
  source 1..22: mol_type = other DNA
cctggtgcagggagacatttac

SEQ ID NO: 30739 - DNA, 20 bp, synthetic construct
  misc_feature 1..20: note = Synthetic Construct
  source 1..20: mol_type = other DNA
gggctgtgcacattccagta

SEQ ID NO: 30740 - DNA, 25 bp, synthetic construct
  misc_feature 1..25: note = Synthetic Construct
  source 1..25: mol_type = other DNA
acactaaatggtctccctgatcctt

SEQ ID NO: 30741 - DNA, 26 bp, synthetic construct
  misc_feature 1..26: note = Synthetic Construct
  source 1..26: mol_type = other DNA
gcaagtaagaatgggtttgagtcagt

SEQ ID NO: 30742 - DNA, 27 bp, synthetic construct
  misc_feature 1..27: note = Synthetic Construct
  source 1..27: mol_type = other DNA
cccacagcaatatgtcagaaacgataa

SEQ ID NO: 30743 - DNA, 25 bp, synthetic construct
  misc_feature 1..25: note = Synthetic Construct
  source 1..25: mol_type = other DNA
tgctgaatcttgctaggattgactt

SEQ ID NO: 30744 - DNA, 26 bp, synthetic construct
  misc_feature 1..26: note = Synthetic Construct
  source 1..26: mol_type = other DNA
cacatgaaacacacacagactgattc

SEQ ID NO: 30745 - DNA, 19 bp, synthetic construct
  misc_feature 1..19: note = Synthetic Construct
  source 1..19: mol_type = other DNA
ggtctggggacagccaagt

SEQ ID NO: 30746 - DNA, 25 bp, synthetic construct
  misc_feature 1..25: note = Synthetic Construct
  source 1..25: mol_type = other DNA
gcacagagacataggacttggtgtt

SEQ ID NO: 30747 - DNA, 20 bp, synthetic construct
  misc_feature 1..20: note = Synthetic Construct
  source 1..20: mol_type = other DNA
gatgcccatctggacgtgat

SEQ ID NO: 30748 - DNA, 24 bp, synthetic construct
  misc_feature 1..24: note = Synthetic Construct
  source 1..24: mol_type = other DNA
gccctgcctcagaaaagtccattc

SEQ ID NO: 30749 - DNA, 22 bp, synthetic construct
  misc_feature 1..22: note = Synthetic Construct
  source 1..22: mol_type = other DNA
gccaaatgcttgaggtttgctt

SEQ ID NO: 30750 - DNA, 23 bp, synthetic construct
  misc_feature 1..23: note = Synthetic Construct
  source 1..23: mol_type = other DNA
gccgttgcagtgattgtaattct

SEQ ID NO: 30751 - DNA, 23 bp, synthetic construct
  misc_feature 1..23: note = Synthetic Construct
  source 1..23: mol_type = other DNA
actaggagcccttctctttccaa

SEQ ID NO: 30752 - DNA, 24 bp, synthetic construct
  misc_feature 1..24: note = Synthetic Construct
  source 1..24: mol_type = other DNA
ccactagcgtaggacagtcattct

SEQ ID NO: 30753 - DNA, 20 bp, synthetic construct
  misc_feature 1..20: note = Synthetic Construct
  source 1..20: mol_type = other DNA
ctcctgtggtggtgatgctt

SEQ ID NO: 30754 - DNA, 26 bp, synthetic construct
  misc_feature 1..26: note = Synthetic Construct
  source 1..26: mol_type = other DNA
ccccaagtctcggtcttttatttaca

SEQ ID NO: 30755 - DNA, 24 bp, synthetic construct
  misc_feature 1..24: note = Synthetic Construct
  source 1..24: mol_type = other DNA
cccagagaatggacagtttacaga

SEQ ID NO: 30756 - DNA, 21 bp, synthetic construct
  misc_feature 1..21: note = Synthetic Construct
  source 1..21: mol_type = other DNA
gcatgggcttcccatccacat

SEQ ID NO: 30757 - DNA, 24 bp, synthetic construct
  misc_feature 1..24: note = Synthetic Construct
  source 1..24: mol_type = other DNA
ggtatttgcaagttcccgaatcaa

SEQ ID NO: 30758 - DNA, 20 bp, synthetic construct
  misc_feature 1..20: note = Synthetic Construct
  source 1..20: mol_type = other DNA
ctgcctcccatagggctagt

SEQ ID NO: 30759 - DNA, 27 bp, synthetic construct
  misc_feature 1..27: note = Synthetic Construct
  source 1..27: mol_type = other DNA
cacttatgtcccctaccaaacccatac

SEQ ID NO: 30760 - DNA, 21 bp, synthetic construct
  misc_feature 1..21: note = Synthetic Construct
  source 1..21: mol_type = other DNA
gggtgggagcgcctattcttg

SEQ ID NO: 30761 - DNA, 23 bp, synthetic construct
  misc_feature 1..23: note = Synthetic Construct
  source 1..23: mol_type = other DNA
gcgttcgaagcactctacacact

SEQ ID NO: 30762 - DNA, 24 bp, synthetic construct
  misc_feature 1..24: note = Synthetic Construct
  source 1..24: mol_type = other DNA
cactgagttccaccagttcaaaca

SEQ ID NO: 30763 - DNA, 20 bp, synthetic construct
  misc_feature 1..20: note = Synthetic Construct
  source 1..20: mol_type = other DNA
tccagcccaacacctcatca

SEQ ID NO: 30764 - DNA, 20 bp, synthetic construct
  misc_feature 1..20: note = Synthetic Construct
  source 1..20: mol_type = other DNA
agtgacagccccatcactgt

SEQ ID NO: 30765 - DNA, 26 bp, synthetic construct
  misc_feature 1..26: note = Synthetic Construct
  source 1..26: mol_type = other DNA
cctgagggtacatttctcacagatac

SEQ ID NO: 30766 - DNA, 25 bp, synthetic construct
  misc_feature 1..25: note = Synthetic Construct
  source 1..25: mol_type = other DNA
gcagacatttggcattagaggaagt

SEQ ID NO: 30767 - DNA, 26 bp, synthetic construct
  misc_feature 1..26: note = Synthetic Construct
  source 1..26: mol_type = other DNA
ctttctgtgattactgtggtgagatg

SEQ ID NO: 30768 - DNA, 20 bp, synthetic construct
  misc_feature 1..20: note = Synthetic Construct
  source 1..20: mol_type = other DNA
gcgtgttcaggagcaagaca

SEQ ID NO: 30769 - DNA, 21 bp, synthetic construct
  misc_feature 1..21: note = Synthetic Construct
  source 1..21: mol_type = other DNA
tgcttttggtgtgtccagtga

SEQ ID NO: 30770 - DNA, 23 bp, synthetic construct
  misc_feature 1..23: note = Synthetic Construct
  source 1..23: mol_type = other DNA
caaaactgctcctggtggagaac

SEQ ID NO: 30771 - DNA, 24 bp, synthetic construct
  misc_feature 1..24: note = Synthetic Construct
  source 1..24: mol_type = other DNA
ctgtactgcccaagatgagctttc

SEQ ID NO: 30772 - DNA, 21 bp, synthetic construct
  misc_feature 1..21: note = Synthetic Construct
  source 1..21: mol_type = other DNA
ggtcctgggctgattttctga

SEQ ID NO: 30773 - DNA, 26 bp, synthetic construct
  misc_feature 1..26: note = Synthetic Construct
  source 1..26: mol_type = other DNA
ggacaggcagagacaaaggaaagaag

SEQ ID NO: 30774 - DNA, 22 bp, synthetic construct
  misc_feature 1..22: note = Synthetic Construct
  source 1..22: mol_type = other DNA
cttttgcacccaggactctgaa

SEQ ID NO: 30775 - DNA, 20 bp, synthetic construct
  misc_feature 1..20: note = Synthetic Construct
  source 1..20: mol_type = other DNA
tgggtggctcagactgtcaa

SEQ ID NO: 30776 - DNA, 20 bp, synthetic construct
  misc_feature 1..20: note = Synthetic Construct
  source 1..20: mol_type = other DNA
tgccacagggagaaggaagt

SEQ ID NO: 30777 - DNA, 25 bp, synthetic construct
  misc_feature 1..25: note = Synthetic Construct
  source 1..25: mol_type = other DNA
cgaaagtaaatgctaagccttgcta

SEQ ID NO: 30778 - DNA, 21 bp, synthetic construct
  misc_feature 1..21: note = Synthetic Construct
  source 1..21: mol_type = other DNA
ccctcttgccacagtgccttt

SEQ ID NO: 30779 - DNA, 25 bp, synthetic construct
  misc_feature 1..25: note = Synthetic Construct
  source 1..25: mol_type = other DNA
gtggagtagagcccttctgaataac

SEQ ID NO: 30780 - DNA, 23 bp, synthetic construct
  misc_feature 1..23: note = Synthetic Construct
  source 1..23: mol_type = other DNA
gagagggaagatttgtgggtgtt

SEQ ID NO: 30781 - DNA, 22 bp, synthetic construct
  misc_feature 1..22: note = Synthetic Construct
  source 1..22: mol_type = other DNA
gcctgcaggattcaaacccaat

SEQ ID NO: 30782 - DNA, 22 bp, synthetic construct
  misc_feature 1..22: note = Synthetic Construct
  source 1..22: mol_type = other DNA
gagagcagggaacatgggttct

SEQ ID NO: 30783 - DNA, 23 bp, synthetic construct
  misc_feature 1..23: note = Synthetic Construct
  source 1..23: mol_type = other DNA
ggaacttaaccccgctccctttc

SEQ ID NO: 30784 - DNA, 23 bp, synthetic construct
  misc_feature 1..23: note = Synthetic Construct
  source 1..23: mol_type = other DNA
aagtgctacaacggaaaggaagt

SEQ ID NO: 30785 - DNA, 23 bp, synthetic construct
  misc_feature 1..23: note = Synthetic Construct
  source 1..23: mol_type = other DNA
gctccaagagaccctgactcact

SEQ ID NO: 30786 - DNA, 20 bp, synthetic construct
  misc_feature 1..20: note = Synthetic Construct
  source 1..20: mol_type = other DNA
ctgggcagagcactgaaagt

SEQ ID NO: 30787 - DNA, 24 bp, synthetic construct
  misc_feature 1..24: note = Synthetic Construct
  source 1..24: mol_type = other DNA
gtcgaggttgatttcgagtcacta

SEQ ID NO: 30788 - DNA, 25 bp, synthetic construct
  misc_feature 1..25: note = Synthetic Construct
  source 1..25: mol_type = other DNA
gtgacaagatgtcattgccaaccaa

SEQ ID NO: 30789 - DNA, 22 bp, synthetic construct
  misc_feature 1..22: note = Synthetic Construct
  source 1..22: mol_type = other DNA
acaaccagcccttgcattaact

SEQ ID NO: 30790 - DNA, 24 bp, synthetic construct
  misc_feature 1..24: note = Synthetic Construct
  source 1..24: mol_type = other DNA
gattgaagcccagccttgaataag

SEQ ID NO: 30791 - DNA, 25 bp, synthetic construct
  misc_feature 1..25: note = Synthetic Construct
  source 1..25: mol_type = other DNA
agggccaaagatgaagaatgtagtt

SEQ ID NO: 30792 - DNA, 20 bp, synthetic construct
  misc_feature 1..20: note = Synthetic Construct
  source 1..20: mol_type = other DNA
gcttgggtggtggtggaaca

SEQ ID NO: 30793 - DNA, 23 bp, synthetic construct
  misc_feature 1..23: note = Synthetic Construct
  source 1..23: mol_type = other DNA
cagagttgcaaggtacccattct

SEQ ID NO: 30794 - DNA, 22 bp, synthetic construct
  misc_feature 1..22: note = Synthetic Construct
  source 1..22: mol_type = other DNA
ctgtcacctggcgtacagaaat

SEQ ID NO: 30795 - DNA, 23 bp, synthetic construct
  misc_feature 1..23: note = Synthetic Construct
  source 1..23: mol_type = other DNA
ccactaccccttactccacttga

SEQ ID NO: 30796 - DNA, 18 bp, synthetic construct
  misc_feature 1..18: note = Synthetic Construct
  source 1..18: mol_type = other DNA
ccccacggaacactgcat

SEQ ID NO: 30797 - DNA, 21 bp, synthetic construct
  misc_feature 1..21: note = Synthetic Construct
  source 1..21: mol_type = other DNA
ttccctggggctcagactgtt

SEQ ID NO: 30798 - DNA, 27 bp, synthetic construct
  misc_feature 1..27: note = Synthetic Construct
  source 1..27: mol_type = other DNA
acagcttccctgtaggaagttataaag

SEQ ID NO: 30799 - DNA, 26 bp, synthetic construct
  misc_feature 1..26: note = Synthetic Construct
  source 1..26: mol_type = other DNA
gtgaagaccaggtatggcttttcaag

SEQ ID NO: 30800 - DNA, 21 bp, synthetic construct
  misc_feature 1..21: note = Synthetic Construct
  source 1..21: mol_type = other DNA
ccccatcaggcagggaaaaca

SEQ ID NO: 30801 - DNA, 23 bp, synthetic construct
  misc_feature 1..23: note = Synthetic Construct
  source 1..23: mol_type = other DNA
cggactggactataagggcaaca

SEQ ID NO: 30802 - DNA, 30 bp, synthetic construct
  misc_feature 1..30: note = Synthetic Construct
  source 1..30: mol_type = other DNA
ggaagacactgtgcttacttaacttgtttg

SEQ ID NO: 30803 - DNA, 25 bp, synthetic construct
  misc_feature 1..25: note = Synthetic Construct
  source 1..25: mol_type = other DNA
tttctccctcccctattacaaggat

SEQ ID NO: 30804 - DNA, 24 bp, synthetic construct
  misc_feature 1..24: note = Synthetic Construct
  source 1..24: mol_type = other DNA
cctgagggtggaaccaaatatgta

SEQ ID NO: 30805 - DNA, 25 bp, synthetic construct
  misc_feature 1..25: note = Synthetic Construct
  source 1..25: mol_type = other DNA
cttattggtgcaagccatgtttagt

SEQ ID NO: 30806 - DNA, 22 bp, synthetic construct
  misc_feature 1..22: note = Synthetic Construct
  source 1..22: mol_type = other DNA
ccctcaacagcaccgagtctat

SEQ ID NO: 30807 - DNA, 21 bp, synthetic construct
  misc_feature 1..21: note = Synthetic Construct
  source 1..21: mol_type = other DNA
acacacacaagccatccagaa

SEQ ID NO: 30808 - DNA, 22 bp, synthetic construct
  misc_feature 1..22: note = Synthetic Construct
  source 1..22: mol_type = other DNA
accgtttgggaggctatttgaa

SEQ ID NO: 30809 - DNA, 27 bp, synthetic construct
  misc_feature 1..27: note = Synthetic Construct
  source 1..27: mol_type = other DNA
gctaggaatcaccaatttttgccctaa

SEQ ID NO: 30810 - DNA, 25 bp, synthetic construct
  misc_feature 1..25: note = Synthetic Construct
  source 1..25: mol_type = other DNA
tctacttgtcttgccatgcacataa

SEQ ID NO: 30811 - DNA, 27 bp, synthetic construct
  misc_feature 1..27: note = Synthetic Construct
  source 1..27: mol_type = other DNA
ctttattccatccatcttgccctaaag

SEQ ID NO: 30812 - DNA, 22 bp, synthetic construct
  misc_feature 1..22: note = Synthetic Construct
  source 1..22: mol_type = other DNA
cccaccaacccaagagtcttct

SEQ ID NO: 30813 - DNA, 24 bp, synthetic construct
  misc_feature 1..24: note = Synthetic Construct
  source 1..24: mol_type = other DNA
tgcccaaagtcacataggaatgat

SEQ ID NO: 30814 - DNA, 21 bp, synthetic construct
  misc_feature 1..21: note = Synthetic Construct
  source 1..21: mol_type = other DNA
acgagaggggaagggagaaga

SEQ ID NO: 30815 - DNA, 22 bp, synthetic construct
  misc_feature 1..22: note = Synthetic Construct
  source 1..22: mol_type = other DNA
ctgctgtacaggtctgcgacaa

SEQ ID NO: 30816 - DNA, 24 bp, synthetic construct
  misc_feature 1..24: note = Synthetic Construct
  source 1..24: mol_type = other DNA
tgctgatagctcagaatctgcatt

SEQ ID NO: 30817 - DNA, 19 bp, synthetic construct
  misc_feature 1..19: note = Synthetic Construct
  source 1..19: mol_type = other DNA
accaccaggctggggatct

SEQ ID NO: 30818 - DNA, 21 bp, synthetic construct
  misc_feature 1..21: note = Synthetic Construct
  source 1..21: mol_type = other DNA
aggctacaggggtctgcaatg

SEQ ID NO: 30819 - DNA, 22 bp, synthetic construct
  misc_feature 1..22: note = Synthetic Construct
  source 1..22: mol_type = other DNA
ggctaaatcacggggtcaaaac

SEQ ID NO: 30820 - DNA, 27 bp, synthetic construct
  misc_feature 1..27: note = Synthetic Construct
  source 1..27: mol_type = other DNA
tcagagattctgagtaatcccagtttg

SEQ ID NO: 30821 - DNA, 22 bp, synthetic construct
  misc_feature 1..22: note = Synthetic Construct
  source 1..22: mol_type = other DNA
gctccccagtgtttttgagaga

SEQ ID NO: 30822 - DNA, 22 bp, synthetic construct
  misc_feature 1..22: note = Synthetic Construct
  source 1..22: mol_type = other DNA
cctcagtctcctgagcctttgt

SEQ ID NO: 30823 - DNA, 24 bp, synthetic construct
  misc_feature 1..24: note = Synthetic Construct
  source 1..24: mol_type = other DNA
ggagttgactccaattgtcctaca

SEQ ID NO: 30824 - DNA, 25 bp, synthetic construct
  misc_feature 1..25: note = Synthetic Construct
  source 1..25: mol_type = other DNA
gctggatcactaaccaccactcctt

SEQ ID NO: 30825 - DNA, 30 bp, synthetic construct
  misc_feature 1..30: note = Synthetic Construct
  source 1..30: mol_type = other DNA
gactgcagtgtcagaatttcataacccaaa

SEQ ID NO: 30826 - DNA, 24 bp, synthetic construct
  misc_feature 1..24: note = Synthetic Construct
  source 1..24: mol_type = other DNA
cagattgaatggaggttgctctgt

SEQ ID NO: 30827 - DNA, 25 bp, synthetic construct
  misc_feature 1..25: note = Synthetic Construct
  source 1..25: mol_type = other DNA
ggttttcccctggatagggagtcta

SEQ ID NO: 30828 - DNA, 20 bp, synthetic construct
  misc_feature 1..20: note = Synthetic Construct
  source 1..20: mol_type = other DNA
aggtggcaggacgcacttag

SEQ ID NO: 30829 - DNA, 23 bp, synthetic construct
  misc_feature 1..23: note = Synthetic Construct
  source 1..23: mol_type = other DNA
ctgttgcgtacaagggagctcta

SEQ ID NO: 30830 - DNA, 25 bp, synthetic construct
  misc_feature 1..25: note = Synthetic Construct
  source 1..25: mol_type = other DNA
gaataaccaacggagtggttttcat

SEQ ID NO: 30831 - DNA, 22 bp, synthetic construct
  misc_feature 1..22: note = Synthetic Construct
  source 1..22: mol_type = other DNA
gctccataagggcagggacaaa

SEQ ID NO: 30832 - DNA, 25 bp, synthetic construct
  misc_feature 1..25: note = Synthetic Construct
  source 1..25: mol_type = other DNA
gggccagaatccagtcttctgactt

SEQ ID NO: 30833 - DNA, 23 bp, synthetic construct
  misc_feature 1..23: note = Synthetic Construct
  source 1..23: mol_type = other DNA
gcaccttcccagtccacctgtat

SEQ ID NO: 30834 - DNA, 22 bp, synthetic construct
  misc_feature 1..22: note = Synthetic Construct
  source 1..22: mol_type = other DNA
cacccagctttggctcttatca

SEQ ID NO: 30835 - DNA, 22 bp, synthetic construct
  misc_feature 1..22: note = Synthetic Construct
  source 1..22: mol_type = other DNA
caacaagctgcagtcaactcaa

SEQ ID NO: 30836 - DNA, 22 bp, synthetic construct
  misc_feature 1..22: note = Synthetic Construct
  source 1..22: mol_type = other DNA
aatgcacatggagtctgggaaa

SEQ ID NO: 30837 - DNA, 22 bp, synthetic construct
  misc_feature 1..22: note = Synthetic Construct
  source 1..22: mol_type = other DNA
ggaaagcccttgtgcacataca

SEQ ID NO: 30838 - DNA, 22 bp, synthetic construct
  misc_feature 1..22: note = Synthetic Construct
  source 1..22: mol_type = other DNA
ggggtttgcagcagggagttta

SEQ ID NO: 30839 - DNA, 24 bp, synthetic construct
  misc_feature 1..24: note = Synthetic Construct
  source 1..24: mol_type = other DNA
gctaacccagacctatgaggaaac

SEQ ID NO: 30840 - DNA, 22 bp, synthetic construct
  misc_feature 1..22: note = Synthetic Construct
  source 1..22: mol_type = other DNA
ctgaaagcaaggaggcttccaa

SEQ ID NO: 30841 - DNA, 20 bp, synthetic construct
  misc_feature 1..20: note = Synthetic Construct
  source 1..20: mol_type = other DNA
gccaggttgcatctctgtgt

SEQ ID NO: 30842 - DNA, 25 bp, synthetic construct
  misc_feature 1..25: note = Synthetic Construct
  source 1..25: mol_type = other DNA
agggaagtaagcatccagaactttg

SEQ ID NO: 30843 - DNA, 24 bp, synthetic construct
  misc_feature 1..24: note = Synthetic Construct
  source 1..24: mol_type = other DNA
ggttttccgcctaggaaaagagat

SEQ ID NO: 30844 - DNA, 27 bp, synthetic construct
  misc_feature 1..27: note = Synthetic Construct
  source 1..27: mol_type = other DNA
cctcttttctctacactggagttttca

SEQ ID NO: 30845 - DNA, 27 bp, synthetic construct
  misc_feature 1..27: note = Synthetic Construct
  source 1..27: mol_type = other DNA
cagcatggacagatcattaagggagaa

SEQ ID NO: 30846 - DNA, 22 bp, synthetic construct
  misc_feature 1..22: note = Synthetic Construct
  source 1..22: mol_type = other DNA
gcttcacccctggtggctatta

SEQ ID NO: 30847 - DNA, 22 bp, synthetic construct
  misc_feature 1..22: note = Synthetic Construct
  source 1..22: mol_type = other DNA
gtgaatgttgggtaggcgttca

SEQ ID NO: 30848 - DNA, 23 bp, synthetic construct
  misc_feature 1..23: note = Synthetic Construct
  source 1..23: mol_type = other DNA
tggtctgggcaaagatttcttga

SEQ ID NO: 30849 - DNA, 22 bp, synthetic construct
  misc_feature 1..22: note = Synthetic Construct
  source 1..22: mol_type = other DNA
gggccacacatttcctcatttg

SEQ ID NO: 30850 - DNA, 27 bp, synthetic construct
  misc_feature 1..27: note = Synthetic Construct
  source 1..27: mol_type = other DNA
gcttgagtttacactccttttctcttc

SEQ ID NO: 30851 - DNA, 22 bp, synthetic construct
  misc_feature 1..22: note = Synthetic Construct
  source 1..22: mol_type = other DNA
gcacatcctgccctttgctgaa

SEQ ID NO: 30852 - DNA, 20 bp, synthetic construct
  misc_feature 1..20: note = Synthetic Construct
  source 1..20: mol_type = other DNA
gtcctacaggtgggctcgaa

SEQ ID NO: 30853 - DNA, 22 bp, synthetic construct
  misc_feature 1..22: note = Synthetic Construct
  source 1..22: mol_type = other DNA
gttctgtgggtgcagcagattc

SEQ ID NO: 30854 - DNA, 25 bp, synthetic construct
  misc_feature 1..25: note = Synthetic Construct
  source 1..25: mol_type = other DNA
tgaaaggaaccactgtgagcaaata

SEQ ID NO: 30855 - DNA, 23 bp, synthetic construct
  misc_feature 1..23: note = Synthetic Construct
  source 1..23: mol_type = other DNA
caaaagcagcaccagaggtgata

SEQ ID NO: 30856 - DNA, 22 bp, synthetic construct
  misc_feature 1..22: note = Synthetic Construct
  source 1..22: mol_type = other DNA
gccccaaacttcctctcagtca

SEQ ID NO: 30857 - DNA, 23 bp, synthetic construct
  misc_feature 1..23: note = Synthetic Construct
  source 1..23: mol_type = other DNA
cacctgagcaggatgtattcctt

SEQ ID NO: 30858 - DNA, 24 bp, synthetic construct
  misc_feature 1..24: note = Synthetic Construct
  source 1..24: mol_type = other DNA
gagaacagaatgcgtgtgtgcaat

SEQ ID NO: 30859 - DNA, 24 bp, synthetic construct
  misc_feature 1..24: note = Synthetic Construct
  source 1..24: mol_type = other DNA
ggagaaggtgtgtaggagatgctt

SEQ ID NO: 30860 - DNA, 27 bp, synthetic construct
  misc_feature 1..27: note = Synthetic Construct
  source 1..27: mol_type = other DNA
caaagagactgcattcataccctcatc

SEQ ID NO: 30861 - DNA, 23 bp, synthetic construct
  misc_feature 1..23: note = Synthetic Construct
  source 1..23: mol_type = other DNA
ggaggcctgacgtagaagaagtt

SEQ ID NO: 30862 - DNA, 27 bp, synthetic construct
  misc_feature 1..27: note = Synthetic Construct
  source 1..27: mol_type = other DNA
ctggctctgtcctttttgtgtaaggat

SEQ ID NO: 30863 - DNA, 25 bp, synthetic construct
  misc_feature 1..25: note = Synthetic Construct
  source 1..25: mol_type = other DNA
gtccaaggcagttctacaggatgaa

SEQ ID NO: 30864 - DNA, 24 bp, synthetic construct
  misc_feature 1..24: note = Synthetic Construct
  source 1..24: mol_type = other DNA
cttgttatgcagcgttcaggttca

SEQ ID NO: 30865 - DNA, 25 bp, synthetic construct
  misc_feature 1..25: note = Synthetic Construct
  source 1..25: mol_type = other DNA
acacctccctcaacttagataccaa

SEQ ID NO: 30866 - DNA, 26 bp, synthetic construct
  misc_feature 1..26: note = Synthetic Construct
  source 1..26: mol_type = other DNA
gcaggcagtaggaatggtctatctca

SEQ ID NO: 30867 - DNA, 23 bp, synthetic construct
  misc_feature 1..23: note = Synthetic Construct
  source 1..23: mol_type = other DNA
agagggcctaaaaagcaagaact

SEQ ID NO: 30868 - DNA, 21 bp, synthetic construct
  misc_feature 1..21: note = Synthetic Construct
  source 1..21: mol_type = other DNA
acatctggcccgggaattttt

SEQ ID NO: 30869 - DNA, 25 bp, synthetic construct
  misc_feature 1..25: note = Synthetic Construct
  source 1..25: mol_type = other DNA
aattgcagttcatggaggttgtatg

SEQ ID NO: 30870 - DNA, 22 bp, synthetic construct
  misc_feature 1..22: note = Synthetic Construct
  source 1..22: mol_type = other DNA
ggtgacctacagctgtgttgtt

SEQ ID NO: 30871 - DNA, 23 bp, synthetic construct
  misc_feature 1..23: note = Synthetic Construct
  source 1..23: mol_type = other DNA
ctctgtccctctctacacctgaa

SEQ ID NO: 30872 - DNA, 27 bp, synthetic construct
  misc_feature 1..27: note = Synthetic Construct
  source 1..27: mol_type = other DNA
gatgtcacagtagattacttgggttct

SEQ ID NO: 30873 - DNA, 25 bp, synthetic construct
  misc_feature 1..25: note = Synthetic Construct
  source 1..25: mol_type = other DNA
gttggtaccctcctagacaaagaca

SEQ ID NO: 30874 - DNA, 22 bp, synthetic construct
  misc_feature 1..22: note = Synthetic Construct
  source 1..22: mol_type = other DNA
gtgtgttctcctgttgcagttg

SEQ ID NO: 30875 - DNA, 27 bp, synthetic construct
  misc_feature 1..27: note = Synthetic Construct
  source 1..27: mol_type = other DNA
gctttctaacccaggcactaattcatc

SEQ ID NO: 30876 - DNA, 22 bp, synthetic construct
  misc_feature 1..22: note = Synthetic Construct
  source 1..22: mol_type = other DNA
gccacacgtggaacatggtaac

SEQ ID NO: 30877 - DNA, 22 bp, synthetic construct
  misc_feature 1..22: note = Synthetic Construct
  source 1..22: mol_type = other DNA
gagcagtgactgaaggttctga

SEQ ID NO: 30878 - DNA, 25 bp, synthetic construct
  misc_feature 1..25: note = Synthetic Construct
  source 1..25: mol_type = other DNA
ggagacttaggaagcctacggatag

SEQ ID NO: 30879 - DNA, 28 bp, synthetic construct
  misc_feature 1..28: note = Synthetic Construct
  source 1..28: mol_type = other DNA
cttcttttcttaccggagtatggactct

SEQ ID NO: 30880 - DNA, 23 bp, synthetic construct
  misc_feature 1..23: note = Synthetic Construct
  source 1..23: mol_type = other DNA
gcatgggccacaattcttctttc

SEQ ID NO: 30881 - DNA, 25 bp, synthetic construct
  misc_feature 1..25: note = Synthetic Construct
  source 1..25: mol_type = other DNA
ggacactgtttgtccctctctatct

SEQ ID NO: 30882 - DNA, 22 bp, synthetic construct
  misc_feature 1..22: note = Synthetic Construct
  source 1..22: mol_type = other DNA
gcaagtcatccagcttctgctt

SEQ ID NO: 30883 - DNA, 20 bp, synthetic construct
  misc_feature 1..20: note = Synthetic Construct
  source 1..20: mol_type = other DNA
acctttgccccagcctgaca

SEQ ID NO: 30884 - DNA, 27 bp, synthetic construct
  misc_feature 1..27: note = Synthetic Construct
  source 1..27: mol_type = other DNA
ggctttttggagggtaggtaatcaaag

SEQ ID NO: 30885 - DNA, 22 bp, synthetic construct
  misc_feature 1..22: note = Synthetic Construct
  source 1..22: mol_type = other DNA
gggagttccttggggacaaact

SEQ ID NO: 30886 - DNA, 20 bp, synthetic construct
  misc_feature 1..20: note = Synthetic Construct
  source 1..20: mol_type = other DNA
gcatggggcaaagggtttgt

SEQ ID NO: 30887 - DNA, 20 bp, synthetic construct
  misc_feature 1..20: note = Synthetic Construct
  source 1..20: mol_type = other DNA
tttcagccgctttgggtttg

SEQ ID NO: 30888 - DNA, 23 bp, synthetic construct
  misc_feature 1..23: note = Synthetic Construct
  source 1..23: mol_type = other DNA
gccattgtgtaggcactccgtaa

SEQ ID NO: 30889 - DNA, 22 bp, synthetic construct
  misc_feature 1..22: note = Synthetic Construct
  source 1..22: mol_type = other DNA
gttcagtcctgtgctgggtctt

SEQ ID NO: 30890 - DNA, 20 bp, synthetic construct
  misc_feature 1..20: note = Synthetic Construct
  source 1..20: mol_type = other DNA
acttgctgctctgccctact

SEQ ID NO: 30891 - DNA, 24 bp, synthetic construct
  misc_feature 1..24: note = Synthetic Construct
  source 1..24: mol_type = other DNA
gcatctctgagtcccagtaacctt

SEQ ID NO: 30892 - DNA, 26 bp, synthetic construct
  misc_feature 1..26: note = Synthetic Construct
  source 1..26: mol_type = other DNA
cctgctacaattacctcaatgtctgt

SEQ ID NO: 30893 - DNA, 25 bp, synthetic construct
  misc_feature 1..25: note = Synthetic Construct
  source 1..25: mol_type = other DNA
ggatcagggtagttggactcttttc

SEQ ID NO: 30894 - DNA, 27 bp, synthetic construct
  misc_feature 1..27: note = Synthetic Construct
  source 1..27: mol_type = other DNA
gccctttgtgctataaataagggaatc

SEQ ID NO: 30895 - DNA, 26 bp, synthetic construct
  misc_feature 1..26: note = Synthetic Construct
  source 1..26: mol_type = other DNA
gtgattgcatgaacaccctgatgtat

SEQ ID NO: 30896 - DNA, 24 bp, synthetic construct
  misc_feature 1..24: note = Synthetic Construct
  source 1..24: mol_type = other DNA
ttcaaggatcactgaggactgaag

SEQ ID NO: 30897 - DNA, 23 bp, synthetic construct
  misc_feature 1..23: note = Synthetic Construct
  source 1..23: mol_type = other DNA
gagcatacccaggtcatgtgtca

SEQ ID NO: 30898 - DNA, 24 bp, synthetic construct
  misc_feature 1..24: note = Synthetic Construct
  source 1..24: mol_type = other DNA
gtcaaaaccctagggcagatgttg

SEQ ID NO: 30899 - DNA, 23 bp, synthetic construct
  misc_feature 1..23: note = Synthetic Construct
  source 1..23: mol_type = other DNA
tccagtgccaaagtacaggtaga

SEQ ID NO: 30900 - DNA, 27 bp, synthetic construct
  misc_feature 1..27: note = Synthetic Construct
  source 1..27: mol_type = other DNA
gggattaacatacgtaaggttgcttct

SEQ ID NO: 30901 - DNA, 26 bp, synthetic construct
  misc_feature 1..26: note = Synthetic Construct
  source 1..26: mol_type = other DNA
cctcttctctttcctgctctatcaaa

SEQ ID NO: 30902 - DNA, 25 bp, synthetic construct
  misc_feature 1..25: note = Synthetic Construct
  source 1..25: mol_type = other DNA
caggctgttgggttttggaagattg

SEQ ID NO: 30903 - DNA, 21 bp, synthetic construct
  misc_feature 1..21: note = Synthetic Construct
  source 1..21: mol_type = other DNA
ccgggttccattgggtacaga

SEQ ID NO: 30904 - DNA, 22 bp, synthetic construct
  misc_feature 1..22: note = Synthetic Construct
  source 1..22: mol_type = other DNA
ccgagagcaagaagcaaacatc

SEQ ID NO: 30905 - DNA, 24 bp, synthetic construct
  misc_feature 1..24: note = Synthetic Construct
  source 1..24: mol_type = other DNA
ctgtttccagatggtatggctgtt

SEQ ID NO: 30906 - DNA, 25 bp, synthetic construct
  misc_feature 1..25: note = Synthetic Construct
  source 1..25: mol_type = other DNA
ccctggtaaaaacctgagtcactac

SEQ ID NO: 30907 - DNA, 22 bp, synthetic construct
  misc_feature 1..22: note = Synthetic Construct
  source 1..22: mol_type = other DNA
ggaaccagaaagagggcctatc

SEQ ID NO: 30908 - DNA, 26 bp, synthetic construct
  misc_feature 1..26: note = Synthetic Construct
  source 1..26: mol_type = other DNA
ccaaaccacaaatcaatggggtagta

SEQ ID NO: 30909 - DNA, 28 bp, synthetic construct
  misc_feature 1..28: note = Synthetic Construct
  source 1..28: mol_type = other DNA
ggggtaactttaggaaaaggctgtctac

SEQ ID NO: 30910 - DNA, 27 bp, synthetic construct
  misc_feature 1..27: note = Synthetic Construct
  source 1..27: mol_type = other DNA
cccatcatttagtgattcccagttttg

SEQ ID NO: 30911 - DNA, 25 bp, synthetic construct
  misc_feature 1..25: note = Synthetic Construct
  source 1..25: mol_type = other DNA
gcacagcagtttcgatgatcccaat

SEQ ID NO: 30912 - DNA, 23 bp, synthetic construct
  misc_feature 1..23: note = Synthetic Construct
  source 1..23: mol_type = other DNA
ctggggttttgttctgccagagt

SEQ ID NO: 30913 - DNA, 28 bp, synthetic construct
  misc_feature 1..28: note = Synthetic Construct
  source 1..28: mol_type = other DNA
ccaagttaccttctgctaaagccataca

SEQ ID NO: 30914 - DNA, 24 bp, synthetic construct
  misc_feature 1..24: note = Synthetic Construct
  source 1..24: mol_type = other DNA
tcaaataccacctacccacagatg

SEQ ID NO: 30915 - DNA, 23 bp, synthetic construct
  misc_feature 1..23: note = Synthetic Construct
  source 1..23: mol_type = other DNA
gcattcctggcaagaggaatagt

SEQ ID NO: 30916 - DNA, 21 bp, synthetic construct
  misc_feature 1..21: note = Synthetic Construct
  source 1..21: mol_type = other DNA
tgcccaaggtggggagtctaa

SEQ ID NO: 30917 - DNA, 26 bp, synthetic construct
  misc_feature 1..26: note = Synthetic Construct
  source 1..26: mol_type = other DNA
ctctcctcctcggaaaacatttcgat

SEQ ID NO: 30918 - DNA, 24 bp, synthetic construct
  misc_feature 1..24: note = Synthetic Construct
  source 1..24: mol_type = other DNA
ggaagtctggaaagcaaagcatca

SEQ ID NO: 30919 - DNA, 22 bp, synthetic construct
  misc_feature 1..22: note = Synthetic Construct
  source 1..22: mol_type = other DNA
ggctggctttgtgagtccttgt

SEQ ID NO: 30920 - DNA, 21 bp, synthetic construct
  misc_feature 1..21: note = Synthetic Construct
  source 1..21: mol_type = other DNA
gctgcctgcagtaccaagtct

SEQ ID NO: 30921 - DNA, 30 bp, synthetic construct
  misc_feature 1..30: note = Synthetic Construct
  source 1..30: mol_type = other DNA
gacttggaatctctaacactctcattcaag

SEQ ID NO: 30922 - DNA, 22 bp, synthetic construct
  misc_feature 1..22: note = Synthetic Construct
  source 1..22: mol_type = other DNA
cagtggtggacaagggagaaac

SEQ ID NO: 30923 - DNA, 28 bp, synthetic construct
  misc_feature 1..28: note = Synthetic Construct
  source 1..28: mol_type = other DNA
cctgaagaatatagagccacctaaccta

SEQ ID NO: 30924 - DNA, 24 bp, synthetic construct
  misc_feature 1..24: note = Synthetic Construct
  source 1..24: mol_type = other DNA
tctaaaccccttgtggctagtaga

SEQ ID NO: 30925 - DNA, 21 bp, synthetic construct
  misc_feature 1..21: note = Synthetic Construct
  source 1..21: mol_type = other DNA
atcccacgccctccccatttt

SEQ ID NO: 30926 - DNA, 28 bp, synthetic construct
  misc_feature 1..28: note = Synthetic Construct
  source 1..28: mol_type = other DNA
ggctgtgagttcagtttagatggtttct

SEQ ID NO: 30927 - DNA, 25 bp, synthetic construct
  misc_feature 1..25: note = Synthetic Construct
  source 1..25: mol_type = other DNA
gggatggaatcttgggtgagtgttg

SEQ ID NO: 30928 - DNA, 23 bp, synthetic construct
  misc_feature 1..23: note = Synthetic Construct
  source 1..23: mol_type = other DNA
caccatggagtgttcagagacat

SEQ ID NO: 30929 - DNA, 23 bp, synthetic construct
  misc_feature 1..23: note = Synthetic Construct
  source 1..23: mol_type = other DNA
accccattgaccaaagaatgtgt

SEQ ID NO: 30930 - DNA, 24 bp, synthetic construct
  misc_feature 1..24: note = Synthetic Construct
  source 1..24: mol_type = other DNA
gcacacatcccttgttttgcacat

SEQ ID NO: 30931 - DNA, 21 bp, synthetic construct
  misc_feature 1..21: note = Synthetic Construct
  source 1..21: mol_type = other DNA
cctctctggctcccatgttct

SEQ ID NO: 30932 - DNA, 24 bp, synthetic construct
  misc_feature 1..24: note = Synthetic Construct
  source 1..24: mol_type = other DNA
ctgagatgccgtcttggtctaaaa

SEQ ID NO: 30933 - DNA, 25 bp, synthetic construct
  misc_feature 1..25: note = Synthetic Construct
  source 1..25: mol_type = other DNA
agtcagggctactcatacagaaaag

SEQ ID NO: 30934 - DNA, 27 bp, synthetic construct
  misc_feature 1..27: note = Synthetic Construct
  source 1..27: mol_type = other DNA
gtgtagtaacccagcatcagagttctt

SEQ ID NO: 30935 - DNA, 21 bp, synthetic construct
  misc_feature 1..21: note = Synthetic Construct
  source 1..21: mol_type = other DNA
ccttcaaaggtcaccgcctaa

SEQ ID NO: 30936 - DNA, 30 bp, synthetic construct
  misc_feature 1..30: note = Synthetic Construct
  source 1..30: mol_type = other DNA
ccaactagatatggccatgtaactccattc

SEQ ID NO: 30937 - DNA, 26 bp, synthetic construct
  misc_feature 1..26: note = Synthetic Construct
  source 1..26: mol_type = other DNA
ctggtgagtctaatcacttgggacat

SEQ ID NO: 30938 - DNA, 26 bp, synthetic construct
  misc_feature 1..26: note = Synthetic Construct
  source 1..26: mol_type = other DNA
tgagttatcagcctgagtctacttga

SEQ ID NO: 30939 - DNA, 21 bp, synthetic construct
  misc_feature 1..21: note = Synthetic Construct
  source 1..21: mol_type = other DNA
ctttcaggctgcactggatgt

SEQ ID NO: 30940 - DNA, 24 bp, synthetic construct
  misc_feature 1..24: note = Synthetic Construct
  source 1..24: mol_type = other DNA
cagctttcgcgaagtactaggtat

SEQ ID NO: 30941 - DNA, 25 bp, synthetic construct
  misc_feature 1..25: note = Synthetic Construct
  source 1..25: mol_type = other DNA
ggtctgtctttcagctctgatcaat

SEQ ID NO: 30942 - DNA, 26 bp, synthetic construct
  misc_feature 1..26: note = Synthetic Construct
  source 1..26: mol_type = other DNA
gaccgatccattaagaagatgctgta

SEQ ID NO: 30943 - DNA, 25 bp, synthetic construct
  misc_feature 1..25: note = Synthetic Construct
  source 1..25: mol_type = other DNA
ctccttggaaggcatttctgagtgt

SEQ ID NO: 30944 - DNA, 20 bp, synthetic construct
  misc_feature 1..20: note = Synthetic Construct
  source 1..20: mol_type = other DNA
cccctccagccagagacaga

SEQ ID NO: 30945 - DNA, 22 bp, synthetic construct
  misc_feature 1..22: note = Synthetic Construct
  source 1..22: mol_type = other DNA
tgacctgtgtggaggcatctct

SEQ ID NO: 30946 - DNA, 27 bp, synthetic construct
  misc_feature 1..27: note = Synthetic Construct
  source 1..27: mol_type = other DNA
gcagtgagggttggtaaatagtgttca

SEQ ID NO: 30947 - DNA, 21 bp, synthetic construct
  misc_feature 1..21: note = Synthetic Construct
  source 1..21: mol_type = other DNA
ggagggtgtggcaaactgtgt

SEQ ID NO: 30948 - DNA, 29 bp, synthetic construct
  misc_feature 1..29: note = Synthetic Construct
  source 1..29: mol_type = other DNA
cctgagaatgcttttgtggaactttcgtt

SEQ ID NO: 30949 - DNA, 22 bp, synthetic construct
  misc_feature 1..22: note = Synthetic Construct
  source 1..22: mol_type = other DNA
gtttcagccaggagatgagctt

SEQ ID NO: 30950 - DNA, 23 bp, synthetic construct
  misc_feature 1..23: note = Synthetic Construct
  source 1..23: mol_type = other DNA
gggttcagtcacgttgcttgctt

SEQ ID NO: 30951 - DNA, 21 bp, synthetic construct
  misc_feature 1..21: note = Synthetic Construct
  source 1..21: mol_type = other DNA
ccaaccggtaaccaccacttc

SEQ ID NO: 30952 - DNA, 24 bp, synthetic construct
  misc_feature 1..24: note = Synthetic Construct
  source 1..24: mol_type = other DNA
gggtaagccttctgagggagcatt

SEQ ID NO: 30953 - DNA, 23 bp, synthetic construct
  misc_feature 1..23: note = Synthetic Construct
  source 1..23: mol_type = other DNA
ggaagggtggtttcttgggacaa

SEQ ID NO: 30954 - DNA, 23 bp, synthetic construct
  misc_feature 1..23: note = Synthetic Construct
  source 1..23: mol_type = other DNA
agatgatccattcctccccttca

SEQ ID NO: 30955 - DNA, 26 bp, synthetic construct
  misc_feature 1..26: note = Synthetic Construct
  source 1..26: mol_type = other DNA
ggaacttacagtggttggaataggtt

SEQ ID NO: 30956 - DNA, 22 bp, synthetic construct
  misc_feature 1..22: note = Synthetic Construct
  source 1..22: mol_type = other DNA
ggccaggcaataagctttcctt

SEQ ID NO: 30957 - DNA, 30 bp, synthetic construct
  misc_feature 1..30: note = Synthetic Construct
  source 1..30: mol_type = other DNA
gagagtctctactcttagctcttagtggtt

SEQ ID NO: 30958 - DNA, 26 bp, synthetic construct
  misc_feature 1..26: note = Synthetic Construct
  source 1..26: mol_type = other DNA
ccaatggagaatttcaaagccctaga

SEQ ID NO: 30959 - DNA, 25 bp, synthetic construct
  misc_feature 1..25: note = Synthetic Construct
  source 1..25: mol_type = other DNA
gccaaccacaagttttgtagcagtt

SEQ ID NO: 30960 - DNA, 24 bp, synthetic construct
  misc_feature 1..24: note = Synthetic Construct
  source 1..24: mol_type = other DNA
ggactgcctggtattctctttctt

SEQ ID NO: 30961 - DNA, 23 bp, synthetic construct
  misc_feature 1..23: note = Synthetic Construct
  source 1..23: mol_type = other DNA
tggtgaaaaggacttggaacctt

SEQ ID NO: 30962 - DNA, 24 bp, synthetic construct
  misc_feature 1..24: note = Synthetic Construct
  source 1..24: mol_type = other DNA
cattatgtgccaacacccttctac

SEQ ID NO: 30963 - DNA, 26 bp, synthetic construct
  misc_feature 1..26: note = Synthetic Construct
  source 1..26: mol_type = other DNA
gtaagactaccttgctctgttcaagt

SEQ ID NO: 30964 - DNA, 25 bp, synthetic construct
  misc_feature 1..25: note = Synthetic Construct
  source 1..25: mol_type = other DNA
ttgacttcaccaaaacatcctgttc

SEQ ID NO: 30965 - DNA, 22 bp, synthetic construct
  misc_feature 1..22: note = Synthetic Construct
  source 1..22: mol_type = other DNA
ctcctggcagacaagcaacaag

SEQ ID NO: 30966 - DNA, 27 bp, synthetic construct
  misc_feature 1..27: note = Synthetic Construct
  source 1..27: mol_type = other DNA
ggtataagattcatcatctgggctgaa

SEQ ID NO: 30967 - DNA, 21 bp, synthetic construct
  misc_feature 1..21: note = Synthetic Construct
  source 1..21: mol_type = other DNA
cagcaagtgcactctttgcat

SEQ ID NO: 30968 - DNA, 30 bp, synthetic construct
  misc_feature 1..30: note = Synthetic Construct
  source 1..30: mol_type = other DNA
cgatgcctaagatacagctgatactcaatg

SEQ ID NO: 30969 - DNA, 27 bp, synthetic construct
  misc_feature 1..27: note = Synthetic Construct
  source 1..27: mol_type = other DNA
cagagaaccttcctaaattccctttct

SEQ ID NO: 30970 - DNA, 27 bp, synthetic construct
  misc_feature 1..27: note = Synthetic Construct
  source 1..27: mol_type = other DNA
gctttgtaacagggttatacaggtttc

SEQ ID NO: 30971 - DNA, 26 bp, synthetic construct
  misc_feature 1..26: note = Synthetic Construct
  source 1..26: mol_type = other DNA
ccaaacttaagggaccctacgaccta

SEQ ID NO: 30972 - DNA, 23 bp, synthetic construct
  misc_feature 1..23: note = Synthetic Construct
  source 1..23: mol_type = other DNA
cccaccatgaattgctgttgctt

SEQ ID NO: 30973 - DNA, 24 bp, synthetic construct
  misc_feature 1..24: note = Synthetic Construct
  source 1..24: mol_type = other DNA
gggtgcaggacactgtgtatggta

SEQ ID NO: 30974 - DNA, 24 bp, synthetic construct
  misc_feature 1..24: note = Synthetic Construct
  source 1..24: mol_type = other DNA
cacagaggtgaaaagggactgaag

SEQ ID NO: 30975 - DNA, 27 bp, synthetic construct
  misc_feature 1..27: note = Synthetic Construct
  source 1..27: mol_type = other DNA
gttcaagactgtttacttggccttatg

SEQ ID NO: 30976 - DNA, 22 bp, synthetic construct
  misc_feature 1..22: note = Synthetic Construct
  source 1..22: mol_type = other DNA
gaaggctggaacaagtccagaa

SEQ ID NO: 30977 - DNA, 26 bp, synthetic construct
  misc_feature 1..26: note = Synthetic Construct
  source 1..26: mol_type = other DNA
cccttctgaggactaaacccaggaaa

SEQ ID NO: 30978 - DNA, 23 bp, synthetic construct
  misc_feature 1..23: note = Synthetic Construct
  source 1..23: mol_type = other DNA
ccctcagccaattcttggtcaat

SEQ ID NO: 30979 - DNA, 21 bp, synthetic construct
  misc_feature 1..21: note = Synthetic Construct
  source 1..21: mol_type = other DNA
cggaatgctggcattggaaag

SEQ ID NO: 30980 - DNA, 22 bp, synthetic construct
  misc_feature 1..22: note = Synthetic Construct
  source 1..22: mol_type = other DNA
gcccagtgcaagcttcagtttc

SEQ ID NO: 30981 - DNA, 28 bp, synthetic construct
  misc_feature 1..28: note = Synthetic Construct
  source 1..28: mol_type = other DNA
gctcagttatagggtgattcacttcaga

SEQ ID NO: 30982 - DNA, 26 bp, synthetic construct
  misc_feature 1..26: note = Synthetic Construct
  source 1..26: mol_type = other DNA
cccacttccctgaagactgaatccta

SEQ ID NO: 30983 - DNA, 21 bp, synthetic construct
  misc_feature 1..21: note = Synthetic Construct
  source 1..21: mol_type = other DNA
ccctgcagtggtcctgacttc

SEQ ID NO: 30984 - DNA, 26 bp, synthetic construct
  misc_feature 1..26: note = Synthetic Construct
  source 1..26: mol_type = other DNA
ggagtaacttgaaactggacatgaca

SEQ ID NO: 30985 - DNA, 25 bp, synthetic construct
  misc_feature 1..25: note = Synthetic Construct
  source 1..25: mol_type = other DNA
cctgtaagccaaagaaaggggttga

SEQ ID NO: 30986 - DNA, 21 bp, synthetic construct
  misc_feature 1..21: note = Synthetic Construct
  source 1..21: mol_type = other DNA
aagtcattcgggctgttctgt

SEQ ID NO: 30987 - DNA, 24 bp, synthetic construct
  misc_feature 1..24: note = Synthetic Construct
  source 1..24: mol_type = other DNA
gactgcctagttgcctgtatcatc

SEQ ID NO: 30988 - DNA, 24 bp, synthetic construct
  misc_feature 1..24: note = Synthetic Construct
  source 1..24: mol_type = other DNA
ccctcctgcccattttaacagcaa

SEQ ID NO: 30989 - DNA, 20 bp, synthetic construct
  misc_feature 1..20: note = Synthetic Construct
  source 1..20: mol_type = other DNA
ggtcaagcgggaagggcttt

SEQ ID NO: 30990 - DNA, 23 bp, synthetic construct
  misc_feature 1..23: note = Synthetic Construct
  source 1..23: mol_type = other DNA
accccatggcacctatttgtttc

SEQ ID NO: 30991 - DNA, 28 bp, synthetic construct
  misc_feature 1..28: note = Synthetic Construct
  source 1..28: mol_type = other DNA
ggcctacaaattagtacagtccctctca

SEQ ID NO: 30992 - DNA, 24 bp, synthetic construct
  misc_feature 1..24: note = Synthetic Construct
  source 1..24: mol_type = other DNA
gccagcatcacagagatagggaaa

SEQ ID NO: 30993 - DNA, 21 bp, synthetic construct
  misc_feature 1..21: note = Synthetic Construct
  source 1..21: mol_type = other DNA
aaggccctgacatggctggaa

SEQ ID NO: 30994 - DNA, 26 bp, synthetic construct
  misc_feature 1..26: note = Synthetic Construct
  source 1..26: mol_type = other DNA
ggtcattggtgaccttcatgttgcta

SEQ ID NO: 30995 - DNA, 25 bp, synthetic construct
  misc_feature 1..25: note = Synthetic Construct
  source 1..25: mol_type = other DNA
ggagataagcccctttccttaagtt

SEQ ID NO: 30996 - DNA, 24 bp, synthetic construct
  misc_feature 1..24: note = Synthetic Construct
  source 1..24: mol_type = other DNA
cctcccgtccccatattcctttca

SEQ ID NO: 30997 - DNA, 27 bp, synthetic construct
  misc_feature 1..27: note = Synthetic Construct
  source 1..27: mol_type = other DNA
gttggacaccttatgctcattcaagat

SEQ ID NO: 30998 - DNA, 22 bp, synthetic construct
  misc_feature 1..22: note = Synthetic Construct
  source 1..22: mol_type = other DNA
ggtgatgtctgagctggacctt

SEQ ID NO: 30999 - DNA, 27 bp, synthetic construct
  misc_feature 1..27: note = Synthetic Construct
  source 1..27: mol_type = other DNA
gagtgctttagtgaatcccaacagtga

SEQ ID NO: 31000 - DNA, 22 bp, synthetic construct
  misc_feature 1..22: note = Synthetic Construct
  source 1..22: mol_type = other DNA
ggccgggatggcttacattgat

SEQ ID NO: 31001 - DNA, 25 bp, synthetic construct
  misc_feature 1..25: note = Synthetic Construct
  source 1..25: mol_type = other DNA
ttttgtctgtgaaggaggcatttac

SEQ ID NO: 31002 - DNA, 25 bp, synthetic construct
  misc_feature 1..25: note = Synthetic Construct
  source 1..25: mol_type = other DNA
cccaataaatcccactgtcttgtct

SEQ ID NO: 31003 - DNA, 22 bp, synthetic construct
  misc_feature 1..22: note = Synthetic Construct
  source 1..22: mol_type = other DNA
gcttgctggacattgcagtcat

SEQ ID NO: 31004 - DNA, 22 bp, synthetic construct
  misc_feature 1..22: note = Synthetic Construct
  source 1..22: mol_type = other DNA
gagctggagtccctgctttgtt

SEQ ID NO: 31005 - DNA, 24 bp, synthetic construct
  misc_feature 1..24: note = Synthetic Construct
  source 1..24: mol_type = other DNA
gcaaaaatctgcggccttttcgta

SEQ ID NO: 31006 - DNA, 27 bp, synthetic construct
  misc_feature 1..27: note = Synthetic Construct
  source 1..27: mol_type = other DNA
gtatacagagtgaagctgtagaagtca

SEQ ID NO: 31007 - DNA, 29 bp, synthetic construct
  misc_feature 1..29: note = Synthetic Construct
  source 1..29: mol_type = other DNA
ggacaagaagtaaatgggagtgaaaggta

SEQ ID NO: 31008 - DNA, 23 bp, synthetic construct
  misc_feature 1..23: note = Synthetic Construct
  source 1..23: mol_type = other DNA
cctaggagaccagctgtggtttg

SEQ ID NO: 31009 - DNA, 24 bp, synthetic construct
  misc_feature 1..24: note = Synthetic Construct
  source 1..24: mol_type = other DNA
agactatggaacctactggtgaca

SEQ ID NO: 31010 - DNA, 20 bp, synthetic construct
  misc_feature 1..20: note = Synthetic Construct
  source 1..20: mol_type = other DNA
accgtgcatccagagtgatg

SEQ ID NO: 31011 - DNA, 22 bp, synthetic construct
  misc_feature 1..22: note = Synthetic Construct
  source 1..22: mol_type = other DNA
cacggggctgtttctccatctt

SEQ ID NO: 31012 - DNA, 22 bp, synthetic construct
  misc_feature 1..22: note = Synthetic Construct
  source 1..22: mol_type = other DNA
cttcatcctcggcctcttttct

SEQ ID NO: 31013 - DNA, 22 bp, synthetic construct
  misc_feature 1..22: note = Synthetic Construct
  source 1..22: mol_type = other DNA
ggcacagaggcagcctgataat

SEQ ID NO: 31014 - DNA, 25 bp, synthetic construct
  misc_feature 1..25: note = Synthetic Construct
  source 1..25: mol_type = other DNA
ggtgaaaagtgtgaaggactcatct

SEQ ID NO: 31015 - DNA, 25 bp, synthetic construct
  misc_feature 1..25: note = Synthetic Construct
  source 1..25: mol_type = other DNA
caggagagctgactcaacttcagat

SEQ ID NO: 31016 - DNA, 24 bp, synthetic construct
  misc_feature 1..24: note = Synthetic Construct
  source 1..24: mol_type = other DNA
gcactccaaacaggtcttcagaaa

SEQ ID NO: 31017 - DNA, 27 bp, synthetic construct
  misc_feature 1..27: note = Synthetic Construct
  source 1..27: mol_type = other DNA
gctactgcacaattggacttgttcttg

SEQ ID NO: 31018 - DNA, 27 bp, synthetic construct
  misc_feature 1..27: note = Synthetic Construct
  source 1..27: mol_type = other DNA
gctgtgtttaggtgactagggatcaga

SEQ ID NO: 31019 - DNA, 22 bp, synthetic construct
  misc_feature 1..22: note = Synthetic Construct
  source 1..22: mol_type = other DNA
tgccgacagcttcaagggtaga

SEQ ID NO: 31020 - DNA, 23 bp, synthetic construct
  misc_feature 1..23: note = Synthetic Construct
  source 1..23: mol_type = other DNA
ctcccactttttccaccttcaga

SEQ ID NO: 31021 - DNA, 22 bp, synthetic construct
  misc_feature 1..22: note = Synthetic Construct
  source 1..22: mol_type = other DNA
tgagtctgtctccccgacatct

SEQ ID NO: 31022 - DNA, 18 bp, synthetic construct
  misc_feature 1..18: note = Synthetic Construct
  source 1..18: mol_type = other DNA
tttgcgccctgactgcat

SEQ ID NO: 31023 - DNA, 20 bp, synthetic construct
  misc_feature 1..20: note = Synthetic Construct
  source 1..20: mol_type = other DNA
agccaacacgcagggacaat

SEQ ID NO: 31024 - DNA, 23 bp, synthetic construct
  misc_feature 1..23: note = Synthetic Construct
  source 1..23: mol_type = other DNA
cacaggtcctgcagattttctct

SEQ ID NO: 31025 - DNA, 30 bp, synthetic construct
  misc_feature 1..30: note = Synthetic Construct
  source 1..30: mol_type = other DNA
ggagccaaatgagagtcaattttcctttct

SEQ ID NO: 31026 - DNA, 25 bp, synthetic construct
  misc_feature 1..25: note = Synthetic Construct
  source 1..25: mol_type = other DNA
cctctgcaggctattcgtgtatttc

SEQ ID NO: 31027 - DNA, 22 bp, synthetic construct
  misc_feature 1..22: note = Synthetic Construct
  source 1..22: mol_type = other DNA
ccagtgggtgcaaacaaacaca

SEQ ID NO: 31028 - DNA, 21 bp, synthetic construct
  misc_feature 1..21: note = Synthetic Construct
  source 1..21: mol_type = other DNA
ttggctcctttcccctagaca

SEQ ID NO: 31029 - DNA, 21 bp, synthetic construct
  misc_feature 1..21: note = Synthetic Construct
  source 1..21: mol_type = other DNA
gcacacgtggccacaaagaaa

SEQ ID NO: 31030 - DNA, 22 bp, synthetic construct
  misc_feature 1..22: note = Synthetic Construct
  source 1..22: mol_type = other DNA
tgaagacgggtggggtccttta

SEQ ID NO: 31031 - DNA, 25 bp, synthetic construct
  misc_feature 1..25: note = Synthetic Construct
  source 1..25: mol_type = other DNA
ggcaggatgaagtatggacctgaga

SEQ ID NO: 31032 - DNA, 25 bp, synthetic construct
  misc_feature 1..25: note = Synthetic Construct
  source 1..25: mol_type = other DNA
cacctacctcactaagacccaagat

SEQ ID NO: 31033 - DNA, 21 bp, synthetic construct
  misc_feature 1..21: note = Synthetic Construct
  source 1..21: mol_type = other DNA
ccccaagctgctctctgtaag

SEQ ID NO: 31034 - DNA, 27 bp, synthetic construct
  misc_feature 1..27: note = Synthetic Construct
  source 1..27: mol_type = other DNA
acttaatgaagaagggtctaccgagat

SEQ ID NO: 31035 - DNA, 26 bp, synthetic construct
  misc_feature 1..26: note = Synthetic Construct
  source 1..26: mol_type = other DNA
cagggcttcaactgaaggactctaag

SEQ ID NO: 31036 - DNA, 20 bp, synthetic construct
  misc_feature 1..20: note = Synthetic Construct
  source 1..20: mol_type = other DNA
cccactcatccaccctgact

SEQ ID NO: 31037 - DNA, 26 bp, synthetic construct
  misc_feature 1..26: note = Synthetic Construct
  source 1..26: mol_type = other DNA
gaagtgtcaacttctcagcaagtaag

SEQ ID NO: 31038 - DNA, 25 bp, synthetic construct
  misc_feature 1..25: note = Synthetic Construct
  source 1..25: mol_type = other DNA
gcctcgtagtatagcttggaaagta

SEQ ID NO: 31039 - DNA, 22 bp, synthetic construct
  misc_feature 1..22: note = Synthetic Construct
  source 1..22: mol_type = other DNA
cgttgaggagcacctgtatcaa

SEQ ID NO: 31040 - DNA, 18 bp, synthetic construct
  misc_feature 1..18: note = Synthetic Construct
  source 1..18: mol_type = other DNA
tgggcagcccctaactgt

SEQ ID NO: 31041 - DNA, 23 bp, synthetic construct
  misc_feature 1..23: note = Synthetic Construct
  source 1..23: mol_type = other DNA
ttgtggaacggaggaagagtatg

SEQ ID NO: 31042 - DNA, 24 bp, synthetic construct
  misc_feature 1..24: note = Synthetic Construct
  source 1..24: mol_type = other DNA
gctgctgggtcagtcttgaacatt

SEQ ID NO: 31043 - DNA, 24 bp, synthetic construct
  misc_feature 1..24: note = Synthetic Construct
  source 1..24: mol_type = other DNA
ccctctgttcctatggtcctggtt

SEQ ID NO: 31044 - DNA, 24 bp, synthetic construct
  misc_feature 1..24: note = Synthetic Construct
  source 1..24: mol_type = other DNA
cctgcccagccttttatgggtaga

SEQ ID NO: 31045 - DNA, 25 bp, synthetic construct
  misc_feature 1..25: note = Synthetic Construct
  source 1..25: mol_type = other DNA
aggaggtcttttcaaacccttttca

SEQ ID NO: 31046 - DNA, 26 bp, synthetic construct
  misc_feature 1..26: note = Synthetic Construct
  source 1..26: mol_type = other DNA
caatgacgaggcaagtcaatatctct

SEQ ID NO: 31047 - DNA, 22 bp, synthetic construct
  misc_feature 1..22: note = Synthetic Construct
  source 1..22: mol_type = other DNA
ttccctgtccctgtcactcctt

SEQ ID NO: 31048 - DNA, 30 bp, synthetic construct
  misc_feature 1..30: note = Synthetic Construct
  source 1..30: mol_type = other DNA
gctgatcaaagagggatattctatggcatt

SEQ ID NO: 31049 - DNA, 20 bp, synthetic construct
  misc_feature 1..20: note = Synthetic Construct
  source 1..20: mol_type = other DNA
gcacatggctccctttctga

SEQ ID NO: 31050 - DNA, 24 bp, synthetic construct
  misc_feature 1..24: note = Synthetic Construct
  source 1..24: mol_type = other DNA
ctggaagaaggaaccctggatatg

SEQ ID NO: 31051 - DNA, 25 bp, synthetic construct
  misc_feature 1..25: note = Synthetic Construct
  source 1..25: mol_type = other DNA
cagagtacttcttcctgaccctaac

SEQ ID NO: 31052 - DNA, 24 bp, synthetic construct
  misc_feature 1..24: note = Synthetic Construct
  source 1..24: mol_type = other DNA
tgaattacacagcttcaggccttt

SEQ ID NO: 31053 - DNA, 25 bp, synthetic construct
  misc_feature 1..25: note = Synthetic Construct
  source 1..25: mol_type = other DNA
tgcttgccttttgcagtaaatgtag

SEQ ID NO: 31054 - DNA, 26 bp, synthetic construct
  misc_feature 1..26: note = Synthetic Construct
  source 1..26: mol_type = other DNA
ggaaacctcaatgtgaactgctctct

SEQ ID NO: 31055 - DNA, 21 bp, synthetic construct
  misc_feature 1..21: note = Synthetic Construct
  source 1..21: mol_type = other DNA
cgagtcagccacttgtgaaac

SEQ ID NO: 31056 - DNA, 26 bp, synthetic construct
  misc_feature 1..26: note = Synthetic Construct
  source 1..26: mol_type = other DNA
cactgtatctggcctggatccaattt

SEQ ID NO: 31057 - DNA, 23 bp, synthetic construct
  misc_feature 1..23: note = Synthetic Construct
  source 1..23: mol_type = other DNA
ggcacaaagctagacttccagta

SEQ ID NO: 31058 - DNA, 23 bp, synthetic construct
  misc_feature 1..23: note = Synthetic Construct
  source 1..23: mol_type = other DNA
gcaaaggtggtttcaaagtcaca

SEQ ID NO: 31059 - DNA, 24 bp, synthetic construct
  misc_feature 1..24: note = Synthetic Construct
  source 1..24: mol_type = other DNA
ggaaacattccctgccatctccta

SEQ ID NO: 31060 - DNA, 22 bp, synthetic construct
  misc_feature 1..22: note = Synthetic Construct
  source 1..22: mol_type = other DNA
agtgcaggcttaaggaaaggtt

SEQ ID NO: 31061 - DNA, 25 bp, synthetic construct
  misc_feature 1..25: note = Synthetic Construct
  source 1..25: mol_type = other DNA
gtggtgaacatagtccccagtaaat

SEQ ID NO: 31062 - DNA, 30 bp, synthetic construct
  misc_feature 1..30: note = Synthetic Construct
  source 1..30: mol_type = other DNA
ggagggaagaggctagattaaataccttag

SEQ ID NO: 31063 - DNA, 24 bp, synthetic construct
  misc_feature 1..24: note = Synthetic Construct
  source 1..24: mol_type = other DNA
gctgacattgaagaccaaggaatc

SEQ ID NO: 31064 - DNA, 23 bp, synthetic construct
  misc_feature 1..23: note = Synthetic Construct
  source 1..23: mol_type = other DNA
cagtgagcgcaaccattccaatc

SEQ ID NO: 31065 - DNA, 28 bp, synthetic construct
  misc_feature 1..28: note = Synthetic Construct
  source 1..28: mol_type = other DNA
ccagatcacatagggcattttagaccat

SEQ ID NO: 31066 - DNA, 24 bp, synthetic construct
  misc_feature 1..24: note = Synthetic Construct
  source 1..24: mol_type = other DNA
acttattcactgtggccacctttc

SEQ ID NO: 31067 - DNA, 26 bp, synthetic construct
  misc_feature 1..26: note = Synthetic Construct
  source 1..26: mol_type = other DNA
ctcgatcaaatgcagtggtcaaatgt

SEQ ID NO: 31068 - DNA, 25 bp, synthetic construct
  misc_feature 1..25: note = Synthetic Construct
  source 1..25: mol_type = other DNA
ctcagccttttatcctgttctgtgt

SEQ ID NO: 31069 - DNA, 23 bp, synthetic construct
  misc_feature 1..23: note = Synthetic Construct
  source 1..23: mol_type = other DNA
cccaccccaccttctcctttttg

SEQ ID NO: 31070 - DNA, 24 bp, synthetic construct
  misc_feature 1..24: note = Synthetic Construct
  source 1..24: mol_type = other DNA
ggtccttgagttcggggttaggat

SEQ ID NO: 31071 - DNA, 24 bp, synthetic construct
  misc_feature 1..24: note = Synthetic Construct
  source 1..24: mol_type = other DNA
gtcatcctgaaagtctccgctaca

SEQ ID NO: 31072 - DNA, 20 bp, synthetic construct
  misc_feature 1..20: note = Synthetic Construct
  source 1..20: mol_type = other DNA
actgcctctttggccacgta

SEQ ID NO: 31073 - DNA, 25 bp, synthetic construct
  misc_feature 1..25: note = Synthetic Construct
  source 1..25: mol_type = other DNA
gaaccactgccttagatcaaacaaa

SEQ ID NO: 31074 - DNA, 22 bp, synthetic construct
  misc_feature 1..22: note = Synthetic Construct
  source 1..22: mol_type = other DNA
ccacagcacctatgccaagtga

SEQ ID NO: 31075 - DNA, 20 bp, synthetic construct
  misc_feature 1..20: note = Synthetic Construct
  source 1..20: mol_type = other DNA
ggacagcccaggtgagtcat

SEQ ID NO: 31076 - DNA, 24 bp, synthetic construct
  misc_feature 1..24: note = Synthetic Construct
  source 1..24: mol_type = other DNA
ggcctagtctccctaagcctaatg

SEQ ID NO: 31077 - DNA, 26 bp, synthetic construct
  misc_feature 1..26: note = Synthetic Construct
  source 1..26: mol_type = other DNA
cccaggagtagcccttaaccaattac

SEQ ID NO: 31078 - DNA, 25 bp, synthetic construct
  misc_feature 1..25: note = Synthetic Construct
  source 1..25: mol_type = other DNA
ccagaattggaattgggttccagta

SEQ ID NO: 31079 - DNA, 21 bp, synthetic construct
  misc_feature 1..21: note = Synthetic Construct
  source 1..21: mol_type = other DNA
caaccaggcttgggagaaaca

SEQ ID NO: 31080 - DNA, 25 bp, synthetic construct
  misc_feature 1..25: note = Synthetic Construct
  source 1..25: mol_type = other DNA
catggttgattgtcggttgttcttc

SEQ ID NO: 31081 - DNA, 23 bp, synthetic construct
  misc_feature 1..23: note = Synthetic Construct
  source 1..23: mol_type = other DNA
gccttttatccctgagccattga

SEQ ID NO: 31082 - DNA, 24 bp, synthetic construct
  misc_feature 1..24: note = Synthetic Construct
  source 1..24: mol_type = other DNA
gcctcatcctcctttcagacaatg

SEQ ID NO: 31083 - DNA, 29 bp, synthetic construct
  misc_feature 1..29: note = Synthetic Construct
  source 1..29: mol_type = other DNA
ggactaaagtaaaagaggcagtgagatga

SEQ ID NO: 31084 - DNA, 23 bp, synthetic construct
  misc_feature 1..23: note = Synthetic Construct
  source 1..23: mol_type = other DNA
cagcgtcatggtccagaatcctt

SEQ ID NO: 31085 - DNA, 20 bp, synthetic construct
  misc_feature 1..20: note = Synthetic Construct
  source 1..20: mol_type = other DNA
gacgcccactgtgattggtt

SEQ ID NO: 31086 - DNA, 20 bp, synthetic construct
  misc_feature 1..20: note = Synthetic Construct
  source 1..20: mol_type = other DNA
agacaaggtcggctgcaaca

SEQ ID NO: 31087 - DNA, 25 bp, synthetic construct
  misc_feature 1..25: note = Synthetic Construct
  source 1..25: mol_type = other DNA
ccagcataaggagcctgtgattttg

SEQ ID NO: 31088 - DNA, 20 bp, synthetic construct
  misc_feature 1..20: note = Synthetic Construct
  source 1..20: mol_type = other DNA
atctcagtcccaggccaact

SEQ ID NO: 31089 - DNA, 22 bp, synthetic construct
  misc_feature 1..22: note = Synthetic Construct
  source 1..22: mol_type = other DNA
ccttcccagtccaactccaaag

SEQ ID NO: 31090 - DNA, 23 bp, synthetic construct
  misc_feature 1..23: note = Synthetic Construct
  source 1..23: mol_type = other DNA
ggttctgtgaatgccagcgctaa

SEQ ID NO: 31091 - DNA, 22 bp, synthetic construct
  misc_feature 1..22: note = Synthetic Construct
  source 1..22: mol_type = other DNA
ctgggccctgtaacagtgagaa

SEQ ID NO: 31092 - DNA, 29 bp, synthetic construct
  misc_feature 1..29: note = Synthetic Construct
  source 1..29: mol_type = other DNA
ccatccataaagtgtataccctcccttgt

SEQ ID NO: 31093 - DNA, 21 bp, synthetic construct
  misc_feature 1..21: note = Synthetic Construct
  source 1..21: mol_type = other DNA
aggcatagtggtccccgtgta

SEQ ID NO: 31094 - DNA, 20 bp, synthetic construct
  misc_feature 1..20: note = Synthetic Construct
  source 1..20: mol_type = other DNA
tcactcacctgggccctaaa

SEQ ID NO: 31095 - DNA, 26 bp, synthetic construct
  misc_feature 1..26: note = Synthetic Construct
  source 1..26: mol_type = other DNA
ggcttgccatattactgagtgcaaaa

SEQ ID NO: 31096 - DNA, 24 bp, synthetic construct
  misc_feature 1..24: note = Synthetic Construct
  source 1..24: mol_type = other DNA
tcaggatggcactggaacttaatc

SEQ ID NO: 31097 - DNA, 25 bp, synthetic construct
  misc_feature 1..25: note = Synthetic Construct
  source 1..25: mol_type = other DNA
ggataataaggcgtatggcaacaaa

SEQ ID NO: 31098 - DNA, 24 bp, synthetic construct
  misc_feature 1..24: note = Synthetic Construct
  source 1..24: mol_type = other DNA
gggagagacagactccagcaatca

SEQ ID NO: 31099 - DNA, 24 bp, synthetic construct
  misc_feature 1..24: note = Synthetic Construct
  source 1..24: mol_type = other DNA
cagtgtcttcatccctcacggaat

SEQ ID NO: 31100 - DNA, 23 bp, synthetic construct
  misc_feature 1..23: note = Synthetic Construct
  source 1..23: mol_type = other DNA
accctctggatgggtaaggtaac

SEQ ID NO: 31101 - DNA, 23 bp, synthetic construct
  misc_feature 1..23: note = Synthetic Construct
  source 1..23: mol_type = other DNA
gtccctctgggacagaacatact

SEQ ID NO: 31102 - DNA, 24 bp, synthetic construct
  misc_feature 1..24: note = Synthetic Construct
  source 1..24: mol_type = other DNA
cccctgaacattgctgatcctctt

SEQ ID NO: 31103 - DNA, 24 bp, synthetic construct
  misc_feature 1..24: note = Synthetic Construct
  source 1..24: mol_type = other DNA
ctgcagctgtttctttcccatagt

SEQ ID NO: 31104 - DNA, 23 bp, synthetic construct
  misc_feature 1..23: note = Synthetic Construct
  source 1..23: mol_type = other DNA
tcaggctcagagtggagaataca

SEQ ID NO: 31105 - DNA, 24 bp, synthetic construct
  misc_feature 1..24: note = Synthetic Construct
  source 1..24: mol_type = other DNA
gcttcaattcctttctggggaagt

SEQ ID NO: 31106 - DNA, 25 bp, synthetic construct
  misc_feature 1..25: note = Synthetic Construct
  source 1..25: mol_type = other DNA
tcctcctcctgtctttttaggctat

SEQ ID NO: 31107 - DNA, 22 bp, synthetic construct
  misc_feature 1..22: note = Synthetic Construct
  source 1..22: mol_type = other DNA
gcccctacccagaccagaaaaa

SEQ ID NO: 31108 - DNA, 29 bp, synthetic construct
  misc_feature 1..29: note = Synthetic Construct
  source 1..29: mol_type = other DNA
gagactaacaggtaagatccaggattcaa

SEQ ID NO: 31109 - DNA, 21 bp, synthetic construct
  misc_feature 1..21: note = Synthetic Construct
  source 1..21: mol_type = other DNA
aggcaggcctcacaatgtatc

SEQ ID NO: 31110 - DNA, 25 bp, synthetic construct
  misc_feature 1..25: note = Synthetic Construct
  source 1..25: mol_type = other DNA
gcaaaggaaatgaatggcatcagta

SEQ ID NO: 31111 - DNA, 24 bp, synthetic construct
  misc_feature 1..24: note = Synthetic Construct
  source 1..24: mol_type = other DNA
gcaagagagagacttggtctgcat

SEQ ID NO: 31112 - DNA, 29 bp, synthetic construct
  misc_feature 1..29: note = Synthetic Construct
  source 1..29: mol_type = other DNA
ggctgtagctgccatttataactactttc

SEQ ID NO: 31113 - DNA, 25 bp, synthetic construct
  misc_feature 1..25: note = Synthetic Construct
  source 1..25: mol_type = other DNA
cagagagcaagtaagctgtcccttt

SEQ ID NO: 31114 - DNA, 24 bp, synthetic construct
  misc_feature 1..24: note = Synthetic Construct
  source 1..24: mol_type = other DNA
gcttgggttacatgcttcctggta

SEQ ID NO: 31115 - DNA, 22 bp, synthetic construct
  misc_feature 1..22: note = Synthetic Construct
  source 1..22: mol_type = other DNA
atcgggagtatcagggatggaa

SEQ ID NO: 31116 - DNA, 26 bp, synthetic construct
  misc_feature 1..26: note = Synthetic Construct
  source 1..26: mol_type = other DNA
ggattttaagtaggggagcaatgtga

SEQ ID NO: 31117 - DNA, 27 bp, synthetic construct
  misc_feature 1..27: note = Synthetic Construct
  source 1..27: mol_type = other DNA
ggagatactcagcctttggacatgaag

SEQ ID NO: 31118 - DNA, 23 bp, synthetic construct
  misc_feature 1..23: note = Synthetic Construct
  source 1..23: mol_type = other DNA
gccctggggagatagatgtgcta

SEQ ID NO: 31119 - DNA, 27 bp, synthetic construct
  misc_feature 1..27: note = Synthetic Construct
  source 1..27: mol_type = other DNA
gacttttcccctaccacctataatcaa

SEQ ID NO: 31120 - DNA, 20 bp, synthetic construct
  misc_feature 1..20: note = Synthetic Construct
  source 1..20: mol_type = other DNA
tgtccaaggtcgcgcagata

SEQ ID NO: 31121 - DNA, 22 bp, synthetic construct
  misc_feature 1..22: note = Synthetic Construct
  source 1..22: mol_type = other DNA
ggctagccagcaaggattctga

SEQ ID NO: 31122 - DNA, 26 bp, synthetic construct
  misc_feature 1..26: note = Synthetic Construct
  source 1..26: mol_type = other DNA
ctcatgtaccagtactaagccattct

SEQ ID NO: 31123 - DNA, 20 bp, synthetic construct
  misc_feature 1..20: note = Synthetic Construct
  source 1..20: mol_type = other DNA
ttcccaggtggccatgtagt

SEQ ID NO: 31124 - DNA, 22 bp, synthetic construct
  misc_feature 1..22: note = Synthetic Construct
  source 1..22: mol_type = other DNA
cgccaaggcctgttccaaaaac

SEQ ID NO: 31125 - DNA, 22 bp, synthetic construct
  misc_feature 1..22: note = Synthetic Construct
  source 1..22: mol_type = other DNA
tggctgaaagcaggtcgctatg

SEQ ID NO: 31126 - DNA, 22 bp, synthetic construct
  misc_feature 1..22: note = Synthetic Construct
  source 1..22: mol_type = other DNA
gacaggcagaggagttctgtga

SEQ ID NO: 31127 - DNA, 22 bp, synthetic construct
  misc_feature 1..22: note = Synthetic Construct
  source 1..22: mol_type = other DNA
cctgtgggttgcttctgtctct

SEQ ID NO: 31128 - DNA, 21 bp, synthetic construct
  misc_feature 1..21: note = Synthetic Construct
  source 1..21: mol_type = other DNA
agagccctatccccactgaac

SEQ ID NO: 31129 - DNA, 24 bp, synthetic construct
  misc_feature 1..24: note = Synthetic Construct
  source 1..24: mol_type = other DNA
catctgtggccaggtaaggaatag

SEQ ID NO: 31130 - DNA, 26 bp, synthetic construct
  misc_feature 1..26: note = Synthetic Construct
  source 1..26: mol_type = other DNA
gtgaatcttcaacagcagatgagtct

SEQ ID NO: 31131 - DNA, 21 bp, synthetic construct
  misc_feature 1..21: note = Synthetic Construct
  source 1..21: mol_type = other DNA
gggctgaacagtggtctgaca

SEQ ID NO: 31132 - DNA, 19 bp, synthetic construct
  misc_feature 1..19: note = Synthetic Construct
  source 1..19: mol_type = other DNA
atcgccctctcccctgcat

SEQ ID NO: 31133 - DNA, 25 bp, synthetic construct
  misc_feature 1..25: note = Synthetic Construct
  source 1..25: mol_type = other DNA
gtgagaaatatggagacagccagtt

SEQ ID NO: 31134 - DNA, 26 bp, synthetic construct
  misc_feature 1..26: note = Synthetic Construct
  source 1..26: mol_type = other DNA
caggaactgtctgaagaagctaaaag

SEQ ID NO: 31135 - DNA, 23 bp, synthetic construct
  misc_feature 1..23: note = Synthetic Construct
  source 1..23: mol_type = other DNA
gctgaaaggctcactgctaggta

SEQ ID NO: 31136 - DNA, 24 bp, synthetic construct
  misc_feature 1..24: note = Synthetic Construct
  source 1..24: mol_type = other DNA
cccacagagtatggtgatgactgt

SEQ ID NO: 31137 - DNA, 25 bp, synthetic construct
  misc_feature 1..25: note = Synthetic Construct
  source 1..25: mol_type = other DNA
cactccatcttcctaatggcctact

SEQ ID NO: 31138 - DNA, 26 bp, synthetic construct
  misc_feature 1..26: note = Synthetic Construct
  source 1..26: mol_type = other DNA
ggatccaaggactgtattccaactga

SEQ ID NO: 31139 - DNA, 25 bp, synthetic construct
  misc_feature 1..25: note = Synthetic Construct
  source 1..25: mol_type = other DNA
ggagttagccctttagacgtcttgt

SEQ ID NO: 31140 - DNA, 21 bp, synthetic construct
  misc_feature 1..21: note = Synthetic Construct
  source 1..21: mol_type = other DNA
ggtgtgctgcaggggtatgtt

SEQ ID NO: 31141 - DNA, 25 bp, synthetic construct
  misc_feature 1..25: note = Synthetic Construct
  source 1..25: mol_type = other DNA
atgtgaggaaatcatcccatcttgt

SEQ ID NO: 31142 - DNA, 20 bp, synthetic construct
  misc_feature 1..20: note = Synthetic Construct
  source 1..20: mol_type = other DNA
aaggcaggtgcagggatgaa

SEQ ID NO: 31143 - DNA, 24 bp, synthetic construct
  misc_feature 1..24: note = Synthetic Construct
  source 1..24: mol_type = other DNA
ccttatgtgacatccaggactcaa

SEQ ID NO: 31144 - DNA, 25 bp, synthetic construct
  misc_feature 1..25: note = Synthetic Construct
  source 1..25: mol_type = other DNA
aggttgagcaagactacacctaatg

SEQ ID NO: 31145 - DNA, 19 bp, synthetic construct
  misc_feature 1..19: note = Synthetic Construct
  source 1..19: mol_type = other DNA
ccccacctgcgcttcactt

SEQ ID NO: 31146 - DNA, 22 bp, synthetic construct
  misc_feature 1..22: note = Synthetic Construct
  source 1..22: mol_type = other DNA
tgtaccaaagctggggcagtag

SEQ ID NO: 31147 - DNA, 22 bp, synthetic construct
  misc_feature 1..22: note = Synthetic Construct
  source 1..22: mol_type = other DNA
ctcggcgagtgacggataaaca

SEQ ID NO: 31148 - DNA, 24 bp, synthetic construct
  misc_feature 1..24: note = Synthetic Construct
  source 1..24: mol_type = other DNA
cctcttcccttcatccctctctgt

SEQ ID NO: 31149 - DNA, 21 bp, synthetic construct
  misc_feature 1..21: note = Synthetic Construct
  source 1..21: mol_type = other DNA
taggcccatgtcccgcttact

SEQ ID NO: 31150 - DNA, 21 bp, synthetic construct
  misc_feature 1..21: note = Synthetic Construct
  source 1..21: mol_type = other DNA
gacgtcagaagaggcatggtt

SEQ ID NO: 31151 - DNA, 22 bp, synthetic construct
  misc_feature 1..22: note = Synthetic Construct
  source 1..22: mol_type = other DNA
gccacagctcagacgagcttat

SEQ ID NO: 31152 - DNA, 19 bp, synthetic construct
  misc_feature 1..19: note = Synthetic Construct
  source 1..19: mol_type = other DNA
tgggtggcatcaggacctt

SEQ ID NO: 31153 - DNA, 23 bp, synthetic construct
  misc_feature 1..23: note = Synthetic Construct
  source 1..23: mol_type = other DNA
gggtattcagtggtacccgatgt

SEQ ID NO: 31154 - DNA, 27 bp, synthetic construct
  misc_feature 1..27: note = Synthetic Construct
  source 1..27: mol_type = other DNA
ccaaaagcatttgagaagaagcagtga

SEQ ID NO: 31155 - DNA, 25 bp, synthetic construct
  misc_feature 1..25: note = Synthetic Construct
  source 1..25: mol_type = other DNA
gtgttttgaaaggctaactctggtt

SEQ ID NO: 31156 - DNA, 23 bp, synthetic construct
  misc_feature 1..23: note = Synthetic Construct
  source 1..23: mol_type = other DNA
gcccttgttggggactttgtgta

SEQ ID NO: 31157 - DNA, 22 bp, synthetic construct
  misc_feature 1..22: note = Synthetic Construct
  source 1..22: mol_type = other DNA
ttagggcctggaatggggtttc

SEQ ID NO: 31158 - DNA, 22 bp, synthetic construct
  misc_feature 1..22: note = Synthetic Construct
  source 1..22: mol_type = other DNA
ggcttgaaccacttggctctct

SEQ ID NO: 31159 - DNA, 24 bp, synthetic construct
  misc_feature 1..24: note = Synthetic Construct
  source 1..24: mol_type = other DNA
gggatcctgggacttcctgtaatc

SEQ ID NO: 31160 - DNA, 28 bp, synthetic construct
  misc_feature 1..28: note = Synthetic Construct
  source 1..28: mol_type = other DNA
cctcttgaaggtccccaaatattcttga

SEQ ID NO: 31161 - DNA, 30 bp, synthetic construct
  misc_feature 1..30: note = Synthetic Construct
  source 1..30: mol_type = other DNA
gggcatatgagattataagggctagttttg

SEQ ID NO: 31162 - DNA, 24 bp, synthetic construct
  misc_feature 1..24: note = Synthetic Construct
  source 1..24: mol_type = other DNA
tgctctgctgatactgtacttgtt

SEQ ID NO: 31163 - DNA, 29 bp, synthetic construct
  misc_feature 1..29: note = Synthetic Construct
  source 1..29: mol_type = other DNA
gaggggaaatggagataaagtgttctaag

SEQ ID NO: 31164 - DNA, 23 bp, synthetic construct
  misc_feature 1..23: note = Synthetic Construct
  source 1..23: mol_type = other DNA
ccaatcctccctcttgcagtttc

SEQ ID NO: 31165 - DNA, 22 bp, synthetic construct
  misc_feature 1..22: note = Synthetic Construct
  source 1..22: mol_type = other DNA
gtgaggcatttccccaccactt

SEQ ID NO: 31166 - DNA, 22 bp, synthetic construct
  misc_feature 1..22: note = Synthetic Construct
  source 1..22: mol_type = other DNA
tgaaccacagcaaggcagatac

SEQ ID NO: 31167 - DNA, 19 bp, synthetic construct
  misc_feature 1..19: note = Synthetic Construct
  source 1..19: mol_type = other DNA
tgagccctgcagacaccaa

SEQ ID NO: 31168 - DNA, 26 bp, synthetic construct
  misc_feature 1..26: note = Synthetic Construct
  source 1..26: mol_type = other DNA
gccttcttagttcctagtagctgatt

SEQ ID NO: 31169 - DNA, 22 bp, synthetic construct
  misc_feature 1..22: note = Synthetic Construct
  source 1..22: mol_type = other DNA
gctgctgccctgattctagctt

SEQ ID NO: 31170 - DNA, 24 bp, synthetic construct
  misc_feature 1..24: note = Synthetic Construct
  source 1..24: mol_type = other DNA
cttccaagtgctgccatttagtca

SEQ ID NO: 31171 - DNA, 25 bp, synthetic construct
  misc_feature 1..25: note = Synthetic Construct
  source 1..25: mol_type = other DNA
ctctacaataagtgcatccccagaa

SEQ ID NO: 31172 - DNA, 20 bp, synthetic construct
  misc_feature 1..20: note = Synthetic Construct
  source 1..20: mol_type = other DNA
cctgctggacaagcttcctt

SEQ ID NO: 31173 - DNA, 21 bp, synthetic construct
  misc_feature 1..21: note = Synthetic Construct
  source 1..21: mol_type = other DNA
acccctcctccactggtttca

SEQ ID NO: 31174 - DNA, 26 bp, synthetic construct
  misc_feature 1..26: note = Synthetic Construct
  source 1..26: mol_type = other DNA
ccccattgatgccaagagatcctaag

SEQ ID NO: 31175 - DNA, 24 bp, synthetic construct
  misc_feature 1..24: note = Synthetic Construct
  source 1..24: mol_type = other DNA
gctgagcatgaagtcaggagaaac

SEQ ID NO: 31176 - DNA, 28 bp, synthetic construct
  misc_feature 1..28: note = Synthetic Construct
  source 1..28: mol_type = other DNA
gagaggaagaaactgacaggtactcaag

SEQ ID NO: 31177 - DNA, 24 bp, synthetic construct
  misc_feature 1..24: note = Synthetic Construct
  source 1..24: mol_type = other DNA
ctgctcagaatttgcctcaagttt

SEQ ID NO: 31178 - DNA, 26 bp, synthetic construct
  misc_feature 1..26: note = Synthetic Construct
  source 1..26: mol_type = other DNA
gagagaaccctaggactccacatttc

SEQ ID NO: 31179 - DNA, 22 bp, synthetic construct
  misc_feature 1..22: note = Synthetic Construct
  source 1..22: mol_type = other DNA
gctgaagcatagtggtccagat

SEQ ID NO: 31180 - DNA, 26 bp, synthetic construct
  misc_feature 1..26: note = Synthetic Construct
  source 1..26: mol_type = other DNA
ccacaaagtttttgacactcctctct

SEQ ID NO: 31181 - DNA, 24 bp, synthetic construct
  misc_feature 1..24: note = Synthetic Construct
  source 1..24: mol_type = other DNA
cacacaaggcagtgtgttgtccta

SEQ ID NO: 31182 - DNA, 20 bp, synthetic construct
  misc_feature 1..20: note = Synthetic Construct
  source 1..20: mol_type = other DNA
atgggcacagaagccacttt

SEQ ID NO: 31183 - DNA, 29 bp, synthetic construct
  misc_feature 1..29: note = Synthetic Construct
  source 1..29: mol_type = other DNA
gtcaagctataaactacagacccatctct

SEQ ID NO: 31184 - DNA, 25 bp, synthetic construct
  misc_feature 1..25: note = Synthetic Construct
  source 1..25: mol_type = other DNA
ctcatggagttgaaggcttggtttg

SEQ ID NO: 31185 - DNA, 25 bp, synthetic construct
  misc_feature 1..25: note = Synthetic Construct
  source 1..25: mol_type = other DNA
gaagtttgaaaggccactaggtgtt

SEQ ID NO: 31186 - DNA, 26 bp, synthetic construct
  misc_feature 1..26: note = Synthetic Construct
  source 1..26: mol_type = other DNA
ggcctcaatatggaacctacattgtt

SEQ ID NO: 31187 - DNA, 23 bp, synthetic construct
  misc_feature 1..23: note = Synthetic Construct
  source 1..23: mol_type = other DNA
cgagggaggtaatgggagctaga

SEQ ID NO: 31188 - DNA, 20 bp, synthetic construct
  misc_feature 1..20: note = Synthetic Construct
  source 1..20: mol_type = other DNA
tgcatcccaacagggctttc

SEQ ID NO: 31189 - DNA, 21 bp, synthetic construct
  misc_feature 1..21: note = Synthetic Construct
  source 1..21: mol_type = other DNA
tgtccacggtatccacactga

SEQ ID NO: 31190 - DNA, 21 bp, synthetic construct
  misc_feature 1..21: note = Synthetic Construct
  source 1..21: mol_type = other DNA
ggttccaagggcaccacattt

SEQ ID NO: 31191 - DNA, 28 bp, synthetic construct
  misc_feature 1..28: note = Synthetic Construct
  source 1..28: mol_type = other DNA
ctgatacaccagtgtccctaatttccaa

SEQ ID NO: 31192 - DNA, 27 bp, synthetic construct
  misc_feature 1..27: note = Synthetic Construct
  source 1..27: mol_type = other DNA
ctgatctttaaggcccaatactgtaga

SEQ ID NO: 31193 - DNA, 22 bp, synthetic construct
  misc_feature 1..22: note = Synthetic Construct
  source 1..22: mol_type = other DNA
caccaagccagtcctggagata

SEQ ID NO: 31194 - DNA, 24 bp, synthetic construct
  misc_feature 1..24: note = Synthetic Construct
  source 1..24: mol_type = other DNA
gaatgatgggagctaggctctaag

SEQ ID NO: 31195 - DNA, 19 bp, synthetic construct
  misc_feature 1..19: note = Synthetic Construct
  source 1..19: mol_type = other DNA
actcccctcgctgggtgat

SEQ ID NO: 31196 - DNA, 26 bp, synthetic construct
  misc_feature 1..26: note = Synthetic Construct
  source 1..26: mol_type = other DNA
gctttctggacttagctcttgtttca

SEQ ID NO: 31197 - DNA, 25 bp, synthetic construct
  misc_feature 1..25: note = Synthetic Construct
  source 1..25: mol_type = other DNA
cttgctagcttcttgggtctcattc

SEQ ID NO: 31198 - DNA, 24 bp, synthetic construct
  misc_feature 1..24: note = Synthetic Construct
  source 1..24: mol_type = other DNA
ctgggaagcagtctttgagaccaa

SEQ ID NO: 31199 - DNA, 22 bp, synthetic construct
  misc_feature 1..22: note = Synthetic Construct
  source 1..22: mol_type = other DNA
ggctagcctccatgtcagcaaa

SEQ ID NO: 31200 - DNA, 22 bp, synthetic construct
  misc_feature 1..22: note = Synthetic Construct
  source 1..22: mol_type = other DNA
ctccacctgccaaaatcctact

SEQ ID NO: 31201 - DNA, 24 bp, synthetic construct
  misc_feature 1..24: note = Synthetic Construct
  source 1..24: mol_type = other DNA
ggtgtgtttgagacccttgcatct

SEQ ID NO: 31202 - DNA, 23 bp, synthetic construct
  misc_feature 1..23: note = Synthetic Construct
  source 1..23: mol_type = other DNA
ctaccgaaagctgttgaccaaac

SEQ ID NO: 31203 - DNA, 23 bp, synthetic construct
  misc_feature 1..23: note = Synthetic Construct
  source 1..23: mol_type = other DNA
cctttgcctgtttcctgcagatt

SEQ ID NO: 31204 - DNA, 24 bp, synthetic construct
  misc_feature 1..24: note = Synthetic Construct
  source 1..24: mol_type = other DNA
agttttccctgaaaggagtgacat

SEQ ID NO: 31205 - DNA, 20 bp, synthetic construct
  misc_feature 1..20: note = Synthetic Construct
  source 1..20: mol_type = other DNA
tgtctgcctcccacatctct

SEQ ID NO: 31206 - DNA, 25 bp, synthetic construct
  misc_feature 1..25: note = Synthetic Construct
  source 1..25: mol_type = other DNA
acaggaccatccaaatcaccttgaa

SEQ ID NO: 31207 - DNA, 27 bp, synthetic construct
  misc_feature 1..27: note = Synthetic Construct
  source 1..27: mol_type = other DNA
cctaaacactggactctttacacatct

SEQ ID NO: 31208 - DNA, 22 bp, synthetic construct
  misc_feature 1..22: note = Synthetic Construct
  source 1..22: mol_type = other DNA
gcacatcacccagttgggaaac

SEQ ID NO: 31209 - DNA, 21 bp, synthetic construct
  misc_feature 1..21: note = Synthetic Construct
  source 1..21: mol_type = other DNA
gggattgggtgttgacgatga

SEQ ID NO: 31210 - DNA, 22 bp, synthetic construct
  misc_feature 1..22: note = Synthetic Construct
  source 1..22: mol_type = other DNA
gacgtgtgtcacgttctcttca

SEQ ID NO: 31211 - DNA, 20 bp, synthetic construct
  misc_feature 1..20: note = Synthetic Construct
  source 1..20: mol_type = other DNA
ccccttgcatttggcacaga

SEQ ID NO: 31212 - DNA, 27 bp, synthetic construct
  misc_feature 1..27: note = Synthetic Construct
  source 1..27: mol_type = other DNA
ctggagggatgtttttcaaacccaaac

SEQ ID NO: 31213 - DNA, 20 bp, synthetic construct
  misc_feature 1..20: note = Synthetic Construct
  source 1..20: mol_type = other DNA
gggcctgaaaactggcatga

SEQ ID NO: 31214 - DNA, 22 bp, synthetic construct
  misc_feature 1..22: note = Synthetic Construct
  source 1..22: mol_type = other DNA
tcgtcaacctgtgcatggtaag

SEQ ID NO: 31215 - DNA, 28 bp, synthetic construct
  misc_feature 1..28: note = Synthetic Construct
  source 1..28: mol_type = other DNA
gcaatcaggacgatcagacaaaaagaag

SEQ ID NO: 31216 - DNA, 21 bp, synthetic construct
  misc_feature 1..21: note = Synthetic Construct
  source 1..21: mol_type = other DNA
ctctgcttttgcaggggttgt

SEQ ID NO: 31217 - DNA, 22 bp, synthetic construct
  misc_feature 1..22: note = Synthetic Construct
  source 1..22: mol_type = other DNA
acccaaggagacaagagcatca

SEQ ID NO: 31218 - DNA, 24 bp, synthetic construct
  misc_feature 1..24: note = Synthetic Construct
  source 1..24: mol_type = other DNA
gaggactggaagtggtaagtcaca

SEQ ID NO: 31219 - DNA, 20 bp, synthetic construct
  misc_feature 1..20: note = Synthetic Construct
  source 1..20: mol_type = other DNA
gcccaagactggcattctca

SEQ ID NO: 31220 - DNA, 23 bp, synthetic construct
  misc_feature 1..23: note = Synthetic Construct
  source 1..23: mol_type = other DNA
acctttttccgactgggatgatt

SEQ ID NO: 31221 - DNA, 23 bp, synthetic construct
  misc_feature 1..23: note = Synthetic Construct
  source 1..23: mol_type = other DNA
cagtcctggattggctgtgatac

SEQ ID NO: 31222 - DNA, 26 bp, synthetic construct
  misc_feature 1..26: note = Synthetic Construct
  source 1..26: mol_type = other DNA
cgcttttggtagcatcagttccttga

SEQ ID NO: 31223 - DNA, 23 bp, synthetic construct
  misc_feature 1..23: note = Synthetic Construct
  source 1..23: mol_type = other DNA
cctagcttgtgccaagaggttct

SEQ ID NO: 31224 - DNA, 21 bp, synthetic construct
  misc_feature 1..21: note = Synthetic Construct
  source 1..21: mol_type = other DNA
ccatttcacggggaaggaagt

SEQ ID NO: 31225 - DNA, 27 bp, synthetic construct
  misc_feature 1..27: note = Synthetic Construct
  source 1..27: mol_type = other DNA
ggcagaggatccctatgttaccagttc

SEQ ID NO: 31226 - DNA, 20 bp, synthetic construct
  misc_feature 1..20: note = Synthetic Construct
  source 1..20: mol_type = other DNA
tgtccctgtggaagccagat

SEQ ID NO: 31227 - DNA, 24 bp, synthetic construct
  misc_feature 1..24: note = Synthetic Construct
  source 1..24: mol_type = other DNA
aagaattgcttcacctagcctgat

SEQ ID NO: 31228 - DNA, 25 bp, synthetic construct
  misc_feature 1..25: note = Synthetic Construct
  source 1..25: mol_type = other DNA
ggccctatacccaacaaagcctcta

SEQ ID NO: 31229 - DNA, 24 bp, synthetic construct
  misc_feature 1..24: note = Synthetic Construct
  source 1..24: mol_type = other DNA
ggggaaccatgaactctacctgaa

SEQ ID NO: 31230 - DNA, 22 bp, synthetic construct
  misc_feature 1..22: note = Synthetic Construct
  source 1..22: mol_type = other DNA
gggacacttacccaaccacgtt

SEQ ID NO: 31231 - DNA, 22 bp, synthetic construct
  misc_feature 1..22: note = Synthetic Construct
  source 1..22: mol_type = other DNA
caccgacttctctgacccaaga

SEQ ID NO: 31232 - DNA, 23 bp, synthetic construct
  misc_feature 1..23: note = Synthetic Construct
  source 1..23: mol_type = other DNA
tgggaaaagtacggagtcagatg

SEQ ID NO: 31233 - DNA, 25 bp, synthetic construct
  misc_feature 1..25: note = Synthetic Construct
  source 1..25: mol_type = other DNA
cgtgtcaactttctccttacctgat

SEQ ID NO: 31234 - DNA, 24 bp, synthetic construct
  misc_feature 1..24: note = Synthetic Construct
  source 1..24: mol_type = other DNA
ggttcagtggagcttgtagtctca

SEQ ID NO: 31235 - DNA, 25 bp, synthetic construct
  misc_feature 1..25: note = Synthetic Construct
  source 1..25: mol_type = other DNA
cacctatgaattcagggctcctttc

SEQ ID NO: 31236 - DNA, 25 bp, synthetic construct
  misc_feature 1..25: note = Synthetic Construct
  source 1..25: mol_type = other DNA
tgggatgggataaggagtaaggaaa

SEQ ID NO: 31237 - DNA, 23 bp, synthetic construct
  misc_feature 1..23: note = Synthetic Construct
  source 1..23: mol_type = other DNA
cccagccagtgaggtagatgttg

SEQ ID NO: 31238 - DNA, 22 bp, synthetic construct
  misc_feature 1..22: note = Synthetic Construct
  source 1..22: mol_type = other DNA
tgccctgtctccttcctttcta

SEQ ID NO: 31239 - DNA, 25 bp, synthetic construct
  misc_feature 1..25: note = Synthetic Construct
  source 1..25: mol_type = other DNA
ggactgtttcccaagtcttcacctt

SEQ ID NO: 31240 - DNA, 20 bp, synthetic construct
  misc_feature 1..20: note = Synthetic Construct
  source 1..20: mol_type = other DNA
agtgtgtccctagcccaagt

SEQ ID NO: 31241 - DNA, 26 bp, synthetic construct
  misc_feature 1..26: note = Synthetic Construct
  source 1..26: mol_type = other DNA
ggcatatatgtaggccgggttgtaag

SEQ ID NO: 31242 - DNA, 24 bp, synthetic construct
  misc_feature 1..24: note = Synthetic Construct
  source 1..24: mol_type = other DNA
ccccgtaacccagatgatgagttt

SEQ ID NO: 31243 - DNA, 24 bp, synthetic construct
  misc_feature 1..24: note = Synthetic Construct
  source 1..24: mol_type = other DNA
aggtagtagacaggcttgaaggtt

SEQ ID NO: 31244 - DNA, 22 bp, synthetic construct
  misc_feature 1..22: note = Synthetic Construct
  source 1..22: mol_type = other DNA
cccggatggggtagcatttcaa

SEQ ID NO: 31245 - DNA, 27 bp, synthetic construct
  misc_feature 1..27: note = Synthetic Construct
  source 1..27: mol_type = other DNA
gcaacaagacttttacccagagaccaa

SEQ ID NO: 31246 - DNA, 23 bp, synthetic construct
  misc_feature 1..23: note = Synthetic Construct
  source 1..23: mol_type = other DNA
ggttccaatggcagactgttgaa

SEQ ID NO: 31247 - DNA, 22 bp, synthetic construct
  misc_feature 1..22: note = Synthetic Construct
  source 1..22: mol_type = other DNA
actggcaaaggagaagggtagt

SEQ ID NO: 31248 - DNA, 22 bp, synthetic construct
  misc_feature 1..22: note = Synthetic Construct
  source 1..22: mol_type = other DNA
tccctgcccaggaccaagaata

SEQ ID NO: 31249 - DNA, 26 bp, synthetic construct
  misc_feature 1..26: note = Synthetic Construct
  source 1..26: mol_type = other DNA
ctgcttattctcctggttgaggttga

SEQ ID NO: 31250 - DNA, 23 bp, synthetic construct
  misc_feature 1..23: note = Synthetic Construct
  source 1..23: mol_type = other DNA
tatgtctcatcccggccctctct

SEQ ID NO: 31251 - DNA, 23 bp, synthetic construct
  misc_feature 1..23: note = Synthetic Construct
  source 1..23: mol_type = other DNA
ccaccacctccgaggatgaaaag

SEQ ID NO: 31252 - DNA, 22 bp, synthetic construct
  misc_feature 1..22: note = Synthetic Construct
  source 1..22: mol_type = other DNA
aggcagccttacacatgacatt

SEQ ID NO: 31253 - DNA, 24 bp, synthetic construct
  misc_feature 1..24: note = Synthetic Construct
  source 1..24: mol_type = other DNA
acatggcctttccactttctcttt

SEQ ID NO: 31254 - DNA, 22 bp, synthetic construct
  misc_feature 1..22: note = Synthetic Construct
  source 1..22: mol_type = other DNA
ctggcgtcgtatgaggcttttg

SEQ ID NO: 31255 - DNA, 26 bp, synthetic construct
  misc_feature 1..26: note = Synthetic Construct
  source 1..26: mol_type = other DNA
ggctgggataaaatgacagtccttga

SEQ ID NO: 31256 - DNA, 20 bp, synthetic construct
  misc_feature 1..20: note = Synthetic Construct
  source 1..20: mol_type = other DNA
gtggtggcttctgtgggttt

SEQ ID NO: 31257 - DNA, 19 bp, synthetic construct
  misc_feature 1..19: note = Synthetic Construct
  source 1..19: mol_type = other DNA
tggcactggtggactcaga

SEQ ID NO: 31258 - DNA, 24 bp, synthetic construct
  misc_feature 1..24: note = Synthetic Construct
  source 1..24: mol_type = other DNA
ccccaactggaataactgttgctt

SEQ ID NO: 31259 - DNA, 24 bp, synthetic construct
  misc_feature 1..24: note = Synthetic Construct
  source 1..24: mol_type = other DNA
gaatgggagaaagagtggtggtat

SEQ ID NO: 31260 - DNA, 23 bp, synthetic construct
  misc_feature 1..23: note = Synthetic Construct
  source 1..23: mol_type = other DNA
gaccgagaagcagtacactgaga

SEQ ID NO: 31261 - DNA, 25 bp, synthetic construct
  misc_feature 1..25: note = Synthetic Construct
  source 1..25: mol_type = other DNA
cagctcatttccctacaggaacagt

SEQ ID NO: 31262 - DNA, 20 bp, synthetic construct
  misc_feature 1..20: note = Synthetic Construct
  source 1..20: mol_type = other DNA
agtgctgggtggccttccta

SEQ ID NO: 31263 - DNA, 23 bp, synthetic construct
  misc_feature 1..23: note = Synthetic Construct
  source 1..23: mol_type = other DNA
cctggtccactaagtgctcttct

SEQ ID NO: 31264 - DNA, 22 bp, synthetic construct
  misc_feature 1..22: note = Synthetic Construct
  source 1..22: mol_type = other DNA
gggagcatcagccatccatcat

SEQ ID NO: 31265 - DNA, 29 bp, synthetic construct
  misc_feature 1..29: note = Synthetic Construct
  source 1..29: mol_type = other DNA
ctcgaaactcattcatcttcctgtgtaag

SEQ ID NO: 31266 - DNA, 24 bp, synthetic construct
  misc_feature 1..24: note = Synthetic Construct
  source 1..24: mol_type = other DNA
tcagtgctaccatcagggatatga

SEQ ID NO: 31267 - DNA, 20 bp, synthetic construct
  misc_feature 1..20: note = Synthetic Construct
  source 1..20: mol_type = other DNA
cctcgctggaagacgggaaa

SEQ ID NO: 31268 - DNA, 18 bp, synthetic construct
  misc_feature 1..18: note = Synthetic Construct
  source 1..18: mol_type = other DNA
gcagtgcctctgctccaa

SEQ ID NO: 31269 - DNA, 25 bp, synthetic construct
  misc_feature 1..25: note = Synthetic Construct
  source 1..25: mol_type = other DNA
ggcataaaagaggatcacgttcaca

SEQ ID NO: 31270 - DNA, 21 bp, synthetic construct
  misc_feature 1..21: note = Synthetic Construct
  source 1..21: mol_type = other DNA
tgagcctagtggaggtcactt

SEQ ID NO: 31271 - DNA, 27 bp, synthetic construct
  misc_feature 1..27: note = Synthetic Construct
  source 1..27: mol_type = other DNA
ccacaataattggtgactgacttgcta

SEQ ID NO: 31272 - DNA, 23 bp, synthetic construct
  misc_feature 1..23: note = Synthetic Construct
  source 1..23: mol_type = other DNA
tgcctagtggttcacgagttaga

SEQ ID NO: 31273 - DNA, 23 bp, synthetic construct
  misc_feature 1..23: note = Synthetic Construct
  source 1..23: mol_type = other DNA
gggttcctgacctgcaaatctct

SEQ ID NO: 31274 - DNA, 25 bp, synthetic construct
  misc_feature 1..25: note = Synthetic Construct
  source 1..25: mol_type = other DNA
gcaagaaagcatccatccatctaca

SEQ ID NO: 31275 - DNA, 25 bp, synthetic construct
  misc_feature 1..25: note = Synthetic Construct
  source 1..25: mol_type = other DNA
ctgtagctttcctgtgactggtttc

SEQ ID NO: 31276 - DNA, 22 bp, synthetic construct
  misc_feature 1..22: note = Synthetic Construct
  source 1..22: mol_type = other DNA
ggggcagaggggactaaggtaa

SEQ ID NO: 31277 - DNA, 27 bp, synthetic construct
  misc_feature 1..27: note = Synthetic Construct
  source 1..27: mol_type = other DNA
ctcctccaaccttaacacctagatatg

SEQ ID NO: 31278 - DNA, 23 bp, synthetic construct
  misc_feature 1..23: note = Synthetic Construct
  source 1..23: mol_type = other DNA
cagctcccctcaaagtcagatag

SEQ ID NO: 31279 - DNA, 25 bp, synthetic construct
  misc_feature 1..25: note = Synthetic Construct
  source 1..25: mol_type = other DNA
gcaaaggagaccatcttcattccaa

SEQ ID NO: 31280 - DNA, 22 bp, synthetic construct
  misc_feature 1..22: note = Synthetic Construct
  source 1..22: mol_type = other DNA
cgcaaaggcccaggaaaagaca

SEQ ID NO: 31281 - DNA, 22 bp, synthetic construct
  misc_feature 1..22: note = Synthetic Construct
  source 1..22: mol_type = other DNA
gggcgggcttattaccttcttg

SEQ ID NO: 31282 - DNA, 22 bp, synthetic construct
  misc_feature 1..22: note = Synthetic Construct
  source 1..22: mol_type = other DNA
gtgtaggactcagccatgttca

SEQ ID NO: 31283 - DNA, 20 bp, synthetic construct
  misc_feature 1..20: note = Synthetic Construct
  source 1..20: mol_type = other DNA
gaagcccagcaagtggatca

SEQ ID NO: 31284 - DNA, 24 bp, synthetic construct
  misc_feature 1..24: note = Synthetic Construct
  source 1..24: mol_type = other DNA
aggaggtgcttgtattgacacttg

SEQ ID NO: 31285 - DNA, 19 bp, synthetic construct
  misc_feature 1..19: note = Synthetic Construct
  source 1..19: mol_type = other DNA
ccacggagcagctggaaca

SEQ ID NO: 31286 - DNA, 21 bp, synthetic construct
  misc_feature 1..21: note = Synthetic Construct
  source 1..21: mol_type = other DNA
cggtaccccaggttcttctgt

SEQ ID NO: 31287 - DNA, 22 bp, synthetic construct
  misc_feature 1..22: note = Synthetic Construct
  source 1..22: mol_type = other DNA
agccagcactagcctcttatgt

SEQ ID NO: 31288 - DNA, 22 bp, synthetic construct
  misc_feature 1..22: note = Synthetic Construct
  source 1..22: mol_type = other DNA
gggactctcccttgaccttgaa

SEQ ID NO: 31289 - DNA, 24 bp, synthetic construct
  misc_feature 1..24: note = Synthetic Construct
  source 1..24: mol_type = other DNA
caggagtagagtaggaaggctgta

SEQ ID NO: 31290 - DNA, 21 bp, synthetic construct
  misc_feature 1..21: note = Synthetic Construct
  source 1..21: mol_type = other DNA
ccagctgtgacgcatggatga

SEQ ID NO: 31291 - DNA, 24 bp, synthetic construct
  misc_feature 1..24: note = Synthetic Construct
  source 1..24: mol_type = other DNA
ggatgtctggggaagaagatgact

SEQ ID NO: 31292 - DNA, 20 bp, synthetic construct
  misc_feature 1..20: note = Synthetic Construct
  source 1..20: mol_type = other DNA
tcctggggcccgactcatag

SEQ ID NO: 31293 - DNA, 24 bp, synthetic construct
  misc_feature 1..24: note = Synthetic Construct
  source 1..24: mol_type = other DNA
gccccttgtcactcagtcaaaaac

SEQ ID NO: 31294 - DNA, 26 bp, synthetic construct
  misc_feature 1..26: note = Synthetic Construct
  source 1..26: mol_type = other DNA
gcaatccaagaggttagtgactgttc

SEQ ID NO: 31295 - DNA, 21 bp, synthetic construct
  misc_feature 1..21: note = Synthetic Construct
  source 1..21: mol_type = other DNA
agccagtcccacgtcacatag

SEQ ID NO: 31296 - DNA, 24 bp, synthetic construct
  misc_feature 1..24: note = Synthetic Construct
  source 1..24: mol_type = other DNA
aactgaaaaagggttccctcactt

SEQ ID NO: 31297 - DNA, 22 bp, synthetic construct
  misc_feature 1..22: note = Synthetic Construct
  source 1..22: mol_type = other DNA
gcccctggaccataaccaaagt

SEQ ID NO: 31298 - DNA, 19 bp, synthetic construct
  misc_feature 1..19: note = Synthetic Construct
  source 1..19: mol_type = other DNA
cggccatagcccacaggaa

SEQ ID NO: 31299 - DNA, 22 bp, synthetic construct
  misc_feature 1..22: note = Synthetic Construct
  source 1..22: mol_type = other DNA
tcagggcctgtaatgtgctatg

SEQ ID NO: 31300 - DNA, 25 bp, synthetic construct
  misc_feature 1..25: note = Synthetic Construct
  source 1..25: mol_type = other DNA
atccatcttccacaatgtcaccata

SEQ ID NO: 31301 - DNA, 22 bp, synthetic construct
  misc_feature 1..22: note = Synthetic Construct
  source 1..22: mol_type = other DNA
gctgggctgcaggtatgaatct

SEQ ID NO: 31302 - DNA, 21 bp, synthetic construct
  misc_feature 1..21: note = Synthetic Construct
  source 1..21: mol_type = other DNA
gagctagctgcaggagttgtt

SEQ ID NO: 31303 - DNA, 24 bp, synthetic construct
  misc_feature 1..24: note = Synthetic Construct
  source 1..24: mol_type = other DNA
tgggatagcatggctggattatct

SEQ ID NO: 31304 - DNA, 24 bp, synthetic construct
  misc_feature 1..24: note = Synthetic Construct
  source 1..24: mol_type = other DNA
gatccaacagccactaagtgaaac

SEQ ID NO: 31305 - DNA, 24 bp, synthetic construct
  misc_feature 1..24: note = Synthetic Construct
  source 1..24: mol_type = other DNA
tcccacggtctagattttgttgat

SEQ ID NO: 31306 - DNA, 21 bp, synthetic construct
  misc_feature 1..21: note = Synthetic Construct
  source 1..21: mol_type = other DNA
gcatgttgggagcagaaccaa

SEQ ID NO: 31307 - DNA, 22 bp, synthetic construct
  misc_feature 1..22: note = Synthetic Construct
  source 1..22: mol_type = other DNA
aggctgccagatcagtggtttc

SEQ ID NO: 31308 - DNA, 26 bp, synthetic construct
  misc_feature 1..26: note = Synthetic Construct
  source 1..26: mol_type = other DNA
ctctcatcaactcacaatggcgtttt

SEQ ID NO: 31309 - DNA, 21 bp, synthetic construct
  misc_feature 1..21: note = Synthetic Construct
  source 1..21: mol_type = other DNA
tccagcagacccagggtgtaa

SEQ ID NO: 31310 - DNA, 23 bp, synthetic construct
  misc_feature 1..23: note = Synthetic Construct
  source 1..23: mol_type = other DNA
gacaatggacacacactccagtt

SEQ ID NO: 31311 - DNA, 24 bp, synthetic construct
  misc_feature 1..24: note = Synthetic Construct
  source 1..24: mol_type = other DNA
agaggtttgcacttcagagacatc

SEQ ID NO: 31312 - DNA, 22 bp, synthetic construct
  misc_feature 1..22: note = Synthetic Construct
  source 1..22: mol_type = other DNA
gctgcctggagacagtgcatag

SEQ ID NO: 31313 - DNA, 26 bp, synthetic construct
  misc_feature 1..26: note = Synthetic Construct
  source 1..26: mol_type = other DNA
cctctgtgttgaagctttgagaatac

SEQ ID NO: 31314 - DNA, 22 bp, synthetic construct
  misc_feature 1..22: note = Synthetic Construct
  source 1..22: mol_type = other DNA
ggaagctgccagtctactgtgt

SEQ ID NO: 31315 - DNA, 23 bp, synthetic construct
  misc_feature 1..23: note = Synthetic Construct
  source 1..23: mol_type = other DNA
aggtacaaacaccaacctcacat

SEQ ID NO: 31316 - DNA, 24 bp, synthetic construct
  misc_feature 1..24: note = Synthetic Construct
  source 1..24: mol_type = other DNA
tgtcttcacactttagggagcttt

SEQ ID NO: 31317 - DNA, 21 bp, synthetic construct
  misc_feature 1..21: note = Synthetic Construct
  source 1..21: mol_type = other DNA
agctttacccctcctctgaca

SEQ ID NO: 31318 - DNA, 27 bp, synthetic construct
  misc_feature 1..27: note = Synthetic Construct
  source 1..27: mol_type = other DNA
cctaggaagaggaacagatttggtaag

SEQ ID NO: 31319 - DNA, 26 bp, synthetic construct
  misc_feature 1..26: note = Synthetic Construct
  source 1..26: mol_type = other DNA
cccaagaaaggtctgttctgactgta

SEQ ID NO: 31320 - DNA, 21 bp, synthetic construct
  misc_feature 1..21: note = Synthetic Construct
  source 1..21: mol_type = other DNA
agctcagatccaccccagcat

SEQ ID NO: 31321 - DNA, 24 bp, synthetic construct
  misc_feature 1..24: note = Synthetic Construct
  source 1..24: mol_type = other DNA
ctgtgtctgttggatgcgtagtga

SEQ ID NO: 31322 - DNA, 26 bp, synthetic construct
  misc_feature 1..26: note = Synthetic Construct
  source 1..26: mol_type = other DNA
gggtccactgtagttcatttccctaa

SEQ ID NO: 31323 - DNA, 20 bp, synthetic construct
  misc_feature 1..20: note = Synthetic Construct
  source 1..20: mol_type = other DNA
actggggctgcagttaccta

SEQ ID NO: 31324 - DNA, 21 bp, synthetic construct
  misc_feature 1..21: note = Synthetic Construct
  source 1..21: mol_type = other DNA
ggccctttaccccaccctgta

SEQ ID NO: 31325 - DNA, 25 bp, synthetic construct
  misc_feature 1..25: note = Synthetic Construct
  source 1..25: mol_type = other DNA
ccaattggaggaaggatgacctatc

SEQ ID NO: 31326 - DNA, 24 bp, synthetic construct
  misc_feature 1..24: note = Synthetic Construct
  source 1..24: mol_type = other DNA
gtcatccgtcttctctcaccctta

SEQ ID NO: 31327 - DNA, 27 bp, synthetic construct
  misc_feature 1..27: note = Synthetic Construct
  source 1..27: mol_type = other DNA
gtctgtctgccaaatctatgcagtttc

SEQ ID NO: 31328 - DNA, 22 bp, synthetic construct
  misc_feature 1..22: note = Synthetic Construct
  source 1..22: mol_type = other DNA
gcttagcggaggttccctgaat

SEQ ID NO: 31329 - DNA, 19 bp, synthetic construct
  misc_feature 1..19: note = Synthetic Construct
  source 1..19: mol_type = other DNA
aggcccaggagtggaccta

SEQ ID NO: 31330 - DNA, 26 bp, synthetic construct
  misc_feature 1..26: note = Synthetic Construct
  source 1..26: mol_type = other DNA
gtgttctgttgaaccattgggtatgt

SEQ ID NO: 31331 - DNA, 25 bp, synthetic construct
  misc_feature 1..25: note = Synthetic Construct
  source 1..25: mol_type = other DNA
gggtcagagaagctcaaccttggaa

SEQ ID NO: 31332 - DNA, 25 bp, synthetic construct
  misc_feature 1..25: note = Synthetic Construct
  source 1..25: mol_type = other DNA
ggctctaacagcttttgtcatgttt

SEQ ID NO: 31333 - DNA, 28 bp, synthetic construct
  misc_feature 1..28: note = Synthetic Construct
  source 1..28: mol_type = other DNA
gctgaaagttaaaggaactggtggattc

SEQ ID NO: 31334 - DNA, 25 bp, synthetic construct
  misc_feature 1..25: note = Synthetic Construct
  source 1..25: mol_type = other DNA
tctgctcttgtactgttctgctatt

SEQ ID NO: 31335 - DNA, 27 bp, synthetic construct
  misc_feature 1..27: note = Synthetic Construct
  source 1..27: mol_type = other DNA
ggacactgtttgctttgtgtgagtaaa

SEQ ID NO: 31336 - DNA, 22 bp, synthetic construct
  misc_feature 1..22: note = Synthetic Construct
  source 1..22: mol_type = other DNA
ggagagtgtcccagactgatct

SEQ ID NO: 31337 - DNA, 22 bp, synthetic construct
  misc_feature 1..22: note = Synthetic Construct
  source 1..22: mol_type = other DNA
ccacgccgagctgtgaaatagt

SEQ ID NO: 31338 - DNA, 23 bp, synthetic construct
  misc_feature 1..23: note = Synthetic Construct
  source 1..23: mol_type = other DNA
tcttctccctgtcctgtctttct

SEQ ID NO: 31339 - DNA, 24 bp, synthetic construct
  misc_feature 1..24: note = Synthetic Construct
  source 1..24: mol_type = other DNA
gcctgtggacacagctttgtttct

SEQ ID NO: 31340 - DNA, 24 bp, synthetic construct
  misc_feature 1..24: note = Synthetic Construct
  source 1..24: mol_type = other DNA
cggctacttccttttgccttaaaa

SEQ ID NO: 31341 - DNA, 22 bp, synthetic construct
  misc_feature 1..22: note = Synthetic Construct
  source 1..22: mol_type = other DNA
gtctaggccacgaggtcttcaa

SEQ ID NO: 31342 - DNA, 22 bp, synthetic construct
  misc_feature 1..22: note = Synthetic Construct
  source 1..22: mol_type = other DNA
ccatagtccagtgtggctgcat

SEQ ID NO: 31343 - DNA, 25 bp, synthetic construct
  misc_feature 1..25: note = Synthetic Construct
  source 1..25: mol_type = other DNA
aaaattcaggctgacaggtaagcta

SEQ ID NO: 31344 - DNA, 20 bp, synthetic construct
  misc_feature 1..20: note = Synthetic Construct
  source 1..20: mol_type = other DNA
gcatggtggtgtgcatctgt

SEQ ID NO: 31345 - DNA, 24 bp, synthetic construct
  misc_feature 1..24: note = Synthetic Construct
  source 1..24: mol_type = other DNA
gcaggctagaagggcaaagggata

SEQ ID NO: 31346 - DNA, 24 bp, synthetic construct
  misc_feature 1..24: note = Synthetic Construct
  source 1..24: mol_type = other DNA
cctgtctacaaatggtccctgact

SEQ ID NO: 31347 - DNA, 27 bp, synthetic construct
  misc_feature 1..27: note = Synthetic Construct
  source 1..27: mol_type = other DNA
cacattgttaccctataacggtgttgt

SEQ ID NO: 31348 - DNA, 26 bp, synthetic construct
  misc_feature 1..26: note = Synthetic Construct
  source 1..26: mol_type = other DNA
ggaaatagctgggtgttgctactaag

SEQ ID NO: 31349 - DNA, 29 bp, synthetic construct
  misc_feature 1..29: note = Synthetic Construct
  source 1..29: mol_type = other DNA
ctgaagttggtatccctttagcttcaaac

SEQ ID NO: 31350 - DNA, 21 bp, synthetic construct
  misc_feature 1..21: note = Synthetic Construct
  source 1..21: mol_type = other DNA
tcctccttggcccaatcaaag

SEQ ID NO: 31351 - DNA, 21 bp, synthetic construct
  misc_feature 1..21: note = Synthetic Construct
  source 1..21: mol_type = other DNA
attggctaagcaggccaatct

SEQ ID NO: 31352 - DNA, 24 bp, synthetic construct
  misc_feature 1..24: note = Synthetic Construct
  source 1..24: mol_type = other DNA
acctggtgttctagtctactgtga

SEQ ID NO: 31353 - DNA, 24 bp, synthetic construct
  misc_feature 1..24: note = Synthetic Construct
  source 1..24: mol_type = other DNA
acttggggaacagaaagatgtcaa

SEQ ID NO: 31354 - DNA, 22 bp, synthetic construct
  misc_feature 1..22: note = Synthetic Construct
  source 1..22: mol_type = other DNA
ccaccaggagctcagttgtgtt

SEQ ID NO: 31355 - DNA, 21 bp, synthetic construct
  misc_feature 1..21: note = Synthetic Construct
  source 1..21: mol_type = other DNA
gtggttactgcatcggacagt

SEQ ID NO: 31356 - DNA, 20 bp, synthetic construct
  misc_feature 1..20: note = Synthetic Construct
  source 1..20: mol_type = other DNA
gggaaatgcttcgggacctt

SEQ ID NO: 31357 - DNA, 20 bp, synthetic construct
  misc_feature 1..20: note = Synthetic Construct
  source 1..20: mol_type = other DNA
ctttgggctggttggtctga

SEQ ID NO: 31358 - DNA, 21 bp, synthetic construct
  misc_feature 1..21: note = Synthetic Construct
  source 1..21: mol_type = other DNA
agtgatggctcctgcccaaac

SEQ ID NO: 31359 - DNA, 22 bp, synthetic construct
  misc_feature 1..22: note = Synthetic Construct
  source 1..22: mol_type = other DNA
gccctcccaggctaagaatatc

SEQ ID NO: 31360 - DNA, 23 bp, synthetic construct
  misc_feature 1..23: note = Synthetic Construct
  source 1..23: mol_type = other DNA
cctaagccttctgcagctgaaat

SEQ ID NO: 31361 - DNA, 21 bp, synthetic construct
  misc_feature 1..21: note = Synthetic Construct
  source 1..21: mol_type = other DNA
gtgaagcagctggaagtctct

SEQ ID NO: 31362 - DNA, 23 bp, synthetic construct
  misc_feature 1..23: note = Synthetic Construct
  source 1..23: mol_type = other DNA
actgcctcccatttccattttct

SEQ ID NO: 31363 - DNA, 26 bp, synthetic construct
  misc_feature 1..26: note = Synthetic Construct
  source 1..26: mol_type = other DNA
cttcactacgtagatgccatcctatt

SEQ ID NO: 31364 - DNA, 22 bp, synthetic construct
  misc_feature 1..22: note = Synthetic Construct
  source 1..22: mol_type = other DNA
gaccctctgtgtctttgtgcat

SEQ ID NO: 31365 - DNA, 20 bp, synthetic construct
  misc_feature 1..20: note = Synthetic Construct
  source 1..20: mol_type = other DNA
agctgcctcccagagaagat

SEQ ID NO: 31366 - DNA, 20 bp, synthetic construct
  misc_feature 1..20: note = Synthetic Construct
  source 1..20: mol_type = other DNA
agtcgctgtggggaaaggaa

SEQ ID NO: 31367 - DNA, 20 bp, synthetic construct
  misc_feature 1..20: note = Synthetic Construct
  source 1..20: mol_type = other DNA
ggcttcacggctgaaaggat

SEQ ID NO: 31368 - DNA, 19 bp, synthetic construct
  misc_feature 1..19: note = Synthetic Construct
  source 1..19: mol_type = other DNA
tggcaaggcatccccaaga

SEQ ID NO: 31369 - DNA, 23 bp, synthetic construct
  misc_feature 1..23: note = Synthetic Construct
  source 1..23: mol_type = other DNA
gtttctgccagttaggagctagt

SEQ ID NO: 31370 - DNA, 23 bp, synthetic construct
  misc_feature 1..23: note = Synthetic Construct
  source 1..23: mol_type = other DNA
ggactccagaagcttcagacaac

SEQ ID NO: 31371 - DNA, 24 bp, synthetic construct
  misc_feature 1..24: note = Synthetic Construct
  source 1..24: mol_type = other DNA
ggcaacagaacaagacctggtgaa

SEQ ID NO: 31372 - DNA, 24 bp, synthetic construct
  misc_feature 1..24: note = Synthetic Construct
  source 1..24: mol_type = other DNA
gcacgaagaccatttaggaaaaca

SEQ ID NO: 31373 - DNA, 27 bp, synthetic construct
  misc_feature 1..27: note = Synthetic Construct
  source 1..27: mol_type = other DNA
ctataacttccagtaactgtgctcctt

SEQ ID NO: 31374 - DNA, 21 bp, synthetic construct
  misc_feature 1..21: note = Synthetic Construct
  source 1..21: mol_type = other DNA
ccccacctagccactctctac

SEQ ID NO: 31375 - DNA, 27 bp, synthetic construct
  misc_feature 1..27: note = Synthetic Construct
  source 1..27: mol_type = other DNA
ggggagggaagaagaagcataatgtca

SEQ ID NO: 31376 - DNA, 22 bp, synthetic construct
  misc_feature 1..22: note = Synthetic Construct
  source 1..22: mol_type = other DNA
ggacctgctcctttctgtccaa

SEQ ID NO: 31377 - DNA, 22 bp, synthetic construct
  misc_feature 1..22: note = Synthetic Construct
  source 1..22: mol_type = other DNA
gccacctttcaggacttgctaa

SEQ ID NO: 31378 - DNA, 22 bp, synthetic construct
  misc_feature 1..22: note = Synthetic Construct
  source 1..22: mol_type = other DNA
ccgtttcaggccatagctcaca

SEQ ID NO: 31379 - DNA, 22 bp, synthetic construct
  misc_feature 1..22: note = Synthetic Construct
  source 1..22: mol_type = other DNA
ctggttctcaggtcctgccttt

SEQ ID NO: 31380 - DNA, 20 bp, synthetic construct
  misc_feature 1..20: note = Synthetic Construct
  source 1..20: mol_type = other DNA
tccagggcagtgcctccttt

SEQ ID NO: 31381 - DNA, 27 bp, synthetic construct
  misc_feature 1..27: note = Synthetic Construct
  source 1..27: mol_type = other DNA
gctttccttttagtccgccttaagatt

SEQ ID NO: 31382 - DNA, 23 bp, synthetic construct
  misc_feature 1..23: note = Synthetic Construct
  source 1..23: mol_type = other DNA
ttctctggccagcctttaagttt

SEQ ID NO: 31383 - DNA, 21 bp, synthetic construct
  misc_feature 1..21: note = Synthetic Construct
  source 1..21: mol_type = other DNA
ctcaaggccagtcagctctgt

SEQ ID NO: 31384 - DNA, 23 bp, synthetic construct
  misc_feature 1..23: note = Synthetic Construct
  source 1..23: mol_type = other DNA
ctgttcatggcatcccctaatgt

SEQ ID NO: 31385 - DNA, 26 bp, synthetic construct
  misc_feature 1..26: note = Synthetic Construct
  source 1..26: mol_type = other DNA
cagcctagtgttttgtgaccatctgt

SEQ ID NO: 31386 - DNA, 23 bp, synthetic construct
  misc_feature 1..23: note = Synthetic Construct
  source 1..23: mol_type = other DNA
gccaaacaaagggagcactggtt

SEQ ID NO: 31387 - DNA, 22 bp, synthetic construct
  misc_feature 1..22: note = Synthetic Construct
  source 1..22: mol_type = other DNA
actgcagcaactatgcatcaca

SEQ ID NO: 31388 - DNA, 23 bp, synthetic construct
  misc_feature 1..23: note = Synthetic Construct
  source 1..23: mol_type = other DNA
ggcttctctccctaccccagatt

SEQ ID NO: 31389 - DNA, 22 bp, synthetic construct
  misc_feature 1..22: note = Synthetic Construct
  source 1..22: mol_type = other DNA
aatggggaagggctgtgagtag

SEQ ID NO: 31390 - DNA, 22 bp, synthetic construct
  misc_feature 1..22: note = Synthetic Construct
  source 1..22: mol_type = other DNA
cttccctatccagctggtcact

SEQ ID NO: 31391 - DNA, 24 bp, synthetic construct
  misc_feature 1..24: note = Synthetic Construct
  source 1..24: mol_type = other DNA
gcagcaggtgataatgcagaattg

SEQ ID NO: 31392 - DNA, 20 bp, synthetic construct
  misc_feature 1..20: note = Synthetic Construct
  source 1..20: mol_type = other DNA
atctgtccgcagagggcttt

SEQ ID NO: 31393 - DNA, 27 bp, synthetic construct
  misc_feature 1..27: note = Synthetic Construct
  source 1..27: mol_type = other DNA
ggaatcccatgtaaggtacttgctgtt

SEQ ID NO: 31394 - DNA, 26 bp, synthetic construct
  misc_feature 1..26: note = Synthetic Construct
  source 1..26: mol_type = other DNA
gtgggcttagatttgggatattggta

SEQ ID NO: 31395 - DNA, 21 bp, synthetic construct
  misc_feature 1..21: note = Synthetic Construct
  source 1..21: mol_type = other DNA
agtggggttttgcagcctatc

SEQ ID NO: 31396 - DNA, 21 bp, synthetic construct
  misc_feature 1..21: note = Synthetic Construct
  source 1..21: mol_type = other DNA
cctggaaaacaccacgctctt

SEQ ID NO: 31397 - DNA, 27 bp, synthetic construct
  misc_feature 1..27: note = Synthetic Construct
  source 1..27: mol_type = other DNA
gagaagacgacaggttcatttgctttg

SEQ ID NO: 31398 - DNA, 20 bp, synthetic construct
  misc_feature 1..20: note = Synthetic Construct
  source 1..20: mol_type = other DNA
gcagggcatgactgacttct

SEQ ID NO: 31399 - DNA, 24 bp, synthetic construct
  misc_feature 1..24: note = Synthetic Construct
  source 1..24: mol_type = other DNA
gtgtccatgcctctaggacatcat

SEQ ID NO: 31400 - DNA, 25 bp, synthetic construct
  misc_feature 1..25: note = Synthetic Construct
  source 1..25: mol_type = other DNA
ccagtagtgcagttccagtctgagt

SEQ ID NO: 31401 - DNA, 24 bp, synthetic construct
  misc_feature 1..24: note = Synthetic Construct
  source 1..24: mol_type = other DNA
gcactaaccctcctgccagagaaa

SEQ ID NO: 31402 - DNA, 22 bp, synthetic construct
  misc_feature 1..22: note = Synthetic Construct
  source 1..22: mol_type = other DNA
ctccaccatcaagaccgtttct

SEQ ID NO: 31403 - DNA, 23 bp, synthetic construct
  misc_feature 1..23: note = Synthetic Construct
  source 1..23: mol_type = other DNA
gggcaggggatggataggagaaa

SEQ ID NO: 31404 - DNA, 29 bp, synthetic construct
  misc_feature 1..29: note = Synthetic Construct
  source 1..29: mol_type = other DNA
cctgtttctcatgcatacttagccatgtt

SEQ ID NO: 31405 - DNA, 24 bp, synthetic construct
  misc_feature 1..24: note = Synthetic Construct
  source 1..24: mol_type = other DNA
ctcctgacaaaataacggctggaa

SEQ ID NO: 31406 - DNA, 23 bp, synthetic construct
  misc_feature 1..23: note = Synthetic Construct
  source 1..23: mol_type = other DNA
agcttgaagtaagccccttcatc

SEQ ID NO: 31407 - DNA, 26 bp, synthetic construct
  misc_feature 1..26: note = Synthetic Construct
  source 1..26: mol_type = other DNA
ccttagtcaatgcaatgggaaagcta

SEQ ID NO: 31408 - DNA, 24 bp, synthetic construct
  misc_feature 1..24: note = Synthetic Construct
  source 1..24: mol_type = other DNA
ggagctggtagagccagaattcaa

SEQ ID NO: 31409 - DNA, 20 bp, synthetic construct
  misc_feature 1..20: note = Synthetic Construct
  source 1..20: mol_type = other DNA
aagactgccaggtggaggtt

SEQ ID NO: 31410 - DNA, 23 bp, synthetic construct
  misc_feature 1..23: note = Synthetic Construct
  source 1..23: mol_type = other DNA
gaaacaccatcccacacagatga

SEQ ID NO: 31411 - DNA, 27 bp, synthetic construct
  misc_feature 1..27: note = Synthetic Construct
  source 1..27: mol_type = other DNA
gagaagccttttgaatgctgttactgt

SEQ ID NO: 31412 - DNA, 25 bp, synthetic construct
  misc_feature 1..25: note = Synthetic Construct
  source 1..25: mol_type = other DNA
gtgaggagttgtttgtgagctttag

SEQ ID NO: 31413 - DNA, 24 bp, synthetic construct
  misc_feature 1..24: note = Synthetic Construct
  source 1..24: mol_type = other DNA
ccaacaggtagttttccagctctt

SEQ ID NO: 31414 - DNA, 23 bp, synthetic construct
  misc_feature 1..23: note = Synthetic Construct
  source 1..23: mol_type = other DNA
ggcagagtagcatttctgcaaac

SEQ ID NO: 31415 - DNA, 23 bp, synthetic construct
  misc_feature 1..23: note = Synthetic Construct
  source 1..23: mol_type = other DNA
ttgcaagccacttatcaggaagt

SEQ ID NO: 31416 - DNA, 25 bp, synthetic construct
  misc_feature 1..25: note = Synthetic Construct
  source 1..25: mol_type = other DNA
gtaagctgctgaaactgatggtaag

SEQ ID NO: 31417 - DNA, 22 bp, synthetic construct
  misc_feature 1..22: note = Synthetic Construct
  source 1..22: mol_type = other DNA
gctggcccaggaaagaagagtt

SEQ ID NO: 31418 - DNA, 24 bp, synthetic construct
  misc_feature 1..24: note = Synthetic Construct
  source 1..24: mol_type = other DNA
tcatcctcaaagggtcctttttca

SEQ ID NO: 31419 - DNA, 27 bp, synthetic construct
  misc_feature 1..27: note = Synthetic Construct
  source 1..27: mol_type = other DNA
ccctccagtatcacagtcttccttttg

SEQ ID NO: 31420 - DNA, 23 bp, synthetic construct
  misc_feature 1..23: note = Synthetic Construct
  source 1..23: mol_type = other DNA
actgagcactgacctgaatgaat

SEQ ID NO: 31421 - DNA, 25 bp, synthetic construct
  misc_feature 1..25: note = Synthetic Construct
  source 1..25: mol_type = other DNA
cataggtacatgcacttggctaaag

SEQ ID NO: 31422 - DNA, 22 bp, synthetic construct
  misc_feature 1..22: note = Synthetic Construct
  source 1..22: mol_type = other DNA
ccctgcagcctcatttcttact

SEQ ID NO: 31423 - DNA, 20 bp, synthetic construct
  misc_feature 1..20: note = Synthetic Construct
  source 1..20: mol_type = other DNA
tgcagggcctgggtataact

SEQ ID NO: 31424 - DNA, 24 bp, synthetic construct
  misc_feature 1..24: note = Synthetic Construct
  source 1..24: mol_type = other DNA
acagagagccagcgagatattttt

SEQ ID NO: 31425 - DNA, 24 bp, synthetic construct
  misc_feature 1..24: note = Synthetic Construct
  source 1..24: mol_type = other DNA
gcagcaaattgcagagaacacatc

SEQ ID NO: 31426 - DNA, 23 bp, synthetic construct
  misc_feature 1..23: note = Synthetic Construct
  source 1..23: mol_type = other DNA
ggaggccatggaacatgtagaac

SEQ ID NO: 31427 - DNA, 26 bp, synthetic construct
  misc_feature 1..26: note = Synthetic Construct
  source 1..26: mol_type = other DNA
gcataatggagagggaaacttgtgat

SEQ ID NO: 31428 - DNA, 25 bp, synthetic construct
  misc_feature 1..25: note = Synthetic Construct
  source 1..25: mol_type = other DNA
ccctaaagtgcttgcttttgtctac

SEQ ID NO: 31429 - DNA, 23 bp, synthetic construct
  misc_feature 1..23: note = Synthetic Construct
  source 1..23: mol_type = other DNA
ggaaatcatgtggcgtcccttct

SEQ ID NO: 31430 - DNA, 23 bp, synthetic construct
  misc_feature 1..23: note = Synthetic Construct
  source 1..23: mol_type = other DNA
agaccgtcctcctcttaatggaa

SEQ ID NO: 31431 - DNA, 20 bp, synthetic construct
  misc_feature 1..20: note = Synthetic Construct
  source 1..20: mol_type = other DNA
tcccttcgcctgagctcctt

SEQ ID NO: 31432 - DNA, 21 bp, synthetic construct
  misc_feature 1..21: note = Synthetic Construct
  source 1..21: mol_type = other DNA
cgactactccccgtgtctttc

SEQ ID NO: 31433 - DNA, 24 bp, synthetic construct
  misc_feature 1..24: note = Synthetic Construct
  source 1..24: mol_type = other DNA
gcctcatccaaagtcatgctccat

SEQ ID NO: 31434 - DNA, 25 bp, synthetic construct
  misc_feature 1..25: note = Synthetic Construct
  source 1..25: mol_type = other DNA
gccagctcacaaaataactctgttc

SEQ ID NO: 31435 - DNA, 25 bp, synthetic construct
  misc_feature 1..25: note = Synthetic Construct
  source 1..25: mol_type = other DNA
gaaacgttttgtggggaattaggaa

SEQ ID NO: 31436 - DNA, 24 bp, synthetic construct
  misc_feature 1..24: note = Synthetic Construct
  source 1..24: mol_type = other DNA
ggtggcaggaaacttaaggccaat

SEQ ID NO: 31437 - DNA, 25 bp, synthetic construct
  misc_feature 1..25: note = Synthetic Construct
  source 1..25: mol_type = other DNA
ggagaaaccagcacaaagaggctaa

SEQ ID NO: 31438 - DNA, 24 bp, synthetic construct
  misc_feature 1..24: note = Synthetic Construct
  source 1..24: mol_type = other DNA
gcagggaagtcctagttgcactct

SEQ ID NO: 31439 - DNA, 27 bp, synthetic construct
  misc_feature 1..27: note = Synthetic Construct
  source 1..27: mol_type = other DNA
cggattatttagcagttgggtaagaag

SEQ ID NO: 31440 - DNA, 23 bp, synthetic construct
  misc_feature 1..23: note = Synthetic Construct
  source 1..23: mol_type = other DNA
gcttccttttccttcggcattag

SEQ ID NO: 31441 - DNA, 25 bp, synthetic construct
  misc_feature 1..25: note = Synthetic Construct
  source 1..25: mol_type = other DNA
gggatgaattgctgggatgatgttc

SEQ ID NO: 31442 - DNA, 25 bp, synthetic construct
  misc_feature 1..25: note = Synthetic Construct
  source 1..25: mol_type = other DNA
gcatcagccagtaaaggaactgaga

SEQ ID NO: 31443 - DNA, 24 bp, synthetic construct
  misc_feature 1..24: note = Synthetic Construct
  source 1..24: mol_type = other DNA
gtgccttgtgactgggatacattc

SEQ ID NO: 31444 - DNA, 25 bp, synthetic construct
  misc_feature 1..25: note = Synthetic Construct
  source 1..25: mol_type = other DNA
gaagggaggaaaatggagaggaatc

SEQ ID NO: 31445 - DNA, 22 bp, synthetic construct
  misc_feature 1..22: note = Synthetic Construct
  source 1..22: mol_type = other DNA
tgttatccccaggttccagtct

SEQ ID NO: 31446 - DNA, 24 bp, synthetic construct
  misc_feature 1..24: note = Synthetic Construct
  source 1..24: mol_type = other DNA
ctttggataccagaaccccacttc

SEQ ID NO: 31447 - DNA, 23 bp, synthetic construct
  misc_feature 1..23: note = Synthetic Construct
  source 1..23: mol_type = other DNA
agcaaggaaatgtggctcaaaag

SEQ ID NO: 31448 - DNA, 26 bp, synthetic construct
  misc_feature 1..26: note = Synthetic Construct
  source 1..26: mol_type = other DNA
ccagcacagtagtttttggtctgctt

SEQ ID NO: 31449 - DNA, 25 bp, synthetic construct
  misc_feature 1..25: note = Synthetic Construct
  source 1..25: mol_type = other DNA
gcaagggtccatctcaagaacacat

SEQ ID NO: 31450 - DNA, 24 bp, synthetic construct
  misc_feature 1..24: note = Synthetic Construct
  source 1..24: mol_type = other DNA
cccctatccagcaggaatggtttc

SEQ ID NO: 31451 - DNA, 27 bp, synthetic construct
  misc_feature 1..27: note = Synthetic Construct
  source 1..27: mol_type = other DNA
ggggaagtttcctttactagtgccatt

SEQ ID NO: 31452 - DNA, 22 bp, synthetic construct
  misc_feature 1..22: note = Synthetic Construct
  source 1..22: mol_type = other DNA
cccgatgagagccaaagactga

SEQ ID NO: 31453 - DNA, 26 bp, synthetic construct
  misc_feature 1..26: note = Synthetic Construct
  source 1..26: mol_type = other DNA
ctggactccataccactgaactgatg

SEQ ID NO: 31454 - DNA, 22 bp, synthetic construct
  misc_feature 1..22: note = Synthetic Construct
  source 1..22: mol_type = other DNA
gggcaaagacgtggaagtgaga

SEQ ID NO: 31455 - DNA, 25 bp, synthetic construct
  misc_feature 1..25: note = Synthetic Construct
  source 1..25: mol_type = other DNA
gcagagaatgttttatgctgggatt

SEQ ID NO: 31456 - DNA, 22 bp, synthetic construct
  misc_feature 1..22: note = Synthetic Construct
  source 1..22: mol_type = other DNA
ggccaaggcaatctcagagaag

SEQ ID NO: 31457 - DNA, 23 bp, synthetic construct
  misc_feature 1..23: note = Synthetic Construct
  source 1..23: mol_type = other DNA
cctgcagtagccagttgaaccta

SEQ ID NO: 31458 - DNA, 21 bp, synthetic construct
  misc_feature 1..21: note = Synthetic Construct
  source 1..21: mol_type = other DNA
gtgccctttgtgtgagagcaa

SEQ ID NO: 31459 - DNA, 25 bp, synthetic construct
  misc_feature 1..25: note = Synthetic Construct
  source 1..25: mol_type = other DNA
gcatttgtggctgaccatagataag

SEQ ID NO: 31460 - DNA, 20 bp, synthetic construct
  misc_feature 1..20: note = Synthetic Construct
  source 1..20: mol_type = other DNA
agctgcagagttggggtttc

SEQ ID NO: 31461 - DNA, 23 bp, synthetic construct
  misc_feature 1..23: note = Synthetic Construct
  source 1..23: mol_type = other DNA
tgccaaccccaagtagctttaat

SEQ ID NO: 31462 - DNA, 20 bp, synthetic construct
  misc_feature 1..20: note = Synthetic Construct
  source 1..20: mol_type = other DNA
agacagctccctacgagcaa

SEQ ID NO: 31463 - DNA, 21 bp, synthetic construct
  misc_feature 1..21: note = Synthetic Construct
  source 1..21: mol_type = other DNA
gcctctgccgggtaaaagtca

SEQ ID NO: 31464 - DNA, 21 bp, synthetic construct
  misc_feature 1..21: note = Synthetic Construct
  source 1..21: mol_type = other DNA
ccatcaccatcgtagctgaca

SEQ ID NO: 31465 - DNA, 30 bp, synthetic construct
  misc_feature 1..30: note = Synthetic Construct
  source 1..30: mol_type = other DNA
gctcaacaactatccagtttcatcctaaag

SEQ ID NO: 31466 - DNA, 25 bp, synthetic construct
  misc_feature 1..25: note = Synthetic Construct
  source 1..25: mol_type = other DNA
gggtctcttggacacttgtttcttc

SEQ ID NO: 31467 - DNA, 23 bp, synthetic construct
  misc_feature 1..23: note = Synthetic Construct
  source 1..23: mol_type = other DNA
caagtgccactgatgctttacaa

SEQ ID NO: 31468 - DNA, 26 bp, synthetic construct
  misc_feature 1..26: note = Synthetic Construct
  source 1..26: mol_type = other DNA
ggaaaagactggaacaagactactga

SEQ ID NO: 31469 - DNA, 25 bp, synthetic construct
  misc_feature 1..25: note = Synthetic Construct
  source 1..25: mol_type = other DNA
tgattgcccttaagtgacatgaagt

SEQ ID NO: 31470 - DNA, 20 bp, synthetic construct
  misc_feature 1..20: note = Synthetic Construct
  source 1..20: mol_type = other DNA
ccctcccctgacaccttact

SEQ ID NO: 31471 - DNA, 23 bp, synthetic construct
  misc_feature 1..23: note = Synthetic Construct
  source 1..23: mol_type = other DNA
gtcctggatgaggggaatgagtt

SEQ ID NO: 31472 - DNA, 25 bp, synthetic construct
  misc_feature 1..25: note = Synthetic Construct
  source 1..25: mol_type = other DNA
ctgaatagacctatcttgccacaca

SEQ ID NO: 31473 - DNA, 24 bp, synthetic construct
  misc_feature 1..24: note = Synthetic Construct
  source 1..24: mol_type = other DNA
gtccttggatcagctaaggcatgt

SEQ ID NO: 31474 - DNA, 24 bp, synthetic construct
  misc_feature 1..24: note = Synthetic Construct
  source 1..24: mol_type = other DNA
gctgagaacttgccttaggctaca

SEQ ID NO: 31475 - DNA, 22 bp, synthetic construct
  misc_feature 1..22: note = Synthetic Construct
  source 1..22: mol_type = other DNA
tgatggccccatctctgagtct

SEQ ID NO: 31476 - DNA, 27 bp, synthetic construct
  misc_feature 1..27: note = Synthetic Construct
  source 1..27: mol_type = other DNA
cagtgtttgcatgggactttcttcatc

SEQ ID NO: 31477 - DNA, 22 bp, synthetic construct
  misc_feature 1..22: note = Synthetic Construct
  source 1..22: mol_type = other DNA
caacacacaaggggtggagttg

SEQ ID NO: 31478 - DNA, 21 bp, synthetic construct
  misc_feature 1..21: note = Synthetic Construct
  source 1..21: mol_type = other DNA
gctgggagactgtgggtcaga

SEQ ID NO: 31479 - DNA, 27 bp, synthetic construct
  misc_feature 1..27: note = Synthetic Construct
  source 1..27: mol_type = other DNA
ctggacaggctaaataatggtggaatc

SEQ ID NO: 31480 - DNA, 22 bp, synthetic construct
  misc_feature 1..22: note = Synthetic Construct
  source 1..22: mol_type = other DNA
gggccactttgtacgtggctat

SEQ ID NO: 31481 - DNA, 26 bp, synthetic construct
  misc_feature 1..26: note = Synthetic Construct
  source 1..26: mol_type = other DNA
tggacttagggtaccatctactcttg

SEQ ID NO: 31482 - DNA, 23 bp, synthetic construct
  misc_feature 1..23: note = Synthetic Construct
  source 1..23: mol_type = other DNA
tcctctaacacctgtgccatttg

SEQ ID NO: 31483 - DNA, 23 bp, synthetic construct
  misc_feature 1..23: note = Synthetic Construct
  source 1..23: mol_type = other DNA
cagatggaggacaaagcctcaga

SEQ ID NO: 31484 - DNA, 24 bp, synthetic construct
  misc_feature 1..24: note = Synthetic Construct
  source 1..24: mol_type = other DNA
accaacctccttaagggaaaggat

SEQ ID NO: 31485 - DNA, 22 bp, synthetic construct
  misc_feature 1..22: note = Synthetic Construct
  source 1..22: mol_type = other DNA
gtggcaagccaggacaactgta

SEQ ID NO: 31486 - DNA, 25 bp, synthetic construct
  misc_feature 1..25: note = Synthetic Construct
  source 1..25: mol_type = other DNA
aaaggaatatgggttcttggctaca

SEQ ID NO: 31487 - DNA, 22 bp, synthetic construct
  misc_feature 1..22: note = Synthetic Construct
  source 1..22: mol_type = other DNA
tggtagttcctcctgcgttcat

SEQ ID NO: 31488 - DNA, 30 bp, synthetic construct
  misc_feature 1..30: note = Synthetic Construct
  source 1..30: mol_type = other DNA
ccattacctagttgtaaccaatacctgact

SEQ ID NO: 31489 - DNA, 20 bp, synthetic construct
  misc_feature 1..20: note = Synthetic Construct
  source 1..20: mol_type = other DNA
ctgccagcacggctaaaatg

SEQ ID NO: 31490 - DNA, 24 bp, synthetic construct
  misc_feature 1..24: note = Synthetic Construct
  source 1..24: mol_type = other DNA
ggagcataaactcccaggcacttc

SEQ ID NO: 31491 - DNA, 27 bp, synthetic construct
  misc_feature 1..27: note = Synthetic Construct
  source 1..27: mol_type = other DNA
ctcctagctctttaatcctttcactgt

SEQ ID NO: 31492 - DNA, 27 bp, synthetic construct
  misc_feature 1..27: note = Synthetic Construct
  source 1..27: mol_type = other DNA
ggctgataaccgggtgattatacaact

SEQ ID NO: 31493 - DNA, 21 bp, synthetic construct
  misc_feature 1..21: note = Synthetic Construct
  source 1..21: mol_type = other DNA
ttccccgaagcccacagtcta

SEQ ID NO: 31494 - DNA, 19 bp, synthetic construct
  misc_feature 1..19: note = Synthetic Construct
  source 1..19: mol_type = other DNA
tgggctcacggcaagttca

SEQ ID NO: 31495 - DNA, 18 bp, synthetic construct
  misc_feature 1..18: note = Synthetic Construct
  source 1..18: mol_type = other DNA
tgcatgcacctgctgtga

SEQ ID NO: 31496 - DNA, 23 bp, synthetic construct
  misc_feature 1..23: note = Synthetic Construct
  source 1..23: mol_type = other DNA
tgtaccctaggtaccagctcatc

SEQ ID NO: 31497 - DNA, 22 bp, synthetic construct
  misc_feature 1..22: note = Synthetic Construct
  source 1..22: mol_type = other DNA
tccacttctcacctctccttca

SEQ ID NO: 31498 - DNA, 21 bp, synthetic construct
  misc_feature 1..21: note = Synthetic Construct
  source 1..21: mol_type = other DNA
gggaggctcgagtggcttatg

SEQ ID NO: 31499 - DNA, 25 bp, synthetic construct
  misc_feature 1..25: note = Synthetic Construct
  source 1..25: mol_type = other DNA
cacgtgtaaatgacagggacacatc

SEQ ID NO: 31500 - DNA, 22 bp, synthetic construct
  misc_feature 1..22: note = Synthetic Construct
  source 1..22: mol_type = other DNA
gcttgggagggtacacagtgat

SEQ ID NO: 31501 - DNA, 26 bp, synthetic construct
  misc_feature 1..26: note = Synthetic Construct
  source 1..26: mol_type = other DNA
ctggaaggaggaaaatgacataggat

SEQ ID NO: 31502 - DNA, 25 bp, synthetic construct
  misc_feature 1..25: note = Synthetic Construct
  source 1..25: mol_type = other DNA
acctaagaaaagcagaggaaacagt

SEQ ID NO: 31503 - DNA, 20 bp, synthetic construct
  misc_feature 1..20: note = Synthetic Construct
  source 1..20: mol_type = other DNA
tgccccagctagtggaaagt

SEQ ID NO: 31504 - DNA, 26 bp, synthetic construct
  misc_feature 1..26: note = Synthetic Construct
  source 1..26: mol_type = other DNA
caccaattatgccctagcctaagaag

SEQ ID NO: 31505 - DNA, 29 bp, synthetic construct
  misc_feature 1..29: note = Synthetic Construct
  source 1..29: mol_type = other DNA
gtgccactagggttgaatttatcatgttc

SEQ ID NO: 31506 - DNA, 20 bp, synthetic construct
  misc_feature 1..20: note = Synthetic Construct
  source 1..20: mol_type = other DNA
ttgctcccacagctccattg

SEQ ID NO: 31507 - DNA, 24 bp, synthetic construct
  misc_feature 1..24: note = Synthetic Construct
  source 1..24: mol_type = other DNA
atctgttccacgagatgttgatga

SEQ ID NO: 31508 - DNA, 20 bp, synthetic construct
  misc_feature 1..20: note = Synthetic Construct
  source 1..20: mol_type = other DNA
ctcacagccagtgcagaagt

SEQ ID NO: 31509 - DNA, 22 bp, synthetic construct
  misc_feature 1..22: note = Synthetic Construct
  source 1..22: mol_type = other DNA
gtgccttcaccccatctgacaa

SEQ ID NO: 31510 - DNA, 24 bp, synthetic construct
  misc_feature 1..24: note = Synthetic Construct
  source 1..24: mol_type = other DNA
gtctaaggtgtgagcaggatgttg

SEQ ID NO: 31511 - DNA, 23 bp, synthetic construct
  misc_feature 1..23: note = Synthetic Construct
  source 1..23: mol_type = other DNA
cctggtctgtttgcactctccaa

SEQ ID NO: 31512 - DNA, 27 bp, synthetic construct
  misc_feature 1..27: note = Synthetic Construct
  source 1..27: mol_type = other DNA
gggtggaagttttgagattatctggtt

SEQ ID NO: 31513 - DNA, 23 bp, synthetic construct
  misc_feature 1..23: note = Synthetic Construct
  source 1..23: mol_type = other DNA
acccatttgttcccaagttgttg

SEQ ID NO: 31514 - DNA, 26 bp, synthetic construct
  misc_feature 1..26: note = Synthetic Construct
  source 1..26: mol_type = other DNA
ggtggttgggtgcagtaaaatagtca

SEQ ID NO: 31515 - DNA, 23 bp, synthetic construct
  misc_feature 1..23: note = Synthetic Construct
  source 1..23: mol_type = other DNA
tggataccctttcggtgacatct

SEQ ID NO: 31516 - DNA, 25 bp, synthetic construct
  misc_feature 1..25: note = Synthetic Construct
  source 1..25: mol_type = other DNA
ctccacaactggagaaacacatgat

SEQ ID NO: 31517 - DNA, 24 bp, synthetic construct
  misc_feature 1..24: note = Synthetic Construct
  source 1..24: mol_type = other DNA
tcacatagcgcagaggtagaaatg

SEQ ID NO: 31518 - DNA, 22 bp, synthetic construct
  misc_feature 1..22: note = Synthetic Construct
  source 1..22: mol_type = other DNA
agctcacctaaaccaagtgcaa

SEQ ID NO: 31519 - DNA, 24 bp, synthetic construct
  misc_feature 1..24: note = Synthetic Construct
  source 1..24: mol_type = other DNA
caggagctcttcccactgatcttg

SEQ ID NO: 31520 - DNA, 23 bp, synthetic construct
  misc_feature 1..23: note = Synthetic Construct
  source 1..23: mol_type = other DNA
ggtgctgttgctaaaggctcaca

SEQ ID NO: 31521 - DNA, 24 bp, synthetic construct
  misc_feature 1..24: note = Synthetic Construct
  source 1..24: mol_type = other DNA
ccagaggtccttttcccaacagat

SEQ ID NO: 31522 - DNA, 29 bp, synthetic construct
  misc_feature 1..29: note = Synthetic Construct
  source 1..29: mol_type = other DNA
gcagagagtacaaatagcagtaagcagtt

SEQ ID NO: 31523 - DNA, 24 bp, synthetic construct
  misc_feature 1..24: note = Synthetic Construct
  source 1..24: mol_type = other DNA
gactccctgtgaccttgaacagat

SEQ ID NO: 31524 - DNA, 22 bp, synthetic construct
  misc_feature 1..22: note = Synthetic Construct
  source 1..22: mol_type = other DNA
ctgatccagctcgcagagtcta

SEQ ID NO: 31525 - DNA, 27 bp, synthetic construct
  misc_feature 1..27: note = Synthetic Construct
  source 1..27: mol_type = other DNA
catggatcgttaaatgtagcaggatct

SEQ ID NO: 31526 - DNA, 24 bp, synthetic construct
  misc_feature 1..24: note = Synthetic Construct
  source 1..24: mol_type = other DNA
ggcttagcaatttccactcggatt

SEQ ID NO: 31527 - DNA, 24 bp, synthetic construct
  misc_feature 1..24: note = Synthetic Construct
  source 1..24: mol_type = other DNA
cagtggagaactggggtctcatag

SEQ ID NO: 31528 - DNA, 22 bp, synthetic construct
  misc_feature 1..22: note = Synthetic Construct
  source 1..22: mol_type = other DNA
tgagctccttgacgacaggaat

SEQ ID NO: 31529 - DNA, 20 bp, synthetic construct
  misc_feature 1..20: note = Synthetic Construct
  source 1..20: mol_type = other DNA
tgtctggcctcctgttccat

SEQ ID NO: 31530 - DNA, 23 bp, synthetic construct
  misc_feature 1..23: note = Synthetic Construct
  source 1..23: mol_type = other DNA
gtgcctctgaagcaagagacttc

SEQ ID NO: 31531 - DNA, 25 bp, synthetic construct
  misc_feature 1..25: note = Synthetic Construct
  source 1..25: mol_type = other DNA
ccccaaaaaggcttacacagttaaa

SEQ ID NO: 31532 - DNA, 25 bp, synthetic construct
  misc_feature 1..25: note = Synthetic Construct
  source 1..25: mol_type = other DNA
ccagaacaggcattgacaaactatg

SEQ ID NO: 31533 - DNA, 25 bp, synthetic construct
  misc_feature 1..25: note = Synthetic Construct
  source 1..25: mol_type = other DNA
gctgtagaccttatgcttcctgtat

SEQ ID NO: 31534 - DNA, 24 bp, synthetic construct
  misc_feature 1..24: note = Synthetic Construct
  source 1..24: mol_type = other DNA
ccttcacacaacaggagaggcatt

SEQ ID NO: 31535 - DNA, 22 bp, synthetic construct
  misc_feature 1..22: note = Synthetic Construct
  source 1..22: mol_type = other DNA
ctcctcagtgccagctatgtca

SEQ ID NO: 31536 - DNA, 27 bp, synthetic construct
  misc_feature 1..27: note = Synthetic Construct
  source 1..27: mol_type = other DNA
gaaggatttgaacgcatttaggaggta

SEQ ID NO: 31537 - DNA, 23 bp, synthetic construct
  misc_feature 1..23: note = Synthetic Construct
  source 1..23: mol_type = other DNA
gggatgttttagggactgtgcaa

SEQ ID NO: 31538 - DNA, 20 bp, synthetic construct
  misc_feature 1..20: note = Synthetic Construct
  source 1..20: mol_type = other DNA
ggttggctgcattgctcaaa

SEQ ID NO: 31539 - DNA, 21 bp, synthetic construct
  misc_feature 1..21: note = Synthetic Construct
  source 1..21: mol_type = other DNA
agggtggccctcatgatttct

SEQ ID NO: 31540 - DNA, 27 bp, synthetic construct
  misc_feature 1..27: note = Synthetic Construct
  source 1..27: mol_type = other DNA
ctgctttgattgggaacagatggtcta

SEQ ID NO: 31541 - DNA, 24 bp, synthetic construct
  misc_feature 1..24: note = Synthetic Construct
  source 1..24: mol_type = other DNA
gagagagaaggttgaggggtcaga

SEQ ID NO: 31542 - DNA, 24 bp, synthetic construct
  misc_feature 1..24: note = Synthetic Construct
  source 1..24: mol_type = other DNA
ggggtagcctgtaaccagtgattg

SEQ ID NO: 31543 - DNA, 26 bp, synthetic construct
  misc_feature 1..26: note = Synthetic Construct
  source 1..26: mol_type = other DNA
ctgcttttcttcctggagtctggaat

SEQ ID NO: 31544 - DNA, 22 bp, synthetic construct
  misc_feature 1..22: note = Synthetic Construct
  source 1..22: mol_type = other DNA
tggtttgctccttttggtggtt

SEQ ID NO: 31545 - DNA, 26 bp, synthetic construct
  misc_feature 1..26: note = Synthetic Construct
  source 1..26: mol_type = other DNA
ctcaaactgtagctgtcttggttttc

SEQ ID NO: 31546 - DNA, 23 bp, synthetic construct
  misc_feature 1..23: note = Synthetic Construct
  source 1..23: mol_type = other DNA
gcccacaagtctcatccctctca

SEQ ID NO: 31547 - DNA, 21 bp, synthetic construct
  misc_feature 1..21: note = Synthetic Construct
  source 1..21: mol_type = other DNA
gctctatgcccaggccagatt

SEQ ID NO: 31548 - DNA, 24 bp, synthetic construct
  misc_feature 1..24: note = Synthetic Construct
  source 1..24: mol_type = other DNA
ggcaacagaatttgcttctggtaa

SEQ ID NO: 31549 - DNA, 25 bp, synthetic construct
  misc_feature 1..25: note = Synthetic Construct
  source 1..25: mol_type = other DNA
ggagagtccaccaaaagataagtgt

SEQ ID NO: 31550 - DNA, 23 bp, synthetic construct
  misc_feature 1..23: note = Synthetic Construct
  source 1..23: mol_type = other DNA
ggtttggcctatggttgggtctt

SEQ ID NO: 31551 - DNA, 27 bp, synthetic construct
  misc_feature 1..27: note = Synthetic Construct
  source 1..27: mol_type = other DNA
ggatatgaaagttacaggacagcaatc

SEQ ID NO: 31552 - DNA, 24 bp, synthetic construct
  misc_feature 1..24: note = Synthetic Construct
  source 1..24: mol_type = other DNA
tctggtgccttccataagactaga

SEQ ID NO: 31553 - DNA, 22 bp, synthetic construct
  misc_feature 1..22: note = Synthetic Construct
  source 1..22: mol_type = other DNA
ggcttagcccacaagtgttctt

SEQ ID NO: 31554 - DNA, 23 bp, synthetic construct
  misc_feature 1..23: note = Synthetic Construct
  source 1..23: mol_type = other DNA
tcctctccctcaattccaaccat

SEQ ID NO: 31555 - DNA, 21 bp, synthetic construct
  misc_feature 1..21: note = Synthetic Construct
  source 1..21: mol_type = other DNA
ggtgctggtggctggaagtta

SEQ ID NO: 31556 - DNA, 20 bp, synthetic construct
  misc_feature 1..20: note = Synthetic Construct
  source 1..20: mol_type = other DNA
ccatggaggtgggcttctca

SEQ ID NO: 31557 - DNA, 20 bp, synthetic construct
  misc_feature 1..20: note = Synthetic Construct
  source 1..20: mol_type = other DNA
agacaggcaggccttgaact

SEQ ID NO: 31558 - DNA, 26 bp, synthetic construct
  misc_feature 1..26: note = Synthetic Construct
  source 1..26: mol_type = other DNA
ggtgtaatctagcctaacttgactga

SEQ ID NO: 31559 - DNA, 25 bp, synthetic construct
  misc_feature 1..25: note = Synthetic Construct
  source 1..25: mol_type = other DNA
ccaagctccaagatgacaagctcaa

SEQ ID NO: 31560 - DNA, 22 bp, synthetic construct
  misc_feature 1..22: note = Synthetic Construct
  source 1..22: mol_type = other DNA
ggatctgtggctcaagctcagt

SEQ ID NO: 31561 - DNA, 25 bp, synthetic construct
  misc_feature 1..25: note = Synthetic Construct
  source 1..25: mol_type = other DNA
aactacagcccaaagtgagaaaatg

SEQ ID NO: 31562 - DNA, 25 bp, synthetic construct
  misc_feature 1..25: note = Synthetic Construct
  source 1..25: mol_type = other DNA
tcctaagggcatcactttgacttac

SEQ ID NO: 31563 - DNA, 20 bp, synthetic construct
  misc_feature 1..20: note = Synthetic Construct
  source 1..20: mol_type = other DNA
tctctgctctgcccatgcta

SEQ ID NO: 31564 - DNA, 22 bp, synthetic construct
  misc_feature 1..22: note = Synthetic Construct
  source 1..22: mol_type = other DNA
agcccttaggcagtagccttgt

SEQ ID NO: 31565 - DNA, 22 bp, synthetic construct
  misc_feature 1..22: note = Synthetic Construct
  source 1..22: mol_type = other DNA
cctcatgcctggcccatttagt

SEQ ID NO: 31566 - DNA, 24 bp, synthetic construct
  misc_feature 1..24: note = Synthetic Construct
  source 1..24: mol_type = other DNA
tgtaacatgcctctgtcatagcaa

SEQ ID NO: 31567 - DNA, 23 bp, synthetic construct
  misc_feature 1..23: note = Synthetic Construct
  source 1..23: mol_type = other DNA
actggcttgaattcagggcttta

SEQ ID NO: 31568 - DNA, 25 bp, synthetic construct
  misc_feature 1..25: note = Synthetic Construct
  source 1..25: mol_type = other DNA
tgctgtggtttatgaatccatgttc

SEQ ID NO: 31569 - DNA, 22 bp, synthetic construct
  misc_feature 1..22: note = Synthetic Construct
  source 1..22: mol_type = other DNA
cttgcaccttccaacccctatc

SEQ ID NO: 31570 - DNA, 22 bp, synthetic construct
  misc_feature 1..22: note = Synthetic Construct
  source 1..22: mol_type = other DNA
gggtcacagaggcagtgatgat

SEQ ID NO: 31571 - DNA, 24 bp, synthetic construct
  misc_feature 1..24: note = Synthetic Construct
  source 1..24: mol_type = other DNA
tgagactggtaagctatggactct

SEQ ID NO: 31572 - DNA, 23 bp, synthetic construct
  misc_feature 1..23: note = Synthetic Construct
  source 1..23: mol_type = other DNA
cctggctagtaggcacctaaaac

SEQ ID NO: 31573 - DNA, 20 bp, synthetic construct
  misc_feature 1..20: note = Synthetic Construct
  source 1..20: mol_type = other DNA
tgtcccacagaggacagctt

SEQ ID NO: 31574 - DNA, 25 bp, synthetic construct
  misc_feature 1..25: note = Synthetic Construct
  source 1..25: mol_type = other DNA
cctgactgattggtcatgtggtctt

SEQ ID NO: 31575 - DNA, 25 bp, synthetic construct
  misc_feature 1..25: note = Synthetic Construct
  source 1..25: mol_type = other DNA
ggacccaccatagtcagaactaaga

SEQ ID NO: 31576 - DNA, 24 bp, synthetic construct
  misc_feature 1..24: note = Synthetic Construct
  source 1..24: mol_type = other DNA
tggacagaatccagtttgatggaa

SEQ ID NO: 31577 - DNA, 24 bp, synthetic construct
  misc_feature 1..24: note = Synthetic Construct
  source 1..24: mol_type = other DNA
gactggagcacaggttactttaca

SEQ ID NO: 31578 - DNA, 26 bp, synthetic construct
  misc_feature 1..26: note = Synthetic Construct
  source 1..26: mol_type = other DNA
gtgcagacaagttcactgagtaattc

SEQ ID NO: 31579 - DNA, 25 bp, synthetic construct
  misc_feature 1..25: note = Synthetic Construct
  source 1..25: mol_type = other DNA
ggatctgttgcagagctttcttttg

SEQ ID NO: 31580 - DNA, 25 bp, synthetic construct
  misc_feature 1..25: note = Synthetic Construct
  source 1..25: mol_type = other DNA
ttacttccacttacattccgtgaca

SEQ ID NO: 31581 - DNA, 26 bp, synthetic construct
  misc_feature 1..26: note = Synthetic Construct
  source 1..26: mol_type = other DNA
gagcaaactggtagccactaattctt

SEQ ID NO: 31582 - DNA, 30 bp, synthetic construct
  misc_feature 1..30: note = Synthetic Construct
  source 1..30: mol_type = other DNA
ggaggagatctgaaataggaaagacagtca

SEQ ID NO: 31583 - DNA, 24 bp, synthetic construct
  misc_feature 1..24: note = Synthetic Construct
  source 1..24: mol_type = other DNA
ggagaacttagggaagtccagttg

SEQ ID NO: 31584 - DNA, 20 bp, synthetic construct
  misc_feature 1..20: note = Synthetic Construct
  source 1..20: mol_type = other DNA
gagcagtgacgcctccattt

SEQ ID NO: 31585 - DNA, 24 bp, synthetic construct
  misc_feature 1..24: note = Synthetic Construct
  source 1..24: mol_type = other DNA
gggagctctgttttcactgtgtta

SEQ ID NO: 31586 - DNA, 22 bp, synthetic construct
  misc_feature 1..22: note = Synthetic Construct
  source 1..22: mol_type = other DNA
cactgggacaagtagcatgaca

SEQ ID NO: 31587 - DNA, 25 bp, synthetic construct
  misc_feature 1..25: note = Synthetic Construct
  source 1..25: mol_type = other DNA
cttctaatgcaggggtttttgtctt

SEQ ID NO: 31588 - DNA, 23 bp, synthetic construct
  misc_feature 1..23: note = Synthetic Construct
  source 1..23: mol_type = other DNA
agtggggtaaaacctgtgtttct

SEQ ID NO: 31589 - DNA, 23 bp, synthetic construct
  misc_feature 1..23: note = Synthetic Construct
  source 1..23: mol_type = other DNA
ggttgagagacaagccttagcat

SEQ ID NO: 31590 - DNA, 29 bp, synthetic construct
  misc_feature 1..29: note = Synthetic Construct
  source 1..29: mol_type = other DNA
ctccattctcaactcattcaacctctaag

SEQ ID NO: 31591 - DNA, 25 bp, synthetic construct
  misc_feature 1..25: note = Synthetic Construct
  source 1..25: mol_type = other DNA
ggcatccatctgtactcccagctat

SEQ ID NO: 31592 - DNA, 25 bp, synthetic construct
  misc_feature 1..25: note = Synthetic Construct
  source 1..25: mol_type = other DNA
ggtgattgacacactgaggatccaa

SEQ ID NO: 31593 - DNA, 25 bp, synthetic construct
  misc_feature 1..25: note = Synthetic Construct
  source 1..25: mol_type = other DNA
ccccaccaccccgatttaataatac

SEQ ID NO: 31594 - DNA, 24 bp, synthetic construct
  misc_feature 1..24: note = Synthetic Construct
  source 1..24: mol_type = other DNA
ccaacacagggaaaggttaagtga

SEQ ID NO: 31595 - DNA, 24 bp, synthetic construct
  misc_feature 1..24: note = Synthetic Construct
  source 1..24: mol_type = other DNA
gcaaacaggaacacctggttgtct

SEQ ID NO: 31596 - DNA, 25 bp, synthetic construct
  misc_feature 1..25: note = Synthetic Construct
  source 1..25: mol_type = other DNA
gtctgttctcaaaccttccttctgt

SEQ ID NO: 31597 - DNA, 27 bp, synthetic construct
  misc_feature 1..27: note = Synthetic Construct
  source 1..27: mol_type = other DNA
cacaacacaggctaagaaaacctaatg

SEQ ID NO: 31598 - DNA, 21 bp, synthetic construct
  misc_feature 1..21: note = Synthetic Construct
  source 1..21: mol_type = other DNA
ggagttggcaggagcatcaga

SEQ ID NO: 31599 - DNA, 24 bp, synthetic construct
  misc_feature 1..24: note = Synthetic Construct
  source 1..24: mol_type = other DNA
gggaccttttgaggcttgcagttc

SEQ ID NO: 31600 - DNA, 26 bp, synthetic construct
  misc_feature 1..26: note = Synthetic Construct
  source 1..26: mol_type = other DNA
cagaggcaaatgaaatgagctgttag

SEQ ID NO: 31601 - DNA, 21 bp, synthetic construct
  misc_feature 1..21: note = Synthetic Construct
  source 1..21: mol_type = other DNA
agcacaaagcacttggtcaga

SEQ ID NO: 31602 - DNA, 23 bp, synthetic construct
  misc_feature 1..23: note = Synthetic Construct
  source 1..23: mol_type = other DNA
ccacagaccctgacccaatgatg

SEQ ID NO: 31603 - DNA, 25 bp, synthetic construct
  misc_feature 1..25: note = Synthetic Construct
  source 1..25: mol_type = other DNA
ggaagttaactgggagaggcaatag

SEQ ID NO: 31604 - DNA, 26 bp, synthetic construct
  misc_feature 1..26: note = Synthetic Construct
  source 1..26: mol_type = other DNA
gcccatgttgagataatggctacctt

SEQ ID NO: 31605 - DNA, 23 bp, synthetic construct
  misc_feature 1..23: note = Synthetic Construct
  source 1..23: mol_type = other DNA
aggatggggaagctagaagtcaa

SEQ ID NO: 31606 - DNA, 22 bp, synthetic construct
  misc_feature 1..22: note = Synthetic Construct
  source 1..22: mol_type = other DNA
cattgccttgaccccactaaga

SEQ ID NO: 31607 - DNA, 25 bp, synthetic construct
  misc_feature 1..25: note = Synthetic Construct
  source 1..25: mol_type = other DNA
ggggaggcaatgaagaaaagcctaa

SEQ ID NO: 31608 - DNA, 22 bp, synthetic construct
  misc_feature 1..22: note = Synthetic Construct
  source 1..22: mol_type = other DNA
tgcccaatgtccaatgtcttga

SEQ ID NO: 31609 - DNA, 22 bp, synthetic construct
  misc_feature 1..22: note = Synthetic Construct
  source 1..22: mol_type = other DNA
gagtctgtcttcttgcctgtca

SEQ ID NO: 31610 - DNA, 23 bp, synthetic construct
  misc_feature 1..23: note = Synthetic Construct
  source 1..23: mol_type = other DNA
tgaaaggcatgcaaacagtcttc

SEQ ID NO: 31611 - DNA, 25 bp, synthetic construct
  misc_feature 1..25: note = Synthetic Construct
  source 1..25: mol_type = other DNA
ggtgggagcttctctttaacttttc

SEQ ID NO: 31612 - DNA, 25 bp, synthetic construct
  misc_feature 1..25: note = Synthetic Construct
  source 1..25: mol_type = other DNA
gcttccaacgtccctatcttagtgt

SEQ ID NO: 31613 - DNA, 23 bp, synthetic construct
  misc_feature 1..23: note = Synthetic Construct
  source 1..23: mol_type = other DNA
gccattgacatgtctggctgaag

SEQ ID NO: 31614 - DNA, 24 bp, synthetic construct
  misc_feature 1..24: note = Synthetic Construct
  source 1..24: mol_type = other DNA
gcctttgactttggtgtgaaccta

SEQ ID NO: 31615 - DNA, 27 bp, synthetic construct
  misc_feature 1..27: note = Synthetic Construct
  source 1..27: mol_type = other DNA
ctggtgagctattttccactggatatg

SEQ ID NO: 31616 - DNA, 23 bp, synthetic construct
  misc_feature 1..23: note = Synthetic Construct
  source 1..23: mol_type = other DNA
tgaaaaagtggcctctagtgtgt

SEQ ID NO: 31617 - DNA, 25 bp, synthetic construct
  misc_feature 1..25: note = Synthetic Construct
  source 1..25: mol_type = other DNA
gggagagagagttttgtgtctgttc

SEQ ID NO: 31618 - DNA, 21 bp, synthetic construct
  misc_feature 1..21: note = Synthetic Construct
  source 1..21: mol_type = other DNA
ccactaccagcaggcaacctt

SEQ ID NO: 31619 - DNA, 24 bp, synthetic construct
  misc_feature 1..24: note = Synthetic Construct
  source 1..24: mol_type = other DNA
cctggaataaactttgcccagaca

SEQ ID NO: 31620 - DNA, 27 bp, synthetic construct
  misc_feature 1..27: note = Synthetic Construct
  source 1..27: mol_type = other DNA
ctcaatcctggagtacaatttctgtct

SEQ ID NO: 31621 - DNA, 23 bp, synthetic construct
  misc_feature 1..23: note = Synthetic Construct
  source 1..23: mol_type = other DNA
aatctgctcctttcctggtcttc

SEQ ID NO: 31622 - DNA, 25 bp, synthetic construct
  misc_feature 1..25: note = Synthetic Construct
  source 1..25: mol_type = other DNA
gacactcaaaaggctaagggctaac

SEQ ID NO: 31623 - DNA, 23 bp, synthetic construct
  misc_feature 1..23: note = Synthetic Construct
  source 1..23: mol_type = other DNA
cacagtggacagcatgactcaga

SEQ ID NO: 31624 - DNA, 25 bp, synthetic construct
  misc_feature 1..25: note = Synthetic Construct
  source 1..25: mol_type = other DNA
gaaatggtgctaacttgctctccaa

SEQ ID NO: 31625 - DNA, 21 bp, synthetic construct
  misc_feature 1..21: note = Synthetic Construct
  source 1..21: mol_type = other DNA
ggctgcccctgtcaatgatga

SEQ ID NO: 31626 - DNA, 24 bp, synthetic construct
  misc_feature 1..24: note = Synthetic Construct
  source 1..24: mol_type = other DNA
gggtcagctgcagattatgtcatt

SEQ ID NO: 31627 - DNA, 21 bp, synthetic construct
  misc_feature 1..21: note = Synthetic Construct
  source 1..21: mol_type = other DNA
caagggagaaggtgggagaca

SEQ ID NO: 31628 - DNA, 22 bp, synthetic construct
  misc_feature 1..22: note = Synthetic Construct
  source 1..22: mol_type = other DNA
agtccaaaaccgtgacaagaca

SEQ ID NO: 31629 - DNA, 20 bp, synthetic construct
  misc_feature 1..20: note = Synthetic Construct
  source 1..20: mol_type = other DNA
accggactttgccagtcatc

SEQ ID NO: 31630 - DNA, 23 bp, synthetic construct
  misc_feature 1..23: note = Synthetic Construct
  source 1..23: mol_type = other DNA
gacacttctggttgccacataca

SEQ ID NO: 31631 - DNA, 23 bp, synthetic construct
  misc_feature 1..23: note = Synthetic Construct
  source 1..23: mol_type = other DNA
gtctcacacacagcccaaacgta

SEQ ID NO: 31632 - DNA, 22 bp, synthetic construct
  misc_feature 1..22: note = Synthetic Construct
  source 1..22: mol_type = other DNA
gtggtcatttgccaaggctcta

SEQ ID NO: 31633 - DNA, 24 bp, synthetic construct
  misc_feature 1..24: note = Synthetic Construct
  source 1..24: mol_type = other DNA
gtcacacccttcattctcccatct

SEQ ID NO: 31634 - DNA, 25 bp, synthetic construct
  misc_feature 1..25: note = Synthetic Construct
  source 1..25: mol_type = other DNA
gtggtcaatgttaggggttcagtct

SEQ ID NO: 31635 - DNA, 21 bp, synthetic construct
  misc_feature 1..21: note = Synthetic Construct
  source 1..21: mol_type = other DNA
tttgcagcgcagcctcagctt

SEQ ID NO: 31636 - DNA, 29 bp, synthetic construct
  misc_feature 1..29: note = Synthetic Construct
  source 1..29: mol_type = other DNA
cctggttaaaggaagagtgagtctcagaa

SEQ ID NO: 31637 - DNA, 24 bp, synthetic construct
  misc_feature 1..24: note = Synthetic Construct
  source 1..24: mol_type = other DNA
ggctaggaaaacccacattcaaca

SEQ ID NO: 31638 - DNA, 29 bp, synthetic construct
  misc_feature 1..29: note = Synthetic Construct
  source 1..29: mol_type = other DNA
gcttaccaaataaagtcttcaccccttag

SEQ ID NO: 31639 - DNA, 25 bp, synthetic construct
  misc_feature 1..25: note = Synthetic Construct
  source 1..25: mol_type = other DNA
cgaatgtcccactacttatggtgaa

SEQ ID NO: 31640 - DNA, 28 bp, synthetic construct
  misc_feature 1..28: note = Synthetic Construct
  source 1..28: mol_type = other DNA
ccttgaatgatgctaatcctgagcgaaa

SEQ ID NO: 31641 - DNA, 27 bp, synthetic construct
  misc_feature 1..27: note = Synthetic Construct
  source 1..27: mol_type = other DNA
ggtttttgtactggaggaaccaaaatg

SEQ ID NO: 31642 - DNA, 26 bp, synthetic construct
  misc_feature 1..26: note = Synthetic Construct
  source 1..26: mol_type = other DNA
cctagcagtagcaattacaaccatct

SEQ ID NO: 31643 - DNA, 23 bp, synthetic construct
  misc_feature 1..23: note = Synthetic Construct
  source 1..23: mol_type = other DNA
gagggaaaggagcactagacttc

SEQ ID NO: 31644 - DNA, 30 bp, synthetic construct
  misc_feature 1..30: note = Synthetic Construct
  source 1..30: mol_type = other DNA
ctggagaaaggactacatagcagaattaga

SEQ ID NO: 31645 - DNA, 19 bp, synthetic construct
  misc_feature 1..19: note = Synthetic Construct
  source 1..19: mol_type = other DNA
tgcaggcctggagcctgat

SEQ ID NO: 31646 - DNA, 21 bp, synthetic construct
  misc_feature 1..21: note = Synthetic Construct
  source 1..21: mol_type = other DNA
gccttctgtgtcaaccagtgt

SEQ ID NO: 31647 - DNA, 25 bp, synthetic construct
  misc_feature 1..25: note = Synthetic Construct
  source 1..25: mol_type = other DNA
agcagtgcaaaacagactaaggtat

SEQ ID NO: 31648 - DNA, 23 bp, synthetic construct
  misc_feature 1..23: note = Synthetic Construct
  source 1..23: mol_type = other DNA
agatggtgtcttgaatgctgctt

SEQ ID NO: 31649 - DNA, 22 bp, synthetic construct
  misc_feature 1..22: note = Synthetic Construct
  source 1..22: mol_type = other DNA
ggtgttgggtgtgtgggatcaa

SEQ ID NO: 31650 - DNA, 20 bp, synthetic construct
  misc_feature 1..20: note = Synthetic Construct
  source 1..20: mol_type = other DNA
acgtggtcaaggccatgtgt

SEQ ID NO: 31651 - DNA, 21 bp, synthetic construct
  misc_feature 1..21: note = Synthetic Construct
  source 1..21: mol_type = other DNA
gcttgtggccagggaaaggtt

SEQ ID NO: 31652 - DNA, 19 bp, synthetic construct
  misc_feature 1..19: note = Synthetic Construct
  source 1..19: mol_type = other DNA
tcccctcaggcctggtgat

SEQ ID NO: 31653 - DNA, 24 bp, synthetic construct
  misc_feature 1..24: note = Synthetic Construct
  source 1..24: mol_type = other DNA
gaccctaggtcttggatgacattt

SEQ ID NO: 31654 - DNA, 20 bp, synthetic construct
  misc_feature 1..20: note = Synthetic Construct
  source 1..20: mol_type = other DNA
ctggcaggcaacagcaaatg

SEQ ID NO: 31655 - DNA, 23 bp, synthetic construct
  misc_feature 1..23: note = Synthetic Construct
  source 1..23: mol_type = other DNA
agtggttggcagattgtctgaag

SEQ ID NO: 31656 - DNA, 23 bp, synthetic construct
  misc_feature 1..23: note = Synthetic Construct
  source 1..23: mol_type = other DNA
ggttggtgagggacaaagtgtag

SEQ ID NO: 31657 - DNA, 21 bp, synthetic construct
  misc_feature 1..21: note = Synthetic Construct
  source 1..21: mol_type = other DNA
ggaagccatttggggctcctt

SEQ ID NO: 31658 - DNA, 20 bp, synthetic construct
  misc_feature 1..20: note = Synthetic Construct
  source 1..20: mol_type = other DNA
tgtcctgcctgggatgtgaa

SEQ ID NO: 31659 - DNA, 22 bp, synthetic construct
  misc_feature 1..22: note = Synthetic Construct
  source 1..22: mol_type = other DNA
cacagggaggtcttgcacatca

SEQ ID NO: 31660 - DNA, 22 bp, synthetic construct
  misc_feature 1..22: note = Synthetic Construct
  source 1..22: mol_type = other DNA
gggcaaccaacatccactcaga

SEQ ID NO: 31661 - DNA, 21 bp, synthetic construct
  misc_feature 1..21: note = Synthetic Construct
  source 1..21: mol_type = other DNA
gctccatcattcagcgcttct

SEQ ID NO: 31662 - DNA, 24 bp, synthetic construct
  misc_feature 1..24: note = Synthetic Construct
  source 1..24: mol_type = other DNA
ggcctcctctgggtaaaacctact

SEQ ID NO: 31663 - DNA, 23 bp, synthetic construct
  misc_feature 1..23: note = Synthetic Construct
  source 1..23: mol_type = other DNA
ggtgttactggggaaaagctagt

SEQ ID NO: 31664 - DNA, 23 bp, synthetic construct
  misc_feature 1..23: note = Synthetic Construct
  source 1..23: mol_type = other DNA
ggatctgagtccttgcaggtgat

SEQ ID NO: 31665 - DNA, 22 bp, synthetic construct
  misc_feature 1..22: note = Synthetic Construct
  source 1..22: mol_type = other DNA
gtccgccatggttgaagtgatg

SEQ ID NO: 31666 - DNA, 24 bp, synthetic construct
  misc_feature 1..24: note = Synthetic Construct
  source 1..24: mol_type = other DNA
ggctgctggttttaatggagatgt

SEQ ID NO: 31667 - DNA, 25 bp, synthetic construct
  misc_feature 1..25: note = Synthetic Construct
  source 1..25: mol_type = other DNA
gtgtcctcaggccagactactctaa

SEQ ID NO: 31668 - DNA, 22 bp, synthetic construct
  misc_feature 1..22: note = Synthetic Construct
  source 1..22: mol_type = other DNA
tccgctagtgcttcagtagtct

SEQ ID NO: 31669 - DNA, 27 bp, synthetic construct
  misc_feature 1..27: note = Synthetic Construct
  source 1..27: mol_type = other DNA
ctggttctagtgtcttgaaaactgttg

SEQ ID NO: 31670 - DNA, 20 bp, synthetic construct
  misc_feature 1..20: note = Synthetic Construct
  source 1..20: mol_type = other DNA
tcaacgggctgccttctctt

SEQ ID NO: 31671 - DNA, 22 bp, synthetic construct
  misc_feature 1..22: note = Synthetic Construct
  source 1..22: mol_type = other DNA
gcaccatcgactttgcacattg

SEQ ID NO: 31672 - DNA, 25 bp, synthetic construct
  misc_feature 1..25: note = Synthetic Construct
  source 1..25: mol_type = other DNA
gcaccctctagcatgctttttgtca

SEQ ID NO: 31673 - DNA, 27 bp, synthetic construct
  misc_feature 1..27: note = Synthetic Construct
  source 1..27: mol_type = other DNA
gcagaagaaagcacaggatttgcatag

SEQ ID NO: 31674 - DNA, 23 bp, synthetic construct
  misc_feature 1..23: note = Synthetic Construct
  source 1..23: mol_type = other DNA
cgggcctttaaggaaaccaggaa

SEQ ID NO: 31675 - DNA, 20 bp, synthetic construct
  misc_feature 1..20: note = Synthetic Construct
  source 1..20: mol_type = other DNA
tggtggtgtggtgggtctat

SEQ ID NO: 31676 - DNA, 22 bp, synthetic construct
  misc_feature 1..22: note = Synthetic Construct
  source 1..22: mol_type = other DNA
ccaccacaggctccttttcact

SEQ ID NO: 31677 - DNA, 23 bp, synthetic construct
  misc_feature 1..23: note = Synthetic Construct
  source 1..23: mol_type = other DNA
gtccagaatcccaaactgtcaga

SEQ ID NO: 31678 - DNA, 23 bp, synthetic construct
  misc_feature 1..23: note = Synthetic Construct
  source 1..23: mol_type = other DNA
ggaggagctgcatccatcttttg

SEQ ID NO: 31679 - DNA, 29 bp, synthetic construct
  misc_feature 1..29: note = Synthetic Construct
  source 1..29: mol_type = other DNA
ccctcctgaaaaataatgcttaccccatt

SEQ ID NO: 31680 - DNA, 19 bp, synthetic construct
  misc_feature 1..19: note = Synthetic Construct
  source 1..19: mol_type = other DNA
ccacagccctgtcgcatgt

SEQ ID NO: 31681 - DNA, 21 bp, synthetic construct
  misc_feature 1..21: note = Synthetic Construct
  source 1..21: mol_type = other DNA
tggtgtggtgcttggctcttc

SEQ ID NO: 31682 - DNA, 25 bp, synthetic construct
  misc_feature 1..25: note = Synthetic Construct
  source 1..25: mol_type = other DNA
cccctgcccaagtattttaaagcaa

SEQ ID NO: 31683 - DNA, 25 bp, synthetic construct
  misc_feature 1..25: note = Synthetic Construct
  source 1..25: mol_type = other DNA
ccattgctctcttcagatccagtag

SEQ ID NO: 31684 - DNA, 26 bp, synthetic construct
  misc_feature 1..26: note = Synthetic Construct
  source 1..26: mol_type = other DNA
caggttgcccattacagctattttga

SEQ ID NO: 31685 - DNA, 22 bp, synthetic construct
  misc_feature 1..22: note = Synthetic Construct
  source 1..22: mol_type = other DNA
ccagtcacaagtgagccttctt

SEQ ID NO: 31686 - DNA, 23 bp, synthetic construct
  misc_feature 1..23: note = Synthetic Construct
  source 1..23: mol_type = other DNA
acacgtgtcagtcacatcacata

SEQ ID NO: 31687 - DNA, 25 bp, synthetic construct
  misc_feature 1..25: note = Synthetic Construct
  source 1..25: mol_type = other DNA
gcagtacccatgattgcttttcaag

SEQ ID NO: 31688 - DNA, 23 bp, synthetic construct
  misc_feature 1..23: note = Synthetic Construct
  source 1..23: mol_type = other DNA
tgaagctggggacactgaatttg

SEQ ID NO: 31689 - DNA, 23 bp, synthetic construct
  misc_feature 1..23: note = Synthetic Construct
  source 1..23: mol_type = other DNA
gcaaaagtaggccagtcaagaca

SEQ ID NO: 31690 - DNA, 20 bp, synthetic construct
  misc_feature 1..20: note = Synthetic Construct
  source 1..20: mol_type = other DNA
tgccaggccatcttgccttt

SEQ ID NO: 31691 - DNA, 23 bp, synthetic construct
  misc_feature 1..23: note = Synthetic Construct
  source 1..23: mol_type = other DNA
gatgtgcagcctaggaaagaaga

SEQ ID NO: 31692 - DNA, 19 bp, synthetic construct
  misc_feature 1..19: note = Synthetic Construct
  source 1..19: mol_type = other DNA
cccagacccctgctccaaa

SEQ ID NO: 31693 - DNA, 22 bp, synthetic construct
  misc_feature 1..22: note = Synthetic Construct
  source 1..22: mol_type = other DNA
cgaaaggtaggctaggccacaa

SEQ ID NO: 31694 - DNA, 27 bp, synthetic construct
  misc_feature 1..27: note = Synthetic Construct
  source 1..27: mol_type = other DNA
gacaagtatttagctgtagggaagaga

SEQ ID NO: 31695 - DNA, 21 bp, synthetic construct
  misc_feature 1..21: note = Synthetic Construct
  source 1..21: mol_type = other DNA
ggggtgcatctgtgtctgtgt

SEQ ID NO: 31696 - DNA, 29 bp, synthetic construct
  misc_feature 1..29: note = Synthetic Construct
  source 1..29: mol_type = other DNA
ggaccaaaaatctgttaggtactcaggaa

SEQ ID NO: 31697 - DNA, 27 bp, synthetic construct
  misc_feature 1..27: note = Synthetic Construct
  source 1..27: mol_type = other DNA
gatctgaattgaaatcccagctctttc

SEQ ID NO: 31698 - DNA, 30 bp, synthetic construct
  misc_feature 1..30: note = Synthetic Construct
  source 1..30: mol_type = other DNA
ggacaccaaattttaggtcagcatttgact

SEQ ID NO: 31699 - DNA, 20 bp, synthetic construct
  misc_feature 1..20: note = Synthetic Construct
  source 1..20: mol_type = other DNA
agctagctgtgtgggtgttg

SEQ ID NO: 31700 - DNA, 20 bp, synthetic construct
  misc_feature 1..20: note = Synthetic Construct
  source 1..20: mol_type = other DNA
gggtccaacatgctgtccaa

SEQ ID NO: 31701 - DNA, 28 bp, synthetic construct
  misc_feature 1..28: note = Synthetic Construct
  source 1..28: mol_type = other DNA
ctgcaaacatagtcggaggtataagaag

SEQ ID NO: 31702 - DNA, 22 bp, synthetic construct
  misc_feature 1..22: note = Synthetic Construct
  source 1..22: mol_type = other DNA
gggtaccgtgattgcctccatt

SEQ ID NO: 31703 - DNA, 23 bp, synthetic construct
  misc_feature 1..23: note = Synthetic Construct
  source 1..23: mol_type = other DNA
ccctccatcataaggtgagcttt

SEQ ID NO: 31704 - DNA, 22 bp, synthetic construct
  misc_feature 1..22: note = Synthetic Construct
  source 1..22: mol_type = other DNA
gccaccagcactatggatgcaa

SEQ ID NO: 31705 - DNA, 22 bp, synthetic construct
  misc_feature 1..22: note = Synthetic Construct
  source 1..22: mol_type = other DNA
cgctcatggtcacagtggtaca

SEQ ID NO: 31706 - DNA, 24 bp, synthetic construct
  misc_feature 1..24: note = Synthetic Construct
  source 1..24: mol_type = other DNA
caccagtaagacactccctgagat

SEQ ID NO: 31707 - DNA, 24 bp, synthetic construct
  misc_feature 1..24: note = Synthetic Construct
  source 1..24: mol_type = other DNA
catccttgcttcctgttagagact

SEQ ID NO: 31708 - DNA, 21 bp, synthetic construct
  misc_feature 1..21: note = Synthetic Construct
  source 1..21: mol_type = other DNA
aaggtgagcaggggcagaact

SEQ ID NO: 31709 - DNA, 23 bp, synthetic construct
  misc_feature 1..23: note = Synthetic Construct
  source 1..23: mol_type = other DNA
gagtagctgcgtatcagtaccaa

SEQ ID NO: 31710 - DNA, 21 bp, synthetic construct
  misc_feature 1..21: note = Synthetic Construct
  source 1..21: mol_type = other DNA
cgcgcccggtcatgagataaa

SEQ ID NO: 31711 - DNA, 22 bp, synthetic construct
  misc_feature 1..22: note = Synthetic Construct
  source 1..22: mol_type = other DNA
tccaaaccactaccacccaaga

SEQ ID NO: 31712 - DNA, 23 bp, synthetic construct
  misc_feature 1..23: note = Synthetic Construct
  source 1..23: mol_type = other DNA
ggcacacgagcattctgtctgta

SEQ ID NO: 31713 - DNA, 24 bp, synthetic construct
  misc_feature 1..24: note = Synthetic Construct
  source 1..24: mol_type = other DNA
gccattgtctgcctcagaagtgtt

SEQ ID NO: 31714 - DNA, 22 bp, synthetic construct
  misc_feature 1..22: note = Synthetic Construct
  source 1..22: mol_type = other DNA
gcactagagcagggctttcttc

SEQ ID NO: 31715 - DNA, 27 bp, synthetic construct
  misc_feature 1..27: note = Synthetic Construct
  source 1..27: mol_type = other DNA
ggggtatacaaaggtagtgaggcatga

SEQ ID NO: 31716 - DNA, 22 bp, synthetic construct
  misc_feature 1..22: note = Synthetic Construct
  source 1..22: mol_type = other DNA
ccagcccaacaaagcccagatt

SEQ ID NO: 31717 - DNA, 24 bp, synthetic construct
  misc_feature 1..24: note = Synthetic Construct
  source 1..24: mol_type = other DNA
ctcacccttgatcagctcccattc

SEQ ID NO: 31718 - DNA, 24 bp, synthetic construct
  misc_feature 1..24: note = Synthetic Construct
  source 1..24: mol_type = other DNA
gccactggaactcagaagagtcaa

SEQ ID NO: 31719 - DNA, 23 bp, synthetic construct
  misc_feature 1..23: note = Synthetic Construct
  source 1..23: mol_type = other DNA
ctctggttcctcctgcaaccatt

SEQ ID NO: 31720 - DNA, 25 bp, synthetic construct
  misc_feature 1..25: note = Synthetic Construct
  source 1..25: mol_type = other DNA
gtggttatccagagaaggtggaaca

SEQ ID NO: 31721 - DNA, 20 bp, synthetic construct
  misc_feature 1..20: note = Synthetic Construct
  source 1..20: mol_type = other DNA
cccagctccagtggatgaag

SEQ ID NO: 31722 - DNA, 21 bp, synthetic construct
  misc_feature 1..21: note = Synthetic Construct
  source 1..21: mol_type = other DNA
cctgcccttgtccacaatgtt

SEQ ID NO: 31723 - DNA, 24 bp, synthetic construct
  misc_feature 1..24: note = Synthetic Construct
  source 1..24: mol_type = other DNA
gcactggctaggacttccagtatg

SEQ ID NO: 31724 - DNA, 23 bp, synthetic construct
  misc_feature 1..23: note = Synthetic Construct
  source 1..23: mol_type = other DNA
tttcccgctatatctgtgcaagt

SEQ ID NO: 31725 - DNA, 25 bp, synthetic construct
  misc_feature 1..25: note = Synthetic Construct
  source 1..25: mol_type = other DNA
ggaagaaggcatcccatttgaaaca

SEQ ID NO: 31726 - DNA, 24 bp, synthetic construct
  misc_feature 1..24: note = Synthetic Construct
  source 1..24: mol_type = other DNA
cacccaggtcccaatataacatga

SEQ ID NO: 31727 - DNA, 25 bp, synthetic construct
  misc_feature 1..25: note = Synthetic Construct
  source 1..25: mol_type = other DNA
caagataagtgccatggttgtctca

SEQ ID NO: 31728 - DNA, 24 bp, synthetic construct
  misc_feature 1..24: note = Synthetic Construct
  source 1..24: mol_type = other DNA
agttggcacagagaaaagtgtttg

SEQ ID NO: 31729 - DNA, 25 bp, synthetic construct
  misc_feature 1..25: note = Synthetic Construct
  source 1..25: mol_type = other DNA
gtctgtgcagaataaagcccaaact

SEQ ID NO: 31730 - DNA, 20 bp, synthetic construct
  misc_feature 1..20: note = Synthetic Construct
  source 1..20: mol_type = other DNA
accaggcaggctttgctgaa

SEQ ID NO: 31731 - DNA, 21 bp, synthetic construct
  misc_feature 1..21: note = Synthetic Construct
  source 1..21: mol_type = other DNA
tcatcctcccaacctgactgt

SEQ ID NO: 31732 - DNA, 24 bp, synthetic construct
  misc_feature 1..24: note = Synthetic Construct
  source 1..24: mol_type = other DNA
tgtcagaaccttgttgagttgtga

SEQ ID NO: 31733 - DNA, 27 bp, synthetic construct
  misc_feature 1..27: note = Synthetic Construct
  source 1..27: mol_type = other DNA
gactcaaccatctgctgcctaaaatag

SEQ ID NO: 31734 - DNA, 24 bp, synthetic construct
  misc_feature 1..24: note = Synthetic Construct
  source 1..24: mol_type = other DNA
tgctggggagttaaaggaaattgt

SEQ ID NO: 31735 - DNA, 23 bp, synthetic construct
  misc_feature 1..23: note = Synthetic Construct
  source 1..23: mol_type = other DNA
caggaccacaattgatgccattt

SEQ ID NO: 31736 - DNA, 26 bp, synthetic construct
  misc_feature 1..26: note = Synthetic Construct
  source 1..26: mol_type = other DNA
agtaggagacagagggtttctatcat

SEQ ID NO: 31737 - DNA, 23 bp, synthetic construct
  misc_feature 1..23: note = Synthetic Construct
  source 1..23: mol_type = other DNA
aacttggtgtctttgtggggtta

SEQ ID NO: 31738 - DNA, 22 bp, synthetic construct
  misc_feature 1..22: note = Synthetic Construct
  source 1..22: mol_type = other DNA
ggggtggcaataggagcacttt

SEQ ID NO: 31739 - DNA, 20 bp, synthetic construct
  misc_feature 1..20: note = Synthetic Construct
  source 1..20: mol_type = other DNA
catgccaagctgtgctgact

SEQ ID NO: 31740 - DNA, 20 bp, synthetic construct
  misc_feature 1..20: note = Synthetic Construct
  source 1..20: mol_type = other DNA
tgcgtgagtgggtgcagaat

SEQ ID NO: 31741 - DNA, 26 bp, synthetic construct
  misc_feature 1..26: note = Synthetic Construct
  source 1..26: mol_type = other DNA
cttctactgaactcctggaaggagaa

SEQ ID NO: 31742 - DNA, 22 bp, synthetic construct
  misc_feature 1..22: note = Synthetic Construct
  source 1..22: mol_type = other DNA
gcagtccattttccacccaatc

SEQ ID NO: 31743 - DNA, 24 bp, synthetic construct
  misc_feature 1..24: note = Synthetic Construct
  source 1..24: mol_type = other DNA
ggaccaggaaaggaaggtgcatag

SEQ ID NO: 31744 - DNA, 25 bp, synthetic construct
  misc_feature 1..25: note = Synthetic Construct
  source 1..25: mol_type = other DNA
acatttgggatggacattcagaaca

SEQ ID NO: 31745 - DNA, 25 bp, synthetic construct
  misc_feature 1..25: note = Synthetic Construct
  source 1..25: mol_type = other DNA
gggaagggaatcttaggcagaggaa

SEQ ID NO: 31746 - DNA, 24 bp, synthetic construct
  misc_feature 1..24: note = Synthetic Construct
  source 1..24: mol_type = other DNA
ccccagtggaagagagatatccaa

SEQ ID NO: 31747 - DNA, 25 bp, synthetic construct
  misc_feature 1..25: note = Synthetic Construct
  source 1..25: mol_type = other DNA
tgaactttaggctgcctttatggaa

SEQ ID NO: 31748 - DNA, 23 bp, synthetic construct
  misc_feature 1..23: note = Synthetic Construct
  source 1..23: mol_type = other DNA
gtgggctcagggaatcatactac

SEQ ID NO: 31749 - DNA, 22 bp, synthetic construct
  misc_feature 1..22: note = Synthetic Construct
  source 1..22: mol_type = other DNA
tcaaggcaatgggtttccttct

SEQ ID NO: 31750 - DNA, 22 bp, synthetic construct
  misc_feature 1..22: note = Synthetic Construct
  source 1..22: mol_type = other DNA
gggcagaggttatgggtacctt

SEQ ID NO: 31751 - DNA, 20 bp, synthetic construct
  misc_feature 1..20: note = Synthetic Construct
  source 1..20: mol_type = other DNA
agccaggtctgggagacaac

SEQ ID NO: 31752 - DNA, 19 bp, synthetic construct
  misc_feature 1..19: note = Synthetic Construct
  source 1..19: mol_type = other DNA
cacggtgaggccattcact

SEQ ID NO: 31753 - DNA, 20 bp, synthetic construct
  misc_feature 1..20: note = Synthetic Construct
  source 1..20: mol_type = other DNA
aggccaagatcagcctcctt

SEQ ID NO: 31754 - DNA, 21 bp, synthetic construct
  misc_feature 1..21: note = Synthetic Construct
  source 1..21: mol_type = other DNA
tcgaccccaggtccatcaact

SEQ ID NO: 31755 - DNA, 23 bp, synthetic construct
  misc_feature 1..23: note = Synthetic Construct
  source 1..23: mol_type = other DNA
gacgcaaaccaaatcccaactgt

SEQ ID NO: 31756 - DNA, 24 bp, synthetic construct
  misc_feature 1..24: note = Synthetic Construct
  source 1..24: mol_type = other DNA
tccctgacaactccttctaagact

SEQ ID NO: 31757 - DNA, 23 bp, synthetic construct
  misc_feature 1..23: note = Synthetic Construct
  source 1..23: mol_type = other DNA
ctgccacttacctagggtcagaa

SEQ ID NO: 31758 - DNA, 19 bp, synthetic construct
  misc_feature 1..19: note = Synthetic Construct
  source 1..19: mol_type = other DNA
gcccttgcctgtgggcttt

SEQ ID NO: 31759 - DNA, 23 bp, synthetic construct
  misc_feature 1..23: note = Synthetic Construct
  source 1..23: mol_type = other DNA
gccactgctgatctcatcccatt

SEQ ID NO: 31760 - DNA, 26 bp, synthetic construct
  misc_feature 1..26: note = Synthetic Construct
  source 1..26: mol_type = other DNA
gactcacatctattcccttggttact

SEQ ID NO: 31761 - DNA, 26 bp, synthetic construct
  misc_feature 1..26: note = Synthetic Construct
  source 1..26: mol_type = other DNA
gagatgggacctagataaagcagaag

SEQ ID NO: 31762 - DNA, 24 bp, synthetic construct
  misc_feature 1..24: note = Synthetic Construct
  source 1..24: mol_type = other DNA
ggccaacatctgggattgtgatac

SEQ ID NO: 31763 - DNA, 22 bp, synthetic construct
  misc_feature 1..22: note = Synthetic Construct
  source 1..22: mol_type = other DNA
ggacttgtgtttgctgtggttt

SEQ ID NO: 31764 - DNA, 21 bp, synthetic construct
  misc_feature 1..21: note = Synthetic Construct
  source 1..21: mol_type = other DNA
gctcttgcggactggtgcata

SEQ ID NO: 31765 - DNA, 19 bp, synthetic construct
  misc_feature 1..19: note = Synthetic Construct
  source 1..19: mol_type = other DNA
tgaactcctggggccaagt

SEQ ID NO: 31766 - DNA, 23 bp, synthetic construct
  misc_feature 1..23: note = Synthetic Construct
  source 1..23: mol_type = other DNA
gatccccttgctcagttagtgaa

SEQ ID NO: 31767 - DNA, 25 bp, synthetic construct
  misc_feature 1..25: note = Synthetic Construct
  source 1..25: mol_type = other DNA
gcactgtaactgcgaaaaccatctt

SEQ ID NO: 31768 - DNA, 25 bp, synthetic construct
  misc_feature 1..25: note = Synthetic Construct
  source 1..25: mol_type = other DNA
agattcagcctaacagtcagtcaat

SEQ ID NO: 31769 - DNA, 22 bp, synthetic construct
  misc_feature 1..22: note = Synthetic Construct
  source 1..22: mol_type = other DNA
agtgaccactgagactgacact

SEQ ID NO: 31770 - DNA, 28 bp, synthetic construct
  misc_feature 1..28: note = Synthetic Construct
  source 1..28: mol_type = other DNA
cctgataagttaagaatgggtccctgat

SEQ ID NO: 31771 - DNA, 24 bp, synthetic construct
  misc_feature 1..24: note = Synthetic Construct
  source 1..24: mol_type = other DNA
ccgactctgacacctgactcctat

SEQ ID NO: 31772 - DNA, 25 bp, synthetic construct
  misc_feature 1..25: note = Synthetic Construct
  source 1..25: mol_type = other DNA
cccctgaaaagcttgtccaataaca

SEQ ID NO: 31773 - DNA, 24 bp, synthetic construct
  misc_feature 1..24: note = Synthetic Construct
  source 1..24: mol_type = other DNA
gccaagctgacttgttggtactgt

SEQ ID NO: 31774 - DNA, 22 bp, synthetic construct
  misc_feature 1..22: note = Synthetic Construct
  source 1..22: mol_type = other DNA
tgacctccagggctgaagtgat

SEQ ID NO: 31775 - DNA, 25 bp, synthetic construct
  misc_feature 1..25: note = Synthetic Construct
  source 1..25: mol_type = other DNA
gctctgcacttttcagtggaggata

SEQ ID NO: 31776 - DNA, 24 bp, synthetic construct
  misc_feature 1..24: note = Synthetic Construct
  source 1..24: mol_type = other DNA
gggttccttttcagcatcatttgt

SEQ ID NO: 31777 - DNA, 23 bp, synthetic construct
  misc_feature 1..23: note = Synthetic Construct
  source 1..23: mol_type = other DNA
tcttcctcagctcagtccttaca

SEQ ID NO: 31778 - DNA, 24 bp, synthetic construct
  misc_feature 1..24: note = Synthetic Construct
  source 1..24: mol_type = other DNA
gactgcaataccccttccaatttc

SEQ ID NO: 31779 - DNA, 21 bp, synthetic construct
  misc_feature 1..21: note = Synthetic Construct
  source 1..21: mol_type = other DNA
ccttgccgggaaacagacaga

SEQ ID NO: 31780 - DNA, 25 bp, synthetic construct
  misc_feature 1..25: note = Synthetic Construct
  source 1..25: mol_type = other DNA
ccagaaacacagcttgttggacaaa

SEQ ID NO: 31781 - DNA, 30 bp, synthetic construct
  misc_feature 1..30: note = Synthetic Construct
  source 1..30: mol_type = other DNA
cacatcctaattcactccagactatggaaa

SEQ ID NO: 31782 - DNA, 28 bp, synthetic construct
  misc_feature 1..28: note = Synthetic Construct
  source 1..28: mol_type = other DNA
cagaaaactggctatggggaaattccta

SEQ ID NO: 31783 - DNA, 22 bp, synthetic construct
  misc_feature 1..22: note = Synthetic Construct
  source 1..22: mol_type = other DNA
cagcttcagattcgggcaggtt

SEQ ID NO: 31784 - DNA, 23 bp, synthetic construct
  misc_feature 1..23: note = Synthetic Construct
  source 1..23: mol_type = other DNA
gctagaggggaggagttctgaag

SEQ ID NO: 31785 - DNA, 23 bp, synthetic construct
  misc_feature 1..23: note = Synthetic Construct
  source 1..23: mol_type = other DNA
ctagccagctatgctcctgttac

SEQ ID NO: 31786 - DNA, 20 bp, synthetic construct
  misc_feature 1..20: note = Synthetic Construct
  source 1..20: mol_type = other DNA
ggggtgcagcggcataatca

SEQ ID NO: 31787 - DNA, 24 bp, synthetic construct
  misc_feature 1..24: note = Synthetic Construct
  source 1..24: mol_type = other DNA
cctaaagccacgtgatctttgaca

SEQ ID NO: 31788 - DNA, 22 bp, synthetic construct
  misc_feature 1..22: note = Synthetic Construct
  source 1..22: mol_type = other DNA
gcctatttcccttgcactgtga

SEQ ID NO: 31789 - DNA, 24 bp, synthetic construct
  misc_feature 1..24: note = Synthetic Construct
  source 1..24: mol_type = other DNA
gaccagtaggactccagtggaaga

SEQ ID NO: 31790 - DNA, 24 bp, synthetic construct
  misc_feature 1..24: note = Synthetic Construct
  source 1..24: mol_type = other DNA
ccaaagcagaccgactctcctaca

SEQ ID NO: 31791 - DNA, 23 bp, synthetic construct
  misc_feature 1..23: note = Synthetic Construct
  source 1..23: mol_type = other DNA
gtgcacacatcacacatccttgt

SEQ ID NO: 31792 - DNA, 26 bp, synthetic construct
  misc_feature 1..26: note = Synthetic Construct
  source 1..26: mol_type = other DNA
ggccaactacaagtccctagctcttt

SEQ ID NO: 31793 - DNA, 20 bp, synthetic construct
  misc_feature 1..20: note = Synthetic Construct
  source 1..20: mol_type = other DNA
acggtggaggtgggtgtaga

SEQ ID NO: 31794 - DNA, 25 bp, synthetic construct
  misc_feature 1..25: note = Synthetic Construct
  source 1..25: mol_type = other DNA
gggtcaaactgtaggctagaccaat

SEQ ID NO: 31795 - DNA, 25 bp, synthetic construct
  misc_feature 1..25: note = Synthetic Construct
  source 1..25: mol_type = other DNA
tggcaaagacactttatcacaggtt

SEQ ID NO: 31796 - DNA, 26 bp, synthetic construct
  misc_feature 1..26: note = Synthetic Construct
  source 1..26: mol_type = other DNA
gggtgttaaaaagtgctttgctccaa

SEQ ID NO: 31797 - DNA, 24 bp, synthetic construct
  misc_feature 1..24: note = Synthetic Construct
  source 1..24: mol_type = other DNA
agccaaacctgactccatcaattt

SEQ ID NO: 31798 - DNA, 24 bp, synthetic construct
  misc_feature 1..24: note = Synthetic Construct
  source 1..24: mol_type = other DNA
tgtctcctggtagttcttggtagt

SEQ ID NO: 31799 - DNA, 22 bp, synthetic construct
  misc_feature 1..22: note = Synthetic Construct
  source 1..22: mol_type = other DNA
cagcgtcactggatgggtaatg

SEQ ID NO: 31800 - DNA, 24 bp, synthetic construct
  misc_feature 1..24: note = Synthetic Construct
  source 1..24: mol_type = other DNA
caacctgataaagggcaaccacaa

SEQ ID NO: 31801 - DNA, 22 bp, synthetic construct
  misc_feature 1..22: note = Synthetic Construct
  source 1..22: mol_type = other DNA
ggctgcaccttcacaaatggat

SEQ ID NO: 31802 - DNA, 20 bp, synthetic construct
  misc_feature 1..20: note = Synthetic Construct
  source 1..20: mol_type = other DNA
tggctggaggtgaacagttg

SEQ ID NO: 31803 - DNA, 20 bp, synthetic construct
  misc_feature 1..20: note = Synthetic Construct
  source 1..20: mol_type = other DNA
tccaagcccgcagttcttca

SEQ ID NO: 31804 - DNA, 21 bp, synthetic construct
  misc_feature 1..21: note = Synthetic Construct
  source 1..21: mol_type = other DNA
aaattgttggctcgcctctct

SEQ ID NO: 31805 - DNA, 26 bp, synthetic construct
  misc_feature 1..26: note = Synthetic Construct
  source 1..26: mol_type = other DNA
caccagttcccatggaaaaccataag

SEQ ID NO: 31806 - DNA, 30 bp, synthetic construct
  misc_feature 1..30: note = Synthetic Construct
  source 1..30: mol_type = other DNA
cctatttgcttccatcctcctagtagattt

SEQ ID NO: 31807 - DNA, 23 bp, synthetic construct
  misc_feature 1..23: note = Synthetic Construct
  source 1..23: mol_type = other DNA
gcgttttggtaacccagacaaag

SEQ ID NO: 31808 - DNA, 22 bp, synthetic construct
  misc_feature 1..22: note = Synthetic Construct
  source 1..22: mol_type = other DNA
tgcctcatgcctggactaattt

SEQ ID NO: 31809 - DNA, 26 bp, synthetic construct
  misc_feature 1..26: note = Synthetic Construct
  source 1..26: mol_type = other DNA
cgaaggtaagactctggcaagtgaag

SEQ ID NO: 31810 - DNA, 22 bp, synthetic construct
  misc_feature 1..22: note = Synthetic Construct
  source 1..22: mol_type = other DNA
ggagcagcctcaaggaccttat

SEQ ID NO: 31811 - DNA, 26 bp, synthetic construct
  misc_feature 1..26: note = Synthetic Construct
  source 1..26: mol_type = other DNA
gcagctgttatatgtacctctgtact

SEQ ID NO: 31812 - DNA, 23 bp, synthetic construct
  misc_feature 1..23: note = Synthetic Construct
  source 1..23: mol_type = other DNA
aaggacagggtagcaaagtgtag

SEQ ID NO: 31813 - DNA, 22 bp, synthetic construct
  misc_feature 1..22: note = Synthetic Construct
  source 1..22: mol_type = other DNA
tgtctgtaacccaggagtctca

SEQ ID NO: 31814 - DNA, 25 bp, synthetic construct
  misc_feature 1..25: note = Synthetic Construct
  source 1..25: mol_type = other DNA
tgggatattggcctgaagttttctt

SEQ ID NO: 31815 - DNA, 23 bp, synthetic construct
  misc_feature 1..23: note = Synthetic Construct
  source 1..23: mol_type = other DNA
aggcatcaaatacctctgtgctt

SEQ ID NO: 31816 - DNA, 24 bp, synthetic construct
  misc_feature 1..24: note = Synthetic Construct
  source 1..24: mol_type = other DNA
caccatagcagtagtgctggtcta

SEQ ID NO: 31817 - DNA, 25 bp, synthetic construct
  misc_feature 1..25: note = Synthetic Construct
  source 1..25: mol_type = other DNA
gcctcattgcaccttttctcctgta

SEQ ID NO: 31818 - DNA, 23 bp, synthetic construct
  misc_feature 1..23: note = Synthetic Construct
  source 1..23: mol_type = other DNA
gggcaaggagaggggtgttttta

SEQ ID NO: 31819 - DNA, 24 bp, synthetic construct
  misc_feature 1..24: note = Synthetic Construct
  source 1..24: mol_type = other DNA
gcagcctctgtaacagggtttgat

SEQ ID NO: 31820 - DNA, 25 bp, synthetic construct
  misc_feature 1..25: note = Synthetic Construct
  source 1..25: mol_type = other DNA
ggcttcctttactggacctactttc

SEQ ID NO: 31821 - DNA, 22 bp, synthetic construct
  misc_feature 1..22: note = Synthetic Construct
  source 1..22: mol_type = other DNA
cccactggttctggctctttgt

SEQ ID NO: 31822 - DNA, 26 bp, synthetic construct
  misc_feature 1..26: note = Synthetic Construct
  source 1..26: mol_type = other DNA
ctcagcttaaaaaccagtgtcctaga

SEQ ID NO: 31823 - DNA, 25 bp, synthetic construct
  misc_feature 1..25: note = Synthetic Construct
  source 1..25: mol_type = other DNA
cagagaggagcaggacattccatac

SEQ ID NO: 31824 - DNA, 22 bp, synthetic construct
  misc_feature 1..22: note = Synthetic Construct
  source 1..22: mol_type = other DNA
ggccaaggcaccttctcattgt

SEQ ID NO: 31825 - DNA, 19 bp, synthetic construct
  misc_feature 1..19: note = Synthetic Construct
  source 1..19: mol_type = other DNA
aggttccaggctgcagtga

SEQ ID NO: 31826 - DNA, 19 bp, synthetic construct
  misc_feature 1..19: note = Synthetic Construct
  source 1..19: mol_type = other DNA
gctctgcgttcccggaagt

SEQ ID NO: 31827 - DNA, 26 bp, synthetic construct
  misc_feature 1..26: note = Synthetic Construct
  source 1..26: mol_type = other DNA
cattctgaaagtagggagggactaag

SEQ ID NO: 31828 - DNA, 22 bp, synthetic construct
  misc_feature 1..22: note = Synthetic Construct
  source 1..22: mol_type = other DNA
caccttcccaaatggaggacat

SEQ ID NO: 31829 - DNA, 22 bp, synthetic construct
  misc_feature 1..22: note = Synthetic Construct
  source 1..22: mol_type = other DNA
tcaggccctaggttcagtctgt

SEQ ID NO: 31830 - DNA, 23 bp, synthetic construct
  misc_feature 1..23: note = Synthetic Construct
  source 1..23: mol_type = other DNA
ggggtctgctctagggaacaatc

SEQ ID NO: 31831 - DNA, 25 bp, synthetic construct
  misc_feature 1..25: note = Synthetic Construct
  source 1..25: mol_type = other DNA
agaacagaactcactggaatgacaa

SEQ ID NO: 31832 - DNA, 27 bp, synthetic construct
  misc_feature 1..27: note = Synthetic Construct
  source 1..27: mol_type = other DNA
ctgactgtatgtgactgactggaattg

SEQ ID NO: 31833 - DNA, 23 bp, synthetic construct
  misc_feature 1..23: note = Synthetic Construct
  source 1..23: mol_type = other DNA
catcgaagtggcaggaaatgaag

SEQ ID NO: 31834 - DNA, 24 bp, synthetic construct
  misc_feature 1..24: note = Synthetic Construct
  source 1..24: mol_type = other DNA
gacaagtccagctcagagaatgaa

SEQ ID NO: 31835 - DNA, 25 bp, synthetic construct
  misc_feature 1..25: note = Synthetic Construct
  source 1..25: mol_type = other DNA
ccttgactgacaggtaactcacaaa

SEQ ID NO: 31836 - DNA, 23 bp, synthetic construct
  misc_feature 1..23: note = Synthetic Construct
  source 1..23: mol_type = other DNA
tctgaagaacaggctcagtgttg

SEQ ID NO: 31837 - DNA, 25 bp, synthetic construct
  misc_feature 1..25: note = Synthetic Construct
  source 1..25: mol_type = other DNA
ttctccaaagaggattctgctctac

SEQ ID NO: 31838 - DNA, 24 bp, synthetic construct
  misc_feature 1..24: note = Synthetic Construct
  source 1..24: mol_type = other DNA
gagctgagcactggatgagactta

SEQ ID NO: 31839 - DNA, 26 bp, synthetic construct
  misc_feature 1..26: note = Synthetic Construct
  source 1..26: mol_type = other DNA
gccgattgagcaagtgagttctccta

SEQ ID NO: 31840 - DNA, 22 bp, synthetic construct
  misc_feature 1..22: note = Synthetic Construct
  source 1..22: mol_type = other DNA
ggacttttcccagggcctcaaa

SEQ ID NO: 31841 - DNA, 21 bp, synthetic construct
  misc_feature 1..21: note = Synthetic Construct
  source 1..21: mol_type = other DNA
gactgcaggggtttcacttgt

SEQ ID NO: 31842 - DNA, 22 bp, synthetic construct
  misc_feature 1..22: note = Synthetic Construct
  source 1..22: mol_type = other DNA
gtcatcccatgtggcctgtagt

SEQ ID NO: 31843 - DNA, 21 bp, synthetic construct
  misc_feature 1..21: note = Synthetic Construct
  source 1..21: mol_type = other DNA
ggatgtcacttgtgggcaact

SEQ ID NO: 31844 - DNA, 20 bp, synthetic construct
  misc_feature 1..20: note = Synthetic Construct
  source 1..20: mol_type = other DNA
gaacgcggctcactcatttg

SEQ ID NO: 31845 - DNA, 20 bp, synthetic construct
  misc_feature 1..20: note = Synthetic Construct
  source 1..20: mol_type = other DNA
ggcgccagtgctttatgtct

SEQ ID NO: 31846 - DNA, 28 bp, synthetic construct
  misc_feature 1..28: note = Synthetic Construct
  source 1..28: mol_type = other DNA
ggaggattctcatcttcctggtatcatc

SEQ ID NO: 31847 - DNA, 21 bp, synthetic construct
  misc_feature 1..21: note = Synthetic Construct
  source 1..21: mol_type = other DNA
aggggtggtctcctcccttat

SEQ ID NO: 31848 - DNA, 19 bp, synthetic construct
  misc_feature 1..19: note = Synthetic Construct
  source 1..19: mol_type = other DNA
tgtgcagtgggcaggaaga

SEQ ID NO: 31849 - DNA, 26 bp, synthetic construct
  misc_feature 1..26: note = Synthetic Construct
  source 1..26: mol_type = other DNA
caaacaaccataggtcctttctctca

SEQ ID NO: 31850 - DNA, 28 bp, synthetic construct
  misc_feature 1..28: note = Synthetic Construct
  source 1..28: mol_type = other DNA
ggtctcttagtttagaggtcacttcgtt

SEQ ID NO: 31851 - DNA, 22 bp, synthetic construct
  misc_feature 1..22: note = Synthetic Construct
  source 1..22: mol_type = other DNA
ttgaggaggggagaggcaaaag

SEQ ID NO: 31852 - DNA, 27 bp, synthetic construct
  misc_feature 1..27: note = Synthetic Construct
  source 1..27: mol_type = other DNA
gcaaacacagtgtaaggtagtaagaac

SEQ ID NO: 31853 - DNA, 26 bp, synthetic construct
  misc_feature 1..26: note = Synthetic Construct
  source 1..26: mol_type = other DNA
ctttctccagcaagctctctttttac

SEQ ID NO: 31854 - DNA, 20 bp, synthetic construct
  misc_feature 1..20: note = Synthetic Construct
  source 1..20: mol_type = other DNA
gctggcaggactcatgtgat

SEQ ID NO: 31855 - DNA, 23 bp, synthetic construct
  misc_feature 1..23: note = Synthetic Construct
  source 1..23: mol_type = other DNA
ccaggatggccaacacattcttc

SEQ ID NO: 31856 - DNA, 20 bp, synthetic construct
  misc_feature 1..20: note = Synthetic Construct
  source 1..20: mol_type = other DNA
cagccgtactgcctttcaca

SEQ ID NO: 31857 - DNA, 22 bp, synthetic construct
  misc_feature 1..22: note = Synthetic Construct
  source 1..22: mol_type = other DNA
gcagaccctgagatggagattg

SEQ ID NO: 31858 - DNA, 23 bp, synthetic construct
  misc_feature 1..23: note = Synthetic Construct
  source 1..23: mol_type = other DNA
ctgcttgctcagggttgtgaaaa

SEQ ID NO: 31859 - DNA, 22 bp, synthetic construct
  misc_feature 1..22: note = Synthetic Construct
  source 1..22: mol_type = other DNA
ctccaagccggctcctttacat

SEQ ID NO: 31860 - DNA, 26 bp, synthetic construct
  misc_feature 1..26: note = Synthetic Construct
  source 1..26: mol_type = other DNA
gtttggagctctccctgaacaataaa

SEQ ID NO: 31861 - DNA, 25 bp, synthetic construct
  misc_feature 1..25: note = Synthetic Construct
  source 1..25: mol_type = other DNA
tgacttcaagtgaattgtggagctt

SEQ ID NO: 31862 - DNA, 22 bp, synthetic construct
  misc_feature 1..22: note = Synthetic Construct
  source 1..22: mol_type = other DNA
ggcccagtgtcgagtttgtcta

SEQ ID NO: 31863 - DNA, 21 bp, synthetic construct
  misc_feature 1..21: note = Synthetic Construct
  source 1..21: mol_type = other DNA
gttcacgtggctgagacaaac

SEQ ID NO: 31864 - DNA, 26 bp, synthetic construct
  misc_feature 1..26: note = Synthetic Construct
  source 1..26: mol_type = other DNA
ggcatacaggaagggaaaggatgaca

SEQ ID NO: 31865 - DNA, 18 bp, synthetic construct
  misc_feature 1..18: note = Synthetic Construct
  source 1..18: mol_type = other DNA
tgcgggatgcagagcaaa

SEQ ID NO: 31866 - DNA, 22 bp, synthetic construct
  misc_feature 1..22: note = Synthetic Construct
  source 1..22: mol_type = other DNA
gagactgaaaagcctccagaca

SEQ ID NO: 31867 - DNA, 24 bp, synthetic construct
  misc_feature 1..24: note = Synthetic Construct
  source 1..24: mol_type = other DNA
gtcattgtgggaagtgcatttgtt

SEQ ID NO: 31868 - DNA, 25 bp, synthetic construct
  misc_feature 1..25: note = Synthetic Construct
  source 1..25: mol_type = other DNA
ccaggacacctatttcgtacccatt

SEQ ID NO: 31869 - DNA, 24 bp, synthetic construct
  misc_feature 1..24: note = Synthetic Construct
  source 1..24: mol_type = other DNA
gacggtgattgtgatctgctacta

SEQ ID NO: 31870 - DNA, 23 bp, synthetic construct
  misc_feature 1..23: note = Synthetic Construct
  source 1..23: mol_type = other DNA
ctgcaccatcttaaccccacttc

SEQ ID NO: 31871 - DNA, 23 bp, synthetic construct
  misc_feature 1..23: note = Synthetic Construct
  source 1..23: mol_type = other DNA
gggcctaacaatccaccaaaaca

SEQ ID NO: 31872 - DNA, 25 bp, synthetic construct
  misc_feature 1..25: note = Synthetic Construct
  source 1..25: mol_type = other DNA
ccagctttctatgacattgggctat

SEQ ID NO: 31873 - DNA, 24 bp, synthetic construct
  misc_feature 1..24: note = Synthetic Construct
  source 1..24: mol_type = other DNA
ccagttactaccctgcgcttaatg

SEQ ID NO: 31874 - DNA, 24 bp, synthetic construct
  misc_feature 1..24: note = Synthetic Construct
  source 1..24: mol_type = other DNA
tggagatggctgtcttctcatttt

SEQ ID NO: 31875 - DNA, 25 bp, synthetic construct
  misc_feature 1..25: note = Synthetic Construct
  source 1..25: mol_type = other DNA
gcacaggatggacatcaggttcact

SEQ ID NO: 31876 - DNA, 19 bp, synthetic construct
  misc_feature 1..19: note = Synthetic Construct
  source 1..19: mol_type = other DNA
cccaggctctgtgctttga

SEQ ID NO: 31877 - DNA, 22 bp, synthetic construct
  misc_feature 1..22: note = Synthetic Construct
  source 1..22: mol_type = other DNA
gtgcacagccagaatcatcctt

SEQ ID NO: 31878 - DNA, 22 bp, synthetic construct
  misc_feature 1..22: note = Synthetic Construct
  source 1..22: mol_type = other DNA
gcagcctggtggactattggat

SEQ ID NO: 31879 - DNA, 19 bp, synthetic construct
  misc_feature 1..19: note = Synthetic Construct
  source 1..19: mol_type = other DNA
gcccctgcctgcatctcta

SEQ ID NO: 31880 - DNA, 24 bp, synthetic construct
  misc_feature 1..24: note = Synthetic Construct
  source 1..24: mol_type = other DNA
ggaggggactcagggacctaaaat

SEQ ID NO: 31881 - DNA, 27 bp, synthetic construct
  misc_feature 1..27: note = Synthetic Construct
  source 1..27: mol_type = other DNA
agtcagtagggttgcagaaagtataac

SEQ ID NO: 31882 - DNA, 22 bp, synthetic construct
  misc_feature 1..22: note = Synthetic Construct
  source 1..22: mol_type = other DNA
ggcctctgtcccttctctttac

SEQ ID NO: 31883 - DNA, 22 bp, synthetic construct
  misc_feature 1..22: note = Synthetic Construct
  source 1..22: mol_type = other DNA
ctccctgcaacaccctcttatc

SEQ ID NO: 31884 - DNA, 25 bp, synthetic construct
  misc_feature 1..25: note = Synthetic Construct
  source 1..25: mol_type = other DNA
caaggtggtaacctgtgatttggtt

SEQ ID NO: 31885 - DNA, 27 bp, synthetic construct
  misc_feature 1..27: note = Synthetic Construct
  source 1..27: mol_type = other DNA
ggaggaataatgtttgcaccagggaat

SEQ ID NO: 31886 - DNA, 21 bp, synthetic construct
  misc_feature 1..21: note = Synthetic Construct
  source 1..21: mol_type = other DNA
ggcccctccctctttacaact

SEQ ID NO: 31887 - DNA, 19 bp, synthetic construct
  misc_feature 1..19: note = Synthetic Construct
  source 1..19: mol_type = other DNA
ccgggttcgggtcaccttt

SEQ ID NO: 31888 - DNA, 22 bp, synthetic construct
  misc_feature 1..22: note = Synthetic Construct
  source 1..22: mol_type = other DNA
aagaagacccacccctcagaga

SEQ ID NO: 31889 - DNA, 20 bp, synthetic construct
  misc_feature 1..20: note = Synthetic Construct
  source 1..20: mol_type = other DNA
agtggggcctgtcctcaagt

SEQ ID NO: 31890 - DNA, 20 bp, synthetic construct
  misc_feature 1..20: note = Synthetic Construct
  source 1..20: mol_type = other DNA
aaggacggcgcagtgaggaa

SEQ ID NO: 31891 - DNA, 22 bp, synthetic construct
  misc_feature 1..22: note = Synthetic Construct
  source 1..22: mol_type = other DNA
ggtcactccctcatcagcttag

SEQ ID NO: 31892 - DNA, 25 bp, synthetic construct
  misc_feature 1..25: note = Synthetic Construct
  source 1..25: mol_type = other DNA
ccctgagcctagggtattgtaattt

SEQ ID NO: 31893 - DNA, 21 bp, synthetic construct
  misc_feature 1..21: note = Synthetic Construct
  source 1..21: mol_type = other DNA
ggtgcaactgatggctgtagt

SEQ ID NO: 31894 - DNA, 25 bp, synthetic construct
  misc_feature 1..25: note = Synthetic Construct
  source 1..25: mol_type = other DNA
gaggaagtttgagcacactgggtta

SEQ ID NO: 31895 - DNA, 27 bp, synthetic construct
  misc_feature 1..27: note = Synthetic Construct
  source 1..27: mol_type = other DNA
cttggttctgaagttttcaggtcaatc

SEQ ID NO: 31896 - DNA, 25 bp, synthetic construct
  misc_feature 1..25: note = Synthetic Construct
  source 1..25: mol_type = other DNA
ccccataagctcccacttagtgtat

SEQ ID NO: 31897 - DNA, 23 bp, synthetic construct
  misc_feature 1..23: note = Synthetic Construct
  source 1..23: mol_type = other DNA
ctgcccagtgctgtatcacacat

SEQ ID NO: 31898 - DNA, 24 bp, synthetic construct
  misc_feature 1..24: note = Synthetic Construct
  source 1..24: mol_type = other DNA
gtccgtccaaacaaaaggttgact

SEQ ID NO: 31899 - DNA, 25 bp, synthetic construct
  misc_feature 1..25: note = Synthetic Construct
  source 1..25: mol_type = other DNA
acacaaaagacttggacttccttct

SEQ ID NO: 31900 - DNA, 30 bp, synthetic construct
  misc_feature 1..30: note = Synthetic Construct
  source 1..30: mol_type = other DNA
ggctcttctacataatactcttctctcatc

SEQ ID NO: 31901 - DNA, 20 bp, synthetic construct
  misc_feature 1..20: note = Synthetic Construct
  source 1..20: mol_type = other DNA
tccgggccactggggtaaat

SEQ ID NO: 31902 - DNA, 26 bp, synthetic construct
  misc_feature 1..26: note = Synthetic Construct
  source 1..26: mol_type = other DNA
ctagggaccaaattgcagtagaaatc

SEQ ID NO: 31903 - DNA, 22 bp, synthetic construct
  misc_feature 1..22: note = Synthetic Construct
  source 1..22: mol_type = other DNA
gcaaaaggtgatccaggtctct

SEQ ID NO: 31904 - DNA, 20 bp, synthetic construct
  misc_feature 1..20: note = Synthetic Construct
  source 1..20: mol_type = other DNA
agtggggagacaccaggaaa

SEQ ID NO: 31905 - DNA, 21 bp, synthetic construct
  misc_feature 1..21: note = Synthetic Construct
  source 1..21: mol_type = other DNA
ttcccaggactgagctcttca

SEQ ID NO: 31906 - DNA, 26 bp, synthetic construct
  misc_feature 1..26: note = Synthetic Construct
  source 1..26: mol_type = other DNA
gagaatgacttcctgcacaattggtt

SEQ ID NO: 31907 - DNA, 21 bp, synthetic construct
  misc_feature 1..21: note = Synthetic Construct
  source 1..21: mol_type = other DNA
tggcttggaggagaccaggta

SEQ ID NO: 31908 - DNA, 26 bp, synthetic construct
  misc_feature 1..26: note = Synthetic Construct
  source 1..26: mol_type = other DNA
gcctgtgtaaactgatcttggacttg

SEQ ID NO: 31909 - DNA, 23 bp, synthetic construct
  misc_feature 1..23: note = Synthetic Construct
  source 1..23: mol_type = other DNA
ggaggcccagaatgccattttca

SEQ ID NO: 31910 - DNA, 22 bp, synthetic construct
  misc_feature 1..22: note = Synthetic Construct
  source 1..22: mol_type = other DNA
gcactgaaagccttggaactga

SEQ ID NO: 31911 - DNA, 26 bp, synthetic construct
  misc_feature 1..26: note = Synthetic Construct
  source 1..26: mol_type = other DNA
cctggctttcctcctttgacatacaa

SEQ ID NO: 31912 - DNA, 22 bp, synthetic construct
  misc_feature 1..22: note = Synthetic Construct
  source 1..22: mol_type = other DNA
accctcaccatcctcagttgat

SEQ ID NO: 31913 - DNA, 24 bp, synthetic construct
  misc_feature 1..24: note = Synthetic Construct
  source 1..24: mol_type = other DNA
tccttaaatgcctgaagccaaaag

SEQ ID NO: 31914 - DNA, 24 bp, synthetic construct
  misc_feature 1..24: note = Synthetic Construct
  source 1..24: mol_type = other DNA
ccacatgtagctgctttgcaatta

SEQ ID NO: 31915 - DNA, 25 bp, synthetic construct
  misc_feature 1..25: note = Synthetic Construct
  source 1..25: mol_type = other DNA
tccttctgaaatccttccattggtt

SEQ ID NO: 31916 - DNA, 25 bp, synthetic construct
  misc_feature 1..25: note = Synthetic Construct
  source 1..25: mol_type = other DNA
gtcttctacccagttccttctcact

SEQ ID NO: 31917 - DNA, 20 bp, synthetic construct
  misc_feature 1..20: note = Synthetic Construct
  source 1..20: mol_type = other DNA
aagccttgtgcctggagagt

SEQ ID NO: 31918 - DNA, 23 bp, synthetic construct
  misc_feature 1..23: note = Synthetic Construct
  source 1..23: mol_type = other DNA
caagatgggtctatgctggaaca

SEQ ID NO: 31919 - DNA, 22 bp, synthetic construct
  misc_feature 1..22: note = Synthetic Construct
  source 1..22: mol_type = other DNA
gggctttctccttcagcaaaga

SEQ ID NO: 31920 - DNA, 20 bp, synthetic construct
  misc_feature 1..20: note = Synthetic Construct
  source 1..20: mol_type = other DNA
gcagaaccagaaggccgaat

SEQ ID NO: 31921 - DNA, 23 bp, synthetic construct
  misc_feature 1..23: note = Synthetic Construct
  source 1..23: mol_type = other DNA
ggggcaaaacctggagtcagatg

SEQ ID NO: 31922 - DNA, 20 bp, synthetic construct
  misc_feature 1..20: note = Synthetic Construct
  source 1..20: mol_type = other DNA
atgctgagctgcaccgtact

SEQ ID NO: 31923 - DNA, 23 bp, synthetic construct
  misc_feature 1..23: note = Synthetic Construct
  source 1..23: mol_type = other DNA
gaggcatccaaccaacagttttc

SEQ ID NO: 31924 - DNA, 29 bp, synthetic construct
  misc_feature 1..29: note = Synthetic Construct
  source 1..29: mol_type = other DNA
ctgaagacttaaaccaaagttggcagaac

SEQ ID NO: 31925 - DNA, 23 bp, synthetic construct
  misc_feature 1..23: note = Synthetic Construct
  source 1..23: mol_type = other DNA
acttttagctcagggtcatgctt

SEQ ID NO: 31926 - DNA, 19 bp, synthetic construct
  misc_feature 1..19: note = Synthetic Construct
  source 1..19: mol_type = other DNA
agagccacgagggctcaaa

SEQ ID NO: 31927 - DNA, 20 bp, synthetic construct
  misc_feature 1..20: note = Synthetic Construct
  source 1..20: mol_type = other DNA
tcctgagtgccctaccttgt

SEQ ID NO: 31928 - DNA, 26 bp, synthetic construct
  misc_feature 1..26: note = Synthetic Construct
  source 1..26: mol_type = other DNA
gccatgttaaactgcatcacctctaa

SEQ ID NO: 31929 - DNA, 22 bp, synthetic construct
  misc_feature 1..22: note = Synthetic Construct
  source 1..22: mol_type = other DNA
caccactgtggagaggaaggta

SEQ ID NO: 31930 - DNA, 22 bp, synthetic construct
  misc_feature 1..22: note = Synthetic Construct
  source 1..22: mol_type = other DNA
caggttcttggcgttttgaaca

SEQ ID NO: 31931 - DNA, 22 bp, synthetic construct
  misc_feature 1..22: note = Synthetic Construct
  source 1..22: mol_type = other DNA
gcattgcaagtgttgtgacaga

SEQ ID NO: 31932 - DNA, 22 bp, synthetic construct
  misc_feature 1..22: note = Synthetic Construct
  source 1..22: mol_type = other DNA
tttcctggaggccattttgtca

SEQ ID NO: 31933 - DNA, 22 bp, synthetic construct
  misc_feature 1..22: note = Synthetic Construct
  source 1..22: mol_type = other DNA
tccagagtcccttgcttcatca

SEQ ID NO: 31934 - DNA, 22 bp, synthetic construct
  misc_feature 1..22: note = Synthetic Construct
  source 1..22: mol_type = other DNA
cactgccagagcaacaagaaac

SEQ ID NO: 31935 - DNA, 22 bp, synthetic construct
  misc_feature 1..22: note = Synthetic Construct
  source 1..22: mol_type = other DNA
gaagggagggagtagggaaagt

SEQ ID NO: 31936 - DNA, 22 bp, synthetic construct
  misc_feature 1..22: note = Synthetic Construct
  source 1..22: mol_type = other DNA
ggctgagggatggggaagaaga

SEQ ID NO: 31937 - DNA, 22 bp, synthetic construct
  misc_feature 1..22: note = Synthetic Construct
  source 1..22: mol_type = other DNA
ccccgtccaccccttctactat

SEQ ID NO: 31938 - DNA, 25 bp, synthetic construct
  misc_feature 1..25: note = Synthetic Construct
  source 1..25: mol_type = other DNA
aattcagggacagaactgagagatg

SEQ ID NO: 31939 - DNA, 29 bp, synthetic construct
  misc_feature 1..29: note = Synthetic Construct
  source 1..29: mol_type = other DNA
ccaggttgagaaaggaagtagctttattc

SEQ ID NO: 31940 - DNA, 22 bp, synthetic construct
  misc_feature 1..22: note = Synthetic Construct
  source 1..22: mol_type = other DNA
cctggtggtgactggtggatta

SEQ ID NO: 31941 - DNA, 22 bp, synthetic construct
  misc_feature 1..22: note = Synthetic Construct
  source 1..22: mol_type = other DNA
tcttcctcccctcactcccaaa

SEQ ID NO: 31942 - DNA, 22 bp, synthetic construct
  misc_feature 1..22: note = Synthetic Construct
  source 1..22: mol_type = other DNA
gtctgcagcaaaccggaggtat

SEQ ID NO: 31943 - DNA, 22 bp, synthetic construct
  misc_feature 1..22: note = Synthetic Construct
  source 1..22: mol_type = other DNA
gagctgcaacaaccatggaaat

SEQ ID NO: 31944 - DNA, 26 bp, synthetic construct
  misc_feature 1..26: note = Synthetic Construct
  source 1..26: mol_type = other DNA
gctagtaaagtaacaaccctccttgt

SEQ ID NO: 31945 - DNA, 26 bp, synthetic construct
  misc_feature 1..26: note = Synthetic Construct
  source 1..26: mol_type = other DNA
gggaaaaatgactcccttcacttcaa

SEQ ID NO: 31946 - DNA, 22 bp, synthetic construct
  misc_feature 1..22: note = Synthetic Construct
  source 1..22: mol_type = other DNA
ccctggtgaccgggaaaatgat

SEQ ID NO: 31947 - DNA, 20 bp, synthetic construct
  misc_feature 1..20: note = Synthetic Construct
  source 1..20: mol_type = other DNA
gggctgctcctcgttttgta

SEQ ID NO: 31948 - DNA, 25 bp, synthetic construct
  misc_feature 1..25: note = Synthetic Construct
  source 1..25: mol_type = other DNA
gccaccacaataatccagtggaaag

SEQ ID NO: 31949 - DNA, 22 bp, synthetic construct
  misc_feature 1..22: note = Synthetic Construct
  source 1..22: mol_type = other DNA
agctgtcaggacttgggtaact

SEQ ID NO: 31950 - DNA, 25 bp, synthetic construct
  misc_feature 1..25: note = Synthetic Construct
  source 1..25: mol_type = other DNA
cgaggatatcttagtggcattgctt

SEQ ID NO: 31951 - DNA, 23 bp, synthetic construct
  misc_feature 1..23: note = Synthetic Construct
  source 1..23: mol_type = other DNA
gggttgacactcaaatgcctctt

SEQ ID NO: 31952 - DNA, 25 bp, synthetic construct
  misc_feature 1..25: note = Synthetic Construct
  source 1..25: mol_type = other DNA
ttgcattcattaccaccttcaccta

SEQ ID NO: 31953 - DNA, 27 bp, synthetic construct
  misc_feature 1..27: note = Synthetic Construct
  source 1..27: mol_type = other DNA
cagaattggagactagtgggtggatac

SEQ ID NO: 31954 - DNA, 24 bp, synthetic construct
  misc_feature 1..24: note = Synthetic Construct
  source 1..24: mol_type = other DNA
ggcttactccagacaccattgctt

SEQ ID NO: 31955 - DNA, 24 bp, synthetic construct
  misc_feature 1..24: note = Synthetic Construct
  source 1..24: mol_type = other DNA
ggctgggaatggtaagccttatac

SEQ ID NO: 31956 - DNA, 25 bp, synthetic construct
  misc_feature 1..25: note = Synthetic Construct
  source 1..25: mol_type = other DNA
ggtgagaagcccatggaagtattga

SEQ ID NO: 31957 - DNA, 22 bp, synthetic construct
  misc_feature 1..22: note = Synthetic Construct
  source 1..22: mol_type = other DNA
ggcctccagccctgatttcata

SEQ ID NO: 31958 - DNA, 24 bp, synthetic construct
  misc_feature 1..24: note = Synthetic Construct
  source 1..24: mol_type = other DNA
catggcatgatccctgactcatag

SEQ ID NO: 31959 - DNA, 21 bp, synthetic construct
  misc_feature 1..21: note = Synthetic Construct
  source 1..21: mol_type = other DNA
ctgaagtgccccagctttaga

SEQ ID NO: 31960 - DNA, 20 bp, synthetic construct
  misc_feature 1..20: note = Synthetic Construct
  source 1..20: mol_type = other DNA
gccagaattggccagagcat

SEQ ID NO: 31961 - DNA, 24 bp, synthetic construct
  misc_feature 1..24: note = Synthetic Construct
  source 1..24: mol_type = other DNA
actgtacggttaaacatcgtctgt

SEQ ID NO: 31962 - DNA, 27 bp, synthetic construct
  misc_feature 1..27: note = Synthetic Construct
  source 1..27: mol_type = other DNA
cttctctcctgctggatatacacatct

SEQ ID NO: 31963 - DNA, 25 bp, synthetic construct
  misc_feature 1..25: note = Synthetic Construct
  source 1..25: mol_type = other DNA
tgttacgtgtagaatgatggtgcat

SEQ ID NO: 31964 - DNA, 22 bp, synthetic construct
  misc_feature 1..22: note = Synthetic Construct
  source 1..22: mol_type = other DNA
agagggaaactctggccaaaaa

SEQ ID NO: 31965 - DNA, 23 bp, synthetic construct
  misc_feature 1..23: note = Synthetic Construct
  source 1..23: mol_type = other DNA
gtgaactgcttcacagaggtttc

SEQ ID NO: 31966 - DNA, 27 bp, synthetic construct
  misc_feature 1..27: note = Synthetic Construct
  source 1..27: mol_type = other DNA
cagcagaaagtagctgcattacctaag

SEQ ID NO: 31967 - DNA, 20 bp, synthetic construct
  misc_feature 1..20: note = Synthetic Construct
  source 1..20: mol_type = other DNA
ttggcagggcggtgtttctt

SEQ ID NO: 31968 - DNA, 22 bp, synthetic construct
  misc_feature 1..22: note = Synthetic Construct
  source 1..22: mol_type = other DNA
acttgggaggtggaatcacttg

SEQ ID NO: 31969 - DNA, 21 bp, synthetic construct
  misc_feature 1..21: note = Synthetic Construct
  source 1..21: mol_type = other DNA
ccatggtcgccatcttgaagt

SEQ ID NO: 31970 - DNA, 23 bp, synthetic construct
  misc_feature 1..23: note = Synthetic Construct
  source 1..23: mol_type = other DNA
acagaaagggcagagttcattgt

SEQ ID NO: 31971 - DNA, 22 bp, synthetic construct
  misc_feature 1..22: note = Synthetic Construct
  source 1..22: mol_type = other DNA
ccctgcctgcctagttctgttt

SEQ ID NO: 31972 - DNA, 19 bp, synthetic construct
  misc_feature 1..19: note = Synthetic Construct
  source 1..19: mol_type = other DNA
accacgctgggctccaaag

SEQ ID NO: 31973 - DNA, 20 bp, synthetic construct
  misc_feature 1..20: note = Synthetic Construct
  source 1..20: mol_type = other DNA
ggtgggttgcattccccttt

SEQ ID NO: 31974 - DNA, 24 bp, synthetic construct
  misc_feature 1..24: note = Synthetic Construct
  source 1..24: mol_type = other DNA
ctgacctgtaaagcttctctgtct

SEQ ID NO: 31975 - DNA, 22 bp, synthetic construct
  misc_feature 1..22: note = Synthetic Construct
  source 1..22: mol_type = other DNA
ggctgcaccatgaccatctgtt

SEQ ID NO: 31976 - DNA, 21 bp, synthetic construct
  misc_feature 1..21: note = Synthetic Construct
  source 1..21: mol_type = other DNA
cgggaaggcaagggaaagagt

SEQ ID NO: 31977 - DNA, 26 bp, synthetic construct
  misc_feature 1..26: note = Synthetic Construct
  source 1..26: mol_type = other DNA
gcagcttctttacatgtcttggttca

SEQ ID NO: 31978 - DNA, 25 bp, synthetic construct
  misc_feature 1..25: note = Synthetic Construct
  source 1..25: mol_type = other DNA
ctgagatctatgggagcagtgagaa

SEQ ID NO: 31979 - DNA, 25 bp, synthetic construct
  misc_feature 1..25: note = Synthetic Construct
  source 1..25: mol_type = other DNA
gcaaaattgccactcatgtggattg

SEQ ID NO: 31980 - DNA, 22 bp, synthetic construct
  misc_feature 1..22: note = Synthetic Construct
  source 1..22: mol_type = other DNA
cctccagcaaaggagtcagtct

SEQ ID NO: 31981 - DNA, 24 bp, synthetic construct
  misc_feature 1..24: note = Synthetic Construct
  source 1..24: mol_type = other DNA
acatgtgtagggtaggaagtctga

SEQ ID NO: 31982 - DNA, 27 bp, synthetic construct
  misc_feature 1..27: note = Synthetic Construct
  source 1..27: mol_type = other DNA
cagaggctactccttttacactgcata

SEQ ID NO: 31983 - DNA, 20 bp, synthetic construct
  misc_feature 1..20: note = Synthetic Construct
  source 1..20: mol_type = other DNA
tctgagccccagcttcctta

SEQ ID NO: 31984 - DNA, 20 bp, synthetic construct
  misc_feature 1..20: note = Synthetic Construct
  source 1..20: mol_type = other DNA
ccacaccccatagccacaca

SEQ ID NO: 31985 - DNA, 25 bp, synthetic construct
  misc_feature 1..25: note = Synthetic Construct
  source 1..25: mol_type = other DNA
gcagagaaggtggaaaggagataga

SEQ ID NO: 31986 - DNA, 22 bp, synthetic construct
  misc_feature 1..22: note = Synthetic Construct
  source 1..22: mol_type = other DNA
cccagagtcgacccacattttg

SEQ ID NO: 31987 - DNA, 22 bp, synthetic construct
  misc_feature 1..22: note = Synthetic Construct
  source 1..22: mol_type = other DNA
cggctctggcgtattgtagcat

SEQ ID NO: 31988 - DNA, 24 bp, synthetic construct
  misc_feature 1..24: note = Synthetic Construct
  source 1..24: mol_type = other DNA
gccctgaagctcatcaattcattc

SEQ ID NO: 31989 - DNA, 22 bp, synthetic construct
  misc_feature 1..22: note = Synthetic Construct
  source 1..22: mol_type = other DNA
ttgtcctggcctagggatgagt

SEQ ID NO: 31990 - DNA, 22 bp, synthetic construct
  misc_feature 1..22: note = Synthetic Construct
  source 1..22: mol_type = other DNA
gccaggcctgcttcattgtcta

SEQ ID NO: 31991 - DNA, 23 bp, synthetic construct
  misc_feature 1..23: note = Synthetic Construct
  source 1..23: mol_type = other DNA
tggaggaagtgaggcttatgcta

SEQ ID NO: 31992 - DNA, 22 bp, synthetic construct
  misc_feature 1..22: note = Synthetic Construct
  source 1..22: mol_type = other DNA
caggcaaactatccctggttgt

SEQ ID NO: 31993 - DNA, 22 bp, synthetic construct
  misc_feature 1..22: note = Synthetic Construct
  source 1..22: mol_type = other DNA
ccaaccaggtgtctccagaact

SEQ ID NO: 31994 - DNA, 19 bp, synthetic construct
  misc_feature 1..19: note = Synthetic Construct
  source 1..19: mol_type = other DNA
gcagggctggtgtgtgaat

SEQ ID NO: 31995 - DNA, 22 bp, synthetic construct
  misc_feature 1..22: note = Synthetic Construct
  source 1..22: mol_type = other DNA
ctgcgttctggaagctcgtttg

SEQ ID NO: 31996 - DNA, 21 bp, synthetic construct
  misc_feature 1..21: note = Synthetic Construct
  source 1..21: mol_type = other DNA
ggatgtttccctgcaggatgt

SEQ ID NO: 31997 - DNA, 26 bp, synthetic construct
  misc_feature 1..26: note = Synthetic Construct
  source 1..26: mol_type = other DNA
ggagagcaaaagaacgcttttcaatg

SEQ ID NO: 31998 - DNA, 19 bp, synthetic construct
  misc_feature 1..19: note = Synthetic Construct
  source 1..19: mol_type = other DNA
cggggaaggtgcaggacat

SEQ ID NO: 31999 - DNA, 22 bp, synthetic construct
  misc_feature 1..22: note = Synthetic Construct
  source 1..22: mol_type = other DNA
cgaccagccagggtgataagaa

SEQ ID NO: 32000 - DNA, 21 bp, synthetic construct
  misc_feature 1..21: note = Synthetic Construct
  source 1..21: mol_type = other DNA
acaggaggtgctgatgtctca

SEQ ID NO: 32001 - DNA, 24 bp, synthetic construct
  misc_feature 1..24: note = Synthetic Construct
  source 1..24: mol_type = other DNA
gctccattgtcttctggttttgaa

SEQ ID NO: 32002 - DNA, 23 bp, synthetic construct
  misc_feature 1..23: note = Synthetic Construct
  source 1..23: mol_type = other DNA
gtgctgaagaggctctgagtcat

SEQ ID NO: 32003 - DNA, 22 bp, synthetic construct
  misc_feature 1..22: note = Synthetic Construct
  source 1..22: mol_type = other DNA
gagagctgcagggtgtttgaga

SEQ ID NO: 32004 - DNA, 22 bp, synthetic construct
  misc_feature 1..22: note = Synthetic Construct
  source 1..22: mol_type = other DNA
gtcaggtatcgcgctggaagtt

SEQ ID NO: 32005 - DNA, 25 bp, synthetic construct
  misc_feature 1..25: note = Synthetic Construct
  source 1..25: mol_type = other DNA
aaaagaaggccttggagagttctaa

SEQ ID NO: 32006 - DNA, 20 bp, synthetic construct
  misc_feature 1..20: note = Synthetic Construct
  source 1..20: mol_type = other DNA
aggtgcctctgtagctgagt

SEQ ID NO: 32007 - DNA, 23 bp, synthetic construct
  misc_feature 1..23: note = Synthetic Construct
  source 1..23: mol_type = other DNA
gggagccaaaggttttcaggaat

SEQ ID NO: 32008 - DNA, 25 bp, synthetic construct
  misc_feature 1..25: note = Synthetic Construct
  source 1..25: mol_type = other DNA
gctgatgcatccatgaaagactaca

SEQ ID NO: 32009 - DNA, 20 bp, synthetic construct
  misc_feature 1..20: note = Synthetic Construct
  source 1..20: mol_type = other DNA
acctctggacaggcagatga

SEQ ID NO: 32010 - DNA, 24 bp, synthetic construct
  misc_feature 1..24: note = Synthetic Construct
  source 1..24: mol_type = other DNA
gcagaatggatagagcttggtact

SEQ ID NO: 32011 - DNA, 22 bp, synthetic construct
  misc_feature 1..22: note = Synthetic Construct
  source 1..22: mol_type = other DNA
ccaccccactcccattgtttga

SEQ ID NO: 32012 - DNA, 20 bp, synthetic construct
  misc_feature 1..20: note = Synthetic Construct
  source 1..20: mol_type = other DNA
aggaccagtgctccaagtca

SEQ ID NO: 32013 - DNA, 25 bp, synthetic construct
  misc_feature 1..25: note = Synthetic Construct
  source 1..25: mol_type = other DNA
agcccaacacatttgagcattacta

SEQ ID NO: 32014 - DNA, 20 bp, synthetic construct
  misc_feature 1..20: note = Synthetic Construct
  source 1..20: mol_type = other DNA
cccttcttcgcgtgtgtgtt

SEQ ID NO: 32015 - DNA, 22 bp, synthetic construct
  misc_feature 1..22: note = Synthetic Construct
  source 1..22: mol_type = other DNA
tgctgtcctggaggtgttgaag

SEQ ID NO: 32016 - DNA, 23 bp, synthetic construct
  misc_feature 1..23: note = Synthetic Construct
  source 1..23: mol_type = other DNA
ggaagggcagtggtacctattca

SEQ ID NO: 32017 - DNA, 23 bp, synthetic construct
  misc_feature 1..23: note = Synthetic Construct
  source 1..23: mol_type = other DNA
gagggttttccccacaacctcta

SEQ ID NO: 32018 - DNA, 26 bp, synthetic construct
  misc_feature 1..26: note = Synthetic Construct
  source 1..26: mol_type = other DNA
ggacacccttccaaatggttttcttc

SEQ ID NO: 32019 - DNA, 24 bp, synthetic construct
  misc_feature 1..24: note = Synthetic Construct
  source 1..24: mol_type = other DNA
ggaagctggtgatccacatttttg

SEQ ID NO: 32020 - DNA, 24 bp, synthetic construct
  misc_feature 1..24: note = Synthetic Construct
  source 1..24: mol_type = other DNA
gcactcatgtgctatgagggagtt

SEQ ID NO: 32021 - DNA, 24 bp, synthetic construct
  misc_feature 1..24: note = Synthetic Construct
  source 1..24: mol_type = other DNA
ggctgtagcctgagtctctgtttg

SEQ ID NO: 32022 - DNA, 22 bp, synthetic construct
  misc_feature 1..22: note = Synthetic Construct
  source 1..22: mol_type = other DNA
agcccactggtggtcatttaag

SEQ ID NO: 32023 - DNA, 28 bp, synthetic construct
  misc_feature 1..28: note = Synthetic Construct
  source 1..28: mol_type = other DNA
gtgatgaggatcatgggaagggaataaa

SEQ ID NO: 32024 - DNA, 24 bp, synthetic construct
  misc_feature 1..24: note = Synthetic Construct
  source 1..24: mol_type = other DNA
gagctccaccctagagcaatgaag

SEQ ID NO: 32025 - DNA, 20 bp, synthetic construct
  misc_feature 1..20: note = Synthetic Construct
  source 1..20: mol_type = other DNA
tggagaggacacccctcaaa

SEQ ID NO: 32026 - DNA, 29 bp, synthetic construct
  misc_feature 1..29: note = Synthetic Construct
  source 1..29: mol_type = other DNA
gccctatttttagtataaccctggagcat

SEQ ID NO: 32027 - DNA, 24 bp, synthetic construct
  misc_feature 1..24: note = Synthetic Construct
  source 1..24: mol_type = other DNA
cccgcaaatcaagcatcagcttac

SEQ ID NO: 32028 - DNA, 20 bp, synthetic construct
  misc_feature 1..20: note = Synthetic Construct
  source 1..20: mol_type = other DNA
tcagagcctcacgcctgaat

SEQ ID NO: 32029 - DNA, 22 bp, synthetic construct
  misc_feature 1..22: note = Synthetic Construct
  source 1..22: mol_type = other DNA
ccccacccatgatacgttgttc

SEQ ID NO: 32030 - DNA, 29 bp, synthetic construct
  misc_feature 1..29: note = Synthetic Construct
  source 1..29: mol_type = other DNA
ctcataaagtaagacacaccgtaccaatg

SEQ ID NO: 32031 - DNA, 24 bp, synthetic construct
  misc_feature 1..24: note = Synthetic Construct
  source 1..24: mol_type = other DNA
cctagattctggaacgccttgttc

SEQ ID NO: 32032 - DNA, 23 bp, synthetic construct
  misc_feature 1..23: note = Synthetic Construct
  source 1..23: mol_type = other DNA
ggccagtgcatttttctccatag

SEQ ID NO: 32033 - DNA, 20 bp, synthetic construct
  misc_feature 1..20: note = Synthetic Construct
  source 1..20: mol_type = other DNA
tgctcacctccaggaagact

SEQ ID NO: 32034 - DNA, 22 bp, synthetic construct
  misc_feature 1..22: note = Synthetic Construct
  source 1..22: mol_type = other DNA
ggagtcctaggctgtcagaaac

SEQ ID NO: 32035 - DNA, 25 bp, synthetic construct
  misc_feature 1..25: note = Synthetic Construct
  source 1..25: mol_type = other DNA
gacacaatgactggaatttgcttca

SEQ ID NO: 32036 - DNA, 24 bp, synthetic construct
  misc_feature 1..24: note = Synthetic Construct
  source 1..24: mol_type = other DNA
cattgtgcaaccagaactgagatt

SEQ ID NO: 32037 - DNA, 23 bp, synthetic construct
  misc_feature 1..23: note = Synthetic Construct
  source 1..23: mol_type = other DNA
cagagtaggcaccaccatctatc

SEQ ID NO: 32038 - DNA, 20 bp, synthetic construct
  misc_feature 1..20: note = Synthetic Construct
  source 1..20: mol_type = other DNA
tgcagccacccgaatgagat

SEQ ID NO: 32039 - DNA, 25 bp, synthetic construct
  misc_feature 1..25: note = Synthetic Construct
  source 1..25: mol_type = other DNA
ctttgtggtgcaaatctgatcttct

SEQ ID NO: 32040 - DNA, 27 bp, synthetic construct
  misc_feature 1..27: note = Synthetic Construct
  source 1..27: mol_type = other DNA
cactggagtgcttactgaatgaaaaca

SEQ ID NO: 32041 - DNA, 20 bp, synthetic construct
  misc_feature 1..20: note = Synthetic Construct
  source 1..20: mol_type = other DNA
aaagctgaggggtggagaga

SEQ ID NO: 32042 - DNA, 25 bp, synthetic construct
  misc_feature 1..25: note = Synthetic Construct
  source 1..25: mol_type = other DNA
gcaggtgctaaggactgtaagaagt

SEQ ID NO: 32043 - DNA, 26 bp, synthetic construct
  misc_feature 1..26: note = Synthetic Construct
  source 1..26: mol_type = other DNA
cacccctttagagctaaggaaacaag

SEQ ID NO: 32044 - DNA, 22 bp, synthetic construct
  misc_feature 1..22: note = Synthetic Construct
  source 1..22: mol_type = other DNA
gagacagaggtccagaggtgtt

SEQ ID NO: 32045 - DNA, 25 bp, synthetic construct
  misc_feature 1..25: note = Synthetic Construct
  source 1..25: mol_type = other DNA
tgtcagtcataaccttggatgctaa

SEQ ID NO: 32046 - DNA, 22 bp, synthetic construct
  misc_feature 1..22: note = Synthetic Construct
  source 1..22: mol_type = other DNA
ggaaccagagctgaggctgtta

SEQ ID NO: 32047 - DNA, 20 bp, synthetic construct
  misc_feature 1..20: note = Synthetic Construct
  source 1..20: mol_type = other DNA
actctgggtgtgtcggcatt

SEQ ID NO: 32048 - DNA, 22 bp, synthetic construct
  misc_feature 1..22: note = Synthetic Construct
  source 1..22: mol_type = other DNA
accctcgtggcatcagagatga

SEQ ID NO: 32049 - DNA, 19 bp, synthetic construct
  misc_feature 1..19: note = Synthetic Construct
  source 1..19: mol_type = other DNA
agtgggcccagtggaggaa

SEQ ID NO: 32050 - DNA, 22 bp, synthetic construct
  misc_feature 1..22: note = Synthetic Construct
  source 1..22: mol_type = other DNA
gtgggctgggcttaatggtatg

SEQ ID NO: 32051 - DNA, 21 bp, synthetic construct
  misc_feature 1..21: note = Synthetic Construct
  source 1..21: mol_type = other DNA
cccagtacgctaggcagaaga

SEQ ID NO: 32052 - DNA, 23 bp, synthetic construct
  misc_feature 1..23: note = Synthetic Construct
  source 1..23: mol_type = other DNA
ctgccaagctcactagaggtaac

SEQ ID NO: 32053 - DNA, 20 bp, synthetic construct
  misc_feature 1..20: note = Synthetic Construct
  source 1..20: mol_type = other DNA
gccaggtcgacacgtaacat

SEQ ID NO: 32054 - DNA, 23 bp, synthetic construct
  misc_feature 1..23: note = Synthetic Construct
  source 1..23: mol_type = other DNA
ccaccctctttctcatcacagtt

SEQ ID NO: 32055 - DNA, 24 bp, synthetic construct
  misc_feature 1..24: note = Synthetic Construct
  source 1..24: mol_type = other DNA
ggacataagacccatccaccaatg

SEQ ID NO: 32056 - DNA, 27 bp, synthetic construct
  misc_feature 1..27: note = Synthetic Construct
  source 1..27: mol_type = other DNA
ggtctgtaaagttgccatgaatactga

SEQ ID NO: 32057 - DNA, 26 bp, synthetic construct
  misc_feature 1..26: note = Synthetic Construct
  source 1..26: mol_type = other DNA
tgtccttgggaagaagtgagtttaag

SEQ ID NO: 32058 - DNA, 27 bp, synthetic construct
  misc_feature 1..27: note = Synthetic Construct
  source 1..27: mol_type = other DNA
ccctgaaaataatacccagctttcatc

SEQ ID NO: 32059 - DNA, 25 bp, synthetic construct
  misc_feature 1..25: note = Synthetic Construct
  source 1..25: mol_type = other DNA
catctgagctgaggtcatgttcttc

SEQ ID NO: 32060 - DNA, 20 bp, synthetic construct
  misc_feature 1..20: note = Synthetic Construct
  source 1..20: mol_type = other DNA
gggcaggtgtttcaggaagt

SEQ ID NO: 32061 - DNA, 27 bp, synthetic construct
  misc_feature 1..27: note = Synthetic Construct
  source 1..27: mol_type = other DNA
agtaactatctcaagtcacaggagtct

SEQ ID NO: 32062 - DNA, 27 bp, synthetic construct
  misc_feature 1..27: note = Synthetic Construct
  source 1..27: mol_type = other DNA
catagttgctaaataacgggagctact

SEQ ID NO: 32063 - DNA, 24 bp, synthetic construct
  misc_feature 1..24: note = Synthetic Construct
  source 1..24: mol_type = other DNA
ggtcattcagaccagctccaataa

SEQ ID NO: 32064 - DNA, 22 bp, synthetic construct
  misc_feature 1..22: note = Synthetic Construct
  source 1..22: mol_type = other DNA
ggccagtggcacattagcaaac

SEQ ID NO: 32065 - DNA, 22 bp, synthetic construct
  misc_feature 1..22: note = Synthetic Construct
  source 1..22: mol_type = other DNA
cagtcaccctgggatgagagta

SEQ ID NO: 32066 - DNA, 22 bp, synthetic construct
  misc_feature 1..22: note = Synthetic Construct
  source 1..22: mol_type = other DNA
tggtgctgcttagcatttcgta

SEQ ID NO: 32067 - DNA, 20 bp, synthetic construct
  misc_feature 1..20: note = Synthetic Construct
  source 1..20: mol_type = other DNA
agaacaggcaagcccactca

SEQ ID NO: 32068 - DNA, 22 bp, synthetic construct
  misc_feature 1..22: note = Synthetic Construct
  source 1..22: mol_type = other DNA
acaacctgtggtctacctgagt

SEQ ID NO: 32069 - DNA, 26 bp, synthetic construct
  misc_feature 1..26: note = Synthetic Construct
  source 1..26: mol_type = other DNA
gatctctggagaatttgggagtatgt

SEQ ID NO: 32070 - DNA, 23 bp, synthetic construct
  misc_feature 1..23: note = Synthetic Construct
  source 1..23: mol_type = other DNA
ggccagagcacctgttctctaaa

SEQ ID NO: 32071 - DNA, 23 bp, synthetic construct
  misc_feature 1..23: note = Synthetic Construct
  source 1..23: mol_type = other DNA
cagggagtctcgccatctgtaac

SEQ ID NO: 32072 - DNA, 27 bp, synthetic construct
  misc_feature 1..27: note = Synthetic Construct
  source 1..27: mol_type = other DNA
caggttagggagattatcttgcttttc

SEQ ID NO: 32073 - DNA, 22 bp, synthetic construct
  misc_feature 1..22: note = Synthetic Construct
  source 1..22: mol_type = other DNA
gccctaaaaccctgctgagatg

SEQ ID NO: 32074 - DNA, 23 bp, synthetic construct
  misc_feature 1..23: note = Synthetic Construct
  source 1..23: mol_type = other DNA
cctgaatcagccagcatagagtt

SEQ ID NO: 32075 - DNA, 25 bp, synthetic construct
  misc_feature 1..25: note = Synthetic Construct
  source 1..25: mol_type = other DNA
ctttcttccatggatcagctgagat

SEQ ID NO: 32076 - DNA, 24 bp, synthetic construct
  misc_feature 1..24: note = Synthetic Construct
  source 1..24: mol_type = other DNA
gttgcagtctaggttttgttggtt

SEQ ID NO: 32077 - DNA, 26 bp, synthetic construct
  misc_feature 1..26: note = Synthetic Construct
  source 1..26: mol_type = other DNA
ggctagggtaggagtagagcagtatc

SEQ ID NO: 32078 - DNA, 20 bp, synthetic construct
  misc_feature 1..20: note = Synthetic Construct
  source 1..20: mol_type = other DNA
ccggaggcccaaacgttaaa

SEQ ID NO: 32079 - DNA, 29 bp, synthetic construct
  misc_feature 1..29: note = Synthetic Construct
  source 1..29: mol_type = other DNA
ccttggagattcattcgatagctacttgt

SEQ ID NO: 32080 - DNA, 20 bp, synthetic construct
  misc_feature 1..20: note = Synthetic Construct
  source 1..20: mol_type = other DNA
tgacagcccactctcacctt

SEQ ID NO: 32081 - DNA, 21 bp, synthetic construct
  misc_feature 1..21: note = Synthetic Construct
  source 1..21: mol_type = other DNA
acctggtcagcactggcttct

SEQ ID NO: 32082 - DNA, 23 bp, synthetic construct
  misc_feature 1..23: note = Synthetic Construct
  source 1..23: mol_type = other DNA
ggagagaactgggctctgaaaac

SEQ ID NO: 32083 - DNA, 24 bp, synthetic construct
  misc_feature 1..24: note = Synthetic Construct
  source 1..24: mol_type = other DNA
gaggcacagaacatgctaccaaag

SEQ ID NO: 32084 - DNA, 28 bp, synthetic construct
  misc_feature 1..28: note = Synthetic Construct
  source 1..28: mol_type = other DNA
cccatgccataagtaggattgtgacttc

SEQ ID NO: 32085 - DNA, 23 bp, synthetic construct
  misc_feature 1..23: note = Synthetic Construct
  source 1..23: mol_type = other DNA
atgaggaaaacgagggtttctgt

SEQ ID NO: 32086 - DNA, 19 bp, synthetic construct
  misc_feature 1..19: note = Synthetic Construct
  source 1..19: mol_type = other DNA
agcagccccacagtgcaaa

SEQ ID NO: 32087 - DNA, 24 bp, synthetic construct
  misc_feature 1..24: note = Synthetic Construct
  source 1..24: mol_type = other DNA
ggtaggttcagggagctggaatga

SEQ ID NO: 32088 - DNA, 26 bp, synthetic construct
  misc_feature 1..26: note = Synthetic Construct
  source 1..26: mol_type = other DNA
ggtactgtttcttccataaccaggat

SEQ ID NO: 32089 - DNA, 24 bp, synthetic construct
  misc_feature 1..24: note = Synthetic Construct
  source 1..24: mol_type = other DNA
tggtttagcagtgcagataaggaa

SEQ ID NO: 32090 - DNA, 23 bp, synthetic construct
  misc_feature 1..23: note = Synthetic Construct
  source 1..23: mol_type = other DNA
agcagaatggggtgaaaaaggtt

SEQ ID NO: 32091 - DNA, 21 bp, synthetic construct
  misc_feature 1..21: note = Synthetic Construct
  source 1..21: mol_type = other DNA
gagggcacccctgaaaaatgt

SEQ ID NO: 32092 - DNA, 23 bp, synthetic construct
  misc_feature 1..23: note = Synthetic Construct
  source 1..23: mol_type = other DNA
actcaatagctgcccttcctact

SEQ ID NO: 32093 - DNA, 26 bp, synthetic construct
  misc_feature 1..26: note = Synthetic Construct
  source 1..26: mol_type = other DNA
gatgtctggaaagatgttggatgatg

SEQ ID NO: 32094 - DNA, 20 bp, synthetic construct
  misc_feature 1..20: note = Synthetic Construct
  source 1..20: mol_type = other DNA
gagggtgtcctgggcattac

SEQ ID NO: 32095 - DNA, 25 bp, synthetic construct
  misc_feature 1..25: note = Synthetic Construct
  source 1..25: mol_type = other DNA
caaatgcaatggtaggtgatgagtt

SEQ ID NO: 32096 - DNA, 19 bp, synthetic construct
  misc_feature 1..19: note = Synthetic Construct
  source 1..19: mol_type = other DNA
agccgcaaggagtgcattt

SEQ ID NO: 32097 - DNA, 28 bp, synthetic construct
  misc_feature 1..28: note = Synthetic Construct
  source 1..28: mol_type = other DNA
ggacatttgggtttaaccagcctaattc

SEQ ID NO: 32098 - DNA, 25 bp, synthetic construct
  misc_feature 1..25: note = Synthetic Construct
  source 1..25: mol_type = other DNA
cctgttgcaccaaatcaatgtgtct

SEQ ID NO: 32099 - DNA, 25 bp, synthetic construct
  misc_feature 1..25: note = Synthetic Construct
  source 1..25: mol_type = other DNA
caaaatcccaaagtagtgcctgagt

SEQ ID NO: 32100 - DNA, 23 bp, synthetic construct
  misc_feature 1..23: note = Synthetic Construct
  source 1..23: mol_type = other DNA
gggtagtcctgatgggtaacaga

SEQ ID NO: 32101 - DNA, 22 bp, synthetic construct
  misc_feature 1..22: note = Synthetic Construct
  source 1..22: mol_type = other DNA
accaaccagcatctctctcagt

SEQ ID NO: 32102 - DNA, 24 bp, synthetic construct
  misc_feature 1..24: note = Synthetic Construct
  source 1..24: mol_type = other DNA
tggtttgatcttagaccgtgacaa

SEQ ID NO: 32103 - DNA, 26 bp, synthetic construct
  misc_feature 1..26: note = Synthetic Construct
  source 1..26: mol_type = other DNA
gtcttcacagtagggcttttgctatg

SEQ ID NO: 32104 - DNA, 24 bp, synthetic construct
  misc_feature 1..24: note = Synthetic Construct
  source 1..24: mol_type = other DNA
cctggatcccaggcctgtttatag

SEQ ID NO: 32105 - DNA, 25 bp, synthetic construct
  misc_feature 1..25: note = Synthetic Construct
  source 1..25: mol_type = other DNA
gttttcaaaagctgtggttgctgaa

SEQ ID NO: 32106 - DNA, 28 bp, synthetic construct
  misc_feature 1..28: note = Synthetic Construct
  source 1..28: mol_type = other DNA
ggaagctgtactgtagaaactagcctaa

SEQ ID NO: 32107 - DNA, 24 bp, synthetic construct
  misc_feature 1..24: note = Synthetic Construct
  source 1..24: mol_type = other DNA
ctcagactgtggcttatgatgtct

SEQ ID NO: 32108 - DNA, 23 bp, synthetic construct
  misc_feature 1..23: note = Synthetic Construct
  source 1..23: mol_type = other DNA
ccttaaggggccttgggtacatc

SEQ ID NO: 32109 - DNA, 24 bp, synthetic construct
  misc_feature 1..24: note = Synthetic Construct
  source 1..24: mol_type = other DNA
gctcagctgtaggagatttgttct

SEQ ID NO: 32110 - DNA, 20 bp, synthetic construct
  misc_feature 1..20: note = Synthetic Construct
  source 1..20: mol_type = other DNA
tccgtgtccacctggtcaaa

SEQ ID NO: 32111 - DNA, 25 bp, synthetic construct
  misc_feature 1..25: note = Synthetic Construct
  source 1..25: mol_type = other DNA
gccaaagccagtgcataattagttg

SEQ ID NO: 32112 - DNA, 27 bp, synthetic construct
  misc_feature 1..27: note = Synthetic Construct
  source 1..27: mol_type = other DNA
ctctgctttagcatttgccactaatac

SEQ ID NO: 32113 - DNA, 22 bp, synthetic construct
  misc_feature 1..22: note = Synthetic Construct
  source 1..22: mol_type = other DNA
cacagaagtccagcggcattga

SEQ ID NO: 32114 - DNA, 27 bp, synthetic construct
  misc_feature 1..27: note = Synthetic Construct
  source 1..27: mol_type = other DNA
ggagtcaagaaagtcgagcctgtaaaa

SEQ ID NO: 32115 - DNA, 24 bp, synthetic construct
  misc_feature 1..24: note = Synthetic Construct
  source 1..24: mol_type = other DNA
gaaggttccagcaggtgtagaatg

SEQ ID NO: 32116 - DNA, 25 bp, synthetic construct
  misc_feature 1..25: note = Synthetic Construct
  source 1..25: mol_type = other DNA
gagtgggagctctaacttgacacta

SEQ ID NO: 32117 - DNA, 27 bp, synthetic construct
  misc_feature 1..27: note = Synthetic Construct
  source 1..27: mol_type = other DNA
cccaggcttgactctttttacacattg

SEQ ID NO: 32118 - DNA, 25 bp, synthetic construct
  misc_feature 1..25: note = Synthetic Construct
  source 1..25: mol_type = other DNA
actaatattcactggccaactgtga

SEQ ID NO: 32119 - DNA, 22 bp, synthetic construct
  misc_feature 1..22: note = Synthetic Construct
  source 1..22: mol_type = other DNA
ggacaggctgggatggaaaatg

SEQ ID NO: 32120 - DNA, 26 bp, synthetic construct
  misc_feature 1..26: note = Synthetic Construct
  source 1..26: mol_type = other DNA
cagtcagacaagtcctgagtaagaga

SEQ ID NO: 32121 - DNA, 22 bp, synthetic construct
  misc_feature 1..22: note = Synthetic Construct
  source 1..22: mol_type = other DNA
aggctgcgaccttcttcagaga

SEQ ID NO: 32122 - DNA, 20 bp, synthetic construct
  misc_feature 1..20: note = Synthetic Construct
  source 1..20: mol_type = other DNA
gtggatgcagctgccaatga

SEQ ID NO: 32123 - DNA, 20 bp, synthetic construct
  misc_feature 1..20: note = Synthetic Construct
  source 1..20: mol_type = other DNA
atgcaccccaggccccactt

SEQ ID NO: 32124 - DNA, 30 bp, synthetic construct
  misc_feature 1..30: note = Synthetic Construct
  source 1..30: mol_type = other DNA
ccagaaacaaccttagtattgcaacctttc

SEQ ID NO: 32125 - DNA, 22 bp, synthetic construct
  misc_feature 1..22: note = Synthetic Construct
  source 1..22: mol_type = other DNA
ttcctcggtcacctccacaatc

SEQ ID NO: 32126 - DNA, 29 bp, synthetic construct
  misc_feature 1..29: note = Synthetic Construct
  source 1..29: mol_type = other DNA
gaaaatagtctctctgaaggagcaagtag

SEQ ID NO: 32127 - DNA, 21 bp, synthetic construct
  misc_feature 1..21: note = Synthetic Construct
  source 1..21: mol_type = other DNA
tggtgatcgcagcagaaacaa

SEQ ID NO: 32128 - DNA, 22 bp, synthetic construct
  misc_feature 1..22: note = Synthetic Construct
  source 1..22: mol_type = other DNA
gtgggcagaggcatgcatataa

SEQ ID NO: 32129 - DNA, 22 bp, synthetic construct
  misc_feature 1..22: note = Synthetic Construct
  source 1..22: mol_type = other DNA
gtgagcctcaagagacgggaaa

SEQ ID NO: 32130 - DNA, 25 bp, synthetic construct
  misc_feature 1..25: note = Synthetic Construct
  source 1..25: mol_type = other DNA
gcctactagtgctattcccctgaga

SEQ ID NO: 32131 - DNA, 26 bp, synthetic construct
  misc_feature 1..26: note = Synthetic Construct
  source 1..26: mol_type = other DNA
gcttgggtaggatttatgcctgtcaa

SEQ ID NO: 32132 - DNA, 28 bp, synthetic construct
  misc_feature 1..28: note = Synthetic Construct
  source 1..28: mol_type = other DNA
gctccactaaaataccgagttggttcat

SEQ ID NO: 32133 - DNA, 24 bp, synthetic construct
  misc_feature 1..24: note = Synthetic Construct
  source 1..24: mol_type = other DNA
tgatcagaggtctaggcacaactt

SEQ ID NO: 32134 - DNA, 23 bp, synthetic construct
  misc_feature 1..23: note = Synthetic Construct
  source 1..23: mol_type = other DNA
actttctggcaggagtgagtttc

SEQ ID NO: 32135 - DNA, 24 bp, synthetic construct
  misc_feature 1..24: note = Synthetic Construct
  source 1..24: mol_type = other DNA
agtagccactagatggcagaattg

SEQ ID NO: 32136 - DNA, 20 bp, synthetic construct
  misc_feature 1..20: note = Synthetic Construct
  source 1..20: mol_type = other DNA
tccaggccctctgattccaa

SEQ ID NO: 32137 - DNA, 24 bp, synthetic construct
  misc_feature 1..24: note = Synthetic Construct
  source 1..24: mol_type = other DNA
ggaactgttgtgctgaaaatgtct

SEQ ID NO: 32138 - DNA, 27 bp, synthetic construct
  misc_feature 1..27: note = Synthetic Construct
  source 1..27: mol_type = other DNA
tggccttatataactgtagggttgact

SEQ ID NO: 32139 - DNA, 22 bp, synthetic construct
  misc_feature 1..22: note = Synthetic Construct
  source 1..22: mol_type = other DNA
gcttcccagcacagatggaatc

SEQ ID NO: 32140 - DNA, 22 bp, synthetic construct
  misc_feature 1..22: note = Synthetic Construct
  source 1..22: mol_type = other DNA
gcggagggagagcactttgttt

SEQ ID NO: 32141 - DNA, 26 bp, synthetic construct
  misc_feature 1..26: note = Synthetic Construct
  source 1..26: mol_type = other DNA
gctgaaatcttgcagaaaccagagtt

SEQ ID NO: 32142 - DNA, 22 bp, synthetic construct
  misc_feature 1..22: note = Synthetic Construct
  source 1..22: mol_type = other DNA
tgggtaagctcacatgctctca

SEQ ID NO: 32143 - DNA, 25 bp, synthetic construct
  misc_feature 1..25: note = Synthetic Construct
  source 1..25: mol_type = other DNA
gcgtatcacaagccaatgctaagtt

SEQ ID NO: 32144 - DNA, 24 bp, synthetic construct
  misc_feature 1..24: note = Synthetic Construct
  source 1..24: mol_type = other DNA
gatgagaatttgcagggcatggta

SEQ ID NO: 32145 - DNA, 24 bp, synthetic construct
  misc_feature 1..24: note = Synthetic Construct
  source 1..24: mol_type = other DNA
gggaaggaaggtgtgttccctaag

SEQ ID NO: 32146 - DNA, 22 bp, synthetic construct
  misc_feature 1..22: note = Synthetic Construct
  source 1..22: mol_type = other DNA
gcagagaccaggtaagcagaca

SEQ ID NO: 32147 - DNA, 23 bp, synthetic construct
  misc_feature 1..23: note = Synthetic Construct
  source 1..23: mol_type = other DNA
gtcagttgagtggtgaaggcaaa

SEQ ID NO: 32148 - DNA, 24 bp, synthetic construct
  misc_feature 1..24: note = Synthetic Construct
  source 1..24: mol_type = other DNA
aaggtacaagaggcatttctgaca

SEQ ID NO: 32149 - DNA, 23 bp, synthetic construct
  misc_feature 1..23: note = Synthetic Construct
  source 1..23: mol_type = other DNA
tccagaaagatggcctgactttg

SEQ ID NO: 32150 - DNA, 25 bp, synthetic construct
  misc_feature 1..25: note = Synthetic Construct
  source 1..25: mol_type = other DNA
gactctttggaggaccaaggtcaag

SEQ ID NO: 32151 - DNA, 24 bp, synthetic construct
  misc_feature 1..24: note = Synthetic Construct
  source 1..24: mol_type = other DNA
tgctcaaggacaaaaatggtcact

SEQ ID NO: 32152 - DNA, 26 bp, synthetic construct
  misc_feature 1..26: note = Synthetic Construct
  source 1..26: mol_type = other DNA
ccatcttctgtatttgacccgaatct

SEQ ID NO: 32153 - DNA, 21 bp, synthetic construct
  misc_feature 1..21: note = Synthetic Construct
  source 1..21: mol_type = other DNA
tgcagggatgctgggacatca

SEQ ID NO: 32154 - DNA, 25 bp, synthetic construct
  misc_feature 1..25: note = Synthetic Construct
  source 1..25: mol_type = other DNA
gagcaaagaccatgctttacacatc

SEQ ID NO: 32155 - DNA, 20 bp, synthetic construct
  misc_feature 1..20: note = Synthetic Construct
  source 1..20: mol_type = other DNA
agagcgcttgggtagagaga

SEQ ID NO: 32156 - DNA, 24 bp, synthetic construct
  misc_feature 1..24: note = Synthetic Construct
  source 1..24: mol_type = other DNA
cctaatggaacccaggtgagtgat

SEQ ID NO: 32157 - DNA, 19 bp, synthetic construct
  misc_feature 1..19: note = Synthetic Construct
  source 1..19: mol_type = other DNA
acactggggctcactcact

SEQ ID NO: 32158 - DNA, 22 bp, synthetic construct
  misc_feature 1..22: note = Synthetic Construct
  source 1..22: mol_type = other DNA
accacagaccacaggctgacta

SEQ ID NO: 32159 - DNA, 29 bp, synthetic construct
  misc_feature 1..29: note = Synthetic Construct
  source 1..29: mol_type = other DNA
ctgaggcttggaattagatgtgatactga

SEQ ID NO: 32160 - DNA, 26 bp, synthetic construct
  misc_feature 1..26: note = Synthetic Construct
  source 1..26: mol_type = other DNA
cctataagaggagaaacagagcatgt

SEQ ID NO: 32161 - DNA, 24 bp, synthetic construct
  misc_feature 1..24: note = Synthetic Construct
  source 1..24: mol_type = other DNA
gggccatggtacctactctcttct

SEQ ID NO: 32162 - DNA, 23 bp, synthetic construct
  misc_feature 1..23: note = Synthetic Construct
  source 1..23: mol_type = other DNA
tgcacagtcctgtgactctgtat

SEQ ID NO: 32163 - DNA, 25 bp, synthetic construct
  misc_feature 1..25: note = Synthetic Construct
  source 1..25: mol_type = other DNA
gacagcaattcccaaagtgtttttg

SEQ ID NO: 32164 - DNA, 24 bp, synthetic construct
  misc_feature 1..24: note = Synthetic Construct
  source 1..24: mol_type = other DNA
gcctcttcctctccacattggatt

SEQ ID NO: 32165 - DNA, 20 bp, synthetic construct
  misc_feature 1..20: note = Synthetic Construct
  source 1..20: mol_type = other DNA
ccaaaggacagcgtgtgtga

SEQ ID NO: 32166 - DNA, 22 bp, synthetic construct
  misc_feature 1..22: note = Synthetic Construct
  source 1..22: mol_type = other DNA
gtggacactggccatccacatt

SEQ ID NO: 32167 - DNA, 25 bp, synthetic construct
  misc_feature 1..25: note = Synthetic Construct
  source 1..25: mol_type = other DNA
acctcacctgtcatgactattcttc

SEQ ID NO: 32168 - DNA, 22 bp, synthetic construct
  misc_feature 1..22: note = Synthetic Construct
  source 1..22: mol_type = other DNA
ggtgcggtgagtggagatgatt

SEQ ID NO: 32169 - DNA, 25 bp, synthetic construct
  misc_feature 1..25: note = Synthetic Construct
  source 1..25: mol_type = other DNA
gttgcaaagtgagctttgttgattg

SEQ ID NO: 32170 - DNA, 21 bp, synthetic construct
  misc_feature 1..21: note = Synthetic Construct
  source 1..21: mol_type = other DNA
accgcagacaatctgcaagta

SEQ ID NO: 32171 - DNA, 27 bp, synthetic construct
  misc_feature 1..27: note = Synthetic Construct
  source 1..27: mol_type = other DNA
tgatacctgagatagggaaaaggaaga

SEQ ID NO: 32172 - DNA, 26 bp, synthetic construct
  misc_feature 1..26: note = Synthetic Construct
  source 1..26: mol_type = other DNA
gccacttttactgttgcaaacacatc

SEQ ID NO: 32173 - DNA, 22 bp, synthetic construct
  misc_feature 1..22: note = Synthetic Construct
  source 1..22: mol_type = other DNA
gagtgggagggaaaggaagtca

SEQ ID NO: 32174 - DNA, 21 bp, synthetic construct
  misc_feature 1..21: note = Synthetic Construct
  source 1..21: mol_type = other DNA
gctgtcttgccacttccacta

SEQ ID NO: 32175 - DNA, 20 bp, synthetic construct
  misc_feature 1..20: note = Synthetic Construct
  source 1..20: mol_type = other DNA
gctgaagaccagcagtctgt

SEQ ID NO: 32176 - DNA, 22 bp, synthetic construct
  misc_feature 1..22: note = Synthetic Construct
  source 1..22: mol_type = other DNA
gcatgcagcaaggagattgact

SEQ ID NO: 32177 - DNA, 22 bp, synthetic construct
  misc_feature 1..22: note = Synthetic Construct
  source 1..22: mol_type = other DNA
ccttgctctctgcctaccattg

SEQ ID NO: 32178 - DNA, 28 bp, synthetic construct
  misc_feature 1..28: note = Synthetic Construct
  source 1..28: mol_type = other DNA
gtgctcagaatagagcagaagtagcttt

SEQ ID NO: 32179 - DNA, 19 bp, synthetic construct
  misc_feature 1..19: note = Synthetic Construct
  source 1..19: mol_type = other DNA
tgcgaagcagcgagcacat

SEQ ID NO: 32180 - DNA, 24 bp, synthetic construct
  misc_feature 1..24: note = Synthetic Construct
  source 1..24: mol_type = other DNA
cacaaaagcagccatcagagacaa

SEQ ID NO: 32181 - DNA, 22 bp, synthetic construct
  misc_feature 1..22: note = Synthetic Construct
  source 1..22: mol_type = other DNA
ccggccctgggtttacttctta

SEQ ID NO: 32182 - DNA, 22 bp, synthetic construct
  misc_feature 1..22: note = Synthetic Construct
  source 1..22: mol_type = other DNA
gggcttggcagtcccaaataca

SEQ ID NO: 32183 - DNA, 22 bp, synthetic construct
  misc_feature 1..22: note = Synthetic Construct
  source 1..22: mol_type = other DNA
ctgacaaagggtgccagcttct

SEQ ID NO: 32184 - DNA, 25 bp, synthetic construct
  misc_feature 1..25: note = Synthetic Construct
  source 1..25: mol_type = other DNA
cactaagatggataaggcggaatgt

SEQ ID NO: 32185 - DNA, 23 bp, synthetic construct
  misc_feature 1..23: note = Synthetic Construct
  source 1..23: mol_type = other DNA
tggcccagagttccataaaacat

SEQ ID NO: 32186 - DNA, 27 bp, synthetic construct
  misc_feature 1..27: note = Synthetic Construct
  source 1..27: mol_type = other DNA
gcttatctgatttcccagcacacagaa

SEQ ID NO: 32187 - DNA, 20 bp, synthetic construct
  misc_feature 1..20: note = Synthetic Construct
  source 1..20: mol_type = other DNA
cagcgggtgagctttcgttt

SEQ ID NO: 32188 - DNA, 24 bp, synthetic construct
  misc_feature 1..24: note = Synthetic Construct
  source 1..24: mol_type = other DNA
cccctagaaactcccttctcttgt

SEQ ID NO: 32189 - DNA, 24 bp, synthetic construct
  misc_feature 1..24: note = Synthetic Construct
  source 1..24: mol_type = other DNA
cccggctgctctcactacaataga

SEQ ID NO: 32190 - DNA, 22 bp, synthetic construct
  misc_feature 1..22: note = Synthetic Construct
  source 1..22: mol_type = other DNA
ccatccccacagctctcttttc

SEQ ID NO: 32191 - DNA, 23 bp, synthetic construct
  misc_feature 1..23: note = Synthetic Construct
  source 1..23: mol_type = other DNA
tgagtccctgaggcataatcagt

SEQ ID NO: 32192 - DNA, 22 bp, synthetic construct
  misc_feature 1..22: note = Synthetic Construct
  source 1..22: mol_type = other DNA
cgacgggtcagtggactctaca

SEQ ID NO: 32193 - DNA, 22 bp, synthetic construct
  misc_feature 1..22: note = Synthetic Construct
  source 1..22: mol_type = other DNA
cctgggagcactccttgtcttt

SEQ ID NO: 32194 - DNA, 25 bp, synthetic construct
  misc_feature 1..25: note = Synthetic Construct
  source 1..25: mol_type = other DNA
aatgggaaataggcagacatacaca

SEQ ID NO: 32195 - DNA, 27 bp, synthetic construct
  misc_feature 1..27: note = Synthetic Construct
  source 1..27: mol_type = other DNA
tgttcctctctaagaaccttctagtct

SEQ ID NO: 32196 - DNA, 25 bp, synthetic construct
  misc_feature 1..25: note = Synthetic Construct
  source 1..25: mol_type = other DNA
ctttcctacaccctcattcagttgt

SEQ ID NO: 32197 - DNA, 23 bp, synthetic construct
  misc_feature 1..23: note = Synthetic Construct
  source 1..23: mol_type = other DNA
aagagcgtgagccttctgttatg

SEQ ID NO: 32198 - DNA, 27 bp, synthetic construct
  misc_feature 1..27: note = Synthetic Construct
  source 1..27: mol_type = other DNA
tgccattctttaatcccttggagttag

SEQ ID NO: 32199 - DNA, 20 bp, synthetic construct
  misc_feature 1..20: note = Synthetic Construct
  source 1..20: mol_type = other DNA
tctaggaggcccgtcacact

SEQ ID NO: 32200 - DNA, 25 bp, synthetic construct
  misc_feature 1..25: note = Synthetic Construct
  source 1..25: mol_type = other DNA
atgcagctcctatgtaattgctact

SEQ ID NO: 32201 - DNA, 23 bp, synthetic construct
  misc_feature 1..23: note = Synthetic Construct
  source 1..23: mol_type = other DNA
ttcctccactgggtggttaattg

SEQ ID NO: 32202 - DNA, 21 bp, synthetic construct
  misc_feature 1..21: note = Synthetic Construct
  source 1..21: mol_type = other DNA
gcggcagctagcgtattttga

SEQ ID NO: 32203 - DNA, 27 bp, synthetic construct
  misc_feature 1..27: note = Synthetic Construct
  source 1..27: mol_type = other DNA
gtggtatggtgtttgcattatgctgta

SEQ ID NO: 32204 - DNA, 20 bp, synthetic construct
  misc_feature 1..20: note = Synthetic Construct
  source 1..20: mol_type = other DNA
agcccagctcaggttcaact

SEQ ID NO: 32205 - DNA, 23 bp, synthetic construct
  misc_feature 1..23: note = Synthetic Construct
  source 1..23: mol_type = other DNA
tgggccataatgggacaaagatg

SEQ ID NO: 32206 - DNA, 25 bp, synthetic construct
  misc_feature 1..25: note = Synthetic Construct
  source 1..25: mol_type = other DNA
ggaggccaaaggagcttatggttac

SEQ ID NO: 32207 - DNA, 23 bp, synthetic construct
  misc_feature 1..23: note = Synthetic Construct
  source 1..23: mol_type = other DNA
caccatagtccacaaagcactct

SEQ ID NO: 32208 - DNA, 22 bp, synthetic construct
  misc_feature 1..22: note = Synthetic Construct
  source 1..22: mol_type = other DNA
gccttcgaacacagactgaaga

SEQ ID NO: 32209 - DNA, 25 bp, synthetic construct
  misc_feature 1..25: note = Synthetic Construct
  source 1..25: mol_type = other DNA
agagctcttttgcctaaacttgttc

SEQ ID NO: 32210 - DNA, 21 bp, synthetic construct
  misc_feature 1..21: note = Synthetic Construct
  source 1..21: mol_type = other DNA
ccagggcccttggatttttga

SEQ ID NO: 32211 - DNA, 27 bp, synthetic construct
  misc_feature 1..27: note = Synthetic Construct
  source 1..27: mol_type = other DNA
caagaggacgtaagtccaatgttaagt

SEQ ID NO: 32212 - DNA, 23 bp, synthetic construct
  misc_feature 1..23: note = Synthetic Construct
  source 1..23: mol_type = other DNA
gccttccctagccacccatctaa

SEQ ID NO: 32213 - DNA, 23 bp, synthetic construct
  misc_feature 1..23: note = Synthetic Construct
  source 1..23: mol_type = other DNA
tgttcggtaccgttgtcttttct

SEQ ID NO: 32214 - DNA, 25 bp, synthetic construct
  misc_feature 1..25: note = Synthetic Construct
  source 1..25: mol_type = other DNA
cagagatgcctcaatctcattgcat

SEQ ID NO: 32215 - DNA, 24 bp, synthetic construct
  misc_feature 1..24: note = Synthetic Construct
  source 1..24: mol_type = other DNA
ggtacaaagggcaaacgtgttcat

SEQ ID NO: 32216 - DNA, 25 bp, synthetic construct
  misc_feature 1..25: note = Synthetic Construct
  source 1..25: mol_type = other DNA
ggctcctgattcttaaacagagctt

SEQ ID NO: 32217 - DNA, 23 bp, synthetic construct
  misc_feature 1..23: note = Synthetic Construct
  source 1..23: mol_type = other DNA
ggtggctctgatgctccctaaag

SEQ ID NO: 32218 - DNA, 25 bp, synthetic construct
  misc_feature 1..25: note = Synthetic Construct
  source 1..25: mol_type = other DNA
aatgtgggaagggtctactttcaat

SEQ ID NO: 32219 - DNA, 28 bp, synthetic construct
  misc_feature 1..28: note = Synthetic Construct
  source 1..28: mol_type = other DNA
ctggttaggaatctgcaggaaaaacaac

SEQ ID NO: 32220 - DNA, 28 bp, synthetic construct
  misc_feature 1..28: note = Synthetic Construct
  source 1..28: mol_type = other DNA
cgtatagtcttccatgccatcttcacta

SEQ ID NO: 32221 - DNA, 22 bp, synthetic construct
  misc_feature 1..22: note = Synthetic Construct
  source 1..22: mol_type = other DNA
tctcaggctcagggagagtcat

SEQ ID NO: 32222 - DNA, 24 bp, synthetic construct
  misc_feature 1..24: note = Synthetic Construct
  source 1..24: mol_type = other DNA
agagtaagcactttgccataggtt

SEQ ID NO: 32223 - DNA, 26 bp, synthetic construct
  misc_feature 1..26: note = Synthetic Construct
  source 1..26: mol_type = other DNA
cagggttcaggatgaattctacaaca

SEQ ID NO: 32224 - DNA, 26 bp, synthetic construct
  misc_feature 1..26: note = Synthetic Construct
  source 1..26: mol_type = other DNA
gcagcagcactaagaatcacaacttt

SEQ ID NO: 32225 - DNA, 20 bp, synthetic construct
  misc_feature 1..20: note = Synthetic Construct
  source 1..20: mol_type = other DNA
tggccccagaggcatctaaa

SEQ ID NO: 32226 - DNA, 23 bp, synthetic construct
  misc_feature 1..23: note = Synthetic Construct
  source 1..23: mol_type = other DNA
cacaggaagtcacctgcaaggaa

SEQ ID NO: 32227 - DNA, 22 bp, synthetic construct
  misc_feature 1..22: note = Synthetic Construct
  source 1..22: mol_type = other DNA
tggctgtttagggtgctttcaa

SEQ ID NO: 32228 - DNA, 28 bp, synthetic construct
  misc_feature 1..28: note = Synthetic Construct
  source 1..28: mol_type = other DNA
ctcatcatacgagctcaagagaacaaga

SEQ ID NO: 32229 - DNA, 22 bp, synthetic construct
  misc_feature 1..22: note = Synthetic Construct
  source 1..22: mol_type = other DNA
gttggagaaggcagtgaagtct

SEQ ID NO: 32230 - DNA, 28 bp, synthetic construct
  misc_feature 1..28: note = Synthetic Construct
  source 1..28: mol_type = other DNA
cgagtagtctggccaaaattacatctct

SEQ ID NO: 32231 - DNA, 22 bp, synthetic construct
  misc_feature 1..22: note = Synthetic Construct
  source 1..22: mol_type = other DNA
ccatcaaccttccttccacaca

SEQ ID NO: 32232 - DNA, 20 bp, synthetic construct
  misc_feature 1..20: note = Synthetic Construct
  source 1..20: mol_type = other DNA
ccgctgacctcaaagcaaca

SEQ ID NO: 32233 - DNA, 21 bp, synthetic construct
  misc_feature 1..21: note = Synthetic Construct
  source 1..21: mol_type = other DNA
ccccattccacggacagaatc

SEQ ID NO: 32234 - DNA, 29 bp, synthetic construct
  misc_feature 1..29: note = Synthetic Construct
  source 1..29: mol_type = other DNA
gctctagataatctgatgacacggtgatg

SEQ ID NO: 32235 - DNA, 19 bp, synthetic construct
  misc_feature 1..19: note = Synthetic Construct
  source 1..19: mol_type = other DNA
gccactggacctggcacaa

SEQ ID NO: 32236 - DNA, 24 bp, synthetic construct
  misc_feature 1..24: note = Synthetic Construct
  source 1..24: mol_type = other DNA
tgattgacatccttttccctgtga

SEQ ID NO: 32237 - DNA, 23 bp, synthetic construct
  misc_feature 1..23: note = Synthetic Construct
  source 1..23: mol_type = other DNA
ctccagcacctacactaccctaa

SEQ ID NO: 32238 - DNA, 22 bp, synthetic construct
  misc_feature 1..22: note = Synthetic Construct
  source 1..22: mol_type = other DNA
ccccagaaggcagcaagtcaat

SEQ ID NO: 32239 - DNA, 24 bp, synthetic construct
  misc_feature 1..24: note = Synthetic Construct
  source 1..24: mol_type = other DNA
gctttgtcacagctgttttaggaa

SEQ ID NO: 32240 - DNA, 25 bp, synthetic construct
  misc_feature 1..25: note = Synthetic Construct
  source 1..25: mol_type = other DNA
gggtctctcaggtgtgttcagtaga

SEQ ID NO: 32241 - DNA, 24 bp, synthetic construct
  misc_feature 1..24: note = Synthetic Construct
  source 1..24: mol_type = other DNA
gcaggcctaggactatttctctga

SEQ ID NO: 32242 - DNA, 24 bp, synthetic construct
  misc_feature 1..24: note = Synthetic Construct
  source 1..24: mol_type = other DNA
gagagtgagcaaggagagtgttta

SEQ ID NO: 32243 - DNA, 26 bp, synthetic construct
  misc_feature 1..26: note = Synthetic Construct
  source 1..26: mol_type = other DNA
ctgacagaatattggagtgggtgatg

SEQ ID NO: 32244 - DNA, 25 bp, synthetic construct
  misc_feature 1..25: note = Synthetic Construct
  source 1..25: mol_type = other DNA
tgagaccagaggtctgtatgtatga

SEQ ID NO: 32245 - DNA, 23 bp, synthetic construct
  misc_feature 1..23: note = Synthetic Construct
  source 1..23: mol_type = other DNA
gaccaagtgtgcttgtagctcat

SEQ ID NO: 32246 - DNA, 22 bp, synthetic construct
  misc_feature 1..22: note = Synthetic Construct
  source 1..22: mol_type = other DNA
ctctgtgtccacctgctacact

SEQ ID NO: 32247 - DNA, 19 bp, synthetic construct
  misc_feature 1..19: note = Synthetic Construct
  source 1..19: mol_type = other DNA
ggcatccatgccaccttct

SEQ ID NO: 32248 - DNA, 22 bp, synthetic construct
  misc_feature 1..22: note = Synthetic Construct
  source 1..22: mol_type = other DNA
ggtaggtcccagtcttcaccat

SEQ ID NO: 32249 - DNA, 20 bp, synthetic construct
  misc_feature 1..20: note = Synthetic Construct
  source 1..20: mol_type = other DNA
ggaggacagtggcatgaaca

SEQ ID NO: 32250 - DNA, 26 bp, synthetic construct
  misc_feature 1..26: note = Synthetic Construct
  source 1..26: mol_type = other DNA
gcagaacagatgcctcattttgctta

SEQ ID NO: 32251 - DNA, 25 bp, synthetic construct
  misc_feature 1..25: note = Synthetic Construct
  source 1..25: mol_type = other DNA
gtgtgtgccatttgtgtttgaaaag

SEQ ID NO: 32252 - DNA, 23 bp, synthetic construct
  misc_feature 1..23: note = Synthetic Construct
  source 1..23: mol_type = other DNA
gctccacaatgggtgttgcatgt

SEQ ID NO: 32253 - DNA, 23 bp, synthetic construct
  misc_feature 1..23: note = Synthetic Construct
  source 1..23: mol_type = other DNA
gctgtgctccttgaagtggcatt

SEQ ID NO: 32254 - DNA, 23 bp, synthetic construct
  misc_feature 1..23: note = Synthetic Construct
  source 1..23: mol_type = other DNA
ggaaaatgagggcattccaggta

SEQ ID NO: 32255 - DNA, 19 bp, synthetic construct
  misc_feature 1..19: note = Synthetic Construct
  source 1..19: mol_type = other DNA
gccccgtggcttctgttct

SEQ ID NO: 32256 - DNA, 26 bp, synthetic construct
  misc_feature 1..26: note = Synthetic Construct
  source 1..26: mol_type = other DNA
gctgtgatcctctcaatgctgtaact

SEQ ID NO: 32257 - DNA, 26 bp, synthetic construct
  misc_feature 1..26: note = Synthetic Construct
  source 1..26: mol_type = other DNA
gggacgtaaactagagaaggcaccat

SEQ ID NO: 32258 - DNA, 22 bp, synthetic construct
  misc_feature 1..22: note = Synthetic Construct
  source 1..22: mol_type = other DNA
agggatggagaggggaaagcat

SEQ ID NO: 32259 - DNA, 26 bp, synthetic construct
  misc_feature 1..26: note = Synthetic Construct
  source 1..26: mol_type = other DNA
ggtcatcacagttggtatgacactct

SEQ ID NO: 32260 - DNA, 19 bp, synthetic construct
  misc_feature 1..19: note = Synthetic Construct
  source 1..19: mol_type = other DNA
agagctctgctggcacctt

SEQ ID NO: 32261 - DNA, 22 bp, synthetic construct
  misc_feature 1..22: note = Synthetic Construct
  source 1..22: mol_type = other DNA
ctcatcttcctcctggccctta

SEQ ID NO: 32262 - DNA, 20 bp, synthetic construct
  misc_feature 1..20: note = Synthetic Construct
  source 1..20: mol_type = other DNA
agggccaccctctcactatg

SEQ ID NO: 32263 - DNA, 23 bp, synthetic construct
  misc_feature 1..23: note = Synthetic Construct
  source 1..23: mol_type = other DNA
gataaggccgccattttctgaac

SEQ ID NO: 32264 - DNA, 24 bp, synthetic construct
  misc_feature 1..24: note = Synthetic Construct
  source 1..24: mol_type = other DNA
agctgcttgggatgattatgttga

SEQ ID NO: 32265 - DNA, 23 bp, synthetic construct
  misc_feature 1..23: note = Synthetic Construct
  source 1..23: mol_type = other DNA
catgaggcaggacttggaaaaca

SEQ ID NO: 32266 - DNA, 23 bp, synthetic construct
  misc_feature 1..23: note = Synthetic Construct
  source 1..23: mol_type = other DNA
actttgaggcccaataaccatgt

SEQ ID NO: 32267 - DNA, 20 bp, synthetic construct
  misc_feature 1..20: note = Synthetic Construct
  source 1..20: mol_type = other DNA
gcgtgccatttgcagtctgt

SEQ ID NO: 32268 - DNA, 23 bp, synthetic construct
  misc_feature 1..23: note = Synthetic Construct
  source 1..23: mol_type = other DNA
acaaacctagacagcccttgttc

SEQ ID NO: 32269 - DNA, 25 bp, synthetic construct
  misc_feature 1..25: note = Synthetic Construct
  source 1..25: mol_type = other DNA
gggtacagaagcttcaatcacatca

SEQ ID NO: 32270 - DNA, 25 bp, synthetic construct
  misc_feature 1..25: note = Synthetic Construct
  source 1..25: mol_type = other DNA
accagcctcagatttgtcttttact

SEQ ID NO: 32271 - DNA, 19 bp, synthetic construct
  misc_feature 1..19: note = Synthetic Construct
  source 1..19: mol_type = other DNA
tggggtggtctgtgcagtt

SEQ ID NO: 32272 - DNA, 25 bp, synthetic construct
  misc_feature 1..25: note = Synthetic Construct
  source 1..25: mol_type = other DNA
ctgtaacagtgtctggtagcaaatg

SEQ ID NO: 32273 - DNA, 25 bp, synthetic construct
  misc_feature 1..25: note = Synthetic Construct
  source 1..25: mol_type = other DNA
gatggagtcctgtgaagatggtaac

SEQ ID NO: 32274 - DNA, 25 bp, synthetic construct
  misc_feature 1..25: note = Synthetic Construct
  source 1..25: mol_type = other DNA
cactaattggtgccattatgcatct

SEQ ID NO: 32275 - DNA, 24 bp, synthetic construct
  misc_feature 1..24: note = Synthetic Construct
  source 1..24: mol_type = other DNA
tgagtacacctaatggcaggtttt

SEQ ID NO: 32276 - DNA, 19 bp, synthetic construct
  misc_feature 1..19: note = Synthetic Construct
  source 1..19: mol_type = other DNA
caccatgcagcaccagtga

SEQ ID NO: 32277 - DNA, 21 bp, synthetic construct
  misc_feature 1..21: note = Synthetic Construct
  source 1..21: mol_type = other DNA
ccctgaggaggggttgattgt

SEQ ID NO: 32278 - DNA, 20 bp, synthetic construct
  misc_feature 1..20: note = Synthetic Construct
  source 1..20: mol_type = other DNA
gtgtctgcaggtgtggttgt

SEQ ID NO: 32279 - DNA, 25 bp, synthetic construct
  misc_feature 1..25: note = Synthetic Construct
  source 1..25: mol_type = other DNA
acgagactcatccttatccctagaa

SEQ ID NO: 32280 - DNA, 22 bp, synthetic construct
  misc_feature 1..22: note = Synthetic Construct
  source 1..22: mol_type = other DNA
tccaaattggccttccacaaca

SEQ ID NO: 32281 - DNA, 20 bp, synthetic construct
  misc_feature 1..20: note = Synthetic Construct
  source 1..20: mol_type = other DNA
agatcgggctccagcttcta

SEQ ID NO: 32282 - DNA, 22 bp, synthetic construct
  misc_feature 1..22: note = Synthetic Construct
  source 1..22: mol_type = other DNA
agagtgactacctccccagcaa

SEQ ID NO: 32283 - DNA, 23 bp, synthetic construct
  misc_feature 1..23: note = Synthetic Construct
  source 1..23: mol_type = other DNA
tgcaataggctgagtccacaatg

SEQ ID NO: 32284 - DNA, 21 bp, synthetic construct
  misc_feature 1..21: note = Synthetic Construct
  source 1..21: mol_type = other DNA
gcagtcgcttctccaccatgt

SEQ ID NO: 32285 - DNA, 28 bp, synthetic construct
  misc_feature 1..28: note = Synthetic Construct
  source 1..28: mol_type = other DNA
gctcagtctaaaacaatagcctcccata

SEQ ID NO: 32286 - DNA, 23 bp, synthetic construct
  misc_feature 1..23: note = Synthetic Construct
  source 1..23: mol_type = other DNA
gctacaagccactgttacgtttc

SEQ ID NO: 32287 - DNA, 25 bp, synthetic construct
  misc_feature 1..25: note = Synthetic Construct
  source 1..25: mol_type = other DNA
actgaaggaatgtggtcatgaaaga

SEQ ID NO: 32288 - DNA, 22 bp, synthetic construct
  misc_feature 1..22: note = Synthetic Construct
  source 1..22: mol_type = other DNA
agggtgggagtgcaacactaac

SEQ ID NO: 32289 - DNA, 20 bp, synthetic construct
  misc_feature 1..20: note = Synthetic Construct
  source 1..20: mol_type = other DNA
gcagccaagcaggctattca

SEQ ID NO: 32290 - DNA, 23 bp, synthetic construct
  misc_feature 1..23: note = Synthetic Construct
  source 1..23: mol_type = other DNA
ggcccttttcctctgagtcacta

SEQ ID NO: 32291 - DNA, 22 bp, synthetic construct
  misc_feature 1..22: note = Synthetic Construct
  source 1..22: mol_type = other DNA
gcacatgctctttgcaggacaa

SEQ ID NO: 32292 - DNA, 24 bp, synthetic construct
  misc_feature 1..24: note = Synthetic Construct
  source 1..24: mol_type = other DNA
cactgaggtaataaccagcagaca

SEQ ID NO: 32293 - DNA, 23 bp, synthetic construct
  misc_feature 1..23: note = Synthetic Construct
  source 1..23: mol_type = other DNA
tcaggaggggagtggtggagtat

SEQ ID NO: 32294 - DNA, 24 bp, synthetic construct
  misc_feature 1..24: note = Synthetic Construct
  source 1..24: mol_type = other DNA
ttttctgctgctcataggggatag

SEQ ID NO: 32295 - DNA, 20 bp, synthetic construct
  misc_feature 1..20: note = Synthetic Construct
  source 1..20: mol_type = other DNA
aagccctccctctccagcaa

SEQ ID NO: 32296 - DNA, 26 bp, synthetic construct
  misc_feature 1..26: note = Synthetic Construct
  source 1..26: mol_type = other DNA
ccatccttctttcaaagtggcagata

SEQ ID NO: 32297 - DNA, 27 bp, synthetic construct
  misc_feature 1..27: note = Synthetic Construct
  source 1..27: mol_type = other DNA
gtcttgctcttactaccttgttgaact

SEQ ID NO: 32298 - DNA, 25 bp, synthetic construct
  misc_feature 1..25: note = Synthetic Construct
  source 1..25: mol_type = other DNA
agccctagattagtgctgaaaatga

SEQ ID NO: 32299 - DNA, 22 bp, synthetic construct
  misc_feature 1..22: note = Synthetic Construct
  source 1..22: mol_type = other DNA
agcagtgtggacagaggctaga

SEQ ID NO: 32300 - DNA, 28 bp, synthetic construct
  misc_feature 1..28: note = Synthetic Construct
  source 1..28: mol_type = other DNA
cagtgcttagtgttcacactggagttat

SEQ ID NO: 32301 - DNA, 25 bp, synthetic construct
  misc_feature 1..25: note = Synthetic Construct
  source 1..25: mol_type = other DNA
gtccctggaagcagctaatctaatg

SEQ ID NO: 32302 - DNA, 25 bp, synthetic construct
  misc_feature 1..25: note = Synthetic Construct
  source 1..25: mol_type = other DNA
ctcagccatacaaagtgactgtctt

SEQ ID NO: 32303 - DNA, 20 bp, synthetic construct
  misc_feature 1..20: note = Synthetic Construct
  source 1..20: mol_type = other DNA
gcccactgcacctctgtttg

SEQ ID NO: 32304 - DNA, 26 bp, synthetic construct
  misc_feature 1..26: note = Synthetic Construct
  source 1..26: mol_type = other DNA
gtgaggatttattgagaggcgattgt

SEQ ID NO: 32305 - DNA, 22 bp, synthetic construct
  misc_feature 1..22: note = Synthetic Construct
  source 1..22: mol_type = other DNA
gaccacgccacacttggtatga

SEQ ID NO: 32306 - DNA, 22 bp, synthetic construct
  misc_feature 1..22: note = Synthetic Construct
  source 1..22: mol_type = other DNA
gctcctgagaagcaaacacaca

SEQ ID NO: 32307 - DNA, 27 bp, synthetic construct
  misc_feature 1..27: note = Synthetic Construct
  source 1..27: mol_type = other DNA
ggaacaaaaatctgctgtctgcatttc

SEQ ID NO: 32308 - DNA, 27 bp, synthetic construct
  misc_feature 1..27: note = Synthetic Construct
  source 1..27: mol_type = other DNA
gccaaatagagaactaacaggcacact

SEQ ID NO: 32309 - DNA, 21 bp, synthetic construct
  misc_feature 1..21: note = Synthetic Construct
  source 1..21: mol_type = other DNA
ctcctgccctgagtctgaaac

SEQ ID NO: 32310 - DNA, 23 bp, synthetic construct
  misc_feature 1..23: note = Synthetic Construct
  source 1..23: mol_type = other DNA
tgtgccagactcaatgctaaagt

SEQ ID NO: 32311 - DNA, 20 bp, synthetic construct
  misc_feature 1..20: note = Synthetic Construct
  source 1..20: mol_type = other DNA
gcccatcacgcccttcagta

SEQ ID NO: 32312 - DNA, 22 bp, synthetic construct
  misc_feature 1..22: note = Synthetic Construct
  source 1..22: mol_type = other DNA
gagggaagccgtgttctgattg

SEQ ID NO: 32313 - DNA, 21 bp, synthetic construct
  misc_feature 1..21: note = Synthetic Construct
  source 1..21: mol_type = other DNA
gctgtccccttgtgaatgagt

SEQ ID NO: 32314 - DNA, 25 bp, synthetic construct
  misc_feature 1..25: note = Synthetic Construct
  source 1..25: mol_type = other DNA
acatgtacactgggtcagaatttgt

SEQ ID NO: 32315 - DNA, 24 bp, synthetic construct
  misc_feature 1..24: note = Synthetic Construct
  source 1..24: mol_type = other DNA
gctctccatgtttctgctgcttgt

SEQ ID NO: 32316 - DNA, 20 bp, synthetic construct
  misc_feature 1..20: note = Synthetic Construct
  source 1..20: mol_type = other DNA
ctggttcttgggccttccaa

SEQ ID NO: 32317 - DNA, 25 bp, synthetic construct
  misc_feature 1..25: note = Synthetic Construct
  source 1..25: mol_type = other DNA
ttcgtgggagagagaagttgataag

SEQ ID NO: 32318 - DNA, 22 bp, synthetic construct
  misc_feature 1..22: note = Synthetic Construct
  source 1..22: mol_type = other DNA
tggaacaatagccacagcagtt

SEQ ID NO: 32319 - DNA, 20 bp, synthetic construct
  misc_feature 1..20: note = Synthetic Construct
  source 1..20: mol_type = other DNA
ccagggccagagtagcaagt

SEQ ID NO: 32320 - DNA, 20 bp, synthetic construct
  misc_feature 1..20: note = Synthetic Construct
  source 1..20: mol_type = other DNA
gcccacacgccatgtaaaga

SEQ ID NO: 32321 - DNA, 24 bp, synthetic construct
  misc_feature 1..24: note = Synthetic Construct
  source 1..24: mol_type = other DNA
gtgtcccagaaaggaaatgagaca

SEQ ID NO: 32322 - DNA, 24 bp, synthetic construct
  misc_feature 1..24: note = Synthetic Construct
  source 1..24: mol_type = other DNA
ggcacctgtcagatagggttggat

SEQ ID NO: 32323 - DNA, 24 bp, synthetic construct
  misc_feature 1..24: note = Synthetic Construct
  source 1..24: mol_type = other DNA
ctggagtgaccctttggtgactta

SEQ ID NO: 32324 - DNA, 27 bp, synthetic construct
  misc_feature 1..27: note = Synthetic Construct
  source 1..27: mol_type = other DNA
ggtcatgatgcatgggactaacaggta

SEQ ID NO: 32325 - DNA, 24 bp, synthetic construct
  misc_feature 1..24: note = Synthetic Construct
  source 1..24: mol_type = other DNA
agtgacagggatcctttttcatgt

SEQ ID NO: 32326 - DNA, 24 bp, synthetic construct
  misc_feature 1..24: note = Synthetic Construct
  source 1..24: mol_type = other DNA
ctggttgtggggaactatgtctca

SEQ ID NO: 32327 - DNA, 23 bp, synthetic construct
  misc_feature 1..23: note = Synthetic Construct
  source 1..23: mol_type = other DNA
gtgttccatgccagacagacatc

SEQ ID NO: 32328 - DNA, 20 bp, synthetic construct
  misc_feature 1..20: note = Synthetic Construct
  source 1..20: mol_type = other DNA
tctgggctccacactccaaa

SEQ ID NO: 32329 - DNA, 22 bp, synthetic construct
  misc_feature 1..22: note = Synthetic Construct
  source 1..22: mol_type = other DNA
cagtttatcctgccagcccata

SEQ ID NO: 32330 - DNA, 27 bp, synthetic construct
  misc_feature 1..27: note = Synthetic Construct
  source 1..27: mol_type = other DNA
gcctgcaaattaattatgggtcagcat

SEQ ID NO: 32331 - DNA, 25 bp, synthetic construct
  misc_feature 1..25: note = Synthetic Construct
  source 1..25: mol_type = other DNA
ccgtagcctacagagtgttgtcatc

SEQ ID NO: 32332 - DNA, 22 bp, synthetic construct
  misc_feature 1..22: note = Synthetic Construct
  source 1..22: mol_type = other DNA
tgacaaaccaagcacgttcagt

SEQ ID NO: 32333 - DNA, 22 bp, synthetic construct
  misc_feature 1..22: note = Synthetic Construct
  source 1..22: mol_type = other DNA
ggggaagggaggtgagttaaag

SEQ ID NO: 32334 - DNA, 24 bp, synthetic construct
  misc_feature 1..24: note = Synthetic Construct
  source 1..24: mol_type = other DNA
cctaggattatgctgccaacaact

SEQ ID NO: 32335 - DNA, 23 bp, synthetic construct
  misc_feature 1..23: note = Synthetic Construct
  source 1..23: mol_type = other DNA
cccctgcttgtctgagttcatgt

SEQ ID NO: 32336 - DNA, 23 bp, synthetic construct
  misc_feature 1..23: note = Synthetic Construct
  source 1..23: mol_type = other DNA
cgtcaatgccagaaggctagaag

SEQ ID NO: 32337 - DNA, 20 bp, synthetic construct
  misc_feature 1..20: note = Synthetic Construct
  source 1..20: mol_type = other DNA
catggctggcacctttctgt

SEQ ID NO: 32338 - DNA, 22 bp, synthetic construct
  misc_feature 1..22: note = Synthetic Construct
  source 1..22: mol_type = other DNA
cggcagtgtgaaaatggactga

SEQ ID NO: 32339 - DNA, 19 bp, synthetic construct
  misc_feature 1..19: note = Synthetic Construct
  source 1..19: mol_type = other DNA
gccagcctggaccacatca

SEQ ID NO: 32340 - DNA, 27 bp, synthetic construct
  misc_feature 1..27: note = Synthetic Construct
  source 1..27: mol_type = other DNA
ggatgggttttgagagcactaattttg

SEQ ID NO: 32341 - DNA, 20 bp, synthetic construct
  misc_feature 1..20: note = Synthetic Construct
  source 1..20: mol_type = other DNA
cccaggcacaggcagaattg

SEQ ID NO: 32342 - DNA, 24 bp, synthetic construct
  misc_feature 1..24: note = Synthetic Construct
  source 1..24: mol_type = other DNA
agtcttgtaacggacagacctcta

SEQ ID NO: 32343 - DNA, 22 bp, synthetic construct
  misc_feature 1..22: note = Synthetic Construct
  source 1..22: mol_type = other DNA
ctcctgtttcagccccttctac

SEQ ID NO: 32344 - DNA, 22 bp, synthetic construct
  misc_feature 1..22: note = Synthetic Construct
  source 1..22: mol_type = other DNA
ggtgaaccgtaggcaactgaac

SEQ ID NO: 32345 - DNA, 25 bp, synthetic construct
  misc_feature 1..25: note = Synthetic Construct
  source 1..25: mol_type = other DNA
gctaattttaaaagccagccgaact

SEQ ID NO: 32346 - DNA, 27 bp, synthetic construct
  misc_feature 1..27: note = Synthetic Construct
  source 1..27: mol_type = other DNA
ggaaggaaaaacttctccctgaggtat

SEQ ID NO: 32347 - DNA, 22 bp, synthetic construct
  misc_feature 1..22: note = Synthetic Construct
  source 1..22: mol_type = other DNA
ggttcggtctggggagagattg

SEQ ID NO: 32348 - DNA, 25 bp, synthetic construct
  misc_feature 1..25: note = Synthetic Construct
  source 1..25: mol_type = other DNA
cggtggcccagaggaatgaaatagt

SEQ ID NO: 32349 - DNA, 29 bp, synthetic construct
  misc_feature 1..29: note = Synthetic Construct
  source 1..29: mol_type = other DNA
ggtgttagaaagagttcaaggcacttttg

SEQ ID NO: 32350 - DNA, 22 bp, synthetic construct
  misc_feature 1..22: note = Synthetic Construct
  source 1..22: mol_type = other DNA
cctcttgagctgggtcttggaa

SEQ ID NO: 32351 - DNA, 23 bp, synthetic construct
  misc_feature 1..23: note = Synthetic Construct
  source 1..23: mol_type = other DNA
gcacgtgcttactctctgtgctt

SEQ ID NO: 32352 - DNA, 22 bp, synthetic construct
  misc_feature 1..22: note = Synthetic Construct
  source 1..22: mol_type = other DNA
tccccggggtgtcatttcttga

SEQ ID NO: 32353 - DNA, 24 bp, synthetic construct
  misc_feature 1..24: note = Synthetic Construct
  source 1..24: mol_type = other DNA
ctcctttcctggtcccaattctgt

SEQ ID NO: 32354 - DNA, 23 bp, synthetic construct
  misc_feature 1..23: note = Synthetic Construct
  source 1..23: mol_type = other DNA
gcctccatagcagtctgtgaatc

SEQ ID NO: 32355 - DNA, 25 bp, synthetic construct
  misc_feature 1..25: note = Synthetic Construct
  source 1..25: mol_type = other DNA
ctccaatgcaggacaggaaaacatc

SEQ ID NO: 32356 - DNA, 23 bp, synthetic construct
  misc_feature 1..23: note = Synthetic Construct
  source 1..23: mol_type = other DNA
caacatatggcatgcctgagaac

SEQ ID NO: 32357 - DNA, 25 bp, synthetic construct
  misc_feature 1..25: note = Synthetic Construct
  source 1..25: mol_type = other DNA
cgtgtgtcagcaacttaacactttg

SEQ ID NO: 32358 - DNA, 26 bp, synthetic construct
  misc_feature 1..26: note = Synthetic Construct
  source 1..26: mol_type = other DNA
ctgttgacaaatactctctccaccta

SEQ ID NO: 32359 - DNA, 25 bp, synthetic construct
  misc_feature 1..25: note = Synthetic Construct
  source 1..25: mol_type = other DNA
actgagaaccagttgatgagagagt

SEQ ID NO: 32360 - DNA, 23 bp, synthetic construct
  misc_feature 1..23: note = Synthetic Construct
  source 1..23: mol_type = other DNA
gggaagaaccagaatcactggaa

SEQ ID NO: 32361 - DNA, 18 bp, synthetic construct
  misc_feature 1..18: note = Synthetic Construct
  source 1..18: mol_type = other DNA
tggggcgatagcgagtct

SEQ ID NO: 32362 - DNA, 23 bp, synthetic construct
  misc_feature 1..23: note = Synthetic Construct
  source 1..23: mol_type = other DNA
gctggtgtattccctggacagaa

SEQ ID NO: 32363 - DNA, 21 bp, synthetic construct
  misc_feature 1..21: note = Synthetic Construct
  source 1..21: mol_type = other DNA
gcgggtagtggtggtgttttc

SEQ ID NO: 32364 - DNA, 22 bp, synthetic construct
  misc_feature 1..22: note = Synthetic Construct
  source 1..22: mol_type = other DNA
cagcactgagaaacccgctctt

SEQ ID NO: 32365 - DNA, 23 bp, synthetic construct
  misc_feature 1..23: note = Synthetic Construct
  source 1..23: mol_type = other DNA
gcaccacacatggagaggagaag

SEQ ID NO: 32366 - DNA, 23 bp, synthetic construct
  misc_feature 1..23: note = Synthetic Construct
  source 1..23: mol_type = other DNA
gtccagcctaaaggtttctctgt

SEQ ID NO: 32367 - DNA, 26 bp, synthetic construct
  misc_feature 1..26: note = Synthetic Construct
  source 1..26: mol_type = other DNA
ctgacaaccatctaactgggaacaca

SEQ ID NO: 32368 - DNA, 21 bp, synthetic construct
  misc_feature 1..21: note = Synthetic Construct
  source 1..21: mol_type = other DNA
ggccatgcaggctgacagatt

SEQ ID NO: 32369 - DNA, 26 bp, synthetic construct
  misc_feature 1..26: note = Synthetic Construct
  source 1..26: mol_type = other DNA
gtacccatttgtgagtgtgaatgaag

SEQ ID NO: 32370 - DNA, 22 bp, synthetic construct
  misc_feature 1..22: note = Synthetic Construct
  source 1..22: mol_type = other DNA
caggaaccagaatagcggtgat

SEQ ID NO: 32371 - DNA, 22 bp, synthetic construct
  misc_feature 1..22: note = Synthetic Construct
  source 1..22: mol_type = other DNA
ccatggatggtgtggacaatga

SEQ ID NO: 32372 - DNA, 30 bp, synthetic construct
  misc_feature 1..30: note = Synthetic Construct
  source 1..30: mol_type = other DNA
cagctcatacagatacgtggttatatcttg

SEQ ID NO: 32373 - DNA, 22 bp, synthetic construct
  misc_feature 1..22: note = Synthetic Construct
  source 1..22: mol_type = other DNA
agacatagggtgtgacgtgtct

SEQ ID NO: 32374 - DNA, 22 bp, synthetic construct
  misc_feature 1..22: note = Synthetic Construct
  source 1..22: mol_type = other DNA
tcagtgaggtggtgatggaaga

SEQ ID NO: 32375 - DNA, 22 bp, synthetic construct
  misc_feature 1..22: note = Synthetic Construct
  source 1..22: mol_type = other DNA
tgtgctctcacttgtcaccatt

SEQ ID NO: 32376 - DNA, 19 bp, synthetic construct
  misc_feature 1..19: note = Synthetic Construct
  source 1..19: mol_type = other DNA
ccaggtggagccacacgaa

SEQ ID NO: 32377 - DNA, 22 bp, synthetic construct
  misc_feature 1..22: note = Synthetic Construct
  source 1..22: mol_type = other DNA
tctcctgtgctgtttcctttgt

SEQ ID NO: 32378 - DNA, 26 bp, synthetic construct
  misc_feature 1..26: note = Synthetic Construct
  source 1..26: mol_type = other DNA
ccagtgaaatttttctgcctccaaga

SEQ ID NO: 32379 - DNA, 29 bp, synthetic construct
  misc_feature 1..29: note = Synthetic Construct
  source 1..29: mol_type = other DNA
gactgggtacagatgtgatattggaagaa

SEQ ID NO: 32380 - DNA, 19 bp, synthetic construct
  misc_feature 1..19: note = Synthetic Construct
  source 1..19: mol_type = other DNA
agcggggaagctccagtca

SEQ ID NO: 32381 - DNA, 21 bp, synthetic construct
  misc_feature 1..21: note = Synthetic Construct
  source 1..21: mol_type = other DNA
gccccttgggcttcagtatgt

SEQ ID NO: 32382 - DNA, 21 bp, synthetic construct
  misc_feature 1..21: note = Synthetic Construct
  source 1..21: mol_type = other DNA
gctgagctcccaaccatgtga

SEQ ID NO: 32383 - DNA, 22 bp, synthetic construct
  misc_feature 1..22: note = Synthetic Construct
  source 1..22: mol_type = other DNA
tctgaaacctgtcaggggactt

SEQ ID NO: 32384 - DNA, 24 bp, synthetic construct
  misc_feature 1..24: note = Synthetic Construct
  source 1..24: mol_type = other DNA
gacagggcagagtgaaaggtattc

SEQ ID NO: 32385 - DNA, 24 bp, synthetic construct
  misc_feature 1..24: note = Synthetic Construct
  source 1..24: mol_type = other DNA
tgccttttgctatatgagctggat

SEQ ID NO: 32386 - DNA, 30 bp, synthetic construct
  misc_feature 1..30: note = Synthetic Construct
  source 1..30: mol_type = other DNA
gcttaccaggtgtataataccttgagttct

SEQ ID NO: 32387 - DNA, 24 bp, synthetic construct
  misc_feature 1..24: note = Synthetic Construct
  source 1..24: mol_type = other DNA
gctaggcacgatgagtagtgactt

SEQ ID NO: 32388 - DNA, 22 bp, synthetic construct
  misc_feature 1..22: note = Synthetic Construct
  source 1..22: mol_type = other DNA
tcctttgctgtgagctgttgta

SEQ ID NO: 32389 - DNA, 30 bp, synthetic construct
  misc_feature 1..30: note = Synthetic Construct
  source 1..30: mol_type = other DNA
ggctgtcacaaattatatcccaatcccttt

SEQ ID NO: 32390 - DNA, 21 bp, synthetic construct
  misc_feature 1..21: note = Synthetic Construct
  source 1..21: mol_type = other DNA
gcatggaaagcagggctttag

SEQ ID NO: 32391 - DNA, 21 bp, synthetic construct
  misc_feature 1..21: note = Synthetic Construct
  source 1..21: mol_type = other DNA
agacaagtgacggaggtctca

SEQ ID NO: 32392 - DNA, 28 bp, synthetic construct
  misc_feature 1..28: note = Synthetic Construct
  source 1..28: mol_type = other DNA
caaatgtcttccctctatcctgatgttg

SEQ ID NO: 32393 - DNA, 24 bp, synthetic construct
  misc_feature 1..24: note = Synthetic Construct
  source 1..24: mol_type = other DNA
cctaggtagtcacagaggcagttc

SEQ ID NO: 32394 - DNA, 26 bp, synthetic construct
  misc_feature 1..26: note = Synthetic Construct
  source 1..26: mol_type = other DNA
cagtgagagaagggaaagagagctta

SEQ ID NO: 32395 - DNA, 23 bp, synthetic construct
  misc_feature 1..23: note = Synthetic Construct
  source 1..23: mol_type = other DNA
tctttgagctggaggctatgttg

SEQ ID NO: 32396 - DNA, 25 bp, synthetic construct
  misc_feature 1..25: note = Synthetic Construct
  source 1..25: mol_type = other DNA
acctcctctagctcatgaagaacaa

SEQ ID NO: 32397 - DNA, 23 bp, synthetic construct
  misc_feature 1..23: note = Synthetic Construct
  source 1..23: mol_type = other DNA
ggtgtactccagcaatggacaga

SEQ ID NO: 32398 - DNA, 27 bp, synthetic construct
  misc_feature 1..27: note = Synthetic Construct
  source 1..27: mol_type = other DNA
ggatgggtccatacttgtcattaggtt

SEQ ID NO: 32399 - DNA, 21 bp, synthetic construct
  misc_feature 1..21: note = Synthetic Construct
  source 1..21: mol_type = other DNA
cccatgtgcttctggtcttct

SEQ ID NO: 32400 - DNA, 23 bp, synthetic construct
  misc_feature 1..23: note = Synthetic Construct
  source 1..23: mol_type = other DNA
ggtgatcactgacggggtaaaac

SEQ ID NO: 32401 - DNA, 25 bp, synthetic construct
  misc_feature 1..25: note = Synthetic Construct
  source 1..25: mol_type = other DNA
ggaagatgaactgagggagctgcta

SEQ ID NO: 32402 - DNA, 19 bp, synthetic construct
  misc_feature 1..19: note = Synthetic Construct
  source 1..19: mol_type = other DNA
cgtggccagcgttccacat

SEQ ID NO: 32403 - DNA, 24 bp, synthetic construct
  misc_feature 1..24: note = Synthetic Construct
  source 1..24: mol_type = other DNA
acctcccatcattcagcagtttag

SEQ ID NO: 32404 - DNA, 26 bp, synthetic construct
  misc_feature 1..26: note = Synthetic Construct
  source 1..26: mol_type = other DNA
gtcctgagaataggccaatccaatta

SEQ ID NO: 32405 - DNA, 24 bp, synthetic construct
  misc_feature 1..24: note = Synthetic Construct
  source 1..24: mol_type = other DNA
acaatgtcccaccttctgatttgt

SEQ ID NO: 32406 - DNA, 22 bp, synthetic construct
  misc_feature 1..22: note = Synthetic Construct
  source 1..22: mol_type = other DNA
gggtaaacatgcccctggtcaa

SEQ ID NO: 32407 - DNA, 25 bp, synthetic construct
  misc_feature 1..25: note = Synthetic Construct
  source 1..25: mol_type = other DNA
aaaagaacaaagtggatgccagtag

SEQ ID NO: 32408 - DNA, 21 bp, synthetic construct
  misc_feature 1..21: note = Synthetic Construct
  source 1..21: mol_type = other DNA
aggcagaccctctgagcactt

SEQ ID NO: 32409 - DNA, 24 bp, synthetic construct
  misc_feature 1..24: note = Synthetic Construct
  source 1..24: mol_type = other DNA
acagtggtactcggaatttgttgt

SEQ ID NO: 32410 - DNA, 26 bp, synthetic construct
  misc_feature 1..26: note = Synthetic Construct
  source 1..26: mol_type = other DNA
aggatggctcaggttaatagagtagt

SEQ ID NO: 32411 - DNA, 21 bp, synthetic construct
  misc_feature 1..21: note = Synthetic Construct
  source 1..21: mol_type = other DNA
tcctggccattgctcttttgt

SEQ ID NO: 32412 - DNA, 27 bp, synthetic construct
  misc_feature 1..27: note = Synthetic Construct
  source 1..27: mol_type = other DNA
cccaactgagaaaggcttaccttctac

SEQ ID NO: 32413 - DNA, 23 bp, synthetic construct
  misc_feature 1..23: note = Synthetic Construct
  source 1..23: mol_type = other DNA
aaggaaggtgaggaaagggaaag

SEQ ID NO: 32414 - DNA, 27 bp, synthetic construct
  misc_feature 1..27: note = Synthetic Construct
  source 1..27: mol_type = other DNA
agataacgaggacagagcttatcttac

SEQ ID NO: 32415 - DNA, 25 bp, synthetic construct
  misc_feature 1..25: note = Synthetic Construct
  source 1..25: mol_type = other DNA
tctattgactctaggtgctgtccta

SEQ ID NO: 32416 - DNA, 22 bp, synthetic construct
  misc_feature 1..22: note = Synthetic Construct
  source 1..22: mol_type = other DNA
gtctccagtcagcctccaatgt

SEQ ID NO: 32417 - DNA, 22 bp, synthetic construct
  misc_feature 1..22: note = Synthetic Construct
  source 1..22: mol_type = other DNA
gggaatacaaccactgctctca

SEQ ID NO: 32418 - DNA, 25 bp, synthetic construct
  misc_feature 1..25: note = Synthetic Construct
  source 1..25: mol_type = other DNA
tgacctcagacagtttgcttttaac

SEQ ID NO: 32419 - DNA, 21 bp, synthetic construct
  misc_feature 1..21: note = Synthetic Construct
  source 1..21: mol_type = other DNA
agcgagaccctctgctcagta

SEQ ID NO: 32420 - DNA, 27 bp, synthetic construct
  misc_feature 1..27: note = Synthetic Construct
  source 1..27: mol_type = other DNA
aggatcctactggagatcaatcagaaa

SEQ ID NO: 32421 - DNA, 25 bp, synthetic construct
  misc_feature 1..25: note = Synthetic Construct
  source 1..25: mol_type = other DNA
cctcctttttgtctctgtcccatag

SEQ ID NO: 32422 - DNA, 22 bp, synthetic construct
  misc_feature 1..22: note = Synthetic Construct
  source 1..22: mol_type = other DNA
gctccacacaggttgaggagat

SEQ ID NO: 32423 - DNA, 24 bp, synthetic construct
  misc_feature 1..24: note = Synthetic Construct
  source 1..24: mol_type = other DNA
gtggctctgatccctgtcactaag

SEQ ID NO: 32424 - DNA, 23 bp, synthetic construct
  misc_feature 1..23: note = Synthetic Construct
  source 1..23: mol_type = other DNA
ctccttggcacctttgagctact

SEQ ID NO: 32425 - DNA, 26 bp, synthetic construct
  misc_feature 1..26: note = Synthetic Construct
  source 1..26: mol_type = other DNA
gaatttcaggctaagggaagatgtgt

SEQ ID NO: 32426 - DNA, 22 bp, synthetic construct
  misc_feature 1..22: note = Synthetic Construct
  source 1..22: mol_type = other DNA
caggtccctggtgtcttggttt

SEQ ID NO: 32427 - DNA, 21 bp, synthetic construct
  misc_feature 1..21: note = Synthetic Construct
  source 1..21: mol_type = other DNA
gccagaggtaggggtggaagt

SEQ ID NO: 32428 - DNA, 23 bp, synthetic construct
  misc_feature 1..23: note = Synthetic Construct
  source 1..23: mol_type = other DNA
cggattgacaaaacacgcagtga

SEQ ID NO: 32429 - DNA, 27 bp, synthetic construct
  misc_feature 1..27: note = Synthetic Construct
  source 1..27: mol_type = other DNA
ccataactttcttcaagcaccactttg

SEQ ID NO: 32430 - DNA, 23 bp, synthetic construct
  misc_feature 1..23: note = Synthetic Construct
  source 1..23: mol_type = other DNA
ggggcatgtgggactttagttct

SEQ ID NO: 32431 - DNA, 24 bp, synthetic construct
  misc_feature 1..24: note = Synthetic Construct
  source 1..24: mol_type = other DNA
ggcttcttgacctccatgggaatg

SEQ ID NO: 32432 - DNA, 25 bp, synthetic construct
  misc_feature 1..25: note = Synthetic Construct
  source 1..25: mol_type = other DNA
aatgatgtacctactgcactctgtt

SEQ ID NO: 32433 - DNA, 21 bp, synthetic construct
  misc_feature 1..21: note = Synthetic Construct
  source 1..21: mol_type = other DNA
acaggagccctgatagccata

SEQ ID NO: 32434 - DNA, 25 bp, synthetic construct
  misc_feature 1..25: note = Synthetic Construct
  source 1..25: mol_type = other DNA
aacctgtagctagtgctttatgtca

SEQ ID NO: 32435 - DNA, 23 bp, synthetic construct
  misc_feature 1..23: note = Synthetic Construct
  source 1..23: mol_type = other DNA
gttttgcaacaaagctccactct

SEQ ID NO: 32436 - DNA, 24 bp, synthetic construct
  misc_feature 1..24: note = Synthetic Construct
  source 1..24: mol_type = other DNA
tcaagttaaggagtggctttgagt

SEQ ID NO: 32437 - DNA, 23 bp, synthetic construct
  misc_feature 1..23: note = Synthetic Construct
  source 1..23: mol_type = other DNA
gagggaaagccctaagccaagat

SEQ ID NO: 32438 - DNA, 24 bp, synthetic construct
  misc_feature 1..24: note = Synthetic Construct
  source 1..24: mol_type = other DNA
cccctgagggtaagtggtacctaa

SEQ ID NO: 32439 - DNA, 22 bp, synthetic construct
  misc_feature 1..22: note = Synthetic Construct
  source 1..22: mol_type = other DNA
tgtccagcaggggactgagtat

SEQ ID NO: 32440 - DNA, 22 bp, synthetic construct
  misc_feature 1..22: note = Synthetic Construct
  source 1..22: mol_type = other DNA
aacacccttcaagcttcccaat

SEQ ID NO: 32441 - DNA, 22 bp, synthetic construct
  misc_feature 1..22: note = Synthetic Construct
  source 1..22: mol_type = other DNA
gcggtactgatgctgctctgtt

SEQ ID NO: 32442 - DNA, 19 bp, synthetic construct
  misc_feature 1..19: note = Synthetic Construct
  source 1..19: mol_type = other DNA
aagccggtggacgtgtctt

SEQ ID NO: 32443 - DNA, 21 bp, synthetic construct
  misc_feature 1..21: note = Synthetic Construct
  source 1..21: mol_type = other DNA
ccaagtgctggacccaaatct

SEQ ID NO: 32444 - DNA, 19 bp, synthetic construct
  misc_feature 1..19: note = Synthetic Construct
  source 1..19: mol_type = other DNA
tggcgggcataggtacaca

SEQ ID NO: 32445 - DNA, 25 bp, synthetic construct
  misc_feature 1..25: note = Synthetic Construct
  source 1..25: mol_type = other DNA
gcagctagcaggagtagaaaaattg

SEQ ID NO: 32446 - DNA, 25 bp, synthetic construct
  misc_feature 1..25: note = Synthetic Construct
  source 1..25: mol_type = other DNA
gggtgctgttcaataaagctgtgta

SEQ ID NO: 32447 - DNA, 28 bp, synthetic construct
  misc_feature 1..28: note = Synthetic Construct
  source 1..28: mol_type = other DNA
gctgtgattcaaattcagttgggtctgt

SEQ ID NO: 32448 - DNA, 23 bp, synthetic construct
  misc_feature 1..23: note = Synthetic Construct
  source 1..23: mol_type = other DNA
cccaggatggagaggggatgaat

SEQ ID NO: 32449 - DNA, 27 bp, synthetic construct
  misc_feature 1..27: note = Synthetic Construct
  source 1..27: mol_type = other DNA
ctttagatagtacctccaaaggctgat

SEQ ID NO: 32450 - DNA, 22 bp, synthetic construct
  misc_feature 1..22: note = Synthetic Construct
  source 1..22: mol_type = other DNA
ccccatagctcctggtgtcact

SEQ ID NO: 32451 - DNA, 23 bp, synthetic construct
  misc_feature 1..23: note = Synthetic Construct
  source 1..23: mol_type = other DNA
ctcaaagcatgcagcctagatga

SEQ ID NO: 32452 - DNA, 20 bp, synthetic construct
  misc_feature 1..20: note = Synthetic Construct
  source 1..20: mol_type = other DNA
ccctgctctccaaggtccta

SEQ ID NO: 32453 - DNA, 28 bp, synthetic construct
  misc_feature 1..28: note = Synthetic Construct
  source 1..28: mol_type = other DNA
gtctctgctaagaaagatggaacgatga

SEQ ID NO: 32454 - DNA, 20 bp, synthetic construct
  misc_feature 1..20: note = Synthetic Construct
  source 1..20: mol_type = other DNA
tcaggcccagagaggcatta

SEQ ID NO: 32455 - DNA, 27 bp, synthetic construct
  misc_feature 1..27: note = Synthetic Construct
  source 1..27: mol_type = other DNA
gcatttttctggagagcaagtctattg

SEQ ID NO: 32456 - DNA, 22 bp, synthetic construct
  misc_feature 1..22: note = Synthetic Construct
  source 1..22: mol_type = other DNA
ctctttagcaggcccagtttct

SEQ ID NO: 32457 - DNA, 25 bp, synthetic construct
  misc_feature 1..25: note = Synthetic Construct
  source 1..25: mol_type = other DNA
ctgagatgtgttagcgtcattgctt

SEQ ID NO: 32458 - DNA, 21 bp, synthetic construct
  misc_feature 1..21: note = Synthetic Construct
  source 1..21: mol_type = other DNA
ctgtcacttgtcagcgtggat

SEQ ID NO: 32459 - DNA, 25 bp, synthetic construct
  misc_feature 1..25: note = Synthetic Construct
  source 1..25: mol_type = other DNA
ctctttcctatcgaggtgggtttca

SEQ ID NO: 32460 - DNA, 23 bp, synthetic construct
  misc_feature 1..23: note = Synthetic Construct
  source 1..23: mol_type = other DNA
acacctggtcaggtcgtaatagt

SEQ ID NO: 32461 - DNA, 22 bp, synthetic construct
  misc_feature 1..22: note = Synthetic Construct
  source 1..22: mol_type = other DNA
caggggatctagaggcagcttt

SEQ ID NO: 32462 - DNA, 25 bp, synthetic construct
  misc_feature 1..25: note = Synthetic Construct
  source 1..25: mol_type = other DNA
ccttacaaggtgtgtctgtgcttct

SEQ ID NO: 32463 - DNA, 27 bp, synthetic construct
  misc_feature 1..27: note = Synthetic Construct
  source 1..27: mol_type = other DNA
gctttgttaagcacttgtctgttgaga

SEQ ID NO: 32464 - DNA, 25 bp, synthetic construct
  misc_feature 1..25: note = Synthetic Construct
  source 1..25: mol_type = other DNA
gtccaggataaggaggtggtggtat

SEQ ID NO: 32465 - DNA, 30 bp, synthetic construct
  misc_feature 1..30: note = Synthetic Construct
  source 1..30: mol_type = other DNA
cctgtcaattatgaaaactgggccttttgt

SEQ ID NO: 32466 - DNA, 28 bp, synthetic construct
  misc_feature 1..28: note = Synthetic Construct
  source 1..28: mol_type = other DNA
gaggtgaatgatgaggagatacagagat

SEQ ID NO: 32467 - DNA, 27 bp, synthetic construct
  misc_feature 1..27: note = Synthetic Construct
  source 1..27: mol_type = other DNA
gatgacaagggtacagaaagatcaact

SEQ ID NO: 32468 - DNA, 25 bp, synthetic construct
  misc_feature 1..25: note = Synthetic Construct
  source 1..25: mol_type = other DNA
acctgactgcactaactagactctt

SEQ ID NO: 32469 - DNA, 20 bp, synthetic construct
  misc_feature 1..20: note = Synthetic Construct
  source 1..20: mol_type = other DNA
ggggcagtgtacaggcaaat

SEQ ID NO: 32470 - DNA, 20 bp, synthetic construct
  misc_feature 1..20: note = Synthetic Construct
  source 1..20: mol_type = other DNA
ggccaggctgagtttcttct

SEQ ID NO: 32471 - DNA, 26 bp, synthetic construct
  misc_feature 1..26: note = Synthetic Construct
  source 1..26: mol_type = other DNA
gtgcagcacacagaaaatacatcact

SEQ ID NO: 32472 - DNA, 24 bp, synthetic construct
  misc_feature 1..24: note = Synthetic Construct
  source 1..24: mol_type = other DNA
ggctttgcaacctgctaattccta

SEQ ID NO: 32473 - DNA, 26 bp, synthetic construct
  misc_feature 1..26: note = Synthetic Construct
  source 1..26: mol_type = other DNA
cacgataatgccacttaggtatgatg

SEQ ID NO: 32474 - DNA, 22 bp, synthetic construct
  misc_feature 1..22: note = Synthetic Construct
  source 1..22: mol_type = other DNA
ccccacagcctagggtaatgaa

SEQ ID NO: 32475 - DNA, 28 bp, synthetic construct
  misc_feature 1..28: note = Synthetic Construct
  source 1..28: mol_type = other DNA
gtgccaaagaaatggctaggtaatgttg

SEQ ID NO: 32476 - DNA, 24 bp, synthetic construct
  misc_feature 1..24: note = Synthetic Construct
  source 1..24: mol_type = other DNA
gacatggtgaagtgcctcctaaca

SEQ ID NO: 32477 - DNA, 22 bp, synthetic construct
  misc_feature 1..22: note = Synthetic Construct
  source 1..22: mol_type = other DNA
actgattcatgtgccacccatt

SEQ ID NO: 32478 - DNA, 24 bp, synthetic construct
  misc_feature 1..24: note = Synthetic Construct
  source 1..24: mol_type = other DNA
tgctctgcacatttttcactctga

SEQ ID NO: 32479 - DNA, 23 bp, synthetic construct
  misc_feature 1..23: note = Synthetic Construct
  source 1..23: mol_type = other DNA
tggtgtagctgggaaaactgaag

SEQ ID NO: 32480 - DNA, 20 bp, synthetic construct
  misc_feature 1..20: note = Synthetic Construct
  source 1..20: mol_type = other DNA
tggtcaggcagtgtggaact

SEQ ID NO: 32481 - DNA, 22 bp, synthetic construct
  misc_feature 1..22: note = Synthetic Construct
  source 1..22: mol_type = other DNA
tcctcaggggagtgggttttga

SEQ ID NO: 32482 - DNA, 27 bp, synthetic construct
  misc_feature 1..27: note = Synthetic Construct
  source 1..27: mol_type = other DNA
gagtaatctgagagctcaaggagtcaa

SEQ ID NO: 32483 - DNA, 24 bp, synthetic construct
  misc_feature 1..24: note = Synthetic Construct
  source 1..24: mol_type = other DNA
ctgaagggtctgtgccttggtaag

SEQ ID NO: 32484 - DNA, 25 bp, synthetic construct
  misc_feature 1..25: note = Synthetic Construct
  source 1..25: mol_type = other DNA
tctctcatctcttgagtgtggaatg

SEQ ID NO: 32485 - DNA, 24 bp, synthetic construct
  misc_feature 1..24: note = Synthetic Construct
  source 1..24: mol_type = other DNA
ctgtgcaaccttcatgctcacaac

SEQ ID NO: 32486 - DNA, 21 bp, synthetic construct
  misc_feature 1..21: note = Synthetic Construct
  source 1..21: mol_type = other DNA
cggctcacccctagcttcttg

SEQ ID NO: 32487 - DNA, 21 bp, synthetic construct
  misc_feature 1..21: note = Synthetic Construct
  source 1..21: mol_type = other DNA
gctgacgggcagagttgttca

SEQ ID NO: 32488 - DNA, 21 bp, synthetic construct
  misc_feature 1..21: note = Synthetic Construct
  source 1..21: mol_type = other DNA
aggctggctcttggtctcaac

SEQ ID NO: 32489 - DNA, 25 bp, synthetic construct
  misc_feature 1..25: note = Synthetic Construct
  source 1..25: mol_type = other DNA
gcacagttagatttaaggcgtgaac

SEQ ID NO: 32490 - DNA, 24 bp, synthetic construct
  misc_feature 1..24: note = Synthetic Construct
  source 1..24: mol_type = other DNA
atgagcaaggagaggatttagcaa

SEQ ID NO: 32491 - DNA, 22 bp, synthetic construct
  misc_feature 1..22: note = Synthetic Construct
  source 1..22: mol_type = other DNA
cactgaagcagtcaggttggtt

SEQ ID NO: 32492 - DNA, 21 bp, synthetic construct
  misc_feature 1..21: note = Synthetic Construct
  source 1..21: mol_type = other DNA
tgtggacactgggacctctct

SEQ ID NO: 32493 - DNA, 22 bp, synthetic construct
  misc_feature 1..22: note = Synthetic Construct
  source 1..22: mol_type = other DNA
gacccatctgtgaaggatgcaa

SEQ ID NO: 32494 - DNA, 23 bp, synthetic construct
  misc_feature 1..23: note = Synthetic Construct
  source 1..23: mol_type = other DNA
ggatgcttgagggaaaactggat

SEQ ID NO: 32495 - DNA, 24 bp, synthetic construct
  misc_feature 1..24: note = Synthetic Construct
  source 1..24: mol_type = other DNA
tttcctgtgcttacttctgtgcta

SEQ ID NO: 32496 - DNA, 23 bp, synthetic construct
  misc_feature 1..23: note = Synthetic Construct
  source 1..23: mol_type = other DNA
tgtaaccttctgggattggcttt

SEQ ID NO: 32497 - DNA, 21 bp, synthetic construct
  misc_feature 1..21: note = Synthetic Construct
  source 1..21: mol_type = other DNA
ggaaacgcagctagccttaga

SEQ ID NO: 32498 - DNA, 21 bp, synthetic construct
  misc_feature 1..21: note = Synthetic Construct
  source 1..21: mol_type = other DNA
agcccaggtcaccaagagact

SEQ ID NO: 32499 - DNA, 21 bp, synthetic construct
  misc_feature 1..21: note = Synthetic Construct
  source 1..21: mol_type = other DNA
ggaagcaaggcccacacatca

SEQ ID NO: 32500 - DNA, 21 bp, synthetic construct
  misc_feature 1..21: note = Synthetic Construct
  source 1..21: mol_type = other DNA
ccctccccagctgacaatcat

SEQ ID NO: 32501 - DNA, 30 bp, synthetic construct
  misc_feature 1..30: note = Synthetic Construct
  source 1..30: mol_type = other DNA
gcccatttattctctgcctaaaacaacaag

SEQ ID NO: 32502 - DNA, 24 bp, synthetic construct
  misc_feature 1..24: note = Synthetic Construct
  source 1..24: mol_type = other DNA
attcccctaaaccatccaggattc

SEQ ID NO: 32503 - DNA, 25 bp, synthetic construct
  misc_feature 1..25: note = Synthetic Construct
  source 1..25: mol_type = other DNA
gcaaatacctgtgtagccagcatca

SEQ ID NO: 32504 - DNA, 20 bp, synthetic construct
  misc_feature 1..20: note = Synthetic Construct
  source 1..20: mol_type = other DNA
agcaggccagtaggcagaga

SEQ ID NO: 32505 - DNA, 26 bp, synthetic construct
  misc_feature 1..26: note = Synthetic Construct
  source 1..26: mol_type = other DNA
gggaaaactcttcctaagcttcagtt

SEQ ID NO: 32506 - DNA, 24 bp, synthetic construct
  misc_feature 1..24: note = Synthetic Construct
  source 1..24: mol_type = other DNA
ttccctttcagtgtaaacctgtgt

SEQ ID NO: 32507 - DNA, 22 bp, synthetic construct
  misc_feature 1..22: note = Synthetic Construct
  source 1..22: mol_type = other DNA
gaagtaccagcggtgcattttc

SEQ ID NO: 32508 - DNA, 22 bp, synthetic construct
  misc_feature 1..22: note = Synthetic Construct
  source 1..22: mol_type = other DNA
ctcacccagggattcaatgaca

SEQ ID NO: 32509 - DNA, 21 bp, synthetic construct
  misc_feature 1..21: note = Synthetic Construct
  source 1..21: mol_type = other DNA
gcagctctgctggatgaaaac

SEQ ID NO: 32510 - DNA, 25 bp, synthetic construct
  misc_feature 1..25: note = Synthetic Construct
  source 1..25: mol_type = other DNA
acaggttgtttgtgatacagcttct

SEQ ID NO: 32511 - DNA, 22 bp, synthetic construct
  misc_feature 1..22: note = Synthetic Construct
  source 1..22: mol_type = other DNA
ccatggcataggcatgcaggat

SEQ ID NO: 32512 - DNA, 25 bp, synthetic construct
  misc_feature 1..25: note = Synthetic Construct
  source 1..25: mol_type = other DNA
gcttggacagcttgattctgaagtt

SEQ ID NO: 32513 - DNA, 19 bp, synthetic construct
  misc_feature 1..19: note = Synthetic Construct
  source 1..19: mol_type = other DNA
agccccagaggccctaaag

SEQ ID NO: 32514 - DNA, 22 bp, synthetic construct
  misc_feature 1..22: note = Synthetic Construct
  source 1..22: mol_type = other DNA
tgctatgcctccctctggtagt

SEQ ID NO: 32515 - DNA, 27 bp, synthetic construct
  misc_feature 1..27: note = Synthetic Construct
  source 1..27: mol_type = other DNA
gatgactgtctttcctccgtaataaac

SEQ ID NO: 32516 - DNA, 26 bp, synthetic construct
  misc_feature 1..26: note = Synthetic Construct
  source 1..26: mol_type = other DNA
cagatgaagaaccgtagactccaact

SEQ ID NO: 32517 - DNA, 19 bp, synthetic construct
  misc_feature 1..19: note = Synthetic Construct
  source 1..19: mol_type = other DNA
gcaggagcccgtgcatttg

SEQ ID NO: 32518 - DNA, 24 bp, synthetic construct
  misc_feature 1..24: note = Synthetic Construct
  source 1..24: mol_type = other DNA
ggggcaggaatgggaatcaaggta

SEQ ID NO: 32519 - DNA, 20 bp, synthetic construct
  misc_feature 1..20: note = Synthetic Construct
  source 1..20: mol_type = other DNA
ttaggggcccatggctcaca

SEQ ID NO: 32520 - DNA, 28 bp, synthetic construct
  misc_feature 1..28: note = Synthetic Construct
  source 1..28: mol_type = other DNA
cccttattacatgcctccagatactttc

SEQ ID NO: 32521 - DNA, 24 bp, synthetic construct
  misc_feature 1..24: note = Synthetic Construct
  source 1..24: mol_type = other DNA
acaggaagtaagggagcaaagatg

SEQ ID NO: 32522 - DNA, 25 bp, synthetic construct
  misc_feature 1..25: note = Synthetic Construct
  source 1..25: mol_type = other DNA
cagccaccacaaatacacttagaac

SEQ ID NO: 32523 - DNA, 22 bp, synthetic construct
  misc_feature 1..22: note = Synthetic Construct
  source 1..22: mol_type = other DNA
gactctcactgtggcaagaaca

SEQ ID NO: 32524 - DNA, 23 bp, synthetic construct
  misc_feature 1..23: note = Synthetic Construct
  source 1..23: mol_type = other DNA
cagagggctcctccaactggata

SEQ ID NO: 32525 - DNA, 25 bp, synthetic construct
  misc_feature 1..25: note = Synthetic Construct
  source 1..25: mol_type = other DNA
acaaagatgcagaagtctcacacaa

SEQ ID NO: 32526 - DNA, 22 bp, synthetic construct
  misc_feature 1..22: note = Synthetic Construct
  source 1..22: mol_type = other DNA
ccagtgaagtgggtgctactct

SEQ ID NO: 32527 - DNA, 27 bp, synthetic construct
  misc_feature 1..27: note = Synthetic Construct
  source 1..27: mol_type = other DNA
cacttttgcctctatcttttccaggtt

SEQ ID NO: 32528 - DNA, 25 bp, synthetic construct
  misc_feature 1..25: note = Synthetic Construct
  source 1..25: mol_type = other DNA
gtgtggccaaatgaaatcaaacaca

SEQ ID NO: 32529 - DNA, 28 bp, synthetic construct
  misc_feature 1..28: note = Synthetic Construct
  source 1..28: mol_type = other DNA
ggaagaattgatcactgacacagtggaa

SEQ ID NO: 32530 - DNA, 20 bp, synthetic construct
  misc_feature 1..20: note = Synthetic Construct
  source 1..20: mol_type = other DNA
gcaagggccaagaagtgaca

SEQ ID NO: 32531 - DNA, 25 bp, synthetic construct
  misc_feature 1..25: note = Synthetic Construct
  source 1..25: mol_type = other DNA
caccttttaattgcctggactggta

SEQ ID NO: 32532 - DNA, 24 bp, synthetic construct
  misc_feature 1..24: note = Synthetic Construct
  source 1..24: mol_type = other DNA
gcatcctctcaaagcacaaagaca

SEQ ID NO: 32533 - DNA, 21 bp, synthetic construct
  misc_feature 1..21: note = Synthetic Construct
  source 1..21: mol_type = other DNA
cgtgggtgagaagaacacact

SEQ ID NO: 32534 - DNA, 27 bp, synthetic construct
  misc_feature 1..27: note = Synthetic Construct
  source 1..27: mol_type = other DNA
cctattatgcagccttcaactcctact

SEQ ID NO: 32535 - DNA, 21 bp, synthetic construct
  misc_feature 1..21: note = Synthetic Construct
  source 1..21: mol_type = other DNA
acaaactgctgccctttccat

SEQ ID NO: 32536 - DNA, 25 bp, synthetic construct
  misc_feature 1..25: note = Synthetic Construct
  source 1..25: mol_type = other DNA
caatgtgtggtgaccagttatccaa

SEQ ID NO: 32537 - DNA, 22 bp, synthetic construct
  misc_feature 1..22: note = Synthetic Construct
  source 1..22: mol_type = other DNA
gccaactggccacatatcattg

SEQ ID NO: 32538 - DNA, 26 bp, synthetic construct
  misc_feature 1..26: note = Synthetic Construct
  source 1..26: mol_type = other DNA
cctgacactggtactcaatcttctac

SEQ ID NO: 32539 - DNA, 22 bp, synthetic construct
  misc_feature 1..22: note = Synthetic Construct
  source 1..22: mol_type = other DNA
gtttggcaggcataccgtaagt

SEQ ID NO: 32540 - DNA, 22 bp, synthetic construct
  misc_feature 1..22: note = Synthetic Construct
  source 1..22: mol_type = other DNA
tctccacctccaccactcttag

SEQ ID NO: 32541 - DNA, 20 bp, synthetic construct
  misc_feature 1..20: note = Synthetic Construct
  source 1..20: mol_type = other DNA
tcgagggcacaggcattcat

SEQ ID NO: 32542 - DNA, 24 bp, synthetic construct
  misc_feature 1..24: note = Synthetic Construct
  source 1..24: mol_type = other DNA
ttatctgctccccacgtatgtaag

SEQ ID NO: 32543 - DNA, 21 bp, synthetic construct
  misc_feature 1..21: note = Synthetic Construct
  source 1..21: mol_type = other DNA
agaagggagggccaggtgtaa

SEQ ID NO: 32544 - DNA, 24 bp, synthetic construct
  misc_feature 1..24: note = Synthetic Construct
  source 1..24: mol_type = other DNA
gaggcaggaggatagtttgagttc

SEQ ID NO: 32545 - DNA, 22 bp, synthetic construct
  misc_feature 1..22: note = Synthetic Construct
  source 1..22: mol_type = other DNA
gctggtaaggggcatccattca

SEQ ID NO: 32546 - DNA, 21 bp, synthetic construct
  misc_feature 1..21: note = Synthetic Construct
  source 1..21: mol_type = other DNA
acccagaggagaaggttgagt

SEQ ID NO: 32547 - DNA, 25 bp, synthetic construct
  misc_feature 1..25: note = Synthetic Construct
  source 1..25: mol_type = other DNA
tcctgaaggccagtatcttctaaac

SEQ ID NO: 32548 - DNA, 25 bp, synthetic construct
  misc_feature 1..25: note = Synthetic Construct
  source 1..25: mol_type = other DNA
agctgtcaggcaaattacttactct

SEQ ID NO: 32549 - DNA, 26 bp, synthetic construct
  misc_feature 1..26: note = Synthetic Construct
  source 1..26: mol_type = other DNA
gagatcagtgaagaaagtgaggttca

SEQ ID NO: 32550 - DNA, 25 bp, synthetic construct
  misc_feature 1..25: note = Synthetic Construct
  source 1..25: mol_type = other DNA
tgcttcagaatgactcctcagtttc

SEQ ID NO: 32551 - DNA, 24 bp, synthetic construct
  misc_feature 1..24: note = Synthetic Construct
  source 1..24: mol_type = other DNA
tccatggacaaggaaaacaaccaa

SEQ ID NO: 32552 - DNA, 24 bp, synthetic construct
  misc_feature 1..24: note = Synthetic Construct
  source 1..24: mol_type = other DNA
agtctgcaaatatcgggagctttt

SEQ ID NO: 32553 - DNA, 26 bp, synthetic construct
  misc_feature 1..26: note = Synthetic Construct
  source 1..26: mol_type = other DNA
ggaaactcaaaagcctttcaccagat

SEQ ID NO: 32554 - DNA, 26 bp, synthetic construct
  misc_feature 1..26: note = Synthetic Construct
  source 1..26: mol_type = other DNA
gtgttactgactccaagagtgtgtct

SEQ ID NO: 32555 - DNA, 24 bp, synthetic construct
  misc_feature 1..24: note = Synthetic Construct
  source 1..24: mol_type = other DNA
ccatcaatcccagttgcagccata

SEQ ID NO: 32556 - DNA, 25 bp, synthetic construct
  misc_feature 1..25: note = Synthetic Construct
  source 1..25: mol_type = other DNA
caccattgagagggtagaggcattg

SEQ ID NO: 32557 - DNA, 24 bp, synthetic construct
  misc_feature 1..24: note = Synthetic Construct
  source 1..24: mol_type = other DNA
ggggcagtacagacaccatctcta

SEQ ID NO: 32558 - DNA, 23 bp, synthetic construct
  misc_feature 1..23: note = Synthetic Construct
  source 1..23: mol_type = other DNA
tcgggagggacactattcaatct

SEQ ID NO: 32559 - DNA, 21 bp, synthetic construct
  misc_feature 1..21: note = Synthetic Construct
  source 1..21: mol_type = other DNA
gctgggcctgcagttccttta

SEQ ID NO: 32560 - DNA, 24 bp, synthetic construct
  misc_feature 1..24: note = Synthetic Construct
  source 1..24: mol_type = other DNA
ggcagagcctggacatcctagaaa

SEQ ID NO: 32561 - DNA, 20 bp, synthetic construct
  misc_feature 1..20: note = Synthetic Construct
  source 1..20: mol_type = other DNA
cacctgtgggcatgggacta

SEQ ID NO: 32562 - DNA, 21 bp, synthetic construct
  misc_feature 1..21: note = Synthetic Construct
  source 1..21: mol_type = other DNA
cgacctctgcccttgttgtct

SEQ ID NO: 32563 - DNA, 22 bp, synthetic construct
  misc_feature 1..22: note = Synthetic Construct
  source 1..22: mol_type = other DNA
gctgcaggcacagtgttagctt

SEQ ID NO: 32564 - DNA, 29 bp, synthetic construct
  misc_feature 1..29: note = Synthetic Construct
  source 1..29: mol_type = other DNA
gggatttggtttgggatttgtggaatcaa

SEQ ID NO: 32565 - DNA, 24 bp, synthetic construct
  misc_feature 1..24: note = Synthetic Construct
  source 1..24: mol_type = other DNA
tggatttagaagcgttgccatttc

SEQ ID NO: 32566 - DNA, 19 bp, synthetic construct
  misc_feature 1..19: note = Synthetic Construct
  source 1..19: mol_type = other DNA
agccgcagcaggagataca

SEQ ID NO: 32567 - DNA, 27 bp, synthetic construct
  misc_feature 1..27: note = Synthetic Construct
  source 1..27: mol_type = other DNA
cagattcacccaactcctctattctgt

SEQ ID NO: 32568 - DNA, 24 bp, synthetic construct
  misc_feature 1..24: note = Synthetic Construct
  source 1..24: mol_type = other DNA
ctctgccagtgggaagtttgattg

SEQ ID NO: 32569 - DNA, 25 bp, synthetic construct
  misc_feature 1..25: note = Synthetic Construct
  source 1..25: mol_type = other DNA
aaaccctgtattatgctgctgtaga

SEQ ID NO: 32570 - DNA, 23 bp, synthetic construct
  misc_feature 1..23: note = Synthetic Construct
  source 1..23: mol_type = other DNA
gggaagctgaaactaggctaact

SEQ ID NO: 32571 - DNA, 25 bp, synthetic construct
  misc_feature 1..25: note = Synthetic Construct
  source 1..25: mol_type = other DNA
cagctaaaccaactttgacaaggaa

SEQ ID NO: 32572 - DNA, 22 bp, synthetic construct
  misc_feature 1..22: note = Synthetic Construct
  source 1..22: mol_type = other DNA
gggaaagatgggcatggctgaa

SEQ ID NO: 32573 - DNA, 23 bp, synthetic construct
  misc_feature 1..23: note = Synthetic Construct
  source 1..23: mol_type = other DNA
tgatctttgagctggacctctct

SEQ ID NO: 32574 - DNA, 29 bp, synthetic construct
  misc_feature 1..29: note = Synthetic Construct
  source 1..29: mol_type = other DNA
ctccatgtgcttttcctcatacacttaga

SEQ ID NO: 32575 - DNA, 20 bp, synthetic construct
  misc_feature 1..20: note = Synthetic Construct
  source 1..20: mol_type = other DNA
gcagggaggcaaagatgact

SEQ ID NO: 32576 - DNA, 24 bp, synthetic construct
  misc_feature 1..24: note = Synthetic Construct
  source 1..24: mol_type = other DNA
aggtggtgcctttaagctagaaaa

SEQ ID NO: 32577 - DNA, 22 bp, synthetic construct
  misc_feature 1..22: note = Synthetic Construct
  source 1..22: mol_type = other DNA
ctcgagggctttccatcagcaa

SEQ ID NO: 32578 - DNA, 22 bp, synthetic construct
  misc_feature 1..22: note = Synthetic Construct
  source 1..22: mol_type = other DNA
ggtcagttgggccaggtttcta

SEQ ID NO: 32579 - DNA, 21 bp, synthetic construct
  misc_feature 1..21: note = Synthetic Construct
  source 1..21: mol_type = other DNA
gcccagcctagctgcatacaa

SEQ ID NO: 32580 - DNA, 25 bp, synthetic construct
  misc_feature 1..25: note = Synthetic Construct
  source 1..25: mol_type = other DNA
aaggctgaatagtgggaagagttac

SEQ ID NO: 32581 - DNA, 24 bp, synthetic construct
  misc_feature 1..24: note = Synthetic Construct
  source 1..24: mol_type = other DNA
acacacacgtaactagggaagatg

SEQ ID NO: 32582 - DNA, 25 bp, synthetic construct
  misc_feature 1..25: note = Synthetic Construct
  source 1..25: mol_type = other DNA
aggtcttagatagcaaggaccatgt

SEQ ID NO: 32583 - DNA, 23 bp, synthetic construct
  misc_feature 1..23: note = Synthetic Construct
  source 1..23: mol_type = other DNA
ctgactgtccagtgcagtttaga

SEQ ID NO: 32584 - DNA, 28 bp, synthetic construct
  misc_feature 1..28: note = Synthetic Construct
  source 1..28: mol_type = other DNA
cacataggtggtatcatctcccttcaga

SEQ ID NO: 32585 - DNA, 25 bp, synthetic construct
  misc_feature 1..25: note = Synthetic Construct
  source 1..25: mol_type = other DNA
acctaaccctcacattcatttgctt

SEQ ID NO: 32586 - DNA, 21 bp, synthetic construct
  misc_feature 1..21: note = Synthetic Construct
  source 1..21: mol_type = other DNA
accctgaccacttgtgactct

SEQ ID NO: 32587 - DNA, 21 bp, synthetic construct
  misc_feature 1..21: note = Synthetic Construct
  source 1..21: mol_type = other DNA
gtgcacgggagcaagaaaaac

SEQ ID NO: 32588 - DNA, 22 bp, synthetic construct
  misc_feature 1..22: note = Synthetic Construct
  source 1..22: mol_type = other DNA
gctctggtgcacccttgactta

SEQ ID NO: 32589 - DNA, 21 bp, synthetic construct
  misc_feature 1..21: note = Synthetic Construct
  source 1..21: mol_type = other DNA
acacgtgctgaaatccaggaa

SEQ ID NO: 32590 - DNA, 26 bp, synthetic construct
  misc_feature 1..26: note = Synthetic Construct
  source 1..26: mol_type = other DNA
aggaagaccaggatacagacataaga

SEQ ID NO: 32591 - DNA, 21 bp, synthetic construct
  misc_feature 1..21: note = Synthetic Construct
  source 1..21: mol_type = other DNA
tccttggcttgggacctcctt

SEQ ID NO: 32592 - DNA, 22 bp, synthetic construct
  misc_feature 1..22: note = Synthetic Construct
  source 1..22: mol_type = other DNA
ccacactgagcacttgcctact

SEQ ID NO: 32593 - DNA, 22 bp, synthetic construct
  misc_feature 1..22: note = Synthetic Construct
  source 1..22: mol_type = other DNA
gtgcttgctgcaattccccaaa

SEQ ID NO: 32594 - DNA, 23 bp, synthetic construct
  misc_feature 1..23: note = Synthetic Construct
  source 1..23: mol_type = other DNA
tgttggatgccatgatgaagaga

SEQ ID NO: 32595 - DNA, 23 bp, synthetic construct
  misc_feature 1..23: note = Synthetic Construct
  source 1..23: mol_type = other DNA
cctcagtccctgtcagttagtgt

SEQ ID NO: 32596 - DNA, 20 bp, synthetic construct
  misc_feature 1..20: note = Synthetic Construct
  source 1..20: mol_type = other DNA
ggggctccgaacggaaaaac

SEQ ID NO: 32597 - DNA, 21 bp, synthetic construct
  misc_feature 1..21: note = Synthetic Construct
  source 1..21: mol_type = other DNA
gccctcagagaggcactcaat

SEQ ID NO: 32598 - DNA, 22 bp, synthetic construct
  misc_feature 1..22: note = Synthetic Construct
  source 1..22: mol_type = other DNA
tgagaaccaggagccagagaat

SEQ ID NO: 32599 - DNA, 20 bp, synthetic construct
  misc_feature 1..20: note = Synthetic Construct
  source 1..20: mol_type = other DNA
gtccagagccaggagagaga

SEQ ID NO: 32600 - DNA, 27 bp, synthetic construct
  misc_feature 1..27: note = Synthetic Construct
  source 1..27: mol_type = other DNA
ctcttcttctcagaattccaccctgaa

SEQ ID NO: 32601 - DNA, 22 bp, synthetic construct
  misc_feature 1..22: note = Synthetic Construct
  source 1..22: mol_type = other DNA
agggcctcagacccattgaaca

SEQ ID NO: 32602 - DNA, 24 bp, synthetic construct
  misc_feature 1..24: note = Synthetic Construct
  source 1..24: mol_type = other DNA
aggatttgttactgggctacacaa

SEQ ID NO: 32603 - DNA, 26 bp, synthetic construct
  misc_feature 1..26: note = Synthetic Construct
  source 1..26: mol_type = other DNA
ccaacgctttcataaacggagttagt

SEQ ID NO: 32604 - DNA, 24 bp, synthetic construct
  misc_feature 1..24: note = Synthetic Construct
  source 1..24: mol_type = other DNA
gaaggttgctttctgtgtttgaga

SEQ ID NO: 32605 - DNA, 27 bp, synthetic construct
  misc_feature 1..27: note = Synthetic Construct
  source 1..27: mol_type = other DNA
gcaaagatgaaaactggaagctacaac

SEQ ID NO: 32606 - DNA, 23 bp, synthetic construct
  misc_feature 1..23: note = Synthetic Construct
  source 1..23: mol_type = other DNA
tctcggagaccagagggagatac

SEQ ID NO: 32607 - DNA, 22 bp, synthetic construct
  misc_feature 1..22: note = Synthetic Construct
  source 1..22: mol_type = other DNA
gaagctgaaagtggcagctagt

SEQ ID NO: 32608 - DNA, 25 bp, synthetic construct
  misc_feature 1..25: note = Synthetic Construct
  source 1..25: mol_type = other DNA
tcttctgccttagcaattgaacagt

SEQ ID NO: 32609 - DNA, 25 bp, synthetic construct
  misc_feature 1..25: note = Synthetic Construct
  source 1..25: mol_type = other DNA
tgctcttgtgtacatatgtctgctt

SEQ ID NO: 32610 - DNA, 29 bp, synthetic construct
  misc_feature 1..29: note = Synthetic Construct
  source 1..29: mol_type = other DNA
caggaataaggatttggatctctggcttt

SEQ ID NO: 32611 - DNA, 22 bp, synthetic construct
  misc_feature 1..22: note = Synthetic Construct
  source 1..22: mol_type = other DNA
cacatgacgtccctgtgtctgt

SEQ ID NO: 32612 - DNA, 25 bp, synthetic construct
  misc_feature 1..25: note = Synthetic Construct
  source 1..25: mol_type = other DNA
tgaggctcaaagtgatacagctatt

SEQ ID NO: 32613 - DNA, 24 bp, synthetic construct
  misc_feature 1..24: note = Synthetic Construct
  source 1..24: mol_type = other DNA
ctgctcgactcttcagtaggtgat

SEQ ID NO: 32614 - DNA, 25 bp, synthetic construct
  misc_feature 1..25: note = Synthetic Construct
  source 1..25: mol_type = other DNA
cctgagtatgggagaaggggatttg

SEQ ID NO: 32615 - DNA, 22 bp, synthetic construct
  misc_feature 1..22: note = Synthetic Construct
  source 1..22: mol_type = other DNA
ggcaacaagagcgaaactgcat

SEQ ID NO: 32616 - DNA, 20 bp, synthetic construct
  misc_feature 1..20: note = Synthetic Construct
  source 1..20: mol_type = other DNA
ccacagctgccagtggtctt

SEQ ID NO: 32617 - DNA, 24 bp, synthetic construct
  misc_feature 1..24: note = Synthetic Construct
  source 1..24: mol_type = other DNA
ccccagaagctgaccctgaagata

SEQ ID NO: 32618 - DNA, 21 bp, synthetic construct
  misc_feature 1..21: note = Synthetic Construct
  source 1..21: mol_type = other DNA
tggccccactccatctctaag

SEQ ID NO: 32619 - DNA, 22 bp, synthetic construct
  misc_feature 1..22: note = Synthetic Construct
  source 1..22: mol_type = other DNA
cctgagctacaggagtgagaca

SEQ ID NO: 32620 - DNA, 22 bp, synthetic construct
  misc_feature 1..22: note = Synthetic Construct
  source 1..22: mol_type = other DNA
ccaagccgcgagtggttttatg

SEQ ID NO: 32621 - DNA, 19 bp, synthetic construct
  misc_feature 1..19: note = Synthetic Construct
  source 1..19: mol_type = other DNA
ccaggagcgcagctacaga

SEQ ID NO: 32622 - DNA, 21 bp, synthetic construct
  misc_feature 1..21: note = Synthetic Construct
  source 1..21: mol_type = other DNA
tgggagccaaagaacttgtgt

SEQ ID NO: 32623 - DNA, 21 bp, synthetic construct
  misc_feature 1..21: note = Synthetic Construct
  source 1..21: mol_type = other DNA
acgctgtgctcaaacacttct

SEQ ID NO: 32624 - DNA, 23 bp, synthetic construct
  misc_feature 1..23: note = Synthetic Construct
  source 1..23: mol_type = other DNA
tgggcaaacatgggagatgatag

SEQ ID NO: 32625 - DNA, 22 bp, synthetic construct
  misc_feature 1..22: note = Synthetic Construct
  source 1..22: mol_type = other DNA
gatgtgctgagaagggttcaga

SEQ ID NO: 32626 - DNA, 22 bp, synthetic construct
  misc_feature 1..22: note = Synthetic Construct
  source 1..22: mol_type = other DNA
aagaattcagctgccaggaaca

SEQ ID NO: 32627 - DNA, 25 bp, synthetic construct
  misc_feature 1..25: note = Synthetic Construct
  source 1..25: mol_type = other DNA
gcttaaggccagaagtttgaaggtt

SEQ ID NO: 32628 - DNA, 20 bp, synthetic construct
  misc_feature 1..20: note = Synthetic Construct
  source 1..20: mol_type = other DNA
gccatggccaggacaaaaac

SEQ ID NO: 32629 - DNA, 20 bp, synthetic construct
  misc_feature 1..20: note = Synthetic Construct
  source 1..20: mol_type = other DNA
ggctcacccaaaccttggaa

SEQ ID NO: 32630 - DNA, 23 bp, synthetic construct
  misc_feature 1..23: note = Synthetic Construct
  source 1..23: mol_type = other DNA
ccccgtcccacagtagtcttatc

SEQ ID NO: 32631 - DNA, 24 bp, synthetic construct
  misc_feature 1..24: note = Synthetic Construct
  source 1..24: mol_type = other DNA
atggtctttgggttggcaaaatac

SEQ ID NO: 32632 - DNA, 29 bp, synthetic construct
  misc_feature 1..29: note = Synthetic Construct
  source 1..29: mol_type = other DNA
ccataacaagagagactaaaggccgtatc

SEQ ID NO: 32633 - DNA, 21 bp, synthetic construct
  misc_feature 1..21: note = Synthetic Construct
  source 1..21: mol_type = other DNA
gctgctggccccagtaacatt

SEQ ID NO: 32634 - DNA, 23 bp, synthetic construct
  misc_feature 1..23: note = Synthetic Construct
  source 1..23: mol_type = other DNA
cttaggcagaaacttgcccaaag

SEQ ID NO: 32635 - DNA, 22 bp, synthetic construct
  misc_feature 1..22: note = Synthetic Construct
  source 1..22: mol_type = other DNA
tggttgcaaatttggcagtgaa

SEQ ID NO: 32636 - DNA, 26 bp, synthetic construct
  misc_feature 1..26: note = Synthetic Construct
  source 1..26: mol_type = other DNA
ggtaatcacccagccataaccaatca

SEQ ID NO: 32637 - DNA, 21 bp, synthetic construct
  misc_feature 1..21: note = Synthetic Construct
  source 1..21: mol_type = other DNA
gcagctgcctctgagtgtttg

SEQ ID NO: 32638 - DNA, 25 bp, synthetic construct
  misc_feature 1..25: note = Synthetic Construct
  source 1..25: mol_type = other DNA
aagtactgacaatacaggcaggttt

SEQ ID NO: 32639 - DNA, 21 bp, synthetic construct
  misc_feature 1..21: note = Synthetic Construct
  source 1..21: mol_type = other DNA
gcagagggagcctctagtgta

SEQ ID NO: 32640 - DNA, 21 bp, synthetic construct
  misc_feature 1..21: note = Synthetic Construct
  source 1..21: mol_type = other DNA
cccacagcactgctcaagatg

SEQ ID NO: 32641 - DNA, 22 bp, synthetic construct
  misc_feature 1..22: note = Synthetic Construct
  source 1..22: mol_type = other DNA
actcctcgcagacatcagtctt

SEQ ID NO: 32642 - DNA, 26 bp, synthetic construct
  misc_feature 1..26: note = Synthetic Construct
  source 1..26: mol_type = other DNA
gtccaaattttcctggcatgcttagt

SEQ ID NO: 32643 - DNA, 20 bp, synthetic construct
  misc_feature 1..20: note = Synthetic Construct
  source 1..20: mol_type = other DNA
acctcctgcttccctgaaca

SEQ ID NO: 32644 - DNA, 20 bp, synthetic construct
  misc_feature 1..20: note = Synthetic Construct
  source 1..20: mol_type = other DNA
catccgcagcactgagagaa

SEQ ID NO: 32645 - DNA, 24 bp, synthetic construct
  misc_feature 1..24: note = Synthetic Construct
  source 1..24: mol_type = other DNA
cccattgtgggatgcacattgatt

SEQ ID NO: 32646 - DNA, 19 bp, synthetic construct
  misc_feature 1..19: note = Synthetic Construct
  source 1..19: mol_type = other DNA
ccggctgagcacaccatct

SEQ ID NO: 32647 - DNA, 21 bp, synthetic construct
  misc_feature 1..21: note = Synthetic Construct
  source 1..21: mol_type = other DNA
ttccagctgactgtcctcaga

SEQ ID NO: 32648 - DNA, 24 bp, synthetic construct
  misc_feature 1..24: note = Synthetic Construct
  source 1..24: mol_type = other DNA
gatcagtgtggtggtgaattggat

SEQ ID NO: 32649 - DNA, 19 bp, synthetic construct
  misc_feature 1..19: note = Synthetic Construct
  source 1..19: mol_type = other DNA
ggcagagtggggacacaca

SEQ ID NO: 32650 - DNA, 23 bp, synthetic construct
  misc_feature 1..23: note = Synthetic Construct
  source 1..23: mol_type = other DNA
atgcaagggagcaatttgcatag

SEQ ID NO: 32651 - DNA, 28 bp, synthetic construct
  misc_feature 1..28: note = Synthetic Construct
  source 1..28: mol_type = other DNA
cctgaaaacatgtagaggagctttgatg

SEQ ID NO: 32652 - DNA, 24 bp, synthetic construct
  misc_feature 1..24: note = Synthetic Construct
  source 1..24: mol_type = other DNA
ccgaggccagacctgctacatatt

SEQ ID NO: 32653 - DNA, 21 bp, synthetic construct
  misc_feature 1..21: note = Synthetic Construct
  source 1..21: mol_type = other DNA
gcaacgagctccttctgatga

SEQ ID NO: 32654 - DNA, 23 bp, synthetic construct
  misc_feature 1..23: note = Synthetic Construct
  source 1..23: mol_type = other DNA
cctagctcagccacagtggaata

SEQ ID NO: 32655 - DNA, 22 bp, synthetic construct
  misc_feature 1..22: note = Synthetic Construct
  source 1..22: mol_type = other DNA
ggagcaggggctcagaaaagtt

SEQ ID NO: 32656 - DNA, 27 bp, synthetic construct
  misc_feature 1..27: note = Synthetic Construct
  source 1..27: mol_type = other DNA
ttcacatattagcctacactcctcttc

SEQ ID NO: 32657 - DNA, 23 bp, synthetic construct
  misc_feature 1..23: note = Synthetic Construct
  source 1..23: mol_type = other DNA
agtttcttggaccccagacattc

SEQ ID NO: 32658 - DNA, 20 bp, synthetic construct
  misc_feature 1..20: note = Synthetic Construct
  source 1..20: mol_type = other DNA
acgcagctgagttccacgtt

SEQ ID NO: 32659 - DNA, 20 bp, synthetic construct
  misc_feature 1..20: note = Synthetic Construct
  source 1..20: mol_type = other DNA
tgtcttggccccatctcctt

SEQ ID NO: 32660 - DNA, 25 bp, synthetic construct
  misc_feature 1..25: note = Synthetic Construct
  source 1..25: mol_type = other DNA
gttcaccttcaagcaaaccctatac

SEQ ID NO: 32661 - DNA, 27 bp, synthetic construct
  misc_feature 1..27: note = Synthetic Construct
  source 1..27: mol_type = other DNA
cccctttttggtctgtttatggcaagt

SEQ ID NO: 32662 - DNA, 25 bp, synthetic construct
  misc_feature 1..25: note = Synthetic Construct
  source 1..25: mol_type = other DNA
gctcagcttatagtagccagagaaa

SEQ ID NO: 32663 - DNA, 22 bp, synthetic construct
  misc_feature 1..22: note = Synthetic Construct
  source 1..22: mol_type = other DNA
ttgcagtgtcacctgggataag

SEQ ID NO: 32664 - DNA, 24 bp, synthetic construct
  misc_feature 1..24: note = Synthetic Construct
  source 1..24: mol_type = other DNA
gcagagagaagcaactcagcttac

SEQ ID NO: 32665 - DNA, 22 bp, synthetic construct
  misc_feature 1..22: note = Synthetic Construct
  source 1..22: mol_type = other DNA
gcagaccatagtggctgaggtt

SEQ ID NO: 32666 - DNA, 23 bp, synthetic construct
  misc_feature 1..23: note = Synthetic Construct
  source 1..23: mol_type = other DNA
ggaggtggggcataaggtgattc

SEQ ID NO: 32667 - DNA, 21 bp, synthetic construct
  misc_feature 1..21: note = Synthetic Construct
  source 1..21: mol_type = other DNA
gccagctgcaacaaccattag

SEQ ID NO: 32668 - DNA, 25 bp, synthetic construct
  misc_feature 1..25: note = Synthetic Construct
  source 1..25: mol_type = other DNA
gcatctgagcaagtctccttcttgt

SEQ ID NO: 32669 - DNA, 20 bp, synthetic construct
  misc_feature 1..20: note = Synthetic Construct
  source 1..20: mol_type = other DNA
gcagaggagctcagctgttt

SEQ ID NO: 32670 - DNA, 27 bp, synthetic construct
  misc_feature 1..27: note = Synthetic Construct
  source 1..27: mol_type = other DNA
cggttttcagatttcaagacggtgtgt

SEQ ID NO: 32671 - DNA, 22 bp, synthetic construct
  misc_feature 1..22: note = Synthetic Construct
  source 1..22: mol_type = other DNA
ggtgcaccgatgcagattctct

SEQ ID NO: 32672 - DNA, 23 bp, synthetic construct
  misc_feature 1..23: note = Synthetic Construct
  source 1..23: mol_type = other DNA
agggacgtagaggggacaactac

SEQ ID NO: 32673 - DNA, 22 bp, synthetic construct
  misc_feature 1..22: note = Synthetic Construct
  source 1..22: mol_type = other DNA
ccacttggaccagagagacgtt

SEQ ID NO: 32674 - DNA, 22 bp, synthetic construct
  misc_feature 1..22: note = Synthetic Construct
  source 1..22: mol_type = other DNA
ccctagagcccaaaggcaacaa

SEQ ID NO: 32675 - DNA, 24 bp, synthetic construct
  misc_feature 1..24: note = Synthetic Construct
  source 1..24: mol_type = other DNA
tgctcttctgctggaatttaccaa

SEQ ID NO: 32676 - DNA, 25 bp, synthetic construct
  misc_feature 1..25: note = Synthetic Construct
  source 1..25: mol_type = other DNA
gcaggaattcagaggaattggactt

SEQ ID NO: 32677 - DNA, 24 bp, synthetic construct
  misc_feature 1..24: note = Synthetic Construct
  source 1..24: mol_type = other DNA
tctctctgaatccacctgctctta

SEQ ID NO: 32678 - DNA, 25 bp, synthetic construct
  misc_feature 1..25: note = Synthetic Construct
  source 1..25: mol_type = other DNA
tcggacaatcacctgaaatgaaaac

SEQ ID NO: 32679 - DNA, 26 bp, synthetic construct
  misc_feature 1..26: note = Synthetic Construct
  source 1..26: mol_type = other DNA
gtcagaattaggcctctctcaaccta

SEQ ID NO: 32680 - DNA, 22 bp, synthetic construct
  misc_feature 1..22: note = Synthetic Construct
  source 1..22: mol_type = other DNA
gtgtgggtgggtactgaaggaa

SEQ ID NO: 32681 - DNA, 22 bp, synthetic construct
  misc_feature 1..22: note = Synthetic Construct
  source 1..22: mol_type = other DNA
ggtgttgaacgccattttcaca

SEQ ID NO: 32682 - DNA, 30 bp, synthetic construct
  misc_feature 1..30: note = Synthetic Construct
  source 1..30: mol_type = other DNA
ccttttctcccattaatccatctgccttat

SEQ ID NO: 32683 - DNA, 25 bp, synthetic construct
  misc_feature 1..25: note = Synthetic Construct
  source 1..25: mol_type = other DNA
ctttgtctgtctgcatctgacattt

SEQ ID NO: 32684 - DNA, 25 bp, synthetic construct
  misc_feature 1..25: note = Synthetic Construct
  source 1..25: mol_type = other DNA
gagaagagcctgggctatatttcaa

SEQ ID NO: 32685 - DNA, 23 bp, synthetic construct
  misc_feature 1..23: note = Synthetic Construct
  source 1..23: mol_type = other DNA
ggcttggcaaggtttcaggtttg

SEQ ID NO: 32686 - DNA, 20 bp, synthetic construct
  misc_feature 1..20: note = Synthetic Construct
  source 1..20: mol_type = other DNA
atcgcgggcatctgtgtaac

SEQ ID NO: 32687 - DNA, 20 bp, synthetic construct
  misc_feature 1..20: note = Synthetic Construct
  source 1..20: mol_type = other DNA
tcacagggttggcaggaact

SEQ ID NO: 32688 - DNA, 27 bp, synthetic construct
  misc_feature 1..27: note = Synthetic Construct
  source 1..27: mol_type = other DNA
gaccatttcatgctcactgctttcttg

SEQ ID NO: 32689 - DNA, 19 bp, synthetic construct
  misc_feature 1..19: note = Synthetic Construct
  source 1..19: mol_type = other DNA
agctgctgcagacccatgt

SEQ ID NO: 32690 - DNA, 20 bp, synthetic construct
  misc_feature 1..20: note = Synthetic Construct
  source 1..20: mol_type = other DNA
tctggctcagcatggtcact

SEQ ID NO: 32691 - DNA, 21 bp, synthetic construct
  misc_feature 1..21: note = Synthetic Construct
  source 1..21: mol_type = other DNA
ggcccctctgtaaaagtgcat

SEQ ID NO: 32692 - DNA, 19 bp, synthetic construct
  misc_feature 1..19: note = Synthetic Construct
  source 1..19: mol_type = other DNA
agctgcgggcaaggtatca

SEQ ID NO: 32693 - DNA, 23 bp, synthetic construct
  misc_feature 1..23: note = Synthetic Construct
  source 1..23: mol_type = other DNA
cctattgcacacggtcacaattt

SEQ ID NO: 32694 - DNA, 24 bp, synthetic construct
  misc_feature 1..24: note = Synthetic Construct
  source 1..24: mol_type = other DNA
ccctactcccaactgcacttgaac

SEQ ID NO: 32695 - DNA, 22 bp, synthetic construct
  misc_feature 1..22: note = Synthetic Construct
  source 1..22: mol_type = other DNA
ccccagacctgtgattcaccaa

SEQ ID NO: 32696 - DNA, 27 bp, synthetic construct
  misc_feature 1..27: note = Synthetic Construct
  source 1..27: mol_type = other DNA
gcacaggagtaatacgatctgacatct

SEQ ID NO: 32697 - DNA, 21 bp, synthetic construct
  misc_feature 1..21: note = Synthetic Construct
  source 1..21: mol_type = other DNA
cctgagggtgcacctgcttag

SEQ ID NO: 32698 - DNA, 25 bp, synthetic construct
  misc_feature 1..25: note = Synthetic Construct
  source 1..25: mol_type = other DNA
gcaggcaataacgaatgagagttta

SEQ ID NO: 32699 - DNA, 21 bp, synthetic construct
  misc_feature 1..21: note = Synthetic Construct
  source 1..21: mol_type = other DNA
gccagttccctctgggaggtt

SEQ ID NO: 32700 - DNA, 22 bp, synthetic construct
  misc_feature 1..22: note = Synthetic Construct
  source 1..22: mol_type = other DNA
cctcttccctcaccgtgtttga

SEQ ID NO: 32701 - DNA, 25 bp, synthetic construct
  misc_feature 1..25: note = Synthetic Construct
  source 1..25: mol_type = other DNA
ttctgagttccagagacactacaag

SEQ ID NO: 32702 - DNA, 20 bp, synthetic construct
  misc_feature 1..20: note = Synthetic Construct
  source 1..20: mol_type = other DNA
acgcccagccccaactttta

SEQ ID NO: 32703 - DNA, 21 bp, synthetic construct
  misc_feature 1..21: note = Synthetic Construct
  source 1..21: mol_type = other DNA
gctctcctccccaggaaccat

SEQ ID NO: 32704 - DNA, 24 bp, synthetic construct
  misc_feature 1..24: note = Synthetic Construct
  source 1..24: mol_type = other DNA
cgctggagactggtctgagttcaa

SEQ ID NO: 32705 - DNA, 21 bp, synthetic construct
  misc_feature 1..21: note = Synthetic Construct
  source 1..21: mol_type = other DNA
gggtgccaggacttcctctga

SEQ ID NO: 32706 - DNA, 21 bp, synthetic construct
  misc_feature 1..21: note = Synthetic Construct
  source 1..21: mol_type = other DNA
acacgggacacgggagatgaa

SEQ ID NO: 32707 - DNA, 26 bp, synthetic construct
  misc_feature 1..26: note = Synthetic Construct
  source 1..26: mol_type = other DNA
gtgtgacctattttaggaggcactgt

SEQ ID NO: 32708 - DNA, 21 bp, synthetic construct
  misc_feature 1..21: note = Synthetic Construct
  source 1..21: mol_type = other DNA
gacccggtcaagttggtttca

SEQ ID NO: 32709 - DNA, 24 bp, synthetic construct
  misc_feature 1..24: note = Synthetic Construct
  source 1..24: mol_type = other DNA
tcttgggaacagccactcttaaac

SEQ ID NO: 32710 - DNA, 25 bp, synthetic construct
  misc_feature 1..25: note = Synthetic Construct
  source 1..25: mol_type = other DNA
gcttcatatccaaggggtctagatg

SEQ ID NO: 32711 - DNA, 27 bp, synthetic construct
  misc_feature 1..27: note = Synthetic Construct
  source 1..27: mol_type = other DNA
gcacacactttgtttccatagcagttc

SEQ ID NO: 32712 - DNA, 20 bp, synthetic construct
  misc_feature 1..20: note = Synthetic Construct
  source 1..20: mol_type = other DNA
ggcctcagcactggaagtct

SEQ ID NO: 32713 - DNA, 22 bp, synthetic construct
  misc_feature 1..22: note = Synthetic Construct
  source 1..22: mol_type = other DNA
actcttggtcgaggagatcaca

SEQ ID NO: 32714 - DNA, 18 bp, synthetic construct
  misc_feature 1..18: note = Synthetic Construct
  source 1..18: mol_type = other DNA
cctgccctcgcacaaaca

SEQ ID NO: 32715 - DNA, 23 bp, synthetic construct
  misc_feature 1..23: note = Synthetic Construct
  source 1..23: mol_type = other DNA
ggcagaggcttggtggatagaag

SEQ ID NO: 32716 - DNA, 21 bp, synthetic construct
  misc_feature 1..21: note = Synthetic Construct
  source 1..21: mol_type = other DNA
cccttcttccaagccaagtga

SEQ ID NO: 32717 - DNA, 22 bp, synthetic construct
  misc_feature 1..22: note = Synthetic Construct
  source 1..22: mol_type = other DNA
gcatgttcctctcccctcttct

SEQ ID NO: 32718 - DNA, 22 bp, synthetic construct
  misc_feature 1..22: note = Synthetic Construct
  source 1..22: mol_type = other DNA
ccgtgagaatgaaggtgctttg

SEQ ID NO: 32719 - DNA, 25 bp, synthetic construct
  misc_feature 1..25: note = Synthetic Construct
  source 1..25: mol_type = other DNA
ccaggcattaacttagcgagtggat

SEQ ID NO: 32720 - DNA, 26 bp, synthetic construct
  misc_feature 1..26: note = Synthetic Construct
  source 1..26: mol_type = other DNA
ctgagagggcctttagggaaagaatg

SEQ ID NO: 32721 - DNA, 29 bp, synthetic construct
  misc_feature 1..29: note = Synthetic Construct
  source 1..29: mol_type = other DNA
gggtaaagttggaggaactatactacttg

SEQ ID NO: 32722 - DNA, 21 bp, synthetic construct
  misc_feature 1..21: note = Synthetic Construct
  source 1..21: mol_type = other DNA
ggcaggctctgtggaagtcaa

SEQ ID NO: 32723 - DNA, 24 bp, synthetic construct
  misc_feature 1..24: note = Synthetic Construct
  source 1..24: mol_type = other DNA
caggcctgattcattctcctgcaa

SEQ ID NO: 32724 - DNA, 23 bp, synthetic construct
  misc_feature 1..23: note = Synthetic Construct
  source 1..23: mol_type = other DNA
ggggaaaagccctggccttatag

SEQ ID NO: 32725 - DNA, 20 bp, synthetic construct
  misc_feature 1..20: note = Synthetic Construct
  source 1..20: mol_type = other DNA
aaactgtgggtcacgctgat

SEQ ID NO: 32726 - DNA, 22 bp, synthetic construct
  misc_feature 1..22: note = Synthetic Construct
  source 1..22: mol_type = other DNA
gctccatggggaaggactctta

SEQ ID NO: 32727 - DNA, 20 bp, synthetic construct
  misc_feature 1..20: note = Synthetic Construct
  source 1..20: mol_type = other DNA
ccacgtggaggggcattcta

SEQ ID NO: 32728 - DNA, 22 bp, synthetic construct
  misc_feature 1..22: note = Synthetic Construct
  source 1..22: mol_type = other DNA
ccacccagaaggggttatccat

SEQ ID NO: 32729 - DNA, 28 bp, synthetic construct
  misc_feature 1..28: note = Synthetic Construct
  source 1..28: mol_type = other DNA
ggtactggattcagttcagtctaacttc

SEQ ID NO: 32730 - DNA, 20 bp, synthetic construct
  misc_feature 1..20: note = Synthetic Construct
  source 1..20: mol_type = other DNA
tgccaccgatgccagacaga

SEQ ID NO: 32731 - DNA, 21 bp, synthetic construct
  misc_feature 1..21: note = Synthetic Construct
  source 1..21: mol_type = other DNA
gcagccaggtcacagagcatt

SEQ ID NO: 32732 - DNA, 21 bp, synthetic construct
  misc_feature 1..21: note = Synthetic Construct
  source 1..21: mol_type = other DNA
ggcggaaagctaaaggcatgt

SEQ ID NO: 32733 - DNA, 25 bp, synthetic construct
  misc_feature 1..25: note = Synthetic Construct
  source 1..25: mol_type = other DNA
gctctttggtgagctgaactctttt

SEQ ID NO: 32734 - DNA, 21 bp, synthetic construct
  misc_feature 1..21: note = Synthetic Construct
  source 1..21: mol_type = other DNA
cttagcctgtggcactcaact

SEQ ID NO: 32735 - DNA, 22 bp, synthetic construct
  misc_feature 1..22: note = Synthetic Construct
  source 1..22: mol_type = other DNA
ctgctgaccccttcacctgtat

SEQ ID NO: 32736 - DNA, 22 bp, synthetic construct
  misc_feature 1..22: note = Synthetic Construct
  source 1..22: mol_type = other DNA
ctttaggggctggcacttttca

SEQ ID NO: 32737 - DNA, 23 bp, synthetic construct
  misc_feature 1..23: note = Synthetic Construct
  source 1..23: mol_type = other DNA
cagctgttttgtgccgcaaagat

SEQ ID NO: 32738 - DNA, 21 bp, synthetic construct
  misc_feature 1..21: note = Synthetic Construct
  source 1..21: mol_type = other DNA
gcccagccttgtaaagtggtt

SEQ ID NO: 32739 - DNA, 24 bp, synthetic construct
  misc_feature 1..24: note = Synthetic Construct
  source 1..24: mol_type = other DNA
ggtggatgggctggtatacaaatg

SEQ ID NO: 32740 - DNA, 21 bp, synthetic construct
  misc_feature 1..21: note = Synthetic Construct
  source 1..21: mol_type = other DNA
agtatactgcggggccatttc

SEQ ID NO: 32741 - DNA, 22 bp, synthetic construct
  misc_feature 1..22: note = Synthetic Construct
  source 1..22: mol_type = other DNA
aaaaggttcgctctggatggat

SEQ ID NO: 32742 - DNA, 21 bp, synthetic construct
  misc_feature 1..21: note = Synthetic Construct
  source 1..21: mol_type = other DNA
tttgaagccactgcagtctga

SEQ ID NO: 32743 - DNA, 23 bp, synthetic construct
  misc_feature 1..23: note = Synthetic Construct
  source 1..23: mol_type = other DNA
ctcaacaagcactgcagttgtaa

SEQ ID NO: 32744 - DNA, 20 bp, synthetic construct
  misc_feature 1..20: note = Synthetic Construct
  source 1..20: mol_type = other DNA
cggctgtgtttgctgcttgt

SEQ ID NO: 32745 - DNA, 24 bp, synthetic construct
  misc_feature 1..24: note = Synthetic Construct
  source 1..24: mol_type = other DNA
agcagaagatccttaatggcagaa

SEQ ID NO: 32746 - DNA, 25 bp, synthetic construct
  misc_feature 1..25: note = Synthetic Construct
  source 1..25: mol_type = other DNA
gctcagtgcatcccttctacctagt

SEQ ID NO: 32747 - DNA, 21 bp, synthetic construct
  misc_feature 1..21: note = Synthetic Construct
  source 1..21: mol_type = other DNA
gctctgggctctgcaggattt

SEQ ID NO: 32748 - DNA, 26 bp, synthetic construct
  misc_feature 1..26: note = Synthetic Construct
  source 1..26: mol_type = other DNA
ccacttgtcaagaacacgcaaggatt

SEQ ID NO: 32749 - DNA, 24 bp, synthetic construct
  misc_feature 1..24: note = Synthetic Construct
  source 1..24: mol_type = other DNA
ggggacctattgctcacaggaaga

SEQ ID NO: 32750 - DNA, 25 bp, synthetic construct
  misc_feature 1..25: note = Synthetic Construct
  source 1..25: mol_type = other DNA
gcaaaggaatcaagtggtgtcaagt

SEQ ID NO: 32751 - DNA, 18 bp, synthetic construct
  misc_feature 1..18: note = Synthetic Construct
  source 1..18: mol_type = other DNA
tggcccggttcagactgt

SEQ ID NO: 32752 - DNA, 25 bp, synthetic construct
  misc_feature 1..25: note = Synthetic Construct
  source 1..25: mol_type = other DNA
ccgaaaaatgaagttacaggggaaa

SEQ ID NO: 32753 - DNA, 27 bp, synthetic construct
  misc_feature 1..27: note = Synthetic Construct
  source 1..27: mol_type = other DNA
gcgaaaattccttcttgccttccttag

SEQ ID NO: 32754 - DNA, 24 bp, synthetic construct
  misc_feature 1..24: note = Synthetic Construct
  source 1..24: mol_type = other DNA
gcattccttggtgcaggctttaat

SEQ ID NO: 32755 - DNA, 20 bp, synthetic construct
  misc_feature 1..20: note = Synthetic Construct
  source 1..20: mol_type = other DNA
ggttgcagtggaggagttca

SEQ ID NO: 32756 - DNA, 23 bp, synthetic construct
  misc_feature 1..23: note = Synthetic Construct
  source 1..23: mol_type = other DNA
ccacacactcaacccacctaatg

SEQ ID NO: 32757 - DNA, 20 bp, synthetic construct
  misc_feature 1..20: note = Synthetic Construct
  source 1..20: mol_type = other DNA
caccctgcagtccagtcaaa

SEQ ID NO: 32758 - DNA, 23 bp, synthetic construct
  misc_feature 1..23: note = Synthetic Construct
  source 1..23: mol_type = other DNA
ggtctgctgtccagattcctact

SEQ ID NO: 32759 - DNA, 23 bp, synthetic construct
  misc_feature 1..23: note = Synthetic Construct
  source 1..23: mol_type = other DNA
ccatgcccagtccatacttgctt

SEQ ID NO: 32760 - DNA, 24 bp, synthetic construct
  misc_feature 1..24: note = Synthetic Construct
  source 1..24: mol_type = other DNA
cctctcttccgtctcctttccata

SEQ ID NO: 32761 - DNA, 23 bp, synthetic construct
  misc_feature 1..23: note = Synthetic Construct
  source 1..23: mol_type = other DNA
ctgtggtagcttgtttcgtgcaa

SEQ ID NO: 32762 - DNA, 25 bp, synthetic construct
  misc_feature 1..25: note = Synthetic Construct
  source 1..25: mol_type = other DNA
gctgtttcccagcagtatggaaatg

SEQ ID NO: 32763 - DNA, 30 bp, synthetic construct
  misc_feature 1..30: note = Synthetic Construct
  source 1..30: mol_type = other DNA
gggccagaatctagtttaaggagagtttat

SEQ ID NO: 32764 - DNA, 18 bp, synthetic construct
  misc_feature 1..18: note = Synthetic Construct
  source 1..18: mol_type = other DNA
aaggcagccagggcacta

SEQ ID NO: 32765 - DNA, 26 bp, synthetic construct
  misc_feature 1..26: note = Synthetic Construct
  source 1..26: mol_type = other DNA
gagaaccgagactcacaacattaaga

SEQ ID NO: 32766 - DNA, 23 bp, synthetic construct
  misc_feature 1..23: note = Synthetic Construct
  source 1..23: mol_type = other DNA
ctggccacattcaccaaccaaag

SEQ ID NO: 32767 - DNA, 21 bp, synthetic construct
  misc_feature 1..21: note = Synthetic Construct
  source 1..21: mol_type = other DNA
aagccagctcagacaggattg

SEQ ID NO: 32768 - DNA, 21 bp, synthetic construct
  misc_feature 1..21: note = Synthetic Construct
  source 1..21: mol_type = other DNA
tctccacagctcacgctggta

SEQ ID NO: 32769 - DNA, 21 bp, synthetic construct
  misc_feature 1..21: note = Synthetic Construct
  source 1..21: mol_type = other DNA
ccagcacagcccatacagtag

SEQ ID NO: 32770 - DNA, 20 bp, synthetic construct
  misc_feature 1..20: note = Synthetic Construct
  source 1..20: mol_type = other DNA
aggaaacaggtgcccctaca

SEQ ID NO: 32771 - DNA, 24 bp, synthetic construct
  misc_feature 1..24: note = Synthetic Construct
  source 1..24: mol_type = other DNA
caaagtgaggcacgcatactcata

SEQ ID NO: 32772 - DNA, 19 bp, synthetic construct
  misc_feature 1..19: note = Synthetic Construct
  source 1..19: mol_type = other DNA
ggggaggcagcatggaaaa

SEQ ID NO: 32773 - DNA, 18 bp, synthetic construct
  misc_feature 1..18: note = Synthetic Construct
  source 1..18: mol_type = other DNA
agaggcgtccagcgtttc

SEQ ID NO: 32774 - DNA, 21 bp, synthetic construct
  misc_feature 1..21: note = Synthetic Construct
  source 1..21: mol_type = other DNA
gcaccagcccttcctcacttt

SEQ ID NO: 32775 - DNA, 24 bp, synthetic construct
  misc_feature 1..24: note = Synthetic Construct
  source 1..24: mol_type = other DNA
gcccgcttaatagctgaggtcaca

SEQ ID NO: 32776 - DNA, 26 bp, synthetic construct
  misc_feature 1..26: note = Synthetic Construct
  source 1..26: mol_type = other DNA
cacagcttttacctcctaagaacttg

SEQ ID NO: 32777 - DNA, 25 bp, synthetic construct
  misc_feature 1..25: note = Synthetic Construct
  source 1..25: mol_type = other DNA
ctctggacctcggtttctttgtttc

SEQ ID NO: 32778 - DNA, 21 bp, synthetic construct
  misc_feature 1..21: note = Synthetic Construct
  source 1..21: mol_type = other DNA
gccacctgccatagccactta

SEQ ID NO: 32779 - DNA, 25 bp, synthetic construct
  misc_feature 1..25: note = Synthetic Construct
  source 1..25: mol_type = other DNA
ccctaagaaccagcaccttctattg

SEQ ID NO: 32780 - DNA, 27 bp, synthetic construct
  misc_feature 1..27: note = Synthetic Construct
  source 1..27: mol_type = other DNA
ctcaaaaccgaaatgtgaccctttttc

SEQ ID NO: 32781 - DNA, 19 bp, synthetic construct
  misc_feature 1..19: note = Synthetic Construct
  source 1..19: mol_type = other DNA
cggtactcggccacaccaa

SEQ ID NO: 32782 - DNA, 27 bp, synthetic construct
  misc_feature 1..27: note = Synthetic Construct
  source 1..27: mol_type = other DNA
ctcagtggcctgataattacattgagt

SEQ ID NO: 32783 - DNA, 26 bp, synthetic construct
  misc_feature 1..26: note = Synthetic Construct
  source 1..26: mol_type = other DNA
cagccaccagctctgtatagtagtta

SEQ ID NO: 32784 - DNA, 20 bp, synthetic construct
  misc_feature 1..20: note = Synthetic Construct
  source 1..20: mol_type = other DNA
ggccaggaagtccacaatca

SEQ ID NO: 32785 - DNA, 25 bp, synthetic construct
  misc_feature 1..25: note = Synthetic Construct
  source 1..25: mol_type = other DNA
gcttcccatactggtcttgatggat

SEQ ID NO: 32786 - DNA, 19 bp, synthetic construct
  misc_feature 1..19: note = Synthetic Construct
  source 1..19: mol_type = other DNA
acggagccggaatctctga

SEQ ID NO: 32787 - DNA, 24 bp, synthetic construct
  misc_feature 1..24: note = Synthetic Construct
  source 1..24: mol_type = other DNA
cccctaaaaatgggtgcaggaatc

SEQ ID NO: 32788 - DNA, 26 bp, synthetic construct
  misc_feature 1..26: note = Synthetic Construct
  source 1..26: mol_type = other DNA
gacccttcctaatcatggaagtcttt

SEQ ID NO: 32789 - DNA, 26 bp, synthetic construct
  misc_feature 1..26: note = Synthetic Construct
  source 1..26: mol_type = other DNA
gtcttacaaagtcgttgatcccacaa

SEQ ID NO: 32790 - DNA, 22 bp, synthetic construct
  misc_feature 1..22: note = Synthetic Construct
  source 1..22: mol_type = other DNA
tcgggccatgtcatctgaggat

SEQ ID NO: 32791 - DNA, 22 bp, synthetic construct
  misc_feature 1..22: note = Synthetic Construct
  source 1..22: mol_type = other DNA
ggactggctgcctaaactgtca

SEQ ID NO: 32792 - DNA, 23 bp, synthetic construct
  misc_feature 1..23: note = Synthetic Construct
  source 1..23: mol_type = other DNA
gcaaagtgaatctccacggaagt

SEQ ID NO: 32793 - DNA, 22 bp, synthetic construct
  misc_feature 1..22: note = Synthetic Construct
  source 1..22: mol_type = other DNA
agagggttgcgtggatggttac

SEQ ID NO: 32794 - DNA, 23 bp, synthetic construct
  misc_feature 1..23: note = Synthetic Construct
  source 1..23: mol_type = other DNA
gctcaccactgctcttgttcctt

SEQ ID NO: 32795 - DNA, 22 bp, synthetic construct
  misc_feature 1..22: note = Synthetic Construct
  source 1..22: mol_type = other DNA
gccccaggaaatgtagccctat

SEQ ID NO: 32796 - DNA, 24 bp, synthetic construct
  misc_feature 1..24: note = Synthetic Construct
  source 1..24: mol_type = other DNA
agatgctttgtcgcatgtagtttg

SEQ ID NO: 32797 - DNA, 23 bp, synthetic construct
  misc_feature 1..23: note = Synthetic Construct
  source 1..23: mol_type = other DNA
tccattactggccttgacctttg

SEQ ID NO: 32798 - DNA, 20 bp, synthetic construct
  misc_feature 1..20: note = Synthetic Construct
  source 1..20: mol_type = other DNA
agccaccacgttgctgtgat

SEQ ID NO: 32799 - DNA, 24 bp, synthetic construct
  misc_feature 1..24: note = Synthetic Construct
  source 1..24: mol_type = other DNA
agtgacagctcaattctgatgcta

SEQ ID NO: 32800 - DNA, 22 bp, synthetic construct
  misc_feature 1..22: note = Synthetic Construct
  source 1..22: mol_type = other DNA
ctgcaggtccatgtctctcttc

SEQ ID NO: 32801 - DNA, 22 bp, synthetic construct
  misc_feature 1..22: note = Synthetic Construct
  source 1..22: mol_type = other DNA
gaacccaacagaacccaagact

SEQ ID NO: 32802 - DNA, 24 bp, synthetic construct
  misc_feature 1..24: note = Synthetic Construct
  source 1..24: mol_type = other DNA
tgatgcttggatgaagtgatgctt

SEQ ID NO: 32803 - DNA, 20 bp, synthetic construct
  misc_feature 1..20: note = Synthetic Construct
  source 1..20: mol_type = other DNA
acacagcagctccctcttgt

SEQ ID NO: 32804 - DNA, 23 bp, synthetic construct
  misc_feature 1..23: note = Synthetic Construct
  source 1..23: mol_type = other DNA
gccaactaccagtcactgtatca

SEQ ID NO: 32805 - DNA, 25 bp, synthetic construct
  misc_feature 1..25: note = Synthetic Construct
  source 1..25: mol_type = other DNA
aggagctaaacatacaatggtgaca

SEQ ID NO: 32806 - DNA, 24 bp, synthetic construct
  misc_feature 1..24: note = Synthetic Construct
  source 1..24: mol_type = other DNA
gggtttgggctgttttcacgtcta

SEQ ID NO: 32807 - DNA, 24 bp, synthetic construct
  misc_feature 1..24: note = Synthetic Construct
  source 1..24: mol_type = other DNA
gcagaagaagcatggggtttaagt

SEQ ID NO: 32808 - DNA, 25 bp, synthetic construct
  misc_feature 1..25: note = Synthetic Construct
  source 1..25: mol_type = other DNA
ccccaagcctattgagacatctgta

SEQ ID NO: 32809 - DNA, 19 bp, synthetic construct
  misc_feature 1..19: note = Synthetic Construct
  source 1..19: mol_type = other DNA
tctgcctgggctcccgaaa

SEQ ID NO: 32810 - DNA, 25 bp, synthetic construct
  misc_feature 1..25: note = Synthetic Construct
  source 1..25: mol_type = other DNA
gaatgcatgtgggatccattactca

SEQ ID NO: 32811 - DNA, 22 bp, synthetic construct
  misc_feature 1..22: note = Synthetic Construct
  source 1..22: mol_type = other DNA
tgaggagggaaggaaggaaact

SEQ ID NO: 32812 - DNA, 25 bp, synthetic construct
  misc_feature 1..25: note = Synthetic Construct
  source 1..25: mol_type = other DNA
tgatggaagatgaacactccacttg

SEQ ID NO: 32813 - DNA, 24 bp, synthetic construct
  misc_feature 1..24: note = Synthetic Construct
  source 1..24: mol_type = other DNA
gtttcatgtgggtttttggcagtt

SEQ ID NO: 32814 - DNA, 25 bp, synthetic construct
  misc_feature 1..25: note = Synthetic Construct
  source 1..25: mol_type = other DNA
agagctgcctaaagctatcctctta

SEQ ID NO: 32815 - DNA, 20 bp, synthetic construct
  misc_feature 1..20: note = Synthetic Construct
  source 1..20: mol_type = other DNA
acttggctagggccttcaga

SEQ ID NO: 32816 - DNA, 26 bp, synthetic construct
  misc_feature 1..26: note = Synthetic Construct
  source 1..26: mol_type = other DNA
gtgttcccatcacatttttcggtatg

SEQ ID NO: 32817 - DNA, 25 bp, synthetic construct
  misc_feature 1..25: note = Synthetic Construct
  source 1..25: mol_type = other DNA
ggtgcaaaatctcattctccttgaa

SEQ ID NO: 32818 - DNA, 21 bp, synthetic construct
  misc_feature 1..21: note = Synthetic Construct
  source 1..21: mol_type = other DNA
tgaaggtggggagggtaaagt

SEQ ID NO: 32819 - DNA, 23 bp, synthetic construct
  misc_feature 1..23: note = Synthetic Construct
  source 1..23: mol_type = other DNA
ggtgagttcctcgaatggtgcat

SEQ ID NO: 32820 - DNA, 20 bp, synthetic construct
  misc_feature 1..20: note = Synthetic Construct
  source 1..20: mol_type = other DNA
agcaggccctgagttcttgt

SEQ ID NO: 32821 - DNA, 20 bp, synthetic construct
  misc_feature 1..20: note = Synthetic Construct
  source 1..20: mol_type = other DNA
caggctcatgggcagaaagt

SEQ ID NO: 32822 - DNA, 18 bp, synthetic construct
  misc_feature 1..18: note = Synthetic Construct
  source 1..18: mol_type = other DNA
tgcccggcctgtgaacat

SEQ ID NO: 32823 - DNA, 23 bp, synthetic construct
  misc_feature 1..23: note = Synthetic Construct
  source 1..23: mol_type = other DNA
atgcacggaatacctctggaaat

SEQ ID NO: 32824 - DNA, 20 bp, synthetic construct
  misc_feature 1..20: note = Synthetic Construct
  source 1..20: mol_type = other DNA
cgtggcccatgaagggtgaa

SEQ ID NO: 32825 - DNA, 20 bp, synthetic construct
  misc_feature 1..20: note = Synthetic Construct
  source 1..20: mol_type = other DNA
tcctgccaccccttctccat

SEQ ID NO: 32826 - DNA, 23 bp, synthetic construct
  misc_feature 1..23: note = Synthetic Construct
  source 1..23: mol_type = other DNA
agactccaccttgcttctgatct

SEQ ID NO: 32827 - DNA, 24 bp, synthetic construct
  misc_feature 1..24: note = Synthetic Construct
  source 1..24: mol_type = other DNA
agaacagcctgattgcaaagatga

SEQ ID NO: 32828 - DNA, 24 bp, synthetic construct
  misc_feature 1..24: note = Synthetic Construct
  source 1..24: mol_type = other DNA
aaattggtgggataccatgtccaa

SEQ ID NO: 32829 - DNA, 22 bp, synthetic construct
  misc_feature 1..22: note = Synthetic Construct
  source 1..22: mol_type = other DNA
tccatgcccacctaacatctca

SEQ ID NO: 32830 - DNA, 22 bp, synthetic construct
  misc_feature 1..22: note = Synthetic Construct
  source 1..22: mol_type = other DNA
ggatgggcaagtggttgtatct

SEQ ID NO: 32831 - DNA, 21 bp, synthetic construct
  misc_feature 1..21: note = Synthetic Construct
  source 1..21: mol_type = other DNA
tgagtgtccctgacctcaagt

SEQ ID NO: 32832 - DNA, 20 bp, synthetic construct
  misc_feature 1..20: note = Synthetic Construct
  source 1..20: mol_type = other DNA
aggccaagtccacacgatct

SEQ ID NO: 32833 - DNA, 22 bp, synthetic construct
  misc_feature 1..22: note = Synthetic Construct
  source 1..22: mol_type = other DNA
ggtggggagcactgttctcaag

SEQ ID NO: 32834 - DNA, 20 bp, synthetic construct
  misc_feature 1..20: note = Synthetic Construct
  source 1..20: mol_type = other DNA
tgcagagcaggacagggatt

SEQ ID NO: 32835 - DNA, 18 bp, synthetic construct
  misc_feature 1..18: note = Synthetic Construct
  source 1..18: mol_type = other DNA
cggctcttcgtggcttca

SEQ ID NO: 32836 - DNA, 25 bp, synthetic construct
  misc_feature 1..25: note = Synthetic Construct
  source 1..25: mol_type = other DNA
gcactcctgaaaagtggacccaaat

SEQ ID NO: 32837 - DNA, 25 bp, synthetic construct
  misc_feature 1..25: note = Synthetic Construct
  source 1..25: mol_type = other DNA
gacccacaaagctgaagatgtttac

SEQ ID NO: 32838 - DNA, 23 bp, synthetic construct
  misc_feature 1..23: note = Synthetic Construct
  source 1..23: mol_type = other DNA
agggattcaggctgtttccattc

SEQ ID NO: 32839 - DNA, 26 bp, synthetic construct
  misc_feature 1..26: note = Synthetic Construct
  source 1..26: mol_type = other DNA
cagtctttacttagtgggcccaaatc

SEQ ID NO: 32840 - DNA, 24 bp, synthetic construct
  misc_feature 1..24: note = Synthetic Construct
  source 1..24: mol_type = other DNA
ggaaatcaggaaggtgatgtgtca

SEQ ID NO: 32841 - DNA, 22 bp, synthetic construct
  misc_feature 1..22: note = Synthetic Construct
  source 1..22: mol_type = other DNA
acagcagggacaaaaaggatca

SEQ ID NO: 32842 - DNA, 20 bp, synthetic construct
  misc_feature 1..20: note = Synthetic Construct
  source 1..20: mol_type = other DNA
tttcccaacggcctctcaca

SEQ ID NO: 32843 - DNA, 22 bp, synthetic construct
  misc_feature 1..22: note = Synthetic Construct
  source 1..22: mol_type = other DNA
tggtcctctggctagaaacagt

SEQ ID NO: 32844 - DNA, 23 bp, synthetic construct
  misc_feature 1..23: note = Synthetic Construct
  source 1..23: mol_type = other DNA
gctgtgcagtgagatacaggtaa

SEQ ID NO: 32845 - DNA, 23 bp, synthetic construct
  misc_feature 1..23: note = Synthetic Construct
  source 1..23: mol_type = other DNA
cacagtcccaggctgacttcatt

SEQ ID NO: 32846 - DNA, 18 bp, synthetic construct
  misc_feature 1..18: note = Synthetic Construct
  source 1..18: mol_type = other DNA
ccaagccctgctggttca

SEQ ID NO: 32847 - DNA, 24 bp, synthetic construct
  misc_feature 1..24: note = Synthetic Construct
  source 1..24: mol_type = other DNA
ggaggagaagactcatccagtcaa

SEQ ID NO: 32848 - DNA, 28 bp, synthetic construct
  misc_feature 1..28: note = Synthetic Construct
  source 1..28: mol_type = other DNA
ccattaagtccaagatagaggagccatt

SEQ ID NO: 32849 - DNA, 20 bp, synthetic construct
  misc_feature 1..20: note = Synthetic Construct
  source 1..20: mol_type = other DNA
acaactcagcggctcgtaag

SEQ ID NO: 32850 - DNA, 22 bp, synthetic construct
  misc_feature 1..22: note = Synthetic Construct
  source 1..22: mol_type = other DNA
ctcacgcttgtgaaaccaacat

SEQ ID NO: 32851 - DNA, 22 bp, synthetic construct
  misc_feature 1..22: note = Synthetic Construct
  source 1..22: mol_type = other DNA
acagctccaggggcactaaact

SEQ ID NO: 32852 - DNA, 22 bp, synthetic construct
  misc_feature 1..22: note = Synthetic Construct
  source 1..22: mol_type = other DNA
ggcccacctcctcaggattaga

SEQ ID NO: 32853 - DNA, 23 bp, synthetic construct
  misc_feature 1..23: note = Synthetic Construct
  source 1..23: mol_type = other DNA
ctggagctagaggaaagggtgaa

SEQ ID NO: 32854 - DNA, 22 bp, synthetic construct
  misc_feature 1..22: note = Synthetic Construct
  source 1..22: mol_type = other DNA
gcaggcaccacaagctttcttc

SEQ ID NO: 32855 - DNA, 21 bp, synthetic construct
  misc_feature 1..21: note = Synthetic Construct
  source 1..21: mol_type = other DNA
gcaaccttggtgagtgagtct

SEQ ID NO: 32856 - DNA, 20 bp, synthetic construct
  misc_feature 1..20: note = Synthetic Construct
  source 1..20: mol_type = other DNA
accatgtggggctcagaatg

SEQ ID NO: 32857 - DNA, 25 bp, synthetic construct
  misc_feature 1..25: note = Synthetic Construct
  source 1..25: mol_type = other DNA
ccgctagaaaatttcgcaggattag

SEQ ID NO: 32858 - DNA, 27 bp, synthetic construct
  misc_feature 1..27: note = Synthetic Construct
  source 1..27: mol_type = other DNA
ccctttcccaaaactaaaccacctttg

SEQ ID NO: 32859 - DNA, 20 bp, synthetic construct
  misc_feature 1..20: note = Synthetic Construct
  source 1..20: mol_type = other DNA
tcaagagggcagtccaggaa

SEQ ID NO: 32860 - DNA, 20 bp, synthetic construct
  misc_feature 1..20: note = Synthetic Construct
  source 1..20: mol_type = other DNA
acggacccatgtgactgtct

SEQ ID NO: 32861 - DNA, 26 bp, synthetic construct
  misc_feature 1..26: note = Synthetic Construct
  source 1..26: mol_type = other DNA
gctcccttcagaagcatgtacactaa

SEQ ID NO: 32862 - DNA, 23 bp, synthetic construct
  misc_feature 1..23: note = Synthetic Construct
  source 1..23: mol_type = other DNA
attaggcccaagctggccagaag

SEQ ID NO: 32863 - DNA, 23 bp, synthetic construct
  misc_feature 1..23: note = Synthetic Construct
  source 1..23: mol_type = other DNA
gtcaatgcctgcaacaatgacaa

SEQ ID NO: 32864 - DNA, 23 bp, synthetic construct
  misc_feature 1..23: note = Synthetic Construct
  source 1..23: mol_type = other DNA
tgggtctcaaagtggttggattc

SEQ ID NO: 32865 - DNA, 27 bp, synthetic construct
  misc_feature 1..27: note = Synthetic Construct
  source 1..27: mol_type = other DNA
gagaacttctagagaaacagggtagtt

SEQ ID NO: 32866 - DNA, 28 bp, synthetic construct
  misc_feature 1..28: note = Synthetic Construct
  source 1..28: mol_type = other DNA
gagtcccaggactacagatctagtgaaa

SEQ ID NO: 32867 - DNA, 23 bp, synthetic construct
  misc_feature 1..23: note = Synthetic Construct
  source 1..23: mol_type = other DNA
ccagcttaactcccagctgtcaa

SEQ ID NO: 32868 - DNA, 22 bp, synthetic construct
  misc_feature 1..22: note = Synthetic Construct
  source 1..22: mol_type = other DNA
agctcccctctgggtgagtatt

SEQ ID NO: 32869 - DNA, 24 bp, synthetic construct
  misc_feature 1..24: note = Synthetic Construct
  source 1..24: mol_type = other DNA
ccccacaatggcaggatctacaac

SEQ ID NO: 32870 - DNA, 24 bp, synthetic construct
  misc_feature 1..24: note = Synthetic Construct
  source 1..24: mol_type = other DNA
tggtaccacaaagtcagaaacgta

SEQ ID NO: 32871 - DNA, 22 bp, synthetic construct
  misc_feature 1..22: note = Synthetic Construct
  source 1..22: mol_type = other DNA
ggtccctcagtgttgcagctat

SEQ ID NO: 32872 - DNA, 24 bp, synthetic construct
  misc_feature 1..24: note = Synthetic Construct
  source 1..24: mol_type = other DNA
gctctgtacccacactaaggaaag

SEQ ID NO: 32873 - DNA, 21 bp, synthetic construct
  misc_feature 1..21: note = Synthetic Construct
  source 1..21: mol_type = other DNA
gccagacaagtagcccacaga

SEQ ID NO: 32874 - DNA, 25 bp, synthetic construct
  misc_feature 1..25: note = Synthetic Construct
  source 1..25: mol_type = other DNA
gccttcaagagactcatctaacaca

SEQ ID NO: 32875 - DNA, 23 bp, synthetic construct
  misc_feature 1..23: note = Synthetic Construct
  source 1..23: mol_type = other DNA
gctgccaaagtgagcacaattca

SEQ ID NO: 32876 - DNA, 20 bp, synthetic construct
  misc_feature 1..20: note = Synthetic Construct
  source 1..20: mol_type = other DNA
ttgccagtgcttccaactca

SEQ ID NO: 32877 - DNA, 21 bp, synthetic construct
  misc_feature 1..21: note = Synthetic Construct
  source 1..21: mol_type = other DNA
cccatcactccgcaagagaca

SEQ ID NO: 32878 - DNA, 22 bp, synthetic construct
  misc_feature 1..22: note = Synthetic Construct
  source 1..22: mol_type = other DNA
tgtctgccggagggcttatagt

SEQ ID NO: 32879 - DNA, 22 bp, synthetic construct
  misc_feature 1..22: note = Synthetic Construct
  source 1..22: mol_type = other DNA
ggacagggcactatgtggaaag

SEQ ID NO: 32880 - DNA, 29 bp, synthetic construct
  misc_feature 1..29: note = Synthetic Construct
  source 1..29: mol_type = other DNA
cagatggaatctgtcttagatgtggatgt

SEQ ID NO: 32881 - DNA, 26 bp, synthetic construct
  misc_feature 1..26: note = Synthetic Construct
  source 1..26: mol_type = other DNA
gagagatgccaagagtccatacattg

SEQ ID NO: 32882 - DNA, 20 bp, synthetic construct
  misc_feature 1..20: note = Synthetic Construct
  source 1..20: mol_type = other DNA
ctcacggggctcctttttga

SEQ ID NO: 32883 - DNA, 22 bp, synthetic construct
  misc_feature 1..22: note = Synthetic Construct
  source 1..22: mol_type = other DNA
gtgggatggaaggtccagaaac

SEQ ID NO: 32884 - DNA, 19 bp, synthetic construct
  misc_feature 1..19: note = Synthetic Construct
  source 1..19: mol_type = other DNA
tgcacctaggcggctgtga

SEQ ID NO: 32885 - DNA, 25 bp, synthetic construct
  misc_feature 1..25: note = Synthetic Construct
  source 1..25: mol_type = other DNA
gggacacaataccatgcctttgtta

SEQ ID NO: 32886 - DNA, 20 bp, synthetic construct
  misc_feature 1..20: note = Synthetic Construct
  source 1..20: mol_type = other DNA
cgtgcaggacttgtcgttct

SEQ ID NO: 32887 - DNA, 23 bp, synthetic construct
  misc_feature 1..23: note = Synthetic Construct
  source 1..23: mol_type = other DNA
gcctcttctgtattgctcgtttg

SEQ ID NO: 32888 - DNA, 27 bp, synthetic construct
  misc_feature 1..27: note = Synthetic Construct
  source 1..27: mol_type = other DNA
gactagaagaccactttttcccaaatg

SEQ ID NO: 32889 - DNA, 25 bp, synthetic construct
  misc_feature 1..25: note = Synthetic Construct
  source 1..25: mol_type = other DNA
ctgaggttcacactgaaaggaacaa

SEQ ID NO: 32890 - DNA, 30 bp, synthetic construct
  misc_feature 1..30: note = Synthetic Construct
  source 1..30: mol_type = other DNA
gacaagttacgaagtcactgaatcctcttt

SEQ ID NO: 32891 - DNA, 21 bp, synthetic construct
  misc_feature 1..21: note = Synthetic Construct
  source 1..21: mol_type = other DNA
gtgccatgtttcctgccactt

SEQ ID NO: 32892 - DNA, 24 bp, synthetic construct
  misc_feature 1..24: note = Synthetic Construct
  source 1..24: mol_type = other DNA
aaagtcctcagagaccaagagttg

SEQ ID NO: 32893 - DNA, 26 bp, synthetic construct
  misc_feature 1..26: note = Synthetic Construct
  source 1..26: mol_type = other DNA
cctctcccttttcctcttgtctttta

SEQ ID NO: 32894 - DNA, 29 bp, synthetic construct
  misc_feature 1..29: note = Synthetic Construct
  source 1..29: mol_type = other DNA
ggctatgtatgcccttgtgtgtcatattc

SEQ ID NO: 32895 - DNA, 25 bp, synthetic construct
  misc_feature 1..25: note = Synthetic Construct
  source 1..25: mol_type = other DNA
caggggcctgatagtgaactaaatc

SEQ ID NO: 32896 - DNA, 25 bp, synthetic construct
  misc_feature 1..25: note = Synthetic Construct
  source 1..25: mol_type = other DNA
tgtaagcctagttccttcctcattc

SEQ ID NO: 32897 - DNA, 26 bp, synthetic construct
  misc_feature 1..26: note = Synthetic Construct
  source 1..26: mol_type = other DNA
ctccttctttctccaggaaccattag

SEQ ID NO: 32898 - DNA, 21 bp, synthetic construct
  misc_feature 1..21: note = Synthetic Construct
  source 1..21: mol_type = other DNA
gggtcctacagggcacagact

SEQ ID NO: 32899 - DNA, 23 bp, synthetic construct
  misc_feature 1..23: note = Synthetic Construct
  source 1..23: mol_type = other DNA
tgggtttctgttgcagtttgact

SEQ ID NO: 32900 - DNA, 22 bp, synthetic construct
  misc_feature 1..22: note = Synthetic Construct
  source 1..22: mol_type = other DNA
ctcccagcttcatgggagtttc

SEQ ID NO: 32901 - DNA, 25 bp, synthetic construct
  misc_feature 1..25: note = Synthetic Construct
  source 1..25: mol_type = other DNA
agcagactcttaaaatccgatctgt

SEQ ID NO: 32902 - DNA, 23 bp, synthetic construct
  misc_feature 1..23: note = Synthetic Construct
  source 1..23: mol_type = other DNA
tgcagccataggtaaatggcttt

SEQ ID NO: 32903 - DNA, 23 bp, synthetic construct
  misc_feature 1..23: note = Synthetic Construct
  source 1..23: mol_type = other DNA
gacagcctttccagtgctattca

SEQ ID NO: 32904 - DNA, 20 bp, synthetic construct
  misc_feature 1..20: note = Synthetic Construct
  source 1..20: mol_type = other DNA
tctttcccgcctgagtgtca

SEQ ID NO: 32905 - DNA, 20 bp, synthetic construct
  misc_feature 1..20: note = Synthetic Construct
  source 1..20: mol_type = other DNA
tgctgccaggtaagatgcaa

SEQ ID NO: 32906 - DNA, 23 bp, synthetic construct
  misc_feature 1..23: note = Synthetic Construct
  source 1..23: mol_type = other DNA
ggtgactcaggaacaggagaact

SEQ ID NO: 32907 - DNA, 20 bp, synthetic construct
  misc_feature 1..20: note = Synthetic Construct
  source 1..20: mol_type = other DNA
gctccaccaccatcaacact

SEQ ID NO: 32908 - DNA, 21 bp, synthetic construct
  misc_feature 1..21: note = Synthetic Construct
  source 1..21: mol_type = other DNA
ctgcagttgcttctcctcaca

SEQ ID NO: 32909 - DNA, 24 bp, synthetic construct
  misc_feature 1..24: note = Synthetic Construct
  source 1..24: mol_type = other DNA
gttcccagtgtacttggatcacat

SEQ ID NO: 32910 - DNA, 27 bp, synthetic construct
  misc_feature 1..27: note = Synthetic Construct
  source 1..27: mol_type = other DNA
cttgagtgtgactgaggtaaatgaaag

SEQ ID NO: 32911 - DNA, 22 bp, synthetic construct
  misc_feature 1..22: note = Synthetic Construct
  source 1..22: mol_type = other DNA
cccctgtggacactcgactaca

SEQ ID NO: 32912 - DNA, 24 bp, synthetic construct
  misc_feature 1..24: note = Synthetic Construct
  source 1..24: mol_type = other DNA
cctcatttccaccatcctgtcctt

SEQ ID NO: 32913 - DNA, 24 bp, synthetic construct
  misc_feature 1..24: note = Synthetic Construct
  source 1..24: mol_type = other DNA
agagtctggccaaattccagtaaa

SEQ ID NO: 32914 - DNA, 20 bp, synthetic construct
  misc_feature 1..20: note = Synthetic Construct
  source 1..20: mol_type = other DNA
ggcagcaatgcctgctacat

SEQ ID NO: 32915 - DNA, 20 bp, synthetic construct
  misc_feature 1..20: note = Synthetic Construct
  source 1..20: mol_type = other DNA
tgccagggtcaatggaggaa

SEQ ID NO: 32916 - DNA, 24 bp, synthetic construct
  misc_feature 1..24: note = Synthetic Construct
  source 1..24: mol_type = other DNA
cagccaaacagaatactccagctt

SEQ ID NO: 32917 - DNA, 22 bp, synthetic construct
  misc_feature 1..22: note = Synthetic Construct
  source 1..22: mol_type = other DNA
tcaacctcccctgccatggtta

SEQ ID NO: 32918 - DNA, 21 bp, synthetic construct
  misc_feature 1..21: note = Synthetic Construct
  source 1..21: mol_type = other DNA
agccggatggtccagagatga

SEQ ID NO: 32919 - DNA, 22 bp, synthetic construct
  misc_feature 1..22: note = Synthetic Construct
  source 1..22: mol_type = other DNA
tttgccagaagttcagcagtct

SEQ ID NO: 32920 - DNA, 23 bp, synthetic construct
  misc_feature 1..23: note = Synthetic Construct
  source 1..23: mol_type = other DNA
ggggacaagcaaggcattagtgt

SEQ ID NO: 32921 - DNA, 24 bp, synthetic construct
  misc_feature 1..24: note = Synthetic Construct
  source 1..24: mol_type = other DNA
tcccaaatgagaccagagttgaag

SEQ ID NO: 32922 - DNA, 22 bp, synthetic construct
  misc_feature 1..22: note = Synthetic Construct
  source 1..22: mol_type = other DNA
gacgaatgtcctcagcactaca

SEQ ID NO: 32923 - DNA, 25 bp, synthetic construct
  misc_feature 1..25: note = Synthetic Construct
  source 1..25: mol_type = other DNA
tgtttaacacgagacagaacccaaa

SEQ ID NO: 32924 - DNA, 21 bp, synthetic construct
  misc_feature 1..21: note = Synthetic Construct
  source 1..21: mol_type = other DNA
ccagctcacgtgtgtggctta

SEQ ID NO: 32925 - DNA, 24 bp, synthetic construct
  misc_feature 1..24: note = Synthetic Construct
  source 1..24: mol_type = other DNA
cctcaacagccctgagtctgtttc

SEQ ID NO: 32926 - DNA, 23 bp, synthetic construct
  misc_feature 1..23: note = Synthetic Construct
  source 1..23: mol_type = other DNA
cgaagaggggatccagctctaat

SEQ ID NO: 32927 - DNA, 22 bp, synthetic construct
  misc_feature 1..22: note = Synthetic Construct
  source 1..22: mol_type = other DNA
ccatgccagcagaactttcact

SEQ ID NO: 32928 - DNA, 27 bp, synthetic construct
  misc_feature 1..27: note = Synthetic Construct
  source 1..27: mol_type = other DNA
gtaggataaattaaggcaagcgtcttc

SEQ ID NO: 32929 - DNA, 26 bp, synthetic construct
  misc_feature 1..26: note = Synthetic Construct
  source 1..26: mol_type = other DNA
catttcccatcatcctggttcttttc

SEQ ID NO: 32930 - DNA, 23 bp, synthetic construct
  misc_feature 1..23: note = Synthetic Construct
  source 1..23: mol_type = other DNA
ggcttcaggcaccagaatacaca

SEQ ID NO: 32931 - DNA, 22 bp, synthetic construct
  misc_feature 1..22: note = Synthetic Construct
  source 1..22: mol_type = other DNA
ggctgagggccttcaatcaaca

SEQ ID NO: 32932 - DNA, 19 bp, synthetic construct
  misc_feature 1..19: note = Synthetic Construct
  source 1..19: mol_type = other DNA
gtgcagtggcgatggtagt

SEQ ID NO: 32933 - DNA, 21 bp, synthetic construct
  misc_feature 1..21: note = Synthetic Construct
  source 1..21: mol_type = other DNA
gttcacaccaggcagtgatct

SEQ ID NO: 32934 - DNA, 23 bp, synthetic construct
  misc_feature 1..23: note = Synthetic Construct
  source 1..23: mol_type = other DNA
gctcttggacagcacaggtctat

SEQ ID NO: 32935 - DNA, 23 bp, synthetic construct
  misc_feature 1..23: note = Synthetic Construct
  source 1..23: mol_type = other DNA
gcctaggcagcatagtgagattc

SEQ ID NO: 32936 - DNA, 25 bp, synthetic construct
  misc_feature 1..25: note = Synthetic Construct
  source 1..25: mol_type = other DNA
cacagaaaactaagtcgcccagagt

SEQ ID NO: 32937 - DNA, 20 bp, synthetic construct
  misc_feature 1..20: note = Synthetic Construct
  source 1..20: mol_type = other DNA
acctggactcctgcttgctt

SEQ ID NO: 32938 - DNA, 23 bp, synthetic construct
  misc_feature 1..23: note = Synthetic Construct
  source 1..23: mol_type = other DNA
ggaggttattggcttctgcttct

SEQ ID NO: 32939 - DNA, 23 bp, synthetic construct
  misc_feature 1..23: note = Synthetic Construct
  source 1..23: mol_type = other DNA
agcaaggttcagtctggaaatga

SEQ ID NO: 32940 - DNA, 26 bp, synthetic construct
  misc_feature 1..26: note = Synthetic Construct
  source 1..26: mol_type = other DNA
gttcagacccacgaaaagtacttgaa

SEQ ID NO: 32941 - DNA, 22 bp, synthetic construct
  misc_feature 1..22: note = Synthetic Construct
  source 1..22: mol_type = other DNA
cagcaactaaggctttgccatt

SEQ ID NO: 32942 - DNA, 24 bp, synthetic construct
  misc_feature 1..24: note = Synthetic Construct
  source 1..24: mol_type = other DNA
ccctctgggtcatcccttcatttc

SEQ ID NO: 32943 - DNA, 22 bp, synthetic construct
  misc_feature 1..22: note = Synthetic Construct
  source 1..22: mol_type = other DNA
cctcccctcctcagcatcattg

SEQ ID NO: 32944 - DNA, 22 bp, synthetic construct
  misc_feature 1..22: note = Synthetic Construct
  source 1..22: mol_type = other DNA
ctgggagcagaacccagcattt

SEQ ID NO: 32945 - DNA, 25 bp, synthetic construct
  misc_feature 1..25: note = Synthetic Construct
  source 1..25: mol_type = other DNA
gaggagtcaggtcaggagtagaaac

SEQ ID NO: 32946 - DNA, 22 bp, synthetic construct
  misc_feature 1..22: note = Synthetic Construct
  source 1..22: mol_type = other DNA
gctcgagagttggttgcagttg

SEQ ID NO: 32947 - DNA, 21 bp, synthetic construct
  misc_feature 1..21: note = Synthetic Construct
  source 1..21: mol_type = other DNA
tcagacaggccatgggatcta

SEQ ID NO: 32948 - DNA, 23 bp, synthetic construct
  misc_feature 1..23: note = Synthetic Construct
  source 1..23: mol_type = other DNA
gcaatggaagggtagtgggtact

SEQ ID NO: 32949 - DNA, 20 bp, synthetic construct
  misc_feature 1..20: note = Synthetic Construct
  source 1..20: mol_type = other DNA
ctgacgctggatggccaaat

SEQ ID NO: 32950 - DNA, 23 bp, synthetic construct
  misc_feature 1..23: note = Synthetic Construct
  source 1..23: mol_type = other DNA
gccactggacttacttcgcaaat

SEQ ID NO: 32951 - DNA, 24 bp, synthetic construct
  misc_feature 1..24: note = Synthetic Construct
  source 1..24: mol_type = other DNA
ctgaactggcttcacaaaaacaca

SEQ ID NO: 32952 - DNA, 20 bp, synthetic construct
  misc_feature 1..20: note = Synthetic Construct
  source 1..20: mol_type = other DNA
gccgcagcagcttctcattc

SEQ ID NO: 32953 - DNA, 27 bp, synthetic construct
  misc_feature 1..27: note = Synthetic Construct
  source 1..27: mol_type = other DNA
gttctagcattggaggaaatccaaagt

SEQ ID NO: 32954 - DNA, 24 bp, synthetic construct
  misc_feature 1..24: note = Synthetic Construct
  source 1..24: mol_type = other DNA
acttgagtgtttgggtcaacaaga

SEQ ID NO: 32955 - DNA, 21 bp, synthetic construct
  misc_feature 1..21: note = Synthetic Construct
  source 1..21: mol_type = other DNA
agagccctgctcctagtctct

SEQ ID NO: 32956 - DNA, 22 bp, synthetic construct
  misc_feature 1..22: note = Synthetic Construct
  source 1..22: mol_type = other DNA
gccatctggaggcagctgaaat

SEQ ID NO: 32957 - DNA, 26 bp, synthetic construct
  misc_feature 1..26: note = Synthetic Construct
  source 1..26: mol_type = other DNA
ccccaatacctttaaagctggagcaa

SEQ ID NO: 32958 - DNA, 23 bp, synthetic construct
  misc_feature 1..23: note = Synthetic Construct
  source 1..23: mol_type = other DNA
agactagctgagggaaagtgtga

SEQ ID NO: 32959 - DNA, 22 bp, synthetic construct
  misc_feature 1..22: note = Synthetic Construct
  source 1..22: mol_type = other DNA
cctggattgccccacattccat

SEQ ID NO: 32960 - DNA, 20 bp, synthetic construct
  misc_feature 1..20: note = Synthetic Construct
  source 1..20: mol_type = other DNA
ggcctcgtaaaaggcaggat

SEQ ID NO: 32961 - DNA, 23 bp, synthetic construct
  misc_feature 1..23: note = Synthetic Construct
  source 1..23: mol_type = other DNA
tgacgactggattgtccaacaaa

SEQ ID NO: 32962 - DNA, 22 bp, synthetic construct
  misc_feature 1..22: note = Synthetic Construct
  source 1..22: mol_type = other DNA
tgagtccaggtgactgtaggaa

SEQ ID NO: 32963 - DNA, 20 bp, synthetic construct
  misc_feature 1..20: note = Synthetic Construct
  source 1..20: mol_type = other DNA
agacccagggcacttctgat

SEQ ID NO: 32964 - DNA, 27 bp, synthetic construct
  misc_feature 1..27: note = Synthetic Construct
  source 1..27: mol_type = other DNA
ctcatctctgggtctctcctttagatg

SEQ ID NO: 32965 - DNA, 23 bp, synthetic construct
  misc_feature 1..23: note = Synthetic Construct
  source 1..23: mol_type = other DNA
aggtgtcctcctcccattcttag

SEQ ID NO: 32966 - DNA, 22 bp, synthetic construct
  misc_feature 1..22: note = Synthetic Construct
  source 1..22: mol_type = other DNA
tgaggttgcaattcacccagaa

SEQ ID NO: 32967 - DNA, 22 bp, synthetic construct
  misc_feature 1..22: note = Synthetic Construct
  source 1..22: mol_type = other DNA
ggtgtgcatctgtgggcatatc

SEQ ID NO: 32968 - DNA, 24 bp, synthetic construct
  misc_feature 1..24: note = Synthetic Construct
  source 1..24: mol_type = other DNA
gtgccctaatgatcagtcttcagt

SEQ ID NO: 32969 - DNA, 20 bp, synthetic construct
  misc_feature 1..20: note = Synthetic Construct
  source 1..20: mol_type = other DNA
agccacaggcgagcacatag

SEQ ID NO: 32970 - DNA, 21 bp, synthetic construct
  misc_feature 1..21: note = Synthetic Construct
  source 1..21: mol_type = other DNA
ccccaaacccttcggttttca

SEQ ID NO: 32971 - DNA, 23 bp, synthetic construct
  misc_feature 1..23: note = Synthetic Construct
  source 1..23: mol_type = other DNA
aggataatgctggcaaagacaca

SEQ ID NO: 32972 - DNA, 27 bp, synthetic construct
  misc_feature 1..27: note = Synthetic Construct
  source 1..27: mol_type = other DNA
ctctgtaactttctggcattggagtct

SEQ ID NO: 32973 - DNA, 20 bp, synthetic construct
  misc_feature 1..20: note = Synthetic Construct
  source 1..20: mol_type = other DNA
tgcagctgggcttagcaact

SEQ ID NO: 32974 - DNA, 21 bp, synthetic construct
  misc_feature 1..21: note = Synthetic Construct
  source 1..21: mol_type = other DNA
acccctaccccaggagttttg

SEQ ID NO: 32975 - DNA, 19 bp, synthetic construct
  misc_feature 1..19: note = Synthetic Construct
  source 1..19: mol_type = other DNA
cggtgcccaagggcatgat

SEQ ID NO: 32976 - DNA, 27 bp, synthetic construct
  misc_feature 1..27: note = Synthetic Construct
  source 1..27: mol_type = other DNA
gttctgtgttagaagccctattcattc

SEQ ID NO: 32977 - DNA, 26 bp, synthetic construct
  misc_feature 1..26: note = Synthetic Construct
  source 1..26: mol_type = other DNA
gtggctttttggtaattgtgctgaac

SEQ ID NO: 32978 - DNA, 22 bp, synthetic construct
  misc_feature 1..22: note = Synthetic Construct
  source 1..22: mol_type = other DNA
gctctgccgaggctggtaaaaa

SEQ ID NO: 32979 - DNA, 22 bp, synthetic construct
  misc_feature 1..22: note = Synthetic Construct
  source 1..22: mol_type = other DNA
cccaaaatgcccgtctgtgaag

SEQ ID NO: 32980 - DNA, 21 bp, synthetic construct
  misc_feature 1..21: note = Synthetic Construct
  source 1..21: mol_type = other DNA
tgacgaaaggccgtgtagtag

SEQ ID NO: 32981 - DNA, 23 bp, synthetic construct
  misc_feature 1..23: note = Synthetic Construct
  source 1..23: mol_type = other DNA
acctgaaagagggaagtccaaag

SEQ ID NO: 32982 - DNA, 28 bp, synthetic construct
  misc_feature 1..28: note = Synthetic Construct
  source 1..28: mol_type = other DNA
ggaaactaactctgggatcagacaaact

SEQ ID NO: 32983 - DNA, 25 bp, synthetic construct
  misc_feature 1..25: note = Synthetic Construct
  source 1..25: mol_type = other DNA
acttagttcaggggctacacaaaaa

SEQ ID NO: 32984 - DNA, 24 bp, synthetic construct
  misc_feature 1..24: note = Synthetic Construct
  source 1..24: mol_type = other DNA
gtggagaacagaaccaggtcaaac

SEQ ID NO: 32985 - DNA, 25 bp, synthetic construct
  misc_feature 1..25: note = Synthetic Construct
  source 1..25: mol_type = other DNA
ctctgaggttctaggctatgacaga

SEQ ID NO: 32986 - DNA, 24 bp, synthetic construct
  misc_feature 1..24: note = Synthetic Construct
  source 1..24: mol_type = other DNA
caaatgttatcccctctgcaccta

SEQ ID NO: 32987 - DNA, 27 bp, synthetic construct
  misc_feature 1..27: note = Synthetic Construct
  source 1..27: mol_type = other DNA
gatggaaaagagggaattgcaagtaga

SEQ ID NO: 32988 - DNA, 25 bp, synthetic construct
  misc_feature 1..25: note = Synthetic Construct
  source 1..25: mol_type = other DNA
ctggaacccagacaaatgaccttgt

SEQ ID NO: 32989 - DNA, 21 bp, synthetic construct
  misc_feature 1..21: note = Synthetic Construct
  source 1..21: mol_type = other DNA
gcaaggaggtgggatgagaca

SEQ ID NO: 32990 - DNA, 25 bp, synthetic construct
  misc_feature 1..25: note = Synthetic Construct
  source 1..25: mol_type = other DNA
ggagatctttaggatgagcagcaat

SEQ ID NO: 32991 - DNA, 22 bp, synthetic construct
  misc_feature 1..22: note = Synthetic Construct
  source 1..22: mol_type = other DNA
cacattctggaactgcccttct

SEQ ID NO: 32992 - DNA, 24 bp, synthetic construct
  misc_feature 1..24: note = Synthetic Construct
  source 1..24: mol_type = other DNA
gcagaagagagctgaggttagatg

SEQ ID NO: 32993 - DNA, 24 bp, synthetic construct
  misc_feature 1..24: note = Synthetic Construct
  source 1..24: mol_type = other DNA
tctaatggacagcattgggtcaaa

SEQ ID NO: 32994 - DNA, 23 bp, synthetic construct
  misc_feature 1..23: note = Synthetic Construct
  source 1..23: mol_type = other DNA
ggatggagggagccatttttagt

SEQ ID NO: 32995 - DNA, 23 bp, synthetic construct
  misc_feature 1..23: note = Synthetic Construct
  source 1..23: mol_type = other DNA
gctagttgaggaagcccaagtat

SEQ ID NO: 32996 - DNA, 22 bp, synthetic construct
  misc_feature 1..22: note = Synthetic Construct
  source 1..22: mol_type = other DNA
ccagtccctcgtttcctcacaa

SEQ ID NO: 32997 - DNA, 22 bp, synthetic construct
  misc_feature 1..22: note = Synthetic Construct
  source 1..22: mol_type = other DNA
ggcagccttccatgtcacttac

SEQ ID NO: 32998 - DNA, 22 bp, synthetic construct
  misc_feature 1..22: note = Synthetic Construct
  source 1..22: mol_type = other DNA
aaggtagcacgattcacagcat

SEQ ID NO: 32999 - DNA, 22 bp, synthetic construct
  misc_feature 1..22: note = Synthetic Construct
  source 1..22: mol_type = other DNA
ggaattgcacggcagcctttac

SEQ ID NO: 33000 - DNA, 24 bp, synthetic construct
  misc_feature 1..24: note = Synthetic Construct
  source 1..24: mol_type = other DNA
cccacatgagctggcttcattttc

SEQ ID NO: 33001 - DNA, 19 bp, synthetic construct
  misc_feature 1..19: note = Synthetic Construct
  source 1..19: mol_type = other DNA
gccttgctggagtgcaaac

SEQ ID NO: 33002 - DNA, 21 bp, synthetic construct
  misc_feature 1..21: note = Synthetic Construct
  source 1..21: mol_type = other DNA
gctgatcatgtcaccgctttg

SEQ ID NO: 33003 - DNA, 24 bp, synthetic construct
  misc_feature 1..24: note = Synthetic Construct
  source 1..24: mol_type = other DNA
gttgacaatcctctctccacttct

SEQ ID NO: 33004 - DNA, 23 bp, synthetic construct
  misc_feature 1..23: note = Synthetic Construct
  source 1..23: mol_type = other DNA
cccagatgcctgtggagtcacta

SEQ ID NO: 33005 - DNA, 24 bp, synthetic construct
  misc_feature 1..24: note = Synthetic Construct
  source 1..24: mol_type = other DNA
agagaaagtggccctgaagataag

SEQ ID NO: 33006 - DNA, 27 bp, synthetic construct
  misc_feature 1..27: note = Synthetic Construct
  source 1..27: mol_type = other DNA
ggagaagactactcgtaccgtgacaat

SEQ ID NO: 33007 - DNA, 20 bp, synthetic construct
  misc_feature 1..20: note = Synthetic Construct
  source 1..20: mol_type = other DNA
cgccaggcttgcagttgtat

SEQ ID NO: 33008 - DNA, 21 bp, synthetic construct
  misc_feature 1..21: note = Synthetic Construct
  source 1..21: mol_type = other DNA
gatcatgctcccaaccgtagt

SEQ ID NO: 33009 - DNA, 25 bp, synthetic construct
  misc_feature 1..25: note = Synthetic Construct
  source 1..25: mol_type = other DNA
cgtgttggatcctttgagaaaaact

SEQ ID NO: 33010 - DNA, 23 bp, synthetic construct
  misc_feature 1..23: note = Synthetic Construct
  source 1..23: mol_type = other DNA
gggagctgatgggctctctttag

SEQ ID NO: 33011 - DNA, 24 bp, synthetic construct
  misc_feature 1..24: note = Synthetic Construct
  source 1..24: mol_type = other DNA
tggtctgttagcacacccaattat

SEQ ID NO: 33012 - DNA, 27 bp, synthetic construct
  misc_feature 1..27: note = Synthetic Construct
  source 1..27: mol_type = other DNA
gaacacatcttaggagggaatatgtct

SEQ ID NO: 33013 - DNA, 22 bp, synthetic construct
  misc_feature 1..22: note = Synthetic Construct
  source 1..22: mol_type = other DNA
gcagtgcagggttcttacattc

SEQ ID NO: 33014 - DNA, 22 bp, synthetic construct
  misc_feature 1..22: note = Synthetic Construct
  source 1..22: mol_type = other DNA
cgcttaccctggcatcttctct

SEQ ID NO: 33015 - DNA, 23 bp, synthetic construct
  misc_feature 1..23: note = Synthetic Construct
  source 1..23: mol_type = other DNA
ctgtaaaaggcctgctttgttga

SEQ ID NO: 33016 - DNA, 23 bp, synthetic construct
  misc_feature 1..23: note = Synthetic Construct
  source 1..23: mol_type = other DNA
ttgacatattcagccctcagcat

SEQ ID NO: 33017 - DNA, 22 bp, synthetic construct
  misc_feature 1..22: note = Synthetic Construct
  source 1..22: mol_type = other DNA
acggtgcccttgggttactaga

SEQ ID NO: 33018 - DNA, 24 bp, synthetic construct
  misc_feature 1..24: note = Synthetic Construct
  source 1..24: mol_type = other DNA
gggctacaaactaaggccaaaaac

SEQ ID NO: 33019 - DNA, 21 bp, synthetic construct
  misc_feature 1..21: note = Synthetic Construct
  source 1..21: mol_type = other DNA
gcctctgctgctcgcatgtat

SEQ ID NO: 33020 - DNA, 25 bp, synthetic construct
  misc_feature 1..25: note = Synthetic Construct
  source 1..25: mol_type = other DNA
actattcagacatcacctcctccat

SEQ ID NO: 33021 - DNA, 21 bp, synthetic construct
  misc_feature 1..21: note = Synthetic Construct
  source 1..21: mol_type = other DNA
accctctggggttctggctat

SEQ ID NO: 33022 - DNA, 25 bp, synthetic construct
  misc_feature 1..25: note = Synthetic Construct
  source 1..25: mol_type = other DNA
cacagtaaacaacccagcacatatt

SEQ ID NO: 33023 - DNA, 25 bp, synthetic construct
  misc_feature 1..25: note = Synthetic Construct
  source 1..25: mol_type = other DNA
ttgcaagaacacccataacctctta

SEQ ID NO: 33024 - DNA, 27 bp, synthetic construct
  misc_feature 1..27: note = Synthetic Construct
  source 1..27: mol_type = other DNA
gagctaacaatgcaaggtaaagcgaat

SEQ ID NO: 33025 - DNA, 29 bp, synthetic construct
  misc_feature 1..29: note = Synthetic Construct
  source 1..29: mol_type = other DNA
gctgtttatcagtgaaatcccagtcactt

SEQ ID NO: 33026 - DNA, 22 bp, synthetic construct
  misc_feature 1..22: note = Synthetic Construct
  source 1..22: mol_type = other DNA
ggacagacacggggtcaaattc

SEQ ID NO: 33027 - DNA, 23 bp, synthetic construct
  misc_feature 1..23: note = Synthetic Construct
  source 1..23: mol_type = other DNA
ggagtgacgctccttcctaccta

SEQ ID NO: 33028 - DNA, 26 bp, synthetic construct
  misc_feature 1..26: note = Synthetic Construct
  source 1..26: mol_type = other DNA
ggtaggaatgtttcccaagctattca

SEQ ID NO: 33029 - DNA, 26 bp, synthetic construct
  misc_feature 1..26: note = Synthetic Construct
  source 1..26: mol_type = other DNA
ggatacacattctctcctatctgcat

SEQ ID NO: 33030 - DNA, 21 bp, synthetic construct
  misc_feature 1..21: note = Synthetic Construct
  source 1..21: mol_type = other DNA
ccctcagacctcagctggttt

SEQ ID NO: 33031 - DNA, 22 bp, synthetic construct
  misc_feature 1..22: note = Synthetic Construct
  source 1..22: mol_type = other DNA
ctggtcccggctactgacattt

SEQ ID NO: 33032 - DNA, 26 bp, synthetic construct
  misc_feature 1..26: note = Synthetic Construct
  source 1..26: mol_type = other DNA
tgttagcctgtaacttgtccttcttg

SEQ ID NO: 33033 - DNA, 21 bp, synthetic construct
  misc_feature 1..21: note = Synthetic Construct
  source 1..21: mol_type = other DNA
gccggctgggtttgaccaata

SEQ ID NO: 33034 - DNA, 21 bp, synthetic construct
  misc_feature 1..21: note = Synthetic Construct
  source 1..21: mol_type = other DNA
gcacagccccttcacttctct

SEQ ID NO: 33035 - DNA, 20 bp, synthetic construct
  misc_feature 1..20: note = Synthetic Construct
  source 1..20: mol_type = other DNA
gcaggcaagcatgcaccttt

SEQ ID NO: 33036 - DNA, 21 bp, synthetic construct
  misc_feature 1..21: note = Synthetic Construct
  source 1..21: mol_type = other DNA
ggcctccgctgtgattcactt

SEQ ID NO: 33037 - DNA, 27 bp, synthetic construct
  misc_feature 1..27: note = Synthetic Construct
  source 1..27: mol_type = other DNA
gcattaagagtcatacagcagagtcat

SEQ ID NO: 33038 - DNA, 20 bp, synthetic construct
  misc_feature 1..20: note = Synthetic Construct
  source 1..20: mol_type = other DNA
atgcgccaggagggttcttg

SEQ ID NO: 33039 - DNA, 23 bp, synthetic construct
  misc_feature 1..23: note = Synthetic Construct
  source 1..23: mol_type = other DNA
gtctagcactggtagcactggat

SEQ ID NO: 33040 - DNA, 27 bp, synthetic construct
  misc_feature 1..27: note = Synthetic Construct
  source 1..27: mol_type = other DNA
ctctagacacacaactgtctctttttc

SEQ ID NO: 33041 - DNA, 24 bp, synthetic construct
  misc_feature 1..24: note = Synthetic Construct
  source 1..24: mol_type = other DNA
gacatttgacagtggtttgtgtga

SEQ ID NO: 33042 - DNA, 30 bp, synthetic construct
  misc_feature 1..30: note = Synthetic Construct
  source 1..30: mol_type = other DNA
gccctttgtcttcttgctaacttcaatatg

SEQ ID NO: 33043 - DNA, 24 bp, synthetic construct
  misc_feature 1..24: note = Synthetic Construct
  source 1..24: mol_type = other DNA
aagctggacccactaatttgaagt

SEQ ID NO: 33044 - DNA, 23 bp, synthetic construct
  misc_feature 1..23: note = Synthetic Construct
  source 1..23: mol_type = other DNA
gagcctcagcatcaaaccatcat

SEQ ID NO: 33045 - DNA, 25 bp, synthetic construct
  misc_feature 1..25: note = Synthetic Construct
  source 1..25: mol_type = other DNA
gagagcttactcctcaagtgtcttt

SEQ ID NO: 33046 - DNA, 20 bp, synthetic construct
  misc_feature 1..20: note = Synthetic Construct
  source 1..20: mol_type = other DNA
tgccttggcaagctcaagtt

SEQ ID NO: 33047 - DNA, 23 bp, synthetic construct
  misc_feature 1..23: note = Synthetic Construct
  source 1..23: mol_type = other DNA
gcaattcctgacctgcatctttc

SEQ ID NO: 33048 - DNA, 23 bp, synthetic construct
  misc_feature 1..23: note = Synthetic Construct
  source 1..23: mol_type = other DNA
ccttacgcagttgctggtgaaag

SEQ ID NO: 33049 - DNA, 20 bp, synthetic construct
  misc_feature 1..20: note = Synthetic Construct
  source 1..20: mol_type = other DNA
agctgcttggtcacccaaag

SEQ ID NO: 33050 - DNA, 24 bp, synthetic construct
  misc_feature 1..24: note = Synthetic Construct
  source 1..24: mol_type = other DNA
ttcttccctcctagagatggtcaa

SEQ ID NO: 33051 - DNA, 19 bp, synthetic construct
  misc_feature 1..19: note = Synthetic Construct
  source 1..19: mol_type = other DNA
aggccaatgccgtcttgaa

SEQ ID NO: 33052 - DNA, 22 bp, synthetic construct
  misc_feature 1..22: note = Synthetic Construct
  source 1..22: mol_type = other DNA
cagagccttggcatagtccttt

SEQ ID NO: 33053 - DNA, 21 bp, synthetic construct
  misc_feature 1..21: note = Synthetic Construct
  source 1..21: mol_type = other DNA
agggccgtagaggcagaacat

SEQ ID NO: 33054 - DNA, 25 bp, synthetic construct
  misc_feature 1..25: note = Synthetic Construct
  source 1..25: mol_type = other DNA
gaaggaaatccagtctgatggaaga

SEQ ID NO: 33055 - DNA, 23 bp, synthetic construct
  misc_feature 1..23: note = Synthetic Construct
  source 1..23: mol_type = other DNA
ccagtggcatggagtcaggatag

SEQ ID NO: 33056 - DNA, 24 bp, synthetic construct
  misc_feature 1..24: note = Synthetic Construct
  source 1..24: mol_type = other DNA
gacctcacacaggtaaccctttca

SEQ ID NO: 33057 - DNA, 20 bp, synthetic construct
  misc_feature 1..20: note = Synthetic Construct
  source 1..20: mol_type = other DNA
cggctgctggacaatccttt

SEQ ID NO: 33058 - DNA, 21 bp, synthetic construct
  misc_feature 1..21: note = Synthetic Construct
  source 1..21: mol_type = other DNA
acgcataataccggcctttgt

SEQ ID NO: 33059 - DNA, 27 bp, synthetic construct
  misc_feature 1..27: note = Synthetic Construct
  source 1..27: mol_type = other DNA
gaaacagctctcagaatctaaggtttc

SEQ ID NO: 33060 - DNA, 24 bp, synthetic construct
  misc_feature 1..24: note = Synthetic Construct
  source 1..24: mol_type = other DNA
tcaagcaggtaccaaatcctttct

SEQ ID NO: 33061 - DNA, 26 bp, synthetic construct
  misc_feature 1..26: note = Synthetic Construct
  source 1..26: mol_type = other DNA
ccccagaggaggattgggagaataag

SEQ ID NO: 33062 - DNA, 20 bp, synthetic construct
  misc_feature 1..20: note = Synthetic Construct
  source 1..20: mol_type = other DNA
agcatcgaccctgctttgaa

SEQ ID NO: 33063 - DNA, 22 bp, synthetic construct
  misc_feature 1..22: note = Synthetic Construct
  source 1..22: mol_type = other DNA
tctccaactgtcccctttggaa

SEQ ID NO: 33064 - DNA, 25 bp, synthetic construct
  misc_feature 1..25: note = Synthetic Construct
  source 1..25: mol_type = other DNA
ccaacttggcctctaatgaaatgtt

SEQ ID NO: 33065 - DNA, 26 bp, synthetic construct
  misc_feature 1..26: note = Synthetic Construct
  source 1..26: mol_type = other DNA
ggagtaaaggtatcaaccacccttga

SEQ ID NO: 33066 - DNA, 25 bp, synthetic construct
  misc_feature 1..25: note = Synthetic Construct
  source 1..25: mol_type = other DNA
acagccctatcatagcctttacttc

SEQ ID NO: 33067 - DNA, 24 bp, synthetic construct
  misc_feature 1..24: note = Synthetic Construct
  source 1..24: mol_type = other DNA
cactcccatgcccaccattttatg

SEQ ID NO: 33068 - DNA, 24 bp, synthetic construct
  misc_feature 1..24: note = Synthetic Construct
  source 1..24: mol_type = other DNA
caatgctgtctttcccaactcttt

SEQ ID NO: 33069 - DNA, 24 bp, synthetic construct
  misc_feature 1..24: note = Synthetic Construct
  source 1..24: mol_type = other DNA
agcctagttaggacacttgacact

SEQ ID NO: 33070 - DNA, 23 bp, synthetic construct
  misc_feature 1..23: note = Synthetic Construct
  source 1..23: mol_type = other DNA
tcctgtgaagccaatgaacacaa

SEQ ID NO: 33071 - DNA, 20 bp, synthetic construct
  misc_feature 1..20: note = Synthetic Construct
  source 1..20: mol_type = other DNA
ggatgcgagtggctcattca

SEQ ID NO: 33072 - DNA, 22 bp, synthetic construct
  misc_feature 1..22: note = Synthetic Construct
  source 1..22: mol_type = other DNA
tgcaacaatttgcaagccaaga

SEQ ID NO: 33073 - DNA, 23 bp, synthetic construct
  misc_feature 1..23: note = Synthetic Construct
  source 1..23: mol_type = other DNA
ggtctgacttggcaggaaataca

SEQ ID NO: 33074 - DNA, 24 bp, synthetic construct
  misc_feature 1..24: note = Synthetic Construct
  source 1..24: mol_type = other DNA
ccactcctcagaaccagtgatgat

SEQ ID NO: 33075 - DNA, 23 bp, synthetic construct
  misc_feature 1..23: note = Synthetic Construct
  source 1..23: mol_type = other DNA
agccaccctagtcctctccttct

SEQ ID NO: 33076 - DNA, 21 bp, synthetic construct
  misc_feature 1..21: note = Synthetic Construct
  source 1..21: mol_type = other DNA
tgatgtggaggaggcaacaga

SEQ ID NO: 33077 - DNA, 24 bp, synthetic construct
  misc_feature 1..24: note = Synthetic Construct
  source 1..24: mol_type = other DNA
ctgaagaatggggcaataggaagt

SEQ ID NO: 33078 - DNA, 25 bp, synthetic construct
  misc_feature 1..25: note = Synthetic Construct
  source 1..25: mol_type = other DNA
gcagttctgaagagaggctttgaac

SEQ ID NO: 33079 - DNA, 25 bp, synthetic construct
  misc_feature 1..25: note = Synthetic Construct
  source 1..25: mol_type = other DNA
gcttttcagctagcattcattcact

SEQ ID NO: 33080 - DNA, 20 bp, synthetic construct
  misc_feature 1..20: note = Synthetic Construct
  source 1..20: mol_type = other DNA
cccctgctgggaattcaagt

SEQ ID NO: 33081 - DNA, 23 bp, synthetic construct
  misc_feature 1..23: note = Synthetic Construct
  source 1..23: mol_type = other DNA
tctgctttgtaccttgcaggaaa

SEQ ID NO: 33082 - DNA, 20 bp, synthetic construct
  misc_feature 1..20: note = Synthetic Construct
  source 1..20: mol_type = other DNA
cgtgcccactccaaccttat

SEQ ID NO: 33083 - DNA, 25 bp, synthetic construct
  misc_feature 1..25: note = Synthetic Construct
  source 1..25: mol_type = other DNA
ccagaactttgccactcttctgtca

SEQ ID NO: 33084 - DNA, 27 bp, synthetic construct
  misc_feature 1..27: note = Synthetic Construct
  source 1..27: mol_type = other DNA
cctggctaatacatgctgtaagacact

SEQ ID NO: 33085 - DNA, 25 bp, synthetic construct
  misc_feature 1..25: note = Synthetic Construct
  source 1..25: mol_type = other DNA
ctctccacatttggtgatcgtgttg

SEQ ID NO: 33086 - DNA, 25 bp, synthetic construct
  misc_feature 1..25: note = Synthetic Construct
  source 1..25: mol_type = other DNA
ccaaaggtaacacaggatgttggta

SEQ ID NO: 33087 - DNA, 25 bp, synthetic construct
  misc_feature 1..25: note = Synthetic Construct
  source 1..25: mol_type = other DNA
ggtgaagtagtgaaaggtggtaaga

SEQ ID NO: 33088 - DNA, 27 bp, synthetic construct
  misc_feature 1..27: note = Synthetic Construct
  source 1..27: mol_type = other DNA
ggaaataatatagcctgccttgacttc

SEQ ID NO: 33089 - DNA, 26 bp, synthetic construct
  misc_feature 1..26: note = Synthetic Construct
  source 1..26: mol_type = other DNA
cccatgggtgtattttgaaggatgaa

SEQ ID NO: 33090 - DNA, 22 bp, synthetic construct
  misc_feature 1..22: note = Synthetic Construct
  source 1..22: mol_type = other DNA
cgtctcccaaaacgtcctcatc

SEQ ID NO: 33091 - DNA, 22 bp, synthetic construct
  misc_feature 1..22: note = Synthetic Construct
  source 1..22: mol_type = other DNA
ggacagccacagaacgtcaact

SEQ ID NO: 33092 - DNA, 22 bp, synthetic construct
  misc_feature 1..22: note = Synthetic Construct
  source 1..22: mol_type = other DNA
cctgcatcctgccgctctttta

SEQ ID NO: 33093 - DNA, 22 bp, synthetic construct
  misc_feature 1..22: note = Synthetic Construct
  source 1..22: mol_type = other DNA
ggggagaattgctccagagatg

SEQ ID NO: 33094 - DNA, 22 bp, synthetic construct
  misc_feature 1..22: note = Synthetic Construct
  source 1..22: mol_type = other DNA
ggcaggtggcagttggaaagta

SEQ ID NO: 33095 - DNA, 27 bp, synthetic construct
  misc_feature 1..27: note = Synthetic Construct
  source 1..27: mol_type = other DNA
ccctgcttataagaccaagaggacttc

SEQ ID NO: 33096 - DNA, 22 bp, synthetic construct
  misc_feature 1..22: note = Synthetic Construct
  source 1..22: mol_type = other DNA
cccaggggaccagcatataaca

SEQ ID NO: 33097 - DNA, 27 bp, synthetic construct
  misc_feature 1..27: note = Synthetic Construct
  source 1..27: mol_type = other DNA
gcattcagcctccccttttgaatagta

SEQ ID NO: 33098 - DNA, 22 bp, synthetic construct
  misc_feature 1..22: note = Synthetic Construct
  source 1..22: mol_type = other DNA
tctcgggaaatttcaggcacaa

SEQ ID NO: 33099 - DNA, 23 bp, synthetic construct
  misc_feature 1..23: note = Synthetic Construct
  source 1..23: mol_type = other DNA
cagaagggtgcagagatacaagt

SEQ ID NO: 33100 - DNA, 22 bp, synthetic construct
  misc_feature 1..22: note = Synthetic Construct
  source 1..22: mol_type = other DNA
aagtgctggcaagatctcagtt

SEQ ID NO: 33101 - DNA, 21 bp, synthetic construct
  misc_feature 1..21: note = Synthetic Construct
  source 1..21: mol_type = other DNA
tcaggggctaggtgttgaact

SEQ ID NO: 33102 - DNA, 22 bp, synthetic construct
  misc_feature 1..22: note = Synthetic Construct
  source 1..22: mol_type = other DNA
agcaatgtcctcccctatcctt

SEQ ID NO: 33103 - DNA, 23 bp, synthetic construct
  misc_feature 1..23: note = Synthetic Construct
  source 1..23: mol_type = other DNA
aagatgaggtgcttgtctcatgt

SEQ ID NO: 33104 - DNA, 25 bp, synthetic construct
  misc_feature 1..25: note = Synthetic Construct
  source 1..25: mol_type = other DNA
gaaatagtgagggctgtccctaaac

SEQ ID NO: 33105 - DNA, 23 bp, synthetic construct
  misc_feature 1..23: note = Synthetic Construct
  source 1..23: mol_type = other DNA
ggaactccacacagcttttctct

SEQ ID NO: 33106 - DNA, 21 bp, synthetic construct
  misc_feature 1..21: note = Synthetic Construct
  source 1..21: mol_type = other DNA
ttctcctgccgacctgtctac

SEQ ID NO: 33107 - DNA, 30 bp, synthetic construct
  misc_feature 1..30: note = Synthetic Construct
  source 1..30: mol_type = other DNA
gctactatatcatccctgaccttgcattag

SEQ ID NO: 33108 - DNA, 24 bp, synthetic construct
  misc_feature 1..24: note = Synthetic Construct
  source 1..24: mol_type = other DNA
ctctcccttaggcagtgattcttc

SEQ ID NO: 33109 - DNA, 23 bp, synthetic construct
  misc_feature 1..23: note = Synthetic Construct
  source 1..23: mol_type = other DNA
gggagggagaaaggaggagaaac

SEQ ID NO: 33110 - DNA, 26 bp, synthetic construct
  misc_feature 1..26: note = Synthetic Construct
  source 1..26: mol_type = other DNA
ctgtaaagagtacagtggttctctga

SEQ ID NO: 33111 - DNA, 23 bp, synthetic construct
  misc_feature 1..23: note = Synthetic Construct
  source 1..23: mol_type = other DNA
cacccttactcttccctctgctt

SEQ ID NO: 33112 - DNA, 24 bp, synthetic construct
  misc_feature 1..24: note = Synthetic Construct
  source 1..24: mol_type = other DNA
ctaggagagagttctagggtggtt

SEQ ID NO: 33113 - DNA, 22 bp, synthetic construct
  misc_feature 1..22: note = Synthetic Construct
  source 1..22: mol_type = other DNA
gggacatgtgactcctccaact

SEQ ID NO: 33114 - DNA, 28 bp, synthetic construct
  misc_feature 1..28: note = Synthetic Construct
  source 1..28: mol_type = other DNA
gtgaactcagcctcctctaaagatctaa

SEQ ID NO: 33115 - DNA, 23 bp, synthetic construct
  misc_feature 1..23: note = Synthetic Construct
  source 1..23: mol_type = other DNA
cccttccttctcagctccatttg

SEQ ID NO: 33116 - DNA, 27 bp, synthetic construct
  misc_feature 1..27: note = Synthetic Construct
  source 1..27: mol_type = other DNA
ggtaaagtcaggatttacacccaagtt

SEQ ID NO: 33117 - DNA, 22 bp, synthetic construct
  misc_feature 1..22: note = Synthetic Construct
  source 1..22: mol_type = other DNA
ctgccagagggatacccatgta

SEQ ID NO: 33118 - DNA, 23 bp, synthetic construct
  misc_feature 1..23: note = Synthetic Construct
  source 1..23: mol_type = other DNA
ttgcaacctagcagtgagaatga

SEQ ID NO: 33119 - DNA, 25 bp, synthetic construct
  misc_feature 1..25: note = Synthetic Construct
  source 1..25: mol_type = other DNA
tgacatgttatggctcatgtctcaa

SEQ ID NO: 33120 - DNA, 22 bp, synthetic construct
  misc_feature 1..22: note = Synthetic Construct
  source 1..22: mol_type = other DNA
ttccagccctgtcccttagtag

SEQ ID NO: 33121 - DNA, 19 bp, synthetic construct
  misc_feature 1..19: note = Synthetic Construct
  source 1..19: mol_type = other DNA
acacccactctgggcatgt

SEQ ID NO: 33122 - DNA, 19 bp, synthetic construct
  misc_feature 1..19: note = Synthetic Construct
  source 1..19: mol_type = other DNA
ttgcctccaccatgccaaa

SEQ ID NO: 33123 - DNA, 23 bp, synthetic construct
  misc_feature 1..23: note = Synthetic Construct
  source 1..23: mol_type = other DNA
ctgagcctccaagtcctcatttc

SEQ ID NO: 33124 - DNA, 26 bp, synthetic construct
  misc_feature 1..26: note = Synthetic Construct
  source 1..26: mol_type = other DNA
ttgagaaagagggaagagtctaggat

SEQ ID NO: 33125 - DNA, 23 bp, synthetic construct
  misc_feature 1..23: note = Synthetic Construct
  source 1..23: mol_type = other DNA
agaggcacacttgaaaagactga

SEQ ID NO: 33126 - DNA, 23 bp, synthetic construct
  misc_feature 1..23: note = Synthetic Construct
  source 1..23: mol_type = other DNA
cacccacacacattctaccttga

SEQ ID NO: 33127 - DNA, 21 bp, synthetic construct
  misc_feature 1..21: note = Synthetic Construct
  source 1..21: mol_type = other DNA
tactgctggcggtgaggatgt

SEQ ID NO: 33128 - DNA, 26 bp, synthetic construct
  misc_feature 1..26: note = Synthetic Construct
  source 1..26: mol_type = other DNA
gtgagcaaggtataggagatgaaaga

SEQ ID NO: 33129 - DNA, 27 bp, synthetic construct
  misc_feature 1..27: note = Synthetic Construct
  source 1..27: mol_type = other DNA
tgcactcctttccctatctccttatta

SEQ ID NO: 33130 - DNA, 26 bp, synthetic construct
  misc_feature 1..26: note = Synthetic Construct
  source 1..26: mol_type = other DNA
gggcaatagccccaaggtatattttc

SEQ ID NO: 33131 - DNA, 24 bp, synthetic construct
  misc_feature 1..24: note = Synthetic Construct
  source 1..24: mol_type = other DNA
tcacttcagcaaaacatgcctaag

SEQ ID NO: 33132 - DNA, 26 bp, synthetic construct
  misc_feature 1..26: note = Synthetic Construct
  source 1..26: mol_type = other DNA
gaccagcatataagagggtcatgaat

SEQ ID NO: 33133 - DNA, 24 bp, synthetic construct
  misc_feature 1..24: note = Synthetic Construct
  source 1..24: mol_type = other DNA
ctggaacattaagcagctcaccta

SEQ ID NO: 33134 - DNA, 22 bp, synthetic construct
  misc_feature 1..22: note = Synthetic Construct
  source 1..22: mol_type = other DNA
aggggtctgggagggaagataa

SEQ ID NO: 33135 - DNA, 22 bp, synthetic construct
  misc_feature 1..22: note = Synthetic Construct
  source 1..22: mol_type = other DNA
gggtcaggggaaggtcactaat

SEQ ID NO: 33136 - DNA, 26 bp, synthetic construct
  misc_feature 1..26: note = Synthetic Construct
  source 1..26: mol_type = other DNA
tctctttatctcaggccatgtagtca

SEQ ID NO: 33137 - DNA, 24 bp, synthetic construct
  misc_feature 1..24: note = Synthetic Construct
  source 1..24: mol_type = other DNA
ggttaccaagggcagtttgagagt

SEQ ID NO: 33138 - DNA, 25 bp, synthetic construct
  misc_feature 1..25: note = Synthetic Construct
  source 1..25: mol_type = other DNA
ccgatattccctccctttattggtt

SEQ ID NO: 33139 - DNA, 21 bp, synthetic construct
  misc_feature 1..21: note = Synthetic Construct
  source 1..21: mol_type = other DNA
agggccacatggctcttctgt

SEQ ID NO: 33140 - DNA, 21 bp, synthetic construct
  misc_feature 1..21: note = Synthetic Construct
  source 1..21: mol_type = other DNA
tggctggcaattctgatgcaa

SEQ ID NO: 33141 - DNA, 21 bp, synthetic construct
  misc_feature 1..21: note = Synthetic Construct
  source 1..21: mol_type = other DNA
tcaggcgcagaactctcaatg

SEQ ID NO: 33142 - DNA, 25 bp, synthetic construct
  misc_feature 1..25: note = Synthetic Construct
  source 1..25: mol_type = other DNA
gtgaaaagctatgccctggagaaca

SEQ ID NO: 33143 - DNA, 24 bp, synthetic construct
  misc_feature 1..24: note = Synthetic Construct
  source 1..24: mol_type = other DNA
cacagagtaggtgctcgtgaagtt

SEQ ID NO: 33144 - DNA, 27 bp, synthetic construct
  misc_feature 1..27: note = Synthetic Construct
  source 1..27: mol_type = other DNA
gagatgcatattcagggagcagtaaac

SEQ ID NO: 33145 - DNA, 26 bp, synthetic construct
  misc_feature 1..26: note = Synthetic Construct
  source 1..26: mol_type = other DNA
ctatgaacttgagtgggagagacatt

SEQ ID NO: 33146 - DNA, 22 bp, synthetic construct
  misc_feature 1..22: note = Synthetic Construct
  source 1..22: mol_type = other DNA
gcagttttgacttggccagcta

SEQ ID NO: 33147 - DNA, 22 bp, synthetic construct
  misc_feature 1..22: note = Synthetic Construct
  source 1..22: mol_type = other DNA
aacaacacaggggctttgtttc

SEQ ID NO: 33148 - DNA, 24 bp, synthetic construct
  misc_feature 1..24: note = Synthetic Construct
  source 1..24: mol_type = other DNA
gacttcagtctgcccattggtgat

SEQ ID NO: 33149 - DNA, 26 bp, synthetic construct
  misc_feature 1..26: note = Synthetic Construct
  source 1..26: mol_type = other DNA
catcacactctgggtacactttgatt

SEQ ID NO: 33150 - DNA, 19 bp, synthetic construct
  misc_feature 1..19: note = Synthetic Construct
  source 1..19: mol_type = other DNA
agcctcagccgagccaagt

SEQ ID NO: 33151 - DNA, 24 bp, synthetic construct
  misc_feature 1..24: note = Synthetic Construct
  source 1..24: mol_type = other DNA
gacccagaaaagggaagggactta

SEQ ID NO: 33152 - DNA, 24 bp, synthetic construct
  misc_feature 1..24: note = Synthetic Construct
  source 1..24: mol_type = other DNA
cttttgcagtaccctaggcacata

SEQ ID NO: 33153 - DNA, 24 bp, synthetic construct
  misc_feature 1..24: note = Synthetic Construct
  source 1..24: mol_type = other DNA
gacacaggtagtccgcagtctaag

SEQ ID NO: 33154 - DNA, 22 bp, synthetic construct
  misc_feature 1..22: note = Synthetic Construct
  source 1..22: mol_type = other DNA
tgtcctcacactatgcccagta

SEQ ID NO: 33155 - DNA, 29 bp, synthetic construct
  misc_feature 1..29: note = Synthetic Construct
  source 1..29: mol_type = other DNA
gtatagaaagggtagagactgtggataac

SEQ ID NO: 33156 - DNA, 21 bp, synthetic construct
  misc_feature 1..21: note = Synthetic Construct
  source 1..21: mol_type = other DNA
ggtggggcctcttcctaacaa

SEQ ID NO: 33157 - DNA, 20 bp, synthetic construct
  misc_feature 1..20: note = Synthetic Construct
  source 1..20: mol_type = other DNA
gcccactgaagagcatcgta

SEQ ID NO: 33158 - DNA, 23 bp, synthetic construct
  misc_feature 1..23: note = Synthetic Construct
  source 1..23: mol_type = other DNA
cccctcactccatacagcacaga

SEQ ID NO: 33159 - DNA, 26 bp, synthetic construct
  misc_feature 1..26: note = Synthetic Construct
  source 1..26: mol_type = other DNA
gctgtacatagggatgtgagtgaaag

SEQ ID NO: 33160 - DNA, 23 bp, synthetic construct
  misc_feature 1..23: note = Synthetic Construct
  source 1..23: mol_type = other DNA
cagatcccaagaggaggggaaat

SEQ ID NO: 33161 - DNA, 20 bp, synthetic construct
  misc_feature 1..20: note = Synthetic Construct
  source 1..20: mol_type = other DNA
aggccaactcctcagctcat

SEQ ID NO: 33162 - DNA, 24 bp, synthetic construct
  misc_feature 1..24: note = Synthetic Construct
  source 1..24: mol_type = other DNA
tgttttctctccactccatgtcaa

SEQ ID NO: 33163 - DNA, 22 bp, synthetic construct
  misc_feature 1..22: note = Synthetic Construct
  source 1..22: mol_type = other DNA
ccttgcattggccattggcttt

SEQ ID NO: 33164 - DNA, 26 bp, synthetic construct
  misc_feature 1..26: note = Synthetic Construct
  source 1..26: mol_type = other DNA
cgtttctgacagagaaagaggtgcta

SEQ ID NO: 33165 - DNA, 26 bp, synthetic construct
  misc_feature 1..26: note = Synthetic Construct
  source 1..26: mol_type = other DNA
gagagaatccaggtaacaaaccaatg

SEQ ID NO: 33166 - DNA, 24 bp, synthetic construct
  misc_feature 1..24: note = Synthetic Construct
  source 1..24: mol_type = other DNA
tcacaaagtttggccatcagaaga

SEQ ID NO: 33167 - DNA, 25 bp, synthetic construct
  misc_feature 1..25: note = Synthetic Construct
  source 1..25: mol_type = other DNA
gggtgagtagaaggaaccgatgaca

SEQ ID NO: 33168 - DNA, 22 bp, synthetic construct
  misc_feature 1..22: note = Synthetic Construct
  source 1..22: mol_type = other DNA
gcagggaagggaatccaacagt

SEQ ID NO: 33169 - DNA, 23 bp, synthetic construct
  misc_feature 1..23: note = Synthetic Construct
  source 1..23: mol_type = other DNA
acagtctgaccccattttgtctt

SEQ ID NO: 33170 - DNA, 24 bp, synthetic construct
  misc_feature 1..24: note = Synthetic Construct
  source 1..24: mol_type = other DNA
ccattattcctgcaacgctctttc

SEQ ID NO: 33171 - DNA, 22 bp, synthetic construct
  misc_feature 1..22: note = Synthetic Construct
  source 1..22: mol_type = other DNA
gggccttgcatggctaactttg

SEQ ID NO: 33172 - DNA, 28 bp, synthetic construct
  misc_feature 1..28: note = Synthetic Construct
  source 1..28: mol_type = other DNA
cagacaacttgttcctgggaaacaaaag

SEQ ID NO: 33173 - DNA, 21 bp, synthetic construct
  misc_feature 1..21: note = Synthetic Construct
  source 1..21: mol_type = other DNA
agcgaggacaccctggtcaaa

SEQ ID NO: 33174 - DNA, 24 bp, synthetic construct
  misc_feature 1..24: note = Synthetic Construct
  source 1..24: mol_type = other DNA
cctctgccagtataggcagtctct

SEQ ID NO: 33175 - DNA, 22 bp, synthetic construct
  misc_feature 1..22: note = Synthetic Construct
  source 1..22: mol_type = other DNA
tccagtagggctctgaccaaca

SEQ ID NO: 33176 - DNA, 24 bp, synthetic construct
  misc_feature 1..24: note = Synthetic Construct
  source 1..24: mol_type = other DNA
ctgccccaatgggttaacagagat

SEQ ID NO: 33177 - DNA, 24 bp, synthetic construct
  misc_feature 1..24: note = Synthetic Construct
  source 1..24: mol_type = other DNA
gttgaatacgcagtaccctacgtt

SEQ ID NO: 33178 - DNA, 23 bp, synthetic construct
  misc_feature 1..23: note = Synthetic Construct
  source 1..23: mol_type = other DNA
acacgtagagtgcaaggaatcat

SEQ ID NO: 33179 - DNA, 26 bp, synthetic construct
  misc_feature 1..26: note = Synthetic Construct
  source 1..26: mol_type = other DNA
cacagctgaaactaccagagaaacta

SEQ ID NO: 33180 - DNA, 25 bp, synthetic construct
  misc_feature 1..25: note = Synthetic Construct
  source 1..25: mol_type = other DNA
cgtagtaatcaggtgcagccaatag

SEQ ID NO: 33181 - DNA, 23 bp, synthetic construct
  misc_feature 1..23: note = Synthetic Construct
  source 1..23: mol_type = other DNA
gcagtagccagagagtggttaca

SEQ ID NO: 33182 - DNA, 20 bp, synthetic construct
  misc_feature 1..20: note = Synthetic Construct
  source 1..20: mol_type = other DNA
aggggttccaccaccagatg

SEQ ID NO: 33183 - DNA, 25 bp, synthetic construct
  misc_feature 1..25: note = Synthetic Construct
  source 1..25: mol_type = other DNA
gccagagagggctacatgcagtaat

SEQ ID NO: 33184 - DNA, 23 bp, synthetic construct
  misc_feature 1..23: note = Synthetic Construct
  source 1..23: mol_type = other DNA
actacgtgagtatgaggcacaag

SEQ ID NO: 33185 - DNA, 25 bp, synthetic construct
  misc_feature 1..25: note = Synthetic Construct
  source 1..25: mol_type = other DNA
gaactccttatgagctttgccttgt

SEQ ID NO: 33186 - DNA, 21 bp, synthetic construct
  misc_feature 1..21: note = Synthetic Construct
  source 1..21: mol_type = other DNA
gcagaccaaagcggcaagaag

SEQ ID NO: 33187 - DNA, 24 bp, synthetic construct
  misc_feature 1..24: note = Synthetic Construct
  source 1..24: mol_type = other DNA
ctttgcatgggaatgttcctcttt

SEQ ID NO: 33188 - DNA, 21 bp, synthetic construct
  misc_feature 1..21: note = Synthetic Construct
  source 1..21: mol_type = other DNA
acgtgaagagggcctgagact

SEQ ID NO: 33189 - DNA, 21 bp, synthetic construct
  misc_feature 1..21: note = Synthetic Construct
  source 1..21: mol_type = other DNA
accagtcgtcagggagtcgaa

SEQ ID NO: 33190 - DNA, 19 bp, synthetic construct
  misc_feature 1..19: note = Synthetic Construct
  source 1..19: mol_type = other DNA
tgcccagtcccctgctttc

SEQ ID NO: 33191 - DNA, 23 bp, synthetic construct
  misc_feature 1..23: note = Synthetic Construct
  source 1..23: mol_type = other DNA
cgttataacctgggcttccacaa

SEQ ID NO: 33192 - DNA, 25 bp, synthetic construct
  misc_feature 1..25: note = Synthetic Construct
  source 1..25: mol_type = other DNA
acaaggaaagttacttggagtcctt

SEQ ID NO: 33193 - DNA, 21 bp, synthetic construct
  misc_feature 1..21: note = Synthetic Construct
  source 1..21: mol_type = other DNA
gggaaagaaggcacaggtaca

SEQ ID NO: 33194 - DNA, 23 bp, synthetic construct
  misc_feature 1..23: note = Synthetic Construct
  source 1..23: mol_type = other DNA
ccaggcaggacatgatacacaca

SEQ ID NO: 33195 - DNA, 23 bp, synthetic construct
  misc_feature 1..23: note = Synthetic Construct
  source 1..23: mol_type = other DNA
gaaaaactgcaggctgacagaga

SEQ ID NO: 33196 - DNA, 23 bp, synthetic construct
  misc_feature 1..23: note = Synthetic Construct
  source 1..23: mol_type = other DNA
cgcgaggaaacttggcttgtgtt

SEQ ID NO: 33197 - DNA, 27 bp, synthetic construct
  misc_feature 1..27: note = Synthetic Construct
  source 1..27: mol_type = other DNA
cttcctaggaggaaaaataggccataa

SEQ ID NO: 33198 - DNA, 21 bp, synthetic construct
  misc_feature 1..21: note = Synthetic Construct
  source 1..21: mol_type = other DNA
ctgtgaagcagtcagggcaaa

SEQ ID NO: 33199 - DNA, 24 bp, synthetic construct
  misc_feature 1..24: note = Synthetic Construct
  source 1..24: mol_type = other DNA
ggcctgatgcaaggatgtaacaca

SEQ ID NO: 33200 - DNA, 23 bp, synthetic construct
  misc_feature 1..23: note = Synthetic Construct
  source 1..23: mol_type = other DNA
ccccatgtaggaggactgaggat

SEQ ID NO: 33201 - DNA, 24 bp, synthetic construct
  misc_feature 1..24: note = Synthetic Construct
  source 1..24: mol_type = other DNA
gacatcagtcaccctctctttcaa

SEQ ID NO: 33202 - DNA, 26 bp, synthetic construct
  misc_feature 1..26: note = Synthetic Construct
  source 1..26: mol_type = other DNA
cactgaaggagaggcaagacagaaat

SEQ ID NO: 33203 - DNA, 23 bp, synthetic construct
  misc_feature 1..23: note = Synthetic Construct
  source 1..23: mol_type = other DNA
gattaggaagggctttggcattg

SEQ ID NO: 33204 - DNA, 24 bp, synthetic construct
  misc_feature 1..24: note = Synthetic Construct
  source 1..24: mol_type = other DNA
catggttaaggcagcaaagtgtaa

SEQ ID NO: 33205 - DNA, 25 bp, synthetic construct
  misc_feature 1..25: note = Synthetic Construct
  source 1..25: mol_type = other DNA
gttggtagggactcttgaagttttg

SEQ ID NO: 33206 - DNA, 22 bp, synthetic construct
  misc_feature 1..22: note = Synthetic Construct
  source 1..22: mol_type = other DNA
cacaggagagtctgggttgact

SEQ ID NO: 33207 - DNA, 19 bp, synthetic construct
  misc_feature 1..19: note = Synthetic Construct
  source 1..19: mol_type = other DNA
ggccagaactgggccgaaa

SEQ ID NO: 33208 - DNA, 23 bp, synthetic construct
  misc_feature 1..23: note = Synthetic Construct
  source 1..23: mol_type = other DNA
ggatgggtacagttggagaacaa

SEQ ID NO: 33209 - DNA, 22 bp, synthetic construct
  misc_feature 1..22: note = Synthetic Construct
  source 1..22: mol_type = other DNA
agaccaactggctacctgatgt

SEQ ID NO: 33210 - DNA, 22 bp, synthetic construct
  misc_feature 1..22: note = Synthetic Construct
  source 1..22: mol_type = other DNA
ggctaagaggagcagtgaccat

SEQ ID NO: 33211 - DNA, 22 bp, synthetic construct
  misc_feature 1..22: note = Synthetic Construct
  source 1..22: mol_type = other DNA
ggtgctcaggggagtgagaaaa

SEQ ID NO: 33212 - DNA, 26 bp, synthetic construct
  misc_feature 1..26: note = Synthetic Construct
  source 1..26: mol_type = other DNA
gagaatgtgaacaggggaaataggaa

SEQ ID NO: 33213 - DNA, 25 bp, synthetic construct
  misc_feature 1..25: note = Synthetic Construct
  source 1..25: mol_type = other DNA
acttcaaagtgtatgacgcttgcta

SEQ ID NO: 33214 - DNA, 24 bp, synthetic construct
  misc_feature 1..24: note = Synthetic Construct
  source 1..24: mol_type = other DNA
gctgggctagattagccattcaac

SEQ ID NO: 33215 - DNA, 18 bp, synthetic construct
  misc_feature 1..18: note = Synthetic Construct
  source 1..18: mol_type = other DNA
tggcagctccagcgaatc

SEQ ID NO: 33216 - DNA, 25 bp, synthetic construct
  misc_feature 1..25: note = Synthetic Construct
  source 1..25: mol_type = other DNA
ctcctcaactcctcactaggaactt

SEQ ID NO: 33217 - DNA, 22 bp, synthetic construct
  misc_feature 1..22: note = Synthetic Construct
  source 1..22: mol_type = other DNA
gggaagggcagcagacatcttt

SEQ ID NO: 33218 - DNA, 26 bp, synthetic construct
  misc_feature 1..26: note = Synthetic Construct
  source 1..26: mol_type = other DNA
ggcctgtgattatgtcagaagggttt

SEQ ID NO: 33219 - DNA, 27 bp, synthetic construct
  misc_feature 1..27: note = Synthetic Construct
  source 1..27: mol_type = other DNA
gggaatacaattggagtcagtggaaag

SEQ ID NO: 33220 - DNA, 26 bp, synthetic construct
  misc_feature 1..26: note = Synthetic Construct
  source 1..26: mol_type = other DNA
gaggaaagaccttgtctgttcaggta

SEQ ID NO: 33221 - DNA, 22 bp, synthetic construct
  misc_feature 1..22: note = Synthetic Construct
  source 1..22: mol_type = other DNA
gccacctggcagagagatgaaa

SEQ ID NO: 33222 - DNA, 28 bp, synthetic construct
  misc_feature 1..28: note = Synthetic Construct
  source 1..28: mol_type = other DNA
ggaggcaagttaaaaacgtgactaggaa

SEQ ID NO: 33223 - DNA, 24 bp, synthetic construct
  misc_feature 1..24: note = Synthetic Construct
  source 1..24: mol_type = other DNA
gctaggctgctattgcagtagttc

SEQ ID NO: 33224 - DNA, 24 bp, synthetic construct
  misc_feature 1..24: note = Synthetic Construct
  source 1..24: mol_type = other DNA
ccccatttgaccctctttttcaga

SEQ ID NO: 33225 - DNA, 21 bp, synthetic construct
  misc_feature 1..21: note = Synthetic Construct
  source 1..21: mol_type = other DNA
ttgggctcctgcctgcacaac

SEQ ID NO: 33226 - DNA, 20 bp, synthetic construct
  misc_feature 1..20: note = Synthetic Construct
  source 1..20: mol_type = other DNA
tgggaggaggcgcgagacta

SEQ ID NO: 33227 - DNA, 22 bp, synthetic construct
  misc_feature 1..22: note = Synthetic Construct
  source 1..22: mol_type = other DNA
acccacaagcctcaaccatttc

SEQ ID NO: 33228 - DNA, 21 bp, synthetic construct
  misc_feature 1..21: note = Synthetic Construct
  source 1..21: mol_type = other DNA
ggcacacctgtgttctgttga

SEQ ID NO: 33229 - DNA, 23 bp, synthetic construct
  misc_feature 1..23: note = Synthetic Construct
  source 1..23: mol_type = other DNA
gccacaacctcctgtttgagaga

SEQ ID NO: 33230 - DNA, 23 bp, synthetic construct
  misc_feature 1..23: note = Synthetic Construct
  source 1..23: mol_type = other DNA
gtttcctgcttggacttgactga

SEQ ID NO: 33231 - DNA, 26 bp, synthetic construct
  misc_feature 1..26: note = Synthetic Construct
  source 1..26: mol_type = other DNA
gacactattaaccaccaccgttcctt

SEQ ID NO: 33232 - DNA, 25 bp, synthetic construct
  misc_feature 1..25: note = Synthetic Construct
  source 1..25: mol_type = other DNA
ccatcccatccgtccaatacgttag

SEQ ID NO: 33233 - DNA, 22 bp, synthetic construct
  misc_feature 1..22: note = Synthetic Construct
  source 1..22: mol_type = other DNA
ggagcagctagaagctgaacaa

SEQ ID NO: 33234 - DNA, 25 bp, synthetic construct
  misc_feature 1..25: note = Synthetic Construct
  source 1..25: mol_type = other DNA
cccctttcctaaggtagaggagtct

SEQ ID NO: 33235 - DNA, 26 bp, synthetic construct
  misc_feature 1..26: note = Synthetic Construct
  source 1..26: mol_type = other DNA
gggtttcagaaagttagagccattca

SEQ ID NO: 33236 - DNA, 25 bp, synthetic construct
  misc_feature 1..25: note = Synthetic Construct
  source 1..25: mol_type = other DNA
ggaaatggatcatcagcagaagcaa

SEQ ID NO: 33237 - DNA, 25 bp, synthetic construct
  misc_feature 1..25: note = Synthetic Construct
  source 1..25: mol_type = other DNA
acagcattggccttatttccaaaag

SEQ ID NO: 33238 - DNA, 22 bp, synthetic construct
  misc_feature 1..22: note = Synthetic Construct
  source 1..22: mol_type = other DNA
ggctctctgcgcatcagaagaa

SEQ ID NO: 33239 - DNA, 23 bp, synthetic construct
  misc_feature 1..23: note = Synthetic Construct
  source 1..23: mol_type = other DNA
gcatggtcttgtctagggaggaa

SEQ ID NO: 33240 - DNA, 29 bp, synthetic construct
  misc_feature 1..29: note = Synthetic Construct
  source 1..29: mol_type = other DNA
ggagcaggacctattattagtcttcgatt

SEQ ID NO: 33241 - DNA, 24 bp, synthetic construct
  misc_feature 1..24: note = Synthetic Construct
  source 1..24: mol_type = other DNA
caggacattcctcctcctcagaca

SEQ ID NO: 33242 - DNA, 22 bp, synthetic construct
  misc_feature 1..22: note = Synthetic Construct
  source 1..22: mol_type = other DNA
caccacatcaaggctctaccat

SEQ ID NO: 33243 - DNA, 22 bp, synthetic construct
  misc_feature 1..22: note = Synthetic Construct
  source 1..22: mol_type = other DNA
gggcaggaggcattcatcaact

SEQ ID NO: 33244 - DNA, 28 bp, synthetic construct
  misc_feature 1..28: note = Synthetic Construct
  source 1..28: mol_type = other DNA
cctggtagtcttaaacaggaatctctca

SEQ ID NO: 33245 - DNA, 20 bp, synthetic construct
  misc_feature 1..20: note = Synthetic Construct
  source 1..20: mol_type = other DNA
ggagctgctgtgttggagtt

SEQ ID NO: 33246 - DNA, 27 bp, synthetic construct
  misc_feature 1..27: note = Synthetic Construct
  source 1..27: mol_type = other DNA
ctcagcgaagtttaaagcacatcattc

SEQ ID NO: 33247 - DNA, 25 bp, synthetic construct
  misc_feature 1..25: note = Synthetic Construct
  source 1..25: mol_type = other DNA
gaacctctcttcccagagattgaaa

SEQ ID NO: 33248 - DNA, 25 bp, synthetic construct
  misc_feature 1..25: note = Synthetic Construct
  source 1..25: mol_type = other DNA
tcttccttagcaccatggtagagat

SEQ ID NO: 33249 - DNA, 25 bp, synthetic construct
  misc_feature 1..25: note = Synthetic Construct
  source 1..25: mol_type = other DNA
ggaaaccaaagctctccagtaagtt

SEQ ID NO: 33250 - DNA, 24 bp, synthetic construct
  misc_feature 1..24: note = Synthetic Construct
  source 1..24: mol_type = other DNA
gctttatgagggtagggcttttca

SEQ ID NO: 33251 - DNA, 23 bp, synthetic construct
  misc_feature 1..23: note = Synthetic Construct
  source 1..23: mol_type = other DNA
agtccacatctcccttgaagaca

SEQ ID NO: 33252 - DNA, 23 bp, synthetic construct
  misc_feature 1..23: note = Synthetic Construct
  source 1..23: mol_type = other DNA
agggtggggaaagataaatgcaa

SEQ ID NO: 33253 - DNA, 23 bp, synthetic construct
  misc_feature 1..23: note = Synthetic Construct
  source 1..23: mol_type = other DNA
tgcagaccatcacacatctcaac

SEQ ID NO: 33254 - DNA, 24 bp, synthetic construct
  misc_feature 1..24: note = Synthetic Construct
  source 1..24: mol_type = other DNA
cagacactaagccaagctctgaag

SEQ ID NO: 33255 - DNA, 23 bp, synthetic construct
  misc_feature 1..23: note = Synthetic Construct
  source 1..23: mol_type = other DNA
caagagccccaagtaatgtgtgt

SEQ ID NO: 33256 - DNA, 24 bp, synthetic construct
  misc_feature 1..24: note = Synthetic Construct
  source 1..24: mol_type = other DNA
ccccaccttaaaggcacagagtag

SEQ ID NO: 33257 - DNA, 20 bp, synthetic construct
  misc_feature 1..20: note = Synthetic Construct
  source 1..20: mol_type = other DNA
ggtggggagaggcaggattg

SEQ ID NO: 33258 - DNA, 22 bp, synthetic construct
  misc_feature 1..22: note = Synthetic Construct
  source 1..22: mol_type = other DNA
aaatgtgtgtttgcgtgtggaa

SEQ ID NO: 33259 - DNA, 22 bp, synthetic construct
  misc_feature 1..22: note = Synthetic Construct
  source 1..22: mol_type = other DNA
ggcctaaacgctgctcacctat

SEQ ID NO: 33260 - DNA, 21 bp, synthetic construct
  misc_feature 1..21: note = Synthetic Construct
  source 1..21: mol_type = other DNA
ggaaaccggcatttggacaca

SEQ ID NO: 33261 - DNA, 23 bp, synthetic construct
  misc_feature 1..23: note = Synthetic Construct
  source 1..23: mol_type = other DNA
gtgactgtggcttcagagtgatg

SEQ ID NO: 33262 - DNA, 24 bp, synthetic construct
  misc_feature 1..24: note = Synthetic Construct
  source 1..24: mol_type = other DNA
gagcacaaaaggtaggagtgagaa

SEQ ID NO: 33263 - DNA, 24 bp, synthetic construct
  misc_feature 1..24: note = Synthetic Construct
  source 1..24: mol_type = other DNA
tcataacgtggaggagaactgttg

SEQ ID NO: 33264 - DNA, 25 bp, synthetic construct
  misc_feature 1..25: note = Synthetic Construct
  source 1..25: mol_type = other DNA
gcctaaaactttcatggggtgtttg

SEQ ID NO: 33265 - DNA, 22 bp, synthetic construct
  misc_feature 1..22: note = Synthetic Construct
  source 1..22: mol_type = other DNA
acagacctcaagctcgctcaga

SEQ ID NO: 33266 - DNA, 19 bp, synthetic construct
  misc_feature 1..19: note = Synthetic Construct
  source 1..19: mol_type = other DNA
agcctggggccttgtctga

SEQ ID NO: 33267 - DNA, 22 bp, synthetic construct
  misc_feature 1..22: note = Synthetic Construct
  source 1..22: mol_type = other DNA
cactggaacatgacctgtgaga

SEQ ID NO: 33268 - DNA, 24 bp, synthetic construct
  misc_feature 1..24: note = Synthetic Construct
  source 1..24: mol_type = other DNA
gacgtttaggtttccatggccaaa

SEQ ID NO: 33269 - DNA, 21 bp, synthetic construct
  misc_feature 1..21: note = Synthetic Construct
  source 1..21: mol_type = other DNA
tcccaggagaggaaggccaat

SEQ ID NO: 33270 - DNA, 24 bp, synthetic construct
  misc_feature 1..24: note = Synthetic Construct
  source 1..24: mol_type = other DNA
ctccttagggtggcatacacaaac

SEQ ID NO: 33271 - DNA, 25 bp, synthetic construct
  misc_feature 1..25: note = Synthetic Construct
  source 1..25: mol_type = other DNA
cagagaaggaatccctgctatcaaa

SEQ ID NO: 33272 - DNA, 25 bp, synthetic construct
  misc_feature 1..25: note = Synthetic Construct
  source 1..25: mol_type = other DNA
ggtttgagaggcacctagaatcact

SEQ ID NO: 33273 - DNA, 21 bp, synthetic construct
  misc_feature 1..21: note = Synthetic Construct
  source 1..21: mol_type = other DNA
gtgtgaaagccaggtgagcat

SEQ ID NO: 33274 - DNA, 24 bp, synthetic construct
  misc_feature 1..24: note = Synthetic Construct
  source 1..24: mol_type = other DNA
ggaccacaatcttcatgagagcaa

SEQ ID NO: 33275 - DNA, 27 bp, synthetic construct
  misc_feature 1..27: note = Synthetic Construct
  source 1..27: mol_type = other DNA
ctcattagatgccttcgtcttttcagt

SEQ ID NO: 33276 - DNA, 26 bp, synthetic construct
  misc_feature 1..26: note = Synthetic Construct
  source 1..26: mol_type = other DNA
gtattggccgtaggtttattgacttc

SEQ ID NO: 33277 - DNA, 22 bp, synthetic construct
  misc_feature 1..22: note = Synthetic Construct
  source 1..22: mol_type = other DNA
ccagatagtggccagattgctt

SEQ ID NO: 33278 - DNA, 22 bp, synthetic construct
  misc_feature 1..22: note = Synthetic Construct
  source 1..22: mol_type = other DNA
agtaggcagcaacagttgtcat

SEQ ID NO: 33279 - DNA, 20 bp, synthetic construct
  misc_feature 1..20: note = Synthetic Construct
  source 1..20: mol_type = other DNA
tctccagcactggctcagat

SEQ ID NO: 33280 - DNA, 24 bp, synthetic construct
  misc_feature 1..24: note = Synthetic Construct
  source 1..24: mol_type = other DNA
atgtcaagacagcctaggttcaaa

SEQ ID NO: 33281 - DNA, 22 bp, synthetic construct
  misc_feature 1..22: note = Synthetic Construct
  source 1..22: mol_type = other DNA
tggagggagctgcttctagctt

SEQ ID NO: 33282 - DNA, 19 bp, synthetic construct
  misc_feature 1..19: note = Synthetic Construct
  source 1..19: mol_type = other DNA
cgtgaccggccaacactga

SEQ ID NO: 33283 - DNA, 20 bp, synthetic construct
  misc_feature 1..20: note = Synthetic Construct
  source 1..20: mol_type = other DNA
tgctgtggttgggtcccatt

SEQ ID NO: 33284 - DNA, 24 bp, synthetic construct
  misc_feature 1..24: note = Synthetic Construct
  source 1..24: mol_type = other DNA
gtgaaatccctgaagtgtttgctt

SEQ ID NO: 33285 - DNA, 23 bp, synthetic construct
  misc_feature 1..23: note = Synthetic Construct
  source 1..23: mol_type = other DNA
agggtaaatgggagtgcttctct

SEQ ID NO: 33286 - DNA, 22 bp, synthetic construct
  misc_feature 1..22: note = Synthetic Construct
  source 1..22: mol_type = other DNA
gcagctggtcaggagataaagt

SEQ ID NO: 33287 - DNA, 21 bp, synthetic construct
  misc_feature 1..21: note = Synthetic Construct
  source 1..21: mol_type = other DNA
cgctggcttccagaagggttt

SEQ ID NO: 33288 - DNA, 24 bp, synthetic construct
  misc_feature 1..24: note = Synthetic Construct
  source 1..24: mol_type = other DNA
tgggtctcttgaagacagaagatg

SEQ ID NO: 33289 - DNA, 27 bp, synthetic construct
  misc_feature 1..27: note = Synthetic Construct
  source 1..27: mol_type = other DNA
ctctgagaagacgtgtctcatttccaa

SEQ ID NO: 33290 - DNA, 21 bp, synthetic construct
  misc_feature 1..21: note = Synthetic Construct
  source 1..21: mol_type = other DNA
ccctcttcagctaggcacaca

SEQ ID NO: 33291 - DNA, 21 bp, synthetic construct
  misc_feature 1..21: note = Synthetic Construct
  source 1..21: mol_type = other DNA
atcggccctcctcacctttca

SEQ ID NO: 33292 - DNA, 22 bp, synthetic construct
  misc_feature 1..22: note = Synthetic Construct
  source 1..22: mol_type = other DNA
cccaggcccatgactactcctt

SEQ ID NO: 33293 - DNA, 26 bp, synthetic construct
  misc_feature 1..26: note = Synthetic Construct
  source 1..26: mol_type = other DNA
ccttaaggattcagccctcttctaaa

SEQ ID NO: 33294 - DNA, 25 bp, synthetic construct
  misc_feature 1..25: note = Synthetic Construct
  source 1..25: mol_type = other DNA
ccctcccttccctctaaatagactt

SEQ ID NO: 33295 - DNA, 24 bp, synthetic construct
  misc_feature 1..24: note = Synthetic Construct
  source 1..24: mol_type = other DNA
gtccaggaagactggagcctagaa

SEQ ID NO: 33296 - DNA, 26 bp, synthetic construct
  misc_feature 1..26: note = Synthetic Construct
  source 1..26: mol_type = other DNA
ggcttctggttttggaaacaggttga

SEQ ID NO: 33297 - DNA, 22 bp, synthetic construct
  misc_feature 1..22: note = Synthetic Construct
  source 1..22: mol_type = other DNA
ggggctttgtactcacaagtca

SEQ ID NO: 33298 - DNA, 20 bp, synthetic construct
  misc_feature 1..20: note = Synthetic Construct
  source 1..20: mol_type = other DNA
ccttgcgcttggcattggtt

SEQ ID NO: 33299 - DNA, 24 bp, synthetic construct
  misc_feature 1..24: note = Synthetic Construct
  source 1..24: mol_type = other DNA
cagaggacactgacaatcaagtca

SEQ ID NO: 33300 - DNA, 24 bp, synthetic construct
  misc_feature 1..24: note = Synthetic Construct
  source 1..24: mol_type = other DNA
cctgaccagggtacagtcactaag

SEQ ID NO: 33301 - DNA, 22 bp, synthetic construct
  misc_feature 1..22: note = Synthetic Construct
  source 1..22: mol_type = other DNA
cagcaaccaagccaatcctgaa

SEQ ID NO: 33302 - DNA, 28 bp, synthetic construct
  misc_feature 1..28: note = Synthetic Construct
  source 1..28: mol_type = other DNA
gggtaaaggtgggagagaagagagtttc

SEQ ID NO: 33303 - DNA, 23 bp, synthetic construct
  misc_feature 1..23: note = Synthetic Construct
  source 1..23: mol_type = other DNA
tgtaaaagtggccagtctgttct

SEQ ID NO: 33304 - DNA, 19 bp, synthetic construct
  misc_feature 1..19: note = Synthetic Construct
  source 1..19: mol_type = other DNA
aggcagagcagctccacaa

SEQ ID NO: 33305 - DNA, 21 bp, synthetic construct
  misc_feature 1..21: note = Synthetic Construct
  source 1..21: mol_type = other DNA
ggtgcttgaagtgggcttttc

SEQ ID NO: 33306 - DNA, 21 bp, synthetic construct
  misc_feature 1..21: note = Synthetic Construct
  source 1..21: mol_type = other DNA
ggccagttcgctaccaaggaa

SEQ ID NO: 33307 - DNA, 20 bp, synthetic construct
  misc_feature 1..20: note = Synthetic Construct
  source 1..20: mol_type = other DNA
cacctcagcctcctgcatag

SEQ ID NO: 33308 - DNA, 22 bp, synthetic construct
  misc_feature 1..22: note = Synthetic Construct
  source 1..22: mol_type = other DNA
agtagtccccaaccagcagaga

SEQ ID NO: 33309 - DNA, 30 bp, synthetic construct
  misc_feature 1..30: note = Synthetic Construct
  source 1..30: mol_type = other DNA
cctcttcttcatcctggttaatttggaagt

SEQ ID NO: 33310 - DNA, 24 bp, synthetic construct
  misc_feature 1..24: note = Synthetic Construct
  source 1..24: mol_type = other DNA
agacgaaggctcaatgtagacaag

SEQ ID NO: 33311 - DNA, 23 bp, synthetic construct
  misc_feature 1..23: note = Synthetic Construct
  source 1..23: mol_type = other DNA
cgtctgtcacagttaacggcaaa

SEQ ID NO: 33312 - DNA, 20 bp, synthetic construct
  misc_feature 1..20: note = Synthetic Construct
  source 1..20: mol_type = other DNA
tccacacctgcggccaaaat

SEQ ID NO: 33313 - DNA, 18 bp, synthetic construct
  misc_feature 1..18: note = Synthetic Construct
  source 1..18: mol_type = other DNA
tgctgggcccatgtgctt

SEQ ID NO: 33314 - DNA, 19 bp, synthetic construct
  misc_feature 1..19: note = Synthetic Construct
  source 1..19: mol_type = other DNA
tgctgggtgccaggacatc

SEQ ID NO: 33315 - DNA, 25 bp, synthetic construct
  misc_feature 1..25: note = Synthetic Construct
  source 1..25: mol_type = other DNA
ctgcagaagacctacaggtaacatc

SEQ ID NO: 33316 - DNA, 20 bp, synthetic construct
  misc_feature 1..20: note = Synthetic Construct
  source 1..20: mol_type = other DNA
gccctgtggcatggtcattt

SEQ ID NO: 33317 - DNA, 24 bp, synthetic construct
  misc_feature 1..24: note = Synthetic Construct
  source 1..24: mol_type = other DNA
gtgagaggaaatcttgggctatga

SEQ ID NO: 33318 - DNA, 22 bp, synthetic construct
  misc_feature 1..22: note = Synthetic Construct
  source 1..22: mol_type = other DNA
ggagcaaggcacagttttcaga

SEQ ID NO: 33319 - DNA, 21 bp, synthetic construct
  misc_feature 1..21: note = Synthetic Construct
  source 1..21: mol_type = other DNA
gccctttaagccaaccctaca

SEQ ID NO: 33320 - DNA, 19 bp, synthetic construct
  misc_feature 1..19: note = Synthetic Construct
  source 1..19: mol_type = other DNA
gcccagccactggtgaact

SEQ ID NO: 33321 - DNA, 20 bp, synthetic construct
  misc_feature 1..20: note = Synthetic Construct
  source 1..20: mol_type = other DNA
ttgtcaccaccgggcacatt

SEQ ID NO: 33322 - DNA, 22 bp, synthetic construct
  misc_feature 1..22: note = Synthetic Construct
  source 1..22: mol_type = other DNA
gcggagcagatgtgatgcctat

SEQ ID NO: 33323 - DNA, 23 bp, synthetic construct
  misc_feature 1..23: note = Synthetic Construct
  source 1..23: mol_type = other DNA
caatctcacccaaacctgcttct

SEQ ID NO: 33324 - DNA, 23 bp, synthetic construct
  misc_feature 1..23: note = Synthetic Construct
  source 1..23: mol_type = other DNA
ccccgtacccaatgaggagctat

SEQ ID NO: 33325 - DNA, 25 bp, synthetic construct
  misc_feature 1..25: note = Synthetic Construct
  source 1..25: mol_type = other DNA
acagaaagtgtgtgcttcactgata

SEQ ID NO: 33326 - DNA, 24 bp, synthetic construct
  misc_feature 1..24: note = Synthetic Construct
  source 1..24: mol_type = other DNA
cagtgcaagaacactgaagactca

SEQ ID NO: 33327 - DNA, 24 bp, synthetic construct
  misc_feature 1..24: note = Synthetic Construct
  source 1..24: mol_type = other DNA
actgatctcccagtcagggtcaag

SEQ ID NO: 33328 - DNA, 22 bp, synthetic construct
  misc_feature 1..22: note = Synthetic Construct
  source 1..22: mol_type = other DNA
cgagccctgctgcttcacatta

SEQ ID NO: 33329 - DNA, 22 bp, synthetic construct
  misc_feature 1..22: note = Synthetic Construct
  source 1..22: mol_type = other DNA
cccgaggctcctccggttatta

SEQ ID NO: 33330 - DNA, 22 bp, synthetic construct
  misc_feature 1..22: note = Synthetic Construct
  source 1..22: mol_type = other DNA
cccagaggacctcacacctcat

SEQ ID NO: 33331 - DNA, 23 bp, synthetic construct
  misc_feature 1..23: note = Synthetic Construct
  source 1..23: mol_type = other DNA
cactctgaatgtgaggctgtagt

SEQ ID NO: 33332 - DNA, 22 bp, synthetic construct
  misc_feature 1..22: note = Synthetic Construct
  source 1..22: mol_type = other DNA
gttcagcaaggtgtgcttctgt

SEQ ID NO: 33333 - DNA, 19 bp, synthetic construct
  misc_feature 1..19: note = Synthetic Construct
  source 1..19: mol_type = other DNA
tggagggccagtgggatgt

SEQ ID NO: 33334 - DNA, 23 bp, synthetic construct
  misc_feature 1..23: note = Synthetic Construct
  source 1..23: mol_type = other DNA
gcatcaccaagagtctcccttgt

SEQ ID NO: 33335 - DNA, 26 bp, synthetic construct
  misc_feature 1..26: note = Synthetic Construct
  source 1..26: mol_type = other DNA
ggacagggtggatactgtgtttgtag

SEQ ID NO: 33336 - DNA, 24 bp, synthetic construct
  misc_feature 1..24: note = Synthetic Construct
  source 1..24: mol_type = other DNA
cttagcacagagtaaacccacaca

SEQ ID NO: 33337 - DNA, 23 bp, synthetic construct
  misc_feature 1..23: note = Synthetic Construct
  source 1..23: mol_type = other DNA
ccctcccaaacctggactgttct

SEQ ID NO: 33338 - DNA, 23 bp, synthetic construct
  misc_feature 1..23: note = Synthetic Construct
  source 1..23: mol_type = other DNA
cccctccccgcaggacttaaata

SEQ ID NO: 33339 - DNA, 28 bp, synthetic construct
  misc_feature 1..28: note = Synthetic Construct
  source 1..28: mol_type = other DNA
cagacccaaaccatatcaccttcttttc

SEQ ID NO: 33340 - DNA, 24 bp, synthetic construct
  misc_feature 1..24: note = Synthetic Construct
  source 1..24: mol_type = other DNA
gggtcagtctgtagagtccgtttc

SEQ ID NO: 33341 - DNA, 18 bp, synthetic construct
  misc_feature 1..18: note = Synthetic Construct
  source 1..18: mol_type = other DNA
tagcagggcccagagcaa

SEQ ID NO: 33342 - DNA, 26 bp, synthetic construct
  misc_feature 1..26: note = Synthetic Construct
  source 1..26: mol_type = other DNA
ctgcagacattctgtgtactgtgaga

SEQ ID NO: 33343 - DNA, 23 bp, synthetic construct
  misc_feature 1..23: note = Synthetic Construct
  source 1..23: mol_type = other DNA
aagtgtggtcttcatggttccaa

SEQ ID NO: 33344 - DNA, 22 bp, synthetic construct
  misc_feature 1..22: note = Synthetic Construct
  source 1..22: mol_type = other DNA
gtgcccacagagggagcattta

SEQ ID NO: 33345 - DNA, 25 bp, synthetic construct
  misc_feature 1..25: note = Synthetic Construct
  source 1..25: mol_type = other DNA
gcacaattttcagcaaggagagatg

SEQ ID NO: 33346 - DNA, 23 bp, synthetic construct
  misc_feature 1..23: note = Synthetic Construct
  source 1..23: mol_type = other DNA
ctgtgagcatctagggtcacgat

SEQ ID NO: 33347 - DNA, 24 bp, synthetic construct
  misc_feature 1..24: note = Synthetic Construct
  source 1..24: mol_type = other DNA
cacaatggtcccagacagaagcaa

SEQ ID NO: 33348 - DNA, 25 bp, synthetic construct
  misc_feature 1..25: note = Synthetic Construct
  source 1..25: mol_type = other DNA
gtgcccatactacccaaagcaatac

SEQ ID NO: 33349 - DNA, 19 bp, synthetic construct
  misc_feature 1..19: note = Synthetic Construct
  source 1..19: mol_type = other DNA
tgggcagggtacccagtga

SEQ ID NO: 33350 - DNA, 22 bp, synthetic construct
  misc_feature 1..22: note = Synthetic Construct
  source 1..22: mol_type = other DNA
cattttccctgggctacactct

SEQ ID NO: 33351 - DNA, 25 bp, synthetic construct
  misc_feature 1..25: note = Synthetic Construct
  source 1..25: mol_type = other DNA
ggtggtgatgaatgatggacatact

SEQ ID NO: 33352 - DNA, 25 bp, synthetic construct
  misc_feature 1..25: note = Synthetic Construct
  source 1..25: mol_type = other DNA
tctgaagatttcacgacaggaagaa

SEQ ID NO: 33353 - DNA, 24 bp, synthetic construct
  misc_feature 1..24: note = Synthetic Construct
  source 1..24: mol_type = other DNA
gaaccacaaacctttggaatggaa

SEQ ID NO: 33354 - DNA, 25 bp, synthetic construct
  misc_feature 1..25: note = Synthetic Construct
  source 1..25: mol_type = other DNA
gctctgctagcaaactgtgcttgtt

SEQ ID NO: 33355 - DNA, 20 bp, synthetic construct
  misc_feature 1..20: note = Synthetic Construct
  source 1..20: mol_type = other DNA
accaggtaggaggctgcttt

SEQ ID NO: 33356 - DNA, 25 bp, synthetic construct
  misc_feature 1..25: note = Synthetic Construct
  source 1..25: mol_type = other DNA
ggggaaggatggaggtattaagtga

SEQ ID NO: 33357 - DNA, 20 bp, synthetic construct
  misc_feature 1..20: note = Synthetic Construct
  source 1..20: mol_type = other DNA
tcgagaggaaagggctgtgt

SEQ ID NO: 33358 - DNA, 20 bp, synthetic construct
  misc_feature 1..20: note = Synthetic Construct
  source 1..20: mol_type = other DNA
aaggccaggtcacctacaga

SEQ ID NO: 33359 - DNA, 20 bp, synthetic construct
  misc_feature 1..20: note = Synthetic Construct
  source 1..20: mol_type = other DNA
tgtgcccaggcctaaactgt

SEQ ID NO: 33360 - DNA, 20 bp, synthetic construct
  misc_feature 1..20: note = Synthetic Construct
  source 1..20: mol_type = other DNA
agcctccagctacccggaat

SEQ ID NO: 33361 - DNA, 21 bp, synthetic construct
  misc_feature 1..21: note = Synthetic Construct
  source 1..21: mol_type = other DNA
gtgtggtgaggaccatggatt

SEQ ID NO: 33362 - DNA, 19 bp, synthetic construct
  misc_feature 1..19: note = Synthetic Construct
  source 1..19: mol_type = other DNA
gggagggcttcccacaaag

SEQ ID NO: 33363 - DNA, 24 bp, synthetic construct
  misc_feature 1..24: note = Synthetic Construct
  source 1..24: mol_type = other DNA
ccccgtagagaactgtctcacatc

SEQ ID NO: 33364 - DNA, 25 bp, synthetic construct
  misc_feature 1..25: note = Synthetic Construct
  source 1..25: mol_type = other DNA
actcaaaatgcagcctagatagcaa

SEQ ID NO: 33365 - DNA, 27 bp, synthetic construct
  misc_feature 1..27: note = Synthetic Construct
  source 1..27: mol_type = other DNA
gcagctaccagatagacttagctgtaa

SEQ ID NO: 33366 - DNA, 29 bp, synthetic construct
  misc_feature 1..29: note = Synthetic Construct
  source 1..29: mol_type = other DNA
gacagaaccccttgtataacaatcagact

SEQ ID NO: 33367 - DNA, 21 bp, synthetic construct
  misc_feature 1..21: note = Synthetic Construct
  source 1..21: mol_type = other DNA
gtccaggcagagccatacatc

SEQ ID NO: 33368 - DNA, 21 bp, synthetic construct
  misc_feature 1..21: note = Synthetic Construct
  source 1..21: mol_type = other DNA
tagggccaagagctcctgcaa

SEQ ID NO: 33369 - DNA, 27 bp, synthetic construct
  misc_feature 1..27: note = Synthetic Construct
  source 1..27: mol_type = other DNA
gaagccatgcagaaaacatttccttac

SEQ ID NO: 33370 - DNA, 21 bp, synthetic construct
  misc_feature 1..21: note = Synthetic Construct
  source 1..21: mol_type = other DNA
cctgccccgcctccatattta

SEQ ID NO: 33371 - DNA, 26 bp, synthetic construct
  misc_feature 1..26: note = Synthetic Construct
  source 1..26: mol_type = other DNA
gtggaaatagaagctcactctcaact

SEQ ID NO: 33372 - DNA, 22 bp, synthetic construct
  misc_feature 1..22: note = Synthetic Construct
  source 1..22: mol_type = other DNA
caacacaccaatgcagccaatc

SEQ ID NO: 33373 - DNA, 24 bp, synthetic construct
  misc_feature 1..24: note = Synthetic Construct
  source 1..24: mol_type = other DNA
cctgcagagttattgggaagatga

SEQ ID NO: 33374 - DNA, 21 bp, synthetic construct
  misc_feature 1..21: note = Synthetic Construct
  source 1..21: mol_type = other DNA
tgggcagcacgtcacagaatc

SEQ ID NO: 33375 - DNA, 20 bp, synthetic construct
  misc_feature 1..20: note = Synthetic Construct
  source 1..20: mol_type = other DNA
agcaggctgggccaaaatca

SEQ ID NO: 33376 - DNA, 23 bp, synthetic construct
  misc_feature 1..23: note = Synthetic Construct
  source 1..23: mol_type = other DNA
cacttgcgaaggaatcaccatca

SEQ ID NO: 33377 - DNA, 22 bp, synthetic construct
  misc_feature 1..22: note = Synthetic Construct
  source 1..22: mol_type = other DNA
tggtggagcagtcacctcttct

SEQ ID NO: 33378 - DNA, 21 bp, synthetic construct
  misc_feature 1..21: note = Synthetic Construct
  source 1..21: mol_type = other DNA
gcctggctttgcagagctttt

SEQ ID NO: 33379 - DNA, 24 bp, synthetic construct
  misc_feature 1..24: note = Synthetic Construct
  source 1..24: mol_type = other DNA
agggcctttacaaaagagtcttga

SEQ ID NO: 33380 - DNA, 22 bp, synthetic construct
  misc_feature 1..22: note = Synthetic Construct
  source 1..22: mol_type = other DNA
cagcccaggaccctcttttgat

SEQ ID NO: 33381 - DNA, 23 bp, synthetic construct
  misc_feature 1..23: note = Synthetic Construct
  source 1..23: mol_type = other DNA
gcaggatatgagtgatgctccat

SEQ ID NO: 33382 - DNA, 19 bp, synthetic construct
  misc_feature 1..19: note = Synthetic Construct
  source 1..19: mol_type = other DNA
gccgccatctctgaactgt

SEQ ID NO: 33383 - DNA, 25 bp, synthetic construct
  misc_feature 1..25: note = Synthetic Construct
  source 1..25: mol_type = other DNA
gtcataactacatggctggaaccta

SEQ ID NO: 33384 - DNA, 27 bp, synthetic construct
  misc_feature 1..27: note = Synthetic Construct
  source 1..27: mol_type = other DNA
accatggactaatgaaatctggctatg

SEQ ID NO: 33385 - DNA, 20 bp, synthetic construct
  misc_feature 1..20: note = Synthetic Construct
  source 1..20: mol_type = other DNA
atccacagccagccatcaag

SEQ ID NO: 33386 - DNA, 27 bp, synthetic construct
  misc_feature 1..27: note = Synthetic Construct
  source 1..27: mol_type = other DNA
gagtgctcactcagcatatctgctatc

SEQ ID NO: 33387 - DNA, 22 bp, synthetic construct
  misc_feature 1..22: note = Synthetic Construct
  source 1..22: mol_type = other DNA
ttctggggacacctgatagaca

SEQ ID NO: 33388 - DNA, 24 bp, synthetic construct
  misc_feature 1..24: note = Synthetic Construct
  source 1..24: mol_type = other DNA
agcaaaaataccgaggtagccaat

SEQ ID NO: 33389 - DNA, 24 bp, synthetic construct
  misc_feature 1..24: note = Synthetic Construct
  source 1..24: mol_type = other DNA
gcccaataggtgtgaaactttgaa

SEQ ID NO: 33390 - DNA, 25 bp, synthetic construct
  misc_feature 1..25: note = Synthetic Construct
  source 1..25: mol_type = other DNA
ggataggcaagtactggctaaaagt

SEQ ID NO: 33391 - DNA, 24 bp, synthetic construct
  misc_feature 1..24: note = Synthetic Construct
  source 1..24: mol_type = other DNA
cccctaccatgactgatgaagaaa

SEQ ID NO: 33392 - DNA, 23 bp, synthetic construct
  misc_feature 1..23: note = Synthetic Construct
  source 1..23: mol_type = other DNA
ggctgagcccatggagttaagat

SEQ ID NO: 33393 - DNA, 23 bp, synthetic construct
  misc_feature 1..23: note = Synthetic Construct
  source 1..23: mol_type = other DNA
cagcctgcaattcctatggacta

SEQ ID NO: 33394 - DNA, 21 bp, synthetic construct
  misc_feature 1..21: note = Synthetic Construct
  source 1..21: mol_type = other DNA
acctgtggctcttctccatct

SEQ ID NO: 33395 - DNA, 26 bp, synthetic construct
  misc_feature 1..26: note = Synthetic Construct
  source 1..26: mol_type = other DNA
gagtctgatcataccagaccatcctt

SEQ ID NO: 33396 - DNA, 26 bp, synthetic construct
  misc_feature 1..26: note = Synthetic Construct
  source 1..26: mol_type = other DNA
gagctcgtgataacaatatccctttg

SEQ ID NO: 33397 - DNA, 25 bp, synthetic construct
  misc_feature 1..25: note = Synthetic Construct
  source 1..25: mol_type = other DNA
cacgctcaattttctcctgttttca

SEQ ID NO: 33398 - DNA, 26 bp, synthetic construct
  misc_feature 1..26: note = Synthetic Construct
  source 1..26: mol_type = other DNA
ggaaagtgggaaacttgaaactgaga

SEQ ID NO: 33399 - DNA, 22 bp, synthetic construct
  misc_feature 1..22: note = Synthetic Construct
  source 1..22: mol_type = other DNA
ccagcaggaccctgactgtact

SEQ ID NO: 33400 - DNA, 28 bp, synthetic construct
  misc_feature 1..28: note = Synthetic Construct
  source 1..28: mol_type = other DNA
caggacctgacattaaccttggttttag

SEQ ID NO: 33401 - DNA, 23 bp, synthetic construct
  misc_feature 1..23: note = Synthetic Construct
  source 1..23: mol_type = other DNA
gcatctatggggaatgggagcaa

SEQ ID NO: 33402 - DNA, 21 bp, synthetic construct
  misc_feature 1..21: note = Synthetic Construct
  source 1..21: mol_type = other DNA
cagcaaggcgttttccactga

SEQ ID NO: 33403 - DNA, 22 bp, synthetic construct
  misc_feature 1..22: note = Synthetic Construct
  source 1..22: mol_type = other DNA
gcctgcttggtatcccctgaat

SEQ ID NO: 33404 - DNA, 26 bp, synthetic construct
  misc_feature 1..26: note = Synthetic Construct
  source 1..26: mol_type = other DNA
caggacacaattggaaacactggtta

SEQ ID NO: 33405 - DNA, 28 bp, synthetic construct
  misc_feature 1..28: note = Synthetic Construct
  source 1..28: mol_type = other DNA
ctgccagctactaagtatgtctatgcta

SEQ ID NO: 33406 - DNA, 20 bp, synthetic construct
  misc_feature 1..20: note = Synthetic Construct
  source 1..20: mol_type = other DNA
gcctaagagcaggcatgcaa

SEQ ID NO: 33407 - DNA, 22 bp, synthetic construct
  misc_feature 1..22: note = Synthetic Construct
  source 1..22: mol_type = other DNA
ggcagctgtggtagacctttgt

SEQ ID NO: 33408 - DNA, 24 bp, synthetic construct
  misc_feature 1..24: note = Synthetic Construct
  source 1..24: mol_type = other DNA
ccattagtggctccatacccttca

SEQ ID NO: 33409 - DNA, 26 bp, synthetic construct
  misc_feature 1..26: note = Synthetic Construct
  source 1..26: mol_type = other DNA
cctgaagccatcaagtttcaggttta

SEQ ID NO: 33410 - DNA, 24 bp, synthetic construct
  misc_feature 1..24: note = Synthetic Construct
  source 1..24: mol_type = other DNA
ctggggactggtcgtataggtatc

SEQ ID NO: 33411 - DNA, 20 bp, synthetic construct
  misc_feature 1..20: note = Synthetic Construct
  source 1..20: mol_type = other DNA
ggccatggacctttggcaat

SEQ ID NO: 33412 - DNA, 26 bp, synthetic construct
  misc_feature 1..26: note = Synthetic Construct
  source 1..26: mol_type = other DNA
gaatgtggatttagcttctccctaga

SEQ ID NO: 33413 - DNA, 27 bp, synthetic construct
  misc_feature 1..27: note = Synthetic Construct
  source 1..27: mol_type = other DNA
caccatgagtttgactttgtacctgat

SEQ ID NO: 33414 - DNA, 20 bp, synthetic construct
  misc_feature 1..20: note = Synthetic Construct
  source 1..20: mol_type = other DNA
ttcctgactccaccgtcctt

SEQ ID NO: 33415 - DNA, 30 bp, synthetic construct
  misc_feature 1..30: note = Synthetic Construct
  source 1..30: mol_type = other DNA
ggagaaatctctgtttctcaccatgactct

SEQ ID NO: 33416 - DNA, 22 bp, synthetic construct
  misc_feature 1..22: note = Synthetic Construct
  source 1..22: mol_type = other DNA
ttccctcaccctcagggatctt

SEQ ID NO: 33417 - DNA, 19 bp, synthetic construct
  misc_feature 1..19: note = Synthetic Construct
  source 1..19: mol_type = other DNA
agggccagaggtgcgcaaa

SEQ ID NO: 33418 - DNA, 21 bp, synthetic construct
  misc_feature 1..21: note = Synthetic Construct
  source 1..21: mol_type = other DNA
caagctgcccctactacaaca

SEQ ID NO: 33419 - DNA, 21 bp, synthetic construct
  misc_feature 1..21: note = Synthetic Construct
  source 1..21: mol_type = other DNA
agccagtgggaggagcagata

SEQ ID NO: 33420 - DNA, 24 bp, synthetic construct
  misc_feature 1..24: note = Synthetic Construct
  source 1..24: mol_type = other DNA
tgtcacggaaactatcacctttga

SEQ ID NO: 33421 - DNA, 25 bp, synthetic construct
  misc_feature 1..25: note = Synthetic Construct
  source 1..25: mol_type = other DNA
gggactaaagcctgagagcatgaga

SEQ ID NO: 33422 - DNA, 24 bp, synthetic construct
  misc_feature 1..24: note = Synthetic Construct
  source 1..24: mol_type = other DNA
gttgagccacctgcattttcttac

SEQ ID NO: 33423 - DNA, 21 bp, synthetic construct
  misc_feature 1..21: note = Synthetic Construct
  source 1..21: mol_type = other DNA
aaccaggggaccaggatatgt

SEQ ID NO: 33424 - DNA, 21 bp, synthetic construct
  misc_feature 1..21: note = Synthetic Construct
  source 1..21: mol_type = other DNA
gggtgaggtgtcctggtctgt

SEQ ID NO: 33425 - DNA, 24 bp, synthetic construct
  misc_feature 1..24: note = Synthetic Construct
  source 1..24: mol_type = other DNA
ctcattccctctctcccacctaac

SEQ ID NO: 33426 - DNA, 20 bp, synthetic construct
  misc_feature 1..20: note = Synthetic Construct
  source 1..20: mol_type = other DNA
gagccaagccatgacacact

SEQ ID NO: 33427 - DNA, 23 bp, synthetic construct
  misc_feature 1..23: note = Synthetic Construct
  source 1..23: mol_type = other DNA
ggaggagcttccctgattggtat

SEQ ID NO: 33428 - DNA, 22 bp, synthetic construct
  misc_feature 1..22: note = Synthetic Construct
  source 1..22: mol_type = other DNA
gcacatgaactgccacgtccta

SEQ ID NO: 33429 - DNA, 27 bp, synthetic construct
  misc_feature 1..27: note = Synthetic Construct
  source 1..27: mol_type = other DNA
ggtggttgtagctgtgatttaacaaga

SEQ ID NO: 33430 - DNA, 26 bp, synthetic construct
  misc_feature 1..26: note = Synthetic Construct
  source 1..26: mol_type = other DNA
tccttcttcagtcctgttgaaagtag

SEQ ID NO: 33431 - DNA, 22 bp, synthetic construct
  misc_feature 1..22: note = Synthetic Construct
  source 1..22: mol_type = other DNA
atcctcaggggctccaggatct

SEQ ID NO: 33432 - DNA, 25 bp, synthetic construct
  misc_feature 1..25: note = Synthetic Construct
  source 1..25: mol_type = other DNA
ggtggagaccagtaggttttattgt

SEQ ID NO: 33433 - DNA, 26 bp, synthetic construct
  misc_feature 1..26: note = Synthetic Construct
  source 1..26: mol_type = other DNA
ccaggaaaatatcaggctcagtttca

SEQ ID NO: 33434 - DNA, 28 bp, synthetic construct
  misc_feature 1..28: note = Synthetic Construct
  source 1..28: mol_type = other DNA
ggtgaaatgtaagctctctggttctttc

SEQ ID NO: 33435 - DNA, 25 bp, synthetic construct
  misc_feature 1..25: note = Synthetic Construct
  source 1..25: mol_type = other DNA
gggtgctgaaatggttggaatgagt

SEQ ID NO: 33436 - DNA, 22 bp, synthetic construct
  misc_feature 1..22: note = Synthetic Construct
  source 1..22: mol_type = other DNA
ggcccagcctataaaaccacat

SEQ ID NO: 33437 - DNA, 26 bp, synthetic construct
  misc_feature 1..26: note = Synthetic Construct
  source 1..26: mol_type = other DNA
ggttaaaaacatgggccttagagtca

SEQ ID NO: 33438 - DNA, 21 bp, synthetic construct
  misc_feature 1..21: note = Synthetic Construct
  source 1..21: mol_type = other DNA
cccacagctagggcaatctga

SEQ ID NO: 33439 - DNA, 23 bp, synthetic construct
  misc_feature 1..23: note = Synthetic Construct
  source 1..23: mol_type = other DNA
gcagagggcactcataagtcagt

SEQ ID NO: 33440 - DNA, 23 bp, synthetic construct
  misc_feature 1..23: note = Synthetic Construct
  source 1..23: mol_type = other DNA
gtccggggacacattctagtttc

SEQ ID NO: 33441 - DNA, 26 bp, synthetic construct
  misc_feature 1..26: note = Synthetic Construct
  source 1..26: mol_type = other DNA
ctaaagacctaagcctgttcacatct

SEQ ID NO: 33442 - DNA, 22 bp, synthetic construct
  misc_feature 1..22: note = Synthetic Construct
  source 1..22: mol_type = other DNA
gtgccaccttactggccaaaga

SEQ ID NO: 33443 - DNA, 21 bp, synthetic construct
  misc_feature 1..21: note = Synthetic Construct
  source 1..21: mol_type = other DNA
ccagctgcagatgaagctcaa

SEQ ID NO: 33444 - DNA, 27 bp, synthetic construct
  misc_feature 1..27: note = Synthetic Construct
  source 1..27: mol_type = other DNA
gtaagtcaagtcacaccaattccttac

SEQ ID NO: 33445 - DNA, 24 bp, synthetic construct
  misc_feature 1..24: note = Synthetic Construct
  source 1..24: mol_type = other DNA
cagatcccagtgttctgaacttga

SEQ ID NO: 33446 - DNA, 22 bp, synthetic construct
  misc_feature 1..22: note = Synthetic Construct
  source 1..22: mol_type = other DNA
gcctgtaccacctcctgctaat

SEQ ID NO: 33447 - DNA, 22 bp, synthetic construct
  misc_feature 1..22: note = Synthetic Construct
  source 1..22: mol_type = other DNA
ctgaacatgcacccgagacaga

SEQ ID NO: 33448 - DNA, 18 bp, synthetic construct
  misc_feature 1..18: note = Synthetic Construct
  source 1..18: mol_type = other DNA
agccaggcctcctgttct

SEQ ID NO: 33449 - DNA, 20 bp, synthetic construct
  misc_feature 1..20: note = Synthetic Construct
  source 1..20: mol_type = other DNA
gcaagccccatcaaccatct

SEQ ID NO: 33450 - DNA, 24 bp, synthetic construct
  misc_feature 1..24: note = Synthetic Construct
  source 1..24: mol_type = other DNA
gatgcctcaaaacgcctcatagat

SEQ ID NO: 33451 - DNA, 25 bp, synthetic construct
  misc_feature 1..25: note = Synthetic Construct
  source 1..25: mol_type = other DNA
gagtcaatgaatactgcaccctctt

SEQ ID NO: 33452 - DNA, 24 bp, synthetic construct
  misc_feature 1..24: note = Synthetic Construct
  source 1..24: mol_type = other DNA
cccagggaatctgctggaatgtag

SEQ ID NO: 33453 - DNA, 23 bp, synthetic construct
  misc_feature 1..23: note = Synthetic Construct
  source 1..23: mol_type = other DNA
aaaatggaccctaactgccagaa

SEQ ID NO: 33454 - DNA, 22 bp, synthetic construct
  misc_feature 1..22: note = Synthetic Construct
  source 1..22: mol_type = other DNA
ggatccctgcctctaactctga

SEQ ID NO: 33455 - DNA, 25 bp, synthetic construct
  misc_feature 1..25: note = Synthetic Construct
  source 1..25: mol_type = other DNA
gttccagaaatctatgaggccatga

SEQ ID NO: 33456 - DNA, 24 bp, synthetic construct
  misc_feature 1..24: note = Synthetic Construct
  source 1..24: mol_type = other DNA
gggaaggccagagagtaagctaca

SEQ ID NO: 33457 - DNA, 24 bp, synthetic construct
  misc_feature 1..24: note = Synthetic Construct
  source 1..24: mol_type = other DNA
gattggaaggacataggcagttca

SEQ ID NO: 33458 - DNA, 24 bp, synthetic construct
  misc_feature 1..24: note = Synthetic Construct
  source 1..24: mol_type = other DNA
gtcccttgacaaagttcccctaga

SEQ ID NO: 33459 - DNA, 22 bp, synthetic construct
  misc_feature 1..22: note = Synthetic Construct
  source 1..22: mol_type = other DNA
gagagtctgggaaggctgaact

SEQ ID NO: 33460 - DNA, 26 bp, synthetic construct
  misc_feature 1..26: note = Synthetic Construct
  source 1..26: mol_type = other DNA
cactattttccacactgagggcatct

SEQ ID NO: 33461 - DNA, 24 bp, synthetic construct
  misc_feature 1..24: note = Synthetic Construct
  source 1..24: mol_type = other DNA
cgtagaaccaagcctgagatatga

SEQ ID NO: 33462 - DNA, 21 bp, synthetic construct
  misc_feature 1..21: note = Synthetic Construct
  source 1..21: mol_type = other DNA
tcgaggagcccagcacatcta

SEQ ID NO: 33463 - DNA, 25 bp, synthetic construct
  misc_feature 1..25: note = Synthetic Construct
  source 1..25: mol_type = other DNA
tgatgtctttggcagagtgttttac

SEQ ID NO: 33464 - DNA, 21 bp, synthetic construct
  misc_feature 1..21: note = Synthetic Construct
  source 1..21: mol_type = other DNA
ctaggcctcagcatcaagcat

SEQ ID NO: 33465 - DNA, 26 bp, synthetic construct
  misc_feature 1..26: note = Synthetic Construct
  source 1..26: mol_type = other DNA
cccttgtagcctatgtttatccttga

SEQ ID NO: 33466 - DNA, 24 bp, synthetic construct
  misc_feature 1..24: note = Synthetic Construct
  source 1..24: mol_type = other DNA
cccaaactgggtctcctctttgat

SEQ ID NO: 33467 - DNA, 21 bp, synthetic construct
  misc_feature 1..21: note = Synthetic Construct
  source 1..21: mol_type = other DNA
cccacctcccagacagcattt

SEQ ID NO: 33468 - DNA, 23 bp, synthetic construct
  misc_feature 1..23: note = Synthetic Construct
  source 1..23: mol_type = other DNA
ttcacattactcgcaaggtcagt

SEQ ID NO: 33469 - DNA, 23 bp, synthetic construct
  misc_feature 1..23: note = Synthetic Construct
  source 1..23: mol_type = other DNA
tgatgaccatgccacatctgtaa

SEQ ID NO: 33470 - DNA, 25 bp, synthetic construct
  misc_feature 1..25: note = Synthetic Construct
  source 1..25: mol_type = other DNA
ggggaaaacagtgacaagtcacgaa

SEQ ID NO: 33471 - DNA, 22 bp, synthetic construct
  misc_feature 1..22: note = Synthetic Construct
  source 1..22: mol_type = other DNA
gagtggtgccacttctgcttca

SEQ ID NO: 33472 - DNA, 25 bp, synthetic construct
  misc_feature 1..25: note = Synthetic Construct
  source 1..25: mol_type = other DNA
gcacttgggagagggaaaaatgcaa

SEQ ID NO: 33473 - DNA, 25 bp, synthetic construct
  misc_feature 1..25: note = Synthetic Construct
  source 1..25: mol_type = other DNA
ccctcatttgtaggtctaccctgat

SEQ ID NO: 33474 - DNA, 20 bp, synthetic construct
  misc_feature 1..20: note = Synthetic Construct
  source 1..20: mol_type = other DNA
ccctgccatgttgccagata

SEQ ID NO: 33475 - DNA, 22 bp, synthetic construct
  misc_feature 1..22: note = Synthetic Construct
  source 1..22: mol_type = other DNA
gggtcggactcttggcatcttc

SEQ ID NO: 33476 - DNA, 22 bp, synthetic construct
  misc_feature 1..22: note = Synthetic Construct
  source 1..22: mol_type = other DNA
aggagctaccacggggtatgaa

SEQ ID NO: 33477 - DNA, 26 bp, synthetic construct
  misc_feature 1..26: note = Synthetic Construct
  source 1..26: mol_type = other DNA
gctttccccttttcctgaaaaaccaa

SEQ ID NO: 33478 - DNA, 25 bp, synthetic construct
  misc_feature 1..25: note = Synthetic Construct
  source 1..25: mol_type = other DNA
cagctgagatcattctgcccttcaa

SEQ ID NO: 33479 - DNA, 24 bp, synthetic construct
  misc_feature 1..24: note = Synthetic Construct
  source 1..24: mol_type = other DNA
acaaatcctaacacagcacgtgaa

SEQ ID NO: 33480 - DNA, 23 bp, synthetic construct
  misc_feature 1..23: note = Synthetic Construct
  source 1..23: mol_type = other DNA
ctgttttcgagcagctagggatt

SEQ ID NO: 33481 - DNA, 26 bp, synthetic construct
  misc_feature 1..26: note = Synthetic Construct
  source 1..26: mol_type = other DNA
tggaatcctttcccctgtaagataac

SEQ ID NO: 33482 - DNA, 20 bp, synthetic construct
  misc_feature 1..20: note = Synthetic Construct
  source 1..20: mol_type = other DNA
gccagaccacttcaggaaca

SEQ ID NO: 33483 - DNA, 26 bp, synthetic construct
  misc_feature 1..26: note = Synthetic Construct
  source 1..26: mol_type = other DNA
ctgttagaaggtttcctctcatggtt

SEQ ID NO: 33484 - DNA, 24 bp, synthetic construct
  misc_feature 1..24: note = Synthetic Construct
  source 1..24: mol_type = other DNA
ccagctgaatgcttggagatggtt

SEQ ID NO: 33485 - DNA, 23 bp, synthetic construct
  misc_feature 1..23: note = Synthetic Construct
  source 1..23: mol_type = other DNA
cactgcagagaagtttgggcttt

SEQ ID NO: 33486 - DNA, 27 bp, synthetic construct
  misc_feature 1..27: note = Synthetic Construct
  source 1..27: mol_type = other DNA
gtgagatgactcaccctttttgcttag

SEQ ID NO: 33487 - DNA, 22 bp, synthetic construct
  misc_feature 1..22: note = Synthetic Construct
  source 1..22: mol_type = other DNA
ctgtggggcagtcagtttttct

SEQ ID NO: 33488 - DNA, 25 bp, synthetic construct
  misc_feature 1..25: note = Synthetic Construct
  source 1..25: mol_type = other DNA
acctaaccctatctcagctgttttc

SEQ ID NO: 33489 - DNA, 27 bp, synthetic construct
  misc_feature 1..27: note = Synthetic Construct
  source 1..27: mol_type = other DNA
cagatacagagatcaattccagctagt

SEQ ID NO: 33490 - DNA, 28 bp, synthetic construct
  misc_feature 1..28: note = Synthetic Construct
  source 1..28: mol_type = other DNA
gcgtctcagatgggttttatgtaactct

SEQ ID NO: 33491 - DNA, 22 bp, synthetic construct
  misc_feature 1..22: note = Synthetic Construct
  source 1..22: mol_type = other DNA
gctcctctctgaagttgggttt

SEQ ID NO: 33492 - DNA, 21 bp, synthetic construct
  misc_feature 1..21: note = Synthetic Construct
  source 1..21: mol_type = other DNA
ggcctgaggcaggtttgagtt

SEQ ID NO: 33493 - DNA, 20 bp, synthetic construct
  misc_feature 1..20: note = Synthetic Construct
  source 1..20: mol_type = other DNA
tacccaggaagccgcctgaa

SEQ ID NO: 33494 - DNA, 20 bp, synthetic construct
  misc_feature 1..20: note = Synthetic Construct
  source 1..20: mol_type = other DNA
aggctgcctaggggctattt

SEQ ID NO: 33495 - DNA, 22 bp, synthetic construct
  misc_feature 1..22: note = Synthetic Construct
  source 1..22: mol_type = other DNA
tggggaggagggactctagttt

SEQ ID NO: 33496 - DNA, 22 bp, synthetic construct
  misc_feature 1..22: note = Synthetic Construct
  source 1..22: mol_type = other DNA
aggtgccagagactgcagaaac

SEQ ID NO: 33497 - DNA, 20 bp, synthetic construct
  misc_feature 1..20: note = Synthetic Construct
  source 1..20: mol_type = other DNA
ccactgcacctggcctatca

SEQ ID NO: 33498 - DNA, 25 bp, synthetic construct
  misc_feature 1..25: note = Synthetic Construct
  source 1..25: mol_type = other DNA
tccttgtcatgttccttcctctttt

SEQ ID NO: 33499 - DNA, 27 bp, synthetic construct
  misc_feature 1..27: note = Synthetic Construct
  source 1..27: mol_type = other DNA
cagatatccatgggaatcaacagtttc

SEQ ID NO: 33500 - DNA, 24 bp, synthetic construct
  misc_feature 1..24: note = Synthetic Construct
  source 1..24: mol_type = other DNA
tgtgctttcacttcctggaaactt

SEQ ID NO: 33501 - DNA, 24 bp, synthetic construct
  misc_feature 1..24: note = Synthetic Construct
  source 1..24: mol_type = other DNA
gccccagttcaaaatctcttgtca

SEQ ID NO: 33502 - DNA, 27 bp, synthetic construct
  misc_feature 1..27: note = Synthetic Construct
  source 1..27: mol_type = other DNA
ggaagaccaaaaagggataaaggttga

SEQ ID NO: 33503 - DNA, 23 bp, synthetic construct
  misc_feature 1..23: note = Synthetic Construct
  source 1..23: mol_type = other DNA
gcctagaggggtggaaagcaaag

SEQ ID NO: 33504 - DNA, 20 bp, synthetic construct
  misc_feature 1..20: note = Synthetic Construct
  source 1..20: mol_type = other DNA
tgcgtctgcatgggtggttt

SEQ ID NO: 33505 - DNA, 22 bp, synthetic construct
  misc_feature 1..22: note = Synthetic Construct
  source 1..22: mol_type = other DNA
gacagccctgtgacgtaggaat

SEQ ID NO: 33506 - DNA, 27 bp, synthetic construct
  misc_feature 1..27: note = Synthetic Construct
  source 1..27: mol_type = other DNA
gagaaacagtagggtcaaaggaacaga

SEQ ID NO: 33507 - DNA, 27 bp, synthetic construct
  misc_feature 1..27: note = Synthetic Construct
  source 1..27: mol_type = other DNA
ggagcaaatttggtggattaaggatag

SEQ ID NO: 33508 - DNA, 21 bp, synthetic construct
  misc_feature 1..21: note = Synthetic Construct
  source 1..21: mol_type = other DNA
cgctcctgccgcaaaactcta

SEQ ID NO: 33509 - DNA, 19 bp, synthetic construct
  misc_feature 1..19: note = Synthetic Construct
  source 1..19: mol_type = other DNA
tgcctccaccttgctgcta

SEQ ID NO: 33510 - DNA, 24 bp, synthetic construct
  misc_feature 1..24: note = Synthetic Construct
  source 1..24: mol_type = other DNA
gagcaaagaggttaaggtcacagt

SEQ ID NO: 33511 - DNA, 21 bp, synthetic construct
  misc_feature 1..21: note = Synthetic Construct
  source 1..21: mol_type = other DNA
ggcacctgcagaccagttctt

SEQ ID NO: 33512 - DNA, 23 bp, synthetic construct
  misc_feature 1..23: note = Synthetic Construct
  source 1..23: mol_type = other DNA
cgatccccttggtgtgagagttg

SEQ ID NO: 33513 - DNA, 24 bp, synthetic construct
  misc_feature 1..24: note = Synthetic Construct
  source 1..24: mol_type = other DNA
cctaggatagcccactggatgtag

SEQ ID NO: 33514 - DNA, 23 bp, synthetic construct
  misc_feature 1..23: note = Synthetic Construct
  source 1..23: mol_type = other DNA
ccctccaaggacgtcttccctaa

SEQ ID NO: 33515 - DNA, 22 bp, synthetic construct
  misc_feature 1..22: note = Synthetic Construct
  source 1..22: mol_type = other DNA
ctttgtgtctcaggctcaccat

SEQ ID NO: 33516 - DNA, 24 bp, synthetic construct
  misc_feature 1..24: note = Synthetic Construct
  source 1..24: mol_type = other DNA
agtcccgcctcctctatagtcatc

SEQ ID NO: 33517 - DNA, 23 bp, synthetic construct
  misc_feature 1..23: note = Synthetic Construct
  source 1..23: mol_type = other DNA
gccagggatagctaacaatgaca

SEQ ID NO: 33518 - DNA, 27 bp, synthetic construct
  misc_feature 1..27: note = Synthetic Construct
  source 1..27: mol_type = other DNA
gtggactcctctaggtcaagctatttg

SEQ ID NO: 33519 - DNA, 27 bp, synthetic construct
  misc_feature 1..27: note = Synthetic Construct
  source 1..27: mol_type = other DNA
acatcatgtggatagaatggggattag

SEQ ID NO: 33520 - DNA, 22 bp, synthetic construct
  misc_feature 1..22: note = Synthetic Construct
  source 1..22: mol_type = other DNA
ccagcctgaggttccttcagat

SEQ ID NO: 33521 - DNA, 24 bp, synthetic construct
  misc_feature 1..24: note = Synthetic Construct
  source 1..24: mol_type = other DNA
gcgagctatcttgcaggctagtaa

SEQ ID NO: 33522 - DNA, 25 bp, synthetic construct
  misc_feature 1..25: note = Synthetic Construct
  source 1..25: mol_type = other DNA
aagtaatgcaggatgagtgatggat

SEQ ID NO: 33523 - DNA, 21 bp, synthetic construct
  misc_feature 1..21: note = Synthetic Construct
  source 1..21: mol_type = other DNA
ggggtggctcagaaacccttt

SEQ ID NO: 33524 - DNA, 27 bp, synthetic construct
  misc_feature 1..27: note = Synthetic Construct
  source 1..27: mol_type = other DNA
ctctactgagagacaagcaaagtttca

SEQ ID NO: 33525 - DNA, 23 bp, synthetic construct
  misc_feature 1..23: note = Synthetic Construct
  source 1..23: mol_type = other DNA
cgccctacttcacttgtttcttg

SEQ ID NO: 33526 - DNA, 23 bp, synthetic construct
  misc_feature 1..23: note = Synthetic Construct
  source 1..23: mol_type = other DNA
gggaggctatccaaccagtaagt

SEQ ID NO: 33527 - DNA, 20 bp, synthetic construct
  misc_feature 1..20: note = Synthetic Construct
  source 1..20: mol_type = other DNA
cccacccctgcccatcttac

SEQ ID NO: 33528 - DNA, 20 bp, synthetic construct
  misc_feature 1..20: note = Synthetic Construct
  source 1..20: mol_type = other DNA
tgggctcccacacctgtttc

SEQ ID NO: 33529 - DNA, 23 bp, synthetic construct
  misc_feature 1..23: note = Synthetic Construct
  source 1..23: mol_type = other DNA
ggctgtgaagaagcagtgaggat

SEQ ID NO: 33530 - DNA, 25 bp, synthetic construct
  misc_feature 1..25: note = Synthetic Construct
  source 1..25: mol_type = other DNA
cctcaatgaatagttcccacctcaa

SEQ ID NO: 33531 - DNA, 27 bp, synthetic construct
  misc_feature 1..27: note = Synthetic Construct
  source 1..27: mol_type = other DNA
ctttaaactgggatcgctacagaaaag

SEQ ID NO: 33532 - DNA, 20 bp, synthetic construct
  misc_feature 1..20: note = Synthetic Construct
  source 1..20: mol_type = other DNA
tgcccaggcagagggagcaa

SEQ ID NO: 33533 - DNA, 27 bp, synthetic construct
  misc_feature 1..27: note = Synthetic Construct
  source 1..27: mol_type = other DNA
cccaaagtgccttgttttctctgatac

SEQ ID NO: 33534 - DNA, 22 bp, synthetic construct
  misc_feature 1..22: note = Synthetic Construct
  source 1..22: mol_type = other DNA
ggctgcagcagagtgaataaga

SEQ ID NO: 33535 - DNA, 25 bp, synthetic construct
  misc_feature 1..25: note = Synthetic Construct
  source 1..25: mol_type = other DNA
cactctgacagtgaggttcttggta

SEQ ID NO: 33536 - DNA, 21 bp, synthetic construct
  misc_feature 1..21: note = Synthetic Construct
  source 1..21: mol_type = other DNA
gccatctcctgctgggttact

SEQ ID NO: 33537 - DNA, 25 bp, synthetic construct
  misc_feature 1..25: note = Synthetic Construct
  source 1..25: mol_type = other DNA
tgcatacagcatactctgttcacat

SEQ ID NO: 33538 - DNA, 20 bp, synthetic construct
  misc_feature 1..20: note = Synthetic Construct
  source 1..20: mol_type = other DNA
tcctacaggcccctgaactt

SEQ ID NO: 33539 - DNA, 25 bp, synthetic construct
  misc_feature 1..25: note = Synthetic Construct
  source 1..25: mol_type = other DNA
ccgaaaagaggtaggcagagctaat

SEQ ID NO: 33540 - DNA, 24 bp, synthetic construct
  misc_feature 1..24: note = Synthetic Construct
  source 1..24: mol_type = other DNA
gtgattggggcacagaactctcta

SEQ ID NO: 33541 - DNA, 24 bp, synthetic construct
  misc_feature 1..24: note = Synthetic Construct
  source 1..24: mol_type = other DNA
ctgaaggtaggtcagatcaagcaa

SEQ ID NO: 33542 - DNA, 20 bp, synthetic construct
  misc_feature 1..20: note = Synthetic Construct
  source 1..20: mol_type = other DNA
attccagccagccaccaatg

SEQ ID NO: 33543 - DNA, 24 bp, synthetic construct
  misc_feature 1..24: note = Synthetic Construct
  source 1..24: mol_type = other DNA
actgtcatgtgtctctctgctttt

SEQ ID NO: 33544 - DNA, 22 bp, synthetic construct
  misc_feature 1..22: note = Synthetic Construct
  source 1..22: mol_type = other DNA
gccttgcaccactacacagaga

SEQ ID NO: 33545 - DNA, 29 bp, synthetic construct
  misc_feature 1..29: note = Synthetic Construct
  source 1..29: mol_type = other DNA
ggggagtattacaaagacctaaggaggta

SEQ ID NO: 33546 - DNA, 23 bp, synthetic construct
  misc_feature 1..23: note = Synthetic Construct
  source 1..23: mol_type = other DNA
gcaatgtgtaccggttctgtact

SEQ ID NO: 33547 - DNA, 25 bp, synthetic construct
  misc_feature 1..25: note = Synthetic Construct
  source 1..25: mol_type = other DNA
gggtctgttcatcactcaatcattc

SEQ ID NO: 33548 - DNA, 24 bp, synthetic construct
  misc_feature 1..24: note = Synthetic Construct
  source 1..24: mol_type = other DNA
gacactgcctagcctttgtcattg

SEQ ID NO: 33549 - DNA, 20 bp, synthetic construct
  misc_feature 1..20: note = Synthetic Construct
  source 1..20: mol_type = other DNA
tgctgggctgtggattggta

SEQ ID NO: 33550 - DNA, 22 bp, synthetic construct
  misc_feature 1..22: note = Synthetic Construct
  source 1..22: mol_type = other DNA
agccaagaggagttgggacttg

SEQ ID NO: 33551 - DNA, 22 bp, synthetic construct
  misc_feature 1..22: note = Synthetic Construct
  source 1..22: mol_type = other DNA
gcactcacagaagggcaggtaa

SEQ ID NO: 33552 - DNA, 24 bp, synthetic construct
  misc_feature 1..24: note = Synthetic Construct
  source 1..24: mol_type = other DNA
gctggtggggagaggagtatagat

SEQ ID NO: 33553 - DNA, 22 bp, synthetic construct
  misc_feature 1..22: note = Synthetic Construct
  source 1..22: mol_type = other DNA
gacccactgggaaggtatggta

SEQ ID NO: 33554 - DNA, 24 bp, synthetic construct
  misc_feature 1..24: note = Synthetic Construct
  source 1..24: mol_type = other DNA
tcctatggggtcccatcattttct

SEQ ID NO: 33555 - DNA, 26 bp, synthetic construct
  misc_feature 1..26: note = Synthetic Construct
  source 1..26: mol_type = other DNA
cattaaactcagtgctgtcctgttag

SEQ ID NO: 33556 - DNA, 26 bp, synthetic construct
  misc_feature 1..26: note = Synthetic Construct
  source 1..26: mol_type = other DNA
gtgtctgatattcctgctcacttttg

SEQ ID NO: 33557 - DNA, 24 bp, synthetic construct
  misc_feature 1..24: note = Synthetic Construct
  source 1..24: mol_type = other DNA
cattcccaacagcatgcctagata

SEQ ID NO: 33558 - DNA, 24 bp, synthetic construct
  misc_feature 1..24: note = Synthetic Construct
  source 1..24: mol_type = other DNA
ggttagcttcagttcttgggagta

SEQ ID NO: 33559 - DNA, 22 bp, synthetic construct
  misc_feature 1..22: note = Synthetic Construct
  source 1..22: mol_type = other DNA
gcatctcagcctttgggttttg

SEQ ID NO: 33560 - DNA, 23 bp, synthetic construct
  misc_feature 1..23: note = Synthetic Construct
  source 1..23: mol_type = other DNA
cctagccctatggcagagttttc

SEQ ID NO: 33561 - DNA, 24 bp, synthetic construct
  misc_feature 1..24: note = Synthetic Construct
  source 1..24: mol_type = other DNA
aactgttgccctatcctccattac

SEQ ID NO: 33562 - DNA, 26 bp, synthetic construct
  misc_feature 1..26: note = Synthetic Construct
  source 1..26: mol_type = other DNA
ctggttgtcttcatgggatttcctta

SEQ ID NO: 33563 - DNA, 20 bp, synthetic construct
  misc_feature 1..20: note = Synthetic Construct
  source 1..20: mol_type = other DNA
cagccctggaggagttctga

SEQ ID NO: 33564 - DNA, 20 bp, synthetic construct
  misc_feature 1..20: note = Synthetic Construct
  source 1..20: mol_type = other DNA
ccagggtgctggagacattt

SEQ ID NO: 33565 - DNA, 27 bp, synthetic construct
  misc_feature 1..27: note = Synthetic Construct
  source 1..27: mol_type = other DNA
ccagaggatatcccacagttcatctca

SEQ ID NO: 33566 - DNA, 27 bp, synthetic construct
  misc_feature 1..27: note = Synthetic Construct
  source 1..27: mol_type = other DNA
ccacatcaacactattatccccaattc

SEQ ID NO: 33567 - DNA, 25 bp, synthetic construct
  misc_feature 1..25: note = Synthetic Construct
  source 1..25: mol_type = other DNA
cggcctgaaatttctttacaaccat

SEQ ID NO: 33568 - DNA, 22 bp, synthetic construct
  misc_feature 1..22: note = Synthetic Construct
  source 1..22: mol_type = other DNA
cagcctggtggacaccttgatt

SEQ ID NO: 33569 - DNA, 22 bp, synthetic construct
  misc_feature 1..22: note = Synthetic Construct
  source 1..22: mol_type = other DNA
gtccgagctgttctgccttttg

SEQ ID NO: 33570 - DNA, 26 bp, synthetic construct
  misc_feature 1..26: note = Synthetic Construct
  source 1..26: mol_type = other DNA
ggagcctcctacatacatcattccaa

SEQ ID NO: 33571 - DNA, 27 bp, synthetic construct
  misc_feature 1..27: note = Synthetic Construct
  source 1..27: mol_type = other DNA
ccaggagtaaaatcagggaatctgagt

SEQ ID NO: 33572 - DNA, 23 bp, synthetic construct
  misc_feature 1..23: note = Synthetic Construct
  source 1..23: mol_type = other DNA
acacactgtgacatgatgggatt

SEQ ID NO: 33573 - DNA, 24 bp, synthetic construct
  misc_feature 1..24: note = Synthetic Construct
  source 1..24: mol_type = other DNA
tccactctgactcagtcttcagta

SEQ ID NO: 33574 - DNA, 23 bp, synthetic construct
  misc_feature 1..23: note = Synthetic Construct
  source 1..23: mol_type = other DNA
agtgacctttggggttcttcttg

SEQ ID NO: 33575 - DNA, 23 bp, synthetic construct
  misc_feature 1..23: note = Synthetic Construct
  source 1..23: mol_type = other DNA
ctgtctctggatcctgtgagtct

SEQ ID NO: 33576 - DNA, 23 bp, synthetic construct
  misc_feature 1..23: note = Synthetic Construct
  source 1..23: mol_type = other DNA
gcccagacagcaagaaaggaagt

SEQ ID NO: 33577 - DNA, 20 bp, synthetic construct
  misc_feature 1..20: note = Synthetic Construct
  source 1..20: mol_type = other DNA
gaacccgctggcattctctt

SEQ ID NO: 33578 - DNA, 19 bp, synthetic construct
  misc_feature 1..19: note = Synthetic Construct
  source 1..19: mol_type = other DNA
acaggaagggcgggagtag

SEQ ID NO: 33579 - DNA, 24 bp, synthetic construct
  misc_feature 1..24: note = Synthetic Construct
  source 1..24: mol_type = other DNA
gacctattgaggcttgggcaaagt

SEQ ID NO: 33580 - DNA, 22 bp, synthetic construct
  misc_feature 1..22: note = Synthetic Construct
  source 1..22: mol_type = other DNA
acctacctgtggcctggaagat

SEQ ID NO: 33581 - DNA, 21 bp, synthetic construct
  misc_feature 1..21: note = Synthetic Construct
  source 1..21: mol_type = other DNA
gacagagctgcagccagtaat

SEQ ID NO: 33582 - DNA, 21 bp, synthetic construct
  misc_feature 1..21: note = Synthetic Construct
  source 1..21: mol_type = other DNA
aggcagagccagggcctaaat

SEQ ID NO: 33583 - DNA, 22 bp, synthetic construct
  misc_feature 1..22: note = Synthetic Construct
  source 1..22: mol_type = other DNA
gagcatggcatggacctggaat

SEQ ID NO: 33584 - DNA, 18 bp, synthetic construct
  misc_feature 1..18: note = Synthetic Construct
  source 1..18: mol_type = other DNA
agcgccacatggctgatg

SEQ ID NO: 33585 - DNA, 24 bp, synthetic construct
  misc_feature 1..24: note = Synthetic Construct
  source 1..24: mol_type = other DNA
gcaaagcttgatggtggaagaaag

SEQ ID NO: 33586 - DNA, 24 bp, synthetic construct
  misc_feature 1..24: note = Synthetic Construct
  source 1..24: mol_type = other DNA
gggaagcaaggagagcagctagta

SEQ ID NO: 33587 - DNA, 20 bp, synthetic construct
  misc_feature 1..20: note = Synthetic Construct
  source 1..20: mol_type = other DNA
ggctcaggggcaaaagttgt

SEQ ID NO: 33588 - DNA, 24 bp, synthetic construct
  misc_feature 1..24: note = Synthetic Construct
  source 1..24: mol_type = other DNA
gtcaccaggaaatgcacatctttt

SEQ ID NO: 33589 - DNA, 26 bp, synthetic construct
  misc_feature 1..26: note = Synthetic Construct
  source 1..26: mol_type = other DNA
gccctgaaaattcgtgctatcaaatg

SEQ ID NO: 33590 - DNA, 25 bp, synthetic construct
  misc_feature 1..25: note = Synthetic Construct
  source 1..25: mol_type = other DNA
tgacaggggctctagaagtagtaag

SEQ ID NO: 33591 - DNA, 23 bp, synthetic construct
  misc_feature 1..23: note = Synthetic Construct
  source 1..23: mol_type = other DNA
ggccaacttcctgctaaggattg

SEQ ID NO: 33592 - DNA, 24 bp, synthetic construct
  misc_feature 1..24: note = Synthetic Construct
  source 1..24: mol_type = other DNA
gctaggcattttgccagaggcttt

SEQ ID NO: 33593 - DNA, 22 bp, synthetic construct
  misc_feature 1..22: note = Synthetic Construct
  source 1..22: mol_type = other DNA
agaacccgagaggcctatccaa

SEQ ID NO: 33594 - DNA, 22 bp, synthetic construct
  misc_feature 1..22: note = Synthetic Construct
  source 1..22: mol_type = other DNA
gctttcctgctctggtgctgaa

SEQ ID NO: 33595 - DNA, 23 bp, synthetic construct
  misc_feature 1..23: note = Synthetic Construct
  source 1..23: mol_type = other DNA
aactgatctggcctgctaaaact

SEQ ID NO: 33596 - DNA, 23 bp, synthetic construct
  misc_feature 1..23: note = Synthetic Construct
  source 1..23: mol_type = other DNA
tgtgcttaacctcctagcctcat

SEQ ID NO: 33597 - DNA, 26 bp, synthetic construct
  misc_feature 1..26: note = Synthetic Construct
  source 1..26: mol_type = other DNA
ggtgatattagtgaagccctctgttg

SEQ ID NO: 33598 - DNA, 27 bp, synthetic construct
  misc_feature 1..27: note = Synthetic Construct
  source 1..27: mol_type = other DNA
ccaaagtagcaaaaggtgtctgcattc

SEQ ID NO: 33599 - DNA, 25 bp, synthetic construct
  misc_feature 1..25: note = Synthetic Construct
  source 1..25: mol_type = other DNA
ggatgatgctggctaatgggagaaa

SEQ ID NO: 33600 - DNA, 21 bp, synthetic construct
  misc_feature 1..21: note = Synthetic Construct
  source 1..21: mol_type = other DNA
accttgtctcccactccagat

SEQ ID NO: 33601 - DNA, 23 bp, synthetic construct
  misc_feature 1..23: note = Synthetic Construct
  source 1..23: mol_type = other DNA
cacatgcatagcttagccagtga

SEQ ID NO: 33602 - DNA, 22 bp, synthetic construct
  misc_feature 1..22: note = Synthetic Construct
  source 1..22: mol_type = other DNA
cgagagattggcagtcccagtt

SEQ ID NO: 33603 - DNA, 22 bp, synthetic construct
  misc_feature 1..22: note = Synthetic Construct
  source 1..22: mol_type = other DNA
ccccattcaaagggctctcagt

SEQ ID NO: 33604 - DNA, 22 bp, synthetic construct
  misc_feature 1..22: note = Synthetic Construct
  source 1..22: mol_type = other DNA
agcctgagtaaccagggactct

SEQ ID NO: 33605 - DNA, 22 bp, synthetic construct
  misc_feature 1..22: note = Synthetic Construct
  source 1..22: mol_type = other DNA
cacagcctgctgctaattgttc

SEQ ID NO: 33606 - DNA, 24 bp, synthetic construct
  misc_feature 1..24: note = Synthetic Construct
  source 1..24: mol_type = other DNA
gctgcaggagtgaaactaggaaca

SEQ ID NO: 33607 - DNA, 25 bp, synthetic construct
  misc_feature 1..25: note = Synthetic Construct
  source 1..25: mol_type = other DNA
tcttccagaattcccttcaaagcat

SEQ ID NO: 33608 - DNA, 23 bp, synthetic construct
  misc_feature 1..23: note = Synthetic Construct
  source 1..23: mol_type = other DNA
gtgaaagcaggtggtcatactct

SEQ ID NO: 33609 - DNA, 25 bp, synthetic construct
  misc_feature 1..25: note = Synthetic Construct
  source 1..25: mol_type = other DNA
ctgcaggtagcagaattaactgaca

SEQ ID NO: 33610 - DNA, 23 bp, synthetic construct
  misc_feature 1..23: note = Synthetic Construct
  source 1..23: mol_type = other DNA
ctgtgctcagatctgcattggat

SEQ ID NO: 33611 - DNA, 23 bp, synthetic construct
  misc_feature 1..23: note = Synthetic Construct
  source 1..23: mol_type = other DNA
cactcatttgacttcccgctgtt

SEQ ID NO: 33612 - DNA, 26 bp, synthetic construct
  misc_feature 1..26: note = Synthetic Construct
  source 1..26: mol_type = other DNA
acagggatccactggtatgataaaga

SEQ ID NO: 33613 - DNA, 23 bp, synthetic construct
  misc_feature 1..23: note = Synthetic Construct
  source 1..23: mol_type = other DNA
ctgagcaggctattccagtctgt

SEQ ID NO: 33614 - DNA, 20 bp, synthetic construct
  misc_feature 1..20: note = Synthetic Construct
  source 1..20: mol_type = other DNA
tcgccaaggacctaggaaca

SEQ ID NO: 33615 - DNA, 18 bp, synthetic construct
  misc_feature 1..18: note = Synthetic Construct
  source 1..18: mol_type = other DNA
cggtggtgcgcaagtagt

SEQ ID NO: 33616 - DNA, 23 bp, synthetic construct
  misc_feature 1..23: note = Synthetic Construct
  source 1..23: mol_type = other DNA
gagttgtgcagatgggttgaaaa

SEQ ID NO: 33617 - DNA, 22 bp, synthetic construct
  misc_feature 1..22: note = Synthetic Construct
  source 1..22: mol_type = other DNA
cctggcatcacagtggctacaa

SEQ ID NO: 33618 - DNA, 18 bp, synthetic construct
  misc_feature 1..18: note = Synthetic Construct
  source 1..18: mol_type = other DNA
agtgccccaccggtgttt

SEQ ID NO: 33619 - DNA, 27 bp, synthetic construct
  misc_feature 1..27: note = Synthetic Construct
  source 1..27: mol_type = other DNA
ccttatagtgggttctgggacttagta

SEQ ID NO: 33620 - DNA, 20 bp, synthetic construct
  misc_feature 1..20: note = Synthetic Construct
  source 1..20: mol_type = other DNA
gggtagccctgggaatgctt

SEQ ID NO: 33621 - DNA, 23 bp, synthetic construct
  misc_feature 1..23: note = Synthetic Construct
  source 1..23: mol_type = other DNA
gaacctcgcctcattgtgatttc

SEQ ID NO: 33622 - DNA, 19 bp, synthetic construct
  misc_feature 1..19: note = Synthetic Construct
  source 1..19: mol_type = other DNA
agcaccggcaggcgacttt

SEQ ID NO: 33623 - DNA, 27 bp, synthetic construct
  misc_feature 1..27: note = Synthetic Construct
  source 1..27: mol_type = other DNA
ctccagaattctacggaaactggaagt

SEQ ID NO: 33624 - DNA, 23 bp, synthetic construct
  misc_feature 1..23: note = Synthetic Construct
  source 1..23: mol_type = other DNA
gctctgtactggccactttgttc

SEQ ID NO: 33625 - DNA, 23 bp, synthetic construct
  misc_feature 1..23: note = Synthetic Construct
  source 1..23: mol_type = other DNA
ccagcctagacctaaacccttga

SEQ ID NO: 33626 - DNA, 22 bp, synthetic construct
  misc_feature 1..22: note = Synthetic Construct
  source 1..22: mol_type = other DNA
gtgatgccagacagagctgaca

SEQ ID NO: 33627 - DNA, 24 bp, synthetic construct
  misc_feature 1..24: note = Synthetic Construct
  source 1..24: mol_type = other DNA
gcttaagccacagaaaggcacaac

SEQ ID NO: 33628 - DNA, 21 bp, synthetic construct
  misc_feature 1..21: note = Synthetic Construct
  source 1..21: mol_type = other DNA
cgagtgccctggaacctgaaa

SEQ ID NO: 33629 - DNA, 21 bp, synthetic construct
  misc_feature 1..21: note = Synthetic Construct
  source 1..21: mol_type = other DNA
agccaccactcctgcttctga

SEQ ID NO: 33630 - DNA, 20 bp, synthetic construct
  misc_feature 1..20: note = Synthetic Construct
  source 1..20: mol_type = other DNA
ttggggacccctggactaag

SEQ ID NO: 33631 - DNA, 26 bp, synthetic construct
  misc_feature 1..26: note = Synthetic Construct
  source 1..26: mol_type = other DNA
cctccccagtatcttaccactacaac

SEQ ID NO: 33632 - DNA, 22 bp, synthetic construct
  misc_feature 1..22: note = Synthetic Construct
  source 1..22: mol_type = other DNA
caccaagccctcaactcctaaa

SEQ ID NO: 33633 - DNA, 25 bp, synthetic construct
  misc_feature 1..25: note = Synthetic Construct
  source 1..25: mol_type = other DNA
gaagtgaaagaaaatggcaggaact

SEQ ID NO: 33634 - DNA, 27 bp, synthetic construct
  misc_feature 1..27: note = Synthetic Construct
  source 1..27: mol_type = other DNA
gctggtattgttttggggatagaggtt

SEQ ID NO: 33635 - DNA, 26 bp, synthetic construct
  misc_feature 1..26: note = Synthetic Construct
  source 1..26: mol_type = other DNA
gtggaggaaattagatgtctgcttct

SEQ ID NO: 33636 - DNA, 21 bp, synthetic construct
  misc_feature 1..21: note = Synthetic Construct
  source 1..21: mol_type = other DNA
gggcaagtccctcacaccttt

SEQ ID NO: 33637 - DNA, 21 bp, synthetic construct
  misc_feature 1..21: note = Synthetic Construct
  source 1..21: mol_type = other DNA
tgaggtctggctgcaggagta

SEQ ID NO: 33638 - DNA, 22 bp, synthetic construct
  misc_feature 1..22: note = Synthetic Construct
  source 1..22: mol_type = other DNA
ctgaagcccaagtggcaagaag

SEQ ID NO: 33639 - DNA, 22 bp, synthetic construct
  misc_feature 1..22: note = Synthetic Construct
  source 1..22: mol_type = other DNA
aagtcctgagcctgagttcttg

SEQ ID NO: 33640 - DNA, 21 bp, synthetic construct
  misc_feature 1..21: note = Synthetic Construct
  source 1..21: mol_type = other DNA
tctcagggtgcctggaaaaag

SEQ ID NO: 33641 - DNA, 24 bp, synthetic construct
  misc_feature 1..24: note = Synthetic Construct
  source 1..24: mol_type = other DNA
gcactgcaaaagaagaggctattg

SEQ ID NO: 33642 - DNA, 20 bp, synthetic construct
  misc_feature 1..20: note = Synthetic Construct
  source 1..20: mol_type = other DNA
tgggaaccagccctttggaa

SEQ ID NO: 33643 - DNA, 29 bp, synthetic construct
  misc_feature 1..29: note = Synthetic Construct
  source 1..29: mol_type = other DNA
ggcttcactatcaagaagggccttgattt

SEQ ID NO: 33644 - DNA, 18 bp, synthetic construct
  misc_feature 1..18: note = Synthetic Construct
  source 1..18: mol_type = other DNA
aagaggccacccgcttct

SEQ ID NO: 33645 - DNA, 19 bp, synthetic construct
  misc_feature 1..19: note = Synthetic Construct
  source 1..19: mol_type = other DNA
tggagcaggctggcgctaa

SEQ ID NO: 33646 - DNA, 21 bp, synthetic construct
  misc_feature 1..21: note = Synthetic Construct
  source 1..21: mol_type = other DNA
ccgaaaaccttccccgcttct

SEQ ID NO: 33647 - DNA, 24 bp, synthetic construct
  misc_feature 1..24: note = Synthetic Construct
  source 1..24: mol_type = other DNA
ggaaggggaatttgtcagcgttta

SEQ ID NO: 33648 - DNA, 24 bp, synthetic construct
  misc_feature 1..24: note = Synthetic Construct
  source 1..24: mol_type = other DNA
gcagtctcagcctttcctttgcat

SEQ ID NO: 33649 - DNA, 24 bp, synthetic construct
  misc_feature 1..24: note = Synthetic Construct
  source 1..24: mol_type = other DNA
gttgggaagcatcttcctagacat

SEQ ID NO: 33650 - DNA, 24 bp, synthetic construct
  misc_feature 1..24: note = Synthetic Construct
  source 1..24: mol_type = other DNA
gcctattttggagtcccaagtcaa

SEQ ID NO: 33651 - DNA, 18 bp, synthetic construct
  misc_feature 1..18: note = Synthetic Construct
  source 1..18: mol_type = other DNA
tgggccacgttgcctact

SEQ ID NO: 33652 - DNA, 29 bp, synthetic construct
  misc_feature 1..29: note = Synthetic Construct
  source 1..29: mol_type = other DNA
caccttattactaccttcctctcacaatg

SEQ ID NO: 33653 - DNA, 21 bp, synthetic construct
  misc_feature 1..21: note = Synthetic Construct
  source 1..21: mol_type = other DNA
actggggtaaaggctggttgt

SEQ ID NO: 33654 - DNA, 21 bp, synthetic construct
  misc_feature 1..21: note = Synthetic Construct
  source 1..21: mol_type = other DNA
aagcctcgtggccgactcaat

SEQ ID NO: 33655 - DNA, 21 bp, synthetic construct
  misc_feature 1..21: note = Synthetic Construct
  source 1..21: mol_type = other DNA
aacagggcgtgagttttcctt

SEQ ID NO: 33656 - DNA, 23 bp, synthetic construct
  misc_feature 1..23: note = Synthetic Construct
  source 1..23: mol_type = other DNA
ggagaggccagggcatttctaag

SEQ ID NO: 33657 - DNA, 23 bp, synthetic construct
  misc_feature 1..23: note = Synthetic Construct
  source 1..23: mol_type = other DNA
cagcctgctaggaacacactgta

SEQ ID NO: 33658 - DNA, 23 bp, synthetic construct
  misc_feature 1..23: note = Synthetic Construct
  source 1..23: mol_type = other DNA
ggtgattctggccgaacttgtct

SEQ ID NO: 33659 - DNA, 22 bp, synthetic construct
  misc_feature 1..22: note = Synthetic Construct
  source 1..22: mol_type = other DNA
tggatcggaaacaccagactca

SEQ ID NO: 33660 - DNA, 26 bp, synthetic construct
  misc_feature 1..26: note = Synthetic Construct
  source 1..26: mol_type = other DNA
cctgagaccgttgctagagaaacaag

SEQ ID NO: 33661 - DNA, 19 bp, synthetic construct
  misc_feature 1..19: note = Synthetic Construct
  source 1..19: mol_type = other DNA
tgggatgcgggcatagaga

SEQ ID NO: 33662 - DNA, 20 bp, synthetic construct
  misc_feature 1..20: note = Synthetic Construct
  source 1..20: mol_type = other DNA
tctcccaggcttcagtcctt

SEQ ID NO: 33663 - DNA, 23 bp, synthetic construct
  misc_feature 1..23: note = Synthetic Construct
  source 1..23: mol_type = other DNA
ccaagttatgcctgctgctcaga

SEQ ID NO: 33664 - DNA, 24 bp, synthetic construct
  misc_feature 1..24: note = Synthetic Construct
  source 1..24: mol_type = other DNA
gggaacctggaaagacctttactt

SEQ ID NO: 33665 - DNA, 25 bp, synthetic construct
  misc_feature 1..25: note = Synthetic Construct
  source 1..25: mol_type = other DNA
ggtgggatagttgagaagggagtaa

SEQ ID NO: 33666 - DNA, 20 bp, synthetic construct
  misc_feature 1..20: note = Synthetic Construct
  source 1..20: mol_type = other DNA
cctcagctcccgcctctaaa

SEQ ID NO: 33667 - DNA, 23 bp, synthetic construct
  misc_feature 1..23: note = Synthetic Construct
  source 1..23: mol_type = other DNA
ggatgagcataagcagtggttca

SEQ ID NO: 33668 - DNA, 24 bp, synthetic construct
  misc_feature 1..24: note = Synthetic Construct
  source 1..24: mol_type = other DNA
aggagtgagaagggagactcaatc

SEQ ID NO: 33669 - DNA, 19 bp, synthetic construct
  misc_feature 1..19: note = Synthetic Construct
  source 1..19: mol_type = other DNA
tcaagtcccggctgccatt

SEQ ID NO: 33670 - DNA, 22 bp, synthetic construct
  misc_feature 1..22: note = Synthetic Construct
  source 1..22: mol_type = other DNA
gacagagagatgagggctgagt

SEQ ID NO: 33671 - DNA, 24 bp, synthetic construct
  misc_feature 1..24: note = Synthetic Construct
  source 1..24: mol_type = other DNA
aattgccagctgtattctccttct

SEQ ID NO: 33672 - DNA, 20 bp, synthetic construct
  misc_feature 1..20: note = Synthetic Construct
  source 1..20: mol_type = other DNA
acagaggatggggcaccaaa

SEQ ID NO: 33673 - DNA, 25 bp, synthetic construct
  misc_feature 1..25: note = Synthetic Construct
  source 1..25: mol_type = other DNA
gcatgaggatggaatggactcatca

SEQ ID NO: 33674 - DNA, 23 bp, synthetic construct
  misc_feature 1..23: note = Synthetic Construct
  source 1..23: mol_type = other DNA
gaccttcaaggggagctcagtat

SEQ ID NO: 33675 - DNA, 24 bp, synthetic construct
  misc_feature 1..24: note = Synthetic Construct
  source 1..24: mol_type = other DNA
tctgatatggaacccagggattgt

SEQ ID NO: 33676 - DNA, 20 bp, synthetic construct
  misc_feature 1..20: note = Synthetic Construct
  source 1..20: mol_type = other DNA
tgcaccatcgctaggccatt

SEQ ID NO: 33677 - DNA, 24 bp, synthetic construct
  misc_feature 1..24: note = Synthetic Construct
  source 1..24: mol_type = other DNA
gtcagttcacacgacacccttaga

SEQ ID NO: 33678 - DNA, 20 bp, synthetic construct
  misc_feature 1..20: note = Synthetic Construct
  source 1..20: mol_type = other DNA
agcctggaaagctggcacaa

SEQ ID NO: 33679 - DNA, 21 bp, synthetic construct
  misc_feature 1..21: note = Synthetic Construct
  source 1..21: mol_type = other DNA
ttcccagcctcctctgcatct

SEQ ID NO: 33680 - DNA, 22 bp, synthetic construct
  misc_feature 1..22: note = Synthetic Construct
  source 1..22: mol_type = other DNA
ctcaaaggggaagaacgtcagt

SEQ ID NO: 33681 - DNA, 21 bp, synthetic construct
  misc_feature 1..21: note = Synthetic Construct
  source 1..21: mol_type = other DNA
tctgcgtctcacttcctggta

SEQ ID NO: 33682 - DNA, 23 bp, synthetic construct
  misc_feature 1..23: note = Synthetic Construct
  source 1..23: mol_type = other DNA
aaggtgacagaggtcttccaaag

SEQ ID NO: 33683 - DNA, 21 bp, synthetic construct
  misc_feature 1..21: note = Synthetic Construct
  source 1..21: mol_type = other DNA
tcccaaatcctgagcctgtca

SEQ ID NO: 33684 - DNA, 22 bp, synthetic construct
  misc_feature 1..22: note = Synthetic Construct
  source 1..22: mol_type = other DNA
ggagaaagagtggagagcaaca

SEQ ID NO: 33685 - DNA, 29 bp, synthetic construct
  misc_feature 1..29: note = Synthetic Construct
  source 1..29: mol_type = other DNA
gactatacgataccaaatagccctacaag

SEQ ID NO: 33686 - DNA, 20 bp, synthetic construct
  misc_feature 1..20: note = Synthetic Construct
  source 1..20: mol_type = other DNA
gtcacaagggaggcacttca

SEQ ID NO: 33687 - DNA, 20 bp, synthetic construct
  misc_feature 1..20: note = Synthetic Construct
  source 1..20: mol_type = other DNA
agagctgccctggaactgaa

SEQ ID NO: 33688 - DNA, 24 bp, synthetic construct
  misc_feature 1..24: note = Synthetic Construct
  source 1..24: mol_type = other DNA
ggaaaggtaccccagaatgaggtt

SEQ ID NO: 33689 - DNA, 23 bp, synthetic construct
  misc_feature 1..23: note = Synthetic Construct
  source 1..23: mol_type = other DNA
ggtggtagaggctcatgtctctt

SEQ ID NO: 33690 - DNA, 22 bp, synthetic construct
  misc_feature 1..22: note = Synthetic Construct
  source 1..22: mol_type = other DNA
tccccaaatcctttggcaatgt

SEQ ID NO: 33691 - DNA, 22 bp, synthetic construct
  misc_feature 1..22: note = Synthetic Construct
  source 1..22: mol_type = other DNA
gtgtcaaagggcctgttcttgt

SEQ ID NO: 33692 - DNA, 24 bp, synthetic construct
  misc_feature 1..24: note = Synthetic Construct
  source 1..24: mol_type = other DNA
ctctcatcagctgtttgctgttac

SEQ ID NO: 33693 - DNA, 25 bp, synthetic construct
  misc_feature 1..25: note = Synthetic Construct
  source 1..25: mol_type = other DNA
gacctctttctccctgcacatgtaa

SEQ ID NO: 33694 - DNA, 24 bp, synthetic construct
  misc_feature 1..24: note = Synthetic Construct
  source 1..24: mol_type = other DNA
ccttccttgaacttgcctctggta

SEQ ID NO: 33695 - DNA, 23 bp, synthetic construct
  misc_feature 1..23: note = Synthetic Construct
  source 1..23: mol_type = other DNA
gctgtcaccaagactgagactga

SEQ ID NO: 33696 - DNA, 24 bp, synthetic construct
  misc_feature 1..24: note = Synthetic Construct
  source 1..24: mol_type = other DNA
tgaaagctattgggacaacaggat

SEQ ID NO: 33697 - DNA, 27 bp, synthetic construct
  misc_feature 1..27: note = Synthetic Construct
  source 1..27: mol_type = other DNA
caggaagataagtactgagccatgtgt

SEQ ID NO: 33698 - DNA, 23 bp, synthetic construct
  misc_feature 1..23: note = Synthetic Construct
  source 1..23: mol_type = other DNA
gcacatgtctgcgacctcacttt

SEQ ID NO: 33699 - DNA, 22 bp, synthetic construct
  misc_feature 1..22: note = Synthetic Construct
  source 1..22: mol_type = other DNA
cagcagagcagagtgctattgt

SEQ ID NO: 33700 - DNA, 21 bp, synthetic construct
  misc_feature 1..21: note = Synthetic Construct
  source 1..21: mol_type = other DNA
gctgttgcactgtgaacttgt

SEQ ID NO: 33701 - DNA, 22 bp, synthetic construct
  misc_feature 1..22: note = Synthetic Construct
  source 1..22: mol_type = other DNA
gcagcagacagctggagatgaa

SEQ ID NO: 33702 - DNA, 23 bp, synthetic construct
  misc_feature 1..23: note = Synthetic Construct
  source 1..23: mol_type = other DNA
ctctgctgttccctcacctgtaa

SEQ ID NO: 33703 - DNA, 20 bp, synthetic construct
  misc_feature 1..20: note = Synthetic Construct
  source 1..20: mol_type = other DNA
tctggcttctcagtgcgttt

SEQ ID NO: 33704 - DNA, 27 bp, synthetic construct
  misc_feature 1..27: note = Synthetic Construct
  source 1..27: mol_type = other DNA
tgtcaagggactaagtttctaggtttc

SEQ ID NO: 33705 - DNA, 24 bp, synthetic construct
  misc_feature 1..24: note = Synthetic Construct
  source 1..24: mol_type = other DNA
ggctcatgcttgtgataggagaca

SEQ ID NO: 33706 - DNA, 25 bp, synthetic construct
  misc_feature 1..25: note = Synthetic Construct
  source 1..25: mol_type = other DNA
gccgaggagaatatgggttggaaac

SEQ ID NO: 33707 - DNA, 24 bp, synthetic construct
  misc_feature 1..24: note = Synthetic Construct
  source 1..24: mol_type = other DNA
gcatcttgtggttgcccttagcaa

SEQ ID NO: 33708 - DNA, 19 bp, synthetic construct
  misc_feature 1..19: note = Synthetic Construct
  source 1..19: mol_type = other DNA
gtccattgggcagccttct

SEQ ID NO: 33709 - DNA, 22 bp, synthetic construct
  misc_feature 1..22: note = Synthetic Construct
  source 1..22: mol_type = other DNA
cctgatgctccctctgccaaaa

SEQ ID NO: 33710 - DNA, 25 bp, synthetic construct
  misc_feature 1..25: note = Synthetic Construct
  source 1..25: mol_type = other DNA
gcctcattctcgcacacatccaatc

SEQ ID NO: 33711 - DNA, 22 bp, synthetic construct
  misc_feature 1..22: note = Synthetic Construct
  source 1..22: mol_type = other DNA
gcccttcctcttgctgaacagt

SEQ ID NO: 33712 - DNA, 20 bp, synthetic construct
  misc_feature 1..20: note = Synthetic Construct
  source 1..20: mol_type = other DNA
acctgaagccaggcactttc

SEQ ID NO: 33713 - DNA, 20 bp, synthetic construct
  misc_feature 1..20: note = Synthetic Construct
  source 1..20: mol_type = other DNA
tgggagaaaaagcccacgtt

SEQ ID NO: 33714 - DNA, 23 bp, synthetic construct
  misc_feature 1..23: note = Synthetic Construct
  source 1..23: mol_type = other DNA
gcaaggctcagtagggtgaaaag

SEQ ID NO: 33715 - DNA, 24 bp, synthetic construct
  misc_feature 1..24: note = Synthetic Construct
  source 1..24: mol_type = other DNA
gccaaactgcttcttgctggatct

SEQ ID NO: 33716 - DNA, 23 bp, synthetic construct
  misc_feature 1..23: note = Synthetic Construct
  source 1..23: mol_type = other DNA
ggaaaggcggtggtaatgtggtt

SEQ ID NO: 33717 - DNA, 21 bp, synthetic construct
  misc_feature 1..21: note = Synthetic Construct
  source 1..21: mol_type = other DNA
tctgaccaagtccgcctctca

SEQ ID NO: 33718 - DNA, 24 bp, synthetic construct
  misc_feature 1..24: note = Synthetic Construct
  source 1..24: mol_type = other DNA
cctcacactttcctgtccttgact

SEQ ID NO: 33719 - DNA, 26 bp, synthetic construct
  misc_feature 1..26: note = Synthetic Construct
  source 1..26: mol_type = other DNA
cagctgatctatgcattggaggacat

SEQ ID NO: 33720 - DNA, 26 bp, synthetic construct
  misc_feature 1..26: note = Synthetic Construct
  source 1..26: mol_type = other DNA
gcatctacccaatcactacagttaga

SEQ ID NO: 33721 - DNA, 21 bp, synthetic construct
  misc_feature 1..21: note = Synthetic Construct
  source 1..21: mol_type = other DNA
ctcatcagacacaggcagctt

SEQ ID NO: 33722 - DNA, 23 bp, synthetic construct
  misc_feature 1..23: note = Synthetic Construct
  source 1..23: mol_type = other DNA
agggcaaaagctttccagagtag

SEQ ID NO: 33723 - DNA, 24 bp, synthetic construct
  misc_feature 1..24: note = Synthetic Construct
  source 1..24: mol_type = other DNA
gcaaagtttcatggccaagtgtca

SEQ ID NO: 33724 - DNA, 20 bp, synthetic construct
  misc_feature 1..20: note = Synthetic Construct
  source 1..20: mol_type = other DNA
tgctgccaggctgctgaaat

SEQ ID NO: 33725 - DNA, 20 bp, synthetic construct
  misc_feature 1..20: note = Synthetic Construct
  source 1..20: mol_type = other DNA
tccccaggcacctgctccaa

SEQ ID NO: 33726 - DNA, 27 bp, synthetic construct
  misc_feature 1..27: note = Synthetic Construct
  source 1..27: mol_type = other DNA
tcacctacctaggattaaaggtgaaag

SEQ ID NO: 33727 - DNA, 20 bp, synthetic construct
  misc_feature 1..20: note = Synthetic Construct
  source 1..20: mol_type = other DNA
ggacaggttggtgccagatt

SEQ ID NO: 33728 - DNA, 19 bp, synthetic construct
  misc_feature 1..19: note = Synthetic Construct
  source 1..19: mol_type = other DNA
aaggaggtcctggggcaat

SEQ ID NO: 33729 - DNA, 22 bp, synthetic construct
  misc_feature 1..22: note = Synthetic Construct
  source 1..22: mol_type = other DNA
cttgcctaggaagggcattaca

SEQ ID NO: 33730 - DNA, 20 bp, synthetic construct
  misc_feature 1..20: note = Synthetic Construct
  source 1..20: mol_type = other DNA
gttgcagcctggaggagaaa

SEQ ID NO: 33731 - DNA, 30 bp, synthetic construct; identical to SEQ ID NO: 2505
  misc_feature 1..30: note = Synthetic Construct
  source 1..30: mol_type = other DNA

SEQ ID NO: 33732 - DNA, 19 bp, synthetic construct
  misc_feature 1..19: note = Synthetic Construct
  source 1..19: mol_type = other DNA
tgggtgagggcggatcttc

SEQ ID NO: 33733 - DNA, 24 bp, synthetic construct
  misc_feature 1..24: note = Synthetic Construct
  source 1..24: mol_type = other DNA
cccagagaggctggatactgtgta

SEQ ID NO: 33734 - DNA, 26 bp, synthetic construct
  misc_feature 1..26: note = Synthetic Construct
  source 1..26: mol_type = other DNA
cctgtggctcctgagagagaaatcaa

SEQ ID NO: 33735 - DNA, 20 bp, synthetic construct
  misc_feature 1..20: note = Synthetic Construct
  source 1..20: mol_type = other DNA
tgggacacttcaggccaaga

SEQ ID NO: 33736 - DNA, 22 bp, synthetic construct
  misc_feature 1..22: note = Synthetic Construct
  source 1..22: mol_type = other DNA
ggctagcattcggcgaaaatga

SEQ ID NO: 33737 - DNA, 28 bp, synthetic construct
  misc_feature 1..28: note = Synthetic Construct
  source 1..28: mol_type = other DNA
gctcagatgtgtaaaggaaggcagtaca

SEQ ID NO: 33738 - DNA, 20 bp, synthetic construct
  misc_feature 1..20: note = Synthetic Construct
  source 1..20: mol_type = other DNA
ttcccggtgttctggcgatt

SEQ ID NO: 33739 - DNA, 26 bp, synthetic construct
  misc_feature 1..26: note = Synthetic Construct
  source 1..26: mol_type = other DNA
ggcatgtaagggtgacaaaggagttg

SEQ ID NO: 33740 - DNA, 20 bp, synthetic construct
  misc_feature 1..20: note = Synthetic Construct
  source 1..20: mol_type = other DNA
ccctcccaggcttctcatct

SEQ ID NO: 33741 - DNA, 22 bp, synthetic construct
  misc_feature 1..22: note = Synthetic Construct
  source 1..22: mol_type = other DNA
cctgcctacggtcctaaagtgt

SEQ ID NO: 33742 - DNA, 21 bp, synthetic construct
  misc_feature 1..21: note = Synthetic Construct
  source 1..21: mol_type = other DNA
tccctcaaaccccagctcctt

SEQ ID NO: 33743 - DNA, 23 bp, synthetic construct
  misc_feature 1..23: note = Synthetic Construct
  source 1..23: mol_type = other DNA
ggcatgcttttcattgtgagtga

SEQ ID NO: 33744 - DNA, 25 bp, synthetic construct
  misc_feature 1..25: note = Synthetic Construct
  source 1..25: mol_type = other DNA
ggatcttccttctgggtcataaagt

SEQ ID NO: 33745 - DNA, 25 bp, synthetic construct
  misc_feature 1..25: note = Synthetic Construct
  source 1..25: mol_type = other DNA
gcttttaaaaacccagctgtgaatg

SEQ ID NO: 33746 - DNA, 20 bp, synthetic construct
  misc_feature 1..20: note = Synthetic Construct
  source 1..20: mol_type = other DNA
tcttcccgctccgtccctta

SEQ ID NO: 33747 - DNA, 20 bp, synthetic construct
  misc_feature 1..20: note = Synthetic Construct
  source 1..20: mol_type = other DNA
ctgtccgcagaagccaaaag

SEQ ID NO: 33748 - DNA, 23 bp, synthetic construct
  misc_feature 1..23: note = Synthetic Construct
  source 1..23: mol_type = other DNA
ctgtactgcctcctttcctctca

SEQ ID NO: 33749 - DNA, 20 bp, synthetic construct
  misc_feature 1..20: note = Synthetic Construct
  source 1..20: mol_type = other DNA
cctgagcaagggcacagaag

SEQ ID NO: 33750 - DNA, 20 bp, synthetic construct
  misc_feature 1..20: note = Synthetic Construct
  source 1..20: mol_type = other DNA
aggttcatgggccctcattg

SEQ ID NO: 33751 - DNA, 21 bp, synthetic construct
  misc_feature 1..21: note = Synthetic Construct
  source 1..21: mol_type = other DNA
gggctcccactttcctgagat

SEQ ID NO: 33752 - DNA, 26 bp, synthetic construct
  misc_feature 1..26: note = Synthetic Construct
  source 1..26: mol_type = other DNA
gcaggctcgatatctaattccagaga

SEQ ID NO: 33753 - DNA, 20 bp, synthetic construct
  misc_feature 1..20: note = Synthetic Construct
  source 1..20: mol_type = other DNA
gcagaatcgcctgtggttgt

SEQ ID NO: 33754 - DNA, 23 bp, synthetic construct
  misc_feature 1..23: note = Synthetic Construct
  source 1..23: mol_type = other DNA
gagaagctaaatggtccccaaga

SEQ ID NO: 33755 - DNA, 21 bp, synthetic construct
  misc_feature 1..21: note = Synthetic Construct
  source 1..21: mol_type = other DNA
ggactgaggggctctctggaa

SEQ ID NO: 33756 - DNA, 22 bp, synthetic construct
  misc_feature 1..22: note = Synthetic Construct
  source 1..22: mol_type = other DNA
gcccctgtagtacatccacact

SEQ ID NO: 33757 - DNA, 24 bp, synthetic construct
  misc_feature 1..24: note = Synthetic Construct
  source 1..24: mol_type = other DNA
cctttcgcatgaattgtgcagtga

SEQ ID NO: 33758 - DNA, 24 bp, synthetic construct
  misc_feature 1..24: note = Synthetic Construct
  source 1..24: mol_type = other DNA
gagctctagctgtgagtaggatct

SEQ ID NO: 33759 - DNA, 20 bp, synthetic construct
  misc_feature 1..20: note = Synthetic Construct
  source 1..20: mol_type = other DNA
cctctttgccaggtcacaca

SEQ ID NO: 33760 - DNA, 24 bp, synthetic construct
  misc_feature 1..24: note = Synthetic Construct
  source 1..24: mol_type = other DNA
actgggtgaataaaggacccaaga

SEQ ID NO: 33761 - DNA, 18 bp, synthetic construct
  misc_feature 1..18: note = Synthetic Construct
  source 1..18: mol_type = other DNA
agaggctcgtgggtgtga

SEQ ID NO: 33762 - DNA, 19 bp, synthetic construct
  misc_feature 1..19: note = Synthetic Construct
  source 1..19: mol_type = other DNA
tgggctctgctgcctgttg

SEQ ID NO: 33763 - DNA, 20 bp, synthetic construct
  misc_feature 1..20: note = Synthetic Construct
  source 1..20: mol_type = other DNA
gatggtccccagagggatga

SEQ ID NO: 33764 - DNA, 21 bp, synthetic construct
  misc_feature 1..21: note = Synthetic Construct
  source 1..21: mol_type = other DNA
acccctgatgggctcaagtca

SEQ ID NO: 33765 - DNA, 25 bp, synthetic construct
  misc_feature 1..25: note = Synthetic Construct
  source 1..25: mol_type = other DNA
gtcaatactgtggacagctgcttct

SEQ ID NO: 33766 - DNA, 19 bp, synthetic construct
  misc_feature 1..19: note = Synthetic Construct
  source 1..19: mol_type = other DNA
ggaagcatcccgccagcat

SEQ ID NO: 33767 - DNA, 27 bp, synthetic construct
  misc_feature 1..27: note = Synthetic Construct
  source 1..27: mol_type = other DNA
actaggatctatttcaacccagaccat

SEQ ID NO: 33768 - DNA, 22 bp, synthetic construct
  misc_feature 1..22: note = Synthetic Construct
  source 1..22: mol_type = other DNA
gcctctgcctgcaaagaaccat

SEQ ID NO: 33769 - DNA, 26 bp, synthetic construct
  misc_feature 1..26: note = Synthetic Construct
  source 1..26: mol_type = other DNA
gctcaccatcttcctcatcaaacaga

SEQ ID NO: 33770 - DNA, 26 bp, synthetic construct
  misc_feature 1..26: note = Synthetic Construct
  source 1..26: mol_type = other DNA
gggagagacaggttaagaggccattg

SEQ ID NO: 33771 - DNA, 20 bp, synthetic construct
  misc_feature 1..20: note = Synthetic Construct
  source 1..20: mol_type = other DNA
ccagcaagcatggggttcaa

SEQ ID NO: 33772 - DNA, 20 bp, synthetic construct
  misc_feature 1..20: note = Synthetic Construct
  source 1..20: mol_type = other DNA
cgccaggaattcgtgcctta

SEQ ID NO: 33773 - DNA, 24 bp, synthetic construct
  misc_feature 1..24: note = Synthetic Construct
  source 1..24: mol_type = other DNA
ggctctcaaaaccctcaggtctca

SEQ ID NO: 33774 - DNA, 21 bp, synthetic construct
  misc_feature 1..21: note = Synthetic Construct
  source 1..21: mol_type = other DNA
atgcttagtgcctgacacaca

SEQ ID NO: 33775 - DNA, 21 bp, synthetic construct
  misc_feature 1..21: note = Synthetic Construct
  source 1..21: mol_type = other DNA
accgactcctgtccctctttg

SEQ ID NO: 33776 - DNA, 25 bp, synthetic construct
  misc_feature 1..25: note = Synthetic Construct
  source 1..25: mol_type = other DNA
caggaggtggtctttacctcaattc

SEQ ID NO: 33777 - DNA, 26 bp, synthetic construct
  misc_feature 1..26: note = Synthetic Construct
  source 1..26: mol_type = other DNA
caccttagaaaaatgcctacccttga

SEQ ID NO: 33778 - DNA, 29 bp, synthetic construct
  misc_feature 1..29: note = Synthetic Construct
  source 1..29: mol_type = other DNA
ggaaatagatttcagggactagccaaaag

SEQ ID NO: 33779 - DNA, 21 bp, synthetic construct
  misc_feature 1..21: note = Synthetic Construct
  source 1..21: mol_type = other DNA
gccttctcactgctgaacctt

SEQ ID NO: 33780 - DNA, 20 bp, synthetic construct
  misc_feature 1..20: note = Synthetic Construct
  source 1..20: mol_type = other DNA
agcctcctcactgccaaatc

SEQ ID NO: 33781 - DNA, 27 bp, synthetic construct
  misc_feature 1..27: note = Synthetic Construct
  source 1..27: mol_type = other DNA
cccactacacgagaattacacccatct

SEQ ID NO: 33782 - DNA, 21 bp, synthetic construct
  misc_feature 1..21: note = Synthetic Construct
  source 1..21: mol_type = other DNA
tttagcagggcaagggctaag

SEQ ID NO: 33783 - DNA, 29 bp, synthetic construct
  misc_feature 1..29: note = Synthetic Construct
  source 1..29: mol_type = other DNA
cagggaaaaagactgaatcctaactccta

SEQ ID NO: 33784 - DNA, 21 bp, synthetic construct
  misc_feature 1..21: note = Synthetic Construct
  source 1..21: mol_type = other DNA
atgaggacgaggccgggacta

SEQ ID NO: 33785 - DNA, 27 bp, synthetic construct
  misc_feature 1..27: note = Synthetic Construct
  source 1..27: mol_type = other DNA
gagttagatgacccttactttctgcta

SEQ ID NO: 33786 - DNA, 22 bp, synthetic construct
  misc_feature 1..22: note = Synthetic Construct
  source 1..22: mol_type = other DNA
ccattagtggcgcacagacatc

SEQ ID NO: 33787 - DNA, 21 bp, synthetic construct
  misc_feature 1..21: note = Synthetic Construct
  source 1..21: mol_type = other DNA
tcctggctgtcactactgtgt

SEQ ID NO: 33788 - DNA, 21 bp, synthetic construct
  misc_feature 1..21: note = Synthetic Construct
  source 1..21: mol_type = other DNA
ctgggaacaaagccgcctaat

SEQ ID NO: 33789 - DNA, 22 bp, synthetic construct
  misc_feature 1..22: note = Synthetic Construct
  source 1..22: mol_type = other DNA
cgtctccgctgatgttctgtag

SEQ ID NO: 33790 - DNA, 19 bp, synthetic construct
  misc_feature 1..19: note = Synthetic Construct
  source 1..19: mol_type = other DNA
gtgccaactgtggctgtga

SEQ ID NO: 33791 - DNA, 22 bp, synthetic construct
  misc_feature 1..22: note = Synthetic Construct
  source 1..22: mol_type = other DNA
tggctagtggggaagccagata

SEQ ID NO: 33792 - DNA, 24 bp, synthetic construct
  misc_feature 1..24: note = Synthetic Construct
  source 1..24: mol_type = other DNA
ttggtaccagaagtgggattcaaa

SEQ ID NO: 33793 - DNA, 23 bp, synthetic construct
  misc_feature 1..23: note = Synthetic Construct
  source 1..23: mol_type = other DNA
ctgtggtttgtgtaggcccaaag

SEQ ID NO: 33794 - DNA, 21 bp, synthetic construct
  misc_feature 1..21: note = Synthetic Construct
  source 1..21: mol_type = other DNA
gggccaacacatgagggatgt

SEQ ID NO: 33795 - DNA, 22 bp, synthetic construct
  misc_feature 1..22: note = Synthetic Construct
  source 1..22: mol_type = other DNA
ccactggatcactgggtgctta

SEQ ID NO: 33796 - DNA, 21 bp, synthetic construct
  misc_feature 1..21: note = Synthetic Construct
  source 1..21: mol_type = other DNA
tgggacagtgattcccagctt

SEQ ID NO: 33797 - DNA, 20 bp, synthetic construct
  misc_feature 1..20: note = Synthetic Construct
  source 1..20: mol_type = other DNA
agggacagggcagccagtca

SEQ ID NO: 33798 - DNA, 21 bp, synthetic construct
  misc_feature 1..21: note = Synthetic Construct
  source 1..21: mol_type = other DNA
ttatagccgctgcctcctaga

SEQ ID NO: 33799 - DNA, 22 bp, synthetic construct
  misc_feature 1..22: note = Synthetic Construct
  source 1..22: mol_type = other DNA
gctcatccaggaccccatcttt

SEQ ID NO: 33800 - DNA, 20 bp, synthetic construct
  misc_feature 1..20: note = Synthetic Construct
  source 1..20: mol_type = other DNA
ctcattggcgtcagccgata

SEQ ID NO: 33801 - DNA, 24 bp, synthetic construct
  misc_feature 1..24: note = Synthetic Construct
  source 1..24: mol_type = other DNA
cctcgatgttggtagggactcttc

SEQ ID NO: 33802 - DNA, 22 bp, synthetic construct
  misc_feature 1..22: note = Synthetic Construct
  source 1..22: mol_type = other DNA
gcgagtcacctctgccatgttt

SEQ ID NO: 33803 - DNA, 21 bp, synthetic construct
  misc_feature 1..21: note = Synthetic Construct
  source 1..21: mol_type = other DNA
aggccactcagggctttgtga

SEQ ID NO: 33804 - DNA, 28 bp, synthetic construct
  misc_feature 1..28: note = Synthetic Construct
  source 1..28: mol_type = other DNA
ctggggagatgatattaaagctgactct

SEQ ID NO: 33805 - DNA, 20 bp, synthetic construct
  misc_feature 1..20: note = Synthetic Construct
  source 1..20: mol_type = other DNA
gctgcctctgtggtcacatc

SEQ ID NO: 33806 - DNA, 20 bp, synthetic construct
  misc_feature 1..20: note = Synthetic Construct
  source 1..20: mol_type = other DNA
ccaaggcagcacttgaggta

SEQ ID NO: 33807 - DNA, 21 bp, synthetic construct
  misc_feature 1..21: note = Synthetic Construct
  source 1..21: mol_type = other DNA
gccaactgctgtgttgtcttg

SEQ ID NO: 33808 - DNA, 21 bp, synthetic construct
  misc_feature 1..21: note = Synthetic Construct
  source 1..21: mol_type = other DNA
acaacctcacctttgcagaca

SEQ ID NO: 33809 - DNA, 25 bp, synthetic construct
  misc_feature 1..25: note = Synthetic Construct
  source 1..25: mol_type = other DNA
gtcatttgctttcatgaccctcctt

SEQ ID NO: 33810 - DNA, 20 bp, synthetic construct
  misc_feature 1..20: note = Synthetic Construct
  source 1..20: mol_type = other DNA
agtgcgcagcccttttcctt

SEQ ID NO: 33811 - DNA, 19 bp, synthetic construct
  misc_feature 1..19: note = Synthetic Construct
  source 1..19: mol_type = other DNA
atggcgaagcgcaggaaga

SEQ ID NO: 33812 - DNA, 22 bp, synthetic construct
  misc_feature 1..22: note = Synthetic Construct
  source 1..22: mol_type = other DNA
ttgccagaggttccccagattg

SEQ ID NO: 33813 - DNA, 25 bp, synthetic construct
  misc_feature 1..25: note = Synthetic Construct
  source 1..25: mol_type = other DNA
caaataaaggccctccttcaacaac

SEQ ID NO: 33814 - DNA, 22 bp, synthetic construct
  misc_feature 1..22: note = Synthetic Construct
  source 1..22: mol_type = other DNA
caaggaggaggaccaagtctca

SEQ ID NO: 33815 - DNA, 23 bp, synthetic construct
  misc_feature 1..23: note = Synthetic Construct
  source 1..23: mol_type = other DNA
gcatctgtatgcacactgggttt

SEQ ID NO: 33816 - DNA, 20 bp, synthetic construct
  misc_feature 1..20: note = Synthetic Construct
  source 1..20: mol_type = other DNA
aaggtgccagggcaactcaa

SEQ ID NO: 33817 - DNA, 20 bp, synthetic construct
  misc_feature 1..20: note = Synthetic Construct
  source 1..20: mol_type = other DNA
gttctgcagctggtcactgt

SEQ ID NO: 33818 - DNA, 20 bp, synthetic construct
  misc_feature 1..20: note = Synthetic Construct
  source 1..20: mol_type = other DNA
tgctgcagccatgcttccta

SEQ ID NO: 33819 - DNA, 18 bp, synthetic construct
  misc_feature 1..18: note = Synthetic Construct
  source 1..18: mol_type = other DNA
agaagcggctggctccat

SEQ ID NO: 33820 - DNA, 21 bp, synthetic construct
  misc_feature 1..21: note = Synthetic Construct
  source 1..21: mol_type = other DNA
gccttcagggaagctttgaca

SEQ ID NO: 33821 - DNA, 22 bp, synthetic construct
  misc_feature 1..22: note = Synthetic Construct
  source 1..22: mol_type = other DNA
gcagcaccgctctctagttaag

SEQ ID NO: 33822 - DNA, 22 bp, synthetic construct
  misc_feature 1..22: note = Synthetic Construct
  source 1..22: mol_type = other DNA
gacactaagtgcggctgtcatc

SEQ ID NO: 33823 - DNA, 20 bp, synthetic construct
  misc_feature 1..20: note = Synthetic Construct
  source 1..20: mol_type = other DNA
gctaccaggaacgggagtca

SEQ ID NO: 33824 - DNA, 20 bp, synthetic construct
  misc_feature 1..20: note = Synthetic Construct
  source 1..20: mol_type = other DNA
accctgttccctctgtcagt

SEQ ID NO: 33825 - DNA, 22 bp, synthetic construct
  misc_feature 1..22: note = Synthetic Construct
  source 1..22: mol_type = other DNA
gcccagctttagcggatgaagt

SEQ ID NO: 33826 - DNA, 21 bp, synthetic construct
  misc_feature 1..21: note = Synthetic Construct
  source 1..21: mol_type = other DNA
gctgcgcccatttgtttgcat

SEQ ID NO: 33827 - DNA, 19 bp, synthetic construct
  misc_feature 1..19: note = Synthetic Construct
  source 1..19: mol_type = other DNA
ggcacaaagccctctgcat

SEQ ID NO: 33828 - DNA, 21 bp, synthetic construct
  misc_feature 1..21: note = Synthetic Construct
  source 1..21: mol_type = other DNA
tgggcccatggtccatccaaa

SEQ ID NO: 33829 - DNA, 20 bp, synthetic construct
  misc_feature 1..20: note = Synthetic Construct
  source 1..20: mol_type = other DNA
ttgccgctcctctttctgtt

SEQ ID NO: 33830 - DNA, 22 bp, synthetic construct
  misc_feature 1..22: note = Synthetic Construct
  source 1..22: mol_type = other DNA
tcttccccaaatgggaccttca

SEQ ID NO: 33831 - DNA, 24 bp, synthetic construct
  misc_feature 1..24: note = Synthetic Construct
  source 1..24: mol_type = other DNA
ccacatagctctccatctggctat

SEQ ID NO: 33832 - DNA, 21 bp, synthetic construct
  misc_feature 1..21: note = Synthetic Construct
  source 1..21: mol_type = other DNA
ggagtttccgaaggcaacagt

SEQ ID NO: 33833 - DNA, 20 bp, synthetic construct
  misc_feature 1..20: note = Synthetic Construct
  source 1..20: mol_type = other DNA
tcctggcctaaggggtgttt

SEQ ID NO: 33834 - DNA, 20 bp, synthetic construct
  misc_feature 1..20: note = Synthetic Construct
  source 1..20: mol_type = other DNA
gtgctcaggttgtggagaca

SEQ ID NO: 33835 - DNA, 22 bp, synthetic construct
  misc_feature 1..22: note = Synthetic Construct
  source 1..22: mol_type = other DNA
ctcttcaagcaaggctgtctct

SEQ ID NO: 33836 - DNA, 24 bp, synthetic construct
  misc_feature 1..24: note = Synthetic Construct
  source 1..24: mol_type = other DNA
gtgtacagtgaaggccatgtgttc

SEQ ID NO: 33837 - DNA, 23 bp, synthetic construct
  misc_feature 1..23: note = Synthetic Construct
  source 1..23: mol_type = other DNA
tccatggctcaggagggacatag

SEQ ID NO: 33838 - DNA, 22 bp, synthetic construct
  misc_feature 1..22: note = Synthetic Construct
  source 1..22: mol_type = other DNA
accacgatccacacctcctaac

SEQ ID NO: 33839 - DNA, 20 bp, synthetic construct
  misc_feature 1..20: note = Synthetic Construct
  source 1..20: mol_type = other DNA
ttggctggagggctctggaa

SEQ ID NO: 33840 - DNA, 20 bp, synthetic construct
  misc_feature 1..20: note = Synthetic Construct
  source 1..20: mol_type = other DNA
gcaccactggagccaagatt

SEQ ID NO: 33841 - DNA, 25 bp, synthetic construct
  misc_feature 1..25: note = Synthetic Construct
  source 1..25: mol_type = other DNA
gctggaactctgtcataggctgaag

SEQ ID NO: 33842 - DNA, 21 bp, synthetic construct
  misc_feature 1..21: note = Synthetic Construct
  source 1..21: mol_type = other DNA
agtgggagtggtctggtcaac

SEQ ID NO: 33843 - DNA, 20 bp, synthetic construct
  misc_feature 1..20: note = Synthetic Construct
  source 1..20: mol_type = other DNA
actggagcgcttgaggtaga

SEQ ID NO: 33844 - DNA, 24 bp, synthetic construct
  misc_feature 1..24: note = Synthetic Construct
  source 1..24: mol_type = other DNA
gcacaccagaagataacccagctt

SEQ ID NO: 33845 - DNA, 27 bp, synthetic construct
  misc_feature 1..27: note = Synthetic Construct
  source 1..27: mol_type = other DNA
gggcattattgaatgctctgctttctt

SEQ ID NO: 33846 - DNA, 22 bp, synthetic construct
  misc_feature 1..22: note = Synthetic Construct
  source 1..22: mol_type = other DNA
accctggagctcccttccaaaa

SEQ ID NO: 33847 - DNA, 21 bp, synthetic construct
  misc_feature 1..21: note = Synthetic Construct
  source 1..21: mol_type = other DNA
ggcctcctggtgcattgaaac

SEQ ID NO: 33848 - DNA, 24 bp, synthetic construct
  misc_feature 1..24: note = Synthetic Construct
  source 1..24: mol_type = other DNA
gtgcatacacttgactgcttgaca

SEQ ID NO: 33849 - DNA, 21 bp, synthetic construct
  misc_feature 1..21: note = Synthetic Construct
  source 1..21: mol_type = other DNA
tgtaagtgccagccagctaga

SEQ ID NO: 33850 - DNA, 23 bp, synthetic construct
  misc_feature 1..23: note = Synthetic Construct
  source 1..23: mol_type = other DNA
gacctgagtgtggtgaaatgtct

SEQ ID NO: 33851 - DNA, 21 bp, synthetic construct
  misc_feature 1..21: note = Synthetic Construct
  source 1..21: mol_type = other DNA
cagggtgcctcatctcaggat

SEQ ID NO: 33852 - DNA, 22 bp, synthetic construct
  misc_feature 1..22: note = Synthetic Construct
  source 1..22: mol_type = other DNA
agctgaggctatggggatgact

SEQ ID NO: 33853 - DNA, 22 bp, synthetic construct
  misc_feature 1..22: note = Synthetic Construct
  source 1..22: mol_type = other DNA
gcttgtttccacccacctcgtt

SEQ ID NO: 33854 - DNA, 21 bp, synthetic construct
  misc_feature 1..21: note = Synthetic Construct
  source 1..21: mol_type = other DNA
gctgagtgcctttctgccttt

SEQ ID NO: 33855 - DNA, 23 bp, synthetic construct
  misc_feature 1..23: note = Synthetic Construct
  source 1..23: mol_type = other DNA
agtgacagagtatggggtgagaa

SEQ ID NO: 33856 - DNA, 22 bp, synthetic construct
  misc_feature 1..22: note = Synthetic Construct
  source 1..22: mol_type = other DNA
gcttcccagatcccacagttag

SEQ ID NO: 33857 - DNA, 22 bp, synthetic construct
  misc_feature 1..22: note = Synthetic Construct
  source 1..22: mol_type = other DNA
cccaggactgtcattcccaaga

SEQ ID NO: 33858 - DNA, 20 bp, synthetic construct
  misc_feature 1..20: note = Synthetic Construct
  source 1..20: mol_type = other DNA
gggttatgggcaccttcaca

SEQ ID NO: 33859 - DNA, 21 bp, synthetic construct
  misc_feature 1..21: note = Synthetic Construct
  source 1..21: mol_type = other DNA
ggcagacacaacttggggaaa

SEQ ID NO: 33860 - DNA, 21 bp, synthetic construct
  misc_feature 1..21: note = Synthetic Construct
  source 1..21: mol_type = other DNA
gacgtgctcagtgggatttgt

SEQ ID NO: 33861 - DNA, 23 bp, synthetic construct
  misc_feature 1..23: note = Synthetic Construct
  source 1..23: mol_type = other DNA
gcaataacccatcggtggagcaa

SEQ ID NO: 33862 - DNA, 22 bp, synthetic construct
  misc_feature 1..22: note = Synthetic Construct
  source 1..22: mol_type = other DNA
tggtgagatcttggctctccat

SEQ ID NO: 33863 - DNA, 22 bp, synthetic construct
  misc_feature 1..22: note = Synthetic Construct
  source 1..22: mol_type = other DNA
gccctctttccattgcccagaa

SEQ ID NO: 33864 - DNA, 22 bp, synthetic construct
  misc_feature 1..22: note = Synthetic Construct
  source 1..22: mol_type = other DNA
gtctctgtctgcccatcagtct

SEQ ID NO: 33865 - DNA, 20 bp, synthetic construct
  misc_feature 1..20: note = Synthetic Construct
  source 1..20: mol_type = other DNA
gcagggaaagcccagtcatc

SEQ ID NO: 33866 - DNA, 27 bp, synthetic construct
  misc_feature 1..27: note = Synthetic Construct
  source 1..27: mol_type = other DNA
ccccacatttcttcagacagtggaatc

SEQ ID NO: 33867 - DNA, 18 bp, synthetic construct
  misc_feature 1..18: note = Synthetic Construct
  source 1..18: mol_type = other DNA
tcccgcccactgctatct

SEQ ID NO: 33868 - DNA, 19 bp, synthetic construct
  misc_feature 1..19: note = Synthetic Construct
  source 1..19: mol_type = other DNA
tgtctcggggtgccacaca

SEQ ID NO: 33869 - DNA, 23 bp, synthetic construct
  misc_feature 1..23: note = Synthetic Construct
  source 1..23: mol_type = other DNA
gcacgtggagagtgttcatccat

SEQ ID NO: 33870 - DNA, 25 bp, synthetic construct
  misc_feature 1..25: note = Synthetic Construct
  source 1..25: mol_type = other DNA
tgaaatgaacagaccagctaacctt

SEQ ID NO: 33871 - DNA, 22 bp, synthetic construct
  misc_feature 1..22: note = Synthetic Construct
  source 1..22: mol_type = other DNA
cctgggctatgctgtcatccat

SEQ ID NO: 33872 - DNA, 25 bp, synthetic construct
  misc_feature 1..25: note = Synthetic Construct
  source 1..25: mol_type = other DNA
gagactgcctgaataccatggaaga

SEQ ID NO: 33873 - DNA, 20 bp, synthetic construct
  misc_feature 1..20: note = Synthetic Construct
  source 1..20: mol_type = other DNA
tgggagggtgccacctcttg

SEQ ID NO: 33874 - DNA, 20 bp, synthetic construct
  misc_feature 1..20: note = Synthetic Construct
  source 1..20: mol_type = other DNA
ctttggttgcaggccacaga

SEQ ID NO: 33875 - DNA, 20 bp, synthetic construct
  misc_feature 1..20: note = Synthetic Construct
  source 1..20: mol_type = other DNA
ggctgccttgggacacatct

SEQ ID NO: 33876 - DNA, 22 bp, synthetic construct
  misc_feature 1..22: note = Synthetic Construct
  source 1..22: mol_type = other DNA
gccaggaacactgcttgtgatg

SEQ ID NO: 33877 - DNA, 22 bp, synthetic construct
  misc_feature 1..22: note = Synthetic Construct
  source 1..22: mol_type = other DNA
gagaggggtttgcttccctctt

SEQ ID NO: 33878 - DNA, 19 bp, synthetic construct
  misc_feature 1..19: note = Synthetic Construct
  source 1..19: mol_type = other DNA
aggggcctgcactgtgatt

SEQ ID NO: 33879 - DNA, 23 bp, synthetic construct
  misc_feature 1..23: note = Synthetic Construct
  source 1..23: mol_type = other DNA
ccatcagcagattcacactcaga

SEQ ID NO: 33880 - DNA, 24 bp, synthetic construct
  misc_feature 1..24: note = Synthetic Construct
  source 1..24: mol_type = other DNA
cagggaaaacagggatgaaagaca

SEQ ID NO: 33881 - DNA, 26 bp, synthetic construct
  misc_feature 1..26: note = Synthetic Construct
  source 1..26: mol_type = other DNA
ctgctgtgaagctggagactttttac

SEQ ID NO: 33882 - DNA, 19 bp, synthetic construct
  misc_feature 1..19: note = Synthetic Construct
  source 1..19: mol_type = other DNA
tcgccgcgttgaccagtgt

SEQ ID NO: 33883 - DNA, 22 bp, synthetic construct
  misc_feature 1..22: note = Synthetic Construct
  source 1..22: mol_type = other DNA
ggacaggtactaggtgctgctt

SEQ ID NO: 33884 - DNA, 22 bp, synthetic construct
  misc_feature 1..22: note = Synthetic Construct
  source 1..22: mol_type = other DNA
gaagccggtttaactggtgttg

SEQ ID NO: 33885 - DNA, 22 bp, synthetic construct
  misc_feature 1..22: note = Synthetic Construct
  source 1..22: mol_type = other DNA
cagcaggagggaaaaggctatg

SEQ ID NO: 33886 - DNA, 22 bp, synthetic construct
  misc_feature 1..22: note = Synthetic Construct
  source 1..22: mol_type = other DNA
ctcaaaaggcaggtgcttgaca

SEQ ID NO: 33887 - DNA, 21 bp, synthetic construct
  misc_feature 1..21: note = Synthetic Construct
  source 1..21: mol_type = other DNA
tggttcccaaggggctcagat

SEQ ID NO: 33888 - DNA, 26 bp, synthetic construct
  misc_feature 1..26: note = Synthetic Construct
  source 1..26: mol_type = other DNA
gtggtgaaagtaatggcatcaagcat

SEQ ID NO: 33889 - DNA, 21 bp, synthetic construct
  misc_feature 1..21: note = Synthetic Construct
  source 1..21: mol_type = other DNA
tgctgtggtgtggtcatttgt

SEQ ID NO: 33890 - DNA, 20 bp, synthetic construct
  misc_feature 1..20: note = Synthetic Construct
  source 1..20: mol_type = other DNA
tcccagtgcaagggcattag

SEQ ID NO: 33891 - DNA, 19 bp, synthetic construct
  misc_feature 1..19: note = Synthetic Construct
  source 1..19: mol_type = other DNA
aggctggcctcccacttac

SEQ ID NO: 33892 - DNA, 26 bp, synthetic construct
  misc_feature 1..26: note = Synthetic Construct
  source 1..26: mol_type = other DNA
agagtaaacttggaaggatgggtttc

SEQ ID NO: 33893 - DNA, 19 bp, synthetic construct
  misc_feature 1..19: note = Synthetic Construct
  source 1..19: mol_type = other DNA
gcaatccctgcgaccacat

SEQ ID NO: 33894 - DNA, 20 bp, synthetic construct
  misc_feature 1..20: note = Synthetic Construct
  source 1..20: mol_type = other DNA
aggccaaagtccctgtgaac

SEQ ID NO: 33895 - DNA, 25 bp, synthetic construct
  misc_feature 1..25: note = Synthetic Construct
  source 1..25: mol_type = other DNA
ggatgagattcccttcctccacact

SEQ ID NO: 33896 - DNA, 21 bp, synthetic construct
  misc_feature 1..21: note = Synthetic Construct
  source 1..21: mol_type = other DNA
gctgtttctctgtcgctcctt

SEQ ID NO: 33897 - DNA, 22 bp, synthetic construct
  misc_feature 1..22: note = Synthetic Construct
  source 1..22: mol_type = other DNA
gggtgctgggaaacatgaggaa

SEQ ID NO: 33898 - DNA, 22 bp, synthetic construct
  misc_feature 1..22: note = Synthetic Construct
  source 1..22: mol_type = other DNA
cagccttctgtccactccttag

SEQ ID NO: 33899 - DNA, 20 bp, synthetic construct
  misc_feature 1..20: note = Synthetic Construct
  source 1..20: mol_type = other DNA
tgcttccagagccccacact

SEQ ID NO: 33900 - DNA, 20 bp, synthetic construct
  misc_feature 1..20: note = Synthetic Construct
  source 1..20: mol_type = other DNA
cactccgcattgttgtgcat

SEQ ID NO: 33901 - DNA, 20 bp, synthetic construct
  misc_feature 1..20: note = Synthetic Construct
  source 1..20: mol_type = other DNA
acaccctgtggggccgatga

SEQ ID NO: 33902 - DNA, 24 bp, synthetic construct
  misc_feature 1..24: note = Synthetic Construct
  source 1..24: mol_type = other DNA
gtggtagttagacctccccgaaag

SEQ ID NO: 33903 - DNA, 21 bp, synthetic construct
  misc_feature 1..21: note = Synthetic Construct
  source 1..21: mol_type = other DNA
gggcagaagtggatggtgaga

SEQ ID NO: 33904 - DNA, 21 bp, synthetic construct
  misc_feature 1..21: note = Synthetic Construct
  source 1..21: mol_type = other DNA
gcccctaccctgttcctccat

SEQ ID NO: 33905 - DNA, 24 bp, synthetic construct
  misc_feature 1..24: note = Synthetic Construct
  source 1..24: mol_type = other DNA
acttccaggagcacctttgaatag

SEQ ID NO: 33906 - DNA, 26 bp, synthetic construct
  misc_feature 1..26: note = Synthetic Construct
  source 1..26: mol_type = other DNA
ccatcaaagaggtaacaagccagtga

SEQ ID NO: 33907 - DNA, 20 bp, synthetic construct
  misc_feature 1..20: note = Synthetic Construct
  source 1..20: mol_type = other DNA
aaccccgtcttggctcgatt

SEQ ID NO: 33908 - DNA, 19 bp, synthetic construct
  misc_feature 1..19: note = Synthetic Construct
  source 1..19: mol_type = other DNA
gctacacgctgggcaccaa

SEQ ID NO: 33909 - DNA, 22 bp, synthetic construct
  misc_feature 1..22: note = Synthetic Construct
  source 1..22: mol_type = other DNA
gccctatggcaaaggctcacta

SEQ ID NO: 33910 - DNA, 20 bp, synthetic construct
  misc_feature 1..20: note = Synthetic Construct
  source 1..20: mol_type = other DNA
aagcctctggctggtgtttc

SEQ ID NO: 33911 - DNA, 20 bp, synthetic construct
  misc_feature 1..20: note = Synthetic Construct
  source 1..20: mol_type = other DNA
cctgtggttttgggcaggtt

SEQ ID NO: 33912 - DNA, 20 bp, synthetic construct
  misc_feature 1..20: note = Synthetic Construct
  source 1..20: mol_type = other DNA
tggttaccaccctgggatca

SEQ ID NO: 33913 - DNA, 21 bp, synthetic construct
  misc_feature 1..21: note = Synthetic Construct
  source 1..21: mol_type = other DNA
tctggtactcccagggtgcat

SEQ ID NO: 33914 - DNA, 20 bp, synthetic construct
  misc_feature 1..20: note = Synthetic Construct
  source 1..20: mol_type = other DNA
tggatacaccgggcttgtct

SEQ ID NO: 33915 - DNA, 20 bp, synthetic construct
  misc_feature 1..20: note = Synthetic Construct
  source 1..20: mol_type = other DNA
aagacaccgcgctgcctagt

SEQ ID NO: 33916 - DNA, 21 bp, synthetic construct
  misc_feature 1..21: note = Synthetic Construct
  source 1..21: mol_type = other DNA
tccagaggcaggagacaatca

SEQ ID NO: 33917 - DNA, 27 bp, synthetic construct
  misc_feature 1..27: note = Synthetic Construct
  source 1..27: mol_type = other DNA
ccgcaattggagctgaattcttaaatc

SEQ ID NO: 33918 - DNA, 20 bp, synthetic construct
  misc_feature 1..20: note = Synthetic Construct
  source 1..20: mol_type = other DNA
ccttggggtggcccacttag

SEQ ID NO: 33919 - DNA, 21 bp, synthetic construct
  misc_feature 1..21: note = Synthetic Construct
  source 1..21: mol_type = other DNA
ttttccctgacgatcggcttt

SEQ ID NO: 33920 - DNA, 23 bp, synthetic construct
  misc_feature 1..23: note = Synthetic Construct
  source 1..23: mol_type = other DNA
gtcagggagaacctatggaccta

SEQ ID NO: 33921 - DNA, 24 bp, synthetic construct
  misc_feature 1..24: note = Synthetic Construct
  source 1..24: mol_type = other DNA
ccccagacagatgtaagtccaaca

SEQ ID NO: 33922 - DNA, 20 bp, synthetic construct
  misc_feature 1..20: note = Synthetic Construct
  source 1..20: mol_type = other DNA
ctgcatgcctggaacacact

SEQ ID NO: 33923 - DNA, 22 bp, synthetic construct
  misc_feature 1..22: note = Synthetic Construct
  source 1..22: mol_type = other DNA
ctggactgctcactctggaact

SEQ ID NO: 33924 - DNA, 20 bp, synthetic construct
  misc_feature 1..20: note = Synthetic Construct
  source 1..20: mol_type = other DNA
tgcccgaagaggcatgaaac

SEQ ID NO: 33925 - DNA, 23 bp, synthetic construct
  misc_feature 1..23: note = Synthetic Construct
  source 1..23: mol_type = other DNA
tcttctccaaagtcagggtgtct

SEQ ID NO: 33926 - DNA, 20 bp, synthetic construct
  misc_feature 1..20: note = Synthetic Construct
  source 1..20: mol_type = other DNA
gcagtgccaggagcaaaaga

SEQ ID NO: 33927 - DNA, 25 bp, synthetic construct
  misc_feature 1..25: note = Synthetic Construct
  source 1..25: mol_type = other DNA
agccttaaaaactgccttctacaca

SEQ ID NO: 33928 - DNA, 25 bp, synthetic construct
  misc_feature 1..25: note = Synthetic Construct
  source 1..25: mol_type = other DNA
gggattcactagtgttgtggattga

SEQ ID NO: 33929 - DNA, 22 bp, synthetic construct
  misc_feature 1..22: note = Synthetic Construct
  source 1..22: mol_type = other DNA
ccaatggtggaaacagcctaca

SEQ ID NO: 33930 - DNA, 23 bp, synthetic construct
  misc_feature 1..23: note = Synthetic Construct
  source 1..23: mol_type = other DNA
gctagatgagggaggctggaaac

SEQ ID NO: 33931 - DNA, 20 bp, synthetic construct
  misc_feature 1..20: note = Synthetic Construct
  source 1..20: mol_type = other DNA
cctggatgtggctggcagta

SEQ ID NO: 33932 - DNA, 20 bp, synthetic construct
  misc_feature 1..20: note = Synthetic Construct
  source 1..20: mol_type = other DNA
cattggcaacccagctcaca

SEQ ID NO: 33933 - DNA, 21 bp, synthetic construct
  misc_feature 1..21: note = Synthetic Construct
  source 1..21: mol_type = other DNA
agcccgagcctcctacaactt

SEQ ID NO: 33934 - DNA, 20 bp, synthetic construct
  misc_feature 1..20: note = Synthetic Construct
  source 1..20: mol_type = other DNA
acagggctccaggcgagtgt

SEQ ID NO: 33935 - DNA, 21 bp, synthetic construct
  misc_feature 1..21: note = Synthetic Construct
  source 1..21: mol_type = other DNA
tgggaggtgaaccagggacat

SEQ ID NO: 33936 - DNA, 22 bp, synthetic construct
  misc_feature 1..22: note = Synthetic Construct
  source 1..22: mol_type = other DNA
gggctgcagagataagctcgtt

SEQ ID NO: 33937 - DNA, 22 bp, synthetic construct
  misc_feature 1..22: note = Synthetic Construct
  source 1..22: mol_type = other DNA
cgtcacagccagttctcacaca

SEQ ID NO: 33938 - DNA, 20 bp, synthetic construct
  misc_feature 1..20: note = Synthetic Construct
  source 1..20: mol_type = other DNA
tctgacctgcgggcagtttg

SEQ ID NO: 33939 - DNA, 23 bp, synthetic construct
  misc_feature 1..23: note = Synthetic Construct
  source 1..23: mol_type = other DNA
gcgagaaacaccactgacatttg

SEQ ID NO: 33940 - DNA, 22 bp, synthetic construct
  misc_feature 1..22: note = Synthetic Construct
  source 1..22: mol_type = other DNA
cccaatggtagctggcatgctt

SEQ ID NO: 33941 - DNA, 21 bp, synthetic construct
  misc_feature 1..21: note = Synthetic Construct
  source 1..21: mol_type = other DNA
acctccccagggacactcact

SEQ ID NO: 33942 - DNA, 22 bp, synthetic construct
  misc_feature 1..22: note = Synthetic Construct
  source 1..22: mol_type = other DNA
aggcagtggcctcctctttgta

SEQ ID NO: 33943 - DNA, 20 bp, synthetic construct
  misc_feature 1..20: note = Synthetic Construct
  source 1..20: mol_type = other DNA
ttgccggtggatcctgactt

SEQ ID NO: 33944 - DNA, 22 bp, synthetic construct
  misc_feature 1..22: note = Synthetic Construct
  source 1..22: mol_type = other DNA
tgcaattgatcgttggctccta

SEQ ID NO: 33945 - DNA, 22 bp, synthetic construct
  misc_feature 1..22: note = Synthetic Construct
  source 1..22: mol_type = other DNA
ggccgctttcttagggtgtaag

SEQ ID NO: 33946 - DNA, 24 bp, synthetic construct
  misc_feature 1..24: note = Synthetic Construct
  source 1..24: mol_type = other DNA
ggtgaaaggtgaggatcaatcaga

SEQ ID NO: 33947 - DNA, 20 bp, synthetic construct
  misc_feature 1..20: note = Synthetic Construct
  source 1..20: mol_type = other DNA
tgtgccttctgggagaccat

SEQ ID NO: 33948 - DNA, 25 bp, synthetic construct
  misc_feature 1..25: note = Synthetic Construct
  source 1..25: mol_type = other DNA
ggttctccagaatggtcctgtcgtt

SEQ ID NO: 33949 - DNA, 20 bp, synthetic construct
  misc_feature 1..20: note = Synthetic Construct
  source 1..20: mol_type = other DNA
gcagccttagggctagcaaa

SEQ ID NO: 33950 - DNA, 22 bp, synthetic construct
  misc_feature 1..22: note = Synthetic Construct
  source 1..22: mol_type = other DNA
cccctaaacctgggccaaatga

SEQ ID NO: 33951 - DNA, 20 bp, synthetic construct
  misc_feature 1..20: note = Synthetic Construct
  source 1..20: mol_type = other DNA
tgacaggccatgccacaaag

SEQ ID NO: 33952 - DNA, 26 bp, synthetic construct
  misc_feature 1..26: note = Synthetic Construct
  source 1..26: mol_type = other DNA
cccatcctattaccccaaacgtcttc

SEQ ID NO: 33953 - DNA, 20 bp, synthetic construct
  misc_feature 1..20: note = Synthetic Construct
  source 1..20: mol_type = other DNA
actgcagcccctgtgaatac

SEQ ID NO: 33954 - DNA, 23 bp, synthetic construct
  misc_feature 1..23: note = Synthetic Construct
  source 1..23: mol_type = other DNA
ggagacgtcctgcctgcagtctt

SEQ ID NO: 33955 - DNA, 20 bp, synthetic construct
  misc_feature 1..20: note = Synthetic Construct
  source 1..20: mol_type = other DNA
gcgcacagcagaatggagat

SEQ ID NO: 33956 - DNA, 23 bp, synthetic construct
  misc_feature 1..23: note = Synthetic Construct
  source 1..23: mol_type = other DNA
gcatgcagtggtgtatgttgtag

SEQ ID NO: 33957 - DNA, 25 bp, synthetic construct
  misc_feature 1..25: note = Synthetic Construct
  source 1..25: mol_type = other DNA
gcctaatgtttgtggggtagtggta

SEQ ID NO: 33958 - DNA, 20 bp, synthetic construct
  misc_feature 1..20: note = Synthetic Construct
  source 1..20: mol_type = other DNA
gggagaccaggcccctaaga

SEQ ID NO: 33959 - DNA, 20 bp, synthetic construct
  misc_feature 1..20: note = Synthetic Construct
  source 1..20: mol_type = other DNA
tccctgcaaggaccctcagt

SEQ ID NO: 33960 - DNA, 22 bp, synthetic construct
  misc_feature 1..22: note = Synthetic Construct
  source 1..22: mol_type = other DNA
tctcacctgaccctgaggtctt

SEQ ID NO: 33961 - DNA, 22 bp, synthetic construct
  misc_feature 1..22: note = Synthetic Construct
  source 1..22: mol_type = other DNA
gacgcagcttgccttagacttc

SEQ ID NO: 33962 - DNA, 24 bp, synthetic construct
  misc_feature 1..24: note = Synthetic Construct
  source 1..24: mol_type = other DNA
gggtgcagctgacttcctagtctt

SEQ ID NO: 33963 - DNA, 22 bp, synthetic construct
  misc_feature 1..22: note = Synthetic Construct
  source 1..22: mol_type = other DNA
gtgcggtcaaggtttacaggtt

SEQ ID NO: 33964 - DNA, 22 bp, synthetic construct
  misc_feature 1..22: note = Synthetic Construct
  source 1..22: mol_type = other DNA
tcacaagctccactccctcaag

SEQ ID NO: 33965 - DNA, 18 bp, synthetic construct
  misc_feature 1..18: note = Synthetic Construct
  source 1..18: mol_type = other DNA
tctgcgtgtgcgtgtgtt

SEQ ID NO: 33966 - DNA, 21 bp, synthetic construct
  misc_feature 1..21: note = Synthetic Construct
  source 1..21: mol_type = other DNA
cagtgacatgtggcccagttt

SEQ ID NO: 33967 - DNA, 25 bp, synthetic construct
  misc_feature 1..25: note = Synthetic Construct
  source 1..25: mol_type = other DNA
tgttcaatgatactggtgcaggatt

SEQ ID NO: 33968 - DNA, 24 bp, synthetic construct
  misc_feature 1..24: note = Synthetic Construct
  source 1..24: mol_type = other DNA
ggcgtggagttgcttcatctcctt

SEQ ID NO: 33969 - DNA, 19 bp, synthetic construct
  misc_feature 1..19: note = Synthetic Construct
  source 1..19: mol_type = other DNA
tggggtggcacagccaact

SEQ ID NO: 33970 - DNA, 22 bp, synthetic construct
  misc_feature 1..22: note = Synthetic Construct
  source 1..22: mol_type = other DNA
accacgtgacaggtgtgaggat

SEQ ID NO: 33971 - DNA, 24 bp, synthetic construct
  misc_feature 1..24: note = Synthetic Construct
  source 1..24: mol_type = other DNA
ggagtagctctgtagggagagttg

SEQ ID NO: 33972 - DNA, 23 bp, synthetic construct
  misc_feature 1..23: note = Synthetic Construct
  source 1..23: mol_type = other DNA
acatgattgatgccaaggggtaa

SEQ ID NO: 33973 - DNA, 22 bp, synthetic construct
  misc_feature 1..22: note = Synthetic Construct
  source 1..22: mol_type = other DNA
tgcgtgctcagagtcacataag

SEQ ID NO: 33974 - DNA, 20 bp, synthetic construct
  misc_feature 1..20: note = Synthetic Construct
  source 1..20: mol_type = other DNA
agcacacccctcctgcactt

SEQ ID NO: 33975 - DNA, 19 bp, synthetic construct
  misc_feature 1..19: note = Synthetic Construct
  source 1..19: mol_type = other DNA
ccaggcggctccaagaagt

SEQ ID NO: 33976 - DNA, 20 bp, synthetic construct
  misc_feature 1..20: note = Synthetic Construct
  source 1..20: mol_type = other DNA
aaacctggcagaggttgcat

SEQ ID NO: 33977 - DNA, 22 bp, synthetic construct
  misc_feature 1..22: note = Synthetic Construct
  source 1..22: mol_type = other DNA
caggatctgaacgggaggtttc

SEQ ID NO: 33978 - DNA, 24 bp, synthetic construct
  misc_feature 1..24: note = Synthetic Construct
  source 1..24: mol_type = other DNA
ggtggaaatctaccccaggcaact

SEQ ID NO: 33979 - DNA, 22 bp, synthetic construct
  misc_feature 1..22: note = Synthetic Construct
  source 1..22: mol_type = other DNA
ctgccggtgaactgagagtaga

SEQ ID NO: 33980 - DNA, 19 bp, synthetic construct
  misc_feature 1..19: note = Synthetic Construct
  source 1..19: mol_type = other DNA
atccctggccatgctgcta

SEQ ID NO: 33981 - DNA, 24 bp, synthetic construct
  misc_feature 1..24: note = Synthetic Construct
  source 1..24: mol_type = other DNA
agtgactcatcctgaagtcctgaa

SEQ ID NO: 33982 - DNA, 20 bp, synthetic construct
  misc_feature 1..20: note = Synthetic Construct
  source 1..20: mol_type = other DNA
acaggaaggcaccacgttga

SEQ ID NO: 33983 - DNA, 19 bp, synthetic construct
  misc_feature 1..19: note = Synthetic Construct
  source 1..19: mol_type = other DNA
gaggggccaagtgcagaag

SEQ ID NO: 33984 - DNA, 21 bp, synthetic construct
  misc_feature 1..21: note = Synthetic Construct
  source 1..21: mol_type = other DNA
agaggtgaccaggccctttga

SEQ ID NO: 33985 - DNA, 22 bp, synthetic construct
  misc_feature 1..22: note = Synthetic Construct
  source 1..22: mol_type = other DNA
gtgacgcgacctgctcataagt

SEQ ID NO: 33986 - DNA, 22 bp, synthetic construct
  misc_feature 1..22: note = Synthetic Construct
  source 1..22: mol_type = other DNA
acctgggctccatcctgtgaat

SEQ ID NO: 33987 - DNA, 23 bp, synthetic construct
  misc_feature 1..23: note = Synthetic Construct
  source 1..23: mol_type = other DNA
gctcaattcctcccactgcttct

SEQ ID NO: 33988 - DNA, 22 bp, synthetic construct
  misc_feature 1..22: note = Synthetic Construct
  source 1..22: mol_type = other DNA
ctcttctggagaaggggagagt

SEQ ID NO: 33989 - DNA, 27 bp, synthetic construct
  misc_feature 1..27: note = Synthetic Construct
  source 1..27: mol_type = other DNA
gtccaactccttccatctgaattcttc

SEQ ID NO: 33990 - DNA, 24 bp, synthetic construct
  misc_feature 1..24: note = Synthetic Construct
  source 1..24: mol_type = other DNA
cacgtaggcctctgttttctggtt

SEQ ID NO: 33991 - DNA, 22 bp, synthetic construct
  misc_feature 1..22: note = Synthetic Construct
  source 1..22: mol_type = other DNA
cccctggctaagctcaaagtca

SEQ ID NO: 33992 - DNA, 22 bp, synthetic construct
  misc_feature 1..22: note = Synthetic Construct
  source 1..22: mol_type = other DNA
ggaaaacacaccgccagagaag

SEQ ID NO: 33993 - DNA, 23 bp, synthetic construct
  misc_feature 1..23: note = Synthetic Construct
  source 1..23: mol_type = other DNA
gcaaactcctaggctctgtgctt

SEQ ID NO: 33994 - DNA, 23 bp, synthetic construct
  misc_feature 1..23: note = Synthetic Construct
  source 1..23: mol_type = other DNA
gtgagaggatgtgtgcgttccat

SEQ ID NO: 33995 - DNA, 23 bp, synthetic construct
  misc_feature 1..23: note = Synthetic Construct
  source 1..23: mol_type = other DNA
cattaccccagttggcagaaaac

SEQ ID NO: 33996 - DNA, 22 bp, synthetic construct
  misc_feature 1..22: note = Synthetic Construct
  source 1..22: mol_type = other DNA
gacaagttgggtggacagtctt

SEQ ID NO: 33997 - DNA, 19 bp, synthetic construct
  misc_feature 1..19: note = Synthetic Construct
  source 1..19: mol_type = other DNA
aaggggtgctctcccttga

SEQ ID NO: 33998 - DNA, 23 bp, synthetic construct
  misc_feature 1..23: note = Synthetic Construct
  source 1..23: mol_type = other DNA
ccccgtgaaatgatggtggaaac

SEQ ID NO: 33999 - DNA, 25 bp, synthetic construct
  misc_feature 1..25: note = Synthetic Construct
  source 1..25: mol_type = other DNA
ggtaatcaaccctcagtctctcatc

SEQ ID NO: 34000 - DNA, 19 bp, synthetic construct
  misc_feature 1..19: note = Synthetic Construct
  source 1..19: mol_type = other DNA
aggccagccctctgacttc

SEQ ID NO: 34001 - DNA, 20 bp, synthetic construct
  misc_feature 1..20: note = Synthetic Construct
  source 1..20: mol_type = other DNA
gcttgggactctggggttga

SEQ ID NO: 34002 - DNA, 21 bp, synthetic construct
  misc_feature 1..21: note = Synthetic Construct
  source 1..21: mol_type = other DNA
cctggctttgccccttcatct

SEQ ID NO: 34003 - DNA, 18 bp, synthetic construct
  misc_feature 1..18: note = Synthetic Construct
  source 1..18: mol_type = other DNA
agccagcctctgcacctt

SEQ ID NO: 34004 - DNA, 21 bp, synthetic construct
  misc_feature 1..21: note = Synthetic Construct
  source 1..21: mol_type = other DNA
cctctgaaaggcggaaaccaa

SEQ ID NO: 34005 - DNA, 18 bp, synthetic construct
  misc_feature 1..18: note = Synthetic Construct
  source 1..18: mol_type = other DNA
agtggccagcaggagcaa

SEQ ID NO: 34006 - DNA, 23 bp, synthetic construct
  misc_feature 1..23: note = Synthetic Construct
  source 1..23: mol_type = other DNA
ccagggcaggactctaaccattg

SEQ ID NO: 34007 - DNA, 24 bp, synthetic construct
  misc_feature 1..24: note = Synthetic Construct
  source 1..24: mol_type = other DNA
gttaggaaagggtcccctaaggtt

SEQ ID NO: 34008 - DNA, 20 bp, synthetic construct
  misc_feature 1..20: note = Synthetic Construct
  source 1..20: mol_type = other DNA
ggtggcttggattgcctact

SEQ ID NO: 34009 - DNA, 20 bp, synthetic construct
  misc_feature 1..20: note = Synthetic Construct
  source 1..20: mol_type = other DNA
tccaccctggccccagcatt

SEQ ID NO: 34010 - DNA, 21 bp, synthetic construct
  misc_feature 1..21: note = Synthetic Construct
  source 1..21: mol_type = other DNA
cgtggaggggaggaagtcttg

SEQ ID NO: 34011 - DNA, 20 bp, synthetic construct
  misc_feature 1..20: note = Synthetic Construct
  source 1..20: mol_type = other DNA
accaatgggaggcaccatca

SEQ ID NO: 34012 - DNA, 24 bp, synthetic construct
  misc_feature 1..24: note = Synthetic Construct
  source 1..24: mol_type = other DNA
gagttgcacttgtactctgtcagt

SEQ ID NO: 34013 - DNA, 25 bp, synthetic construct
  misc_feature 1..25: note = Synthetic Construct
  source 1..25: mol_type = other DNA
ggctttttggctttccaggttgatg

SEQ ID NO: 34014 - DNA, 20 bp, synthetic construct
  misc_feature 1..20: note = Synthetic Construct
  source 1..20: mol_type = other DNA
cccgcaagggttggggaaat

SEQ ID NO: 34015 - DNA, 20 bp, synthetic construct
  misc_feature 1..20: note = Synthetic Construct
  source 1..20: mol_type = other DNA
tccaacaccatccgctcttc

SEQ ID NO: 34016 - DNA, 22 bp, synthetic construct
  misc_feature 1..22: note = Synthetic Construct
  source 1..22: mol_type = other DNA
gtgggtgccagagttgagattc

SEQ ID NO: 34017 - DNA, 19 bp, synthetic construct
  misc_feature 1..19: note = Synthetic Construct
  source 1..19: mol_type = other DNA
ggccgggaaaagggagcat

SEQ ID NO: 34018 - DNA, 28 bp, synthetic construct
  misc_feature 1..28: note = Synthetic Construct
  source 1..28: mol_type = other DNA
gtcttccccatagttaagttgtctcttc

SEQ ID NO: 34019 - DNA, 28 bp, synthetic construct
  misc_feature 1..28: note = Synthetic Construct
  source 1..28: mol_type = other DNA
gcagctacgcatacaaatcactcacatc

SEQ ID NO: 34020 - DNA, 21 bp, synthetic construct
  misc_feature 1..21: note = Synthetic Construct
  source 1..21: mol_type = other DNA
actggactcagggagcagcat

SEQ ID NO: 34021 - DNA, 19 bp, synthetic construct
  misc_feature 1..19: note = Synthetic Construct
  source 1..19: mol_type = other DNA
aggccactgcctcgcatca

SEQ ID NO: 34022 - DNA, 25 bp, synthetic construct
  misc_feature 1..25: note = Synthetic Construct
  source 1..25: mol_type = other DNA
ggacttttgttttccccgtttgaag

SEQ ID NO: 34023 - DNA, 25 bp, synthetic construct
  misc_feature 1..25: note = Synthetic Construct
  source 1..25: mol_type = other DNA
tctaaatgttctctgggtgctgttc

SEQ ID NO: 34024 - DNA, 22 bp, synthetic construct
  misc_feature 1..22: note = Synthetic Construct
  source 1..22: mol_type = other DNA
ggggtctaatggctgtggttgt

SEQ ID NO: 34025 - DNA, 22 bp, synthetic construct
  misc_feature 1..22: note = Synthetic Construct
  source 1..22: mol_type = other DNA
ggctgttagccctgtggaacaa

SEQ ID NO: 34026 - DNA, 20 bp, synthetic construct
  misc_feature 1..20: note = Synthetic Construct
  source 1..20: mol_type = other DNA
acggcagagcaaaggcttgt

SEQ ID NO: 34027 - DNA, 28 bp, synthetic construct
  misc_feature 1..28: note = Synthetic Construct
  source 1..28: mol_type = other DNA
ggacaaggccctttaattcataccaaga

SEQ ID NO: 34028 - DNA, 18 bp, synthetic construct
  misc_feature 1..18: note = Synthetic Construct
  source 1..18: mol_type = other DNA
agcccagagcagcgttca

SEQ ID NO: 34029 - DNA, 21 bp, synthetic construct
  misc_feature 1..21: note = Synthetic Construct
  source 1..21: mol_type = other DNA
tggtagtgtagaggggcaact

SEQ ID NO: 34030 - DNA, 20 bp, synthetic construct
  misc_feature 1..20: note = Synthetic Construct
  source 1..20: mol_type = other DNA
gggccaagcgttcagactac

SEQ ID NO: 34031 - DNA, 18 bp, synthetic construct
  misc_feature 1..18: note = Synthetic Construct
  source 1..18: mol_type = other DNA
atgctcaggctgcgttgt

SEQ ID NO: 34032 - DNA, 21 bp, synthetic construct
  misc_feature 1..21: note = Synthetic Construct
  source 1..21: mol_type = other DNA
tggctccctgaggagtgtttg

SEQ ID NO: 34033 - DNA, 25 bp, synthetic construct
  misc_feature 1..25: note = Synthetic Construct
  source 1..25: mol_type = other DNA
cagaaaagtctagtgaagccagaca

SEQ ID NO: 34034 - DNA, 22 bp, synthetic construct
  misc_feature 1..22: note = Synthetic Construct
  source 1..22: mol_type = other DNA
cacagacaactggagggtgaac

SEQ ID NO: 34035 - DNA, 23 bp, synthetic construct
  misc_feature 1..23: note = Synthetic Construct
  source 1..23: mol_type = other DNA
acatacctgctgtaccccaaatg

SEQ ID NO: 34036 - DNA, 24 bp, synthetic construct
  misc_feature 1..24: note = Synthetic Construct
  source 1..24: mol_type = other DNA
gcaatgaacaacgacaggctttca

SEQ ID NO: 34037 - DNA, 22 bp, synthetic construct
  misc_feature 1..22: note = Synthetic Construct
  source 1..22: mol_type = other DNA
gactgagcttgtgaggcaggaa

SEQ ID NO: 34038 - DNA, 25 bp, synthetic construct
  misc_feature 1..25: note = Synthetic Construct
  source 1..25: mol_type = other DNA
gcatactaaaggagctttggagaca

SEQ ID NO: 34039 - DNA, 19 bp, synthetic construct
  misc_feature 1..19: note = Synthetic Construct
  source 1..19: mol_type = other DNA
gccaaccaggccagcatca

SEQ ID NO: 34040 - DNA, 21 bp, synthetic construct
  misc_feature 1..21: note = Synthetic Construct
  source 1..21: mol_type = other DNA
acagagcggtacagcggaatc

SEQ ID NO: 34041 - DNA, 26 bp, synthetic construct
  misc_feature 1..26: note = Synthetic Construct
  source 1..26: mol_type = other DNA
gagaaagtgagcatttgccatgaaag

SEQ ID NO: 34042 - DNA, 26 bp, synthetic construct
  misc_feature 1..26: note = Synthetic Construct
  source 1..26: mol_type = other DNA
ggtcttaccttcagagttctgtccta

SEQ ID NO: 34043 - DNA, 27 bp, synthetic construct
  misc_feature 1..27: note = Synthetic Construct
  source 1..27: mol_type = other DNA
ggggaacatttcagaccagataacact

SEQ ID NO: 34044 - DNA, 20 bp, synthetic construct
  misc_feature 1..20: note = Synthetic Construct
  source 1..20: mol_type = other DNA
agggccaatcctggaacact

SEQ ID NO: 34045 - DNA, 29 bp, synthetic construct
  misc_feature 1..29: note = Synthetic Construct
  source 1..29: mol_type = other DNA
ccttgcaccaaaaatagaagtgtgagcta

SEQ ID NO: 34046 - DNA, 18 bp, synthetic construct
  misc_feature 1..18: note = Synthetic Construct
  source 1..18: mol_type = other DNA
actgccaagtggctgcaa

SEQ ID NO: 34047 - DNA, 22 bp, synthetic construct
  misc_feature 1..22: note = Synthetic Construct
  source 1..22: mol_type = other DNA
cacagctgaacctcaggcaatc

SEQ ID NO: 34048 - DNA, 22 bp, synthetic construct
  misc_feature 1..22: note = Synthetic Construct
  source 1..22: mol_type = other DNA
caacagccgggatcttctgaac

SEQ ID NO: 34049 - DNA, 24 bp, synthetic construct
  misc_feature 1..24: note = Synthetic Construct
  source 1..24: mol_type = other DNA
gggcctaggtgtgtgtatccagtt

SEQ ID NO: 34050 - DNA, 25 bp, synthetic construct
  misc_feature 1..25: note = Synthetic Construct
  source 1..25: mol_type = other DNA
cctgtcggaatgttttctccaccaa

SEQ ID NO: 34051 - DNA, 22 bp, synthetic construct
  misc_feature 1..22: note = Synthetic Construct
  source 1..22: mol_type = other DNA
gggtctaaggacaccgggtcta

SEQ ID NO: 34052 - DNA, 21 bp, synthetic construct
  misc_feature 1..21: note = Synthetic Construct
  source 1..21: mol_type = other DNA
tttccggtggggccaatgtgt

SEQ ID NO: 34053 - DNA, 23 bp, synthetic construct
  misc_feature 1..23: note = Synthetic Construct
  source 1..23: mol_type = other DNA
gcattgtcaggcttctctctttg

SEQ ID NO: 34054 - DNA, 25 bp, synthetic construct
  misc_feature 1..25: note = Synthetic Construct
  source 1..25: mol_type = other DNA
cagaaatcagaagctctcagggaaa

SEQ ID NO: 34055 - DNA, 24 bp, synthetic construct
  misc_feature 1..24: note = Synthetic Construct
  source 1..24: mol_type = other DNA
actcttttgcctgggatttaccat

SEQ ID NO: 34056 - DNA, 20 bp, synthetic construct
  misc_feature 1..20: note = Synthetic Construct
  source 1..20: mol_type = other DNA
atctggcccgtgctccactt

SEQ ID NO: 34057 - DNA, 19 bp, synthetic construct
  misc_feature 1..19: note = Synthetic Construct
  source 1..19: mol_type = other DNA
aacacctggggaggcaaca

SEQ ID NO: 34058 - DNA, 19 bp, synthetic construct
  misc_feature 1..19: note = Synthetic Construct
  source 1..19: mol_type = other DNA
aggcagggagcacagagat

SEQ ID NO: 34059 - DNA, 23 bp, synthetic construct
  misc_feature 1..23: note = Synthetic Construct
  source 1..23: mol_type = other DNA
ggttttggggcatagtccacagt

SEQ ID NO: 34060 - DNA, 20 bp, synthetic construct
  misc_feature 1..20: note = Synthetic Construct
  source 1..20: mol_type = other DNA
cctcccctcccagcatgaag

SEQ ID NO: 34061 - DNA, 22 bp, synthetic construct
  misc_feature 1..22: note = Synthetic Construct
  source 1..22: mol_type = other DNA
tccctgggtggtctgtctgatt

SEQ ID NO: 34062 - DNA, 22 bp, synthetic construct
  misc_feature 1..22: note = Synthetic Construct
  source 1..22: mol_type = other DNA
ccccatcccattgcttctcagt

SEQ ID NO: 34063 - DNA, 21 bp, synthetic construct
  misc_feature 1..21: note = Synthetic Construct
  source 1..21: mol_type = other DNA
tggcttcaaggtagggaggtt

SEQ ID NO: 34064 - DNA, 19 bp, synthetic construct
  misc_feature 1..19: note = Synthetic Construct
  source 1..19: mol_type = other DNA
ggagggtggcagtgtggta

SEQ ID NO: 34065 - DNA, 23 bp, synthetic construct
  misc_feature 1..23: note = Synthetic Construct
  source 1..23: mol_type = other DNA
gctgtatccagggaggtgacaag

SEQ ID NO: 34066 - DNA, 25 bp, synthetic construct
  misc_feature 1..25: note = Synthetic Construct
  source 1..25: mol_type = other DNA
cctgcgtgtcaaatactcctttcta

SEQ ID NO: 34067 - DNA, 24 bp, synthetic construct
  misc_feature 1..24: note = Synthetic Construct
  source 1..24: mol_type = other DNA
gctgttgtggttaagagcctggat

SEQ ID NO: 34068 - DNA, 23 bp, synthetic construct
  misc_feature 1..23: note = Synthetic Construct
  source 1..23: mol_type = other DNA
accaggcatagtggagataggaa

SEQ ID NO: 34069 - DNA, 20 bp, synthetic construct
  misc_feature 1..20: note = Synthetic Construct
  source 1..20: mol_type = other DNA
tgccggcctcccagtctcat

SEQ ID NO: 34070 - DNA, 19 bp, synthetic construct
  misc_feature 1..19: note = Synthetic Construct
  source 1..19: mol_type = other DNA
tgctcgggcagggtgagaa

SEQ ID NO: 34071 - DNA, 22 bp, synthetic construct
  misc_feature 1..22: note = Synthetic Construct
  source 1..22: mol_type = other DNA
ggcacccgtttggccttaattg

SEQ ID NO: 34072 - DNA, 20 bp, synthetic construct
  misc_feature 1..20: note = Synthetic Construct
  source 1..20: mol_type = other DNA
tggtgggcaggagaggctaa

SEQ ID NO: 34073 - DNA, 22 bp, synthetic construct
  misc_feature 1..22: note = Synthetic Construct
  source 1..22: mol_type = other DNA
aagtgggtgctacagaagcatt

SEQ ID NO: 34074 - DNA, 27 bp, synthetic construct
  misc_feature 1..27: note = Synthetic Construct
  source 1..27: mol_type = other DNA
gggctaagaatgagtgattgggtcata

SEQ ID NO: 34075 - DNA, 22 bp, synthetic construct
  misc_feature 1..22: note = Synthetic Construct
  source 1..22: mol_type = other DNA
ttcaggctctgagacacgaaag

SEQ ID NO: 34076 - DNA, 20 bp, synthetic construct
  misc_feature 1..20: note = Synthetic Construct
  source 1..20: mol_type = other DNA
actcctgaccgagggaatgt

SEQ ID NO: 34077 - DNA, 22 bp, synthetic construct
  misc_feature 1..22: note = Synthetic Construct
  source 1..22: mol_type = other DNA
cccaaaggaaaccatcccatgt

SEQ ID NO: 34078 - DNA, 22 bp, synthetic construct
  misc_feature 1..22: note = Synthetic Construct
  source 1..22: mol_type = other DNA
cacaggttccctcccacttact

SEQ ID NO: 34079 - DNA, 22 bp, synthetic construct
  misc_feature 1..22: note = Synthetic Construct
  source 1..22: mol_type = other DNA
agccggggaatgtcctgtattc

SEQ ID NO: 34080 - DNA, 25 bp, synthetic construct
  misc_feature 1..25: note = Synthetic Construct
  source 1..25: mol_type = other DNA
ccttctgatgcttggataccgcaaa

SEQ ID NO: 34081 - DNA, 23 bp, synthetic construct
  misc_feature 1..23: note = Synthetic Construct
  source 1..23: mol_type = other DNA
gcagatcaggattgcaggctttg

SEQ ID NO: 34082 - DNA, 21 bp, synthetic construct
  misc_feature 1..21: note = Synthetic Construct
  source 1..21: mol_type = other DNA
ggcctcagaagccaggataag

SEQ ID NO: 34083 - DNA, 22 bp, synthetic construct
  misc_feature 1..22: note = Synthetic Construct
  source 1..22: mol_type = other DNA
ggtttcgctcatgcctctgttg

SEQ ID NO: 34084 - DNA, 20 bp, synthetic construct
  misc_feature 1..20: note = Synthetic Construct
  source 1..20: mol_type = other DNA
ttcctgagagggctgtgcta

SEQ ID NO: 34085 - DNA, 21 bp, synthetic construct
  misc_feature 1..21: note = Synthetic Construct
  source 1..21: mol_type = other DNA
accagctccttcctcccttct

SEQ ID NO: 34086 - DNA, 21 bp, synthetic construct
  misc_feature 1..21: note = Synthetic Construct
  source 1..21: mol_type = other DNA
gcacagctaggaatgggaaca

SEQ ID NO: 34087 - DNA, 27 bp, synthetic construct
  misc_feature 1..27: note = Synthetic Construct
  source 1..27: mol_type = other DNA
gctaatgctcaaagggaaaagtgtctt

SEQ ID NO: 34088 - DNA, 24 bp, synthetic construct
  misc_feature 1..24: note = Synthetic Construct
  source 1..24: mol_type = other DNA
gtggcattgtggaaacaagcaaag

SEQ ID NO: 34089 - DNA, 22 bp, synthetic construct
  misc_feature 1..22: note = Synthetic Construct
  source 1..22: mol_type = other DNA
cctgccagcagggcatttttct

SEQ ID NO: 34090 - DNA, 21 bp, synthetic construct
  misc_feature 1..21: note = Synthetic Construct
  source 1..21: mol_type = other DNA
cctcagatggctgagggaaga

SEQ ID NO: 34091 - DNA, 20 bp, synthetic construct
  misc_feature 1..20: note = Synthetic Construct
  source 1..20: mol_type = other DNA
gttcaggcctgcagggaaaa

SEQ ID NO: 34092 - DNA, 26 bp, synthetic construct
  misc_feature 1..26: note = Synthetic Construct
  source 1..26: mol_type = other DNA
gggtacaaatagcctttacagcattg

SEQ ID NO: 34093 - DNA, 22 bp, synthetic construct
  misc_feature 1..22: note = Synthetic Construct
  source 1..22: mol_type = other DNA
aggcagcttaggccactagtct

SEQ ID NO: 34094 - DNA, 25 bp, synthetic construct
  misc_feature 1..25: note = Synthetic Construct
  source 1..25: mol_type = other DNA
gaactccacccagttctaaggatag

SEQ ID NO: 34095 - DNA, 22 bp, synthetic construct
  misc_feature 1..22: note = Synthetic Construct
  source 1..22: mol_type = other DNA
ccctggaagaaggagagggaat

SEQ ID NO: 34096 - DNA, 21 bp, synthetic construct
  misc_feature 1..21: note = Synthetic Construct
  source 1..21: mol_type = other DNA
agggcagtgagcactgagttg

SEQ ID NO: 34097 - DNA, 21 bp, synthetic construct
  misc_feature 1..21: note = Synthetic Construct
  source 1..21: mol_type = other DNA
atccccacggacaccaacgat

SEQ ID NO: 34098 - DNA, 21 bp, synthetic construct
  misc_feature 1..21: note = Synthetic Construct
  source 1..21: mol_type = other DNA
gcagccattccctcaccacat

SEQ ID NO: 34099 - DNA, 19 bp, synthetic construct
  misc_feature 1..19: note = Synthetic Construct
  source 1..19: mol_type = other DNA
ccccgggcaaacacatact

SEQ ID NO: 34100 - DNA, 20 bp, synthetic construct
  misc_feature 1..20: note = Synthetic Construct
  source 1..20: mol_type = other DNA
atcctggtcctgggcagtaa

SEQ ID NO: 34101 - DNA, 22 bp, synthetic construct
  misc_feature 1..22: note = Synthetic Construct
  source 1..22: mol_type = other DNA
accaggtgccagctccctatac

SEQ ID NO: 34102 - DNA, 24 bp, synthetic construct
  misc_feature 1..24: note = Synthetic Construct
  source 1..24: mol_type = other DNA
gtggagcaggactagctgagaatc

SEQ ID NO: 34103 - DNA, 23 bp, synthetic construct
  misc_feature 1..23: note = Synthetic Construct
  source 1..23: mol_type = other DNA
gccagaaatccacaccatacaag

SEQ ID NO: 34104 - DNA, 24 bp, synthetic construct
  misc_feature 1..24: note = Synthetic Construct
  source 1..24: mol_type = other DNA
ggggacagtttcaagtggatgaga

SEQ ID NO: 34105 - DNA, 21 bp, synthetic construct
  misc_feature 1..21: note = Synthetic Construct
  source 1..21: mol_type = other DNA
aggtgagggcttgaggcagtt

SEQ ID NO: 34106 - DNA, 23 bp, synthetic construct
  misc_feature 1..23: note = Synthetic Construct
  source 1..23: mol_type = other DNA
tgagggaaaccaaaactgcattc

SEQ ID NO: 34107 - DNA, 22 bp, synthetic construct
  misc_feature 1..22: note = Synthetic Construct
  source 1..22: mol_type = other DNA
aggccttttccactctccctta

SEQ ID NO: 34108 - DNA, 24 bp, synthetic construct
  misc_feature 1..24: note = Synthetic Construct
  source 1..24: mol_type = other DNA
cccttacaaaccacagatgcaaag

SEQ ID NO: 34109 - DNA, 24 bp, synthetic construct
  misc_feature 1..24: note = Synthetic Construct
  source 1..24: mol_type = other DNA
cactcttaggaagggagtgtctgt

SEQ ID NO: 34110 - DNA, 22 bp, synthetic construct
  misc_feature 1..22: note = Synthetic Construct
  source 1..22: mol_type = other DNA
atagggaagtggtgtggtcaac

SEQ ID NO: 34111 - DNA, 18 bp, synthetic construct
  misc_feature 1..18: note = Synthetic Construct
  source 1..18: mol_type = other DNA
tccctgcctgggtcttgt

SEQ ID NO: 34112 - DNA, 22 bp, synthetic construct
  misc_feature 1..22: note = Synthetic Construct
  source 1..22: mol_type = other DNA
caggagctgaggctttggtttg

SEQ ID NO: 34113 - DNA, 22 bp, synthetic construct
  misc_feature 1..22: note = Synthetic Construct
  source 1..22: mol_type = other DNA
tgttttctgtgtgccagtgtgt

SEQ ID NO: 34114 - DNA, 20 bp, synthetic construct
  misc_feature 1..20: note = Synthetic Construct
  source 1..20: mol_type = other DNA
gcagggttcaggccagtaga

SEQ ID NO: 34115 - DNA, 22 bp, synthetic construct
  misc_feature 1..22: note = Synthetic Construct
  source 1..22: mol_type = other DNA
agctgggatggagggacattga

SEQ ID NO: 34116 - DNA, 27 bp, synthetic construct
  misc_feature 1..27: note = Synthetic Construct
  source 1..27: mol_type = other DNA
ggtgtacaattgctggatcctaagaca

SEQ ID NO: 34117 - DNA, 22 bp, synthetic construct
  misc_feature 1..22: note = Synthetic Construct
  source 1..22: mol_type = other DNA
cagcctccaggcaaatttccaa

SEQ ID NO: 34118 - DNA, 23 bp, synthetic construct
  misc_feature 1..23: note = Synthetic Construct
  source 1..23: mol_type = other DNA
gcaagtttggccatctcttgtga

SEQ ID NO: 34119 - DNA, 25 bp, synthetic construct
  misc_feature 1..25: note = Synthetic Construct
  source 1..25: mol_type = other DNA
cgtccatgaaggaatagctggtgtt

SEQ ID NO: 34120 - DNA, 23 bp, synthetic construct
  misc_feature 1..23: note = Synthetic Construct
  source 1..23: mol_type = other DNA
acccggctatacgagaactcttt

SEQ ID NO: 34121 - DNA, 25 bp, synthetic construct
  misc_feature 1..25: note = Synthetic Construct
  source 1..25: mol_type = other DNA
gttcatgaaagtgaaagagccatga

SEQ ID NO: 34122 - DNA, 23 bp, synthetic construct
  misc_feature 1..23: note = Synthetic Construct
  source 1..23: mol_type = other DNA
gggacaaaatcggctccttcaga

SEQ ID NO: 34123 - DNA, 20 bp, synthetic construct
  misc_feature 1..20: note = Synthetic Construct
  source 1..20: mol_type = other DNA
atgccctgaatcgcccttgt

SEQ ID NO: 34124 - DNA, 21 bp, synthetic construct
  misc_feature 1..21: note = Synthetic Construct
  source 1..21: mol_type = other DNA
cccacacctcttgccaaggaa

SEQ ID NO: 34125 - DNA, 20 bp, synthetic construct
  misc_feature 1..20: note = Synthetic Construct
  source 1..20: mol_type = other DNA
gcccatgggtaaggcaggaa

SEQ ID NO: 34126 - DNA, 19 bp, synthetic construct
  misc_feature 1..19: note = Synthetic Construct
  source 1..19: mol_type = other DNA
actggccggtggtcctgtt

SEQ ID NO: 34127 - DNA, 22 bp, synthetic construct
  misc_feature 1..22: note = Synthetic Construct
  source 1..22: mol_type = other DNA
cgctgtcctggaagtgttgttc

SEQ ID NO: 34128 - DNA, 21 bp, synthetic construct
  misc_feature 1..21: note = Synthetic Construct
  source 1..21: mol_type = other DNA
tggcccacagaaagggtctca

SEQ ID NO: 34129 - DNA, 24 bp, synthetic construct
  misc_feature 1..24: note = Synthetic Construct
  source 1..24: mol_type = other DNA
tctctggttaacagatgccagatg

SEQ ID NO: 34130 - DNA, 22 bp, synthetic construct
  misc_feature 1..22: note = Synthetic Construct
  source 1..22: mol_type = other DNA
cccaaaaggctctgaggtcatc

SEQ ID NO: 34131 - DNA, 21 bp, synthetic construct
  misc_feature 1..21: note = Synthetic Construct
  source 1..21: mol_type = other DNA
ggacatgactccctgggacaa

SEQ ID NO: 34132 - DNA, 20 bp, synthetic construct
  misc_feature 1..20: note = Synthetic Construct
  source 1..20: mol_type = other DNA
tgtcttagctgcgcctctgt

SEQ ID NO: 34133 - DNA, 19 bp, synthetic construct
  misc_feature 1..19: note = Synthetic Construct
  source 1..19: mol_type = other DNA
gccaagggcaggtgggata

SEQ ID NO: 34134 - DNA, 25 bp, synthetic construct
  misc_feature 1..25: note = Synthetic Construct
  source 1..25: mol_type = other DNA
cctttccaactccatcatctggtta

SEQ ID NO: 34135 - DNA, 25 bp, synthetic construct
  misc_feature 1..25: note = Synthetic Construct
  source 1..25: mol_type = other DNA
cctgcctgataccttcttgatgact

SEQ ID NO: 34136 - DNA, 22 bp, synthetic construct
  misc_feature 1..22: note = Synthetic Construct
  source 1..22: mol_type = other DNA
ggcctaaaggccaaggagtgaa

SEQ ID NO: 34137 - DNA, 20 bp, synthetic construct
  misc_feature 1..20: note = Synthetic Construct
  source 1..20: mol_type = other DNA
cactgcttagcgacctgtgt

SEQ ID NO: 34138 - DNA, 20 bp, synthetic construct
  misc_feature 1..20: note = Synthetic Construct
  source 1..20: mol_type = other DNA
tggtcagcgtgaagctctgt

SEQ ID NO: 34139 - DNA, 20 bp, synthetic construct
  misc_feature 1..20: note = Synthetic Construct
  source 1..20: mol_type = other DNA
aggctccacaggaggtcatt

SEQ ID NO: 34140 - DNA, 25 bp, synthetic construct
  misc_feature 1..25: note = Synthetic Construct
  source 1..25: mol_type = other DNA
tgtgaaagaaagggcagacattgta

SEQ ID NO: 34141 - DNA, 22 bp, synthetic construct
  misc_feature 1..22: note = Synthetic Construct
  source 1..22: mol_type = other DNA
ccagtgtgggatctcaggcatt

SEQ ID NO: 34142 - DNA, 25 bp, synthetic construct
  misc_feature 1..25: note = Synthetic Construct
  source 1..25: mol_type = other DNA
gaatttactctgaccaccacaccta

SEQ ID NO: 34143 - DNA, 19 bp, synthetic construct
  misc_feature 1..19: note = Synthetic Construct
  source 1..19: mol_type = other DNA
tgctgtgtgcagggactgt

SEQ ID NO: 34144 - DNA, 22 bp, synthetic construct
  misc_feature 1..22: note = Synthetic Construct
  source 1..22: mol_type = other DNA
tcaggtgacaggtggggtaaca

SEQ ID NO: 34145 - DNA, 20 bp, synthetic construct
  misc_feature 1..20: note = Synthetic Construct
  source 1..20: mol_type = other DNA
gaaaccaactgccggagact

SEQ ID NO: 34146 - DNA, 20 bp, synthetic construct
  misc_feature 1..20: note = Synthetic Construct
  source 1..20: mol_type = other DNA
aaggaagtggccgcagtatg

SEQ ID NO: 34147 - DNA, 19 bp, synthetic construct
  misc_feature 1..19: note = Synthetic Construct
  source 1..19: mol_type = other DNA
agcgctgggccatgtcatt

SEQ ID NO: 34148 - DNA, 27 bp, synthetic construct
  misc_feature 1..27: note = Synthetic Construct
  source 1..27: mol_type = other DNA
ggttagttccctttattgccccaagat

SEQ ID NO: 34149 - DNA, 23 bp, synthetic construct
  misc_feature 1..23: note = Synthetic Construct
  source 1..23: mol_type = other DNA
gtgtgcagttggtaaaggcaaag

SEQ ID NO: 34150 - DNA, 24 bp, synthetic construct
  misc_feature 1..24: note = Synthetic Construct
  source 1..24: mol_type = other DNA
gtgattttccagcacctcccacta

SEQ ID NO: 34151 - DNA, 27 bp, synthetic construct
  misc_feature 1..27: note = Synthetic Construct
  source 1..27: mol_type = other DNA
gggaaaccctgtaataactcactctgt

SEQ ID NO: 34152 - DNA, 23 bp, synthetic construct
  misc_feature 1..23: note = Synthetic Construct
  source 1..23: mol_type = other DNA
gtcagtgcttttcatggcatctt

SEQ ID NO: 34153 - DNA, 24 bp, synthetic construct
  misc_feature 1..24: note = Synthetic Construct
  source 1..24: mol_type = other DNA
aaattactccatggtgggaagtgt

SEQ ID NO: 34154 - DNA, 22 bp, synthetic construct
  misc_feature 1..22: note = Synthetic Construct
  source 1..22: mol_type = other DNA
gcctgattgaacccctacaaca

SEQ ID NO: 34155 - DNA, 19 bp, synthetic construct
  misc_feature 1..19: note = Synthetic Construct
  source 1..19: mol_type = other DNA
cggcgtccaggagacagtt

SEQ ID NO: 34156 - DNA, 23 bp, synthetic construct
  misc_feature 1..23: note = Synthetic Construct
  source 1..23: mol_type = other DNA
ccagggtctttccaagagcattc

SEQ ID NO: 34157 - DNA, 25 bp, synthetic construct
  misc_feature 1..25: note = Synthetic Construct
  source 1..25: mol_type = other DNA
gtttctcaggataagcagctcaaac

SEQ ID NO: 34158 - DNA, 20 bp, synthetic construct
  misc_feature 1..20: note = Synthetic Construct
  source 1..20: mol_type = other DNA
tgaccaggcagagggctgat

SEQ ID NO: 34159 - DNA, 21 bp, synthetic construct
  misc_feature 1..21: note = Synthetic Construct
  source 1..21: mol_type = other DNA
ttggccacccagagcagtcat

SEQ ID NO: 34160 - DNA, 21 bp, synthetic construct
  misc_feature 1..21: note = Synthetic Construct
  source 1..21: mol_type = other DNA
gcagtgatgcgatgtgagtct

SEQ ID NO: 34161 - DNA, 27 bp, synthetic construct
  misc_feature 1..27: note = Synthetic Construct
  source 1..27: mol_type = other DNA
gaaacctaaggatatcaaagggctgat

SEQ ID NO: 34162 - DNA, 22 bp, synthetic construct
  misc_feature 1..22: note = Synthetic Construct
  source 1..22: mol_type = other DNA
caggcccaataggcccatttac

SEQ ID NO: 34163 - DNA, 22 bp, synthetic construct
  misc_feature 1..22: note = Synthetic Construct
  source 1..22: mol_type = other DNA
ctgggtcagctcaagtggattg

SEQ ID NO: 34164 - DNA, 20 bp, synthetic construct
  misc_feature 1..20: note = Synthetic Construct
  source 1..20: mol_type = other DNA
tgtgccgctgtgtgacattc

SEQ ID NO: 34165 - DNA, 22 bp, synthetic construct
  misc_feature 1..22: note = Synthetic Construct
  source 1..22: mol_type = other DNA
gcccaggcatccaatccctaag

SEQ ID NO: 34166 - DNA, 23 bp, synthetic construct
  misc_feature 1..23: note = Synthetic Construct
  source 1..23: mol_type = other DNA
tgatgtgcctctcttgttccaat

SEQ ID NO: 34167 - DNA, 21 bp, synthetic construct
  misc_feature 1..21: note = Synthetic Construct
  source 1..21: mol_type = other DNA
aggaactctggggagatgcaa

SEQ ID NO: 34168 - DNA, 22 bp, synthetic construct
  misc_feature 1..22: note = Synthetic Construct
  source 1..22: mol_type = other DNA
cgttgctgcaatcaaggtgttg

SEQ ID NO: 34169 - DNA, 25 bp, synthetic construct
  misc_feature 1..25: note = Synthetic Construct
  source 1..25: mol_type = other DNA
gacacctcctctatcctgtggaatg

SEQ ID NO: 34170 - DNA, 25 bp, synthetic construct
  misc_feature 1..25: note = Synthetic Construct
  source 1..25: mol_type = other DNA
aaaggtaatgtccattcggctagat

SEQ ID NO: 34171 - DNA, 29 bp, synthetic construct
  misc_feature 1..29: note = Synthetic Construct
  source 1..29: mol_type = other DNA
cggagaaaattggttttcctatcggtgtt

SEQ ID NO: 34172 - DNA, 20 bp, synthetic construct
  misc_feature 1..20: note = Synthetic Construct
  source 1..20: mol_type = other DNA
gcactaaacgccagggtgat

SEQ ID NO: 34173 - DNA, 21 bp, synthetic construct
  misc_feature 1..21: note = Synthetic Construct
  source 1..21: mol_type = other DNA
aaaggggacctgccaccttca

SEQ ID NO: 34174 - DNA, 22 bp, synthetic construct
  misc_feature 1..22: note = Synthetic Construct
  source 1..22: mol_type = other DNA
tggtgtcagcctcgttccttct

SEQ ID NO: 34175 - DNA, 20 bp, synthetic construct
  misc_feature 1..20: note = Synthetic Construct
  source 1..20: mol_type = other DNA
caccacacaggtgcatcaca

SEQ ID NO: 34176 - DNA, 22 bp, synthetic construct
  misc_feature 1..22: note = Synthetic Construct
  source 1..22: mol_type = other DNA
cccattgccaaaagcaaactgt

SEQ ID NO: 34177 - DNA, 20 bp, synthetic construct
  misc_feature 1..20: note = Synthetic Construct
  source 1..20: mol_type = other DNA
agggccacagcagaggagat

SEQ ID NO: 34178 - DNA, 23 bp, synthetic construct
  misc_feature 1..23: note = Synthetic Construct
  source 1..23: mol_type = other DNA
ctgcgtttgtgttcaggctaaag

SEQ ID NO: 34179 - DNA, 21 bp, synthetic construct
  misc_feature 1..21: note = Synthetic Construct
  source 1..21: mol_type = other DNA
atgttcccaggccctgctctt

SEQ ID NO: 34180 - DNA, 20 bp, synthetic construct
  misc_feature 1..20: note = Synthetic Construct
  source 1..20: mol_type = other DNA
cacgcggaactagcaaccta

SEQ ID NO: 34181 - DNA, 21 bp, synthetic construct
  misc_feature 1..21: note = Synthetic Construct
  source 1..21: mol_type = other DNA
atgtgctgcctaccccacttg

SEQ ID NO: 34182 - DNA, 18 bp, synthetic construct
  misc_feature 1..18: note = Synthetic Construct
  source 1..18: mol_type = other DNA
tgggtgcaccaggagtgt

SEQ ID NO: 34183 - DNA, 25 bp, synthetic construct
  misc_feature 1..25: note = Synthetic Construct
  source 1..25: mol_type = other DNA
ctcagggactaagtgtctctgacaa

SEQ ID NO: 34184 - DNA, 28 bp, synthetic construct
  misc_feature 1..28: note = Synthetic Construct
  source 1..28: mol_type = other DNA
cctaaatacagggagtgggatgtagaag

SEQ ID NO: 34185 - DNA, 23 bp, synthetic construct
  misc_feature 1..23: note = Synthetic Construct
  source 1..23: mol_type = other DNA
gcttcctccaccccgtgattaag

SEQ ID NO: 34186 - DNA, 22 bp, synthetic construct
  misc_feature 1..22: note = Synthetic Construct
  source 1..22: mol_type = other DNA
ggagaacctccgaccacagaaa

SEQ ID NO: 34187 - DNA, 20 bp, synthetic construct
  misc_feature 1..20: note = Synthetic Construct
  source 1..20: mol_type = other DNA
agtccccagggaggcagctt

SEQ ID NO: 34188 - DNA, 18 bp, synthetic construct
  misc_feature 1..18: note = Synthetic Construct
  source 1..18: mol_type = other DNA
accccagagcctgctgtt

SEQ ID NO: 34189 - DNA, 23 bp, synthetic construct
  misc_feature 1..23: note = Synthetic Construct
  source 1..23: mol_type = other DNA
ctcgagctgaacacttgtgtgat

SEQ ID NO: 34190 - DNA, 19 bp, synthetic construct
  misc_feature 1..19: note = Synthetic Construct
  source 1..19: mol_type = other DNA
tggaagggacgcccgcaat

SEQ ID NO: 34191 - DNA, 22 bp, synthetic construct
  misc_feature 1..22: note = Synthetic Construct
  source 1..22: mol_type = other DNA
atttggcctggaggggctgagt

SEQ ID NO: 34192 - DNA, 22 bp, synthetic construct
  misc_feature 1..22: note = Synthetic Construct
  source 1..22: mol_type = other DNA
gaagtcagtggtcagagcatca

SEQ ID NO: 34193 - DNA, 22 bp, synthetic construct
  misc_feature 1..22: note = Synthetic Construct
  source 1..22: mol_type = other DNA
caccgtgtctctaagggtcagt

SEQ ID NO: 34194 - DNA, 24 bp, synthetic construct
  misc_feature 1..24: note = Synthetic Construct
  source 1..24: mol_type = other DNA
ggagccacagaattagcacagtca

SEQ ID NO: 34195 - DNA, 24 bp, synthetic construct
  misc_feature 1..24: note = Synthetic Construct
  source 1..24: mol_type = other DNA
cagatttggctggcatttcagaag

SEQ ID NO: 34196 - DNA, 24 bp, synthetic construct
  misc_feature 1..24: note = Synthetic Construct
  source 1..24: mol_type = other DNA
cctgtctgcttttgtgtcaacagt

SEQ ID NO: 34197 - DNA, 20 bp, synthetic construct
  misc_feature 1..20: note = Synthetic Construct
  source 1..20: mol_type = other DNA
agagaggtgagacggtgcaa

SEQ ID NO: 34198 - DNA, 21 bp, synthetic construct
  misc_feature 1..21: note = Synthetic Construct
  source 1..21: mol_type = other DNA
cgacaggggagcaggagagat

SEQ ID NO: 34199 - DNA, 24 bp, synthetic construct
  misc_feature 1..24: note = Synthetic Construct
  source 1..24: mol_type = other DNA
gctggatggtctaggatggcttca

SEQ ID NO: 34200 - DNA, 22 bp, synthetic construct
  misc_feature 1..22: note = Synthetic Construct
  source 1..22: mol_type = other DNA
ccaacttcagcacatgcacttc

SEQ ID NO: 34201 - DNA, 20 bp, synthetic construct
  misc_feature 1..20: note = Synthetic Construct
  source 1..20: mol_type = other DNA
gcacgcacctcttgcaaatc

SEQ ID NO: 34202 - DNA, 26 bp, synthetic construct
  misc_feature 1..26: note = Synthetic Construct
  source 1..26: mol_type = other DNA
cacaccttttctcaggtacaccttca

SEQ ID NO: 34203 - DNA, 19 bp, synthetic construct
  misc_feature 1..19: note = Synthetic Construct
  source 1..19: mol_type = other DNA
tggcgtctgcactcactca

SEQ ID NO: 34204 - DNA, 20 bp, synthetic construct
  misc_feature 1..20: note = Synthetic Construct
  source 1..20: mol_type = other DNA
gctatgaggcagtgcgtgtt

SEQ ID NO: 34205 - DNA, 20 bp, synthetic construct
  misc_feature 1..20: note = Synthetic Construct
  source 1..20: mol_type = other DNA
agatggggcagcagcattca

SEQ ID NO: 34206 - DNA, 24 bp, synthetic construct
  misc_feature 1..24: note = Synthetic Construct
  source 1..24: mol_type = other DNA
ctcatgacctttgcatttgctgat

SEQ ID NO: 34207 - DNA, 20 bp, synthetic construct
  misc_feature 1..20: note = Synthetic Construct
  source 1..20: mol_type = other DNA
tgcctcccactcttggtgtt

SEQ ID NO: 34208 - DNA, 22 bp, synthetic construct
  misc_feature 1..22: note = Synthetic Construct
  source 1..22: mol_type = other DNA
ggcttctgcacccctaagtttg

SEQ ID NO: 34209 - DNA, 20 bp, synthetic construct
  misc_feature 1..20: note = Synthetic Construct
  source 1..20: mol_type = other DNA
cttgctgtgccccttccaat

SEQ ID NO: 34210 - DNA, 22 bp, synthetic construct
  misc_feature 1..22: note = Synthetic Construct
  source 1..22: mol_type = other DNA
agtacaggccacaggggatgaa

SEQ ID NO: 34211 - DNA, 23 bp, synthetic construct
  misc_feature 1..23: note = Synthetic Construct
  source 1..23: mol_type = other DNA
aaaagccacaaagatgggtcaag

SEQ ID NO: 34212 - DNA, 22 bp, synthetic construct
  misc_feature 1..22: note = Synthetic Construct
  source 1..22: mol_type = other DNA
gcagccctgaattggaagttct

SEQ ID NO: 34213 - DNA, 21 bp, synthetic construct
  misc_feature 1..21: note = Synthetic Construct
  source 1..21: mol_type = other DNA
cccattcccacagagcaggaa

SEQ ID NO: 34214 - DNA, 22 bp, synthetic construct
  misc_feature 1..22: note = Synthetic Construct
  source 1..22: mol_type = other DNA
cccacaggagcaggtgttttag

SEQ ID NO: 34215 - DNA, 24 bp, synthetic construct
  misc_feature 1..24: note = Synthetic Construct
  source 1..24: mol_type = other DNA
cagtaaatggtgaggccacagttg

SEQ ID NO: 34216 - DNA, 20 bp, synthetic construct
  misc_feature 1..20: note = Synthetic Construct
  source 1..20: mol_type = other DNA
accaaccagtggacccagat

SEQ ID NO: 34217 - DNA, 30 bp, synthetic construct; identical to SEQ ID NO: 2991
  misc_feature 1..30: note = Synthetic Construct
  source 1..30: mol_type = other DNA

SEQ ID NO: 34218 - DNA, 23 bp, synthetic construct
  misc_feature 1..23: note = Synthetic Construct
  source 1..23: mol_type = other DNA
ggtccttccatgtccctcagtct

SEQ ID NO: 34219 - DNA, 20 bp, synthetic construct
  misc_feature 1..20: note = Synthetic Construct
  source 1..20: mol_type = other DNA
tcctgtggctgaaggacaga

SEQ ID NO: 34220 - DNA, 20 bp, synthetic construct
  misc_feature 1..20: note = Synthetic Construct
  source 1..20: mol_type = other DNA
aactgagcgaggggctttgt

SEQ ID NO: 34221 - DNA, 19 bp, synthetic construct
  misc_feature 1..19: note = Synthetic Construct
  source 1..19: mol_type = other DNA
ggagccacaggggatggaa

SEQ ID NO: 34222 - DNA, 20 bp, synthetic construct
  misc_feature 1..20: note = Synthetic Construct
  source 1..20: mol_type = other DNA
tccagcaggctgaggcattg

SEQ ID NO: 34223 - DNA, 20 bp, synthetic construct
  misc_feature 1..20: note = Synthetic Construct
  source 1..20: mol_type = other DNA
tcctggtccgggagaacgat

SEQ ID NO: 34224 - DNA, 20 bp, synthetic construct
  misc_feature 1..20: note = Synthetic Construct
  source 1..20: mol_type = other DNA
agggaagcctgcatgtctct

SEQ ID NO: 34225 - DNA, 22 bp, synthetic construct
  misc_feature 1..22: note = Synthetic Construct
  source 1..22: mol_type = other DNA
gtctggaacccgcacaacttac

SEQ ID NO: 34226 - DNA, 23 bp, synthetic construct
  misc_feature 1..23: note = Synthetic Construct
  source 1..23: mol_type = other DNA
tgggtttttccaccatagcaaga

SEQ ID NO: 34227 - DNA, 19 bp, synthetic construct
  misc_feature 1..19: note = Synthetic Construct
  source 1..19: mol_type = other DNA
ggaccgcacggtgtcttct

SEQ ID NO: 34228 - DNA, 20 bp, synthetic construct
  misc_feature 1..20: note = Synthetic Construct
  source 1..20: mol_type = other DNA
ggtgggtcccttgtgagcat

SEQ ID NO: 34229 - DNA, 24 bp, synthetic construct
  misc_feature 1..24: note = Synthetic Construct
  source 1..24: mol_type = other DNA
cacctcgttcatatccaggtgagt

SEQ ID NO: 34230 - DNA, 20 bp, synthetic construct
  misc_feature 1..20: note = Synthetic Construct
  source 1..20: mol_type = other DNA
tggaactgcaccagcacaga

SEQ ID NO: 34231 - DNA, 19 bp, synthetic construct
  misc_feature 1..19: note = Synthetic Construct
  source 1..19: mol_type = other DNA
gtaccctccagcccaggaa

SEQ ID NO: 34232 - DNA, 20 bp, synthetic construct
  misc_feature 1..20: note = Synthetic Construct
  source 1..20: mol_type = other DNA
aggaggggctcagcatggat

SEQ ID NO: 34233 - DNA, 19 bp, synthetic construct
  misc_feature 1..19: note = Synthetic Construct
  source 1..19: mol_type = other DNA
tggacgtgcagacctcaca

SEQ ID NO: 34234 - DNA, 24 bp, synthetic construct
  misc_feature 1..24: note = Synthetic Construct
  source 1..24: mol_type = other DNA
tcaaggaaatgcagtggtatgtgt

SEQ ID NO: 34235 - DNA, 25 bp, synthetic construct
  misc_feature 1..25: note = Synthetic Construct
  source 1..25: mol_type = other DNA
gggcagtgggtaagaagaacccatt

SEQ ID NO: 34236 - DNA, 20 bp, synthetic construct
  misc_feature 1..20: note = Synthetic Construct
  source 1..20: mol_type = other DNA
taggccacggagccacttta

SEQ ID NO: 34237 - DNA, 24 bp, synthetic construct
  misc_feature 1..24: note = Synthetic Construct
  source 1..24: mol_type = other DNA
cgcttctgtttaatgccttagcaa

SEQ ID NO: 34238 - DNA, 25 bp, synthetic construct
  misc_feature 1..25: note = Synthetic Construct
  source 1..25: mol_type = other DNA
gggcgagtttcagaacaagggaaag

SEQ ID NO: 34239 - DNA, 24 bp, synthetic construct
  misc_feature 1..24: note = Synthetic Construct
  source 1..24: mol_type = other DNA
ctgtatctgtgggcttttccttca

SEQ ID NO: 34240 - DNA, 23 bp, synthetic construct
  misc_feature 1..23: note = Synthetic Construct
  source 1..23: mol_type = other DNA
tctatcccatggaagggcaaaag

SEQ ID NO: 34241 - DNA, 25 bp, synthetic construct
  misc_feature 1..25: note = Synthetic Construct
  source 1..25: mol_type = other DNA
tcaaaacagagtctcactgtcactt

SEQ ID NO: 34242 - DNA, 20 bp, synthetic construct
  misc_feature 1..20: note = Synthetic Construct
  source 1..20: mol_type = other DNA
ggccctctctgggcactttg

SEQ ID NO: 34243 - DNA, 21 bp, synthetic construct
  misc_feature 1..21: note = Synthetic Construct
  source 1..21: mol_type = other DNA
cctcatattgctccgccacaa

SEQ ID NO: 34244 - DNA, 20 bp, synthetic construct
  misc_feature 1..20: note = Synthetic Construct
  source 1..20: mol_type = other DNA
ccttgttctccggcgatgtt

SEQ ID NO: 34245 - DNA, 27 bp, synthetic construct
  misc_feature 1..27: note = Synthetic Construct
  source 1..27: mol_type = other DNA
ctgatgtgtaccccgaaatcattgaac

SEQ ID NO: 34246 - DNA, 25 bp, synthetic construct
  misc_feature 1..25: note = Synthetic Construct
  source 1..25: mol_type = other DNA
ggctcctccatttccttccacctaa

SEQ ID NO: 34247 - DNA, 26 bp, synthetic construct
  misc_feature 1..26: note = Synthetic Construct
  source 1..26: mol_type = other DNA
cacatcagaaacgtttgggctgatac

SEQ ID NO: 34248 - DNA, 21 bp, synthetic construct
  misc_feature 1..21: note = Synthetic Construct
  source 1..21: mol_type = other DNA
tcgggccagcccagatttact

SEQ ID NO: 34249 - DNA, 25 bp, synthetic construct
  misc_feature 1..25: note = Synthetic Construct
  source 1..25: mol_type = other DNA
caagaatttccctgtctggaaccaa

SEQ ID NO: 34250 - DNA, 22 bp, synthetic construct
  misc_feature 1..22: note = Synthetic Construct
  source 1..22: mol_type = other DNA
ggccagcccagagtagtaacaa

SEQ ID NO: 34251 - DNA, 22 bp, synthetic construct
  misc_feature 1..22: note = Synthetic Construct
  source 1..22: mol_type = other DNA
gacagagggctaaggtcagcaa

SEQ ID NO: 34252 - DNA, 21 bp, synthetic construct
  misc_feature 1..21: note = Synthetic Construct
  source 1..21: mol_type = other DNA
cagccatcaccacagaagtca

SEQ ID NO: 34253 - DNA, 20 bp, synthetic construct
  misc_feature 1..20: note = Synthetic Construct
  source 1..20: mol_type = other DNA
tgccaggtgctggagaaaga

SEQ ID NO: 34254 - DNA, 25 bp, synthetic construct
  misc_feature 1..25: note = Synthetic Construct
  source 1..25: mol_type = other DNA
agcatacccttagctctacttcaca

SEQ ID NO: 34255 - DNA, 24 bp, synthetic construct
  misc_feature 1..24: note = Synthetic Construct
  source 1..24: mol_type = other DNA
cctttgttgttgctcttccagttc

SEQ ID NO: 34256 - DNA, 20 bp, synthetic construct
  misc_feature 1..20: note = Synthetic Construct
  source 1..20: mol_type = other DNA
cagtttccccagccttgctt

SEQ ID NO: 34257 - DNA, 20 bp, synthetic construct
  misc_feature 1..20: note = Synthetic Construct
  source 1..20: mol_type = other DNA
ttcactgaggggcagggaat

SEQ ID NO: 34258 - DNA, 28 bp, synthetic construct
  misc_feature 1..28: note = Synthetic Construct
  source 1..28: mol_type = other DNA
ggccaacttggtgtaaaaatcccttgaa

SEQ ID NO: 34259 - DNA, 24 bp, synthetic construct
  misc_feature 1..24: note = Synthetic Construct
  source 1..24: mol_type = other DNA
gagttaccagtgaggtgtggaaac

SEQ ID NO: 34260 - DNA, 20 bp, synthetic construct
  misc_feature 1..20: note = Synthetic Construct
  source 1..20: mol_type = other DNA
cgcctccacggcttgattga

SEQ ID NO: 34261 - DNA, 29 bp, synthetic construct
  misc_feature 1..29: note = Synthetic Construct
  source 1..29: mol_type = other DNA
ggcaccaacactaaaaatcaacccgaaga

SEQ ID NO: 34262 - DNA, 22 bp, synthetic construct
  misc_feature 1..22: note = Synthetic Construct
  source 1..22: mol_type = other DNA
tgctttcttgggcatgggaata

SEQ ID NO: 34263 - DNA, 22 bp, synthetic construct
  misc_feature 1..22: note = Synthetic Construct
  source 1..22: mol_type = other DNA
aagcctgagggcaggagacttg

SEQ ID NO: 34264 - DNA, 24 bp, synthetic construct
  misc_feature 1..24: note = Synthetic Construct
  source 1..24: mol_type = other DNA
gcagaatagccagcagttttgaag

SEQ ID NO: 34265 - DNA, 23 bp, synthetic construct
  misc_feature 1..23: note = Synthetic Construct
  source 1..23: mol_type = other DNA
gcagctacttgcaaggtctgagt

SEQ ID NO: 34266 - DNA, 24 bp, synthetic construct
  misc_feature 1..24: note = Synthetic Construct
  source 1..24: mol_type = other DNA
cctccattctggatgccacttttg

SEQ ID NO: 34267 - DNA, 23 bp, synthetic construct
  misc_feature 1..23: note = Synthetic Construct
  source 1..23: mol_type = other DNA
gcacttcaccaagctctgtctca

SEQ ID NO: 34268 - DNA, 24 bp, synthetic construct
  misc_feature 1..24: note = Synthetic Construct
  source 1..24: mol_type = other DNA
ggcgtggaaggatgtctaacaagt

SEQ ID NO: 34269 - DNA, 20 bp, synthetic construct
  misc_feature 1..20: note = Synthetic Construct
  source 1..20: mol_type = other DNA
ccaaatgggcaggtgggaaa

SEQ ID NO: 34270 - DNA, 20 bp, synthetic construct
  misc_feature 1..20: note = Synthetic Construct
  source 1..20: mol_type = other DNA
actcctgggctcaagcaatc

SEQ ID NO: 34271 - DNA, 21 bp, synthetic construct
  misc_feature 1..21: note = Synthetic Construct
  source 1..21: mol_type = other DNA
ctgcattgtcagtccctctgt

SEQ ID NO: 34272 - DNA, 24 bp, synthetic construct
  misc_feature 1..24: note = Synthetic Construct
  source 1..24: mol_type = other DNA
gcagaagttatagcagggatgaca

SEQ ID NO: 34273 - DNA, 23 bp, synthetic construct
  misc_feature 1..23: note = Synthetic Construct
  source 1..23: mol_type = other DNA
ccagcaacctttttggagtgttt

SEQ ID NO: 34274 - DNA, 23 bp, synthetic construct
  misc_feature 1..23: note = Synthetic Construct
  source 1..23: mol_type = other DNA
aacagcttgatgtcttccctgaa

SEQ ID NO: 34275 - DNA, 25 bp, synthetic construct
  misc_feature 1..25: note = Synthetic Construct
  source 1..25: mol_type = other DNA
ggacagaacaatatcctggtgagaa

SEQ ID NO: 34276 - DNA, 24 bp, synthetic construct
  misc_feature 1..24: note = Synthetic Construct
  source 1..24: mol_type = other DNA
ccaccagagcaggtcttctacaac

SEQ ID NO: 34277 - DNA, 25 bp, synthetic construct
  misc_feature 1..25: note = Synthetic Construct
  source 1..25: mol_type = other DNA
ccaaatgtgaggatcaacccaggaa

SEQ ID NO: 34278 - DNA, 24 bp, synthetic construct
  misc_feature 1..24: note = Synthetic Construct
  source 1..24: mol_type = other DNA
ggagctaaggccagaaggtagttc

SEQ ID NO: 34279 - DNA, 20 bp, synthetic construct
  misc_feature 1..20: note = Synthetic Construct
  source 1..20: mol_type = other DNA
acagagtgggctggcacata

SEQ ID NO: 34280 - DNA, 20 bp, synthetic construct
  misc_feature 1..20: note = Synthetic Construct
  source 1..20: mol_type = other DNA
gtgtgttcagggcgacaaca

SEQ ID NO: 34281 - DNA, 20 bp, synthetic construct
  misc_feature 1..20: note = Synthetic Construct
  source 1..20: mol_type = other DNA
gccgcccctctcttttctca

SEQ ID NO: 34282 - DNA, 20 bp, synthetic construct
  misc_feature 1..20: note = Synthetic Construct
  source 1..20: mol_type = other DNA
gaatggggctgcactgcata

SEQ ID NO: 34283 - DNA, 24 bp, synthetic construct
  misc_feature 1..24: note = Synthetic Construct
  source 1..24: mol_type = other DNA
ttcaccacactagtaaggcaaagt

SEQ ID NO: 34284 - DNA, 27 bp, synthetic construct
  misc_feature 1..27: note = Synthetic Construct
  source 1..27: mol_type = other DNA
gtgagaatccattggaaatctgagcat

SEQ ID NO: 34285 - DNA, 26 bp, synthetic construct
  misc_feature 1..26: note = Synthetic Construct
  source 1..26: mol_type = other DNA
gggccctgaataaccaatagcgatac

SEQ ID NO: 34286 - DNA, 21 bp, synthetic construct
  misc_feature 1..21: note = Synthetic Construct
  source 1..21: mol_type = other DNA
gccaggagaggaaggccattt

SEQ ID NO: 34287 - DNA, 20 bp, synthetic construct
  misc_feature 1..20: note = Synthetic Construct
  source 1..20: mol_type = other DNA
caaagctgcccttggtctgt

SEQ ID NO: 34288 - DNA, 27 bp, synthetic construct
  misc_feature 1..27: note = Synthetic Construct
  source 1..27: mol_type = other DNA
ggccttaaagaggacatcgagagaaag

SEQ ID NO: 34289 - DNA, 21 bp, synthetic construct
  misc_feature 1..21: note = Synthetic Construct
  source 1..21: mol_type = other DNA
tatggctccaccctgcctaac

SEQ ID NO: 34290 - DNA, 22 bp, synthetic construct
  misc_feature 1..22: note = Synthetic Construct
  source 1..22: mol_type = other DNA
gggtggtgaggtttggtggaaa

SEQ ID NO: 34291 - DNA, 24 bp, synthetic construct
  misc_feature 1..24: note = Synthetic Construct
  source 1..24: mol_type = other DNA
ggagacaaacagaccaagcgaaca

SEQ ID NO: 34292 - DNA, 22 bp, synthetic construct
  misc_feature 1..22: note = Synthetic Construct
  source 1..22: mol_type = other DNA
gctctctcactgggatggacta

SEQ ID NO: 34293 - DNA, 27 bp, synthetic construct
  misc_feature 1..27: note = Synthetic Construct
  source 1..27: mol_type = other DNA
acaacctaggaagaattagggcttttc

SEQ ID NO: 34294 - DNA, 21 bp, synthetic construct
  misc_feature 1..21: note = Synthetic Construct
  source 1..21: mol_type = other DNA
cctaccccaggacagaagcat

SEQ ID NO: 34295 - DNA, 25 bp, synthetic construct
  misc_feature 1..25: note = Synthetic Construct
  source 1..25: mol_type = other DNA
gtcaaggataggcaagagacgaagt

SEQ ID NO: 34296 - DNA, 21 bp, synthetic construct
  misc_feature 1..21: note = Synthetic Construct
  source 1..21: mol_type = other DNA
ctgaagcaagctgggtgaagt

SEQ ID NO: 34297 - DNA, 24 bp, synthetic construct
  misc_feature 1..24: note = Synthetic Construct
  source 1..24: mol_type = other DNA
ggtccccaaattctctgccagttg

SEQ ID NO: 34298 - DNA, 23 bp, synthetic construct
  misc_feature 1..23: note = Synthetic Construct
  source 1..23: mol_type = other DNA
ccggaaagaatcggcctccttag

SEQ ID NO: 34299 - DNA, 25 bp, synthetic construct
  misc_feature 1..25: note = Synthetic Construct
  source 1..25: mol_type = other DNA
gaaaaagagctgaacaaacggaaac

SEQ ID NO: 34300 - DNA, 20 bp, synthetic construct
  misc_feature 1..20: note = Synthetic Construct
  source 1..20: mol_type = other DNA
tgctgctccagccataggtt

SEQ ID NO: 34301 - DNA, 20 bp, synthetic construct
  misc_feature 1..20: note = Synthetic Construct
  source 1..20: mol_type = other DNA
aacaccctgggaggcatagt

SEQ ID NO: 34302 - DNA, 22 bp, synthetic construct
  misc_feature 1..22: note = Synthetic Construct
  source 1..22: mol_type = other DNA
ggccctccaaactcatggaagt

SEQ ID NO: 34303 - DNA, 24 bp, synthetic construct
  misc_feature 1..24: note = Synthetic Construct
  source 1..24: mol_type = other DNA
gctctcacaaaggaggttcaaaga

SEQ ID NO: 34304 - DNA, 25 bp, synthetic construct
  misc_feature 1..25: note = Synthetic Construct
  source 1..25: mol_type = other DNA
catgcctatctcccttagtcctact

SEQ ID NO: 34305 - DNA, 21 bp, synthetic construct
  misc_feature 1..21: note = Synthetic Construct
  source 1..21: mol_type = other DNA
agtcagctcaggggtgacctt

SEQ ID NO: 34306 - DNA, 21 bp, synthetic construct
  misc_feature 1..21: note = Synthetic Construct
  source 1..21: mol_type = other DNA
ccacagcactgactgccatct

SEQ ID NO: 34307 - DNA, 24 bp, synthetic construct
  misc_feature 1..24: note = Synthetic Construct
  source 1..24: mol_type = other DNA
acatgctgaaagccaaaacctcta

SEQ ID NO: 34308 - DNA, 24 bp, synthetic construct
  misc_feature 1..24: note = Synthetic Construct
  source 1..24: mol_type = other DNA
cagaatagcacagagtgtcacaga

SEQ ID NO: 34309 - DNA, 22 bp, synthetic construct
  misc_feature 1..22: note = Synthetic Construct
  source 1..22: mol_type = other DNA
ccacatcctgccataggagcta

SEQ ID NO: 34310 - DNA, 20 bp, synthetic construct
  misc_feature 1..20: note = Synthetic Construct
  source 1..20: mol_type = other DNA
tagggcaaagagcgcctagt

SEQ ID NO: 34311 - DNA, 27 bp, synthetic construct
  misc_feature 1..27: note = Synthetic Construct
  source 1..27: mol_type = other DNA
ggaattctgtaagctaagaagccaagt

SEQ ID NO: 34312 - DNA, 20 bp, synthetic construct
  misc_feature 1..20: note = Synthetic Construct
  source 1..20: mol_type = other DNA
gctcccaaccccagaacact

SEQ ID NO: 34313 - DNA, 22 bp, synthetic construct
  misc_feature 1..22: note = Synthetic Construct
  source 1..22: mol_type = other DNA
ggcattccagcagtgaccatag

SEQ ID NO: 34314 - DNA, 23 bp, synthetic construct
  misc_feature 1..23: note = Synthetic Construct
  source 1..23: mol_type = other DNA
ccatgggcacaatccaagcctat

SEQ ID NO: 34315 - DNA, 19 bp, synthetic construct
  misc_feature 1..19: note = Synthetic Construct
  source 1..19: mol_type = other DNA
ggggccctttctggaggta

SEQ ID NO: 34316 - DNA, 19 bp, synthetic construct
  misc_feature 1..19: note = Synthetic Construct
  source 1..19: mol_type = other DNA
aacggcaggtgagcagtct

SEQ ID NO: 34317 - DNA, 25 bp, synthetic construct
  misc_feature 1..25: note = Synthetic Construct
  source 1..25: mol_type = other DNA
gtggttgctttcaccctacttcttc

SEQ ID NO: 34318 - DNA, 21 bp, synthetic construct
  misc_feature 1..21: note = Synthetic Construct
  source 1..21: mol_type = other DNA
gactcctggcttggaacagaa

SEQ ID NO: 34319 - DNA, 27 bp, synthetic construct
  misc_feature 1..27: note = Synthetic Construct
  source 1..27: mol_type = other DNA
gcaaagatgacataagcaaaggcttga

SEQ ID NO: 34320 - DNA, 25 bp, synthetic construct
  misc_feature 1..25: note = Synthetic Construct
  source 1..25: mol_type = other DNA
ggagtatcactttagcactggagtt

SEQ ID NO: 34321 - DNA, 20 bp, synthetic construct
  misc_feature 1..20: note = Synthetic Construct
  source 1..20: mol_type = other DNA
aggatcggtcaggccagtgt

SEQ ID NO: 34322 - DNA, 18 bp, synthetic construct
  misc_feature 1..18: note = Synthetic Construct
  source 1..18: mol_type = other DNA
tccaagccaccgccatca

SEQ ID NO: 34323 - DNA, 26 bp, synthetic construct
  misc_feature 1..26: note = Synthetic Construct
  source 1..26: mol_type = other DNA
cctccactctaccaaagcttataaca

SEQ ID NO: 34324 - DNA, 21 bp, synthetic construct
  misc_feature 1..21: note = Synthetic Construct
  source 1..21: mol_type = other DNA
tacgctgaccaccctgacact

SEQ ID NO: 34325 - DNA, 23 bp, synthetic construct
  misc_feature 1..23: note = Synthetic Construct
  source 1..23: mol_type = other DNA
gtgggtactactctgtgcaggaa

SEQ ID NO: 34326 - DNA, 25 bp, synthetic construct
  misc_feature 1..25: note = Synthetic Construct
  source 1..25: mol_type = other DNA
tgaggcatttgagtcaaggtgatac

SEQ ID NO: 34327 - DNA, 20 bp, synthetic construct
  misc_feature 1..20: note = Synthetic Construct
  source 1..20: mol_type = other DNA
tgcctgggttaaggcgcata

SEQ ID NO: 34328 - DNA, 29 bp, synthetic construct
  misc_feature 1..29: note = Synthetic Construct
  source 1..29: mol_type = other DNA
gggaaccttactgatcactagtacaaaac

SEQ ID NO: 34329 - DNA, 22 bp, synthetic construct
  misc_feature 1..22: note = Synthetic Construct
  source 1..22: mol_type = other DNA
ctcctgacacatgcccagtaaa

SEQ ID NO: 34330 - DNA, 19 bp, synthetic construct
  misc_feature 1..19: note = Synthetic Construct
  source 1..19: mol_type = other DNA
agtgtggggccacctggaa

SEQ ID NO: 34331 - DNA, 21 bp, synthetic construct
  misc_feature 1..21: note = Synthetic Construct
  source 1..21: mol_type = other DNA
atgtccggtcggaggtacagt

SEQ ID NO: 34332 - DNA, 23 bp, synthetic construct
  misc_feature 1..23: note = Synthetic Construct
  source 1..23: mol_type = other DNA
aatactgccctccccggactaca

SEQ ID NO: 34333 - DNA, 22 bp, synthetic construct
  misc_feature 1..22: note = Synthetic Construct
  source 1..22: mol_type = other DNA
cactgcagcaaaggctttcaac

SEQ ID NO: 34334 - DNA, 23 bp, synthetic construct
  misc_feature 1..23: note = Synthetic Construct
  source 1..23: mol_type = other DNA
ctcagctctgtgcctggataatg

SEQ ID NO: 34335 - DNA, 25 bp, synthetic construct
  misc_feature 1..25: note = Synthetic Construct
  source 1..25: mol_type = other DNA
ctgatgaattgctggggtggttaag

SEQ ID NO: 34336 - DNA, 26 bp, synthetic construct
  misc_feature 1..26: note = Synthetic Construct
  source 1..26: mol_type = other DNA
ggtttaggtcctccatagtgagcata

SEQ ID NO: 34337 - DNA, 25 bp, synthetic construct
  misc_feature 1..25: note = Synthetic Construct
  source 1..25: mol_type = other DNA
cgggttctttcttgacaggggatct

SEQ ID NO: 34338 - DNA, 20 bp, synthetic construct
  misc_feature 1..20: note = Synthetic Construct
  source 1..20: mol_type = other DNA
aggcttcccctggtgactgt

SEQ ID NO: 34339 - DNA, 20 bp, synthetic construct
  misc_feature 1..20: note = Synthetic Construct
  source 1..20: mol_type = other DNA
agagctggcaggctcaagta

SEQ ID NO: 34340 - DNA, 20 bp, synthetic construct
  misc_feature 1..20: note = Synthetic Construct
  source 1..20: mol_type = other DNA
ctggggcctgcagtttgatt

SEQ ID NO: 34341 - DNA, 22 bp, synthetic construct
  misc_feature 1..22: note = Synthetic Construct
  source 1..22: mol_type = other DNA
gcagcctgaatcttggcagaca

SEQ ID NO: 34342 - DNA, 30 bp, synthetic construct; identical to SEQ ID NO: 3116
  misc_feature 1..30: note = Synthetic Construct
  source 1..30: mol_type = other DNA

SEQ ID NO: 34343 - DNA, 21 bp, synthetic construct
  misc_feature 1..21: note = Synthetic Construct
  source 1..21: mol_type = other DNA
tctcaccttagcctcccaagt

SEQ ID NO: 34344 - DNA, 21 bp, synthetic construct
  misc_feature 1..21: note = Synthetic Construct
  source 1..21: mol_type = other DNA
tggctgccctccttccatgat

SEQ ID NO: 34345 - DNA, 25 bp, synthetic construct
  misc_feature 1..25: note = Synthetic Construct
  source 1..25: mol_type = other DNA
cccaggagtgtatcttggtcctaca

SEQ ID NO: 34346 - DNA, 23 bp, synthetic construct
  misc_feature 1..23: note = Synthetic Construct
  source 1..23: mol_type = other DNA
gcggattttgaagccagagatga

SEQ ID NO: 34347 - DNA, 23 bp, synthetic construct
  misc_feature 1..23: note = Synthetic Construct
  source 1..23: mol_type = other DNA
ccatatgagctctccctgtgcta

SEQ ID NO: 34348 - DNA, 20 bp, synthetic construct
  misc_feature 1..20: note = Synthetic Construct
  source 1..20: mol_type = other DNA
gcgtggtgcagatggtgttt

SEQ ID NO: 34349 - DNA, 20 bp, synthetic construct
  misc_feature 1..20: note = Synthetic Construct
  source 1..20: mol_type = other DNA
tggtctcctggaagctcctt

SEQ ID NO: 34350 - DNA, 24 bp, synthetic construct
  misc_feature 1..24: note = Synthetic Construct
  source 1..24: mol_type = other DNA
tgtaaaacagggaagatgcactca

SEQ ID NO: 34351 - DNA, 25 bp, synthetic construct
  misc_feature 1..25: note = Synthetic Construct
  source 1..25: mol_type = other DNA
cctcctgtgaggatcaaagttcaag

SEQ ID NO: 34352 - DNA, 20 bp, synthetic construct
  misc_feature 1..20: note = Synthetic Construct
  source 1..20: mol_type = other DNA
ggaaaatccgccaccagcat

SEQ ID NO: 34353 - DNA, 22 bp, synthetic construct
  misc_feature 1..22: note = Synthetic Construct
  source 1..22: mol_type = other DNA
agcagtcagtcagttccagcta

SEQ ID NO: 34354 - DNA, 23 bp, synthetic construct
  misc_feature 1..23: note = Synthetic Construct
  source 1..23: mol_type = other DNA
cctcaatgattaccggggctttc

SEQ ID NO: 34355 - DNA, 20 bp, synthetic construct
  misc_feature 1..20: note = Synthetic Construct
  source 1..20: mol_type = other DNA
ggctctcttggccacaggtt

SEQ ID NO: 34356 - DNA, 23 bp, synthetic construct
  misc_feature 1..23: note = Synthetic Construct
  source 1..23: mol_type = other DNA
cacgcccagaatcaaagccaaag

SEQ ID NO: 34357 - DNA, 24 bp, synthetic construct
  misc_feature 1..24: note = Synthetic Construct
  source 1..24: mol_type = other DNA
cctcttagctgtccctcttgtttc

SEQ ID NO: 34358 - DNA, 20 bp, synthetic construct
  misc_feature 1..20: note = Synthetic Construct
  source 1..20: mol_type = other DNA
acacaccccacagcttcttc

SEQ ID NO: 34359 - DNA, 21 bp, synthetic construct
  misc_feature 1..21: note = Synthetic Construct
  source 1..21: mol_type = other DNA
ggctggagggcaaatctgtgt

SEQ ID NO: 34360 - DNA, 24 bp, synthetic construct
  misc_feature 1..24: note = Synthetic Construct
  source 1..24: mol_type = other DNA
gccatcacagaggggttacaggtt

SEQ ID NO: 34361 - DNA, 27 bp, synthetic construct
  misc_feature 1..27: note = Synthetic Construct
  source 1..27: mol_type = other DNA
tcactaagtataaggcctagcctacaa

SEQ ID NO: 34362 - DNA, 25 bp, synthetic construct
  misc_feature 1..25: note = Synthetic Construct
  source 1..25: mol_type = other DNA
gggtccaatgtgaaaagcacagagt

SEQ ID NO: 34363 - DNA, 22 bp, synthetic construct
  misc_feature 1..22: note = Synthetic Construct
  source 1..22: mol_type = other DNA
caaggccataaggccaatgagt

SEQ ID NO: 34364 - DNA, 21 bp, synthetic construct
  misc_feature 1..21: note = Synthetic Construct
  source 1..21: mol_type = other DNA
cctgaggtgaggggtgctagt

SEQ ID NO: 34365 - DNA, 25 bp, synthetic construct
  misc_feature 1..25: note = Synthetic Construct
  source 1..25: mol_type = other DNA
ggcatgctcttcagggagaagttag

SEQ ID NO: 34366 - DNA, 22 bp, synthetic construct
  misc_feature 1..22: note = Synthetic Construct
  source 1..22: mol_type = other DNA
tgtccccagcaccagtaagttc

SEQ ID NO: 34367 - DNA, 24 bp, synthetic construct
  misc_feature 1..24: note = Synthetic Construct
  source 1..24: mol_type = other DNA
gcgggaattggacacagactggta

SEQ ID NO: 34368 - DNA, 27 bp, synthetic construct
  misc_feature 1..27: note = Synthetic Construct
  source 1..27: mol_type = other DNA
ggcttcttcaactccaagtccaggata

SEQ ID NO: 34369 - DNA, 22 bp, synthetic construct
  misc_feature 1..22: note = Synthetic Construct
  source 1..22: mol_type = other DNA
gggctccattgtgttcctcaac

SEQ ID NO: 34370 - DNA, 23 bp, synthetic construct
  misc_feature 1..23: note = Synthetic Construct
  source 1..23: mol_type = other DNA
ggttctgagggagcaaacctctt

SEQ ID NO: 34371 - DNA, 25 bp, synthetic construct
  misc_feature 1..25: note = Synthetic Construct
  source 1..25: mol_type = other DNA
accctcttaattgctttggggtttt

SEQ ID NO: 34372 - DNA, 24 bp, synthetic construct
  misc_feature 1..24: note = Synthetic Construct
  source 1..24: mol_type = other DNA
cgtggagaggtattttggcagtgt

SEQ ID NO: 34373 - DNA, 27 bp, synthetic construct
  misc_feature 1..27: note = Synthetic Construct
  source 1..27: mol_type = other DNA
ggctgatttctgctgtccttcaagcta

SEQ ID NO: 34374 - DNA, 23 bp, synthetic construct
  misc_feature 1..23: note = Synthetic Construct
  source 1..23: mol_type = other DNA
cagttgcctgcatcttgatctgt

SEQ ID NO: 34375 - DNA, 24 bp, synthetic construct
  misc_feature 1..24: note = Synthetic Construct
  source 1..24: mol_type = other DNA
gcactggtggaagagacagcaaag

SEQ ID NO: 34376 - DNA, 20 bp, synthetic construct
  misc_feature 1..20: note = Synthetic Construct
  source 1..20: mol_type = other DNA
acccatgacagccgactctt

SEQ ID NO: 34377 - DNA, 24 bp, synthetic construct
  misc_feature 1..24: note = Synthetic Construct
  source 1..24: mol_type = other DNA
ccttagaaggcctctcttctctgt

SEQ ID NO: 34378 - DNA, 23 bp, synthetic construct
  misc_feature 1..23: note = Synthetic Construct
  source 1..23: mol_type = other DNA
cggtctgaacggaaactgccata

SEQ ID NO: 34379 - DNA, 21 bp, synthetic construct
  misc_feature 1..21: note = Synthetic Construct
  source 1..21: mol_type = other DNA
accctggtctgccttgccttt

SEQ ID NO: 34380 - DNA, 22 bp, synthetic construct
  misc_feature 1..22: note = Synthetic Construct
  source 1..22: mol_type = other DNA
gctcaatcgaggcaggactaac

SEQ ID NO: 34381 - DNA, 22 bp, synthetic construct
  misc_feature 1..22: note = Synthetic Construct
  source 1..22: mol_type = other DNA
ggagttggcccagaacttccat

SEQ ID NO: 34382 - DNA, 23 bp, synthetic construct
  misc_feature 1..23: note = Synthetic Construct
  source 1..23: mol_type = other DNA
ctaagggcttggagaagagcaaa

SEQ ID NO: 34383 - DNA, 21 bp, synthetic construct
  misc_feature 1..21: note = Synthetic Construct
  source 1..21: mol_type = other DNA
agccaaccaggacccagaagt

SEQ ID NO: 34384 - DNA, 23 bp, synthetic construct
  misc_feature 1..23: note = Synthetic Construct
  source 1..23: mol_type = other DNA
agacacatttgcatgcctaccat

SEQ ID NO: 34385 - DNA, 30 bp, synthetic construct; identical to SEQ ID NO: 3159
  misc_feature 1..30: note = Synthetic Construct
  source 1..30: mol_type = other DNA

SEQ ID NO: 34386 - DNA, 24 bp, synthetic construct
  misc_feature 1..24: note = Synthetic Construct
  source 1..24: mol_type = other DNA
gcagccaaaagggcttgttaaatg

SEQ ID NO: 34387 - DNA, 22 bp, synthetic construct
  misc_feature 1..22: note = Synthetic Construct
  source 1..22: mol_type = other DNA
tgggtaccagttaagccacagt

SEQ ID NO: 34388 - DNA, 24 bp, synthetic construct
  misc_feature 1..24: note = Synthetic Construct
  source 1..24: mol_type = other DNA
agagggacttatgtgcagtgaatg

SEQ ID NO: 34389 - DNA, 23 bp, synthetic construct
  misc_feature 1..23: note = Synthetic Construct
  source 1..23: mol_type = other DNA
gctggttttctcacaagcctaga

SEQ ID NO: 34390 - DNA, 21 bp, synthetic construct
  misc_feature 1..21: note = Synthetic Construct
  source 1..21: mol_type = other DNA
agactgcctgctgtttcatca

SEQ ID NO: 34391 - DNA, 21 bp, synthetic construct
  misc_feature 1..21: note = Synthetic Construct
  source 1..21: mol_type = other DNA
gcaggggctgtaaagggtgta

SEQ ID NO: 34392 - DNA, 23 bp, synthetic construct
  misc_feature 1..23: note = Synthetic Construct
  source 1..23: mol_type = other DNA
ctgggtcttctatggccttgttg

SEQ ID NO: 34393 - DNA, 22 bp, synthetic construct
  misc_feature 1..22: note = Synthetic Construct
  source 1..22: mol_type = other DNA
ggtgcctcacttcatagtgtca

SEQ ID NO: 34394 - DNA, 23 bp, synthetic construct
  misc_feature 1..23: note = Synthetic Construct
  source 1..23: mol_type = other DNA
agatggagggcagatttcagaag

SEQ ID NO: 34395 - DNA, 23 bp, synthetic construct
  misc_feature 1..23: note = Synthetic Construct
  source 1..23: mol_type = other DNA
cacacagagcctgggcttatatc

SEQ ID NO: 34396 - DNA, 25 bp, synthetic construct
  misc_feature 1..25: note = Synthetic Construct
  source 1..25: mol_type = other DNA
gcctgggatctctgaagaacagttg

SEQ ID NO: 34397 - DNA, 25 bp, synthetic construct
  misc_feature 1..25: note = Synthetic Construct
  source 1..25: mol_type = other DNA
ccctttgtaaagcatggccctatac

SEQ ID NO: 34398 - DNA, 25 bp, synthetic construct
  misc_feature 1..25: note = Synthetic Construct
  source 1..25: mol_type = other DNA
ttctcatacacaggtgatagcaaca

SEQ ID NO: 34399 - DNA, 21 bp, synthetic construct
  misc_feature 1..21: note = Synthetic Construct
  source 1..21: mol_type = other DNA
cctctttgcccttgggtggaa

SEQ ID NO: 34400 - DNA, 19 bp, synthetic construct
  misc_feature 1..19: note = Synthetic Construct
  source 1..19: mol_type = other DNA
gttgttggccaggcaccat

SEQ ID NO: 34401 - DNA, 21 bp, synthetic construct
  misc_feature 1..21: note = Synthetic Construct
  source 1..21: mol_type = other DNA
ccctggctactgcccatgttt

SEQ ID NO: 34402 - DNA, 22 bp, synthetic construct
  misc_feature 1..22: note = Synthetic Construct
  source 1..22: mol_type = other DNA
gccttgctgtcagctccaatgt

SEQ ID NO: 34403 - DNA, 22 bp, synthetic construct
  misc_feature 1..22: note = Synthetic Construct
  source 1..22: mol_type = other DNA
catctttgtggggctggagttc

SEQ ID NO: 34404 - DNA, 20 bp, synthetic construct
  misc_feature 1..20: note = Synthetic Construct
  source 1..20: mol_type = other DNA
gagcccacatcccgtgaaca

SEQ ID NO: 34405 - DNA, 20 bp, synthetic construct
  misc_feature 1..20: note = Synthetic Construct
  source 1..20: mol_type = other DNA
gaatgtgtccgccagtctgt

SEQ ID NO: 34406 - DNA, 23 bp, synthetic construct
  misc_feature 1..23: note = Synthetic Construct
  source 1..23: mol_type = other DNA
cctggaagccagctagaaaccat

SEQ ID NO: 34407 - DNA, 22 bp, synthetic construct
  misc_feature 1..22: note = Synthetic Construct
  source 1..22: mol_type = other DNA
ggagaggaagacagtggcatct

SEQ ID NO: 34408 - DNA, 22 bp, synthetic construct
  misc_feature 1..22: note = Synthetic Construct
  source 1..22: mol_type = other DNA
gggtgaatgccggtagttgtga

SEQ ID NO: 34409 - DNA, 20 bp, synthetic construct
  misc_feature 1..20: note = Synthetic Construct
  source 1..20: mol_type = other DNA
agccgggcgtacttcctttt

SEQ ID NO: 34410 - DNA, 22 bp, synthetic construct
  misc_feature 1..22: note = Synthetic Construct
  source 1..22: mol_type = other DNA
gctgtatgtctgcaggtcaagt

SEQ ID NO: 34411 - DNA, 24 bp, synthetic construct
  misc_feature 1..24: note = Synthetic Construct
  source 1..24: mol_type = other DNA
tcctcacatgagagtttcctgttc

SEQ ID NO: 34412 - DNA, 22 bp, synthetic construct
  misc_feature 1..22: note = Synthetic Construct
  source 1..22: mol_type = other DNA
ctccagcatctggaaggagaca

SEQ ID NO: 34413 - DNA, 20 bp, synthetic construct
  misc_feature 1..20: note = Synthetic Construct
  source 1..20: mol_type = other DNA
cgggaggcttgcctgagaaa

SEQ ID NO: 34414 - DNA, 20 bp, synthetic construct
  misc_feature 1..20: note = Synthetic Construct
  source 1..20: mol_type = other DNA
tagccagctcccacacacaa

SEQ ID NO: 34415 - DNA, 21 bp, synthetic construct
  misc_feature 1..21: note = Synthetic Construct
  source 1..21: mol_type = other DNA
tgggcgtagcacaagaaatca

SEQ ID NO: 34416 - DNA, 22 bp, synthetic construct
  misc_feature 1..22: note = Synthetic Construct
  source 1..22: mol_type = other DNA
tgggttgctctttgctgttcaa

SEQ ID NO: 34417 - DNA, 24 bp, synthetic construct
  misc_feature 1..24: note = Synthetic Construct
  source 1..24: mol_type = other DNA
gtggcaaacaactctgaggctaac

SEQ ID NO: 34418 - DNA, 24 bp, synthetic construct
  misc_feature 1..24: note = Synthetic Construct
  source 1..24: mol_type = other DNA
gggaagaatgctgtgtcctcacaa

SEQ ID NO: 34419 - DNA, 20 bp, synthetic construct
  misc_feature 1..20: note = Synthetic Construct
  source 1..20: mol_type = other DNA
atttcctgccgtgccacctt

SEQ ID NO: 34420 - DNA, 20 bp, synthetic construct
  misc_feature 1..20: note = Synthetic Construct
  source 1..20: mol_type = other DNA
cacagaaagctggggcaaca

SEQ ID NO: 34421 - DNA, 23 bp, synthetic construct
  misc_feature 1..23: note = Synthetic Construct
  source 1..23: mol_type = other DNA
ccagtacatgctttcccaacaca

SEQ ID NO: 34422 - DNA, 27 bp, synthetic construct
  misc_feature 1..27: note = Synthetic Construct
  source 1..27: mol_type = other DNA
cctttttaaaggagtggatgcagaagt

SEQ ID NO: 34423 - DNA, 23 bp, synthetic construct
  misc_feature 1..23: note = Synthetic Construct
  source 1..23: mol_type = other DNA
gagccccaaatgtacactagcaa

SEQ ID NO: 34424 - DNA, 27 bp, synthetic construct
  misc_feature 1..27: note = Synthetic Construct
  source 1..27: mol_type = other DNA
gcccagtgcttttcttaattgctttga

SEQ ID NO: 34425 - DNA, 23 bp, synthetic construct
  misc_feature 1..23: note = Synthetic Construct
  source 1..23: mol_type = other DNA
ccactggactactggactacact

SEQ ID NO: 34426 - DNA, 24 bp, synthetic construct
  misc_feature 1..24: note = Synthetic Construct
  source 1..24: mol_type = other DNA
caatagccagggtctgaattgcat

SEQ ID NO: 34427 - DNA, 23 bp, synthetic construct
  misc_feature 1..23: note = Synthetic Construct
  source 1..23: mol_type = other DNA
gagtgcagaagaatgggttctga

SEQ ID NO: 34428 - DNA, 20 bp, synthetic construct
  misc_feature 1..20: note = Synthetic Construct
  source 1..20: mol_type = other DNA
aagccctaaacccgcgttac

SEQ ID NO: 34429 - DNA, 25 bp, synthetic construct
  misc_feature 1..25: note = Synthetic Construct
  source 1..25: mol_type = other DNA
agcagaaatcacacaatggcaatac

SEQ ID NO: 34430 - DNA, 20 bp, synthetic construct
  misc_feature 1..20: note = Synthetic Construct
  source 1..20: mol_type = other DNA
tgccttcactgcctggtgat

SEQ ID NO: 34431 - DNA, 20 bp, synthetic construct
  misc_feature 1..20: note = Synthetic Construct
  source 1..20: mol_type = other DNA
accctccccgccatcaagta

SEQ ID NO: 34432 - DNA, 27 bp, synthetic construct
  misc_feature 1..27: note = Synthetic Construct
  source 1..27: mol_type = other DNA
cgtctttctccagtttctgagccctat

SEQ ID NO: 34433 - DNA, 25 bp, synthetic construct
  misc_feature 1..25: note = Synthetic Construct
  source 1..25: mol_type = other DNA
ggtcagctgtgtcaataaggactga

SEQ ID NO: 34434 - DNA, 20 bp, synthetic construct
  misc_feature 1..20: note = Synthetic Construct
  source 1..20: mol_type = other DNA
ggaagcaggtgtcagtgtga

SEQ ID NO: 34435 - DNA, 24 bp, synthetic construct
  misc_feature 1..24: note = Synthetic Construct
  source 1..24: mol_type = other DNA
ggtctgcttctggagtctgcagtt

SEQ ID NO: 34436 - DNA, 25 bp, synthetic construct
  misc_feature 1..25: note = Synthetic Construct
  source 1..25: mol_type = other DNA
cacactcggttcctgtttcaggatt

SEQ ID NO: 34437 - DNA, 25 bp, synthetic construct
  misc_feature 1..25: note = Synthetic Construct
  source 1..25: mol_type = other DNA
acacccatcccaaagggattaaaag

SEQ ID NO: 34438 - DNA, 22 bp, synthetic construct
  misc_feature 1..22: note = Synthetic Construct
  source 1..22: mol_type = other DNA
cctgtctcccttgccagatcaa

SEQ ID NO: 34439 - DNA, 23 bp, synthetic construct
  misc_feature 1..23: note = Synthetic Construct
  source 1..23: mol_type = other DNA
aggcttccctgagcagagatatt

SEQ ID NO: 34440 - DNA, 20 bp, synthetic construct
  misc_feature 1..20: note = Synthetic Construct
  source 1..20: mol_type = other DNA
tctctggctccagcgtctga

SEQ ID NO: 34441 - DNA, 19 bp, synthetic construct
  misc_feature 1..19: note = Synthetic Construct
  source 1..19: mol_type = other DNA
agggatatggccggcttct

SEQ ID NO: 34442 - DNA, 20 bp, synthetic construct
  misc_feature 1..20: note = Synthetic Construct
  source 1..20: mol_type = other DNA
gtggtggtggttgtgctact

SEQ ID NO: 34443 - DNA, 24 bp, synthetic construct
  misc_feature 1..24: note = Synthetic Construct
  source 1..24: mol_type = other DNA
ccttccttttcactaagcctgtct

SEQ ID NO: 34444 - DNA, 24 bp, synthetic construct
  misc_feature 1..24: note = Synthetic Construct
  source 1..24: mol_type = other DNA
gagagattggaaggggagagattg

SEQ ID NO: 34445 - DNA, 26 bp, synthetic construct
  misc_feature 1..26: note = Synthetic Construct
  source 1..26: mol_type = other DNA
ggtggagtaaaaacagcactggacta

SEQ ID NO: 34446 - DNA, 25 bp, synthetic construct
  misc_feature 1..25: note = Synthetic Construct
  source 1..25: mol_type = other DNA
ccttcagggcagtgagttctcttct

SEQ ID NO: 34447 - DNA, 22 bp, synthetic construct
  misc_feature 1..22: note = Synthetic Construct
  source 1..22: mol_type = other DNA
tccaggaaaaggaactgcaaca

SEQ ID NO: 34448 - DNA, 26 bp, synthetic construct
  misc_feature 1..26: note = Synthetic Construct
  source 1..26: mol_type = other DNA
cgcatgtgtaccttaatgatgtcaac

SEQ ID NO: 34449 - DNA, 21 bp, synthetic construct
  misc_feature 1..21: note = Synthetic Construct
  source 1..21: mol_type = other DNA
ccctgaatgttccaccagctt

SEQ ID NO: 34450 - DNA, 23 bp, synthetic construct
  misc_feature 1..23: note = Synthetic Construct
  source 1..23: mol_type = other DNA
gcctccagagctagggatggtta

SEQ ID NO: 34451 - DNA, 19 bp, synthetic construct
  misc_feature 1..19: note = Synthetic Construct
  source 1..19: mol_type = other DNA
tggaggggaccgggttcta

SEQ ID NO: 34452 - DNA, 24 bp, synthetic construct
  misc_feature 1..24: note = Synthetic Construct
  source 1..24: mol_type = other DNA
cctggatttgtctcctgtcacttc

SEQ ID NO: 34453 - DNA, 24 bp, synthetic construct
  misc_feature 1..24: note = Synthetic Construct
  source 1..24: mol_type = other DNA
ggggacacgtcttactgtagtctt

SEQ ID NO: 34454 - DNA, 22 bp, synthetic construct
  misc_feature 1..22: note = Synthetic Construct
  source 1..22: mol_type = other DNA
tcagcaggaaaagcacttgact

SEQ ID NO: 34455 - DNA, 24 bp, synthetic construct
  misc_feature 1..24: note = Synthetic Construct
  source 1..24: mol_type = other DNA
gtttccttccttgtttgcagagtt

SEQ ID NO: 34456 - DNA, 27 bp, synthetic construct
  misc_feature 1..27: note = Synthetic Construct
  source 1..27: mol_type = other DNA
ccataccagacacaaactacagtcaca

SEQ ID NO: 34457 - DNA, 28 bp, synthetic construct
  misc_feature 1..28: note = Synthetic Construct
  source 1..28: mol_type = other DNA
cctgactttctagttcaactcagccttt

SEQ ID NO: 34458 - DNA, 22 bp, synthetic construct
  misc_feature 1..22: note = Synthetic Construct
  source 1..22: mol_type = other DNA
gttgatgctctggctactgcta

SEQ ID NO: 34459 - DNA, 24 bp, synthetic construct
  misc_feature 1..24: note = Synthetic Construct
  source 1..24: mol_type = other DNA
caagggctattcaggactcacaaa

SEQ ID NO: 34460 - DNA, 25 bp, synthetic construct
  misc_feature 1..25: note = Synthetic Construct
  source 1..25: mol_type = other DNA
cactgcataccagcaaatgagttgt

SEQ ID NO: 34461 - DNA, 20 bp, synthetic construct
  misc_feature 1..20: note = Synthetic Construct
  source 1..20: mol_type = other DNA
actgcatggcagagcagctt

SEQ ID NO: 34462 - DNA, 21 bp, synthetic construct
  misc_feature 1..21: note = Synthetic Construct
  source 1..21: mol_type = other DNA
gcagagctcctcaaagggaaa

SEQ ID NO: 34463 - DNA, 25 bp, synthetic construct
  misc_feature 1..25: note = Synthetic Construct
  source 1..25: mol_type = other DNA
ccaccactaccatcatcactatgaa

SEQ ID NO: 34464 - DNA, 22 bp, synthetic construct
  misc_feature 1..22: note = Synthetic Construct
  source 1..22: mol_type = other DNA
gtgagtgaatgggtgggaggta

SEQ ID NO: 34465 - DNA, 25 bp, synthetic construct
  misc_feature 1..25: note = Synthetic Construct
  source 1..25: mol_type = other DNA
catgtgctctagcaagacaatcaaa

SEQ ID NO: 34466 - DNA, 24 bp, synthetic construct
  misc_feature 1..24: note = Synthetic Construct
  source 1..24: mol_type = other DNA
ggagaccacaatgcacaggtctac

SEQ ID NO: 34467 - DNA, 22 bp, synthetic construct
  misc_feature 1..22: note = Synthetic Construct
  source 1..22: mol_type = other DNA
agctctgtaggagggcaaggat

SEQ ID NO: 34468 - DNA, 20 bp, synthetic construct
  misc_feature 1..20: note = Synthetic Construct
  source 1..20: mol_type = other DNA
tccatggctctggctgctat

SEQ ID NO: 34469 - DNA, 22 bp, synthetic construct
  misc_feature 1..22: note = Synthetic Construct
  source 1..22: mol_type = other DNA
ccgtgactagtgcttcgtgctt

SEQ ID NO: 34470 - DNA, 22 bp, synthetic construct
  misc_feature 1..22: note = Synthetic Construct
  source 1..22: mol_type = other DNA
ggaccaatggctggaagaccaa

SEQ ID NO: 34471 - DNA, 24 bp, synthetic construct
  misc_feature 1..24: note = Synthetic Construct
  source 1..24: mol_type = other DNA
cagaagtgtggtggggttacttac

SEQ ID NO: 34472 - DNA, 21 bp, synthetic construct
  misc_feature 1..21: note = Synthetic Construct
  source 1..21: mol_type = other DNA
ggctgttgcagaagcatcact

SEQ ID NO: 34473 - DNA, 21 bp, synthetic construct
  misc_feature 1..21: note = Synthetic Construct
  source 1..21: mol_type = other DNA
ccaaacctgctcctccaccat

SEQ ID NO: 34474 - DNA, 20 bp, synthetic construct
  misc_feature 1..20: note = Synthetic Construct
  source 1..20: mol_type = other DNA
gcccaggtctcgtctccatt

SEQ ID NO: 34475 - DNA, 21 bp, synthetic construct
  misc_feature 1..21: note = Synthetic Construct
  source 1..21: mol_type = other DNA
tgagccttgcagtggggtaac

SEQ ID NO: 34476 - DNA, 30 bp, synthetic construct; identical to SEQ ID NO: 3250
  misc_feature 1..30: note = Synthetic Construct
  source 1..30: mol_type = other DNA

SEQ ID NO: 34477 - DNA, 22 bp, synthetic construct
  misc_feature 1..22: note = Synthetic Construct
  source 1..22: mol_type = other DNA
ccacagtgaagcctggagaaca

SEQ ID NO: 34478 - DNA, 20 bp, synthetic construct
  misc_feature 1..20: note = Synthetic Construct
  source 1..20: mol_type = other DNA
ggacatgggcgaggcaattt

SEQ ID NO: 34479 - DNA, 23 bp, synthetic construct
  misc_feature 1..23: note = Synthetic Construct
  source 1..23: mol_type = other DNA
atcccagggaggagaggtgacat

SEQ ID NO: 34480 - DNA, 22 bp, synthetic construct
  misc_feature 1..22: note = Synthetic Construct
  source 1..22: mol_type = other DNA
cgctggcccttctagtgaatgt

SEQ ID NO: 34481 - DNA, 24 bp, synthetic construct
  misc_feature 1..24: note = Synthetic Construct
  source 1..24: mol_type = other DNA
ctgcaattccccaacaatctctgt

SEQ ID NO: 34482 - DNA, 20 bp, synthetic construct
  misc_feature 1..20: note = Synthetic Construct
  source 1..20: mol_type = other DNA
ggctgtcctccctgcctaaa

SEQ ID NO: 34483 - DNA, 21 bp, synthetic construct
  misc_feature 1..21: note = Synthetic Construct
  source 1..21: mol_type = other DNA
gctgtggggtttgagggctat

SEQ ID NO: 34484 - DNA, 23 bp, synthetic construct
  misc_feature 1..23: note = Synthetic Construct
  source 1..23: mol_type = other DNA
ccctgagagtggtagctactgaa

SEQ ID NO: 34485 - DNA, 25 bp, synthetic construct
  misc_feature 1..25: note = Synthetic Construct
  source 1..25: mol_type = other DNA
gccagatcaaatcattccaggtgaa

SEQ ID NO: 34486 - DNA, 24 bp, synthetic construct
  misc_feature 1..24: note = Synthetic Construct
  source 1..24: mol_type = other DNA
cacagaagggcagataaagcaaaa

SEQ ID NO: 34487 - DNA, 23 bp, synthetic construct
  misc_feature 1..23: note = Synthetic Construct
  source 1..23: mol_type = other DNA
gccatgtggatttccaggtcact

SEQ ID NO: 34488 - DNA, 24 bp, synthetic construct
  misc_feature 1..24: note = Synthetic Construct
  source 1..24: mol_type = other DNA
cgctgtagctgaagcactgtccta

SEQ ID NO: 34489 - DNA, 22 bp, synthetic construct
  misc_feature 1..22: note = Synthetic Construct
  source 1..22: mol_type = other DNA
ctgctgattcaggaccacagaa

SEQ ID NO: 34490 - DNA, 22 bp, synthetic construct
  misc_feature 1..22: note = Synthetic Construct
  source 1..22: mol_type = other DNA
agcacagggcaacagaagtaac

SEQ ID NO: 34491 - DNA, 25 bp, synthetic construct
  misc_feature 1..25: note = Synthetic Construct
  source 1..25: mol_type = other DNA
gggcccaacatctagttctgctaca

SEQ ID NO: 34492 - DNA, 25 bp, synthetic construct
  misc_feature 1..25: note = Synthetic Construct
  source 1..25: mol_type = other DNA
gagaaagcaggtactgaccttttca

SEQ ID NO: 34493 - DNA, 23 bp, synthetic construct
  misc_feature 1..23: note = Synthetic Construct
  source 1..23: mol_type = other DNA
ccagtctccatctggaggaccaa

SEQ ID NO: 34494 - DNA, 28 bp, synthetic construct
  misc_feature 1..28: note = Synthetic Construct
  source 1..28: mol_type = other DNA
ggcaagcccatcatagattttagtgaca

SEQ ID NO: 34495 - DNA, 22 bp, synthetic construct
  misc_feature 1..22: note = Synthetic Construct
  source 1..22: mol_type = other DNA
ccccacctctttctgggatttg

SEQ ID NO: 34496 - DNA, 22 bp, synthetic construct
  misc_feature 1..22: note = Synthetic Construct
  source 1..22: mol_type = other DNA
agtggctgaacagaccgtctac

SEQ ID NO: 34497 - DNA, 24 bp, synthetic construct
  misc_feature 1..24: note = Synthetic Construct
  source 1..24: mol_type = other DNA
cagcctagtgagggtgtaagacta

SEQ ID NO: 34498 - DNA, 19 bp, synthetic construct
  misc_feature 1..19: note = Synthetic Construct
  source 1..19: mol_type = other DNA
gggtgtggggcgtagtgaa

SEQ ID NO: 34499 - DNA, 19 bp, synthetic construct
  misc_feature 1..19: note = Synthetic Construct
  source 1..19: mol_type = other DNA
gcagaggcaccaccacact

SEQ ID NO: 34500 - DNA, 22 bp, synthetic construct
  misc_feature 1..22: note = Synthetic Construct
  source 1..22: mol_type = other DNA
cctgcatacggagaggtcaaag

SEQ ID NO: 34501 - DNA, 22 bp, synthetic construct
  misc_feature 1..22: note = Synthetic Construct
  source 1..22: mol_type = other DNA
gcgccatctttttgaggcatag

SEQ ID NO: 34502 - DNA, 26 bp, synthetic construct
  misc_feature 1..26: note = Synthetic Construct
  source 1..26: mol_type = other DNA
ggaaggttctgacagacaatggaact

SEQ ID NO: 34503 - DNA, 20 bp, synthetic construct
  misc_feature 1..20: note = Synthetic Construct
  source 1..20: mol_type = other DNA
catcttccacgcctgagctt

SEQ ID NO: 34504 - DNA, 21 bp, synthetic construct
  misc_feature 1..21: note = Synthetic Construct
  source 1..21: mol_type = other DNA
gctcatgggcagggttcactt

SEQ ID NO: 34505 - DNA, 20 bp, synthetic construct
  misc_feature 1..20: note = Synthetic Construct
  source 1..20: mol_type = other DNA
gcagaagcactgtccagact

SEQ ID NO: 34506 - DNA, 26 bp, synthetic construct
  misc_feature 1..26: note = Synthetic Construct
  source 1..26: mol_type = other DNA
ccttctatcagtagcaaggagacagt

SEQ ID NO: 34507 - DNA, 20 bp, synthetic construct
  misc_feature 1..20: note = Synthetic Construct
  source 1..20: mol_type = other DNA
agcgggttggactcactgtt

SEQ ID NO: 34508 - DNA, 23 bp, synthetic construct
  misc_feature 1..23: note = Synthetic Construct
  source 1..23: mol_type = other DNA
ggctaactgagccctggtgaatg

SEQ ID NO: 34509 - DNA, 22 bp, synthetic construct
  misc_feature 1..22: note = Synthetic Construct
  source 1..22: mol_type = other DNA
ctggagacgtacatgccagtca

SEQ ID NO: 34510 - DNA, 22 bp, synthetic construct
  misc_feature 1..22: note = Synthetic Construct
  source 1..22: mol_type = other DNA
ccgcccatctctcctgtttgtt

SEQ ID NO: 34511 - DNA, 21 bp, synthetic construct
  misc_feature 1..21: note = Synthetic Construct
  source 1..21: mol_type = other DNA
ggggaacagctggaaaagcat

SEQ ID NO: 34512 - DNA, 21 bp, synthetic construct
  misc_feature 1..21: note = Synthetic Construct
  source 1..21: mol_type = other DNA
agtctggcctgtggtgtctgt

SEQ ID NO: 34513 - DNA, 22 bp, synthetic construct
  misc_feature 1..22: note = Synthetic Construct
  source 1..22: mol_type = other DNA
agggaccccatcacccatttac

SEQ ID NO: 34514 - DNA, 30 bp, synthetic construct; identical to SEQ ID NO: 3288
  misc_feature 1..30: note = Synthetic Construct
  source 1..30: mol_type = other DNA

SEQ ID NO: 34515 - DNA, 24 bp, synthetic construct
  misc_feature 1..24: note = Synthetic Construct
  source 1..24: mol_type = other DNA
tgttttagcagcacgagatgaact

SEQ ID NO: 34516 - DNA, 22 bp, synthetic construct
  misc_feature 1..22: note = Synthetic Construct
  source 1..22: mol_type = other DNA
aggcaaatggcaggagggaatg

SEQ ID NO: 34517 - DNA, 24 bp, synthetic construct
  misc_feature 1..24: note = Synthetic Construct
  source 1..24: mol_type = other DNA
gagattacaggagcatgccacttc

SEQ ID NO: 34518 - DNA, 22 bp, synthetic construct
  misc_feature 1..22: note = Synthetic Construct
  source 1..22: mol_type = other DNA
tgctttcgagaaaagccacact

SEQ ID NO: 34519 - DNA, 23 bp, synthetic construct
  misc_feature 1..23: note = Synthetic Construct
  source 1..23: mol_type = other DNA
gcagcggctatagacagatccaa

SEQ ID NO: 34520 - DNA, 20 bp, synthetic construct
  misc_feature 1..20: note = Synthetic Construct
  source 1..20: mol_type = other DNA
gcactgcctctgcctcaaaa

SEQ ID NO: 34521 - DNA, 23 bp, synthetic construct
  misc_feature 1..23: note = Synthetic Construct
  source 1..23: mol_type = other DNA
taccaccagggctgatccagaga

SEQ ID NO: 34522 - DNA, 22 bp, synthetic construct
  misc_feature 1..22: note = Synthetic Construct
  source 1..22: mol_type = other DNA
gtggtctgcagtcacatcttga

SEQ ID NO: 34523 - DNA, 23 bp, synthetic construct
  misc_feature 1..23: note = Synthetic Construct
  source 1..23: mol_type = other DNA
gtccatcagccagatgtggagtt

SEQ ID NO: 34524 - DNA, 22 bp, synthetic construct
  misc_feature 1..22: note = Synthetic Construct
  source 1..22: mol_type = other DNA
gggtctgtcgcctgacttaaca

SEQ ID NO: 34525 - DNA, 21 bp, synthetic construct
  misc_feature 1..21: note = Synthetic Construct
  source 1..21: mol_type = other DNA
agaggtcagggtgaagcacta

SEQ ID NO: 34526 - DNA, 27 bp, synthetic construct
  misc_feature 1..27: note = Synthetic Construct
  source 1..27: mol_type = other DNA
ggaaaaagtggaggcactgattcattc

SEQ ID NO: 34527 - DNA, 26 bp, synthetic construct
  misc_feature 1..26: note = Synthetic Construct
  source 1..26: mol_type = other DNA
agagaatagtacctcccatgggtaaa

SEQ ID NO: 34528 - DNA, 20 bp, synthetic construct
  misc_feature 1..20: note = Synthetic Construct
  source 1..20: mol_type = other DNA
gcagagccaggcctcaaaac

SEQ ID NO: 34529 - DNA, 19 bp, synthetic construct
  misc_feature 1..19: note = Synthetic Construct
  source 1..19: mol_type = other DNA
tgagtcctgccgcttcaca

SEQ ID NO: 34530 - DNA, 22 bp, synthetic construct
  misc_feature 1..22: note = Synthetic Construct
  source 1..22: mol_type = other DNA
gtgggaagcgggttaggaagat

SEQ ID NO: 34531 - DNA, 22 bp, synthetic construct
  misc_feature 1..22: note = Synthetic Construct
  source 1..22: mol_type = other DNA
ggagccagacttcttggtcctt

SEQ ID NO: 34532 - DNA, 21 bp, synthetic construct
  misc_feature 1..21: note = Synthetic Construct
  source 1..21: mol_type = other DNA
gcgttgtggtgctttcctttc

SEQ ID NO: 34533 - DNA, 25 bp, synthetic construct
  misc_feature 1..25: note = Synthetic Construct
  source 1..25: mol_type = other DNA
aattttcagaggaaagggaggaaca

SEQ ID NO: 34534 - DNA, 21 bp, synthetic construct
  misc_feature 1..21: note = Synthetic Construct
  source 1..21: mol_type = other DNA
gcaccacataggtgacagcaa

SEQ ID NO: 34535 - DNA, 18 bp, synthetic construct
  misc_feature 1..18: note = Synthetic Construct
  source 1..18: mol_type = other DNA
agtgcacgtccgccgtaa

SEQ ID NO: 34536 - DNA, 24 bp, synthetic construct
  misc_feature 1..24: note = Synthetic Construct
  source 1..24: mol_type = other DNA
tcctcaggttgttaggcattttga

SEQ ID NO: 34537 - DNA, 21 bp, synthetic construct
  misc_feature 1..21: note = Synthetic Construct
  source 1..21: mol_type = other DNA
ggcactggggaagacgaagaa

SEQ ID NO: 34538 - DNA, 21 bp, synthetic construct
  misc_feature 1..21: note = Synthetic Construct
  source 1..21: mol_type = other DNA
tcctgcttgcctctggggaat

SEQ ID NO: 34539 - DNA, 20 bp, synthetic construct
  misc_feature 1..20: note = Synthetic Construct
  source 1..20: mol_type = other DNA
accctggtgggatccagaaa

SEQ ID NO: 34540 - DNA, 23 bp, synthetic construct
  misc_feature 1..23: note = Synthetic Construct
  source 1..23: mol_type = other DNA
cgagcccctatccagaaagaaaa

SEQ ID NO: 34541 - DNA, 23 bp, synthetic construct
  misc_feature 1..23: note = Synthetic Construct
  source 1..23: mol_type = other DNA
gctcaaatcaccttcctgcaagt

SEQ ID NO: 34542 - DNA, 27 bp, synthetic construct
  misc_feature 1..27: note = Synthetic Construct
  source 1..27: mol_type = other DNA
ggtacttttacttttgccgtaggtagt

SEQ ID NO: 34543 - DNA, 22 bp, synthetic construct
  misc_feature 1..22: note = Synthetic Construct
  source 1..22: mol_type = other DNA
gggctgttacctcatcctcttg

SEQ ID NO: 34544 - DNA, 22 bp, synthetic construct
  misc_feature 1..22: note = Synthetic Construct
  source 1..22: mol_type = other DNA
catcatgcccaagtagcgttca

SEQ ID NO: 34545 - DNA, 24 bp, synthetic construct
  misc_feature 1..24: note = Synthetic Construct
  source 1..24: mol_type = other DNA
gggatttttgagcccctgaaattg

SEQ ID NO: 34546 - DNA, 20 bp, synthetic construct
  misc_feature 1..20: note = Synthetic Construct
  source 1..20: mol_type = other DNA
acaccggcgacttctccaat

SEQ ID NO: 34547 - DNA, 22 bp, synthetic construct
  misc_feature 1..22: note = Synthetic Construct
  source 1..22: mol_type = other DNA
tggcctcaggcaacactctgta

SEQ ID NO: 34548 - DNA, 28 bp, synthetic construct
  misc_feature 1..28: note = Synthetic Construct
  source 1..28: mol_type = other DNA
ctcaaggctaaagtaactccttggaaag

SEQ ID NO: 34549 - DNA, 20 bp, synthetic construct
  misc_feature 1..20: note = Synthetic Construct
  source 1..20: mol_type = other DNA
agtctgcagagacccgtgta

SEQ ID NO: 34550 - DNA, 22 bp, synthetic construct
  misc_feature 1..22: note = Synthetic Construct
  source 1..22: mol_type = other DNA
tgctgggtaggtgtgtggtaca

SEQ ID NO: 34551 - DNA, 20 bp, synthetic construct
  misc_feature 1..20: note = Synthetic Construct
  source 1..20: mol_type = other DNA
aacacaggcctggctctcaa

SEQ ID NO: 34552 - DNA, 20 bp, synthetic construct
  misc_feature 1..20: note = Synthetic Construct
  source 1..20: mol_type = other DNA
ggaaagggagggaggtgctt

SEQ ID NO: 34553 - DNA, 22 bp, synthetic construct
  misc_feature 1..22: note = Synthetic Construct
  source 1..22: mol_type = other DNA
gctctcctggctctgtgaggat

SEQ ID NO: 34554 - DNA, 22 bp, synthetic construct
  misc_feature 1..22: note = Synthetic Construct
  source 1..22: mol_type = other DNA
acaacctagtgccaggggaagt

SEQ ID NO: 34555 - DNA, 21 bp, synthetic construct
  misc_feature 1..21: note = Synthetic Construct
  source 1..21: mol_type = other DNA
acaagccccacagggtagact

SEQ ID NO: 34556 - DNA, 24 bp, synthetic construct
  misc_feature 1..24: note = Synthetic Construct
  source 1..24: mol_type = other DNA
gaaccagtttcctttctcctggaa

SEQ ID NO: 34557 - DNA, 18 bp, synthetic construct
  misc_feature 1..18: note = Synthetic Construct
  source 1..18: mol_type = other DNA
ggaagccactcgctgcat

SEQ ID NO: 34558 - DNA, 18 bp, synthetic construct
  misc_feature 1..18: note = Synthetic Construct
  source 1..18: mol_type = other DNA
tgggtgcctcggatgctt

SEQ ID NO: 34559 - DNA, 23 bp, synthetic construct
  misc_feature 1..23: note = Synthetic Construct
  source 1..23: mol_type = other DNA
gctcattaatgcacgcagacaca

SEQ ID NO: 34560 - DNA, 28 bp, synthetic construct
  misc_feature 1..28: note = Synthetic Construct
  source 1..28: mol_type = other DNA
ggtggtacagaatacaatggctgtgatg

SEQ ID NO: 34561 - DNA, 22 bp, synthetic construct
  misc_feature 1..22: note = Synthetic Construct
  source 1..22: mol_type = other DNA
tctggtagcaggagggagaaag

SEQ ID NO: 34562 - DNA, 26 bp, synthetic construct
  misc_feature 1..26: note = Synthetic Construct
  source 1..26: mol_type = other DNA
ggatgtgttcatccgtctcttcacta

SEQ ID NO: 34563 - DNA, 20 bp, synthetic construct
  misc_feature 1..20: note = Synthetic Construct
  source 1..20: mol_type = other DNA
agacatgggtccctctgctt

SEQ ID NO: 34564 - DNA, 28 bp, synthetic construct
  misc_feature 1..28: note = Synthetic Construct
  source 1..28: mol_type = other DNA
cctggtacctgatatgatgttagctgta

SEQ ID NO: 34565 - DNA, 21 bp, synthetic construct
  misc_feature 1..21: note = Synthetic Construct
  source 1..21: mol_type = other DNA
ggtccacccatagccctctga

SEQ ID NO: 34566 - DNA, 25 bp, synthetic construct
  misc_feature 1..25: note = Synthetic Construct
  source 1..25: mol_type = other DNA
ggtaggcatttttcgatggcagaga

SEQ ID NO: 34567 - DNA, 20 bp, synthetic construct
  misc_feature 1..20: note = Synthetic Construct
  source 1..20: mol_type = other DNA
agtagaggcagggtcacaca

SEQ ID NO: 34568 - DNA, 23 bp, synthetic construct
  misc_feature 1..23: note = Synthetic Construct
  source 1..23: mol_type = other DNA
actaaggaagcctcttgggttct

SEQ ID NO: 34569 - DNA, 24 bp, synthetic construct
  misc_feature 1..24: note = Synthetic Construct
  source 1..24: mol_type = other DNA
ctcttccctgaagacaaccaactt

SEQ ID NO: 34570 - DNA, 23 bp, synthetic construct
  misc_feature 1..23: note = Synthetic Construct
  source 1..23: mol_type = other DNA
ccttccaggttgatggtcgcatt

SEQ ID NO: 34571 - DNA, 20 bp, synthetic construct
  misc_feature 1..20: note = Synthetic Construct
  source 1..20: mol_type = other DNA
cactgcccagatggcagaag

SEQ ID NO: 34572 - DNA, 22 bp, synthetic construct
  misc_feature 1..22: note = Synthetic Construct
  source 1..22: mol_type = other DNA
cgtggctgcatctgatcctttc

SEQ ID NO: 34573 - DNA, 20 bp, synthetic construct
  misc_feature 1..20: note = Synthetic Construct
  source 1..20: mol_type = other DNA
tgtgagaggccgttgggaaa

SEQ ID NO: 34574 - DNA, 26 bp, synthetic construct
  misc_feature 1..26: note = Synthetic Construct
  source 1..26: mol_type = other DNA
ggaaatgtttgactcatgccctgatg

SEQ ID NO: 34575 - DNA, 20 bp, synthetic construct
  misc_feature 1..20: note = Synthetic Construct
  source 1..20: mol_type = other DNA
agtcagccagatgcccagaa

SEQ ID NO: 34576 - DNA, 20 bp, synthetic construct
  misc_feature 1..20: note = Synthetic Construct
  source 1..20: mol_type = other DNA
agctcaggactgcgttcttc

SEQ ID NO: 34577 - DNA, 24 bp, synthetic construct
  misc_feature 1..24: note = Synthetic Construct
  source 1..24: mol_type = other DNA
ccatgtacccaggagaggtgatga

SEQ ID NO: 34578 - DNA, 20 bp, synthetic construct
  misc_feature 1..20: note = Synthetic Construct
  source 1..20: mol_type = other DNA
tgtgtgctgcagtggagctt

SEQ ID NO: 34579 - DNA, 25 bp, synthetic construct
  misc_feature 1..25: note = Synthetic Construct
  source 1..25: mol_type = other DNA
ggcgtaacattagggtaccttctct

SEQ ID NO: 34580 - DNA, 24 bp, synthetic construct
  misc_feature 1..24: note = Synthetic Construct
  source 1..24: mol_type = other DNA
gggtctgggagagggataacttca

SEQ ID NO: 34581 - DNA, 23 bp, synthetic construct
  misc_feature 1..23: note = Synthetic Construct
  source 1..23: mol_type = other DNA
gtggtaactgcacgaggacaaag

SEQ ID NO: 34582 - DNA, 21 bp, synthetic construct
  misc_feature 1..21: note = Synthetic Construct
  source 1..21: mol_type = other DNA
ggagcctcttggttcctgtgt

SEQ ID NO: 34583 - DNA, 21 bp, synthetic construct
  misc_feature 1..21: note = Synthetic Construct
  source 1..21: mol_type = other DNA
aagacctctcgcaggccgatt

SEQ ID NO: 34584 - DNA, 20 bp, synthetic construct
  misc_feature 1..20: note = Synthetic Construct
  source 1..20: mol_type = other DNA
agtgaaggccctctcctgaa

SEQ ID NO: 34585 - DNA, 24 bp, synthetic construct
  misc_feature 1..24: note = Synthetic Construct
  source 1..24: mol_type = other DNA
cctcgattcagtctggggacattc

SEQ ID NO: 34586 - DNA, 22 bp, synthetic construct
  misc_feature 1..22: note = Synthetic Construct
  source 1..22: mol_type = other DNA
tcactttccacctctcgaggaa

SEQ ID NO: 34587 - DNA, 22 bp, synthetic construct
  misc_feature 1..22: note = Synthetic Construct
  source 1..22: mol_type = other DNA
aggtgaagcagagcaggacttc

SEQ ID NO: 34588 - DNA, 23 bp, synthetic construct
  misc_feature 1..23: note = Synthetic Construct
  source 1..23: mol_type = other DNA
gcctcctcatctcatgggtttca

SEQ ID NO: 34589 - DNA, 21 bp, synthetic construct
  misc_feature 1..21: note = Synthetic Construct
  source 1..21: mol_type = other DNA
aacccctttggtcttgcacat

SEQ ID NO: 34590 - DNA, 26 bp, synthetic construct
  misc_feature 1..26: note = Synthetic Construct
  source 1..26: mol_type = other DNA
gctgctatggtggtatcagggagttc

SEQ ID NO: 34591 - DNA, 22 bp, synthetic construct
  misc_feature 1..22: note = Synthetic Construct
  source 1..22: mol_type = other DNA
gcaggagcaggtttagctgaca

SEQ ID NO: 34592 - DNA, 20 bp, synthetic construct
  misc_feature 1..20: note = Synthetic Construct
  source 1..20: mol_type = other DNA
ctcacacttgggcactgctt

SEQ ID NO: 34593 - DNA, 21 bp, synthetic construct
  misc_feature 1..21: note = Synthetic Construct
  source 1..21: mol_type = other DNA
gctccccagtgatgggctttt

SEQ ID NO: 34594 - DNA, 27 bp, synthetic construct
  misc_feature 1..27: note = Synthetic Construct
  source 1..27: mol_type = other DNA
cctctgtctacacagtgaacagcattg

SEQ ID NO: 34595 - DNA, 21 bp, synthetic construct
  misc_feature 1..21: note = Synthetic Construct
  source 1..21: mol_type = other DNA
agcacccctgagcatgtggat

SEQ ID NO: 34596 - DNA, 21 bp, synthetic construct
  misc_feature 1..21: note = Synthetic Construct
  source 1..21: mol_type = other DNA
cgatgcaggccatgacagaca

SEQ ID NO: 34597 - DNA, 23 bp, synthetic construct
  misc_feature 1..23: note = Synthetic Construct
  source 1..23: mol_type = other DNA
ataatcagcctgcctcaaacaga

SEQ ID NO: 34598 - DNA, 23 bp, synthetic construct
  misc_feature 1..23: note = Synthetic Construct
  source 1..23: mol_type = other DNA
gctgccaagagaaatgggacact

SEQ ID NO: 34599 - DNA, 22 bp, synthetic construct
  misc_feature 1..22: note = Synthetic Construct
  source 1..22: mol_type = other DNA
gccatctcaaactcggccaatg

SEQ ID NO: 34600 - DNA, 22 bp, synthetic construct
  misc_feature 1..22: note = Synthetic Construct
  source 1..22: mol_type = other DNA
gcagcttgcatgctttggaaca

SEQ ID NO: 34601 - DNA, 25 bp, synthetic construct
  misc_feature 1..25: note = Synthetic Construct
  source 1..25: mol_type = other DNA
gtgaatggaaggtgcatgtaagaag

SEQ ID NO: 34602 - DNA, 25 bp, synthetic construct
  misc_feature 1..25: note = Synthetic Construct
  source 1..25: mol_type = other DNA
ggggagaaacataatgctgggtctt

SEQ ID NO: 34603 - DNA, 22 bp, synthetic construct
  misc_feature 1..22: note = Synthetic Construct
  source 1..22: mol_type = other DNA
gacagaccaagcctggagatca

SEQ ID NO: 34604 - DNA, 26 bp, synthetic construct
  misc_feature 1..26: note = Synthetic Construct
  source 1..26: mol_type = other DNA
gcttcactaacaccagggtaggtatc

SEQ ID NO: 34605 - DNA, 22 bp, synthetic construct
  misc_feature 1..22: note = Synthetic Construct
  source 1..22: mol_type = other DNA
gctggaactgggatttcagcaa

SEQ ID NO: 34606 - DNA, 24 bp, synthetic construct
  misc_feature 1..24: note = Synthetic Construct
  source 1..24: mol_type = other DNA
gtccataacaggaccttagagcaa

SEQ ID NO: 34607 - DNA, 22 bp, synthetic construct
  misc_feature 1..22: note = Synthetic Construct
  source 1..22: mol_type = other DNA
gctcttgggagtaggtggaaac

SEQ ID NO: 34608 - DNA, 24 bp, synthetic construct
  misc_feature 1..24: note = Synthetic Construct
  source 1..24: mol_type = other DNA
ggttttgggacctagaagcagtca

SEQ ID NO: 34609 - DNA, 23 bp, synthetic construct
  misc_feature 1..23: note = Synthetic Construct
  source 1..23: mol_type = other DNA
gggatagcaggtctctgttccaa

SEQ ID NO: 34610 - DNA, 23 bp, synthetic construct
  misc_feature 1..23: note = Synthetic Construct
  source 1..23: mol_type = other DNA
ctcttctggagctctacccaact

SEQ ID NO: 34611 - DNA, 23 bp, synthetic construct
  misc_feature 1..23: note = Synthetic Construct
  source 1..23: mol_type = other DNA
ccctttttccctgaagagctgaa

SEQ ID NO: 34612 - DNA, 24 bp, synthetic construct
  misc_feature 1..24: note = Synthetic Construct
  source 1..24: mol_type = other DNA
ggactggtgaggaaggtgtaggaa

SEQ ID NO: 34613 - DNA, 22 bp, synthetic construct
  misc_feature 1..22: note = Synthetic Construct
  source 1..22: mol_type = other DNA
gcaaaactccgggatcctcaac

SEQ ID NO: 34614 - DNA, 21 bp, synthetic construct
  misc_feature 1..21: note = Synthetic Construct
  source 1..21: mol_type = other DNA
ttccctcccaggcaaggagtt

SEQ ID NO: 34615 - DNA, 18 bp, synthetic construct
  misc_feature 1..18: note = Synthetic Construct
  source 1..18: mol_type = other DNA
tgcccaggtggagggttt

SEQ ID NO: 34616 - DNA, 22 bp, synthetic construct
  misc_feature 1..22: note = Synthetic Construct
  source 1..22: mol_type = other DNA
aatcagccccaaagcaaagaac

SEQ ID NO: 34617 - DNA, 21 bp, synthetic construct
  misc_feature 1..21: note = Synthetic Construct
  source 1..21: mol_type = other DNA
ccaaagtcgggagaagccaaa

SEQ ID NO: 34618 - DNA, 20 bp, synthetic construct
  misc_feature 1..20: note = Synthetic Construct
  source 1..20: mol_type = other DNA
cctcaacacagcagccaaga

SEQ ID NO: 34619 - DNA, 23 bp, synthetic construct
  misc_feature 1..23: note = Synthetic Construct
  source 1..23: mol_type = other DNA
cccacttcggtacaagtcagaca

SEQ ID NO: 34620 - DNA, 21 bp, synthetic construct
  misc_feature 1..21: note = Synthetic Construct
  source 1..21: mol_type = other DNA
gccagtgtcactcccaagtca

SEQ ID NO: 34621 - DNA, 20 bp, synthetic construct
  misc_feature 1..20: note = Synthetic Construct
  source 1..20: mol_type = other DNA
gggtagacagcagccgtaca

SEQ ID NO: 34622 - DNA, 21 bp, synthetic construct
  misc_feature 1..21: note = Synthetic Construct
  source 1..21: mol_type = other DNA
cccctcctctgcagggttcta

SEQ ID NO: 34623 - DNA, 22 bp, synthetic construct
  misc_feature 1..22: note = Synthetic Construct
  source 1..22: mol_type = other DNA
agggtcagttgggagtagaaca

SEQ ID NO: 34624 - DNA, 24 bp, synthetic construct
  misc_feature 1..24: note = Synthetic Construct
  source 1..24: mol_type = other DNA
tgttcccacctctttatcctcctt

SEQ ID NO: 34625 - DNA, 18 bp, synthetic construct
  misc_feature 1..18: note = Synthetic Construct
  source 1..18: mol_type = other DNA
tcagcgggctgtgtgtct

SEQ ID NO: 34626 - DNA, 19 bp, synthetic construct
  misc_feature 1..19: note = Synthetic Construct
  source 1..19: mol_type = other DNA
ggagggctgcagctgaact

SEQ ID NO: 34627 - DNA, 19 bp, synthetic construct
  misc_feature 1..19: note = Synthetic Construct
  source 1..19: mol_type = other DNA
acagccacagggcacttct

SEQ ID NO: 34628 - DNA, 22 bp, synthetic construct
  misc_feature 1..22: note = Synthetic Construct
  source 1..22: mol_type = other DNA
gcagaagcttaggacggcattc

SEQ ID NO: 34629 - DNA, 26 bp, synthetic construct
  misc_feature 1..26: note = Synthetic Construct
  source 1..26: mol_type = other DNA
gcctttccacctttgtctgaggagat

SEQ ID NO: 34630 - DNA, 22 bp, synthetic construct
  misc_feature 1..22: note = Synthetic Construct
  source 1..22: mol_type = other DNA
gggcaggaatgcatgggcataa

SEQ ID NO: 34631 - DNA, 25 bp, synthetic construct
  misc_feature 1..25: note = Synthetic Construct
  source 1..25: mol_type = other DNA
aaaactgcaaggagcctattgttac

SEQ ID NO: 34632 - DNA, 20 bp, synthetic construct
  misc_feature 1..20: note = Synthetic Construct
  source 1..20: mol_type = other DNA
gcaaacagctgggcaagaga

SEQ ID NO: 34633 - DNA, 20 bp, synthetic construct
  misc_feature 1..20: note = Synthetic Construct
  source 1..20: mol_type = other DNA
tccaggagcaggaggaggta

SEQ ID NO: 34634 - DNA, 21 bp, synthetic construct
  misc_feature 1..21: note = Synthetic Construct
  source 1..21: mol_type = other DNA
ttgaatggccccagtgatgtt

SEQ ID NO: 34635 - DNA, 23 bp, synthetic construct
  misc_feature 1..23: note = Synthetic Construct
  source 1..23: mol_type = other DNA
gaggctcagaaagatgcactgat

SEQ ID NO: 34636 - DNA, 21 bp, synthetic construct
  misc_feature 1..21: note = Synthetic Construct
  source 1..21: mol_type = other DNA
aaggtgtggggagagcagtca

SEQ ID NO: 34637 - DNA, 20 bp, synthetic construct
  misc_feature 1..20: note = Synthetic Construct
  source 1..20: mol_type = other DNA
gccttcgtggctagggttgt

SEQ ID NO: 34638 - DNA, 22 bp, synthetic construct
  misc_feature 1..22: note = Synthetic Construct
  source 1..22: mol_type = other DNA
ggacggatgcaccaaacgtgat

SEQ ID NO: 34639 - DNA, 25 bp, synthetic construct
  misc_feature 1..25: note = Synthetic Construct
  source 1..25: mol_type = other DNA
ccaatcagccatttggtgaatagtt

SEQ ID NO: 34640 - DNA, 22 bp, synthetic construct
  misc_feature 1..22: note = Synthetic Construct
  source 1..22: mol_type = other DNA
cacaaaagcgcctctggtgaag

SEQ ID NO: 34641 - DNA, 19 bp, synthetic construct
  misc_feature 1..19: note = Synthetic Construct
  source 1..19: mol_type = other DNA
taacgctgtggcggactca

SEQ ID NO: 34642 - DNA, 25 bp, synthetic construct
  misc_feature 1..25: note = Synthetic Construct
  source 1..25: mol_type = other DNA
tttctacctgtgtcatttggacctt

SEQ ID NO: 34643 - DNA, 23 bp, synthetic construct
  misc_feature 1..23: note = Synthetic Construct
  source 1..23: mol_type = other DNA
accatgacacttttcctgaccat

SEQ ID NO: 34644 - DNA, 22 bp, synthetic construct
  misc_feature 1..22: note = Synthetic Construct
  source 1..22: mol_type = other DNA
gcatctccactccaagttcctt

SEQ ID NO: 34645 - DNA, 24 bp, synthetic construct
  misc_feature 1..24: note = Synthetic Construct
  source 1..24: mol_type = other DNA
gttagaaaacctctgtgccagtga

SEQ ID NO: 34646 - DNA, 25 bp, synthetic construct
  misc_feature 1..25: note = Synthetic Construct
  source 1..25: mol_type = other DNA
acgtatattttggtggggttgatgt

SEQ ID NO: 34647 - DNA, 20 bp, synthetic construct
  misc_feature 1..20: note = Synthetic Construct
  source 1..20: mol_type = other DNA
cccggagtgttccccagttt

SEQ ID NO: 34648 - DNA, 21 bp, synthetic construct
  misc_feature 1..21: note = Synthetic Construct
  source 1..21: mol_type = other DNA
aggctagtcccaggacaggaa

SEQ ID NO: 34649 - DNA, 21 bp, synthetic construct
  misc_feature 1..21: note = Synthetic Construct
  source 1..21: mol_type = other DNA
agtgctaccggctcctgaact

SEQ ID NO: 34650 - DNA, 22 bp, synthetic construct
  misc_feature 1..22: note = Synthetic Construct
  source 1..22: mol_type = other DNA
gggccactgtgattgcagactt

SEQ ID NO: 34651 - DNA, 20 bp, synthetic construct
  misc_feature 1..20: note = Synthetic Construct
  source 1..20: mol_type = other DNA
cccaggcagctggtcctcta

SEQ ID NO: 34652 - DNA, 20 bp, synthetic construct
  misc_feature 1..20: note = Synthetic Construct
  source 1..20: mol_type = other DNA
aactgatggcccctccaagt

SEQ ID NO: 34653 - DNA, 18 bp, synthetic construct
  misc_feature 1..18: note = Synthetic Construct
  source 1..18: mol_type = other DNA
tgcccaccagtgccatgt

SEQ ID NO: 34654 - DNA, 19 bp, synthetic construct
  misc_feature 1..19: note = Synthetic Construct
  source 1..19: mol_type = other DNA
aggatggcgagggctggaa

SEQ ID NO: 34655 - DNA, 23 bp, synthetic construct
  misc_feature 1..23: note = Synthetic Construct
  source 1..23: mol_type = other DNA
ttggttcccagctactacagaga

SEQ ID NO: 34656 - DNA, 24 bp, synthetic construct
  misc_feature 1..24: note = Synthetic Construct
  source 1..24: mol_type = other DNA
ggagcctggttttccatgccattc

SEQ ID NO: 34657 - DNA, 26 bp, synthetic construct
  misc_feature 1..26: note = Synthetic Construct
  source 1..26: mol_type = other DNA
cagaagaaaacaatgcaggggttatg

SEQ ID NO: 34658 - DNA, 28 bp, synthetic construct
  misc_feature 1..28: note = Synthetic Construct
  source 1..28: mol_type = other DNA
ccagctaccaaactcatttacagacaga

SEQ ID NO: 34659 - DNA, 20 bp, synthetic construct
  misc_feature 1..20: note = Synthetic Construct
  source 1..20: mol_type = other DNA
tgacttctggtgccctggtt

SEQ ID NO: 34660 - DNA, 21 bp, synthetic construct
  misc_feature 1..21: note = Synthetic Construct
  source 1..21: mol_type = other DNA
tgcaggggacccaacctttca

SEQ ID NO: 34661 - DNA, 21 bp, synthetic construct
  misc_feature 1..21: note = Synthetic Construct
  source 1..21: mol_type = other DNA
tgcctaagcagaggcagtttg

SEQ ID NO: 34662 - DNA, 25 bp, synthetic construct
  misc_feature 1..25: note = Synthetic Construct
  source 1..25: mol_type = other DNA
tccaatgtcagttggggtaactaaa

SEQ ID NO: 34663 - DNA, 27 bp, synthetic construct
  misc_feature 1..27: note = Synthetic Construct
  source 1..27: mol_type = other DNA
gtccatttccacttattccagcatttg

SEQ ID NO: 34664 - DNA, 22 bp, synthetic construct
  misc_feature 1..22: note = Synthetic Construct
  source 1..22: mol_type = other DNA
ccattgagagcaagggcaggta

SEQ ID NO: 34665 - DNA, 25 bp, synthetic construct
  misc_feature 1..25: note = Synthetic Construct
  source 1..25: mol_type = other DNA
tgacatgtgtgtttatgagggagaa

SEQ ID NO: 34666 - DNA, 19 bp, synthetic construct
  misc_feature 1..19: note = Synthetic Construct
  source 1..19: mol_type = other DNA
ttcggtgggagggctgtca

SEQ ID NO: 34667 - DNA, 26 bp, synthetic construct
  misc_feature 1..26: note = Synthetic Construct
  source 1..26: mol_type = other DNA
cctgattccttgctcctcatccatag

SEQ ID NO: 34668 - DNA, 27 bp, synthetic construct
  misc_feature 1..27: note = Synthetic Construct
  source 1..27: mol_type = other DNA
tgctgcttattgtctagaagctgtatc

SEQ ID NO: 34669 - DNA, 21 bp, synthetic construct
  misc_feature 1..21: note = Synthetic Construct
  source 1..21: mol_type = other DNA
acatccctgcctcccacaagt

SEQ ID NO: 34670 - DNA, 20 bp, synthetic construct
  misc_feature 1..20: note = Synthetic Construct
  source 1..20: mol_type = other DNA
tgctcctgcacggtcacaat

SEQ ID NO: 34671 - DNA, 23 bp, synthetic construct
  misc_feature 1..23: note = Synthetic Construct
  source 1..23: mol_type = other DNA
gtgatcatttgcccttggctaca

SEQ ID NO: 34672 - DNA, 27 bp, synthetic construct
  misc_feature 1..27: note = Synthetic Construct
  source 1..27: mol_type = other DNA
ctgacaatgattatggattggggtgtt

SEQ ID NO: 34673 - DNA, 25 bp, synthetic construct
  misc_feature 1..25: note = Synthetic Construct
  source 1..25: mol_type = other DNA
ccctagaggttcatgggtacagaca

SEQ ID NO: 34674 - DNA, 19 bp, synthetic construct
  misc_feature 1..19: note = Synthetic Construct
  source 1..19: mol_type = other DNA
acaatggagccggcactga

SEQ ID NO: 34675 - DNA, 27 bp, synthetic construct
  misc_feature 1..27: note = Synthetic Construct
  source 1..27: mol_type = other DNA
gcttgtgggtttgactgaagagacttt

SEQ ID NO: 34676 - DNA, 20 bp, synthetic construct
  misc_feature 1..20: note = Synthetic Construct
  source 1..20: mol_type = other DNA
ggccctggaagtcaggaaag

SEQ ID NO: 34677 - DNA, 21 bp, synthetic construct
  misc_feature 1..21: note = Synthetic Construct
  source 1..21: mol_type = other DNA
ccagccttggttgtcctggtt

SEQ ID NO: 34678 - DNA, 27 bp, synthetic construct
  misc_feature 1..27: note = Synthetic Construct
  source 1..27: mol_type = other DNA
ggaaggtaatacagcctgatgggagaa

SEQ ID NO: 34679 - DNA, 21 bp, synthetic construct
  misc_feature 1..21: note = Synthetic Construct
  source 1..21: mol_type = other DNA
gcaagcagtgtctggcaaatc

SEQ ID NO: 34680 - DNA, 22 bp, synthetic construct
  misc_feature 1..22: note = Synthetic Construct
  source 1..22: mol_type = other DNA
ccaactgcttcctgctgactgt

SEQ ID NO: 34681 - DNA, 22 bp, synthetic construct
  misc_feature 1..22: note = Synthetic Construct
  source 1..22: mol_type = other DNA
ggtactaatgccgctgatgctt

SEQ ID NO: 34682 - DNA, 24 bp, synthetic construct
  misc_feature 1..24: note = Synthetic Construct
  source 1..24: mol_type = other DNA
gtggtttaagtgcggactgtgttg

SEQ ID NO: 34683 - DNA, 21 bp, synthetic construct
  misc_feature 1..21: note = Synthetic Construct
  source 1..21: mol_type = other DNA
tgagggaggtcggcacctaaa

SEQ ID NO: 34684 - DNA, 19 bp, synthetic construct
  misc_feature 1..19: note = Synthetic Construct
  source 1..19: mol_type = other DNA
ggagcaggtccccagtgaa

SEQ ID NO: 34685 - DNA, 20 bp, synthetic construct
  misc_feature 1..20: note = Synthetic Construct
  source 1..20: mol_type = other DNA
agtgctgagggtggcagaca

SEQ ID NO: 34686 - DNA, 25 bp, synthetic construct
  misc_feature 1..25: note = Synthetic Construct
  source 1..25: mol_type = other DNA
gttctcaaatcaatccatggcaact

SEQ ID NO: 34687 - DNA, 23 bp, synthetic construct
  misc_feature 1..23: note = Synthetic Construct
  source 1..23: mol_type = other DNA
ccttctccagcttcccaggatac

SEQ ID NO: 34688 - DNA, 19 bp, synthetic construct
  misc_feature 1..19: note = Synthetic Construct
  source 1..19: mol_type = other DNA
aggcgatggcacgctgtct

SEQ ID NO: 34689 - DNA, 23 bp, synthetic construct
  misc_feature 1..23: note = Synthetic Construct
  source 1..23: mol_type = other DNA
caacatccaacagagccgatttt

SEQ ID NO: 34690 - DNA, 20 bp, synthetic construct
  misc_feature 1..20: note = Synthetic Construct
  source 1..20: mol_type = other DNA
acacaaggggcacccagaaa

SEQ ID NO: 34691 - DNA, 27 bp, synthetic construct
  misc_feature 1..27: note = Synthetic Construct
  source 1..27: mol_type = other DNA
gcttcaggggagataaggaaatcaaga

SEQ ID NO: 34692 - DNA, 25 bp, synthetic construct
  misc_feature 1..25: note = Synthetic Construct
  source 1..25: mol_type = other DNA
gcaatcacccaagaccaaacccaat

SEQ ID NO: 34693 - DNA, 19 bp, synthetic construct
  misc_feature 1..19: note = Synthetic Construct
  source 1..19: mol_type = other DNA
caaggggctgccttcttga

SEQ ID NO: 34694 - DNA, 20 bp, synthetic construct
  misc_feature 1..20: note = Synthetic Construct
  source 1..20: mol_type = other DNA
tgccccatttccctcagagt

SEQ ID NO: 34695 - DNA, 22 bp, synthetic construct
  misc_feature 1..22: note = Synthetic Construct
  source 1..22: mol_type = other DNA
tttgtggagaaggcaagtgtca

SEQ ID NO: 34696 - DNA, 20 bp, synthetic construct
  misc_feature 1..20: note = Synthetic Construct
  source 1..20: mol_type = other DNA
gcctgtgccatcagccaact

SEQ ID NO: 34697 - DNA, 22 bp, synthetic construct
  misc_feature 1..22: note = Synthetic Construct
  source 1..22: mol_type = other DNA
aaccagatacacctgcatgctt

SEQ ID NO: 34698 - DNA, 19 bp, synthetic construct
  misc_feature 1..19: note = Synthetic Construct
  source 1..19: mol_type = other DNA
atgccggggaaagccagaa

SEQ ID NO: 34699 - DNA, 22 bp, synthetic construct
  misc_feature 1..22: note = Synthetic Construct
  source 1..22: mol_type = other DNA
ccatctgtgctggccaatccta

SEQ ID NO: 34700 - DNA, 21 bp, synthetic construct
  misc_feature 1..21: note = Synthetic Construct
  source 1..21: mol_type = other DNA
ttcccaccatccgagactttg

SEQ ID NO: 34701 - DNA, 18 bp, synthetic construct
  misc_feature 1..18: note = Synthetic Construct
  source 1..18: mol_type = other DNA
tgtgccctgggacactga

SEQ ID NO: 34702 - DNA, 21 bp, synthetic construct
  misc_feature 1..21: note = Synthetic Construct
  source 1..21: mol_type = other DNA
gctgggtctggacccttctaa

SEQ ID NO: 34703 - DNA, 24 bp, synthetic construct
  misc_feature 1..24: note = Synthetic Construct
  source 1..24: mol_type = other DNA
ggtgtgctggaccgagattctaac

SEQ ID NO: 34704 - DNA, 20 bp, synthetic construct
  misc_feature 1..20: note = Synthetic Construct
  source 1..20: mol_type = other DNA
tgcacgcactctcccttatg

SEQ ID NO: 34705 - DNA, 22 bp, synthetic construct
  misc_feature 1..22: note = Synthetic Construct
  source 1..22: mol_type = other DNA
ggaatgctgccacttggtgtag

SEQ ID NO: 34706 - DNA, 20 bp, synthetic construct
  misc_feature 1..20: note = Synthetic Construct
  source 1..20: mol_type = other DNA
acacccacccatctctcctt

SEQ ID NO: 34707 - DNA, 19 bp, synthetic construct
  misc_feature 1..19: note = Synthetic Construct
  source 1..19: mol_type = other DNA
tgccccaggccagaagcat

SEQ ID NO: 34708 - DNA, 19 bp, synthetic construct
  misc_feature 1..19: note = Synthetic Construct
  source 1..19: mol_type = other DNA
ccgacggcagaacggaaac

SEQ ID NO: 34709 - DNA, 18 bp, synthetic construct
  misc_feature 1..18: note = Synthetic Construct
  source 1..18: mol_type = other DNA
agggcaccagaggtgaca

SEQ ID NO: 34710 - DNA, 20 bp, synthetic construct
  misc_feature 1..20: note = Synthetic Construct
  source 1..20: mol_type = other DNA
tggcaggtgctgctgtcaga

SEQ ID NO: 34711 - DNA, 20 bp, synthetic construct
  misc_feature 1..20: note = Synthetic Construct
  source 1..20: mol_type = other DNA
tgttccctgcggtaggatgt

SEQ ID NO: 34712 - DNA, 22 bp, synthetic construct
  misc_feature 1..22: note = Synthetic Construct
  source 1..22: mol_type = other DNA
gcccttgtgctttggggttcaa

SEQ ID NO: 34713 - DNA, 23 bp, synthetic construct
  misc_feature 1..23: note = Synthetic Construct
  source 1..23: mol_type = other DNA
tccttactgctcagcatggatct

SEQ ID NO: 34714 - DNA, 26 bp, synthetic construct
  misc_feature 1..26: note = Synthetic Construct
  source 1..26: mol_type = other DNA
ggaaacctcctatagtacggccagaa

SEQ ID NO: 34715 - DNA, 21 bp, synthetic construct
  misc_feature 1..21: note = Synthetic Construct
  source 1..21: mol_type = other DNA
caccagccatggacaacaagt

SEQ ID NO: 34716 - DNA, 22 bp, synthetic construct
  misc_feature 1..22: note = Synthetic Construct
  source 1..22: mol_type = other DNA
gcctcctggtattcctgtgcta

SEQ ID NO: 34717 - DNA, 23 bp, synthetic construct
  misc_feature 1..23: note = Synthetic Construct
  source 1..23: mol_type = other DNA
ccgggaaatcagaggtgggtaac

SEQ ID NO: 34718 - DNA, 22 bp, synthetic construct
  misc_feature 1..22: note = Synthetic Construct
  source 1..22: mol_type = other DNA
gtccatcaggaagcaagcacat

SEQ ID NO: 34719 - DNA, 22 bp, synthetic construct
  misc_feature 1..22: note = Synthetic Construct
  source 1..22: mol_type = other DNA
ccagcaagaggaaactgcgtaa

SEQ ID NO: 34720 - DNA, 25 bp, synthetic construct
  misc_feature 1..25: note = Synthetic Construct
  source 1..25: mol_type = other DNA
gggcagtagaaggtatcagcagtgt

SEQ ID NO: 34721 - DNA, 22 bp, synthetic construct
  misc_feature 1..22: note = Synthetic Construct
  source 1..22: mol_type = other DNA
gtgccttacttcgggagctttc

SEQ ID NO: 34722 - DNA, 18 bp, synthetic construct
  misc_feature 1..18: note = Synthetic Construct
  source 1..18: mol_type = other DNA
tgctgcgggtgaggttca

SEQ ID NO: 34723 - DNA, 21 bp, synthetic construct
  misc_feature 1..21: note = Synthetic Construct
  source 1..21: mol_type = other DNA
cccaatccgagctgcagtcat

SEQ ID NO: 34724 - DNA, 23 bp, synthetic construct
  misc_feature 1..23: note = Synthetic Construct
  source 1..23: mol_type = other DNA
tcctccatctaactcctgctcat

SEQ ID NO: 34725 - DNA, 24 bp, synthetic construct
  misc_feature 1..24: note = Synthetic Construct
  source 1..24: mol_type = other DNA
ctgccttgataactctgggcattg

SEQ ID NO: 34726 - DNA, 19 bp, synthetic construct
  misc_feature 1..19: note = Synthetic Construct
  source 1..19: mol_type = other DNA
ctggggtacccagggatgt

SEQ ID NO: 34727 - DNA, 20 bp, synthetic construct
  misc_feature 1..20: note = Synthetic Construct
  source 1..20: mol_type = other DNA
tgggccagggctgtaatcta

SEQ ID NO: 34728 - DNA, 20 bp, synthetic construct
  misc_feature 1..20: note = Synthetic Construct
  source 1..20: mol_type = other DNA
accggccgaggggtctttga

SEQ ID NO: 34729 - DNA, 21 bp, synthetic construct
  misc_feature 1..21: note = Synthetic Construct
  source 1..21: mol_type = other DNA
tcccttccccacctctctttc

SEQ ID NO: 34730 - DNA, 20 bp, synthetic construct
  misc_feature 1..20: note = Synthetic Construct
  source 1..20: mol_type = other DNA
ccgaaagctctgccaggaaa

SEQ ID NO: 34731 - DNA, 24 bp, synthetic construct
  misc_feature 1..24: note = Synthetic Construct
  source 1..24: mol_type = other DNA
gtgccaatttttgtggggctgata

SEQ ID NO: 34732 - DNA, 21 bp, synthetic construct
  misc_feature 1..21: note = Synthetic Construct
  source 1..21: mol_type = other DNA
cctctccaccaagcacagcat

SEQ ID NO: 34733 - DNA, 22 bp, synthetic construct
  misc_feature 1..22: note = Synthetic Construct
  source 1..22: mol_type = other DNA
ctgccactgtccatccacatct

SEQ ID NO: 34734 - DNA, 20 bp, synthetic construct
  misc_feature 1..20: note = Synthetic Construct
  source 1..20: mol_type = other DNA
tgcaaagtgcatggcacaga

SEQ ID NO: 34735 - DNA, 19 bp, synthetic construct
  misc_feature 1..19: note = Synthetic Construct
  source 1..19: mol_type = other DNA
ggtggcgctgtctctccat

SEQ ID NO: 34736 - DNA, 22 bp, synthetic construct
  misc_feature 1..22: note = Synthetic Construct
  source 1..22: mol_type = other DNA
tcctggcatcaagactgtgaac

SEQ ID NO: 34737 - DNA, 26 bp, synthetic construct
  misc_feature 1..26: note = Synthetic Construct
  source 1..26: mol_type = other DNA
gtctttgtttacctccagggttccta

SEQ ID NO: 34738 - DNA, 24 bp, synthetic construct
  misc_feature 1..24: note = Synthetic Construct
  source 1..24: mol_type = other DNA
ccatctctgcattcccaaatggat

SEQ ID NO: 34739 - DNA, 24 bp, synthetic construct
  misc_feature 1..24: note = Synthetic Construct
  source 1..24: mol_type = other DNA
ccctctgttttcagctccactttc

SEQ ID NO: 34740 - DNA, 23 bp, synthetic construct
  misc_feature 1..23: note = Synthetic Construct
  source 1..23: mol_type = other DNA
cagacttcacccactttgctctt

SEQ ID NO: 34741 - DNA, 20 bp, synthetic construct
  misc_feature 1..20: note = Synthetic Construct
  source 1..20: mol_type = other DNA
tgggctgagcggctttctta

SEQ ID NO: 34742 - DNA, 24 bp, synthetic construct
  misc_feature 1..24: note = Synthetic Construct
  source 1..24: mol_type = other DNA
gggatagcccttgtggctactttc

SEQ ID NO: 34743 - DNA, 27 bp, synthetic construct
  misc_feature 1..27: note = Synthetic Construct
  source 1..27: mol_type = other DNA
tcccattggaaagtatggactacaaag

SEQ ID NO: 34744 - DNA, 24 bp, synthetic construct
  misc_feature 1..24: note = Synthetic Construct
  source 1..24: mol_type = other DNA
gttcaggagtaaggaatggaccaa

SEQ ID NO: 34745 - DNA, 20 bp, synthetic construct
  misc_feature 1..20: note = Synthetic Construct
  source 1..20: mol_type = other DNA
acttggcaggaagggtggat

SEQ ID NO: 34746 - DNA, 18 bp, synthetic construct
  misc_feature 1..18: note = Synthetic Construct
  source 1..18: mol_type = other DNA
tccacccctgccccaaat

SEQ ID NO: 34747 - DNA, 22 bp, synthetic construct
  misc_feature 1..22: note = Synthetic Construct
  source 1..22: mol_type = other DNA
ggcagacgggattcagttgcta

SEQ ID NO: 34748 - DNA, 18 bp, synthetic construct
  misc_feature 1..18: note = Synthetic Construct
  source 1..18: mol_type = other DNA
accatgctggcccacagt

SEQ ID NO: 34749 - DNA, 21 bp, synthetic construct
  misc_feature 1..21: note = Synthetic Construct
  source 1..21: mol_type = other DNA
gggactttcccaggccatgta

SEQ ID NO: 34750 - DNA, 26 bp, synthetic construct
  misc_feature 1..26: note = Synthetic Construct
  source 1..26: mol_type = other DNA
gtcttgtgctgaatgctgaatggttt

SEQ ID NO: 34751 - DNA, 19 bp, synthetic construct
  misc_feature 1..19: note = Synthetic Construct
  source 1..19: mol_type = other DNA
cctggctccatgggtcact

SEQ ID NO: 34752 - DNA, 19 bp, synthetic construct
  misc_feature 1..19: note = Synthetic Construct
  source 1..19: mol_type = other DNA
tctggggtgccaccagcaa

SEQ ID NO: 34753 - DNA, 22 bp, synthetic construct
  misc_feature 1..22: note = Synthetic Construct
  source 1..22: mol_type = other DNA
gcctcttcatacctgcagaact

SEQ ID NO: 34754 - DNA, 22 bp, synthetic construct
  misc_feature 1..22: note = Synthetic Construct
  source 1..22: mol_type = other DNA
gcaggtggagtctgaagtgtca

SEQ ID NO: 34755 - DNA, 26 bp, synthetic construct
  misc_feature 1..26: note = Synthetic Construct
  source 1..26: mol_type = other DNA
gtcctcattatccactccttccctta

SEQ ID NO: 34756 - DNA, 21 bp, synthetic construct
  misc_feature 1..21: note = Synthetic Construct
  source 1..21: mol_type = other DNA
aggctgcagaacagcaaagat

SEQ ID NO: 34757 - DNA, 22 bp, synthetic construct
  misc_feature 1..22: note = Synthetic Construct
  source 1..22: mol_type = other DNA
ctggtgggccttatggacaaga

SEQ ID NO: 34758 - DNA, 24 bp, synthetic construct
  misc_feature 1..24: note = Synthetic Construct
  source 1..24: mol_type = other DNA
ctggggccagagtctgattcttag

SEQ ID NO: 34759 - DNA, 22 bp, synthetic construct
  misc_feature 1..22: note = Synthetic Construct
  source 1..22: mol_type = other DNA
gcactggagatgaggctgcttt

SEQ ID NO: 34760 - DNA, 20 bp, synthetic construct
  misc_feature 1..20: note = Synthetic Construct
  source 1..20: mol_type = other DNA
tttctgccccacctgcacaa

SEQ ID NO: 34761 - DNA, 24 bp, synthetic construct
  misc_feature 1..24: note = Synthetic Construct
  source 1..24: mol_type = other DNA
ccaaaactatctcaggtgcaggaa

SEQ ID NO: 34762 - DNA, 22 bp, synthetic construct
  misc_feature 1..22: note = Synthetic Construct
  source 1..22: mol_type = other DNA
cctctggcaaagcacccattca

SEQ ID NO: 34763 - DNA, 20 bp, synthetic construct
  misc_feature 1..20: note = Synthetic Construct
  source 1..20: mol_type = other DNA
agagccaagaggctgcaaca

SEQ ID NO: 34764 - DNA, 22 bp, synthetic construct
  misc_feature 1..22: note = Synthetic Construct
  source 1..22: mol_type = other DNA
gcagtgagccagtagccttttg

SEQ ID NO: 34765 - DNA, 23 bp, synthetic construct
  misc_feature 1..23: note = Synthetic Construct
  source 1..23: mol_type = other DNA
gctccaaggtactagtgctgcat

SEQ ID NO: 34766 - DNA, 22 bp, synthetic construct
  misc_feature 1..22: note = Synthetic Construct
  source 1..22: mol_type = other DNA
ggccaacctctgtaccttcagt

SEQ ID NO: 34767 - DNA, 23 bp, synthetic construct
  misc_feature 1..23: note = Synthetic Construct
  source 1..23: mol_type = other DNA
cacttctcagtctctcccctttg

SEQ ID NO: 34768 - DNA, 22 bp, synthetic construct
  misc_feature 1..22: note = Synthetic Construct
  source 1..22: mol_type = other DNA
ctcctggtttgcctggtactct

SEQ ID NO: 34769 - DNA, 20 bp, synthetic construct
  misc_feature 1..20: note = Synthetic Construct
  source 1..20: mol_type = other DNA
agggagggaccagtcaactt

SEQ ID NO: 34770 - DNA, 29 bp, synthetic construct
  misc_feature 1..29: note = Synthetic Construct
  source 1..29: mol_type = other DNA
gccctacaggtttacatgcaaagatattc

SEQ ID NO: 34771 - DNA, 21 bp, synthetic construct
  misc_feature 1..21: note = Synthetic Construct
  source 1..21: mol_type = other DNA
gctgtccatgcagagctaagt

SEQ ID NO: 34772 - DNA, 22 bp, synthetic construct
  misc_feature 1..22: note = Synthetic Construct
  source 1..22: mol_type = other DNA
gaatgaactggcaggcatctgt

SEQ ID NO: 34773 - DNA, 22 bp, synthetic construct
  misc_feature 1..22: note = Synthetic Construct
  source 1..22: mol_type = other DNA
ggctaagggaatgccgacataa

SEQ ID NO: 34774 - DNA, 20 bp, synthetic construct
  misc_feature 1..20: note = Synthetic Construct
  source 1..20: mol_type = other DNA
gccagaagggaatcgccaat

SEQ ID NO: 34775 - DNA, 20 bp, synthetic construct
  misc_feature 1..20: note = Synthetic Construct
  source 1..20: mol_type = other DNA
ttccatccccggagcaactt

SEQ ID NO: 34776 - DNA, 21 bp, synthetic construct
  misc_feature 1..21: note = Synthetic Construct
  source 1..21: mol_type = other DNA
ttgaaggaagtggcagccttt

SEQ ID NO: 34777 - DNA, 20 bp, synthetic construct
  misc_feature 1..20: note = Synthetic Construct
  source 1..20: mol_type = other DNA
gccttccctggagctcgtta

SEQ ID NO: 34778 - DNA, 26 bp, synthetic construct
  misc_feature 1..26: note = Synthetic Construct
  source 1..26: mol_type = other DNA
ctgaaatggcagcctttatgttcatc

SEQ ID NO: 34779 - DNA, 20 bp, synthetic construct
  misc_feature 1..20: note = Synthetic Construct
  source 1..20: mol_type = other DNA
ttcctcggagtgctgctttg

SEQ ID NO: 34780 - DNA, 20 bp, synthetic construct
  misc_feature 1..20: note = Synthetic Construct
  source 1..20: mol_type = other DNA
tggagctggcaggagtcagt

SEQ ID NO: 34781 - DNA, 20 bp, synthetic construct
  misc_feature 1..20: note = Synthetic Construct
  source 1..20: mol_type = other DNA
gggctgtgaggtttgtgtca

SEQ ID NO: 34782 - DNA, 22 bp, synthetic construct
  misc_feature 1..22: note = Synthetic Construct
  source 1..22: mol_type = other DNA
gctcagggcttgcacattcctt

SEQ ID NO: 34783 - DNA, 22 bp, synthetic construct
  misc_feature 1..22: note = Synthetic Construct
  source 1..22: mol_type = other DNA
tgccctaacttctcctgcattg

SEQ ID NO: 34784 - DNA, 21 bp, synthetic construct
  misc_feature 1..21: note = Synthetic Construct
  source 1..21: mol_type = other DNA
accaggccttccttctagtca

SEQ ID NO: 34785 - DNA, 20 bp, synthetic construct
  misc_feature 1..20: note = Synthetic Construct
  source 1..20: mol_type = other DNA
gggtgagccgaatgttcact

SEQ ID NO: 34786 - DNA, 22 bp, synthetic construct
  misc_feature 1..22: note = Synthetic Construct
  source 1..22: mol_type = other DNA
cccagccagagaggtatcaact

SEQ ID NO: 34787 - DNA, 23 bp, synthetic construct
  misc_feature 1..23: note = Synthetic Construct
  source 1..23: mol_type = other DNA
gctactttgcagctaccactgaa

SEQ ID NO: 34788 - DNA, 26 bp, synthetic construct
  misc_feature 1..26: note = Synthetic Construct
  source 1..26: mol_type = other DNA
ctgaagtatcatctcttccccggatt

SEQ ID NO: 34789 - DNA, 22 bp, synthetic construct
  misc_feature 1..22: note = Synthetic Construct
  source 1..22: mol_type = other DNA
cagaggggtaggatgcatgaga

SEQ ID NO: 34790 - DNA, 26 bp, synthetic construct
  misc_feature 1..26: note = Synthetic Construct
  source 1..26: mol_type = other DNA
ctgatgctagatcctccttctacttg

SEQ ID NO: 34791 - DNA, 20 bp, synthetic construct
  misc_feature 1..20: note = Synthetic Construct
  source 1..20: mol_type = other DNA
ggcaataggagcctgcagat

SEQ ID NO: 34792 - DNA, 20 bp, synthetic construct
  misc_feature 1..20: note = Synthetic Construct
  source 1..20: mol_type = other DNA
gggctgttgggccaagattt

SEQ ID NO: 34793 - DNA, 27 bp, synthetic construct
  misc_feature 1..27: note = Synthetic Construct
  source 1..27: mol_type = other DNA
cccaactatttttgggttaggaagaac

SEQ ID NO: 34794 - DNA, 22 bp, synthetic construct
  misc_feature 1..22: note = Synthetic Construct
  source 1..22: mol_type = other DNA
gggtgacacctgaggttcttga

SEQ ID NO: 34795 - DNA, 22 bp, synthetic construct
  misc_feature 1..22: note = Synthetic Construct
  source 1..22: mol_type = other DNA
cccaaaatgcctcctgggaaac

SEQ ID NO: 34796 - DNA, 25 bp, synthetic construct
  misc_feature 1..25: note = Synthetic Construct
  source 1..25: mol_type = other DNA
ggaacatctcatggtcacgtatttg

SEQ ID NO: 34797 - DNA, 25 bp, synthetic construct
  misc_feature 1..25: note = Synthetic Construct
  source 1..25: mol_type = other DNA
ggtctagggtctcaatttggtcagt

SEQ ID NO: 34798 - DNA, 24 bp, synthetic construct
  misc_feature 1..24: note = Synthetic Construct
  source 1..24: mol_type = other DNA
ccctttggatgactcttcgcacat

SEQ ID NO: 34799 - DNA, 20 bp, synthetic construct
  misc_feature 1..20: note = Synthetic Construct
  source 1..20: mol_type = other DNA
ccactgccaccactgacaaa

SEQ ID NO: 34800 - DNA, 23 bp, synthetic construct
  misc_feature 1..23: note = Synthetic Construct
  source 1..23: mol_type = other DNA
gagtggtttcccatcagggatga

SEQ ID NO: 34801 - DNA, 21 bp, synthetic construct
  misc_feature 1..21: note = Synthetic Construct
  source 1..21: mol_type = other DNA
ggcaaaactgcaacactgtga

SEQ ID NO: 34802 - DNA, 24 bp, synthetic construct
  misc_feature 1..24: note = Synthetic Construct
  source 1..24: mol_type = other DNA
tgcaggtttctcacataactcctt

SEQ ID NO: 34803 - DNA, 24 bp, synthetic construct
  misc_feature 1..24: note = Synthetic Construct
  source 1..24: mol_type = other DNA
ttctctccagcagcactctttatt

SEQ ID NO: 34804 - DNA, 20 bp, synthetic construct
  misc_feature 1..20: note = Synthetic Construct
  source 1..20: mol_type = other DNA
ctgtggcccatgaagcatct

SEQ ID NO: 34805 - DNA, 21 bp, synthetic construct
  misc_feature 1..21: note = Synthetic Construct
  source 1..21: mol_type = other DNA
tgtctgcttcctagcgtcttc

SEQ ID NO: 34806 - DNA, 27 bp, synthetic construct
  misc_feature 1..27: note = Synthetic Construct
  source 1..27: mol_type = other DNA
cacacatttcaggagcttgatctcatc

SEQ ID NO: 34807 - DNA, 26 bp, synthetic construct
  misc_feature 1..26: note = Synthetic Construct
  source 1..26: mol_type = other DNA
ggaaccatgttcctttccaggttgtt

SEQ ID NO: 34808 - DNA, 23 bp, synthetic construct
  misc_feature 1..23: note = Synthetic Construct
  source 1..23: mol_type = other DNA
tcatcatcccagagacacagcta

SEQ ID NO: 34809 - DNA, 24 bp, synthetic construct
  misc_feature 1..24: note = Synthetic Construct
  source 1..24: mol_type = other DNA
ccttgtgctgctaaccatgagact

SEQ ID NO: 34810 - DNA, 24 bp, synthetic construct
  misc_feature 1..24: note = Synthetic Construct
  source 1..24: mol_type = other DNA
ggaccctagtgattctcccatcat

SEQ ID NO: 34811 - DNA, 22 bp, synthetic construct
  misc_feature 1..22: note = Synthetic Construct
  source 1..22: mol_type = other DNA
cacacttttcggtggtgccttt

SEQ ID NO: 34812 - DNA, 22 bp, synthetic construct
  misc_feature 1..22: note = Synthetic Construct
  source 1..22: mol_type = other DNA
aggagccaagaacaaggagaag

SEQ ID NO: 34813 - DNA, 23 bp, synthetic construct
  misc_feature 1..23: note = Synthetic Construct
  source 1..23: mol_type = other DNA
tggccataacagagtaggtgtga

SEQ ID NO: 34814 - DNA, 20 bp, synthetic construct
  misc_feature 1..20: note = Synthetic Construct
  source 1..20: mol_type = other DNA
tagccccacgtgtcttccta

SEQ ID NO: 34815 - DNA, 24 bp, synthetic construct
  misc_feature 1..24: note = Synthetic Construct
  source 1..24: mol_type = other DNA
acttgttcacttgctaggggatac

SEQ ID NO: 34816 - DNA, 22 bp, synthetic construct
  misc_feature 1..22: note = Synthetic Construct
  source 1..22: mol_type = other DNA
cagagagaaggaggcccaaaga

SEQ ID NO: 34817 - DNA, 22 bp, synthetic construct
  misc_feature 1..22: note = Synthetic Construct
  source 1..22: mol_type = other DNA
tgtcagtaacggtggagaccta

SEQ ID NO: 34818 - DNA, 24 bp, synthetic construct
  misc_feature 1..24: note = Synthetic Construct
  source 1..24: mol_type = other DNA
gccttttaattagccttgcagctt

SEQ ID NO: 34819 - DNA, 20 bp, synthetic construct
  misc_feature 1..20: note = Synthetic Construct
  source 1..20: mol_type = other DNA
agtgggagcctcgtaagcat

SEQ ID NO: 34820 - DNA, 24 bp, synthetic construct
  misc_feature 1..24: note = Synthetic Construct
  source 1..24: mol_type = other DNA
ggaataggtaggtgcaagcagttg

SEQ ID NO: 34821 - DNA, 25 bp, synthetic construct
  misc_feature 1..25: note = Synthetic Construct
  source 1..25: mol_type = other DNA
atccacaatttccctaggctagaag

SEQ ID NO: 34822 - DNA, 25 bp, synthetic construct
  misc_feature 1..25: note = Synthetic Construct
  source 1..25: mol_type = other DNA
gcctagggttctcttccttcccttt

SEQ ID NO: 34823 - DNA, 20 bp, synthetic construct
  misc_feature 1..20: note = Synthetic Construct
  source 1..20: mol_type = other DNA
tggttccccgagctcttttc

SEQ ID NO: 34824 - DNA, 25 bp, synthetic construct
  misc_feature 1..25: note = Synthetic Construct
  source 1..25: mol_type = other DNA
tgggtctagaaggaaactgactttg

SEQ ID NO: 34825 - DNA, 21 bp, synthetic construct
  misc_feature 1..21: note = Synthetic Construct
  source 1..21: mol_type = other DNA
gggctcagggagaaaatcaca

SEQ ID NO: 34826 - DNA, 21 bp, synthetic construct
  misc_feature 1..21: note = Synthetic Construct
  source 1..21: mol_type = other DNA
tgagtcttacggggacgaagt

SEQ ID NO: 34827 - DNA, 24 bp, synthetic construct
  misc_feature 1..24: note = Synthetic Construct
  source 1..24: mol_type = other DNA
gatgaccttgccagagaaaacaga

SEQ ID NO: 34828 - DNA, 20 bp, synthetic construct
  misc_feature 1..20: note = Synthetic Construct
  source 1..20: mol_type = other DNA
gcagggctcctgggctaatg

SEQ ID NO: 34829 - DNA, 28 bp, synthetic construct
  misc_feature 1..28: note = Synthetic Construct
  source 1..28: mol_type = other DNA
cctgtgagcaaaagaaagtacaggctat

SEQ ID NO: 34830 - DNA, 18 bp, synthetic construct
  misc_feature 1..18: note = Synthetic Construct
  source 1..18: mol_type = other DNA
aggaacacggggccattg

SEQ ID NO: 34831 - DNA, 20 bp, synthetic construct
  misc_feature 1..20: note = Synthetic Construct
  source 1..20: mol_type = other DNA
agcatctctctgccctgtga

SEQ ID NO: 34832 - DNA, 25 bp, synthetic construct
  misc_feature 1..25: note = Synthetic Construct
  source 1..25: mol_type = other DNA
ggtttgtggtcagtgactccttgta

SEQ ID NO: 34833 - DNA, 18 bp, synthetic construct
  misc_feature 1..18: note = Synthetic Construct
  source 1..18: mol_type = other DNA
aggtgggtgggagcagaa

SEQ ID NO: 34834 - DNA, 20 bp, synthetic construct
  misc_feature 1..20: note = Synthetic Construct
  source 1..20: mol_type = other DNA
ggcacttggcaggcaaaaca

SEQ ID NO: 34835 - DNA, 22 bp, synthetic construct
  misc_feature 1..22: note = Synthetic Construct
  source 1..22: mol_type = other DNA
tctgggaagagcaatggagtct

SEQ ID NO: 34836 - DNA, 20 bp, synthetic construct
  misc_feature 1..20: note = Synthetic Construct
  source 1..20: mol_type = other DNA
tgcgcaagtccacagtgagt

SEQ ID NO: 34837 - DNA, 20 bp, synthetic construct
  misc_feature 1..20: note = Synthetic Construct
  source 1..20: mol_type = other DNA
ggctcaatgcctggccctat

SEQ ID NO: 34838 - DNA, 25 bp, synthetic construct
  misc_feature 1..25: note = Synthetic Construct
  source 1..25: mol_type = other DNA
ctgagaaaggaggcttcttgggatt

SEQ ID NO: 34839 - DNA, 19 bp, synthetic construct
  misc_feature 1..19: note = Synthetic Construct
  source 1..19: mol_type = other DNA
cgcgtcccatgacgtgaac

SEQ ID NO: 34840 - DNA, 20 bp, synthetic construct
  misc_feature 1..20: note = Synthetic Construct
  source 1..20: mol_type = other DNA
tttccgcatggcctgtcatc

SEQ ID NO: 34841 - DNA, 22 bp, synthetic construct
  misc_feature 1..22: note = Synthetic Construct
  source 1..22: mol_type = other DNA
tggggacagaggagtcctaact

SEQ ID NO: 34842 - DNA, 26 bp, synthetic construct
  misc_feature 1..26: note = Synthetic Construct
  source 1..26: mol_type = other DNA
ctctctgtgtaggctgagtttctttg

SEQ ID NO: 34843 - DNA, 25 bp, synthetic construct
  misc_feature 1..25: note = Synthetic Construct
  source 1..25: mol_type = other DNA
ccatctgtgacccttgcatagttag

SEQ ID NO: 34844 - DNA, 27 bp, synthetic construct
  misc_feature 1..27: note = Synthetic Construct
  source 1..27: mol_type = other DNA
agaagttctgccctaaataacctctac

SEQ ID NO: 34845 - DNA, 24 bp, synthetic construct
  misc_feature 1..24: note = Synthetic Construct
  source 1..24: mol_type = other DNA
tctcactacaaaaacccagtgctt

SEQ ID NO: 34846 - DNA, 23 bp, synthetic construct
  misc_feature 1..23: note = Synthetic Construct
  source 1..23: mol_type = other DNA
gttgaacaatgagccccatccat

SEQ ID NO: 34847 - DNA, 19 bp, synthetic construct
  misc_feature 1..19: note = Synthetic Construct
  source 1..19: mol_type = other DNA
ggccatgcagaccctctgt

SEQ ID NO: 34848 - DNA, 22 bp, synthetic construct
  misc_feature 1..22: note = Synthetic Construct
  source 1..22: mol_type = other DNA
cctgggtgaagccaagaaccta

SEQ ID NO: 34849 - DNA, 22 bp, synthetic construct
  misc_feature 1..22: note = Synthetic Construct
  source 1..22: mol_type = other DNA
cccctgctacagaatgcagctt

SEQ ID NO: 34850 - DNA, 23 bp, synthetic construct
  misc_feature 1..23: note = Synthetic Construct
  source 1..23: mol_type = other DNA
acaggggatgtaaacccactttg

SEQ ID NO: 34851 - DNA, 27 bp, synthetic construct
  misc_feature 1..27: note = Synthetic Construct
  source 1..27: mol_type = other DNA
gcatatgtcctagaacaacctgagcat

SEQ ID NO: 34852 - DNA, 24 bp, synthetic construct
  misc_feature 1..24: note = Synthetic Construct
  source 1..24: mol_type = other DNA
ccactatatgcctggggacctcaa

SEQ ID NO: 34853 - DNA, 23 bp, synthetic construct
  misc_feature 1..23: note = Synthetic Construct
  source 1..23: mol_type = other DNA
agtggggacatagggaaaagtgt

SEQ ID NO: 34854 - DNA, 22 bp, synthetic construct
  misc_feature 1..22: note = Synthetic Construct
  source 1..22: mol_type = other DNA
ccatggggaatctgggcaatca

SEQ ID NO: 34855 - DNA, 25 bp, synthetic construct
  misc_feature 1..25: note = Synthetic Construct
  source 1..25: mol_type = other DNA
ccatgtctagtcaagggcaggtaga

SEQ ID NO: 34856 - DNA, 24 bp, synthetic construct
  misc_feature 1..24: note = Synthetic Construct
  source 1..24: mol_type = other DNA
gtgttcaaattgcagtgctctgtt

SEQ ID NO: 34857 - DNA, 24 bp, synthetic construct
  misc_feature 1..24: note = Synthetic Construct
  source 1..24: mol_type = other DNA
tctgtctgagtgaagatggagaca

SEQ ID NO: 34858 - DNA, 20 bp, synthetic construct
  misc_feature 1..20: note = Synthetic Construct
  source 1..20: mol_type = other DNA
gcaccagccagggataccat

SEQ ID NO: 34859 - DNA, 27 bp, synthetic construct
  misc_feature 1..27: note = Synthetic Construct
  source 1..27: mol_type = other DNA
cccacaggttttagcaaatgactgctt

SEQ ID NO: 34860 - DNA, 25 bp, synthetic construct
  misc_feature 1..25: note = Synthetic Construct
  source 1..25: mol_type = other DNA
gctgtctgctctatcttccaaatgt

SEQ ID NO: 34861 - DNA, 21 bp, synthetic construct
  misc_feature 1..21: note = Synthetic Construct
  source 1..21: mol_type = other DNA
gggagctgaggacctgcaatc

SEQ ID NO: 34862 - DNA, 25 bp, synthetic construct
  misc_feature 1..25: note = Synthetic Construct
  source 1..25: mol_type = other DNA
tggcttctagagcaagagaatcaag

SEQ ID NO: 34863 - DNA, 25 bp, synthetic construct
  misc_feature 1..25: note = Synthetic Construct
  source 1..25: mol_type = other DNA
ggctgtttcctaaggctctgtccat

SEQ ID NO: 34864 - DNA, 22 bp, synthetic construct
  misc_feature 1..22: note = Synthetic Construct
  source 1..22: mol_type = other DNA
ccccactgctgatcaagccaaa

SEQ ID NO: 34865 - DNA, 22 bp, synthetic construct
  misc_feature 1..22: note = Synthetic Construct
  source 1..22: mol_type = other DNA
ctgacccttccttctcccatca

SEQ ID NO: 34866 - DNA, 24 bp, synthetic construct
  misc_feature 1..24: note = Synthetic Construct
  source 1..24: mol_type = other DNA
ccctagaaagcaactccagccaaa

SEQ ID NO: 34867 - DNA, 26 bp, synthetic construct
  misc_feature 1..26: note = Synthetic Construct
  source 1..26: mol_type = other DNA
ccccattaagaaaagtcagcagtatc

SEQ ID NO: 34868 - DNA, 24 bp, synthetic construct
  misc_feature 1..24: note = Synthetic Construct
  source 1..24: mol_type = other DNA
tgtcaatggatttccagctcacat

SEQ ID NO: 34869 - DNA, 20 bp, synthetic construct
  misc_feature 1..20: note = Synthetic Construct
  source 1..20: mol_type = other DNA
agggttcagggcatctgtct

SEQ ID NO: 34870 - DNA, 22 bp, synthetic construct
  misc_feature 1..22: note = Synthetic Construct
  source 1..22: mol_type = other DNA
tggtgtctccctgtggaacaga

SEQ ID NO: 34871 - DNA, 25 bp, synthetic construct
  misc_feature 1..25: note = Synthetic Construct
  source 1..25: mol_type = other DNA
tccagctaattttacccaaccttca

SEQ ID NO: 34872 - DNA, 23 bp, synthetic construct
  misc_feature 1..23: note = Synthetic Construct
  source 1..23: mol_type = other DNA
tggcctgtgggagtaaaaacttg

SEQ ID NO: 34873 - DNA, 24 bp, synthetic construct
  misc_feature 1..24: note = Synthetic Construct
  source 1..24: mol_type = other DNA
ttcttcatcagcacagtgacaaac

SEQ ID NO: 34874 - DNA, 20 bp, synthetic construct
  misc_feature 1..20: note = Synthetic Construct
  source 1..20: mol_type = other DNA
ggagccagtgctgaggaagt

SEQ ID NO: 34875 - DNA, 24 bp, synthetic construct
  misc_feature 1..24: note = Synthetic Construct
  source 1..24: mol_type = other DNA
gaccttgtgaaggagatgctgatg

SEQ ID NO: 34876 - DNA, 26 bp, synthetic construct
  misc_feature 1..26: note = Synthetic Construct
  source 1..26: mol_type = other DNA
tgaataagtgctcctggtctcaattc

SEQ ID NO: 34877 - DNA, 23 bp, synthetic construct
  misc_feature 1..23: note = Synthetic Construct
  source 1..23: mol_type = other DNA
cactttggatgcatgaggctgtt

SEQ ID NO: 34878 - DNA, 21 bp, synthetic construct
  misc_feature 1..21: note = Synthetic Construct
  source 1..21: mol_type = other DNA
ggtggtgtcaggaccatgctt

SEQ ID NO: 34879 - DNA, 23 bp, synthetic construct
  misc_feature 1..23: note = Synthetic Construct
  source 1..23: mol_type = other DNA
cccctagccagcagagattgatg

SEQ ID NO: 34880 - DNA, 26 bp, synthetic construct
  misc_feature 1..26: note = Synthetic Construct
  source 1..26: mol_type = other DNA
gcacttccttccttctgaagcccata

SEQ ID NO: 34881 - DNA, 24 bp, synthetic construct
  misc_feature 1..24: note = Synthetic Construct
  source 1..24: mol_type = other DNA
tgctacttactacccgcttgatct

SEQ ID NO: 34882 - DNA, 22 bp, synthetic construct
  misc_feature 1..22: note = Synthetic Construct
  source 1..22: mol_type = other DNA
ggaccctcagaacacctcaaca

SEQ ID NO: 34883 - DNA, 22 bp, synthetic construct
  misc_feature 1..22: note = Synthetic Construct
  source 1..22: mol_type = other DNA
ccacctgcttgtgttggtgaca

SEQ ID NO: 34884 - DNA, 23 bp, synthetic construct
  misc_feature 1..23: note = Synthetic Construct
  source 1..23: mol_type = other DNA
tgttagagaaggagggcgttttc

SEQ ID NO: 34885 - DNA, 22 bp, synthetic construct
  misc_feature 1..22: note = Synthetic Construct
  source 1..22: mol_type = other DNA
gtccccactcatgcagaactga

SEQ ID NO: 34886 - DNA, 24 bp, synthetic construct
  misc_feature 1..24: note = Synthetic Construct
  source 1..24: mol_type = other DNA
agcaccgtaattcttcacctaaca

SEQ ID NO: 34887 - DNA, 29 bp, synthetic construct
  misc_feature 1..29: note = Synthetic Construct
  source 1..29: mol_type = other DNA
gacactttggaaatactagagctgtcctt

SEQ ID NO: 34888 - DNA, 23 bp, synthetic construct
  misc_feature 1..23: note = Synthetic Construct
  source 1..23: mol_type = other DNA
gggaattggcctgggaaaactgt

SEQ ID NO: 34889 - DNA, 22 bp, synthetic construct
  misc_feature 1..22: note = Synthetic Construct
  source 1..22: mol_type = other DNA
gctgtgtcctgtcattgggaat

SEQ ID NO: 34890 - DNA, 23 bp, synthetic construct
  misc_feature 1..23: note = Synthetic Construct
  source 1..23: mol_type = other DNA
gtcacagagttccagatcccaaa

SEQ ID NO: 34891 - DNA, 23 bp, synthetic construct
  misc_feature 1..23: note = Synthetic Construct
  source 1..23: mol_type = other DNA
cccttgtggaagagggaaagttg

SEQ ID NO: 34892 - DNA, 23 bp, synthetic construct
  misc_feature 1..23: note = Synthetic Construct
  source 1..23: mol_type = other DNA
caatggccctactgcttttgtct

SEQ ID NO: 34893 - DNA, 21 bp, synthetic construct
  misc_feature 1..21: note = Synthetic Construct
  source 1..21: mol_type = other DNA
cctgggtaaccagctcagcaa

SEQ ID NO: 34894 - DNA, 19 bp, synthetic construct
  misc_feature 1..19: note = Synthetic Construct
  source 1..19: mol_type = other DNA
aggtgcggggacagtggta

SEQ ID NO: 34895 - DNA, 22 bp, synthetic construct
  misc_feature 1..22: note = Synthetic Construct
  source 1..22: mol_type = other DNA
ccccagctgttgagagtgttga

SEQ ID NO: 34896 - DNA, 25 bp, synthetic construct
  misc_feature 1..25: note = Synthetic Construct
  source 1..25: mol_type = other DNA
caaatgttgtcaagacatccaccat

SEQ ID NO: 34897 - DNA, 19 bp, synthetic construct
  misc_feature 1..19: note = Synthetic Construct
  source 1..19: mol_type = other DNA
agcactgggcaggcagaca

SEQ ID NO: 34898 - DNA, 24 bp, synthetic construct
  misc_feature 1..24: note = Synthetic Construct
  source 1..24: mol_type = other DNA
ccacacccaaggaccatatgtaac

SEQ ID NO: 34899 - DNA, 19 bp, synthetic construct
  misc_feature 1..19: note = Synthetic Construct
  source 1..19: mol_type = other DNA
tgtgcacctcccgcttttg

SEQ ID NO: 34900 - DNA, 27 bp, synthetic construct
  misc_feature 1..27: note = Synthetic Construct
  source 1..27: mol_type = other DNA
gcagctaatggttgtcatagggaggaa

SEQ ID NO: 34901 - DNA, 20 bp, synthetic construct
  misc_feature 1..20: note = Synthetic Construct
  source 1..20: mol_type = other DNA
atcccagcttccgtggtttc

SEQ ID NO: 34902 - DNA, 25 bp, synthetic construct
  misc_feature 1..25: note = Synthetic Construct
  source 1..25: mol_type = other DNA
tctacatgtaaagatgcgcttccaa

SEQ ID NO: 34903 - DNA, 20 bp, synthetic construct
  misc_feature 1..20: note = Synthetic Construct
  source 1..20: mol_type = other DNA
tggtcgtgtccgttcctcta

SEQ ID NO: 34904 - DNA, 21 bp, synthetic construct
  misc_feature 1..21: note = Synthetic Construct
  source 1..21: mol_type = other DNA
cccagcagagtgtctggaaca

SEQ ID NO: 34905 - DNA, 24 bp, synthetic construct
  misc_feature 1..24: note = Synthetic Construct
  source 1..24: mol_type = other DNA
ccttgcatgtgcttctgtacattt

SEQ ID NO: 34906 - DNA, 23 bp, synthetic construct
  misc_feature 1..23: note = Synthetic Construct
  source 1..23: mol_type = other DNA
gcattggctttgaagacggtaac

SEQ ID NO: 34907 - DNA, 21 bp, synthetic construct
  misc_feature 1..21: note = Synthetic Construct
  source 1..21: mol_type = other DNA
accaggtgtgaggctctgcta

SEQ ID NO: 34908 - DNA, 26 bp, synthetic construct
  misc_feature 1..26: note = Synthetic Construct
  source 1..26: mol_type = other DNA
gctatttcaataacacctggcaggaa

SEQ ID NO: 34909 - DNA, 23 bp, synthetic construct
  misc_feature 1..23: note = Synthetic Construct
  source 1..23: mol_type = other DNA
tcaagctctgggcttcattcatc

SEQ ID NO: 34910 - DNA, 21 bp, synthetic construct
  misc_feature 1..21: note = Synthetic Construct
  source 1..21: mol_type = other DNA
ggggcaaaggtgggcttagaa

SEQ ID NO: 34911 - DNA, 24 bp, synthetic construct
  misc_feature 1..24: note = Synthetic Construct
  source 1..24: mol_type = other DNA
ccctacatctttgacaggctgaag

SEQ ID NO: 34912 - DNA, 19 bp, synthetic construct
  misc_feature 1..19: note = Synthetic Construct
  source 1..19: mol_type = other DNA
cgccgtgtccttcccacaa

SEQ ID NO: 34913 - DNA, 20 bp, synthetic construct
  misc_feature 1..20: note = Synthetic Construct
  source 1..20: mol_type = other DNA
gcatgcacctgtgagcaaca

SEQ ID NO: 34914 - DNA, 24 bp, synthetic construct
  misc_feature 1..24: note = Synthetic Construct
  source 1..24: mol_type = other DNA
ccatgcctactcacctccagtttc

SEQ ID NO: 34915 - DNA, 22 bp, synthetic construct
  misc_feature 1..22: note = Synthetic Construct
  source 1..22: mol_type = other DNA
cacaccatgaagagggaacgat

SEQ ID NO: 34916 - DNA, 27 bp, synthetic construct
  misc_feature 1..27: note = Synthetic Construct
  source 1..27: mol_type = other DNA
gtgatccgtagggaatttcaagttcta

SEQ ID NO: 34917 - DNA, 22 bp, synthetic construct
  misc_feature 1..22: note = Synthetic Construct
  source 1..22: mol_type = other DNA
aggaagggttcctgtctcttct

SEQ ID NO: 34918 - DNA, 22 bp, synthetic construct
  misc_feature 1..22: note = Synthetic Construct
  source 1..22: mol_type = other DNA
ataggcaggcagaggccgatca

SEQ ID NO: 34919 - DNA, 28 bp, synthetic construct
  misc_feature 1..28: note = Synthetic Construct
  source 1..28: mol_type = other DNA
gcaaagaaggtagactttgtccttcaga

SEQ ID NO: 34920 - DNA, 21 bp, synthetic construct
  misc_feature 1..21: note = Synthetic Construct
  source 1..21: mol_type = other DNA
tccctccagcagcagttcagt

SEQ ID NO: 34921 - DNA, 20 bp, synthetic construct
  misc_feature 1..20: note = Synthetic Construct
  source 1..20: mol_type = other DNA
tcctttcgctcccaccattg

SEQ ID NO: 34922 - DNA, 26 bp, synthetic construct
  misc_feature 1..26: note = Synthetic Construct
  source 1..26: mol_type = other DNA
gaccaccctgtagataacacacatag

SEQ ID NO: 34923 - DNA, 18 bp, synthetic construct
  misc_feature 1..18: note = Synthetic Construct
  source 1..18: mol_type = other DNA
tgcctgcagcacagtgaa

SEQ ID NO: 34924 - DNA, 18 bp, synthetic construct
  misc_feature 1..18: note = Synthetic Construct
  source 1..18: mol_type = other DNA
acgcgcagccacaccaaa

SEQ ID NO: 34925 - DNA, 22 bp, synthetic construct
  misc_feature 1..22: note = Synthetic Construct
  source 1..22: mol_type = other DNA
ccccaaatcctcactggcacaa

SEQ ID NO: 34926 - DNA, 22 bp, synthetic construct
  misc_feature 1..22: note = Synthetic Construct
  source 1..22: mol_type = other DNA
actcactggagcccacagtatc

SEQ ID NO: 34927 - DNA, 23 bp, synthetic construct
  misc_feature 1..23: note = Synthetic Construct
  source 1..23: mol_type = other DNA
ccaagcaggtattggcttagttg

SEQ ID NO: 34928 - DNA, 20 bp, synthetic construct
  misc_feature 1..20: note = Synthetic Construct
  source 1..20: mol_type = other DNA
tgggaaggcagacgggttta

SEQ ID NO: 34929 - DNA, 30 bp, synthetic construct
  misc_feature 1..30: note = Synthetic Construct
  source 1..30: mol_type = other DNA
gccactatatctgtatctccttttgcacat

SEQ ID NO: 34930 - DNA, 19 bp, synthetic construct
  misc_feature 1..19: note = Synthetic Construct
  source 1..19: mol_type = other DNA
ccacctgggccaacctgaa

SEQ ID NO: 34931 - DNA, 24 bp, synthetic construct
  misc_feature 1..24: note = Synthetic Construct
  source 1..24: mol_type = other DNA
cgacctcttcggatctatgactgt

SEQ ID NO: 34932 - DNA, 20 bp, synthetic construct
  misc_feature 1..20: note = Synthetic Construct
  source 1..20: mol_type = other DNA
gcccatttcggcctctgact

SEQ ID NO: 34933 - DNA, 25 bp, synthetic construct
  misc_feature 1..25: note = Synthetic Construct
  source 1..25: mol_type = other DNA
ggctcatcttaacaaggatgtgaga

SEQ ID NO: 34934 - DNA, 23 bp, synthetic construct
  misc_feature 1..23: note = Synthetic Construct
  source 1..23: mol_type = other DNA
ggagagacctacccgaaatccaa

SEQ ID NO: 34935 - DNA, 24 bp, synthetic construct
  misc_feature 1..24: note = Synthetic Construct
  source 1..24: mol_type = other DNA
gggacattggtgacctggttggtt

SEQ ID NO: 34936 - DNA, 22 bp, synthetic construct
  misc_feature 1..22: note = Synthetic Construct
  source 1..22: mol_type = other DNA
gccccactcaacaccttcattg

SEQ ID NO: 34937 - DNA, 20 bp, synthetic construct
  misc_feature 1..20: note = Synthetic Construct
  source 1..20: mol_type = other DNA
tgggacacctggccttgttg

SEQ ID NO: 34938 - DNA, 24 bp, synthetic construct
  misc_feature 1..24: note = Synthetic Construct
  source 1..24: mol_type = other DNA
ggtcaggaatttgggttgaacttg

SEQ ID NO: 34939 - DNA, 26 bp, synthetic construct
  misc_feature 1..26: note = Synthetic Construct
  source 1..26: mol_type = other DNA
gctttctgcaagagggacagaaaagt

SEQ ID NO: 34940 - DNA, 22 bp, synthetic construct
  misc_feature 1..22: note = Synthetic Construct
  source 1..22: mol_type = other DNA
gacacagccgaaaggaaagcat

SEQ ID NO: 34941 - DNA, 25 bp, synthetic construct
  misc_feature 1..25: note = Synthetic Construct
  source 1..25: mol_type = other DNA
gaggtttcagtatctttccctgcat

SEQ ID NO: 34942 - DNA, 20 bp, synthetic construct
  misc_feature 1..20: note = Synthetic Construct
  source 1..20: mol_type = other DNA
aggcagccctcactttgttc

SEQ ID NO: 34943 - DNA, 22 bp, synthetic construct
  misc_feature 1..22: note = Synthetic Construct
  source 1..22: mol_type = other DNA
gttcccagtgcttaaggcatca

SEQ ID NO: 34944 - DNA, 24 bp, synthetic construct
  misc_feature 1..24: note = Synthetic Construct
  source 1..24: mol_type = other DNA
gcctgaggtgaaacaagcagtaag

SEQ ID NO: 34945 - DNA, 25 bp, synthetic construct
  misc_feature 1..25: note = Synthetic Construct
  source 1..25: mol_type = other DNA
gctcccgaatagacatctcttgctt

SEQ ID NO: 34946 - DNA, 22 bp, synthetic construct
  misc_feature 1..22: note = Synthetic Construct
  source 1..22: mol_type = other DNA
ggagagctggagacagcattca

SEQ ID NO: 34947 - DNA, 19 bp, synthetic construct
  misc_feature 1..19: note = Synthetic Construct
  source 1..19: mol_type = other DNA
ggacagtggaggcccacat

SEQ ID NO: 34948 - DNA, 20 bp, synthetic construct
  misc_feature 1..20: note = Synthetic Construct
  source 1..20: mol_type = other DNA
aggtggcatgaagggacaca

SEQ ID NO: 34949 - DNA, 24 bp, synthetic construct
  misc_feature 1..24: note = Synthetic Construct
  source 1..24: mol_type = other DNA
gtgctacaaatgcctactcacctt

SEQ ID NO: 34950 - DNA, 24 bp, synthetic construct
  misc_feature 1..24: note = Synthetic Construct
  source 1..24: mol_type = other DNA
acctctttgacaaatgcctgaagt

SEQ ID NO: 34951 - DNA, 23 bp, synthetic construct
  misc_feature 1..23: note = Synthetic Construct
  source 1..23: mol_type = other DNA
aggttgaaatggacatggtgaca

SEQ ID NO: 34952 - DNA, 20 bp, synthetic construct
  misc_feature 1..20: note = Synthetic Construct
  source 1..20: mol_type = other DNA
aggcccaggtttgtgtcttc

SEQ ID NO: 34953 - DNA, 21 bp, synthetic construct
  misc_feature 1..21: note = Synthetic Construct
  source 1..21: mol_type = other DNA
ccaggagatgctcagccttca

SEQ ID NO: 34954 - DNA, 19 bp, synthetic construct
  misc_feature 1..19: note = Synthetic Construct
  source 1..19: mol_type = other DNA
aggagctgctacggacaga

SEQ ID NO: 34955 - DNA, 22 bp, synthetic construct
  misc_feature 1..22: note = Synthetic Construct
  source 1..22: mol_type = other DNA
cccgtgtgctcctcagtttgta

SEQ ID NO: 34956 - DNA, 20 bp, synthetic construct
  misc_feature 1..20: note = Synthetic Construct
  source 1..20: mol_type = other DNA
agggtcgggatgagcccaaa

SEQ ID NO: 34957 - DNA, 21 bp, synthetic construct
  misc_feature 1..21: note = Synthetic Construct
  source 1..21: mol_type = other DNA
ggcagcagagctgaatgaaag

SEQ ID NO: 34958 - DNA, 25 bp, synthetic construct
  misc_feature 1..25: note = Synthetic Construct
  source 1..25: mol_type = other DNA
cctacaatctgagagccctttggat

SEQ ID NO: 34959 - DNA, 21 bp, synthetic construct
  misc_feature 1..21: note = Synthetic Construct
  source 1..21: mol_type = other DNA
ccatgctaggcgtcccaaagt

SEQ ID NO: 34960 - DNA, 24 bp, synthetic construct
  misc_feature 1..24: note = Synthetic Construct
  source 1..24: mol_type = other DNA
ctacattctcctccacagttggaa

SEQ ID NO: 34961 - DNA, 22 bp, synthetic construct
  misc_feature 1..22: note = Synthetic Construct
  source 1..22: mol_type = other DNA
ggccttccactcaccctttttg

SEQ ID NO: 34962 - DNA, 22 bp, synthetic construct
  misc_feature 1..22: note = Synthetic Construct
  source 1..22: mol_type = other DNA
ctgtgcccatccacttccagta

SEQ ID NO: 34963 - DNA, 20 bp, synthetic construct
  misc_feature 1..20: note = Synthetic Construct
  source 1..20: mol_type = other DNA
tccccgccctcctccatttc

SEQ ID NO: 34964 - DNA, 19 bp, synthetic construct
  misc_feature 1..19: note = Synthetic Construct
  source 1..19: mol_type = other DNA
acagtggcagcagctcgtt

SEQ ID NO: 34965 - DNA, 25 bp, synthetic construct
  misc_feature 1..25: note = Synthetic Construct
  source 1..25: mol_type = other DNA
gcttccttggtagtggagtaggtaa

SEQ ID NO: 34966 - DNA, 20 bp, synthetic construct
  misc_feature 1..20: note = Synthetic Construct
  source 1..20: mol_type = other DNA
cactgtgttgccgtgagaac

SEQ ID NO: 34967 - DNA, 25 bp, synthetic construct
  misc_feature 1..25: note = Synthetic Construct
  source 1..25: mol_type = other DNA
gcagttttcctgtttccagcacttc

SEQ ID NO: 34968 - DNA, 24 bp, synthetic construct
  misc_feature 1..24: note = Synthetic Construct
  source 1..24: mol_type = other DNA
ctctagaagtacagggtgggacat

SEQ ID NO: 34969 - DNA, 22 bp, synthetic construct
  misc_feature 1..22: note = Synthetic Construct
  source 1..22: mol_type = other DNA
gggttgtgagttgacgcctgta

SEQ ID NO: 34970 - DNA, 25 bp, synthetic construct
  misc_feature 1..25: note = Synthetic Construct
  source 1..25: mol_type = other DNA
cccttggtattaagcaaaaggcaaa

SEQ ID NO: 34971 - DNA, 22 bp, synthetic construct
  misc_feature 1..22: note = Synthetic Construct
  source 1..22: mol_type = other DNA
cacgggcacttcacttccaaga

SEQ ID NO: 34972 - DNA, 23 bp, synthetic construct
  misc_feature 1..23: note = Synthetic Construct
  source 1..23: mol_type = other DNA
cccagcagcttttcttctacaca

SEQ ID NO: 34973 - DNA, 22 bp, synthetic construct
  misc_feature 1..22: note = Synthetic Construct
  source 1..22: mol_type = other DNA
gatgagggattgcttcgagctt

SEQ ID NO: 34974 - DNA, 22 bp, synthetic construct
  misc_feature 1..22: note = Synthetic Construct
  source 1..22: mol_type = other DNA
ttccctaggggcccagctctga

SEQ ID NO: 34975 - DNA, 21 bp, synthetic construct
  misc_feature 1..21: note = Synthetic Construct
  source 1..21: mol_type = other DNA
cctccccatgccatcttctca

SEQ ID NO: 34976 - DNA, 20 bp, synthetic construct
  misc_feature 1..20: note = Synthetic Construct
  source 1..20: mol_type = other DNA
acactgaggtgccaggttgt

SEQ ID NO: 34977 - DNA, 21 bp, synthetic construct
  misc_feature 1..21: note = Synthetic Construct
  source 1..21: mol_type = other DNA
cctggtgcaaagggtcagact

SEQ ID NO: 34978 - DNA, 22 bp, synthetic construct
  misc_feature 1..22: note = Synthetic Construct
  source 1..22: mol_type = other DNA
ccaaggcaacagagcccttctt

SEQ ID NO: 34979 - DNA, 23 bp, synthetic construct
  misc_feature 1..23: note = Synthetic Construct
  source 1..23: mol_type = other DNA
gggctcagtgctttctgttggat

SEQ ID NO: 34980 - DNA, 19 bp, synthetic construct
  misc_feature 1..19: note = Synthetic Construct
  source 1..19: mol_type = other DNA
tgggactcctgccccactt

SEQ ID NO: 34981 - DNA, 23 bp, synthetic construct
  misc_feature 1..23: note = Synthetic Construct
  source 1..23: mol_type = other DNA
gcaatgtgattgatccccacaaa

SEQ ID NO: 34982 - DNA, 20 bp, synthetic construct
  misc_feature 1..20: note = Synthetic Construct
  source 1..20: mol_type = other DNA
tgggcacttccggactttct

SEQ ID NO: 34983 - DNA, 20 bp, synthetic construct
  misc_feature 1..20: note = Synthetic Construct
  source 1..20: mol_type = other DNA
accaaaaggcggaggctcaa

SEQ ID NO: 34984 - DNA, 20 bp, synthetic construct
  misc_feature 1..20: note = Synthetic Construct
  source 1..20: mol_type = other DNA
ggcagaagctgggagttcaa

SEQ ID NO: 34985 - DNA, 24 bp, synthetic construct
  misc_feature 1..24: note = Synthetic Construct
  source 1..24: mol_type = other DNA
gagggatcactcactccttaggta

SEQ ID NO: 34986 - DNA, 22 bp, synthetic construct
  misc_feature 1..22: note = Synthetic Construct
  source 1..22: mol_type = other DNA
gtgatgcacaaagccagtcatc

SEQ ID NO: 34987 - DNA, 22 bp, synthetic construct
  misc_feature 1..22: note = Synthetic Construct
  source 1..22: mol_type = other DNA
cccatggaccaaccctcctagt

SEQ ID NO: 34988 - DNA, 24 bp, synthetic construct
  misc_feature 1..24: note = Synthetic Construct
  source 1..24: mol_type = other DNA
caaacaaacagcaaacagcacttc

SEQ ID NO: 34989 - DNA, 24 bp, synthetic construct
  misc_feature 1..24: note = Synthetic Construct
  source 1..24: mol_type = other DNA
gcaatcccaacaggatgtatctca

SEQ ID NO: 34990 - DNA, 20 bp, synthetic construct
  misc_feature 1..20: note = Synthetic Construct
  source 1..20: mol_type = other DNA
agtgaggcgtctccccattc

SEQ ID NO: 34991 - DNA, 23 bp, synthetic construct
  misc_feature 1..23: note = Synthetic Construct
  source 1..23: mol_type = other DNA
gtagaatagccggggattgtcat

SEQ ID NO: 34992 - DNA, 24 bp, synthetic construct
  misc_feature 1..24: note = Synthetic Construct
  source 1..24: mol_type = other DNA
gtcaccatcaacacctctgacaac

SEQ ID NO: 34993 - DNA, 23 bp, synthetic construct
  misc_feature 1..23: note = Synthetic Construct
  source 1..23: mol_type = other DNA
ggccatacagtctctgtcacaac

SEQ ID NO: 34994 - DNA, 25 bp, synthetic construct
  misc_feature 1..25: note = Synthetic Construct
  source 1..25: mol_type = other DNA
ggagactctaaatggttcccagaat

SEQ ID NO: 34995 - DNA, 24 bp, synthetic construct
  misc_feature 1..24: note = Synthetic Construct
  source 1..24: mol_type = other DNA
ccaagcttatggtgggaacaggaa

SEQ ID NO: 34996 - DNA, 23 bp, synthetic construct
  misc_feature 1..23: note = Synthetic Construct
  source 1..23: mol_type = other DNA
gttgggtgggattgttcctatca

SEQ ID NO: 34997 - DNA, 23 bp, synthetic construct
  misc_feature 1..23: note = Synthetic Construct
  source 1..23: mol_type = other DNA
ctgatgcctgacctgactgttac

SEQ ID NO: 34998 - DNA, 19 bp, synthetic construct
  misc_feature 1..19: note = Synthetic Construct
  source 1..19: mol_type = other DNA
agctaggcgagggaaggtt

SEQ ID NO: 34999 - DNA, 21 bp, synthetic construct
  misc_feature 1..21: note = Synthetic Construct
  source 1..21: mol_type = other DNA
gccatatgattgccccagctt

SEQ ID NO: 35000 - DNA, 22 bp, synthetic construct
  misc_feature 1..22: note = Synthetic Construct
  source 1..22: mol_type = other DNA
gtcagtagtcgagccaggattg

SEQ ID NO: 35001 - DNA, 22 bp, synthetic construct
  misc_feature 1..22: note = Synthetic Construct
  source 1..22: mol_type = other DNA
acccaaggatctccatgcacta

SEQ ID NO: 35002 - DNA, 23 bp, synthetic construct
  misc_feature 1..23: note = Synthetic Construct
  source 1..23: mol_type = other DNA
gcagggccttcctttctaacaga

SEQ ID NO: 35003 - DNA, 21 bp, synthetic construct
  misc_feature 1..21: note = Synthetic Construct
  source 1..21: mol_type = other DNA
agccctgtgaaggagcactgt

SEQ ID NO: 35004 - DNA, 21 bp, synthetic construct
  misc_feature 1..21: note = Synthetic Construct
  source 1..21: mol_type = other DNA
agaaggtgaaggtcccaggaa

SEQ ID NO: 35005 - DNA, 19 bp, synthetic construct
  misc_feature 1..19: note = Synthetic Construct
  source 1..19: mol_type = other DNA
gcagctctggctggtctca

SEQ ID NO: 35006 - DNA, 22 bp, synthetic construct
  misc_feature 1..22: note = Synthetic Construct
  source 1..22: mol_type = other DNA
cctcctcttcctgcctcgttat

SEQ ID NO: 35007 - DNA, 25 bp, synthetic construct
  misc_feature 1..25: note = Synthetic Construct
  source 1..25: mol_type = other DNA
gtggaatggagggtaggtgagaaaa

SEQ ID NO: 35008 - DNA, 26 bp, synthetic construct
  misc_feature 1..26: note = Synthetic Construct
  source 1..26: mol_type = other DNA
agtatgctacagtttgagctggttag

SEQ ID NO: 35009 - DNA, 24 bp, synthetic construct
  misc_feature 1..24: note = Synthetic Construct
  source 1..24: mol_type = other DNA
gcctatgtacacatggggtattca

SEQ ID NO: 35010 - DNA, 20 bp, synthetic construct
  misc_feature 1..20: note = Synthetic Construct
  source 1..20: mol_type = other DNA
tgcctgcaccagcattttca

SEQ ID NO: 35011 - DNA, 22 bp, synthetic construct
  misc_feature 1..22: note = Synthetic Construct
  source 1..22: mol_type = other DNA
gagacatcacagtgacctgcat

SEQ ID NO: 35012 - DNA, 22 bp, synthetic construct
  misc_feature 1..22: note = Synthetic Construct
  source 1..22: mol_type = other DNA
ccctccttccctgtgaggaatg

SEQ ID NO: 35013 - DNA, 27 bp, synthetic construct
  misc_feature 1..27: note = Synthetic Construct
  source 1..27: mol_type = other DNA
gatagtggaaagtgagactaagaggtt

SEQ ID NO: 35014 - DNA, 20 bp, synthetic construct
  misc_feature 1..20: note = Synthetic Construct
  source 1..20: mol_type = other DNA
gaagccaaggagcagcaaac

SEQ ID NO: 35015 - DNA, 23 bp, synthetic construct
  misc_feature 1..23: note = Synthetic Construct
  source 1..23: mol_type = other DNA
ccagtgcattaggctggaaggaa

SEQ ID NO: 35016 - DNA, 22 bp, synthetic construct
  misc_feature 1..22: note = Synthetic Construct
  source 1..22: mol_type = other DNA
ggtgtctggcctcagaacacta

SEQ ID NO: 35017 - DNA, 20 bp, synthetic construct
  misc_feature 1..20: note = Synthetic Construct
  source 1..20: mol_type = other DNA
tgcctgctgggaaaccaaga

SEQ ID NO: 35018 - DNA, 18 bp, synthetic construct
  misc_feature 1..18: note = Synthetic Construct
  source 1..18: mol_type = other DNA
tgggcaaggcctccatct

SEQ ID NO: 35019 - DNA, 19 bp, synthetic construct
  misc_feature 1..19: note = Synthetic Construct
  source 1..19: mol_type = other DNA
acccctgcagcttccatgt

SEQ ID NO: 35020 - DNA, 22 bp, synthetic construct
  misc_feature 1..22: note = Synthetic Construct
  source 1..22: mol_type = other DNA
cctcctcccttcctgtgtggta

SEQ ID NO: 35021 - DNA, 23 bp, synthetic construct
  misc_feature 1..23: note = Synthetic Construct
  source 1..23: mol_type = other DNA
tgcagagtatttggagggcaaaa

SEQ ID NO: 35022 - DNA, 22 bp, synthetic construct
  misc_feature 1..22: note = Synthetic Construct
  source 1..22: mol_type = other DNA
tctttcttcccctcctccatgt

SEQ ID NO: 35023 - DNA, 25 bp, synthetic construct
  misc_feature 1..25: note = Synthetic Construct
  source 1..25: mol_type = other DNA
ccaggaatcctaaccgctagaccat

SEQ ID NO: 35024 - DNA, 20 bp, synthetic construct
  misc_feature 1..20: note = Synthetic Construct
  source 1..20: mol_type = other DNA
gcgctgaaggctagagaaca

SEQ ID NO: 35025 - DNA, 22 bp, synthetic construct
  misc_feature 1..22: note = Synthetic Construct
  source 1..22: mol_type = other DNA
caggtgccttggtgttgagttc

SEQ ID NO: 35026 - DNA, 20 bp, synthetic construct
  misc_feature 1..20: note = Synthetic Construct
  source 1..20: mol_type = other DNA
tgacacggactccccagatt

SEQ ID NO: 35027 - DNA, 30 bp, synthetic construct
  misc_feature 1..30: note = Synthetic Construct
  source 1..30: mol_type = other DNA
gagaggatcatacatttacaagacctgaag

SEQ ID NO: 35028 - DNA, 25 bp, synthetic construct
  misc_feature 1..25: note = Synthetic Construct
  source 1..25: mol_type = other DNA
ccggtaggggcatttctatttccat

SEQ ID NO: 35029 - DNA, 23 bp, synthetic construct
  misc_feature 1..23: note = Synthetic Construct
  source 1..23: mol_type = other DNA
agtgataaggacctgtggtggaa

SEQ ID NO: 35030 - DNA, 29 bp, synthetic construct
  misc_feature 1..29: note = Synthetic Construct
  source 1..29: mol_type = other DNA
ggctgaacccactaattagaaacacttac

SEQ ID NO: 35031 - DNA, 19 bp, synthetic construct
  misc_feature 1..19: note = Synthetic Construct
  source 1..19: mol_type = other DNA
tgccccaaaccagcatgaa

SEQ ID NO: 35032 - DNA, 24 bp, synthetic construct
  misc_feature 1..24: note = Synthetic Construct
  source 1..24: mol_type = other DNA
cgtgtgcctttccacctaggacat

SEQ ID NO: 35033 - DNA, 20 bp, synthetic construct
  misc_feature 1..20: note = Synthetic Construct
  source 1..20: mol_type = other DNA
cgtgccgcggctagaactaa

SEQ ID NO: 35034 - DNA, 24 bp, synthetic construct
  misc_feature 1..24: note = Synthetic Construct
  source 1..24: mol_type = other DNA
ggagaagctcatggatcgcgtttg

SEQ ID NO: 35035 - DNA, 24 bp, synthetic construct
  misc_feature 1..24: note = Synthetic Construct
  source 1..24: mol_type = other DNA
gcaccgtaagggtagaaagcagtt

SEQ ID NO: 35036 - DNA, 18 bp, synthetic construct
  misc_feature 1..18: note = Synthetic Construct
  source 1..18: mol_type = other DNA
tgcgtgcgagcaaacctt

SEQ ID NO: 35037 - DNA, 23 bp, synthetic construct
  misc_feature 1..23: note = Synthetic Construct
  source 1..23: mol_type = other DNA
ggctgttgcatactcagccatca

SEQ ID NO: 35038 - DNA, 24 bp, synthetic construct
  misc_feature 1..24: note = Synthetic Construct
  source 1..24: mol_type = other DNA
tcttgaccatggaaagttctgtca

SEQ ID NO: 35039 - DNA, 24 bp, synthetic construct
  misc_feature 1..24: note = Synthetic Construct
  source 1..24: mol_type = other DNA
gccagcaagaaagggaaggcttag

SEQ ID NO: 35040 - DNA, 22 bp, synthetic construct
  misc_feature 1..22: note = Synthetic Construct
  source 1..22: mol_type = other DNA
ctctgggcagtgttgctgaaag

SEQ ID NO: 35041 - DNA, 26 bp, synthetic construct
  misc_feature 1..26: note = Synthetic Construct
  source 1..26: mol_type = other DNA
cagcagaacttacaaagcttccatga

SEQ ID NO: 35042 - DNA, 20 bp, synthetic construct
  misc_feature 1..20: note = Synthetic Construct
  source 1..20: mol_type = other DNA
tcagccccagaccctgctat

SEQ ID NO: 35043 - DNA, 19 bp, synthetic construct
  misc_feature 1..19: note = Synthetic Construct
  source 1..19: mol_type = other DNA
gggaggccagcctgaagta

SEQ ID NO: 35044 - DNA, 25 bp, synthetic construct
  misc_feature 1..25: note = Synthetic Construct
  source 1..25: mol_type = other DNA
ggaacaacactgacccttgcagatg

SEQ ID NO: 35045 - DNA, 19 bp, synthetic construct
  misc_feature 1..19: note = Synthetic Construct
  source 1..19: mol_type = other DNA
tgggtcgatgggtgtggtt

SEQ ID NO: 35046 - DNA, 25 bp, synthetic construct
  misc_feature 1..25: note = Synthetic Construct
  source 1..25: mol_type = other DNA
cagacttccatagttgcctttctct

SEQ ID NO: 35047 - DNA, 24 bp, synthetic construct
  misc_feature 1..24: note = Synthetic Construct
  source 1..24: mol_type = other DNA
ccccgaaattcaccctgtaaacat

SEQ ID NO: 35048 - DNA, 21 bp, synthetic construct
  misc_feature 1..21: note = Synthetic Construct
  source 1..21: mol_type = other DNA
ggctgactctgaagagccttt

SEQ ID NO: 35049 - DNA, 22 bp, synthetic construct
  misc_feature 1..22: note = Synthetic Construct
  source 1..22: mol_type = other DNA
ccacacaggcacttgtccttca

SEQ ID NO: 35050 - DNA, 24 bp, synthetic construct
  misc_feature 1..24: note = Synthetic Construct
  source 1..24: mol_type = other DNA
ggagaaataggcccacctcagtca

SEQ ID NO: 35051 - DNA, 25 bp, synthetic construct
  misc_feature 1..25: note = Synthetic Construct
  source 1..25: mol_type = other DNA
tgggttttaaagcaatggagtcaag

SEQ ID NO: 35052 - DNA, 20 bp, synthetic construct
  misc_feature 1..20: note = Synthetic Construct
  source 1..20: mol_type = other DNA
gggtcaaatgggctgtggaa

SEQ ID NO: 35053 - DNA, 21 bp, synthetic construct
  misc_feature 1..21: note = Synthetic Construct
  source 1..21: mol_type = other DNA
gccttaccattgcctcccaaa

SEQ ID NO: 35054 - DNA, 21 bp, synthetic construct
  misc_feature 1..21: note = Synthetic Construct
  source 1..21: mol_type = other DNA
gaccatctccaaagccctgaa

SEQ ID NO: 35055 - DNA, 21 bp, synthetic construct
  misc_feature 1..21: note = Synthetic Construct
  source 1..21: mol_type = other DNA
aggcagcagggtcaccttgaa

SEQ ID NO: 35056 - DNA, 26 bp, synthetic construct
  misc_feature 1..26: note = Synthetic Construct
  source 1..26: mol_type = other DNA
ggctttgtcaagcaatcaggcttaga

SEQ ID NO: 35057 - DNA, 23 bp, synthetic construct
  misc_feature 1..23: note = Synthetic Construct
  source 1..23: mol_type = other DNA
cctcccacaaaatctgctgctta

SEQ ID NO: 35058 - DNA, 21 bp, synthetic construct
  misc_feature 1..21: note = Synthetic Construct
  source 1..21: mol_type = other DNA
ggcctcacagtcatggtgttg

SEQ ID NO: 35059 - DNA, 23 bp, synthetic construct
  misc_feature 1..23: note = Synthetic Construct
  source 1..23: mol_type = other DNA
tgtctcccatattgggctgatct

SEQ ID NO: 35060 - DNA, 19 bp, synthetic construct
  misc_feature 1..19: note = Synthetic Construct
  source 1..19: mol_type = other DNA
tctggcccttggtgcacat

SEQ ID NO: 35061 - DNA, 19 bp, synthetic construct
  misc_feature 1..19: note = Synthetic Construct
  source 1..19: mol_type = other DNA
gccagccccaggtgtttga

SEQ ID NO: 35062 - DNA, 26 bp, synthetic construct
  misc_feature 1..26: note = Synthetic Construct
  source 1..26: mol_type = other DNA
gcccttatcttcccagtaacaggttt

SEQ ID NO: 35063 - DNA, 22 bp, synthetic construct
  misc_feature 1..22: note = Synthetic Construct
  source 1..22: mol_type = other DNA
ttcctcgcctcctactgtgaga

SEQ ID NO: 35064 - DNA, 23 bp, synthetic construct
  misc_feature 1..23: note = Synthetic Construct
  source 1..23: mol_type = other DNA
atttaccaaaggggcagaactca

SEQ ID NO: 35065 - DNA, 24 bp, synthetic construct
  misc_feature 1..24: note = Synthetic Construct
  source 1..24: mol_type = other DNA
gccacaattgctgcctgaatggat

SEQ ID NO: 35066 - DNA, 25 bp, synthetic construct
  misc_feature 1..25: note = Synthetic Construct
  source 1..25: mol_type = other DNA
tgaatgatgcctatcaagtgtgtgt

SEQ ID NO: 35067 - DNA, 21 bp, synthetic construct
  misc_feature 1..21: note = Synthetic Construct
  source 1..21: mol_type = other DNA
gctggccttcctcacctttca

SEQ ID NO: 35068 - DNA, 22 bp, synthetic construct
  misc_feature 1..22: note = Synthetic Construct
  source 1..22: mol_type = other DNA
aggccaggattcagggctttac

SEQ ID NO: 35069 - DNA, 22 bp, synthetic construct
  misc_feature 1..22: note = Synthetic Construct
  source 1..22: mol_type = other DNA
gcccactggaacctctctttga

SEQ ID NO: 35070 - DNA, 20 bp, synthetic construct
  misc_feature 1..20: note = Synthetic Construct
  source 1..20: mol_type = other DNA
gcgtgatgctgggacactaa

SEQ ID NO: 35071 - DNA, 23 bp, synthetic construct
  misc_feature 1..23: note = Synthetic Construct
  source 1..23: mol_type = other DNA
gcctcctgatgcatgttgactga

SEQ ID NO: 35072 - DNA, 25 bp, synthetic construct
  misc_feature 1..25: note = Synthetic Construct
  source 1..25: mol_type = other DNA
gccactgaggtttactgagtcattg

SEQ ID NO: 35073 - DNA, 20 bp, synthetic construct
  misc_feature 1..20: note = Synthetic Construct
  source 1..20: mol_type = other DNA
agtgggtctgccaagcaaca

SEQ ID NO: 35074 - DNA, 24 bp, synthetic construct
  misc_feature 1..24: note = Synthetic Construct
  source 1..24: mol_type = other DNA
ggcattgtctgatagcgagggaaa

SEQ ID NO: 35075 - DNA, 20 bp, synthetic construct
  misc_feature 1..20: note = Synthetic Construct
  source 1..20: mol_type = other DNA
accgggtgaggctcctactt

SEQ ID NO: 35076 - DNA, 25 bp, synthetic construct
  misc_feature 1..25: note = Synthetic Construct
  source 1..25: mol_type = other DNA
gttactgtcatagctggaacagact

SEQ ID NO: 35077 - DNA, 26 bp, synthetic construct
  misc_feature 1..26: note = Synthetic Construct
  source 1..26: mol_type = other DNA
gcacaactcctgcctatttatctaac

SEQ ID NO: 35078 - DNA, 26 bp, synthetic construct
  misc_feature 1..26: note = Synthetic Construct
  source 1..26: mol_type = other DNA
gtccttcaaagcttcctgaaacatct

SEQ ID NO: 35079 - DNA, 23 bp, synthetic construct
  misc_feature 1..23: note = Synthetic Construct
  source 1..23: mol_type = other DNA
ccatcccctgtattcctgtcttc

SEQ ID NO: 35080 - DNA, 21 bp, synthetic construct
  misc_feature 1..21: note = Synthetic Construct
  source 1..21: mol_type = other DNA
cctgagccattcctcttgctt

SEQ ID NO: 35081 - DNA, 26 bp, synthetic construct
  misc_feature 1..26: note = Synthetic Construct
  source 1..26: mol_type = other DNA
ggatatctgtgtacgtctgtgtgtca

SEQ ID NO: 35082 - DNA, 23 bp, synthetic construct
  misc_feature 1..23: note = Synthetic Construct
  source 1..23: mol_type = other DNA
cttaccctcttcccctcttctgt

SEQ ID NO: 35083 - DNA, 22 bp, synthetic construct
  misc_feature 1..22: note = Synthetic Construct
  source 1..22: mol_type = other DNA
ggctgggagtctgcaactacat

SEQ ID NO: 35084 - DNA, 28 bp, synthetic construct
  misc_feature 1..28: note = Synthetic Construct
  source 1..28: mol_type = other DNA
gccagaagtggagagtagacttcctaaa

SEQ ID NO: 35085 - DNA, 25 bp, synthetic construct
  misc_feature 1..25: note = Synthetic Construct
  source 1..25: mol_type = other DNA
ggggtagaaagaagtggacgggatt

SEQ ID NO: 35086 - DNA, 23 bp, synthetic construct
  misc_feature 1..23: note = Synthetic Construct
  source 1..23: mol_type = other DNA
gtgaaagtggagggaagtgttgt

SEQ ID NO: 35087 - DNA, 25 bp, synthetic construct
  misc_feature 1..25: note = Synthetic Construct
  source 1..25: mol_type = other DNA
gtgtgagacttggtttggtgtgaac

SEQ ID NO: 35088 - DNA, 23 bp, synthetic construct
  misc_feature 1..23: note = Synthetic Construct
  source 1..23: mol_type = other DNA
ggtcagtgctgtcattcagatca

SEQ ID NO: 35089 - DNA, 21 bp, synthetic construct
  misc_feature 1..21: note = Synthetic Construct
  source 1..21: mol_type = other DNA
acccatgccctggacctgtaa

SEQ ID NO: 35090 - DNA, 22 bp, synthetic construct
  misc_feature 1..22: note = Synthetic Construct
  source 1..22: mol_type = other DNA
tcagcagcggagatcctgtaga

SEQ ID NO: 35091 - DNA, 23 bp, synthetic construct
  misc_feature 1..23: note = Synthetic Construct
  source 1..23: mol_type = other DNA
acctaaattcggccactttccat

SEQ ID NO: 35092 - DNA, 22 bp, synthetic construct
  misc_feature 1..22: note = Synthetic Construct
  source 1..22: mol_type = other DNA
tgtagtttgagggcctggaatc

SEQ ID NO: 35093 - DNA, 20 bp, synthetic construct
  misc_feature 1..20: note = Synthetic Construct
  source 1..20: mol_type = other DNA
agttggggcacccaccacta

SEQ ID NO: 35094 - DNA, 22 bp, synthetic construct
  misc_feature 1..22: note = Synthetic Construct
  source 1..22: mol_type = other DNA
ggtggaacacagtcacagtttg

SEQ ID NO: 35095 - DNA, 26 bp, synthetic construct
  misc_feature 1..26: note = Synthetic Construct
  source 1..26: mol_type = other DNA
gttcaccaattagcttccatctctca

SEQ ID NO: 35096 - DNA, 25 bp, synthetic construct
  misc_feature 1..25: note = Synthetic Construct
  source 1..25: mol_type = other DNA
gtactgtacaggcatgagttcaagt

SEQ ID NO: 35097 - DNA, 23 bp, synthetic construct
  misc_feature 1..23: note = Synthetic Construct
  source 1..23: mol_type = other DNA
gaacgcagaatacctgggttcaa

SEQ ID NO: 35098 - DNA, 22 bp, synthetic construct
  misc_feature 1..22: note = Synthetic Construct
  source 1..22: mol_type = other DNA
tcttacagctccttccccacaa

SEQ ID NO: 35099 - DNA, 23 bp, synthetic construct
  misc_feature 1..23: note = Synthetic Construct
  source 1..23: mol_type = other DNA
gatggttggaacatggtgctttt

SEQ ID NO: 35100 - DNA, 20 bp, synthetic construct
  misc_feature 1..20: note = Synthetic Construct
  source 1..20: mol_type = other DNA
agcttcaggaaggcctcaca

SEQ ID NO: 35101 - DNA, 24 bp, synthetic construct
  misc_feature 1..24: note = Synthetic Construct
  source 1..24: mol_type = other DNA
cttggcaattttccagccttttct

SEQ ID NO: 35102 - DNA, 26 bp, synthetic construct
  misc_feature 1..26: note = Synthetic Construct
  source 1..26: mol_type = other DNA
cctcggtctatcagttaggcttgttc

SEQ ID NO: 35103 - DNA, 22 bp, synthetic construct
  misc_feature 1..22: note = Synthetic Construct
  source 1..22: mol_type = other DNA
gggagaaggggacacaatgaag

SEQ ID NO: 35104 - DNA, 26 bp, synthetic construct
  misc_feature 1..26: note = Synthetic Construct
  source 1..26: mol_type = other DNA
gctcatggctgaatactgactgatag

SEQ ID NO: 35105 - DNA, 22 bp, synthetic construct
  misc_feature 1..22: note = Synthetic Construct
  source 1..22: mol_type = other DNA
ctcaaaccacagcccagtgtag

SEQ ID NO: 35106 - DNA, 21 bp, synthetic construct
  misc_feature 1..21: note = Synthetic Construct
  source 1..21: mol_type = other DNA
aggaggctgagttagctccaa

SEQ ID NO: 35107 - DNA, 20 bp, synthetic construct
  misc_feature 1..20: note = Synthetic Construct
  source 1..20: mol_type = other DNA
tccccacgtgagctggtgta

SEQ ID NO: 35108 - DNA, 24 bp, synthetic construct
  misc_feature 1..24: note = Synthetic Construct
  source 1..24: mol_type = other DNA
acttcagtgtatgccaatccaaca

SEQ ID NO: 35109 - DNA, 22 bp, synthetic construct
  misc_feature 1..22: note = Synthetic Construct
  source 1..22: mol_type = other DNA
tggggaggcttctgatgcttga

SEQ ID NO: 35110 - DNA, 19 bp, synthetic construct
  misc_feature 1..19: note = Synthetic Construct
  source 1..19: mol_type = other DNA
gggccttgccagccaagat

SEQ ID NO: 35111 - DNA, 27 bp, synthetic construct
  misc_feature 1..27: note = Synthetic Construct
  source 1..27: mol_type = other DNA
cagtttaagttaccctagttccagctt

SEQ ID NO: 35112 - DNA, 25 bp, synthetic construct
  misc_feature 1..25: note = Synthetic Construct
  source 1..25: mol_type = other DNA
ggctgagcttttcacaagttttaca

SEQ ID NO: 35113 - DNA, 26 bp, synthetic construct
  misc_feature 1..26: note = Synthetic Construct
  source 1..26: mol_type = other DNA
agaagagtcaggatcttaaggacaga

SEQ ID NO: 35114 - DNA, 24 bp, synthetic construct
  misc_feature 1..24: note = Synthetic Construct
  source 1..24: mol_type = other DNA
ggtgatcagagaggcctggatttc

SEQ ID NO: 35115 - DNA, 20 bp, synthetic construct
  misc_feature 1..20: note = Synthetic Construct
  source 1..20: mol_type = other DNA
acagacacccacgcttcctt

SEQ ID NO: 35116 - DNA, 22 bp, synthetic construct
  misc_feature 1..22: note = Synthetic Construct
  source 1..22: mol_type = other DNA
agcctcagactggtgcatctct

SEQ ID NO: 35117 - DNA, 21 bp, synthetic construct
  misc_feature 1..21: note = Synthetic Construct
  source 1..21: mol_type = other DNA
tctgggaagtctgcagtgcta

SEQ ID NO: 35118 - DNA, 21 bp, synthetic construct
  misc_feature 1..21: note = Synthetic Construct
  source 1..21: mol_type = other DNA
gctggaaaagctggtgagttg

SEQ ID NO: 35119 - DNA, 24 bp, synthetic construct
  misc_feature 1..24: note = Synthetic Construct
  source 1..24: mol_type = other DNA
ggctggaagaagtccagagcaact

SEQ ID NO: 35120 - DNA, 20 bp, synthetic construct
  misc_feature 1..20: note = Synthetic Construct
  source 1..20: mol_type = other DNA
gcccagtcagctcagattgt

SEQ ID NO: 35121 - DNA, 23 bp, synthetic construct
  misc_feature 1..23: note = Synthetic Construct
  source 1..23: mol_type = other DNA
actgagttaaaggcagggacaag

SEQ ID NO: 35122 - DNA, 24 bp, synthetic construct
  misc_feature 1..24: note = Synthetic Construct
  source 1..24: mol_type = other DNA
gccctggcatcatcttgattgcat

SEQ ID NO: 35123 - DNA, 26 bp, synthetic construct
  misc_feature 1..26: note = Synthetic Construct
  source 1..26: mol_type = other DNA
cccaatttgaatgaaagcccctcgat

SEQ ID NO: 35124 - DNA, 21 bp, synthetic construct
  misc_feature 1..21: note = Synthetic Construct
  source 1..21: mol_type = other DNA
ccagagaggttgcacccagat

SEQ ID NO: 35125 - DNA, 24 bp, synthetic construct
  misc_feature 1..24: note = Synthetic Construct
  source 1..24: mol_type = other DNA
tctttctctctcctctcgtgaaca

SEQ ID NO: 35126 - DNA, 20 bp, synthetic construct
  misc_feature 1..20: note = Synthetic Construct
  source 1..20: mol_type = other DNA
tccaaggacaggctgccaat

SEQ ID NO: 35127 - DNA, 27 bp, synthetic construct
  misc_feature 1..27: note = Synthetic Construct
  source 1..27: mol_type = other DNA
actaaagctataacccctgtaccctaa

SEQ ID NO: 35128 - DNA, 21 bp, synthetic construct
  misc_feature 1..21: note = Synthetic Construct
  source 1..21: mol_type = other DNA
agccttccgactcctcacctt

SEQ ID NO: 35129 - DNA, 22 bp, synthetic construct
  misc_feature 1..22: note = Synthetic Construct
  source 1..22: mol_type = other DNA
gccagagagaacgtgggaactt

SEQ ID NO: 35130 - DNA, 22 bp, synthetic construct
  misc_feature 1..22: note = Synthetic Construct
  source 1..22: mol_type = other DNA
gtgaagctctcaccgagaggaa

SEQ ID NO: 35131 - DNA, 24 bp, synthetic construct
  misc_feature 1..24: note = Synthetic Construct
  source 1..24: mol_type = other DNA
agcaatgatgacagtgccttatga

SEQ ID NO: 35132 - DNA, 30 bp, synthetic construct
  misc_feature 1..30: note = Synthetic Construct
  source 1..30: mol_type = other DNA
gcacagtgatgatacgaatgtcaatctttg

SEQ ID NO: 35133 - DNA, 21 bp, synthetic construct
  misc_feature 1..21: note = Synthetic Construct
  source 1..21: mol_type = other DNA
ggccaggtgagcctcagaaaa

SEQ ID NO: 35134 - DNA, 20 bp, synthetic construct
  misc_feature 1..20: note = Synthetic Construct
  source 1..20: mol_type = other DNA
tcctcgggtctctgtgctta

SEQ ID NO: 35135 - DNA, 22 bp, synthetic construct
  misc_feature 1..22: note = Synthetic Construct
  source 1..22: mol_type = other DNA
cagccgatgccaggaatacaac

SEQ ID NO: 35136 - DNA, 23 bp, synthetic construct
  misc_feature 1..23: note = Synthetic Construct
  source 1..23: mol_type = other DNA
gggaggaggcattggaggttttc

SEQ ID NO: 35137 - DNA, 24 bp, synthetic construct
  misc_feature 1..24: note = Synthetic Construct
  source 1..24: mol_type = other DNA
cctctggctggctgaaaactcaac

SEQ ID NO: 35138 - DNA, 20 bp, synthetic construct
  misc_feature 1..20: note = Synthetic Construct
  source 1..20: mol_type = other DNA
tgcccagtgttccagcagat

SEQ ID NO: 35139 - DNA, 18 bp, synthetic construct
  misc_feature 1..18: note = Synthetic Construct
  source 1..18: mol_type = other DNA
agggctcgctcctgaaga

SEQ ID NO: 35140 - DNA, 24 bp, synthetic construct
  misc_feature 1..24: note = Synthetic Construct
  source 1..24: mol_type = other DNA
ctagggtgtttttctcccatcctt

SEQ ID NO: 35141 - DNA, 20 bp, synthetic construct
  misc_feature 1..20: note = Synthetic Construct
  source 1..20: mol_type = other DNA
cccagcccactgcaaagtca

SEQ ID NO: 35142 - DNA, 20 bp, synthetic construct
  misc_feature 1..20: note = Synthetic Construct
  source 1..20: mol_type = other DNA
cgcagacacacagggtttga

SEQ ID NO: 35143 - DNA, 21 bp, synthetic construct
  misc_feature 1..21: note = Synthetic Construct
  source 1..21: mol_type = other DNA
tacctaggaccctggggtaga

SEQ ID NO: 35144 - DNA, 22 bp, synthetic construct
  misc_feature 1..22: note = Synthetic Construct
  source 1..22: mol_type = other DNA
gagaattcacttgccgggactt

SEQ ID NO: 35145 - DNA, 25 bp, synthetic construct
  misc_feature 1..25: note = Synthetic Construct
  source 1..25: mol_type = other DNA
ggcaggataacggacactccaaatc

SEQ ID NO: 35146 - DNA, 25 bp, synthetic construct
  misc_feature 1..25: note = Synthetic Construct
  source 1..25: mol_type = other DNA
cctccagcaggtattgccatagttc

SEQ ID NO: 35147 - DNA, 23 bp, synthetic construct
  misc_feature 1..23: note = Synthetic Construct
  source 1..23: mol_type = other DNA
ccctcacctactacccacagact

SEQ ID NO: 35148 - DNA, 21 bp, synthetic construct
  misc_feature 1..21: note = Synthetic Construct
  source 1..21: mol_type = other DNA
gacacacacggtatcgctgaa

SEQ ID NO: 35149 - DNA, 24 bp, synthetic construct
  misc_feature 1..24: note = Synthetic Construct
  source 1..24: mol_type = other DNA
ccacccactggattctcccttagt

SEQ ID NO: 35150 - DNA, 20 bp, synthetic construct
  misc_feature 1..20: note = Synthetic Construct
  source 1..20: mol_type = other DNA
tcaaggcctaggagcaggtt

SEQ ID NO: 35151 - DNA, 20 bp, synthetic construct
  misc_feature 1..20: note = Synthetic Construct
  source 1..20: mol_type = other DNA
tctcacagggctgactcaca

SEQ ID NO: 35152 - DNA, 20 bp, synthetic construct
  misc_feature 1..20: note = Synthetic Construct
  source 1..20: mol_type = other DNA
gagacctgccaccctactgt

SEQ ID NO: 35153 - DNA, 25 bp, synthetic construct
  misc_feature 1..25: note = Synthetic Construct
  source 1..25: mol_type = other DNA
acactaacaccgttactgattgtga

SEQ ID NO: 35154 - DNA, 20 bp, synthetic construct
  misc_feature 1..20: note = Synthetic Construct
  source 1..20: mol_type = other DNA
gtgatggtcaggcagctgtt

SEQ ID NO: 35155 - DNA, 19 bp, synthetic construct
  misc_feature 1..19: note = Synthetic Construct
  source 1..19: mol_type = other DNA
ccttggggctgccaggaat

SEQ ID NO: 35156 - DNA, 25 bp, synthetic construct
  misc_feature 1..25: note = Synthetic Construct
  source 1..25: mol_type = other DNA
gactgaagtatagtggtggggatga

SEQ ID NO: 35157 - DNA, 19 bp, synthetic construct
  misc_feature 1..19: note = Synthetic Construct
  source 1..19: mol_type = other DNA
ccagggctgagtccaggat

SEQ ID NO: 35158 - DNA, 29 bp, synthetic construct
  misc_feature 1..29: note = Synthetic Construct
  source 1..29: mol_type = other DNA
gccacgatacctccataattgttctgact

SEQ ID NO: 35159 - DNA, 20 bp, synthetic construct
  misc_feature 1..20: note = Synthetic Construct
  source 1..20: mol_type = other DNA
tggggcagaggccacgatgt

SEQ ID NO: 35160 - DNA, 25 bp, synthetic construct
  misc_feature 1..25: note = Synthetic Construct
  source 1..25: mol_type = other DNA
cctgctgtgtcagttttatggatga

SEQ ID NO: 35161 - DNA, 23 bp, synthetic construct
  misc_feature 1..23: note = Synthetic Construct
  source 1..23: mol_type = other DNA
tctctttcctctgggtttgcatt

SEQ ID NO: 35162 - DNA, 29 bp, synthetic construct
  misc_feature 1..29: note = Synthetic Construct
  source 1..29: mol_type = other DNA
ctgggttcttagtgcagactctaatacaa

SEQ ID NO: 35163 - DNA, 20 bp, synthetic construct
  misc_feature 1..20: note = Synthetic Construct
  source 1..20: mol_type = other DNA
acctggcactgtgctgcttt

SEQ ID NO: 35164 - DNA, 24 bp, synthetic construct
  misc_feature 1..24: note = Synthetic Construct
  source 1..24: mol_type = other DNA
gctggaggaaaatgtgagttcaag

SEQ ID NO: 35165 - DNA, 24 bp, synthetic construct
  misc_feature 1..24: note = Synthetic Construct
  source 1..24: mol_type = other DNA
cctggagctaatttcacccagttc

SEQ ID NO: 35166 - DNA, 20 bp, synthetic construct
  misc_feature 1..20: note = Synthetic Construct
  source 1..20: mol_type = other DNA
atcccagaaggcggcagaat

SEQ ID NO: 35167 - DNA, 24 bp, synthetic construct
  misc_feature 1..24: note = Synthetic Construct
  source 1..24: mol_type = other DNA
tggtaacaagatccatggggagat

SEQ ID NO: 35168 - DNA, 23 bp, synthetic construct
  misc_feature 1..23: note = Synthetic Construct
  source 1..23: mol_type = other DNA
gtgtatttgcagcaggtcactgt

SEQ ID NO: 35169 - DNA, 26 bp, synthetic construct
  misc_feature 1..26: note = Synthetic Construct
  source 1..26: mol_type = other DNA
gggagaaggatctgggatttctgaca

SEQ ID NO: 35170 - DNA, 21 bp, synthetic construct
  misc_feature 1..21: note = Synthetic Construct
  source 1..21: mol_type = other DNA
agaaaaccaacggtgcgacta

SEQ ID NO: 35171 - DNA, 23 bp, synthetic construct
  misc_feature 1..23: note = Synthetic Construct
  source 1..23: mol_type = other DNA
ccacctttttcagtgggcctaga

SEQ ID NO: 35172 - DNA, 24 bp, synthetic construct
  misc_feature 1..24: note = Synthetic Construct
  source 1..24: mol_type = other DNA
tttccttccaatgaactccacaga

SEQ ID NO: 35173 - DNA, 24 bp, synthetic construct
  misc_feature 1..24: note = Synthetic Construct
  source 1..24: mol_type = other DNA
cccaaggactctatctccctcaca

SEQ ID NO: 35174 - DNA, 21 bp, synthetic construct
  misc_feature 1..21: note = Synthetic Construct
  source 1..21: mol_type = other DNA
tgattgtgggaggagggtaca

SEQ ID NO: 35175 - DNA, 21 bp, synthetic construct
  misc_feature 1..21: note = Synthetic Construct
  source 1..21: mol_type = other DNA
caaactggtcttgcgcctaca

SEQ ID NO: 35176 - DNA, 21 bp, synthetic construct
  misc_feature 1..21: note = Synthetic Construct
  source 1..21: mol_type = other DNA
ctccattgctggcagatgctt

SEQ ID NO: 35177 - DNA, 25 bp, synthetic construct
  misc_feature 1..25: note = Synthetic Construct
  source 1..25: mol_type = other DNA
cccaggtctcaaacttgttcagttg

SEQ ID NO: 35178 - DNA, 29 bp, synthetic construct
  misc_feature 1..29: note = Synthetic Construct
  source 1..29: mol_type = other DNA
ctcaaacctggacacaggataaacttttg

SEQ ID NO: 35179 - DNA, 24 bp, synthetic construct
  misc_feature 1..24: note = Synthetic Construct
  source 1..24: mol_type = other DNA
tgtgagcactttgaggacaaaatc

SEQ ID NO: 35180 - DNA, 25 bp, synthetic construct
  misc_feature 1..25: note = Synthetic Construct
  source 1..25: mol_type = other DNA
ggctgatttgtaaacggctttccat

SEQ ID NO: 35181 - DNA, 22 bp, synthetic construct
  misc_feature 1..22: note = Synthetic Construct
  source 1..22: mol_type = other DNA
agctccttcccagagcatcaac

SEQ ID NO: 35182 - DNA, 22 bp, synthetic construct
  misc_feature 1..22: note = Synthetic Construct
  source 1..22: mol_type = other DNA
taggtggggatgtcccctgttg

SEQ ID NO: 35183 - DNA, 23 bp, synthetic construct
  misc_feature 1..23: note = Synthetic Construct
  source 1..23: mol_type = other DNA
gtctaaggcaatggcttcacttc

SEQ ID NO: 35184 - DNA, 24 bp, synthetic construct
  misc_feature 1..24: note = Synthetic Construct
  source 1..24: mol_type = other DNA
gacaattctcaggagtggtgcttt

SEQ ID NO: 35185 - DNA, 22 bp, synthetic construct
  misc_feature 1..22: note = Synthetic Construct
  source 1..22: mol_type = other DNA
cgacacggtgcctcctataatg

SEQ ID NO: 35186 - DNA, 25 bp, synthetic construct
  misc_feature 1..25: note = Synthetic Construct
  source 1..25: mol_type = other DNA
gtgattaaatcccaggagtgtgtgt

SEQ ID NO: 35187 - DNA, 22 bp, synthetic construct
  misc_feature 1..22: note = Synthetic Construct
  source 1..22: mol_type = other DNA
ttggtgtctgggcaaggtctac

SEQ ID NO: 35188 - DNA, 21 bp, synthetic construct
  misc_feature 1..21: note = Synthetic Construct
  source 1..21: mol_type = other DNA
aggctcactgcctgagaggat

SEQ ID NO: 35189 - DNA, 23 bp, synthetic construct
  misc_feature 1..23: note = Synthetic Construct
  source 1..23: mol_type = other DNA
ggcaacaaagtttaggcagacaa

SEQ ID NO: 35190 - DNA, 20 bp, synthetic construct
  misc_feature 1..20: note = Synthetic Construct
  source 1..20: mol_type = other DNA
gtccttccccttcccaggtt

SEQ ID NO: 35191 - DNA, 23 bp, synthetic construct
  misc_feature 1..23: note = Synthetic Construct
  source 1..23: mol_type = other DNA
gccaacctaaagcaagctcaaac

SEQ ID NO: 35192 - DNA, 21 bp, synthetic construct
  misc_feature 1..21: note = Synthetic Construct
  source 1..21: mol_type = other DNA
tgcaagggcctgtctcccatt

SEQ ID NO: 35193 - DNA, 22 bp, synthetic construct
  misc_feature 1..22: note = Synthetic Construct
  source 1..22: mol_type = other DNA
gagaccagatgctgggaaatca

SEQ ID NO: 35194 - DNA, 23 bp, synthetic construct
  misc_feature 1..23: note = Synthetic Construct
  source 1..23: mol_type = other DNA
gggaggtggtactgtaggtggtt

SEQ ID NO: 35195 - DNA, 21 bp, synthetic construct
  misc_feature 1..21: note = Synthetic Construct
  source 1..21: mol_type = other DNA
caaagatcagggtgccagcat

SEQ ID NO: 35196 - DNA, 22 bp, synthetic construct
  misc_feature 1..22: note = Synthetic Construct
  source 1..22: mol_type = other DNA
gtccttcccagaactccaggat

SEQ ID NO: 35197 - DNA, 20 bp, synthetic construct
  misc_feature 1..20: note = Synthetic Construct
  source 1..20: mol_type = other DNA
aaatcggggcactccagctt

SEQ ID NO: 35198 - DNA, 24 bp, synthetic construct
  misc_feature 1..24: note = Synthetic Construct
  source 1..24: mol_type = other DNA
ggaggaggaagggaaggagatttt

SEQ ID NO: 35199 - DNA, 24 bp, synthetic construct
  misc_feature 1..24: note = Synthetic Construct
  source 1..24: mol_type = other DNA
ccatggggagtactgccagactat

SEQ ID NO: 35200 - DNA, 22 bp, synthetic construct
  misc_feature 1..22: note = Synthetic Construct
  source 1..22: mol_type = other DNA
agtccagctgctgtaatgaaca

SEQ ID NO: 35201 - DNA, 22 bp, synthetic construct
  misc_feature 1..22: note = Synthetic Construct
  source 1..22: mol_type = other DNA
ccaaggaaagctgctgaagtga

SEQ ID NO: 35202 - DNA, 21 bp, synthetic construct
  misc_feature 1..21: note = Synthetic Construct
  source 1..21: mol_type = other DNA
agagccacgctgacccatact

SEQ ID NO: 35203 - DNA, 22 bp, synthetic construct
  misc_feature 1..22: note = Synthetic Construct
  source 1..22: mol_type = other DNA
ctgagggaaagccaatgcaaag

SEQ ID NO: 35204 - DNA, 25 bp, synthetic construct
  misc_feature 1..25: note = Synthetic Construct
  source 1..25: mol_type = other DNA
ggagtcatttttcactctgcgctta

SEQ ID NO: 35205 - DNA, 23 bp, synthetic construct
  misc_feature 1..23: note = Synthetic Construct
  source 1..23: mol_type = other DNA
ccctttccactgcctgttactgt

SEQ ID NO: 35206 - DNA, 20 bp, synthetic construct
  misc_feature 1..20: note = Synthetic Construct
  source 1..20: mol_type = other DNA
actctgggtgctgtgcattc

SEQ ID NO: 35207 - DNA, 26 bp, synthetic construct
  misc_feature 1..26: note = Synthetic Construct
  source 1..26: mol_type = other DNA
ccccaagtcacacgttacttatcatc

SEQ ID NO: 35208 - DNA, 27 bp, synthetic construct
  misc_feature 1..27: note = Synthetic Construct
  source 1..27: mol_type = other DNA
agaggaatggaactgcatgagtattag

SEQ ID NO: 35209 - DNA, 25 bp, synthetic construct
  misc_feature 1..25: note = Synthetic Construct
  source 1..25: mol_type = other DNA
tcatctgttgggagtctaggattgt

SEQ ID NO: 35210 - DNA, 24 bp, synthetic construct
  misc_feature 1..24: note = Synthetic Construct
  source 1..24: mol_type = other DNA
cttgggcagtgaataagaggcttt

SEQ ID NO: 35211 - DNA, 23 bp, synthetic construct
  misc_feature 1..23: note = Synthetic Construct
  source 1..23: mol_type = other DNA
tgtggtttagcgtctgacctagt

SEQ ID NO: 35212 - DNA, 23 bp, synthetic construct
  misc_feature 1..23: note = Synthetic Construct
  source 1..23: mol_type = other DNA
ccccattgatggcttggacatga

SEQ ID NO: 35213 - DNA, 23 bp, synthetic construct
  misc_feature 1..23: note = Synthetic Construct
  source 1..23: mol_type = other DNA
gtgcctcatctcactgacccaaa

SEQ ID NO: 35214 - DNA, 22 bp, synthetic construct
  misc_feature 1..22: note = Synthetic Construct
  source 1..22: mol_type = other DNA
gggtcagagtgttggcctaagt

SEQ ID NO: 35215 - DNA, 23 bp, synthetic construct
  misc_feature 1..23: note = Synthetic Construct
  source 1..23: mol_type = other DNA
ctgctgtgaaagggaagctgact

SEQ ID NO: 35216 - DNA, 24 bp, synthetic construct
  misc_feature 1..24: note = Synthetic Construct
  source 1..24: mol_type = other DNA
gtccagggatagtaaggcagtttg

SEQ ID NO: 35217 - DNA, 21 bp, synthetic construct
  misc_feature 1..21: note = Synthetic Construct
  source 1..21: mol_type = other DNA
acccaccggctctatctcaca

SEQ ID NO: 35218 - DNA, 20 bp, synthetic construct
  misc_feature 1..20: note = Synthetic Construct
  source 1..20: mol_type = other DNA
tggaggagcgtggcaacaat

SEQ ID NO: 35219 - DNA, 22 bp, synthetic construct
  misc_feature 1..22: note = Synthetic Construct
  source 1..22: mol_type = other DNA
ctggagggcagtggtacaatca

SEQ ID NO: 35220 - DNA, 20 bp, synthetic construct
  misc_feature 1..20: note = Synthetic Construct
  source 1..20: mol_type = other DNA
ggccttgtgcagaactgaga

SEQ ID NO: 35221 - DNA, 26 bp, synthetic construct
  misc_feature 1..26: note = Synthetic Construct
  source 1..26: mol_type = other DNA
gtcacttgactgctttcctaatcact

SEQ ID NO: 35222 - DNA, 18 bp, synthetic construct
  misc_feature 1..18: note = Synthetic Construct
  source 1..18: mol_type = other DNA
tcagtgcctggcgcagta

SEQ ID NO: 35223 - DNA, 23 bp, synthetic construct
  misc_feature 1..23: note = Synthetic Construct
  source 1..23: mol_type = other DNA
gcccttcttagtcctgtggattc

SEQ ID NO: 35224 - DNA, 25 bp, synthetic construct
  misc_feature 1..25: note = Synthetic Construct
  source 1..25: mol_type = other DNA
ccaaaatcaatatgggctccacaca

SEQ ID NO: 35225 - DNA, 24 bp, synthetic construct
  misc_feature 1..24: note = Synthetic Construct
  source 1..24: mol_type = other DNA
ccctgcctgtctcaatgaggtcaa

SEQ ID NO: 35226 - DNA, 24 bp, synthetic construct
  misc_feature 1..24: note = Synthetic Construct
  source 1..24: mol_type = other DNA
ggggaacaggatatagacccatga

SEQ ID NO: 35227 - DNA, 23 bp, synthetic construct
  misc_feature 1..23: note = Synthetic Construct
  source 1..23: mol_type = other DNA
cctgatcagaagctacgctgtgt

SEQ ID NO: 35228 - DNA, 22 bp, synthetic construct
  misc_feature 1..22: note = Synthetic Construct
  source 1..22: mol_type = other DNA
tcttcacccagagggaaagact

SEQ ID NO: 35229 - DNA, 20 bp, synthetic construct
  misc_feature 1..20: note = Synthetic Construct
  source 1..20: mol_type = other DNA
tggcataccagcgtgtttca

SEQ ID NO: 35230 - DNA, 24 bp, synthetic construct
  misc_feature 1..24: note = Synthetic Construct
  source 1..24: mol_type = other DNA
cccagaggaagcatggaactgaag

SEQ ID NO: 35231 - DNA, 21 bp, synthetic construct
  misc_feature 1..21: note = Synthetic Construct
  source 1..21: mol_type = other DNA
gccacaccccttcctgttctt

SEQ ID NO: 35232 - DNA, 26 bp, synthetic construct
  misc_feature 1..26: note = Synthetic Construct
  source 1..26: mol_type = other DNA
gtgttcttgcttttgaaggacaggat

SEQ ID NO: 35233 - DNA, 22 bp, synthetic construct
  misc_feature 1..22: note = Synthetic Construct
  source 1..22: mol_type = other DNA
ccctgcccaagcaagacatttg

SEQ ID NO: 35234 - DNA, 23 bp, synthetic construct
  misc_feature 1..23: note = Synthetic Construct
  source 1..23: mol_type = other DNA
gctcagagaagcagtcccaatgt

SEQ ID NO: 35235 - DNA, 20 bp, synthetic construct
  misc_feature 1..20: note = Synthetic Construct
  source 1..20: mol_type = other DNA
tggggtcatgtggggtgaaa

SEQ ID NO: 35236 - DNA, 25 bp, synthetic construct
  misc_feature 1..25: note = Synthetic Construct
  source 1..25: mol_type = other DNA
ttatggcagctagatgaaggaactt

SEQ ID NO: 35237 - DNA, 18 bp, synthetic construct
  misc_feature 1..18: note = Synthetic Construct
  source 1..18: mol_type = other DNA
agccagctgcgcacaaaa

SEQ ID NO: 35238 - DNA, 21 bp, synthetic construct
  misc_feature 1..21: note = Synthetic Construct
  source 1..21: mol_type = other DNA
tcctccccagtctgctccttt

SEQ ID NO: 35239 - DNA, 25 bp, synthetic construct
  misc_feature 1..25: note = Synthetic Construct
  source 1..25: mol_type = other DNA
gctaacggtccatcaagacttccaa

SEQ ID NO: 35240 - DNA, 24 bp, synthetic construct
  misc_feature 1..24: note = Synthetic Construct
  source 1..24: mol_type = other DNA
acacatttgactttggctggagaa

SEQ ID NO: 35241 - DNA, 20 bp, synthetic construct
  misc_feature 1..20: note = Synthetic Construct
  source 1..20: mol_type = other DNA
tctgcctaagctggggatca

SEQ ID NO: 35242 - DNA, 20 bp, synthetic construct
  misc_feature 1..20: note = Synthetic Construct
  source 1..20: mol_type = other DNA
agtgaagacgctccctgcat

SEQ ID NO: 35243 - DNA, 20 bp, synthetic construct
  misc_feature 1..20: note = Synthetic Construct
  source 1..20: mol_type = other DNA
aacctggcagctggtgttag

SEQ ID NO: 35244 - DNA, 19 bp, synthetic construct
  misc_feature 1..19: note = Synthetic Construct
  source 1..19: mol_type = other DNA
tcgcactcccagcctgaat

SEQ ID NO: 35245 - DNA, 20 bp, synthetic construct
  misc_feature 1..20: note = Synthetic Construct
  source 1..20: mol_type = other DNA
ccttgtgcagtggccaaaaa

SEQ ID NO: 35246 - DNA, 25 bp, synthetic construct
  misc_feature 1..25: note = Synthetic Construct
  source 1..25: mol_type = other DNA
ggtgatgaagttttgtgctctttct

SEQ ID NO: 35247 - DNA, 30 bp, synthetic construct
  misc_feature 1..30: note = Synthetic Construct
  source 1..30: mol_type = other DNA
ccacttcaaactctgcacttttatccttct

SEQ ID NO: 35248 - DNA, 26 bp, synthetic construct
  misc_feature 1..26: note = Synthetic Construct
  source 1..26: mol_type = other DNA
cctatgaatggactttgttcctgttc

SEQ ID NO: 35249 - DNA, 19 bp, synthetic construct
  misc_feature 1..19: note = Synthetic Construct
  source 1..19: mol_type = other DNA
tcggctgcaccaggacgaa

SEQ ID NO: 35250 - DNA, 24 bp, synthetic construct
  misc_feature 1..24: note = Synthetic Construct
  source 1..24: mol_type = other DNA
tctctaactggactctgggacttc

SEQ ID NO: 35251 - DNA, 25 bp, synthetic construct
  misc_feature 1..25: note = Synthetic Construct
  source 1..25: mol_type = other DNA
gctgaactggaagatccaaccaact

SEQ ID NO: 35252 - DNA, 22 bp, synthetic construct
  misc_feature 1..22: note = Synthetic Construct
  source 1..22: mol_type = other DNA
aagaggctcccctagtcagctt

SEQ ID NO: 35253 - DNA, 22 bp, synthetic construct
  misc_feature 1..22: note = Synthetic Construct
  source 1..22: mol_type = other DNA
gcagcctctgcactctggattt

SEQ ID NO: 35254 - DNA, 20 bp, synthetic construct
  misc_feature 1..20: note = Synthetic Construct
  source 1..20: mol_type = other DNA
agtgtgccacagtgatgcaa

SEQ ID NO: 35255 - DNA, 24 bp, synthetic construct
  misc_feature 1..24: note = Synthetic Construct
  source 1..24: mol_type = other DNA
accccagttctttagctgagattg

SEQ ID NO: 35256 - DNA, 20 bp, synthetic construct
  misc_feature 1..20: note = Synthetic Construct
  source 1..20: mol_type = other DNA
gctggtgatcccacactgaa

SEQ ID NO: 35257 - DNA, 24 bp, synthetic construct
  misc_feature 1..24: note = Synthetic Construct
  source 1..24: mol_type = other DNA
tgactcgaggagtgactaagagat

SEQ ID NO: 35258 - DNA, 20 bp, synthetic construct
  misc_feature 1..20: note = Synthetic Construct
  source 1..20: mol_type = other DNA
tccaggtcgtagcagcagta

SEQ ID NO: 35259 - DNA, 22 bp, synthetic construct
  misc_feature 1..22: note = Synthetic Construct
  source 1..22: mol_type = other DNA
ggcctctgtgtttggtgctgtt

SEQ ID NO: 35260 - DNA, 24 bp, synthetic construct
  misc_feature 1..24: note = Synthetic Construct
  source 1..24: mol_type = other DNA
cgtcatcagccagaaggaatgtca

SEQ ID NO: 35261 - DNA, 20 bp, synthetic construct
  misc_feature 1..20: note = Synthetic Construct
  source 1..20: mol_type = other DNA
acctctgcctcttgcctttc

SEQ ID NO: 35262 - DNA, 22 bp, synthetic construct
  misc_feature 1..22: note = Synthetic Construct
  source 1..22: mol_type = other DNA
cccttttggttgctgtgctttc

SEQ ID NO: 35263 - DNA, 21 bp, synthetic construct
  misc_feature 1..21: note = Synthetic Construct
  source 1..21: mol_type = other DNA
tggctttcttaggtcgtgctt

SEQ ID NO: 35264 - DNA, 20 bp, synthetic construct
  misc_feature 1..20: note = Synthetic Construct
  source 1..20: mol_type = other DNA
gacatggtgggagagcacaa

SEQ ID NO: 35265 - DNA, 20 bp, synthetic construct
  misc_feature 1..20: note = Synthetic Construct
  source 1..20: mol_type = other DNA
aggcaggtgtgcactgtatg

SEQ ID NO: 35266 - DNA, 22 bp, synthetic construct
  misc_feature 1..22: note = Synthetic Construct
  source 1..22: mol_type = other DNA
ccaggcctttctcactctgtca

SEQ ID NO: 35267 - DNA, 20 bp, synthetic construct
  misc_feature 1..20: note = Synthetic Construct
  source 1..20: mol_type = other DNA
ggctcctccaaccccacttc

SEQ ID NO: 35268 - DNA, 19 bp, synthetic construct
  misc_feature 1..19: note = Synthetic Construct
  source 1..19: mol_type = other DNA
ccaccgagctgctgtgtca

SEQ ID NO: 35269 - DNA, 20 bp, synthetic construct
  misc_feature 1..20: note = Synthetic Construct
  source 1..20: mol_type = other DNA
tccacgtgacctctctgtgt

SEQ ID NO: 35270 - DNA, 22 bp, synthetic construct
  misc_feature 1..22: note = Synthetic Construct
  source 1..22: mol_type = other DNA
ggccagcacctggtgttttaca

SEQ ID NO: 35271 - DNA, 19 bp, synthetic construct
  misc_feature 1..19: note = Synthetic Construct
  source 1..19: mol_type = other DNA
tggagcacagtgggtgaga

SEQ ID NO: 35272 - DNA, 22 bp, synthetic construct
  misc_feature 1..22: note = Synthetic Construct
  source 1..22: mol_type = other DNA
ggtcattccctttgtgccaagt

SEQ ID NO: 35273 - DNA, 25 bp, synthetic construct
  misc_feature 1..25: note = Synthetic Construct
  source 1..25: mol_type = other DNA
gctgtcatccttcattgggtgaatg

SEQ ID NO: 35274 - DNA, 22 bp, synthetic construct
  misc_feature 1..22: note = Synthetic Construct
  source 1..22: mol_type = other DNA
ctgacccgagactgcatagctt

SEQ ID NO: 35275 - DNA, 21 bp, synthetic construct
  misc_feature 1..21: note = Synthetic Construct
  source 1..21: mol_type = other DNA
actgcagtggtcctggtgaga

SEQ ID NO: 35276 - DNA, 26 bp, synthetic construct
  misc_feature 1..26: note = Synthetic Construct
  source 1..26: mol_type = other DNA
tgtgcagtgatagaatggcatcttag

SEQ ID NO: 35277 - DNA, 25 bp, synthetic construct
  misc_feature 1..25: note = Synthetic Construct
  source 1..25: mol_type = other DNA
agtactgtgctagaaggtgatgcta

SEQ ID NO: 35278 - DNA, 22 bp, synthetic construct
  misc_feature 1..22: note = Synthetic Construct
  source 1..22: mol_type = other DNA
gggccctgaccaagtctttgaa

SEQ ID NO: 35279 - DNA, 21 bp, synthetic construct
  misc_feature 1..21: note = Synthetic Construct
  source 1..21: mol_type = other DNA
tctccccaccacccatcttga

SEQ ID NO: 35280 - DNA, 19 bp, synthetic construct
  misc_feature 1..19: note = Synthetic Construct
  source 1..19: mol_type = other DNA
tggaaagggccggttgtgt

SEQ ID NO: 35281 - DNA, 19 bp, synthetic construct
  misc_feature 1..19: note = Synthetic Construct
  source 1..19: mol_type = other DNA
attgggcctccctgcaaag

SEQ ID NO: 35282 - DNA, 24 bp, synthetic construct
  misc_feature 1..24: note = Synthetic Construct
  source 1..24: mol_type = other DNA
gagtagacccctaatcacagcaaa

SEQ ID NO: 35283 - DNA, 24 bp, synthetic construct
  misc_feature 1..24: note = Synthetic Construct
  source 1..24: mol_type = other DNA
cccagttatctgcttgcgggatgt

SEQ ID NO: 35284 - DNA, 23 bp, synthetic construct
  misc_feature 1..23: note = Synthetic Construct
  source 1..23: mol_type = other DNA
gcagacttgccaaatccctctca

SEQ ID NO: 35285 - DNA, 21 bp, synthetic construct
  misc_feature 1..21: note = Synthetic Construct
  source 1..21: mol_type = other DNA
tctcctaggcctctgccactt

SEQ ID NO: 35286 - DNA, 20 bp, synthetic construct
  misc_feature 1..20: note = Synthetic Construct
  source 1..20: mol_type = other DNA
ccttgagggcttggctcaaa

SEQ ID NO: 35287 - DNA, 20 bp, synthetic construct
  misc_feature 1..20: note = Synthetic Construct
  source 1..20: mol_type = other DNA
tcccactggggcccttgtaa

SEQ ID NO: 35288 - DNA, 20 bp, synthetic construct
  misc_feature 1..20: note = Synthetic Construct
  source 1..20: mol_type = other DNA
acccaccctggctgtgttca

SEQ ID NO: 35289 - DNA, 26 bp, synthetic construct
  misc_feature 1..26: note = Synthetic Construct
  source 1..26: mol_type = other DNA
catggtgagtaaaagctggtaaggta

SEQ ID NO: 35290 - DNA, 20 bp, synthetic construct
  misc_feature 1..20: note = Synthetic Construct
  source 1..20: mol_type = other DNA
acccgaggtgcctgccctaa

SEQ ID NO: 35291 - DNA, 20 bp, synthetic construct
  misc_feature 1..20: note = Synthetic Construct
  source 1..20: mol_type = other DNA
tccctcctcacagccacttg

SEQ ID NO: 35292 - DNA, 25 bp, synthetic construct
  misc_feature 1..25: note = Synthetic Construct
  source 1..25: mol_type = other DNA
actaagaggctgcatgcttattcaa

SEQ ID NO: 35293 - DNA, 26 bp, synthetic construct
  misc_feature 1..26: note = Synthetic Construct
  source 1..26: mol_type = other DNA
cacccagtgtgactgaacaatgtaag

SEQ ID NO: 35294 - DNA, 22 bp, synthetic construct
  misc_feature 1..22: note = Synthetic Construct
  source 1..22: mol_type = other DNA
gccctgttgtatgcaggacaga

SEQ ID NO: 35295 - DNA, 21 bp, synthetic construct
  misc_feature 1..21: note = Synthetic Construct
  source 1..21: mol_type = other DNA
tgtctttcaggcctcccctta

SEQ ID NO: 35296 - DNA, 20 bp, synthetic construct
  misc_feature 1..20: note = Synthetic Construct
  source 1..20: mol_type = other DNA
aagccagggatgcactgaag

SEQ ID NO: 35297 - DNA, 21 bp, synthetic construct
  misc_feature 1..21: note = Synthetic Construct
  source 1..21: mol_type = other DNA
tgggcggatgtctccaactgt

SEQ ID NO: 35298 - DNA, 23 bp, synthetic construct
  misc_feature 1..23: note = Synthetic Construct
  source 1..23: mol_type = other DNA
ctgcagacaacacagttcccttt

SEQ ID NO: 35299 - DNA, 22 bp, synthetic construct
  misc_feature 1..22: note = Synthetic Construct
  source 1..22: mol_type = other DNA
ccctacaagtgtggacctctca

SEQ ID NO: 35300 - DNA, 20 bp, synthetic construct
  misc_feature 1..20: note = Synthetic Construct
  source 1..20: mol_type = other DNA
ggagatggcgtgaagtcgat

SEQ ID NO: 35301 - DNA, 23 bp, synthetic construct
  misc_feature 1..23: note = Synthetic Construct
  source 1..23: mol_type = other DNA
gctgtgtccaggaaagtcaattc

SEQ ID NO: 35302 - DNA, 23 bp, synthetic construct
  misc_feature 1..23: note = Synthetic Construct
  source 1..23: mol_type = other DNA
gggaaatgcctgtgcatccttca

SEQ ID NO: 35303 - DNA, 22 bp, synthetic construct
  misc_feature 1..22: note = Synthetic Construct
  source 1..22: mol_type = other DNA
ggcagcagtgtcaagcttctgt

SEQ ID NO: 35304 - DNA, 21 bp, synthetic construct
  misc_feature 1..21: note = Synthetic Construct
  source 1..21: mol_type = other DNA
gtccacccctcaacattgcat

SEQ ID NO: 35305 - DNA, 27 bp, synthetic construct
  misc_feature 1..27: note = Synthetic Construct
  source 1..27: mol_type = other DNA
ggcccgaaatcaatactcacagagcta

SEQ ID NO: 35306 - DNA, 23 bp, synthetic construct
  misc_feature 1..23: note = Synthetic Construct
  source 1..23: mol_type = other DNA
ccaggaaccatggcagagatgtt

SEQ ID NO: 35307 - DNA, 20 bp, synthetic construct
  misc_feature 1..20: note = Synthetic Construct
  source 1..20: mol_type = other DNA
ggcttgcctggtgaagaaca

SEQ ID NO: 35308 - DNA, 22 bp, synthetic construct
  misc_feature 1..22: note = Synthetic Construct
  source 1..22: mol_type = other DNA
gtgattcctggagagccaccaa

SEQ ID NO: 35309 - DNA, 20 bp, synthetic construct
  misc_feature 1..20: note = Synthetic Construct
  source 1..20: mol_type = other DNA
actgcagagggcctggagat

SEQ ID NO: 35310 - DNA, 20 bp, synthetic construct
  misc_feature 1..20: note = Synthetic Construct
  source 1..20: mol_type = other DNA
ctctcctgcttgtggcactt

SEQ ID NO: 35311 - DNA, 24 bp, synthetic construct
  misc_feature 1..24: note = Synthetic Construct
  source 1..24: mol_type = other DNA
ggctctgtagcctcggatttccat

SEQ ID NO: 35312 - DNA, 20 bp, synthetic construct
  misc_feature 1..20: note = Synthetic Construct
  source 1..20: mol_type = other DNA
tggtgcaatcctggctcaca

SEQ ID NO: 35313 - DNA, 21 bp, synthetic construct
  misc_feature 1..21: note = Synthetic Construct
  source 1..21: mol_type = other DNA
gcactttgggaatgccagtga

SEQ ID NO: 35314 - DNA, 18 bp, synthetic construct
  misc_feature 1..18: note = Synthetic Construct
  source 1..18: mol_type = other DNA
acctcccgcatggctaca

SEQ ID NO: 35315 - DNA, 20 bp, synthetic construct
  misc_feature 1..20: note = Synthetic Construct
  source 1..20: mol_type = other DNA
ctccggtgccttgttgaact

SEQ ID NO: 35316 - DNA, 22 bp, synthetic construct
  misc_feature 1..22: note = Synthetic Construct
  source 1..22: mol_type = other DNA
gtcatccccagttgtgttgaga

SEQ ID NO: 35317 - DNA, 19 bp, synthetic construct
  misc_feature 1..19: note = Synthetic Construct
  source 1..19: mol_type = other DNA
tgcagcccagttccagagt

SEQ ID NO: 35318 - DNA, 25 bp, synthetic construct
  misc_feature 1..25: note = Synthetic Construct
  source 1..25: mol_type = other DNA
gggttaaaactgtgactcggtgcat

SEQ ID NO: 35319 - DNA, 20 bp, synthetic construct
  misc_feature 1..20: note = Synthetic Construct
  source 1..20: mol_type = other DNA
gcactcgtcaccgaacaagt

SEQ ID NO: 35320 - DNA, 20 bp, synthetic construct
  misc_feature 1..20: note = Synthetic Construct
  source 1..20: mol_type = other DNA
actcccatccccatcacctt

SEQ ID NO: 35321 - DNA, 22 bp, synthetic construct
  misc_feature 1..22: note = Synthetic Construct
  source 1..22: mol_type = other DNA
ggttaaccaagcgcaagtccta

SEQ ID NO: 35322 - DNA, 23 bp, synthetic construct
  misc_feature 1..23: note = Synthetic Construct
  source 1..23: mol_type = other DNA
gggcattaagtctccctgccaat

SEQ ID NO: 35323 - DNA, 21 bp, synthetic construct
  misc_feature 1..21: note = Synthetic Construct
  source 1..21: mol_type = other DNA
ggtgatgtgcctgtggtggat

SEQ ID NO: 35324 - DNA, 24 bp, synthetic construct
  misc_feature 1..24: note = Synthetic Construct
  source 1..24: mol_type = other DNA
ggaaccatgatgagctgaagttct

SEQ ID NO: 35325 - DNA, 20 bp, synthetic construct
  misc_feature 1..20: note = Synthetic Construct
  source 1..20: mol_type = other DNA
gccactgccctgaggctatc

SEQ ID NO: 35326 - DNA, 26 bp, synthetic construct
  misc_feature 1..26: note = Synthetic Construct
  source 1..26: mol_type = other DNA
gctaatctgtggataactggctcata

SEQ ID NO: 35327 - DNA, 22 bp, synthetic construct
  misc_feature 1..22: note = Synthetic Construct
  source 1..22: mol_type = other DNA
tccccttctccaggttggttag

SEQ ID NO: 35328 - DNA, 21 bp, synthetic construct
  misc_feature 1..21: note = Synthetic Construct
  source 1..21: mol_type = other DNA
gcagggcaccaaaggcatact

SEQ ID NO: 35329 - DNA, 22 bp, synthetic construct
  misc_feature 1..22: note = Synthetic Construct
  source 1..22: mol_type = other DNA
agctgctttagaggctgtcttc

SEQ ID NO: 35330 - DNA, 22 bp, synthetic construct
  misc_feature 1..22: note = Synthetic Construct
  source 1..22: mol_type = other DNA
gagactcagacgtgagcaaaga

SEQ ID NO: 35331 - DNA, 24 bp, synthetic construct
  misc_feature 1..24: note = Synthetic Construct
  source 1..24: mol_type = other DNA
ggtgctaggtcgtgttctctcttc

SEQ ID NO: 35332 - DNA, 24 bp, synthetic construct
  misc_feature 1..24: note = Synthetic Construct
  source 1..24: mol_type = other DNA
cctagtgtttgatggccattcctt

SEQ ID NO: 35333 - DNA, 20 bp, synthetic construct
  misc_feature 1..20: note = Synthetic Construct
  source 1..20: mol_type = other DNA
tcccttcccctaggtgcttt

SEQ ID NO: 35334 - DNA, 19 bp, synthetic construct
  misc_feature 1..19: note = Synthetic Construct
  source 1..19: mol_type = other DNA
ccaaggctggcctcacaag

SEQ ID NO: 35335 - DNA, 20 bp, synthetic construct
  misc_feature 1..20: note = Synthetic Construct
  source 1..20: mol_type = other DNA
gcaggtgtgaacggttgcat

SEQ ID NO: 35336 - DNA, 22 bp, synthetic construct
  misc_feature 1..22: note = Synthetic Construct
  source 1..22: mol_type = other DNA
gttggacctgagactccaccat

SEQ ID NO: 35337 - DNA, 20 bp, synthetic construct
  misc_feature 1..20: note = Synthetic Construct
  source 1..20: mol_type = other DNA
tttccagccttgggctcaga

SEQ ID NO: 35338 - DNA, 23 bp, synthetic construct
  misc_feature 1..23: note = Synthetic Construct
  source 1..23: mol_type = other DNA
cgggaaggaggtcccaagttaca

SEQ ID NO: 35339 - DNA, 20 bp, synthetic construct
  misc_feature 1..20: note = Synthetic Construct
  source 1..20: mol_type = other DNA
tccagaggggtcatccacaa

SEQ ID NO: 35340 - DNA, 20 bp, synthetic construct
  misc_feature 1..20: note = Synthetic Construct
  source 1..20: mol_type = other DNA
aggaccagggcccacaccat

SEQ ID NO: 35341 - DNA, 22 bp, synthetic construct
  misc_feature 1..22: note = Synthetic Construct
  source 1..22: mol_type = other DNA
gaccgtgccttcctgatttaca

SEQ ID NO: 35342 - DNA, 22 bp, synthetic construct
  misc_feature 1..22: note = Synthetic Construct
  source 1..22: mol_type = other DNA
tttccctccactgtagctcaac

SEQ ID NO: 35343 - DNA, 20 bp, synthetic construct
  misc_feature 1..20: note = Synthetic Construct
  source 1..20: mol_type = other DNA
accacagggtgatgcagagt

SEQ ID NO: 35344 - DNA, 20 bp, synthetic construct
  misc_feature 1..20: note = Synthetic Construct
  source 1..20: mol_type = other DNA
acaaccgagcaggtcaggaa

SEQ ID NO: 35345 - DNA, 24 bp, synthetic construct
  misc_feature 1..24: note = Synthetic Construct
  source 1..24: mol_type = other DNA
cccaagcttgtaagtggaacagta

SEQ ID NO: 35346 - DNA, 20 bp, synthetic construct
  misc_feature 1..20: note = Synthetic Construct
  source 1..20: mol_type = other DNA
atgcccggccagtcctttat

SEQ ID NO: 35347 - DNA, 22 bp, synthetic construct
  misc_feature 1..22: note = Synthetic Construct
  source 1..22: mol_type = other DNA
gcagctagcaatgacctagcaa

SEQ ID NO: 35348 - DNA, 21 bp, synthetic construct
  misc_feature 1..21: note = Synthetic Construct
  source 1..21: mol_type = other DNA
aactccaggggtgccttccaa

SEQ ID NO: 35349 - DNA, 25 bp, synthetic construct
  misc_feature 1..25: note = Synthetic Construct
  source 1..25: mol_type = other DNA
ggaagacccggatgaacaaacaaag

SEQ ID NO: 35350 - DNA, 27 bp, synthetic construct
  misc_feature 1..27: note = Synthetic Construct
  source 1..27: mol_type = other DNA
cccctgttctatttacaggaccccttt

SEQ ID NO: 35351 - DNA, 24 bp, synthetic construct
  misc_feature 1..24: note = Synthetic Construct
  source 1..24: mol_type = other DNA
cagcaccaggatgtctcagattac

SEQ ID NO: 35352 - DNA, 20 bp, synthetic construct
  misc_feature 1..20: note = Synthetic Construct
  source 1..20: mol_type = other DNA
tgggagcccagcctgctaga

SEQ ID NO: 35353 - DNA, 20 bp, synthetic construct
  misc_feature 1..20: note = Synthetic Construct
  source 1..20: mol_type = other DNA
agggccctggccttaggatt

SEQ ID NO: 35354 - DNA, 19 bp, synthetic construct
  misc_feature 1..19: note = Synthetic Construct
  source 1..19: mol_type = other DNA
ttcaatgccagcccacgaa

SEQ ID NO: 35355 - DNA, 23 bp, synthetic construct
  misc_feature 1..23: note = Synthetic Construct
  source 1..23: mol_type = other DNA
gcctcttccccatcctcacttct

SEQ ID NO: 35356 - DNA, 24 bp, synthetic construct
  misc_feature 1..24: note = Synthetic Construct
  source 1..24: mol_type = other DNA
ccactgggcaattgaagagaggaa

SEQ ID NO: 35357 - DNA, 23 bp, synthetic construct
  misc_feature 1..23: note = Synthetic Construct
  source 1..23: mol_type = other DNA
tcccttactggggtgggagtagt

SEQ ID NO: 35358 - DNA, 19 bp, synthetic construct
  misc_feature 1..19: note = Synthetic Construct
  source 1..19: mol_type = other DNA
agtgggccggagtcaggta

SEQ ID NO: 35359 - DNA, 20 bp, synthetic construct
  misc_feature 1..20: note = Synthetic Construct
  source 1..20: mol_type = other DNA
agagttaggcaggccccaaa

SEQ ID NO: 35360 - DNA, 22 bp, synthetic construct
  misc_feature 1..22: note = Synthetic Construct
  source 1..22: mol_type = other DNA
cagccttccaggccaagtatgt

SEQ ID NO: 35361 - DNA, 21 bp, synthetic construct
  misc_feature 1..21: note = Synthetic Construct
  source 1..21: mol_type = other DNA
tctccagcacaccctctccat

SEQ ID NO: 35362 - DNA, 22 bp, synthetic construct
  misc_feature 1..22: note = Synthetic Construct
  source 1..22: mol_type = other DNA
tggggtcgaaaggggttgtaag

SEQ ID NO: 35363 - DNA, 21 bp, synthetic construct
  misc_feature 1..21: note = Synthetic Construct
  source 1..21: mol_type = other DNA
ccaagggacaggaccatctct

SEQ ID NO: 35364 - DNA, 20 bp, synthetic construct
  misc_feature 1..20: note = Synthetic Construct
  source 1..20: mol_type = other DNA
tgctcctccctgcaacaaac

SEQ ID NO: 35365 - DNA, 23 bp, synthetic construct
  misc_feature 1..23: note = Synthetic Construct
  source 1..23: mol_type = other DNA
cagcctttgcttctgagggtttc

SEQ ID NO: 35366 - DNA, 26 bp, synthetic construct
  misc_feature 1..26: note = Synthetic Construct
  source 1..26: mol_type = other DNA
gcaagcaatgcacaaagaaaggaaag

SEQ ID NO: 35367 - DNA, 27 bp, synthetic construct
  misc_feature 1..27: note = Synthetic Construct
  source 1..27: mol_type = other DNA
gacctaactttatgtcacttgctgttg

SEQ ID NO: 35368 - DNA, 27 bp, synthetic construct
  misc_feature 1..27: note = Synthetic Construct
  source 1..27: mol_type = other DNA
cctgttgaaaggcatttctcacctgaa

SEQ ID NO: 35369 - DNA, 20 bp, synthetic construct
  misc_feature 1..20: note = Synthetic Construct
  source 1..20: mol_type = other DNA
tctcacagccaagcccaaca

SEQ ID NO: 35370 - DNA, 18 bp, synthetic construct
  misc_feature 1..18: note = Synthetic Construct
  source 1..18: mol_type = other DNA
agacagcacgggccactt

SEQ ID NO: 35371 - DNA, 23 bp, synthetic construct
  misc_feature 1..23: note = Synthetic Construct
  source 1..23: mol_type = other DNA
tgaaaacttggtggcaacacttg

SEQ ID NO: 35372 - DNA, 22 bp, synthetic construct
  misc_feature 1..22: note = Synthetic Construct
  source 1..22: mol_type = other DNA
gcctgccccagcttttcttcta

SEQ ID NO: 35373 - DNA, 18 bp, synthetic construct
  misc_feature 1..18: note = Synthetic Construct
  source 1..18: mol_type = other DNA
tgaggagcctgcctgcaa

SEQ ID NO: 35374 - DNA, 25 bp, synthetic construct
  misc_feature 1..25: note = Synthetic Construct
  source 1..25: mol_type = other DNA
gctcactacttaaggggatgtcagt

SEQ ID NO: 35375 - DNA, 24 bp, synthetic construct
  misc_feature 1..24: note = Synthetic Construct
  source 1..24: mol_type = other DNA
ctgtgttgaatgagtagggtggaa

SEQ ID NO: 35376 - DNA, 23 bp, synthetic construct
  misc_feature 1..23: note = Synthetic Construct
  source 1..23: mol_type = other DNA
cccaggctgaaattgctttccta

SEQ ID NO: 35377 - DNA, 23 bp, synthetic construct
  misc_feature 1..23: note = Synthetic Construct
  source 1..23: mol_type = other DNA
ggcagagactagggttccaggtt

SEQ ID NO: 35378 - DNA, 19 bp, synthetic construct
  misc_feature 1..19: note = Synthetic Construct
  source 1..19: mol_type = other DNA
acggctcgcttgctgactt

SEQ ID NO: 35379 - DNA, 21 bp, synthetic construct
  misc_feature 1..21: note = Synthetic Construct
  source 1..21: mol_type = other DNA
atccccagcccatcagcaagt

SEQ ID NO: 35380 - DNA, 20 bp, synthetic construct
  misc_feature 1..20: note = Synthetic Construct
  source 1..20: mol_type = other DNA
agctctccttccctgtgtgt

SEQ ID NO: 35381 - DNA, 20 bp, synthetic construct
  misc_feature 1..20: note = Synthetic Construct
  source 1..20: mol_type = other DNA
acagactcgggttggctgtt

SEQ ID NO: 35382 - DNA, 21 bp, synthetic construct
  misc_feature 1..21: note = Synthetic Construct
  source 1..21: mol_type = other DNA
tgtcccctcaggccttctgta

SEQ ID NO: 35383 - DNA, 19 bp, synthetic construct
  misc_feature 1..19: note = Synthetic Construct
  source 1..19: mol_type = other DNA
tccggaggtgcaggttttg

SEQ ID NO: 35384 - DNA, 24 bp, synthetic construct
  misc_feature 1..24: note = Synthetic Construct
  source 1..24: mol_type = other DNA
ctgggtagtaaaagcggtgtttga

SEQ ID NO: 35385 - DNA, 25 bp, synthetic construct
  misc_feature 1..25: note = Synthetic Construct
  source 1..25: mol_type = other DNA
gcagctacacttgcctctaggagaa

SEQ ID NO: 35386 - DNA, 21 bp, synthetic construct
  misc_feature 1..21: note = Synthetic Construct
  source 1..21: mol_type = other DNA
tcctgcccctttccttctagt

SEQ ID NO: 35387 - DNA, 19 bp, synthetic construct
  misc_feature 1..19: note = Synthetic Construct
  source 1..19: mol_type = other DNA
aaccagctgcgccccaaca

SEQ ID NO: 35388 - DNA, 30 bp, synthetic construct
  misc_feature 1..30: note = Synthetic Construct
  source 1..30: mol_type = other DNA
ggtcttgttaccataatgtgagtcttcact

SEQ ID NO: 35389 - DNA, 20 bp, synthetic construct
  misc_feature 1..20: note = Synthetic Construct
  source 1..20: mol_type = other DNA
tttggcaggaagccccaaag

SEQ ID NO: 35390 - DNA, 23 bp, synthetic construct
  misc_feature 1..23: note = Synthetic Construct
  source 1..23: mol_type = other DNA
gctgagtttcagtcggactctgt

SEQ ID NO: 35391 - DNA, 27 bp, synthetic construct
  misc_feature 1..27: note = Synthetic Construct
  source 1..27: mol_type = other DNA
gaggatgtgagcaggaacttactaatg

SEQ ID NO: 35392 - DNA, 21 bp, synthetic construct
  misc_feature 1..21: note = Synthetic Construct
  source 1..21: mol_type = other DNA
taagaggagggcggtgggaat

SEQ ID NO: 35393 - DNA, 25 bp, synthetic construct
  misc_feature 1..25: note = Synthetic Construct
  source 1..25: mol_type = other DNA
gtgtgctgcttgcagatgtatcttt

SEQ ID NO: 35394 - DNA, 23 bp, synthetic construct
  misc_feature 1..23: note = Synthetic Construct
  source 1..23: mol_type = other DNA
ctgtagtgccaaaaggacggttt

SEQ ID NO: 35395 - DNA, 20 bp, synthetic construct
  misc_feature 1..20: note = Synthetic Construct
  source 1..20: mol_type = other DNA
gccttccctgagatggcaaa

SEQ ID NO: 35396 - DNA, 21 bp, synthetic construct
  misc_feature 1..21: note = Synthetic Construct
  source 1..21: mol_type = other DNA
ggctcagaaatgcagggctat

SEQ ID NO: 35397 - DNA, 21 bp, synthetic construct
  misc_feature 1..21: note = Synthetic Construct
  source 1..21: mol_type = other DNA
gcgcaggccatttttctgctt

SEQ ID NO: 35398 - DNA, 22 bp, synthetic construct
  misc_feature 1..22: note = Synthetic Construct
  source 1..22: mol_type = other DNA
ggcaaagcatcgctgaggaagt

SEQ ID NO: 35399 - DNA, 23 bp, synthetic construct
  misc_feature 1..23: note = Synthetic Construct
  source 1..23: mol_type = other DNA
gctgtcacattccaccagacctt

SEQ ID NO: 35400 - DNA, 24 bp, synthetic construct
  misc_feature 1..24: note = Synthetic Construct
  source 1..24: mol_type = other DNA
ccccatacagtcttagggaacaga

SEQ ID NO: 35401 - DNA, 25 bp, synthetic construct
  misc_feature 1..25: note = Synthetic Construct
  source 1..25: mol_type = other DNA
ctcattcaccatttctccccagttg

SEQ ID NO: 35402 - DNA, 20 bp, synthetic construct
  misc_feature 1..20: note = Synthetic Construct
  source 1..20: mol_type = other DNA
tggtgggactgtgctgttac

SEQ ID NO: 35403 - DNA, 24 bp, synthetic construct
  misc_feature 1..24: note = Synthetic Construct
  source 1..24: mol_type = other DNA
caccatcatgccagggataagttc

SEQ ID NO: 35404 - DNA, 27 bp, synthetic construct
  misc_feature 1..27: note = Synthetic Construct
  source 1..27: mol_type = other DNA
tccacctactttctcaaactctacttc

SEQ ID NO: 35405 - DNA, 23 bp, synthetic construct
  misc_feature 1..23: note = Synthetic Construct
  source 1..23: mol_type = other DNA
tgcacactttgcttccatctgta

SEQ ID NO: 35406 - DNA, 20 bp, synthetic construct
  misc_feature 1..20: note = Synthetic Construct
  source 1..20: mol_type = other DNA
agaagcacaggaggccaatc

SEQ ID NO: 35407 - DNA, 23 bp, synthetic construct
  misc_feature 1..23: note = Synthetic Construct
  source 1..23: mol_type = other DNA
cctgcatgcactggaaaggatga

SEQ ID NO: 35408 - DNA, 19 bp, synthetic construct
  misc_feature 1..19: note = Synthetic Construct
  source 1..19: mol_type = other DNA
gggagggtccacagtcaca

SEQ ID NO: 35409 - DNA, 25 bp, synthetic construct
  misc_feature 1..25: note = Synthetic Construct
  source 1..25: mol_type = other DNA
ctggttttgaagggagcccttatct

SEQ ID NO: 35410 - DNA, 20 bp, synthetic construct
  misc_feature 1..20: note = Synthetic Construct
  source 1..20: mol_type = other DNA
aacccaccctcactgcatct

SEQ ID NO: 35411 - DNA, 28 bp, synthetic construct
  misc_feature 1..28: note = Synthetic Construct
  source 1..28: mol_type = other DNA
ggcagagaggaataaagacccatcattg

SEQ ID NO: 35412 - DNA, 22 bp, synthetic construct
  misc_feature 1..22: note = Synthetic Construct
  source 1..22: mol_type = other DNA
ccttcctaccctagagccacat

SEQ ID NO: 35413 - DNA, 25 bp, synthetic construct
  misc_feature 1..25: note = Synthetic Construct
  source 1..25: mol_type = other DNA
ggttccagagacccaagtcgaagtt

SEQ ID NO: 35414 - DNA, 27 bp, synthetic construct
  misc_feature 1..27: note = Synthetic Construct
  source 1..27: mol_type = other DNA
cctttagttcaccctgtccttcctaag

SEQ ID NO: 35415 - DNA, 20 bp, synthetic construct
  misc_feature 1..20: note = Synthetic Construct
  source 1..20: mol_type = other DNA
tcctgacctctggcctgtct

SEQ ID NO: 35416 - DNA, 20 bp, synthetic construct
  misc_feature 1..20: note = Synthetic Construct
  source 1..20: mol_type = other DNA
gtgttggcggagatgcagaa

SEQ ID NO: 35417 - DNA, 21 bp, synthetic construct
  misc_feature 1..21: note = Synthetic Construct
  source 1..21: mol_type = other DNA
ctcgagtttgccagcaacaga

SEQ ID NO: 35418 - DNA, 22 bp, synthetic construct
  misc_feature 1..22: note = Synthetic Construct
  source 1..22: mol_type = other DNA
cccctaatgcctcgcagttctt

SEQ ID NO: 35419 - DNA, 18 bp, synthetic construct
  misc_feature 1..18: note = Synthetic Construct
  source 1..18: mol_type = other DNA
aggctagagcgcggcaaa

SEQ ID NO: 35420 - DNA, 22 bp, synthetic construct
  misc_feature 1..22: note = Synthetic Construct
  source 1..22: mol_type = other DNA
agtcctgagagggtcagctatc

SEQ ID NO: 35421 - DNA, 21 bp, synthetic construct
  misc_feature 1..21: note = Synthetic Construct
  source 1..21: mol_type = other DNA
tagctgtggctccctcctact

SEQ ID NO: 35422 - DNA, 20 bp, synthetic construct
  misc_feature 1..20: note = Synthetic Construct
  source 1..20: mol_type = other DNA
atcctcaccccagcctcttc

SEQ ID NO: 35423 - DNA, 23 bp, synthetic construct
  misc_feature 1..23: note = Synthetic Construct
  source 1..23: mol_type = other DNA
gtgaaggaaacagcatggcaaca

SEQ ID NO: 35424 - DNA, 18 bp, synthetic construct
  misc_feature 1..18: note = Synthetic Construct
  source 1..18: mol_type = other DNA
agcctctggaggcagcat

SEQ ID NO: 35425 - DNA, 19 bp, synthetic construct
  misc_feature 1..19: note = Synthetic Construct
  source 1..19: mol_type = other DNA
aagcctccccgcctcttct

SEQ ID NO: 35426 - DNA, 25 bp, synthetic construct
  misc_feature 1..25: note = Synthetic Construct
  source 1..25: mol_type = other DNA
ccgccctgaagagaagaacacaaac

SEQ ID NO: 35427 - DNA, 20 bp, synthetic construct
  misc_feature 1..20: note = Synthetic Construct
  source 1..20: mol_type = other DNA
aggcatggcagcagtgtgta

SEQ ID NO: 35428 - DNA, 29 bp, synthetic construct
  misc_feature 1..29: note = Synthetic Construct
  source 1..29: mol_type = other DNA
gcatgtaacttaccgtactgtgactgttt

SEQ ID NO: 35429 - DNA, 20 bp, synthetic construct
  misc_feature 1..20: note = Synthetic Construct
  source 1..20: mol_type = other DNA
aagcagggtctgtgctgaca

SEQ ID NO: 35430 - DNA, 19 bp, synthetic construct
  misc_feature 1..19: note = Synthetic Construct
  source 1..19: mol_type = other DNA
tcgagtcgcgggaagctaa

SEQ ID NO: 35431 - DNA, 23 bp, synthetic construct
  misc_feature 1..23: note = Synthetic Construct
  source 1..23: mol_type = other DNA
cactgatagcaaggggtggaatc

SEQ ID NO: 35432 - DNA, 24 bp, synthetic construct
  misc_feature 1..24: note = Synthetic Construct
  source 1..24: mol_type = other DNA
gaggagatggaggccttaacatac

SEQ ID NO: 35433 - DNA, 21 bp, synthetic construct
  misc_feature 1..21: note = Synthetic Construct
  source 1..21: mol_type = other DNA
ttccccttgccaggaggttgt

SEQ ID NO: 35434 - DNA, 22 bp, synthetic construct
  misc_feature 1..22: note = Synthetic Construct
  source 1..22: mol_type = other DNA
ctgccttcatcaggccctactt

SEQ ID NO: 35435 - DNA, 19 bp, synthetic construct
  misc_feature 1..19: note = Synthetic Construct
  source 1..19: mol_type = other DNA
tcgctgtgacgcgggtaag

SEQ ID NO: 35436 - DNA, 19 bp, synthetic construct
  misc_feature 1..19: note = Synthetic Construct
  source 1..19: mol_type = other DNA
aagtggcgtggccttggaa

SEQ ID NO: 35437 - DNA, 23 bp, synthetic construct
  misc_feature 1..23: note = Synthetic Construct
  source 1..23: mol_type = other DNA
gggcacaagcgatttccaatcaa

SEQ ID NO: 35438 - DNA, 22 bp, synthetic construct
  misc_feature 1..22: note = Synthetic Construct
  source 1..22: mol_type = other DNA
cagtgggattccagacggcata

SEQ ID NO: 35439 - DNA, 26 bp, synthetic construct
  misc_feature 1..26: note = Synthetic Construct
  source 1..26: mol_type = other DNA
gggctgctttacctctaatgccaagt

SEQ ID NO: 35440 - DNA, 26 bp, synthetic construct
  misc_feature 1..26: note = Synthetic Construct
  source 1..26: mol_type = other DNA
cgaatctaagacaacactccgacgta

SEQ ID NO: 35441 - DNA, 22 bp, synthetic construct
  misc_feature 1..22: note = Synthetic Construct
  source 1..22: mol_type = other DNA
gaggtgagggaatgagctgtgt

SEQ ID NO: 35442 - DNA, 23 bp, synthetic construct
  misc_feature 1..23: note = Synthetic Construct
  source 1..23: mol_type = other DNA
cctgaacaccacagccttagaga

SEQ ID NO: 35443 - DNA, 22 bp, synthetic construct
  misc_feature 1..22: note = Synthetic Construct
  source 1..22: mol_type = other DNA
ggaaggaagggctatgctctgt

SEQ ID NO: 35444 - DNA, 24 bp, synthetic construct
  misc_feature 1..24: note = Synthetic Construct
  source 1..24: mol_type = other DNA
gcacctgacaggaaatacgactca

SEQ ID NO: 35445 - DNA, 27 bp, synthetic construct
  misc_feature 1..27: note = Synthetic Construct
  source 1..27: mol_type = other DNA
cacttatcagcaggtactatgctccaa

SEQ ID NO: 35446 - DNA, 21 bp, synthetic construct
  misc_feature 1..21: note = Synthetic Construct
  source 1..21: mol_type = other DNA
tcaccatggctgctgggattg

SEQ ID NO: 35447 - DNA, 27 bp, synthetic construct
  misc_feature 1..27: note = Synthetic Construct
  source 1..27: mol_type = other DNA
gctctcacttattggaactggtggatt

SEQ ID NO: 35448 - DNA, 24 bp, synthetic construct
  misc_feature 1..24: note = Synthetic Construct
  source 1..24: mol_type = other DNA
cccagaatgttcccaggtgtgttc

SEQ ID NO: 35449 - DNA, 24 bp, synthetic construct
  misc_feature 1..24: note = Synthetic Construct
  source 1..24: mol_type = other DNA
ctcatgctaatcctctgccctttt

SEQ ID NO: 35450 - DNA, 20 bp, synthetic construct
  misc_feature 1..20: note = Synthetic Construct
  source 1..20: mol_type = other DNA
acggccagtgtcttcaggtt

SEQ ID NO: 35451 - DNA, 23 bp, synthetic construct
  misc_feature 1..23: note = Synthetic Construct
  source 1..23: mol_type = other DNA
ccaagttgggaaagctggtgttg

SEQ ID NO: 35452 - DNA, 24 bp, synthetic construct
  misc_feature 1..24: note = Synthetic Construct
  source 1..24: mol_type = other DNA
ccatgttgctgagagcttgggtta

SEQ ID NO: 35453 - DNA, 27 bp, synthetic construct
  misc_feature 1..27: note = Synthetic Construct
  source 1..27: mol_type = other DNA
tctatgagactctggaactgtcttttg

SEQ ID NO: 35454 - DNA, 25 bp, synthetic construct
  misc_feature 1..25: note = Synthetic Construct
  source 1..25: mol_type = other DNA
cagagaggaaaggactgtgtacttg

SEQ ID NO: 35455 - DNA, 24 bp, synthetic construct
  misc_feature 1..24: note = Synthetic Construct
  source 1..24: mol_type = other DNA
ctggaagcatcaagaaaggcttca

SEQ ID NO: 35456 - DNA, 21 bp, synthetic construct
  misc_feature 1..21: note = Synthetic Construct
  source 1..21: mol_type = other DNA
cccaagttgaggacagctgaa

SEQ ID NO: 35457 - DNA, 19 bp, synthetic construct
  misc_feature 1..19: note = Synthetic Construct
  source 1..19: mol_type = other DNA
agcagggcagggcagtgaa

SEQ ID NO: 35458 - DNA, 21 bp, synthetic construct
  misc_feature 1..21: note = Synthetic Construct
  source 1..21: mol_type = other DNA
tcatctcggcccagtgagaga

SEQ ID NO: 35459 - DNA, 23 bp, synthetic construct
  misc_feature 1..23: note = Synthetic Construct
  source 1..23: mol_type = other DNA
tgaacaacgtagcaacactggat

SEQ ID NO: 35460 - DNA, 21 bp, synthetic construct
  misc_feature 1..21: note = Synthetic Construct
  source 1..21: mol_type = other DNA
gcaaaggcttgtggtcgagaa

SEQ ID NO: 35461 - DNA, 25 bp, synthetic construct
  misc_feature 1..25: note = Synthetic Construct
  source 1..25: mol_type = other DNA
gctacaagggtaaaaccaggaccaa

SEQ ID NO: 35462 - DNA, 20 bp, synthetic construct
  misc_feature 1..20: note = Synthetic Construct
  source 1..20: mol_type = other DNA
tgccatttggccagcctttc

SEQ ID NO: 35463 - DNA, 20 bp, synthetic construct
  misc_feature 1..20: note = Synthetic Construct
  source 1..20: mol_type = other DNA
agagctctggcacctgtttg

SEQ ID NO: 35464 - DNA, 24 bp, synthetic construct
  misc_feature 1..24: note = Synthetic Construct
  source 1..24: mol_type = other DNA
gctcccagacgtcattggatctgt

SEQ ID NO: 35465 - DNA, 23 bp, synthetic construct
  misc_feature 1..23: note = Synthetic Construct
  source 1..23: mol_type = other DNA
ccctggaacttctgaccgcattt

SEQ ID NO: 35466 - DNA, 25 bp, synthetic construct
  misc_feature 1..25: note = Synthetic Construct
  source 1..25: mol_type = other DNA
gctaagcatcccagaaacccaaatg

SEQ ID NO: 35467 - DNA, 20 bp, synthetic construct
  misc_feature 1..20: note = Synthetic Construct
  source 1..20: mol_type = other DNA
accccgtgcagctggtcact

SEQ ID NO: 35468 - DNA, 24 bp, synthetic construct
  misc_feature 1..24: note = Synthetic Construct
  source 1..24: mol_type = other DNA
ggccctccctgaggaagtaaaatg

SEQ ID NO: 35469 - DNA, 20 bp, synthetic construct
  misc_feature 1..20: note = Synthetic Construct
  source 1..20: mol_type = other DNA
ttctgggcagcatccagttg

SEQ ID NO: 35470 - DNA, 21 bp, synthetic construct
  misc_feature 1..21: note = Synthetic Construct
  source 1..21: mol_type = other DNA
ccaggttcgaggcactgactt

SEQ ID NO: 35471 - DNA, 21 bp, synthetic construct
  misc_feature 1..21: note = Synthetic Construct
  source 1..21: mol_type = other DNA
gtgctttggcttcctcgaatc

SEQ ID NO: 35472 - DNA, 20 bp, synthetic construct
  misc_feature 1..20: note = Synthetic Construct
  source 1..20: mol_type = other DNA
tccttgcaggtggtgacctt

SEQ ID NO: 35473 - DNA, 21 bp, synthetic construct
  misc_feature 1..21: note = Synthetic Construct
  source 1..21: mol_type = other DNA
ggtgtgcgtgcattagcaaac

SEQ ID NO: 35474 - DNA, 29 bp, synthetic construct
  misc_feature 1..29: note = Synthetic Construct
  source 1..29: mol_type = other DNA
ggacaatgacctttagagagaaggaatct

SEQ ID NO: 35475 - DNA, 21 bp, synthetic construct
  misc_feature 1..21: note = Synthetic Construct
  source 1..21: mol_type = other DNA
gactcaggtatcccggtctct

SEQ ID NO: 35476 - DNA, 26 bp, synthetic construct
  misc_feature 1..26: note = Synthetic Construct
  source 1..26: mol_type = other DNA
cctccttgcctctaaagctcttggtt

SEQ ID NO: 35477 - DNA, 22 bp, synthetic construct
  misc_feature 1..22: note = Synthetic Construct
  source 1..22: mol_type = other DNA
gcccacagaactctgggagatt

SEQ ID NO: 35478 - DNA, 22 bp, synthetic construct
  misc_feature 1..22: note = Synthetic Construct
  source 1..22: mol_type = other DNA
tgaacagaagagctccatgcaa

SEQ ID NO: 35479 - DNA, 22 bp, synthetic construct
  misc_feature 1..22: note = Synthetic Construct
  source 1..22: mol_type = other DNA
gggctggcttcccaaagtgatt

SEQ ID NO: 35480 - DNA, 21 bp, synthetic construct
  misc_feature 1..21: note = Synthetic Construct
  source 1..21: mol_type = other DNA
tctctctagcctggggctttg

SEQ ID NO: 35481 - DNA, 22 bp, synthetic construct
  misc_feature 1..22: note = Synthetic Construct
  source 1..22: mol_type = other DNA
ggagcatactgtgtggggagaa

SEQ ID NO: 35482 - DNA, 20 bp, synthetic construct
  misc_feature 1..20: note = Synthetic Construct
  source 1..20: mol_type = other DNA
agtcggggctgcaggactaa

SEQ ID NO: 35483 - DNA, 21 bp, synthetic construct
  misc_feature 1..21: note = Synthetic Construct
  source 1..21: mol_type = other DNA
cctcaaagccggtgcatctct

SEQ ID NO: 35484 - DNA, 19 bp, synthetic construct
  misc_feature 1..19: note = Synthetic Construct
  source 1..19: mol_type = other DNA
tcgcacctccggtcacttg

SEQ ID NO: 35485 - DNA, 20 bp, synthetic construct
  misc_feature 1..20: note = Synthetic Construct
  source 1..20: mol_type = other DNA
tgcgtctgcctacgcatgtt

SEQ ID NO: 35486 - DNA, 24 bp, synthetic construct
  misc_feature 1..24: note = Synthetic Construct
  source 1..24: mol_type = other DNA
agtcagatgcagaataggctgatg

SEQ ID NO: 35487 - DNA, 20 bp, synthetic construct
  misc_feature 1..20: note = Synthetic Construct
  source 1..20: mol_type = other DNA
agaaggcgacctccccaaat

SEQ ID NO: 35488 - DNA, 23 bp, synthetic construct
  misc_feature 1..23: note = Synthetic Construct
  source 1..23: mol_type = other DNA
cctcccagcctctctacctcttt

SEQ ID NO: 35489 - DNA, 26 bp, synthetic construct
  misc_feature 1..26: note = Synthetic Construct
  source 1..26: mol_type = other DNA
catgtgttgaccctaaacttgacaac

SEQ ID NO: 35490 - DNA, 21 bp, synthetic construct
  misc_feature 1..21: note = Synthetic Construct
  source 1..21: mol_type = other DNA
gcctccctttggcccattttg

SEQ ID NO: 35491 - DNA, 22 bp, synthetic construct
  misc_feature 1..22: note = Synthetic Construct
  source 1..22: mol_type = other DNA
caggccttgcctaactcagatg

SEQ ID NO: 35492 - DNA, 25 bp, synthetic construct
  misc_feature 1..25: note = Synthetic Construct
  source 1..25: mol_type = other DNA
gggttgttcactccattcacagcta

SEQ ID NO: 35493 - DNA, 20 bp, synthetic construct
  misc_feature 1..20: note = Synthetic Construct
  source 1..20: mol_type = other DNA
cagcagtgcacacagcacta

SEQ ID NO: 35494 - DNA, 20 bp, synthetic construct
  misc_feature 1..20: note = Synthetic Construct
  source 1..20: mol_type = other DNA
gccattggtgctgcatgtct

SEQ ID NO: 35495 - DNA, 20 bp, synthetic construct
  misc_feature 1..20: note = Synthetic Construct
  source 1..20: mol_type = other DNA
ttccgcttccctgccaagat

SEQ ID NO: 35496 - DNA, 23 bp, synthetic construct
  misc_feature 1..23: note = Synthetic Construct
  source 1..23: mol_type = other DNA
ctcactctgggactatgcgagat

SEQ ID NO: 35497 - DNA, 23 bp, synthetic construct
  misc_feature 1..23: note = Synthetic Construct
  source 1..23: mol_type = other DNA
cccttttcatggacagaggacat

SEQ ID NO: 35498 - DNA, 19 bp, synthetic construct
  misc_feature 1..19: note = Synthetic Construct
  source 1..19: mol_type = other DNA
tcttgccagttgccgttga

SEQ ID NO: 35499 - DNA, 21 bp, synthetic construct
  misc_feature 1..21: note = Synthetic Construct
  source 1..21: mol_type = other DNA
tgccggaacagcaggatgact

SEQ ID NO: 35500 - DNA, 27 bp, synthetic construct
  misc_feature 1..27: note = Synthetic Construct
  source 1..27: mol_type = other DNA
gagagttctgtacctgtgtgtatcttc

SEQ ID NO: 35501 - DNA, 18 bp, synthetic construct
  misc_feature 1..18: note = Synthetic Construct
  source 1..18: mol_type = other DNA
atggccagggcagtgcat

SEQ ID NO: 35502 - DNA, 22 bp, synthetic construct
  misc_feature 1..22: note = Synthetic Construct
  source 1..22: mol_type = other DNA
tggctctcccttgggcagtaag

SEQ ID NO: 35503 - DNA, 24 bp, synthetic construct
  misc_feature 1..24: note = Synthetic Construct
  source 1..24: mol_type = other DNA
ggggcattaaagctagtggaaaac

SEQ ID NO: 35504 - DNA, 21 bp, synthetic construct
  misc_feature 1..21: note = Synthetic Construct
  source 1..21: mol_type = other DNA
ccctatgtgctgacggaggta

SEQ ID NO: 35505 - DNA, 26 bp, synthetic construct
  misc_feature 1..26: note = Synthetic Construct
  source 1..26: mol_type = other DNA
gtctgcctatcatttgtgtagtggaa

SEQ ID NO: 35506 - DNA, 20 bp, synthetic construct
  misc_feature 1..20: note = Synthetic Construct
  source 1..20: mol_type = other DNA
gcaaggtggccattctgaca

SEQ ID NO: 35507 - DNA, 22 bp, synthetic construct
  misc_feature 1..22: note = Synthetic Construct
  source 1..22: mol_type = other DNA
ttgatcagggtcttggctcttc

SEQ ID NO: 35508 - DNA, 21 bp, synthetic construct
  misc_feature 1..21: note = Synthetic Construct
  source 1..21: mol_type = other DNA
gaagcccaagggttgagttga

SEQ ID NO: 35509 - DNA, 19 bp, synthetic construct
  misc_feature 1..19: note = Synthetic Construct
  source 1..19: mol_type = other DNA
ggggacctgggagaccatt

SEQ ID NO: 35510 - DNA, 20 bp, synthetic construct
  misc_feature 1..20: note = Synthetic Construct
  source 1..20: mol_type = other DNA
ccctctcagcctccctcctt

SEQ ID NO: 35511 - DNA, 22 bp, synthetic construct
  misc_feature 1..22: note = Synthetic Construct
  source 1..22: mol_type = other DNA
cagtccagagagtgggcatttg

SEQ ID NO: 35512 - DNA, 24 bp, synthetic construct
  misc_feature 1..24: note = Synthetic Construct
  source 1..24: mol_type = other DNA
ttccaggcatcacctgaagataag

SEQ ID NO: 35513 - DNA, 24 bp, synthetic construct
  misc_feature 1..24: note = Synthetic Construct
  source 1..24: mol_type = other DNA
ccctctgtaccctgaggacaaaca

SEQ ID NO: 35514 - DNA, 24 bp, synthetic construct
  misc_feature 1..24: note = Synthetic Construct
  source 1..24: mol_type = other DNA
gggccttgtgtagacaacctggaa

SEQ ID NO: 35515 - DNA, 24 bp, synthetic construct
  misc_feature 1..24: note = Synthetic Construct
  source 1..24: mol_type = other DNA
gcgatgcacagtgctttctcaaac

SEQ ID NO: 35516 - DNA, 20 bp, synthetic construct
  misc_feature 1..20: note = Synthetic Construct
  source 1..20: mol_type = other DNA
tcgcacgtggacccaactaa

SEQ ID NO: 35517 - DNA, 28 bp, synthetic construct
  misc_feature 1..28: note = Synthetic Construct
  source 1..28: mol_type = other DNA
ggttcctgaaaggtttaaagaccgtgaa

SEQ ID NO: 35518 - DNA, 25 bp, synthetic construct
  misc_feature 1..25: note = Synthetic Construct
  source 1..25: mol_type = other DNA
gtgatcctgtgaactttgtgcctaa

SEQ ID NO: 35519 - DNA, 23 bp, synthetic construct
  misc_feature 1..23: note = Synthetic Construct
  source 1..23: mol_type = other DNA
ggtgcatgaaagggacagagcat

SEQ ID NO: 35520 - DNA, 22 bp, synthetic construct
  misc_feature 1..22: note = Synthetic Construct
  source 1..22: mol_type = other DNA
actgcctgaatctctggagtct

SEQ ID NO: 35521 - DNA, 19 bp, synthetic construct
  misc_feature 1..19: note = Synthetic Construct
  source 1..19: mol_type = other DNA
tgggctggagtgcaccatt

SEQ ID NO: 35522 - DNA, 22 bp, synthetic construct
  misc_feature 1..22: note = Synthetic Construct
  source 1..22: mol_type = other DNA
cctggcctcataacgtccattc

SEQ ID NO: 35523 - DNA, 21 bp, synthetic construct
  misc_feature 1..21: note = Synthetic Construct
  source 1..21: mol_type = other DNA
cccctttcccttcgcacttct

SEQ ID NO: 35524 - DNA, 26 bp, synthetic construct
  misc_feature 1..26: note = Synthetic Construct
  source 1..26: mol_type = other DNA
ggaagaaaagatctgggagggtggtt

SEQ ID NO: 35525 - DNA, 23 bp, synthetic construct
  misc_feature 1..23: note = Synthetic Construct
  source 1..23: mol_type = other DNA
caaacacagatctgcctctggat

SEQ ID NO: 35526 - DNA, 26 bp, synthetic construct
  misc_feature 1..26: note = Synthetic Construct
  source 1..26: mol_type = other DNA
gggctattttagaagcagaaggatga

SEQ ID NO: 35527 - DNA, 26 bp, synthetic construct
  misc_feature 1..26: note = Synthetic Construct
  source 1..26: mol_type = other DNA
cacactcgacatcaactgagactaga

SEQ ID NO: 35528 - DNA, 21 bp, synthetic construct
  misc_feature 1..21: note = Synthetic Construct
  source 1..21: mol_type = other DNA
gcagctacaagccttcacact

SEQ ID NO: 35529 - DNA, 21 bp, synthetic construct
  misc_feature 1..21: note = Synthetic Construct
  source 1..21: mol_type = other DNA
gcttgggcttcctcacagcat

SEQ ID NO: 35530 - DNA, 21 bp, synthetic construct
  misc_feature 1..21: note = Synthetic Construct
  source 1..21: mol_type = other DNA
tagggagtgggatggggacaa

SEQ ID NO: 35531 - DNA, 22 bp, synthetic construct
  misc_feature 1..22: note = Synthetic Construct
  source 1..22: mol_type = other DNA
gaccagagaacccttgcgattc

SEQ ID NO: 35532 - DNA, 22 bp, synthetic construct
  misc_feature 1..22: note = Synthetic Construct
  source 1..22: mol_type = other DNA
agtaggtgtacccaccttgtct

SEQ ID NO: 35533 - DNA, 25 bp, synthetic construct
  misc_feature 1..25: note = Synthetic Construct
  source 1..25: mol_type = other DNA
tccttctgtatgatcaacggacttg

SEQ ID NO: 35534 - DNA, 20 bp, synthetic construct
  misc_feature 1..20: note = Synthetic Construct
  source 1..20: mol_type = other DNA
tcacaaggcagtggggaatg

SEQ ID NO: 35535 - DNA, 19 bp, synthetic construct
  misc_feature 1..19: note = Synthetic Construct
  source 1..19: mol_type = other DNA
gcggcttggtgaccgtgat

SEQ ID NO: 35536 - DNA, 24 bp, synthetic construct
  misc_feature 1..24: note = Synthetic Construct
  source 1..24: mol_type = other DNA
ggatgttgtttctaggctgtgatg

SEQ ID NO: 35537 - DNA, 24 bp, synthetic construct
  misc_feature 1..24: note = Synthetic Construct
  source 1..24: mol_type = other DNA
gagagagaatgccagacagttttg

SEQ ID NO: 35538 - DNA, 19 bp, synthetic construct
  misc_feature 1..19: note = Synthetic Construct
  source 1..19: mol_type = other DNA
gccgagtccagcccaatca

SEQ ID NO: 35539 - DNA, 19 bp, synthetic construct
  misc_feature 1..19: note = Synthetic Construct
  source 1..19: mol_type = other DNA
accccaggagccagtctgt

SEQ ID NO: 35540 - DNA, 24 bp, synthetic construct
  misc_feature 1..24: note = Synthetic Construct
  source 1..24: mol_type = other DNA
tgcccagctgttattaggtgttac

SEQ ID NO: 35541 - DNA, 22 bp, synthetic construct
  misc_feature 1..22: note = Synthetic Construct
  source 1..22: mol_type = other DNA
tgcctcagagacttgggctgta

SEQ ID NO: 35542 - DNA, 27 bp, synthetic construct
  misc_feature 1..27: note = Synthetic Construct
  source 1..27: mol_type = other DNA
gacatgcctatttgacccaaattctgt

SEQ ID NO: 35543 - DNA, 24 bp, synthetic construct
  misc_feature 1..24: note = Synthetic Construct
  source 1..24: mol_type = other DNA
gcagtgctaacagtttggcagatg

SEQ ID NO: 35544 - DNA, 19 bp, synthetic construct
  misc_feature 1..19: note = Synthetic Construct
  source 1..19: mol_type = other DNA
cgggcatgtggggttgaca

SEQ ID NO: 35545 - DNA, 21 bp, synthetic construct
  misc_feature 1..21: note = Synthetic Construct
  source 1..21: mol_type = other DNA
tgtgcctcgtctcatctcact

SEQ ID NO: 35546 - DNA, 27 bp, synthetic construct
  misc_feature 1..27: note = Synthetic Construct
  source 1..27: mol_type = other DNA
cactgattaatatccacaggccagctt

SEQ ID NO: 35547 - DNA, 29 bp, synthetic construct
  misc_feature 1..29: note = Synthetic Construct
  source 1..29: mol_type = other DNA
ccgaaggataatgtaggaggtgagagatg

SEQ ID NO: 35548 - DNA, 22 bp, synthetic construct
  misc_feature 1..22: note = Synthetic Construct
  source 1..22: mol_type = other DNA
gctgatcccaggctcacttttg

SEQ ID NO: 35549 - DNA, 22 bp, synthetic construct
  misc_feature 1..22: note = Synthetic Construct
  source 1..22: mol_type = other DNA
agggaactggctcagctggtat

SEQ ID NO: 35550 - DNA, 22 bp, synthetic construct
  misc_feature 1..22: note = Synthetic Construct
  source 1..22: mol_type = other DNA
gtggagcaaaacccctctcact

SEQ ID NO: 35551 - DNA, 20 bp, synthetic construct
  misc_feature 1..20: note = Synthetic Construct
  source 1..20: mol_type = other DNA
aaacacccctccccacaaag

SEQ ID NO: 35552 - DNA, 27 bp, synthetic construct
  misc_feature 1..27: note = Synthetic Construct
  source 1..27: mol_type = other DNA
ggtggctctccagagattttagacaga

SEQ ID NO: 35553 - DNA, 21 bp, synthetic construct
  misc_feature 1..21: note = Synthetic Construct
  source 1..21: mol_type = other DNA
ccacttcccggctgtgttctt

SEQ ID NO: 35554 - DNA, 19 bp, synthetic construct
  misc_feature 1..19: note = Synthetic Construct
  source 1..19: mol_type = other DNA
agaccaccggggaccttga

SEQ ID NO: 35555 - DNA, 24 bp, synthetic construct
  misc_feature 1..24: note = Synthetic Construct
  source 1..24: mol_type = other DNA
gggctagacacaggatgagtttct

SEQ ID NO: 35556 - DNA, 22 bp, synthetic construct
  misc_feature 1..22: note = Synthetic Construct
  source 1..22: mol_type = other DNA
gggccctgtgaaaagagactga

SEQ ID NO: 35557 - DNA, 19 bp, synthetic construct
  misc_feature 1..19: note = Synthetic Construct
  source 1..19: mol_type = other DNA
ccagcagctgaggcagaga

SEQ ID NO: 35558 - DNA, 23 bp, synthetic construct
  misc_feature 1..23: note = Synthetic Construct
  source 1..23: mol_type = other DNA
ggtgacctacagcaaggcactac

SEQ ID NO: 35559 - DNA, 22 bp, synthetic construct
  misc_feature 1..22: note = Synthetic Construct
  source 1..22: mol_type = other DNA
ggggtgcgtgtgttggatttca

SEQ ID NO: 35560 - DNA, 25 bp, synthetic construct
  misc_feature 1..25: note = Synthetic Construct
  source 1..25: mol_type = other DNA
acgagatccaggactacatttctca

SEQ ID NO: 35561 - DNA, 24 bp, synthetic construct
  misc_feature 1..24: note = Synthetic Construct
  source 1..24: mol_type = other DNA
gtcagcttcagctcccaattccta

SEQ ID NO: 35562 - DNA, 23 bp, synthetic construct
  misc_feature 1..23: note = Synthetic Construct
  source 1..23: mol_type = other DNA
cttttccatgaagggagcaggaa

SEQ ID NO: 35563 - DNA, 22 bp, synthetic construct
  misc_feature 1..22: note = Synthetic Construct
  source 1..22: mol_type = other DNA
actcgcaaaatgggtggctatc

SEQ ID NO: 35564 - DNA, 20 bp, synthetic construct
  misc_feature 1..20: note = Synthetic Construct
  source 1..20: mol_type = other DNA
aaatgggcatggggcagagt

SEQ ID NO: 35565 - DNA, 22 bp, synthetic construct
  misc_feature 1..22: note = Synthetic Construct
  source 1..22: mol_type = other DNA
gtggtacccttagtccccaaga

SEQ ID NO: 35566 - DNA, 22 bp, synthetic construct
  misc_feature 1..22: note = Synthetic Construct
  source 1..22: mol_type = other DNA
ggtgctgtgctggcactaaaag

SEQ ID NO: 35567 - DNA, 21 bp, synthetic construct
  misc_feature 1..21: note = Synthetic Construct
  source 1..21: mol_type = other DNA
tgtggccagaccaggcatact

SEQ ID NO: 35568 - DNA, 21 bp, synthetic construct
  misc_feature 1..21: note = Synthetic Construct
  source 1..21: mol_type = other DNA
tccctgaagcagagagcttgt

SEQ ID NO: 35569 - DNA, 24 bp, synthetic construct
  misc_feature 1..24: note = Synthetic Construct
  source 1..24: mol_type = other DNA
ctgcatgtaaatcagggcatccaa

SEQ ID NO: 35570 - DNA, 20 bp, synthetic construct
  misc_feature 1..20: note = Synthetic Construct
  source 1..20: mol_type = other DNA
ggaattgggtccgtccatgt

SEQ ID NO: 35571 - DNA, 24 bp, synthetic construct
  misc_feature 1..24: note = Synthetic Construct
  source 1..24: mol_type = other DNA
gctagagaggctgtccctagttgt

SEQ ID NO: 35572 - DNA, 26 bp, synthetic construct
  misc_feature 1..26: note = Synthetic Construct
  source 1..26: mol_type = other DNA
cacaacctatgaggttaggtggcata

SEQ ID NO: 35573 - DNA, 21 bp, synthetic construct
  misc_feature 1..21: note = Synthetic Construct
  source 1..21: mol_type = other DNA
ggccagtgtgacagcccttta

SEQ ID NO: 35574 - DNA, 20 bp, synthetic construct
  misc_feature 1..20: note = Synthetic Construct
  source 1..20: mol_type = other DNA
atgggcaacaggtggtctga

SEQ ID NO: 35575 - DNA, 25 bp, synthetic construct
  misc_feature 1..25: note = Synthetic Construct
  source 1..25: mol_type = other DNA
cttctccctcatttggcattttgtt

SEQ ID NO: 35576 - DNA, 23 bp, synthetic construct
  misc_feature 1..23: note = Synthetic Construct
  source 1..23: mol_type = other DNA
tgaagacaaaactgtgggactgt

SEQ ID NO: 35577 - DNA, 24 bp, synthetic construct
  misc_feature 1..24: note = Synthetic Construct
  source 1..24: mol_type = other DNA
cagggtaggaacagtgagaagaga

SEQ ID NO: 35578 - DNA, 20 bp, synthetic construct
  misc_feature 1..20: note = Synthetic Construct
  source 1..20: mol_type = other DNA
tcccactgtcaccacagtca

SEQ ID NO: 35579 - DNA, 22 bp, synthetic construct
  misc_feature 1..22: note = Synthetic Construct
  source 1..22: mol_type = other DNA
ttctgcaggtagcagtttgtga

SEQ ID NO: 35580 - DNA, 22 bp, synthetic construct
  misc_feature 1..22: note = Synthetic Construct
  source 1..22: mol_type = other DNA
gggttctcaggcgagtagatgt

SEQ ID NO: 35581 - DNA, 26 bp, synthetic construct
  misc_feature 1..26: note = Synthetic Construct
  source 1..26: mol_type = other DNA
ggcttattcaagggtttcagcagcat

SEQ ID NO: 35582 - DNA, 20 bp, synthetic construct
  misc_feature 1..20: note = Synthetic Construct
  source 1..20: mol_type = other DNA
tggtgagcaggcctggttgt

SEQ ID NO: 35583 - DNA, 19 bp, synthetic construct
  misc_feature 1..19: note = Synthetic Construct
  source 1..19: mol_type = other DNA
acaccatggcgtggattgt

SEQ ID NO: 35584 - DNA, 20 bp, synthetic construct
  misc_feature 1..20: note = Synthetic Construct
  source 1..20: mol_type = other DNA
ggtcttggtgctggcctgtt

SEQ ID NO: 35585 - DNA, 21 bp, synthetic construct
  misc_feature 1..21: note = Synthetic Construct
  source 1..21: mol_type = other DNA
tccctggaggggtgaggtcat

SEQ ID NO: 35586 - DNA, 21 bp, synthetic construct
  misc_feature 1..21: note = Synthetic Construct
  source 1..21: mol_type = other DNA
aggaggaagacggcctcattg

SEQ ID NO: 35587 - DNA, 20 bp, synthetic construct
  misc_feature 1..20: note = Synthetic Construct
  source 1..20: mol_type = other DNA
aggagtccggaggagcagat

SEQ ID NO: 35588 - DNA, 20 bp, synthetic construct
  misc_feature 1..20: note = Synthetic Construct
  source 1..20: mol_type = other DNA
atcggggtgcctcacccatt

SEQ ID NO: 35589 - DNA, 24 bp, synthetic construct
  misc_feature 1..24: note = Synthetic Construct
  source 1..24: mol_type = other DNA
gtcgttgaaaactggagtcaggaa

SEQ ID NO: 35590 - DNA, 20 bp, synthetic construct
  misc_feature 1..20: note = Synthetic Construct
  source 1..20: mol_type = other DNA
actccagctggtgggagact

SEQ ID NO: 35591 - DNA, 21 bp, synthetic construct
  misc_feature 1..21: note = Synthetic Construct
  source 1..21: mol_type = other DNA
gacctctgctacaggcaaact

SEQ ID NO: 35592 - DNA, 24 bp, synthetic construct
  misc_feature 1..24: note = Synthetic Construct
  source 1..24: mol_type = other DNA
cctagacctgttagggcaatgtgt

SEQ ID NO: 35593 - DNA, 20 bp, synthetic construct
  misc_feature 1..20: note = Synthetic Construct
  source 1..20: mol_type = other DNA
accattggctgggcctttga

SEQ ID NO: 35594 - DNA, 20 bp, synthetic construct
  misc_feature 1..20: note = Synthetic Construct
  source 1..20: mol_type = other DNA
ttgccaactggcctcgcaat

SEQ ID NO: 35595 - DNA, 19 bp, synthetic construct
  misc_feature 1..19: note = Synthetic Construct
  source 1..19: mol_type = other DNA
aaggtgctgggagcaggaa

SEQ ID NO: 35596 - DNA, 22 bp, synthetic construct
  misc_feature 1..22: note = Synthetic Construct
  source 1..22: mol_type = other DNA
tgcagtaagacaggagccatga

SEQ ID NO: 35597 - DNA, 24 bp, synthetic construct
  misc_feature 1..24: note = Synthetic Construct
  source 1..24: mol_type = other DNA
gcttccctcagaacagaaaagcaa

SEQ ID NO: 35598 - DNA, 20 bp, synthetic construct
  misc_feature 1..20: note = Synthetic Construct
  source 1..20: mol_type = other DNA
ccaagctgtgggcagtgatg

SEQ ID NO: 35599 - DNA, 21 bp, synthetic construct
  misc_feature 1..21: note = Synthetic Construct
  source 1..21: mol_type = other DNA
tggtcaacaagcctggagatg

SEQ ID NO: 35600 - DNA, 23 bp, synthetic construct
  misc_feature 1..23: note = Synthetic Construct
  source 1..23: mol_type = other DNA
caggattgtgattcctggctttg

SEQ ID NO: 35601 - DNA, 29 bp, synthetic construct
  misc_feature 1..29: note = Synthetic Construct
  source 1..29: mol_type = other DNA
cgagattaagaatgatccaggtgactgtt

SEQ ID NO: 35602 - DNA, 23 bp, synthetic construct
  misc_feature 1..23: note = Synthetic Construct
  source 1..23: mol_type = other DNA
ccagtaagctgaaccgggacttc

SEQ ID NO: 35603 - DNA, 24 bp, synthetic construct
  misc_feature 1..24: note = Synthetic Construct
  source 1..24: mol_type = other DNA
ggcattctctgcaaacaggtgcta

SEQ ID NO: 35604 - DNA, 20 bp, synthetic construct
  misc_feature 1..20: note = Synthetic Construct
  source 1..20: mol_type = other DNA
acagtgccaccacctcagtt

SEQ ID NO: 35605 - DNA, 19 bp, synthetic construct
  misc_feature 1..19: note = Synthetic Construct
  source 1..19: mol_type = other DNA
tgccggccttctccttgtt

SEQ ID NO: 35606 - DNA, 22 bp, synthetic construct
  misc_feature 1..22: note = Synthetic Construct
  source 1..22: mol_type = other DNA
tgtcttgctctgtcctggtctt

SEQ ID NO: 35607 - DNA, 19 bp, synthetic construct
  misc_feature 1..19: note = Synthetic Construct
  source 1..19: mol_type = other DNA
agagcggcgctacctcatt

SEQ ID NO: 35608 - DNA, 23 bp, synthetic construct
  misc_feature 1..23: note = Synthetic Construct
  source 1..23: mol_type = other DNA
gcctaaaggtctgggaggaggaa

SEQ ID NO: 35609 - DNA, 22 bp, synthetic construct
  misc_feature 1..22: note = Synthetic Construct
  source 1..22: mol_type = other DNA
caaatgcagccgtgtgaaaaca

SEQ ID NO: 35610 - DNA, 25 bp, synthetic construct
  misc_feature 1..25: note = Synthetic Construct
  source 1..25: mol_type = other DNA
gacattggtggtaaatttgcagtga

SEQ ID NO: 35611 - DNA, 22 bp, synthetic construct
  misc_feature 1..22: note = Synthetic Construct
  source 1..22: mol_type = other DNA
gggaaagcctcatgggatggaa

SEQ ID NO: 35612 - DNA, 19 bp, synthetic construct
  misc_feature 1..19: note = Synthetic Construct
  source 1..19: mol_type = other DNA
cccgcatgcctgtgtctca

SEQ ID NO: 35613 - DNA, 22 bp, synthetic construct
  misc_feature 1..22: note = Synthetic Construct
  source 1..22: mol_type = other DNA
gagttgtgcttccacagtccaa

SEQ ID NO: 35614 - DNA, 22 bp, synthetic construct
  misc_feature 1..22: note = Synthetic Construct
  source 1..22: mol_type = other DNA
ggaaaacagcagcgaagaggaa

SEQ ID NO: 35615 - DNA, 22 bp, synthetic construct
  misc_feature 1..22: note = Synthetic Construct
  source 1..22: mol_type = other DNA
ctgagagctgtcttgggctcta

SEQ ID NO: 35616 - DNA, 25 bp, synthetic construct
  misc_feature 1..25: note = Synthetic Construct
  source 1..25: mol_type = other DNA
ggggctaaatgtgttgctcttcagt

SEQ ID NO: 35617 - DNA, 21 bp, synthetic construct
  misc_feature 1..21: note = Synthetic Construct
  source 1..21: mol_type = other DNA
aaaccaggctccccagcttca

SEQ ID NO: 35618 - DNA, 20 bp, synthetic construct
  misc_feature 1..20: note = Synthetic Construct
  source 1..20: mol_type = other DNA
agcaacgggagaggatgagt

SEQ ID NO: 35619 - DNA, 24 bp, synthetic construct
  misc_feature 1..24: note = Synthetic Construct
  source 1..24: mol_type = other DNA
cgttctcctccctcaaagcaacat

SEQ ID NO: 35620 - DNA, 23 bp, synthetic construct
  misc_feature 1..23: note = Synthetic Construct
  source 1..23: mol_type = other DNA
gtggtttgaaagagctggacttc

SEQ ID NO: 35621 - DNA, 21 bp, synthetic construct
  misc_feature 1..21: note = Synthetic Construct
  source 1..21: mol_type = other DNA
aaggcacagctcgctgagttc

SEQ ID NO: 35622 - DNA, 21 bp, synthetic construct
  misc_feature 1..21: note = Synthetic Construct
  source 1..21: mol_type = other DNA
ccctggggtgcatgagtccaa

SEQ ID NO: 35623 - DNA, 20 bp, synthetic construct
  misc_feature 1..20: note = Synthetic Construct
  source 1..20: mol_type = other DNA
ccctgcgagagggctagaaa

SEQ ID NO: 35624 - DNA, 24 bp, synthetic construct
  misc_feature 1..24: note = Synthetic Construct
  source 1..24: mol_type = other DNA
ggtagccatccaggtagacccaaa

SEQ ID NO: 35625 - DNA, 22 bp, synthetic construct
  misc_feature 1..22: note = Synthetic Construct
  source 1..22: mol_type = other DNA
aaggggtctcggtttcctcgta

SEQ ID NO: 35626 - DNA, 20 bp, synthetic construct
  misc_feature 1..20: note = Synthetic Construct
  source 1..20: mol_type = other DNA
tttgcagccttcaccaggaa

SEQ ID NO: 35627 - DNA, 25 bp, synthetic construct
  misc_feature 1..25: note = Synthetic Construct
  source 1..25: mol_type = other DNA
caggcagaacttttcaggtcagaga

SEQ ID NO: 35628 - DNA, 20 bp, synthetic construct
  misc_feature 1..20: note = Synthetic Construct
  source 1..20: mol_type = other DNA
cccaggcaatgacactggaa

SEQ ID NO: 35629 - DNA, 25 bp, synthetic construct
  misc_feature 1..25: note = Synthetic Construct
  source 1..25: mol_type = other DNA
gtggaattacacacagctcctccat

SEQ ID NO: 35630 - DNA, 25 bp, synthetic construct
  misc_feature 1..25: note = Synthetic Construct
  source 1..25: mol_type = other DNA
ggggcacagttaatgaatggtgaga

SEQ ID NO: 35631 - DNA, 22 bp, synthetic construct
  misc_feature 1..22: note = Synthetic Construct
  source 1..22: mol_type = other DNA
acctgcagggacctgttagcat

SEQ ID NO: 35632 - DNA, 22 bp, synthetic construct
  misc_feature 1..22: note = Synthetic Construct
  source 1..22: mol_type = other DNA
gagacagagaagggtggcatct

SEQ ID NO: 35633 - DNA, 20 bp, synthetic construct
  misc_feature 1..20: note = Synthetic Construct
  source 1..20: mol_type = other DNA
ggcggtagcaatctctgctt

SEQ ID NO: 35634 - DNA, 24 bp, synthetic construct
  misc_feature 1..24: note = Synthetic Construct
  source 1..24: mol_type = other DNA
cccattgacatcatccgagagctt

SEQ ID NO: 35635 - DNA, 25 bp, synthetic construct
  misc_feature 1..25: note = Synthetic Construct
  source 1..25: mol_type = other DNA
cacagaattgtgccagtgtttctct

SEQ ID NO: 35636 - DNA, 29 bp, synthetic construct
  misc_feature 1..29: note = Synthetic Construct
  source 1..29: mol_type = other DNA
ctaatattctccgtgtctctagtctcttc

SEQ ID NO: 35637 - DNA, 25 bp, synthetic construct
  misc_feature 1..25: note = Synthetic Construct
  source 1..25: mol_type = other DNA
cttccaaacgctataggaagagact

SEQ ID NO: 35638 - DNA, 24 bp, synthetic construct
  misc_feature 1..24: note = Synthetic Construct
  source 1..24: mol_type = other DNA
tcagctatagacacaccagcttct

SEQ ID NO: 35639 - DNA, 27 bp, synthetic construct
  misc_feature 1..27: note = Synthetic Construct
  source 1..27: mol_type = other DNA
cctcctgactctatcgtctctggattg

SEQ ID NO: 35640 - DNA, 21 bp, synthetic construct
  misc_feature 1..21: note = Synthetic Construct
  source 1..21: mol_type = other DNA
cctgctgctcttggtgacagt

SEQ ID NO: 35641 - DNA, 21 bp, synthetic construct
  misc_feature 1..21: note = Synthetic Construct
  source 1..21: mol_type = other DNA
aggggaacttcaggggtggtt

SEQ ID NO: 35642 - DNA, 20 bp, synthetic construct
  misc_feature 1..20: note = Synthetic Construct
  source 1..20: mol_type = other DNA
agcagcacagacgggagtca

SEQ ID NO: 35643 - DNA, 22 bp, synthetic construct
  misc_feature 1..22: note = Synthetic Construct
  source 1..22: mol_type = other DNA
tccccgctctgttcttcctttg

SEQ ID NO: 35644 - DNA, 20 bp, synthetic construct
  misc_feature 1..20: note = Synthetic Construct
  source 1..20: mol_type = other DNA
tccatccacggctcagcttt

SEQ ID NO: 35645 - DNA, 23 bp, synthetic construct
  misc_feature 1..23: note = Synthetic Construct
  source 1..23: mol_type = other DNA
caggtgggacaagccatttgaga

SEQ ID NO: 35646 - DNA, 19 bp, synthetic construct
  misc_feature 1..19: note = Synthetic Construct
  source 1..19: mol_type = other DNA
ggtgctggggcagactctt

SEQ ID NO: 35647 - DNA, 19 bp, synthetic construct
  misc_feature 1..19: note = Synthetic Construct
  source 1..19: mol_type = other DNA
tgtttccccacccgcattg

SEQ ID NO: 35648 - DNA, 24 bp, synthetic construct
  misc_feature 1..24: note = Synthetic Construct
  source 1..24: mol_type = other DNA
cggttggtatttcggacatgcaat

SEQ ID NO: 35649 - DNA, 30 bp, synthetic construct
  misc_feature 1..30: note = Synthetic Construct
  source 1..30: mol_type = other DNA
gacatattaaccttatagcccaccaacctt

SEQ ID NO: 35650 - DNA, 22 bp, synthetic construct
  misc_feature 1..22: note = Synthetic Construct
  source 1..22: mol_type = other DNA
ccttctcaactggagcctgaac

SEQ ID NO: 35651 - DNA, 23 bp, synthetic construct
  misc_feature 1..23: note = Synthetic Construct
  source 1..23: mol_type = other DNA
tctgagccttgctctcatctaca

SEQ ID NO: 35652 - DNA, 23 bp, synthetic construct
  misc_feature 1..23: note = Synthetic Construct
  source 1..23: mol_type = other DNA
gttctggtaggtgggagttctct

SEQ ID NO: 35653 - DNA, 26 bp, synthetic construct
  misc_feature 1..26: note = Synthetic Construct
  source 1..26: mol_type = other DNA
cagactaaatgatgtgactggtgttc

SEQ ID NO: 35654 - DNA, 26 bp, synthetic construct
  misc_feature 1..26: note = Synthetic Construct
  source 1..26: mol_type = other DNA
ccaggcctatcctttatctccgatca

SEQ ID NO: 35655 - DNA, 22 bp, synthetic construct
  misc_feature 1..22: note = Synthetic Construct
  source 1..22: mol_type = other DNA
cctcttgcattgctgtttgtca

SEQ ID NO: 35656 - DNA, 22 bp, synthetic construct
  misc_feature 1..22: note = Synthetic Construct
  source 1..22: mol_type = other DNA
ccgctcccactgctcctatttt

SEQ ID NO: 35657 - DNA, 25 bp, synthetic construct
  misc_feature 1..25: note = Synthetic Construct
  source 1..25: mol_type = other DNA
ggtgaacatgagatgggctcctaac

SEQ ID NO: 35658 - DNA, 21 bp, synthetic construct
  misc_feature 1..21: note = Synthetic Construct
  source 1..21: mol_type = other DNA
ttagccttgaccggggtctga

SEQ ID NO: 35659 - DNA, 24 bp, synthetic construct
  misc_feature 1..24: note = Synthetic Construct
  source 1..24: mol_type = other DNA
atcaggcagattcaactcctttca

SEQ ID NO: 35660 - DNA, 19 bp, synthetic construct
  misc_feature 1..19: note = Synthetic Construct
  source 1..19: mol_type = other DNA
ttcccctggctgcagaact

SEQ ID NO: 35661 - DNA, 23 bp, synthetic construct
  misc_feature 1..23: note = Synthetic Construct
  source 1..23: mol_type = other DNA
agggctgtttgggagtaatttca

SEQ ID NO: 35662 - DNA, 22 bp, synthetic construct
  misc_feature 1..22: note = Synthetic Construct
  source 1..22: mol_type = other DNA
cagtgattggctacctccacaa

SEQ ID NO: 35663 - DNA, 22 bp, synthetic construct
  misc_feature 1..22: note = Synthetic Construct
  source 1..22: mol_type = other DNA
caccttgccctccagttcatag

SEQ ID NO: 35664 - DNA, 24 bp, synthetic construct
  misc_feature 1..24: note = Synthetic Construct
  source 1..24: mol_type = other DNA
tctctatttggcgagaggtaggaa

SEQ ID NO: 35665 - DNA, 23 bp, synthetic construct
  misc_feature 1..23: note = Synthetic Construct
  source 1..23: mol_type = other DNA
ggagccacattaagtcccctact

SEQ ID NO: 35666 - DNA, 22 bp, synthetic construct
  misc_feature 1..22: note = Synthetic Construct
  source 1..22: mol_type = other DNA
gccaccatgccatgcaactcta

SEQ ID NO: 35667 - DNA, 20 bp, synthetic construct
  misc_feature 1..20: note = Synthetic Construct
  source 1..20: mol_type = other DNA
agccgcatcgccatgtatga

SEQ ID NO: 35668 - DNA, 24 bp, synthetic construct
  misc_feature 1..24: note = Synthetic Construct
  source 1..24: mol_type = other DNA
caggaccgtatacgaaaacacaca

SEQ ID NO: 35669 - DNA, 21 bp, synthetic construct
  misc_feature 1..21: note = Synthetic Construct
  source 1..21: mol_type = other DNA
ctgtcattgctgggtgcagaa

SEQ ID NO: 35670 - DNA, 24 bp, synthetic construct
  misc_feature 1..24: note = Synthetic Construct
  source 1..24: mol_type = other DNA
gtgatggtgggtgttagcatcttc

SEQ ID NO: 35671 - DNA, 23 bp, synthetic construct
  misc_feature 1..23: note = Synthetic Construct
  source 1..23: mol_type = other DNA
cgtgctggaacctgaattgaaac

SEQ ID NO: 35672 - DNA, 22 bp, synthetic construct
  misc_feature 1..22: note = Synthetic Construct
  source 1..22: mol_type = other DNA
gcacagacagaggggagtttca

SEQ ID NO: 35673 - DNA, 22 bp, synthetic construct
  misc_feature 1..22: note = Synthetic Construct
  source 1..22: mol_type = other DNA
cccggagagaagacaagggttt

SEQ ID NO: 35674 - DNA, 20 bp, synthetic construct
  misc_feature 1..20: note = Synthetic Construct
  source 1..20: mol_type = other DNA
cctcgctaaggacccagcat

SEQ ID NO: 35675 - DNA, 22 bp, synthetic construct
  misc_feature 1..22: note = Synthetic Construct
  source 1..22: mol_type = other DNA
aaggctggagcttctccctaga

SEQ ID NO: 35676 - DNA, 24 bp, synthetic construct
  misc_feature 1..24: note = Synthetic Construct
  source 1..24: mol_type = other DNA
acaaagaaatagcagtggctgaca

SEQ ID NO: 35677 - DNA, 24 bp, synthetic construct
  misc_feature 1..24: note = Synthetic Construct
  source 1..24: mol_type = other DNA
gaaaaaccctgcttgctatgaact

SEQ ID NO: 35678 - DNA, 28 bp, synthetic construct
  misc_feature 1..28: note = Synthetic Construct
  source 1..28: mol_type = other DNA
gctggggaaatgaacttgaaaggattag

SEQ ID NO: 35679 - DNA, 20 bp, synthetic construct
  misc_feature 1..20: note = Synthetic Construct
  source 1..20: mol_type = other DNA
gccaccaagccagagctcaa

SEQ ID NO: 35680 - DNA, 19 bp, synthetic construct
  misc_feature 1..19: note = Synthetic Construct
  source 1..19: mol_type = other DNA
gcccacctacccggataca

SEQ ID NO: 35681 - DNA, 19 bp, synthetic construct
  misc_feature 1..19: note = Synthetic Construct
  source 1..19: mol_type = other DNA
acactgcctggggctacaa

SEQ ID NO: 35682 - DNA, 22 bp, synthetic construct
  misc_feature 1..22: note = Synthetic Construct
  source 1..22: mol_type = other DNA
cagtaggcaagggatggagtgt

SEQ ID NO: 35683 - DNA, 22 bp, synthetic construct
  misc_feature 1..22: note = Synthetic Construct
  source 1..22: mol_type = other DNA
ggctggatgaccatggactact

SEQ ID NO: 35684 - DNA, 21 bp, synthetic construct
  misc_feature 1..21: note = Synthetic Construct
  source 1..21: mol_type = other DNA
caagggactggatgctgttca

SEQ ID NO: 35685 - DNA, 23 bp, synthetic construct
  misc_feature 1..23: note = Synthetic Construct
  source 1..23: mol_type = other DNA
ggaaggccatggtcaaggagatg

SEQ ID NO: 35686 - DNA, 21 bp, synthetic construct
  misc_feature 1..21: note = Synthetic Construct
  source 1..21: mol_type = other DNA
aggacaatggcccctctcagt

SEQ ID NO: 35687 - DNA, 25 bp, synthetic construct
  misc_feature 1..25: note = Synthetic Construct
  source 1..25: mol_type = other DNA
acctaaccaccacattgtgagaaag

SEQ ID NO: 35688 - DNA, 20 bp, synthetic construct
  misc_feature 1..20: note = Synthetic Construct
  source 1..20: mol_type = other DNA
aaggctgggtgcaggactga

SEQ ID NO: 35689 - DNA, 24 bp, synthetic construct
  misc_feature 1..24: note = Synthetic Construct
  source 1..24: mol_type = other DNA
gtgtagtcaagcttgccaccagat

SEQ ID NO: 35690 - DNA, 23 bp, synthetic construct
  misc_feature 1..23: note = Synthetic Construct
  source 1..23: mol_type = other DNA
gacagaatcctcgccgttctcaa

SEQ ID NO: 35691 - DNA, 22 bp, synthetic construct
  misc_feature 1..22: note = Synthetic Construct
  source 1..22: mol_type = other DNA
gtgggaaaccctcaagccaaag

SEQ ID NO: 35692 - DNA, 21 bp, synthetic construct
  misc_feature 1..21: note = Synthetic Construct
  source 1..21: mol_type = other DNA
ctggttctgtctgtgcagcta

SEQ ID NO: 35693 - DNA, 24 bp, synthetic construct
  misc_feature 1..24: note = Synthetic Construct
  source 1..24: mol_type = other DNA
ggaagcatatagggctggggaaag

SEQ ID NO: 35694 - DNA, 20 bp, synthetic construct
  misc_feature 1..20: note = Synthetic Construct
  source 1..20: mol_type = other DNA
ggccacagctcctgtcttca

SEQ ID NO: 35695 - DNA, 22 bp, synthetic construct
  misc_feature 1..22: note = Synthetic Construct
  source 1..22: mol_type = other DNA
tggtggatttggaagggtttga

SEQ ID NO: 35696 - DNA, 20 bp, synthetic construct
  misc_feature 1..20: note = Synthetic Construct
  source 1..20: mol_type = other DNA
acccgtgactctgctgaact

SEQ ID NO: 35697 - DNA, 24 bp, synthetic construct
  misc_feature 1..24: note = Synthetic Construct
  source 1..24: mol_type = other DNA
ctttcctgggaatgtaggaacaca

SEQ ID NO: 35698 - DNA, 30 bp, synthetic construct
  misc_feature 1..30: note = Synthetic Construct
  source 1..30: mol_type = other DNA
ccatctatttatgtcgaaaggcactgtact

SEQ ID NO: 35699 - DNA, 24 bp, synthetic construct
  misc_feature 1..24: note = Synthetic Construct
  source 1..24: mol_type = other DNA
gccatggatactagcgcaggacaa

SEQ ID NO: 35700 - DNA, 21 bp, synthetic construct
  misc_feature 1..21: note = Synthetic Construct
  source 1..21: mol_type = other DNA
atgcgctgcaccccagtgatt

SEQ ID NO: 35701 - DNA, 24 bp, synthetic construct
  misc_feature 1..24: note = Synthetic Construct
  source 1..24: mol_type = other DNA
ggaatccaacaggaccacaccaat

SEQ ID NO: 35702 - DNA, 24 bp, synthetic construct
  misc_feature 1..24: note = Synthetic Construct
  source 1..24: mol_type = other DNA
ggagctgcaaggagaaggagaaca

SEQ ID NO: 35703 - DNA, 24 bp, synthetic construct
  misc_feature 1..24: note = Synthetic Construct
  source 1..24: mol_type = other DNA
gcacttactgaaaggggagcttct

SEQ ID NO: 35704 - DNA, 22 bp, synthetic construct
  misc_feature 1..22: note = Synthetic Construct
  source 1..22: mol_type = other DNA
gctccaccttcattccccacat

SEQ ID NO: 35705 - DNA, 22 bp, synthetic construct
  misc_feature 1..22: note = Synthetic Construct
  source 1..22: mol_type = other DNA
cgcatctttcccagagcaccta

SEQ ID NO: 35706 - DNA, 23 bp, synthetic construct
  misc_feature 1..23: note = Synthetic Construct
  source 1..23: mol_type = other DNA
ggaagattgcccagaacaggaaa

SEQ ID NO: 35707 - DNA, 20 bp, synthetic construct
  misc_feature 1..20: note = Synthetic Construct
  source 1..20: mol_type = other DNA
aggttcccgaggggcctgaa

SEQ ID NO: 35708 - DNA, 22 bp, synthetic construct
  misc_feature 1..22: note = Synthetic Construct
  source 1..22: mol_type = other DNA
cctcactttctctgccaaggtt

SEQ ID NO: 35709 - DNA, 25 bp, synthetic construct
  misc_feature 1..25: note = Synthetic Construct
  source 1..25: mol_type = other DNA
ctgcagcttcgttttgtaagcagta

SEQ ID NO: 35710 - DNA, 22 bp, synthetic construct
  misc_feature 1..22: note = Synthetic Construct
  source 1..22: mol_type = other DNA
caggcaacacaagtcccagaag

SEQ ID NO: 35711 - DNA, 25 bp, synthetic construct
  misc_feature 1..25: note = Synthetic Construct
  source 1..25: mol_type = other DNA
tggagatgacacagacataaacaca

SEQ ID NO: 35712 - DNA, 20 bp, synthetic construct
  misc_feature 1..20: note = Synthetic Construct
  source 1..20: mol_type = other DNA
ttcccacccggcacatggtt

SEQ ID NO: 35713 - DNA, 19 bp, synthetic construct
  misc_feature 1..19: note = Synthetic Construct
  source 1..19: mol_type = other DNA
tgggtcctgagggtgacaa

SEQ ID NO: 35714 - DNA, 23 bp, synthetic construct
  misc_feature 1..23: note = Synthetic Construct
  source 1..23: mol_type = other DNA
ggagggaaaagggattggactgt

SEQ ID NO: 35715 - DNA, 21 bp, synthetic construct
  misc_feature 1..21: note = Synthetic Construct
  source 1..21: mol_type = other DNA
gcttctctcccatggccagtt

SEQ ID NO: 35716 - DNA, 23 bp, synthetic construct
  misc_feature 1..23: note = Synthetic Construct
  source 1..23: mol_type = other DNA
ggaaaatggagccgatggagatg

SEQ ID NO: 35717 - DNA, 24 bp, synthetic construct
  misc_feature 1..24: note = Synthetic Construct
  source 1..24: mol_type = other DNA
ggaacctcccagaacctcctagtt

SEQ ID NO: 35718 - DNA, 22 bp, synthetic construct
  misc_feature 1..22: note = Synthetic Construct
  source 1..22: mol_type = other DNA
ctgacagaaattggccccaaac

SEQ ID NO: 35719 - DNA, 25 bp, synthetic construct
  misc_feature 1..25: note = Synthetic Construct
  source 1..25: mol_type = other DNA
gcatctttccccaaactcctacctt

SEQ ID NO: 35720 - DNA, 19 bp, synthetic construct
  misc_feature 1..19: note = Synthetic Construct
  source 1..19: mol_type = other DNA
tggcacggtcctccaagaa

SEQ ID NO: 35721 - DNA, 24 bp, synthetic construct
  misc_feature 1..24: note = Synthetic Construct
  source 1..24: mol_type = other DNA
gtgacctgctgtccttccagaaaa

SEQ ID NO: 35722 - DNA, 21 bp, synthetic construct
  misc_feature 1..21: note = Synthetic Construct
  source 1..21: mol_type = other DNA
tgctccagagccagacccaaa

SEQ ID NO: 35723 - DNA, 22 bp, synthetic construct
  misc_feature 1..22: note = Synthetic Construct
  source 1..22: mol_type = other DNA
cccagctaaagcatggcagaca

SEQ ID NO: 35724 - DNA, 22 bp, synthetic construct
  misc_feature 1..22: note = Synthetic Construct
  source 1..22: mol_type = other DNA
gcaggctgacgtatgtgtctga

SEQ ID NO: 35725 - DNA, 21 bp, synthetic construct
  misc_feature 1..21: note = Synthetic Construct
  source 1..21: mol_type = other DNA
gggtttcatgccactgaggtt

SEQ ID NO: 35726 - DNA, 21 bp, synthetic construct
  misc_feature 1..21: note = Synthetic Construct
  source 1..21: mol_type = other DNA
cgctgcttctccacaccaagt

SEQ ID NO: 35727 - DNA, 24 bp, synthetic construct
  misc_feature 1..24: note = Synthetic Construct
  source 1..24: mol_type = other DNA
cctctctgaggtcttgggaagcaa

SEQ ID NO: 35728 - DNA, 23 bp, synthetic construct
  misc_feature 1..23: note = Synthetic Construct
  source 1..23: mol_type = other DNA
ggcggattggattagctgcttgt

SEQ ID NO: 35729 - DNA, 24 bp, synthetic construct
  misc_feature 1..24: note = Synthetic Construct
  source 1..24: mol_type = other DNA
cagagcatcaaatgctacccttgt

SEQ ID NO: 35730 - DNA, 20 bp, synthetic construct
  misc_feature 1..20: note = Synthetic Construct
  source 1..20: mol_type = other DNA
aaaaggcacagccagtccaa

SEQ ID NO: 35731 - DNA, 23 bp, synthetic construct
  misc_feature 1..23: note = Synthetic Construct
  source 1..23: mol_type = other DNA
tcagtacttactccctgccagtt

SEQ ID NO: 35732 - DNA, 26 bp, synthetic construct
  misc_feature 1..26: note = Synthetic Construct
  source 1..26: mol_type = other DNA
caccattgctcctattccatctaaac

SEQ ID NO: 35733 - DNA, 25 bp, synthetic construct
  misc_feature 1..25: note = Synthetic Construct
  source 1..25: mol_type = other DNA
ggtctcagtaagaatgccctgcttt

SEQ ID NO: 35734 - DNA, 24 bp, synthetic construct
  misc_feature 1..24: note = Synthetic Construct
  source 1..24: mol_type = other DNA
cctgcctggtgttcagtgtcatag

SEQ ID NO: 35735 - DNA, 25 bp, synthetic construct
  misc_feature 1..25: note = Synthetic Construct
  source 1..25: mol_type = other DNA
gcaaacatacagtggctctttcagt

SEQ ID NO: 35736 - DNA, 24 bp, synthetic construct
  misc_feature 1..24: note = Synthetic Construct
  source 1..24: mol_type = other DNA
cctgcagaattcaaaggctcaact

SEQ ID NO: 35737 - DNA, 26 bp, synthetic construct
  misc_feature 1..26: note = Synthetic Construct
  source 1..26: mol_type = other DNA
caccagggaaatcagagacaatgatg

SEQ ID NO: 35738 - DNA, 20 bp, synthetic construct
  misc_feature 1..20: note = Synthetic Construct
  source 1..20: mol_type = other DNA
ccccttgggcattggctgat

SEQ ID NO: 35739 - DNA, 24 bp, synthetic construct
  misc_feature 1..24: note = Synthetic Construct
  source 1..24: mol_type = other DNA
ccctgctgaaaccaggtgtgagtt

SEQ ID NO: 35740 - DNA, 20 bp, synthetic construct
  misc_feature 1..20: note = Synthetic Construct
  source 1..20: mol_type = other DNA
tctgctacatggggcctttg

SEQ ID NO: 35741 - DNA, 25 bp, synthetic construct
  misc_feature 1..25: note = Synthetic Construct
  source 1..25: mol_type = other DNA
ggtggaaggaatccatgagttgagt

SEQ ID NO: 35742 - DNA, 21 bp, synthetic construct
  misc_feature 1..21: note = Synthetic Construct
  source 1..21: mol_type = other DNA
gctcccagttggatgctggta

SEQ ID NO: 35743 - DNA, 24 bp, synthetic construct
  misc_feature 1..24: note = Synthetic Construct
  source 1..24: mol_type = other DNA
gggctatagtcattgggtggatga

SEQ ID NO: 35744 - DNA, 21 bp, synthetic construct
  misc_feature 1..21: note = Synthetic Construct
  source 1..21: mol_type = other DNA
catcaacacagccctggcatt

SEQ ID NO: 35745 - DNA, 19 bp, synthetic construct
  misc_feature 1..19: note = Synthetic Construct
  source 1..19: mol_type = other DNA
atggccaccagtgggaaga

SEQ ID NO: 35746 - DNA, 20 bp, synthetic construct
  misc_feature 1..20: note = Synthetic Construct
  source 1..20: mol_type = other DNA
tgagtgaggggtgtcgagat

SEQ ID NO: 35747 - DNA, 23 bp, synthetic construct
  misc_feature 1..23: note = Synthetic Construct
  source 1..23: mol_type = other DNA
taatgggaggctggaggcaggtt

SEQ ID NO: 35748 - DNA, 24 bp, synthetic construct
  misc_feature 1..24: note = Synthetic Construct
  source 1..24: mol_type = other DNA
gtctaaaatgaaccctgcccaact

SEQ ID NO: 35749 - DNA, 23 bp, synthetic construct
  misc_feature 1..23: note = Synthetic Construct
  source 1..23: mol_type = other DNA
ggctaacagtgccatttgtgaaa

SEQ ID NO: 35750 - DNA, 22 bp, synthetic construct
  misc_feature 1..22: note = Synthetic Construct
  source 1..22: mol_type = other DNA
aggaatgggacagaccctaagt

SEQ ID NO: 35751 - DNA, 20 bp, synthetic construct
  misc_feature 1..20: note = Synthetic Construct
  source 1..20: mol_type = other DNA
agcccctcaacaggttccat

SEQ ID NO: 35752 - DNA, 26 bp, synthetic construct
  misc_feature 1..26: note = Synthetic Construct
  source 1..26: mol_type = other DNA
gcaattgtcttagtgtcatccagcta

SEQ ID NO: 35753 - DNA, 21 bp, synthetic construct
  misc_feature 1..21: note = Synthetic Construct
  source 1..21: mol_type = other DNA
ccttcagccctcagcttccat

SEQ ID NO: 35754 - DNA, 24 bp, synthetic construct
  misc_feature 1..24: note = Synthetic Construct
  source 1..24: mol_type = other DNA
gtctgcaagaaactggcttaacaa

SEQ ID NO: 35755 - DNA, 26 bp, synthetic construct
  misc_feature 1..26: note = Synthetic Construct
  source 1..26: mol_type = other DNA
cagttgtagctgaaatcagaggttga

SEQ ID NO: 35756 - DNA, 25 bp, synthetic construct
  misc_feature 1..25: note = Synthetic Construct
  source 1..25: mol_type = other DNA
tgtgacagaagtttgtgagccatta

SEQ ID NO: 35757 - DNA, 23 bp, synthetic construct
  misc_feature 1..23: note = Synthetic Construct
  source 1..23: mol_type = other DNA
ctcctgcctgggacaatgtaatg

SEQ ID NO: 35758 - DNA, 22 bp, synthetic construct
  misc_feature 1..22: note = Synthetic Construct
  source 1..22: mol_type = other DNA
catcacagcacatgacccaaag

SEQ ID NO: 35759 - DNA, 25 bp, synthetic construct
  misc_feature 1..25: note = Synthetic Construct
  source 1..25: mol_type = other DNA
ggtcaggacgtacgcatttggatta

SEQ ID NO: 35760 - DNA, 20 bp, synthetic construct
  misc_feature 1..20: note = Synthetic Construct
  source 1..20: mol_type = other DNA
tggtcagcccagggtgattt

SEQ ID NO: 35761 - DNA, 23 bp, synthetic construct
  misc_feature 1..23: note = Synthetic Construct
  source 1..23: mol_type = other DNA
tcaggtaactctggtgacaggaa

SEQ ID NO: 35762 - DNA, 25 bp, synthetic construct
  misc_feature 1..25: note = Synthetic Construct
  source 1..25: mol_type = other DNA
ggctttcctctctccaggtttcctt

SEQ ID NO: 35763 - DNA, 21 bp, synthetic construct
  misc_feature 1..21: note = Synthetic Construct
  source 1..21: mol_type = other DNA
gcgctgcgtggaactaaaaag

SEQ ID NO: 35764 - DNA, 20 bp, synthetic construct
  misc_feature 1..20: note = Synthetic Construct
  source 1..20: mol_type = other DNA
gctggcctggcagtgaaact

SEQ ID NO: 35765 - DNA, 22 bp, synthetic construct
  misc_feature 1..22: note = Synthetic Construct
  source 1..22: mol_type = other DNA
tccatggccccgactaagtgta

SEQ ID NO: 35766 - DNA, 23 bp, synthetic construct
  misc_feature 1..23: note = Synthetic Construct
  source 1..23: mol_type = other DNA
cctgcatcggaattcccctgatt

SEQ ID NO: 35767 - DNA, 26 bp, synthetic construct
  misc_feature 1..26: note = Synthetic Construct
  source 1..26: mol_type = other DNA
ggtctgtgttttcagtggaagaaact

SEQ ID NO: 35768 - DNA, 25 bp, synthetic construct
  misc_feature 1..25: note = Synthetic Construct
  source 1..25: mol_type = other DNA
gtccctgaaactacagtttggatgt

SEQ ID NO: 35769 - DNA, 20 bp, synthetic construct
  misc_feature 1..20: note = Synthetic Construct
  source 1..20: mol_type = other DNA
gcctggctgtttggaaggaa

SEQ ID NO: 35770 - DNA, 20 bp, synthetic construct
  misc_feature 1..20: note = Synthetic Construct
  source 1..20: mol_type = other DNA
gcacctccacagagtgcttt

SEQ ID NO: 35771 - DNA, 22 bp, synthetic construct
  misc_feature 1..22: note = Synthetic Construct
  source 1..22: mol_type = other DNA
gagcaccaggaaacagcttgta

SEQ ID NO: 35772 - DNA, 22 bp, synthetic construct
  misc_feature 1..22: note = Synthetic Construct
  source 1..22: mol_type = other DNA
ggctctggctctgtcttcattg

SEQ ID NO: 35773 - DNA, 21 bp, synthetic construct
  misc_feature 1..21: note = Synthetic Construct
  source 1..21: mol_type = other DNA
ggcattctagggctgcaggaa

SEQ ID NO: 35774 - DNA, 20 bp, synthetic construct
  misc_feature 1..20: note = Synthetic Construct
  source 1..20: mol_type = other DNA
atggcccagggctttacaac

SEQ ID NO: 35775 - DNA, 20 bp, synthetic construct
  misc_feature 1..20: note = Synthetic Construct
  source 1..20: mol_type = other DNA
ttcactgccctgcagcaaga

SEQ ID NO: 35776 - DNA, 23 bp, synthetic construct
  misc_feature 1..23: note = Synthetic Construct
  source 1..23: mol_type = other DNA
cagctctcaaaccctcaccattg

SEQ ID NO: 35777 - DNA, 23 bp, synthetic construct
  misc_feature 1..23: note = Synthetic Construct
  source 1..23: mol_type = other DNA
gcttctcattcctgcctccaagt

SEQ ID NO: 35778 - DNA, 20 bp, synthetic construct
  misc_feature 1..20: note = Synthetic Construct
  source 1..20: mol_type = other DNA
cacaattgcccgccatggaa

SEQ ID NO: 35779 - DNA, 20 bp, synthetic construct
  misc_feature 1..20: note = Synthetic Construct
  source 1..20: mol_type = other DNA
acccaggctggcgactctaa

SEQ ID NO: 35780 - DNA, 21 bp, synthetic construct
  misc_feature 1..21: note = Synthetic Construct
  source 1..21: mol_type = other DNA
atggccacacacccctgacat

SEQ ID NO: 35781 - DNA, 20 bp, synthetic construct
  misc_feature 1..20: note = Synthetic Construct
  source 1..20: mol_type = other DNA
gaagggtggccattgtctga

SEQ ID NO: 35782 - DNA, 23 bp, synthetic construct
  misc_feature 1..23: note = Synthetic Construct
  source 1..23: mol_type = other DNA
ccaggagagggagccattgaatc

SEQ ID NO: 35783 - DNA, 21 bp, synthetic construct
  misc_feature 1..21: note = Synthetic Construct
  source 1..21: mol_type = other DNA
gagctgggagagagacaggaa

SEQ ID NO: 35784 - DNA, 29 bp, synthetic construct
  misc_feature 1..29: note = Synthetic Construct
  source 1..29: mol_type = other DNA
gagaaactgagttatagagccatcgagta

SEQ ID NO: 35785 - DNA, 24 bp, synthetic construct
  misc_feature 1..24: note = Synthetic Construct
  source 1..24: mol_type = other DNA
cgagactcaaacggagaggcaaac

SEQ ID NO: 35786 - DNA, 22 bp, synthetic construct
  misc_feature 1..22: note = Synthetic Construct
  source 1..22: mol_type = other DNA
aaccagtgaatgccatgagtgt

SEQ ID NO: 35787 - DNA, 21 bp, synthetic construct
  misc_feature 1..21: note = Synthetic Construct
  source 1..21: mol_type = other DNA
gtctgcaacaagcaccagcat

SEQ ID NO: 35788 - DNA, 22 bp, synthetic construct
  misc_feature 1..22: note = Synthetic Construct
  source 1..22: mol_type = other DNA
ggcgacatggtctgaggatgaa

SEQ ID NO: 35789 - DNA, 21 bp, synthetic construct
  misc_feature 1..21: note = Synthetic Construct
  source 1..21: mol_type = other DNA
tagaggcgtccctgggtgaga

SEQ ID NO: 35790 - DNA, 19 bp, synthetic construct
  misc_feature 1..19: note = Synthetic Construct
  source 1..19: mol_type = other DNA
agagcaccccagcatggtt

SEQ ID NO: 35791 - DNA, 22 bp, synthetic construct
  misc_feature 1..22: note = Synthetic Construct
  source 1..22: mol_type = other DNA
acctccaaaaccggaaaaggaa

SEQ ID NO: 35792 - DNA, 20 bp, synthetic construct
  misc_feature 1..20: note = Synthetic Construct
  source 1..20: mol_type = other DNA
tttggcaagcccaccagtga

SEQ ID NO: 35793 - DNA, 26 bp, synthetic construct
  misc_feature 1..26: note = Synthetic Construct
  source 1..26: mol_type = other DNA
cgggacagaaaattccgtaagaaaga

SEQ ID NO: 35794 - DNA, 22 bp, synthetic construct
  misc_feature 1..22: note = Synthetic Construct
  source 1..22: mol_type = other DNA
aggatcaggagggccaggtaga

SEQ ID NO: 35795 - DNA, 20 bp, synthetic construct
  misc_feature 1..20: note = Synthetic Construct
  source 1..20: mol_type = other DNA
taccacaacgtgcccagact

SEQ ID NO: 35796 - DNA, 27 bp, synthetic construct
  misc_feature 1..27: note = Synthetic Construct
  source 1..27: mol_type = other DNA
cagctctgaatgtattccagctctttc

SEQ ID NO: 35797 - DNA, 21 bp, synthetic construct
  misc_feature 1..21: note = Synthetic Construct
  source 1..21: mol_type = other DNA
ggtagcctgggaagctgctat

SEQ ID NO: 35798 - DNA, 21 bp, synthetic construct
  misc_feature 1..21: note = Synthetic Construct
  source 1..21: mol_type = other DNA
agagtggtcagggccttacat

SEQ ID NO: 35799 - DNA, 20 bp, synthetic construct
  misc_feature 1..20: note = Synthetic Construct
  source 1..20: mol_type = other DNA
tgactccccaggcacctcta

SEQ ID NO: 35800 - DNA, 24 bp, synthetic construct
  misc_feature 1..24: note = Synthetic Construct
  source 1..24: mol_type = other DNA
cctcagtgagagccacaagcgata

SEQ ID NO: 35801 - DNA, 21 bp, synthetic construct
  misc_feature 1..21: note = Synthetic Construct
  source 1..21: mol_type = other DNA
ctgctttccaacagccacact

SEQ ID NO: 35802 - DNA, 22 bp, synthetic construct
  misc_feature 1..22: note = Synthetic Construct
  source 1..22: mol_type = other DNA
cccacgtgtccaggcttgattt

SEQ ID NO: 35803 - DNA, 20 bp, synthetic construct
  misc_feature 1..20: note = Synthetic Construct
  source 1..20: mol_type = other DNA
tgctcagggtctccctgttt

SEQ ID NO: 35804 - DNA, 22 bp, synthetic construct
  misc_feature 1..22: note = Synthetic Construct
  source 1..22: mol_type = other DNA
gactgtgggagaagccaactca

SEQ ID NO: 35805 - DNA, 24 bp, synthetic construct
  misc_feature 1..24: note = Synthetic Construct
  source 1..24: mol_type = other DNA
gcggaaggataaagggtcctgatg

SEQ ID NO: 35806 - DNA, 26 bp, synthetic construct
  misc_feature 1..26: note = Synthetic Construct
  source 1..26: mol_type = other DNA
cggaaccagatagttttgtggctaag

SEQ ID NO: 35807 - DNA, 19 bp, synthetic construct
  misc_feature 1..19: note = Synthetic Construct
  source 1..19: mol_type = other DNA
atcggcctccacccaccat

SEQ ID NO: 35808 - DNA, 22 bp, synthetic construct
  misc_feature 1..22: note = Synthetic Construct
  source 1..22: mol_type = other DNA
ggaagtggtgctgtggcttcat

SEQ ID NO: 35809 - DNA, 23 bp, synthetic construct
  misc_feature 1..23: note = Synthetic Construct
  source 1..23: mol_type = other DNA
ggattataactgcgtgccaccat

SEQ ID NO: 35810 - DNA, 22 bp, synthetic construct
  misc_feature 1..22: note = Synthetic Construct
  source 1..22: mol_type = other DNA
gctttgctaaggccaggccaat

SEQ ID NO: 35811 - DNA, 27 bp, synthetic construct
  misc_feature 1..27: note = Synthetic Construct
  source 1..27: mol_type = other DNA
gcacatctacaatatgtttggcaccat

SEQ ID NO: 35812 - DNA, 22 bp, synthetic construct
  misc_feature 1..22: note = Synthetic Construct
  source 1..22: mol_type = other DNA
gcacgggcactgagaaaagtca

SEQ ID NO: 35813 - DNA, 21 bp, synthetic construct
  misc_feature 1..21: note = Synthetic Construct
  source 1..21: mol_type = other DNA
tggcctttgccctcagctact

SEQ ID NO: 35814 - DNA, 20 bp, synthetic construct
  misc_feature 1..20: note = Synthetic Construct
  source 1..20: mol_type = other DNA
tagaggcacccactcaccaa

SEQ ID NO: 35815 - DNA, 22 bp, synthetic construct
  misc_feature 1..22: note = Synthetic Construct
  source 1..22: mol_type = other DNA
cgggcaattcccaaggcttagt

SEQ ID NO: 35816 - DNA, 19 bp, synthetic construct
  misc_feature 1..19: note = Synthetic Construct
  source 1..19: mol_type = other DNA
tgaggcctgggtcctcagt

SEQ ID NO: 35817 - DNA, 22 bp, synthetic construct
  misc_feature 1..22: note = Synthetic Construct
  source 1..22: mol_type = other DNA
cctgcttccctctgagctgttt

SEQ ID NO: 35818 - DNA, 22 bp, synthetic construct
  misc_feature 1..22: note = Synthetic Construct
  source 1..22: mol_type = other DNA
ctcccagtgtttcaggggttag

SEQ ID NO: 35819 - DNA, 20 bp, synthetic construct
  misc_feature 1..20: note = Synthetic Construct
  source 1..20: mol_type = other DNA
acctgtcccctgaacccaat

SEQ ID NO: 35820 - DNA, 25 bp, synthetic construct
  misc_feature 1..25: note = Synthetic Construct
  source 1..25: mol_type = other DNA
ggtgaccctcattggagttgacctt

SEQ ID NO: 35821 - DNA, 22 bp, synthetic construct
  misc_feature 1..22: note = Synthetic Construct
  source 1..22: mol_type = other DNA
ggctagaggaggtggacaggat

SEQ ID NO: 35822 - DNA, 21 bp, synthetic construct
  misc_feature 1..21: note = Synthetic Construct
  source 1..21: mol_type = other DNA
aagtcccgcctggtgttcact

SEQ ID NO: 35823 - DNA, 22 bp, synthetic construct
  misc_feature 1..22: note = Synthetic Construct
  source 1..22: mol_type = other DNA
ctgagctgtgtcttcccagatg

SEQ ID NO: 35824 - DNA, 22 bp, synthetic construct
  misc_feature 1..22: note = Synthetic Construct
  source 1..22: mol_type = other DNA
gcagagcgttgcttaggccatt

SEQ ID NO: 35825 - DNA, 28 bp, synthetic construct
  misc_feature 1..28: note = Synthetic Construct
  source 1..28: mol_type = other DNA
gcccttctggatgacaataaggtcttga

SEQ ID NO: 35826 - DNA, 20 bp, synthetic construct
  misc_feature 1..20: note = Synthetic Construct
  source 1..20: mol_type = other DNA
tgactgtgtccctcgcacat

SEQ ID NO: 35827 - DNA, 24 bp, synthetic construct
  misc_feature 1..24: note = Synthetic Construct
  source 1..24: mol_type = other DNA
tttttagtgccacaggttggattg

SEQ ID NO: 35828 - DNA, 21 bp, synthetic construct
  misc_feature 1..21: note = Synthetic Construct
  source 1..21: mol_type = other DNA
gagtaaagcagggagcagcat

SEQ ID NO: 35829 - DNA, 22 bp, synthetic construct
  misc_feature 1..22: note = Synthetic Construct
  source 1..22: mol_type = other DNA
cctgaaagcctcgggataccat

SEQ ID NO: 35830 - DNA, 22 bp, synthetic construct
  misc_feature 1..22: note = Synthetic Construct
  source 1..22: mol_type = other DNA
gctcgcacattgctgtctgctt

SEQ ID NO: 35831 - DNA, 22 bp, synthetic construct
  misc_feature 1..22: note = Synthetic Construct
  source 1..22: mol_type = other DNA
cggccaaccttagacacagcta

SEQ ID NO: 35832 - DNA, 20 bp, synthetic construct
  misc_feature 1..20: note = Synthetic Construct
  source 1..20: mol_type = other DNA
gcaaagcgagagtcctgcta

SEQ ID NO: 35833 - DNA, 21 bp, synthetic construct
  misc_feature 1..21: note = Synthetic Construct
  source 1..21: mol_type = other DNA
ctgggcatctttcctcacctt

SEQ ID NO: 35834 - DNA, 21 bp, synthetic construct
  misc_feature 1..21: note = Synthetic Construct
  source 1..21: mol_type = other DNA
agcaagcatgggctccactac

SEQ ID NO: 35835 - DNA, 20 bp, synthetic construct
  misc_feature 1..20: note = Synthetic Construct
  source 1..20: mol_type = other DNA
tgcatagggtcccggagtta

SEQ ID NO: 35836 - DNA, 21 bp, synthetic construct
  misc_feature 1..21: note = Synthetic Construct
  source 1..21: mol_type = other DNA
tctggctttggacctcacctt

SEQ ID NO: 35837 - DNA, 23 bp, synthetic construct
  misc_feature 1..23: note = Synthetic Construct
  source 1..23: mol_type = other DNA
cagttcagctccttcctctgcta

SEQ ID NO: 35838 - DNA, 22 bp, synthetic construct
  misc_feature 1..22: note = Synthetic Construct
  source 1..22: mol_type = other DNA
ctgggaagtaagcaggctgaga

SEQ ID NO: 35839 - DNA, 20 bp, synthetic construct
  misc_feature 1..20: note = Synthetic Construct
  source 1..20: mol_type = other DNA
tccaggctcacccacttcat

SEQ ID NO: 35840 - DNA, 21 bp, synthetic construct
  misc_feature 1..21: note = Synthetic Construct
  source 1..21: mol_type = other DNA
cagattgccagggaagtgaca

SEQ ID NO: 35841 - DNA, 25 bp, synthetic construct
  misc_feature 1..25: note = Synthetic Construct
  source 1..25: mol_type = other DNA
gaaccaaagcatcaagaaggaaact

SEQ ID NO: 35842 - DNA, 20 bp, synthetic construct
  misc_feature 1..20: note = Synthetic Construct
  source 1..20: mol_type = other DNA
ggcctgttgggtgatagcaa

SEQ ID NO: 35843 - DNA, 23 bp, synthetic construct
  misc_feature 1..23: note = Synthetic Construct
  source 1..23: mol_type = other DNA
ggagcaaagggaaccaaatgact

SEQ ID NO: 35844 - DNA, 20 bp, synthetic construct
  misc_feature 1..20: note = Synthetic Construct
  source 1..20: mol_type = other DNA
acctggctccagccctgatt

SEQ ID NO: 35845 - DNA, 19 bp, synthetic construct
  misc_feature 1..19: note = Synthetic Construct
  source 1..19: mol_type = other DNA
gcaggcactgggcctcaaa

SEQ ID NO: 35846 - DNA, 28 bp, synthetic construct
  misc_feature 1..28: note = Synthetic Construct
  source 1..28: mol_type = other DNA
ccttacttctagttcctactcagcttct

SEQ ID NO: 35847 - DNA, 20 bp, synthetic construct
  misc_feature 1..20: note = Synthetic Construct
  source 1..20: mol_type = other DNA
agctgaggtctggtgcagta

SEQ ID NO: 35848 - DNA, 22 bp, synthetic construct
  misc_feature 1..22: note = Synthetic Construct
  source 1..22: mol_type = other DNA
gtgacaccagcagcttccaaac

SEQ ID NO: 35849 - DNA, 22 bp, synthetic construct
  misc_feature 1..22: note = Synthetic Construct
  source 1..22: mol_type = other DNA
gggcagactatgctggtggatt

SEQ ID NO: 35850 - DNA, 22 bp, synthetic construct
  misc_feature 1..22: note = Synthetic Construct
  source 1..22: mol_type = other DNA
cagctgggcatctaggaagcat

SEQ ID NO: 35851 - DNA, 22 bp, synthetic construct
  misc_feature 1..22: note = Synthetic Construct
  source 1..22: mol_type = other DNA
cacacagtcctccctggaatct

SEQ ID NO: 35852 - DNA, 20 bp, synthetic construct
  misc_feature 1..20: note = Synthetic Construct
  source 1..20: mol_type = other DNA
tgggccccaagttcacaagt

SEQ ID NO: 35853 - DNA, 23 bp, synthetic construct
  misc_feature 1..23: note = Synthetic Construct
  source 1..23: mol_type = other DNA
gcagaaatgcttccaccaacttc

SEQ ID NO: 35854 - DNA, 22 bp, synthetic construct
  misc_feature 1..22: note = Synthetic Construct
  source 1..22: mol_type = other DNA
gggcatgaaggcttggtcaact

SEQ ID NO: 35855 - DNA, 25 bp, synthetic construct
  misc_feature 1..25: note = Synthetic Construct
  source 1..25: mol_type = other DNA
tttatcggaaaggggagcaaatact

SEQ ID NO: 35856 - DNA, 24 bp, synthetic construct
  misc_feature 1..24: note = Synthetic Construct
  source 1..24: mol_type = other DNA
cagctcctctttccactctgaatc

SEQ ID NO: 35857 - DNA, 24 bp, synthetic construct
  misc_feature 1..24: note = Synthetic Construct
  source 1..24: mol_type = other DNA
ctggaaggtaatgggaaactgcaa

SEQ ID NO: 35858 - DNA, 22 bp, synthetic construct
  misc_feature 1..22: note = Synthetic Construct
  source 1..22: mol_type = other DNA
ggtgaacgacggggatgtttac

SEQ ID NO: 35859 - DNA, 23 bp, synthetic construct
  misc_feature 1..23: note = Synthetic Construct
  source 1..23: mol_type = other DNA
gcctctatgctcttgcctactac

SEQ ID NO: 35860 - DNA, 19 bp, synthetic construct
  misc_feature 1..19: note = Synthetic Construct
  source 1..19: mol_type = other DNA
tcagtggcacgcagcagta

SEQ ID NO: 35861 - DNA, 22 bp, synthetic construct
  misc_feature 1..22: note = Synthetic Construct
  source 1..22: mol_type = other DNA
ctcaccctccctacaccaaaac

SEQ ID NO: 35862 - DNA, 25 bp, synthetic construct
  misc_feature 1..25: note = Synthetic Construct
  source 1..25: mol_type = other DNA
tcccaaaatgatgatgagaggtgtt

SEQ ID NO: 35863 - DNA, 25 bp, synthetic construct
  misc_feature 1..25: note = Synthetic Construct
  source 1..25: mol_type = other DNA
aggaaggagaaaattatgggtgcaa

SEQ ID NO: 35864 - DNA, 22 bp, synthetic construct
  misc_feature 1..22: note = Synthetic Construct
  source 1..22: mol_type = other DNA
aatcaggaccggagccccagat

SEQ ID NO: 35865 - DNA, 23 bp, synthetic construct
  misc_feature 1..23: note = Synthetic Construct
  source 1..23: mol_type = other DNA
aagccagaatgtctgacctgaaa

SEQ ID NO: 35866 - DNA, 27 bp, synthetic construct
  misc_feature 1..27: note = Synthetic Construct
  source 1..27: mol_type = other DNA
cctcctaggaatgtctgccatggattt

SEQ ID NO: 35867 - DNA, 24 bp, synthetic construct
  misc_feature 1..24: note = Synthetic Construct
  source 1..24: mol_type = other DNA
gtctctgtgactcgcacatagttg

SEQ ID NO: 35868 - DNA, 18 bp, synthetic construct
  misc_feature 1..18: note = Synthetic Construct
  source 1..18: mol_type = other DNA
agtgggctcctgggttga

SEQ ID NO: 35869 - DNA, 21 bp, synthetic construct
  misc_feature 1..21: note = Synthetic Construct
  source 1..21: mol_type = other DNA
caaccttgcaccccagaaaca

SEQ ID NO: 35870 - DNA, 22 bp, synthetic construct
  misc_feature 1..22: note = Synthetic Construct
  source 1..22: mol_type = other DNA
ggtcttctggctttacgtgttg

SEQ ID NO: 35871 - DNA, 22 bp, synthetic construct
  misc_feature 1..22: note = Synthetic Construct
  source 1..22: mol_type = other DNA
tggttcaggaatgagccactct

SEQ ID NO: 35872 - DNA, 21 bp, synthetic construct
  misc_feature 1..21: note = Synthetic Construct
  source 1..21: mol_type = other DNA
gcttactagtgccgggtgctt

SEQ ID NO: 35873 - DNA, 20 bp, synthetic construct
  misc_feature 1..20: note = Synthetic Construct
  source 1..20: mol_type = other DNA
ggggccaagagctactgtgt

SEQ ID NO: 35874 - DNA, 23 bp, synthetic construct
  misc_feature 1..23: note = Synthetic Construct
  source 1..23: mol_type = other DNA
ggtggaggtagcaaagcctcaaa

SEQ ID NO: 35875 - DNA, 25 bp, synthetic construct
  misc_feature 1..25: note = Synthetic Construct
  source 1..25: mol_type = other DNA
gctggctaagcttttgtggacagat

SEQ ID NO: 35876 - DNA, 19 bp, synthetic construct
  misc_feature 1..19: note = Synthetic Construct
  source 1..19: mol_type = other DNA
ttccccgtgggctggatca

SEQ ID NO: 35877 - DNA, 30 bp, synthetic construct
  misc_feature 1..30: note = Synthetic Construct
  source 1..30: mol_type = other DNA
gcatctaaatcttcctagcgattggagaag

SEQ ID NO: 35878 - DNA, 21 bp, synthetic construct
  misc_feature 1..21: note = Synthetic Construct
  source 1..21: mol_type = other DNA
ccaagacaaggtgctgctgat

SEQ ID NO: 35879 - DNA, 27 bp, synthetic construct
  misc_feature 1..27: note = Synthetic Construct
  source 1..27: mol_type = other DNA
gacctgagaaaagagtgttatccaaga

SEQ ID NO: 35880 - DNA, 23 bp, synthetic construct
  misc_feature 1..23: note = Synthetic Construct
  source 1..23: mol_type = other DNA
ctgcatccaaacagccctaaatg

SEQ ID NO: 35881 - DNA, 23 bp, synthetic construct
  misc_feature 1..23: note = Synthetic Construct
  source 1..23: mol_type = other DNA
cccagcacaatagggaacttctt

SEQ ID NO: 35882 - DNA, 20 bp, synthetic construct
  misc_feature 1..20: note = Synthetic Construct
  source 1..20: mol_type = other DNA
gcaccttgcaaccctctctt

SEQ ID NO: 35883 - DNA, 22 bp, synthetic construct
  misc_feature 1..22: note = Synthetic Construct
  source 1..22: mol_type = other DNA
ggcaatcggtggtgcattcctt

SEQ ID NO: 35884 - DNA, 27 bp, synthetic construct
  misc_feature 1..27: note = Synthetic Construct
  source 1..27: mol_type = other DNA
gcaggcccagaacttatagatgtcaac

SEQ ID NO: 35885 - DNA, 18 bp, synthetic construct
  misc_feature 1..18: note = Synthetic Construct
  source 1..18: mol_type = other DNA
acaccacgcgctgacaga

SEQ ID NO: 35886 - DNA, 19 bp, synthetic construct
  misc_feature 1..19: note = Synthetic Construct
  source 1..19: mol_type = other DNA
gctggccagggctttcagt

SEQ ID NO: 35887 - DNA, 20 bp, synthetic construct
  misc_feature 1..20: note = Synthetic Construct
  source 1..20: mol_type = other DNA
ttcctcctggccctgccaaa

SEQ ID NO: 35888 - DNA, 23 bp, synthetic construct
  misc_feature 1..23: note = Synthetic Construct
  source 1..23: mol_type = other DNA
ggcagaggctgctattataggtt

SEQ ID NO: 35889 - DNA, 20 bp, synthetic construct
  misc_feature 1..20: note = Synthetic Construct
  source 1..20: mol_type = other DNA
ccgaggcatgtgctggatga

SEQ ID NO: 35890 - DNA, 26 bp, synthetic construct
  misc_feature 1..26: note = Synthetic Construct
  source 1..26: mol_type = other DNA
ggctgtagattgcaaaagcaggacta

SEQ ID NO: 35891 - DNA, 20 bp, synthetic construct
  misc_feature 1..20: note = Synthetic Construct
  source 1..20: mol_type = other DNA
aggggactgcagagaagtca

SEQ ID NO: 35892 - DNA, 20 bp, synthetic construct
  misc_feature 1..20: note = Synthetic Construct
  source 1..20: mol_type = other DNA
actggcagcgctgtgtgatt

SEQ ID NO: 35893 - DNA, 21 bp, synthetic construct
  misc_feature 1..21: note = Synthetic Construct
  source 1..21: mol_type = other DNA
tgtcctgccctgtggggattt

SEQ ID NO: 35894 - DNA, 25 bp, synthetic construct
  misc_feature 1..25: note = Synthetic Construct
  source 1..25: mol_type = other DNA
ggagactcaaagggatcttgggtta

SEQ ID NO: 35895 - DNA, 26 bp, synthetic construct
  misc_feature 1..26: note = Synthetic Construct
  source 1..26: mol_type = other DNA
gggaaattttagacctgcctccagaa

SEQ ID NO: 35896 - DNA, 23 bp, synthetic construct
  misc_feature 1..23: note = Synthetic Construct
  source 1..23: mol_type = other DNA
gataaatcaggccacctgggaat

SEQ ID NO: 35897 - DNA, 22 bp, synthetic construct
  misc_feature 1..22: note = Synthetic Construct
  source 1..22: mol_type = other DNA
cgtatgttgagggccagagagt

SEQ ID NO: 35898 - DNA, 23 bp, synthetic construct
  misc_feature 1..23: note = Synthetic Construct
  source 1..23: mol_type = other DNA
gctgccttggttttccccagatt

SEQ ID NO: 35899 - DNA, 20 bp, synthetic construct
  misc_feature 1..20: note = Synthetic Construct
  source 1..20: mol_type = other DNA
gttgaggcagatggcagtgt

SEQ ID NO: 35900 - DNA, 20 bp, synthetic construct
  misc_feature 1..20: note = Synthetic Construct
  source 1..20: mol_type = other DNA
gggaagaaaacgggccaagt

SEQ ID NO: 35901 - DNA, 24 bp, synthetic construct
  misc_feature 1..24: note = Synthetic Construct
  source 1..24: mol_type = other DNA
gggtttggagttagcttgactttg

SEQ ID NO: 35902 - DNA, 21 bp, synthetic construct
  misc_feature 1..21: note = Synthetic Construct
  source 1..21: mol_type = other DNA
agcagtcaccctcggatccat

SEQ ID NO: 35903 - DNA, 22 bp, synthetic construct
  misc_feature 1..22: note = Synthetic Construct
  source 1..22: mol_type = other DNA
cggcttttggccacctttgaga

SEQ ID NO: 35904 - DNA, 25 bp, synthetic construct
  misc_feature 1..25: note = Synthetic Construct
  source 1..25: mol_type = other DNA
ctcagactcaaggggctctattaag

SEQ ID NO: 35905 - DNA, 26 bp, synthetic construct
  misc_feature 1..26: note = Synthetic Construct
  source 1..26: mol_type = other DNA
gaagttctttagctgtaacccctctt

SEQ ID NO: 35906 - DNA, 24 bp, synthetic construct
  misc_feature 1..24: note = Synthetic Construct
  source 1..24: mol_type = other DNA
ctgtgtccattccttctccaatga

SEQ ID NO: 35907 - DNA, 22 bp, synthetic construct
  misc_feature 1..22: note = Synthetic Construct
  source 1..22: mol_type = other DNA
cagtgacctccactgcttgact

SEQ ID NO: 35908 - DNA, 21 bp, synthetic construct
  misc_feature 1..21: note = Synthetic Construct
  source 1..21: mol_type = other DNA
tctcaacaggcacgtgagatg

SEQ ID NO: 35909 - DNA, 24 bp, synthetic construct
  misc_feature 1..24: note = Synthetic Construct
  source 1..24: mol_type = other DNA
gagtcacagctaaccacaaacaca

SEQ ID NO: 35910 - DNA, 20 bp, synthetic construct
  misc_feature 1..20: note = Synthetic Construct
  source 1..20: mol_type = other DNA
ccttcgcgttgcttcctttc

SEQ ID NO: 35911 - DNA, 20 bp, synthetic construct
  misc_feature 1..20: note = Synthetic Construct
  source 1..20: mol_type = other DNA
atgaaccctgcctgcacaga

SEQ ID NO: 35912 - DNA, 25 bp, synthetic construct
  misc_feature 1..25: note = Synthetic Construct
  source 1..25: mol_type = other DNA
tgtgatcagatccacgtttgtgtag

SEQ ID NO: 35913 - DNA, 20 bp, synthetic construct
  misc_feature 1..20: note = Synthetic Construct
  source 1..20: mol_type = other DNA
agaatggcctgcaccacatc

SEQ ID NO: 35914 - DNA, 21 bp, synthetic construct
  misc_feature 1..21: note = Synthetic Construct
  source 1..21: mol_type = other DNA
tgtgccatgactctcccttca

SEQ ID NO: 35915 - DNA, 22 bp, synthetic construct
  misc_feature 1..22: note = Synthetic Construct
  source 1..22: mol_type = other DNA
gcctggatgaacctagccaaga

SEQ ID NO: 35916 - DNA, 19 bp, synthetic construct
  misc_feature 1..19: note = Synthetic Construct
  source 1..19: mol_type = other DNA
tgccttcgtgcaggtgaca

SEQ ID NO: 35917 - DNA, 21 bp, synthetic construct
  misc_feature 1..21: note = Synthetic Construct
  source 1..21: mol_type = other DNA
cctggtgctacccaacaccta

SEQ ID NO: 35918 - DNA, 24 bp, synthetic construct
  misc_feature 1..24: note = Synthetic Construct
  source 1..24: mol_type = other DNA
aggaaagaaattgcagaccacaag

SEQ ID NO: 35919 - DNA, 21 bp, synthetic construct
  misc_feature 1..21: note = Synthetic Construct
  source 1..21: mol_type = other DNA
gcccttccttctgcctgcaat

SEQ ID NO: 35920 - DNA, 23 bp, synthetic construct
  misc_feature 1..23: note = Synthetic Construct
  source 1..23: mol_type = other DNA
ggggtttttggagcacaaaatgt

SEQ ID NO: 35921 - DNA, 18 bp, synthetic construct
  misc_feature 1..18: note = Synthetic Construct
  source 1..18: mol_type = other DNA
tggagggcagcgatggta

SEQ ID NO: 35922 - DNA, 21 bp, synthetic construct
  misc_feature 1..21: note = Synthetic Construct
  source 1..21: mol_type = other DNA
gtccttcagggcaacgaaagt

SEQ ID NO: 35923 - DNA, 24 bp, synthetic construct
  misc_feature 1..24: note = Synthetic Construct
  source 1..24: mol_type = other DNA
ggtcagggcttcaggtatccattc

SEQ ID NO: 35924 - DNA, 21 bp, synthetic construct
  misc_feature 1..21: note = Synthetic Construct
  source 1..21: mol_type = other DNA
atccgtgacgccctctctgaa

SEQ ID NO: 35925 - DNA, 19 bp, synthetic construct
  misc_feature 1..19: note = Synthetic Construct
  source 1..19: mol_type = other DNA
gcacagggctgcctcactt

SEQ ID NO: 35926 - DNA, 20 bp, synthetic construct
  misc_feature 1..20: note = Synthetic Construct
  source 1..20: mol_type = other DNA
tggcctttgggagcaggttt

SEQ ID NO: 35927 - DNA, 19 bp, synthetic construct
  misc_feature 1..19: note = Synthetic Construct
  source 1..19: mol_type = other DNA
tctggtgggctggcgtgaa

SEQ ID NO: 35928 - DNA, 24 bp, synthetic construct
  misc_feature 1..24: note = Synthetic Construct
  source 1..24: mol_type = other DNA
gccctgagaactgtatacgacctt

SEQ ID NO: 35929 - DNA, 24 bp, synthetic construct
  misc_feature 1..24: note = Synthetic Construct
  source 1..24: mol_type = other DNA
ggcagttgaagtcatgaaactgaa

SEQ ID NO: 35930 - DNA, 20 bp, synthetic construct
  misc_feature 1..20: note = Synthetic Construct
  source 1..20: mol_type = other DNA
aggctctcccggctctctgt

SEQ ID NO: 35931 - DNA, 23 bp, synthetic construct
  misc_feature 1..23: note = Synthetic Construct
  source 1..23: mol_type = other DNA
gcaggtcacaagtccaggaaact

SEQ ID NO: 35932 - DNA, 20 bp, synthetic construct
  misc_feature 1..20: note = Synthetic Construct
  source 1..20: mol_type = other DNA
ggccgtgaaagctgatctgt

SEQ ID NO: 35933 - DNA, 25 bp, synthetic construct
  misc_feature 1..25: note = Synthetic Construct
  source 1..25: mol_type = other DNA
gagcttgggaaactacaaggtatga

SEQ ID NO: 35934 - DNA, 24 bp, synthetic construct
  misc_feature 1..24: note = Synthetic Construct
  source 1..24: mol_type = other DNA
ccctcccaaaagcagacagcagta

SEQ ID NO: 35935 - DNA, 22 bp, synthetic construct
  misc_feature 1..22: note = Synthetic Construct
  source 1..22: mol_type = other DNA
ccgtaggaagaaccaggtgtga

SEQ ID NO: 35936 - DNA, 20 bp, synthetic construct
  misc_feature 1..20: note = Synthetic Construct
  source 1..20: mol_type = other DNA
aaccctgacggcagttgcta

SEQ ID NO: 35937 - DNA, 20 bp, synthetic construct
  misc_feature 1..20: note = Synthetic Construct
  source 1..20: mol_type = other DNA
cgtggagtggtggcttggaa

SEQ ID NO: 35938 - DNA, 26 bp, synthetic construct
  misc_feature 1..26: note = Synthetic Construct
  source 1..26: mol_type = other DNA
gggaaaattccagactgagagagttg

SEQ ID NO: 35939 - DNA, 22 bp, synthetic construct
  misc_feature 1..22: note = Synthetic Construct
  source 1..22: mol_type = other DNA
caaaggcaccctgagctcatta

SEQ ID NO: 35940 - DNA, 21 bp, synthetic construct
  misc_feature 1..21: note = Synthetic Construct
  source 1..21: mol_type = other DNA
cggctattagaccccagcaaa

SEQ ID NO: 35941 - DNA, 22 bp, synthetic construct
  misc_feature 1..22: note = Synthetic Construct
  source 1..22: mol_type = other DNA
ccagacgctctgaaggctacaa

SEQ ID NO: 35942 - DNA, 22 bp, synthetic construct
  misc_feature 1..22: note = Synthetic Construct
  source 1..22: mol_type = other DNA
gacaccaagggtgaagggaaga

SEQ ID NO: 35943 - DNA, 27 bp, synthetic construct
  misc_feature 1..27: note = Synthetic Construct
  source 1..27: mol_type = other DNA
ggtatatgctgagtagacaaggacact

SEQ ID NO: 35944 - DNA, 22 bp, synthetic construct
  misc_feature 1..22: note = Synthetic Construct
  source 1..22: mol_type = other DNA
agtccatggaaggcggtgtaag

SEQ ID NO: 35945 - DNA, 25 bp, synthetic construct
  misc_feature 1..25: note = Synthetic Construct
  source 1..25: mol_type = other DNA
ggagttatcagtgagggatgtgtct

SEQ ID NO: 35946 - DNA, 23 bp, synthetic construct
  misc_feature 1..23: note = Synthetic Construct
  source 1..23: mol_type = other DNA
gatcctcactggtggtaggatgt

SEQ ID NO: 35947 - DNA, 20 bp, synthetic construct
  misc_feature 1..20: note = Synthetic Construct
  source 1..20: mol_type = other DNA
gccttgctcctgccaaactt

SEQ ID NO: 35948 - DNA, 22 bp, synthetic construct
  misc_feature 1..22: note = Synthetic Construct
  source 1..22: mol_type = other DNA
atctcctgtcccagcatctttg

SEQ ID NO: 35949 - DNA, 20 bp, synthetic construct
  misc_feature 1..20: note = Synthetic Construct
  source 1..20: mol_type = other DNA
aatgtacggcttgccgtttg

SEQ ID NO: 35950 - DNA, 20 bp, synthetic construct
  misc_feature 1..20: note = Synthetic Construct
  source 1..20: mol_type = other DNA
gggagcagttgggactcaga

SEQ ID NO: 35951 - DNA, 20 bp, synthetic construct
  misc_feature 1..20: note = Synthetic Construct
  source 1..20: mol_type = other DNA
cacacctgctgtcgtctgaa

SEQ ID NO: 35952 - DNA, 20 bp, synthetic construct
  misc_feature 1..20: note = Synthetic Construct
  source 1..20: mol_type = other DNA
gcatggctcccatggttaca

SEQ ID NO: 35953 - DNA, 22 bp, synthetic construct
  misc_feature 1..22: note = Synthetic Construct
  source 1..22: mol_type = other DNA
gctcttggaaggctgtgttttc

SEQ ID NO: 35954 - DNA, 22 bp, synthetic construct
  misc_feature 1..22: note = Synthetic Construct
  source 1..22: mol_type = other DNA
tggttactgggctcccttgagt

SEQ ID NO: 35955 - DNA, 19 bp, synthetic construct
  misc_feature 1..19: note = Synthetic Construct
  source 1..19: mol_type = other DNA
actccgacgtggccagtat

SEQ ID NO: 35956 - DNA, 20 bp, synthetic construct
  misc_feature 1..20: note = Synthetic Construct
  source 1..20: mol_type = other DNA
aacacaggaggggcaggata

SEQ ID NO: 35957 - DNA, 20 bp, synthetic construct
  misc_feature 1..20: note = Synthetic Construct
  source 1..20: mol_type = other DNA
tgtaggccattggcgcgtta

SEQ ID NO: 35958 - DNA, 25 bp, synthetic construct
  misc_feature 1..25: note = Synthetic Construct
  source 1..25: mol_type = other DNA
ggagaaggcttaagttccacagcaa

SEQ ID NO: 35959 - DNA, 27 bp, synthetic construct
  misc_feature 1..27: note = Synthetic Construct
  source 1..27: mol_type = other DNA
caggtactttgtgtcagctacatctca

SEQ ID NO: 35960 - DNA, 22 bp, synthetic construct
  misc_feature 1..22: note = Synthetic Construct
  source 1..22: mol_type = other DNA
caagaagaagcaacccgactga

SEQ ID NO: 35961 - DNA, 20 bp, synthetic construct
  misc_feature 1..20: note = Synthetic Construct
  source 1..20: mol_type = other DNA
tgggcagtcccagggaaata

SEQ ID NO: 35962 - DNA, 23 bp, synthetic construct
  misc_feature 1..23: note = Synthetic Construct
  source 1..23: mol_type = other DNA
cagcttcacaaagtggcgttgtt

SEQ ID NO: 35963 - DNA, 20 bp, synthetic construct
  misc_feature 1..20: note = Synthetic Construct
  source 1..20: mol_type = other DNA
ccccgagggtccttcctgta

SEQ ID NO: 35964 - DNA, 20 bp, synthetic construct
  misc_feature 1..20: note = Synthetic Construct
  source 1..20: mol_type = other DNA
gaagcaggcgcagttacaca

SEQ ID NO: 35965 - DNA, 24 bp, synthetic construct
  misc_feature 1..24: note = Synthetic Construct
  source 1..24: mol_type = other DNA
ccctgttctccctgcattttgaca

SEQ ID NO: 35966 - DNA, 21 bp, synthetic construct
  misc_feature 1..21: note = Synthetic Construct
  source 1..21: mol_type = other DNA
ccacccaggtctgggagtatg

SEQ ID NO: 35967 - DNA, 22 bp, synthetic construct
  misc_feature 1..22: note = Synthetic Construct
  source 1..22: mol_type = other DNA
ggcaagggtaagagccagcaaa

SEQ ID NO: 35968 - DNA, 21 bp, synthetic construct
  misc_feature 1..21: note = Synthetic Construct
  source 1..21: mol_type = other DNA
ggagcccctagtctggacttc

SEQ ID NO: 35969 - DNA, 20 bp, synthetic construct
  misc_feature 1..20: note = Synthetic Construct
  source 1..20: mol_type = other DNA
tgagtgcagggctggaaact

SEQ ID NO: 35970 - DNA, 20 bp, synthetic construct
  misc_feature 1..20: note = Synthetic Construct
  source 1..20: mol_type = other DNA
gcctctatgccaggccaagt

SEQ ID NO: 35971 - DNA, 20 bp, synthetic construct
  misc_feature 1..20: note = Synthetic Construct
  source 1..20: mol_type = other DNA
aggacatggcctggaagttg

SEQ ID NO: 35972 - DNA, 21 bp, synthetic construct
  misc_feature 1..21: note = Synthetic Construct
  source 1..21: mol_type = other DNA
ggcgggaatcagccttcatca

SEQ ID NO: 35973 - DNA, 22 bp, synthetic construct
  misc_feature 1..22: note = Synthetic Construct
  source 1..22: mol_type = other DNA
ccaatgcttggagcagggaact

SEQ ID NO: 35974 - DNA, 24 bp, synthetic construct
  misc_feature 1..24: note = Synthetic Construct
  source 1..24: mol_type = other DNA
cctccttctgaccaatggcaaaca

SEQ ID NO: 35975 - DNA, 19 bp, synthetic construct
  misc_feature 1..19: note = Synthetic Construct
  source 1..19: mol_type = other DNA
tggaggatgcgtggagcaa

SEQ ID NO: 35976 - DNA, 27 bp, synthetic construct
  misc_feature 1..27: note = Synthetic Construct
  source 1..27: mol_type = other DNA
gcatctctacacctaccttcagccttt

SEQ ID NO: 35977 - DNA, 25 bp, synthetic construct
  misc_feature 1..25: note = Synthetic Construct
  source 1..25: mol_type = other DNA
cctgccacattgccttatcctctac

SEQ ID NO: 35978 - DNA, 21 bp, synthetic construct
  misc_feature 1..21: note = Synthetic Construct
  source 1..21: mol_type = other DNA
gtctctcacggcatggattgt

SEQ ID NO: 35979 - DNA, 23 bp, synthetic construct
  misc_feature 1..23: note = Synthetic Construct
  source 1..23: mol_type = other DNA
cctcaatgaatggtgccgtggat

SEQ ID NO: 35980 - DNA, 20 bp, synthetic construct
  misc_feature 1..20: note = Synthetic Construct
  source 1..20: mol_type = other DNA
gctgcaaagacacgctcaga

SEQ ID NO: 35981 - DNA, 21 bp, synthetic construct
  misc_feature 1..21: note = Synthetic Construct
  source 1..21: mol_type = other DNA
agacatggtccctgcctggtt

SEQ ID NO: 35982 - DNA, 23 bp, synthetic construct
  misc_feature 1..23: note = Synthetic Construct
  source 1..23: mol_type = other DNA
gcaaatgtttcagggaggcaatc

SEQ ID NO: 35983 - DNA, 22 bp, synthetic construct
  misc_feature 1..22: note = Synthetic Construct
  source 1..22: mol_type = other DNA
ttccaggtggcttagggacttc

SEQ ID NO: 35984 - DNA, 24 bp, synthetic construct
  misc_feature 1..24: note = Synthetic Construct
  source 1..24: mol_type = other DNA
gcattgttttgcctgctaggaact

SEQ ID NO: 35985 - DNA, 25 bp, synthetic construct
  misc_feature 1..25: note = Synthetic Construct
  source 1..25: mol_type = other DNA
gcttatctcaagaccagtgcttgtt

SEQ ID NO: 35986 - DNA, 24 bp, synthetic construct
  misc_feature 1..24: note = Synthetic Construct
  source 1..24: mol_type = other DNA
ggggtcagcttgactcttgtggtt

SEQ ID NO: 35987 - DNA, 20 bp, synthetic construct
  misc_feature 1..20: note = Synthetic Construct
  source 1..20: mol_type = other DNA
acacaggtggtggcctctga

SEQ ID NO: 35988 - DNA, 20 bp, synthetic construct
  misc_feature 1..20: note = Synthetic Construct
  source 1..20: mol_type = other DNA
gggctgccctggatgtgtta

SEQ ID NO: 35989 - DNA, 22 bp, synthetic construct
  misc_feature 1..22: note = Synthetic Construct
  source 1..22: mol_type = other DNA
tgcccagacagcttggatgaag

SEQ ID NO: 35990 - DNA, 20 bp, synthetic construct
  misc_feature 1..20: note = Synthetic Construct
  source 1..20: mol_type = other DNA
cagacagcccttgtgtgcat

SEQ ID NO: 35991 - DNA, 19 bp, synthetic construct
  misc_feature 1..19: note = Synthetic Construct
  source 1..19: mol_type = other DNA
tgagtgccgggctccagaa

SEQ ID NO: 35992 - DNA, 26 bp, synthetic construct
  misc_feature 1..26: note = Synthetic Construct
  source 1..26: mol_type = other DNA
gggagcagttcattgaaagcccaact

SEQ ID NO: 35993 - DNA, 24 bp, synthetic construct
  misc_feature 1..24: note = Synthetic Construct
  source 1..24: mol_type = other DNA
ccacactgtgtatgactcccctta

SEQ ID NO: 35994 - DNA, 20 bp, synthetic construct
  misc_feature 1..20: note = Synthetic Construct
  source 1..20: mol_type = other DNA
cccaaggagaggctgtcagt

SEQ ID NO: 35995 - DNA, 23 bp, synthetic construct
  misc_feature 1..23: note = Synthetic Construct
  source 1..23: mol_type = other DNA
gccataggctaacctcacagaca

SEQ ID NO: 35996 - DNA, 23 bp, synthetic construct
  misc_feature 1..23: note = Synthetic Construct
  source 1..23: mol_type = other DNA
cgccatttgagtttggccctgta

SEQ ID NO: 35997 - DNA, 20 bp, synthetic construct
  misc_feature 1..20: note = Synthetic Construct
  source 1..20: mol_type = other DNA
ggcctaagaactgccccaat

SEQ ID NO: 35998 - DNA, 19 bp, synthetic construct
  misc_feature 1..19: note = Synthetic Construct
  source 1..19: mol_type = other DNA
gtgagtggccagcacatct

SEQ ID NO: 35999 - DNA, 21 bp, synthetic construct
  misc_feature 1..21: note = Synthetic Construct
  source 1..21: mol_type = other DNA
gcatttggcatccctgtctga

SEQ ID NO: 36000 - DNA, 27 bp, synthetic construct
  misc_feature 1..27: note = Synthetic Construct
  source 1..27: mol_type = other DNA
ctggagtatagaatctgggagggtaag

SEQ ID NO: 36001 - DNA, 19 bp, synthetic construct
  misc_feature 1..19: note = Synthetic Construct
  source 1..19: mol_type = other DNA
acccagccccgtctgaatg

SEQ ID NO: 36002 - DNA, 20 bp, synthetic construct
  misc_feature 1..20: note = Synthetic Construct
  source 1..20: mol_type = other DNA
aggaccccagcgtgctccat

SEQ ID NO: 36003 - DNA, 27 bp, synthetic construct
  misc_feature 1..27: note = Synthetic Construct
  source 1..27: mol_type = other DNA
ctatgcttataaaacctgacccagttc

SEQ ID NO: 36004 - DNA, 21 bp, synthetic construct
  misc_feature 1..21: note = Synthetic Construct
  source 1..21: mol_type = other DNA
tccagagcacccctcctcaaa

SEQ ID NO: 36005 - DNA, 18 bp, synthetic construct
  misc_feature 1..18: note = Synthetic Construct
  source 1..18: mol_type = other DNA
agcaggggccactactgt

SEQ ID NO: 36006 - DNA, 21 bp, synthetic construct
  misc_feature 1..21: note = Synthetic Construct
  source 1..21: mol_type = other DNA
cgggttcctggtgctcatctt

SEQ ID NO: 36007 - DNA, 22 bp, synthetic construct
  misc_feature 1..22: note = Synthetic Construct
  source 1..22: mol_type = other DNA
ctaggagcagagatgcgacttc

SEQ ID NO: 36008 - DNA, 21 bp, synthetic construct
  misc_feature 1..21: note = Synthetic Construct
  source 1..21: mol_type = other DNA
tcccgggaacatgctgcattc

SEQ ID NO: 36009 - DNA, 22 bp, synthetic construct
  misc_feature 1..22: note = Synthetic Construct
  source 1..22: mol_type = other DNA
gctttgaggaggatgggtggta

SEQ ID NO: 36010 - DNA, 21 bp, synthetic construct
  misc_feature 1..21: note = Synthetic Construct
  source 1..21: mol_type = other DNA
gcagaagccactggcagaaac

SEQ ID NO: 36011 - DNA, 25 bp, synthetic construct
  misc_feature 1..25: note = Synthetic Construct
  source 1..25: mol_type = other DNA
cctaggacattaagggaacatggaa

SEQ ID NO: 36012 - DNA, 23 bp, synthetic construct
  misc_feature 1..23: note = Synthetic Construct
  source 1..23: mol_type = other DNA
gctatgttgttccaggcctctgt

SEQ ID NO: 36013 - DNA, 19 bp, synthetic construct
  misc_feature 1..19: note = Synthetic Construct
  source 1..19: mol_type = other DNA
tccctgtccccacgcagtt

SEQ ID NO: 36014 - DNA, 25 bp, synthetic construct
  misc_feature 1..25: note = Synthetic Construct
  source 1..25: mol_type = other DNA
ggtcttcgactctccaaggaacaga

SEQ ID NO: 36015 - DNA, 22 bp, synthetic construct
  misc_feature 1..22: note = Synthetic Construct
  source 1..22: mol_type = other DNA
gcccaggcccatgaattactgt

SEQ ID NO: 36016 - DNA, 20 bp, synthetic construct
  misc_feature 1..20: note = Synthetic Construct
  source 1..20: mol_type = other DNA
ggcacccatttggtcactgt

SEQ ID NO: 36017 - DNA, 20 bp, synthetic construct
  misc_feature 1..20: note = Synthetic Construct
  source 1..20: mol_type = other DNA
ttggccagcgcaactggaaa

SEQ ID NO: 36018 - DNA, 20 bp, synthetic construct
  misc_feature 1..20: note = Synthetic Construct
  source 1..20: mol_type = other DNA
gtaggtctggggcaggaaga

SEQ ID NO: 36019 - DNA, 20 bp, synthetic construct
  misc_feature 1..20: note = Synthetic Construct
  source 1..20: mol_type = other DNA
atgcccagagcacccactgt

SEQ ID NO: 36020 - DNA, 25 bp, synthetic construct
  misc_feature 1..25: note = Synthetic Construct
  source 1..25: mol_type = other DNA
gcttatggagcaaaggatcggtgat

SEQ ID NO: 36021 - DNA, 20 bp, synthetic construct
  misc_feature 1..20: note = Synthetic Construct
  source 1..20: mol_type = other DNA
tctgccccttaccccaggat

SEQ ID NO: 36022 - DNA, 18 bp, synthetic construct
  misc_feature 1..18: note = Synthetic Construct
  source 1..18: mol_type = other DNA
tgcttgctgtgcccaagt

SEQ ID NO: 36023 - DNA, 22 bp, synthetic construct
  misc_feature 1..22: note = Synthetic Construct
  source 1..22: mol_type = other DNA
ggacaggaagcacagcaggttt

SEQ ID NO: 36024 - DNA, 23 bp, synthetic construct
  misc_feature 1..23: note = Synthetic Construct
  source 1..23: mol_type = other DNA
ggcccaaagtgagcatttacatc

SEQ ID NO: 36025 - DNA, 20 bp, synthetic construct
  misc_feature 1..20: note = Synthetic Construct
  source 1..20: mol_type = other DNA
gcagagggaacagaggcttt

SEQ ID NO: 36026 - DNA, 22 bp, synthetic construct
  misc_feature 1..22: note = Synthetic Construct
  source 1..22: mol_type = other DNA
gcgtggctacagagaagtgaga

SEQ ID NO: 36027 - DNA, 22 bp, synthetic construct
  misc_feature 1..22: note = Synthetic Construct
  source 1..22: mol_type = other DNA
cctgctccctgcagtatctttc

SEQ ID NO: 36028 - DNA, 20 bp, synthetic construct
  misc_feature 1..20: note = Synthetic Construct
  source 1..20: mol_type = other DNA
agaggctggtgtccccatag

SEQ ID NO: 36029 - DNA, 20 bp, synthetic construct
  misc_feature 1..20: note = Synthetic Construct
  source 1..20: mol_type = other DNA
taggggtcctacgtgcagaa

SEQ ID NO: 36030 - DNA, 25 bp, synthetic construct
  misc_feature 1..25: note = Synthetic Construct
  source 1..25: mol_type = other DNA
tcagggcacagagatataagaggtt

SEQ ID NO: 36031 - DNA, 22 bp, synthetic construct
  misc_feature 1..22: note = Synthetic Construct
  source 1..22: mol_type = other DNA
tccagcctcgcttctgagctat

SEQ ID NO: 36032 - DNA, 20 bp, synthetic construct
  misc_feature 1..20: note = Synthetic Construct
  source 1..20: mol_type = other DNA
acacgaccacgtggaactca

SEQ ID NO: 36033 - DNA, 21 bp, synthetic construct
  misc_feature 1..21: note = Synthetic Construct
  source 1..21: mol_type = other DNA
tcagtctgccggacaccattg

SEQ ID NO: 36034 - DNA, 18 bp, synthetic construct
  misc_feature 1..18: note = Synthetic Construct
  source 1..18: mol_type = other DNA
ttgcccacgcagtgttga

SEQ ID NO: 36035 - DNA, 22 bp, synthetic construct
  misc_feature 1..22: note = Synthetic Construct
  source 1..22: mol_type = other DNA
ccagatcctgcctgctcttcaa

SEQ ID NO: 36036 - DNA, 27 bp, synthetic construct
  misc_feature 1..27: note = Synthetic Construct
  source 1..27: mol_type = other DNA
gccttatggactgtgatgtcctcagaa

SEQ ID NO: 36037 - DNA, 24 bp, synthetic construct
  misc_feature 1..24: note = Synthetic Construct
  source 1..24: mol_type = other DNA
gagatgggatttcgtgacccattg

SEQ ID NO: 36038 - DNA, 21 bp, synthetic construct
  misc_feature 1..21: note = Synthetic Construct
  source 1..21: mol_type = other DNA
tcctgcccatagccccagaaa

SEQ ID NO: 36039 - DNA, 21 bp, synthetic construct
  misc_feature 1..21: note = Synthetic Construct
  source 1..21: mol_type = other DNA
ttggtgggagcccgttccttt

SEQ ID NO: 36040 - DNA, 24 bp, synthetic construct
  misc_feature 1..24: note = Synthetic Construct
  source 1..24: mol_type = other DNA
cctgccagaaaacttaccccagta

SEQ ID NO: 36041 - DNA, 19 bp, synthetic construct
  misc_feature 1..19: note = Synthetic Construct
  source 1..19: mol_type = other DNA
atccctcccagccacaact

SEQ ID NO: 36042 - DNA, 20 bp, synthetic construct
  misc_feature 1..20: note = Synthetic Construct
  source 1..20: mol_type = other DNA
gcaaaccttaccgccacagt

SEQ ID NO: 36043 - DNA, 21 bp, synthetic construct
  misc_feature 1..21: note = Synthetic Construct
  source 1..21: mol_type = other DNA
catgccattctagcccagcaa

SEQ ID NO: 36044 - DNA, 23 bp, synthetic construct
  misc_feature 1..23: note = Synthetic Construct
  source 1..23: mol_type = other DNA
ggtgcataaatgaggctgcttgt

SEQ ID NO: 36045 - DNA, 24 bp, synthetic construct
  misc_feature 1..24: note = Synthetic Construct
  source 1..24: mol_type = other DNA
gattggtatctggaggaggacaag

SEQ ID NO: 36046 - DNA, 28 bp, synthetic construct
  misc_feature 1..28: note = Synthetic Construct
  source 1..28: mol_type = other DNA
ccctgtggggtacagtattttcatggat

SEQ ID NO: 36047 - DNA, 26 bp, synthetic construct
  misc_feature 1..26: note = Synthetic Construct
  source 1..26: mol_type = other DNA
gacactaccctgaaatcctcttgcta

SEQ ID NO: 36048 - DNA, 22 bp, synthetic construct
  misc_feature 1..22: note = Synthetic Construct
  source 1..22: mol_type = other DNA
tccccacctcctaaagcacagt

SEQ ID NO: 36049 - DNA, 26 bp, synthetic construct
  misc_feature 1..26: note = Synthetic Construct
  source 1..26: mol_type = other DNA
ccaaggattttctcctctcctcagat

SEQ ID NO: 36050 - DNA, 21 bp, synthetic construct
  misc_feature 1..21: note = Synthetic Construct
  source 1..21: mol_type = other DNA
aagtggtggctcctgtagaga

SEQ ID NO: 36051 - DNA, 24 bp, synthetic construct
  misc_feature 1..24: note = Synthetic Construct
  source 1..24: mol_type = other DNA
tggtgattctccaagacctactgt

SEQ ID NO: 36052 - DNA, 24 bp, synthetic construct
  misc_feature 1..24: note = Synthetic Construct
  source 1..24: mol_type = other DNA
ggatgtgatttgctggagcgttga

SEQ ID NO: 36053 - DNA, 22 bp, synthetic construct
  misc_feature 1..22: note = Synthetic Construct
  source 1..22: mol_type = other DNA
cacagatctggccctgtcaatc

SEQ ID NO: 36054 - DNA, 24 bp, synthetic construct
  misc_feature 1..24: note = Synthetic Construct
  source 1..24: mol_type = other DNA
ccttgaacatgcacttgagtctct

SEQ ID NO: 36055 - DNA, 20 bp, synthetic construct
  misc_feature 1..20: note = Synthetic Construct
  source 1..20: mol_type = other DNA
aggggtgggtgtgccctctt

SEQ ID NO: 36056 - DNA, 22 bp, synthetic construct
  misc_feature 1..22: note = Synthetic Construct
  source 1..22: mol_type = other DNA
gcacacaagaggggaacctaac

SEQ ID NO: 36057 - DNA, 26 bp, synthetic construct
  misc_feature 1..26: note = Synthetic Construct
  source 1..26: mol_type = other DNA
gggccttgatggtaataggaaacaga

SEQ ID NO: 36058 - DNA, 25 bp, synthetic construct
  misc_feature 1..25: note = Synthetic Construct
  source 1..25: mol_type = other DNA
aagtcaagctggaacatagagttga

SEQ ID NO: 36059 - DNA, 20 bp, synthetic construct
  misc_feature 1..20: note = Synthetic Construct
  source 1..20: mol_type = other DNA
ggaccctttccagcagcttt

SEQ ID NO: 36060 - DNA, 23 bp, synthetic construct
  misc_feature 1..23: note = Synthetic Construct
  source 1..23: mol_type = other DNA
cctcccctttatgagcaggacaa

SEQ ID NO: 36061 - DNA, 22 bp, synthetic construct
  misc_feature 1..22: note = Synthetic Construct
  source 1..22: mol_type = other DNA
gcaaaacaccctgagccaatag

SEQ ID NO: 36062 - DNA, 21 bp, synthetic construct
  misc_feature 1..21: note = Synthetic Construct
  source 1..21: mol_type = other DNA
ttactcctccaccgcactttc

SEQ ID NO: 36063 - DNA, 22 bp, synthetic construct
  misc_feature 1..22: note = Synthetic Construct
  source 1..22: mol_type = other DNA
gggcccttcacacacatacctt

SEQ ID NO: 36064 - DNA, 22 bp, synthetic construct
  misc_feature 1..22: note = Synthetic Construct
  source 1..22: mol_type = other DNA
gccactataccccgacctcttg

SEQ ID NO: 36065 - DNA, 22 bp, synthetic construct
  misc_feature 1..22: note = Synthetic Construct
  source 1..22: mol_type = other DNA
cgatctcactgggagctgtaga

SEQ ID NO: 36066 - DNA, 26 bp, synthetic construct
  misc_feature 1..26: note = Synthetic Construct
  source 1..26: mol_type = other DNA
ggcagaatttttgatgaaggggaaac

SEQ ID NO: 36067 - DNA, 22 bp, synthetic construct
  misc_feature 1..22: note = Synthetic Construct
  source 1..22: mol_type = other DNA
ggctgtcgcatgatggttgtct

SEQ ID NO: 36068 - DNA, 23 bp, synthetic construct
  misc_feature 1..23: note = Synthetic Construct
  source 1..23: mol_type = other DNA
cccctccagggaaattgggattg

SEQ ID NO: 36069 - DNA, 20 bp, synthetic construct
  misc_feature 1..20: note = Synthetic Construct
  source 1..20: mol_type = other DNA
agccaccatgcctggcctaa

SEQ ID NO: 36070 - DNA, 25 bp, synthetic construct
  misc_feature 1..25: note = Synthetic Construct
  source 1..25: mol_type = other DNA
tcatcatgaggttctgacgttttct

SEQ ID NO: 36071 - DNA, 29 bp, synthetic construct
  misc_feature 1..29: note = Synthetic Construct
  source 1..29: mol_type = other DNA
gcaagtgtaccttaaagtgagtcatcaga

SEQ ID NO: 36072 - DNA, 23 bp, synthetic construct
  misc_feature 1..23: note = Synthetic Construct
  source 1..23: mol_type = other DNA
ttcttgccttggttcatcgtact

SEQ ID NO: 36073 - DNA, 22 bp, synthetic construct
  misc_feature 1..22: note = Synthetic Construct
  source 1..22: mol_type = other DNA
gtggagggtctctatgctcact

SEQ ID NO: 36074 - DNA, 23 bp, synthetic construct
  misc_feature 1..23: note = Synthetic Construct
  source 1..23: mol_type = other DNA
cccagaaggagaactgggtcaga

SEQ ID NO: 36075 - DNA, 21 bp, synthetic construct
  misc_feature 1..21: note = Synthetic Construct
  source 1..21: mol_type = other DNA
agctttagccctgccctcctt

SEQ ID NO: 36076 - DNA, 25 bp, synthetic construct
  misc_feature 1..25: note = Synthetic Construct
  source 1..25: mol_type = other DNA
ggcatatttgaaatgctggcaggta

SEQ ID NO: 36077 - DNA, 21 bp, synthetic construct
  misc_feature 1..21: note = Synthetic Construct
  source 1..21: mol_type = other DNA
gcagagctgcaactgggctat

SEQ ID NO: 36078 - DNA, 18 bp, synthetic construct
  misc_feature 1..18: note = Synthetic Construct
  source 1..18: mol_type = other DNA
aggctgctgagggacaca

SEQ ID NO: 36079 - DNA, 21 bp, synthetic construct
  misc_feature 1..21: note = Synthetic Construct
  source 1..21: mol_type = other DNA
cagacgcagaatgagctccaa

SEQ ID NO: 36080 - DNA, 22 bp, synthetic construct
  misc_feature 1..22: note = Synthetic Construct
  source 1..22: mol_type = other DNA
tggaaggagcaagtttgcatgt

SEQ ID NO: 36081 - DNA, 27 bp, synthetic construct
  misc_feature 1..27: note = Synthetic Construct
  source 1..27: mol_type = other DNA
cacccatggaacaatacaagacatgat

SEQ ID NO: 36082 - DNA, 24 bp, synthetic construct
  misc_feature 1..24: note = Synthetic Construct
  source 1..24: mol_type = other DNA
gctttcttctgccaggaaggtcaa

SEQ ID NO: 36083 - DNA, 24 bp, synthetic construct
  misc_feature 1..24: note = Synthetic Construct
  source 1..24: mol_type = other DNA
tcttggaaagctgttgtagcttgt

SEQ ID NO: 36084 - DNA, 24 bp, synthetic construct
  misc_feature 1..24: note = Synthetic Construct
  source 1..24: mol_type = other DNA
gagaacatcagaggctgtgtgaag

SEQ ID NO: 36085 - DNA, 26 bp, synthetic construct
  misc_feature 1..26: note = Synthetic Construct
  source 1..26: mol_type = other DNA
cagcctcaattacagcagaagctaac

SEQ ID NO: 36086 - DNA, 26 bp, synthetic construct
  misc_feature 1..26: note = Synthetic Construct
  source 1..26: mol_type = other DNA
caagtgaggtatcacttcccaaaaag

SEQ ID NO: 36087 - DNA, 19 bp, synthetic construct
  misc_feature 1..19: note = Synthetic Construct
  source 1..19: mol_type = other DNA
ggcagctgtggagcacttc

SEQ ID NO: 36088 - DNA, 24 bp, synthetic construct
  misc_feature 1..24: note = Synthetic Construct
  source 1..24: mol_type = other DNA
gtggagcctctccaaattgtgttg

SEQ ID NO: 36089 - DNA, 20 bp, synthetic construct
  misc_feature 1..20: note = Synthetic Construct
  source 1..20: mol_type = other DNA
tgaatggggccatggtgagt

SEQ ID NO: 36090 - DNA, 30 bp, synthetic construct
  misc_feature 1..30: note = Synthetic Construct
  source 1..30: mol_type = other DNA
ggacagaagttataaggagctaggatttag

SEQ ID NO: 36091 - DNA, 25 bp, synthetic construct
  misc_feature 1..25: note = Synthetic Construct
  source 1..25: mol_type = other DNA
gtggtaggactgctgtttatcagtt

SEQ ID NO: 36092 - DNA, 21 bp, synthetic construct
  misc_feature 1..21: note = Synthetic Construct
  source 1..21: mol_type = other DNA
gggaatggttgccagtacctt

SEQ ID NO: 36093 - DNA, 21 bp, synthetic construct
  misc_feature 1..21: note = Synthetic Construct
  source 1..21: mol_type = other DNA
ggcctcactgctgccttcata

SEQ ID NO: 36094 - DNA, 25 bp, synthetic construct
  misc_feature 1..25: note = Synthetic Construct
  source 1..25: mol_type = other DNA
tgttcaaacagaaccctacttggaa

SEQ ID NO: 36095 - DNA, 21 bp, synthetic construct
  misc_feature 1..21: note = Synthetic Construct
  source 1..21: mol_type = other DNA
aaagactgcaccaagctggaa

SEQ ID NO: 36096 - DNA, 21 bp, synthetic construct
  misc_feature 1..21: note = Synthetic Construct
  source 1..21: mol_type = other DNA
tgtctgcagagggactgaaac

SEQ ID NO: 36097 - DNA, 19 bp, synthetic construct
  misc_feature 1..19: note = Synthetic Construct
  source 1..19: mol_type = other DNA
cgcacgatccgagggagat

SEQ ID NO: 36098 - DNA, 23 bp, synthetic construct
  misc_feature 1..23: note = Synthetic Construct
  source 1..23: mol_type = other DNA
catcttgctgtaaccaccacagt

SEQ ID NO: 36099 - DNA, 20 bp, synthetic construct
  misc_feature 1..20: note = Synthetic Construct
  source 1..20: mol_type = other DNA
agggcagagatggggaaaca

SEQ ID NO: 36100 - DNA, 22 bp, synthetic construct
  misc_feature 1..22: note = Synthetic Construct
  source 1..22: mol_type = other DNA
gtgtgggtgtgtgtcagcatag

SEQ ID NO: 36101 - DNA, 24 bp, synthetic construct
  misc_feature 1..24: note = Synthetic Construct
  source 1..24: mol_type = other DNA
gcactagggatctctggaaacctt

SEQ ID NO: 36102 - DNA, 25 bp, synthetic construct
  misc_feature 1..25: note = Synthetic Construct
  source 1..25: mol_type = other DNA
gccctagatgaagaggttcccacta

SEQ ID NO: 36103 - DNA, 22 bp, synthetic construct
  misc_feature 1..22: note = Synthetic Construct
  source 1..22: mol_type = other DNA
caatgtgactggggtgttgaga

SEQ ID NO: 36104 - DNA, 25 bp, synthetic construct
  misc_feature 1..25: note = Synthetic Construct
  source 1..25: mol_type = other DNA
ggcaggaatgcaaccaaggacatga

SEQ ID NO: 36105 - DNA, 23 bp, synthetic construct
  misc_feature 1..23: note = Synthetic Construct
  source 1..23: mol_type = other DNA
cacagactggcttaggacctatc

SEQ ID NO: 36106 - DNA, 20 bp, synthetic construct
  misc_feature 1..20: note = Synthetic Construct
  source 1..20: mol_type = other DNA
tctgggccaccaggaagtga

SEQ ID NO: 36107 - DNA, 22 bp, synthetic construct
  misc_feature 1..22: note = Synthetic Construct
  source 1..22: mol_type = other DNA
gaggtaagccagaggaaacgaa

SEQ ID NO: 36108 - DNA, 22 bp, synthetic construct
  misc_feature 1..22: note = Synthetic Construct
  source 1..22: mol_type = other DNA
aacgtggagggtcagaggtttg

SEQ ID NO: 36109 - DNA, 23 bp, synthetic construct
  misc_feature 1..23: note = Synthetic Construct
  source 1..23: mol_type = other DNA
cagatggctaatggcacagcatt

SEQ ID NO: 36110 - DNA, 22 bp, synthetic construct
  misc_feature 1..22: note = Synthetic Construct
  source 1..22: mol_type = other DNA
agcagattcagagcgagacatc

SEQ ID NO: 36111 - DNA, 20 bp, synthetic construct
  misc_feature 1..20: note = Synthetic Construct
  source 1..20: mol_type = other DNA
cttggcctctaaggctgctt

SEQ ID NO: 36112 - DNA, 22 bp, synthetic construct
  misc_feature 1..22: note = Synthetic Construct
  source 1..22: mol_type = other DNA
cgcttccacacaccaaggaatg

SEQ ID NO: 36113 - DNA, 26 bp, synthetic construct
  misc_feature 1..26: note = Synthetic Construct
  source 1..26: mol_type = other DNA
gcaactcactcctcttcctaagaaat

SEQ ID NO: 36114 - DNA, 22 bp, synthetic construct
  misc_feature 1..22: note = Synthetic Construct
  source 1..22: mol_type = other DNA
ggcttcgagattcagtccacaa

SEQ ID NO: 36115 - DNA, 22 bp, synthetic construct
  misc_feature 1..22: note = Synthetic Construct
  source 1..22: mol_type = other DNA
ggacccagcaacaacagcaaga

SEQ ID NO: 36116 - DNA, 22 bp, synthetic construct
  misc_feature 1..22: note = Synthetic Construct
  source 1..22: mol_type = other DNA
agcccttcctccacctcatttg

SEQ ID NO: 36117 - DNA, 22 bp, synthetic construct
  misc_feature 1..22: note = Synthetic Construct
  source 1..22: mol_type = other DNA
tcaggtgtgaaggtgcctctct

SEQ ID NO: 36118 - DNA, 18 bp, synthetic construct
  misc_feature 1..18: note = Synthetic Construct
  source 1..18: mol_type = other DNA
agcggcatccctgtcctt

SEQ ID NO: 36119 - DNA, 20 bp, synthetic construct
  misc_feature 1..20: note = Synthetic Construct
  source 1..20: mol_type = other DNA
acctctgtgccaggtcagtt

SEQ ID NO: 36120 - DNA, 23 bp, synthetic construct
  misc_feature 1..23: note = Synthetic Construct
  source 1..23: mol_type = other DNA
gggaccgctgagattatgccaat

SEQ ID NO: 36121 - DNA, 26 bp, synthetic construct
  misc_feature 1..26: note = Synthetic Construct
  source 1..26: mol_type = other DNA
cgtagaccttctcagatgccactact

SEQ ID NO: 36122 - DNA, 20 bp, synthetic construct
  misc_feature 1..20: note = Synthetic Construct
  source 1..20: mol_type = other DNA
cccatgagttggccgtgttt

SEQ ID NO: 36123 - DNA, 18 bp, synthetic construct
  misc_feature 1..18: note = Synthetic Construct
  source 1..18: mol_type = other DNA
aggtcctgccgaggtcat

SEQ ID NO: 36124 - DNA, 21 bp, synthetic construct
  misc_feature 1..21: note = Synthetic Construct
  source 1..21: mol_type = other DNA
ggtgtgacttaggcccactgt

SEQ ID NO: 36125 - DNA, 22 bp, synthetic construct
  misc_feature 1..22: note = Synthetic Construct
  source 1..22: mol_type = other DNA
gctctaccctcctgtccctcaa

SEQ ID NO: 36126 - DNA, 22 bp, synthetic construct
  misc_feature 1..22: note = Synthetic Construct
  source 1..22: mol_type = other DNA
cagagccaggccttctcttaaa

SEQ ID NO: 36127 - DNA, 18 bp, synthetic construct
  misc_feature 1..18: note = Synthetic Construct
  source 1..18: mol_type = other DNA
aggaatgcggggcactca

SEQ ID NO: 36128 - DNA, 25 bp, synthetic construct
  misc_feature 1..25: note = Synthetic Construct
  source 1..25: mol_type = other DNA
ctatctgaggcaaacagaccctatc

SEQ ID NO: 36129 - DNA, 20 bp, synthetic construct
  misc_feature 1..20: note = Synthetic Construct
  source 1..20: mol_type = other DNA
tgcctcctcacagcctcctt

SEQ ID NO: 36130 - DNA, 22 bp, synthetic construct
  misc_feature 1..22: note = Synthetic Construct
  source 1..22: mol_type = other DNA
gggtgctcgagattccaccata

SEQ ID NO: 36131 - DNA, 22 bp, synthetic construct
  misc_feature 1..22: note = Synthetic Construct
  source 1..22: mol_type = other DNA
tttcctgaaacacaggcagaca

SEQ ID NO: 36132 - DNA, 20 bp, synthetic construct
  misc_feature 1..20: note = Synthetic Construct
  source 1..20: mol_type = other DNA
gcccacaaagggtggtgaaa

SEQ ID NO: 36133 - DNA, 20 bp, synthetic construct
  misc_feature 1..20: note = Synthetic Construct
  source 1..20: mol_type = other DNA
gcttgcttgcttgcttgctt

SEQ ID NO: 36134 - DNA, 22 bp, synthetic construct
  misc_feature 1..22: note = Synthetic Construct
  source 1..22: mol_type = other DNA
gctaggcaaaggcttgtagctt

SEQ ID NO: 36135 - DNA, 23 bp, synthetic construct
  misc_feature 1..23: note = Synthetic Construct
  source 1..23: mol_type = other DNA
ggatgacttggtcaccctgttct

SEQ ID NO: 36136 - DNA, 24 bp, synthetic construct
  misc_feature 1..24: note = Synthetic Construct
  source 1..24: mol_type = other DNA
gagagtttcaccctgtctgtctca

SEQ ID NO: 36137 - DNA, 21 bp, synthetic construct
  misc_feature 1..21: note = Synthetic Construct
  source 1..21: mol_type = other DNA
cccacaaaggccatgggacat

SEQ ID NO: 36138 - DNA, 21 bp, synthetic construct
  misc_feature 1..21: note = Synthetic Construct
  source 1..21: mol_type = other DNA
tcggccaagaacagggaaatc

SEQ ID NO: 36139 - DNA, 19 bp, synthetic construct
  misc_feature 1..19: note = Synthetic Construct
  source 1..19: mol_type = other DNA
aggacaggtgaccgtgagt

SEQ ID NO: 36140 - DNA, 22 bp, synthetic construct
  misc_feature 1..22: note = Synthetic Construct
  source 1..22: mol_type = other DNA
cctgcaggcagggagatttatt

SEQ ID NO: 36141 - DNA, 20 bp, synthetic construct
  misc_feature 1..20: note = Synthetic Construct
  source 1..20: mol_type = other DNA
tgtgcttcggggaggtgata

SEQ ID NO: 36142 - DNA, 20 bp, synthetic construct
  misc_feature 1..20: note = Synthetic Construct
  source 1..20: mol_type = other DNA
cagggatgtgcatggcaact

SEQ ID NO: 36143 - DNA, 23 bp, synthetic construct
  misc_feature 1..23: note = Synthetic Construct
  source 1..23: mol_type = other DNA
gagcagcttccatcgttttctgt

SEQ ID NO: 36144 - DNA, 23 bp, synthetic construct
  misc_feature 1..23: note = Synthetic Construct
  source 1..23: mol_type = other DNA
cagagatccaactgtccccattg

SEQ ID NO: 36145 - DNA, 23 bp, synthetic construct
  misc_feature 1..23: note = Synthetic Construct
  source 1..23: mol_type = other DNA
cctggagagcttggtgtttggat

SEQ ID NO: 36146 - DNA, 24 bp, synthetic construct
  misc_feature 1..24: note = Synthetic Construct
  source 1..24: mol_type = other DNA
gagcaacattgcattccagtgtga

SEQ ID NO: 36147 - DNA, 18 bp, synthetic construct
  misc_feature 1..18: note = Synthetic Construct
  source 1..18: mol_type = other DNA
agctcccctggcccaaat

SEQ ID NO: 36148 - DNA, 25 bp, synthetic construct
  misc_feature 1..25: note = Synthetic Construct
  source 1..25: mol_type = other DNA
ggcttatattcccttcatggtgcta

SEQ ID NO: 36149 - DNA, 22 bp, synthetic construct
  misc_feature 1..22: note = Synthetic Construct
  source 1..22: mol_type = other DNA
gaggggcagataaggacagagt

SEQ ID NO: 36150 - DNA, 22 bp, synthetic construct
  misc_feature 1..22: note = Synthetic Construct
  source 1..22: mol_type = other DNA
caggcaggggtgtgttgttact

SEQ ID NO: 36151 - DNA, 27 bp, synthetic construct
  misc_feature 1..27: note = Synthetic Construct
  source 1..27: mol_type = other DNA
tccccatcctagattttctacttcttg

SEQ ID NO: 36152 - DNA, 22 bp, synthetic construct
  misc_feature 1..22: note = Synthetic Construct
  source 1..22: mol_type = other DNA
aatgtagtgtgagcgagcaaga

SEQ ID NO: 36153 - DNA, 23 bp, synthetic construct
  misc_feature 1..23: note = Synthetic Construct
  source 1..23: mol_type = other DNA
ggagaacgtgatgccctatttct

SEQ ID NO: 36154 - DNA, 20 bp, synthetic construct
  misc_feature 1..20: note = Synthetic Construct
  source 1..20: mol_type = other DNA
tgtggaaagaggggccaaga

SEQ ID NO: 36155 - DNA, 22 bp, synthetic construct
  misc_feature 1..22: note = Synthetic Construct
  source 1..22: mol_type = other DNA
tgtctgaagccagtaggctttg

SEQ ID NO: 36156 - DNA, 25 bp, synthetic construct
  misc_feature 1..25: note = Synthetic Construct
  source 1..25: mol_type = other DNA
caacatgaatcagatgcggtcattc

SEQ ID NO: 36157 - DNA, 25 bp, synthetic construct
  misc_feature 1..25: note = Synthetic Construct
  source 1..25: mol_type = other DNA
ggaaacatctccctttcctccttga

SEQ ID NO: 36158 - DNA, 21 bp, synthetic construct
  misc_feature 1..21: note = Synthetic Construct
  source 1..21: mol_type = other DNA
ttggtttcccctgggctcctt

SEQ ID NO: 36159 - DNA, 21 bp, synthetic construct
  misc_feature 1..21: note = Synthetic Construct
  source 1..21: mol_type = other DNA
tcagcacccggggtattctca

SEQ ID NO: 36160 - DNA, 20 bp, synthetic construct
  misc_feature 1..20: note = Synthetic Construct
  source 1..20: mol_type = other DNA
gcacaggcaagagcaagagt

SEQ ID NO: 36161 - DNA, 25 bp, synthetic construct
  misc_feature 1..25: note = Synthetic Construct
  source 1..25: mol_type = other DNA
cttcacattaaattgtgggctcctt

SEQ ID NO: 36162 - DNA, 23 bp, synthetic construct
  misc_feature 1..23: note = Synthetic Construct
  source 1..23: mol_type = other DNA
gtgggagttggattcttcctgtt

SEQ ID NO: 36163 - DNA, 23 bp, synthetic construct
  misc_feature 1..23: note = Synthetic Construct
  source 1..23: mol_type = other DNA
gggcagtatgtacaaggatgtgt

SEQ ID NO: 36164 - DNA, 25 bp, synthetic construct
  misc_feature 1..25: note = Synthetic Construct
  source 1..25: mol_type = other DNA
acacaatctcttctcgatccacttt

SEQ ID NO: 36165 - DNA, 22 bp, synthetic construct
  misc_feature 1..22: note = Synthetic Construct
  source 1..22: mol_type = other DNA
ggcagcacagagtggttgttac

SEQ ID NO: 36166 - DNA, 24 bp, synthetic construct
  misc_feature 1..24: note = Synthetic Construct
  source 1..24: mol_type = other DNA
ctggcaacatatcactgagcaagt

SEQ ID NO: 36167 - DNA, 20 bp, synthetic construct
  misc_feature 1..20: note = Synthetic Construct
  source 1..20: mol_type = other DNA
cgggtggggaaacaggctta

SEQ ID NO: 36168 - DNA, 22 bp, synthetic construct
  misc_feature 1..22: note = Synthetic Construct
  source 1..22: mol_type = other DNA
tcgggctttggagtctgtctga

SEQ ID NO: 36169 - DNA, 21 bp, synthetic construct
  misc_feature 1..21: note = Synthetic Construct
  source 1..21: mol_type = other DNA
tgcagatcacacgaccaggta

SEQ ID NO: 36170 - DNA, 20 bp, synthetic construct
  misc_feature 1..20: note = Synthetic Construct
  source 1..20: mol_type = other DNA
ccgtcccaaactgcttgttg

SEQ ID NO: 36171 - DNA, 18 bp, synthetic construct
  misc_feature 1..18: note = Synthetic Construct
  source 1..18: mol_type = other DNA
atccggcctgcaggtaca

SEQ ID NO: 36172 - DNA, 26 bp, synthetic construct
  misc_feature 1..26: note = Synthetic Construct
  source 1..26: mol_type = other DNA
aggatggagctatcagtatcatcaga

SEQ ID NO: 36173 - DNA, 26 bp, synthetic construct
  misc_feature 1..26: note = Synthetic Construct
  source 1..26: mol_type = other DNA
ggacaaaggtaggtgagaaccactct

SEQ ID NO: 36174 - DNA, 24 bp, synthetic construct
  misc_feature 1..24: note = Synthetic Construct
  source 1..24: mol_type = other DNA
gggtgaattctgaatggtgctgaa

SEQ ID NO: 36175 - DNA, 20 bp, synthetic construct
  misc_feature 1..20: note = Synthetic Construct
  source 1..20: mol_type = other DNA
tcgagtccggctcccactca

SEQ ID NO: 36176 - DNA, 22 bp, synthetic construct
  misc_feature 1..22: note = Synthetic Construct
  source 1..22: mol_type = other DNA
ggcaggactggtccttgaaaag

SEQ ID NO: 36177 - DNA, 23 bp, synthetic construct
  misc_feature 1..23: note = Synthetic Construct
  source 1..23: mol_type = other DNA
cctcactctcacctcccaaccta

SEQ ID NO: 36178 - DNA, 24 bp, synthetic construct
  misc_feature 1..24: note = Synthetic Construct
  source 1..24: mol_type = other DNA
atgcccatgtttgaagtacagaga

SEQ ID NO: 36179 - DNA, 22 bp, synthetic construct
  misc_feature 1..22: note = Synthetic Construct
  source 1..22: mol_type = other DNA
tccctcctgccaggtctttatg

SEQ ID NO: 36180 - DNA, 23 bp, synthetic construct
  misc_feature 1..23: note = Synthetic Construct
  source 1..23: mol_type = other DNA
cccctgcagattcacaggacttt

SEQ ID NO: 36181 - DNA, 22 bp, synthetic construct
  misc_feature 1..22: note = Synthetic Construct
  source 1..22: mol_type = other DNA
agccctgcctttctcttacaac

SEQ ID NO: 36182 - DNA, 19 bp, synthetic construct
  misc_feature 1..19: note = Synthetic Construct
  source 1..19: mol_type = other DNA
ttgtcccactgcggggtta

SEQ ID NO: 36183 - DNA, 26 bp, synthetic construct
  misc_feature 1..26: note = Synthetic Construct
  source 1..26: mol_type = other DNA
accactcaagactatagacctacaca

SEQ ID NO: 36184 - DNA, 22 bp, synthetic construct
  misc_feature 1..22: note = Synthetic Construct
  source 1..22: mol_type = other DNA
gcagtgtaacaaagtgccaact

SEQ ID NO: 36185 - DNA, 22 bp, synthetic construct
  misc_feature 1..22: note = Synthetic Construct
  source 1..22: mol_type = other DNA
ccagttcctgttgccactcttc

SEQ ID NO: 36186 - DNA, 19 bp, synthetic construct
  misc_feature 1..19: note = Synthetic Construct
  source 1..19: mol_type = other DNA
ctggctggagctcccctaa

SEQ ID NO: 36187 - DNA, 21 bp, synthetic construct
  misc_feature 1..21: note = Synthetic Construct
  source 1..21: mol_type = other DNA
tagtgtgctggctgggaggat

SEQ ID NO: 36188 - DNA, 20 bp, synthetic construct
  misc_feature 1..20: note = Synthetic Construct
  source 1..20: mol_type = other DNA
aagctgcctcccctctcatt

SEQ ID NO: 36189 - DNA, 25 bp, synthetic construct
  misc_feature 1..25: note = Synthetic Construct
  source 1..25: mol_type = other DNA
ctgtgctcatgaatttgtcttccaa

SEQ ID NO: 36190 - DNA, 24 bp, synthetic construct
  misc_feature 1..24: note = Synthetic Construct
  source 1..24: mol_type = other DNA
gggagaacctaggctatggagtca

SEQ ID NO: 36191 - DNA, 25 bp, synthetic construct
  misc_feature 1..25: note = Synthetic Construct
  source 1..25: mol_type = other DNA
cactccatactggctcaaagacatt

SEQ ID NO: 36192 - DNA, 23 bp, synthetic construct
  misc_feature 1..23: note = Synthetic Construct
  source 1..23: mol_type = other DNA
ggctggtgaagtctgaggtcttg

SEQ ID NO: 36193 - DNA, 26 bp, synthetic construct
  misc_feature 1..26: note = Synthetic Construct
  source 1..26: mol_type = other DNA
gatcacagaaccaggaaaaggaaaac

SEQ ID NO: 36194 - DNA, 20 bp, synthetic construct
  misc_feature 1..20: note = Synthetic Construct
  source 1..20: mol_type = other DNA
gccctgtgggtggccataaa

SEQ ID NO: 36195 - DNA, 27 bp, synthetic construct
  misc_feature 1..27: note = Synthetic Construct
  source 1..27: mol_type = other DNA
ccacaaacaaagcgggctaaaatcctt

SEQ ID NO: 36196 - DNA, 24 bp, synthetic construct
  misc_feature 1..24: note = Synthetic Construct
  source 1..24: mol_type = other DNA
cagggtcatgtctcatgcacaaag

SEQ ID NO: 36197 - DNA, 24 bp, synthetic construct
  misc_feature 1..24: note = Synthetic Construct
  source 1..24: mol_type = other DNA
gcgagacctgattacagggagtgt

SEQ ID NO: 36198 - DNA, 26 bp, synthetic construct
  misc_feature 1..26: note = Synthetic Construct
  source 1..26: mol_type = other DNA
gtctagttgatctccaagaccctttc

SEQ ID NO: 36199 - DNA, 19 bp, synthetic construct
  misc_feature 1..19: note = Synthetic Construct
  source 1..19: mol_type = other DNA
aattgcgctgggcagtagt

SEQ ID NO: 36200 - DNA, 21 bp, synthetic construct
  misc_feature 1..21: note = Synthetic Construct
  source 1..21: mol_type = other DNA
ggcagtgcaatgtctgtctgt

SEQ ID NO: 36201 - DNA, 19 bp, synthetic construct
  misc_feature 1..19: note = Synthetic Construct
  source 1..19: mol_type = other DNA
tgaggggcctgagcctctt

SEQ ID NO: 36202 - DNA, 28 bp, synthetic construct
  misc_feature 1..28: note = Synthetic Construct
  source 1..28: mol_type = other DNA
gcctacataagataagcagtctgacatc

SEQ ID NO: 36203 - DNA, 21 bp, synthetic construct
  misc_feature 1..21: note = Synthetic Construct
  source 1..21: mol_type = other DNA
ggacttccctcaccacagctt

SEQ ID NO: 36204 - DNA, 27 bp, synthetic construct
  misc_feature 1..27: note = Synthetic Construct
  source 1..27: mol_type = other DNA
acaccaaagagatattggaggaagaag

SEQ ID NO: 36205 - DNA, 20 bp, synthetic construct
  misc_feature 1..20: note = Synthetic Construct
  source 1..20: mol_type = other DNA
gctgcccgaaaggattctga

SEQ ID NO: 36206 - DNA, 22 bp, synthetic construct
  misc_feature 1..22: note = Synthetic Construct
  source 1..22: mol_type = other DNA
gcgctcgtaggtcatggctatc

SEQ ID NO: 36207 - DNA, 23 bp, synthetic construct
  misc_feature 1..23: note = Synthetic Construct
  source 1..23: mol_type = other DNA
ggacatcagatctgggccttgaa

SEQ ID NO: 36208 - DNA, 20 bp, synthetic construct
  misc_feature 1..20: note = Synthetic Construct
  source 1..20: mol_type = other DNA
tgggacacctcagctcacaa

SEQ ID NO: 36209 - DNA, 23 bp, synthetic construct
  misc_feature 1..23: note = Synthetic Construct
  source 1..23: mol_type = other DNA
cccttttgtttttccaggtggtt

SEQ ID NO: 36210 - DNA, 19 bp, synthetic construct
  misc_feature 1..19: note = Synthetic Construct
  source 1..19: mol_type = other DNA
tggtgaacgcctgcatcat

SEQ ID NO: 36211 - DNA, 25 bp, synthetic construct
  misc_feature 1..25: note = Synthetic Construct
  source 1..25: mol_type = other DNA
ggtctgtctgatagcaagtttgtgt

SEQ ID NO: 36212 - DNA, 25 bp, synthetic construct
  misc_feature 1..25: note = Synthetic Construct
  source 1..25: mol_type = other DNA
ctgtgtcactgatgaaagggagaga

SEQ ID NO: 36213 - DNA, 22 bp, synthetic construct
  misc_feature 1..22: note = Synthetic Construct
  source 1..22: mol_type = other DNA
gcgtggctgctggttactgtat

SEQ ID NO: 36214 - DNA, 22 bp, synthetic construct
  misc_feature 1..22: note = Synthetic Construct
  source 1..22: mol_type = other DNA
ggattctgggactggcagaaag

SEQ ID NO: 36215 - DNA, 23 bp, synthetic construct
  misc_feature 1..23: note = Synthetic Construct
  source 1..23: mol_type = other DNA
cctgtattctgcagcgttctcaa

SEQ ID NO: 36216 - DNA, 28 bp, synthetic construct
  misc_feature 1..28: note = Synthetic Construct
  source 1..28: mol_type = other DNA
ggctttcccactgtcttaattccagcaa

SEQ ID NO: 36217 - DNA, 23 bp, synthetic construct
  misc_feature 1..23: note = Synthetic Construct
  source 1..23: mol_type = other DNA
catctgccctgagagatgggtat

SEQ ID NO: 36218 - DNA, 20 bp, synthetic construct
  misc_feature 1..20: note = Synthetic Construct
  source 1..20: mol_type = other DNA
tgcgaccctgtgggcagaat

SEQ ID NO: 36219 - DNA, 20 bp, synthetic construct
  misc_feature 1..20: note = Synthetic Construct
  source 1..20: mol_type = other DNA
cacctgatcacagcgggttt

SEQ ID NO: 36220 - DNA, 22 bp, synthetic construct
  misc_feature 1..22: note = Synthetic Construct
  source 1..22: mol_type = other DNA
cgacacagtgggaagaactgaa

SEQ ID NO: 36221 - DNA, 21 bp, synthetic construct
  misc_feature 1..21: note = Synthetic Construct
  source 1..21: mol_type = other DNA
acccaaccccatcgtctcgtt

SEQ ID NO: 36222 - DNA, 23 bp, synthetic construct
  misc_feature 1..23: note = Synthetic Construct
  source 1..23: mol_type = other DNA
tgacaaactgatcctggcacttg

SEQ ID NO: 36223 - DNA, 22 bp, synthetic construct
  misc_feature 1..22: note = Synthetic Construct
  source 1..22: mol_type = other DNA
cctacctgctggtgtcttggtt

SEQ ID NO: 36224 - DNA, 22 bp, synthetic construct
  misc_feature 1..22: note = Synthetic Construct
  source 1..22: mol_type = other DNA
ccccttagggattcctgcacta

SEQ ID NO: 36225 - DNA, 26 bp, synthetic construct
  misc_feature 1..26: note = Synthetic Construct
  source 1..26: mol_type = other DNA
gcccagacaagactcattccatcctt

SEQ ID NO: 36226 - DNA, 19 bp, synthetic construct
  misc_feature 1..19: note = Synthetic Construct
  source 1..19: mol_type = other DNA
tgggcttctggggcaaaaa

SEQ ID NO: 36227 - DNA, 22 bp, synthetic construct
  misc_feature 1..22: note = Synthetic Construct
  source 1..22: mol_type = other DNA
gcaactaaccaccctccagatg

SEQ ID NO: 36228 - DNA, 23 bp, synthetic construct
  misc_feature 1..23: note = Synthetic Construct
  source 1..23: mol_type = other DNA
ggtgggtatctccagaacagctt

SEQ ID NO: 36229 - DNA, 21 bp, synthetic construct
  misc_feature 1..21: note = Synthetic Construct
  source 1..21: mol_type = other DNA
gctggctgaagctcagtggtt

SEQ ID NO: 36230 - DNA, 20 bp, synthetic construct
  misc_feature 1..20: note = Synthetic Construct
  source 1..20: mol_type = other DNA
ggggtttcagcggactgtga

SEQ ID NO: 36231 - DNA, 22 bp, synthetic construct
  misc_feature 1..22: note = Synthetic Construct
  source 1..22: mol_type = other DNA
agcctctgccttgagagacaac

SEQ ID NO: 36232 - DNA, 23 bp, synthetic construct
  misc_feature 1..23: note = Synthetic Construct
  source 1..23: mol_type = other DNA
gctggctgatggactggtagtct

SEQ ID NO: 36233 - DNA, 24 bp, synthetic construct
  misc_feature 1..24: note = Synthetic Construct
  source 1..24: mol_type = other DNA
gggacacactaactgctcaaccaa

SEQ ID NO: 36234 - DNA, 22 bp, synthetic construct
  misc_feature 1..22: note = Synthetic Construct
  source 1..22: mol_type = other DNA
gcaacacacagcctggacattc

SEQ ID NO: 36235 - DNA, 27 bp, synthetic construct
  misc_feature 1..27: note = Synthetic Construct
  source 1..27: mol_type = other DNA
gccatatcttgttcaagggaggctgaa

SEQ ID NO: 36236 - DNA, 24 bp, synthetic construct
  misc_feature 1..24: note = Synthetic Construct
  source 1..24: mol_type = other DNA
gctgacttggaattgttcacttgt

SEQ ID NO: 36237 - DNA, 20 bp, synthetic construct
  misc_feature 1..20: note = Synthetic Construct
  source 1..20: mol_type = other DNA
gcgtccttccccagttgaca

SEQ ID NO: 36238 - DNA, 22 bp, synthetic construct
  misc_feature 1..22: note = Synthetic Construct
  source 1..22: mol_type = other DNA
cagatggcccaacttggtgatg

SEQ ID NO: 36239 - DNA, 21 bp, synthetic construct
  misc_feature 1..21: note = Synthetic Construct
  source 1..21: mol_type = other DNA
aagctggtggtgcctgcttgt

SEQ ID NO: 36240 - DNA, 20 bp, synthetic construct
  misc_feature 1..20: note = Synthetic Construct
  source 1..20: mol_type = other DNA
cgtttaccaacgggcgaaga

SEQ ID NO: 36241 - DNA, 22 bp, synthetic construct
  misc_feature 1..22: note = Synthetic Construct
  source 1..22: mol_type = other DNA
ggaggcaggaagaagtccacat

SEQ ID NO: 36242 - DNA, 25 bp, synthetic construct
  misc_feature 1..25: note = Synthetic Construct
  source 1..25: mol_type = other DNA
cggtgagtttgtctgcgttcctttc

SEQ ID NO: 36243 - DNA, 22 bp, synthetic construct
  misc_feature 1..22: note = Synthetic Construct
  source 1..22: mol_type = other DNA
accagtccctggtgactcagat

SEQ ID NO: 36244 - DNA, 20 bp, synthetic construct
  misc_feature 1..20: note = Synthetic Construct
  source 1..20: mol_type = other DNA
ggtgaggggtgtgtgtggaa

SEQ ID NO: 36245 - DNA, 22 bp, synthetic construct
  misc_feature 1..22: note = Synthetic Construct
  source 1..22: mol_type = other DNA
acccacccagaggaaggagata

SEQ ID NO: 36246 - DNA, 19 bp, synthetic construct
  misc_feature 1..19: note = Synthetic Construct
  source 1..19: mol_type = other DNA
agccatctgccagccttga

SEQ ID NO: 36247 - DNA, 30 bp, synthetic construct
  misc_feature 1..30: note = Synthetic Construct
  source 1..30: mol_type = other DNA
ggcagatattttaatccacctaacctgtca

SEQ ID NO: 36248 - DNA, 23 bp, synthetic construct
  misc_feature 1..23: note = Synthetic Construct
  source 1..23: mol_type = other DNA
tgtataagggctgcgctgattat

SEQ ID NO: 36249 - DNA, 24 bp, synthetic construct
  misc_feature 1..24: note = Synthetic Construct
  source 1..24: mol_type = other DNA
ggtgctttgaagaccgatgagttc

SEQ ID NO: 36250 - DNA, 24 bp, synthetic construct
  misc_feature 1..24: note = Synthetic Construct
  source 1..24: mol_type = other DNA
ctcctatgtcagccacactgatct

SEQ ID NO: 36251 - DNA, 19 bp, synthetic construct
  misc_feature 1..19: note = Synthetic Construct
  source 1..19: mol_type = other DNA
tgacagtgggagcctcgaa

SEQ ID NO: 36252 - DNA, 23 bp, synthetic construct
  misc_feature 1..23: note = Synthetic Construct
  source 1..23: mol_type = other DNA
ccagttgaaggaggagaaaccaa

SEQ ID NO: 36253 - DNA, 24 bp, synthetic construct
  misc_feature 1..24: note = Synthetic Construct
  source 1..24: mol_type = other DNA
gacagacgaggagaagtcaaacat

SEQ ID NO: 36254 - DNA, 22 bp, synthetic construct
  misc_feature 1..22: note = Synthetic Construct
  source 1..22: mol_type = other DNA
gcaggtcaaccttggctcttac

SEQ ID NO: 36255 - DNA, 22 bp, synthetic construct
  misc_feature 1..22: note = Synthetic Construct
  source 1..22: mol_type = other DNA
cagcagggtcattttccagaga

SEQ ID NO: 36256 - DNA, 27 bp, synthetic construct
  misc_feature 1..27: note = Synthetic Construct
  source 1..27: mol_type = other DNA
gggactcaaaaagtgacatcccagttc

SEQ ID NO: 36257 - DNA, 26 bp, synthetic construct
  misc_feature 1..26: note = Synthetic Construct
  source 1..26: mol_type = other DNA
gcatattctcacattccaccctgaac

SEQ ID NO: 36258 - DNA, 22 bp, synthetic construct
  misc_feature 1..22: note = Synthetic Construct
  source 1..22: mol_type = other DNA
ccctcatcgatgccccttcttt

SEQ ID NO: 36259 - DNA, 22 bp, synthetic construct
  misc_feature 1..22: note = Synthetic Construct
  source 1..22: mol_type = other DNA
ccccaggctaagcagtgacaat

SEQ ID NO: 36260 - DNA, 26 bp, synthetic construct
  misc_feature 1..26: note = Synthetic Construct
  source 1..26: mol_type = other DNA
gtgacagggagctattgaatgactga

SEQ ID NO: 36261 - DNA, 22 bp, synthetic construct
  misc_feature 1..22: note = Synthetic Construct
  source 1..22: mol_type = other DNA
gggtagagcatggcaggaagat

SEQ ID NO: 36262 - DNA, 20 bp, synthetic construct
  misc_feature 1..20: note = Synthetic Construct
  source 1..20: mol_type = other DNA
aggtctgggcttcagtggat

SEQ ID NO: 36263 - DNA, 22 bp, synthetic construct
  misc_feature 1..22: note = Synthetic Construct
  source 1..22: mol_type = other DNA
gccattgcctcctccattgttc

SEQ ID NO: 36264 - DNA, 24 bp, synthetic construct
  misc_feature 1..24: note = Synthetic Construct
  source 1..24: mol_type = other DNA
gtctgaatgaccaggcatctgatt

SEQ ID NO: 36265 - DNA, 26 bp, synthetic construct
  misc_feature 1..26: note = Synthetic Construct
  source 1..26: mol_type = other DNA
ctcataactcctgattgcctggaatg

SEQ ID NO: 36266 - DNA, 22 bp, synthetic construct
  misc_feature 1..22: note = Synthetic Construct
  source 1..22: mol_type = other DNA
gcggtaggattggtctgggaat

SEQ ID NO: 36267 - DNA, 25 bp, synthetic construct
  misc_feature 1..25: note = Synthetic Construct
  source 1..25: mol_type = other DNA
cctgaggcataaccagttgatcttg

SEQ ID NO: 36268 - DNA, 20 bp, synthetic construct
  misc_feature 1..20: note = Synthetic Construct
  source 1..20: mol_type = other DNA
tctgtcgctttgggctcttc

SEQ ID NO: 36269 - DNA, 25 bp, synthetic construct
  misc_feature 1..25: note = Synthetic Construct
  source 1..25: mol_type = other DNA
cagactgtaaagtgaaacccctgtt

SEQ ID NO: 36270 - DNA, 22 bp, synthetic construct
  misc_feature 1..22: note = Synthetic Construct
  source 1..22: mol_type = other DNA
tgggccataagaggctggtcta

SEQ ID NO: 36271 - DNA, 26 bp, synthetic construct
  misc_feature 1..26: note = Synthetic Construct
  source 1..26: mol_type = other DNA
ctctgtcaatttggggctaaagtcat

SEQ ID NO: 36272 - DNA, 20 bp, synthetic construct
  misc_feature 1..20: note = Synthetic Construct
  source 1..20: mol_type = other DNA
tggctcctctgccccattga

SEQ ID NO: 36273 - DNA, 20 bp, synthetic construct
  misc_feature 1..20: note = Synthetic Construct
  source 1..20: mol_type = other DNA
tgtggcaggggacaccttct

SEQ ID NO: 36274 - DNA, 20 bp, synthetic construct
  misc_feature 1..20: note = Synthetic Construct
  source 1..20: mol_type = other DNA
gtggtggcggagacacaaaa

SEQ ID NO: 36275 - DNA, 26 bp, synthetic construct
  misc_feature 1..26: note = Synthetic Construct
  source 1..26: mol_type = other DNA
tctcctcttctttgagctagcagtat

SEQ ID NO: 36276 - DNA, 21 bp, synthetic construct
  misc_feature 1..21: note = Synthetic Construct
  source 1..21: mol_type = other DNA
tgtgtacctggagggcacaag

SEQ ID NO: 36277 - DNA, 20 bp, synthetic construct
  misc_feature 1..20: note = Synthetic Construct
  source 1..20: mol_type = other DNA
gctggatggccacattgaac

SEQ ID NO: 36278 - DNA, 21 bp, synthetic construct
  misc_feature 1..21: note = Synthetic Construct
  source 1..21: mol_type = other DNA
cacctggcctgaggagagaat

SEQ ID NO: 36279 - DNA, 22 bp, synthetic construct
  misc_feature 1..22: note = Synthetic Construct
  source 1..22: mol_type = other DNA
ccacgagttaggggagactttg

SEQ ID NO: 36280 - DNA, 23 bp, synthetic construct
  misc_feature 1..23: note = Synthetic Construct
  source 1..23: mol_type = other DNA
ctggaaaaatgcccgggaacaag

SEQ ID NO: 36281 - DNA, 20 bp, synthetic construct
  misc_feature 1..20: note = Synthetic Construct
  source 1..20: mol_type = other DNA
caactctggctgctcggtaa

SEQ ID NO: 36282 - DNA, 26 bp, synthetic construct
  misc_feature 1..26: note = Synthetic Construct
  source 1..26: mol_type = other DNA
cccaataaaatggcctctgaaacctt

SEQ ID NO: 36283 - DNA, 22 bp, synthetic construct
  misc_feature 1..22: note = Synthetic Construct
  source 1..22: mol_type = other DNA
cctaccagccacaattccttct

SEQ ID NO: 36284 - DNA, 26 bp, synthetic construct
  misc_feature 1..26: note = Synthetic Construct
  source 1..26: mol_type = other DNA
gctaaattgatttccttgccctccaa

SEQ ID NO: 36285 - DNA, 22 bp, synthetic construct
  misc_feature 1..22: note = Synthetic Construct
  source 1..22: mol_type = other DNA
gcctccctgctacttgagcaaa

SEQ ID NO: 36286 - DNA, 27 bp, synthetic construct
  misc_feature 1..27: note = Synthetic Construct
  source 1..27: mol_type = other DNA
ggggtagttggtgtagacagaaacctt

SEQ ID NO: 36287 - DNA, 20 bp, synthetic construct
  misc_feature 1..20: note = Synthetic Construct
  source 1..20: mol_type = other DNA
tctgactgcctgaggtggaa

SEQ ID NO: 36288 - DNA, 22 bp, synthetic construct
  misc_feature 1..22: note = Synthetic Construct
  source 1..22: mol_type = other DNA
cctatccttgggcctggatttg

SEQ ID NO: 36289 - DNA, 20 bp, synthetic construct
  misc_feature 1..20: note = Synthetic Construct
  source 1..20: mol_type = other DNA
tccaccctgggctcctctgt

SEQ ID NO: 36290 - DNA, 21 bp, synthetic construct
  misc_feature 1..21: note = Synthetic Construct
  source 1..21: mol_type = other DNA
agggaggagagaacgtggatt

SEQ ID NO: 36291 - DNA, 25 bp, synthetic construct
  misc_feature 1..25: note = Synthetic Construct
  source 1..25: mol_type = other DNA
caaactggatttgactagcccatct

SEQ ID NO: 36292 - DNA, 24 bp, synthetic construct
  misc_feature 1..24: note = Synthetic Construct
  source 1..24: mol_type = other DNA
atgggactacctggctatagtctt

SEQ ID NO: 36293 - DNA, 22 bp, synthetic construct
  misc_feature 1..22: note = Synthetic Construct
  source 1..22: mol_type = other DNA
ggacacagtctgacccaaggaa

SEQ ID NO: 36294 - DNA, 20 bp, synthetic construct
  misc_feature 1..20: note = Synthetic Construct
  source 1..20: mol_type = other DNA
gtctggacaggagggcttca

SEQ ID NO: 36295 - DNA, 20 bp, synthetic construct
  misc_feature 1..20: note = Synthetic Construct
  source 1..20: mol_type = other DNA
tgggaagggtctcccaaaga

SEQ ID NO: 36296 - DNA, 22 bp, synthetic construct
  misc_feature 1..22: note = Synthetic Construct
  source 1..22: mol_type = other DNA
tctggaggtagggtggatgatg

SEQ ID NO: 36297 - DNA, 20 bp, synthetic construct
  misc_feature 1..20: note = Synthetic Construct
  source 1..20: mol_type = other DNA
agccaagcatggggtagtga

SEQ ID NO: 36298 - DNA, 30 bp, synthetic construct
  misc_feature 1..30: note = Synthetic Construct
  source 1..30: mol_type = other DNA
ccacttcccttcagtataaatcccacaatc

SEQ ID NO: 36299 - DNA, 26 bp, synthetic construct
  misc_feature 1..26: note = Synthetic Construct
  source 1..26: mol_type = other DNA
cctgaaacaggctttaacagggaact

SEQ ID NO: 36300 - DNA, 20 bp, synthetic construct
  misc_feature 1..20: note = Synthetic Construct
  source 1..20: mol_type = other DNA
tggagccctgacctgcttag

SEQ ID NO: 36301 - DNA, 23 bp, synthetic construct
  misc_feature 1..23: note = Synthetic Construct
  source 1..23: mol_type = other DNA
ggtctgggagccagtgtaacttc

SEQ ID NO: 36302 - DNA, 20 bp, synthetic construct
  misc_feature 1..20: note = Synthetic Construct
  source 1..20: mol_type = other DNA
tgtgcatccagagccccatt

SEQ ID NO: 36303 - DNA, 20 bp, synthetic construct
  misc_feature 1..20: note = Synthetic Construct
  source 1..20: mol_type = other DNA
tccaggaggtgcagacacaa

SEQ ID NO: 36304 - DNA, 23 bp, synthetic construct
  misc_feature 1..23: note = Synthetic Construct
  source 1..23: mol_type = other DNA
tgcaaagcttagtacctggcata

SEQ ID NO: 36305 - DNA, 23 bp, synthetic construct
  misc_feature 1..23: note = Synthetic Construct
  source 1..23: mol_type = other DNA
ggagcgcatttaaggggtttttg

SEQ ID NO: 36306 - DNA, 20 bp, synthetic construct
  misc_feature 1..20: note = Synthetic Construct
  source 1..20: mol_type = other DNA
atgcctttcccgtcgctgaa

SEQ ID NO: 36307 - DNA, 20 bp, synthetic construct
  misc_feature 1..20: note = Synthetic Construct
  source 1..20: mol_type = other DNA
ttcacttcccaggggctctt

SEQ ID NO: 36308 - DNA, 22 bp, synthetic construct
  misc_feature 1..22: note = Synthetic Construct
  source 1..22: mol_type = other DNA
tgctgactcaggggtggatctt

SEQ ID NO: 36309 - DNA, 20 bp, synthetic construct
  misc_feature 1..20: note = Synthetic Construct
  source 1..20: mol_type = other DNA
tgacgagatgccagcacaca

SEQ ID NO: 36310 - DNA, 22 bp, synthetic construct
  misc_feature 1..22: note = Synthetic Construct
  source 1..22: mol_type = other DNA
ggccctgtttgccacagaaaag

SEQ ID NO: 36311 - DNA, 24 bp, synthetic construct
  misc_feature 1..24: note = Synthetic Construct
  source 1..24: mol_type = other DNA
gaacagcttcattgagtggtttgt

SEQ ID NO: 36312 - DNA, 23 bp, synthetic construct
  misc_feature 1..23: note = Synthetic Construct
  source 1..23: mol_type = other DNA
atgttaccaatccctcctgcaaa

SEQ ID NO: 36313 - DNA, 22 bp, synthetic construct
  misc_feature 1..22: note = Synthetic Construct
  source 1..22: mol_type = other DNA
catacccgagtgaggcagtatc

SEQ ID NO: 36314 - DNA, 23 bp, synthetic construct
  misc_feature 1..23: note = Synthetic Construct
  source 1..23: mol_type = other DNA
gacctcgctagtctaacccaaac

SEQ ID NO: 36315 - DNA, 27 bp, synthetic construct
  misc_feature 1..27: note = Synthetic Construct
  source 1..27: mol_type = other DNA
gctgaaaaagatggagagttccactca

SEQ ID NO: 36316 - DNA, 20 bp, synthetic construct
  misc_feature 1..20: note = Synthetic Construct
  source 1..20: mol_type = other DNA
gcctcccaaagtgcgtgaac

SEQ ID NO: 36317 - DNA, 22 bp, synthetic construct
  misc_feature 1..22: note = Synthetic Construct
  source 1..22: mol_type = other DNA
tctcactaatgcccctcactgt

SEQ ID NO: 36318 - DNA, 28 bp, synthetic construct
  misc_feature 1..28: note = Synthetic Construct
  source 1..28: mol_type = other DNA
cagagaagggaaagccagtaaatagtgt

SEQ ID NO: 36319 - DNA, 21 bp, synthetic construct
  misc_feature 1..21: note = Synthetic Construct
  source 1..21: mol_type = other DNA
agtgatgcgggtgtccactct

SEQ ID NO: 36320 - DNA, 21 bp, synthetic construct
  misc_feature 1..21: note = Synthetic Construct
  source 1..21: mol_type = other DNA
agaggcgtctccaggactctt

SEQ ID NO: 36321 - DNA, 24 bp, synthetic construct
  misc_feature 1..24: note = Synthetic Construct
  source 1..24: mol_type = other DNA
gtcataaggggctattccgtcagt

SEQ ID NO: 36322 - DNA, 21 bp, synthetic construct
  misc_feature 1..21: note = Synthetic Construct
  source 1..21: mol_type = other DNA
tcaaagctccgggctgtttag

SEQ ID NO: 36323 - DNA, 20 bp, synthetic construct
  misc_feature 1..20: note = Synthetic Construct
  source 1..20: mol_type = other DNA
ggaccgtgaaggcacacaga

SEQ ID NO: 36324 - DNA, 20 bp, synthetic construct
  misc_feature 1..20: note = Synthetic Construct
  source 1..20: mol_type = other DNA
tcccattgcggcagacatca

SEQ ID NO: 36325 - DNA, 21 bp, synthetic construct
  misc_feature 1..21: note = Synthetic Construct
  source 1..21: mol_type = other DNA
aacctgcctgaagcaagacat

SEQ ID NO: 36326 - DNA, 20 bp, synthetic construct
  misc_feature 1..20: note = Synthetic Construct
  source 1..20: mol_type = other DNA
accctggcagtcttgctctt

SEQ ID NO: 36327 - DNA, 20 bp, synthetic construct
  misc_feature 1..20: note = Synthetic Construct
  source 1..20: mol_type = other DNA
ccaggcatgggaaggagaca

SEQ ID NO: 36328 - DNA, 22 bp, synthetic construct
  misc_feature 1..22: note = Synthetic Construct
  source 1..22: mol_type = other DNA
caagtcaagtttgggcccttgt

SEQ ID NO: 36329 - DNA, 29 bp, synthetic construct
  misc_feature 1..29: note = Synthetic Construct
  source 1..29: mol_type = other DNA
cctcatatcaaagtagggtcgatttcatc

SEQ ID NO: 36330 - DNA, 23 bp, synthetic construct
  misc_feature 1..23: note = Synthetic Construct
  source 1..23: mol_type = other DNA
ccacccatctatcccatgcatct

SEQ ID NO: 36331 - DNA, 19 bp, synthetic construct
  misc_feature 1..19: note = Synthetic Construct
  source 1..19: mol_type = other DNA
ttccgccgcccagattgtt

SEQ ID NO: 36332 - DNA, 22 bp, synthetic construct
  misc_feature 1..22: note = Synthetic Construct
  source 1..22: mol_type = other DNA
ggagaatagtccctgccctcaa

SEQ ID NO: 36333 - DNA, 23 bp, synthetic construct
  misc_feature 1..23: note = Synthetic Construct
  source 1..23: mol_type = other DNA
gacttcatgtgatgggtgcattc

SEQ ID NO: 36334 - DNA, 22 bp, synthetic construct
  misc_feature 1..22: note = Synthetic Construct
  source 1..22: mol_type = other DNA
gtcccagctccattccagtaga

SEQ ID NO: 36335 - DNA, 25 bp, synthetic construct
  misc_feature 1..25: note = Synthetic Construct
  source 1..25: mol_type = other DNA
aaagcagtagttcagagtgcctatt

SEQ ID NO: 36336 - DNA, 22 bp, synthetic construct
  misc_feature 1..22: note = Synthetic Construct
  source 1..22: mol_type = other DNA
gtggcaagtcagcccttgtaga

SEQ ID NO: 36337 - DNA, 19 bp, synthetic construct
  misc_feature 1..19: note = Synthetic Construct
  source 1..19: mol_type = other DNA
tacggaggccaagggttca

SEQ ID NO: 36338 - DNA, 22 bp, synthetic construct
  misc_feature 1..22: note = Synthetic Construct
  source 1..22: mol_type = other DNA
tcgtaaaggggcctggacctaa

SEQ ID NO: 36339 - DNA, 24 bp, synthetic construct
  misc_feature 1..24: note = Synthetic Construct
  source 1..24: mol_type = other DNA
ccacctagacttggggcatgatga

SEQ ID NO: 36340 - DNA, 19 bp, synthetic construct
  misc_feature 1..19: note = Synthetic Construct
  source 1..19: mol_type = other DNA
agcctgcagaccccaccaa

SEQ ID NO: 36341 - DNA, 24 bp, synthetic construct
  misc_feature 1..24: note = Synthetic Construct
  source 1..24: mol_type = other DNA
agaacaatttaccgacagccatct

SEQ ID NO: 36342 - DNA, 20 bp, synthetic construct
  misc_feature 1..20: note = Synthetic Construct
  source 1..20: mol_type = other DNA
ggctgcagatggccaggtaa

SEQ ID NO: 36343 - DNA, 19 bp, synthetic construct
  misc_feature 1..19: note = Synthetic Construct
  source 1..19: mol_type = other DNA
tcagggtggctcgggtttg

SEQ ID NO: 36344 - DNA, 22 bp, synthetic construct
  misc_feature 1..22: note = Synthetic Construct
  source 1..22: mol_type = other DNA
cagtcagttcacccctggaaac

SEQ ID NO: 36345 - DNA, 21 bp, synthetic construct
  misc_feature 1..21: note = Synthetic Construct
  source 1..21: mol_type = other DNA
tctgcctgctctgtggaggat

SEQ ID NO: 36346 - DNA, 22 bp, synthetic construct
  misc_feature 1..22: note = Synthetic Construct
  source 1..22: mol_type = other DNA
tcctactgtatgccaggtgcta

SEQ ID NO: 36347 - DNA, 24 bp, synthetic construct
  misc_feature 1..24: note = Synthetic Construct
  source 1..24: mol_type = other DNA
gcagatgtacagtgtttgccactt

SEQ ID NO: 36348 - DNA, 24 bp, synthetic construct
  misc_feature 1..24: note = Synthetic Construct
  source 1..24: mol_type = other DNA
cagttgtaagaggccaagcctaga

SEQ ID NO: 36349 - DNA, 21 bp, synthetic construct
  misc_feature 1..21: note = Synthetic Construct
  source 1..21: mol_type = other DNA
agaggacaggagaccggagaa

SEQ ID NO: 36350 - DNA, 19 bp, synthetic construct
  misc_feature 1..19: note = Synthetic Construct
  source 1..19: mol_type = other DNA
cgggctgcccctcacaaaa

SEQ ID NO: 36351 - DNA, 26 bp, synthetic construct
  misc_feature 1..26: note = Synthetic Construct
  source 1..26: mol_type = other DNA
ggtgatgtctttaatccctcccttag

SEQ ID NO: 36352 - DNA, 23 bp, synthetic construct
  misc_feature 1..23: note = Synthetic Construct
  source 1..23: mol_type = other DNA
gggctataccaatcccagcctat

SEQ ID NO: 36353 - DNA, 21 bp, synthetic construct
  misc_feature 1..21: note = Synthetic Construct
  source 1..21: mol_type = other DNA
ggggctccctggccttaaaaa

SEQ ID NO: 36354 - DNA, 26 bp, synthetic construct
  misc_feature 1..26: note = Synthetic Construct
  source 1..26: mol_type = other DNA
ggaatacaatctgggacaaggacatc

SEQ ID NO: 36355 - DNA, 27 bp, synthetic construct
  misc_feature 1..27: note = Synthetic Construct
  source 1..27: mol_type = other DNA
cccagctaaagtgatacacccttcttg

SEQ ID NO: 36356 - DNA, 21 bp, synthetic construct
  misc_feature 1..21: note = Synthetic Construct
  source 1..21: mol_type = other DNA
agtagctgcatttgccaccat

SEQ ID NO: 36357 - DNA, 24 bp, synthetic construct
  misc_feature 1..24: note = Synthetic Construct
  source 1..24: mol_type = other DNA
ggatgctgggtgttattccagtgt

SEQ ID NO: 36358 - DNA, 25 bp, synthetic construct
  misc_feature 1..25: note = Synthetic Construct
  source 1..25: mol_type = other DNA
gctccccactattatttcccagtta

SEQ ID NO: 36359 - DNA, 24 bp, synthetic construct
  misc_feature 1..24: note = Synthetic Construct
  source 1..24: mol_type = other DNA
gacacactacttcagaagcacctt

SEQ ID NO: 36360 - DNA, 24 bp, synthetic construct
  misc_feature 1..24: note = Synthetic Construct
  source 1..24: mol_type = other DNA
gggagtcccttagtccatgggaaa

SEQ ID NO: 36361 - DNA, 23 bp, synthetic construct
  misc_feature 1..23: note = Synthetic Construct
  source 1..23: mol_type = other DNA
cccaccaatagaagagcctgaac

SEQ ID NO: 36362 - DNA, 20 bp, synthetic construct
  misc_feature 1..20: note = Synthetic Construct
  source 1..20: mol_type = other DNA
tgcctccgccagctaaaaca

SEQ ID NO: 36363 - DNA, 20 bp, synthetic construct
  misc_feature 1..20: note = Synthetic Construct
  source 1..20: mol_type = other DNA
acctaacaccccagcagaca

SEQ ID NO: 36364 - DNA, 21 bp, synthetic construct
  misc_feature 1..21: note = Synthetic Construct
  source 1..21: mol_type = other DNA
gggctaaatgtaggcccagtt

SEQ ID NO: 36365 - DNA, 19 bp, synthetic construct
  misc_feature 1..19: note = Synthetic Construct
  source 1..19: mol_type = other DNA
cccagccatcacccaccat

SEQ ID NO: 36366 - DNA, 20 bp, synthetic construct
  misc_feature 1..20: note = Synthetic Construct
  source 1..20: mol_type = other DNA
ccaaagcccaacctggcaat

SEQ ID NO: 36367 - DNA, 20 bp, synthetic construct
  misc_feature 1..20: note = Synthetic Construct
  source 1..20: mol_type = other DNA
gggcctttgtgagccaaact

SEQ ID NO: 36368 - DNA, 22 bp, synthetic construct
  misc_feature 1..22: note = Synthetic Construct
  source 1..22: mol_type = other DNA
atgccctctccccatccagctt

SEQ ID NO: 36369 - DNA, 25 bp, synthetic construct
  misc_feature 1..25: note = Synthetic Construct
  source 1..25: mol_type = other DNA
gttccgtagatttgagctgtgctaa

SEQ ID NO: 36370 - DNA, 19 bp, synthetic construct
  misc_feature 1..19: note = Synthetic Construct
  source 1..19: mol_type = other DNA
ccaagcactccccgactca

SEQ ID NO: 36371 - DNA, 20 bp, synthetic construct
  misc_feature 1..20: note = Synthetic Construct
  source 1..20: mol_type = other DNA
actgggaggcttgctggaaa

SEQ ID NO: 36372 - DNA, 22 bp, synthetic construct
  misc_feature 1..22: note = Synthetic Construct
  source 1..22: mol_type = other DNA
aagcagctctaatggctgttga

SEQ ID NO: 36373 - DNA, 22 bp, synthetic construct
  misc_feature 1..22: note = Synthetic Construct
  source 1..22: mol_type = other DNA
ggcctgactttctgtggcacta

SEQ ID NO: 36374 - DNA, 23 bp, synthetic construct
  misc_feature 1..23: note = Synthetic Construct
  source 1..23: mol_type = other DNA
aaatgcattccccagagatggaa

SEQ ID NO: 36375 - DNA, 22 bp, synthetic construct
  misc_feature 1..22: note = Synthetic Construct
  source 1..22: mol_type = other DNA
tctttccaaagcacccagttgt

SEQ ID NO: 36376 - DNA, 26 bp, synthetic construct
  misc_feature 1..26: note = Synthetic Construct
  source 1..26: mol_type = other DNA
gggccagaataagcaacaaagccaat

SEQ ID NO: 36377 - DNA, 20 bp, synthetic construct
  misc_feature 1..20: note = Synthetic Construct
  source 1..20: mol_type = other DNA
ggcgtggctgacacaaactt

SEQ ID NO: 36378 - DNA, 19 bp, synthetic construct
  misc_feature 1..19: note = Synthetic Construct
  source 1..19: mol_type = other DNA
tggccaaaacccgccttca

SEQ ID NO: 36379 - DNA, 22 bp, synthetic construct
  misc_feature 1..22: note = Synthetic Construct
  source 1..22: mol_type = other DNA
gcaactcccatccaggtctaca

SEQ ID NO: 36380 - DNA, 25 bp, synthetic construct
  misc_feature 1..25: note = Synthetic Construct
  source 1..25: mol_type = other DNA
gcataaactcgggtatggctgaaag

SEQ ID NO: 36381 - DNA, 22 bp, synthetic construct
  misc_feature 1..22: note = Synthetic Construct
  source 1..22: mol_type = other DNA
accatgaacctgtcctctcctt

SEQ ID NO: 36382 - DNA, 23 bp, synthetic construct
  misc_feature 1..23: note = Synthetic Construct
  source 1..23: mol_type = other DNA
cctggagctaaatgacgcagaaa

SEQ ID NO: 36383 - DNA, 22 bp, synthetic construct
  misc_feature 1..22: note = Synthetic Construct
  source 1..22: mol_type = other DNA
gctcttccctccaccagtctct

SEQ ID NO: 36384 - DNA, 18 bp, synthetic construct
  misc_feature 1..18: note = Synthetic Construct
  source 1..18: mol_type = other DNA
catgtgcggggccacttt

SEQ ID NO: 36385 - DNA, 25 bp, synthetic construct
  misc_feature 1..25: note = Synthetic Construct
  source 1..25: mol_type = other DNA
gtttttacctagggtgaacggtact

SEQ ID NO: 36386 - DNA, 24 bp, synthetic construct
  misc_feature 1..24: note = Synthetic Construct
  source 1..24: mol_type = other DNA
cagtgtcagctgttttgcaaagtt

SEQ ID NO: 36387 - DNA, 27 bp, synthetic construct
  misc_feature 1..27: note = Synthetic Construct
  source 1..27: mol_type = other DNA
ggtacaaaatccctcagtcctaaccat

SEQ ID NO: 36388 - DNA, 23 bp, synthetic construct
  misc_feature 1..23: note = Synthetic Construct
  source 1..23: mol_type = other DNA
cacctagtatgggagtgcagtgt

SEQ ID NO: 36389 - DNA, 21 bp, synthetic construct
  misc_feature 1..21: note = Synthetic Construct
  source 1..21: mol_type = other DNA
gctgggagtcacgctgtttca

SEQ ID NO: 36390 - DNA, 22 bp, synthetic construct
  misc_feature 1..22: note = Synthetic Construct
  source 1..22: mol_type = other DNA
gactgtccaggtccaagtgcat

SEQ ID NO: 36391 - DNA, 19 bp, synthetic construct
  misc_feature 1..19: note = Synthetic Construct
  source 1..19: mol_type = other DNA
actgcctggcttcccttca

SEQ ID NO: 36392 - DNA, 21 bp, synthetic construct
  misc_feature 1..21: note = Synthetic Construct
  source 1..21: mol_type = other DNA
tctggatacaggagccacctt

SEQ ID NO: 36393 - DNA, 22 bp, synthetic construct
  misc_feature 1..22: note = Synthetic Construct
  source 1..22: mol_type = other DNA
cagtcttcatgggccagtcttc

SEQ ID NO: 36394 - DNA, 21 bp, synthetic construct
  misc_feature 1..21: note = Synthetic Construct
  source 1..21: mol_type = other DNA
accacgtgtcaccccagattg

SEQ ID NO: 36395 - DNA, 22 bp, synthetic construct
  misc_feature 1..22: note = Synthetic Construct
  source 1..22: mol_type = other DNA
gatctgttggcctctgttccat

SEQ ID NO: 36396 - DNA, 24 bp, synthetic construct
  misc_feature 1..24: note = Synthetic Construct
  source 1..24: mol_type = other DNA
ctgatgacatgcagcagagacagt

SEQ ID NO: 36397 - DNA, 18 bp, synthetic construct
  misc_feature 1..18: note = Synthetic Construct
  source 1..18: mol_type = other DNA
ttgcctgcaaggccaact

SEQ ID NO: 36398 - DNA, 24 bp, synthetic construct
  misc_feature 1..24: note = Synthetic Construct
  source 1..24: mol_type = other DNA
ccaaggaggaacaaaaaggagaca

SEQ ID NO: 36399 - DNA, 25 bp, synthetic construct
  misc_feature 1..25: note = Synthetic Construct
  source 1..25: mol_type = other DNA
ggaggacagtgtatggtcacgaatc

SEQ ID NO: 36400 - DNA, 20 bp, synthetic construct
  misc_feature 1..20: note = Synthetic Construct
  source 1..20: mol_type = other DNA
gaggcaaggctgttctgtga

SEQ ID NO: 36401 - DNA, 22 bp, synthetic construct
  misc_feature 1..22: note = Synthetic Construct
  source 1..22: mol_type = other DNA
gggtatggagaggcccacattg

SEQ ID NO: 36402 - DNA, 22 bp, synthetic construct
  misc_feature 1..22: note = Synthetic Construct
  source 1..22: mol_type = other DNA
catctcctgcccaactccattg

SEQ ID NO: 36403 - DNA, 24 bp, synthetic construct
  misc_feature 1..24: note = Synthetic Construct
  source 1..24: mol_type = other DNA
catgggttggttttcaccacaatc

SEQ ID NO: 36404 - DNA, 22 bp, synthetic construct
  misc_feature 1..22: note = Synthetic Construct
  source 1..22: mol_type = other DNA
cctgccctggggtttcttttgt

SEQ ID NO: 36405 - DNA, 24 bp, synthetic construct
  misc_feature 1..24: note = Synthetic Construct
  source 1..24: mol_type = other DNA
cattgaacttcagcaccacgtatg

SEQ ID NO: 36406 - DNA, 27 bp, synthetic construct
  misc_feature 1..27: note = Synthetic Construct
  source 1..27: mol_type = other DNA
gggcactgtgttttcattttctgtcaa

SEQ ID NO: 36407 - DNA, 20 bp, synthetic construct
  misc_feature 1..20: note = Synthetic Construct
  source 1..20: mol_type = other DNA
cctgccggatggcagaacat

SEQ ID NO: 36408 - DNA, 23 bp, synthetic construct
  misc_feature 1..23: note = Synthetic Construct
  source 1..23: mol_type = other DNA
gggagatgattaggggaggctta

SEQ ID NO: 36409 - DNA, 20 bp, synthetic construct
  misc_feature 1..20: note = Synthetic Construct
  source 1..20: mol_type = other DNA
agtgctgcatccgctgagaa

SEQ ID NO: 36410 - DNA, 20 bp, synthetic construct
  misc_feature 1..20: note = Synthetic Construct
  source 1..20: mol_type = other DNA
agcggctctcctcctacaga

SEQ ID NO: 36411 - DNA, 20 bp, synthetic construct
  misc_feature 1..20: note = Synthetic Construct
  source 1..20: mol_type = other DNA
tgccatggtgtggtctcaag

SEQ ID NO: 36412 - DNA, 22 bp, synthetic construct
  misc_feature 1..22: note = Synthetic Construct
  source 1..22: mol_type = other DNA
ccgcctgctggtcattgttcta

SEQ ID NO: 36413 - DNA, 20 bp, synthetic construct
  misc_feature 1..20: note = Synthetic Construct
  source 1..20: mol_type = other DNA
gccaatggctgggctgtatt

SEQ ID NO: 36414 - DNA, 19 bp, synthetic construct
  misc_feature 1..19: note = Synthetic Construct
  source 1..19: mol_type = other DNA
tgcctcctccctggggttt

SEQ ID NO: 36415 - DNA, 20 bp, synthetic construct
  misc_feature 1..20: note = Synthetic Construct
  source 1..20: mol_type = other DNA
cacagccaatctgggcatct

SEQ ID NO: 36416 - DNA, 24 bp, synthetic construct
  misc_feature 1..24: note = Synthetic Construct
  source 1..24: mol_type = other DNA
ggcagagacgtataccaccacctt

SEQ ID NO: 36417 - DNA, 23 bp, synthetic construct
  misc_feature 1..23: note = Synthetic Construct
  source 1..23: mol_type = other DNA
gctcaatacggaggtcggaaaga

SEQ ID NO: 36418 - DNA, 21 bp, synthetic construct
  misc_feature 1..21: note = Synthetic Construct
  source 1..21: mol_type = other DNA
ccctgggtggggctaaaaatc

SEQ ID NO: 36419 - DNA, 30 bp, synthetic construct
  misc_feature 1..30: note = Synthetic Construct
  source 1..30: mol_type = other DNA
cacattgaaaaagaaccctctgatctcttg

SEQ ID NO: 36420 - DNA, 27 bp, synthetic construct
  misc_feature 1..27: note = Synthetic Construct
  source 1..27: mol_type = other DNA
gctgagtatacagccatctcgaacaac

SEQ ID NO: 36421 - DNA, 26 bp, synthetic construct
  misc_feature 1..26: note = Synthetic Construct
  source 1..26: mol_type = other DNA
gggaatagcctaatagggtctacgtt

SEQ ID NO: 36422 - DNA, 20 bp, synthetic construct
  misc_feature 1..20: note = Synthetic Construct
  source 1..20: mol_type = other DNA
agcgtggcctctgtgtcact

SEQ ID NO: 36423 - DNA, 24 bp, synthetic construct
  misc_feature 1..24: note = Synthetic Construct
  source 1..24: mol_type = other DNA
gatgagcttggctcttggtaattg

SEQ ID NO: 36424 - DNA, 23 bp, synthetic construct
  misc_feature 1..23: note = Synthetic Construct
  source 1..23: mol_type = other DNA
gctaggtcttgatgccagagtgt

SEQ ID NO: 36425 - DNA, 25 bp, synthetic construct
  misc_feature 1..25: note = Synthetic Construct
  source 1..25: mol_type = other DNA
ggtgaagtagtgaagggcacaggtt

SEQ ID NO: 36426 - DNA, 23 bp, synthetic construct
  misc_feature 1..23: note = Synthetic Construct
  source 1..23: mol_type = other DNA
gcatttctgctttccaggtttct

SEQ ID NO: 36427 - DNA, 22 bp, synthetic construct
  misc_feature 1..22: note = Synthetic Construct
  source 1..22: mol_type = other DNA
ggacgggaaaaggtgtgcctaa

SEQ ID NO: 36428 - DNA, 22 bp, synthetic construct
  misc_feature 1..22: note = Synthetic Construct
  source 1..22: mol_type = other DNA
acccagcttcagtcactacaac

SEQ ID NO: 36429 - DNA, 20 bp, synthetic construct
  misc_feature 1..20: note = Synthetic Construct
  source 1..20: mol_type = other DNA
accccaagagcccactttgt

SEQ ID NO: 36430 - DNA, 23 bp, synthetic construct
  misc_feature 1..23: note = Synthetic Construct
  source 1..23: mol_type = other DNA
gagcgcacattcatgttgcagaa

SEQ ID NO: 36431 - DNA, 21 bp, synthetic construct
  misc_feature 1..21: note = Synthetic Construct
  source 1..21: mol_type = other DNA
agcctgagaccctgacctttc

SEQ ID NO: 36432 - DNA, 23 bp, synthetic construct
  misc_feature 1..23: note = Synthetic Construct
  source 1..23: mol_type = other DNA
ggaagggatcaaggatggcctta

SEQ ID NO: 36433 - DNA, 23 bp, synthetic construct
  misc_feature 1..23: note = Synthetic Construct
  source 1..23: mol_type = other DNA
ggaaaggaaatgtggcactcttg

SEQ ID NO: 36434 - DNA, 26 bp, synthetic construct
  misc_feature 1..26: note = Synthetic Construct
  source 1..26: mol_type = other DNA
cacaatcggtcagatcttatctggaa

SEQ ID NO: 36435 - DNA, 25 bp, synthetic construct
  misc_feature 1..25: note = Synthetic Construct
  source 1..25: mol_type = other DNA
ccatgaacattggagttgccttttg

SEQ ID NO: 36436 - DNA, 21 bp, synthetic construct
  misc_feature 1..21: note = Synthetic Construct
  source 1..21: mol_type = other DNA
agcagggacatccgcatggta

SEQ ID NO: 36437 - DNA, 24 bp, synthetic construct
  misc_feature 1..24: note = Synthetic Construct
  source 1..24: mol_type = other DNA
gctcaatccggactgtgacgagtt

SEQ ID NO: 36438 - DNA, 22 bp, synthetic construct
  misc_feature 1..22: note = Synthetic Construct
  source 1..22: mol_type = other DNA
ggctgaactgctacagggctat

SEQ ID NO: 36439 - DNA, 20 bp, synthetic construct
  misc_feature 1..20: note = Synthetic Construct
  source 1..20: mol_type = other DNA
ggcaaacaggcatgggaaag

SEQ ID NO: 36440 - DNA, 22 bp, synthetic construct
  misc_feature 1..22: note = Synthetic Construct
  source 1..22: mol_type = other DNA
ctcggaaatccacggggaaatg

SEQ ID NO: 36441 - DNA, 22 bp, synthetic construct
  misc_feature 1..22: note = Synthetic Construct
  source 1..22: mol_type = other DNA
gctaaagggtctgggaggtttg

SEQ ID NO: 36442 - DNA, 23 bp, synthetic construct
  misc_feature 1..23: note = Synthetic Construct
  source 1..23: mol_type = other DNA
ggcttcagggccttagacacttg

SEQ ID NO: 36443 - DNA, 30 bp, synthetic construct
  misc_feature 1..30: note = Synthetic Construct
  source 1..30: mol_type = other DNA
cggaactttctcatctgacacgtctttttc

SEQ ID NO: 36444 - DNA, 27 bp, synthetic construct
  misc_feature 1..27: note = Synthetic Construct
  source 1..27: mol_type = other DNA
gcatcttcaggtctcagacagatcact

SEQ ID NO: 36445 - DNA, 24 bp, synthetic construct
  misc_feature 1..24: note = Synthetic Construct
  source 1..24: mol_type = other DNA
tgaagcacatctctcatccctttc

SEQ ID NO: 36446 - DNA, 20 bp, synthetic construct
  misc_feature 1..20: note = Synthetic Construct
  source 1..20: mol_type = other DNA
agaggtttcccgaggcttgt

SEQ ID NO: 36447 - DNA, 22 bp, synthetic construct
  misc_feature 1..22: note = Synthetic Construct
  source 1..22: mol_type = other DNA
accattgcatgcctgacttcaa

SEQ ID NO: 36448 - DNA, 23 bp, synthetic construct
  misc_feature 1..23: note = Synthetic Construct
  source 1..23: mol_type = other DNA
cactgtcagagccgtcatcttgt

SEQ ID NO: 36449 - DNA, 22 bp, synthetic construct
  misc_feature 1..22: note = Synthetic Construct
  source 1..22: mol_type = other DNA
gggcaagcgtggtaagtggaaa

SEQ ID NO: 36450 - DNA, 20 bp, synthetic construct
  misc_feature 1..20: note = Synthetic Construct
  source 1..20: mol_type = other DNA
gccacatctggggagtgaca

SEQ ID NO: 36451 - DNA, 19 bp, synthetic construct
  misc_feature 1..19: note = Synthetic Construct
  source 1..19: mol_type = other DNA
tgagctggggcgctactac

SEQ ID NO: 36452 - DNA, 26 bp, synthetic construct
  misc_feature 1..26: note = Synthetic Construct
  source 1..26: mol_type = other DNA
ctgggtttgtcttactaaagccaatg

SEQ ID NO: 36453 - DNA, 22 bp, synthetic construct
  misc_feature 1..22: note = Synthetic Construct
  source 1..22: mol_type = other DNA
gcacacagtgctgggtctacaa

SEQ ID NO: 36454 - DNA, 26 bp, synthetic construct
  misc_feature 1..26: note = Synthetic Construct
  source 1..26: mol_type = other DNA
cacaatgttacagagggtagagtcat

SEQ ID NO: 36455 - DNA, 20 bp, synthetic construct
  misc_feature 1..20: note = Synthetic Construct
  source 1..20: mol_type = other DNA
tcccaatcgagggcttgtca

SEQ ID NO: 36456 - DNA, 19 bp, synthetic construct
  misc_feature 1..19: note = Synthetic Construct
  source 1..19: mol_type = other DNA
ccccaggggcaatggtgaa

SEQ ID NO: 36457 - DNA, 25 bp, synthetic construct
  misc_feature 1..25: note = Synthetic Construct
  source 1..25: mol_type = other DNA
ctgtgcaaagaggtctcatcctatc

SEQ ID NO: 36458 - DNA, 25 bp, synthetic construct
  misc_feature 1..25: note = Synthetic Construct
  source 1..25: mol_type = other DNA
cccgaaatcatagtcaccccacact

SEQ ID NO: 36459 - DNA, 21 bp, synthetic construct
  misc_feature 1..21: note = Synthetic Construct
  source 1..21: mol_type = other DNA
gccaatgagcagcaaggacaa

SEQ ID NO: 36460 - DNA, 21 bp, synthetic construct
  misc_feature 1..21: note = Synthetic Construct
  source 1..21: mol_type = other DNA
acagagtggggtgggaagtct

SEQ ID NO: 36461 - DNA, 19 bp, synthetic construct
  misc_feature 1..19: note = Synthetic Construct
  source 1..19: mol_type = other DNA
actgcgggtcacgttgaga

SEQ ID NO: 36462 - DNA, 22 bp, synthetic construct
  misc_feature 1..22: note = Synthetic Construct
  source 1..22: mol_type = other DNA
ggcagactattccttccgcaat

SEQ ID NO: 36463 - DNA, 20 bp, synthetic construct
  misc_feature 1..20: note = Synthetic Construct
  source 1..20: mol_type = other DNA
agctccaatcgcccatcttg

SEQ ID NO: 36464 - DNA, 20 bp, synthetic construct
  misc_feature 1..20: note = Synthetic Construct
  source 1..20: mol_type = other DNA
aggggccgtgtcatttttgt

SEQ ID NO: 36465 - DNA, 20 bp, synthetic construct
  misc_feature 1..20: note = Synthetic Construct
  source 1..20: mol_type = other DNA
ggagagtggcagacccatct

SEQ ID NO: 36466 - DNA, 20 bp, synthetic construct
  misc_feature 1..20: note = Synthetic Construct
  source 1..20: mol_type = other DNA
ccggaaatgcttgccgtcat

SEQ ID NO: 36467 - DNA, 21 bp, synthetic construct
  misc_feature 1..21: note = Synthetic Construct
  source 1..21: mol_type = other DNA
cctggaaactggggtctttgt

SEQ ID NO: 36468 - DNA, 20 bp, synthetic construct
  misc_feature 1..20: note = Synthetic Construct
  source 1..20: mol_type = other DNA
tgtggacttgcctgctgtgt

SEQ ID NO: 36469 - DNA, 24 bp, synthetic construct
  misc_feature 1..24: note = Synthetic Construct
  source 1..24: mol_type = other DNA
cctttggtcacttttcaccaggta

SEQ ID NO: 36470 - DNA, 20 bp, synthetic construct
  misc_feature 1..20: note = Synthetic Construct
  source 1..20: mol_type = other DNA
tggtggccaagttccgagat

SEQ ID NO: 36471 - DNA, 23 bp, synthetic construct
  misc_feature 1..23: note = Synthetic Construct
  source 1..23: mol_type = other DNA
gtccacgccaccattatctcttg

SEQ ID NO: 36472 - DNA, 21 bp, synthetic construct
  misc_feature 1..21: note = Synthetic Construct
  source 1..21: mol_type = other DNA
ggggtgggctccagatacaga

SEQ ID NO: 36473 - DNA, 21 bp, synthetic construct
  misc_feature 1..21: note = Synthetic Construct
  source 1..21: mol_type = other DNA
gggtgagaggaatgcagaaca

SEQ ID NO: 36474 - DNA, 26 bp, synthetic construct
  misc_feature 1..26: note = Synthetic Construct
  source 1..26: mol_type = other DNA
cgcaaaacttgatgcttccctcattc

SEQ ID NO: 36475 - DNA, 27 bp, synthetic construct
  misc_feature 1..27: note = Synthetic Construct
  source 1..27: mol_type = other DNA
cgatctctaaggatcttccgtggtcta

SEQ ID NO: 36476 - DNA, 21 bp, synthetic construct
  misc_feature 1..21: note = Synthetic Construct
  source 1..21: mol_type = other DNA
ccgtgacacctggactctttc

SEQ ID NO: 36477 - DNA, 23 bp, synthetic construct
  misc_feature 1..23: note = Synthetic Construct
  source 1..23: mol_type = other DNA
tgctcctcaaacataccaagcat

SEQ ID NO: 36478 - DNA, 20 bp, synthetic construct
  misc_feature 1..20: note = Synthetic Construct
  source 1..20: mol_type = other DNA
agaagccatggtggggaaga

SEQ ID NO: 36479 - DNA, 19 bp, synthetic construct
  misc_feature 1..19: note = Synthetic Construct
  source 1..19: mol_type = other DNA
ggtcagcagcctcgtggaa

SEQ ID NO: 36480 - DNA, 22 bp, synthetic construct
  misc_feature 1..22: note = Synthetic Construct
  source 1..22: mol_type = other DNA
gcgacatgatttgcaggcaatg

SEQ ID NO: 36481 - DNA, 19 bp, synthetic construct
  misc_feature 1..19: note = Synthetic Construct
  source 1..19: mol_type = other DNA
gcggtgcagagcacagaga

SEQ ID NO: 36482 - DNA, 28 bp, synthetic construct
  misc_feature 1..28: note = Synthetic Construct
  source 1..28: mol_type = other DNA
gagctctaaaccaaaccctcaatcaaac

SEQ ID NO: 36483 - DNA, 22 bp, synthetic construct
  misc_feature 1..22: note = Synthetic Construct
  source 1..22: mol_type = other DNA
actcaccggctctcctttctct

SEQ ID NO: 36484 - DNA, 22 bp, synthetic construct
  misc_feature 1..22: note = Synthetic Construct
  source 1..22: mol_type = other DNA
gcctggacagacaacagctact

SEQ ID NO: 36485 - DNA, 20 bp, synthetic construct
  misc_feature 1..20: note = Synthetic Construct
  source 1..20: mol_type = other DNA
atgtctggctgtggctgttg

SEQ ID NO: 36486 - DNA, 21 bp, synthetic construct
  misc_feature 1..21: note = Synthetic Construct
  source 1..21: mol_type = other DNA
ccctgagctaggccttggttt

SEQ ID NO: 36487 - DNA, 21 bp, synthetic construct
  misc_feature 1..21: note = Synthetic Construct
  source 1..21: mol_type = other DNA
gccacagccagaagaaacaca

SEQ ID NO: 36488 - DNA, 22 bp, synthetic construct
  misc_feature 1..22: note = Synthetic Construct
  source 1..22: mol_type = other DNA
ggcaacagacacagcccatcta

SEQ ID NO: 36489 - DNA, 24 bp, synthetic construct
  misc_feature 1..24: note = Synthetic Construct
  source 1..24: mol_type = other DNA
ggaaagaactggaagcaggcaact

SEQ ID NO: 36490 - DNA, 23 bp, synthetic construct
  misc_feature 1..23: note = Synthetic Construct
  source 1..23: mol_type = other DNA
ggataggctggtaccatgagaag

SEQ ID NO: 36491 - DNA, 24 bp, synthetic construct
  misc_feature 1..24: note = Synthetic Construct
  source 1..24: mol_type = other DNA
tggacaagcccttaacacttgatg

SEQ ID NO: 36492 - DNA, 25 bp, synthetic construct
  misc_feature 1..25: note = Synthetic Construct
  source 1..25: mol_type = other DNA
ggctccaaggattaaggtcccagaa

SEQ ID NO: 36493 - DNA, 25 bp, synthetic construct
  misc_feature 1..25: note = Synthetic Construct
  source 1..25: mol_type = other DNA
ggtcaatacttagggagcctgtact

SEQ ID NO: 36494 - DNA, 21 bp, synthetic construct
  misc_feature 1..21: note = Synthetic Construct
  source 1..21: mol_type = other DNA
gtttcctaagtggcgggaaca

SEQ ID NO: 36495 - DNA, 20 bp, synthetic construct
  misc_feature 1..20: note = Synthetic Construct
  source 1..20: mol_type = other DNA
ttgccctttggccctagact

SEQ ID NO: 36496 - DNA, 22 bp, synthetic construct
  misc_feature 1..22: note = Synthetic Construct
  source 1..22: mol_type = other DNA
tgttcccaccaggactccatct

SEQ ID NO: 36497 - DNA, 18 bp, synthetic construct
  misc_feature 1..18: note = Synthetic Construct
  source 1..18: mol_type = other DNA
accagggctgggaagtca

SEQ ID NO: 36498 - DNA, 22 bp, synthetic construct
  misc_feature 1..22: note = Synthetic Construct
  source 1..22: mol_type = other DNA
gagcctagtgatcggggtttct

SEQ ID NO: 36499 - DNA, 22 bp, synthetic construct
  misc_feature 1..22: note = Synthetic Construct
  source 1..22: mol_type = other DNA
gcctgatgtgttgccagtgttg

SEQ ID NO: 36500 - DNA, 22 bp, synthetic construct
  misc_feature 1..22: note = Synthetic Construct
  source 1..22: mol_type = other DNA
ctggggaaactgcatgggaagt

SEQ ID NO: 36501 - DNA, 24 bp, synthetic construct
  misc_feature 1..24: note = Synthetic Construct
  source 1..24: mol_type = other DNA
gacacagactgaaaaccaggaagt

SEQ ID NO: 36502 - DNA, 22 bp, synthetic construct
  misc_feature 1..22: note = Synthetic Construct
  source 1..22: mol_type = other DNA
gtgcgtctcgcaggcaattatc

SEQ ID NO: 36503 - DNA, 24 bp, synthetic construct
  misc_feature 1..24: note = Synthetic Construct
  source 1..24: mol_type = other DNA
ctgtcttcacaccttcacctccta

SEQ ID NO: 36504 - DNA, 19 bp, synthetic construct
  misc_feature 1..19: note = Synthetic Construct
  source 1..19: mol_type = other DNA
gcaggccactctgctctca

SEQ ID NO: 36505 - DNA, 20 bp, synthetic construct
  misc_feature 1..20: note = Synthetic Construct
  source 1..20: mol_type = other DNA
tgggcacctcacccatgtca

SEQ ID NO: 36506 - DNA, 24 bp, synthetic construct
  misc_feature 1..24: note = Synthetic Construct
  source 1..24: mol_type = other DNA
gaagaaaaagggccgttctaccat

SEQ ID NO: 36507 - DNA, 20 bp, synthetic construct
  misc_feature 1..20: note = Synthetic Construct
  source 1..20: mol_type = other DNA
tcactggctgacgactccaa

SEQ ID NO: 36508 - DNA, 22 bp, synthetic construct
  misc_feature 1..22: note = Synthetic Construct
  source 1..22: mol_type = other DNA
cctactggagtttggcctgtct

SEQ ID NO: 36509 - DNA, 19 bp, synthetic construct
  misc_feature 1..19: note = Synthetic Construct
  source 1..19: mol_type = other DNA
cacggagaccccaccatca

SEQ ID NO: 36510 - DNA, 23 bp, synthetic construct
  misc_feature 1..23: note = Synthetic Construct
  source 1..23: mol_type = other DNA
ccctgatgctctgagtggtgttt

SEQ ID NO: 36511 - DNA, 26 bp, synthetic construct
  misc_feature 1..26: note = Synthetic Construct
  source 1..26: mol_type = other DNA
gatagagcacataacctgagcaattc

SEQ ID NO: 36512 - DNA, 21 bp, synthetic construct
  misc_feature 1..21: note = Synthetic Construct
  source 1..21: mol_type = other DNA
cacagaactggagccctgaat

SEQ ID NO: 36513 - DNA, 20 bp, synthetic construct
  misc_feature 1..20: note = Synthetic Construct
  source 1..20: mol_type = other DNA
tcacgctaggtggtggtgaa

SEQ ID NO: 36514 - DNA, 20 bp, synthetic construct
  misc_feature 1..20: note = Synthetic Construct
  source 1..20: mol_type = other DNA
aggacatggaagggcctcaa

SEQ ID NO: 36515 - DNA, 21 bp, synthetic construct
  misc_feature 1..21: note = Synthetic Construct
  source 1..21: mol_type = other DNA
cccatggcccagatgaacagt

SEQ ID NO: 36516 - DNA, 18 bp, synthetic construct
  misc_feature 1..18: note = Synthetic Construct
  source 1..18: mol_type = other DNA
tggcagtcctggcaccat

SEQ ID NO: 36517 - DNA, 20 bp, synthetic construct
  misc_feature 1..20: note = Synthetic Construct
  source 1..20: mol_type = other DNA
gaagccttggcagacacaga

SEQ ID NO: 36518 - DNA, 20 bp, synthetic construct
  misc_feature 1..20: note = Synthetic Construct
  source 1..20: mol_type = other DNA
cagtgtcagggtgggactca

SEQ ID NO: 36519 - DNA, 23 bp, synthetic construct
  misc_feature 1..23: note = Synthetic Construct
  source 1..23: mol_type = other DNA
ggagggaagaacctgcttgctta

SEQ ID NO: 36520 - DNA, 21 bp, synthetic construct
  misc_feature 1..21: note = Synthetic Construct
  source 1..21: mol_type = other DNA
atgtccctgtgccgtgtctct

SEQ ID NO: 36521 - DNA, 21 bp, synthetic construct
  misc_feature 1..21: note = Synthetic Construct
  source 1..21: mol_type = other DNA
cccttggacttcagccagtca

SEQ ID NO: 36522 - DNA, 21 bp, synthetic construct
  misc_feature 1..21: note = Synthetic Construct
  source 1..21: mol_type = other DNA
gcccctgctcctttgcactta

SEQ ID NO: 36523 - DNA, 20 bp, synthetic construct
  misc_feature 1..20: note = Synthetic Construct
  source 1..20: mol_type = other DNA
cctagggtagctgccaccaa

SEQ ID NO: 36524 - DNA, 23 bp, synthetic construct
  misc_feature 1..23: note = Synthetic Construct
  source 1..23: mol_type = other DNA
gcaaatgagtgttgggcgggaaa

SEQ ID NO: 36525 - DNA, 22 bp, synthetic construct
  misc_feature 1..22: note = Synthetic Construct
  source 1..22: mol_type = other DNA
gctcacaccctcttcaccacaa

SEQ ID NO: 36526 - DNA, 20 bp, synthetic construct
  misc_feature 1..20: note = Synthetic Construct
  source 1..20: mol_type = other DNA
acagcccatctgtggtgctt

SEQ ID NO: 36527 - DNA, 20 bp, synthetic construct
  misc_feature 1..20: note = Synthetic Construct
  source 1..20: mol_type = other DNA
ggaggcagaggccagatgta

SEQ ID NO: 36528 - DNA, 20 bp, synthetic construct
  misc_feature 1..20: note = Synthetic Construct
  source 1..20: mol_type = other DNA
tgtcagctgaggggatgagt

SEQ ID NO: 36529 - DNA, 25 bp, synthetic construct
  misc_feature 1..25: note = Synthetic Construct
  source 1..25: mol_type = other DNA
catcgacattgcctaaaacctcttg

SEQ ID NO: 36530 - DNA, 20 bp, synthetic construct
  misc_feature 1..20: note = Synthetic Construct
  source 1..20: mol_type = other DNA
aggctcacgtgccagagagt

SEQ ID NO: 36531 - DNA, 20 bp, synthetic construct
  misc_feature 1..20: note = Synthetic Construct
  source 1..20: mol_type = other DNA
ggcccagggaagaagcaaca

SEQ ID NO: 36532 - DNA, 22 bp, synthetic construct
  misc_feature 1..22: note = Synthetic Construct
  source 1..22: mol_type = other DNA
cagaccagattacgccccaaag

SEQ ID NO: 36533 - DNA, 20 bp, synthetic construct
  misc_feature 1..20: note = Synthetic Construct
  source 1..20: mol_type = other DNA
gggctttttgcgccaggaaa

SEQ ID NO: 36534 - DNA, 19 bp, synthetic construct
  misc_feature 1..19: note = Synthetic Construct
  source 1..19: mol_type = other DNA
ccgacctcagtggggagaa

SEQ ID NO: 36535 - DNA, 20 bp, synthetic construct
  misc_feature 1..20: note = Synthetic Construct
  source 1..20: mol_type = other DNA
tcgctgccacagagggtgaa

SEQ ID NO: 36536 - DNA, 22 bp, synthetic construct
  misc_feature 1..22: note = Synthetic Construct
  source 1..22: mol_type = other DNA
cacctctgatgccagctgttct

SEQ ID NO: 36537 - DNA, 20 bp, synthetic construct
  misc_feature 1..20: note = Synthetic Construct
  source 1..20: mol_type = other DNA
cgcttaggcacagggattga

SEQ ID NO: 36538 - DNA, 22 bp, synthetic construct
  misc_feature 1..22: note = Synthetic Construct
  source 1..22: mol_type = other DNA
gaggcaagagacaagtcagtca

SEQ ID NO: 36539 - DNA, 22 bp, synthetic construct
  misc_feature 1..22: note = Synthetic Construct
  source 1..22: mol_type = other DNA
gaacacatgagccacagacagt

SEQ ID NO: 36540 - DNA, 19 bp, synthetic construct
  misc_feature 1..19: note = Synthetic Construct
  source 1..19: mol_type = other DNA
acgcccaggaggagacaac

SEQ ID NO: 36541 - DNA, 21 bp, synthetic construct
  misc_feature 1..21: note = Synthetic Construct
  source 1..21: mol_type = other DNA
aggagagctgaggaccagaca

SEQ ID NO: 36542 - DNA, 19 bp, synthetic construct
  misc_feature 1..19: note = Synthetic Construct
  source 1..19: mol_type = other DNA
atctcctggtggcgctgaa

SEQ ID NO: 36543 - DNA, 20 bp, synthetic construct
  misc_feature 1..20: note = Synthetic Construct
  source 1..20: mol_type = other DNA
tccccagccagccaggtgat

SEQ ID NO: 36544 - DNA, 20 bp, synthetic construct
  misc_feature 1..20: note = Synthetic Construct
  source 1..20: mol_type = other DNA
cccatgccaacaggacatct

SEQ ID NO: 36545 - DNA, 21 bp, synthetic construct
  misc_feature 1..21: note = Synthetic Construct
  source 1..21: mol_type = other DNA
ggaccgactcttgcctcatct

SEQ ID NO: 36546 - DNA, 19 bp, synthetic construct
  misc_feature 1..19: note = Synthetic Construct
  source 1..19: mol_type = other DNA
tggaccccgcaagtactca

SEQ ID NO: 36547 - DNA, 20 bp, synthetic construct
  misc_feature 1..20: note = Synthetic Construct
  source 1..20: mol_type = other DNA
cccctgaccacacacactga

SEQ ID NO: 36548 - DNA, 22 bp, synthetic construct
  misc_feature 1..22: note = Synthetic Construct
  source 1..22: mol_type = other DNA
ggcctgccctttgatctagttg

SEQ ID NO: 36549 - DNA, 22 bp, synthetic construct
  misc_feature 1..22: note = Synthetic Construct
  source 1..22: mol_type = other DNA
cgtgcagtgaaacctggagtga

SEQ ID NO: 36550 - DNA, 22 bp, synthetic construct
  misc_feature 1..22: note = Synthetic Construct
  source 1..22: mol_type = other DNA
aggaggcttcgggatggacaat

SEQ ID NO: 36551 - DNA, 22 bp, synthetic construct
  misc_feature 1..22: note = Synthetic Construct
  source 1..22: mol_type = other DNA
gcataacctcagtgccctcaca

SEQ ID NO: 36552 - DNA, 25 bp, synthetic construct
  misc_feature 1..25: note = Synthetic Construct
  source 1..25: mol_type = other DNA
tggggctttatttgggaagtgtaaa

SEQ ID NO: 36553 - DNA, 22 bp, synthetic construct
  misc_feature 1..22: note = Synthetic Construct
  source 1..22: mol_type = other DNA
ctcttcccaggtcccttctttc

SEQ ID NO: 36554 - DNA, 22 bp, synthetic construct
  misc_feature 1..22: note = Synthetic Construct
  source 1..22: mol_type = other DNA
gcttttgctctggccatgtaag

SEQ ID NO: 36555 - DNA, 19 bp, synthetic construct
  misc_feature 1..19: note = Synthetic Construct
  source 1..19: mol_type = other DNA
tttgggaacccggggcata

SEQ ID NO: 36556 - DNA, 22 bp, synthetic construct
  misc_feature 1..22: note = Synthetic Construct
  source 1..22: mol_type = other DNA
ggccagctaattccagcagact

SEQ ID NO: 36557 - DNA, 20 bp, synthetic construct
  misc_feature 1..20: note = Synthetic Construct
  source 1..20: mol_type = other DNA
agacagagcaaggggctgat

SEQ ID NO: 36558 - DNA, 22 bp, synthetic construct
  misc_feature 1..22: note = Synthetic Construct
  source 1..22: mol_type = other DNA
gctccacaaatggctcccagaa

SEQ ID NO: 36559 - DNA, 20 bp, synthetic construct
  misc_feature 1..20: note = Synthetic Construct
  source 1..20: mol_type = other DNA
cgctgtctgtcacgctttgt

SEQ ID NO: 36560 - DNA, 18 bp, synthetic construct
  misc_feature 1..18: note = Synthetic Construct
  source 1..18: mol_type = other DNA
agggagtcagcggacgtt

SEQ ID NO: 36561 - DNA, 24 bp, synthetic construct
  misc_feature 1..24: note = Synthetic Construct
  source 1..24: mol_type = other DNA
gtgggtctgtgtggagatggatac

SEQ ID NO: 36562 - DNA, 18 bp, synthetic construct
  misc_feature 1..18: note = Synthetic Construct
  source 1..18: mol_type = other DNA
ttgggagcagggctggaa

SEQ ID NO: 36563 - DNA, 20 bp, synthetic construct
  misc_feature 1..20: note = Synthetic Construct
  source 1..20: mol_type = other DNA
cccctccaaggggtgattgt

SEQ ID NO: 36564 - DNA, 20 bp, synthetic construct
  misc_feature 1..20: note = Synthetic Construct
  source 1..20: mol_type = other DNA
gccacagcgtccagcttcat

SEQ ID NO: 36565 - DNA, 19 bp, synthetic construct
  misc_feature 1..19: note = Synthetic Construct
  source 1..19: mol_type = other DNA
acacgactccaggccacat

SEQ ID NO: 36566 - DNA, 21 bp, synthetic construct
  misc_feature 1..21: note = Synthetic Construct
  source 1..21: mol_type = other DNA
tgagcacgtcagcgtctctac

SEQ ID NO: 36567 - DNA, 23 bp, synthetic construct
  misc_feature 1..23: note = Synthetic Construct
  source 1..23: mol_type = other DNA
cccaaggtggggaagaaggtttg

SEQ ID NO: 36568 - DNA, 27 bp, synthetic construct
  misc_feature 1..27: note = Synthetic Construct
  source 1..27: mol_type = other DNA
gggtataaaactcccagagcccatttc

SEQ ID NO: 36569 - DNA, 25 bp, synthetic construct
  misc_feature 1..25: note = Synthetic Construct
  source 1..25: mol_type = other DNA
ggagggaagactcctcactttgtct

SEQ ID NO: 36570 - DNA, 21 bp, synthetic construct
  misc_feature 1..21: note = Synthetic Construct
  source 1..21: mol_type = other DNA
ttgaagcggggaggcctggtt

SEQ ID NO: 36571 - DNA, 22 bp, synthetic construct
  misc_feature 1..22: note = Synthetic Construct
  source 1..22: mol_type = other DNA
ggtgattacatccccgccacta

SEQ ID NO: 36572 - DNA, 24 bp, synthetic construct
  misc_feature 1..24: note = Synthetic Construct
  source 1..24: mol_type = other DNA
ctgccccaatcttcatttcctttc

SEQ ID NO: 36573 - DNA, 23 bp, synthetic construct
  misc_feature 1..23: note = Synthetic Construct
  source 1..23: mol_type = other DNA
ccagggtcttgtttccactgaca

SEQ ID NO: 36574 - DNA, 18 bp, synthetic construct
  misc_feature 1..18: note = Synthetic Construct
  source 1..18: mol_type = other DNA
atttggcgtgccgtgcat

SEQ ID NO: 36575 - DNA, 20 bp, synthetic construct
  misc_feature 1..20: note = Synthetic Construct
  source 1..20: mol_type = other DNA
tgcccattggcttcccctaa

SEQ ID NO: 36576 - DNA, 20 bp, synthetic construct
  misc_feature 1..20: note = Synthetic Construct
  source 1..20: mol_type = other DNA
tgaggaaggccccaaggaaa

SEQ ID NO: 36577 - DNA, 20 bp, synthetic construct
  misc_feature 1..20: note = Synthetic Construct
  source 1..20: mol_type = other DNA
tgggcttcgtggcatcttca

SEQ ID NO: 36578 - DNA, 24 bp, synthetic construct
  misc_feature 1..24: note = Synthetic Construct
  source 1..24: mol_type = other DNA
gttgactttgatcaccagccattc

SEQ ID NO: 36579 - DNA, 20 bp, synthetic construct
  misc_feature 1..20: note = Synthetic Construct
  source 1..20: mol_type = other DNA
atgcccttgcgtagggtttg

SEQ ID NO: 36580 - DNA, 21 bp, synthetic construct
  misc_feature 1..21: note = Synthetic Construct
  source 1..21: mol_type = other DNA
ttagcaggagccccacactca

SEQ ID NO: 36581 - DNA, 22 bp, synthetic construct
  misc_feature 1..22: note = Synthetic Construct
  source 1..22: mol_type = other DNA
ccacctattgcagggagctgtt

SEQ ID NO: 36582 - DNA, 22 bp, synthetic construct
  misc_feature 1..22: note = Synthetic Construct
  source 1..22: mol_type = other DNA
gctgtgtaccatggtggaaact

SEQ ID NO: 36583 - DNA, 25 bp, synthetic construct
  misc_feature 1..25: note = Synthetic Construct
  source 1..25: mol_type = other DNA
gctgcagatgaatgtctctggatct

SEQ ID NO: 36584 - DNA, 21 bp, synthetic construct
  misc_feature 1..21: note = Synthetic Construct
  source 1..21: mol_type = other DNA
gccagcgtacacatccctgaa

SEQ ID NO: 36585 - DNA, 22 bp, synthetic construct
  misc_feature 1..22: note = Synthetic Construct
  source 1..22: mol_type = other DNA
cccatctcttccctgagacaac

SEQ ID NO: 36586 - DNA, 28 bp, synthetic construct
  misc_feature 1..28: note = Synthetic Construct
  source 1..28: mol_type = other DNA
cagaggacattaagaaaactccctctga

SEQ ID NO: 36587 - DNA, 24 bp, synthetic construct
  misc_feature 1..24: note = Synthetic Construct
  source 1..24: mol_type = other DNA
gtaactaatcacagggcagctcaa

SEQ ID NO: 36588 - DNA, 22 bp, synthetic construct
  misc_feature 1..22: note = Synthetic Construct
  source 1..22: mol_type = other DNA
ctgcctgccttctctgcttttc

SEQ ID NO: 36589 - DNA, 22 bp, synthetic construct
  misc_feature 1..22: note = Synthetic Construct
  source 1..22: mol_type = other DNA
cttgtcagaactgctcccatgt

SEQ ID NO: 36590 - DNA, 22 bp, synthetic construct
  misc_feature 1..22: note = Synthetic Construct
  source 1..22: mol_type = other DNA
gggcctgaggaactgttaccat

SEQ ID NO: 36591 - DNA, 20 bp, synthetic construct
  misc_feature 1..20: note = Synthetic Construct
  source 1..20: mol_type = other DNA
atgtgtccttgggcctgtga

SEQ ID NO: 36592 - DNA, 21 bp, synthetic construct
  misc_feature 1..21: note = Synthetic Construct
  source 1..21: mol_type = other DNA
tgtgccagactctgtgtgaga

SEQ ID NO: 36593 - DNA, 23 bp, synthetic construct
  misc_feature 1..23: note = Synthetic Construct
  source 1..23: mol_type = other DNA
gaggctttgtcatggtgagtcaa

SEQ ID NO: 36594 - DNA, 21 bp, synthetic construct
  misc_feature 1..21: note = Synthetic Construct
  source 1..21: mol_type = other DNA
tgcctgccataggggagcata

SEQ ID NO: 36595 - DNA, 23 bp, synthetic construct
  misc_feature 1..23: note = Synthetic Construct
  source 1..23: mol_type = other DNA
ccaaacacaccaggttgtctcta

SEQ ID NO: 36596 - DNA, 20 bp, synthetic construct
  misc_feature 1..20: note = Synthetic Construct
  source 1..20: mol_type = other DNA
agcttctcagcctggtggta

SEQ ID NO: 36597 - DNA, 22 bp, synthetic construct
  misc_feature 1..22: note = Synthetic Construct
  source 1..22: mol_type = other DNA
gaaggctggagaatgtggtaca

SEQ ID NO: 36598 - DNA, 21 bp, synthetic construct
  misc_feature 1..21: note = Synthetic Construct
  source 1..21: mol_type = other DNA
tggggtcttctgcagccacta

SEQ ID NO: 36599 - DNA, 22 bp, synthetic construct
  misc_feature 1..22: note = Synthetic Construct
  source 1..22: mol_type = other DNA
actgcctcactcctcatgtact

SEQ ID NO: 36600 - DNA, 20 bp, synthetic construct
  misc_feature 1..20: note = Synthetic Construct
  source 1..20: mol_type = other DNA
agggcagccccaacctcatt

SEQ ID NO: 36601 - DNA, 23 bp, synthetic construct
  misc_feature 1..23: note = Synthetic Construct
  source 1..23: mol_type = other DNA
ccaaaaacccacaggcaggttag

SEQ ID NO: 36602 - DNA, 20 bp, synthetic construct
  misc_feature 1..20: note = Synthetic Construct
  source 1..20: mol_type = other DNA
agggtggggacgtgtagtca

SEQ ID NO: 36603 - DNA, 23 bp, synthetic construct
  misc_feature 1..23: note = Synthetic Construct
  source 1..23: mol_type = other DNA
gcgaaacgtggtgatcctcaaag

SEQ ID NO: 36604 - DNA, 23 bp, synthetic construct
  misc_feature 1..23: note = Synthetic Construct
  source 1..23: mol_type = other DNA
gggctccaaaacgtatcctggtt

SEQ ID NO: 36605 - DNA, 22 bp, synthetic construct
  misc_feature 1..22: note = Synthetic Construct
  source 1..22: mol_type = other DNA
ggaggtggggcagaatggaatc

SEQ ID NO: 36606 - DNA, 21 bp, synthetic construct
  misc_feature 1..21: note = Synthetic Construct
  source 1..21: mol_type = other DNA
ccaagctgtctcgggacctat

SEQ ID NO: 36607 - DNA, 23 bp, synthetic construct
  misc_feature 1..23: note = Synthetic Construct
  source 1..23: mol_type = other DNA
ccagttcctatgcctggactttt

SEQ ID NO: 36608 - DNA, 20 bp, synthetic construct
  misc_feature 1..20: note = Synthetic Construct
  source 1..20: mol_type = other DNA
caaggccctgttccctctct

SEQ ID NO: 36609 - DNA, 23 bp, synthetic construct
  misc_feature 1..23: note = Synthetic Construct
  source 1..23: mol_type = other DNA
ggggactgcagagatatgagctt

SEQ ID NO: 36610 - DNA, 24 bp, synthetic construct
  misc_feature 1..24: note = Synthetic Construct
  source 1..24: mol_type = other DNA
agtgaagttggaaaccaaggttga

SEQ ID NO: 36611 - DNA, 20 bp, synthetic construct
  misc_feature 1..20: note = Synthetic Construct
  source 1..20: mol_type = other DNA
tgggccagagcaaggctgat

SEQ ID NO: 36612 - DNA, 20 bp, synthetic construct
  misc_feature 1..20: note = Synthetic Construct
  source 1..20: mol_type = other DNA
tagaggccgcaatgctgaca

SEQ ID NO: 36613 - DNA, 21 bp, synthetic construct
  misc_feature 1..21: note = Synthetic Construct
  source 1..21: mol_type = other DNA
gtgctgaaggccaagaggaaa

SEQ ID NO: 36614 - DNA, 19 bp, synthetic construct
  misc_feature 1..19: note = Synthetic Construct
  source 1..19: mol_type = other DNA
ccagcagccctcgcaagat

SEQ ID NO: 36615 - DNA, 22 bp, synthetic construct
  misc_feature 1..22: note = Synthetic Construct
  source 1..22: mol_type = other DNA
tcaaggtgacctctggaaccaa

SEQ ID NO: 36616 - DNA, 19 bp, synthetic construct
  misc_feature 1..19: note = Synthetic Construct
  source 1..19: mol_type = other DNA
agccagggctgtccacgaa

SEQ ID NO: 36617 - DNA, 25 bp, synthetic construct
  misc_feature 1..25: note = Synthetic Construct
  source 1..25: mol_type = other DNA
gggcacaagcaatacttaggcagaa

SEQ ID NO: 36618 - DNA, 19 bp, synthetic construct
  misc_feature 1..19: note = Synthetic Construct
  source 1..19: mol_type = other DNA
ttgcggagaggggccttca

SEQ ID NO: 36619 - DNA, 24 bp, synthetic construct
  misc_feature 1..24: note = Synthetic Construct
  source 1..24: mol_type = other DNA
gctgggagggctgagtatgatgta

SEQ ID NO: 36620 - DNA, 25 bp, synthetic construct
  misc_feature 1..25: note = Synthetic Construct
  source 1..25: mol_type = other DNA
ggggtggatgggaatattgggaaac

SEQ ID NO: 36621 - DNA, 25 bp, synthetic construct
  misc_feature 1..25: note = Synthetic Construct
  source 1..25: mol_type = other DNA
ggtggagtggtagatgttcttgctt

SEQ ID NO: 36622 - DNA, 22 bp, synthetic construct
  misc_feature 1..22: note = Synthetic Construct
  source 1..22: mol_type = other DNA
gctgtgctcagccagatgtgat

SEQ ID NO: 36623 - DNA, 23 bp, synthetic construct
  misc_feature 1..23: note = Synthetic Construct
  source 1..23: mol_type = other DNA
ggactccctcaagcaggaagttg

SEQ ID NO: 36624 - DNA, 26 bp, synthetic construct
  misc_feature 1..26: note = Synthetic Construct
  source 1..26: mol_type = other DNA
gcacaagtgctgttctcaaaatcaca

SEQ ID NO: 36625 - DNA, 22 bp, synthetic construct
  misc_feature 1..22: note = Synthetic Construct
  source 1..22: mol_type = other DNA
gctctgcttcttgccacctact

SEQ ID NO: 36626 - DNA, 22 bp, synthetic construct
  misc_feature 1..22: note = Synthetic Construct
  source 1..22: mol_type = other DNA
gagcgcaatgtctccctgtatg

SEQ ID NO: 36627 - DNA, 21 bp, synthetic construct
  misc_feature 1..21: note = Synthetic Construct
  source 1..21: mol_type = other DNA
ctgggatttccaacccaccaa

SEQ ID NO: 36628 - DNA, 22 bp, synthetic construct
  misc_feature 1..22: note = Synthetic Construct
  source 1..22: mol_type = other DNA
ctggtggccaatggggataact

SEQ ID NO: 36629 - DNA, 25 bp, synthetic construct
  misc_feature 1..25: note = Synthetic Construct
  source 1..25: mol_type = other DNA
gtccctcacttttctaagcctctgt

SEQ ID NO: 36630 - DNA, 20 bp, synthetic construct
  misc_feature 1..20: note = Synthetic Construct
  source 1..20: mol_type = other DNA
gcgtggcgtgttagaaggta

SEQ ID NO: 36631 - DNA, 21 bp, synthetic construct
  misc_feature 1..21: note = Synthetic Construct
  source 1..21: mol_type = other DNA
ttgcctggagccgggaaagtt

SEQ ID NO: 36632 - DNA, 26 bp, synthetic construct
  misc_feature 1..26: note = Synthetic Construct
  source 1..26: mol_type = other DNA
gcttcctctctttcatgtgatgttct

SEQ ID NO: 36633 - DNA, 25 bp, synthetic construct
  misc_feature 1..25: note = Synthetic Construct
  source 1..25: mol_type = other DNA
gagttttgtgtgatagaggcgtaga

SEQ ID NO: 36634 - DNA, 24 bp, synthetic construct
  misc_feature 1..24: note = Synthetic Construct
  source 1..24: mol_type = other DNA
ggctagtgccaggctcatatctca

SEQ ID NO: 36635 - DNA, 25 bp, synthetic construct
  misc_feature 1..25: note = Synthetic Construct
  source 1..25: mol_type = other DNA
gatgttacaagtggatggcttccta

SEQ ID NO: 36636 - DNA, 20 bp, synthetic construct
  misc_feature 1..20: note = Synthetic Construct
  source 1..20: mol_type = other DNA
tagctgctggctgtgagttc

SEQ ID NO: 36637 - DNA, 24 bp, synthetic construct
  misc_feature 1..24: note = Synthetic Construct
  source 1..24: mol_type = other DNA
ggtctaggtagtgtgaggttcagt

SEQ ID NO: 36638 - DNA, 24 bp, synthetic construct
  misc_feature 1..24: note = Synthetic Construct
  source 1..24: mol_type = other DNA
tcacgttctttccttccagattgt

SEQ ID NO: 36639 - DNA, 22 bp, synthetic construct
  misc_feature 1..22: note = Synthetic Construct
  source 1..22: mol_type = other DNA
ctgaaaggggcacatcccatca

SEQ ID NO: 36640 - DNA, 20 bp, synthetic construct
  misc_feature 1..20: note = Synthetic Construct
  source 1..20: mol_type = other DNA
gcacaaacaccccacaggat

SEQ ID NO: 36641 - DNA, 19 bp, synthetic construct
  misc_feature 1..19: note = Synthetic Construct
  source 1..19: mol_type = other DNA
aggcattccgaggctcaca

SEQ ID NO: 36642 - DNA, 25 bp, synthetic construct
  misc_feature 1..25: note = Synthetic Construct
  source 1..25: mol_type = other DNA
gcccaatggctgggatattaaaaag

SEQ ID NO: 36643 - DNA, 19 bp, synthetic construct
  misc_feature 1..19: note = Synthetic Construct
  source 1..19: mol_type = other DNA
cgggagcagcaagtgcaaa

SEQ ID NO: 36644 - DNA, 20 bp, synthetic construct
  misc_feature 1..20: note = Synthetic Construct
  source 1..20: mol_type = other DNA
tgtccagctcagccacttgt

SEQ ID NO: 36645 - DNA, 22 bp, synthetic construct
  misc_feature 1..22: note = Synthetic Construct
  source 1..22: mol_type = other DNA
gcaggtgtcctacccaatgact

SEQ ID NO: 36646 - DNA, 22 bp, synthetic construct
  misc_feature 1..22: note = Synthetic Construct
  source 1..22: mol_type = other DNA
tctggaaggatcagaggctcaa

SEQ ID NO: 36647 - DNA, 19 bp, synthetic construct
  misc_feature 1..19: note = Synthetic Construct
  source 1..19: mol_type = other DNA
gcttgcggcagcagaacaa

SEQ ID NO: 36648 - DNA, 20 bp, synthetic construct
  misc_feature 1..20: note = Synthetic Construct
  source 1..20: mol_type = other DNA
ttgaggcctgttgggtgctt

SEQ ID NO: 36649 - DNA, 21 bp, synthetic construct
  misc_feature 1..21: note = Synthetic Construct
  source 1..21: mol_type = other DNA
gaagttgcaaaagccgtcact

SEQ ID NO: 36650 - DNA, 19 bp, synthetic construct
  misc_feature 1..19: note = Synthetic Construct
  source 1..19: mol_type = other DNA
taggtgcccgccaccacat

SEQ ID NO: 36651 - DNA, 21 bp, synthetic construct
  misc_feature 1..21: note = Synthetic Construct
  source 1..21: mol_type = other DNA
aggcactgagacagagtgagt

SEQ ID NO: 36652 - DNA, 19 bp, synthetic construct
  misc_feature 1..19: note = Synthetic Construct
  source 1..19: mol_type = other DNA
tgttaaccccgtgcagcaa

SEQ ID NO: 36653 - DNA, 20 bp, synthetic construct
  misc_feature 1..20: note = Synthetic Construct
  source 1..20: mol_type = other DNA
ctgcagaggttcggcatgaa

SEQ ID NO: 36654 - DNA, 24 bp, synthetic construct
  misc_feature 1..24: note = Synthetic Construct
  source 1..24: mol_type = other DNA
ccggggtcacatgtgcttaagtgt

SEQ ID NO: 36655 - DNA, 19 bp, synthetic construct
  misc_feature 1..19: note = Synthetic Construct
  source 1..19: mol_type = other DNA
acgcgcccaggtgatgttg

SEQ ID NO: 36656 - DNA, 19 bp, synthetic construct
  misc_feature 1..19: note = Synthetic Construct
  source 1..19: mol_type = other DNA
ctgcatctggcccctccta

SEQ ID NO: 36657 - DNA, 25 bp, synthetic construct
  misc_feature 1..25: note = Synthetic Construct
  source 1..25: mol_type = other DNA
gcctggatggacttcaaacttgctt

SEQ ID NO: 36658 - DNA, 24 bp, synthetic construct
  misc_feature 1..24: note = Synthetic Construct
  source 1..24: mol_type = other DNA
gggaaaatgagccctgtgaacttg

SEQ ID NO: 36659 - DNA, 22 bp, synthetic construct
  misc_feature 1..22: note = Synthetic Construct
  source 1..22: mol_type = other DNA
cagactggctttgtctgggaaa

SEQ ID NO: 36660 - DNA, 22 bp, synthetic construct
  misc_feature 1..22: note = Synthetic Construct
  source 1..22: mol_type = other DNA
cttgggagttggagccactttc

SEQ ID NO: 36661 - DNA, 25 bp, synthetic construct
  misc_feature 1..25: note = Synthetic Construct
  source 1..25: mol_type = other DNA
ggaggatttccacttgcttttgcat

SEQ ID NO: 36662 - DNA, 24 bp, synthetic construct
  misc_feature 1..24: note = Synthetic Construct
  source 1..24: mol_type = other DNA
ggcatagaaggattccaagactca

SEQ ID NO: 36663 - DNA, 20 bp, synthetic construct
  misc_feature 1..20: note = Synthetic Construct
  source 1..20: mol_type = other DNA
tgacgcatgcctgggaaaag

SEQ ID NO: 36664 - DNA, 21 bp, synthetic construct
  misc_feature 1..21: note = Synthetic Construct
  source 1..21: mol_type = other DNA
agggctgttcttgacacacaa

SEQ ID NO: 36665 - DNA, 22 bp, synthetic construct
  misc_feature 1..22: note = Synthetic Construct
  source 1..22: mol_type = other DNA
ctgcttcctcccacaagacaga

SEQ ID NO: 36666 - DNA, 21 bp, synthetic construct
  misc_feature 1..21: note = Synthetic Construct
  source 1..21: mol_type = other DNA
agccatccaggctccccaaat

SEQ ID NO: 36667 - DNA, 22 bp, synthetic construct
  misc_feature 1..22: note = Synthetic Construct
  source 1..22: mol_type = other DNA
cctccatgggctgtttcacatc

SEQ ID NO: 36668 - DNA, 18 bp, synthetic construct
  misc_feature 1..18: note = Synthetic Construct
  source 1..18: mol_type = other DNA
tgcaggggaaggggcaat

SEQ ID NO: 36669 - DNA, 28 bp, synthetic construct
  misc_feature 1..28: note = Synthetic Construct
  source 1..28: mol_type = other DNA
ccacctttgcatagttcagtaggggtta

SEQ ID NO: 36670 - DNA, 23 bp, synthetic construct
  misc_feature 1..23: note = Synthetic Construct
  source 1..23: mol_type = other DNA
cccatccttagcctcatcgatac

SEQ ID NO: 36671 - DNA, 23 bp, synthetic construct
  misc_feature 1..23: note = Synthetic Construct
  source 1..23: mol_type = other DNA
ggaatgccatttgggaggtgtct

SEQ ID NO: 36672 - DNA, 20 bp, synthetic construct
  misc_feature 1..20: note = Synthetic Construct
  source 1..20: mol_type = other DNA
gttcctgagtcgcaccttga

SEQ ID NO: 36673 - DNA, 21 bp, synthetic construct
  misc_feature 1..21: note = Synthetic Construct
  source 1..21: mol_type = other DNA
gagggttgggagaaacagctt

SEQ ID NO: 36674 - DNA, 19 bp, synthetic construct
  misc_feature 1..19: note = Synthetic Construct
  source 1..19: mol_type = other DNA
ggaagatccgcccctctga

SEQ ID NO: 36675 - DNA, 25 bp, synthetic construct
  misc_feature 1..25: note = Synthetic Construct
  source 1..25: mol_type = other DNA
acagagtggatgaagactcacattg

SEQ ID NO: 36676 - DNA, 22 bp, synthetic construct
  misc_feature 1..22: note = Synthetic Construct
  source 1..22: mol_type = other DNA
agaacagaagggcccctgaaag

SEQ ID NO: 36677 - DNA, 19 bp, synthetic construct
  misc_feature 1..19: note = Synthetic Construct
  source 1..19: mol_type = other DNA
agcaccgctcccacctttc

SEQ ID NO: 36678 - DNA, 27 bp, synthetic construct
  misc_feature 1..27: note = Synthetic Construct
  source 1..27: mol_type = other DNA
gcttcactccccaggagaaatgaaatg

SEQ ID NO: 36679 - DNA, 26 bp, synthetic construct
  misc_feature 1..26: note = Synthetic Construct
  source 1..26: mol_type = other DNA
gcaggaatcttgacgaagcctgatct

SEQ ID NO: 36680 - DNA, 25 bp, synthetic construct
  misc_feature 1..25: note = Synthetic Construct
  source 1..25: mol_type = other DNA
gtcccttcacaaacccagtgtttta

SEQ ID NO: 36681 - DNA, 21 bp, synthetic construct
  misc_feature 1..21: note = Synthetic Construct
  source 1..21: mol_type = other DNA
tccctacccacccctccattc

SEQ ID NO: 36682 - DNA, 22 bp, synthetic construct
  misc_feature 1..22: note = Synthetic Construct
  source 1..22: mol_type = other DNA
accccagcttgtatcccctatc

SEQ ID NO: 36683 - DNA, 22 bp, synthetic construct
  misc_feature 1..22: note = Synthetic Construct
  source 1..22: mol_type = other DNA
gaatggggatgtggtgggaatc

SEQ ID NO: 36684 - DNA, 20 bp, synthetic construct
  misc_feature 1..20: note = Synthetic Construct
  source 1..20: mol_type = other DNA
tgccagtttagacgcagtgt

SEQ ID NO: 36685 - DNA, 24 bp, synthetic construct
  misc_feature 1..24: note = Synthetic Construct
  source 1..24: mol_type = other DNA
agcaaagctttaagagcacacatc

SEQ ID NO: 36686 - DNA, 20 bp, synthetic construct
  misc_feature 1..20: note = Synthetic Construct
  source 1..20: mol_type = other DNA
ggcaggtgagaacgttcagt

SEQ ID NO: 36687 - DNA, 20 bp, synthetic construct
  misc_feature 1..20: note = Synthetic Construct
  source 1..20: mol_type = other DNA
gtgtcctgccctgaggtttg

SEQ ID NO: 36688 - DNA, 20 bp, synthetic construct
  misc_feature 1..20: note = Synthetic Construct
  source 1..20: mol_type = other DNA
tcagatccggctgactcaca

SEQ ID NO: 36689 - DNA, 20 bp, synthetic construct
  misc_feature 1..20: note = Synthetic Construct
  source 1..20: mol_type = other DNA
gcccctcatccccaccttca

SEQ ID NO: 36690 - DNA, 21 bp, synthetic construct
  misc_feature 1..21: note = Synthetic Construct
  source 1..21: mol_type = other DNA
ctgaaaccctgcaacgagact

SEQ ID NO: 36691 - DNA, 22 bp, synthetic construct
  misc_feature 1..22: note = Synthetic Construct
  source 1..22: mol_type = other DNA
cacttatcagctgggcctcaca

SEQ ID NO: 36692 - DNA, 23 bp, synthetic construct
  misc_feature 1..23: note = Synthetic Construct
  source 1..23: mol_type = other DNA
ctcagcttaaagccccagctaag

SEQ ID NO: 36693 - DNA, 21 bp, synthetic construct
  misc_feature 1..21: note = Synthetic Construct
  source 1..21: mol_type = other DNA
gctgctagttggctcctgaaa

SEQ ID NO: 36694 - DNA, 21 bp, synthetic construct
  misc_feature 1..21: note = Synthetic Construct
  source 1..21: mol_type = other DNA
ccgcagggaacaatgaaggtt

SEQ ID NO: 36695 - DNA, 21 bp, synthetic construct
  misc_feature 1..21: note = Synthetic Construct
  source 1..21: mol_type = other DNA
tgtgggtggagtcttcgtttg

SEQ ID NO: 36696 - DNA, 24 bp, synthetic construct
  misc_feature 1..24: note = Synthetic Construct
  source 1..24: mol_type = other DNA
agactggagtaacacagccataag

SEQ ID NO: 36697 - DNA, 22 bp, synthetic construct
  misc_feature 1..22: note = Synthetic Construct
  source 1..22: mol_type = other DNA
agtcagaggctccctccctttt

SEQ ID NO: 36698 - DNA, 21 bp, synthetic construct
  misc_feature 1..21: note = Synthetic Construct
  source 1..21: mol_type = other DNA
agacacagtgcacaccacttc

SEQ ID NO: 36699 - DNA, 22 bp, synthetic construct
  misc_feature 1..22: note = Synthetic Construct
  source 1..22: mol_type = other DNA
gcttagagacgctgagcaactt

SEQ ID NO: 36700 - DNA, 21 bp, synthetic construct
  misc_feature 1..21: note = Synthetic Construct
  source 1..21: mol_type = other DNA
agccgtgcagctaggagtagt

SEQ ID NO: 36701 - DNA, 21 bp, synthetic construct
  misc_feature 1..21: note = Synthetic Construct
  source 1..21: mol_type = other DNA
tcgcctttgccaacccctcta

SEQ ID NO: 36702 - DNA, 20 bp, synthetic construct
  misc_feature 1..20: note = Synthetic Construct
  source 1..20: mol_type = other DNA
gtgcctgcatctgaggtcaa

SEQ ID NO: 36703 - DNA, 20 bp, synthetic construct
  misc_feature 1..20: note = Synthetic Construct
  source 1..20: mol_type = other DNA
ctgtggcagctgcaggtttt

SEQ ID NO: 36704 - DNA, 20 bp, synthetic construct
  misc_feature 1..20: note = Synthetic Construct
  source 1..20: mol_type = other DNA
ctggctgggtttggtgacaa

SEQ ID NO: 36705 - DNA, 21 bp, synthetic construct
  misc_feature 1..21: note = Synthetic Construct
  source 1..21: mol_type = other DNA
gccggccctgactttgatctt

SEQ ID NO: 36706 - DNA, 24 bp, synthetic construct
  misc_feature 1..24: note = Synthetic Construct
  source 1..24: mol_type = other DNA
ccacctcctatggcgatggagtaa

SEQ ID NO: 36707 - DNA, 22 bp, synthetic construct
  misc_feature 1..22: note = Synthetic Construct
  source 1..22: mol_type = other DNA
ctcctagttggaccctgggtaa

SEQ ID NO: 36708 - DNA, 22 bp, synthetic construct
  misc_feature 1..22: note = Synthetic Construct
  source 1..22: mol_type = other DNA
ggacatgttgcagcccatctca

SEQ ID NO: 36709 - DNA, 23 bp, synthetic construct
  misc_feature 1..23: note = Synthetic Construct
  source 1..23: mol_type = other DNA
ggtgctgtgcatgaagacagtga

SEQ ID NO: 36710 - DNA, 20 bp, synthetic construct
  misc_feature 1..20: note = Synthetic Construct
  source 1..20: mol_type = other DNA
tccagccatcaggcactttc

SEQ ID NO: 36711 - DNA, 22 bp, synthetic construct
  misc_feature 1..22: note = Synthetic Construct
  source 1..22: mol_type = other DNA
gctcccttggagtctgcatctt

SEQ ID NO: 36712 - DNA, 20 bp, synthetic construct
  misc_feature 1..20: note = Synthetic Construct
  source 1..20: mol_type = other DNA
tggcataagcctggcacaca

SEQ ID NO: 36713 - DNA, 20 bp, synthetic construct
  misc_feature 1..20: note = Synthetic Construct
  source 1..20: mol_type = other DNA
gcttgcagctttgcctgtca

SEQ ID NO: 36714 - DNA, 21 bp, synthetic construct
  misc_feature 1..21: note = Synthetic Construct
  source 1..21: mol_type = other DNA
ggtggtgttggcttgctcttc

SEQ ID NO: 36715 - DNA, 21 bp, synthetic construct
  misc_feature 1..21: note = Synthetic Construct
  source 1..21: mol_type = other DNA
tggagccctgactgctgatct

SEQ ID NO: 36716 - DNA, 19 bp, synthetic construct
  misc_feature 1..19: note = Synthetic Construct
  source 1..19: mol_type = other DNA
tgagcagggcctagcagtt

SEQ ID NO: 36717 - DNA, 19 bp, synthetic construct
  misc_feature 1..19: note = Synthetic Construct
  source 1..19: mol_type = other DNA
gatgtgccagccacacctt

SEQ ID NO: 36718 - DNA, 21 bp, synthetic construct
  misc_feature 1..21: note = Synthetic Construct
  source 1..21: mol_type = other DNA
cccaggttggctccacattct

SEQ ID NO: 36719 - DNA, 22 bp, synthetic construct
  misc_feature 1..22: note = Synthetic Construct
  source 1..22: mol_type = other DNA
gctgtcaacttcctcccttgaa

SEQ ID NO: 36720 - DNA, 26 bp, synthetic construct
  misc_feature 1..26: note = Synthetic Construct
  source 1..26: mol_type = other DNA
tgggatgatggattcatgggttattg

SEQ ID NO: 36721 - DNA, 20 bp, synthetic construct
  misc_feature 1..20: note = Synthetic Construct
  source 1..20: mol_type = other DNA
atctccgccctgcgacagtt

SEQ ID NO: 36722 - DNA, 19 bp, synthetic construct
  misc_feature 1..19: note = Synthetic Construct
  source 1..19: mol_type = other DNA
agccctttcctggctcaca

SEQ ID NO: 36723 - DNA, 23 bp, synthetic construct
  misc_feature 1..23: note = Synthetic Construct
  source 1..23: mol_type = other DNA
gtgccatgagcagacttggtttc

SEQ ID NO: 36724 - DNA, 23 bp, synthetic construct
  misc_feature 1..23: note = Synthetic Construct
  source 1..23: mol_type = other DNA
tgtcctcagagacaatcccttga

SEQ ID NO: 36725 - DNA, 21 bp, synthetic construct
  misc_feature 1..21: note = Synthetic Construct
  source 1..21: mol_type = other DNA
ataggcacaggtccgcagaga

SEQ ID NO: 36726 - DNA, 27 bp, synthetic construct
  misc_feature 1..27: note = Synthetic Construct
  source 1..27: mol_type = other DNA
gtcacttcccatggacttacatttttg

SEQ ID NO: 36727 - DNA, 21 bp, synthetic construct
  misc_feature 1..21: note = Synthetic Construct
  source 1..21: mol_type = other DNA
cccttgtgtgctcctcagtgt

SEQ ID NO: 36728 - DNA, 21 bp, synthetic construct
  misc_feature 1..21: note = Synthetic Construct
  source 1..21: mol_type = other DNA
tctgggtggagagtggagatg

SEQ ID NO: 36729 - DNA, 20 bp, synthetic construct
  misc_feature 1..20: note = Synthetic Construct
  source 1..20: mol_type = other DNA
tgaggcatgtggtcccaaga

SEQ ID NO: 36730 - DNA, 21 bp, synthetic construct
  misc_feature 1..21: note = Synthetic Construct
  source 1..21: mol_type = other DNA
acccactgctgagcctgtttc

SEQ ID NO: 36731 - DNA, 24 bp, synthetic construct
  misc_feature 1..24: note = Synthetic Construct
  source 1..24: mol_type = other DNA
gccttttcagttttgtgccatttc

SEQ ID NO: 36732 - DNA, 20 bp, synthetic construct
  misc_feature 1..20: note = Synthetic Construct
  source 1..20: mol_type = other DNA
atcggtggccgcttgagttt

SEQ ID NO: 36733 - DNA, 20 bp, synthetic construct
  misc_feature 1..20: note = Synthetic Construct
  source 1..20: mol_type = other DNA
agggtccatctgcaggagtt

SEQ ID NO: 36734 - DNA, 19 bp, synthetic construct
  misc_feature 1..19: note = Synthetic Construct
  source 1..19: mol_type = other DNA
atgccccttccgactgttg

SEQ ID NO: 36735 - DNA, 21 bp, synthetic construct
  misc_feature 1..21: note = Synthetic Construct
  source 1..21: mol_type = other DNA
caatggcacatgctggctgta

SEQ ID NO: 36736 - DNA, 20 bp, synthetic construct
  misc_feature 1..20: note = Synthetic Construct
  source 1..20: mol_type = other DNA
ttcttcccagctccggaaac

SEQ ID NO: 36737 - DNA, 22 bp, synthetic construct
  misc_feature 1..22: note = Synthetic Construct
  source 1..22: mol_type = other DNA
ggaacactgttgacctctggtt

SEQ ID NO: 36738 - DNA, 22 bp, synthetic construct
  misc_feature 1..22: note = Synthetic Construct
  source 1..22: mol_type = other DNA
gcctggatggcaaccaacactt

SEQ ID NO: 36739 - DNA, 19 bp, synthetic construct
  misc_feature 1..19: note = Synthetic Construct
  source 1..19: mol_type = other DNA
agccaacccaagcgtcttt

SEQ ID NO: 36740 - DNA, 20 bp, synthetic construct
  misc_feature 1..20: note = Synthetic Construct
  source 1..20: mol_type = other DNA
tgggtctcaggctggcatca

SEQ ID NO: 36741 - DNA, 19 bp, synthetic construct
  misc_feature 1..19: note = Synthetic Construct
  source 1..19: mol_type = other DNA
agagcgagcccaggctttg

SEQ ID NO: 36742 - DNA, 23 bp, synthetic construct
  misc_feature 1..23: note = Synthetic Construct
  source 1..23: mol_type = other DNA
gcaccactgtgtgacagaagcta

SEQ ID NO: 36743 - DNA, 21 bp, synthetic construct
  misc_feature 1..21: note = Synthetic Construct
  source 1..21: mol_type = other DNA
aagctcctagccacccagaca

SEQ ID NO: 36744 - DNA, 20 bp, synthetic construct
  misc_feature 1..20: note = Synthetic Construct
  source 1..20: mol_type = other DNA
tcctcccaggcccaagcaat

SEQ ID NO: 36745 - DNA, 24 bp, synthetic construct
  misc_feature 1..24: note = Synthetic Construct
  source 1..24: mol_type = other DNA
cgatcagtgagggagaagggaaca

SEQ ID NO: 36746 - DNA, 22 bp, synthetic construct
  misc_feature 1..22: note = Synthetic Construct
  source 1..22: mol_type = other DNA
gctcttggccttccgcttcaat

SEQ ID NO: 36747 - DNA, 19 bp, synthetic construct
  misc_feature 1..19: note = Synthetic Construct
  source 1..19: mol_type = other DNA
tgtacgctcccctcacagt

SEQ ID NO: 36748 - DNA, 20 bp, synthetic construct
  misc_feature 1..20: note = Synthetic Construct
  source 1..20: mol_type = other DNA
aggcgtcacagtcagtggat

SEQ ID NO: 36749 - DNA, 21 bp, synthetic construct
  misc_feature 1..21: note = Synthetic Construct
  source 1..21: mol_type = other DNA
ctgccaggcaagcttttcaga

SEQ ID NO: 36750 - DNA, 19 bp, synthetic construct
  misc_feature 1..19: note = Synthetic Construct
  source 1..19: mol_type = other DNA
ggcagcagctggggaagtt

SEQ ID NO: 36751 - DNA, 26 bp, synthetic construct
  misc_feature 1..26: note = Synthetic Construct
  source 1..26: mol_type = other DNA
cacccggctacagttactaatgctat

SEQ ID NO: 36752 - DNA, 21 bp, synthetic construct
  misc_feature 1..21: note = Synthetic Construct
  source 1..21: mol_type = other DNA
cctaggaagtgctgcttcgat

SEQ ID NO: 36753 - DNA, 19 bp, synthetic construct
  misc_feature 1..19: note = Synthetic Construct
  source 1..19: mol_type = other DNA
tcgtgccctcggtctcttg

SEQ ID NO: 36754 - DNA, 22 bp, synthetic construct
  misc_feature 1..22: note = Synthetic Construct
  source 1..22: mol_type = other DNA
cccctccttacctgcaaaggtt

SEQ ID NO: 36755 - DNA, 25 bp, synthetic construct
  misc_feature 1..25: note = Synthetic Construct
  source 1..25: mol_type = other DNA
ggcacgtttggatttcaggttcgat

SEQ ID NO: 36756 - DNA, 19 bp, synthetic construct
  misc_feature 1..19: note = Synthetic Construct
  source 1..19: mol_type = other DNA
ccttcggggctgggcttta

SEQ ID NO: 36757 - DNA, 19 bp, synthetic construct
  misc_feature 1..19: note = Synthetic Construct
  source 1..19: mol_type = other DNA
cccctcctcccgatgttca

SEQ ID NO: 36758 - DNA, 20 bp, synthetic construct
  misc_feature 1..20: note = Synthetic Construct
  source 1..20: mol_type = other DNA
agcaccgagaggcaggtttg

SEQ ID NO: 36759 - DNA, 22 bp, synthetic construct
  misc_feature 1..22: note = Synthetic Construct
  source 1..22: mol_type = other DNA
actggtgtgagcaacttgtgat

SEQ ID NO: 36760 - DNA, 20 bp, synthetic construct
  misc_feature 1..20: note = Synthetic Construct
  source 1..20: mol_type = other DNA
ggccatgctgggagtgtttg

SEQ ID NO: 36761 - DNA, 20 bp, synthetic construct
  misc_feature 1..20: note = Synthetic Construct
  source 1..20: mol_type = other DNA
tgtgcagaggtgctgtggaa

SEQ ID NO: 36762 - DNA, 20 bp, synthetic construct
  misc_feature 1..20: note = Synthetic Construct
  source 1..20: mol_type = other DNA
aaggccaccctggggtgtag

SEQ ID NO: 36763 - DNA, 24 bp, synthetic construct
  misc_feature 1..24: note = Synthetic Construct
  source 1..24: mol_type = other DNA
ccgtagacgtccgaggtaatcatc

SEQ ID NO: 36764 - DNA, 19 bp, synthetic construct
  misc_feature 1..19: note = Synthetic Construct
  source 1..19: mol_type = other DNA
caccgtctcgctggcattt

SEQ ID NO: 36765 - DNA, 22 bp, synthetic construct
  misc_feature 1..22: note = Synthetic Construct
  source 1..22: mol_type = other DNA
tgtcagctgtaatgtgctgtga

SEQ ID NO: 36766 - DNA, 25 bp, synthetic construct
  misc_feature 1..25: note = Synthetic Construct
  source 1..25: mol_type = other DNA
ctgggcatatgctttgaacagattg

SEQ ID NO: 36767 - DNA, 23 bp, synthetic construct
  misc_feature 1..23: note = Synthetic Construct
  source 1..23: mol_type = other DNA
ggctgactttctgagcccctaag

SEQ ID NO: 36768 - DNA, 25 bp, synthetic construct
  misc_feature 1..25: note = Synthetic Construct
  source 1..25: mol_type = other DNA
cacaagagaagagcccatgcaaatc

SEQ ID NO: 36769 - DNA, 22 bp, synthetic construct
  misc_feature 1..22: note = Synthetic Construct
  source 1..22: mol_type = other DNA
ggggagaggaaagccatcttca

SEQ ID NO: 36770 - DNA, 20 bp, synthetic construct
  misc_feature 1..20: note = Synthetic Construct
  source 1..20: mol_type = other DNA
caccagagtggagccaactt

SEQ ID NO: 36771 - DNA, 24 bp, synthetic construct
  misc_feature 1..24: note = Synthetic Construct
  source 1..24: mol_type = other DNA
gcctgtggctaggcttaaataact

SEQ ID NO: 36772 - DNA, 18 bp, synthetic construct
  misc_feature 1..18: note = Synthetic Construct
  source 1..18: mol_type = other DNA
ctgccggaaccgcttctt

SEQ ID NO: 36773 - DNA, 23 bp, synthetic construct
  misc_feature 1..23: note = Synthetic Construct
  source 1..23: mol_type = other DNA
ctgctgtgacaggttctcaccaa

SEQ ID NO: 36774 - DNA, 25 bp, synthetic construct
  misc_feature 1..25: note = Synthetic Construct
  source 1..25: mol_type = other DNA
gggcttgtcttcagttcctcacact

SEQ ID NO: 36775 - DNA, 21 bp, synthetic construct
  misc_feature 1..21: note = Synthetic Construct
  source 1..21: mol_type = other DNA
cgctcagaacccaggtcttca

SEQ ID NO: 36776 - DNA, 20 bp, synthetic construct
  misc_feature 1..20: note = Synthetic Construct
  source 1..20: mol_type = other DNA
tgagcccaggagagaaccat

SEQ ID NO: 36777 - DNA, 20 bp, synthetic construct
  misc_feature 1..20: note = Synthetic Construct
  source 1..20: mol_type = other DNA
caaaccagcgccaagactca

SEQ ID NO: 36778 - DNA, 20 bp, synthetic construct
  misc_feature 1..20: note = Synthetic Construct
  source 1..20: mol_type = other DNA
ctgcttacggacgtggttgt

SEQ ID NO: 36779 - DNA, 22 bp, synthetic construct
  misc_feature 1..22: note = Synthetic Construct
  source 1..22: mol_type = other DNA
gtctctaccttgtggcctggtt

SEQ ID NO: 36780 - DNA, 19 bp, synthetic construct
  misc_feature 1..19: note = Synthetic Construct
  source 1..19: mol_type = other DNA
accaggagcctgggagtct

SEQ ID NO: 36781 - DNA, 22 bp, synthetic construct
  misc_feature 1..22: note = Synthetic Construct
  source 1..22: mol_type = other DNA
ggaggagctgcacgttactaag

SEQ ID NO: 36782 - DNA, 22 bp, synthetic construct
  misc_feature 1..22: note = Synthetic Construct
  source 1..22: mol_type = other DNA
gctgtgacactgctgctcttct

SEQ ID NO: 36783 - DNA, 19 bp, synthetic construct
  misc_feature 1..19: note = Synthetic Construct
  source 1..19: mol_type = other DNA
gctgggtggctctctggaa

SEQ ID NO: 36784 - DNA, 20 bp, synthetic construct
  misc_feature 1..20: note = Synthetic Construct
  source 1..20: mol_type = other DNA
tcacggcagtcacggaacat

SEQ ID NO: 36785 - DNA, 24 bp, synthetic construct
  misc_feature 1..24: note = Synthetic Construct
  source 1..24: mol_type = other DNA
tctgtttgaacgcactgttgattg

SEQ ID NO: 36786 - DNA, 22 bp, synthetic construct
  misc_feature 1..22: note = Synthetic Construct
  source 1..22: mol_type = other DNA
ggccttggctttcaaggtgttg

SEQ ID NO: 36787 - DNA, 23 bp, synthetic construct
  misc_feature 1..23: note = Synthetic Construct
  source 1..23: mol_type = other DNA
gcctaggtgtagattgggcatga

SEQ ID NO: 36788 - DNA, 18 bp, synthetic construct
  misc_feature 1..18: note = Synthetic Construct
  source 1..18: mol_type = other DNA
aacgccgtggccagaaca

SEQ ID NO: 36789 - DNA, 19 bp, synthetic construct
  misc_feature 1..19: note = Synthetic Construct
  source 1..19: mol_type = other DNA
tgcacccgccagaggaaac

SEQ ID NO: 36790 - DNA, 20 bp, synthetic construct
  misc_feature 1..20: note = Synthetic Construct
  source 1..20: mol_type = other DNA
tctggggcccctgcctcttt

SEQ ID NO: 36791 - DNA, 20 bp, synthetic construct
  misc_feature 1..20: note = Synthetic Construct
  source 1..20: mol_type = other DNA
gaacaggctggttcccatga

SEQ ID NO: 36792 - DNA, 22 bp, synthetic construct
  misc_feature 1..22: note = Synthetic Construct
  source 1..22: mol_type = other DNA
ccatgttccccttgaccctgaa

SEQ ID NO: 36793 - DNA, 20 bp, synthetic construct
  misc_feature 1..20: note = Synthetic Construct
  source 1..20: mol_type = other DNA
gcacctttccccagcactaa

SEQ ID NO: 36794 - DNA, 20 bp, synthetic construct
  misc_feature 1..20: note = Synthetic Construct
  source 1..20: mol_type = other DNA
tgtgtggccagactccaaag

SEQ ID NO: 36795 - DNA, 20 bp, synthetic construct
  misc_feature 1..20: note = Synthetic Construct
  source 1..20: mol_type = other DNA
ggaaccggagtggtgtttga

SEQ ID NO: 36796 - DNA, 22 bp, synthetic construct
  misc_feature 1..22: note = Synthetic Construct
  source 1..22: mol_type = other DNA
gaggttctcaccgtcactctgt

SEQ ID NO: 36797 - DNA, 20 bp, synthetic construct
  misc_feature 1..20: note = Synthetic Construct
  source 1..20: mol_type = other DNA
tgcatggtgtgacccgaatc

SEQ ID NO: 36798 - DNA, 21 bp, synthetic construct
  misc_feature 1..21: note = Synthetic Construct
  source 1..21: mol_type = other DNA
ttcagcctgggctccgacact

SEQ ID NO: 36799 - DNA, 18 bp, synthetic construct
  misc_feature 1..18: note = Synthetic Construct
  source 1..18: mol_type = other DNA
agactcggcctgcgtgat

SEQ ID NO: 36800 - DNA, 25 bp, synthetic construct
  misc_feature 1..25: note = Synthetic Construct
  source 1..25: mol_type = other DNA
actttgggtcttgctaaagttcagt

SEQ ID NO: 36801 - DNA, 18 bp, synthetic construct
  misc_feature 1..18: note = Synthetic Construct
  source 1..18: mol_type = other DNA
actgcgcctgagcacgta

SEQ ID NO: 36802 - DNA, 23 bp, synthetic construct
  misc_feature 1..23: note = Synthetic Construct
  source 1..23: mol_type = other DNA
gggtgggaatgagcaaagcatgt

SEQ ID NO: 36803 - DNA, 24 bp, synthetic construct
  misc_feature 1..24: note = Synthetic Construct
  source 1..24: mol_type = other DNA
cccctgggctacgagtatatgtga

SEQ ID NO: 36804 - DNA, 19 bp, synthetic construct
  misc_feature 1..19: note = Synthetic Construct
  source 1..19: mol_type = other DNA
tgtggagcagcccagatca

SEQ ID NO: 36805 - DNA, 25 bp, synthetic construct
  misc_feature 1..25: note = Synthetic Construct
  source 1..25: mol_type = other DNA
gggctatgattaggagagcctatct

SEQ ID NO: 36806 - DNA, 19 bp, synthetic construct
  misc_feature 1..19: note = Synthetic Construct
  source 1..19: mol_type = other DNA
tccgcaagcaagtgctgtt

SEQ ID NO: 36807 - DNA, 22 bp, synthetic construct
  misc_feature 1..22: note = Synthetic Construct
  source 1..22: mol_type = other DNA
aggccagggagtggttgaaaga

SEQ ID NO: 36808 - DNA, 19 bp, synthetic construct
  misc_feature 1..19: note = Synthetic Construct
  source 1..19: mol_type = other DNA
gcacctgtgcccagctact

SEQ ID NO: 36809 - DNA, 22 bp, synthetic construct
  misc_feature 1..22: note = Synthetic Construct
  source 1..22: mol_type = other DNA
ctctttcaagccagacgagtca

SEQ ID NO: 36810 - DNA, 24 bp, synthetic construct
  misc_feature 1..24: note = Synthetic Construct
  source 1..24: mol_type = other DNA
gctgatgtgtgcacagtcactatt

SEQ ID NO: 36811 - DNA, 22 bp, synthetic construct
  misc_feature 1..22: note = Synthetic Construct
  source 1..22: mol_type = other DNA
ccacggatcctcacccaaacat

SEQ ID NO: 36812 - DNA, 22 bp, synthetic construct
  misc_feature 1..22: note = Synthetic Construct
  source 1..22: mol_type = other DNA
acaaaaggatgaggcactggtt

SEQ ID NO: 36813 - DNA, 20 bp, synthetic construct
  misc_feature 1..20: note = Synthetic Construct
  source 1..20: mol_type = other DNA
aggtgcagggctcacagtaa

SEQ ID NO: 36814 - DNA, 21 bp, synthetic construct
  misc_feature 1..21: note = Synthetic Construct
  source 1..21: mol_type = other DNA
gcggctctgagggagaataca

SEQ ID NO: 36815 - DNA, 22 bp, synthetic construct
  misc_feature 1..22: note = Synthetic Construct
  source 1..22: mol_type = other DNA
ttgttggaggagggagggaaac

SEQ ID NO: 36816 - DNA, 24 bp, synthetic construct
  misc_feature 1..24: note = Synthetic Construct
  source 1..24: mol_type = other DNA
gcaggttcaggcaaagtggagaga

SEQ ID NO: 36817 - DNA, 22 bp, synthetic construct
  misc_feature 1..22: note = Synthetic Construct
  source 1..22: mol_type = other DNA
gagaagcccactgtctctctga

SEQ ID NO: 36818 - DNA, 27 bp, synthetic construct
  misc_feature 1..27: note = Synthetic Construct
  source 1..27: mol_type = other DNA
gaaggaagacttaaactggttggtaac

SEQ ID NO: 36819 - DNA, 21 bp, synthetic construct
  misc_feature 1..21: note = Synthetic Construct
  source 1..21: mol_type = other DNA
tgtggtctcagcttggtctga

SEQ ID NO: 36820 - DNA, 24 bp, synthetic construct
  misc_feature 1..24: note = Synthetic Construct
  source 1..24: mol_type = other DNA
acatactcttccttccctccaagt

SEQ ID NO: 36821 - DNA, 24 bp, synthetic construct
  misc_feature 1..24: note = Synthetic Construct
  source 1..24: mol_type = other DNA
agatgaagttaggtgttgctggaa

SEQ ID NO: 36822 - DNA, 23 bp, synthetic construct
  misc_feature 1..23: note = Synthetic Construct
  source 1..23: mol_type = other DNA
cccaccaatcaccatagccagta

SEQ ID NO: 36823 - DNA, 25 bp, synthetic construct
  misc_feature 1..25: note = Synthetic Construct
  source 1..25: mol_type = other DNA
ggacatggaactgtgacccagaaac

SEQ ID NO: 36824 - DNA, 21 bp, synthetic construct
  misc_feature 1..21: note = Synthetic Construct
  source 1..21: mol_type = other DNA
ccccacaaagaaccgcataga

SEQ ID NO: 36825 - DNA, 23 bp, synthetic construct
  misc_feature 1..23: note = Synthetic Construct
  source 1..23: mol_type = other DNA
gcaaacacatgttggcatcaact

SEQ ID NO: 36826 - DNA, 19 bp, synthetic construct
  misc_feature 1..19: note = Synthetic Construct
  source 1..19: mol_type = other DNA
ctcaccccgagacccttgt

SEQ ID NO: 36827 - DNA, 24 bp, synthetic construct
  misc_feature 1..24: note = Synthetic Construct
  source 1..24: mol_type = other DNA
gagggaaatcaaggagcaatgtct

SEQ ID NO: 36828 - DNA, 23 bp, synthetic construct
  misc_feature 1..23: note = Synthetic Construct
  source 1..23: mol_type = other DNA
gtggatggcacacagtcatggta

SEQ ID NO: 36829 - DNA, 21 bp, synthetic construct
  misc_feature 1..21: note = Synthetic Construct
  source 1..21: mol_type = other DNA
catggcacacagtgaccaagt

SEQ ID NO: 36830 - DNA, 22 bp, synthetic construct
  misc_feature 1..22: note = Synthetic Construct
  source 1..22: mol_type = other DNA
gcccgggagctatgacacaaat

SEQ ID NO: 36831 - DNA, 27 bp, synthetic construct
  misc_feature 1..27: note = Synthetic Construct
  source 1..27: mol_type = other DNA
ggcaaaacttttcctcaaccctcttag

SEQ ID NO: 36832 - DNA, 22 bp, synthetic construct
  misc_feature 1..22: note = Synthetic Construct
  source 1..22: mol_type = other DNA
acaccaacagggacaggacttg

SEQ ID NO: 36833 - DNA, 22 bp, synthetic construct
  misc_feature 1..22: note = Synthetic Construct
  source 1..22: mol_type = other DNA
atggtcaacgtgatgacagaca

SEQ ID NO: 36834 - DNA, 22 bp, synthetic construct
  misc_feature 1..22: note = Synthetic Construct
  source 1..22: mol_type = other DNA
tgtttgtaacccctccctctct

SEQ ID NO: 36835 - DNA, 24 bp, synthetic construct
  misc_feature 1..24: note = Synthetic Construct
  source 1..24: mol_type = other DNA
cctgtttgaacaaacccaatgcta

SEQ ID NO: 36836 - DNA, 20 bp, synthetic construct
  misc_feature 1..20: note = Synthetic Construct
  source 1..20: mol_type = other DNA
caggccctggggaatacaga

SEQ ID NO: 36837 - DNA, 21 bp, synthetic construct
  misc_feature 1..21: note = Synthetic Construct
  source 1..21: mol_type = other DNA
tgggaatacggtcggcagttc

SEQ ID NO: 36838 - DNA, 22 bp, synthetic construct
  misc_feature 1..22: note = Synthetic Construct
  source 1..22: mol_type = other DNA
cacctatgcttcccctcacaac

SEQ ID NO: 36839 - DNA, 18 bp, synthetic construct
  misc_feature 1..18: note = Synthetic Construct
  source 1..18: mol_type = other DNA
tgtccctgcgccttcctt

SEQ ID NO: 36840 - DNA, 24 bp, synthetic construct
  misc_feature 1..24: note = Synthetic Construct
  source 1..24: mol_type = other DNA
gccacagttgactctgcactcctt

SEQ ID NO: 36841 - DNA, 26 bp, synthetic construct
  misc_feature 1..26: note = Synthetic Construct
  source 1..26: mol_type = other DNA
ccagcccattttgagatagagctttg

SEQ ID NO: 36842 - DNA, 21 bp, synthetic construct
  misc_feature 1..21: note = Synthetic Construct
  source 1..21: mol_type = other DNA
aaccccttgacggcccatctt

SEQ ID NO: 36843 - DNA, 20 bp, synthetic construct
  misc_feature 1..20: note = Synthetic Construct
  source 1..20: mol_type = other DNA
ccaaagggtcgctacaccaa

SEQ ID NO: 36844 - DNA, 24 bp, synthetic construct
  misc_feature 1..24: note = Synthetic Construct
  source 1..24: mol_type = other DNA
ccagatggaaaagccatcgtggaa

SEQ ID NO: 36845 - DNA, 19 bp, synthetic construct
  misc_feature 1..19: note = Synthetic Construct
  source 1..19: mol_type = other DNA
acgaggcccagctgaacaa

SEQ ID NO: 36846 - DNA, 24 bp, synthetic construct
  misc_feature 1..24: note = Synthetic Construct
  source 1..24: mol_type = other DNA
cctcagcttccccagatacctgtt

SEQ ID NO: 36847 - DNA, 22 bp, synthetic construct
  misc_feature 1..22: note = Synthetic Construct
  source 1..22: mol_type = other DNA
ccaggacaggcattgagtgtga

SEQ ID NO: 36848 - DNA, 22 bp, synthetic construct
  misc_feature 1..22: note = Synthetic Construct
  source 1..22: mol_type = other DNA
tccctcagatgcctgctgttac

SEQ ID NO: 36849 - DNA, 21 bp, synthetic construct
  misc_feature 1..21: note = Synthetic Construct
  source 1..21: mol_type = other DNA
cctgctcgactctgctattgt

SEQ ID NO: 36850 - DNA, 23 bp, synthetic construct
  misc_feature 1..23: note = Synthetic Construct
  source 1..23: mol_type = other DNA
agaaatcaatggggtgcagttga

SEQ ID NO: 36851 - DNA, 23 bp, synthetic construct
  misc_feature 1..23: note = Synthetic Construct
  source 1..23: mol_type = other DNA
ggcacttccccatcactctttct

SEQ ID NO: 36852 - DNA, 20 bp, synthetic construct
  misc_feature 1..20: note = Synthetic Construct
  source 1..20: mol_type = other DNA
gggtggcctgagctaagagt

SEQ ID NO: 36853 - DNA, 19 bp, synthetic construct
  misc_feature 1..19: note = Synthetic Construct
  source 1..19: mol_type = other DNA
agtcaccccactgcaccat

SEQ ID NO: 36854 - DNA, 20 bp, synthetic construct
  misc_feature 1..20: note = Synthetic Construct
  source 1..20: mol_type = other DNA
ggcagaaggggaagcaaaca

SEQ ID NO: 36855 - DNA, 20 bp, synthetic construct
  misc_feature 1..20: note = Synthetic Construct
  source 1..20: mol_type = other DNA
tgggttgctgcagactcaac

SEQ ID NO: 36856 - DNA, 23 bp, synthetic construct
  misc_feature 1..23: note = Synthetic Construct
  source 1..23: mol_type = other DNA
ttgactgctactcccatggaatc

SEQ ID NO: 36857 - DNA, 24 bp, synthetic construct
  misc_feature 1..24: note = Synthetic Construct
  source 1..24: mol_type = other DNA
ctgagagcttaaactggacacaca

SEQ ID NO: 36858 - DNA, 24 bp, synthetic construct
  misc_feature 1..24: note = Synthetic Construct
  source 1..24: mol_type = other DNA
aggaacttccctctcctttactca

SEQ ID NO: 36859 - DNA, 22 bp, synthetic construct
  misc_feature 1..22: note = Synthetic Construct
  source 1..22: mol_type = other DNA
tgggacacctagaccacctaga

SEQ ID NO: 36860 - DNA, 20 bp, synthetic construct
  misc_feature 1..20: note = Synthetic Construct
  source 1..20: mol_type = other DNA
accaggtcccagacctcaca

SEQ ID NO: 36861 - DNA, 25 bp, synthetic construct
  misc_feature 1..25: note = Synthetic Construct
  source 1..25: mol_type = other DNA
gcacacaaaatgaggataggcaact

SEQ ID NO: 36862 - DNA, 24 bp, synthetic construct
  misc_feature 1..24: note = Synthetic Construct
  source 1..24: mol_type = other DNA
cacttcccagttacccctcagttc

SEQ ID NO: 36863 - DNA, 22 bp, synthetic construct
  misc_feature 1..22: note = Synthetic Construct
  source 1..22: mol_type = other DNA
cctcaaccttctgggctcaaac

SEQ ID NO: 36864 - DNA, 22 bp, synthetic construct
  misc_feature 1..22: note = Synthetic Construct
  source 1..22: mol_type = other DNA
agaggtaggcacagagggacta

SEQ ID NO: 36865 - DNA, 20 bp, synthetic construct
  misc_feature 1..20: note = Synthetic Construct
  source 1..20: mol_type = other DNA
ggccttagggacacccaaca

SEQ ID NO: 36866 - DNA, 24 bp, synthetic construct
  misc_feature 1..24: note = Synthetic Construct
  source 1..24: mol_type = other DNA
cacacatgccctgatcttgcctaa

SEQ ID NO: 36867 - DNA, 23 bp, synthetic construct
  misc_feature 1..23: note = Synthetic Construct
  source 1..23: mol_type = other DNA
cacattaggccaagatccactgt

SEQ ID NO: 36868 - DNA, 24 bp, synthetic construct
  misc_feature 1..24: note = Synthetic Construct
  source 1..24: mol_type = other DNA
gttgatcatcatgcaggtgggaaa

SEQ ID NO: 36869 - DNA, 24 bp, synthetic construct
  misc_feature 1..24: note = Synthetic Construct
  source 1..24: mol_type = other DNA
gcccttttcagctgtaatgtgatg

SEQ ID NO: 36870 - DNA, 21 bp, synthetic construct
  misc_feature 1..21: note = Synthetic Construct
  source 1..21: mol_type = other DNA
ggacgtgaagagaagcggttt

SEQ ID NO: 36871 - DNA, 24 bp, synthetic construct
  misc_feature 1..24: note = Synthetic Construct
  source 1..24: mol_type = other DNA
cccacatgtccacctgacttgcat

SEQ ID NO: 36872 - DNA, 20 bp, synthetic construct
  misc_feature 1..20: note = Synthetic Construct
  source 1..20: mol_type = other DNA
aaccagaccctcccaactct

SEQ ID NO: 36873 - DNA, 20 bp, synthetic construct
  misc_feature 1..20: note = Synthetic Construct
  source 1..20: mol_type = other DNA
aggcgaagagctgtgtcaac

SEQ ID NO: 36874 - DNA, 20 bp, synthetic construct
  misc_feature 1..20: note = Synthetic Construct
  source 1..20: mol_type = other DNA
tgggctgaccactgactaca

SEQ ID NO: 36875 - DNA, 22 bp, synthetic construct
  misc_feature 1..22: note = Synthetic Construct
  source 1..22: mol_type = other DNA
ccgaagtcgtgtcatcggaagt

SEQ ID NO: 36876 - DNA, 23 bp, synthetic construct
  misc_feature 1..23: note = Synthetic Construct
  source 1..23: mol_type = other DNA
gctggattagagtaggggcaatg

SEQ ID NO: 36877 - DNA, 20 bp, synthetic construct
  misc_feature 1..20: note = Synthetic Construct
  source 1..20: mol_type = other DNA
tccgtctcaggagggtttca

SEQ ID NO: 36878 - DNA, 24 bp, synthetic construct
  misc_feature 1..24: note = Synthetic Construct
  source 1..24: mol_type = other DNA
ctgcctccttcgatcttctggaaa

SEQ ID NO: 36879 - DNA, 21 bp, synthetic construct
  misc_feature 1..21: note = Synthetic Construct
  source 1..21: mol_type = other DNA
gtccccagccaaactttccaa

SEQ ID NO: 36880 - DNA, 25 bp, synthetic construct
  misc_feature 1..25: note = Synthetic Construct
  source 1..25: mol_type = other DNA
caggtagtttgtcgagagcaagtca

SEQ ID NO: 36881 - DNA, 22 bp, synthetic construct
  misc_feature 1..22: note = Synthetic Construct
  source 1..22: mol_type = other DNA
acagaccagagtggggacttgt

SEQ ID NO: 36882 - DNA, 22 bp, synthetic construct
  misc_feature 1..22: note = Synthetic Construct
  source 1..22: mol_type = other DNA
tcctccagtttccacgggagat

SEQ ID NO: 36883 - DNA, 23 bp, synthetic construct
  misc_feature 1..23: note = Synthetic Construct
  source 1..23: mol_type = other DNA
gagtctcttgaggcacttagcat

SEQ ID NO: 36884 - DNA, 23 bp, synthetic construct
  misc_feature 1..23: note = Synthetic Construct
  source 1..23: mol_type = other DNA
ggacgttcaaaccctgatgaaag

SEQ ID NO: 36885 - DNA, 20 bp, synthetic construct
  misc_feature 1..20: note = Synthetic Construct
  source 1..20: mol_type = other DNA
acaatgctcccgaggtgaga

SEQ ID NO: 36886 - DNA, 20 bp, synthetic construct
  misc_feature 1..20: note = Synthetic Construct
  source 1..20: mol_type = other DNA
actgatggaggtggcctgaa

SEQ ID NO: 36887 - DNA, 25 bp, synthetic construct
  misc_feature 1..25: note = Synthetic Construct
  source 1..25: mol_type = other DNA
cagctaaatccaacaggctatgaca

SEQ ID NO: 36888 - DNA, 22 bp, synthetic construct
  misc_feature 1..22: note = Synthetic Construct
  source 1..22: mol_type = other DNA
gccaagaaaggtcgcctcaatg

SEQ ID NO: 36889 - DNA, 26 bp, synthetic construct
  misc_feature 1..26: note = Synthetic Construct
  source 1..26: mol_type = other DNA
gccatcactgtatcctctccatcact

SEQ ID NO: 36890 - DNA, 20 bp, synthetic construct
  misc_feature 1..20: note = Synthetic Construct
  source 1..20: mol_type = other DNA
gggtccctctgcctggaatg

SEQ ID NO: 36891 - DNA, 21 bp, synthetic construct
  misc_feature 1..21: note = Synthetic Construct
  source 1..21: mol_type = other DNA
gcccctgcagtgtcaggaaat

SEQ ID NO: 36892 - DNA, 24 bp, synthetic construct
  misc_feature 1..24: note = Synthetic Construct
  source 1..24: mol_type = other DNA
ggaacaaaaccatggatggctgat

SEQ ID NO: 36893 - DNA, 19 bp, synthetic construct
  misc_feature 1..19: note = Synthetic Construct
  source 1..19: mol_type = other DNA
gcgaaacgcgtgccttaca

SEQ ID NO: 36894 - DNA, 22 bp, synthetic construct
  misc_feature 1..22: note = Synthetic Construct
  source 1..22: mol_type = other DNA
ccacacttcggcttgaccaact

SEQ ID NO: 36895 - DNA, 21 bp, synthetic construct
  misc_feature 1..21: note = Synthetic Construct
  source 1..21: mol_type = other DNA
gccctgcctaaccacatgttc

SEQ ID NO: 36896 - DNA, 24 bp, synthetic construct
  misc_feature 1..24: note = Synthetic Construct
  source 1..24: mol_type = other DNA
ctcccttaaggaaacccacagttg

SEQ ID NO: 36897 - DNA, 22 bp, synthetic construct
  misc_feature 1..22: note = Synthetic Construct
  source 1..22: mol_type = other DNA
cttgacttgctgaggactgaca

SEQ ID NO: 36898 - DNA, 21 bp, synthetic construct
  misc_feature 1..21: note = Synthetic Construct
  source 1..21: mol_type = other DNA
gggaaggtccgcagagacaat

SEQ ID NO: 36899 - DNA, 24 bp, synthetic construct
  misc_feature 1..24: note = Synthetic Construct
  source 1..24: mol_type = other DNA
gacatggaaaaggctggaatgtag

SEQ ID NO: 36900 - DNA, 23 bp, synthetic construct
  misc_feature 1..23: note = Synthetic Construct
  source 1..23: mol_type = other DNA
tgctgatccacatacctcctcaa

SEQ ID NO: 36901 - DNA, 25 bp, synthetic construct
  misc_feature 1..25: note = Synthetic Construct
  source 1..25: mol_type = other DNA
cttcattgaatctccagtgggaaca

SEQ ID NO: 36902 - DNA, 21 bp, synthetic construct
  misc_feature 1..21: note = Synthetic Construct
  source 1..21: mol_type = other DNA
tcctggtcttctcccagtgtt

SEQ ID NO: 36903 - DNA, 24 bp, synthetic construct
  misc_feature 1..24: note = Synthetic Construct
  source 1..24: mol_type = other DNA
ccaaaatagctccccaaacccttt

SEQ ID NO: 36904 - DNA, 19 bp, synthetic construct
  misc_feature 1..19: note = Synthetic Construct
  source 1..19: mol_type = other DNA
agcccaggacctgcccaaa

SEQ ID NO: 36905 - DNA, 20 bp, synthetic construct
  misc_feature 1..20: note = Synthetic Construct
  source 1..20: mol_type = other DNA
ttgcccttgctggtgctgaa

SEQ ID NO: 36906 - DNA, 22 bp, synthetic construct
  misc_feature 1..22: note = Synthetic Construct
  source 1..22: mol_type = other DNA
cactgactggagctgggttcaa

SEQ ID NO: 36907 - DNA, 24 bp, synthetic construct
  misc_feature 1..24: note = Synthetic Construct
  source 1..24: mol_type = other DNA
acgagccagagacatccttaaaaa

SEQ ID NO: 36908 - DNA, 20 bp, synthetic construct
  misc_feature 1..20: note = Synthetic Construct
  source 1..20: mol_type = other DNA
ctccaactgcttggcctctt

SEQ ID NO: 36909 - DNA, 22 bp, synthetic construct
  misc_feature 1..22: note = Synthetic Construct
  source 1..22: mol_type = other DNA
acttctttgagcttcccagcat

SEQ ID NO: 36910 - DNA, 25 bp, synthetic construct
  misc_feature 1..25: note = Synthetic Construct
  source 1..25: mol_type = other DNA
agaagagatgtccttccctgagaat

SEQ ID NO: 36911 - DNA, 24 bp, synthetic construct
  misc_feature 1..24: note = Synthetic Construct
  source 1..24: mol_type = other DNA
gtggcatttgaagacactcgtaac

SEQ ID NO: 36912 - DNA, 23 bp, synthetic construct
  misc_feature 1..23: note = Synthetic Construct
  source 1..23: mol_type = other DNA
ggaatctacaccactgcctctct

SEQ ID NO: 36913 - DNA, 23 bp, synthetic construct
  misc_feature 1..23: note = Synthetic Construct
  source 1..23: mol_type = other DNA
caccacactacagccacatgagt

SEQ ID NO: 36914 - DNA, 25 bp, synthetic construct
  misc_feature 1..25: note = Synthetic Construct
  source 1..25: mol_type = other DNA
gtctcgaggagaatagcatgtcttg

SEQ ID NO: 36915 - DNA, 28 bp, synthetic construct
  misc_feature 1..28: note = Synthetic Construct
  source 1..28: mol_type = other DNA
ctgtgtaaactataccagggagactaag

SEQ ID NO: 36916 - DNA, 24 bp, synthetic construct
  misc_feature 1..24: note = Synthetic Construct
  source 1..24: mol_type = other DNA
cagctacttcatcccttccctact

SEQ ID NO: 36917 - DNA, 18 bp, synthetic construct
  misc_feature 1..18: note = Synthetic Construct
  source 1..18: mol_type = other DNA
cagcaagcccgtccagtt

SEQ ID NO: 36918 - DNA, 22 bp, synthetic construct
  misc_feature 1..22: note = Synthetic Construct
  source 1..22: mol_type = other DNA
gctcagcccaaagcctcaaaac

SEQ ID NO: 36919 - DNA, 22 bp, synthetic construct
  misc_feature 1..22: note = Synthetic Construct
  source 1..22: mol_type = other DNA
gctgccattcaagaacagcaat

SEQ ID NO: 36920 - DNA, 25 bp, synthetic construct
  misc_feature 1..25: note = Synthetic Construct
  source 1..25: mol_type = other DNA
gagatggaggttatgcatggattct

SEQ ID NO: 36921 - DNA, 23 bp, synthetic construct
  misc_feature 1..23: note = Synthetic Construct
  source 1..23: mol_type = other DNA
gccatcaccatggatgaggaaag

SEQ ID NO: 36922 - DNA, 21 bp, synthetic construct
  misc_feature 1..21: note = Synthetic Construct
  source 1..21: mol_type = other DNA
cagacaggaatgggcatgcaa

SEQ ID NO: 36923 - DNA, 23 bp, synthetic construct
  misc_feature 1..23: note = Synthetic Construct
  source 1..23: mol_type = other DNA
ttagcgatcccagttcacctaac

SEQ ID NO: 36924 - DNA, 25 bp, synthetic construct
  misc_feature 1..25: note = Synthetic Construct
  source 1..25: mol_type = other DNA
gcagctgaaatctgccaccttaact

SEQ ID NO: 36925 - DNA, 21 bp, synthetic construct
  misc_feature 1..21: note = Synthetic Construct
  source 1..21: mol_type = other DNA
tgcaggacagtgggctccaaa

SEQ ID NO: 36926 - DNA, 24 bp, synthetic construct
  misc_feature 1..24: note = Synthetic Construct
  source 1..24: mol_type = other DNA
gcacaggaatgcatgaagcgaaac

SEQ ID NO: 36927 - DNA, 27 bp, synthetic construct
  misc_feature 1..27: note = Synthetic Construct
  source 1..27: mol_type = other DNA
ggacttgccctgatttctttcctgagt

SEQ ID NO: 36928 - DNA, 26 bp, synthetic construct
  misc_feature 1..26: note = Synthetic Construct
  source 1..26: mol_type = other DNA
gtctctatctcagtctaaggggatct

SEQ ID NO: 36929 - DNA, 27 bp, synthetic construct
  misc_feature 1..27: note = Synthetic Construct
  source 1..27: mol_type = other DNA
cacacatctggtcatttctccttcaac

SEQ ID NO: 36930 - DNA, 20 bp, synthetic construct
  misc_feature 1..20: note = Synthetic Construct
  source 1..20: mol_type = other DNA
tcgtggtgcatgccgatagt

SEQ ID NO: 36931 - DNA, 20 bp, synthetic construct
  misc_feature 1..20: note = Synthetic Construct
  source 1..20: mol_type = other DNA
cagctgcaaggtgcatggtt

SEQ ID NO: 36932 - DNA, 22 bp, synthetic construct
  misc_feature 1..22: note = Synthetic Construct
  source 1..22: mol_type = other DNA
ggaacctgcagcgttggtaaga

SEQ ID NO: 36933 - DNA, 20 bp, synthetic construct
  misc_feature 1..20: note = Synthetic Construct
  source 1..20: mol_type = other DNA
ggtgtgtgtggtgtgctgat

SEQ ID NO: 36934 - DNA, 22 bp, synthetic construct
  misc_feature 1..22: note = Synthetic Construct
  source 1..22: mol_type = other DNA
ggatcctgtgaagaggccaaat

SEQ ID NO: 36935 - DNA, 24 bp, synthetic construct
  misc_feature 1..24: note = Synthetic Construct
  source 1..24: mol_type = other DNA
cctctctgggcattatggttctga

SEQ ID NO: 36936 - DNA, 20 bp, synthetic construct
  misc_feature 1..20: note = Synthetic Construct
  source 1..20: mol_type = other DNA
ggctgtgtgtccgctgtgta

SEQ ID NO: 36937 - DNA, 22 bp, synthetic construct
  misc_feature 1..22: note = Synthetic Construct
  source 1..22: mol_type = other DNA
ccgtggctgtctgagatacact

SEQ ID NO: 36938 - DNA, 24 bp, synthetic construct
  misc_feature 1..24: note = Synthetic Construct
  source 1..24: mol_type = other DNA
cgtcaagttcaagtctcacctttc

SEQ ID NO: 36939 - DNA, 20 bp, synthetic construct
  misc_feature 1..20: note = Synthetic Construct
  source 1..20: mol_type = other DNA
tgctgtctgcccacagactt

SEQ ID NO: 36940 - DNA, 20 bp, synthetic construct
  misc_feature 1..20: note = Synthetic Construct
  source 1..20: mol_type = other DNA
gcgctgctgtctctggaaat

SEQ ID NO: 36941 - DNA, 26 bp, synthetic construct
  misc_feature 1..26: note = Synthetic Construct
  source 1..26: mol_type = other DNA
gacagagttcctgtcggaaaacaaag

SEQ ID NO: 36942 - DNA, 19 bp, synthetic construct
  misc_feature 1..19: note = Synthetic Construct
  source 1..19: mol_type = other DNA
catcgcagcgagctctcaa

SEQ ID NO: 36943 - DNA, 22 bp, synthetic construct
  misc_feature 1..22: note = Synthetic Construct
  source 1..22: mol_type = other DNA
ccaagttcgcacacctcctgaa

SEQ ID NO: 36944 - DNA, 25 bp, synthetic construct
  misc_feature 1..25: note = Synthetic Construct
  source 1..25: mol_type = other DNA
cactctccagcatcttaaggaacaa

SEQ ID NO: 36945 - DNA, 22 bp, synthetic construct
  misc_feature 1..22: note = Synthetic Construct
  source 1..22: mol_type = other DNA
gggaagcttcaggcttggttca

SEQ ID NO: 36946 - DNA, 23 bp, synthetic construct
  misc_feature 1..23: note = Synthetic Construct
  source 1..23: mol_type = other DNA
gccatccagaaccattcctgtca

SEQ ID NO: 36947 - DNA, 22 bp, synthetic construct
  misc_feature 1..22: note = Synthetic Construct
  source 1..22: mol_type = other DNA
ttggagagcagtttgagcatct

SEQ ID NO: 36948 - DNA, 20 bp, synthetic construct
  misc_feature 1..20: note = Synthetic Construct
  source 1..20: mol_type = other DNA
cgtgtaggctgggaccacat

SEQ ID NO: 36949 - DNA, 20 bp, synthetic construct
  misc_feature 1..20: note = Synthetic Construct
  source 1..20: mol_type = other DNA
ggaaatggccaccagagctt

SEQ ID NO: 36950 - DNA, 23 bp, synthetic construct
  misc_feature 1..23: note = Synthetic Construct
  source 1..23: mol_type = other DNA
agaggaagagggtggagaagtag

SEQ ID NO: 36951 - DNA, 23 bp, synthetic construct
  misc_feature 1..23: note = Synthetic Construct
  source 1..23: mol_type = other DNA
gcgggaaaatgaccagagcagat

SEQ ID NO: 36952 - DNA, 22 bp, synthetic construct
  misc_feature 1..22: note = Synthetic Construct
  source 1..22: mol_type = other DNA
ctgggcaaccgtcaggattatg

SEQ ID NO: 36953 - DNA, 24 bp, synthetic construct
  misc_feature 1..24: note = Synthetic Construct
  source 1..24: mol_type = other DNA
caaaccaaagtgaacaccaacagt

SEQ ID NO: 36954 - DNA, 21 bp, synthetic construct
  misc_feature 1..21: note = Synthetic Construct
  source 1..21: mol_type = other DNA
tcacagtgtgccacggattac

SEQ ID NO: 36955 - DNA, 22 bp, synthetic construct
  misc_feature 1..22: note = Synthetic Construct
  source 1..22: mol_type = other DNA
ccttgcacagagcggaaaggat

SEQ ID NO: 36956 - DNA, 20 bp, synthetic construct
  misc_feature 1..20: note = Synthetic Construct
  source 1..20: mol_type = other DNA
tctgcttccagtggggactt

SEQ ID NO: 36957 - DNA, 22 bp, synthetic construct
  misc_feature 1..22: note = Synthetic Construct
  source 1..22: mol_type = other DNA
cctcacttccaacacagggaat

SEQ ID NO: 36958 - DNA, 22 bp, synthetic construct
  misc_feature 1..22: note = Synthetic Construct
  source 1..22: mol_type = other DNA
cctgaggtcaccacgctagttg

SEQ ID NO: 36959 - DNA, 22 bp, synthetic construct
  misc_feature 1..22: note = Synthetic Construct
  source 1..22: mol_type = other DNA
ccgtcacccaaccctcaaaagt

SEQ ID NO: 36960 - DNA, 22 bp, synthetic construct
  misc_feature 1..22: note = Synthetic Construct
  source 1..22: mol_type = other DNA
accagcacctagatgccactgt

SEQ ID NO: 36961 - DNA, 20 bp, synthetic construct
  misc_feature 1..20: note = Synthetic Construct
  source 1..20: mol_type = other DNA
tgcatgatccaggcgtcaac

SEQ ID NO: 36962 - DNA, 23 bp, synthetic construct
  misc_feature 1..23: note = Synthetic Construct
  source 1..23: mol_type = other DNA
gacttagggaagtggtgctggat

SEQ ID NO: 36963 - DNA, 21 bp, synthetic construct
  misc_feature 1..21: note = Synthetic Construct
  source 1..21: mol_type = other DNA
ccccaggtctgtagcaagaca

SEQ ID NO: 36964 - DNA, 21 bp, synthetic construct
  misc_feature 1..21: note = Synthetic Construct
  source 1..21: mol_type = other DNA
gcctccactgagcttcagcaa

SEQ ID NO: 36965 - DNA, 19 bp, synthetic construct
  misc_feature 1..19: note = Synthetic Construct
  source 1..19: mol_type = other DNA
agccgctcccttccttttc

SEQ ID NO: 36966 - DNA, 20 bp, synthetic construct
  misc_feature 1..20: note = Synthetic Construct
  source 1..20: mol_type = other DNA
actgcagcctcaacctctca

SEQ ID NO: 36967 - DNA, 26 bp, synthetic construct
  misc_feature 1..26: note = Synthetic Construct
  source 1..26: mol_type = other DNA
ccagagtcagcagtaggaaggagttc

SEQ ID NO: 36968 - DNA, 23 bp, synthetic construct
  misc_feature 1..23: note = Synthetic Construct
  source 1..23: mol_type = other DNA
gcctttagctctccactcacaga

SEQ ID NO: 36969 - DNA, 21 bp, synthetic construct
  misc_feature 1..21: note = Synthetic Construct
  source 1..21: mol_type = other DNA
gactcggttgcacccaaaatg

SEQ ID NO: 36970 - DNA, 22 bp, synthetic construct
  misc_feature 1..22: note = Synthetic Construct
  source 1..22: mol_type = other DNA
gcaagacacaggcactctgatg

SEQ ID NO: 36971 - DNA, 24 bp, synthetic construct
  misc_feature 1..24: note = Synthetic Construct
  source 1..24: mol_type = other DNA
tcctaggatctgcactaacacgta

SEQ ID NO: 36972 - DNA, 24 bp, synthetic construct
  misc_feature 1..24: note = Synthetic Construct
  source 1..24: mol_type = other DNA
ggggaaggaattcagggagagaca

SEQ ID NO: 36973 - DNA, 20 bp, synthetic construct
  misc_feature 1..20: note = Synthetic Construct
  source 1..20: mol_type = other DNA
ggcttgaggccatcgtgcta

SEQ ID NO: 36974 - DNA, 22 bp, synthetic construct
  misc_feature 1..22: note = Synthetic Construct
  source 1..22: mol_type = other DNA
ccctgtggatctacccctcttt

SEQ ID NO: 36975 - DNA, 20 bp, synthetic construct
  misc_feature 1..20: note = Synthetic Construct
  source 1..20: mol_type = other DNA
aaggggcatggtggcgaaga

SEQ ID NO: 36976 - DNA, 23 bp, synthetic construct
  misc_feature 1..23: note = Synthetic Construct
  source 1..23: mol_type = other DNA
ctccccactaaggatgaggaact

SEQ ID NO: 36977 - DNA, 25 bp, synthetic construct
  misc_feature 1..25: note = Synthetic Construct
  source 1..25: mol_type = other DNA
ggctggctaacaatgggttatctct

SEQ ID NO: 36978 - DNA, 22 bp, synthetic construct
  misc_feature 1..22: note = Synthetic Construct
  source 1..22: mol_type = other DNA
agagaggcagagggacatttga

SEQ ID NO: 36979 - DNA, 24 bp, synthetic construct
  misc_feature 1..24: note = Synthetic Construct
  source 1..24: mol_type = other DNA
ccattcgcagtaattctccaccta

SEQ ID NO: 36980 - DNA, 24 bp, synthetic construct
  misc_feature 1..24: note = Synthetic Construct
  source 1..24: mol_type = other DNA
gcattgagaaactgaagcacatct

SEQ ID NO: 36981 - DNA, 23 bp, synthetic construct
  misc_feature 1..23: note = Synthetic Construct
  source 1..23: mol_type = other DNA
cagcttaattctcccagcagcaa

SEQ ID NO: 36982 - DNA, 22 bp, synthetic construct
  misc_feature 1..22: note = Synthetic Construct
  source 1..22: mol_type = other DNA
ccaggcaagtgaccctgtgtta

SEQ ID NO: 36983 - DNA, 23 bp, synthetic construct
  misc_feature 1..23: note = Synthetic Construct
  source 1..23: mol_type = other DNA
gtgcaatcgtgctttccaagaca

SEQ ID NO: 36984 - DNA, 22 bp, synthetic construct
  misc_feature 1..22: note = Synthetic Construct
  source 1..22: mol_type = other DNA
ggtgtggtgggaggatcacttg

SEQ ID NO: 36985 - DNA, 24 bp, synthetic construct
  misc_feature 1..24: note = Synthetic Construct
  source 1..24: mol_type = other DNA
tcctctaaggagtggcatgatcta

SEQ ID NO: 36986 - DNA, 23 bp, synthetic construct
  misc_feature 1..23: note = Synthetic Construct
  source 1..23: mol_type = other DNA
tgcaagtctgtgtcctactgaac

SEQ ID NO: 36987 - DNA, 22 bp, synthetic construct
  misc_feature 1..22: note = Synthetic Construct
  source 1..22: mol_type = other DNA
ccctttgctcagccatgcatca

SEQ ID NO: 36988 - DNA, 26 bp, synthetic construct
  misc_feature 1..26: note = Synthetic Construct
  source 1..26: mol_type = other DNA
ggcattgatcacaagtgagactggaa

SEQ ID NO: 36989 - DNA, 25 bp, synthetic construct
  misc_feature 1..25: note = Synthetic Construct
  source 1..25: mol_type = other DNA
cctgacatggaagggtttcctggta

SEQ ID NO: 36990 - DNA, 24 bp, synthetic construct
  misc_feature 1..24: note = Synthetic Construct
  source 1..24: mol_type = other DNA
cgctaatgaattgcctgggacata

SEQ ID NO: 36991 - DNA, 23 bp, synthetic construct
  misc_feature 1..23: note = Synthetic Construct
  source 1..23: mol_type = other DNA
ccctacagaacggttgagaggtt

SEQ ID NO: 36992 - DNA, 26 bp, synthetic construct
  misc_feature 1..26: note = Synthetic Construct
  source 1..26: mol_type = other DNA
gtcctccttattcctttctgctcttg

SEQ ID NO: 36993 - DNA, 20 bp, synthetic construct
  misc_feature 1..20: note = Synthetic Construct
  source 1..20: mol_type = other DNA
tggcagttttcagccacaca

SEQ ID NO: 36994 - DNA, 20 bp, synthetic construct
  misc_feature 1..20: note = Synthetic Construct
  source 1..20: mol_type = other DNA
tgggtgcataaggcggtaca

SEQ ID NO: 36995 - DNA, 23 bp, synthetic construct
  misc_feature 1..23: note = Synthetic Construct
  source 1..23: mol_type = other DNA
gtcactgggaacgagtggttcaa

SEQ ID NO: 36996 - DNA, 23 bp, synthetic construct
  misc_feature 1..23: note = Synthetic Construct
  source 1..23: mol_type = other DNA
gctctcagcattttccaggcatt

SEQ ID NO: 36997 - DNA, 23 bp, synthetic construct
  misc_feature 1..23: note = Synthetic Construct
  source 1..23: mol_type = other DNA
gtggagcttaacccatgaaggtt

SEQ ID NO: 36998 - DNA, 23 bp, synthetic construct
  misc_feature 1..23: note = Synthetic Construct
  source 1..23: mol_type = other DNA
ccacaagttggacacccttggat

SEQ ID NO: 36999 - DNA, 20 bp, synthetic construct
  misc_feature 1..20: note = Synthetic Construct
  source 1..20: mol_type = other DNA
ctctgcctggttgggattgt

SEQ ID NO: 37000 - DNA, 22 bp, synthetic construct
  misc_feature 1..22: note = Synthetic Construct
  source 1..22: mol_type = other DNA
actgttttcagcagacctgtgt

SEQ ID NO: 37001 - DNA, 22 bp, synthetic construct
  misc_feature 1..22: note = Synthetic Construct
  source 1..22: mol_type = other DNA
gcctggatgtctgccatgatct

SEQ ID NO: 37002 - DNA, 22 bp, synthetic construct
  misc_feature 1..22: note = Synthetic Construct
  source 1..22: mol_type = other DNA
cctcccatgttggaggaagcat

SEQ ID NO: 37003 - DNA, 24 bp, synthetic construct
  misc_feature 1..24: note = Synthetic Construct
  source 1..24: mol_type = other DNA
ggggatcaataagccatcgataca

SEQ ID NO: 37004 - DNA, 20 bp, synthetic construct
  misc_feature 1..20: note = Synthetic Construct
  source 1..20: mol_type = other DNA
ccttggttgtgcctccactt

SEQ ID NO: 37005 - DNA, 25 bp, synthetic construct
  misc_feature 1..25: note = Synthetic Construct
  source 1..25: mol_type = other DNA
cccttgtctaaccagtgatactgaa

SEQ ID NO: 37006 - DNA, 25 bp, synthetic construct
  misc_feature 1..25: note = Synthetic Construct
  source 1..25: mol_type = other DNA
ttcttctgcagacacaaatggaaag

SEQ ID NO: 37007 - DNA, 21 bp, synthetic construct
  misc_feature 1..21: note = Synthetic Construct
  source 1..21: mol_type = other DNA
tccctcgccagtccatcttct

SEQ ID NO: 37008 - DNA, 22 bp, synthetic construct
  misc_feature 1..22: note = Synthetic Construct
  source 1..22: mol_type = other DNA
agtcccacccctcccctataaa

SEQ ID NO: 37009 - DNA, 20 bp, synthetic construct
  misc_feature 1..20: note = Synthetic Construct
  source 1..20: mol_type = other DNA
tgccaagtctgctccaggaa

SEQ ID NO: 37010 - DNA, 25 bp, synthetic construct
  misc_feature 1..25: note = Synthetic Construct
  source 1..25: mol_type = other DNA
gtgctctgaaagtgtgggttcttct

SEQ ID NO: 37011 - DNA, 26 bp, synthetic construct
  misc_feature 1..26: note = Synthetic Construct
  source 1..26: mol_type = other DNA
ccttgaaaacactcagggactagaag

SEQ ID NO: 37012 - DNA, 22 bp, synthetic construct
  misc_feature 1..22: note = Synthetic Construct
  source 1..22: mol_type = other DNA
ccccatgtagcagggtcttctt

SEQ ID NO: 37013 - DNA, 24 bp, synthetic construct
  misc_feature 1..24: note = Synthetic Construct
  source 1..24: mol_type = other DNA
ttttccattgagagaggtgcagat

SEQ ID NO: 37014 - DNA, 23 bp, synthetic construct
  misc_feature 1..23: note = Synthetic Construct
  source 1..23: mol_type = other DNA
gattttcagccagccatcctttg

SEQ ID NO: 37015 - DNA, 23 bp, synthetic construct
  misc_feature 1..23: note = Synthetic Construct
  source 1..23: mol_type = other DNA
ggatgcagcaaaagtatgccatt

SEQ ID NO: 37016 - DNA, 22 bp, synthetic construct
  misc_feature 1..22: note = Synthetic Construct
  source 1..22: mol_type = other DNA
tggagacagcaggaaccacaga

SEQ ID NO: 37017 - DNA, 22 bp, synthetic construct
  misc_feature 1..22: note = Synthetic Construct
  source 1..22: mol_type = other DNA
gagcctgttgtgacctgattct

SEQ ID NO: 37018 - DNA, 22 bp, synthetic construct
  misc_feature 1..22: note = Synthetic Construct
  source 1..22: mol_type = other DNA
acgattctggaggcaaggagta

SEQ ID NO: 37019 - DNA, 23 bp, synthetic construct
  misc_feature 1..23: note = Synthetic Construct
  source 1..23: mol_type = other DNA
cggctatctctgtctccatcaac

SEQ ID NO: 37020 - DNA, 23 bp, synthetic construct
  misc_feature 1..23: note = Synthetic Construct
  source 1..23: mol_type = other DNA
cccacatggtagcctctttcact

SEQ ID NO: 37021 - DNA, 21 bp, synthetic construct
  misc_feature 1..21: note = Synthetic Construct
  source 1..21: mol_type = other DNA
ggagcagggtgttttgctgtt

SEQ ID NO: 37022 - DNA, 24 bp, synthetic construct
  misc_feature 1..24: note = Synthetic Construct
  source 1..24: mol_type = other DNA
gggcttgggtgtgggagaaaagta

SEQ ID NO: 37023 - DNA, 23 bp, synthetic construct
  misc_feature 1..23: note = Synthetic Construct
  source 1..23: mol_type = other DNA
agaagagcagagcaggtttgatg

SEQ ID NO: 37024 - DNA, 24 bp, synthetic construct
  misc_feature 1..24: note = Synthetic Construct
  source 1..24: mol_type = other DNA
cctcatcaagccccatagcctcat

SEQ ID NO: 37025 - DNA, 30 bp, synthetic construct
  misc_feature 1..30: note = Synthetic Construct
  source 1..30: mol_type = other DNA
ctgaggctttaactctttgactcgaatatg

SEQ ID NO: 37026 - DNA, 24 bp, synthetic construct
  misc_feature 1..24: note = Synthetic Construct
  source 1..24: mol_type = other DNA
gaggatggaacctgtgaaaaccta

SEQ ID NO: 37027 - DNA, 21 bp, synthetic construct
  misc_feature 1..21: note = Synthetic Construct
  source 1..21: mol_type = other DNA
actcttggcttgcttgcattg

SEQ ID NO: 37028 - DNA, 22 bp, synthetic construct
  misc_feature 1..22: note = Synthetic Construct
  source 1..22: mol_type = other DNA
ctgctagagcttctggccaagt

SEQ ID NO: 37029 - DNA, 24 bp, synthetic construct
  misc_feature 1..24: note = Synthetic Construct
  source 1..24: mol_type = other DNA
acaaagatgatgtcacctgcctaa

SEQ ID NO: 37030 - DNA, 26 bp, synthetic construct
  misc_feature 1..26: note = Synthetic Construct
  source 1..26: mol_type = other DNA
ggttatgtcaatgagagcagcctttg

SEQ ID NO: 37031 - DNA, 22 bp, synthetic construct
  misc_feature 1..22: note = Synthetic Construct
  source 1..22: mol_type = other DNA
cacttagccgtgcaggaacaac

SEQ ID NO: 37032 - DNA, 21 bp, synthetic construct
  misc_feature 1..21: note = Synthetic Construct
  source 1..21: mol_type = other DNA
gggcaggacttgcatcaggaa

SEQ ID NO: 37033 - DNA, 24 bp, synthetic construct
  misc_feature 1..24: note = Synthetic Construct
  source 1..24: mol_type = other DNA
aatatgcagactcaaggtcacact

SEQ ID NO: 37034 - DNA, 23 bp, synthetic construct
  misc_feature 1..23: note = Synthetic Construct
  source 1..23: mol_type = other DNA
ggagatcccacccagtgaggaaa

SEQ ID NO: 37035 - DNA, 21 bp, synthetic construct
  misc_feature 1..21: note = Synthetic Construct
  source 1..21: mol_type = other DNA
tgctcacatcacatgcccatt

SEQ ID NO: 37036 - DNA, 19 bp, synthetic construct
  misc_feature 1..19: note = Synthetic Construct
  source 1..19: mol_type = other DNA
gccttcctccagccaccaa

SEQ ID NO: 37037 - DNA, 21 bp, synthetic construct
  misc_feature 1..21: note = Synthetic Construct
  source 1..21: mol_type = other DNA
gccaaagtccacggacagaca

SEQ ID NO: 37038 - DNA, 20 bp, synthetic construct
  misc_feature 1..20: note = Synthetic Construct
  source 1..20: mol_type = other DNA
cttgcagccccttacacaca

SEQ ID NO: 37039 - DNA, 24 bp, synthetic construct
  misc_feature 1..24: note = Synthetic Construct
  source 1..24: mol_type = other DNA
ggactgattggcaaagacctcaca

SEQ ID NO: 37040 - DNA, 23 bp, synthetic construct
  misc_feature 1..23: note = Synthetic Construct
  source 1..23: mol_type = other DNA
cgagccacagtcattcagagcat

SEQ ID NO: 37041 - DNA, 21 bp, synthetic construct
  misc_feature 1..21: note = Synthetic Construct
  source 1..21: mol_type = other DNA
ggctctcagctgatgcttagt

SEQ ID NO: 37042 - DNA, 23 bp, synthetic construct
  misc_feature 1..23: note = Synthetic Construct
  source 1..23: mol_type = other DNA
tggattacatttgccctctgcaa

SEQ ID NO: 37043 - DNA, 22 bp, synthetic construct
  misc_feature 1..22: note = Synthetic Construct
  source 1..22: mol_type = other DNA
ggcccaaggttcctgtgtatca

SEQ ID NO: 37044 - DNA, 24 bp, synthetic construct
  misc_feature 1..24: note = Synthetic Construct
  source 1..24: mol_type = other DNA
ccagactgatgatcctggatgaag

SEQ ID NO: 37045 - DNA, 24 bp, synthetic construct
  misc_feature 1..24: note = Synthetic Construct
  source 1..24: mol_type = other DNA
caggtttccaccagaaggttgtct

SEQ ID NO: 37046 - DNA, 23 bp, synthetic construct
  misc_feature 1..23: note = Synthetic Construct
  source 1..23: mol_type = other DNA
ccttttgctcacagggatagtca

SEQ ID NO: 37047 - DNA, 22 bp, synthetic construct
  misc_feature 1..22: note = Synthetic Construct
  source 1..22: mol_type = other DNA
ggggaaaacaatgacccaccaa

SEQ ID NO: 37048 - DNA, 22 bp, synthetic construct
  misc_feature 1..22: note = Synthetic Construct
  source 1..22: mol_type = other DNA
ggggatacagtaggagggcaaa

SEQ ID NO: 37049 - DNA, 22 bp, synthetic construct
  misc_feature 1..22: note = Synthetic Construct
  source 1..22: mol_type = other DNA
cacaccaagtggagaggcaaga

SEQ ID NO: 37050 - DNA, 25 bp, synthetic construct
  misc_feature 1..25: note = Synthetic Construct
  source 1..25: mol_type = other DNA
ggggaacctcctcttatttccttca

SEQ ID NO: 37051 - DNA, 25 bp, synthetic construct
  misc_feature 1..25: note = Synthetic Construct
  source 1..25: mol_type = other DNA
cccagcctttctagcaaaagcaaat

SEQ ID NO: 37052 - DNA, 24 bp, synthetic construct
  misc_feature 1..24: note = Synthetic Construct
  source 1..24: mol_type = other DNA
ggagcaggtgatagctcttaaaca

SEQ ID NO: 37053 - DNA, 22 bp, synthetic construct
  misc_feature 1..22: note = Synthetic Construct
  source 1..22: mol_type = other DNA
ctgtcactgcacctgtcaaaac

SEQ ID NO: 37054 - DNA, 26 bp, synthetic construct
  misc_feature 1..26: note = Synthetic Construct
  source 1..26: mol_type = other DNA
tcctatcctccttgtttctgctaaag

SEQ ID NO: 37055 - DNA, 21 bp, synthetic construct
  misc_feature 1..21: note = Synthetic Construct
  source 1..21: mol_type = other DNA
atgaggcttcactggctcatc

SEQ ID NO: 37056 - DNA, 21 bp, synthetic construct
  misc_feature 1..21: note = Synthetic Construct
  source 1..21: mol_type = other DNA
tgccctgcatcctccttcaca

SEQ ID NO: 37057 - DNA, 20 bp, synthetic construct
  misc_feature 1..20: note = Synthetic Construct
  source 1..20: mol_type = other DNA
aacgccagagcactgcattc

SEQ ID NO: 37058 - DNA, 26 bp, synthetic construct
  misc_feature 1..26: note = Synthetic Construct
  source 1..26: mol_type = other DNA
gagcagaaatcttccaccttgtctac

SEQ ID NO: 37059 - DNA, 21 bp, synthetic construct
  misc_feature 1..21: note = Synthetic Construct
  source 1..21: mol_type = other DNA
cccctgcctcacagtcttact

SEQ ID NO: 37060 - DNA, 20 bp, synthetic construct
  misc_feature 1..20: note = Synthetic Construct
  source 1..20: mol_type = other DNA
acatggagcgttcgcacttc

SEQ ID NO: 37061 - DNA, 22 bp, synthetic construct
  misc_feature 1..22: note = Synthetic Construct
  source 1..22: mol_type = other DNA
ccaagccctcctgcctcatatc

SEQ ID NO: 37062 - DNA, 25 bp, synthetic construct
  misc_feature 1..25: note = Synthetic Construct
  source 1..25: mol_type = other DNA
gcattagctcggtttctaggcaaag

SEQ ID NO: 37063 - DNA, 23 bp, synthetic construct
  misc_feature 1..23: note = Synthetic Construct
  source 1..23: mol_type = other DNA
gtgttctgagtttgggtgacaac

SEQ ID NO: 37064 - DNA, 22 bp, synthetic construct
  misc_feature 1..22: note = Synthetic Construct
  source 1..22: mol_type = other DNA
ccccacagcaactctgcacata

SEQ ID NO: 37065 - DNA, 25 bp, synthetic construct
  misc_feature 1..25: note = Synthetic Construct
  source 1..25: mol_type = other DNA
ccctagattttgtgacccagtgaac

SEQ ID NO: 37066 - DNA, 19 bp, synthetic construct
  misc_feature 1..19: note = Synthetic Construct
  source 1..19: mol_type = other DNA
acagcccggtgctggttca

SEQ ID NO: 37067 - DNA, 19 bp, synthetic construct
  misc_feature 1..19: note = Synthetic Construct
  source 1..19: mol_type = other DNA
agaagccagccggtctgta

SEQ ID NO: 37068 - DNA, 21 bp, synthetic construct
  misc_feature 1..21: note = Synthetic Construct
  source 1..21: mol_type = other DNA
ccactgcaggcacgttgtaga

SEQ ID NO: 37069 - DNA, 22 bp, synthetic construct
  misc_feature 1..22: note = Synthetic Construct
  source 1..22: mol_type = other DNA
ttcaaacttcagctccccaagt

SEQ ID NO: 37070 - DNA, 21 bp, synthetic construct
  misc_feature 1..21: note = Synthetic Construct
  source 1..21: mol_type = other DNA
cctctggggccagaaagaaca

SEQ ID NO: 37071 - DNA, 23 bp, synthetic construct
  misc_feature 1..23: note = Synthetic Construct
  source 1..23: mol_type = other DNA
ggtgaatccagctcattccttca

SEQ ID NO: 37072 - DNA, 23 bp, synthetic construct
  misc_feature 1..23: note = Synthetic Construct
  source 1..23: mol_type = other DNA
ggaagagcttagggcaaggaatc

SEQ ID NO: 37073 - DNA, 22 bp, synthetic construct
  misc_feature 1..22: note = Synthetic Construct
  source 1..22: mol_type = other DNA
caagtcccttccacctggagta

SEQ ID NO: 37074 - DNA, 22 bp, synthetic construct
  misc_feature 1..22: note = Synthetic Construct
  source 1..22: mol_type = other DNA
aggttacgcacatgaagagcat

SEQ ID NO: 37075 - DNA, 22 bp, synthetic construct
  misc_feature 1..22: note = Synthetic Construct
  source 1..22: mol_type = other DNA
agggattcccacactggggttt

SEQ ID NO: 37076 - DNA, 21 bp, synthetic construct
  misc_feature 1..21: note = Synthetic Construct
  source 1..21: mol_type = other DNA
gcagcccaagtctcagggttt

SEQ ID NO: 37077 - DNA, 24 bp, synthetic construct
  misc_feature 1..24: note = Synthetic Construct
  source 1..24: mol_type = other DNA
tgacatcaatgtggatgtgcgata

SEQ ID NO: 37078 - DNA, 22 bp, synthetic construct
  misc_feature 1..22: note = Synthetic Construct
  source 1..22: mol_type = other DNA
gcacaaggctagcgtccaaatg

SEQ ID NO: 37079 - DNA, 23 bp, synthetic construct
  misc_feature 1..23: note = Synthetic Construct
  source 1..23: mol_type = other DNA
tgctgtaaacttcaggccaatgt

SEQ ID NO: 37080 - DNA, 19 bp, synthetic construct
  misc_feature 1..19: note = Synthetic Construct
  source 1..19: mol_type = other DNA
acaggcctgggtgcaaact

SEQ ID NO: 37081 - DNA, 20 bp, synthetic construct
  misc_feature 1..20: note = Synthetic Construct
  source 1..20: mol_type = other DNA
aagggtggggacgtgtgttt

SEQ ID NO: 37082 - DNA, 19 bp, synthetic construct
  misc_feature 1..19: note = Synthetic Construct
  source 1..19: mol_type = other DNA
tcagcccttgcacaacaca

SEQ ID NO: 37083 - DNA, 22 bp, synthetic construct
  misc_feature 1..22: note = Synthetic Construct
  source 1..22: mol_type = other DNA
gatccaggctgggactgaaatc

SEQ ID NO: 37084 - DNA, 24 bp, synthetic construct
  misc_feature 1..24: note = Synthetic Construct
  source 1..24: mol_type = other DNA
gtgatcatctgggatggagacttg

SEQ ID NO: 37085 - DNA, 23 bp, synthetic construct
  misc_feature 1..23: note = Synthetic Construct
  source 1..23: mol_type = other DNA
gctccatatccttccacctcaga

SEQ ID NO: 37086 - DNA, 24 bp, synthetic construct
  misc_feature 1..24: note = Synthetic Construct
  source 1..24: mol_type = other DNA
agtctacactcaagaggggagttc

SEQ ID NO: 37087 - DNA, 24 bp, synthetic construct
  misc_feature 1..24: note = Synthetic Construct
  source 1..24: mol_type = other DNA
cgaagcatgtctctgtggtagcaa

SEQ ID NO: 37088 - DNA, 19 bp, synthetic construct
  misc_feature 1..19: note = Synthetic Construct
  source 1..19: mol_type = other DNA
aggtgggtgcacttgcatt

SEQ ID NO: 37089 - DNA, 20 bp, synthetic construct
  misc_feature 1..20: note = Synthetic Construct
  source 1..20: mol_type = other DNA
accaggcttccagacactca

SEQ ID NO: 37090 - DNA, 21 bp, synthetic construct
  misc_feature 1..21: note = Synthetic Construct
  source 1..21: mol_type = other DNA
actccgacagccagtggtact

SEQ ID NO: 37091 - DNA, 22 bp, synthetic construct
  misc_feature 1..22: note = Synthetic Construct
  source 1..22: mol_type = other DNA
tctgtcactgggaaccttgact

SEQ ID NO: 37092 - DNA, 20 bp, synthetic construct
  misc_feature 1..20: note = Synthetic Construct
  source 1..20: mol_type = other DNA
gcagctgagagtgcgctttg

SEQ ID NO: 37093 - DNA, 21 bp, synthetic construct
  misc_feature 1..21: note = Synthetic Construct
  source 1..21: mol_type = other DNA
gcagctgagggtgatgtgtga

SEQ ID NO: 37094 - DNA, 20 bp, synthetic construct
  misc_feature 1..20: note = Synthetic Construct
  source 1..20: mol_type = other DNA
catgaaggtgcctgctgtgt

SEQ ID NO: 37095 - DNA, 22 bp, synthetic construct
  misc_feature 1..22: note = Synthetic Construct
  source 1..22: mol_type = other DNA
acactcaggctcagggaagtga

SEQ ID NO: 37096 - DNA, 19 bp, synthetic construct
  misc_feature 1..19: note = Synthetic Construct
  source 1..19: mol_type = other DNA
ccccaacagggctgactgt

SEQ ID NO: 37097 - DNA, 21 bp, synthetic construct
  misc_feature 1..21: note = Synthetic Construct
  source 1..21: mol_type = other DNA
tggccctgggtaccaccattt

SEQ ID NO: 37098 - DNA, 20 bp, synthetic construct
  misc_feature 1..20: note = Synthetic Construct
  source 1..20: mol_type = other DNA
taaggccaccagcggaaagt

SEQ ID NO: 37099 - DNA, 22 bp, synthetic construct
  misc_feature 1..22: note = Synthetic Construct
  source 1..22: mol_type = other DNA
gagatggggtcccatagcttga

SEQ ID NO: 37100 - DNA, 19 bp, synthetic construct
  misc_feature 1..19: note = Synthetic Construct
  source 1..19: mol_type = other DNA
tccacagggcccacacaga

SEQ ID NO: 37101 - DNA, 20 bp, synthetic construct
  misc_feature 1..20: note = Synthetic Construct
  source 1..20: mol_type = other DNA
atgcaggctgggtgctcttt

SEQ ID NO: 37102 - DNA, 21 bp, synthetic construct
  misc_feature 1..21: note = Synthetic Construct
  source 1..21: mol_type = other DNA
agcctgctggatggagagaga

SEQ ID NO: 37103 - DNA, 27 bp, synthetic construct
  misc_feature 1..27: note = Synthetic Construct
  source 1..27: mol_type = other DNA
gtctggtaataggaggaagtgtaacat

SEQ ID NO: 37104 - DNA, 19 bp, synthetic construct
  misc_feature 1..19: note = Synthetic Construct
  source 1..19: mol_type = other DNA
cccttccagcctggtcact

SEQ ID NO: 37105 - DNA, 30 bp, synthetic construct
  misc_feature 1..30: note = Synthetic Construct
  source 1..30: mol_type = other DNA
gagaagactaaaataccctttccactgtca

SEQ ID NO: 37106 - DNA, 23 bp, synthetic construct
  misc_feature 1..23: note = Synthetic Construct
  source 1..23: mol_type = other DNA
ctgtgatctccctgttggctttc

SEQ ID NO: 37107 - DNA, 24 bp, synthetic construct
  misc_feature 1..24: note = Synthetic Construct
  source 1..24: mol_type = other DNA
cctctgaaaactgctgaggtgctt

SEQ ID NO: 37108 - DNA, 19 bp, synthetic construct
  misc_feature 1..19: note = Synthetic Construct
  source 1..19: mol_type = other DNA
tggccagagggaagcaaag

SEQ ID NO: 37109 - DNA, 22 bp, synthetic construct
  misc_feature 1..22: note = Synthetic Construct
  source 1..22: mol_type = other DNA
gacagcccttcctgcataagaa

SEQ ID NO: 37110 - DNA, 23 bp, synthetic construct
  misc_feature 1..23: note = Synthetic Construct
  source 1..23: mol_type = other DNA
caggaaaagttccaggagaccat

SEQ ID NO: 37111 - DNA, 24 bp, synthetic construct
  misc_feature 1..24: note = Synthetic Construct
  source 1..24: mol_type = other DNA
gtcgccttatgtctccttcaaact

SEQ ID NO: 37112 - DNA, 24 bp, synthetic construct
  misc_feature 1..24: note = Synthetic Construct
  source 1..24: mol_type = other DNA
gtcagtatctctgtggctcacact

SEQ ID NO: 37113 - DNA, 18 bp, synthetic construct
  misc_feature 1..18: note = Synthetic Construct
  source 1..18: mol_type = other DNA
cttggctccaggctgcaa

SEQ ID NO: 37114 - DNA, 27 bp, synthetic construct
  misc_feature 1..27: note = Synthetic Construct
  source 1..27: mol_type = other DNA
ccacaggtgtttccaagtaggatctca

SEQ ID NO: 37115 - DNA, 20 bp, synthetic construct
  misc_feature 1..20: note = Synthetic Construct
  source 1..20: mol_type = other DNA
tctctgcctgtgtcctgcaa

SEQ ID NO: 37116 - DNA, 24 bp, synthetic construct
  misc_feature 1..24: note = Synthetic Construct
  source 1..24: mol_type = other DNA
cccattggccagaatttagtctca

SEQ ID NO: 37117 - DNA, 22 bp, synthetic construct
  misc_feature 1..22: note = Synthetic Construct
  source 1..22: mol_type = other DNA
acaggggtggaagtgaggaaag

SEQ ID NO: 37118 - DNA, 22 bp, synthetic construct
  misc_feature 1..22: note = Synthetic Construct
  source 1..22: mol_type = other DNA
tcacatttggccagtgcttagt

SEQ ID NO: 37119 - DNA, 20 bp, synthetic construct
  misc_feature 1..20: note = Synthetic Construct
  source 1..20: mol_type = other DNA
tgtgctgcctcagtctgtga

SEQ ID NO: 37120 - DNA, 20 bp, synthetic construct
  misc_feature 1..20: note = Synthetic Construct
  source 1..20: mol_type = other DNA
tgcacttgagccacctcgaa

SEQ ID NO: 37121 - DNA, 22 bp, synthetic construct
  misc_feature 1..22: note = Synthetic Construct
  source 1..22: mol_type = other DNA
ggggcagctgggatgaaataga

SEQ ID NO: 37122 - DNA, 27 bp, synthetic construct
  misc_feature 1..27: note = Synthetic Construct
  source 1..27: mol_type = other DNA
gtgtaatgaatggattggagggactga

SEQ ID NO: 37123 - DNA, 24 bp, synthetic construct
  misc_feature 1..24: note = Synthetic Construct
  source 1..24: mol_type = other DNA
ggcaccttccatctacggttggat

SEQ ID NO: 37124 - DNA, 22 bp, synthetic construct
  misc_feature 1..22: note = Synthetic Construct
  source 1..22: mol_type = other DNA
ccttcagcctaccttgcagtct

SEQ ID NO: 37125 - DNA, 27 bp, synthetic construct
  misc_feature 1..27: note = Synthetic Construct
  source 1..27: mol_type = other DNA
gctctcttctattaccagggaccagta

SEQ ID NO: 37126 - DNA, 20 bp, synthetic construct
  misc_feature 1..20: note = Synthetic Construct
  source 1..20: mol_type = other DNA
ccccatggctgtaagcatca

SEQ ID NO: 37127 - DNA, 22 bp, synthetic construct
  misc_feature 1..22: note = Synthetic Construct
  source 1..22: mol_type = other DNA
cacctaccctcttcccatgcaa

SEQ ID NO: 37128 - DNA, 23 bp, synthetic construct
  misc_feature 1..23: note = Synthetic Construct
  source 1..23: mol_type = other DNA
cacaacacctcacgtcagcatag

SEQ ID NO: 37129 - DNA, 23 bp, synthetic construct
  misc_feature 1..23: note = Synthetic Construct
  source 1..23: mol_type = other DNA
ttggcaggaaacttctaggcaat

SEQ ID NO: 37130 - DNA, 27 bp, synthetic construct
  misc_feature 1..27: note = Synthetic Construct
  source 1..27: mol_type = other DNA
gagactaaggaggaagacagttagaag

SEQ ID NO: 37131 - DNA, 26 bp, synthetic construct
  misc_feature 1..26: note = Synthetic Construct
  source 1..26: mol_type = other DNA
cactccattacacatggaggcatagt

SEQ ID NO: 37132 - DNA, 21 bp, synthetic construct
  misc_feature 1..21: note = Synthetic Construct
  source 1..21: mol_type = other DNA
tcttaggtaccgccctagctt

SEQ ID NO: 37133 - DNA, 24 bp, synthetic construct
  misc_feature 1..24: note = Synthetic Construct
  source 1..24: mol_type = other DNA
cccacatactcccaaatggactgt

SEQ ID NO: 37134 - DNA, 21 bp, synthetic construct
  misc_feature 1..21: note = Synthetic Construct
  source 1..21: mol_type = other DNA
tcccaggggcttcaagtctgt

SEQ ID NO: 37135 - DNA, 24 bp, synthetic construct
  misc_feature 1..24: note = Synthetic Construct
  source 1..24: mol_type = other DNA
gtgactggttcaatagcaccgata

SEQ ID NO: 37136 - DNA, 22 bp, synthetic construct
  misc_feature 1..22: note = Synthetic Construct
  source 1..22: mol_type = other DNA
cagatccagggagcatcccaat

SEQ ID NO: 37137 - DNA, 21 bp, synthetic construct
  misc_feature 1..21: note = Synthetic Construct
  source 1..21: mol_type = other DNA
ggaattgcctccctcgtctct

SEQ ID NO: 37138 - DNA, 22 bp, synthetic construct
  misc_feature 1..22: note = Synthetic Construct
  source 1..22: mol_type = other DNA
cagtagcccatggggaaacaag

SEQ ID NO: 37139 - DNA, 25 bp, synthetic construct
  misc_feature 1..25: note = Synthetic Construct
  source 1..25: mol_type = other DNA
tgcaggtccggatagtaaatagaga

SEQ ID NO: 37140 - DNA, 22 bp, synthetic construct
  misc_feature 1..22: note = Synthetic Construct
  source 1..22: mol_type = other DNA
gagcagaatgcaacgcacaact

SEQ ID NO: 37141 - DNA, 20 bp, synthetic construct
  misc_feature 1..20: note = Synthetic Construct
  source 1..20: mol_type = other DNA
cctgccagcattcaccacaa

SEQ ID NO: 37142 - DNA, 19 bp, synthetic construct
  misc_feature 1..19: note = Synthetic Construct
  source 1..19: mol_type = other DNA
agcagccagcagccactga

SEQ ID NO: 37143 - DNA, 20 bp, synthetic construct
  misc_feature 1..20: note = Synthetic Construct
  source 1..20: mol_type = other DNA
aacaggccagtgagggtgat

SEQ ID NO: 37144 - DNA, 21 bp, synthetic construct
  misc_feature 1..21: note = Synthetic Construct
  source 1..21: mol_type = other DNA
tggtgcaagggtgagggacaa

SEQ ID NO: 37145 - DNA, 23 bp, synthetic construct
  misc_feature 1..23: note = Synthetic Construct
  source 1..23: mol_type = other DNA
ctccaatccctcctagtccctaa

SEQ ID NO: 37146 - DNA, 25 bp, synthetic construct
  misc_feature 1..25: note = Synthetic Construct
  source 1..25: mol_type = other DNA
gtggtaacttgacataagccacttg

SEQ ID NO: 37147 - DNA, 20 bp, synthetic construct
  misc_feature 1..20: note = Synthetic Construct
  source 1..20: mol_type = other DNA
tgccttgcagagcccagaat

SEQ ID NO: 37148 - DNA, 22 bp, synthetic construct
  misc_feature 1..22: note = Synthetic Construct
  source 1..22: mol_type = other DNA
gcagagccaggtgacgttttca

SEQ ID NO: 37149 - DNA, 23 bp, synthetic construct
  misc_feature 1..23: note = Synthetic Construct
  source 1..23: mol_type = other DNA
gcagttgaggtcaaggacaccat

SEQ ID NO: 37150 - DNA, 21 bp, synthetic construct
  misc_feature 1..21: note = Synthetic Construct
  source 1..21: mol_type = other DNA
ggagccgaagcaactggtaca

SEQ ID NO: 37151 - DNA, 22 bp, synthetic construct
  misc_feature 1..22: note = Synthetic Construct
  source 1..22: mol_type = other DNA
gtgtggagggagaagtgtgcaa

SEQ ID NO: 37152 - DNA, 22 bp, synthetic construct
  misc_feature 1..22: note = Synthetic Construct
  source 1..22: mol_type = other DNA
accagccttagccagataggaa

SEQ ID NO: 37153 - DNA, 24 bp, synthetic construct
  misc_feature 1..24: note = Synthetic Construct
  source 1..24: mol_type = other DNA
tgacacttggtgggcaagtaattt

SEQ ID NO: 37154 - DNA, 23 bp, synthetic construct
  misc_feature 1..23: note = Synthetic Construct
  source 1..23: mol_type = other DNA
gaatgaagcagagctcagtgcta

SEQ ID NO: 37155 - DNA, 21 bp, synthetic construct
  misc_feature 1..21: note = Synthetic Construct
  source 1..21: mol_type = other DNA
atcagctcctccccactgttg

SEQ ID NO: 37156 - DNA, 23 bp, synthetic construct
  misc_feature 1..23: note = Synthetic Construct
  source 1..23: mol_type = other DNA
tgcaattttcactgcaccagttc

SEQ ID NO: 37157 - DNA, 23 bp, synthetic construct
  misc_feature 1..23: note = Synthetic Construct
  source 1..23: mol_type = other DNA
gggtctgccccatagatccaaag

SEQ ID NO: 37158 - DNA, 24 bp, synthetic construct
  misc_feature 1..24: note = Synthetic Construct
  source 1..24: mol_type = other DNA
ctgctttaagaggttgggttgaga

SEQ ID NO: 37159 - DNA, 26 bp, synthetic construct
  misc_feature 1..26: note = Synthetic Construct
  source 1..26: mol_type = other DNA
ctctcactgtaaaatgcctgtgaatc

SEQ ID NO: 37160 - DNA, 24 bp, synthetic construct
  misc_feature 1..24: note = Synthetic Construct
  source 1..24: mol_type = other DNA
cttcattacctcccaactggcatt

SEQ ID NO: 37161 - DNA, 20 bp, synthetic construct
  misc_feature 1..20: note = Synthetic Construct
  source 1..20: mol_type = other DNA
gacaggcacttggcgatcat

SEQ ID NO: 37162 - DNA, 22 bp, synthetic construct
  misc_feature 1..22: note = Synthetic Construct
  source 1..22: mol_type = other DNA
ggacttccccataccaggatct

SEQ ID NO: 37163 - DNA, 23 bp, synthetic construct
  misc_feature 1..23: note = Synthetic Construct
  source 1..23: mol_type = other DNA
ccaatgatggcgctcagcttttt

SEQ ID NO: 37164 - DNA, 22 bp, synthetic construct
  misc_feature 1..22: note = Synthetic Construct
  source 1..22: mol_type = other DNA
caggccaagctctttccacttc

SEQ ID NO: 37165 - DNA, 26 bp, synthetic construct
  misc_feature 1..26: note = Synthetic Construct
  source 1..26: mol_type = other DNA
gggtctgtaagattttccccagaagt

SEQ ID NO: 37166 - DNA, 24 bp, synthetic construct
  misc_feature 1..24: note = Synthetic Construct
  source 1..24: mol_type = other DNA
ctgagctaggattcaaggcagcta

SEQ ID NO: 37167 - DNA, 21 bp, synthetic construct
  misc_feature 1..21: note = Synthetic Construct
  source 1..21: mol_type = other DNA
acctggactgagtctcacctt

SEQ ID NO: 37168 - DNA, 20 bp, synthetic construct
  misc_feature 1..20: note = Synthetic Construct
  source 1..20: mol_type = other DNA
aagaccacccagaccacaga

SEQ ID NO: 37169 - DNA, 24 bp, synthetic construct
  misc_feature 1..24: note = Synthetic Construct
  source 1..24: mol_type = other DNA
gtggcaggttgaatgcagtagttg

SEQ ID NO: 37170 - DNA, 21 bp, synthetic construct
  misc_feature 1..21: note = Synthetic Construct
  source 1..21: mol_type = other DNA
cacagctgctgctttgaggaa

SEQ ID NO: 37171 - DNA, 22 bp, synthetic construct
  misc_feature 1..22: note = Synthetic Construct
  source 1..22: mol_type = other DNA
ggggtgtgtagaacctgtggaa

SEQ ID NO: 37172 - DNA, 24 bp, synthetic construct
  misc_feature 1..24: note = Synthetic Construct
  source 1..24: mol_type = other DNA
ggcctctaagaacccaatctgtct

SEQ ID NO: 37173 - DNA, 24 bp, synthetic construct
  misc_feature 1..24: note = Synthetic Construct
  source 1..24: mol_type = other DNA
ccatcagagagtggaggtcacaag

SEQ ID NO: 37174 - DNA, 20 bp, synthetic construct
  misc_feature 1..20: note = Synthetic Construct
  source 1..20: mol_type = other DNA
acccaggaaccgttcagttg

SEQ ID NO: 37175 - DNA, 27 bp, synthetic construct
  misc_feature 1..27: note = Synthetic Construct
  source 1..27: mol_type = other DNA
gaggataatgcctcatcccttatttca

SEQ ID NO: 37176 - DNA, 20 bp, synthetic construct
  misc_feature 1..20: note = Synthetic Construct
  source 1..20: mol_type = other DNA
ggtagaagggtgcccactca

SEQ ID NO: 37177 - DNA, 20 bp, synthetic construct
  misc_feature 1..20: note = Synthetic Construct
  source 1..20: mol_type = other DNA
ctgtggaggctttggagcaa

SEQ ID NO: 37178 - DNA, 20 bp, synthetic construct
  misc_feature 1..20: note = Synthetic Construct
  source 1..20: mol_type = other DNA
cctggccgatcccactttga

SEQ ID NO: 37179 - DNA, 22 bp, synthetic construct
  misc_feature 1..22: note = Synthetic Construct
  source 1..22: mol_type = other DNA
tgggcctatcctggttgtctct

SEQ ID NO: 37180 - DNA, 24 bp, synthetic construct
  misc_feature 1..24: note = Synthetic Construct
  source 1..24: mol_type = other DNA
gaagtggcaaggacagttagaagt

SEQ ID NO: 37181 - DNA, 24 bp, synthetic construct
  misc_feature 1..24: note = Synthetic Construct
  source 1..24: mol_type = other DNA
gtgacagtctttggctacctccaa

SEQ ID NO: 37182 - DNA, 22 bp, synthetic construct
  misc_feature 1..22: note = Synthetic Construct
  source 1..22: mol_type = other DNA
gacctagtgccttcagtgaaca

SEQ ID NO: 37183 - DNA, 22 bp, synthetic construct
  misc_feature 1..22: note = Synthetic Construct
  source 1..22: mol_type = other DNA
gggaagtggatcaggtttccat

SEQ ID NO: 37184 - DNA, 23 bp, synthetic construct
  misc_feature 1..23: note = Synthetic Construct
  source 1..23: mol_type = other DNA
ggaacagcagatcagagaaggtt

SEQ ID NO: 37185 - DNA, 20 bp, synthetic construct
  misc_feature 1..20: note = Synthetic Construct
  source 1..20: mol_type = other DNA
agtgcttggccctacagttg

SEQ ID NO: 37186 - DNA, 24 bp, synthetic construct
  misc_feature 1..24: note = Synthetic Construct
  source 1..24: mol_type = other DNA
cctgcatctttgagggtagccaaa

SEQ ID NO: 37187 - DNA, 24 bp, synthetic construct
  misc_feature 1..24: note = Synthetic Construct
  source 1..24: mol_type = other DNA
tcctttgctgtttccctttcatct

SEQ ID NO: 37188 - DNA, 22 bp, synthetic construct
  misc_feature 1..22: note = Synthetic Construct
  source 1..22: mol_type = other DNA
gagcagggatctcaggctcttt

SEQ ID NO: 37189 - DNA, 22 bp, synthetic construct
  misc_feature 1..22: note = Synthetic Construct
  source 1..22: mol_type = other DNA
gcctcactgagcccaagtttct

SEQ ID NO: 37190 - DNA, 18 bp, synthetic construct
  misc_feature 1..18: note = Synthetic Construct
  source 1..18: mol_type = other DNA
agtgccagggccatcagt

SEQ ID NO: 37191 - DNA, 21 bp, synthetic construct
  misc_feature 1..21: note = Synthetic Construct
  source 1..21: mol_type = other DNA
agccctggatctccactgttg

SEQ ID NO: 37192 - DNA, 25 bp, synthetic construct
  misc_feature 1..25: note = Synthetic Construct
  source 1..25: mol_type = other DNA
attgctatcacataggtggttctgt

SEQ ID NO: 37193 - DNA, 29 bp, synthetic construct
  misc_feature 1..29: note = Synthetic Construct
  source 1..29: mol_type = other DNA
ctctcagttagtgattaaggggtactttc

SEQ ID NO: 37194 - DNA, 22 bp, synthetic construct
  misc_feature 1..22: note = Synthetic Construct
  source 1..22: mol_type = other DNA
agtacctggggacttgactgaa

SEQ ID NO: 37195 - DNA, 19 bp, synthetic construct
  misc_feature 1..19: note = Synthetic Construct
  source 1..19: mol_type = other DNA
aggttgccaggccctgagt

SEQ ID NO: 37196 - DNA, 22 bp, synthetic construct
  misc_feature 1..22: note = Synthetic Construct
  source 1..22: mol_type = other DNA
ctcacccaaggcttgctgtaac

SEQ ID NO: 37197 - DNA, 25 bp, synthetic construct
  misc_feature 1..25: note = Synthetic Construct
  source 1..25: mol_type = other DNA
gaaggaatttagagggactgcagaa

SEQ ID NO: 37198 - DNA, 26 bp, synthetic construct
  misc_feature 1..26: note = Synthetic Construct
  source 1..26: mol_type = other DNA
cacagtcttccatctctcacttctca

SEQ ID NO: 37199 - DNA, 23 bp, synthetic construct
  misc_feature 1..23: note = Synthetic Construct
  source 1..23: mol_type = other DNA
cagaaaagcaaggcatcctggaa

SEQ ID NO: 37200 - DNA, 24 bp, synthetic construct
  misc_feature 1..24: note = Synthetic Construct
  source 1..24: mol_type = other DNA
gtcagaaagaaggccagtgtgtca

SEQ ID NO: 37201 - DNA, 24 bp, synthetic construct
  misc_feature 1..24: note = Synthetic Construct
  source 1..24: mol_type = other DNA
gcttcccattgcctacgaggtaca

SEQ ID NO: 37202 - DNA, 23 bp, synthetic construct
  misc_feature 1..23: note = Synthetic Construct
  source 1..23: mol_type = other DNA
ctcgccaggaatttagcctcttc

SEQ ID NO: 37203 - DNA, 22 bp, synthetic construct
  misc_feature 1..22: note = Synthetic Construct
  source 1..22: mol_type = other DNA
gtggctgctcttgggctacagt

SEQ ID NO: 37204 - DNA, 29 bp, synthetic construct
  misc_feature 1..29: note = Synthetic Construct
  source 1..29: mol_type = other DNA
gcggaatttctcattccatttgaggaaag

SEQ ID NO: 37205 - DNA, 23 bp, synthetic construct
  misc_feature 1..23: note = Synthetic Construct
  source 1..23: mol_type = other DNA
gaccaagttcttggggtggaaga

SEQ ID NO: 37206 - DNA, 22 bp, synthetic construct
  misc_feature 1..22: note = Synthetic Construct
  source 1..22: mol_type = other DNA
ctttgtgtctaccacggtccat

SEQ ID NO: 37207 - DNA, 25 bp, synthetic construct
  misc_feature 1..25: note = Synthetic Construct
  source 1..25: mol_type = other DNA
tcatgtgtaccagaagcatctgaag

SEQ ID NO: 37208 - DNA, 21 bp, synthetic construct
  misc_feature 1..21: note = Synthetic Construct
  source 1..21: mol_type = other DNA
ttactcagcgggccagggaaa

SEQ ID NO: 37209 - DNA, 20 bp, synthetic construct
  misc_feature 1..20: note = Synthetic Construct
  source 1..20: mol_type = other DNA
gagggtggcaccatgtttgt

SEQ ID NO: 37210 - DNA, 19 bp, synthetic construct
  misc_feature 1..19: note = Synthetic Construct
  source 1..19: mol_type = other DNA
tcgcacacctcacccagat

SEQ ID NO: 37211 - DNA, 22 bp, synthetic construct
  misc_feature 1..22: note = Synthetic Construct
  source 1..22: mol_type = other DNA
gggatccacaggtggttcagat

SEQ ID NO: 37212 - DNA, 25 bp, synthetic construct
  misc_feature 1..25: note = Synthetic Construct
  source 1..25: mol_type = other DNA
tcctataaatcctgggatggaggaa

SEQ ID NO: 37213 - DNA, 20 bp, synthetic construct
  misc_feature 1..20: note = Synthetic Construct
  source 1..20: mol_type = other DNA
gcccacacaaggtcagcatt

SEQ ID NO: 37214 - DNA, 22 bp, synthetic construct
  misc_feature 1..22: note = Synthetic Construct
  source 1..22: mol_type = other DNA
ccactcaccacttcagggatca

SEQ ID NO: 37215 - DNA, 23 bp, synthetic construct
  misc_feature 1..23: note = Synthetic Construct
  source 1..23: mol_type = other DNA
ggagctctcatcctggataggta

SEQ ID NO: 37216 - DNA, 23 bp, synthetic construct
  misc_feature 1..23: note = Synthetic Construct
  source 1..23: mol_type = other DNA
cctctccttacgttggcttgaac

SEQ ID NO: 37217 - DNA, 20 bp, synthetic construct
  misc_feature 1..20: note = Synthetic Construct
  source 1..20: mol_type = other DNA
atctgggcagagccagaagt

SEQ ID NO: 37218 - DNA, 22 bp, synthetic construct
  misc_feature 1..22: note = Synthetic Construct
  source 1..22: mol_type = other DNA
aggcagtgtcccaaagctgttc

SEQ ID NO: 37219 - DNA, 25 bp, synthetic construct
  misc_feature 1..25: note = Synthetic Construct
  source 1..25: mol_type = other DNA
ggacctagacactgaatgcttcttg

SEQ ID NO: 37220 - DNA, 20 bp, synthetic construct
  misc_feature 1..20: note = Synthetic Construct
  source 1..20: mol_type = other DNA
tggtccttgctgccttcttc

SEQ ID NO: 37221 - DNA, 22 bp, synthetic construct
  misc_feature 1..22: note = Synthetic Construct
  source 1..22: mol_type = other DNA
gggtttttcgcgactggggatt

SEQ ID NO: 37222 - DNA, 21 bp, synthetic construct
  misc_feature 1..21: note = Synthetic Construct
  source 1..21: mol_type = other DNA
actgtgctgatccctccctta

SEQ ID NO: 37223 - DNA, 24 bp, synthetic construct
  misc_feature 1..24: note = Synthetic Construct
  source 1..24: mol_type = other DNA
caattggacttgtgttgcctcaaa

SEQ ID NO: 37224 - DNA, 22 bp, synthetic construct
  misc_feature 1..22: note = Synthetic Construct
  source 1..22: mol_type = other DNA
ccgcctttccctgaggttcatt

SEQ ID NO: 37225 - DNA, 23 bp, synthetic construct
  misc_feature 1..23: note = Synthetic Construct
  source 1..23: mol_type = other DNA
tgaaagaggtcctggtgacaaac

SEQ ID NO: 37226 - DNA, 26 bp, synthetic construct
  misc_feature 1..26: note = Synthetic Construct
  source 1..26: mol_type = other DNA
cagtgttcaattcaagcacgtacatc

SEQ ID NO: 37227 - DNA, 25 bp, synthetic construct
  misc_feature 1..25: note = Synthetic Construct
  source 1..25: mol_type = other DNA
ccatgcaaactgctaatccttccaa

SEQ ID NO: 37228 - DNA, 22 bp, synthetic construct
  misc_feature 1..22: note = Synthetic Construct
  source 1..22: mol_type = other DNA
ccaggacaaccacgcgtctaaa

SEQ ID NO: 37229 - DNA, 20 bp, synthetic construct
  misc_feature 1..20: note = Synthetic Construct
  source 1..20: mol_type = other DNA
gccaaaagctgagggtggaa

SEQ ID NO: 37230 - DNA, 24 bp, synthetic construct
  misc_feature 1..24: note = Synthetic Construct
  source 1..24: mol_type = other DNA
ggatccaacttttcccatgctaga

SEQ ID NO: 37231 - DNA, 23 bp, synthetic construct
  misc_feature 1..23: note = Synthetic Construct
  source 1..23: mol_type = other DNA
gatcaacctgcattgtcctgtca

SEQ ID NO: 37232 - DNA, 19 bp, synthetic construct
  misc_feature 1..19: note = Synthetic Construct
  source 1..19: mol_type = other DNA
tctttcccgggcacagaac

SEQ ID NO: 37233 - DNA, 25 bp, synthetic construct
  misc_feature 1..25: note = Synthetic Construct
  source 1..25: mol_type = other DNA
gggaattgtctcttgactccaaaac

SEQ ID NO: 37234 - DNA, 19 bp, synthetic construct
  misc_feature 1..19: note = Synthetic Construct
  source 1..19: mol_type = other DNA
tggctgcccaccccaagta

SEQ ID NO: 37235 - DNA, 22 bp, synthetic construct
  misc_feature 1..22: note = Synthetic Construct
  source 1..22: mol_type = other DNA
tgaagcactagagcaggagtct

SEQ ID NO: 37236 - DNA, 19 bp, synthetic construct
  misc_feature 1..19: note = Synthetic Construct
  source 1..19: mol_type = other DNA
gcaaaggggacaggcgaaa

SEQ ID NO: 37237 - DNA, 28 bp, synthetic construct
  misc_feature 1..28: note = Synthetic Construct
  source 1..28: mol_type = other DNA
gcacttttctattggttggtgggcttag

SEQ ID NO: 37238 - DNA, 22 bp, synthetic construct
  misc_feature 1..22: note = Synthetic Construct
  source 1..22: mol_type = other DNA
cgccgggcctacacatcttaaa

SEQ ID NO: 37239 - DNA, 22 bp, synthetic construct
  misc_feature 1..22: note = Synthetic Construct
  source 1..22: mol_type = other DNA
ggagggtgattctgggaagatg

SEQ ID NO: 37240 - DNA, 26 bp, synthetic construct
  misc_feature 1..26: note = Synthetic Construct
  source 1..26: mol_type = other DNA
caaaacccagattctttcctcacaga

SEQ ID NO: 37241 - DNA, 26 bp, synthetic construct
  misc_feature 1..26: note = Synthetic Construct
  source 1..26: mol_type = other DNA
gggaaggttagaccaaatgatgatga

SEQ ID NO: 37242 - DNA, 24 bp, synthetic construct
  misc_feature 1..24: note = Synthetic Construct
  source 1..24: mol_type = other DNA
cgatcctctaggcttgagttctct

SEQ ID NO: 37243 - DNA, 25 bp, synthetic construct
  misc_feature 1..25: note = Synthetic Construct
  source 1..25: mol_type = other DNA
ccccgttggtatgatgagaaactgt

SEQ ID NO: 37244 - DNA, 21 bp, synthetic construct
  misc_feature 1..21: note = Synthetic Construct
  source 1..21: mol_type = other DNA
ggtgcagggctttctgaatgt

SEQ ID NO: 37245 - DNA, 26 bp, synthetic construct
  misc_feature 1..26: note = Synthetic Construct
  source 1..26: mol_type = other DNA
gcatttctatgtccatgcacgatttc

SEQ ID NO: 37246 - DNA, 24 bp, synthetic construct
  misc_feature 1..24: note = Synthetic Construct
  source 1..24: mol_type = other DNA
gcctttgtcaatgggtggcaatag

SEQ ID NO: 37247 - DNA, 19 bp, synthetic construct
  misc_feature 1..19: note = Synthetic Construct
  source 1..19: mol_type = other DNA
tgtggggccgcaatgatag

SEQ ID NO: 37248 - DNA, 23 bp, synthetic construct
  misc_feature 1..23: note = Synthetic Construct
  source 1..23: mol_type = other DNA
ccggacaaagccactgatgaaga

SEQ ID NO: 37249 - DNA, 22 bp, synthetic construct
  misc_feature 1..22: note = Synthetic Construct
  source 1..22: mol_type = other DNA
gtatgctccagtcgaggtcttg

SEQ ID NO: 37250 - DNA, 22 bp, synthetic construct
  misc_feature 1..22: note = Synthetic Construct
  source 1..22: mol_type = other DNA
ccctggaccgcacttgaagtat

SEQ ID NO: 37251 - DNA, 24 bp, synthetic construct
  misc_feature 1..24: note = Synthetic Construct
  source 1..24: mol_type = other DNA
atttccctaggatacagggcattg

SEQ ID NO: 37252 - DNA, 23 bp, synthetic construct
  misc_feature 1..23: note = Synthetic Construct
  source 1..23: mol_type = other DNA
cctgaaatgtgggctgacacagt

SEQ ID NO: 37253 - DNA, 22 bp, synthetic construct
  misc_feature 1..22: note = Synthetic Construct
  source 1..22: mol_type = other DNA
aagggctctcaggttccagttg

SEQ ID NO: 37254 - DNA, 23 bp, synthetic construct
  misc_feature 1..23: note = Synthetic Construct
  source 1..23: mol_type = other DNA
ccccacagagccatgtgaagaag

SEQ ID NO: 37255 - DNA, 26 bp, synthetic construct
  misc_feature 1..26: note = Synthetic Construct
  source 1..26: mol_type = other DNA
tgaataaattcccttccccaggaaac

SEQ ID NO: 37256 - DNA, 22 bp, synthetic construct
  misc_feature 1..22: note = Synthetic Construct
  source 1..22: mol_type = other DNA
ggtggagaagtggagtgtgact

SEQ ID NO: 37257 - DNA, 24 bp, synthetic construct
  misc_feature 1..24: note = Synthetic Construct
  source 1..24: mol_type = other DNA
gctctaggctacaggttccatatc

SEQ ID NO: 37258 - DNA, 24 bp, synthetic construct
  misc_feature 1..24: note = Synthetic Construct
  source 1..24: mol_type = other DNA
ggggtggaaacgtgagacaaggaa

SEQ ID NO: 37259 - DNA, 27 bp, synthetic construct
  misc_feature 1..27: note = Synthetic Construct
  source 1..27: mol_type = other DNA
gagccataaagatagctcaagctggta

SEQ ID NO: 37260 - DNA, 22 bp, synthetic construct
  misc_feature 1..22: note = Synthetic Construct
  source 1..22: mol_type = other DNA
ggcatcctgcagaagggaagtt

SEQ ID NO: 37261 - DNA, 22 bp, synthetic construct
  misc_feature 1..22: note = Synthetic Construct
  source 1..22: mol_type = other DNA
gccatgactccccattgggtta

SEQ ID NO: 37262 - DNA, 20 bp, synthetic construct
  misc_feature 1..20: note = Synthetic Construct
  source 1..20: mol_type = other DNA
agggccctgtctcttgaact

SEQ ID NO: 37263 - DNA, 21 bp, synthetic construct
  misc_feature 1..21: note = Synthetic Construct
  source 1..21: mol_type = other DNA
atgtgggagccgtccagttct

SEQ ID NO: 37264 - DNA, 22 bp, synthetic construct
  misc_feature 1..22: note = Synthetic Construct
  source 1..22: mol_type = other DNA
caggatcactactgggccacaa

SEQ ID NO: 37265 - DNA, 24 bp, synthetic construct
  misc_feature 1..24: note = Synthetic Construct
  source 1..24: mol_type = other DNA
atttgacttacagtgcggctaatg

SEQ ID NO: 37266 - DNA, 25 bp, synthetic construct
  misc_feature 1..25: note = Synthetic Construct
  source 1..25: mol_type = other DNA
ctttctggatgtctgggtttcaact

SEQ ID NO: 37267 - DNA, 22 bp, synthetic construct
  misc_feature 1..22: note = Synthetic Construct
  source 1..22: mol_type = other DNA
caggagtgggtgtctgatggaa

SEQ ID NO: 37268 - DNA, 25 bp, synthetic construct
  misc_feature 1..25: note = Synthetic Construct
  source 1..25: mol_type = other DNA
ggaatatagggcacatccgtgtaag

SEQ ID NO: 37269 - DNA, 22 bp, synthetic construct
  misc_feature 1..22: note = Synthetic Construct
  source 1..22: mol_type = other DNA
ctgggttgagcttggggttaga

SEQ ID NO: 37270 - DNA, 22 bp, synthetic construct
  misc_feature 1..22: note = Synthetic Construct
  source 1..22: mol_type = other DNA
gatagcgtgcaccatgcataac

SEQ ID NO: 37271 - DNA, 20 bp, synthetic construct
  misc_feature 1..20: note = Synthetic Construct
  source 1..20: mol_type = other DNA
cactcattgccctccactgt

SEQ ID NO: 37272 - DNA, 24 bp, synthetic construct
  misc_feature 1..24: note = Synthetic Construct
  source 1..24: mol_type = other DNA
cagccctattggtcaaggcctatt

SEQ ID NO: 37273 - DNA, 27 bp, synthetic construct
  misc_feature 1..27: note = Synthetic Construct
  source 1..27: mol_type = other DNA
cctgccatcctacctgaatcattctca

SEQ ID NO: 37274 - DNA, 21 bp, synthetic construct
  misc_feature 1..21: note = Synthetic Construct
  source 1..21: mol_type = other DNA
tggtgactcagtggcctcctt

SEQ ID NO: 37275 - DNA, 24 bp, synthetic construct
  misc_feature 1..24: note = Synthetic Construct
  source 1..24: mol_type = other DNA
gcggcaactaagctcaattaggaa

SEQ ID NO: 37276 - DNA, 21 bp, synthetic construct
  misc_feature 1..21: note = Synthetic Construct
  source 1..21: mol_type = other DNA
tcatggtgtttgcggtgaaac

SEQ ID NO: 37277 - DNA, 22 bp, synthetic construct
  misc_feature 1..22: note = Synthetic Construct
  source 1..22: mol_type = other DNA
gcctgaggtcacatcccaccta

SEQ ID NO: 37278 - DNA, 21 bp, synthetic construct
  misc_feature 1..21: note = Synthetic Construct
  source 1..21: mol_type = other DNA
ccagagcccttcagcaagaaa

SEQ ID NO: 37279 - DNA, 22 bp, synthetic construct
  misc_feature 1..22: note = Synthetic Construct
  source 1..22: mol_type = other DNA
ccgcagcatcaaagagttgcat

SEQ ID NO: 37280 - DNA, 22 bp, synthetic construct
  misc_feature 1..22: note = Synthetic Construct
  source 1..22: mol_type = other DNA
cacacacggcttgtggaaatag

SEQ ID NO: 37281 - DNA, 21 bp, synthetic construct
  misc_feature 1..21: note = Synthetic Construct
  source 1..21: mol_type = other DNA
tgtgcacttcctggctcattt

SEQ ID NO: 37282 - DNA, 22 bp, synthetic construct
  misc_feature 1..22: note = Synthetic Construct
  source 1..22: mol_type = other DNA
agctgtctggccctgaagaaag

SEQ ID NO: 37283 - DNA, 20 bp, synthetic construct
  misc_feature 1..20: note = Synthetic Construct
  source 1..20: mol_type = other DNA
actggggaagcaggactaca

SEQ ID NO: 37284 - DNA, 26 bp, synthetic construct
  misc_feature 1..26: note = Synthetic Construct
  source 1..26: mol_type = other DNA
gcttgaagaagctcttggtgatgatg

SEQ ID NO: 37285 - DNA, 24 bp, synthetic construct
  misc_feature 1..24: note = Synthetic Construct
  source 1..24: mol_type = other DNA
catcccactggtacagtcaagttc

SEQ ID NO: 37286 - DNA, 24 bp, synthetic construct
  misc_feature 1..24: note = Synthetic Construct
  source 1..24: mol_type = other DNA
gggtagaactccacgtgctagatg

SEQ ID NO: 37287 - DNA, 19 bp, synthetic construct
  misc_feature 1..19: note = Synthetic Construct
  source 1..19: mol_type = other DNA
acaggggtgggcttgctta

SEQ ID NO: 37288 - DNA, 19 bp, synthetic construct
  misc_feature 1..19: note = Synthetic Construct
  source 1..19: mol_type = other DNA
tgctggaggtgccagcata

SEQ ID NO: 37289 - DNA, 25 bp, synthetic construct
  misc_feature 1..25: note = Synthetic Construct
  source 1..25: mol_type = other DNA
ctgaccataggacagaaaccctgta

SEQ ID NO: 37290 - DNA, 22 bp, synthetic construct
  misc_feature 1..22: note = Synthetic Construct
  source 1..22: mol_type = other DNA
gcatggcatagtggggacattg

SEQ ID NO: 37291 - DNA, 23 bp, synthetic construct
  misc_feature 1..23: note = Synthetic Construct
  source 1..23: mol_type = other DNA
ggactggctcaaagcagcttaac

SEQ ID NO: 37292 - DNA, 25 bp, synthetic construct
  misc_feature 1..25: note = Synthetic Construct
  source 1..25: mol_type = other DNA
tcaagtgagactgatgctggtaatc

SEQ ID NO: 37293 - DNA, 19 bp, synthetic construct
  misc_feature 1..19: note = Synthetic Construct
  source 1..19: mol_type = other DNA
agctggcaagcctcgtaga

SEQ ID NO: 37294 - DNA, 21 bp, synthetic construct
  misc_feature 1..21: note = Synthetic Construct
  source 1..21: mol_type = other DNA
ataagcggaggccctgacttc

SEQ ID NO: 37295 - DNA, 24 bp, synthetic construct
  misc_feature 1..24: note = Synthetic Construct
  source 1..24: mol_type = other DNA
gctgggacgtacctaagtggatga

SEQ ID NO: 37296 - DNA, 22 bp, synthetic construct
  misc_feature 1..22: note = Synthetic Construct
  source 1..22: mol_type = other DNA
acccaccctatacaccgcattc

SEQ ID NO: 37297 - DNA, 20 bp, synthetic construct
  misc_feature 1..20: note = Synthetic Construct
  source 1..20: mol_type = other DNA
tctggctcccggtaacatct

SEQ ID NO: 37298 - DNA, 21 bp, synthetic construct
  misc_feature 1..21: note = Synthetic Construct
  source 1..21: mol_type = other DNA
aaaccaggcctgcactttttc

SEQ ID NO: 37299 - DNA, 21 bp, synthetic construct
  misc_feature 1..21: note = Synthetic Construct
  source 1..21: mol_type = other DNA
acctgtagccagggtgaggat

SEQ ID NO: 37300 - DNA, 23 bp, synthetic construct
  misc_feature 1..23: note = Synthetic Construct
  source 1..23: mol_type = other DNA
ggaggataactgccactgtgctt

SEQ ID NO: 37301 - DNA, 20 bp, synthetic construct
  misc_feature 1..20: note = Synthetic Construct
  source 1..20: mol_type = other DNA
cttgcccctttgcaccacta

SEQ ID NO: 37302 - DNA, 20 bp, synthetic construct
  misc_feature 1..20: note = Synthetic Construct
  source 1..20: mol_type = other DNA
agccccaaactccccagaaa

SEQ ID NO: 37303 - DNA, 20 bp, synthetic construct
  misc_feature 1..20: note = Synthetic Construct
  source 1..20: mol_type = other DNA
aaggcaagggaaaggtgcaa

SEQ ID NO: 37304 - DNA, 21 bp, synthetic construct
  misc_feature 1..21: note = Synthetic Construct
  source 1..21: mol_type = other DNA
gcctgaccttgggctttgtct

SEQ ID NO: 37305 - DNA, 20 bp, synthetic construct
  misc_feature 1..20: note = Synthetic Construct
  source 1..20: mol_type = other DNA
tggagcagctgccagttaga

SEQ ID NO: 37306 - DNA, 23 bp, synthetic construct
  misc_feature 1..23: note = Synthetic Construct
  source 1..23: mol_type = other DNA
gggaacagaggatcccactgaag

SEQ ID NO: 37307 - DNA, 24 bp, synthetic construct
  misc_feature 1..24: note = Synthetic Construct
  source 1..24: mol_type = other DNA
ccagttcccagggtagaatcatct

SEQ ID NO: 37308 - DNA, 22 bp, synthetic construct
  misc_feature 1..22: note = Synthetic Construct
  source 1..22: mol_type = other DNA
agtagccctgaatggcctgaag

SEQ ID NO: 37309 - DNA, 24 bp, synthetic construct
  misc_feature 1..24: note = Synthetic Construct
  source 1..24: mol_type = other DNA
ccaggagctgaagacactaagatg

SEQ ID NO: 37310 - DNA, 24 bp, synthetic construct
  misc_feature 1..24: note = Synthetic Construct
  source 1..24: mol_type = other DNA
ggtgagacactggggatagcacaa

SEQ ID NO: 37311 - DNA, 24 bp, synthetic construct
  misc_feature 1..24: note = Synthetic Construct
  source 1..24: mol_type = other DNA
ggtgcctgttagatagtggtgcta

SEQ ID NO: 37312 - DNA, 26 bp, synthetic construct
  misc_feature 1..26: note = Synthetic Construct
  source 1..26: mol_type = other DNA
ccttggctgtgattacaagaccacat

SEQ ID NO: 37313 - DNA, 22 bp, synthetic construct
  misc_feature 1..22: note = Synthetic Construct
  source 1..22: mol_type = other DNA
ggcagggcttggccttaaagat

SEQ ID NO: 37314 - DNA, 25 bp, synthetic construct
  misc_feature 1..25: note = Synthetic Construct
  source 1..25: mol_type = other DNA
agctgtcttagtcaataagcgtgaa

SEQ ID NO: 37315 - DNA, 19 bp, synthetic construct
  misc_feature 1..19: note = Synthetic Construct
  source 1..19: mol_type = other DNA
tggaaggcccctgctgttc

SEQ ID NO: 37316 - DNA, 26 bp, synthetic construct
  misc_feature 1..26: note = Synthetic Construct
  source 1..26: mol_type = other DNA
gctgaaatgaagtgactctacctcta

SEQ ID NO: 37317 - DNA, 22 bp, synthetic construct
  misc_feature 1..22: note = Synthetic Construct
  source 1..22: mol_type = other DNA
agcttttccctgcttctcacaa

SEQ ID NO: 37318 - DNA, 23 bp, synthetic construct
  misc_feature 1..23: note = Synthetic Construct
  source 1..23: mol_type = other DNA
tccaatcaataggttgccagtgt

SEQ ID NO: 37319 - DNA, 24 bp, synthetic construct
  misc_feature 1..24: note = Synthetic Construct
  source 1..24: mol_type = other DNA
ggaaagacaactccttggccattc

SEQ ID NO: 37320 - DNA, 25 bp, synthetic construct
  misc_feature 1..25: note = Synthetic Construct
  source 1..25: mol_type = other DNA
gtgggagtacagtgaaaggttgaag

SEQ ID NO: 37321 - DNA, 22 bp, synthetic construct
  misc_feature 1..22: note = Synthetic Construct
  source 1..22: mol_type = other DNA
ggagaccagatggcgggaaaaa

SEQ ID NO: 37322 - DNA, 26 bp, synthetic construct
  misc_feature 1..26: note = Synthetic Construct
  source 1..26: mol_type = other DNA
ccttactcctgagaagtgcttctttc

SEQ ID NO: 37323 - DNA, 23 bp, synthetic construct
  misc_feature 1..23: note = Synthetic Construct
  source 1..23: mol_type = other DNA
agtgttgcgagctgacaatttac

SEQ ID NO: 37324 - DNA, 25 bp, synthetic construct
  misc_feature 1..25: note = Synthetic Construct
  source 1..25: mol_type = other DNA
gcaggcctgactaaattctcaacta

SEQ ID NO: 37325 - DNA, 22 bp, synthetic construct
  misc_feature 1..22: note = Synthetic Construct
  source 1..22: mol_type = other DNA
tccaacagtgggttacctctca

SEQ ID NO: 37326 - DNA, 24 bp, synthetic construct
  misc_feature 1..24: note = Synthetic Construct
  source 1..24: mol_type = other DNA
ccaggttcaacactctggatctgt

SEQ ID NO: 37327 - DNA, 24 bp, synthetic construct
  misc_feature 1..24: note = Synthetic Construct
  source 1..24: mol_type = other DNA
cattaacattagcgccctggaaac

SEQ ID NO: 37328 - DNA, 24 bp, synthetic construct
  misc_feature 1..24: note = Synthetic Construct
  source 1..24: mol_type = other DNA
cggcctgtcacacacatcagatag

SEQ ID NO: 37329 - DNA, 20 bp, synthetic construct
  misc_feature 1..20: note = Synthetic Construct
  source 1..20: mol_type = other DNA
acacaaggttggggcaggat

SEQ ID NO: 37330 - DNA, 26 bp, synthetic construct
  misc_feature 1..26: note = Synthetic Construct
  source 1..26: mol_type = other DNA
ggtctgggagaattaggagtagtaga

SEQ ID NO: 37331 - DNA, 23 bp, synthetic construct
  misc_feature 1..23: note = Synthetic Construct
  source 1..23: mol_type = other DNA
gctgtttcgcagccatcactgtt

SEQ ID NO: 37332 - DNA, 19 bp, synthetic construct
  misc_feature 1..19: note = Synthetic Construct
  source 1..19: mol_type = other DNA
aaggagggtgcggggtctt

SEQ ID NO: 37333 - DNA, 18 bp, synthetic construct
  misc_feature 1..18: note = Synthetic Construct
  source 1..18: mol_type = other DNA
cagccgtcagcggcaaaa

SEQ ID NO: 37334 - DNA, 19 bp, synthetic construct
  misc_feature 1..19: note = Synthetic Construct
  source 1..19: mol_type = other DNA
tgccttgctgggcctcgaa

SEQ ID NO: 37335 - DNA, 24 bp, synthetic construct
  misc_feature 1..24: note = Synthetic Construct
  source 1..24: mol_type = other DNA
acccctttctagggagaagctatg

SEQ ID NO: 37336 - DNA, 24 bp, synthetic construct
  misc_feature 1..24: note = Synthetic Construct
  source 1..24: mol_type = other DNA
tccattctttccccactgatttga

SEQ ID NO: 37337 - DNA, 23 bp, synthetic construct
  misc_feature 1..23: note = Synthetic Construct
  source 1..23: mol_type = other DNA
cacagacaggatctggcaactac

SEQ ID NO: 37338 - DNA, 26 bp, synthetic construct
  misc_feature 1..26: note = Synthetic Construct
  source 1..26: mol_type = other DNA
gtcattgccttacagtgaaaccttct

SEQ ID NO: 37339 - DNA, 24 bp, synthetic construct
  misc_feature 1..24: note = Synthetic Construct
  source 1..24: mol_type = other DNA
gccccttacaccactttccacctt

SEQ ID NO: 37340 - DNA, 22 bp, synthetic construct
  misc_feature 1..22: note = Synthetic Construct
  source 1..22: mol_type = other DNA
ggtgattggtggttgcactcta

SEQ ID NO: 37341 - DNA, 20 bp, synthetic construct
  misc_feature 1..20: note = Synthetic Construct
  source 1..20: mol_type = other DNA
gcgatacgtaggcggagctt

SEQ ID NO: 37342 - DNA, 20 bp, synthetic construct
  misc_feature 1..20: note = Synthetic Construct
  source 1..20: mol_type = other DNA
tggggtgcttctctctggat

SEQ ID NO: 37343 - DNA, 26 bp, synthetic construct
  misc_feature 1..26: note = Synthetic Construct
  source 1..26: mol_type = other DNA
gagaggaaactggtgacaatacagat

SEQ ID NO: 37344 - DNA, 23 bp, synthetic construct
  misc_feature 1..23: note = Synthetic Construct
  source 1..23: mol_type = other DNA
gggtggatccctccaggatgtaa

SEQ ID NO: 37345 - DNA, 20 bp, synthetic construct
  misc_feature 1..20: note = Synthetic Construct
  source 1..20: mol_type = other DNA
tccggctacgccagtcaaaa

SEQ ID NO: 37346 - DNA, 19 bp, synthetic construct
  misc_feature 1..19: note = Synthetic Construct
  source 1..19: mol_type = other DNA
acccgtggcaacccctttc

SEQ ID NO: 37347 - DNA, 19 bp, synthetic construct
  misc_feature 1..19: note = Synthetic Construct
  source 1..19: mol_type = other DNA
ttgccctggtcgctgtagt

SEQ ID NO: 37348 - DNA, 21 bp, synthetic construct
  misc_feature 1..21: note = Synthetic Construct
  source 1..21: mol_type = other DNA
aaggggacttggcccacagat

SEQ ID NO: 37349 - DNA, 20 bp, synthetic construct
  misc_feature 1..20: note = Synthetic Construct
  source 1..20: mol_type = other DNA
cctgtgaccaccctgcttct

SEQ ID NO: 37350 - DNA, 20 bp, synthetic construct
  misc_feature 1..20: note = Synthetic Construct
  source 1..20: mol_type = other DNA
tgtgccggctctcctcttct

SEQ ID NO: 37351 - DNA, 22 bp, synthetic construct
  misc_feature 1..22: note = Synthetic Construct
  source 1..22: mol_type = other DNA
ccttcctaccactgaccccaat

SEQ ID NO: 37352 - DNA, 20 bp, synthetic construct
  misc_feature 1..20: note = Synthetic Construct
  source 1..20: mol_type = other DNA
ctcctggagcgtctgcaaaa

SEQ ID NO: 37353 - DNA, 24 bp, synthetic construct
  misc_feature 1..24: note = Synthetic Construct
  source 1..24: mol_type = other DNA
tgaacctttttgggtgaaggtagt

SEQ ID NO: 37354 - DNA, 23 bp, synthetic construct
  misc_feature 1..23: note = Synthetic Construct
  source 1..23: mol_type = other DNA
gtgcagaataggcaaggagaact

SEQ ID NO: 37355 - DNA, 26 bp, synthetic construct
  misc_feature 1..26: note = Synthetic Construct
  source 1..26: mol_type = other DNA
ggagaacttcacccatgtcccacatt

SEQ ID NO: 37356 - DNA, 24 bp, synthetic construct
  misc_feature 1..24: note = Synthetic Construct
  source 1..24: mol_type = other DNA
gggctccaatcaaggaattgaaca

SEQ ID NO: 37357 - DNA, 23 bp, synthetic construct
  misc_feature 1..23: note = Synthetic Construct
  source 1..23: mol_type = other DNA
gacaggttggcctgagtttcaga

SEQ ID NO: 37358 - DNA, 26 bp, synthetic construct
  misc_feature 1..26: note = Synthetic Construct
  source 1..26: mol_type = other DNA
gtccctgtcatttacacgtgttctct

SEQ ID NO: 37359 - DNA, 20 bp, synthetic construct
  misc_feature 1..20: note = Synthetic Construct
  source 1..20: mol_type = other DNA
cctgtgttggccgactttga

SEQ ID NO: 37360 - DNA, 22 bp, synthetic construct
  misc_feature 1..22: note = Synthetic Construct
  source 1..22: mol_type = other DNA
ctggaaacagaccctgctcaca

SEQ ID NO: 37361 - DNA, 23 bp, synthetic construct
  misc_feature 1..23: note = Synthetic Construct
  source 1..23: mol_type = other DNA
tttctctccgctctctccttttc

SEQ ID NO: 37362 - DNA, 19 bp, synthetic construct
  misc_feature 1..19: note = Synthetic Construct
  source 1..19: mol_type = other DNA
ccaccgtccgcatcagctt

SEQ ID NO: 37363 - DNA, 22 bp, synthetic construct
  misc_feature 1..22: note = Synthetic Construct
  source 1..22: mol_type = other DNA
gggaagaagggtgaaggccaat

SEQ ID NO: 37364 - DNA, 22 bp, synthetic construct
  misc_feature 1..22: note = Synthetic Construct
  source 1..22: mol_type = other DNA
gggagggtgccattcattccat

SEQ ID NO: 37365 - DNA, 25 bp, synthetic construct
  misc_feature 1..25: note = Synthetic Construct
  source 1..25: mol_type = other DNA
ggagagggaggaagatggagttttc

SEQ ID NO: 37366 - DNA, 22 bp, synthetic construct
  misc_feature 1..22: note = Synthetic Construct
  source 1..22: mol_type = other DNA
ctggtacggcattggtctctga

SEQ ID NO: 37367 - DNA, 24 bp, synthetic construct
  misc_feature 1..24: note = Synthetic Construct
  source 1..24: mol_type = other DNA
ggtaatcgacagcaacatgctaca

SEQ ID NO: 37368 - DNA, 21 bp, synthetic construct
  misc_feature 1..21: note = Synthetic Construct
  source 1..21: mol_type = other DNA
ggcggcaccgcattcttatag

SEQ ID NO: 37369 - DNA, 22 bp, synthetic construct
  misc_feature 1..22: note = Synthetic Construct
  source 1..22: mol_type = other DNA
tttggggaaggaaggccctaag

SEQ ID NO: 37370 - DNA, 23 bp, synthetic construct
  misc_feature 1..23: note = Synthetic Construct
  source 1..23: mol_type = other DNA
caggaatttcgcgaaggggtttc

SEQ ID NO: 37371 - DNA, 24 bp, synthetic construct
  misc_feature 1..24: note = Synthetic Construct
  source 1..24: mol_type = other DNA
gctacagaagggaagtgactgttc

SEQ ID NO: 37372 - DNA, 24 bp, synthetic construct
  misc_feature 1..24: note = Synthetic Construct
  source 1..24: mol_type = other DNA
ccatttaagagccaactcctggaa

SEQ ID NO: 37373 - DNA, 24 bp, synthetic construct
  misc_feature 1..24: note = Synthetic Construct
  source 1..24: mol_type = other DNA
ttccttcacctcattgcatacaga

SEQ ID NO: 37374 - DNA, 21 bp, synthetic construct
  misc_feature 1..21: note = Synthetic Construct
  source 1..21: mol_type = other DNA
tgctttaccctcagccagtga

SEQ ID NO: 37375 - DNA, 20 bp, synthetic construct
  misc_feature 1..20: note = Synthetic Construct
  source 1..20: mol_type = other DNA
tgcagactggggctgattct

SEQ ID NO: 37376 - DNA, 20 bp, synthetic construct
  misc_feature 1..20: note = Synthetic Construct
  source 1..20: mol_type = other DNA
tcccaagactctggcagaca

SEQ ID NO: 37377 - DNA, 22 bp, synthetic construct
  misc_feature 1..22: note = Synthetic Construct
  source 1..22: mol_type = other DNA
ccctcaggcctgtcatcctagt

SEQ ID NO: 37378 - DNA, 21 bp, synthetic construct
  misc_feature 1..21: note = Synthetic Construct
  source 1..21: mol_type = other DNA
ggggcttaaggagcccaatgt

SEQ ID NO: 37379 - DNA, 20 bp, synthetic construct
  misc_feature 1..20: note = Synthetic Construct
  source 1..20: mol_type = other DNA
accatgcctgccccattgat

SEQ ID NO: 37380 - DNA, 26 bp, synthetic construct
  misc_feature 1..26: note = Synthetic Construct
  source 1..26: mol_type = other DNA
gggtaaatgctactgcagtgcctaag

SEQ ID NO: 37381 - DNA, 27 bp, synthetic construct
  misc_feature 1..27: note = Synthetic Construct
  source 1..27: mol_type = other DNA
gaggttactgtttgctttgcattgact

SEQ ID NO: 37382 - DNA, 20 bp, synthetic construct
  misc_feature 1..20: note = Synthetic Construct
  source 1..20: mol_type = other DNA
ttcctgttcctccgcctaca

SEQ ID NO: 37383 - DNA, 20 bp, synthetic construct
  misc_feature 1..20: note = Synthetic Construct
  source 1..20: mol_type = other DNA
gcctccatggttgcaccaaa

SEQ ID NO: 37384 - DNA, 26 bp, synthetic construct
  misc_feature 1..26: note = Synthetic Construct
  source 1..26: mol_type = other DNA
gccatgataaggaatctcgggtgaag

SEQ ID NO: 37385 - DNA, 20 bp, synthetic construct
  misc_feature 1..20: note = Synthetic Construct
  source 1..20: mol_type = other DNA
atcctcgcgatggcagtagt

SEQ ID NO: 37386 - DNA, 24 bp, synthetic construct
  misc_feature 1..24: note = Synthetic Construct
  source 1..24: mol_type = other DNA
ggagtgcagaggaaggactttatg

SEQ ID NO: 37387 - DNA, 21 bp, synthetic construct
  misc_feature 1..21: note = Synthetic Construct
  source 1..21: mol_type = other DNA
gaacttgggccactagcttca

SEQ ID NO: 37388 - DNA, 21 bp, synthetic construct
  misc_feature 1..21: note = Synthetic Construct
  source 1..21: mol_type = other DNA
ttctcctagaccgccagctaa

SEQ ID NO: 37389 - DNA, 21 bp, synthetic construct
  misc_feature 1..21: note = Synthetic Construct
  source 1..21: mol_type = other DNA
ccagctctccaagacgctgaa

SEQ ID NO: 37390 - DNA, 20 bp, synthetic construct
  misc_feature 1..20: note = Synthetic Construct
  source 1..20: mol_type = other DNA
tcttgccctggtcccacagt

SEQ ID NO: 37391 - DNA, 22 bp, synthetic construct
  misc_feature 1..22: note = Synthetic Construct
  source 1..22: mol_type = other DNA
ggtggtagaaaggcgtgtggaa

SEQ ID NO: 37392 - DNA, 20 bp, synthetic construct
  misc_feature 1..20: note = Synthetic Construct
  source 1..20: mol_type = other DNA
atcggtttcctgggctgttg

SEQ ID NO: 37393 - DNA, 20 bp, synthetic construct
  misc_feature 1..20: note = Synthetic Construct
  source 1..20: mol_type = other DNA
tccacttgtgaccccagaca

SEQ ID NO: 37394 - DNA, 25 bp, synthetic construct
  misc_feature 1..25: note = Synthetic Construct
  source 1..25: mol_type = other DNA
gtgcaacttttctccatgaacttgt

SEQ ID NO: 37395 - DNA, 21 bp, synthetic construct
  misc_feature 1..21: note = Synthetic Construct
  source 1..21: mol_type = other DNA
gcctagtacatgtggggcttt

SEQ ID NO: 37396 - DNA, 23 bp, synthetic construct
  misc_feature 1..23: note = Synthetic Construct
  source 1..23: mol_type = other DNA
gtcatgggatggagccatgatct

SEQ ID NO: 37397 - DNA, 21 bp, synthetic construct
  misc_feature 1..21: note = Synthetic Construct
  source 1..21: mol_type = other DNA
ggttgtgccagcagcaaacta

SEQ ID NO: 37398 - DNA, 22 bp, synthetic construct
  misc_feature 1..22: note = Synthetic Construct
  source 1..22: mol_type = other DNA
ggtgccatgttttctccctgaa

SEQ ID NO: 37399 - DNA, 20 bp, synthetic construct
  misc_feature 1..20: note = Synthetic Construct
  source 1..20: mol_type = other DNA
gctccctgctttaggcacat

SEQ ID NO: 37400 - DNA, 25 bp, synthetic construct
  misc_feature 1..25: note = Synthetic Construct
  source 1..25: mol_type = other DNA
cccatctgccttcactaagggcttt

SEQ ID NO: 37401 - DNA, 21 bp, synthetic construct
  misc_feature 1..21: note = Synthetic Construct
  source 1..21: mol_type = other DNA
cactgagcaggctgatgtttg

SEQ ID NO: 37402 - DNA, 25 bp, synthetic construct
  misc_feature 1..25: note = Synthetic Construct
  source 1..25: mol_type = other DNA
gcatgggtttttgaggcacagattc

SEQ ID NO: 37403 - DNA, 21 bp, synthetic construct
  misc_feature 1..21: note = Synthetic Construct
  source 1..21: mol_type = other DNA
tgcactgctccgtacctggat

SEQ ID NO: 37404 - DNA, 22 bp, synthetic construct
  misc_feature 1..22: note = Synthetic Construct
  source 1..22: mol_type = other DNA
acaccaaggcttccttgtgcta

SEQ ID NO: 37405 - DNA, 20 bp, synthetic construct
  misc_feature 1..20: note = Synthetic Construct
  source 1..20: mol_type = other DNA
ttcccagcctcccttgtagt

SEQ ID NO: 37406 - DNA, 23 bp, synthetic construct
  misc_feature 1..23: note = Synthetic Construct
  source 1..23: mol_type = other DNA
ggctcctgttttagtccccagat

SEQ ID NO: 37407 - DNA, 23 bp, synthetic construct
  misc_feature 1..23: note = Synthetic Construct
  source 1..23: mol_type = other DNA
ggccaatatgacagctagcctaa

SEQ ID NO: 37408 - DNA, 24 bp, synthetic construct
  misc_feature 1..24: note = Synthetic Construct
  source 1..24: mol_type = other DNA
gagaaggggataggagacctgaac

SEQ ID NO: 37409 - DNA, 24 bp, synthetic construct
  misc_feature 1..24: note = Synthetic Construct
  source 1..24: mol_type = other DNA
cagggtatcaaactgtagctgtgt

SEQ ID NO: 37410 - DNA, 24 bp, synthetic construct
  misc_feature 1..24: note = Synthetic Construct
  source 1..24: mol_type = other DNA
ccacaaagtgctctttccccacaa

SEQ ID NO: 37411 - DNA, 23 bp, synthetic construct
  misc_feature 1..23: note = Synthetic Construct
  source 1..23: mol_type = other DNA
gcatagcaccctgtccagactat

SEQ ID NO: 37412 - DNA, 22 bp, synthetic construct
  misc_feature 1..22: note = Synthetic Construct
  source 1..22: mol_type = other DNA
gcctcatctgcagtttggtaca

SEQ ID NO: 37413 - DNA, 20 bp, synthetic construct
  misc_feature 1..20: note = Synthetic Construct
  source 1..20: mol_type = other DNA
tcaggcctgcaaggatctgt

SEQ ID NO: 37414 - DNA, 20 bp, synthetic construct
  misc_feature 1..20: note = Synthetic Construct
  source 1..20: mol_type = other DNA
cattcaggcactggctgtga

SEQ ID NO: 37415 - DNA, 24 bp, synthetic construct
  misc_feature 1..24: note = Synthetic Construct
  source 1..24: mol_type = other DNA
ggcagaactgaaacatgcttcttc

SEQ ID NO: 37416 - DNA, 24 bp, synthetic construct
  misc_feature 1..24: note = Synthetic Construct
  source 1..24: mol_type = other DNA
tgttggttaatgcactctgtgttg

SEQ ID NO: 37417 - DNA, 20 bp, synthetic construct
  misc_feature 1..20: note = Synthetic Construct
  source 1..20: mol_type = other DNA
ggttttgtgggccccattct

SEQ ID NO: 37418 - DNA, 23 bp, synthetic construct
  misc_feature 1..23: note = Synthetic Construct
  source 1..23: mol_type = other DNA
ggttgtcgctgcttctacaaatc

SEQ ID NO: 37419 - DNA, 24 bp, synthetic construct
  misc_feature 1..24: note = Synthetic Construct
  source 1..24: mol_type = other DNA
ggacttgggagaagcaaagtgttc

SEQ ID NO: 37420 - DNA, 26 bp, synthetic construct
  misc_feature 1..26: note = Synthetic Construct
  source 1..26: mol_type = other DNA
cctagcctaaaataaccatgcacttg

SEQ ID NO: 37421 - DNA, 25 bp, synthetic construct
  misc_feature 1..25: note = Synthetic Construct
  source 1..25: mol_type = other DNA
cctgggccaatagttagaagtggtt

SEQ ID NO: 37422 - DNA, 20 bp, synthetic construct
  misc_feature 1..20: note = Synthetic Construct
  source 1..20: mol_type = other DNA
taggggtgcctgcagtttct

SEQ ID NO: 37423 - DNA, 21 bp, synthetic construct
  misc_feature 1..21: note = Synthetic Construct
  source 1..21: mol_type = other DNA
ggcctttcctcatgcttccaa

SEQ ID NO: 37424 - DNA, 25 bp, synthetic construct
  misc_feature 1..25: note = Synthetic Construct
  source 1..25: mol_type = other DNA
ccccaggaaatctacacttctctca

SEQ ID NO: 37425 - DNA, 20 bp, synthetic construct
  misc_feature 1..20: note = Synthetic Construct
  source 1..20: mol_type = other DNA
ccttgtgaggccagggagtt

SEQ ID NO: 37426 - DNA, 20 bp, synthetic construct
  misc_feature 1..20: note = Synthetic Construct
  source 1..20: mol_type = other DNA
agtgccagcaggggcagact

SEQ ID NO: 37427 - DNA, 23 bp, synthetic construct
  misc_feature 1..23: note = Synthetic Construct
  source 1..23: mol_type = other DNA
cactacattgtccgttcccattg

SEQ ID NO: 37428 - DNA, 21 bp, synthetic construct
  misc_feature 1..21: note = Synthetic Construct
  source 1..21: mol_type = other DNA
ggtgtgtggatgggttagctt

SEQ ID NO: 37429 - DNA, 21 bp, synthetic construct
  misc_feature 1..21: note = Synthetic Construct
  source 1..21: mol_type = other DNA
gctcaaaccacctttgcaact

SEQ ID NO: 37430 - DNA, 25 bp, synthetic construct
  misc_feature 1..25: note = Synthetic Construct
  source 1..25: mol_type = other DNA
agaaggacttcacaatgccattaca

SEQ ID NO: 37431 - DNA, 25 bp, synthetic construct
  misc_feature 1..25: note = Synthetic Construct
  source 1..25: mol_type = other DNA
ggtagcagaatatgggtccctgtct

SEQ ID NO: 37432 - DNA, 22 bp, synthetic construct
  misc_feature 1..22: note = Synthetic Construct
  source 1..22: mol_type = other DNA
cgaaacccaccttcaagcctaa

SEQ ID NO: 37433 - DNA, 20 bp, synthetic construct
  misc_feature 1..20: note = Synthetic Construct
  source 1..20: mol_type = other DNA
tcctttccacagcgcgtcaa

SEQ ID NO: 37434 - DNA, 24 bp, synthetic construct
  misc_feature 1..24: note = Synthetic Construct
  source 1..24: mol_type = other DNA
gtcttgtaccctcttaccatgctt

SEQ ID NO: 37435 - DNA, 19 bp, synthetic construct
  misc_feature 1..19: note = Synthetic Construct
  source 1..19: mol_type = other DNA
tgcgtctggccgtgtgagt

SEQ ID NO: 37436 - DNA, 21 bp, synthetic construct
  misc_feature 1..21: note = Synthetic Construct
  source 1..21: mol_type = other DNA
aagggccgtccttgggagtta

SEQ ID NO: 37437 - DNA, 21 bp, synthetic construct
  misc_feature 1..21: note = Synthetic Construct
  source 1..21: mol_type = other DNA
tagctgggaccacaggtgcat

SEQ ID NO: 37438 - DNA, 24 bp, synthetic construct
  misc_feature 1..24: note = Synthetic Construct
  source 1..24: mol_type = other DNA
cctctcttgtgtcagcacccaatc

SEQ ID NO: 37439 - DNA, 22 bp, synthetic construct
  misc_feature 1..22: note = Synthetic Construct
  source 1..22: mol_type = other DNA
tccctgagggtaggcctctgaa

SEQ ID NO: 37440 - DNA, 22 bp, synthetic construct
  misc_feature 1..22: note = Synthetic Construct
  source 1..22: mol_type = other DNA
aagtgtgaggactgaggagtca

SEQ ID NO: 37441 - DNA, 23 bp, synthetic construct
  misc_feature 1..23: note = Synthetic Construct
  source 1..23: mol_type = other DNA
ccagcaaacaatcccagggtctt

SEQ ID NO: 37442 - DNA, 21 bp, synthetic construct
  misc_feature 1..21: note = Synthetic Construct
  source 1..21: mol_type = other DNA
tgccaggaacaactcaacact

SEQ ID NO: 37443 - DNA, 21 bp, synthetic construct
  misc_feature 1..21: note = Synthetic Construct
  source 1..21: mol_type = other DNA
agcattgtgagtgcctgaaga

SEQ ID NO: 37444 - DNA, 26 bp, synthetic construct
  misc_feature 1..26: note = Synthetic Construct
  source 1..26: mol_type = other DNA
catagctgggagattaaaccagttgt

SEQ ID NO: 37445 - DNA, 19 bp, synthetic construct
  misc_feature 1..19: note = Synthetic Construct
  source 1..19: mol_type = other DNA
tggtccagggctgctgtgt

SEQ ID NO: 37446 - DNA, 24 bp, synthetic construct
  misc_feature 1..24: note = Synthetic Construct
  source 1..24: mol_type = other DNA
actttctgggtgtaagtggtccta

SEQ ID NO: 37447 - DNA, 27 bp, synthetic construct
  misc_feature 1..27: note = Synthetic Construct
  source 1..27: mol_type = other DNA
ccaaatatctgatgccagggaaggata

SEQ ID NO: 37448 - DNA, 23 bp, synthetic construct
  misc_feature 1..23: note = Synthetic Construct
  source 1..23: mol_type = other DNA
ccactggaagaggcactggtatc

SEQ ID NO: 37449 - DNA, 22 bp, synthetic construct
  misc_feature 1..22: note = Synthetic Construct
  source 1..22: mol_type = other DNA
gcaagccagtccataggtgaca

SEQ ID NO: 37450 - DNA, 25 bp, synthetic construct
  misc_feature 1..25: note = Synthetic Construct
  source 1..25: mol_type = other DNA
gtccaactgggttccccaataaaca

SEQ ID NO: 37451 - DNA, 24 bp, synthetic construct
  misc_feature 1..24: note = Synthetic Construct
  source 1..24: mol_type = other DNA
gctttccagagaaatccagcaaca

SEQ ID NO: 37452 - DNA, 19 bp, synthetic construct
  misc_feature 1..19: note = Synthetic Construct
  source 1..19: mol_type = other DNA
ccacgacacccagccaaca

SEQ ID NO: 37453 - DNA, 22 bp, synthetic construct
  misc_feature 1..22: note = Synthetic Construct
  source 1..22: mol_type = other DNA
cacgctcagcctaagcctcttt

SEQ ID NO: 37454 - DNA, 22 bp, synthetic construct
  misc_feature 1..22: note = Synthetic Construct
  source 1..22: mol_type = other DNA
aggacctggttcacagatggtt

SEQ ID NO: 37455 - DNA, 24 bp, synthetic construct
  misc_feature 1..24: note = Synthetic Construct
  source 1..24: mol_type = other DNA
ggcctccattagtctcacccagat

SEQ ID NO: 37456 - DNA, 24 bp, synthetic construct
  misc_feature 1..24: note = Synthetic Construct
  source 1..24: mol_type = other DNA
gctgatgaaagagggaaaggtcta

SEQ ID NO: 37457 - DNA, 21 bp, synthetic construct
  misc_feature 1..21: note = Synthetic Construct
  source 1..21: mol_type = other DNA
tcagatcatgcctggttgcat

SEQ ID NO: 37458 - DNA, 20 bp, synthetic construct
  misc_feature 1..20: note = Synthetic Construct
  source 1..20: mol_type = other DNA
ggcccatctgggatctctgt

SEQ ID NO: 37459 - DNA, 20 bp, synthetic construct
  misc_feature 1..20: note = Synthetic Construct
  source 1..20: mol_type = other DNA
tgggctggggctgcagactt

SEQ ID NO: 37460 - DNA, 19 bp, synthetic construct
  misc_feature 1..19: note = Synthetic Construct
  source 1..19: mol_type = other DNA
tccaggctttgcccaggtt

SEQ ID NO: 37461 - DNA, 18 bp, synthetic construct
  misc_feature 1..18: note = Synthetic Construct
  source 1..18: mol_type = other DNA
acctgggccatccactga

SEQ ID NO: 37462 - DNA, 20 bp, synthetic construct
  misc_feature 1..20: note = Synthetic Construct
  source 1..20: mol_type = other DNA
ccttgacccctgcccatcat

SEQ ID NO: 37463 - DNA, 20 bp, synthetic construct
  misc_feature 1..20: note = Synthetic Construct
  source 1..20: mol_type = other DNA
gctatggctgcctgctgtct

SEQ ID NO: 37464 - DNA, 27 bp, synthetic construct
  misc_feature 1..27: note = Synthetic Construct
  source 1..27: mol_type = other DNA
ccccttctaaagctatctcaggcttca

SEQ ID NO: 37465 - DNA, 23 bp, synthetic construct
  misc_feature 1..23: note = Synthetic Construct
  source 1..23: mol_type = other DNA
gaggtgtcccaagtagcagattg

SEQ ID NO: 37466 - DNA, 23 bp, synthetic construct
  misc_feature 1..23: note = Synthetic Construct
  source 1..23: mol_type = other DNA
gcctttttggtagcccgaatatg

SEQ ID NO: 37467 - DNA, 22 bp, synthetic construct
  misc_feature 1..22: note = Synthetic Construct
  source 1..22: mol_type = other DNA
gccagcctgctcctaaggaaat

SEQ ID NO: 37468 - DNA, 20 bp, synthetic construct
  misc_feature 1..20: note = Synthetic Construct
  source 1..20: mol_type = other DNA
ggccacagcagccagaaaaa

SEQ ID NO: 37469 - DNA, 27 bp, synthetic construct
  misc_feature 1..27: note = Synthetic Construct
  source 1..27: mol_type = other DNA
gacagggcataattggaaagcctttta

SEQ ID NO: 37470 - DNA, 24 bp, synthetic construct
  misc_feature 1..24: note = Synthetic Construct
  source 1..24: mol_type = other DNA
ccagaagggctaagagacttgtca

SEQ ID NO: 37471 - DNA, 20 bp, synthetic construct
  misc_feature 1..20: note = Synthetic Construct
  source 1..20: mol_type = other DNA
tgccctgccccagaggtact

SEQ ID NO: 37472 - DNA, 21 bp, synthetic construct
  misc_feature 1..21: note = Synthetic Construct
  source 1..21: mol_type = other DNA
agcccagacgaatgggttact

SEQ ID NO: 37473 - DNA, 25 bp, synthetic construct
  misc_feature 1..25: note = Synthetic Construct
  source 1..25: mol_type = other DNA
cgtggaataggactcttcagcttgt

SEQ ID NO: 37474 - DNA, 24 bp, synthetic construct
  misc_feature 1..24: note = Synthetic Construct
  source 1..24: mol_type = other DNA
gcaagcaagggcttgaatgtgctt

SEQ ID NO: 37475 - DNA, 26 bp, synthetic construct
  misc_feature 1..26: note = Synthetic Construct
  source 1..26: mol_type = other DNA
ggtccttctcttcaaggaaatgagtt

SEQ ID NO: 37476 - DNA, 25 bp, synthetic construct
  misc_feature 1..25: note = Synthetic Construct
  source 1..25: mol_type = other DNA
ctgataagcacactatcccttcact

SEQ ID NO: 37477 - DNA, 22 bp, synthetic construct
  misc_feature 1..22: note = Synthetic Construct
  source 1..22: mol_type = other DNA
ctgcttcatgttgcaggtctgt

SEQ ID NO: 37478 - DNA, 27 bp, synthetic construct
  misc_feature 1..27: note = Synthetic Construct
  source 1..27: mol_type = other DNA
gtgctgaggttgagaaactctgaatta

SEQ ID NO: 37479 - DNA, 19 bp, synthetic construct
  misc_feature 1..19: note = Synthetic Construct
  source 1..19: mol_type = other DNA
agtggcagcctcacagaga

SEQ ID NO: 37480 - DNA, 20 bp, synthetic construct
  misc_feature 1..20: note = Synthetic Construct
  source 1..20: mol_type = other DNA
gacctcctgactgggagcat

SEQ ID NO: 37481 - DNA, 22 bp, synthetic construct
  misc_feature 1..22: note = Synthetic Construct
  source 1..22: mol_type = other DNA
ggctagcagctgtggagaacat

SEQ ID NO: 37482 - DNA, 22 bp, synthetic construct
  misc_feature 1..22: note = Synthetic Construct
  source 1..22: mol_type = other DNA
ggtagggaagaggcagtgatga

SEQ ID NO: 37483 - DNA, 23 bp, synthetic construct
  misc_feature 1..23: note = Synthetic Construct
  source 1..23: mol_type = other DNA
ggaactggtctgcatgtgttact

SEQ ID NO: 37484 - DNA, 20 bp, synthetic construct
  misc_feature 1..20: note = Synthetic Construct
  source 1..20: mol_type = other DNA
tgcaggagacagcaggacat

SEQ ID NO: 37485 - DNA, 22 bp, synthetic construct
  misc_feature 1..22: note = Synthetic Construct
  source 1..22: mol_type = other DNA
gggccttgctgattctgtgctt

SEQ ID NO: 37486 - DNA, 20 bp, synthetic construct
  misc_feature 1..20: note = Synthetic Construct
  source 1..20: mol_type = other DNA
aggctgcaggtgctacacta

SEQ ID NO: 37487 - DNA, 26 bp, synthetic construct
  misc_feature 1..26: note = Synthetic Construct
  source 1..26: mol_type = other DNA
ggattaacctgtttgggacagctact

SEQ ID NO: 37488 - DNA, 22 bp, synthetic construct
  misc_feature 1..22: note = Synthetic Construct
  source 1..22: mol_type = other DNA
ctactgaaccactgccacttga

SEQ ID NO: 37489 - DNA, 22 bp, synthetic construct
  misc_feature 1..22: note = Synthetic Construct
  source 1..22: mol_type = other DNA
gcctagtggcatctgtggcatt

SEQ ID NO: 37490 - DNA, 24 bp, synthetic construct
  misc_feature 1..24: note = Synthetic Construct
  source 1..24: mol_type = other DNA
cctcttcccactttgcagctattc

SEQ ID NO: 37491 - DNA, 22 bp, synthetic construct
  misc_feature 1..22: note = Synthetic Construct
  source 1..22: mol_type = other DNA
gagtccaagaagcccctcaaat

SEQ ID NO: 37492 - DNA, 24 bp, synthetic construct
  misc_feature 1..24: note = Synthetic Construct
  source 1..24: mol_type = other DNA
cccactacagagcatttactggaa

SEQ ID NO: 37493 - DNA, 26 bp, synthetic construct
  misc_feature 1..26: note = Synthetic Construct
  source 1..26: mol_type = other DNA
ggcagcagaattattacgcagagaca

SEQ ID NO: 37494 - DNA, 23 bp, synthetic construct
  misc_feature 1..23: note = Synthetic Construct
  source 1..23: mol_type = other DNA
cgtgtctccatttgacacagact

SEQ ID NO: 37495 - DNA, 23 bp, synthetic construct
  misc_feature 1..23: note = Synthetic Construct
  source 1..23: mol_type = other DNA
ccagctctccatcctccttcttg

SEQ ID NO: 37496 - DNA, 22 bp, synthetic construct
  misc_feature 1..22: note = Synthetic Construct
  source 1..22: mol_type = other DNA
ccaccctgtttcaaggctggat

SEQ ID NO: 37497 - DNA, 25 bp, synthetic construct
  misc_feature 1..25: note = Synthetic Construct
  source 1..25: mol_type = other DNA
gtgactatagagccatggagtgagt

SEQ ID NO: 37498 - DNA, 20 bp, synthetic construct
  misc_feature 1..20: note = Synthetic Construct
  source 1..20: mol_type = other DNA
tgctgacaagggccacctta

SEQ ID NO: 37499 - DNA, 20 bp, synthetic construct
  misc_feature 1..20: note = Synthetic Construct
  source 1..20: mol_type = other DNA
tgagggcctttctgccacat

SEQ ID NO: 37500 - DNA, 20 bp, synthetic construct
  misc_feature 1..20: note = Synthetic Construct
  source 1..20: mol_type = other DNA
atgatcagggtgggccttgt

SEQ ID NO: 37501 - DNA, 20 bp, synthetic construct
  misc_feature 1..20: note = Synthetic Construct
  source 1..20: mol_type = other DNA
tgctgagtgccctgcatctt

SEQ ID NO: 37502 - DNA, 19 bp, synthetic construct
  misc_feature 1..19: note = Synthetic Construct
  source 1..19: mol_type = other DNA
cttggtatgcgcccctgat

SEQ ID NO: 37503 - DNA, 19 bp, synthetic construct
  misc_feature 1..19: note = Synthetic Construct
  source 1..19: mol_type = other DNA
ccccagctctgtcccgtaa

SEQ ID NO: 37504 - DNA, 25 bp, synthetic construct
  misc_feature 1..25: note = Synthetic Construct
  source 1..25: mol_type = other DNA
ccgttgctatctcaacactgaccat

SEQ ID NO: 37505 - DNA, 24 bp, synthetic construct
  misc_feature 1..24: note = Synthetic Construct
  source 1..24: mol_type = other DNA
tctgtgatattgggccatgcataa

SEQ ID NO: 37506 - DNA, 25 bp, synthetic construct
  misc_feature 1..25: note = Synthetic Construct
  source 1..25: mol_type = other DNA
ctctcaacagagaggatgacctaga

SEQ ID NO: 37507 - DNA, 22 bp, synthetic construct
  misc_feature 1..22: note = Synthetic Construct
  source 1..22: mol_type = other DNA
gcccgcatctttagctgtgctt

SEQ ID NO: 37508 - DNA, 23 bp, synthetic construct
  misc_feature 1..23: note = Synthetic Construct
  source 1..23: mol_type = other DNA
agtgccaaatctctttccccaaa

SEQ ID NO: 37509 - DNA, 22 bp, synthetic construct
  misc_feature 1..22: note = Synthetic Construct
  source 1..22: mol_type = other DNA
tcaattcctggccatgtggaaa

SEQ ID NO: 37510 - DNA, 24 bp, synthetic construct
  misc_feature 1..24: note = Synthetic Construct
  source 1..24: mol_type = other DNA
gcttgctatggtaatggctacagt

SEQ ID NO: 37511 - DNA, 20 bp, synthetic construct
  misc_feature 1..20: note = Synthetic Construct
  source 1..20: mol_type = other DNA
tggccgcttggaaagagaga

SEQ ID NO: 37512 - DNA, 21 bp, synthetic construct
  misc_feature 1..21: note = Synthetic Construct
  source 1..21: mol_type = other DNA
gcgagtcctacacccttgtca

SEQ ID NO: 37513 - DNA, 22 bp, synthetic construct
  misc_feature 1..22: note = Synthetic Construct
  source 1..22: mol_type = other DNA
gggagggccaaagcctaagaaa

SEQ ID NO: 37514 - DNA, 23 bp, synthetic construct
  misc_feature 1..23: note = Synthetic Construct
  source 1..23: mol_type = other DNA
ccatctgcttactccagttctgt

SEQ ID NO: 37515 - DNA, 22 bp, synthetic construct
  misc_feature 1..22: note = Synthetic Construct
  source 1..22: mol_type = other DNA
tccccaagtggaaggagtctct

SEQ ID NO: 37516 - DNA, 25 bp, synthetic construct
  misc_feature 1..25: note = Synthetic Construct
  source 1..25: mol_type = other DNA
gcaataaagttagtccaggctgttg

SEQ ID NO: 37517 - DNA, 28 bp, synthetic construct
  misc_feature 1..28: note = Synthetic Construct
  source 1..28: mol_type = other DNA
ggtccagaaggttaaccaacctgtttac

SEQ ID NO: 37518 - DNA, 28 bp, synthetic construct
  misc_feature 1..28: note = Synthetic Construct
  source 1..28: mol_type = other DNA
caggctgagctctcctatctaatatttc

SEQ ID NO: 37519 - DNA, 26 bp, synthetic construct
  misc_feature 1..26: note = Synthetic Construct
  source 1..26: mol_type = other DNA
gaggctagagaactagtaagcagaga

SEQ ID NO: 37520 - DNA, 21 bp, synthetic construct
  misc_feature 1..21: note = Synthetic Construct
  source 1..21: mol_type = other DNA
tctcaccaaggactcctgcaa

SEQ ID NO: 37521 - DNA, 24 bp, synthetic construct
  misc_feature 1..24: note = Synthetic Construct
  source 1..24: mol_type = other DNA
gcctcaagctttctgtaaaacact

SEQ ID NO: 37522 - DNA, 22 bp, synthetic construct
  misc_feature 1..22: note = Synthetic Construct
  source 1..22: mol_type = other DNA
gtgttccaccagctaggcacat

SEQ ID NO: 37523 - DNA, 23 bp, synthetic construct
  misc_feature 1..23: note = Synthetic Construct
  source 1..23: mol_type = other DNA
gctcaaccagctcactcctcaac

SEQ ID NO: 37524 - DNA, 19 bp, synthetic construct
  misc_feature 1..19: note = Synthetic Construct
  source 1..19: mol_type = other DNA
tggccgtgtggcagtctta

SEQ ID NO: 37525 - DNA, 24 bp, synthetic construct
  misc_feature 1..24: note = Synthetic Construct
  source 1..24: mol_type = other DNA
ggaatcaggatgccatgggatgaa

SEQ ID NO: 37526 - DNA, 21 bp, synthetic construct
  misc_feature 1..21: note = Synthetic Construct
  source 1..21: mol_type = other DNA
aactgaccaaagtggctgtca

SEQ ID NO: 37527 - DNA, 22 bp, synthetic construct
  misc_feature 1..22: note = Synthetic Construct
  source 1..22: mol_type = other DNA
tccccaacccaccattcagttg

SEQ ID NO: 37528 - DNA, 28 bp, synthetic construct
  misc_feature 1..28: note = Synthetic Construct
  source 1..28: mol_type = other DNA
gctaagttcatcacaagtcttggctcta

SEQ ID NO: 37529 - DNA, 27 bp, synthetic construct
  misc_feature 1..27: note = Synthetic Construct
  source 1..27: mol_type = other DNA
cgattatggctctaccggagataattg

SEQ ID NO: 37530 - DNA, 24 bp, synthetic construct
  misc_feature 1..24: note = Synthetic Construct
  source 1..24: mol_type = other DNA
cttgcctgacatttagccttctgt

SEQ ID NO: 37531 - DNA, 25 bp, synthetic construct
  misc_feature 1..25: note = Synthetic Construct
  source 1..25: mol_type = other DNA
gcgtgtgagctatttaagagcagat

SEQ ID NO: 37532 - DNA, 22 bp, synthetic construct
  misc_feature 1..22: note = Synthetic Construct
  source 1..22: mol_type = other DNA
ccttagcttccagccattgtgt

SEQ ID NO: 37533 - DNA, 30 bp, synthetic construct
  misc_feature 1..30: note = Synthetic Construct
  source 1..30: mol_type = other DNA
ggacaagtgaaataatcaaggggtggtact

SEQ ID NO: 37534 - DNA, 23 bp, synthetic construct
  misc_feature 1..23: note = Synthetic Construct
  source 1..23: mol_type = other DNA
ccctctggctaggggctcattta

SEQ ID NO: 37535 - DNA, 22 bp, synthetic construct
  misc_feature 1..22: note = Synthetic Construct
  source 1..22: mol_type = other DNA
ctccagcgacccttgctatttg

SEQ ID NO: 37536 - DNA, 19 bp, synthetic construct
  misc_feature 1..19: note = Synthetic Construct
  source 1..19: mol_type = other DNA
gcactgccacctgctgatt

SEQ ID NO: 37537 - DNA, 29 bp, synthetic construct
  misc_feature 1..29: note = Synthetic Construct
  source 1..29: mol_type = other DNA
gggaaaatgttttgaccaaggagttctct

SEQ ID NO: 37538 - DNA, 25 bp, synthetic construct
  misc_feature 1..25: note = Synthetic Construct
  source 1..25: mol_type = other DNA
tcaggaagcaactaaaaggttccat

SEQ ID NO: 37539 - DNA, 19 bp, synthetic construct
  misc_feature 1..19: note = Synthetic Construct
  source 1..19: mol_type = other DNA
aggcgccgagagcaagcta

SEQ ID NO: 37540 - DNA, 20 bp, synthetic construct
  misc_feature 1..20: note = Synthetic Construct
  source 1..20: mol_type = other DNA
ctgcaggcctccatcttgtt

SEQ ID NO: 37541 - DNA, 24 bp, synthetic construct
  misc_feature 1..24: note = Synthetic Construct
  source 1..24: mol_type = other DNA
ggctgatcttattgcagtggaact

SEQ ID NO: 37542 - DNA, 22 bp, synthetic construct
  misc_feature 1..22: note = Synthetic Construct
  source 1..22: mol_type = other DNA
ccctctgtggaagaatgtgtga

SEQ ID NO: 37543 - DNA, 24 bp, synthetic construct
  misc_feature 1..24: note = Synthetic Construct
  source 1..24: mol_type = other DNA
cagcagatcctacagacctgtttc

SEQ ID NO: 37544 - DNA, 25 bp, synthetic construct
  misc_feature 1..25: note = Synthetic Construct
  source 1..25: mol_type = other DNA
gtcttatcgtcttcacagggttctt

SEQ ID NO: 37545 - DNA, 22 bp, synthetic construct
  misc_feature 1..22: note = Synthetic Construct
  source 1..22: mol_type = other DNA
ctgaccctgagcctgctttttg

SEQ ID NO: 37546 - DNA, 21 bp, synthetic construct
  misc_feature 1..21: note = Synthetic Construct
  source 1..21: mol_type = other DNA
tgccagccttccacaaacttc

SEQ ID NO: 37547 - DNA, 25 bp, synthetic construct
  misc_feature 1..25: note = Synthetic Construct
  source 1..25: mol_type = other DNA
gtttgtcctcctttatcaccacact

SEQ ID NO: 37548 - DNA, 19 bp, synthetic construct
  misc_feature 1..19: note = Synthetic Construct
  source 1..19: mol_type = other DNA
agtgggccttgtcctgtga

SEQ ID NO: 37549 - DNA, 21 bp, synthetic construct
  misc_feature 1..21: note = Synthetic Construct
  source 1..21: mol_type = other DNA
ggagcctgaaccactgcatga

SEQ ID NO: 37550 - DNA, 22 bp, synthetic construct
  misc_feature 1..22: note = Synthetic Construct
  source 1..22: mol_type = other DNA
aagggagggccaggactctaaa

SEQ ID NO: 37551 - DNA, 23 bp, synthetic construct
  misc_feature 1..23: note = Synthetic Construct
  source 1..23: mol_type = other DNA
ccccttcctgggtaccacctaat

SEQ ID NO: 37552 - DNA, 22 bp, synthetic construct
  misc_feature 1..22: note = Synthetic Construct
  source 1..22: mol_type = other DNA
ggtcacagctttccccatcata

SEQ ID NO: 37553 - DNA, 30 bp, synthetic construct
  misc_feature 1..30: note = Synthetic Construct
  source 1..30: mol_type = other DNA
cccttgaaatacctaatttcttgcccttct

SEQ ID NO: 37554 - DNA, 19 bp, synthetic construct
  misc_feature 1..19: note = Synthetic Construct
  source 1..19: mol_type = other DNA
atgccccacccctccacaa

SEQ ID NO: 37555 - DNA, 24 bp, synthetic construct
  misc_feature 1..24: note = Synthetic Construct
  source 1..24: mol_type = other DNA
ccctgctgggcactatatcacctt

SEQ ID NO: 37556 - DNA, 20 bp, synthetic construct
  misc_feature 1..20: note = Synthetic Construct
  source 1..20: mol_type = other DNA
ggaggtgcctttgccaaaca

SEQ ID NO: 37557 - DNA, 20 bp, synthetic construct
  misc_feature 1..20: note = Synthetic Construct
  source 1..20: mol_type = other DNA
ggactttgggccgtaaggaa

SEQ ID NO: 37558 - DNA, 25 bp, synthetic construct
  misc_feature 1..25: note = Synthetic Construct
  source 1..25: mol_type = other DNA
ggcttaaagagtgaccaagcaccta

SEQ ID NO: 37559 - DNA, 30 bp, synthetic construct
  misc_feature 1..30: note = Synthetic Construct
  source 1..30: mol_type = other DNA
ggaatgttgtcttaaataagcccctactga

SEQ ID NO: 37560 - DNA, 26 bp, synthetic construct
  misc_feature 1..26: note = Synthetic Construct
  source 1..26: mol_type = other DNA
gaatttctgcttactgggccaatatc

SEQ ID NO: 37561 - DNA, 23 bp, synthetic construct
  misc_feature 1..23: note = Synthetic Construct
  source 1..23: mol_type = other DNA
cactccaccgtgcttttctctct

SEQ ID NO: 37562 - DNA, 19 bp, synthetic construct
  misc_feature 1..19: note = Synthetic Construct
  source 1..19: mol_type = other DNA
agggtggcagccttcttct

SEQ ID NO: 37563 - DNA, 20 bp, synthetic construct
  misc_feature 1..20: note = Synthetic Construct
  source 1..20: mol_type = other DNA
ccagccgcttcaggtgatct

SEQ ID NO: 37564 - DNA, 27 bp, synthetic construct
  misc_feature 1..27: note = Synthetic Construct
  source 1..27: mol_type = other DNA
caatacttttaagaagcccctcctttc

SEQ ID NO: 37565 - DNA, 26 bp, synthetic construct
  misc_feature 1..26: note = Synthetic Construct
  source 1..26: mol_type = other DNA
ctttttgggcttaccatcactacaga

SEQ ID NO: 37566 - DNA, 22 bp, synthetic construct
  misc_feature 1..22: note = Synthetic Construct
  source 1..22: mol_type = other DNA
cttcttctcactggtgggcaat

SEQ ID NO: 37567 - DNA, 27 bp, synthetic construct
  misc_feature 1..27: note = Synthetic Construct
  source 1..27: mol_type = other DNA
ctgtggaaataaaggttgggatgaaag

SEQ ID NO: 37568 - DNA, 26 bp, synthetic construct
  misc_feature 1..26: note = Synthetic Construct
  source 1..26: mol_type = other DNA
cctcaggactggagtttacacgaagt

SEQ ID NO: 37569 - DNA, 21 bp, synthetic construct
  misc_feature 1..21: note = Synthetic Construct
  source 1..21: mol_type = other DNA
cgaggaccccaggcaattcaa

SEQ ID NO: 37570 - DNA, 21 bp, synthetic construct
  misc_feature 1..21: note = Synthetic Construct
  source 1..21: mol_type = other DNA
ccgataggagggagggagctt

SEQ ID NO: 37571 - DNA, 24 bp, synthetic construct
  misc_feature 1..24: note = Synthetic Construct
  source 1..24: mol_type = other DNA
gaggcaggacgatttcttgaccta

SEQ ID NO: 37572 - DNA, 21 bp, synthetic construct
  misc_feature 1..21: note = Synthetic Construct
  source 1..21: mol_type = other DNA
aggccgagccagatcctattg

SEQ ID NO: 37573 - DNA, 19 bp, synthetic construct
  misc_feature 1..19: note = Synthetic Construct
  source 1..19: mol_type = other DNA
acccacccaggccagtttc

SEQ ID NO: 37574 - DNA, 23 bp, synthetic construct
  misc_feature 1..23: note = Synthetic Construct
  source 1..23: mol_type = other DNA
gcaaggctagagttttcgagttc

SEQ ID NO: 37575 - DNA, 18 bp, synthetic construct
  misc_feature 1..18: note = Synthetic Construct
  source 1..18: mol_type = other DNA
taagccagggcgcccaaa

SEQ ID NO: 37576 - DNA, 23 bp, synthetic construct
  misc_feature 1..23: note = Synthetic Construct
  source 1..23: mol_type = other DNA
cagatggcaagtgtccagggtaa

SEQ ID NO: 37577 - DNA, 21 bp, synthetic construct
  misc_feature 1..21: note = Synthetic Construct
  source 1..21: mol_type = other DNA
ttgcctcctggttaccacttc

SEQ ID NO: 37578 - DNA, 18 bp, synthetic construct
  misc_feature 1..18: note = Synthetic Construct
  source 1..18: mol_type = other DNA
tctcgcggctcgcttttc

SEQ ID NO: 37579 - DNA, 23 bp, synthetic construct
  misc_feature 1..23: note = Synthetic Construct
  source 1..23: mol_type = other DNA
tgggatatgaagggcaggttttg

SEQ ID NO: 37580 - DNA, 22 bp, synthetic construct
  misc_feature 1..22: note = Synthetic Construct
  source 1..22: mol_type = other DNA
ggtctgaaactcctgggctcaa

SEQ ID NO: 37581 - DNA, 21 bp, synthetic construct
  misc_feature 1..21: note = Synthetic Construct
  source 1..21: mol_type = other DNA
ccctgtgagggcaggatgaac

SEQ ID NO: 37582 - DNA, 22 bp, synthetic construct
  misc_feature 1..22: note = Synthetic Construct
  source 1..22: mol_type = other DNA
gaggaacaagggcaaggtgatg

SEQ ID NO: 37583 - DNA, 21 bp, synthetic construct
  misc_feature 1..21: note = Synthetic Construct
  source 1..21: mol_type = other DNA
ctggtcacactaaggcaccat

SEQ ID NO: 37584 - DNA, 25 bp, synthetic construct
  misc_feature 1..25: note = Synthetic Construct
  source 1..25: mol_type = other DNA
gggaggggatttaaggtcacaaaac

SEQ ID NO: 37585 - DNA, 24 bp, synthetic construct
  misc_feature 1..24: note = Synthetic Construct
  source 1..24: mol_type = other DNA
ggtgtgactgtgtgtttacaggtt

SEQ ID NO: 37586 - DNA, 25 bp, synthetic construct
  misc_feature 1..25: note = Synthetic Construct
  source 1..25: mol_type = other DNA
ctctggattaggacccagaaacttg

SEQ ID NO: 37587 - DNA, 25 bp, synthetic construct
  misc_feature 1..25: note = Synthetic Construct
  source 1..25: mol_type = other DNA
gagacagaatccagagctgtagaag

SEQ ID NO: 37588 - DNA, 20 bp, synthetic construct
  misc_feature 1..20: note = Synthetic Construct
  source 1..20: mol_type = other DNA
tcaccgccatgcccaagaat

SEQ ID NO: 37589 - DNA, 23 bp, synthetic construct
  misc_feature 1..23: note = Synthetic Construct
  source 1..23: mol_type = other DNA
atgtttagaaccccgtggaatgt

SEQ ID NO: 37590 - DNA, 25 bp, synthetic construct
  misc_feature 1..25: note = Synthetic Construct
  source 1..25: mol_type = other DNA
ccagctacctcctacaggtgctatt

SEQ ID NO: 37591 - DNA, 25 bp, synthetic construct
  misc_feature 1..25: note = Synthetic Construct
  source 1..25: mol_type = other DNA
gcccactgaagaaattgggacatac

SEQ ID NO: 37592 - DNA, 26 bp, synthetic construct
  misc_feature 1..26: note = Synthetic Construct
  source 1..26: mol_type = other DNA
ggatcatccaaaggggtcatatctct

SEQ ID NO: 37593 - DNA, 22 bp, synthetic construct
  misc_feature 1..22: note = Synthetic Construct
  source 1..22: mol_type = other DNA
gaccccatatgctccagggttt

SEQ ID NO: 37594 - DNA, 20 bp, synthetic construct
  misc_feature 1..20: note = Synthetic Construct
  source 1..20: mol_type = other DNA
tgactgctgtgggcagaact

SEQ ID NO: 37595 - DNA, 24 bp, synthetic construct
  misc_feature 1..24: note = Synthetic Construct
  source 1..24: mol_type = other DNA
gcgctaaaccacagcagtataaaa

SEQ ID NO: 37596 - DNA, 25 bp, synthetic construct
  misc_feature 1..25: note = Synthetic Construct
  source 1..25: mol_type = other DNA
gggcttcttttccacctatcaattc

SEQ ID NO: 37597 - DNA, 27 bp, synthetic construct
  misc_feature 1..27: note = Synthetic Construct
  source 1..27: mol_type = other DNA
gcactaagggttcttgctacaatcaga

SEQ ID NO: 37598 - DNA, 22 bp, synthetic construct
  misc_feature 1..22: note = Synthetic Construct
  source 1..22: mol_type = other DNA
gcagggtgttgctctgtcatca

SEQ ID NO: 37599 - DNA, 20 bp, synthetic construct
  misc_feature 1..20: note = Synthetic Construct
  source 1..20: mol_type = other DNA
gccagtcctgctgtgtccaa

SEQ ID NO: 37600 - DNA, 22 bp, synthetic construct
  misc_feature 1..22: note = Synthetic Construct
  source 1..22: mol_type = other DNA
tgtgagaccagcttcctctagt

SEQ ID NO: 37601 - DNA, 21 bp, synthetic construct
  misc_feature 1..21: note = Synthetic Construct
  source 1..21: mol_type = other DNA
caatgcccttctcaccacgta

SEQ ID NO: 37602 - DNA, 21 bp, synthetic construct
  misc_feature 1..21: note = Synthetic Construct
  source 1..21: mol_type = other DNA
gcccacagccctacccatttt

SEQ ID NO: 37603 - DNA, 23 bp, synthetic construct
  misc_feature 1..23: note = Synthetic Construct
  source 1..23: mol_type = other DNA
ttcacttcctagcaggtctctct

SEQ ID NO: 37604 - DNA, 24 bp, synthetic construct
  misc_feature 1..24: note = Synthetic Construct
  source 1..24: mol_type = other DNA
ccaaagccctttccatgagctaga

SEQ ID NO: 37605 - DNA, 26 bp, synthetic construct
  misc_feature 1..26: note = Synthetic Construct
  source 1..26: mol_type = other DNA
ggtatctgaatcagccaggactgtag

SEQ ID NO: 37606 - DNA, 24 bp, synthetic construct
  misc_feature 1..24: note = Synthetic Construct
  source 1..24: mol_type = other DNA
aaagatgcaagagtccttggtttg

SEQ ID NO: 37607 - DNA, 23 bp, synthetic construct
  misc_feature 1..23: note = Synthetic Construct
  source 1..23: mol_type = other DNA
cccacatgctctcacacatttac

SEQ ID NO: 37608 - DNA, 21 bp, synthetic construct
  misc_feature 1..21: note = Synthetic Construct
  source 1..21: mol_type = other DNA
agcagcactgaggcctgtctt

SEQ ID NO: 37609 - DNA, 22 bp, synthetic construct
  misc_feature 1..22: note = Synthetic Construct
  source 1..22: mol_type = other DNA
aggcaaagtcaacatgcagaga

SEQ ID NO: 37610 - DNA, 26 bp, synthetic construct
  misc_feature 1..26: note = Synthetic Construct
  source 1..26: mol_type = other DNA
gtggatataagctcccagtgggtaag

SEQ ID NO: 37611 - DNA, 23 bp, synthetic construct
  misc_feature 1..23: note = Synthetic Construct
  source 1..23: mol_type = other DNA
cagctaactaacgtggggacttc

SEQ ID NO: 37612 - DNA, 19 bp, synthetic construct
  misc_feature 1..19: note = Synthetic Construct
  source 1..19: mol_type = other DNA
acctgctgctgggtgaaga

SEQ ID NO: 37613 - DNA, 24 bp, synthetic construct
  misc_feature 1..24: note = Synthetic Construct
  source 1..24: mol_type = other DNA
gggctcctagggaaagcaaaccta

SEQ ID NO: 37614 - DNA, 25 bp, synthetic construct
  misc_feature 1..25: note = Synthetic Construct
  source 1..25: mol_type = other DNA
ctgttggttttggagtcaggtcaga

SEQ ID NO: 37615 - DNA, 21 bp, synthetic construct
  misc_feature 1..21: note = Synthetic Construct
  source 1..21: mol_type = other DNA
gagtgcttacgtgtggtgcat

SEQ ID NO: 37616 - DNA, 22 bp, synthetic construct
  misc_feature 1..22: note = Synthetic Construct
  source 1..22: mol_type = other DNA
aggctctcagtggtggtgttag

SEQ ID NO: 37617 - DNA, 20 bp, synthetic construct
  misc_feature 1..20: note = Synthetic Construct
  source 1..20: mol_type = other DNA
ggtttgccctgctggaaatg

SEQ ID NO: 37618 - DNA, 20 bp, synthetic construct
  misc_feature 1..20: note = Synthetic Construct
  source 1..20: mol_type = other DNA
agggcaagtggtgtgagaga

SEQ ID NO: 37619 - DNA, 23 bp, synthetic construct
  misc_feature 1..23: note = Synthetic Construct
  source 1..23: mol_type = other DNA
tccctacctctcctcccatctca

SEQ ID NO: 37620 - DNA, 26 bp, synthetic construct
  misc_feature 1..26: note = Synthetic Construct
  source 1..26: mol_type = other DNA
ctcctttccctagaccgtaagcaata

SEQ ID NO: 37621 - DNA, 23 bp, synthetic construct
  misc_feature 1..23: note = Synthetic Construct
  source 1..23: mol_type = other DNA
gatacctttctggggagggagta

SEQ ID NO: 37622 - DNA, 24 bp, synthetic construct
  misc_feature 1..24: note = Synthetic Construct
  source 1..24: mol_type = other DNA
tgtctaagaggtgatgggtgacta

SEQ ID NO: 37623 - DNA, 22 bp, synthetic construct
  misc_feature 1..22: note = Synthetic Construct
  source 1..22: mol_type = other DNA
ctcctgggaaactctgccttga

SEQ ID NO: 37624 - DNA, 23 bp, synthetic construct
  misc_feature 1..23: note = Synthetic Construct
  source 1..23: mol_type = other DNA
gtggaagccattgtgtacgatca

SEQ ID NO: 37625 - DNA, 22 bp, synthetic construct
  misc_feature 1..22: note = Synthetic Construct
  source 1..22: mol_type = other DNA
tggcgagtaattttggcacctt

SEQ ID NO: 37626 - DNA, 22 bp, synthetic construct
  misc_feature 1..22: note = Synthetic Construct
  source 1..22: mol_type = other DNA
gcccagccgttccaggatttat

SEQ ID NO: 37627 - DNA, 21 bp, synthetic construct
  misc_feature 1..21: note = Synthetic Construct
  source 1..21: mol_type = other DNA
aaaccatcctggaggcagaac

SEQ ID NO: 37628 - DNA, 24 bp, synthetic construct
  misc_feature 1..24: note = Synthetic Construct
  source 1..24: mol_type = other DNA
gatcaggaaaatccaaccctgtga

SEQ ID NO: 37629 - DNA, 21 bp, synthetic construct
  misc_feature 1..21: note = Synthetic Construct
  source 1..21: mol_type = other DNA
cggggtatcgggagtctgaca

SEQ ID NO: 37630 - DNA, 26 bp, synthetic construct
  misc_feature 1..26: note = Synthetic Construct
  source 1..26: mol_type = other DNA
ccagttctgcctgaggtgaatgtact

SEQ ID NO: 37631 - DNA, 24 bp, synthetic construct
  misc_feature 1..24: note = Synthetic Construct
  source 1..24: mol_type = other DNA
gctgctctgaaaacctctgcttga

SEQ ID NO: 37632 - DNA, 25 bp, synthetic construct
  misc_feature 1..25: note = Synthetic Construct
  source 1..25: mol_type = other DNA
cacatggaatgtactgtctgcaagt

SEQ ID NO: 37633 - DNA, 22 bp, synthetic construct
  misc_feature 1..22: note = Synthetic Construct
  source 1..22: mol_type = other DNA
gtgctgcctaggtaccagtttc

SEQ ID NO: 37634 - DNA, 22 bp, synthetic construct
  misc_feature 1..22: note = Synthetic Construct
  source 1..22: mol_type = other DNA
tggtagggctcccttcctctat

SEQ ID NO: 37635 - DNA, 23 bp, synthetic construct
  misc_feature 1..23: note = Synthetic Construct
  source 1..23: mol_type = other DNA
agttctttgtctctgcgatgtgt

SEQ ID NO: 37636 - DNA, 22 bp, synthetic construct
  misc_feature 1..22: note = Synthetic Construct
  source 1..22: mol_type = other DNA
ggtaagtgtccctgggtctgat

SEQ ID NO: 37637 - DNA, 23 bp, synthetic construct
  misc_feature 1..23: note = Synthetic Construct
  source 1..23: mol_type = other DNA
ggcctatggcttaacacgagaga

SEQ ID NO: 37638 - DNA, 23 bp, synthetic construct
  misc_feature 1..23: note = Synthetic Construct
  source 1..23: mol_type = other DNA
gggataacaaggggccagatagt

SEQ ID NO: 37639 - DNA, 23 bp, synthetic construct
  misc_feature 1..23: note = Synthetic Construct
  source 1..23: mol_type = other DNA
ttccatacaatccaggccagaag

SEQ ID NO: 37640 - DNA, 20 bp, synthetic construct
  misc_feature 1..20: note = Synthetic Construct
  source 1..20: mol_type = other DNA
ggctgcactacctgaacaca

SEQ ID NO: 37641 - DNA, 24 bp, synthetic construct
  misc_feature 1..24: note = Synthetic Construct
  source 1..24: mol_type = other DNA
ctctcaagctagttcttgctcagt

SEQ ID NO: 37642 - DNA, 24 bp, synthetic construct
  misc_feature 1..24: note = Synthetic Construct
  source 1..24: mol_type = other DNA
ggagaagctttccaccttctggtt

SEQ ID NO: 37643 - DNA, 22 bp, synthetic construct
  misc_feature 1..22: note = Synthetic Construct
  source 1..22: mol_type = other DNA
ggctgtcagcacttcggactta

SEQ ID NO: 37644 - DNA, 20 bp, synthetic construct
  misc_feature 1..20: note = Synthetic Construct
  source 1..20: mol_type = other DNA
ttcggccccacagtgcagtt

SEQ ID NO: 37645 - DNA, 24 bp, synthetic construct
  misc_feature 1..24: note = Synthetic Construct
  source 1..24: mol_type = other DNA
atctccaaactgtgagtctggttt

SEQ ID NO: 37646 - DNA, 22 bp, synthetic construct
  misc_feature 1..22: note = Synthetic Construct
  source 1..22: mol_type = other DNA
gcctgatgctccatcctcacat

SEQ ID NO: 37647 - DNA, 25 bp, synthetic construct
  misc_feature 1..25: note = Synthetic Construct
  source 1..25: mol_type = other DNA
ggtaataagactgaccatcgcacaa

SEQ ID NO: 37648 - DNA, 21 bp, synthetic construct
  misc_feature 1..21: note = Synthetic Construct
  source 1..21: mol_type = other DNA
acaggtcagcccaggaccaaa

SEQ ID NO: 37649 - DNA, 23 bp, synthetic construct
  misc_feature 1..23: note = Synthetic Construct
  source 1..23: mol_type = other DNA
cttggcatcccagacctacctaa

SEQ ID NO: 37650 - DNA, 24 bp, synthetic construct
  misc_feature 1..24: note = Synthetic Construct
  source 1..24: mol_type = other DNA
tggttgtaaggaaagttggaggaa

SEQ ID NO: 37651 - DNA, 20 bp, synthetic construct
  misc_feature 1..20: note = Synthetic Construct
  source 1..20: mol_type = other DNA
tgggaggtggtagggagttg

SEQ ID NO: 37652 - DNA, 25 bp, synthetic construct
  misc_feature 1..25: note = Synthetic Construct
  source 1..25: mol_type = other DNA
cgtcatttgaattcgggacttgtct

SEQ ID NO: 37653 - DNA, 21 bp, synthetic construct
  misc_feature 1..21: note = Synthetic Construct
  source 1..21: mol_type = other DNA
cctgaccctgctacctgtgtt

SEQ ID NO: 37654 - DNA, 25 bp, synthetic construct
  misc_feature 1..25: note = Synthetic Construct
  source 1..25: mol_type = other DNA
ggatgtcttcaatcctggctgatgt

SEQ ID NO: 37655 - DNA, 20 bp, synthetic construct
  misc_feature 1..20: note = Synthetic Construct
  source 1..20: mol_type = other DNA
tgggcctgggatttctcgtt

SEQ ID NO: 37656 - DNA, 22 bp, synthetic construct
  misc_feature 1..22: note = Synthetic Construct
  source 1..22: mol_type = other DNA
aggcatcggtctgaaggacttg

SEQ ID NO: 37657 - DNA, 22 bp, synthetic construct
  misc_feature 1..22: note = Synthetic Construct
  source 1..22: mol_type = other DNA
gtggagactgtgctgcctaaca

SEQ ID NO: 37658 - DNA, 22 bp, synthetic construct
  misc_feature 1..22: note = Synthetic Construct
  source 1..22: mol_type = other DNA
tctctggggccaggtacaaaag

SEQ ID NO: 37659 - DNA, 20 bp, synthetic construct
  misc_feature 1..20: note = Synthetic Construct
  source 1..20: mol_type = other DNA
tgcttccagaggggcactgt

SEQ ID NO: 37660 - DNA, 24 bp, synthetic construct
  misc_feature 1..24: note = Synthetic Construct
  source 1..24: mol_type = other DNA
ggtgcctaattttcagcacagtct

SEQ ID NO: 37661 - DNA, 23 bp, synthetic construct
  misc_feature 1..23: note = Synthetic Construct
  source 1..23: mol_type = other DNA
tgctgtgacagagtgttgtgaag

SEQ ID NO: 37662 - DNA, 19 bp, synthetic construct
  misc_feature 1..19: note = Synthetic Construct
  source 1..19: mol_type = other DNA
agcaggagctgtgctctga

SEQ ID NO: 37663 - DNA, 22 bp, synthetic construct
  misc_feature 1..22: note = Synthetic Construct
  source 1..22: mol_type = other DNA
agctacagtccccagcctgaat

SEQ ID NO: 37664 - DNA, 29 bp, synthetic construct
  misc_feature 1..29: note = Synthetic Construct
  source 1..29: mol_type = other DNA
ggatggactaatataaggtctggctcaca

SEQ ID NO: 37665 - DNA, 22 bp, synthetic construct
  misc_feature 1..22: note = Synthetic Construct
  source 1..22: mol_type = other DNA
gacaggcacaccttctccttct

SEQ ID NO: 37666 - DNA, 27 bp, synthetic construct
  misc_feature 1..27: note = Synthetic Construct
  source 1..27: mol_type = other DNA
ctggagagttcacagattaacagaaga

SEQ ID NO: 37667 - DNA, 23 bp, synthetic construct
  misc_feature 1..23: note = Synthetic Construct
  source 1..23: mol_type = other DNA
ttcagtctcaggagcgctgactt

SEQ ID NO: 37668 - DNA, 23 bp, synthetic construct
  misc_feature 1..23: note = Synthetic Construct
  source 1..23: mol_type = other DNA
cattttgctacagctggggtctt

SEQ ID NO: 37669 - DNA, 22 bp, synthetic construct
  misc_feature 1..22: note = Synthetic Construct
  source 1..22: mol_type = other DNA
tcttccagagctgagacccttt

SEQ ID NO: 37670 - DNA, 22 bp, synthetic construct
  misc_feature 1..22: note = Synthetic Construct
  source 1..22: mol_type = other DNA
gccagccttcttccccaagata

SEQ ID NO: 37671 - DNA, 26 bp, synthetic construct
  misc_feature 1..26: note = Synthetic Construct
  source 1..26: mol_type = other DNA
ccagcaaaaattgagagctggcaaag

SEQ ID NO: 37672 - DNA, 23 bp, synthetic construct
  misc_feature 1..23: note = Synthetic Construct
  source 1..23: mol_type = other DNA
ctctgggtgtcagtagcttcttt

SEQ ID NO: 37673 - DNA, 27 bp, synthetic construct
  misc_feature 1..27: note = Synthetic Construct
  source 1..27: mol_type = other DNA
ctacactgcagaagtagcttaaacttg

SEQ ID NO: 37674 - DNA, 24 bp, synthetic construct
  misc_feature 1..24: note = Synthetic Construct
  source 1..24: mol_type = other DNA
tgtttgctataaagtcgggcaaga

SEQ ID NO: 37675 - DNA, 24 bp, synthetic construct
  misc_feature 1..24: note = Synthetic Construct
  source 1..24: mol_type = other DNA
gacttatggcttgagcctctgctt

SEQ ID NO: 37676 - DNA, 19 bp, synthetic construct
  misc_feature 1..19: note = Synthetic Construct
  source 1..19: mol_type = other DNA
acccctgccccaactgtct

SEQ ID NO: 37677 - DNA, 22 bp, synthetic construct
  misc_feature 1..22: note = Synthetic Construct
  source 1..22: mol_type = other DNA
ctacctccaccattccctctga

SEQ ID NO: 37678 - DNA, 22 bp, synthetic construct
  misc_feature 1..22: note = Synthetic Construct
  source 1..22: mol_type = other DNA
cttggtggagaggtacgctaag

SEQ ID NO: 37679 - DNA, 22 bp, synthetic construct
  misc_feature 1..22: note = Synthetic Construct
  source 1..22: mol_type = other DNA
ccaaggggtcctcactgtctct

SEQ ID NO: 37680 - DNA, 23 bp, synthetic construct
  misc_feature 1..23: note = Synthetic Construct
  source 1..23: mol_type = other DNA
gctccatttcctggttcccatgt

SEQ ID NO: 37681 - DNA, 25 bp, synthetic construct
  misc_feature 1..25: note = Synthetic Construct
  source 1..25: mol_type = other DNA
cagagagtggggtagtatactcaga

SEQ ID NO: 37682 - DNA, 20 bp, synthetic construct
  misc_feature 1..20: note = Synthetic Construct
  source 1..20: mol_type = other DNA
ggatgaggctgacactgcat

SEQ ID NO: 37683 - DNA, 20 bp, synthetic construct
  misc_feature 1..20: note = Synthetic Construct
  source 1..20: mol_type = other DNA
actcaagtgcagccccgata

SEQ ID NO: 37684 - DNA, 23 bp, synthetic construct
  misc_feature 1..23: note = Synthetic Construct
  source 1..23: mol_type = other DNA
gtgaatcaaagcggaacttgtca

SEQ ID NO: 37685 - DNA, 24 bp, synthetic construct
  misc_feature 1..24: note = Synthetic Construct
  source 1..24: mol_type = other DNA
cgctttgtgaaggacaccccaatc

SEQ ID NO: 37686 - DNA, 23 bp, synthetic construct
  misc_feature 1..23: note = Synthetic Construct
  source 1..23: mol_type = other DNA
cagaccactccccttacaactga

SEQ ID NO: 37687 - DNA, 26 bp, synthetic construct
  misc_feature 1..26: note = Synthetic Construct
  source 1..26: mol_type = other DNA
ctgtatgtcttacgcttcctcccaat

SEQ ID NO: 37688 - DNA, 20 bp, synthetic construct
  misc_feature 1..20: note = Synthetic Construct
  source 1..20: mol_type = other DNA
tccggggaggaccactcaca

SEQ ID NO: 37689 - DNA, 22 bp, synthetic construct
  misc_feature 1..22: note = Synthetic Construct
  source 1..22: mol_type = other DNA
gactctccccaggaatgaccta

SEQ ID NO: 37690 - DNA, 19 bp, synthetic construct
  misc_feature 1..19: note = Synthetic Construct
  source 1..19: mol_type = other DNA
ccagtgcagatggcagcat

SEQ ID NO: 37691 - DNA, 22 bp, synthetic construct
  misc_feature 1..22: note = Synthetic Construct
  source 1..22: mol_type = other DNA
ctcctgttgccctggataggaa

SEQ ID NO: 37692 - DNA, 21 bp, synthetic construct
  misc_feature 1..21: note = Synthetic Construct
  source 1..21: mol_type = other DNA
ccccttgccttggactgaaag

SEQ ID NO: 37693 - DNA, 19 bp, synthetic construct
  misc_feature 1..19: note = Synthetic Construct
  source 1..19: mol_type = other DNA
gctggcgattgccgtctct

SEQ ID NO: 37694 - DNA, 20 bp, synthetic construct
  misc_feature 1..20: note = Synthetic Construct
  source 1..20: mol_type = other DNA
accacactgctcgggatgta

SEQ ID NO: 37695 - DNA, 20 bp, synthetic construct
  misc_feature 1..20: note = Synthetic Construct
  source 1..20: mol_type = other DNA
aatgcaggcagtggcctaag

SEQ ID NO: 37696 - DNA, 19 bp, synthetic construct
  misc_feature 1..19: note = Synthetic Construct
  source 1..19: mol_type = other DNA
tgcgccagctatggacaca

SEQ ID NO: 37697 - DNA, 27 bp, synthetic construct
  misc_feature 1..27: note = Synthetic Construct
  source 1..27: mol_type = other DNA
ggtgtcatcttaaatcttggaccacaa

SEQ ID NO: 37698 - DNA, 23 bp, synthetic construct
  misc_feature 1..23: note = Synthetic Construct
  source 1..23: mol_type = other DNA
aaaatcaggcctgttgtccttct

SEQ ID NO: 37699 - DNA, 19 bp, synthetic construct
  misc_feature 1..19: note = Synthetic Construct
  source 1..19: mol_type = other DNA
acacccggttacgcagaga

SEQ ID NO: 37700 - DNA, 24 bp, synthetic construct
  misc_feature 1..24: note = Synthetic Construct
  source 1..24: mol_type = other DNA
cacaagtaagagctgctgagcaat

SEQ ID NO: 37701 - DNA, 21 bp, synthetic construct
  misc_feature 1..21: note = Synthetic Construct
  source 1..21: mol_type = other DNA
agggaccgaggaggttactct

SEQ ID NO: 37702 - DNA, 20 bp, synthetic construct
  misc_feature 1..20: note = Synthetic Construct
  source 1..20: mol_type = other DNA
gctgcagccagagcctaaga

SEQ ID NO: 37703 - DNA, 25 bp, synthetic construct
  misc_feature 1..25: note = Synthetic Construct
  source 1..25: mol_type = other DNA
ggctatgggttgatcagaacctgaa

SEQ ID NO: 37704 - DNA, 20 bp, synthetic construct
  misc_feature 1..20: note = Synthetic Construct
  source 1..20: mol_type = other DNA
agcaaggggtgtgtgagcaa

SEQ ID NO: 37705 - DNA, 22 bp, synthetic construct
  misc_feature 1..22: note = Synthetic Construct
  source 1..22: mol_type = other DNA
ccttcagcacaggctttctaca

SEQ ID NO: 37706 - DNA, 21 bp, synthetic construct
  misc_feature 1..21: note = Synthetic Construct
  source 1..21: mol_type = other DNA
agggacagcacagatggatga

SEQ ID NO: 37707 - DNA, 24 bp, synthetic construct
  misc_feature 1..24: note = Synthetic Construct
  source 1..24: mol_type = other DNA
tgcggtatgacatgaggaagaatc

SEQ ID NO: 37708 - DNA, 22 bp, synthetic construct
  misc_feature 1..22: note = Synthetic Construct
  source 1..22: mol_type = other DNA
gagtgctttcagcccaagaaca

SEQ ID NO: 37709 - DNA, 25 bp, synthetic construct
  misc_feature 1..25: note = Synthetic Construct
  source 1..25: mol_type = other DNA
cgggagccttccctaagaaggtttt

SEQ ID NO: 37710 - DNA, 20 bp, synthetic construct
  misc_feature 1..20: note = Synthetic Construct
  source 1..20: mol_type = other DNA
agtacggagaaggccaccaa

SEQ ID NO: 37711 - DNA, 20 bp, synthetic construct
  misc_feature 1..20: note = Synthetic Construct
  source 1..20: mol_type = other DNA
agctagccccacttgcattg

SEQ ID NO: 37712 - DNA, 25 bp, synthetic construct
  misc_feature 1..25: note = Synthetic Construct
  source 1..25: mol_type = other DNA
tgatcagaatgagttcggaggtttg

SEQ ID NO: 37713 - DNA, 22 bp, synthetic construct
  misc_feature 1..22: note = Synthetic Construct
  source 1..22: mol_type = other DNA
acctaggaaggggtcaggttct

SEQ ID NO: 37714 - DNA, 21 bp, synthetic construct
  misc_feature 1..21: note = Synthetic Construct
  source 1..21: mol_type = other DNA
cgccttcatggtgatctgtgt

SEQ ID NO: 37715 - DNA, 24 bp, synthetic construct
  misc_feature 1..24: note = Synthetic Construct
  source 1..24: mol_type = other DNA
acttgttcagggtcagaggagtag

SEQ ID NO: 37716 - DNA, 21 bp, synthetic construct
  misc_feature 1..21: note = Synthetic Construct
  source 1..21: mol_type = other DNA
aagccttccacagctctcatc

SEQ ID NO: 37717 - DNA, 20 bp, synthetic construct
  misc_feature 1..20: note = Synthetic Construct
  source 1..20: mol_type = other DNA
agcagctacgaggcccttca

SEQ ID NO: 37718 - DNA, 22 bp, synthetic construct
  misc_feature 1..22: note = Synthetic Construct
  source 1..22: mol_type = other DNA
ctgtcgcacatttcctgcgaat

SEQ ID NO: 37719 - DNA, 21 bp, synthetic construct
  misc_feature 1..21: note = Synthetic Construct
  source 1..21: mol_type = other DNA
ggcgtagatgccaaagcatac

SEQ ID NO: 37720 - DNA, 23 bp, synthetic construct
  misc_feature 1..23: note = Synthetic Construct
  source 1..23: mol_type = other DNA
ctggagattgaattgccccgaat

SEQ ID NO: 37721 - DNA, 26 bp, synthetic construct
  misc_feature 1..26: note = Synthetic Construct
  source 1..26: mol_type = other DNA
ggcagtggaagcctttgataccaatc

SEQ ID NO: 37722 - DNA, 25 bp, synthetic construct
  misc_feature 1..25: note = Synthetic Construct
  source 1..25: mol_type = other DNA
ccctggaaccttccaagttcacact

SEQ ID NO: 37723 - DNA, 22 bp, synthetic construct
  misc_feature 1..22: note = Synthetic Construct
  source 1..22: mol_type = other DNA
cccagccatttagtgcctgctt

SEQ ID NO: 37724 - DNA, 23 bp, synthetic construct
  misc_feature 1..23: note = Synthetic Construct
  source 1..23: mol_type = other DNA
gaccacgaaagtatcggcgaaaa

SEQ ID NO: 37725 - DNA, 22 bp, synthetic construct
  misc_feature 1..22: note = Synthetic Construct
  source 1..22: mol_type = other DNA
tcaaagaggcaaagcactggat

SEQ ID NO: 37726 - DNA, 23 bp, synthetic construct
  misc_feature 1..23: note = Synthetic Construct
  source 1..23: mol_type = other DNA
gcaaggctacctaggcagagaag

SEQ ID NO: 37727 - DNA, 18 bp, synthetic construct
  misc_feature 1..18: note = Synthetic Construct
  source 1..18: mol_type = other DNA
acgcacatgccgaggaaa

SEQ ID NO: 37728 - DNA, 27 bp, synthetic construct
  misc_feature 1..27: note = Synthetic Construct
  source 1..27: mol_type = other DNA
cagtccaacttaaaactagagcagctt

SEQ ID NO: 37729 - DNA, 25 bp, synthetic construct
  misc_feature 1..25: note = Synthetic Construct
  source 1..25: mol_type = other DNA
ctctctaggacgaggaagctaaact

SEQ ID NO: 37730 - DNA, 23 bp, synthetic construct
  misc_feature 1..23: note = Synthetic Construct
  source 1..23: mol_type = other DNA
gacacaccacagtgaaacgatga

SEQ ID NO: 37731 - DNA, 26 bp, synthetic construct
  misc_feature 1..26: note = Synthetic Construct
  source 1..26: mol_type = other DNA
gtgtgtgtggtttataggctgtcatc

SEQ ID NO: 37732 - DNA, 24 bp, synthetic construct
  misc_feature 1..24: note = Synthetic Construct
  source 1..24: mol_type = other DNA
gctcaagcaatcctggcactgtag

SEQ ID NO: 37733 - DNA, 25 bp, synthetic construct
  misc_feature 1..25: note = Synthetic Construct
  source 1..25: mol_type = other DNA
ccgcaagatggtgaaagtccagcta

SEQ ID NO: 37734 - DNA, 27 bp, synthetic construct
  misc_feature 1..27: note = Synthetic Construct
  source 1..27: mol_type = other DNA
gagtgaagaacacttgactgactcttg

SEQ ID NO: 37735 - DNA, 28 bp, synthetic construct
  misc_feature 1..28: note = Synthetic Construct
  source 1..28: mol_type = other DNA
gctgaatgaaatgaacaggacactggtt

SEQ ID NO: 37736 - DNA, 20 bp, synthetic construct
  misc_feature 1..20: note = Synthetic Construct
  source 1..20: mol_type = other DNA
ccagaccccatgcagcattt

SEQ ID NO: 37737 - DNA, 22 bp, synthetic construct
  misc_feature 1..22: note = Synthetic Construct
  source 1..22: mol_type = other DNA
acatggtccttggggtggatac

SEQ ID NO: 37738 - DNA, 24 bp, synthetic construct
  misc_feature 1..24: note = Synthetic Construct
  source 1..24: mol_type = other DNA
ggcactggaagttcctagaaatca

SEQ ID NO: 37739 - DNA, 23 bp, synthetic construct
  misc_feature 1..23: note = Synthetic Construct
  source 1..23: mol_type = other DNA
cactagttgccatgtaccgagaa

SEQ ID NO: 37740 - DNA, 22 bp, synthetic construct
  misc_feature 1..22: note = Synthetic Construct
  source 1..22: mol_type = other DNA
gcctttgtaaaagcgacccaaa

SEQ ID NO: 37741 - DNA, 25 bp, synthetic construct
  misc_feature 1..25: note = Synthetic Construct
  source 1..25: mol_type = other DNA
agacaaacctcttggtctcaaaaca

SEQ ID NO: 37742 - DNA, 25 bp, synthetic construct
  misc_feature 1..25: note = Synthetic Construct
  source 1..25: mol_type = other DNA
ggacaggagcagctatctagaatca

SEQ ID NO: 37743 - DNA, 22 bp, synthetic construct
  misc_feature 1..22: note = Synthetic Construct
  source 1..22: mol_type = other DNA
gcaagggcagaacctagagcaa

SEQ ID NO: 37744 - DNA, 20 bp, synthetic construct
  misc_feature 1..20: note = Synthetic Construct
  source 1..20: mol_type = other DNA
agtggaaggctgtggggata

SEQ ID NO: 37745 - DNA, 22 bp, synthetic construct
  misc_feature 1..22: note = Synthetic Construct
  source 1..22: mol_type = other DNA
gagaggcattccttgcttctga

SEQ ID NO: 37746 - DNA, 20 bp, synthetic construct
  misc_feature 1..20: note = Synthetic Construct
  source 1..20: mol_type = other DNA
acggccaagacgtggtaagt

SEQ ID NO: 37747 - DNA, 22 bp, synthetic construct
  misc_feature 1..22: note = Synthetic Construct
  source 1..22: mol_type = other DNA
gcgtggagcagtgagaaagtct

SEQ ID NO: 37748 - DNA, 27 bp, synthetic construct
  misc_feature 1..27: note = Synthetic Construct
  source 1..27: mol_type = other DNA
gggagtaagagatacaggacaccatct

SEQ ID NO: 37749 - DNA, 23 bp, synthetic construct
  misc_feature 1..23: note = Synthetic Construct
  source 1..23: mol_type = other DNA
cctgttcacatcccatcccttct

SEQ ID NO: 37750 - DNA, 25 bp, synthetic construct
  misc_feature 1..25: note = Synthetic Construct
  source 1..25: mol_type = other DNA
ctggaattttcagggttcacagctt

SEQ ID NO: 37751 - DNA, 24 bp, synthetic construct
  misc_feature 1..24: note = Synthetic Construct
  source 1..24: mol_type = other DNA
gtttttcccttttgtggggagttg

SEQ ID NO: 37752 - DNA, 24 bp, synthetic construct
  misc_feature 1..24: note = Synthetic Construct
  source 1..24: mol_type = other DNA
cacagatcactgcccaatcagaca

SEQ ID NO: 37753 - DNA, 22 bp, synthetic construct
  misc_feature 1..22: note = Synthetic Construct
  source 1..22: mol_type = other DNA
tcgaattcctctccccgcagaa

SEQ ID NO: 37754 - DNA, 21 bp, synthetic construct
  misc_feature 1..21: note = Synthetic Construct
  source 1..21: mol_type = other DNA
ctgttgttgtgcccaggcttt

SEQ ID NO: 37755 - DNA, 22 bp, synthetic construct
  misc_feature 1..22: note = Synthetic Construct
  source 1..22: mol_type = other DNA
gtcctctaggggcccttcaaat

SEQ ID NO: 37756 - DNA, 20 bp, synthetic construct
  misc_feature 1..20: note = Synthetic Construct
  source 1..20: mol_type = other DNA
ccttggcactccccactgtt

SEQ ID NO: 37757 - DNA, 27 bp, synthetic construct
  misc_feature 1..27: note = Synthetic Construct
  source 1..27: mol_type = other DNA
ccagatataacacggaaacagccaaag

SEQ ID NO: 37758 - DNA, 19 bp, synthetic construct
  misc_feature 1..19: note = Synthetic Construct
  source 1..19: mol_type = other DNA
aaccgaggcggctggaaca

SEQ ID NO: 37759 - DNA, 20 bp, synthetic construct
  misc_feature 1..20: note = Synthetic Construct
  source 1..20: mol_type = other DNA
ctgtgtgcagagcactgtgt

SEQ ID NO: 37760 - DNA, 23 bp, synthetic construct
  misc_feature 1..23: note = Synthetic Construct
  source 1..23: mol_type = other DNA
ggatgttgcagccttcctgttag

SEQ ID NO: 37761 - DNA, 20 bp, synthetic construct
  misc_feature 1..20: note = Synthetic Construct
  source 1..20: mol_type = other DNA
tgcacaccgctccccagatt

SEQ ID NO: 37762 - DNA, 18 bp, synthetic construct
  misc_feature 1..18: note = Synthetic Construct
  source 1..18: mol_type = other DNA
tcgtctcgtgcagcgttt

SEQ ID NO: 37763 - DNA, 22 bp, synthetic construct
  misc_feature 1..22: note = Synthetic Construct
  source 1..22: mol_type = other DNA
cagctttggggtgagggtaaag

SEQ ID NO: 37764 - DNA, 21 bp, synthetic construct
  misc_feature 1..21: note = Synthetic Construct
  source 1..21: mol_type = other DNA
ccctggagaggggtcttttct

SEQ ID NO: 37765 - DNA, 28 bp, synthetic construct
  misc_feature 1..28: note = Synthetic Construct
  source 1..28: mol_type = other DNA
ccaggcttttgttcgtttttcagtcatc

SEQ ID NO: 37766 - DNA, 20 bp, synthetic construct
  misc_feature 1..20: note = Synthetic Construct
  source 1..20: mol_type = other DNA
tgtggggaatgagcgagtca

SEQ ID NO: 37767 - DNA, 24 bp, synthetic construct
  misc_feature 1..24: note = Synthetic Construct
  source 1..24: mol_type = other DNA
cacttgcagtttaccctgtgactt

SEQ ID NO: 37768 - DNA, 22 bp, synthetic construct
  misc_feature 1..22: note = Synthetic Construct
  source 1..22: mol_type = other DNA
ggttggcctatggaaggtgcat

SEQ ID NO: 37769 - DNA, 25 bp, synthetic construct
  misc_feature 1..25: note = Synthetic Construct
  source 1..25: mol_type = other DNA
ccattgcctgcttgtcaaaatgaac

SEQ ID NO: 37770 - DNA, 23 bp, synthetic construct
  misc_feature 1..23: note = Synthetic Construct
  source 1..23: mol_type = other DNA
aagaaggaatggatgtgccaagt

SEQ ID NO: 37771 - DNA, 19 bp, synthetic construct
  misc_feature 1..19: note = Synthetic Construct
  source 1..19: mol_type = other DNA
ccaccctccccactccttt

SEQ ID NO: 37772 - DNA, 19 bp, synthetic construct
  misc_feature 1..19: note = Synthetic Construct
  source 1..19: mol_type = other DNA
agctggaggagggcagaga

SEQ ID NO: 37773 - DNA, 27 bp, synthetic construct
  misc_feature 1..27: note = Synthetic Construct
  source 1..27: mol_type = other DNA
ggagagggtaaacaacaagcagaggta

SEQ ID NO: 37774 - DNA, 24 bp, synthetic construct
  misc_feature 1..24: note = Synthetic Construct
  source 1..24: mol_type = other DNA
gcgtgtgctgagaaactggatttg

SEQ ID NO: 37775 - DNA, 22 bp, synthetic construct
  misc_feature 1..22: note = Synthetic Construct
  source 1..22: mol_type = other DNA
ggcaggattgcacttccttact

SEQ ID NO: 37776 - DNA, 24 bp, synthetic construct
  misc_feature 1..24: note = Synthetic Construct
  source 1..24: mol_type = other DNA
ggaggagaagccattggtgggtat

SEQ ID NO: 37777 - DNA, 25 bp, synthetic construct
  misc_feature 1..25: note = Synthetic Construct
  source 1..25: mol_type = other DNA
agtaaagtggaggaactcaaagcat

SEQ ID NO: 37778 - DNA, 19 bp, synthetic construct
  misc_feature 1..19: note = Synthetic Construct
  source 1..19: mol_type = other DNA
tggagctgggcttcagaga

SEQ ID NO: 37779 - DNA, 18 bp, synthetic construct
  misc_feature 1..18: note = Synthetic Construct
  source 1..18: mol_type = other DNA
agtgcggcctggagcaaa

SEQ ID NO: 37780 - DNA, 22 bp, synthetic construct
  misc_feature 1..22: note = Synthetic Construct
  source 1..22: mol_type = other DNA
cccatctgactgcaagcactac

SEQ ID NO: 37781 - DNA, 20 bp, synthetic construct
  misc_feature 1..20: note = Synthetic Construct
  source 1..20: mol_type = other DNA
accgccacgcaaaagcctaa

SEQ ID NO: 37782 - DNA, 24 bp, synthetic construct
  misc_feature 1..24: note = Synthetic Construct
  source 1..24: mol_type = other DNA
gttggagtagagtggtacaagcat

SEQ ID NO: 37783 - DNA, 21 bp, synthetic construct
  misc_feature 1..21: note = Synthetic Construct
  source 1..21: mol_type = other DNA
cgatgtccagcaaagctccta

SEQ ID NO: 37784 - DNA, 26 bp, synthetic construct
  misc_feature 1..26: note = Synthetic Construct
  source 1..26: mol_type = other DNA
cccctcctccagtatttccaatccaa

SEQ ID NO: 37785 - DNA, 22 bp, synthetic construct
  misc_feature 1..22: note = Synthetic Construct
  source 1..22: mol_type = other DNA
agtcctgtgttagcctctgttg

SEQ ID NO: 37786 - DNA, 22 bp, synthetic construct
  misc_feature 1..22: note = Synthetic Construct
  source 1..22: mol_type = other DNA
ggaactggatgtggctgacagt

SEQ ID NO: 37787 - DNA, 21 bp, synthetic construct
  misc_feature 1..21: note = Synthetic Construct
  source 1..21: mol_type = other DNA
gacatgagcttggccttccat

SEQ ID NO: 37788 - DNA, 22 bp, synthetic construct
  misc_feature 1..22: note = Synthetic Construct
  source 1..22: mol_type = other DNA
tgagagtcgtacagcagcaaat

SEQ ID NO: 37789 - DNA, 21 bp, synthetic construct
  misc_feature 1..21: note = Synthetic Construct
  source 1..21: mol_type = other DNA
cctgggccccaaagacagttt

SEQ ID NO: 37790 - DNA, 24 bp, synthetic construct
  misc_feature 1..24: note = Synthetic Construct
  source 1..24: mol_type = other DNA
cacatcagtgcaatccctgctttc

SEQ ID NO: 37791 - DNA, 21 bp, synthetic construct
  misc_feature 1..21: note = Synthetic Construct
  source 1..21: mol_type = other DNA
tgccctcgaaatcctgtgaga

SEQ ID NO: 37792 - DNA, 23 bp, synthetic construct
  misc_feature 1..23: note = Synthetic Construct
  source 1..23: mol_type = other DNA
ggcaagtttcaccaagccgatga

SEQ ID NO: 37793 - DNA, 20 bp, synthetic construct
  misc_feature 1..20: note = Synthetic Construct
  source 1..20: mol_type = other DNA
tctgtccaggagacctgcaa

SEQ ID NO: 37794 - DNA, 21 bp, synthetic construct
  misc_feature 1..21: note = Synthetic Construct
  source 1..21: mol_type = other DNA
gagaatcagtgggagctgcat

SEQ ID NO: 37795 - DNA, 23 bp, synthetic construct
  misc_feature 1..23: note = Synthetic Construct
  source 1..23: mol_type = other DNA
gggtcaccattttgcctccttct

SEQ ID NO: 37796 - DNA, 25 bp, synthetic construct
  misc_feature 1..25: note = Synthetic Construct
  source 1..25: mol_type = other DNA
aggtaatcacttggcagtaatgctt

SEQ ID NO: 37797 - DNA, 20 bp, synthetic construct
  misc_feature 1..20: note = Synthetic Construct
  source 1..20: mol_type = other DNA
tagcagtctgggcagccata

SEQ ID NO: 37798 - DNA, 22 bp, synthetic construct
  misc_feature 1..22: note = Synthetic Construct
  source 1..22: mol_type = other DNA
tctggtgacctcgttgagtagt

SEQ ID NO: 37799 - DNA, 25 bp, synthetic construct
  misc_feature 1..25: note = Synthetic Construct
  source 1..25: mol_type = other DNA
gccatgtgtatttagtgctggtctt

SEQ ID NO: 37800 - DNA, 20 bp, synthetic construct
  misc_feature 1..20: note = Synthetic Construct
  source 1..20: mol_type = other DNA
accacccaggcaagggaaat

SEQ ID NO: 37801 - DNA, 22 bp, synthetic construct
  misc_feature 1..22: note = Synthetic Construct
  source 1..22: mol_type = other DNA
tgtggtcccactctggcttatg

SEQ ID NO: 37802 - DNA, 19 bp, synthetic construct
  misc_feature 1..19: note = Synthetic Construct
  source 1..19: mol_type = other DNA
ccaaggggtgccgtagtga

SEQ ID NO: 37803 - DNA, 19 bp, synthetic construct
  misc_feature 1..19: note = Synthetic Construct
  source 1..19: mol_type = other DNA
tctgcgggcagctgttaga

SEQ ID NO: 37804 - DNA, 19 bp, synthetic construct
  misc_feature 1..19: note = Synthetic Construct
  source 1..19: mol_type = other DNA
tgggcagacaggtgagctt

SEQ ID NO: 37805 - DNA, 23 bp, synthetic construct
  misc_feature 1..23: note = Synthetic Construct
  source 1..23: mol_type = other DNA
gacagccattcatccccagtttc

SEQ ID NO: 37806 - DNA, 23 bp, synthetic construct
  misc_feature 1..23: note = Synthetic Construct
  source 1..23: mol_type = other DNA
accaaatgcccagctatatgtgt

SEQ ID NO: 37807 - DNA, 20 bp, synthetic construct
  misc_feature 1..20: note = Synthetic Construct
  source 1..20: mol_type = other DNA
gctcagaggtcacggtcaca

SEQ ID NO: 37808 - DNA, 20 bp, synthetic construct
  misc_feature 1..20: note = Synthetic Construct
  source 1..20: mol_type = other DNA
tgctgtgtccttgacagcaa

SEQ ID NO: 37809 - DNA, 24 bp, synthetic construct
  misc_feature 1..24: note = Synthetic Construct
  source 1..24: mol_type = other DNA
ctatcagtaggtttggcacaggat

SEQ ID NO: 37810 - DNA, 20 bp, synthetic construct
  misc_feature 1..20: note = Synthetic Construct
  source 1..20: mol_type = other DNA
tccttgccacaggccctcat

SEQ ID NO: 37811 - DNA, 21 bp, synthetic construct
  misc_feature 1..21: note = Synthetic Construct
  source 1..21: mol_type = other DNA
gctgtaggagccagggcaaaa

SEQ ID NO: 37812 - DNA, 24 bp, synthetic construct
  misc_feature 1..24: note = Synthetic Construct
  source 1..24: mol_type = other DNA
gcttcaacaatgaggggcgtctac

SEQ ID NO: 37813 - DNA, 20 bp, synthetic construct
  misc_feature 1..20: note = Synthetic Construct
  source 1..20: mol_type = other DNA
aggtgagaggagcaggtgtt

SEQ ID NO: 37814 - DNA, 24 bp, synthetic construct
  misc_feature 1..24: note = Synthetic Construct
  source 1..24: mol_type = other DNA
gattaacaacactcttgcgcacat

SEQ ID NO: 37815 - DNA, 22 bp, synthetic construct
  misc_feature 1..22: note = Synthetic Construct
  source 1..22: mol_type = other DNA
gaaggagctgcagatggaatca

SEQ ID NO: 37816 - DNA, 21 bp, synthetic construct
  misc_feature 1..21: note = Synthetic Construct
  source 1..21: mol_type = other DNA
aggagtcatgctgggctatgt

SEQ ID NO: 37817 - DNA, 24 bp, synthetic construct
  misc_feature 1..24: note = Synthetic Construct
  source 1..24: mol_type = other DNA
ggctgtggcttgggaggagtataa

SEQ ID NO: 37818 - DNA, 20 bp, synthetic construct
  misc_feature 1..20: note = Synthetic Construct
  source 1..20: mol_type = other DNA
gctgctgccttggacagaaa

SEQ ID NO: 37819 - DNA, 25 bp, synthetic construct
  misc_feature 1..25: note = Synthetic Construct
  source 1..25: mol_type = other DNA
gtgaagtaacaaggactctgtctca

SEQ ID NO: 37820 - DNA, 25 bp, synthetic construct
  misc_feature 1..25: note = Synthetic Construct
  source 1..25: mol_type = other DNA
gccaatgaggcaatatggccaatga

SEQ ID NO: 37821 - DNA, 19 bp, synthetic construct
  misc_feature 1..19: note = Synthetic Construct
  source 1..19: mol_type = other DNA
gcagggctgatggccctat

SEQ ID NO: 37822 - DNA, 26 bp, synthetic construct
  misc_feature 1..26: note = Synthetic Construct
  source 1..26: mol_type = other DNA
tctatccagtatctacatgcccttga

SEQ ID NO: 37823 - DNA, 24 bp, synthetic construct
  misc_feature 1..24: note = Synthetic Construct
  source 1..24: mol_type = other DNA
gtactttctgcctcagaacgatga

SEQ ID NO: 37824 - DNA, 24 bp, synthetic construct
  misc_feature 1..24: note = Synthetic Construct
  source 1..24: mol_type = other DNA
ggcggagatagagctatgaactga

SEQ ID NO: 37825 - DNA, 27 bp, synthetic construct
  misc_feature 1..27: note = Synthetic Construct
  source 1..27: mol_type = other DNA
ggtgggtaggttctaagcacacctaag

SEQ ID NO: 37826 - DNA, 23 bp, synthetic construct
  misc_feature 1..23: note = Synthetic Construct
  source 1..23: mol_type = other DNA
ccaaagccatgatctggggatct

SEQ ID NO: 37827 - DNA, 22 bp, synthetic construct
  misc_feature 1..22: note = Synthetic Construct
  source 1..22: mol_type = other DNA
gaggtcagggtaaggcagagat

SEQ ID NO: 37828 - DNA, 19 bp, synthetic construct
  misc_feature 1..19: note = Synthetic Construct
  source 1..19: mol_type = other DNA
gccttgggcacgtcacttc

SEQ ID NO: 37829 - DNA, 25 bp, synthetic construct
  misc_feature 1..25: note = Synthetic Construct
  source 1..25: mol_type = other DNA
ggttctcttcccaactatcccattg

SEQ ID NO: 37830 - DNA, 24 bp, synthetic construct
  misc_feature 1..24: note = Synthetic Construct
  source 1..24: mol_type = other DNA
gacgtgcaaaatcactgagagaca

SEQ ID NO: 37831 - DNA, 23 bp, synthetic construct
  misc_feature 1..23: note = Synthetic Construct
  source 1..23: mol_type = other DNA
gcaggaaagcagctcttttggta

SEQ ID NO: 37832 - DNA, 24 bp, synthetic construct
  misc_feature 1..24: note = Synthetic Construct
  source 1..24: mol_type = other DNA
acacaggcctgatattttctcaca

SEQ ID NO: 37833 - DNA, 21 bp, synthetic construct
  misc_feature 1..21: note = Synthetic Construct
  source 1..21: mol_type = other DNA
acaggtggagcaggtcagtct

SEQ ID NO: 37834 - DNA, 21 bp, synthetic construct
  misc_feature 1..21: note = Synthetic Construct
  source 1..21: mol_type = other DNA
gttgggttggcttgtcctgaa

SEQ ID NO: 37835 - DNA, 23 bp, synthetic construct
  misc_feature 1..23: note = Synthetic Construct
  source 1..23: mol_type = other DNA
ggctcttagaagtggcctgtgtt

SEQ ID NO: 37836 - DNA, 20 bp, synthetic construct
  misc_feature 1..20: note = Synthetic Construct
  source 1..20: mol_type = other DNA
agacccggcctgggctttct

SEQ ID NO: 37837 - DNA, 26 bp, synthetic construct
  misc_feature 1..26: note = Synthetic Construct
  source 1..26: mol_type = other DNA
ggcaattacaacagtcagtcttcaca

SEQ ID NO: 37838 - DNA, 23 bp, synthetic construct
  misc_feature 1..23: note = Synthetic Construct
  source 1..23: mol_type = other DNA
gcactggagtttgagcacagctt

SEQ ID NO: 37839 - DNA, 24 bp, synthetic construct
  misc_feature 1..24: note = Synthetic Construct
  source 1..24: mol_type = other DNA
gctggaggaaggaagcatggtgaa

SEQ ID NO: 37840 - DNA, 24 bp, synthetic construct
  misc_feature 1..24: note = Synthetic Construct
  source 1..24: mol_type = other DNA
cctataagcttgctggaggtctct

SEQ ID NO: 37841 - DNA, 22 bp, synthetic construct
  misc_feature 1..22: note = Synthetic Construct
  source 1..22: mol_type = other DNA
cctccacccttgtatcgtgagt

SEQ ID NO: 37842 - DNA, 22 bp, synthetic construct
  misc_feature 1..22: note = Synthetic Construct
  source 1..22: mol_type = other DNA
ctctgcatacaccctcctgtga

SEQ ID NO: 37843 - DNA, 22 bp, synthetic construct
  misc_feature 1..22: note = Synthetic Construct
  source 1..22: mol_type = other DNA
aacttacgggcccagggaatac

SEQ ID NO: 37844 - DNA, 26 bp, synthetic construct
  misc_feature 1..26: note = Synthetic Construct
  source 1..26: mol_type = other DNA
gcaggatggtgttaattcagggagat

SEQ ID NO: 37845 - DNA, 22 bp, synthetic construct
  misc_feature 1..22: note = Synthetic Construct
  source 1..22: mol_type = other DNA
aggtttctaggtggggctgaag

SEQ ID NO: 37846 - DNA, 21 bp, synthetic construct
  misc_feature 1..21: note = Synthetic Construct
  source 1..21: mol_type = other DNA
acctctcctccacagccagta

SEQ ID NO: 37847 - DNA, 25 bp, synthetic construct
  misc_feature 1..25: note = Synthetic Construct
  source 1..25: mol_type = other DNA
ggagtagagcaggagttgggaatag

SEQ ID NO: 37848 - DNA, 20 bp, synthetic construct
  misc_feature 1..20: note = Synthetic Construct
  source 1..20: mol_type = other DNA
tcccagagctgacccgataa

SEQ ID NO: 37849 - DNA, 20 bp, synthetic construct
  misc_feature 1..20: note = Synthetic Construct
  source 1..20: mol_type = other DNA
ggcagccaacgattggtact

SEQ ID NO: 37850 - DNA, 20 bp, synthetic construct
  misc_feature 1..20: note = Synthetic Construct
  source 1..20: mol_type = other DNA
tcctcacctccaggcttcat

SEQ ID NO: 37851 - DNA, 23 bp, synthetic construct
  misc_feature 1..23: note = Synthetic Construct
  source 1..23: mol_type = other DNA
gaagaatctcagagccccgttac

SEQ ID NO: 37852 - DNA, 25 bp, synthetic construct
  misc_feature 1..25: note = Synthetic Construct
  source 1..25: mol_type = other DNA
ggcttaattggaggggaagggagat

SEQ ID NO: 37853 - DNA, 22 bp, synthetic construct
  misc_feature 1..22: note = Synthetic Construct
  source 1..22: mol_type = other DNA
caatcagtcccacggtccattc

SEQ ID NO: 37854 - DNA, 27 bp, synthetic construct
  misc_feature 1..27: note = Synthetic Construct
  source 1..27: mol_type = other DNA
gcctgtatttgaaagggtttgtcttac

SEQ ID NO: 37855 - DNA, 22 bp, synthetic construct
  misc_feature 1..22: note = Synthetic Construct
  source 1..22: mol_type = other DNA
tgaggctggcttccaaatttca

SEQ ID NO: 37856 - DNA, 25 bp, synthetic construct
  misc_feature 1..25: note = Synthetic Construct
  source 1..25: mol_type = other DNA
aagtgaaggcataaggtatcgttct

SEQ ID NO: 37857 - DNA, 20 bp, synthetic construct
  misc_feature 1..20: note = Synthetic Construct
  source 1..20: mol_type = other DNA
cggaagtccagcaggcctaa

SEQ ID NO: 37858 - DNA, 20 bp, synthetic construct
  misc_feature 1..20: note = Synthetic Construct
  source 1..20: mol_type = other DNA
gggaagcttgggctttgcta

SEQ ID NO: 37859 - DNA, 23 bp, synthetic construct
  misc_feature 1..23: note = Synthetic Construct
  source 1..23: mol_type = other DNA
gccaaatgcaaaagccaggtgat

SEQ ID NO: 37860 - DNA, 24 bp, synthetic construct
  misc_feature 1..24: note = Synthetic Construct
  source 1..24: mol_type = other DNA
cggcctcatccagacttctgttac

SEQ ID NO: 37861 - DNA, 25 bp, synthetic construct
  misc_feature 1..25: note = Synthetic Construct
  source 1..25: mol_type = other DNA
cacactgagctataaggcaggaaac

SEQ ID NO: 37862 - DNA, 18 bp, synthetic construct
  misc_feature 1..18: note = Synthetic Construct
  source 1..18: mol_type = other DNA
tgccagctggggaagagt

SEQ ID NO: 37863 - DNA, 23 bp, synthetic construct
  misc_feature 1..23: note = Synthetic Construct
  source 1..23: mol_type = other DNA
gtggatgggatctgtctgagcat

SEQ ID NO: 37864 - DNA, 21 bp, synthetic construct
  misc_feature 1..21: note = Synthetic Construct
  source 1..21: mol_type = other DNA
tgacccaccaggaccacagtt

SEQ ID NO: 37865 - DNA, 20 bp, synthetic construct
  misc_feature 1..20: note = Synthetic Construct
  source 1..20: mol_type = other DNA
tagcaggggccacagcttag

SEQ ID NO: 37866 - DNA, 24 bp, synthetic construct
  misc_feature 1..24: note = Synthetic Construct
  source 1..24: mol_type = other DNA
gcactgtttttagacacgaagaca

SEQ ID NO: 37867 - DNA, 19 bp, synthetic construct
  misc_feature 1..19: note = Synthetic Construct
  source 1..19: mol_type = other DNA
atggcgctggtgcttggaa

SEQ ID NO: 37868 - DNA, 20 bp, synthetic construct
  misc_feature 1..20: note = Synthetic Construct
  source 1..20: mol_type = other DNA
atagggctgcctcccagaga

SEQ ID NO: 37869 - DNA, 27 bp, synthetic construct
  misc_feature 1..27: note = Synthetic Construct
  source 1..27: mol_type = other DNA
ctgactactgtcaaagagttagggaat

SEQ ID NO: 37870 - DNA, 22 bp, synthetic construct
  misc_feature 1..22: note = Synthetic Construct
  source 1..22: mol_type = other DNA
gagtcacctgtagccagctcaa

SEQ ID NO: 37871 - DNA, 23 bp, synthetic construct
  misc_feature 1..23: note = Synthetic Construct
  source 1..23: mol_type = other DNA
ccagttgaagctctctgatggtt

SEQ ID NO: 37872 - DNA, 22 bp, synthetic construct
  misc_feature 1..22: note = Synthetic Construct
  source 1..22: mol_type = other DNA
ctcacagggcccattcattaca

SEQ ID NO: 37873 - DNA, 21 bp, synthetic construct
  misc_feature 1..21: note = Synthetic Construct
  source 1..21: mol_type = other DNA
cccaggccttaccgaggttta

SEQ ID NO: 37874 - DNA, 27 bp, synthetic construct
  misc_feature 1..27: note = Synthetic Construct
  source 1..27: mol_type = other DNA
gcctgttaatactccagtgaggagaag

SEQ ID NO: 37875 - DNA, 20 bp, synthetic construct
  misc_feature 1..20: note = Synthetic Construct
  source 1..20: mol_type = other DNA
cacaacctgagtgccgagaa

SEQ ID NO: 37876 - DNA, 20 bp, synthetic construct
  misc_feature 1..20: note = Synthetic Construct
  source 1..20: mol_type = other DNA
ttcctcccaggaggggtaca

SEQ ID NO: 37877 - DNA, 18 bp, synthetic construct
  misc_feature 1..18: note = Synthetic Construct
  source 1..18: mol_type = other DNA
tcaggcaccccgctgttt

SEQ ID NO: 37878 - DNA, 27 bp, synthetic construct
  misc_feature 1..27: note = Synthetic Construct
  source 1..27: mol_type = other DNA
ggccaaaaggtgaaacactgtccttga

SEQ ID NO: 37879 - DNA, 22 bp, synthetic construct
  misc_feature 1..22: note = Synthetic Construct
  source 1..22: mol_type = other DNA
cttgccaagcaaattggtgact

SEQ ID NO: 37880 - DNA, 25 bp, synthetic construct
  misc_feature 1..25: note = Synthetic Construct
  source 1..25: mol_type = other DNA
ccaaggttatggagtgtcctacttc

SEQ ID NO: 37881 - DNA, 20 bp, synthetic construct
  misc_feature 1..20: note = Synthetic Construct
  source 1..20: mol_type = other DNA
gcatgctgccctacttgtca

SEQ ID NO: 37882 - DNA, 21 bp, synthetic construct
  misc_feature 1..21: note = Synthetic Construct
  source 1..21: mol_type = other DNA
cccagtggcttccacaagtga

SEQ ID NO: 37883 - DNA, 23 bp, synthetic construct
  misc_feature 1..23: note = Synthetic Construct
  source 1..23: mol_type = other DNA
ggacaactagggacagcctctct

SEQ ID NO: 37884 - DNA, 22 bp, synthetic construct
  misc_feature 1..22: note = Synthetic Construct
  source 1..22: mol_type = other DNA
tcagcagtgtgaggggttgatg

SEQ ID NO: 37885 - DNA, 20 bp, synthetic construct
  misc_feature 1..20: note = Synthetic Construct
  source 1..20: mol_type = other DNA
tgagtcacgtgccggcatta

SEQ ID NO: 37886 - DNA, 24 bp, synthetic construct
  misc_feature 1..24: note = Synthetic Construct
  source 1..24: mol_type = other DNA
cagtgtagactgctttctgtgcaa

SEQ ID NO: 37887 - DNA, 24 bp, synthetic construct
  misc_feature 1..24: note = Synthetic Construct
  source 1..24: mol_type = other DNA
tgtgttctcagttgtctgggtaag

SEQ ID NO: 37888 - DNA, 24 bp, synthetic construct
  misc_feature 1..24: note = Synthetic Construct
  source 1..24: mol_type = other DNA
ccaggtacctccatgccatagaca

SEQ ID NO: 37889 - DNA, 24 bp, synthetic construct
  misc_feature 1..24: note = Synthetic Construct
  source 1..24: mol_type = other DNA
ggggaacactcaggtcttgtgaga

SEQ ID NO: 37890 - DNA, 26 bp, synthetic construct
  misc_feature 1..26: note = Synthetic Construct
  source 1..26: mol_type = other DNA
gaggataaatggaagaggaggaggtt

SEQ ID NO: 37891 - DNA, 25 bp, synthetic construct
  misc_feature 1..25: note = Synthetic Construct
  source 1..25: mol_type = other DNA
gtgactcattccaggtgtagaggat

SEQ ID NO: 37892 - DNA, 24 bp, synthetic construct
  misc_feature 1..24: note = Synthetic Construct
  source 1..24: mol_type = other DNA
aaaagtagggcagtcaccttgatt

SEQ ID NO: 37893 - DNA, 20 bp, synthetic construct
  misc_feature 1..20: note = Synthetic Construct
  source 1..20: mol_type = other DNA
acgtgcaagcagtgcgttag

SEQ ID NO: 37894 - DNA, 22 bp, synthetic construct
  misc_feature 1..22: note = Synthetic Construct
  source 1..22: mol_type = other DNA
cctggctttgctctccacattg

SEQ ID NO: 37895 - DNA, 21 bp, synthetic construct
  misc_feature 1..21: note = Synthetic Construct
  source 1..21: mol_type = other DNA
cctgcttcactctgtggcata

SEQ ID NO: 37896 - DNA, 26 bp, synthetic construct
  misc_feature 1..26: note = Synthetic Construct
  source 1..26: mol_type = other DNA
gggaaaaacatgtacagctcctctca

SEQ ID NO: 37897 - DNA, 20 bp, synthetic construct
  misc_feature 1..20: note = Synthetic Construct
  source 1..20: mol_type = other DNA
tggaacaggcctcaggctaa

SEQ ID NO: 37898 - DNA, 20 bp, synthetic construct
  misc_feature 1..20: note = Synthetic Construct
  source 1..20: mol_type = other DNA
gcaccataggacagcagtgt

SEQ ID NO: 37899 - DNA, 25 bp, synthetic construct
  misc_feature 1..25: note = Synthetic Construct
  source 1..25: mol_type = other DNA
gcctaactcttcccttgttctgtgt

SEQ ID NO: 37900 - DNA, 20 bp, synthetic construct
  misc_feature 1..20: note = Synthetic Construct
  source 1..20: mol_type = other DNA
tcccgctgtccccatcaaga

SEQ ID NO: 37901 - DNA, 22 bp, synthetic construct
  misc_feature 1..22: note = Synthetic Construct
  source 1..22: mol_type = other DNA
tgggctaatccactctgtctga

SEQ ID NO: 37902 - DNA, 21 bp, synthetic construct
  misc_feature 1..21: note = Synthetic Construct
  source 1..21: mol_type = other DNA
caagccaactcagggcttgaa

SEQ ID NO: 37903 - DNA, 24 bp, synthetic construct
  misc_feature 1..24: note = Synthetic Construct
  source 1..24: mol_type = other DNA
ggtgactgtgttcctcctcacgaa

SEQ ID NO: 37904 - DNA, 23 bp, synthetic construct
  misc_feature 1..23: note = Synthetic Construct
  source 1..23: mol_type = other DNA
gcctcctgaggcttaggtcaatg

SEQ ID NO: 37905 - DNA, 21 bp, synthetic construct
  misc_feature 1..21: note = Synthetic Construct
  source 1..21: mol_type = other DNA
aagccatccccagcccacatt

SEQ ID NO: 37906 - DNA, 22 bp, synthetic construct
  misc_feature 1..22: note = Synthetic Construct
  source 1..22: mol_type = other DNA
ggagaaatgggacgcaggagat

SEQ ID NO: 37907 - DNA, 20 bp, synthetic construct
  misc_feature 1..20: note = Synthetic Construct
  source 1..20: mol_type = other DNA
ccccagcaccaccttattgt

SEQ ID NO: 37908 - DNA, 19 bp, synthetic construct
  misc_feature 1..19: note = Synthetic Construct
  source 1..19: mol_type = other DNA
tctccggccgtccagcttt

SEQ ID NO: 37909 - DNA, 24 bp, synthetic construct
  misc_feature 1..24: note = Synthetic Construct
  source 1..24: mol_type = other DNA
tgttcagctcctaaaatggcatca

SEQ ID NO: 37910 - DNA, 24 bp, synthetic construct
  misc_feature 1..24: note = Synthetic Construct
  source 1..24: mol_type = other DNA
gggaagaacacaccagctgccaaa

SEQ ID NO: 37911 - DNA, 23 bp, synthetic construct
  misc_feature 1..23: note = Synthetic Construct
  source 1..23: mol_type = other DNA
ggatgccctaggtgagtttggaa

SEQ ID NO: 37912 - DNA, 22 bp, synthetic construct
  misc_feature 1..22: note = Synthetic Construct
  source 1..22: mol_type = other DNA
ccccacaaaactggcactgaga

SEQ ID NO: 37913 - DNA, 23 bp, synthetic construct
  misc_feature 1..23: note = Synthetic Construct
  source 1..23: mol_type = other DNA
ggggctgtggtttcagaatcagt

SEQ ID NO: 37914 - DNA, 22 bp, synthetic construct
  misc_feature 1..22: note = Synthetic Construct
  source 1..22: mol_type = other DNA
agaacaggggagacagtgagaa

SEQ ID NO: 37915 - DNA, 22 bp, synthetic construct
  misc_feature 1..22: note = Synthetic Construct
  source 1..22: mol_type = other DNA
aagaccagcagaggacctggaa

SEQ ID NO: 37916 - DNA, 22 bp, synthetic construct
  misc_feature 1..22: note = Synthetic Construct
  source 1..22: mol_type = other DNA
tgccctatgctagaacccaaga

SEQ ID NO: 37917 - DNA, 20 bp, synthetic construct
  misc_feature 1..20: note = Synthetic Construct
  source 1..20: mol_type = other DNA
gcgggaaccatgcattctct

SEQ ID NO: 37918 - DNA, 26 bp, synthetic construct
  misc_feature 1..26: note = Synthetic Construct
  source 1..26: mol_type = other DNA
gcctgttggatggtcatagacactac

SEQ ID NO: 37919 - DNA, 27 bp, synthetic construct
  misc_feature 1..27: note = Synthetic Construct
  source 1..27: mol_type = other DNA
gtcacagggatttgaagatactacact

SEQ ID NO: 37920 - DNA, 20 bp, synthetic construct
  misc_feature 1..20: note = Synthetic Construct
  source 1..20: mol_type = other DNA
ttctgagcggaagcctgaac

SEQ ID NO: 37921 - DNA, 22 bp, synthetic construct
  misc_feature 1..22: note = Synthetic Construct
  source 1..22: mol_type = other DNA
caccagtcaaggaggctgtaag

SEQ ID NO: 37922 - DNA, 23 bp, synthetic construct
  misc_feature 1..23: note = Synthetic Construct
  source 1..23: mol_type = other DNA
gtacagcttctaccagcagttca

SEQ ID NO: 37923 - DNA, 25 bp, synthetic construct
  misc_feature 1..25: note = Synthetic Construct
  source 1..25: mol_type = other DNA
ggttgtacacttgcttttgcacttg

SEQ ID NO: 37924 - DNA, 25 bp, synthetic construct
  misc_feature 1..25: note = Synthetic Construct
  source 1..25: mol_type = other DNA
gacacaagaactgggaatggaggaa

SEQ ID NO: 37925 - DNA, 25 bp, synthetic construct
  misc_feature 1..25: note = Synthetic Construct
  source 1..25: mol_type = other DNA
gtcagatgttgtcttcacactccta

SEQ ID NO: 37926 - DNA, 20 bp, synthetic construct
  misc_feature 1..20: note = Synthetic Construct
  source 1..20: mol_type = other DNA
tcagcctagcctctcccaaa

SEQ ID NO: 37927 - DNA, 24 bp, synthetic construct
  misc_feature 1..24: note = Synthetic Construct
  source 1..24: mol_type = other DNA
agagcttggatctgcgagaattag

SEQ ID NO: 37928 - DNA, 23 bp, synthetic construct
  misc_feature 1..23: note = Synthetic Construct
  source 1..23: mol_type = other DNA
acaaccacagaaggatgtcaact

SEQ ID NO: 37929 - DNA, 26 bp, synthetic construct
  misc_feature 1..26: note = Synthetic Construct
  source 1..26: mol_type = other DNA
ggataggatgtgggcgaaattcttac

SEQ ID NO: 37930 - DNA, 25 bp, synthetic construct
  misc_feature 1..25: note = Synthetic Construct
  source 1..25: mol_type = other DNA
gctttcctctagggttggactgtga

SEQ ID NO: 37931 - DNA, 23 bp, synthetic construct
  misc_feature 1..23: note = Synthetic Construct
  source 1..23: mol_type = other DNA
cggtgtccctaggctgagataac

SEQ ID NO: 37932 - DNA, 24 bp, synthetic construct
  misc_feature 1..24: note = Synthetic Construct
  source 1..24: mol_type = other DNA
gcacaactttatcttggccctgaa

SEQ ID NO: 37933 - DNA, 24 bp, synthetic construct
  misc_feature 1..24: note = Synthetic Construct
  source 1..24: mol_type = other DNA
ggcccagtctatgaggaactgttg

SEQ ID NO: 37934 - DNA, 23 bp, synthetic construct
  misc_feature 1..23: note = Synthetic Construct
  source 1..23: mol_type = other DNA
gtctcaattcctctggcccttgt

SEQ ID NO: 37935 - DNA, 22 bp, synthetic construct
  misc_feature 1..22: note = Synthetic Construct
  source 1..22: mol_type = other DNA
ccctaacaggcttcctcacaca

SEQ ID NO: 37936 - DNA, 23 bp, synthetic construct
  misc_feature 1..23: note = Synthetic Construct
  source 1..23: mol_type = other DNA
gagggatgtgaggaagcctttac

SEQ ID NO: 37937 - DNA, 23 bp, synthetic construct
  misc_feature 1..23: note = Synthetic Construct
  source 1..23: mol_type = other DNA
tccccgtggtcatattcagagaa

SEQ ID NO: 37938 - DNA, 22 bp, synthetic construct
  misc_feature 1..22: note = Synthetic Construct
  source 1..22: mol_type = other DNA
ccagtggtggatcagtcctcaa

SEQ ID NO: 37939 - DNA, 23 bp, synthetic construct
  misc_feature 1..23: note = Synthetic Construct
  source 1..23: mol_type = other DNA
ggggaggagacccaatccaaatc

SEQ ID NO: 37940 - DNA, 24 bp, synthetic construct
  misc_feature 1..24: note = Synthetic Construct
  source 1..24: mol_type = other DNA
gacactggggacaaataggctgaa

SEQ ID NO: 37941 - DNA, 20 bp, synthetic construct
  misc_feature 1..20: note = Synthetic Construct
  source 1..20: mol_type = other DNA
cagcaactgcgtggagagaa

SEQ ID NO: 37942 - DNA, 22 bp, synthetic construct
  misc_feature 1..22: note = Synthetic Construct
  source 1..22: mol_type = other DNA
ttcagggacctccaccatcttg

SEQ ID NO: 37943 - DNA, 22 bp, synthetic construct
  misc_feature 1..22: note = Synthetic Construct
  source 1..22: mol_type = other DNA
aggcaaagtccaaccccagaag

SEQ ID NO: 37944 - DNA, 20 bp, synthetic construct
  misc_feature 1..20: note = Synthetic Construct
  source 1..20: mol_type = other DNA
caccgccacatgcaatcatc

SEQ ID NO: 37945 - DNA, 27 bp, synthetic construct
  misc_feature 1..27: note = Synthetic Construct
  source 1..27: mol_type = other DNA
cctcacttctaagagtagcagcctttc

SEQ ID NO: 37946 - DNA, 18 bp, synthetic construct
  misc_feature 1..18: note = Synthetic Construct
  source 1..18: mol_type = other DNA
cgcaggccttgtggaaca

SEQ ID NO: 37947 - DNA, 21 bp, synthetic construct
  misc_feature 1..21: note = Synthetic Construct
  source 1..21: mol_type = other DNA
ccaccaaggtacgcacagaca

SEQ ID NO: 37948 - DNA, 25 bp, synthetic construct
  misc_feature 1..25: note = Synthetic Construct
  source 1..25: mol_type = other DNA
gatacaagaacactgtgccctatct

SEQ ID NO: 37949 - DNA, 28 bp, synthetic construct
  misc_feature 1..28: note = Synthetic Construct
  source 1..28: mol_type = other DNA
gcagtaatgcctctgaatacaccactgt

SEQ ID NO: 37950 - DNA, 25 bp, synthetic construct
  misc_feature 1..25: note = Synthetic Construct
  source 1..25: mol_type = other DNA
gacatttctgggctatgtggtcgat

SEQ ID NO: 37951 - DNA, 20 bp, synthetic construct
  misc_feature 1..20: note = Synthetic Construct
  source 1..20: mol_type = other DNA
aacttgcccttggcgtgcat

SEQ ID NO: 37952 - DNA, 24 bp, synthetic construct
  misc_feature 1..24: note = Synthetic Construct
  source 1..24: mol_type = other DNA
cccaggtactgactgatactgaga

SEQ ID NO: 37953 - DNA, 25 bp, synthetic construct
  misc_feature 1..25: note = Synthetic Construct
  source 1..25: mol_type = other DNA
ttctaagctcctagagggaaagact

SEQ ID NO: 37954 - DNA, 24 bp, synthetic construct
  misc_feature 1..24: note = Synthetic Construct
  source 1..24: mol_type = other DNA
agaatagtgtgagctggattgtgt

SEQ ID NO: 37955 - DNA, 20 bp, synthetic construct
  misc_feature 1..20: note = Synthetic Construct
  source 1..20: mol_type = other DNA
cgtgaagtccttggccacat

SEQ ID NO: 37956 - DNA, 24 bp, synthetic construct
  misc_feature 1..24: note = Synthetic Construct
  source 1..24: mol_type = other DNA
ggtcccacttgacaacaagcaaag

SEQ ID NO: 37957 - DNA, 27 bp, synthetic construct
  misc_feature 1..27: note = Synthetic Construct
  source 1..27: mol_type = other DNA
ctggtaagttttccaaatggtggtgta

SEQ ID NO: 37958 - DNA, 23 bp, synthetic construct
  misc_feature 1..23: note = Synthetic Construct
  source 1..23: mol_type = other DNA
gctgctcccatgaaatccactct

SEQ ID NO: 37959 - DNA, 21 bp, synthetic construct
  misc_feature 1..21: note = Synthetic Construct
  source 1..21: mol_type = other DNA
gggacagcgacagtcctgatg

SEQ ID NO: 37960 - DNA, 19 bp, synthetic construct
  misc_feature 1..19: note = Synthetic Construct
  source 1..19: mol_type = other DNA
tggggtgggagacggtaga

SEQ ID NO: 37961 - DNA, 21 bp, synthetic construct
  misc_feature 1..21: note = Synthetic Construct
  source 1..21: mol_type = other DNA
tggaagagggcgataccatgt

SEQ ID NO: 37962 - DNA, 24 bp, synthetic construct
  misc_feature 1..24: note = Synthetic Construct
  source 1..24: mol_type = other DNA
catctgagtagagaagcaccaaca

SEQ ID NO: 37963 - DNA, 25 bp, synthetic construct
  misc_feature 1..25: note = Synthetic Construct
  source 1..25: mol_type = other DNA
gtgtattggcaggcttgatctctca

SEQ ID NO: 37964 - DNA, 23 bp, synthetic construct
  misc_feature 1..23: note = Synthetic Construct
  source 1..23: mol_type = other DNA
cccttcataatccagtggacaca

SEQ ID NO: 37965 - DNA, 21 bp, synthetic construct
  misc_feature 1..21: note = Synthetic Construct
  source 1..21: mol_type = other DNA
ccagaccacgagctcctcaaa

SEQ ID NO: 37966 - DNA, 20 bp, synthetic construct
  misc_feature 1..20: note = Synthetic Construct
  source 1..20: mol_type = other DNA
tccagggcctgagccacaaa

SEQ ID NO: 37967 - DNA, 21 bp, synthetic construct
  misc_feature 1..21: note = Synthetic Construct
  source 1..21: mol_type = other DNA
agagtcatccagcccctccat

SEQ ID NO: 37968 - DNA, 22 bp, synthetic construct
  misc_feature 1..22: note = Synthetic Construct
  source 1..22: mol_type = other DNA
gtggtcacattggcaggaattg

SEQ ID NO: 37969 - DNA, 20 bp, synthetic construct
  misc_feature 1..20: note = Synthetic Construct
  source 1..20: mol_type = other DNA
accaggctgtgggacagaca

SEQ ID NO: 37970 - DNA, 22 bp, synthetic construct
  misc_feature 1..22: note = Synthetic Construct
  source 1..22: mol_type = other DNA
caaaagcagggcttcctttgaa

SEQ ID NO: 37971 - DNA, 22 bp, synthetic construct
  misc_feature 1..22: note = Synthetic Construct
  source 1..22: mol_type = other DNA
ggggtgcagtggcacaatcata

SEQ ID NO: 37972 - DNA, 21 bp, synthetic construct
  misc_feature 1..21: note = Synthetic Construct
  source 1..21: mol_type = other DNA
gttgggctggctaaaccgata

SEQ ID NO: 37973 - DNA, 20 bp, synthetic construct
  misc_feature 1..20: note = Synthetic Construct
  source 1..20: mol_type = other DNA
agggcccttgttcacacaca

SEQ ID NO: 37974 - DNA, 20 bp, synthetic construct
  misc_feature 1..20: note = Synthetic Construct
  source 1..20: mol_type = other DNA
tccccactgaatgcggtgtt

SEQ ID NO: 37975 - DNA, 24 bp, synthetic construct
  misc_feature 1..24: note = Synthetic Construct
  source 1..24: mol_type = other DNA
gtcagcttgcaaagctcctttaga

SEQ ID NO: 37976 - DNA, 22 bp, synthetic construct
  misc_feature 1..22: note = Synthetic Construct
  source 1..22: mol_type = other DNA
tgccacatgctctctcccaaac

SEQ ID NO: 37977 - DNA, 23 bp, synthetic construct
  misc_feature 1..23: note = Synthetic Construct
  source 1..23: mol_type = other DNA
ctgttagggccctgtttgtcttg

SEQ ID NO: 37978 - DNA, 21 bp, synthetic construct
  misc_feature 1..21: note = Synthetic Construct
  source 1..21: mol_type = other DNA
tgaggaaggaagaccctgcat

SEQ ID NO: 37979 - DNA, 22 bp, synthetic construct
  misc_feature 1..22: note = Synthetic Construct
  source 1..22: mol_type = other DNA
ggacttccccgcaatacgaaag

SEQ ID NO: 37980 - DNA, 26 bp, synthetic construct
  misc_feature 1..26: note = Synthetic Construct
  source 1..26: mol_type = other DNA
tccatcttctctgtacagtgtctact

SEQ ID NO: 37981 - DNA, 20 bp, synthetic construct
  misc_feature 1..20: note = Synthetic Construct
  source 1..20: mol_type = other DNA
agccctcctcggacccatgt

SEQ ID NO: 37982 - DNA, 23 bp, synthetic construct
  misc_feature 1..23: note = Synthetic Construct
  source 1..23: mol_type = other DNA
gaagaggctgttagaagcgtagt

SEQ ID NO: 37983 - DNA, 22 bp, synthetic construct
  misc_feature 1..22: note = Synthetic Construct
  source 1..22: mol_type = other DNA
gcagtagtccagcctgagtttc

SEQ ID NO: 37984 - DNA, 20 bp, synthetic construct
  misc_feature 1..20: note = Synthetic Construct
  source 1..20: mol_type = other DNA
tgccggcctcagcctcagta

SEQ ID NO: 37985 - DNA, 22 bp, synthetic construct
  misc_feature 1..22: note = Synthetic Construct
  source 1..22: mol_type = other DNA
ccccagccatagtctctgattc

SEQ ID NO: 37986 - DNA, 22 bp, synthetic construct
  misc_feature 1..22: note = Synthetic Construct
  source 1..22: mol_type = other DNA
cctggtctctcagccttagtca

SEQ ID NO: 37987 - DNA, 24 bp, synthetic construct
  misc_feature 1..24: note = Synthetic Construct
  source 1..24: mol_type = other DNA
agtgaagacaaagtcctcctgaag

SEQ ID NO: 37988 - DNA, 29 bp, synthetic construct
  misc_feature 1..29: note = Synthetic Construct
  source 1..29: mol_type = other DNA
ggcaaggaattataacttaggccctggaa

SEQ ID NO: 37989 - DNA, 20 bp, synthetic construct
  misc_feature 1..20: note = Synthetic Construct
  source 1..20: mol_type = other DNA
tcccagggcacactatgact

SEQ ID NO: 37990 - DNA, 22 bp, synthetic construct
  misc_feature 1..22: note = Synthetic Construct
  source 1..22: mol_type = other DNA
atttgcacccatgtctgtctga

SEQ ID NO: 37991 - DNA, 20 bp, synthetic construct
  misc_feature 1..20: note = Synthetic Construct
  source 1..20: mol_type = other DNA
tgcaggaggccagagaacat

SEQ ID NO: 37992 - DNA, 24 bp, synthetic construct
  misc_feature 1..24: note = Synthetic Construct
  source 1..24: mol_type = other DNA
gccccatccctttgccttatcttc

SEQ ID NO: 37993 - DNA, 20 bp, synthetic construct
  misc_feature 1..20: note = Synthetic Construct
  source 1..20: mol_type = other DNA
gtgtcacacgctgagaggtt

SEQ ID NO: 37994 - DNA, 25 bp, synthetic construct
  misc_feature 1..25: note = Synthetic Construct
  source 1..25: mol_type = other DNA
cctgcaacaagagataagcccaact

SEQ ID NO: 37995 - DNA, 20 bp, synthetic construct
  misc_feature 1..20: note = Synthetic Construct
  source 1..20: mol_type = other DNA
tgagccactgtgcctggata

SEQ ID NO: 37996 - DNA, 29 bp, synthetic construct
  misc_feature 1..29: note = Synthetic Construct
  source 1..29: mol_type = other DNA
cagtttagatatgcttagccagtccttca

SEQ ID NO: 37997 - DNA, 20 bp, synthetic construct
  misc_feature 1..20: note = Synthetic Construct
  source 1..20: mol_type = other DNA
tcacctcaccttggcctttg

SEQ ID NO: 37998 - DNA, 25 bp, synthetic construct
  misc_feature 1..25: note = Synthetic Construct
  source 1..25: mol_type = other DNA
caaacacatgctttcctcaaacaag

SEQ ID NO: 37999 - DNA, 23 bp, synthetic construct
  misc_feature 1..23: note = Synthetic Construct
  source 1..23: mol_type = other DNA
gaggatactgaggcatggggata

SEQ ID NO: 38000 - DNA, 22 bp, synthetic construct
  misc_feature 1..22: note = Synthetic Construct
  source 1..22: mol_type = other DNA
ggcatggggaggaagtacacat

SEQ ID NO: 38001 - DNA, 21 bp, synthetic construct
  misc_feature 1..21: note = Synthetic Construct
  source 1..21: mol_type = other DNA
tgaaaaggccttgtgggtcaa

SEQ ID NO: 38002 - DNA, 20 bp, synthetic construct
  misc_feature 1..20: note = Synthetic Construct
  source 1..20: mol_type = other DNA
aactactgcccaggctggaa

SEQ ID NO: 38003 - DNA, 23 bp, synthetic construct
  misc_feature 1..23: note = Synthetic Construct
  source 1..23: mol_type = other DNA
gaatgcttcatgcgacacgaaaa

SEQ ID NO: 38004 - DNA, 24 bp, synthetic construct
  misc_feature 1..24: note = Synthetic Construct
  source 1..24: mol_type = other DNA
ccagctgtcattttagggcagact

SEQ ID NO: 38005 - DNA, 21 bp, synthetic construct
  misc_feature 1..21: note = Synthetic Construct
  source 1..21: mol_type = other DNA
ccctgaagccctgtgtcttct

SEQ ID NO: 38006 - DNA, 27 bp, synthetic construct
  misc_feature 1..27: note = Synthetic Construct
  source 1..27: mol_type = other DNA
ggagtttctgtctcttttcccctagaa

SEQ ID NO: 38007 - DNA, 20 bp, synthetic construct
  misc_feature 1..20: note = Synthetic Construct
  source 1..20: mol_type = other DNA
cttgatctggcaggcagctt

SEQ ID NO: 38008 - DNA, 23 bp, synthetic construct
  misc_feature 1..23: note = Synthetic Construct
  source 1..23: mol_type = other DNA
acagaaccctttcacacgtgatt

SEQ ID NO: 38009 - DNA, 28 bp, synthetic construct
  misc_feature 1..28: note = Synthetic Construct
  source 1..28: mol_type = other DNA
gcctgtatgatattcaggtcacttcttc

SEQ ID NO: 38010 - DNA, 22 bp, synthetic construct
  misc_feature 1..22: note = Synthetic Construct
  source 1..22: mol_type = other DNA
gccaaccagttctttgggagaa

SEQ ID NO: 38011 - DNA, 24 bp, synthetic construct
  misc_feature 1..24: note = Synthetic Construct
  source 1..24: mol_type = other DNA
gaaagcagccaggattacaaccta

SEQ ID NO: 38012 - DNA, 20 bp, synthetic construct
  misc_feature 1..20: note = Synthetic Construct
  source 1..20: mol_type = other DNA
tcctgcctgtccccagtgta

SEQ ID NO: 38013 - DNA, 22 bp, synthetic construct
  misc_feature 1..22: note = Synthetic Construct
  source 1..22: mol_type = other DNA
gagagggtgagacggtagaaac

SEQ ID NO: 38014 - DNA, 27 bp, synthetic construct
  misc_feature 1..27: note = Synthetic Construct
  source 1..27: mol_type = other DNA
cacctgaagcatttttcatcctgttca

SEQ ID NO: 38015 - DNA, 18 bp, synthetic construct
  misc_feature 1..18: note = Synthetic Construct
  source 1..18: mol_type = other DNA
agtgcggccacaagcatt

SEQ ID NO: 38016 - DNA, 25 bp, synthetic construct
  misc_feature 1..25: note = Synthetic Construct
  source 1..25: mol_type = other DNA
gacatcttctacagctctgccaaaa

SEQ ID NO: 38017 - DNA, 18 bp, synthetic construct
  misc_feature 1..18: note = Synthetic Construct
  source 1..18: mol_type = other DNA
ctgcactgccctgtgctt

SEQ ID NO: 38018 - DNA, 21 bp, synthetic construct
  misc_feature 1..21: note = Synthetic Construct
  source 1..21: mol_type = other DNA
accagtggcttccccacaaca

SEQ ID NO: 38019 - DNA, 22 bp, synthetic construct
  misc_feature 1..22: note = Synthetic Construct
  source 1..22: mol_type = other DNA
ggacttctgtgggatgagcatt

SEQ ID NO: 38020 - DNA, 22 bp, synthetic construct
  misc_feature 1..22: note = Synthetic Construct
  source 1..22: mol_type = other DNA
agccctttccacacctctcctt

SEQ ID NO: 38021 - DNA, 21 bp, synthetic construct
  misc_feature 1..21: note = Synthetic Construct
  source 1..21: mol_type = other DNA
tgccctctgcagggaatggta

SEQ ID NO: 38022 - DNA, 24 bp, synthetic construct
  misc_feature 1..24: note = Synthetic Construct
  source 1..24: mol_type = other DNA
gcagccaggagcaacttgtactca

SEQ ID NO: 38023 - DNA, 26 bp, synthetic construct
  misc_feature 1..26: note = Synthetic Construct
  source 1..26: mol_type = other DNA
ctcttctctagaccacaggtttccat

SEQ ID NO: 38024 - DNA, 21 bp, synthetic construct
  misc_feature 1..21: note = Synthetic Construct
  source 1..21: mol_type = other DNA
gtgcgaaagactggagcaatc

SEQ ID NO: 38025 - DNA, 20 bp, synthetic construct
  misc_feature 1..20: note = Synthetic Construct
  source 1..20: mol_type = other DNA
ggacagcaccaactctgctt

SEQ ID NO: 38026 - DNA, 23 bp, synthetic construct
  misc_feature 1..23: note = Synthetic Construct
  source 1..23: mol_type = other DNA
agcattaatgggcaacaggagat

SEQ ID NO: 38027 - DNA, 26 bp, synthetic construct
  misc_feature 1..26: note = Synthetic Construct
  source 1..26: mol_type = other DNA
gatagttgagcagagaaacaggaaga

SEQ ID NO: 38028 - DNA, 25 bp, synthetic construct
  misc_feature 1..25: note = Synthetic Construct
  source 1..25: mol_type = other DNA
tcataggcatctggagggacaataa

SEQ ID NO: 38029 - DNA, 25 bp, synthetic construct
  misc_feature 1..25: note = Synthetic Construct
  source 1..25: mol_type = other DNA
gcatgacgtcagaaaccatgcttca

SEQ ID NO: 38030 - DNA, 24 bp, synthetic construct
  misc_feature 1..24: note = Synthetic Construct
  source 1..24: mol_type = other DNA
gtggaaacccgattccctttggta

SEQ ID NO: 38031 - DNA, 23 bp, synthetic construct
  misc_feature 1..23: note = Synthetic Construct
  source 1..23: mol_type = other DNA
tgaccaaaccaaaacacctgtga

SEQ ID NO: 38032 - DNA, 22 bp, synthetic construct
  misc_feature 1..22: note = Synthetic Construct
  source 1..22: mol_type = other DNA
gtggtctccctggtgctagttt

SEQ ID NO: 38033 - DNA, 20 bp, synthetic construct
  misc_feature 1..20: note = Synthetic Construct
  source 1..20: mol_type = other DNA
cgagacccgatccctgaagt

SEQ ID NO: 38034 - DNA, 20 bp, synthetic construct
  misc_feature 1..20: note = Synthetic Construct
  source 1..20: mol_type = other DNA
atagccgagccgccatgttt

SEQ ID NO: 38035 - DNA, 24 bp, synthetic construct
  misc_feature 1..24: note = Synthetic Construct
  source 1..24: mol_type = other DNA
ggtggcaaaatgaccagagcagtt

SEQ ID NO: 38036 - DNA, 19 bp, synthetic construct
  misc_feature 1..19: note = Synthetic Construct
  source 1..19: mol_type = other DNA
gggctccggggtaaagtct

SEQ ID NO: 38037 - DNA, 20 bp, synthetic construct
  misc_feature 1..20: note = Synthetic Construct
  source 1..20: mol_type = other DNA
tgcaccaggcactgtgttag

SEQ ID NO: 38038 - DNA, 22 bp, synthetic construct
  misc_feature 1..22: note = Synthetic Construct
  source 1..22: mol_type = other DNA
cacagccttccagggagaagaa

SEQ ID NO: 38039 - DNA, 25 bp, synthetic construct
  misc_feature 1..25: note = Synthetic Construct
  source 1..25: mol_type = other DNA
ccatgagagtacccactctgtccaa

SEQ ID NO: 38040 - DNA, 21 bp, synthetic construct
  misc_feature 1..21: note = Synthetic Construct
  source 1..21: mol_type = other DNA
tgggtgggtgtgaggaccaat

SEQ ID NO: 38041 - DNA, 29 bp, synthetic construct
  misc_feature 1..29: note = Synthetic Construct
  source 1..29: mol_type = other DNA
gaggatgaaatgatatagaggggcttcat

SEQ ID NO: 38042 - DNA, 28 bp, synthetic construct
  misc_feature 1..28: note = Synthetic Construct
  source 1..28: mol_type = other DNA
cactcagagtagaaggcaaagtccttac

SEQ ID NO: 38043 - DNA, 22 bp, synthetic construct
  misc_feature 1..22: note = Synthetic Construct
  source 1..22: mol_type = other DNA
ccccaatgctaactcccctaga

SEQ ID NO: 38044 - DNA, 22 bp, synthetic construct
  misc_feature 1..22: note = Synthetic Construct
  source 1..22: mol_type = other DNA
gcctccacaatcctcccaggta

SEQ ID NO: 38045 - DNA, 27 bp, synthetic construct
  misc_feature 1..27: note = Synthetic Construct
  source 1..27: mol_type = other DNA
gcactaagaagttgctttgctgtctac

SEQ ID NO: 38046 - DNA, 21 bp, synthetic construct
  misc_feature 1..21: note = Synthetic Construct
  source 1..21: mol_type = other DNA
cccagccattccctccaacat

SEQ ID NO: 38047 - DNA, 26 bp, synthetic construct
  misc_feature 1..26: note = Synthetic Construct
  source 1..26: mol_type = other DNA
gcatatcccttgactgttccctcaaa

SEQ ID NO: 38048 - DNA, 22 bp, synthetic construct
  misc_feature 1..22: note = Synthetic Construct
  source 1..22: mol_type = other DNA
tgccagtagggagtcactgaga

SEQ ID NO: 38049 - DNA, 21 bp, synthetic construct
  misc_feature 1..21: note = Synthetic Construct
  source 1..21: mol_type = other DNA
ccaaggcagcaggatcatttg

SEQ ID NO: 38050 - DNA, 22 bp, synthetic construct
  misc_feature 1..22: note = Synthetic Construct
  source 1..22: mol_type = other DNA
ctttccggtctccctacacact

SEQ ID NO: 38051 - DNA, 22 bp, synthetic construct
  misc_feature 1..22: note = Synthetic Construct
  source 1..22: mol_type = other DNA
catagatggggcatcactgtgt

SEQ ID NO: 38052 - DNA, 22 bp, synthetic construct
  misc_feature 1..22: note = Synthetic Construct
  source 1..22: mol_type = other DNA
ccagtagacccaccatgtctgt

SEQ ID NO: 38053 - DNA, 23 bp, synthetic construct
  misc_feature 1..23: note = Synthetic Construct
  source 1..23: mol_type = other DNA
gcagagagtgcatgagtttcaca

SEQ ID NO: 38054 - DNA, 24 bp, synthetic construct
  misc_feature 1..24: note = Synthetic Construct
  source 1..24: mol_type = other DNA
gtgcgtgagaatagatgctgacat

SEQ ID NO: 38055 - DNA, 20 bp, synthetic construct
  misc_feature 1..20: note = Synthetic Construct
  source 1..20: mol_type = other DNA
ggtggtggggtcaactccta

SEQ ID NO: 38056 - DNA, 20 bp, synthetic construct
  misc_feature 1..20: note = Synthetic Construct
  source 1..20: mol_type = other DNA
tagcctgactgtgggagtgt

SEQ ID NO: 38057 - DNA, 21 bp, synthetic construct
  misc_feature 1..21: note = Synthetic Construct
  source 1..21: mol_type = other DNA
aggccctgttactggcagaga

SEQ ID NO: 38058 - DNA, 22 bp, synthetic construct
  misc_feature 1..22: note = Synthetic Construct
  source 1..22: mol_type = other DNA
gctgcacagctcgtagctctaa

SEQ ID NO: 38059 - DNA, 21 bp, synthetic construct
  misc_feature 1..21: note = Synthetic Construct
  source 1..21: mol_type = other DNA
tgccttccacagggaggagaa

SEQ ID NO: 38060 - DNA, 23 bp, synthetic construct
  misc_feature 1..23: note = Synthetic Construct
  source 1..23: mol_type = other DNA
ccaggactaagggagttgtctgt

SEQ ID NO: 38061 - DNA, 19 bp, synthetic construct
  misc_feature 1..19: note = Synthetic Construct
  source 1..19: mol_type = other DNA
gcaccaggccaccatcaga

SEQ ID NO: 38062 - DNA, 21 bp, synthetic construct
  misc_feature 1..21: note = Synthetic Construct
  source 1..21: mol_type = other DNA
ggtgcacagcagaggatgtga

SEQ ID NO: 38063 - DNA, 22 bp, synthetic construct
  misc_feature 1..22: note = Synthetic Construct
  source 1..22: mol_type = other DNA
gggtggacatctgtgtgcttgt

SEQ ID NO: 38064 - DNA, 27 bp, synthetic construct
  misc_feature 1..27: note = Synthetic Construct
  source 1..27: mol_type = other DNA
gggattcaagtccacatcttttgattc

SEQ ID NO: 38065 - DNA, 22 bp, synthetic construct
  misc_feature 1..22: note = Synthetic Construct
  source 1..22: mol_type = other DNA
accaagatccactccagcaaaa

SEQ ID NO: 38066 - DNA, 22 bp, synthetic construct
  misc_feature 1..22: note = Synthetic Construct
  source 1..22: mol_type = other DNA
cacagagcccaaagggaagaca

SEQ ID NO: 38067 - DNA, 20 bp, synthetic construct
  misc_feature 1..20: note = Synthetic Construct
  source 1..20: mol_type = other DNA
tgcagtcgatgtggcggtat

SEQ ID NO: 38068 - DNA, 22 bp, synthetic construct
  misc_feature 1..22: note = Synthetic Construct
  source 1..22: mol_type = other DNA
tcagttttgctcacgcttcact

SEQ ID NO: 38069 - DNA, 23 bp, synthetic construct
  misc_feature 1..23: note = Synthetic Construct
  source 1..23: mol_type = other DNA
gctctatgtgctagtgtgtgcat

SEQ ID NO: 38070 - DNA, 23 bp, synthetic construct
  misc_feature 1..23: note = Synthetic Construct
  source 1..23: mol_type = other DNA
gcacagtcagttgtcagggatag

SEQ ID NO: 38071 - DNA, 24 bp, synthetic construct
  misc_feature 1..24: note = Synthetic Construct
  source 1..24: mol_type = other DNA
gcaacacaacacctacaggagaca

SEQ ID NO: 38072 - DNA, 20 bp, synthetic construct
  misc_feature 1..20: note = Synthetic Construct
  source 1..20: mol_type = other DNA
agaggaggctccagcgtgaa

SEQ ID NO: 38073 - DNA, 21 bp, synthetic construct
  misc_feature 1..21: note = Synthetic Construct
  source 1..21: mol_type = other DNA
tctctgggcagctgaggagtt

SEQ ID NO: 38074 - DNA, 20 bp, synthetic construct
  misc_feature 1..20: note = Synthetic Construct
  source 1..20: mol_type = other DNA
cagccacaggcttggaaact

SEQ ID NO: 38075 - DNA, 22 bp, synthetic construct
  misc_feature 1..22: note = Synthetic Construct
  source 1..22: mol_type = other DNA
ggttcctggtgagggaagatgt

SEQ ID NO: 38076 - DNA, 22 bp, synthetic construct
  misc_feature 1..22: note = Synthetic Construct
  source 1..22: mol_type = other DNA
cacccctgacttagctgtggtt

SEQ ID NO: 38077 - DNA, 20 bp, synthetic construct
  misc_feature 1..20: note = Synthetic Construct
  source 1..20: mol_type = other DNA
ttgctcactaccgcctggtt

SEQ ID NO: 38078 - DNA, 23 bp, synthetic construct
  misc_feature 1..23: note = Synthetic Construct
  source 1..23: mol_type = other DNA
tgcatagacaggggaggcctaga

SEQ ID NO: 38079 - DNA, 19 bp, synthetic construct
  misc_feature 1..19: note = Synthetic Construct
  source 1..19: mol_type = other DNA
cgtccacgaagccccagta

SEQ ID NO: 38080 - DNA, 21 bp, synthetic construct
  misc_feature 1..21: note = Synthetic Construct
  source 1..21: mol_type = other DNA
tggccccactacttcctgaac

SEQ ID NO: 38081 - DNA, 22 bp, synthetic construct
  misc_feature 1..22: note = Synthetic Construct
  source 1..22: mol_type = other DNA
gagtgtggcagtcggtactaag

SEQ ID NO: 38082 - DNA, 24 bp, synthetic construct
  misc_feature 1..24: note = Synthetic Construct
  source 1..24: mol_type = other DNA
tctgatggccaagtttttcagaga

SEQ ID NO: 38083 - DNA, 22 bp, synthetic construct
  misc_feature 1..22: note = Synthetic Construct
  source 1..22: mol_type = other DNA
ctccaggaagcatctgttgact

SEQ ID NO: 38084 - DNA, 21 bp, synthetic construct
  misc_feature 1..21: note = Synthetic Construct
  source 1..21: mol_type = other DNA
tggggacttggtgtccactga

SEQ ID NO: 38085 - DNA, 22 bp, synthetic construct
  misc_feature 1..22: note = Synthetic Construct
  source 1..22: mol_type = other DNA
tctggatgacgaagcccctatc

SEQ ID NO: 38086 - DNA, 20 bp, synthetic construct
  misc_feature 1..20: note = Synthetic Construct
  source 1..20: mol_type = other DNA
caagcagctcttggctggaa

SEQ ID NO: 38087 - DNA, 22 bp, synthetic construct
  misc_feature 1..22: note = Synthetic Construct
  source 1..22: mol_type = other DNA
catgttacccagaggccaccta

SEQ ID NO: 38088 - DNA, 22 bp, synthetic construct
  misc_feature 1..22: note = Synthetic Construct
  source 1..22: mol_type = other DNA
ggaggggacaattgctgtgtga

SEQ ID NO: 38089 - DNA, 26 bp, synthetic construct
  misc_feature 1..26: note = Synthetic Construct
  source 1..26: mol_type = other DNA
ccttccctaaagtcccaggagagaag

SEQ ID NO: 38090 - DNA, 21 bp, synthetic construct
  misc_feature 1..21: note = Synthetic Construct
  source 1..21: mol_type = other DNA
tgtgtccagtggctagagctt

SEQ ID NO: 38091 - DNA, 20 bp, synthetic construct
  misc_feature 1..20: note = Synthetic Construct
  source 1..20: mol_type = other DNA
cggatgtgcaggtggaatct

SEQ ID NO: 38092 - DNA, 20 bp, synthetic construct
  misc_feature 1..20: note = Synthetic Construct
  source 1..20: mol_type = other DNA
cccacagagctcgccagaaa

SEQ ID NO: 38093 - DNA, 21 bp, synthetic construct
  misc_feature 1..21: note = Synthetic Construct
  source 1..21: mol_type = other DNA
aggtgactagggcttcccaaa

SEQ ID NO: 38094 - DNA, 24 bp, synthetic construct
  misc_feature 1..24: note = Synthetic Construct
  source 1..24: mol_type = other DNA
caggtttggacttgagtcaacaga

SEQ ID NO: 38095 - DNA, 22 bp, synthetic construct
  misc_feature 1..22: note = Synthetic Construct
  source 1..22: mol_type = other DNA
tggctgaggaggtggatgaatg

SEQ ID NO: 38096 - DNA, 20 bp, synthetic construct
  misc_feature 1..20: note = Synthetic Construct
  source 1..20: mol_type = other DNA
ccgaaggcctctgggcttta

SEQ ID NO: 38097 - DNA, 20 bp, synthetic construct
  misc_feature 1..20: note = Synthetic Construct
  source 1..20: mol_type = other DNA
acatgtgcgtccgtgtcact

SEQ ID NO: 38098 - DNA, 19 bp, synthetic construct
  misc_feature 1..19: note = Synthetic Construct
  source 1..19: mol_type = other DNA
tccagttgcccctcctgaa

SEQ ID NO: 38099 - DNA, 24 bp, synthetic construct
  misc_feature 1..24: note = Synthetic Construct
  source 1..24: mol_type = other DNA
agggatatcatggctggaatgagt

SEQ ID NO: 38100 - DNA, 20 bp, synthetic construct
  misc_feature 1..20: note = Synthetic Construct
  source 1..20: mol_type = other DNA
aggctggcacaggtatgact

SEQ ID NO: 38101 - DNA, 24 bp, synthetic construct
  misc_feature 1..24: note = Synthetic Construct
  source 1..24: mol_type = other DNA
gcgaggctgggcagtatctgatta

SEQ ID NO: 38102 - DNA, 23 bp, synthetic construct
  misc_feature 1..23: note = Synthetic Construct
  source 1..23: mol_type = other DNA
gttgcatcttcatctccctgtct

SEQ ID NO: 38103 - DNA, 20 bp, synthetic construct
  misc_feature 1..20: note = Synthetic Construct
  source 1..20: mol_type = other DNA
tggtggatgcagctggtatg

SEQ ID NO: 38104 - DNA, 23 bp, synthetic construct
  misc_feature 1..23: note = Synthetic Construct
  source 1..23: mol_type = other DNA
ccacagaaacacttctcgctgaa

SEQ ID NO: 38105 - DNA, 23 bp, synthetic construct
  misc_feature 1..23: note = Synthetic Construct
  source 1..23: mol_type = other DNA
gatatgctgagctctgtgctttg

SEQ ID NO: 38106 - DNA, 23 bp, synthetic construct
  misc_feature 1..23: note = Synthetic Construct
  source 1..23: mol_type = other DNA
gactcgatctagccaggaagcat

SEQ ID NO: 38107 - DNA, 19 bp, synthetic construct
  misc_feature 1..19: note = Synthetic Construct
  source 1..19: mol_type = other DNA
tgctgtgtgccactggaaa

SEQ ID NO: 38108 - DNA, 22 bp, synthetic construct
  misc_feature 1..22: note = Synthetic Construct
  source 1..22: mol_type = other DNA
tcaagaggaaaggcgaggacta

SEQ ID NO: 38109 - DNA, 24 bp, synthetic construct
  misc_feature 1..24: note = Synthetic Construct
  source 1..24: mol_type = other DNA
ggcaagaaccctgtgtgtttcttc

SEQ ID NO: 38110 - DNA, 22 bp, synthetic construct
  misc_feature 1..22: note = Synthetic Construct
  source 1..22: mol_type = other DNA
aggcttgacttggggaggacaa

SEQ ID NO: 38111 - DNA, 25 bp, synthetic construct
  misc_feature 1..25: note = Synthetic Construct
  source 1..25: mol_type = other DNA
gctcttctagcttaggcctacattc

SEQ ID NO: 38112 - DNA, 22 bp, synthetic construct
  misc_feature 1..22: note = Synthetic Construct
  source 1..22: mol_type = other DNA
cgcaaacagcagctctgagaaa

SEQ ID NO: 38113 - DNA, 26 bp, synthetic construct
  misc_feature 1..26: note = Synthetic Construct
  source 1..26: mol_type = other DNA
ggtacaaggggtgtaaccataacagt

SEQ ID NO: 38114 - DNA, 23 bp, synthetic construct
  misc_feature 1..23: note = Synthetic Construct
  source 1..23: mol_type = other DNA
gccatcatttcctttcactgctt

SEQ ID NO: 38115 - DNA, 27 bp, synthetic construct
  misc_feature 1..27: note = Synthetic Construct
  source 1..27: mol_type = other DNA
cagaaatagaatgtgaacccaggtagt

SEQ ID NO: 38116 - DNA, 24 bp, synthetic construct
  misc_feature 1..24: note = Synthetic Construct
  source 1..24: mol_type = other DNA
ggacaactagcctggccttagtca

SEQ ID NO: 38117 - DNA, 22 bp, synthetic construct
  misc_feature 1..22: note = Synthetic Construct
  source 1..22: mol_type = other DNA
ctggtcctggaatgttctgtga

SEQ ID NO: 38118 - DNA, 25 bp, synthetic construct
  misc_feature 1..25: note = Synthetic Construct
  source 1..25: mol_type = other DNA
cctggaaaaccaggtgaaccgatct

SEQ ID NO: 38119 - DNA, 20 bp, synthetic construct
  misc_feature 1..20: note = Synthetic Construct
  source 1..20: mol_type = other DNA
cagcccagcacactgacaat

SEQ ID NO: 38120 - DNA, 20 bp, synthetic construct
  misc_feature 1..20: note = Synthetic Construct
  source 1..20: mol_type = other DNA
gcagtggtcctgagccacaa

SEQ ID NO: 38121 - DNA, 21 bp, synthetic construct
  misc_feature 1..21: note = Synthetic Construct
  source 1..21: mol_type = other DNA
tgcctgctacctcctttcagt

SEQ ID NO: 38122 - DNA, 22 bp, synthetic construct
  misc_feature 1..22: note = Synthetic Construct
  source 1..22: mol_type = other DNA
gaactctgggacccttctcaac

SEQ ID NO: 38123 - DNA, 22 bp, synthetic construct
  misc_feature 1..22: note = Synthetic Construct
  source 1..22: mol_type = other DNA
gagagaagagctcctgggaaga

SEQ ID NO: 38124 - DNA, 23 bp, synthetic construct
  misc_feature 1..23: note = Synthetic Construct
  source 1..23: mol_type = other DNA
gggctcaaattctggctccacta

SEQ ID NO: 38125 - DNA, 25 bp, synthetic construct
  misc_feature 1..25: note = Synthetic Construct
  source 1..25: mol_type = other DNA
gtcactgtagtgggagacactgaaa

SEQ ID NO: 38126 - DNA, 21 bp, synthetic construct
  misc_feature 1..21: note = Synthetic Construct
  source 1..21: mol_type = other DNA
tgggcctggcagaacaggaaa

SEQ ID NO: 38127 - DNA, 19 bp, synthetic construct
  misc_feature 1..19: note = Synthetic Construct
  source 1..19: mol_type = other DNA
tggcatgtgccctgtgtca

SEQ ID NO: 38128 - DNA, 21 bp, synthetic construct
  misc_feature 1..21: note = Synthetic Construct
  source 1..21: mol_type = other DNA
aggctgatgcctgtctctttc

SEQ ID NO: 38129 - DNA, 25 bp, synthetic construct
  misc_feature 1..25: note = Synthetic Construct
  source 1..25: mol_type = other DNA
gggaataaccaaccccatggagcat

SEQ ID NO: 38130 - DNA, 20 bp, synthetic construct
  misc_feature 1..20: note = Synthetic Construct
  source 1..20: mol_type = other DNA
gcaggggtgggttgttttga

SEQ ID NO: 38131 - DNA, 19 bp, synthetic construct
  misc_feature 1..19: note = Synthetic Construct
  source 1..19: mol_type = other DNA
gctccacgatgcgctcctt

SEQ ID NO: 38132 - DNA, 25 bp, synthetic construct
  misc_feature 1..25: note = Synthetic Construct
  source 1..25: mol_type = other DNA
ccagttaggtactcctgtggtctga

SEQ ID NO: 38133 - DNA, 23 bp, synthetic construct
  misc_feature 1..23: note = Synthetic Construct
  source 1..23: mol_type = other DNA
gctgaagccctaggtttgccttt

SEQ ID NO: 38134 - DNA, 25 bp, synthetic construct
  misc_feature 1..25: note = Synthetic Construct
  source 1..25: mol_type = other DNA
ggctagcaaacacctacagttgtga

SEQ ID NO: 38135 - DNA, 20 bp, synthetic construct
  misc_feature 1..20: note = Synthetic Construct
  source 1..20: mol_type = other DNA
cccacggttctgcaatcaca

SEQ ID NO: 38136 - DNA, 21 bp, synthetic construct
  misc_feature 1..21: note = Synthetic Construct
  source 1..21: mol_type = other DNA
acatccacttcccagctcctt

SEQ ID NO: 38137 - DNA, 20 bp, synthetic construct
  misc_feature 1..20: note = Synthetic Construct
  source 1..20: mol_type = other DNA
gccctactgcttgtcaccat

SEQ ID NO: 38138 - DNA, 24 bp, synthetic construct
  misc_feature 1..24: note = Synthetic Construct
  source 1..24: mol_type = other DNA
cagctacaaaagcctttggggaat

SEQ ID NO: 38139 - DNA, 22 bp, synthetic construct
  misc_feature 1..22: note = Synthetic Construct
  source 1..22: mol_type = other DNA
cagaaatgcccagtcccctaac

SEQ ID NO: 38140 - DNA, 24 bp, synthetic construct
  misc_feature 1..24: note = Synthetic Construct
  source 1..24: mol_type = other DNA
cggaggcatgattgcaggacattg

SEQ ID NO: 38141 - DNA, 22 bp, synthetic construct
  misc_feature 1..22: note = Synthetic Construct
  source 1..22: mol_type = other DNA
agcagacagagcagtgggtaag

SEQ ID NO: 38142 - DNA, 19 bp, synthetic construct
  misc_feature 1..19: note = Synthetic Construct
  source 1..19: mol_type = other DNA
cctggctggcagcagatca

SEQ ID NO: 38143 - DNA, 20 bp, synthetic construct
  misc_feature 1..20: note = Synthetic Construct
  source 1..20: mol_type = other DNA
tggtgaggggtggagtgttg

SEQ ID NO: 38144 - DNA, 20 bp, synthetic construct
  misc_feature 1..20: note = Synthetic Construct
  source 1..20: mol_type = other DNA
tccaagtctgcagggtgaac

SEQ ID NO: 38145 - DNA, 19 bp, synthetic construct
  misc_feature 1..19: note = Synthetic Construct
  source 1..19: mol_type = other DNA
ttggcctgccaacaacact

SEQ ID NO: 38146 - DNA, 23 bp, synthetic construct
  misc_feature 1..23: note = Synthetic Construct
  source 1..23: mol_type = other DNA
ggacagtgtgggaatggaactca

SEQ ID NO: 38147 - DNA, 22 bp, synthetic construct
  misc_feature 1..22: note = Synthetic Construct
  source 1..22: mol_type = other DNA
cccgcatttacgcgtggatttc

SEQ ID NO: 38148 - DNA, 21 bp, synthetic construct
  misc_feature 1..21: note = Synthetic Construct
  source 1..21: mol_type = other DNA
gtgcagagttcccagtgctat

SEQ ID NO: 38149 - DNA, 18 bp, synthetic construct
  misc_feature 1..18: note = Synthetic Construct
  source 1..18: mol_type = other DNA
tggctccgtcacctctgt

SEQ ID NO: 38150 - DNA, 20 bp, synthetic construct
  misc_feature 1..20: note = Synthetic Construct
  source 1..20: mol_type = other DNA
taccaggacaggcagtgaca

SEQ ID NO: 38151 - DNA, 21 bp, synthetic construct
  misc_feature 1..21: note = Synthetic Construct
  source 1..21: mol_type = other DNA
ccagttccaagcctggcctta

SEQ ID NO: 38152 - DNA, 23 bp, synthetic construct
  misc_feature 1..23: note = Synthetic Construct
  source 1..23: mol_type = other DNA
gtgtgtgtccattctccccttag

SEQ ID NO: 38153 - DNA, 21 bp, synthetic construct
  misc_feature 1..21: note = Synthetic Construct
  source 1..21: mol_type = other DNA
tggtggcaacagacccagact

SEQ ID NO: 38154 - DNA, 26 bp, synthetic construct
  misc_feature 1..26: note = Synthetic Construct
  source 1..26: mol_type = other DNA
ggaacatgcagcagcctcatattttg

SEQ ID NO: 38155 - DNA, 27 bp, synthetic construct
  misc_feature 1..27: note = Synthetic Construct
  source 1..27: mol_type = other DNA
ggaggaaaaataagaaccagacactga

SEQ ID NO: 38156 - DNA, 20 bp, synthetic construct
  misc_feature 1..20: note = Synthetic Construct
  source 1..20: mol_type = other DNA
cgcggaaaaccagtgcagtt

SEQ ID NO: 38157 - DNA, 25 bp, synthetic construct
  misc_feature 1..25: note = Synthetic Construct
  source 1..25: mol_type = other DNA
gctctggagtccttgttctggaaag

SEQ ID NO: 38158 - DNA, 23 bp, synthetic construct
  misc_feature 1..23: note = Synthetic Construct
  source 1..23: mol_type = other DNA
gctatttgatggcattgctcctt

SEQ ID NO: 38159 - DNA, 24 bp, synthetic construct
  misc_feature 1..24: note = Synthetic Construct
  source 1..24: mol_type = other DNA
tcaataatcaggctctgggaggaa

SEQ ID NO: 38160 - DNA, 21 bp, synthetic construct
  misc_feature 1..21: note = Synthetic Construct
  source 1..21: mol_type = other DNA
agaccatccaggggctagtgt

SEQ ID NO: 38161 - DNA, 20 bp, synthetic construct
  misc_feature 1..20: note = Synthetic Construct
  source 1..20: mol_type = other DNA
gtgtgttggggacacagcaa

SEQ ID NO: 38162 - DNA, 29 bp, synthetic construct
  misc_feature 1..29: note = Synthetic Construct
  source 1..29: mol_type = other DNA
ggctttttaacaggtagaactggtgtgtt

SEQ ID NO: 38163 - DNA, 26 bp, synthetic construct
  misc_feature 1..26: note = Synthetic Construct
  source 1..26: mol_type = other DNA
ctctgtatctggtcttgtcaggagtt

SEQ ID NO: 38164 - DNA, 22 bp, synthetic construct
  misc_feature 1..22: note = Synthetic Construct
  source 1..22: mol_type = other DNA
gctcccgtggtcatctgtgttt

SEQ ID NO: 38165 - DNA, 21 bp, synthetic construct
  misc_feature 1..21: note = Synthetic Construct
  source 1..21: mol_type = other DNA
tacccctggcggctgcttgta

SEQ ID NO: 38166 - DNA, 24 bp, synthetic construct
  misc_feature 1..24: note = Synthetic Construct
  source 1..24: mol_type = other DNA
ggtcagggtaggaggtcaatgtca

SEQ ID NO: 38167 - DNA, 25 bp, synthetic construct
  misc_feature 1..25: note = Synthetic Construct
  source 1..25: mol_type = other DNA
ccatgttcccctttggactagagtt

SEQ ID NO: 38168 - DNA, 20 bp, synthetic construct
  misc_feature 1..20: note = Synthetic Construct
  source 1..20: mol_type = other DNA
cctccgtgaccccagaaaga

SEQ ID NO: 38169 - DNA, 26 bp, synthetic construct
  misc_feature 1..26: note = Synthetic Construct
  source 1..26: mol_type = other DNA
cccaccagatttcttccttcctgaga

SEQ ID NO: 38170 - DNA, 20 bp, synthetic construct
  misc_feature 1..20: note = Synthetic Construct
  source 1..20: mol_type = other DNA
cagcttgtcgctggagcaat

SEQ ID NO: 38171 - DNA, 21 bp, synthetic construct
  misc_feature 1..21: note = Synthetic Construct
  source 1..21: mol_type = other DNA
cccagccccaggtttacaaca

SEQ ID NO: 38172 - DNA, 26 bp, synthetic construct
  misc_feature 1..26: note = Synthetic Construct
  source 1..26: mol_type = other DNA
gctggagtttcaattggcatggaagt

SEQ ID NO: 38173 - DNA, 21 bp, synthetic construct
  misc_feature 1..21: note = Synthetic Construct
  source 1..21: mol_type = other DNA
ggctttggcagcagtgataag

SEQ ID NO: 38174 - DNA, 21 bp, synthetic construct
  misc_feature 1..21: note = Synthetic Construct
  source 1..21: mol_type = other DNA
aggagacgtgggtctgaaaca

SEQ ID NO: 38175 - DNA, 26 bp, synthetic construct
  misc_feature 1..26: note = Synthetic Construct
  source 1..26: mol_type = other DNA
gaccagcctacatttatcaggcaatg

SEQ ID NO: 38176 - DNA, 20 bp, synthetic construct
  misc_feature 1..20: note = Synthetic Construct
  source 1..20: mol_type = other DNA
cctgtcagcccctccttcat

SEQ ID NO: 38177 - DNA, 23 bp, synthetic construct
  misc_feature 1..23: note = Synthetic Construct
  source 1..23: mol_type = other DNA
gggccaggcagattcagagattg

SEQ ID NO: 38178 - DNA, 23 bp, synthetic construct
  misc_feature 1..23: note = Synthetic Construct
  source 1..23: mol_type = other DNA
gaccaagttgccatcatctcttg

SEQ ID NO: 38179 - DNA, 22 bp, synthetic construct
  misc_feature 1..22: note = Synthetic Construct
  source 1..22: mol_type = other DNA
accctccaggcactagaagtga

SEQ ID NO: 38180 - DNA, 20 bp, synthetic construct
  misc_feature 1..20: note = Synthetic Construct
  source 1..20: mol_type = other DNA
acccgacagctcaggtcaat

SEQ ID NO: 38181 - DNA, 18 bp, synthetic construct
  misc_feature 1..18: note = Synthetic Construct
  source 1..18: mol_type = other DNA
tgcgccctgcctctaaac

SEQ ID NO: 38182 - DNA, 22 bp, synthetic construct
  misc_feature 1..22: note = Synthetic Construct
  source 1..22: mol_type = other DNA
cctctctgtaatgccccactgt

SEQ ID NO: 38183 - DNA, 20 bp, synthetic construct
  misc_feature 1..20: note = Synthetic Construct
  source 1..20: mol_type = other DNA
ggttgcctcttgccagttca

SEQ ID NO: 38184 - DNA, 22 bp, synthetic construct
  misc_feature 1..22: note = Synthetic Construct
  source 1..22: mol_type = other DNA
cagggaggagcaacacagttca

SEQ ID NO: 38185 - DNA, 21 bp, synthetic construct
  misc_feature 1..21: note = Synthetic Construct
  source 1..21: mol_type = other DNA
tcaaccactgtcggtcaggat

SEQ ID NO: 38186 - DNA, 20 bp, synthetic construct
  misc_feature 1..20: note = Synthetic Construct
  source 1..20: mol_type = other DNA
ttcacgccactggtctctca

SEQ ID NO: 38187 - DNA, 23 bp, synthetic construct
  misc_feature 1..23: note = Synthetic Construct
  source 1..23: mol_type = other DNA
atcacctaaagcagcatgcaaag

SEQ ID NO: 38188 - DNA, 20 bp, synthetic construct
  misc_feature 1..20: note = Synthetic Construct
  source 1..20: mol_type = other DNA
aagtcatggggcagggagat

SEQ ID NO: 38189 - DNA, 21 bp, synthetic construct
  misc_feature 1..21: note = Synthetic Construct
  source 1..21: mol_type = other DNA
tccaagccaaacgatgactga

SEQ ID NO: 38190 - DNA, 18 bp, synthetic construct
  misc_feature 1..18: note = Synthetic Construct
  source 1..18: mol_type = other DNA
ttgccccaagcagcatca

SEQ ID NO: 38191 - DNA, 26 bp, synthetic construct
  misc_feature 1..26: note = Synthetic Construct
  source 1..26: mol_type = other DNA
gaggcatctataccgtgaagaacttg

SEQ ID NO: 38192 - DNA, 23 bp, synthetic construct
  misc_feature 1..23: note = Synthetic Construct
  source 1..23: mol_type = other DNA
cctgcacacagtctgttggatag

SEQ ID NO: 38193 - DNA, 24 bp, synthetic construct
  misc_feature 1..24: note = Synthetic Construct
  source 1..24: mol_type = other DNA
gccaagcatggaaaccatttgact

SEQ ID NO: 38194 - DNA, 21 bp, synthetic construct
  misc_feature 1..21: note = Synthetic Construct
  source 1..21: mol_type = other DNA
cgtgggagtcgatgacaccat

SEQ ID NO: 38195 - DNA, 22 bp, synthetic construct
  misc_feature 1..22: note = Synthetic Construct
  source 1..22: mol_type = other DNA
ccccagaccagcatacttgtga

SEQ ID NO: 38196 - DNA, 27 bp, synthetic construct
  misc_feature 1..27: note = Synthetic Construct
  source 1..27: mol_type = other DNA
gggctcaccatggatcattatctgtat

SEQ ID NO: 38197 - DNA, 21 bp, synthetic construct
  misc_feature 1..21: note = Synthetic Construct
  source 1..21: mol_type = other DNA
gagggaaagtgacctgtgcaa

SEQ ID NO: 38198 - DNA, 24 bp, synthetic construct
  misc_feature 1..24: note = Synthetic Construct
  source 1..24: mol_type = other DNA
gtctgactgcagagcttgtacttg

SEQ ID NO: 38199 - DNA, 24 bp, synthetic construct
  misc_feature 1..24: note = Synthetic Construct
  source 1..24: mol_type = other DNA
cacttcccaagctaaaggggttga

SEQ ID NO: 38200 - DNA, 19 bp, synthetic construct
  misc_feature 1..19: note = Synthetic Construct
  source 1..19: mol_type = other DNA
agccagcatctgcaactgt

SEQ ID NO: 38201 - DNA, 23 bp, synthetic construct
  misc_feature 1..23: note = Synthetic Construct
  source 1..23: mol_type = other DNA
aagggctttaaccagcctagaag

SEQ ID NO: 38202 - DNA, 22 bp, synthetic construct
  misc_feature 1..22: note = Synthetic Construct
  source 1..22: mol_type = other DNA
cacagtgcacagaaagcacttg

SEQ ID NO: 38203 - DNA, 22 bp, synthetic construct
  misc_feature 1..22: note = Synthetic Construct
  source 1..22: mol_type = other DNA
ttgagaccaaccctgccctttg

SEQ ID NO: 38204 - DNA, 22 bp, synthetic construct
  misc_feature 1..22: note = Synthetic Construct
  source 1..22: mol_type = other DNA
cggctcttcactgctctactgt

SEQ ID NO: 38205 - DNA, 22 bp, synthetic construct
  misc_feature 1..22: note = Synthetic Construct
  source 1..22: mol_type = other DNA
ggaacacacagcctcagagcat

SEQ ID NO: 38206 - DNA, 23 bp, synthetic construct
  misc_feature 1..23: note = Synthetic Construct
  source 1..23: mol_type = other DNA
ctccaaagaacactgcccagtaa

SEQ ID NO: 38207 - DNA, 24 bp, synthetic construct
  misc_feature 1..24: note = Synthetic Construct
  source 1..24: mol_type = other DNA
gcttcctgtaatgggtctaaggtt

SEQ ID NO: 38208 - DNA, 30 bp, synthetic construct
  misc_feature 1..30: note = Synthetic Construct
  source 1..30: mol_type = other DNA
gcaaggaagtaattagatcactggggtgta

SEQ ID NO: 38209 - DNA, 23 bp, synthetic construct
  misc_feature 1..23: note = Synthetic Construct
  source 1..23: mol_type = other DNA
gtgggttgttgtaaagccacgat

SEQ ID NO: 38210 - DNA, 22 bp, synthetic construct
  misc_feature 1..22: note = Synthetic Construct
  source 1..22: mol_type = other DNA
cgaacccacacttctcttctga

SEQ ID NO: 38211 - DNA, 23 bp, synthetic construct
  misc_feature 1..23: note = Synthetic Construct
  source 1..23: mol_type = other DNA
gaatcagaatgggagaggcgtat

SEQ ID NO: 38212 - DNA, 22 bp, synthetic construct
  misc_feature 1..22: note = Synthetic Construct
  source 1..22: mol_type = other DNA
cggccttagccatgggaaatca

SEQ ID NO: 38213 - DNA, 24 bp, synthetic construct
  misc_feature 1..24: note = Synthetic Construct
  source 1..24: mol_type = other DNA
gtggggagacctgctatcttctac

SEQ ID NO: 38214 - DNA, 23 bp, synthetic construct
  misc_feature 1..23: note = Synthetic Construct
  source 1..23: mol_type = other DNA
gccaggatggtggatgatggtaa

SEQ ID NO: 38215 - DNA, 23 bp, synthetic construct
  misc_feature 1..23: note = Synthetic Construct
  source 1..23: mol_type = other DNA
cctctttggtgactcagggattc

SEQ ID NO: 38216 - DNA, 22 bp, synthetic construct
  misc_feature 1..22: note = Synthetic Construct
  source 1..22: mol_type = other DNA
ggcttcaagagcttccctgttg

SEQ ID NO: 38217 - DNA, 21 bp, synthetic construct
  misc_feature 1..21: note = Synthetic Construct
  source 1..21: mol_type = other DNA
gaccttgctgaacggttcctt

SEQ ID NO: 38218 - DNA, 22 bp, synthetic construct
  misc_feature 1..22: note = Synthetic Construct
  source 1..22: mol_type = other DNA
tggaaacgggtgtgagagtttg

SEQ ID NO: 38219 - DNA, 24 bp, synthetic construct
  misc_feature 1..24: note = Synthetic Construct
  source 1..24: mol_type = other DNA
aggcagaattgacgttcatcctat

SEQ ID NO: 38220 - DNA, 23 bp, synthetic construct
  misc_feature 1..23: note = Synthetic Construct
  source 1..23: mol_type = other DNA
gtggttcacagcgtgatctgact

SEQ ID NO: 38221 - DNA, 21 bp, synthetic construct
  misc_feature 1..21: note = Synthetic Construct
  source 1..21: mol_type = other DNA
gcagagcgaggtcacctttga

SEQ ID NO: 38222 - DNA, 20 bp, synthetic construct
  misc_feature 1..20: note = Synthetic Construct
  source 1..20: mol_type = other DNA
tcagtgggctggatggtagt

SEQ ID NO: 38223 - DNA, 20 bp, synthetic construct
  misc_feature 1..20: note = Synthetic Construct
  source 1..20: mol_type = other DNA
aggccaaatcctggctcaag

SEQ ID NO: 38224 - DNA, 21 bp, synthetic construct
  misc_feature 1..21: note = Synthetic Construct
  source 1..21: mol_type = other DNA
tgttgctgtctggcaagatgt

SEQ ID NO: 38225 - DNA, 20 bp, synthetic construct
  misc_feature 1..20: note = Synthetic Construct
  source 1..20: mol_type = other DNA
tggcttggggcagggaggta

SEQ ID NO: 38226 - DNA, 27 bp, synthetic construct
  misc_feature 1..27: note = Synthetic Construct
  source 1..27: mol_type = other DNA
ctaattgtgttccatacctccactact

SEQ ID NO: 38227 - DNA, 24 bp, synthetic construct
  misc_feature 1..24: note = Synthetic Construct
  source 1..24: mol_type = other DNA
agtgcagagagcaaatttcaggat

SEQ ID NO: 38228 - DNA, 20 bp, synthetic construct
  misc_feature 1..20: note = Synthetic Construct
  source 1..20: mol_type = other DNA
aaggcctgacttggccattg

SEQ ID NO: 38229 - DNA, 23 bp, synthetic construct
  misc_feature 1..23: note = Synthetic Construct
  source 1..23: mol_type = other DNA
tctttgttcaaaacgcccagaac

SEQ ID NO: 38230 - DNA, 22 bp, synthetic construct
  misc_feature 1..22: note = Synthetic Construct
  source 1..22: mol_type = other DNA
cacaatctcagcccctggcttt

SEQ ID NO: 38231 - DNA, 20 bp, synthetic construct
  misc_feature 1..20: note = Synthetic Construct
  source 1..20: mol_type = other DNA
cccaaggtgccaagctcatt

SEQ ID NO: 38232 - DNA, 25 bp, synthetic construct
  misc_feature 1..25: note = Synthetic Construct
  source 1..25: mol_type = other DNA
tgatgacagaggagtaaaggtctct

SEQ ID NO: 38233 - DNA, 23 bp, synthetic construct
  misc_feature 1..23: note = Synthetic Construct
  source 1..23: mol_type = other DNA
ggtgcatgcaaagagtgggatag

SEQ ID NO: 38234 - DNA, 22 bp, synthetic construct
  misc_feature 1..22: note = Synthetic Construct
  source 1..22: mol_type = other DNA
ctcagcccttccaccttcttct

SEQ ID NO: 38235 - DNA, 21 bp, synthetic construct
  misc_feature 1..21: note = Synthetic Construct
  source 1..21: mol_type = other DNA
cccatcccgaatcccaccttt

SEQ ID NO: 38236 - DNA, 23 bp, synthetic construct
  misc_feature 1..23: note = Synthetic Construct
  source 1..23: mol_type = other DNA
tgggagtacctggatccccttag

SEQ ID NO: 38237 - DNA, 22 bp, synthetic construct
  misc_feature 1..22: note = Synthetic Construct
  source 1..22: mol_type = other DNA
ggcacacgatgaaagggataga

SEQ ID NO: 38238 - DNA, 22 bp, synthetic construct
  misc_feature 1..22: note = Synthetic Construct
  source 1..22: mol_type = other DNA
aggaccacagcagcttcgattc

SEQ ID NO: 38239 - DNA, 22 bp, synthetic construct
  misc_feature 1..22: note = Synthetic Construct
  source 1..22: mol_type = other DNA
gtccagaaggcaggaaccatac

SEQ ID NO: 38240 - DNA, 20 bp, synthetic construct
  misc_feature 1..20: note = Synthetic Construct
  source 1..20: mol_type = other DNA
tcagggtgccctagctccat

SEQ ID NO: 38241 - DNA, 20 bp, synthetic construct
  misc_feature 1..20: note = Synthetic Construct
  source 1..20: mol_type = other DNA
cccaaccacagcagcctttg

SEQ ID NO: 38242 - DNA, 22 bp, synthetic construct
  misc_feature 1..22: note = Synthetic Construct
  source 1..22: mol_type = other DNA
aggttccctgccttagggatga

SEQ ID NO: 38243 - DNA, 22 bp, synthetic construct
  misc_feature 1..22: note = Synthetic Construct
  source 1..22: mol_type = other DNA
aatcctccctcccctgcatcta

SEQ ID NO: 38244 - DNA, 28 bp, synthetic construct
  misc_feature 1..28: note = Synthetic Construct
  source 1..28: mol_type = other DNA
ccatcctatatgtcaggtgcaagacaac

SEQ ID NO: 38245 - DNA, 23 bp, synthetic construct
  misc_feature 1..23: note = Synthetic Construct
  source 1..23: mol_type = other DNA
ggaggtagcagcatttacctgtt

SEQ ID NO: 38246 - DNA, 19 bp, synthetic construct
  misc_feature 1..19: note = Synthetic Construct
  source 1..19: mol_type = other DNA
tctccagccgagggtctca

SEQ ID NO: 38247 - DNA, 28 bp, synthetic construct
  misc_feature 1..28: note = Synthetic Construct
  source 1..28: mol_type = other DNA
gggagtgtaattcagggagtgtaattct

SEQ ID NO: 38248 - DNA, 22 bp, synthetic construct
  misc_feature 1..22: note = Synthetic Construct
  source 1..22: mol_type = other DNA
tggtcagctccggctctaaatc

SEQ ID NO: 38249 - DNA, 23 bp, synthetic construct
  misc_feature 1..23: note = Synthetic Construct
  source 1..23: mol_type = other DNA
taccgtcctccctgctaggaaca

SEQ ID NO: 38250 - DNA, 26 bp, synthetic construct
  misc_feature 1..26: note = Synthetic Construct
  source 1..26: mol_type = other DNA
ccactgcagtttacagtgtgaagcat

SEQ ID NO: 38251 - DNA, 22 bp, synthetic construct
  misc_feature 1..22: note = Synthetic Construct
  source 1..22: mol_type = other DNA
gcctggggaatgctactgattg

SEQ ID NO: 38252 - DNA, 24 bp, synthetic construct
  misc_feature 1..24: note = Synthetic Construct
  source 1..24: mol_type = other DNA
ggacaaggactgtgtagagagaac

SEQ ID NO: 38253 - DNA, 21 bp, synthetic construct
  misc_feature 1..21: note = Synthetic Construct
  source 1..21: mol_type = other DNA
tgtggtgtccagcccttcact

SEQ ID NO: 38254 - DNA, 21 bp, synthetic construct
  misc_feature 1..21: note = Synthetic Construct
  source 1..21: mol_type = other DNA
gtgtgtccgagcacattgttg

SEQ ID NO: 38255 - DNA, 22 bp, synthetic construct
  misc_feature 1..22: note = Synthetic Construct
  source 1..22: mol_type = other DNA
ggggcacgtggagtttctcatt

SEQ ID NO: 38256 - DNA, 24 bp, synthetic construct
  misc_feature 1..24: note = Synthetic Construct
  source 1..24: mol_type = other DNA
tgtagtgatggtgtttgtgacctt

SEQ ID NO: 38257 - DNA, 22 bp, synthetic construct
  misc_feature 1..22: note = Synthetic Construct
  source 1..22: mol_type = other DNA
ggagggcacaaaactgccttct

SEQ ID NO: 38258 - DNA, 20 bp, synthetic construct
  misc_feature 1..20: note = Synthetic Construct
  source 1..20: mol_type = other DNA
ttagcaggaggtgggtgagt

SEQ ID NO: 38259 - DNA, 20 bp, synthetic construct
  misc_feature 1..20: note = Synthetic Construct
  source 1..20: mol_type = other DNA
aactggaggtggggatggaa

SEQ ID NO: 38260 - DNA, 22 bp, synthetic construct
  misc_feature 1..22: note = Synthetic Construct
  source 1..22: mol_type = other DNA
atgctacccctggccctctgta

SEQ ID NO: 38261 - DNA, 19 bp, synthetic construct
  misc_feature 1..19: note = Synthetic Construct
  source 1..19: mol_type = other DNA
tccctctggccctgtggtt

SEQ ID NO: 38262 - DNA, 20 bp, synthetic construct
  misc_feature 1..20: note = Synthetic Construct
  source 1..20: mol_type = other DNA
gctgcatcttcacgcctaca

SEQ ID NO: 38263 - DNA, 26 bp, synthetic construct
  misc_feature 1..26: note = Synthetic Construct
  source 1..26: mol_type = other DNA
gcccagttttagggaccaaagaccat

SEQ ID NO: 38264 - DNA, 27 bp, synthetic construct
  misc_feature 1..27: note = Synthetic Construct
  source 1..27: mol_type = other DNA
gagttggtctccagagaatacttcctt

SEQ ID NO: 38265 - DNA, 20 bp, synthetic construct
  misc_feature 1..20: note = Synthetic Construct
  source 1..20: mol_type = other DNA
acctccagagcccacactct

SEQ ID NO: 38266 - DNA, 23 bp, synthetic construct
  misc_feature 1..23: note = Synthetic Construct
  source 1..23: mol_type = other DNA
gggagacttcgttgtgggacaag

SEQ ID NO: 38267 - DNA, 22 bp, synthetic construct
  misc_feature 1..22: note = Synthetic Construct
  source 1..22: mol_type = other DNA
ccggcccctttaaggaagaagt

SEQ ID NO: 38268 - DNA, 24 bp, synthetic construct
  misc_feature 1..24: note = Synthetic Construct
  source 1..24: mol_type = other DNA
gggaacaggtgtcctttccaggtt

SEQ ID NO: 38269 - DNA, 22 bp, synthetic construct
  misc_feature 1..22: note = Synthetic Construct
  source 1..22: mol_type = other DNA
ccagcaacttaggctggactca

SEQ ID NO: 38270 - DNA, 25 bp, synthetic construct
  misc_feature 1..25: note = Synthetic Construct
  source 1..25: mol_type = other DNA
cctccttatgccactgtgtcccaat

SEQ ID NO: 38271 - DNA, 21 bp, synthetic construct
  misc_feature 1..21: note = Synthetic Construct
  source 1..21: mol_type = other DNA
tccgaggcaggcaactctaca

SEQ ID NO: 38272 - DNA, 30 bp, synthetic construct
  misc_feature 1..30: note = Synthetic Construct
  source 1..30: mol_type = other DNA
gactccataataaaagtgggtggtttgcta

SEQ ID NO: 38273 - DNA, 19 bp, synthetic construct
  misc_feature 1..19: note = Synthetic Construct
  source 1..19: mol_type = other DNA
gaggagctgcccacaccta

SEQ ID NO: 38274 - DNA, 20 bp, synthetic construct
  misc_feature 1..20: note = Synthetic Construct
  source 1..20: mol_type = other DNA
agctcccgctggctctgtct

SEQ ID NO: 38275 - DNA, 20 bp, synthetic construct
  misc_feature 1..20: note = Synthetic Construct
  source 1..20: mol_type = other DNA
ggaggcagcaccctttttga

SEQ ID NO: 38276 - DNA, 22 bp, synthetic construct
  misc_feature 1..22: note = Synthetic Construct
  source 1..22: mol_type = other DNA
tgtctccctgttcccagtgtca

SEQ ID NO: 38277 - DNA, 19 bp, synthetic construct
  misc_feature 1..19: note = Synthetic Construct
  source 1..19: mol_type = other DNA
caacacccctcccctgagt

SEQ ID NO: 38278 - DNA, 23 bp, synthetic construct
  misc_feature 1..23: note = Synthetic Construct
  source 1..23: mol_type = other DNA
gggacagatgggatgaaaacaca

SEQ ID NO: 38279 - DNA, 24 bp, synthetic construct
  misc_feature 1..24: note = Synthetic Construct
  source 1..24: mol_type = other DNA
tcagaggatgaaggggacattttc

SEQ ID NO: 38280 - DNA, 20 bp, synthetic construct
  misc_feature 1..20: note = Synthetic Construct
  source 1..20: mol_type = other DNA
gggtcctgtgtgggaacctt

SEQ ID NO: 38281 - DNA, 20 bp, synthetic construct
  misc_feature 1..20: note = Synthetic Construct
  source 1..20: mol_type = other DNA
cgcatttggtggctctctgt

SEQ ID NO: 38282 - DNA, 23 bp, synthetic construct
  misc_feature 1..23: note = Synthetic Construct
  source 1..23: mol_type = other DNA
cctaaatgcatgggaggcaggaa

SEQ ID NO: 38283 - DNA, 25 bp, synthetic construct
  misc_feature 1..25: note = Synthetic Construct
  source 1..25: mol_type = other DNA
agtacaatggatctgtcgtttggaa

SEQ ID NO: 38284 - DNA, 22 bp, synthetic construct
  misc_feature 1..22: note = Synthetic Construct
  source 1..22: mol_type = other DNA
gcctccactccagaaagagaga

SEQ ID NO: 38285 - DNA, 19 bp, synthetic construct
  misc_feature 1..19: note = Synthetic Construct
  source 1..19: mol_type = other DNA
ccaccacctctgggcaaca

SEQ ID NO: 38286 - DNA, 20 bp, synthetic construct
  misc_feature 1..20: note = Synthetic Construct
  source 1..20: mol_type = other DNA
tctctggggcagctgaagtt

SEQ ID NO: 38287 - DNA, 20 bp, synthetic construct
  misc_feature 1..20: note = Synthetic Construct
  source 1..20: mol_type = other DNA
cccaaagtgctgggccatag

SEQ ID NO: 38288 - DNA, 25 bp, synthetic construct
  misc_feature 1..25: note = Synthetic Construct
  source 1..25: mol_type = other DNA
ccttttgagaaccagctcaaatgtt

SEQ ID NO: 38289 - DNA, 23 bp, synthetic construct
  misc_feature 1..23: note = Synthetic Construct
  source 1..23: mol_type = other DNA
agagaggactttgggaacacaga

SEQ ID NO: 38290 - DNA, 20 bp, synthetic construct
  misc_feature 1..20: note = Synthetic Construct
  source 1..20: mol_type = other DNA
tctgtctggaagcgggtgaa

SEQ ID NO: 38291 - DNA, 22 bp, synthetic construct
  misc_feature 1..22: note = Synthetic Construct
  source 1..22: mol_type = other DNA
cacatcaaagccctgctgtagt

SEQ ID NO: 38292 - DNA, 26 bp, synthetic construct
  misc_feature 1..26: note = Synthetic Construct
  source 1..26: mol_type = other DNA
ctggggcaaaagactgattttcttca

SEQ ID NO: 38293 - DNA, 20 bp, synthetic construct
  misc_feature 1..20: note = Synthetic Construct
  source 1..20: mol_type = other DNA
gcaccttggggtgtgcttgt

SEQ ID NO: 38294 - DNA, 22 bp, synthetic construct
  misc_feature 1..22: note = Synthetic Construct
  source 1..22: mol_type = other DNA
ggcagacgccactttctactca

SEQ ID NO: 38295 - DNA, 20 bp, synthetic construct
  misc_feature 1..20: note = Synthetic Construct
  source 1..20: mol_type = other DNA
ttgggacgggtctcccactt

SEQ ID NO: 38296 - DNA, 22 bp, synthetic construct
  misc_feature 1..22: note = Synthetic Construct
  source 1..22: mol_type = other DNA
acagaaagccctgcagctctac

SEQ ID NO: 38297 - DNA, 22 bp, synthetic construct
  misc_feature 1..22: note = Synthetic Construct
  source 1..22: mol_type = other DNA
gcatgccccaaggtagacagtt

SEQ ID NO: 38298 - DNA, 21 bp, synthetic construct
  misc_feature 1..21: note = Synthetic Construct
  source 1..21: mol_type = other DNA
gtgcatggtggttccaagtga

SEQ ID NO: 38299 - DNA, 23 bp, synthetic construct
  misc_feature 1..23: note = Synthetic Construct
  source 1..23: mol_type = other DNA
ggtttcatgactccctggtccaa

SEQ ID NO: 38300 - DNA, 18 bp, synthetic construct
  misc_feature 1..18: note = Synthetic Construct
  source 1..18: mol_type = other DNA
tgagccaggcaggtgcta

SEQ ID NO: 38301 - DNA, 21 bp, synthetic construct
  misc_feature 1..21: note = Synthetic Construct
  source 1..21: mol_type = other DNA
ttgccccagaatcacacaagt

SEQ ID NO: 38302 - DNA, 23 bp, synthetic construct
  misc_feature 1..23: note = Synthetic Construct
  source 1..23: mol_type = other DNA
gtccccacacatcctctttgttg

SEQ ID NO: 38303 - DNA, 19 bp, synthetic construct
  misc_feature 1..19: note = Synthetic Construct
  source 1..19: mol_type = other DNA
cctccccagccccaaacta

SEQ ID NO: 38304 - DNA, 24 bp, synthetic construct
  misc_feature 1..24: note = Synthetic Construct
  source 1..24: mol_type = other DNA
agagataggaccacacaccattga

SEQ ID NO: 38305 - DNA, 20 bp, synthetic construct
  misc_feature 1..20: note = Synthetic Construct
  source 1..20: mol_type = other DNA
tggtggggtcagtggttaga

SEQ ID NO: 38306 - DNA, 19 bp, synthetic construct
  misc_feature 1..19: note = Synthetic Construct
  source 1..19: mol_type = other DNA
gcagcgagtcctccgtgta

SEQ ID NO: 38307 - DNA, 19 bp, synthetic construct
  misc_feature 1..19: note = Synthetic Construct
  source 1..19: mol_type = other DNA
caggcccagtgggaagttg

SEQ ID NO: 38308 - DNA, 24 bp, synthetic construct
  misc_feature 1..24: note = Synthetic Construct
  source 1..24: mol_type = other DNA
caccaggactagcactagaaggaa

SEQ ID NO: 38309 - DNA, 21 bp, synthetic construct
  misc_feature 1..21: note = Synthetic Construct
  source 1..21: mol_type = other DNA
tcaccccagcctgacacttct

SEQ ID NO: 38310 - DNA, 22 bp, synthetic construct
  misc_feature 1..22: note = Synthetic Construct
  source 1..22: mol_type = other DNA
gacgacgcacaacatcttgcat

SEQ ID NO: 38311 - DNA, 24 bp, synthetic construct
  misc_feature 1..24: note = Synthetic Construct
  source 1..24: mol_type = other DNA
ccacctatgtgccaggaagctttg

SEQ ID NO: 38312 - DNA, 21 bp, synthetic construct
  misc_feature 1..21: note = Synthetic Construct
  source 1..21: mol_type = other DNA
gggattgtcccaaagcggaaa

SEQ ID NO: 38313 - DNA, 25 bp, synthetic construct
  misc_feature 1..25: note = Synthetic Construct
  source 1..25: mol_type = other DNA
ttccctgcattgttactactcagtt

SEQ ID NO: 38314 - DNA, 20 bp, synthetic construct
  misc_feature 1..20: note = Synthetic Construct
  source 1..20: mol_type = other DNA
ggcatggcagtgagaagcat

SEQ ID NO: 38315 - DNA, 20 bp, synthetic construct
  misc_feature 1..20: note = Synthetic Construct
  source 1..20: mol_type = other DNA
agccaacaccaccggaagat

SEQ ID NO: 38316 - DNA, 23 bp, synthetic construct
  misc_feature 1..23: note = Synthetic Construct
  source 1..23: mol_type = other DNA
gcagtcctgtcctcttggtcttc

SEQ ID NO: 38317 - DNA, 22 bp, synthetic construct
  misc_feature 1..22: note = Synthetic Construct
  source 1..22: mol_type = other DNA
gccaaggccgaggtgctaaaaa

SEQ ID NO: 38318 - DNA, 20 bp, synthetic construct
  misc_feature 1..20: note = Synthetic Construct
  source 1..20: mol_type = other DNA
accaccccgcttgaaaccta

SEQ ID NO: 38319 - DNA, 22 bp, synthetic construct
  misc_feature 1..22: note = Synthetic Construct
  source 1..22: mol_type = other DNA
ggggtgaattccagctctgaca

SEQ ID NO: 38320 - DNA, 22 bp, synthetic construct
  misc_feature 1..22: note = Synthetic Construct
  source 1..22: mol_type = other DNA
gcaaactgaggctggacgactt

SEQ ID NO: 38321 - DNA, 23 bp, synthetic construct
  misc_feature 1..23: note = Synthetic Construct
  source 1..23: mol_type = other DNA
ccctcaagcatggatgcacagtt

SEQ ID NO: 38322 - DNA, 24 bp, synthetic construct
  misc_feature 1..24: note = Synthetic Construct
  source 1..24: mol_type = other DNA
gccccacctatcagccagacttta

SEQ ID NO: 38323 - DNA, 19 bp, synthetic construct
  misc_feature 1..19: note = Synthetic Construct
  source 1..19: mol_type = other DNA
tggtctccaccgtgctttg

SEQ ID NO: 38324 - DNA, 19 bp, synthetic construct
  misc_feature 1..19: note = Synthetic Construct
  source 1..19: mol_type = other DNA
tgtctgccagcgctgttgt

SEQ ID NO: 38325 - DNA, 21 bp, synthetic construct
  misc_feature 1..21: note = Synthetic Construct
  source 1..21: mol_type = other DNA
caaccatgtccccaacccttt

SEQ ID NO: 38326 - DNA, 22 bp, synthetic construct
  misc_feature 1..22: note = Synthetic Construct
  source 1..22: mol_type = other DNA
gaggccacactctcagattcaa

SEQ ID NO: 38327 - DNA, 22 bp, synthetic construct
  misc_feature 1..22: note = Synthetic Construct
  source 1..22: mol_type = other DNA
gttggcctcaaacaccttcact

SEQ ID NO: 38328 - DNA, 23 bp, synthetic construct
  misc_feature 1..23: note = Synthetic Construct
  source 1..23: mol_type = other DNA
gagtcacgccacctaatccattc

SEQ ID NO: 38329 - DNA, 18 bp, synthetic construct
  misc_feature 1..18: note = Synthetic Construct
  source 1..18: mol_type = other DNA
agcccgtctccccatgtt

SEQ ID NO: 38330 - DNA, 24 bp, synthetic construct
  misc_feature 1..24: note = Synthetic Construct
  source 1..24: mol_type = other DNA
cccctctaggaagtcctgctttca

SEQ ID NO: 38331 - DNA, 22 bp, synthetic construct
  misc_feature 1..22: note = Synthetic Construct
  source 1..22: mol_type = other DNA
cgcatgcaagagactggttttg

SEQ ID NO: 38332 - DNA, 20 bp, synthetic construct
  misc_feature 1..20: note = Synthetic Construct
  source 1..20: mol_type = other DNA
ggacctgaaggccccaatct

SEQ ID NO: 38333 - DNA, 25 bp, synthetic construct
  misc_feature 1..25: note = Synthetic Construct
  source 1..25: mol_type = other DNA
ccaagggaactaacttctggctagt

SEQ ID NO: 38334 - DNA, 23 bp, synthetic construct
  misc_feature 1..23: note = Synthetic Construct
  source 1..23: mol_type = other DNA
gcagagctcaggtctcaccaatg

SEQ ID NO: 38335 - DNA, 24 bp, synthetic construct
  misc_feature 1..24: note = Synthetic Construct
  source 1..24: mol_type = other DNA
ctgctgaaggttagcctcctctta

SEQ ID NO: 38336 - DNA, 22 bp, synthetic construct
  misc_feature 1..22: note = Synthetic Construct
  source 1..22: mol_type = other DNA
ggaagtcaaacggccaaacgaa

SEQ ID NO: 38337 - DNA, 24 bp, synthetic construct
  misc_feature 1..24: note = Synthetic Construct
  source 1..24: mol_type = other DNA
cccgcacagtttaaacattcatct

SEQ ID NO: 38338 - DNA, 23 bp, synthetic construct
  misc_feature 1..23: note = Synthetic Construct
  source 1..23: mol_type = other DNA
gccctgtgcactgatgagacaaa

SEQ ID NO: 38339 - DNA, 19 bp, synthetic construct
  misc_feature 1..19: note = Synthetic Construct
  source 1..19: mol_type = other DNA
tgcccctggcgggatacat

SEQ ID NO: 38340 - DNA, 22 bp, synthetic construct
  misc_feature 1..22: note = Synthetic Construct
  source 1..22: mol_type = other DNA
caggagaggaaaactgctgact

SEQ ID NO: 38341 - DNA, 22 bp, synthetic construct
  misc_feature 1..22: note = Synthetic Construct
  source 1..22: mol_type = other DNA
gacagagtgagacacccacttc

SEQ ID NO: 38342 - DNA, 22 bp, synthetic construct
  misc_feature 1..22: note = Synthetic Construct
  source 1..22: mol_type = other DNA
tcgaaggctacctctgccatca

SEQ ID NO: 38343 - DNA, 25 bp, synthetic construct
  misc_feature 1..25: note = Synthetic Construct
  source 1..25: mol_type = other DNA
tgtgatgacgagtaagtgaggaaga

SEQ ID NO: 38344 - DNA, 22 bp, synthetic construct
  misc_feature 1..22: note = Synthetic Construct
  source 1..22: mol_type = other DNA
gcctaaccttggccttgacaca

SEQ ID NO: 38345 - DNA, 20 bp, synthetic construct
  misc_feature 1..20: note = Synthetic Construct
  source 1..20: mol_type = other DNA
gcctgggaatcatggcaact

SEQ ID NO: 38346 - DNA, 21 bp, synthetic construct
  misc_feature 1..21: note = Synthetic Construct
  source 1..21: mol_type = other DNA
gccgcccttgacccattgtat

SEQ ID NO: 38347 - DNA, 25 bp, synthetic construct
  misc_feature 1..25: note = Synthetic Construct
  source 1..25: mol_type = other DNA
ggcgtatgaattggagtcagtaagt

SEQ ID NO: 38348 - DNA, 24 bp, synthetic construct
  misc_feature 1..24: note = Synthetic Construct
  source 1..24: mol_type = other DNA
caggcaccaagtacattcatcagt

SEQ ID NO: 38349 - DNA, 22 bp, synthetic construct
  misc_feature 1..22: note = Synthetic Construct
  source 1..22: mol_type = other DNA
gcatgcagtatgaggggtctac

SEQ ID NO: 38350 - DNA, 20 bp, synthetic construct
  misc_feature 1..20: note = Synthetic Construct
  source 1..20: mol_type = other DNA
tggaaggggcacacaacact

SEQ ID NO: 38351 - DNA, 22 bp, synthetic construct
  misc_feature 1..22: note = Synthetic Construct
  source 1..22: mol_type = other DNA
gctcccatcagtgccaagcaat

SEQ ID NO: 38352 - DNA, 18 bp, synthetic construct
  misc_feature 1..18: note = Synthetic Construct
  source 1..18: mol_type = other DNA
tgggaggctctgcactga

SEQ ID NO: 38353 - DNA, 19 bp, synthetic construct
  misc_feature 1..19: note = Synthetic Construct
  source 1..19: mol_type = other DNA
cgcacacagtgcctgacat

SEQ ID NO: 38354 - DNA, 23 bp, synthetic construct
  misc_feature 1..23: note = Synthetic Construct
  source 1..23: mol_type = other DNA
gccccgtaactgtactggtgaga

SEQ ID NO: 38355 - DNA, 25 bp, synthetic construct
  misc_feature 1..25: note = Synthetic Construct
  source 1..25: mol_type = other DNA
cctccccactattcaagtcccaact

SEQ ID NO: 38356 - DNA, 24 bp, synthetic construct
  misc_feature 1..24: note = Synthetic Construct
  source 1..24: mol_type = other DNA
agcaactaagaaggttccttgaca

SEQ ID NO: 38357 - DNA, 22 bp, synthetic construct
  misc_feature 1..22: note = Synthetic Construct
  source 1..22: mol_type = other DNA
tgctgctccctctgtgtctttc

SEQ ID NO: 38358 - DNA, 27 bp, synthetic construct
  misc_feature 1..27: note = Synthetic Construct
  source 1..27: mol_type = other DNA
ctgaatggaactgaagttaccctgaat

SEQ ID NO: 38359 - DNA, 21 bp, synthetic construct
  misc_feature 1..21: note = Synthetic Construct
  source 1..21: mol_type = other DNA
gaaagcacagatgccccaaag

SEQ ID NO: 38360 - DNA, 19 bp, synthetic construct
  misc_feature 1..19: note = Synthetic Construct
  source 1..19: mol_type = other DNA
ttctctggggccggactga

SEQ ID NO: 38361 - DNA, 21 bp, synthetic construct
  misc_feature 1..21: note = Synthetic Construct
  source 1..21: mol_type = other DNA
cctggtgggatgcctacgttt

SEQ ID NO: 38362 - DNA, 21 bp, synthetic construct
  misc_feature 1..21: note = Synthetic Construct
  source 1..21: mol_type = other DNA
tcggtaggtaggcgtcctaga

SEQ ID NO: 38363 - DNA, 20 bp, synthetic construct
  misc_feature 1..20: note = Synthetic Construct
  source 1..20: mol_type = other DNA
tggcagagctgctggaattg

SEQ ID NO: 38364 - DNA, 21 bp, synthetic construct
  misc_feature 1..21: note = Synthetic Construct
  source 1..21: mol_type = other DNA
gggtgtcttctggtggtcatc

SEQ ID NO: 38365 - DNA, 20 bp, synthetic construct
  misc_feature 1..20: note = Synthetic Construct
  source 1..20: mol_type = other DNA
cgcaggttctcgatgcttgt

SEQ ID NO: 38366 - DNA, 22 bp, synthetic construct
  misc_feature 1..22: note = Synthetic Construct
  source 1..22: mol_type = other DNA
ggtgttttccacttcgggagtt

SEQ ID NO: 38367 - DNA, 23 bp, synthetic construct
  misc_feature 1..23: note = Synthetic Construct
  source 1..23: mol_type = other DNA
gaactttcccatggcttccaaac

SEQ ID NO: 38368 - DNA, 24 bp, synthetic construct
  misc_feature 1..24: note = Synthetic Construct
  source 1..24: mol_type = other DNA
ccgagatctggacttgtgtctatc

SEQ ID NO: 38369 - DNA, 20 bp, synthetic construct
  misc_feature 1..20: note = Synthetic Construct
  source 1..20: mol_type = other DNA
ggaaaggatggggccaggaa

SEQ ID NO: 38370 - DNA, 25 bp, synthetic construct
  misc_feature 1..25: note = Synthetic Construct
  source 1..25: mol_type = other DNA
ccaatgctatgtcgtgtttgattga

SEQ ID NO: 38371 - DNA, 22 bp, synthetic construct
  misc_feature 1..22: note = Synthetic Construct
  source 1..22: mol_type = other DNA
cagctgctaagggaccaagtca

SEQ ID NO: 38372 - DNA, 28 bp, synthetic construct
  misc_feature 1..28: note = Synthetic Construct
  source 1..28: mol_type = other DNA
ggacagctaaatcagagagctatggaaa

SEQ ID NO: 38373 - DNA, 23 bp, synthetic construct
  misc_feature 1..23: note = Synthetic Construct
  source 1..23: mol_type = other DNA
acagtgaatcagcactcctcaga

SEQ ID NO: 38374 - DNA, 25 bp, synthetic construct
  misc_feature 1..25: note = Synthetic Construct
  source 1..25: mol_type = other DNA
actgataccatcttctggaggactt

SEQ ID NO: 38375 - DNA, 22 bp, synthetic construct
  misc_feature 1..22: note = Synthetic Construct
  source 1..22: mol_type = other DNA
ggggtccttactccctttcttg

SEQ ID NO: 38376 - DNA, 19 bp, synthetic construct
  misc_feature 1..19: note = Synthetic Construct
  source 1..19: mol_type = other DNA
aaggggcaaggtgctgaag

SEQ ID NO: 38377 - DNA, 26 bp, synthetic construct
  misc_feature 1..26: note = Synthetic Construct
  source 1..26: mol_type = other DNA
ccattaatccagcagttccttgatac

SEQ ID NO: 38378 - DNA, 20 bp, synthetic construct
  misc_feature 1..20: note = Synthetic Construct
  source 1..20: mol_type = other DNA
tcccagtcagccccttgaga

SEQ ID NO: 38379 - DNA, 22 bp, synthetic construct
  misc_feature 1..22: note = Synthetic Construct
  source 1..22: mol_type = other DNA
tcacctgtcactccgtgtgtag

SEQ ID NO: 38380 - DNA, 25 bp, synthetic construct
  misc_feature 1..25: note = Synthetic Construct
  source 1..25: mol_type = other DNA
tcaatgacatcctagagccactttg

SEQ ID NO: 38381 - DNA, 19 bp, synthetic construct
  misc_feature 1..19: note = Synthetic Construct
  source 1..19: mol_type = other DNA
ggctttgggcctggtggtt

SEQ ID NO: 38382 - DNA, 23 bp, synthetic construct
  misc_feature 1..23: note = Synthetic Construct
  source 1..23: mol_type = other DNA
cccttgcccatctcagttacaag

SEQ ID NO: 38383 - DNA, 22 bp, synthetic construct
  misc_feature 1..22: note = Synthetic Construct
  source 1..22: mol_type = other DNA
cctgcccattcaaccccatctt

SEQ ID NO: 38384 - DNA, 24 bp, synthetic construct
  misc_feature 1..24: note = Synthetic Construct
  source 1..24: mol_type = other DNA
gctcagagagccactgaaggctta

SEQ ID NO: 38385 - DNA, 20 bp, synthetic construct
  misc_feature 1..20: note = Synthetic Construct
  source 1..20: mol_type = other DNA
gtgcccgggataggagactt

SEQ ID NO: 38386 - DNA, 20 bp, synthetic construct
  misc_feature 1..20: note = Synthetic Construct
  source 1..20: mol_type = other DNA
ggcagcagagaccaccagtt

SEQ ID NO: 38387 - DNA, 20 bp, synthetic construct
  misc_feature 1..20: note = Synthetic Construct
  source 1..20: mol_type = other DNA
tggaggtcacctgctgtgaa

SEQ ID NO: 38388 - DNA, 28 bp, synthetic construct
  misc_feature 1..28: note = Synthetic Construct
  source 1..28: mol_type = other DNA
gtgggtgttttaggccttgtaattctac

SEQ ID NO: 38389 - DNA, 22 bp, synthetic construct
  misc_feature 1..22: note = Synthetic Construct
  source 1..22: mol_type = other DNA
gctcggctccaacgtgtcaata

SEQ ID NO: 38390 - DNA, 20 bp, synthetic construct
  misc_feature 1..20: note = Synthetic Construct
  source 1..20: mol_type = other DNA
agtgggacagcagggaaaga

SEQ ID NO: 38391 - DNA, 26 bp, synthetic construct
  misc_feature 1..26: note = Synthetic Construct
  source 1..26: mol_type = other DNA
ggagactcatgtcaaatgtcctgtca

SEQ ID NO: 38392 - DNA, 21 bp, synthetic construct
  misc_feature 1..21: note = Synthetic Construct
  source 1..21: mol_type = other DNA
ggccctatgcaggtggtttct

SEQ ID NO: 38393 - DNA, 21 bp, synthetic construct
  misc_feature 1..21: note = Synthetic Construct
  source 1..21: mol_type = other DNA
cttcccaagttgctgcactct

SEQ ID NO: 38394 - DNA, 22 bp, synthetic construct
  misc_feature 1..22: note = Synthetic Construct
  source 1..22: mol_type = other DNA
cctgagacccaggcatgttagt

SEQ ID NO: 38395 - DNA, 22 bp, synthetic construct
  misc_feature 1..22: note = Synthetic Construct
  source 1..22: mol_type = other DNA
ccaccaggctcacaaattcact

SEQ ID NO: 38396 - DNA, 24 bp, synthetic construct
  misc_feature 1..24: note = Synthetic Construct
  source 1..24: mol_type = other DNA
gagaggaggacagaagtctgaaag

SEQ ID NO: 38397 - DNA, 20 bp, synthetic construct
  misc_feature 1..20: note = Synthetic Construct
  source 1..20: mol_type = other DNA
ttggggaggtgggcttttca

SEQ ID NO: 38398 - DNA, 20 bp, synthetic construct
  misc_feature 1..20: note = Synthetic Construct
  source 1..20: mol_type = other DNA
gcctcactgggcccgatttt

SEQ ID NO: 38399 - DNA, 22 bp, synthetic construct
  misc_feature 1..22: note = Synthetic Construct
  source 1..22: mol_type = other DNA
cgagctttggatgctccctttc

SEQ ID NO: 38400 - DNA, 30 bp, synthetic construct
  misc_feature 1..30: note = Synthetic Construct
  source 1..30: mol_type = other DNA
gcctattttccttttgagggaatgcatctt

SEQ ID NO: 38401 - DNA, 26 bp, synthetic construct
  misc_feature 1..26: note = Synthetic Construct
  source 1..26: mol_type = other DNA
ccgactggcatgctgacagaatctaa

SEQ ID NO: 38402 - DNA, 28 bp, synthetic construct
  misc_feature 1..28: note = Synthetic Construct
  source 1..28: mol_type = other DNA
gcaaatctgtttgatatggagccgaaag

SEQ ID NO: 38403 - DNA, 20 bp, synthetic construct
  misc_feature 1..20: note = Synthetic Construct
  source 1..20: mol_type = other DNA
tctagcttggggcactggaa

SEQ ID NO: 38404 - DNA, 21 bp, synthetic construct
  misc_feature 1..21: note = Synthetic Construct
  source 1..21: mol_type = other DNA
acatccttaggggccctttgt

SEQ ID NO: 38405 - DNA, 21 bp, synthetic construct
  misc_feature 1..21: note = Synthetic Construct
  source 1..21: mol_type = other DNA
ggtgtgggccagacaatgtga

SEQ ID NO: 38406 - DNA, 22 bp, synthetic construct
  misc_feature 1..22: note = Synthetic Construct
  source 1..22: mol_type = other DNA
ccagagtggctgaagcacagat

SEQ ID NO: 38407 - DNA, 23 bp, synthetic construct
  misc_feature 1..23: note = Synthetic Construct
  source 1..23: mol_type = other DNA
agacttagagctgcgagacaaaa

SEQ ID NO: 38408 - DNA, 21 bp, synthetic construct
  misc_feature 1..21: note = Synthetic Construct
  source 1..21: mol_type = other DNA
ccagtgtcatgtggccgagta

SEQ ID NO: 38409 - DNA, 22 bp, synthetic construct
  misc_feature 1..22: note = Synthetic Construct
  source 1..22: mol_type = other DNA
ggaaaccatgccaggctctttg

SEQ ID NO: 38410 - DNA, 25 bp, synthetic construct
  misc_feature 1..25: note = Synthetic Construct
  source 1..25: mol_type = other DNA
cccagcatcagctgctcatatgtaa

SEQ ID NO: 38411 - DNA, 26 bp, synthetic construct
  misc_feature 1..26: note = Synthetic Construct
  source 1..26: mol_type = other DNA
gttcctaaaaggatcatgcagagaga

SEQ ID NO: 38412 - DNA, 21 bp, synthetic construct
  misc_feature 1..21: note = Synthetic Construct
  source 1..21: mol_type = other DNA
tggtggcaactagggatgtga

SEQ ID NO: 38413 - DNA, 24 bp, synthetic construct
  misc_feature 1..24: note = Synthetic Construct
  source 1..24: mol_type = other DNA
gtggacaaagtactcactccttct

SEQ ID NO: 38414 - DNA, 23 bp, synthetic construct
  misc_feature 1..23: note = Synthetic Construct
  source 1..23: mol_type = other DNA
ccacatgaccctaagacggtaga

SEQ ID NO: 38415 - DNA, 25 bp, synthetic construct
  misc_feature 1..25: note = Synthetic Construct
  source 1..25: mol_type = other DNA
ccttgcaggaaggtttatcttttgt

SEQ ID NO: 38416 - DNA, 20 bp, synthetic construct
  misc_feature 1..20: note = Synthetic Construct
  source 1..20: mol_type = other DNA
caagggcctggcttctttgt

SEQ ID NO: 38417 - DNA, 22 bp, synthetic construct
  misc_feature 1..22: note = Synthetic Construct
  source 1..22: mol_type = other DNA
ctgggcggagagacactaaatg

SEQ ID NO: 38418 - DNA, 19 bp, synthetic construct
  misc_feature 1..19: note = Synthetic Construct
  source 1..19: mol_type = other DNA
atcaggggctggtccaaca

SEQ ID NO: 38419 - DNA, 23 bp, synthetic construct
  misc_feature 1..23: note = Synthetic Construct
  source 1..23: mol_type = other DNA
cgaacgctacacctaggacattg

SEQ ID NO: 38420 - DNA, 23 bp, synthetic construct
  misc_feature 1..23: note = Synthetic Construct
  source 1..23: mol_type = other DNA
gaaggcaaaagtagtggggatct

SEQ ID NO: 38421 - DNA, 18 bp, synthetic construct
  misc_feature 1..18: note = Synthetic Construct
  source 1..18: mol_type = other DNA
tgcctgcacctccaccat

SEQ ID NO: 38422 - DNA, 23 bp, synthetic construct
  misc_feature 1..23: note = Synthetic Construct
  source 1..23: mol_type = other DNA
ggcaccagctcttccatctgtag

SEQ ID NO: 38423 - DNA, 19 bp, synthetic construct
  misc_feature 1..19: note = Synthetic Construct
  source 1..19: mol_type = other DNA
gctgggcatggtggtgtgt

SEQ ID NO: 38424 - DNA, 19 bp, synthetic construct
  misc_feature 1..19: note = Synthetic Construct
  source 1..19: mol_type = other DNA
gctgatggccccacacaca

SEQ ID NO: 38425 - DNA, 20 bp, synthetic construct
  misc_feature 1..20: note = Synthetic Construct
  source 1..20: mol_type = other DNA
ggtgcccacacagaggaaga

SEQ ID NO: 38426 - DNA, 20 bp, synthetic construct
  misc_feature 1..20: note = Synthetic Construct
  source 1..20: mol_type = other DNA
gcctgtcctcaggagccaaa

SEQ ID NO: 38427 - DNA, 24 bp, synthetic construct
  misc_feature 1..24: note = Synthetic Construct
  source 1..24: mol_type = other DNA
caaacaggagtcagtgggtaatga

SEQ ID NO: 38428 - DNA, 23 bp, synthetic construct
  misc_feature 1..23: note = Synthetic Construct
  source 1..23: mol_type = other DNA
ggtgagcagtttccagtgcaagt

SEQ ID NO: 38429 - DNA, 26 bp, synthetic construct
  misc_feature 1..26: note = Synthetic Construct
  source 1..26: mol_type = other DNA
ccttgtcctcctaatgagctgactgt

SEQ ID NO: 38430 - DNA, 24 bp, synthetic construct
  misc_feature 1..24: note = Synthetic Construct
  source 1..24: mol_type = other DNA
gcctgaggtctaagggagatgaac

SEQ ID NO: 38431 - DNA, 21 bp, synthetic construct
  misc_feature 1..21: note = Synthetic Construct
  source 1..21: mol_type = other DNA
ttcactctgcggttgtgagaa

SEQ ID NO: 38432 - DNA, 28 bp, synthetic construct
  misc_feature 1..28: note = Synthetic Construct
  source 1..28: mol_type = other DNA
ccccactacctagttccagaatactatc

SEQ ID NO: 38433 - DNA, 23 bp, synthetic construct
  misc_feature 1..23: note = Synthetic Construct
  source 1..23: mol_type = other DNA
tctggagaggtgggagaggtttg

SEQ ID NO: 38434 - DNA, 20 bp, synthetic construct
  misc_feature 1..20: note = Synthetic Construct
  source 1..20: mol_type = other DNA
agcagaaggctaccgtccaa

SEQ ID NO: 38435 - DNA, 22 bp, synthetic construct
  misc_feature 1..22: note = Synthetic Construct
  source 1..22: mol_type = other DNA
ggaagtagtggtgccagcattg

SEQ ID NO: 38436 - DNA, 21 bp, synthetic construct
  misc_feature 1..21: note = Synthetic Construct
  source 1..21: mol_type = other DNA
cacaccagcatctctccacat

SEQ ID NO: 38437 - DNA, 22 bp, synthetic construct
  misc_feature 1..22: note = Synthetic Construct
  source 1..22: mol_type = other DNA
cgaacaggagcctcttctcaca

SEQ ID NO: 38438 - DNA, 24 bp, synthetic construct
  misc_feature 1..24: note = Synthetic Construct
  source 1..24: mol_type = other DNA
gtccttttcaatggcgttgctaga

SEQ ID NO: 38439 - DNA, 23 bp, synthetic construct
  misc_feature 1..23: note = Synthetic Construct
  source 1..23: mol_type = other DNA
cgacaacagacccctctccttct

SEQ ID NO: 38440 - DNA, 23 bp, synthetic construct
  misc_feature 1..23: note = Synthetic Construct
  source 1..23: mol_type = other DNA
cagaggcctgaaatcgaggatga

SEQ ID NO: 38441 - DNA, 18 bp, synthetic construct
  misc_feature 1..18: note = Synthetic Construct
  source 1..18: mol_type = other DNA
aggcaagccggtgccatt

SEQ ID NO: 38442 - DNA, 19 bp, synthetic construct
  misc_feature 1..19: note = Synthetic Construct
  source 1..19: mol_type = other DNA
aggcaccgaagtcccaatg

SEQ ID NO: 38443 - DNA, 19 bp, synthetic construct
  misc_feature 1..19: note = Synthetic Construct
  source 1..19: mol_type = other DNA
aggaggcaggtcgcggatt

SEQ ID NO: 38444 - DNA, 22 bp, synthetic construct
  misc_feature 1..22: note = Synthetic Construct
  source 1..22: mol_type = other DNA
gtggagatcgaggcttgcttct

SEQ ID NO: 38445 - DNA, 22 bp, synthetic construct
  misc_feature 1..22: note = Synthetic Construct
  source 1..22: mol_type = other DNA
cactgtgtttccaggcccaaac

SEQ ID NO: 38446 - DNA, 23 bp, synthetic construct
  misc_feature 1..23: note = Synthetic Construct
  source 1..23: mol_type = other DNA
ggggaaagcagcgaaatggagtt

SEQ ID NO: 38447 - DNA, 24 bp, synthetic construct
  misc_feature 1..24: note = Synthetic Construct
  source 1..24: mol_type = other DNA
gcatggagacgagtcagtgggaaa

SEQ ID NO: 38448 - DNA, 19 bp, synthetic construct
  misc_feature 1..19: note = Synthetic Construct
  source 1..19: mol_type = other DNA
tctggtgcgagctttgctt

SEQ ID NO: 38449 - DNA, 22 bp, synthetic construct
  misc_feature 1..22: note = Synthetic Construct
  source 1..22: mol_type = other DNA
gcactgagcgtgtagggtttga

SEQ ID NO: 38450 - DNA, 23 bp, synthetic construct
  misc_feature 1..23: note = Synthetic Construct
  source 1..23: mol_type = other DNA
ccaaaatactcccctcccacgtt

SEQ ID NO: 38451 - DNA, 26 bp, synthetic construct
  misc_feature 1..26: note = Synthetic Construct
  source 1..26: mol_type = other DNA
gcaaacctcagtagagagaactgtag

SEQ ID NO: 38452 - DNA, 24 bp, synthetic construct
  misc_feature 1..24: note = Synthetic Construct
  source 1..24: mol_type = other DNA
gccaagaaaagacattggtcactt

SEQ ID NO: 38453 - DNA, 23 bp, synthetic construct
  misc_feature 1..23: note = Synthetic Construct
  source 1..23: mol_type = other DNA
ggcctcttcagcgttgaaactgt

SEQ ID NO: 38454 - DNA, 23 bp, synthetic construct
  misc_feature 1..23: note = Synthetic Construct
  source 1..23: mol_type = other DNA
ctgatcatggcccacatgtgtta

SEQ ID NO: 38455 - DNA, 20 bp, synthetic construct
  misc_feature 1..20: note = Synthetic Construct
  source 1..20: mol_type = other DNA
atagcagcaccaggccacat

SEQ ID NO: 38456 - DNA, 21 bp, synthetic construct
  misc_feature 1..21: note = Synthetic Construct
  source 1..21: mol_type = other DNA
gtgcgcagtttgtgattctga

SEQ ID NO: 38457 - DNA, 24 bp, synthetic construct
  misc_feature 1..24: note = Synthetic Construct
  source 1..24: mol_type = other DNA
cgtgttgggctcaaaatgctgttc

SEQ ID NO: 38458 - DNA, 19 bp, synthetic construct
  misc_feature 1..19: note = Synthetic Construct
  source 1..19: mol_type = other DNA
acacctgcccacgcacaca

SEQ ID NO: 38459 - DNA, 24 bp, synthetic construct
  misc_feature 1..24: note = Synthetic Construct
  source 1..24: mol_type = other DNA
caccatcacagccaactccaaatg

SEQ ID NO: 38460 - DNA, 27 bp, synthetic construct
  misc_feature 1..27: note = Synthetic Construct
  source 1..27: mol_type = other DNA
gctgctgaaaatattggctgtccagaa

SEQ ID NO: 38461 - DNA, 25 bp, synthetic construct
  misc_feature 1..25: note = Synthetic Construct
  source 1..25: mol_type = other DNA
ggtacagccaaccaaattagacaag

SEQ ID NO: 38462 - DNA, 24 bp, synthetic construct
  misc_feature 1..24: note = Synthetic Construct
  source 1..24: mol_type = other DNA
tgtggttccaagtcaatcacatct

SEQ ID NO: 38463 - DNA, 24 bp, synthetic construct
  misc_feature 1..24: note = Synthetic Construct
  source 1..24: mol_type = other DNA
ccggagtggaatcatccctagttc

SEQ ID NO: 38464 - DNA, 20 bp, synthetic construct
  misc_feature 1..20: note = Synthetic Construct
  source 1..20: mol_type = other DNA
atggtgggctctgcatcagt

SEQ ID NO: 38465 - DNA, 22 bp, synthetic construct
  misc_feature 1..22: note = Synthetic Construct
  source 1..22: mol_type = other DNA
ctcttaccgagttccagccatt

SEQ ID NO: 38466 - DNA, 22 bp, synthetic construct
  misc_feature 1..22: note = Synthetic Construct
  source 1..22: mol_type = other DNA
ggctgtagggaatgaaggaaca

SEQ ID NO: 38467 - DNA, 22 bp, synthetic construct
  misc_feature 1..22: note = Synthetic Construct
  source 1..22: mol_type = other DNA
actgtgatgcaggctacacttc

SEQ ID NO: 38468 - DNA, 22 bp, synthetic construct
  misc_feature 1..22: note = Synthetic Construct
  source 1..22: mol_type = other DNA
ggccagtagcattggctcacat

SEQ ID NO: 38469 - DNA, 24 bp, synthetic construct
  misc_feature 1..24: note = Synthetic Construct
  source 1..24: mol_type = other DNA
cccagaagcctgctacttccattc

SEQ ID NO: 38470 - DNA, 24 bp, synthetic construct
  misc_feature 1..24: note = Synthetic Construct
  source 1..24: mol_type = other DNA
actcaagactggactcaagcaatc

SEQ ID NO: 38471 - DNA, 20 bp, synthetic construct
  misc_feature 1..20: note = Synthetic Construct
  source 1..20: mol_type = other DNA
gctcagacttgggcagaaca

SEQ ID NO: 38472 - DNA, 26 bp, synthetic construct
  misc_feature 1..26: note = Synthetic Construct
  source 1..26: mol_type = other DNA
cagctcaacaaaattgaccccacaat

SEQ ID NO: 38473 - DNA, 22 bp, synthetic construct
  misc_feature 1..22: note = Synthetic Construct
  source 1..22: mol_type = other DNA
cacactcatcggcccttgttac

SEQ ID NO: 38474 - DNA, 19 bp, synthetic construct
  misc_feature 1..19: note = Synthetic Construct
  source 1..19: mol_type = other DNA
gcagagaggaggcgagtga

SEQ ID NO: 38475 - DNA, 23 bp, synthetic construct
  misc_feature 1..23: note = Synthetic Construct
  source 1..23: mol_type = other DNA
cggcaaatgtaaacccagagcat

SEQ ID NO: 38476 - DNA, 23 bp, synthetic construct
  misc_feature 1..23: note = Synthetic Construct
  source 1..23: mol_type = other DNA
tcctctcactgttcttccacctt

SEQ ID NO: 38477 - DNA, 30 bp, synthetic construct
  misc_feature 1..30: note = Synthetic Construct
  source 1..30: mol_type = other DNA
ccctggaaggtaatttacatgctctgatac

SEQ ID NO: 38478 - DNA, 27 bp, synthetic construct
  misc_feature 1..27: note = Synthetic Construct
  source 1..27: mol_type = other DNA
ccatgaggcatagcatttaccagaaac

SEQ ID NO: 38479 - DNA, 22 bp, synthetic construct
  misc_feature 1..22: note = Synthetic Construct
  source 1..22: mol_type = other DNA
gcgactttgagcccatccttct

SEQ ID NO: 38480 - DNA, 20 bp, synthetic construct
  misc_feature 1..20: note = Synthetic Construct
  source 1..20: mol_type = other DNA
agcactggcgaagcaccaaa

SEQ ID NO: 38481 - DNA, 23 bp, synthetic construct
  misc_feature 1..23: note = Synthetic Construct
  source 1..23: mol_type = other DNA
gtgtgcttcagcatgccagttag

SEQ ID NO: 38482 - DNA, 20 bp, synthetic construct
  misc_feature 1..20: note = Synthetic Construct
  source 1..20: mol_type = other DNA
atgccttttccgggcgtgtt

SEQ ID NO: 38483 - DNA, 25 bp, synthetic construct
  misc_feature 1..25: note = Synthetic Construct
  source 1..25: mol_type = other DNA
tgaaactggagaaccaaaggtgtaa

SEQ ID NO: 38484 - DNA, 22 bp, synthetic construct
  misc_feature 1..22: note = Synthetic Construct
  source 1..22: mol_type = other DNA
ctgagtcacctggaaggtctgt

SEQ ID NO: 38485 - DNA, 20 bp, synthetic construct
  misc_feature 1..20: note = Synthetic Construct
  source 1..20: mol_type = other DNA
gtaagtggggctctgtgctt

SEQ ID NO: 38486 - DNA, 23 bp, synthetic construct
  misc_feature 1..23: note = Synthetic Construct
  source 1..23: mol_type = other DNA
gcaggttcagtgactcttcatca

SEQ ID NO: 38487 - DNA, 24 bp, synthetic construct
  misc_feature 1..24: note = Synthetic Construct
  source 1..24: mol_type = other DNA
tgagtcctaatctcagctccatct

SEQ ID NO: 38488 - DNA, 22 bp, synthetic construct
  misc_feature 1..22: note = Synthetic Construct
  source 1..22: mol_type = other DNA
cttatctcaccacgcggtaact

SEQ ID NO: 38489 - DNA, 23 bp, synthetic construct
  misc_feature 1..23: note = Synthetic Construct
  source 1..23: mol_type = other DNA
ggcagcaattggtgagagacaag

SEQ ID NO: 38490 - DNA, 23 bp, synthetic construct
  misc_feature 1..23: note = Synthetic Construct
  source 1..23: mol_type = other DNA
cctgttgacactggcttggaaca

SEQ ID NO: 38491 - DNA, 19 bp, synthetic construct
  misc_feature 1..19: note = Synthetic Construct
  source 1..19: mol_type = other DNA
gggcagcacagtcctcact

SEQ ID NO: 38492 - DNA, 23 bp, synthetic construct
  misc_feature 1..23: note = Synthetic Construct
  source 1..23: mol_type = other DNA
ggtttgtaggccatgggatctct

SEQ ID NO: 38493 - DNA, 20 bp, synthetic construct
  misc_feature 1..20: note = Synthetic Construct
  source 1..20: mol_type = other DNA
ccgtgcctgtgtgcatgtta

SEQ ID NO: 38494 - DNA, 22 bp, synthetic construct
  misc_feature 1..22: note = Synthetic Construct
  source 1..22: mol_type = other DNA
gctcactcccagttggtgcaat

SEQ ID NO: 38495 - DNA, 23 bp, synthetic construct
  misc_feature 1..23: note = Synthetic Construct
  source 1..23: mol_type = other DNA
gacccaaagaagccaaggtcaga

SEQ ID NO: 38496 - DNA, 26 bp, synthetic construct
  misc_feature 1..26: note = Synthetic Construct
  source 1..26: mol_type = other DNA
ctcacctactctcaaggtaactgttc

SEQ ID NO: 38497 - DNA, 22 bp, synthetic construct
  misc_feature 1..22: note = Synthetic Construct
  source 1..22: mol_type = other DNA
ccacctgtatggagcggcaata

SEQ ID NO: 38498 - DNA, 24 bp, synthetic construct
  misc_feature 1..24: note = Synthetic Construct
  source 1..24: mol_type = other DNA
gtctcccaagtaacggagactaca

SEQ ID NO: 38499 - DNA, 19 bp, synthetic construct
  misc_feature 1..19: note = Synthetic Construct
  source 1..19: mol_type = other DNA
tcggtgccccttggcttgt

SEQ ID NO: 38500 - DNA, 24 bp, synthetic construct
  misc_feature 1..24: note = Synthetic Construct
  source 1..24: mol_type = other DNA
gaggtaaagccaggagctcaaatc

SEQ ID NO: 38501 - DNA, 25 bp, synthetic construct
  misc_feature 1..25: note = Synthetic Construct
  source 1..25: mol_type = other DNA
gtgaagtaaaggggcaaggagaaga

SEQ ID NO: 38502 - DNA, 20 bp, synthetic construct
  misc_feature 1..20: note = Synthetic Construct
  source 1..20: mol_type = other DNA
ccgtccaacgtgcactgaat

SEQ ID NO: 38503 - DNA, 21 bp, synthetic construct
  misc_feature 1..21: note = Synthetic Construct
  source 1..21: mol_type = other DNA
agctccgtcctaacccacgaa

SEQ ID NO: 38504 - DNA, 25 bp, synthetic construct
  misc_feature 1..25: note = Synthetic Construct
  source 1..25: mol_type = other DNA
ctgcggtgtagataactgagtgaag

SEQ ID NO: 38505 - DNA, 21 bp, synthetic construct
  misc_feature 1..21: note = Synthetic Construct
  source 1..21: mol_type = other DNA
gtgcagaagcaccttggttgt

SEQ ID NO: 38506 - DNA, 21 bp, synthetic construct
  misc_feature 1..21: note = Synthetic Construct
  source 1..21: mol_type = other DNA
gtgttgtgtgcacgtgtgttc

SEQ ID NO: 38507 - DNA, 22 bp, synthetic construct
  misc_feature 1..22: note = Synthetic Construct
  source 1..22: mol_type = other DNA
ttgcgttcagggagaggagaga

SEQ ID NO: 38508 - DNA, 22 bp, synthetic construct
  misc_feature 1..22: note = Synthetic Construct
  source 1..22: mol_type = other DNA
ccgccttcacctctctttgagt

SEQ ID NO: 38509 - DNA, 26 bp, synthetic construct
  misc_feature 1..26: note = Synthetic Construct
  source 1..26: mol_type = other DNA
ggagctttgaaaacttccgacactct

SEQ ID NO: 38510 - DNA, 21 bp, synthetic construct
  misc_feature 1..21: note = Synthetic Construct
  source 1..21: mol_type = other DNA
ccacttgctggagttccttga

SEQ ID NO: 38511 - DNA, 26 bp, synthetic construct
  misc_feature 1..26: note = Synthetic Construct
  source 1..26: mol_type = other DNA
gggtggcatgaactttacacccaatg

SEQ ID NO: 38512 - DNA, 23 bp, synthetic construct
  misc_feature 1..23: note = Synthetic Construct
  source 1..23: mol_type = other DNA
cctgtttgcagatccagccttct

SEQ ID NO: 38513 - DNA, 26 bp, synthetic construct
  misc_feature 1..26: note = Synthetic Construct
  source 1..26: mol_type = other DNA
cccttggattctgatgccatctcgtt

SEQ ID NO: 38514 - DNA, 30 bp, synthetic construct
  misc_feature 1..30: note = Synthetic Construct
  source 1..30: mol_type = other DNA
ctgggatgttaattccctctctagttcaag

SEQ ID NO: 38515 - DNA, 21 bp, synthetic construct
  misc_feature 1..21: note = Synthetic Construct
  source 1..21: mol_type = other DNA
acagcgccctctgctatccat

SEQ ID NO: 38516 - DNA, 23 bp, synthetic construct
  misc_feature 1..23: note = Synthetic Construct
  source 1..23: mol_type = other DNA
ggcgcaaccagaaatgtggctta

SEQ ID NO: 38517 - DNA, 22 bp, synthetic construct
  misc_feature 1..22: note = Synthetic Construct
  source 1..22: mol_type = other DNA
acatggtggtcccagctactca

SEQ ID NO: 38518 - DNA, 24 bp, synthetic construct
  misc_feature 1..24: note = Synthetic Construct
  source 1..24: mol_type = other DNA
gggagacagccagagcaactcatt

SEQ ID NO: 38519 - DNA, 20 bp, synthetic construct
  misc_feature 1..20: note = Synthetic Construct
  source 1..20: mol_type = other DNA
tccctggagaccggtgtttt

SEQ ID NO: 38520 - DNA, 21 bp, synthetic construct
  misc_feature 1..21: note = Synthetic Construct
  source 1..21: mol_type = other DNA
gatcacacccaaaggcactga

SEQ ID NO: 38521 - DNA, 22 bp, synthetic construct
  misc_feature 1..22: note = Synthetic Construct
  source 1..22: mol_type = other DNA
cgtgcccatttgcaatccattc

SEQ ID NO: 38522 - DNA, 23 bp, synthetic construct
  misc_feature 1..23: note = Synthetic Construct
  source 1..23: mol_type = other DNA
gaagaagagattctggggagcaa

SEQ ID NO: 38523 - DNA, 22 bp, synthetic construct
  misc_feature 1..22: note = Synthetic Construct
  source 1..22: mol_type = other DNA
tgggttggatttgggtgagtct

SEQ ID NO: 38524 - DNA, 19 bp, synthetic construct
  misc_feature 1..19: note = Synthetic Construct
  source 1..19: mol_type = other DNA
gctgcttcgcgttcacaaa

SEQ ID NO: 38525 - DNA, 26 bp, synthetic construct
  misc_feature 1..26: note = Synthetic Construct
  source 1..26: mol_type = other DNA
cctccctcgttaacttcccttgtttc

SEQ ID NO: 38526 - DNA, 20 bp, synthetic construct
  misc_feature 1..20: note = Synthetic Construct
  source 1..20: mol_type = other DNA
gctgcaagggcttcctgaaa

SEQ ID NO: 38527 - DNA, 21 bp, synthetic construct
  misc_feature 1..21: note = Synthetic Construct
  source 1..21: mol_type = other DNA
tgagggaggccctgtcctttt

SEQ ID NO: 38528 - DNA, 26 bp, synthetic construct
  misc_feature 1..26: note = Synthetic Construct
  source 1..26: mol_type = other DNA
ccctgattctcaagacctctttgttg

SEQ ID NO: 38529 - DNA, 20 bp, synthetic construct
  misc_feature 1..20: note = Synthetic Construct
  source 1..20: mol_type = other DNA
ccaggggcctgggaaacttg

SEQ ID NO: 38530 - DNA, 22 bp, synthetic construct
  misc_feature 1..22: note = Synthetic Construct
  source 1..22: mol_type = other DNA
cagcgatggagctagtctgtga

SEQ ID NO: 38531 - DNA, 26 bp, synthetic construct
  misc_feature 1..26: note = Synthetic Construct
  source 1..26: mol_type = other DNA
ggaggtgtaaccaacttcacctggaa

SEQ ID NO: 38532 - DNA, 23 bp, synthetic construct
  misc_feature 1..23: note = Synthetic Construct
  source 1..23: mol_type = other DNA
cgcatataacaggcacccagcaa

SEQ ID NO: 38533 - DNA, 20 bp, synthetic construct
  misc_feature 1..20: note = Synthetic Construct
  source 1..20: mol_type = other DNA
tgggccgtctttccctgaga

SEQ ID NO: 38534 - DNA, 22 bp, synthetic construct
  misc_feature 1..22: note = Synthetic Construct
  source 1..22: mol_type = other DNA
ccacgtgtcttcgtccatcttc

SEQ ID NO: 38535 - DNA, 20 bp, synthetic construct
  misc_feature 1..20: note = Synthetic Construct
  source 1..20: mol_type = other DNA
ggggacctttgctccgtttg

SEQ ID NO: 38536 - DNA, 22 bp, synthetic construct
  misc_feature 1..22: note = Synthetic Construct
  source 1..22: mol_type = other DNA
cccagaaggaagttggggaaac

SEQ ID NO: 38537 - DNA, 21 bp, synthetic construct
  misc_feature 1..21: note = Synthetic Construct
  source 1..21: mol_type = other DNA
aggctgtagacggcgaggtta

SEQ ID NO: 38538 - DNA, 20 bp, synthetic construct
  misc_feature 1..20: note = Synthetic Construct
  source 1..20: mol_type = other DNA
acacgccccagtctccactt

SEQ ID NO: 38539 - DNA, 20 bp, synthetic construct
  misc_feature 1..20: note = Synthetic Construct
  source 1..20: mol_type = other DNA
gccctgcagaactcccaact

SEQ ID NO: 38540 - DNA, 21 bp, synthetic construct
  misc_feature 1..21: note = Synthetic Construct
  source 1..21: mol_type = other DNA
accaccctctcactgcagctt

SEQ ID NO: 38541 - DNA, 20 bp, synthetic construct
  misc_feature 1..20: note = Synthetic Construct
  source 1..20: mol_type = other DNA
aagatgagggcgctgtgact

SEQ ID NO: 38542 - DNA, 23 bp, synthetic construct
  misc_feature 1..23: note = Synthetic Construct
  source 1..23: mol_type = other DNA
ggggaagacgatgaagacagcaa

SEQ ID NO: 38543 - DNA, 20 bp, synthetic construct
  misc_feature 1..20: note = Synthetic Construct
  source 1..20: mol_type = other DNA
gggaggcaagggagtcatct

SEQ ID NO: 38544 - DNA, 20 bp, synthetic construct
  misc_feature 1..20: note = Synthetic Construct
  source 1..20: mol_type = other DNA
aagtggcagcgccagtggaa

SEQ ID NO: 38545 - DNA, 21 bp, synthetic construct
  misc_feature 1..21: note = Synthetic Construct
  source 1..21: mol_type = other DNA
agccacacaggacaggacttg

SEQ ID NO: 38546 - DNA, 23 bp, synthetic construct
  misc_feature 1..23: note = Synthetic Construct
  source 1..23: mol_type = other DNA
ctcagtgcccaggtagtgatttc

SEQ ID NO: 38547 - DNA, 20 bp, synthetic construct
  misc_feature 1..20: note = Synthetic Construct
  source 1..20: mol_type = other DNA
gcgagtcgctgaacctctct

SEQ ID NO: 38548 - DNA, 20 bp, synthetic construct
  misc_feature 1..20: note = Synthetic Construct
  source 1..20: mol_type = other DNA
aggtcttgctgtgggtcttg

SEQ ID NO: 38549 - DNA, 19 bp, synthetic construct
  misc_feature 1..19: note = Synthetic Construct
  source 1..19: mol_type = other DNA
agtgcctggcatcctgcta

SEQ ID NO: 38550 - DNA, 22 bp, synthetic construct
  misc_feature 1..22: note = Synthetic Construct
  source 1..22: mol_type = other DNA
tgaggcctggggtatttgaaga

SEQ ID NO: 38551 - DNA, 23 bp, synthetic construct
  misc_feature 1..23: note = Synthetic Construct
  source 1..23: mol_type = other DNA
gcccacagaaggttgttttcgtt

SEQ ID NO: 38552 - DNA, 23 bp, synthetic construct
  misc_feature 1..23: note = Synthetic Construct
  source 1..23: mol_type = other DNA
gcttggccaatgacagcctttct

SEQ ID NO: 38553 - DNA, 21 bp, synthetic construct
  misc_feature 1..21: note = Synthetic Construct
  source 1..21: mol_type = other DNA
accagcctcaatgtggagttg

SEQ ID NO: 38554 - DNA, 25 bp, synthetic construct
  misc_feature 1..25: note = Synthetic Construct
  source 1..25: mol_type = other DNA
gcagaagtctccacactgtcctaga

SEQ ID NO: 38555 - DNA, 21 bp, synthetic construct
  misc_feature 1..21: note = Synthetic Construct
  source 1..21: mol_type = other DNA
gcctacatcccgggctcattt

SEQ ID NO: 38556 - DNA, 21 bp, synthetic construct
  misc_feature 1..21: note = Synthetic Construct
  source 1..21: mol_type = other DNA
gaaaacaaccccaggcgtttc

SEQ ID NO: 38557 - DNA, 25 bp, synthetic construct
  misc_feature 1..25: note = Synthetic Construct
  source 1..25: mol_type = other DNA
gcttctctgggtctcaagacataat

SEQ ID NO: 38558 - DNA, 22 bp, synthetic construct
  misc_feature 1..22: note = Synthetic Construct
  source 1..22: mol_type = other DNA
cacccacgtttgctggacttac

SEQ ID NO: 38559 - DNA, 23 bp, synthetic construct
  misc_feature 1..23: note = Synthetic Construct
  source 1..23: mol_type = other DNA
gctcttcgttggttccagccttt

SEQ ID NO: 38560 - DNA, 24 bp, synthetic construct
  misc_feature 1..24: note = Synthetic Construct
  source 1..24: mol_type = other DNA
actctttgtgaaaccagctcctta

SEQ ID NO: 38561 - DNA, 20 bp, synthetic construct
  misc_feature 1..20: note = Synthetic Construct
  source 1..20: mol_type = other DNA
aacccagggcgtggcattct

SEQ ID NO: 38562 - DNA, 21 bp, synthetic construct
  misc_feature 1..21: note = Synthetic Construct
  source 1..21: mol_type = other DNA
gtgcgcttattgcaccacttg

SEQ ID NO: 38563 - DNA, 28 bp, synthetic construct
  misc_feature 1..28: note = Synthetic Construct
  source 1..28: mol_type = other DNA
gcctaggagaatctatactcaaccaaag

SEQ ID NO: 38564 - DNA, 22 bp, synthetic construct
  misc_feature 1..22: note = Synthetic Construct
  source 1..22: mol_type = other DNA
cccagtgaatatgggcctgatg

SEQ ID NO: 38565 - DNA, 22 bp, synthetic construct
  misc_feature 1..22: note = Synthetic Construct
  source 1..22: mol_type = other DNA
gcagacaggaggctctttccat

SEQ ID NO: 38566 - DNA, 23 bp, synthetic construct
  misc_feature 1..23: note = Synthetic Construct
  source 1..23: mol_type = other DNA
cagtctcactttccctgcacctt

SEQ ID NO: 38567 - DNA, 25 bp, synthetic construct
  misc_feature 1..25: note = Synthetic Construct
  source 1..25: mol_type = other DNA
ccagcagattcacactgtagacaca

SEQ ID NO: 38568 - DNA, 21 bp, synthetic construct
  misc_feature 1..21: note = Synthetic Construct
  source 1..21: mol_type = other DNA
gagaatggccaaggtgtggaa

SEQ ID NO: 38569 - DNA, 20 bp, synthetic construct
  misc_feature 1..20: note = Synthetic Construct
  source 1..20: mol_type = other DNA
agcaaggttgagcagccaat

SEQ ID NO: 38570 - DNA, 30 bp, synthetic construct
  misc_feature 1..30: note = Synthetic Construct
  source 1..30: mol_type = other DNA
ggagagatgttcttattgttcagacctctt

SEQ ID NO: 38571 - DNA, 21 bp, synthetic construct
  misc_feature 1..21: note = Synthetic Construct
  source 1..21: mol_type = other DNA
atccctcatcccctggctttg

SEQ ID NO: 38572 - DNA, 19 bp, synthetic construct
  misc_feature 1..19: note = Synthetic Construct
  source 1..19: mol_type = other DNA
aagggaacgcggtggttag

SEQ ID NO: 38573 - DNA, 25 bp, synthetic construct
  misc_feature 1..25: note = Synthetic Construct
  source 1..25: mol_type = other DNA
agagaattagggtgaggaaccttga

SEQ ID NO: 38574 - DNA, 20 bp, synthetic construct
  misc_feature 1..20: note = Synthetic Construct
  source 1..20: mol_type = other DNA
ttgcccctctgttggtctga

SEQ ID NO: 38575 - DNA, 23 bp, synthetic construct
  misc_feature 1..23: note = Synthetic Construct
  source 1..23: mol_type = other DNA
ccatacagtgagctgtggagcta

SEQ ID NO: 38576 - DNA, 27 bp, synthetic construct
  misc_feature 1..27: note = Synthetic Construct
  source 1..27: mol_type = other DNA
gggaataagagtgtagctccaaagtga

SEQ ID NO: 38577 - DNA, 22 bp, synthetic construct
  misc_feature 1..22: note = Synthetic Construct
  source 1..22: mol_type = other DNA
ccaaaacgttgggatgcagcaa

SEQ ID NO: 38578 - DNA, 23 bp, synthetic construct
  misc_feature 1..23: note = Synthetic Construct
  source 1..23: mol_type = other DNA
cacccaaatgtcacttgctggat

SEQ ID NO: 38579 - DNA, 22 bp, synthetic construct
  misc_feature 1..22: note = Synthetic Construct
  source 1..22: mol_type = other DNA
caggaggttctcagctctgttg

SEQ ID NO: 38580 - DNA, 23 bp, synthetic construct
  misc_feature 1..23: note = Synthetic Construct
  source 1..23: mol_type = other DNA
ctgtggagagggaaggctgataa

SEQ ID NO: 38581 - DNA, 23 bp, synthetic construct
  misc_feature 1..23: note = Synthetic Construct
  source 1..23: mol_type = other DNA
aacctttctttcaagggctgtct

SEQ ID NO: 38582 - DNA, 20 bp, synthetic construct
  misc_feature 1..20: note = Synthetic Construct
  source 1..20: mol_type = other DNA
gactgcaaggatggcaccaa

SEQ ID NO: 38583 - DNA, 20 bp, synthetic construct
  misc_feature 1..20: note = Synthetic Construct
  source 1..20: mol_type = other DNA
cagccacctggaagctttgt

SEQ ID NO: 38584 - DNA, 22 bp, synthetic construct
  misc_feature 1..22: note = Synthetic Construct
  source 1..22: mol_type = other DNA
tgacctcccaggttgagggaat

SEQ ID NO: 38585 - DNA, 22 bp, synthetic construct
  misc_feature 1..22: note = Synthetic Construct
  source 1..22: mol_type = other DNA
gcagcagatgagatgggagcta

SEQ ID NO: 38586 - DNA, 22 bp, synthetic construct
  misc_feature 1..22: note = Synthetic Construct
  source 1..22: mol_type = other DNA
ggctcaccacataccagtcctt

SEQ ID NO: 38587 - DNA, 22 bp, synthetic construct
  misc_feature 1..22: note = Synthetic Construct
  source 1..22: mol_type = other DNA
cagccagctctgggagaaaaga

SEQ ID NO: 38588 - DNA, 22 bp, synthetic construct
  misc_feature 1..22: note = Synthetic Construct
  source 1..22: mol_type = other DNA
gtgtgacatgccatgactgaga

SEQ ID NO: 38589 - DNA, 22 bp, synthetic construct
  misc_feature 1..22: note = Synthetic Construct
  source 1..22: mol_type = other DNA
ccatggttcctcctctgccatt

SEQ ID NO: 38590 - DNA, 25 bp, synthetic construct
  misc_feature 1..25: note = Synthetic Construct
  source 1..25: mol_type = other DNA
cctgagagcactgaaacctctcctt

SEQ ID NO: 38591 - DNA, 26 bp, synthetic construct
  misc_feature 1..26: note = Synthetic Construct
  source 1..26: mol_type = other DNA
ccagtaatgatgaggcagatgtcttg

SEQ ID NO: 38592 - DNA, 20 bp, synthetic construct
  misc_feature 1..20: note = Synthetic Construct
  source 1..20: mol_type = other DNA
tgttagcggctggaggatga

SEQ ID NO: 38593 - DNA, 22 bp, synthetic construct
  misc_feature 1..22: note = Synthetic Construct
  source 1..22: mol_type = other DNA
ggaaccatgcttaaccccatct

SEQ ID NO: 38594 - DNA, 22 bp, synthetic construct
  misc_feature 1..22: note = Synthetic Construct
  source 1..22: mol_type = other DNA
ccagatggctagcattgacctt

SEQ ID NO: 38595 - DNA, 24 bp, synthetic construct
  misc_feature 1..24: note = Synthetic Construct
  source 1..24: mol_type = other DNA
ggcactgtatgcctagtgcctttg

SEQ ID NO: 38596 - DNA, 24 bp, synthetic construct
  misc_feature 1..24: note = Synthetic Construct
  source 1..24: mol_type = other DNA
gcttgccaaagtcagagagagtca

SEQ ID NO: 38597 - DNA, 24 bp, synthetic construct
  misc_feature 1..24: note = Synthetic Construct
  source 1..24: mol_type = other DNA
ggggaagtgcatgatcctgagtga

SEQ ID NO: 38598 - DNA, 25 bp, synthetic construct
  misc_feature 1..25: note = Synthetic Construct
  source 1..25: mol_type = other DNA
tgactctcggttaatgtctttgctt

SEQ ID NO: 38599 - DNA, 21 bp, synthetic construct
  misc_feature 1..21: note = Synthetic Construct
  source 1..21: mol_type = other DNA
cacatgaccactgctgctgtt

SEQ ID NO: 38600 - DNA, 20 bp, synthetic construct
  misc_feature 1..20: note = Synthetic Construct
  source 1..20: mol_type = other DNA
gtggcgcacatgtggcattt

SEQ ID NO: 38601 - DNA, 20 bp, synthetic construct
  misc_feature 1..20: note = Synthetic Construct
  source 1..20: mol_type = other DNA
ggcatggggcagtgagtatt

SEQ ID NO: 38602 - DNA, 25 bp, synthetic construct
  misc_feature 1..25: note = Synthetic Construct
  source 1..25: mol_type = other DNA
gggttgcattgctcccttattcagt

SEQ ID NO: 38603 - DNA, 22 bp, synthetic construct
  misc_feature 1..22: note = Synthetic Construct
  source 1..22: mol_type = other DNA
gagctggcttcctcatcatctt

SEQ ID NO: 38604 - DNA, 25 bp, synthetic construct
  misc_feature 1..25: note = Synthetic Construct
  source 1..25: mol_type = other DNA
gcattcctaggaggtcaattcttct

SEQ ID NO: 38605 - DNA, 22 bp, synthetic construct
  misc_feature 1..22: note = Synthetic Construct
  source 1..22: mol_type = other DNA
cttggtgtagacgaggttgtga

SEQ ID NO: 38606 - DNA, 24 bp, synthetic construct
  misc_feature 1..24: note = Synthetic Construct
  source 1..24: mol_type = other DNA
ggctgaatgtacccagccaagtca

SEQ ID NO: 38607 - DNA, 23 bp, synthetic construct
  misc_feature 1..23: note = Synthetic Construct
  source 1..23: mol_type = other DNA
ccactccatccgtaaaccatttg

SEQ ID NO: 38608 - DNA, 20 bp, synthetic construct
  misc_feature 1..20: note = Synthetic Construct
  source 1..20: mol_type = other DNA
ggttgcacaggcctcagttg

SEQ ID NO: 38609 - DNA, 20 bp, synthetic construct
  misc_feature 1..20: note = Synthetic Construct
  source 1..20: mol_type = other DNA
gctatttccgaggccacagt

SEQ ID NO: 38610 - DNA, 24 bp, synthetic construct
  misc_feature 1..24: note = Synthetic Construct
  source 1..24: mol_type = other DNA
ggaggtctcaaaaccggtcagatg

SEQ ID NO: 38611 - DNA, 23 bp, synthetic construct
  misc_feature 1..23: note = Synthetic Construct
  source 1..23: mol_type = other DNA
acacagaggactttttgggcatt

SEQ ID NO: 38612 - DNA, 22 bp, synthetic construct
  misc_feature 1..22: note = Synthetic Construct
  source 1..22: mol_type = other DNA
tgatggaaggtcctgggctttg

SEQ ID NO: 38613 - DNA, 21 bp, synthetic construct
  misc_feature 1..21: note = Synthetic Construct
  source 1..21: mol_type = other DNA
tgcttccacccctgctctatg

SEQ ID NO: 38614 - DNA, 18 bp, synthetic construct
  misc_feature 1..18: note = Synthetic Construct
  source 1..18: mol_type = other DNA
tgctgctggccccttctt

SEQ ID NO: 38615 - DNA, 27 bp, synthetic construct
  misc_feature 1..27: note = Synthetic Construct
  source 1..27: mol_type = other DNA
gcaaaataggcattacctccattcaac

SEQ ID NO: 38616 - DNA, 19 bp, synthetic construct
  misc_feature 1..19: note = Synthetic Construct
  source 1..19: mol_type = other DNA
gcgtgggaggcctgaagat

SEQ ID NO: 38617 - DNA, 22 bp, synthetic construct
  misc_feature 1..22: note = Synthetic Construct
  source 1..22: mol_type = other DNA
acaccgaaaagggcaagaaagt

SEQ ID NO: 38618 - DNA, 25 bp, synthetic construct
  misc_feature 1..25: note = Synthetic Construct
  source 1..25: mol_type = other DNA
ggtggagacagtaggacctcagaag

SEQ ID NO: 38619 - DNA, 21 bp, synthetic construct
  misc_feature 1..21: note = Synthetic Construct
  source 1..21: mol_type = other DNA
gggtaggggagggttgcaaat

SEQ ID NO: 38620 - DNA, 22 bp, synthetic construct
  misc_feature 1..22: note = Synthetic Construct
  source 1..22: mol_type = other DNA
gagatctggcagggtaggatga

SEQ ID NO: 38621 - DNA, 19 bp, synthetic construct
  misc_feature 1..19: note = Synthetic Construct
  source 1..19: mol_type = other DNA
agtcccaggctggctggat

SEQ ID NO: 38622 - DNA, 21 bp, synthetic construct
  misc_feature 1..21: note = Synthetic Construct
  source 1..21: mol_type = other DNA
gcgtttgcagttcccatttca

SEQ ID NO: 38623 - DNA, 24 bp, synthetic construct
  misc_feature 1..24: note = Synthetic Construct
  source 1..24: mol_type = other DNA
acagaaaaccaacatagccccaaa

SEQ ID NO: 38624 - DNA, 24 bp, synthetic construct
  misc_feature 1..24: note = Synthetic Construct
  source 1..24: mol_type = other DNA
ttggccaataaaaggacagtgaac

SEQ ID NO: 38625 - DNA, 20 bp, synthetic construct
  misc_feature 1..20: note = Synthetic Construct
  source 1..20: mol_type = other DNA
ccagaagccggaagttgtgt

SEQ ID NO: 38626 - DNA, 22 bp, synthetic construct
  misc_feature 1..22: note = Synthetic Construct
  source 1..22: mol_type = other DNA
gtgaatgaccagctggctgtag

SEQ ID NO: 38627 - DNA, 25 bp, synthetic construct
  misc_feature 1..25: note = Synthetic Construct
  source 1..25: mol_type = other DNA
caggactcaccttagtcccatacaa

SEQ ID NO: 38628 - DNA, 23 bp, synthetic construct
  misc_feature 1..23: note = Synthetic Construct
  source 1..23: mol_type = other DNA
gagaagggaccaagccaatttca

SEQ ID NO: 38629 - DNA, 23 bp, synthetic construct
  misc_feature 1..23: note = Synthetic Construct
  source 1..23: mol_type = other DNA
tggccttacattacagccattct

SEQ ID NO: 38630 - DNA, 21 bp, synthetic construct
  misc_feature 1..21: note = Synthetic Construct
  source 1..21: mol_type = other DNA
ttccaccaccactcccagtga

SEQ ID NO: 38631 - DNA, 22 bp, synthetic construct
  misc_feature 1..22: note = Synthetic Construct
  source 1..22: mol_type = other DNA
aggtagggccctgaaagctatg

SEQ ID NO: 38632 - DNA, 29 bp, synthetic construct
  misc_feature 1..29: note = Synthetic Construct
  source 1..29: mol_type = other DNA
cccagatcatattttgggaaagaggttca

SEQ ID NO: 38633 - DNA, 23 bp, synthetic construct
  misc_feature 1..23: note = Synthetic Construct
  source 1..23: mol_type = other DNA
ctgaaggcactagggaaggatgt

SEQ ID NO: 38634 - DNA, 22 bp, synthetic construct
  misc_feature 1..22: note = Synthetic Construct
  source 1..22: mol_type = other DNA
gggattctcccacctcaacctt

SEQ ID NO: 38635 - DNA, 23 bp, synthetic construct
  misc_feature 1..23: note = Synthetic Construct
  source 1..23: mol_type = other DNA
ccctttggtgattcagcatggta

SEQ ID NO: 38636 - DNA, 22 bp, synthetic construct
  misc_feature 1..22: note = Synthetic Construct
  source 1..22: mol_type = other DNA
caggagttggtgttcagtcaga

SEQ ID NO: 38637 - DNA, 24 bp, synthetic construct
  misc_feature 1..24: note = Synthetic Construct
  source 1..24: mol_type = other DNA
ccccagagtctttgaaaagtgcat

SEQ ID NO: 38638 - DNA, 23 bp, synthetic construct
  misc_feature 1..23: note = Synthetic Construct
  source 1..23: mol_type = other DNA
gtgaagcgatttgctggaactca

SEQ ID NO: 38639 - DNA, 25 bp, synthetic construct
  misc_feature 1..25: note = Synthetic Construct
  source 1..25: mol_type = other DNA
ctctctttctctctggcctcaattc

SEQ ID NO: 38640 - DNA, 23 bp, synthetic construct
  misc_feature 1..23: note = Synthetic Construct
  source 1..23: mol_type = other DNA
cccttgtgttggactgtggttgt

SEQ ID NO: 38641 - DNA, 23 bp, synthetic construct
  misc_feature 1..23: note = Synthetic Construct
  source 1..23: mol_type = other DNA
gaccatacaagacagcacaggta

SEQ ID NO: 38642 - DNA, 28 bp, synthetic construct
  misc_feature 1..28: note = Synthetic Construct
  source 1..28: mol_type = other DNA
gtggtagattctagctacttccacaatg

SEQ ID NO: 38643 - DNA, 20 bp, synthetic construct
  misc_feature 1..20: note = Synthetic Construct
  source 1..20: mol_type = other DNA
tgtcagaaggcgaccaggat

SEQ ID NO: 38644 - DNA, 24 bp, synthetic construct
  misc_feature 1..24: note = Synthetic Construct
  source 1..24: mol_type = other DNA
gagaatcaaccactttgcctgcat

SEQ ID NO: 38645 - DNA, 22 bp, synthetic construct
  misc_feature 1..22: note = Synthetic Construct
  source 1..22: mol_type = other DNA
gggctttcagctcccagttaca

SEQ ID NO: 38646 - DNA, 20 bp, synthetic construct
  misc_feature 1..20: note = Synthetic Construct
  source 1..20: mol_type = other DNA
accccaaagcggcaagaagt

SEQ ID NO: 38647 - DNA, 20 bp, synthetic construct
  misc_feature 1..20: note = Synthetic Construct
  source 1..20: mol_type = other DNA
acctgggcctttgtggtgat

SEQ ID NO: 38648 - DNA, 27 bp, synthetic construct
  misc_feature 1..27: note = Synthetic Construct
  source 1..27: mol_type = other DNA
agggacagtctcctagatctaactatc

SEQ ID NO: 38649 - DNA, 21 bp, synthetic construct
  misc_feature 1..21: note = Synthetic Construct
  source 1..21: mol_type = other DNA
acaaacaaacccaggcagtgt

SEQ ID NO: 38650 - DNA, 21 bp, synthetic construct
  misc_feature 1..21: note = Synthetic Construct
  source 1..21: mol_type = other DNA
agctggagctaggctgctgaa

SEQ ID NO: 38651 - DNA, 22 bp, synthetic construct
  misc_feature 1..22: note = Synthetic Construct
  source 1..22: mol_type = other DNA
ccagaaccactctctccactga

SEQ ID NO: 38652 - DNA, 22 bp, synthetic construct
  misc_feature 1..22: note = Synthetic Construct
  source 1..22: mol_type = other DNA
tgactggatcccagtgctgttg

SEQ ID NO: 38653 - DNA, 27 bp, synthetic construct
  misc_feature 1..27: note = Synthetic Construct
  source 1..27: mol_type = other DNA
cgtttggcaaaaccttaatccacatag

SEQ ID NO: 38654 - DNA, 21 bp, synthetic construct
  misc_feature 1..21: note = Synthetic Construct
  source 1..21: mol_type = other DNA
tcctggtcagatgcccacaag

SEQ ID NO: 38655 - DNA, 27 bp, synthetic construct
  misc_feature 1..27: note = Synthetic Construct
  source 1..27: mol_type = other DNA
ggggacattccatagtccatacctttg

SEQ ID NO: 38656 - DNA, 22 bp, synthetic construct
  misc_feature 1..22: note = Synthetic Construct
  source 1..22: mol_type = other DNA
gaatgggtgaggggagacaatc

SEQ ID NO: 38657 - DNA, 19 bp, synthetic construct
  misc_feature 1..19: note = Synthetic Construct
  source 1..19: mol_type = other DNA
tgaaggggctgaggacaca

SEQ ID NO: 38658 - DNA, 19 bp, synthetic construct
  misc_feature 1..19: note = Synthetic Construct
  source 1..19: mol_type = other DNA
tggcccatgcctgctccat

SEQ ID NO: 38659 - DNA, 19 bp, synthetic construct
  misc_feature 1..19: note = Synthetic Construct
  source 1..19: mol_type = other DNA
agggatgcaacccgactgt

SEQ ID NO: 38660 - DNA, 25 bp, synthetic construct
  misc_feature 1..25: note = Synthetic Construct
  source 1..25: mol_type = other DNA
gctaatacaacctctgagcctgact

SEQ ID NO: 38661 - DNA, 25 bp, synthetic construct
  misc_feature 1..25: note = Synthetic Construct
  source 1..25: mol_type = other DNA
ggacagccaatccagatcaccttct

SEQ ID NO: 38662 - DNA, 19 bp, synthetic construct
  misc_feature 1..19: note = Synthetic Construct
  source 1..19: mol_type = other DNA
ccaggagcctggtcacctt

SEQ ID NO: 38663 - DNA, 22 bp, synthetic construct
  misc_feature 1..22: note = Synthetic Construct
  source 1..22: mol_type = other DNA
ggtgaggtccaagaagctggaa

SEQ ID NO: 38664 - DNA, 21 bp, synthetic construct
  misc_feature 1..21: note = Synthetic Construct
  source 1..21: mol_type = other DNA
tctccagaggcctgaggttag

SEQ ID NO: 38665 - DNA, 24 bp, synthetic construct
  misc_feature 1..24: note = Synthetic Construct
  source 1..24: mol_type = other DNA
gctttccacatcctccataaccat

SEQ ID NO: 38666 - DNA, 22 bp, synthetic construct
  misc_feature 1..22: note = Synthetic Construct
  source 1..22: mol_type = other DNA
cccacagttctccagtgtcaga

SEQ ID NO: 38667 - DNA, 19 bp, synthetic construct
  misc_feature 1..19: note = Synthetic Construct
  source 1..19: mol_type = other DNA
aggtgtccctgccttgcat

SEQ ID NO: 38668 - DNA, 25 bp, synthetic construct
  misc_feature 1..25: note = Synthetic Construct
  source 1..25: mol_type = other DNA
tccgaattcttgacaccagtcttag

SEQ ID NO: 38669 - DNA, 23 bp, synthetic construct
  misc_feature 1..23: note = Synthetic Construct
  source 1..23: mol_type = other DNA
gtgcagcctactactgtttcctt

SEQ ID NO: 38670 - DNA, 23 bp, synthetic construct
  misc_feature 1..23: note = Synthetic Construct
  source 1..23: mol_type = other DNA
gacggaaccaagatgttctccat

SEQ ID NO: 38671 - DNA, 20 bp, synthetic construct
  misc_feature 1..20: note = Synthetic Construct
  source 1..20: mol_type = other DNA
tatttgccccggggtctttg

SEQ ID NO: 38672 - DNA, 23 bp, synthetic construct
  misc_feature 1..23: note = Synthetic Construct
  source 1..23: mol_type = other DNA
ggctgccctgcaattattgaact

SEQ ID NO: 38673 - DNA, 24 bp, synthetic construct
  misc_feature 1..24: note = Synthetic Construct
  source 1..24: mol_type = other DNA
ggagaccaacttttggggaagaag

SEQ ID NO: 38674 - DNA, 21 bp, synthetic construct
  misc_feature 1..21: note = Synthetic Construct
  source 1..21: mol_type = other DNA
gattcagcaccaagggtccat

SEQ ID NO: 38675 - DNA, 22 bp, synthetic construct
  misc_feature 1..22: note = Synthetic Construct
  source 1..22: mol_type = other DNA
ccagaggaagtttgtgccatga

SEQ ID NO: 38676 - DNA, 22 bp, synthetic construct
  misc_feature 1..22: note = Synthetic Construct
  source 1..22: mol_type = other DNA
cagacgttagcacccacacttg

SEQ ID NO: 38677 - DNA, 24 bp, synthetic construct
  misc_feature 1..24: note = Synthetic Construct
  source 1..24: mol_type = other DNA
gggcttcaggcatagtttgaattg

SEQ ID NO: 38678 - DNA, 20 bp, synthetic construct
  misc_feature 1..20: note = Synthetic Construct
  source 1..20: mol_type = other DNA
cctccgcacaagttgcaatg

SEQ ID NO: 38679 - DNA, 29 bp, synthetic construct
  misc_feature 1..29: note = Synthetic Construct
  source 1..29: mol_type = other DNA
cagctagctctaaatgagttttggagaca

SEQ ID NO: 38680 - DNA, 21 bp, synthetic construct
  misc_feature 1..21: note = Synthetic Construct
  source 1..21: mol_type = other DNA
tactgagcagccgtggactga

SEQ ID NO: 38681 - DNA, 26 bp, synthetic construct
  misc_feature 1..26: note = Synthetic Construct
  source 1..26: mol_type = other DNA
cctgttatacagggccagatgtcttc

SEQ ID NO: 38682 - DNA, 21 bp, synthetic construct
  misc_feature 1..21: note = Synthetic Construct
  source 1..21: mol_type = other DNA
tgcagaccctgtctccatctt

SEQ ID NO: 38683 - DNA, 22 bp, synthetic construct
  misc_feature 1..22: note = Synthetic Construct
  source 1..22: mol_type = other DNA
cctgtgatggttccccgttctt

SEQ ID NO: 38684 - DNA, 20 bp, synthetic construct
  misc_feature 1..20: note = Synthetic Construct
  source 1..20: mol_type = other DNA
gtggctcatggtggcagtaa

SEQ ID NO: 38685 - DNA, 22 bp, synthetic construct
  misc_feature 1..22: note = Synthetic Construct
  source 1..22: mol_type = other DNA
agggatgggtcagaggttgttc

SEQ ID NO: 38686 - DNA, 27 bp, synthetic construct
  misc_feature 1..27: note = Synthetic Construct
  source 1..27: mol_type = other DNA
agacaatccagtaataaccacctgaag

SEQ ID NO: 38687 - DNA, 22 bp, synthetic construct
  misc_feature 1..22: note = Synthetic Construct
  source 1..22: mol_type = other DNA
gacagggcttagcttccacatc

SEQ ID NO: 38688 - DNA, 24 bp, synthetic construct
  misc_feature 1..24: note = Synthetic Construct
  source 1..24: mol_type = other DNA
caccggggactggtctcttatttg

SEQ ID NO: 38689 - DNA, 20 bp, synthetic construct
  misc_feature 1..20: note = Synthetic Construct
  source 1..20: mol_type = other DNA
tgctgcaggggagttcttca

SEQ ID NO: 38690 - DNA, 23 bp, synthetic construct
  misc_feature 1..23: note = Synthetic Construct
  source 1..23: mol_type = other DNA
ttcaagacctgaacacgaagtga

SEQ ID NO: 38691 - DNA, 28 bp, synthetic construct
  misc_feature 1..28: note = Synthetic Construct
  source 1..28: mol_type = other DNA
gacttagaacaactgcctcctacttttg

SEQ ID NO: 38692 - DNA, 21 bp, synthetic construct
  misc_feature 1..21: note = Synthetic Construct
  source 1..21: mol_type = other DNA
gctgggtccctcacacttctt

SEQ ID NO: 38693 - DNA, 22 bp, synthetic construct
  misc_feature 1..22: note = Synthetic Construct
  source 1..22: mol_type = other DNA
gccctctgaaacctcctacttc

SEQ ID NO: 38694 - DNA, 20 bp, synthetic construct
  misc_feature 1..20: note = Synthetic Construct
  source 1..20: mol_type = other DNA
gcccggtgtcttttcccttt

SEQ ID NO: 38695 - DNA, 23 bp, synthetic construct
  misc_feature 1..23: note = Synthetic Construct
  source 1..23: mol_type = other DNA
cccagcaagctggagataaaact

SEQ ID NO: 38696 - DNA, 24 bp, synthetic construct
  misc_feature 1..24: note = Synthetic Construct
  source 1..24: mol_type = other DNA
gctctaaaatgcccattcccatgt

SEQ ID NO: 38697 - DNA, 20 bp, synthetic construct
  misc_feature 1..20: note = Synthetic Construct
  source 1..20: mol_type = other DNA
gggcagtccagagagacaca

SEQ ID NO: 38698 - DNA, 25 bp, synthetic construct
  misc_feature 1..25: note = Synthetic Construct
  source 1..25: mol_type = other DNA
aataccagaaaacacccctcttcaa

SEQ ID NO: 38699 - DNA, 19 bp, synthetic construct
  misc_feature 1..19: note = Synthetic Construct
  source 1..19: mol_type = other DNA
ccactgcgctgcaggaaac

SEQ ID NO: 38700 - DNA, 23 bp, synthetic construct
  misc_feature 1..23: note = Synthetic Construct
  source 1..23: mol_type = other DNA
tctgctcagcaaaagatcactct

SEQ ID NO: 38701 - DNA, 25 bp, synthetic construct
  misc_feature 1..25: note = Synthetic Construct
  source 1..25: mol_type = other DNA
ggctgatattgacagccagggtttg

SEQ ID NO: 38702 - DNA, 23 bp, synthetic construct
  misc_feature 1..23: note = Synthetic Construct
  source 1..23: mol_type = other DNA
cccaggcaaagtatgtgggtact

SEQ ID NO: 38703 - DNA, 28 bp, synthetic construct
  misc_feature 1..28: note = Synthetic Construct
  source 1..28: mol_type = other DNA
ctcttctgttaaccaatgaaccccattc

SEQ ID NO: 38704 - DNA, 18 bp, synthetic construct
  misc_feature 1..18: note = Synthetic Construct
  source 1..18: mol_type = other DNA
cgcagccagttgctgtca

SEQ ID NO: 38705 - DNA, 24 bp, synthetic construct
  misc_feature 1..24: note = Synthetic Construct
  source 1..24: mol_type = other DNA
tcaggacagtcatttctgctctac

SEQ ID NO: 38706 - DNA, 22 bp, synthetic construct
  misc_feature 1..22: note = Synthetic Construct
  source 1..22: mol_type = other DNA
tgagggatgggcttatcacaga

SEQ ID NO: 38707 - DNA, 24 bp, synthetic construct
  misc_feature 1..24: note = Synthetic Construct
  source 1..24: mol_type = other DNA
gttgtttctcccacctcttcacaa

SEQ ID NO: 38708 - DNA, 26 bp, synthetic construct
  misc_feature 1..26: note = Synthetic Construct
  source 1..26: mol_type = other DNA
gtgtcctggagactaaattggctaga

SEQ ID NO: 38709 - DNA, 24 bp, synthetic construct
  misc_feature 1..24: note = Synthetic Construct
  source 1..24: mol_type = other DNA
gcaagtagggtccatctactcaca

SEQ ID NO: 38710 - DNA, 26 bp, synthetic construct
  misc_feature 1..26: note = Synthetic Construct
  source 1..26: mol_type = other DNA
cgggaggtttagtaacaggagacaag

SEQ ID NO: 38711 - DNA, 23 bp, synthetic construct
  misc_feature 1..23: note = Synthetic Construct
  source 1..23: mol_type = other DNA
ggtgtatgcctccatgaccttga

SEQ ID NO: 38712 - DNA, 22 bp, synthetic construct
  misc_feature 1..22: note = Synthetic Construct
  source 1..22: mol_type = other DNA
gcatatgctccagcctcaggta

SEQ ID NO: 38713 - DNA, 21 bp, synthetic construct
  misc_feature 1..21: note = Synthetic Construct
  source 1..21: mol_type = other DNA
ggcccctctgtttctgtcctt

SEQ ID NO: 38714 - DNA, 25 bp, synthetic construct
  misc_feature 1..25: note = Synthetic Construct
  source 1..25: mol_type = other DNA
cgcatggcttatataggcggtctgt

SEQ ID NO: 38715 - DNA, 19 bp, synthetic construct
  misc_feature 1..19: note = Synthetic Construct
  source 1..19: mol_type = other DNA
atccccagcacggctgact

SEQ ID NO: 38716 - DNA, 24 bp, synthetic construct
  misc_feature 1..24: note = Synthetic Construct
  source 1..24: mol_type = other DNA
cagcaactttgctttagtctgcat

SEQ ID NO: 38717 - DNA, 22 bp, synthetic construct
  misc_feature 1..22: note = Synthetic Construct
  source 1..22: mol_type = other DNA
agccaggccaatcaggatcaag

SEQ ID NO: 38718 - DNA, 20 bp, synthetic construct
  misc_feature 1..20: note = Synthetic Construct
  source 1..20: mol_type = other DNA
gcaaggtgggtggagcaaca

SEQ ID NO: 38719 - DNA, 20 bp, synthetic construct
  misc_feature 1..20: note = Synthetic Construct
  source 1..20: mol_type = other DNA
gccaggtcttgccatccaaa

SEQ ID NO: 38720 - DNA, 20 bp, synthetic construct
  misc_feature 1..20: note = Synthetic Construct
  source 1..20: mol_type = other DNA
tacctcacaggtcggtgcaa

SEQ ID NO: 38721 - DNA, 24 bp, synthetic construct
  misc_feature 1..24: note = Synthetic Construct
  source 1..24: mol_type = other DNA
gcatttctggttttcaacgtgtct

SEQ ID NO: 38722 - DNA, 19 bp, synthetic construct
  misc_feature 1..19: note = Synthetic Construct
  source 1..19: mol_type = other DNA
ccccatgctccatgtgcaa

SEQ ID NO: 38723 - DNA, 25 bp, synthetic construct
  misc_feature 1..25: note = Synthetic Construct
  source 1..25: mol_type = other DNA
tgaccacttgttaccactgaaacat

SEQ ID NO: 38724 - DNA, 22 bp, synthetic construct
  misc_feature 1..22: note = Synthetic Construct
  source 1..22: mol_type = other DNA
gtcgtgaccaaaggcagacatc

SEQ ID NO: 38725 - DNA, 22 bp, synthetic construct
  misc_feature 1..22: note = Synthetic Construct
  source 1..22: mol_type = other DNA
agagatacacctcccagcatga

SEQ ID NO: 38726 - DNA, 22 bp, synthetic construct
  misc_feature 1..22: note = Synthetic Construct
  source 1..22: mol_type = other DNA
ggttagcctcacccacctgttc

SEQ ID NO: 38727 - DNA, 24 bp, synthetic construct
  misc_feature 1..24: note = Synthetic Construct
  source 1..24: mol_type = other DNA
gcaatgagctcttgatccatctga

SEQ ID NO: 38728 - DNA, 24 bp, synthetic construct
  misc_feature 1..24: note = Synthetic Construct
  source 1..24: mol_type = other DNA
gagggtggatagaacggttacact

SEQ ID NO: 38729 - DNA, 25 bp, synthetic construct
  misc_feature 1..25: note = Synthetic Construct
  source 1..25: mol_type = other DNA
cccagaaggttaagaggcttaggaa

SEQ ID NO: 38730 - DNA, 20 bp, synthetic construct
  misc_feature 1..20: note = Synthetic Construct
  source 1..20: mol_type = other DNA
ggaaaggcgaccccgaactt

SEQ ID NO: 38731 - DNA, 25 bp, synthetic construct
  misc_feature 1..25: note = Synthetic Construct
  source 1..25: mol_type = other DNA
gcagaagcattagcagtcagctcta

SEQ ID NO: 38732 - DNA, 20 bp, synthetic construct
  misc_feature 1..20: note = Synthetic Construct
  source 1..20: mol_type = other DNA
agggcaggtgggtacagtga

SEQ ID NO: 38733 - DNA, 22 bp, synthetic construct
  misc_feature 1..22: note = Synthetic Construct
  source 1..22: mol_type = other DNA
gcagagggcagatgaaggaaag

SEQ ID NO: 38734 - DNA, 21 bp, synthetic construct
  misc_feature 1..21: note = Synthetic Construct
  source 1..21: mol_type = other DNA
gaagcagagccaccatagctt

SEQ ID NO: 38735 - DNA, 26 bp, synthetic construct
  misc_feature 1..26: note = Synthetic Construct
  source 1..26: mol_type = other DNA
gggccaacttctgattctaggtcaag

SEQ ID NO: 38736 - DNA, 24 bp, synthetic construct
  misc_feature 1..24: note = Synthetic Construct
  source 1..24: mol_type = other DNA
cccaggtagagtcactgcttctgt

SEQ ID NO: 38737 - DNA, 22 bp, synthetic construct
  misc_feature 1..22: note = Synthetic Construct
  source 1..22: mol_type = other DNA
agacttccagaggaccccattg

SEQ ID NO: 38738 - DNA, 19 bp, synthetic construct
  misc_feature 1..19: note = Synthetic Construct
  source 1..19: mol_type = other DNA
accctccccaccaccttct

SEQ ID NO: 38739 - DNA, 21 bp, synthetic construct
  misc_feature 1..21: note = Synthetic Construct
  source 1..21: mol_type = other DNA
gcagttgacaggaagcagaga

SEQ ID NO: 38740 - DNA, 22 bp, synthetic construct
  misc_feature 1..22: note = Synthetic Construct
  source 1..22: mol_type = other DNA
tccaaacagaccttccctcaga

SEQ ID NO: 38741 - DNA, 19 bp, synthetic construct
  misc_feature 1..19: note = Synthetic Construct
  source 1..19: mol_type = other DNA
atccagttggcgcccttgt

SEQ ID NO: 38742 - DNA, 19 bp, synthetic construct
  misc_feature 1..19: note = Synthetic Construct
  source 1..19: mol_type = other DNA
cccaagaggggctgctatg

SEQ ID NO: 38743 - DNA, 28 bp, synthetic construct
  misc_feature 1..28: note = Synthetic Construct
  source 1..28: mol_type = other DNA
gccctaattaatggtctggtaacctttc

SEQ ID NO: 38744 - DNA, 22 bp, synthetic construct
  misc_feature 1..22: note = Synthetic Construct
  source 1..22: mol_type = other DNA
ggagtcaggttgttagcactgt

SEQ ID NO: 38745 - DNA, 20 bp, synthetic construct
  misc_feature 1..20: note = Synthetic Construct
  source 1..20: mol_type = other DNA
aggctgcaggtcctttctga

SEQ ID NO: 38746 - DNA, 20 bp, synthetic construct
  misc_feature 1..20: note = Synthetic Construct
  source 1..20: mol_type = other DNA
cccagcatccccacttggaa

SEQ ID NO: 38747 - DNA, 21 bp, synthetic construct
  misc_feature 1..21: note = Synthetic Construct
  source 1..21: mol_type = other DNA
cgagctcacctcactctgtca

SEQ ID NO: 38748 - DNA, 22 bp, synthetic construct
  misc_feature 1..22: note = Synthetic Construct
  source 1..22: mol_type = other DNA
tgcctcccacctctaccctatt

SEQ ID NO: 38749 - DNA, 26 bp, synthetic construct
  misc_feature 1..26: note = Synthetic Construct
  source 1..26: mol_type = other DNA
tcatgataggtagatacgcaggtgat

SEQ ID NO: 38750 - DNA, 19 bp, synthetic construct
  misc_feature 1..19: note = Synthetic Construct
  source 1..19: mol_type = other DNA
ggaccgcttcggtgtggaa

SEQ ID NO: 38751 - DNA, 19 bp, synthetic construct
  misc_feature 1..19: note = Synthetic Construct
  source 1..19: mol_type = other DNA
tgggcagcaggaccccaaa

SEQ ID NO: 38752 - DNA, 21 bp, synthetic construct
  misc_feature 1..21: note = Synthetic Construct
  source 1..21: mol_type = other DNA
agtgaagcccgggtacctgat

SEQ ID NO: 38753 - DNA, 20 bp, synthetic construct
  misc_feature 1..20: note = Synthetic Construct
  source 1..20: mol_type = other DNA
aacagcctgtgcgtgggata

SEQ ID NO: 38754 - DNA, 20 bp, synthetic construct
  misc_feature 1..20: note = Synthetic Construct
  source 1..20: mol_type = other DNA
tctgcctcttcctgctggtt

SEQ ID NO: 38755 - DNA, 25 bp, synthetic construct
  misc_feature 1..25: note = Synthetic Construct
  source 1..25: mol_type = other DNA
gtcacagttaaagagcaggaacact

SEQ ID NO: 38756 - DNA, 20 bp, synthetic construct
  misc_feature 1..20: note = Synthetic Construct
  source 1..20: mol_type = other DNA
agaggcagtggcagtcaaac

SEQ ID NO: 38757 - DNA, 19 bp, synthetic construct
  misc_feature 1..19: note = Synthetic Construct
  source 1..19: mol_type = other DNA
gcacacccaaggtcagcaa

SEQ ID NO: 38758 - DNA, 25 bp, synthetic construct
  misc_feature 1..25: note = Synthetic Construct
  source 1..25: mol_type = other DNA
gagtaggattaggcagagggagaaa

SEQ ID NO: 38759 - DNA, 25 bp, synthetic construct
  misc_feature 1..25: note = Synthetic Construct
  source 1..25: mol_type = other DNA
ggaagggtttggctctgaatcattg

SEQ ID NO: 38760 - DNA, 22 bp, synthetic construct
  misc_feature 1..22: note = Synthetic Construct
  source 1..22: mol_type = other DNA
gcatatgaggggccagggtttc

SEQ ID NO: 38761 - DNA, 22 bp, synthetic construct
  misc_feature 1..22: note = Synthetic Construct
  source 1..22: mol_type = other DNA
ccctgtatggcagggagaaaga

SEQ ID NO: 38762 - DNA, 22 bp, synthetic construct
  misc_feature 1..22: note = Synthetic Construct
  source 1..22: mol_type = other DNA
gagcctcccctaccatagcatt

SEQ ID NO: 38763 - DNA, 24 bp, synthetic construct
  misc_feature 1..24: note = Synthetic Construct
  source 1..24: mol_type = other DNA
catgtgaattgtggtcagtgcaaa

SEQ ID NO: 38764 - DNA, 20 bp, synthetic construct
  misc_feature 1..20: note = Synthetic Construct
  source 1..20: mol_type = other DNA
ggggaaggatttcccgttgt

SEQ ID NO: 38765 - DNA, 23 bp, synthetic construct
  misc_feature 1..23: note = Synthetic Construct
  source 1..23: mol_type = other DNA
accctcacagggtgtttgttatc

SEQ ID NO: 38766 - DNA, 22 bp, synthetic construct
  misc_feature 1..22: note = Synthetic Construct
  source 1..22: mol_type = other DNA
gccttttaacacccacctgtct

SEQ ID NO: 38767 - DNA, 22 bp, synthetic construct
  misc_feature 1..22: note = Synthetic Construct
  source 1..22: mol_type = other DNA
gcatggggcaggagtgtaaaga

SEQ ID NO: 38768 - DNA, 24 bp, synthetic construct
  misc_feature 1..24: note = Synthetic Construct
  source 1..24: mol_type = other DNA
gagacctgagctggactagaactt

SEQ ID NO: 38769 - DNA, 23 bp, synthetic construct
  misc_feature 1..23: note = Synthetic Construct
  source 1..23: mol_type = other DNA
gcctccagcaacaatgagcactt

SEQ ID NO: 38770 - DNA, 18 bp, synthetic construct
  misc_feature 1..18: note = Synthetic Construct
  source 1..18: mol_type = other DNA
acgtgggccaccagaaag

SEQ ID NO: 38771 - DNA, 22 bp, synthetic construct
  misc_feature 1..22: note = Synthetic Construct
  source 1..22: mol_type = other DNA
cctcgggcacatgcctttagaa

SEQ ID NO: 38772 - DNA, 23 bp, synthetic construct
  misc_feature 1..23: note = Synthetic Construct
  source 1..23: mol_type = other DNA
gaaataagtaccggggccctttc

SEQ ID NO: 38773 - DNA, 25 bp, synthetic construct
  misc_feature 1..25: note = Synthetic Construct
  source 1..25: mol_type = other DNA
acaagtgcgtatcattcaaggaaca

SEQ ID NO: 38774 - DNA, 22 bp, synthetic construct
  misc_feature 1..22: note = Synthetic Construct
  source 1..22: mol_type = other DNA
gcaggtggtgggcattcttgtt

SEQ ID NO: 38775 - DNA, 20 bp, synthetic construct
  misc_feature 1..20: note = Synthetic Construct
  source 1..20: mol_type = other DNA
tgccgggccacagttcatac

SEQ ID NO: 38776 - DNA, 24 bp, synthetic construct
  misc_feature 1..24: note = Synthetic Construct
  source 1..24: mol_type = other DNA
ccacctggtagcaaggatggagat

SEQ ID NO: 38777 - DNA, 20 bp, synthetic construct
  misc_feature 1..20: note = Synthetic Construct
  source 1..20: mol_type = other DNA
ccagttggcttggggaagtt

SEQ ID NO: 38778 - DNA, 20 bp, synthetic construct
  misc_feature 1..20: note = Synthetic Construct
  source 1..20: mol_type = other DNA
tggcaaacaccccagctgta

SEQ ID NO: 38779 - DNA, 25 bp, synthetic construct
  misc_feature 1..25: note = Synthetic Construct
  source 1..25: mol_type = other DNA
cccaagtgatcatccctatcccata

SEQ ID NO: 38780 - DNA, 22 bp, synthetic construct
  misc_feature 1..22: note = Synthetic Construct
  source 1..22: mol_type = other DNA
gggcggggatgtgaatcctaaa

SEQ ID NO: 38781 - DNA, 25 bp, synthetic construct
  misc_feature 1..25: note = Synthetic Construct
  source 1..25: mol_type = other DNA
gtcctcacttacatgactccaggaa

SEQ ID NO: 38782 - DNA, 21 bp, synthetic construct
  misc_feature 1..21: note = Synthetic Construct
  source 1..21: mol_type = other DNA
ggagcctggcatatgcagaaa

SEQ ID NO: 38783 - DNA, 25 bp, synthetic construct
  misc_feature 1..25: note = Synthetic Construct
  source 1..25: mol_type = other DNA
gtggtcctgaatctaaagcgagact

SEQ ID NO: 38784 - DNA, 19 bp, synthetic construct
  misc_feature 1..19: note = Synthetic Construct
  source 1..19: mol_type = other DNA
ggccctagccttggcttca

SEQ ID NO: 38785 - DNA, 22 bp, synthetic construct
  misc_feature 1..22: note = Synthetic Construct
  source 1..22: mol_type = other DNA
cttctctgcacgttgtgcattc

SEQ ID NO: 38786 - DNA, 24 bp, synthetic construct
  misc_feature 1..24: note = Synthetic Construct
  source 1..24: mol_type = other DNA
tctggcctgcactactgaaataag

SEQ ID NO: 38787 - DNA, 22 bp, synthetic construct
  misc_feature 1..22: note = Synthetic Construct
  source 1..22: mol_type = other DNA
tgtatacagggaggcacagcta

SEQ ID NO: 38788 - DNA, 22 bp, synthetic construct
  misc_feature 1..22: note = Synthetic Construct
  source 1..22: mol_type = other DNA
gcccagccacactaaattgcat

SEQ ID NO: 38789 - DNA, 22 bp, synthetic construct
  misc_feature 1..22: note = Synthetic Construct
  source 1..22: mol_type = other DNA
cactgaccattccccttccttt

SEQ ID NO: 38790 - DNA, 22 bp, synthetic construct
  misc_feature 1..22: note = Synthetic Construct
  source 1..22: mol_type = other DNA
actctaggtggtcggtggtgtt

SEQ ID NO: 38791 - DNA, 21 bp, synthetic construct
  misc_feature 1..21: note = Synthetic Construct
  source 1..21: mol_type = other DNA
cggaaaaggaggcctcagtca

SEQ ID NO: 38792 - DNA, 21 bp, synthetic construct
  misc_feature 1..21: note = Synthetic Construct
  source 1..21: mol_type = other DNA
ggtggctacaggtgcaaggat

SEQ ID NO: 38793 - DNA, 19 bp, synthetic construct
  misc_feature 1..19: note = Synthetic Construct
  source 1..19: mol_type = other DNA
tggcagcagccaaacttct

SEQ ID NO: 38794 - DNA, 21 bp, synthetic construct
  misc_feature 1..21: note = Synthetic Construct
  source 1..21: mol_type = other DNA
gccagagctgagcagtcatca

SEQ ID NO: 38795 - DNA, 21 bp, synthetic construct
  misc_feature 1..21: note = Synthetic Construct
  source 1..21: mol_type = other DNA
ccacagtatcgccgctgacat

SEQ ID NO: 38796 - DNA, 20 bp, synthetic construct
  misc_feature 1..20: note = Synthetic Construct
  source 1..20: mol_type = other DNA
aaagcctccgcctcttgttg

SEQ ID NO: 38797 - DNA, 20 bp, synthetic construct
  misc_feature 1..20: note = Synthetic Construct
  source 1..20: mol_type = other DNA
tgctctccctgacaccatgt

SEQ ID NO: 38798 - DNA, 20 bp, synthetic construct
  misc_feature 1..20: note = Synthetic Construct
  source 1..20: mol_type = other DNA
aggggagccaattggtgcaa

SEQ ID NO: 38799 - DNA, 22 bp, synthetic construct
  misc_feature 1..22: note = Synthetic Construct
  source 1..22: mol_type = other DNA
gcagaggtcaggtgtgaagtga

SEQ ID NO: 38800 - DNA, 29 bp, synthetic construct
  misc_feature 1..29: note = Synthetic Construct
  source 1..29: mol_type = other DNA
cagggaaatcctataactacccctcattc

SEQ ID NO: 38801 - DNA, 20 bp, synthetic construct
  misc_feature 1..20: note = Synthetic Construct
  source 1..20: mol_type = other DNA
cctcctggctactcctctgt

SEQ ID NO: 38802 - DNA, 23 bp, synthetic construct
  misc_feature 1..23: note = Synthetic Construct
  source 1..23: mol_type = other DNA
ggtctcaaactcctgggtacaag

SEQ ID NO: 38803 - DNA, 23 bp, synthetic construct
  misc_feature 1..23: note = Synthetic Construct
  source 1..23: mol_type = other DNA
gcatgcccattgagtctgctact

SEQ ID NO: 38804 - DNA, 24 bp, synthetic construct
  misc_feature 1..24: note = Synthetic Construct
  source 1..24: mol_type = other DNA
agtcccttgtggtttttactccat

SEQ ID NO: 38805 - DNA, 24 bp, synthetic construct
  misc_feature 1..24: note = Synthetic Construct
  source 1..24: mol_type = other DNA
gcaggaggaggaagaggctaaatg

SEQ ID NO: 38806 - DNA, 20 bp, synthetic construct
  misc_feature 1..20: note = Synthetic Construct
  source 1..20: mol_type = other DNA
gggtcgtgggcttcatcagt

SEQ ID NO: 38807 - DNA, 20 bp, synthetic construct
  misc_feature 1..20: note = Synthetic Construct
  source 1..20: mol_type = other DNA
aagcctggccacacacatag

SEQ ID NO: 38808 - DNA, 24 bp, synthetic construct
  misc_feature 1..24: note = Synthetic Construct
  source 1..24: mol_type = other DNA
ctgttgtggcacatgaacttttct

SEQ ID NO: 38809 - DNA, 24 bp, synthetic construct
  misc_feature 1..24: note = Synthetic Construct
  source 1..24: mol_type = other DNA
gtcgtcctctcagtattccctttg

SEQ ID NO: 38810 - DNA, 24 bp, synthetic construct
  misc_feature 1..24: note = Synthetic Construct
  source 1..24: mol_type = other DNA
gccaaaggtagcaacattgacact

SEQ ID NO: 38811 - DNA, 22 bp, synthetic construct
  misc_feature 1..22: note = Synthetic Construct
  source 1..22: mol_type = other DNA
ccaaattcaggccccaggaaga

SEQ ID NO: 38812 - DNA, 22 bp, synthetic construct
  misc_feature 1..22: note = Synthetic Construct
  source 1..22: mol_type = other DNA
cacttagcagccacctctcact

SEQ ID NO: 38813 - DNA, 21 bp, synthetic construct
  misc_feature 1..21: note = Synthetic Construct
  source 1..21: mol_type = other DNA
aaatgccaggggaacaacctt

SEQ ID NO: 38814 - DNA, 24 bp, synthetic construct
  misc_feature 1..24: note = Synthetic Construct
  source 1..24: mol_type = other DNA
ggtcgccgtacatgtaattagtga

SEQ ID NO: 38815 - DNA, 22 bp, synthetic construct
  misc_feature 1..22: note = Synthetic Construct
  source 1..22: mol_type = other DNA
gcaaccataacaggggcctaga

SEQ ID NO: 38816 - DNA, 19 bp, synthetic construct
  misc_feature 1..19: note = Synthetic Construct
  source 1..19: mol_type = other DNA
tccccgtgggcagagatga

SEQ ID NO: 38817 - DNA, 25 bp, synthetic construct
  misc_feature 1..25: note = Synthetic Construct
  source 1..25: mol_type = other DNA
ggggaaaatcctctgcttgtggaaa

SEQ ID NO: 38818 - DNA, 20 bp, synthetic construct
  misc_feature 1..20: note = Synthetic Construct
  source 1..20: mol_type = other DNA
tcccttgcccttctgctctt

SEQ ID NO: 38819 - DNA, 19 bp, synthetic construct
  misc_feature 1..19: note = Synthetic Construct
  source 1..19: mol_type = other DNA
tccacccaacccactgcaa

SEQ ID NO: 38820 - DNA, 25 bp, synthetic construct
  misc_feature 1..25: note = Synthetic Construct
  source 1..25: mol_type = other DNA
tggtggctgcttttacaatcttttg

SEQ ID NO: 38821 - DNA, 22 bp, synthetic construct
  misc_feature 1..22: note = Synthetic Construct
  source 1..22: mol_type = other DNA
ggaccacagaatccagctcagt

SEQ ID NO: 38822 - DNA, 24 bp, synthetic construct
  misc_feature 1..24: note = Synthetic Construct
  source 1..24: mol_type = other DNA
cccactggtgaaacctggttaatg

SEQ ID NO: 38823 - DNA, 21 bp, synthetic construct
  misc_feature 1..21: note = Synthetic Construct
  source 1..21: mol_type = other DNA
ggtgaggccagtttcacttca

SEQ ID NO: 38824 - DNA, 19 bp, synthetic construct
  misc_feature 1..19: note = Synthetic Construct
  source 1..19: mol_type = other DNA
tgccccacaggtgtgtcat

SEQ ID NO: 38825 - DNA, 23 bp, synthetic construct
  misc_feature 1..23: note = Synthetic Construct
  source 1..23: mol_type = other DNA
tggaggatcttctcgaaggctat

SEQ ID NO: 38826 - DNA, 21 bp, synthetic construct
  misc_feature 1..21: note = Synthetic Construct
  source 1..21: mol_type = other DNA
agctcagaccattgcctcttg

SEQ ID NO: 38827 - DNA, 22 bp, synthetic construct
  misc_feature 1..22: note = Synthetic Construct
  source 1..22: mol_type = other DNA
ccagcttcaaaggggtgtttct

SEQ ID NO: 38828 - DNA, 20 bp, synthetic construct
  misc_feature 1..20: note = Synthetic Construct
  source 1..20: mol_type = other DNA
acacaggtgcaagcccatag

SEQ ID NO: 38829 - DNA, 19 bp, synthetic construct
  misc_feature 1..19: note = Synthetic Construct
  source 1..19: mol_type = other DNA
accaaggctgtgcctgttg

SEQ ID NO: 38830 - DNA, 20 bp, synthetic construct
  misc_feature 1..20: note = Synthetic Construct
  source 1..20: mol_type = other DNA
caccggctctgccaaaacat

SEQ ID NO: 38831 - DNA, 18 bp, synthetic construct
  misc_feature 1..18: note = Synthetic Construct
  source 1..18: mol_type = other DNA
tgtctcggccctcagctt

SEQ ID NO: 38832 - DNA, 24 bp, synthetic construct
  misc_feature 1..24: note = Synthetic Construct
  source 1..24: mol_type = other DNA
ccaacctcatagcctgacactttc

SEQ ID NO: 38833 - DNA, 24 bp, synthetic construct
  misc_feature 1..24: note = Synthetic Construct
  source 1..24: mol_type = other DNA
cctgcttctttgcccagatttttg

SEQ ID NO: 38834 - DNA, 22 bp, synthetic construct
  misc_feature 1..22: note = Synthetic Construct
  source 1..22: mol_type = other DNA
ccaatgaatggctgtcctccaa

SEQ ID NO: 38835 - DNA, 22 bp, synthetic construct
  misc_feature 1..22: note = Synthetic Construct
  source 1..22: mol_type = other DNA
ggttgggtgactttcccagact

SEQ ID NO: 38836 - DNA, 23 bp, synthetic construct
  misc_feature 1..23: note = Synthetic Construct
  source 1..23: mol_type = other DNA
cagcttctggagagcttttctct

SEQ ID NO: 38837 - DNA, 21 bp, synthetic construct
  misc_feature 1..21: note = Synthetic Construct
  source 1..21: mol_type = other DNA
agtgacagccttggcctctta

SEQ ID NO: 38838 - DNA, 18 bp, synthetic construct
  misc_feature 1..18: note = Synthetic Construct
  source 1..18: mol_type = other DNA
tgccgggatcccttctca

SEQ ID NO: 38839 - DNA, 20 bp, synthetic construct
  misc_feature 1..20: note = Synthetic Construct
  source 1..20: mol_type = other DNA
tgatgcctgcacagctcctt

SEQ ID NO: 38840 - DNA, 20 bp, synthetic construct
  misc_feature 1..20: note = Synthetic Construct
  source 1..20: mol_type = other DNA
tgagcaccaaggagcccaaa

SEQ ID NO: 38841 - DNA, 19 bp, synthetic construct
  misc_feature 1..19: note = Synthetic Construct
  source 1..19: mol_type = other DNA
ccagtgacccagggaccaa

SEQ ID NO: 38842 - DNA, 20 bp, synthetic construct
  misc_feature 1..20: note = Synthetic Construct
  source 1..20: mol_type = other DNA
gggcagcacttcatcgttct

SEQ ID NO: 38843 - DNA, 20 bp, synthetic construct
  misc_feature 1..20: note = Synthetic Construct
  source 1..20: mol_type = other DNA
tgggcaagggcatgtggtaa

SEQ ID NO: 38844 - DNA, 22 bp, synthetic construct
  misc_feature 1..22: note = Synthetic Construct
  source 1..22: mol_type = other DNA
ggccaggaagcttgaggaagat

SEQ ID NO: 38845 - DNA, 23 bp, synthetic construct
  misc_feature 1..23: note = Synthetic Construct
  source 1..23: mol_type = other DNA
ctgcaaagcacttttgggaacat

SEQ ID NO: 38846 - DNA, 21 bp, synthetic construct
  misc_feature 1..21: note = Synthetic Construct
  source 1..21: mol_type = other DNA
aaccctgccctctgagagttg

SEQ ID NO: 38847 - DNA, 21 bp, synthetic construct
  misc_feature 1..21: note = Synthetic Construct
  source 1..21: mol_type = other DNA
cacttcaaagccctcgtccat

SEQ ID NO: 38848 - DNA, 19 bp, synthetic construct
  misc_feature 1..19: note = Synthetic Construct
  source 1..19: mol_type = other DNA
agcccaagccagagggaat

SEQ ID NO: 38849 - DNA, 25 bp, synthetic construct
  misc_feature 1..25: note = Synthetic Construct
  source 1..25: mol_type = other DNA
cctcttgatcctttggactcgttga

SEQ ID NO: 38850 - DNA, 22 bp, synthetic construct
  misc_feature 1..22: note = Synthetic Construct
  source 1..22: mol_type = other DNA
agagtctgtaggggaggacaca

SEQ ID NO: 38851 - DNA, 22 bp, synthetic construct
  misc_feature 1..22: note = Synthetic Construct
  source 1..22: mol_type = other DNA
cggcctagggagacaccagtta

SEQ ID NO: 38852 - DNA, 22 bp, synthetic construct
  misc_feature 1..22: note = Synthetic Construct
  source 1..22: mol_type = other DNA
cgtggtccaacagtgacaccta

SEQ ID NO: 38853 - DNA, 22 bp, synthetic construct
  misc_feature 1..22: note = Synthetic Construct
  source 1..22: mol_type = other DNA
ccatgaaacccacagcctctaa

SEQ ID NO: 38854 - DNA, 22 bp, synthetic construct
  misc_feature 1..22: note = Synthetic Construct
  source 1..22: mol_type = other DNA
tcccaaagcaggtggacagagt

SEQ ID NO: 38855 - DNA, 23 bp, synthetic construct
  misc_feature 1..23: note = Synthetic Construct
  source 1..23: mol_type = other DNA
tttctgttgagctcccatgttct

SEQ ID NO: 38856 - DNA, 20 bp, synthetic construct
  misc_feature 1..20: note = Synthetic Construct
  source 1..20: mol_type = other DNA
tccaagagtctgccctgtga

SEQ ID NO: 38857 - DNA, 23 bp, synthetic construct
  misc_feature 1..23: note = Synthetic Construct
  source 1..23: mol_type = other DNA
gggtatcagcaccagctctaaca

SEQ ID NO: 38858 - DNA, 21 bp, synthetic construct
  misc_feature 1..21: note = Synthetic Construct
  source 1..21: mol_type = other DNA
gacccagaagatgcacaggaa

SEQ ID NO: 38859 - DNA, 21 bp, synthetic construct
  misc_feature 1..21: note = Synthetic Construct
  source 1..21: mol_type = other DNA
tcaaccccaggagcccaaatg

SEQ ID NO: 38860 - DNA, 22 bp, synthetic construct
  misc_feature 1..22: note = Synthetic Construct
  source 1..22: mol_type = other DNA
tgccatgggtgattcttcatgt

SEQ ID NO: 38861 - DNA, 28 bp, synthetic construct
  misc_feature 1..28: note = Synthetic Construct
  source 1..28: mol_type = other DNA
gggacccaccataaataacaaagacact

SEQ ID NO: 38862 - DNA, 23 bp, synthetic construct
  misc_feature 1..23: note = Synthetic Construct
  source 1..23: mol_type = other DNA
gtctctggctttccttgcctaca

SEQ ID NO: 38863 - DNA, 23 bp, synthetic construct
  misc_feature 1..23: note = Synthetic Construct
  source 1..23: mol_type = other DNA
tgggtctcagggtggatagaaac

SEQ ID NO: 38864 - DNA, 28 bp, synthetic construct
  misc_feature 1..28: note = Synthetic Construct
  source 1..28: mol_type = other DNA
gctcctgatgtgtgtcataaacccttac

SEQ ID NO: 38865 - DNA, 21 bp, synthetic construct
  misc_feature 1..21: note = Synthetic Construct
  source 1..21: mol_type = other DNA
ccagacagcctcatactgcaa

SEQ ID NO: 38866 - DNA, 22 bp, synthetic construct
  misc_feature 1..22: note = Synthetic Construct
  source 1..22: mol_type = other DNA
agagagagctgaggggtacagt

SEQ ID NO: 38867 - DNA, 20 bp, synthetic construct
  misc_feature 1..20: note = Synthetic Construct
  source 1..20: mol_type = other DNA
gcatgcctggagcctgagat

SEQ ID NO: 38868 - DNA, 22 bp, synthetic construct
  misc_feature 1..22: note = Synthetic Construct
  source 1..22: mol_type = other DNA
ggaagagttgtgggaggcttac

SEQ ID NO: 38869 - DNA, 19 bp, synthetic construct
  misc_feature 1..19: note = Synthetic Construct
  source 1..19: mol_type = other DNA
gcagctgtgagtgcagctt

SEQ ID NO: 38870 - DNA, 22 bp, synthetic construct
  misc_feature 1..22: note = Synthetic Construct
  source 1..22: mol_type = other DNA
tccttcttgcctcccaccattg

SEQ ID NO: 38871 - DNA, 22 bp, synthetic construct
  misc_feature 1..22: note = Synthetic Construct
  source 1..22: mol_type = other DNA
aacagaagcttccctccagttc

SEQ ID NO: 38872 - DNA, 22 bp, synthetic construct
  misc_feature 1..22: note = Synthetic Construct
  source 1..22: mol_type = other DNA
tggtgaccagataaccctcaca

SEQ ID NO: 38873 - DNA, 22 bp, synthetic construct
  misc_feature 1..22: note = Synthetic Construct
  source 1..22: mol_type = other DNA
tgcaggaacagggaagcctatc

SEQ ID NO: 38874 - DNA, 23 bp, synthetic construct
  misc_feature 1..23: note = Synthetic Construct
  source 1..23: mol_type = other DNA
cccagtggatagcccctactcaa

SEQ ID NO: 38875 - DNA, 28 bp, synthetic construct
  misc_feature 1..28: note = Synthetic Construct
  source 1..28: mol_type = other DNA
gggaataactaatgaaaggggcctgaga

SEQ ID NO: 38876 - DNA, 24 bp, synthetic construct
  misc_feature 1..24: note = Synthetic Construct
  source 1..24: mol_type = other DNA
ggggtcagaatcaagttccaaagt

SEQ ID NO: 38877 - DNA, 22 bp, synthetic construct
  misc_feature 1..22: note = Synthetic Construct
  source 1..22: mol_type = other DNA
cctagactcccaggaccccttt

SEQ ID NO: 38878 - DNA, 22 bp, synthetic construct
  misc_feature 1..22: note = Synthetic Construct
  source 1..22: mol_type = other DNA
ggacaagcaggccctgtaaaag

SEQ ID NO: 38879 - DNA, 25 bp, synthetic construct
  misc_feature 1..25: note = Synthetic Construct
  source 1..25: mol_type = other DNA
cactcaccatttagggacaccaaca

SEQ ID NO: 38880 - DNA, 20 bp, synthetic construct
  misc_feature 1..20: note = Synthetic Construct
  source 1..20: mol_type = other DNA
tcctggttgctctggctcta

SEQ ID NO: 38881 - DNA, 25 bp, synthetic construct
  misc_feature 1..25: note = Synthetic Construct
  source 1..25: mol_type = other DNA
tcccatgaacacagtatggtagaag

SEQ ID NO: 38882 - DNA, 20 bp, synthetic construct
  misc_feature 1..20: note = Synthetic Construct
  source 1..20: mol_type = other DNA
ccttgggtctcgcagacttc

SEQ ID NO: 38883 - DNA, 29 bp, synthetic construct
  misc_feature 1..29: note = Synthetic Construct
  source 1..29: mol_type = other DNA
gcttgtctacattgcaggtagcaatacaa

SEQ ID NO: 38884 - DNA, 20 bp, synthetic construct
  misc_feature 1..20: note = Synthetic Construct
  source 1..20: mol_type = other DNA
tggcctgccacacaatgact

SEQ ID NO: 38885 - DNA, 21 bp, synthetic construct
  misc_feature 1..21: note = Synthetic Construct
  source 1..21: mol_type = other DNA
tgtgcagaaaggagacgcaaa

SEQ ID NO: 38886 - DNA, 19 bp, synthetic construct
  misc_feature 1..19: note = Synthetic Construct
  source 1..19: mol_type = other DNA
agcaccctgctgccaagaa

SEQ ID NO: 38887 - DNA, 24 bp, synthetic construct
  misc_feature 1..24: note = Synthetic Construct
  source 1..24: mol_type = other DNA
ccggggtgcataagtgaggctaat

SEQ ID NO: 38888 - DNA, 23 bp, synthetic construct
  misc_feature 1..23: note = Synthetic Construct
  source 1..23: mol_type = other DNA
gcggtaaagaagctggccaaatc

SEQ ID NO: 38889 - DNA, 30 bp, synthetic construct
  misc_feature 1..30: note = Synthetic Construct
  source 1..30: mol_type = other DNA
ggtgggattgtcattagttcttacaggttt

SEQ ID NO: 38890 - DNA, 20 bp, synthetic construct
  misc_feature 1..20: note = Synthetic Construct
  source 1..20: mol_type = other DNA
aaggagagcgaaggcaccat

SEQ ID NO: 38891 - DNA, 21 bp, synthetic construct
  misc_feature 1..21: note = Synthetic Construct
  source 1..21: mol_type = other DNA
ctcaaaccagcctgggaaaga

SEQ ID NO: 38892 - DNA, 21 bp, synthetic construct
  misc_feature 1..21: note = Synthetic Construct
  source 1..21: mol_type = other DNA
tcagggaagggatgggcttgt

SEQ ID NO: 38893 - DNA, 19 bp, synthetic construct
  misc_feature 1..19: note = Synthetic Construct
  source 1..19: mol_type = other DNA
ggcacaggctgaccgactt

SEQ ID NO: 38894 - DNA, 20 bp, synthetic construct
  misc_feature 1..20: note = Synthetic Construct
  source 1..20: mol_type = other DNA
tagctcagtggcccctcaaa

SEQ ID NO: 38895 - DNA, 18 bp, synthetic construct
  misc_feature 1..18: note = Synthetic Construct
  source 1..18: mol_type = other DNA
ggccattggctggcaaga

SEQ ID NO: 38896 - DNA, 22 bp, synthetic construct
  misc_feature 1..22: note = Synthetic Construct
  source 1..22: mol_type = other DNA
ggcagcctccttttgcagtaga

SEQ ID NO: 38897 - DNA, 22 bp, synthetic construct
  misc_feature 1..22: note = Synthetic Construct
  source 1..22: mol_type = other DNA
gcccaggaatttgaggccatag

SEQ ID NO: 38898 - DNA, 22 bp, synthetic construct
  misc_feature 1..22: note = Synthetic Construct
  source 1..22: mol_type = other DNA
tccctcctaccagagtgagtgt

SEQ ID NO: 38899 - DNA, 24 bp, synthetic construct
  misc_feature 1..24: note = Synthetic Construct
  source 1..24: mol_type = other DNA
cctgagaacatggctccaggaaag

SEQ ID NO: 38900 - DNA, 23 bp, synthetic construct
  misc_feature 1..23: note = Synthetic Construct
  source 1..23: mol_type = other DNA
gctcactgcagtctcaacttttg

SEQ ID NO: 38901 - DNA, 22 bp, synthetic construct
  misc_feature 1..22: note = Synthetic Construct
  source 1..22: mol_type = other DNA
ccagctctcagtgttcccatag

SEQ ID NO: 38902 - DNA, 27 bp, synthetic construct
  misc_feature 1..27: note = Synthetic Construct
  source 1..27: mol_type = other DNA
cctgtgaaataacagctgacaatcctt

SEQ ID NO: 38903 - DNA, 24 bp, synthetic construct
  misc_feature 1..24: note = Synthetic Construct
  source 1..24: mol_type = other DNA
gcctgatggaactgtgtgccttac

SEQ ID NO: 38904 - DNA, 26 bp, synthetic construct
  misc_feature 1..26: note = Synthetic Construct
  source 1..26: mol_type = other DNA
tgtgtctcctggagtttatctagttg

SEQ ID NO: 38905 - DNA, 21 bp, synthetic construct
  misc_feature 1..21: note = Synthetic Construct
  source 1..21: mol_type = other DNA
gggatcggcctactgaaggaa

SEQ ID NO: 38906 - DNA, 20 bp, synthetic construct
  misc_feature 1..20: note = Synthetic Construct
  source 1..20: mol_type = other DNA
gggcaccaggagtaatgctt

SEQ ID NO: 38907 - DNA, 26 bp, synthetic construct
  misc_feature 1..26: note = Synthetic Construct
  source 1..26: mol_type = other DNA
ccctgttaccattttccaaagcaaag

SEQ ID NO: 38908 - DNA, 21 bp, synthetic construct
  misc_feature 1..21: note = Synthetic Construct
  source 1..21: mol_type = other DNA
ggcaaggggctctgtcaagta

SEQ ID NO: 38909 - DNA, 22 bp, synthetic construct
  misc_feature 1..22: note = Synthetic Construct
  source 1..22: mol_type = other DNA
tcagggctacctgaccatcaca

SEQ ID NO: 38910 - DNA, 23 bp, synthetic construct
  misc_feature 1..23: note = Synthetic Construct
  source 1..23: mol_type = other DNA
cctctctcctaacagcccagaga

SEQ ID NO: 38911 - DNA, 20 bp, synthetic construct
  misc_feature 1..20: note = Synthetic Construct
  source 1..20: mol_type = other DNA
tgacaggtaggccagctttg

SEQ ID NO: 38912 - DNA, 20 bp, synthetic construct
  misc_feature 1..20: note = Synthetic Construct
  source 1..20: mol_type = other DNA
tcccacttctggcaggatga

SEQ ID NO: 38913 - DNA, 27 bp, synthetic construct
  misc_feature 1..27: note = Synthetic Construct
  source 1..27: mol_type = other DNA
ccaacccacctattgagaaaggaattg

SEQ ID NO: 38914 - DNA, 21 bp, synthetic construct
  misc_feature 1..21: note = Synthetic Construct
  source 1..21: mol_type = other DNA
actggaaggagggaacagctt

SEQ ID NO: 38915 - DNA, 20 bp, synthetic construct
  misc_feature 1..20: note = Synthetic Construct
  source 1..20: mol_type = other DNA
agccctgctgtaaggactgt

SEQ ID NO: 38916 - DNA, 24 bp, synthetic construct
  misc_feature 1..24: note = Synthetic Construct
  source 1..24: mol_type = other DNA
aatgcagaaagtcatggtgtgaag

SEQ ID NO: 38917 - DNA, 24 bp, synthetic construct
  misc_feature 1..24: note = Synthetic Construct
  source 1..24: mol_type = other DNA
caccaattgccactactgctcttc

SEQ ID NO: 38918 - DNA, 22 bp, synthetic construct
  misc_feature 1..22: note = Synthetic Construct
  source 1..22: mol_type = other DNA
gcttgggttatgcctgctgcaa

SEQ ID NO: 38919 - DNA, 24 bp, synthetic construct
  misc_feature 1..24: note = Synthetic Construct
  source 1..24: mol_type = other DNA
ctgcactcaggacttggagttttg

SEQ ID NO: 38920 - DNA, 22 bp, synthetic construct
  misc_feature 1..22: note = Synthetic Construct
  source 1..22: mol_type = other DNA
ggctctaaaacgcagggctgtt

SEQ ID NO: 38921 - DNA, 22 bp, synthetic construct
  misc_feature 1..22: note = Synthetic Construct
  source 1..22: mol_type = other DNA
gactaacaacagggagccagaa

SEQ ID NO: 38922 - DNA, 20 bp, synthetic construct
  misc_feature 1..20: note = Synthetic Construct
  source 1..20: mol_type = other DNA
acaaggcccctcctgctgaa

SEQ ID NO: 38923 - DNA, 21 bp, synthetic construct
  misc_feature 1..21: note = Synthetic Construct
  source 1..21: mol_type = other DNA
caggggctccaggttaggaat

SEQ ID NO: 38924 - DNA, 21 bp, synthetic construct
  misc_feature 1..21: note = Synthetic Construct
  source 1..21: mol_type = other DNA
tgcaccccatgaaggttttgt

SEQ ID NO: 38925 - DNA, 24 bp, synthetic construct
  misc_feature 1..24: note = Synthetic Construct
  source 1..24: mol_type = other DNA
ggtgagtggtgccactttcacttc

SEQ ID NO: 38926 - DNA, 19 bp, synthetic construct
  misc_feature 1..19: note = Synthetic Construct
  source 1..19: mol_type = other DNA
gggagtggcaccccagaaa

SEQ ID NO: 38927 - DNA, 20 bp, synthetic construct
  misc_feature 1..20: note = Synthetic Construct
  source 1..20: mol_type = other DNA
gcctgcttcaccgccttttt

SEQ ID NO: 38928 - DNA, 22 bp, synthetic construct
  misc_feature 1..22: note = Synthetic Construct
  source 1..22: mol_type = other DNA
tgcctcgaagaggtttggtatc

SEQ ID NO: 38929 - DNA, 20 bp, synthetic construct
  misc_feature 1..20: note = Synthetic Construct
  source 1..20: mol_type = other DNA
aggccgtggagggacgtgat

SEQ ID NO: 38930 - DNA, 22 bp, synthetic construct
  misc_feature 1..22: note = Synthetic Construct
  source 1..22: mol_type = other DNA
gccaaaggcaattcatgtgcaa

SEQ ID NO: 38931 - DNA, 22 bp, synthetic construct
  misc_feature 1..22: note = Synthetic Construct
  source 1..22: mol_type = other DNA
gtgctcccctcagagtgagatt

SEQ ID NO: 38932 - DNA, 24 bp, synthetic construct
  misc_feature 1..24: note = Synthetic Construct
  source 1..24: mol_type = other DNA
cctctccctctgaagcaagacagt

SEQ ID NO: 38933 - DNA, 20 bp, synthetic construct
  misc_feature 1..20: note = Synthetic Construct
  source 1..20: mol_type = other DNA
atggcacaggggcccaaaat

SEQ ID NO: 38934 - DNA, 27 bp, synthetic construct
  misc_feature 1..27: note = Synthetic Construct
  source 1..27: mol_type = other DNA
gggcttggagaatatacagtgatctga

SEQ ID NO: 38935 - DNA, 23 bp, synthetic construct
  misc_feature 1..23: note = Synthetic Construct
  source 1..23: mol_type = other DNA
aggacatggatgtgatgctgatg

SEQ ID NO: 38936 - DNA, 22 bp, synthetic construct
  misc_feature 1..22: note = Synthetic Construct
  source 1..22: mol_type = other DNA
ctgaaccagcccaggcaaaatc

SEQ ID NO: 38937 - DNA, 22 bp, synthetic construct
  misc_feature 1..22: note = Synthetic Construct
  source 1..22: mol_type = other DNA
ggtggaggaatcctgcctaaca

SEQ ID NO: 38938 - DNA, 24 bp, synthetic construct
  misc_feature 1..24: note = Synthetic Construct
  source 1..24: mol_type = other DNA
caagctgtagtagttcagccactt

SEQ ID NO: 38939 - DNA, 23 bp, synthetic construct
  misc_feature 1..23: note = Synthetic Construct
  source 1..23: mol_type = other DNA
gagctgggttctgaaggatgaag

SEQ ID NO: 38940 - DNA, 24 bp, synthetic construct
  misc_feature 1..24: note = Synthetic Construct
  source 1..24: mol_type = other DNA
ggagaagcagaagattcgacaaga

SEQ ID NO: 38941 - DNA, 20 bp, synthetic construct
  misc_feature 1..20: note = Synthetic Construct
  source 1..20: mol_type = other DNA
gacgctggcaagtcagtcaa

SEQ ID NO: 38942 - DNA, 20 bp, synthetic construct
  misc_feature 1..20: note = Synthetic Construct
  source 1..20: mol_type = other DNA
tgcccacttcccttcacaga

SEQ ID NO: 38943 - DNA, 26 bp, synthetic construct
  misc_feature 1..26: note = Synthetic Construct
  source 1..26: mol_type = other DNA
ggtggaagaaagaaccacagaaatga

SEQ ID NO: 38944 - DNA, 21 bp, synthetic construct
  misc_feature 1..21: note = Synthetic Construct
  source 1..21: mol_type = other DNA
tgcttagccatcatcgccatt

SEQ ID NO: 38945 - DNA, 25 bp, synthetic construct
  misc_feature 1..25: note = Synthetic Construct
  source 1..25: mol_type = other DNA
tctttggttccctctgttttaggaa

SEQ ID NO: 38946 - DNA, 21 bp, synthetic construct
  misc_feature 1..21: note = Synthetic Construct
  source 1..21: mol_type = other DNA
ggaagggtgttgccctgaaca

SEQ ID NO: 38947 - DNA, 22 bp, synthetic construct
  misc_feature 1..22: note = Synthetic Construct
  source 1..22: mol_type = other DNA
gtcccattgtttctgcccaact

SEQ ID NO: 38948 - DNA, 22 bp, synthetic construct
  misc_feature 1..22: note = Synthetic Construct
  source 1..22: mol_type = other DNA
ggaccaatgagcagaagaggaa

SEQ ID NO: 38949 - DNA, 29 bp, synthetic construct
  misc_feature 1..29: note = Synthetic Construct
  source 1..29: mol_type = other DNA
cagtttcatgtactaggagaagtgtgaac

SEQ ID NO: 38950 - DNA, 24 bp, synthetic construct
  misc_feature 1..24: note = Synthetic Construct
  source 1..24: mol_type = other DNA
gcaatgactggagtgtagggtatg

SEQ ID NO: 38951 - DNA, 26 bp, synthetic construct
  misc_feature 1..26: note = Synthetic Construct
  source 1..26: mol_type = other DNA
gaggctatttagaccttccagccata

SEQ ID NO: 38952 - DNA, 20 bp, synthetic construct
  misc_feature 1..20: note = Synthetic Construct
  source 1..20: mol_type = other DNA
cctggccatttgctccagaa

SEQ ID NO: 38953 - DNA, 21 bp, synthetic construct
  misc_feature 1..21: note = Synthetic Construct
  source 1..21: mol_type = other DNA
catttgccagggccattcact

SEQ ID NO: 38954 - DNA, 25 bp, synthetic construct
  misc_feature 1..25: note = Synthetic Construct
  source 1..25: mol_type = other DNA
cattaatgcctgagtagccctcttc

SEQ ID NO: 38955 - DNA, 20 bp, synthetic construct
  misc_feature 1..20: note = Synthetic Construct
  source 1..20: mol_type = other DNA
tctccccactctggctgtga

SEQ ID NO: 38956 - DNA, 23 bp, synthetic construct
  misc_feature 1..23: note = Synthetic Construct
  source 1..23: mol_type = other DNA
cacctggaagccagagaatgtca

SEQ ID NO: 38957 - DNA, 21 bp, synthetic construct
  misc_feature 1..21: note = Synthetic Construct
  source 1..21: mol_type = other DNA
acaacccaagggatcggtgta

SEQ ID NO: 38958 - DNA, 21 bp, synthetic construct
  misc_feature 1..21: note = Synthetic Construct
  source 1..21: mol_type = other DNA
gtgtcagtagggtccggttct

SEQ ID NO: 38959 - DNA, 20 bp, synthetic construct
  misc_feature 1..20: note = Synthetic Construct
  source 1..20: mol_type = other DNA
acctgtgagtgcgagtccat

SEQ ID NO: 38960 - DNA, 22 bp, synthetic construct
  misc_feature 1..22: note = Synthetic Construct
  source 1..22: mol_type = other DNA
tcccatccaaggcagaggtact

SEQ ID NO: 38961 - DNA, 19 bp, synthetic construct
  misc_feature 1..19: note = Synthetic Construct
  source 1..19: mol_type = other DNA
cctgctgcccaagcaactt

SEQ ID NO: 38962 - DNA, 26 bp, synthetic construct
  misc_feature 1..26: note = Synthetic Construct
  source 1..26: mol_type = other DNA
ccccttttatcctataaaccctcaca

SEQ ID NO: 38963 - DNA, 30 bp, synthetic construct
  misc_feature 1..30: note = Synthetic Construct
  source 1..30: mol_type = other DNA
gctgtttacagagacctttgaagtcagaac

SEQ ID NO: 38964 - DNA, 18 bp, synthetic construct
  misc_feature 1..18: note = Synthetic Construct
  source 1..18: mol_type = other DNA
agccagggctgtctgcat

SEQ ID NO: 38965 - DNA, 22 bp, synthetic construct
  misc_feature 1..22: note = Synthetic Construct
  source 1..22: mol_type = other DNA
cagcgaaccatgagctcacatc

SEQ ID NO: 38966 - DNA, 22 bp, synthetic construct
  misc_feature 1..22: note = Synthetic Construct
  source 1..22: mol_type = other DNA
cccatgagaagcctgggtcttg

SEQ ID NO: 38967 - DNA, 27 bp, synthetic construct
  misc_feature 1..27: note = Synthetic Construct
  source 1..27: mol_type = other DNA
gagctttaaagaacaagggtacctgat

SEQ ID NO: 38968 - DNA, 21 bp, synthetic construct
  misc_feature 1..21: note = Synthetic Construct
  source 1..21: mol_type = other DNA
agggacacagagccgacacat

SEQ ID NO: 38969 - DNA, 27 bp, synthetic construct
  misc_feature 1..27: note = Synthetic Construct
  source 1..27: mol_type = other DNA
caccactgagagcaaagaagagtcatt

SEQ ID NO: 38970 - DNA, 20 bp, synthetic construct
  misc_feature 1..20: note = Synthetic Construct
  source 1..20: mol_type = other DNA
gcgccactaaccatgtcaga

SEQ ID NO: 38971 - DNA, 22 bp, synthetic construct
  misc_feature 1..22: note = Synthetic Construct
  source 1..22: mol_type = other DNA
ggcgtccaagcacatgaaggaa

SEQ ID NO: 38972 - DNA, 23 bp, synthetic construct
  misc_feature 1..23: note = Synthetic Construct
  source 1..23: mol_type = other DNA
gcttactagtgaggcagggttca

SEQ ID NO: 38973 - DNA, 22 bp, synthetic construct
  misc_feature 1..22: note = Synthetic Construct
  source 1..22: mol_type = other DNA
gctgccacagagaacagcaatg

SEQ ID NO: 38974 - DNA, 19 bp, synthetic construct
  misc_feature 1..19: note = Synthetic Construct
  source 1..19: mol_type = other DNA
aacagcagcgcccctcaat

SEQ ID NO: 38975 - DNA, 21 bp, synthetic construct
  misc_feature 1..21: note = Synthetic Construct
  source 1..21: mol_type = other DNA
taggtctgcccgccttacagt

SEQ ID NO: 38976 - DNA, 22 bp, synthetic construct
  misc_feature 1..22: note = Synthetic Construct
  source 1..22: mol_type = other DNA
ggaaaccaggacaagcgtcact

SEQ ID NO: 38977 - DNA, 20 bp, synthetic construct
  misc_feature 1..20: note = Synthetic Construct
  source 1..20: mol_type = other DNA
tgcaagcctcatggcctcaa

SEQ ID NO: 38978 - DNA, 25 bp, synthetic construct
  misc_feature 1..25: note = Synthetic Construct
  source 1..25: mol_type = other DNA
acattgagaaggaagaaggagcatt

SEQ ID NO: 38979 - DNA, 25 bp, synthetic construct
  misc_feature 1..25: note = Synthetic Construct
  source 1..25: mol_type = other DNA
gggagattttgggaggcgattaagt

SEQ ID NO: 38980 - DNA, 21 bp, synthetic construct
  misc_feature 1..21: note = Synthetic Construct
  source 1..21: mol_type = other DNA
tgatctgaccccagcccttct

SEQ ID NO: 38981 - DNA, 20 bp, synthetic construct
  misc_feature 1..20: note = Synthetic Construct
  source 1..20: mol_type = other DNA
agcagggtggggagtgtaga

SEQ ID NO: 38982 - DNA, 23 bp, synthetic construct
  misc_feature 1..23: note = Synthetic Construct
  source 1..23: mol_type = other DNA
gcctcatctccatgacaaccaaa

SEQ ID NO: 38983 - DNA, 19 bp, synthetic construct
  misc_feature 1..19: note = Synthetic Construct
  source 1..19: mol_type = other DNA
gggtcagcagccctggatt

SEQ ID NO: 38984 - DNA, 23 bp, synthetic construct
  misc_feature 1..23: note = Synthetic Construct
  source 1..23: mol_type = other DNA
ggctttggccttttgctcataca

SEQ ID NO: 38985 - DNA, 26 bp, synthetic construct
  misc_feature 1..26: note = Synthetic Construct
  source 1..26: mol_type = other DNA
gacagttaccctcataaatgggaaga

SEQ ID NO: 38986 - DNA, 20 bp, synthetic construct
  misc_feature 1..20: note = Synthetic Construct
  source 1..20: mol_type = other DNA
aaggtcagggctgcctgttt

SEQ ID NO: 38987 - DNA, 24 bp, synthetic construct
  misc_feature 1..24: note = Synthetic Construct
  source 1..24: mol_type = other DNA
tcaggagccaagtttatgcttgat

SEQ ID NO: 38988 - DNA, 20 bp, synthetic construct
  misc_feature 1..20: note = Synthetic Construct
  source 1..20: mol_type = other DNA
gcccctcacaaagcctcatt

SEQ ID NO: 38989 - DNA, 19 bp, synthetic construct
  misc_feature 1..19: note = Synthetic Construct
  source 1..19: mol_type = other DNA
tgatgcccggaggcagatt

SEQ ID NO: 38990 - DNA, 22 bp, synthetic construct
  misc_feature 1..22: note = Synthetic Construct
  source 1..22: mol_type = other DNA
ttgggagtagaggccaggacaa

SEQ ID NO: 38991 - DNA, 24 bp, synthetic construct
  misc_feature 1..24: note = Synthetic Construct
  source 1..24: mol_type = other DNA
gcccctgtttattcctcccctgat

SEQ ID NO: 38992 - DNA, 22 bp, synthetic construct
  misc_feature 1..22: note = Synthetic Construct
  source 1..22: mol_type = other DNA
gaagggcctgtttttcccaaga

SEQ ID NO: 38993 - DNA, 21 bp, synthetic construct
  misc_feature 1..21: note = Synthetic Construct
  source 1..21: mol_type = other DNA
catccagagaggccaccatct

SEQ ID NO: 38994 - DNA, 24 bp, synthetic construct
  misc_feature 1..24: note = Synthetic Construct
  source 1..24: mol_type = other DNA
gccttcacttaaatgtcaggcaaa

SEQ ID NO: 38995 - DNA, 21 bp, synthetic construct
  misc_feature 1..21: note = Synthetic Construct
  source 1..21: mol_type = other DNA
acctctggggagagggtcctt

SEQ ID NO: 38996 - DNA, 19 bp, synthetic construct
  misc_feature 1..19: note = Synthetic Construct
  source 1..19: mol_type = other DNA
ggcctggcttcccatggtt

SEQ ID NO: 38997 - DNA, 21 bp, synthetic construct
  misc_feature 1..21: note = Synthetic Construct
  source 1..21: mol_type = other DNA
ttgatctcaccgcccctgaac

SEQ ID NO: 38998 - DNA, 24 bp, synthetic construct
  misc_feature 1..24: note = Synthetic Construct
  source 1..24: mol_type = other DNA
cactgggacacctacgttccttac

SEQ ID NO: 38999 - DNA, 22 bp, synthetic construct
  misc_feature 1..22: note = Synthetic Construct
  source 1..22: mol_type = other DNA
acggtcaggcctttctcgtaca

SEQ ID NO: 39000 - DNA, 28 bp, synthetic construct
  misc_feature 1..28: note = Synthetic Construct
  source 1..28: mol_type = other DNA
ccttcattccagtgtgatacagaacaac

SEQ ID NO: 39001 - DNA, 23 bp, synthetic construct
  misc_feature 1..23: note = Synthetic Construct
  source 1..23: mol_type = other DNA
ggccagatgattgctccctctac

SEQ ID NO: 39002 - DNA, 22 bp, synthetic construct
  misc_feature 1..22: note = Synthetic Construct
  source 1..22: mol_type = other DNA
cccgattcctgactctttgcat

SEQ ID NO: 39003 - DNA, 22 bp, synthetic construct
  misc_feature 1..22: note = Synthetic Construct
  source 1..22: mol_type = other DNA
ccattcagcaggtcccaagttt

SEQ ID NO: 39004 - DNA, 24 bp, synthetic construct
  misc_feature 1..24: note = Synthetic Construct
  source 1..24: mol_type = other DNA
cttcaggttgtccttaaccacgtt

SEQ ID NO: 39005 - DNA, 19 bp, synthetic construct
  misc_feature 1..19: note = Synthetic Construct
  source 1..19: mol_type = other DNA
gcctgggtgcaaggctcaa

SEQ ID NO: 39006 - DNA, 19 bp, synthetic construct
  misc_feature 1..19: note = Synthetic Construct
  source 1..19: mol_type = other DNA
gcgaaggccaccacctcat

SEQ ID NO: 39007 - DNA, 23 bp, synthetic construct
  misc_feature 1..23: note = Synthetic Construct
  source 1..23: mol_type = other DNA
gagctccacgtgtacttactgaa

SEQ ID NO: 39008 - DNA, 25 bp, synthetic construct
  misc_feature 1..25: note = Synthetic Construct
  source 1..25: mol_type = other DNA
tccttcatgtaggcaggtagaaatg

SEQ ID NO: 39009 - DNA, 24 bp, synthetic construct
  misc_feature 1..24: note = Synthetic Construct
  source 1..24: mol_type = other DNA
ggggaggtttgaacttggctggaa

SEQ ID NO: 39010 - DNA, 30 bp, synthetic construct
  misc_feature 1..30: note = Synthetic Construct
  source 1..30: mol_type = other DNA
gccaaatagggacttctaagtacaacacaa

SEQ ID NO: 39011 - DNA, 19 bp, synthetic construct
  misc_feature 1..19: note = Synthetic Construct
  source 1..19: mol_type = other DNA
aatgctgctgtgggcagaa

SEQ ID NO: 39012 - DNA, 25 bp, synthetic construct
  misc_feature 1..25: note = Synthetic Construct
  source 1..25: mol_type = other DNA
tcagagagtctgaaacgaatcacat

SEQ ID NO: 39013 - DNA, 21 bp, synthetic construct
  misc_feature 1..21: note = Synthetic Construct
  source 1..21: mol_type = other DNA
tgcccaggtcattacccttct

SEQ ID NO: 39014 - DNA, 21 bp, synthetic construct
  misc_feature 1..21: note = Synthetic Construct
  source 1..21: mol_type = other DNA
cctcctacccacaagcacaca

SEQ ID NO: 39015 - DNA, 21 bp, synthetic construct
  misc_feature 1..21: note = Synthetic Construct
  source 1..21: mol_type = other DNA
ggaacgaggagggcaccattt

SEQ ID NO: 39016 - DNA, 22 bp, synthetic construct
  misc_feature 1..22: note = Synthetic Construct
  source 1..22: mol_type = other DNA
tgggtgttctcacccagttaca

SEQ ID NO: 39017 - DNA, 23 bp, synthetic construct
  misc_feature 1..23: note = Synthetic Construct
  source 1..23: mol_type = other DNA
ccatcctcagggtgttcttgcta

SEQ ID NO: 39018 - DNA, 22 bp, synthetic construct
  misc_feature 1..22: note = Synthetic Construct
  source 1..22: mol_type = other DNA
gctggagcgatactcgcttttc

SEQ ID NO: 39019 - DNA, 22 bp, synthetic construct
  misc_feature 1..22: note = Synthetic Construct
  source 1..22: mol_type = other DNA
tggggtggaagagtgaacaaac

SEQ ID NO: 39020 - DNA, 22 bp, synthetic construct
  misc_feature 1..22: note = Synthetic Construct
  source 1..22: mol_type = other DNA
ggctgatgcgaggtgagtgaaa

SEQ ID NO: 39021 - DNA, 21 bp, synthetic construct
  misc_feature 1..21: note = Synthetic Construct
  source 1..21: mol_type = other DNA
ggcagtttgtccagccttaca

SEQ ID NO: 39022 - DNA, 22 bp, synthetic construct
  misc_feature 1..22: note = Synthetic Construct
  source 1..22: mol_type = other DNA
tgtccacacagaagctgctaat

SEQ ID NO: 39023 - DNA, 24 bp, synthetic construct
  misc_feature 1..24: note = Synthetic Construct
  source 1..24: mol_type = other DNA
ttccaggtgtcaaatacacgagtt

SEQ ID NO: 39024 - DNA, 24 bp, synthetic construct
  misc_feature 1..24: note = Synthetic Construct
  source 1..24: mol_type = other DNA
gtacagtgctcagtgactaggttt

SEQ ID NO: 39025 - DNA, 20 bp, synthetic construct
  misc_feature 1..20: note = Synthetic Construct
  source 1..20: mol_type = other DNA
aaatggcgctgggagaggaa

SEQ ID NO: 39026 - DNA, 30 bp, synthetic construct
  misc_feature 1..30: note = Synthetic Construct
  source 1..30: mol_type = other DNA
gggatgcttcctaatgcttctttaagacta

SEQ ID NO: 39027 - DNA, 22 bp, synthetic construct
  misc_feature 1..22: note = Synthetic Construct
  source 1..22: mol_type = other DNA
tgtcctcaaggagccatgaaag

SEQ ID NO: 39028 - DNA, 27 bp, synthetic construct
  misc_feature 1..27: note = Synthetic Construct
  source 1..27: mol_type = other DNA
gctctacgatacaccatagctccctta

SEQ ID NO: 39029 - DNA, 22 bp, synthetic construct
  misc_feature 1..22: note = Synthetic Construct
  source 1..22: mol_type = other DNA
cctgaacagggtgagggaggta

SEQ ID NO: 39030 - DNA, 27 bp, synthetic construct
  misc_feature 1..27: note = Synthetic Construct
  source 1..27: mol_type = other DNA
gctggacaattttctaggtgctgactt

SEQ ID NO: 39031 - DNA, 20 bp, synthetic construct
  misc_feature 1..20: note = Synthetic Construct
  source 1..20: mol_type = other DNA
ggcctcagcctgctttcact

SEQ ID NO: 39032 - DNA, 23 bp, synthetic construct
  misc_feature 1..23: note = Synthetic Construct
  source 1..23: mol_type = other DNA
gctgatggattgactggctgtga

SEQ ID NO: 39033 - DNA, 21 bp, synthetic construct
  misc_feature 1..21: note = Synthetic Construct
  source 1..21: mol_type = other DNA
agaggccctcaccatgtaaga

SEQ ID NO: 39034 - DNA, 25 bp, synthetic construct
  misc_feature 1..25: note = Synthetic Construct
  source 1..25: mol_type = other DNA
gctctcagtaaaggagggtgaggaa

SEQ ID NO: 39035 - DNA, 25 bp, synthetic construct
  misc_feature 1..25: note = Synthetic Construct
  source 1..25: mol_type = other DNA
caggattctgaggtcatggaggaat

SEQ ID NO: 39036 - DNA, 22 bp, synthetic construct
  misc_feature 1..22: note = Synthetic Construct
  source 1..22: mol_type = other DNA
ctcagctcttcaccaggaccat

SEQ ID NO: 39037 - DNA, 24 bp, synthetic construct
  misc_feature 1..24: note = Synthetic Construct
  source 1..24: mol_type = other DNA
ggacatcgaccccagttagtgttc

SEQ ID NO: 39038 - DNA, 20 bp, synthetic construct
  misc_feature 1..20: note = Synthetic Construct
  source 1..20: mol_type = other DNA
cccaaagtgcaaggctgtca

SEQ ID NO: 39039 - DNA, 22 bp, synthetic construct
  misc_feature 1..22: note = Synthetic Construct
  source 1..22: mol_type = other DNA
gtcccatgtttggggatagcat

SEQ ID NO: 39040 - DNA, 22 bp, synthetic construct
  misc_feature 1..22: note = Synthetic Construct
  source 1..22: mol_type = other DNA
tgggtgcctcattctgagtaca

SEQ ID NO: 39041 - DNA, 21 bp, synthetic construct
  misc_feature 1..21: note = Synthetic Construct
  source 1..21: mol_type = other DNA
agaccttggacttggtgcaaa

SEQ ID NO: 39042 - DNA, 24 bp, synthetic construct
  misc_feature 1..24: note = Synthetic Construct
  source 1..24: mol_type = other DNA
actctgcctagtgtccatctttct

SEQ ID NO: 39043 - DNA, 26 bp, synthetic construct
  misc_feature 1..26: note = Synthetic Construct
  source 1..26: mol_type = other DNA
ggtaccaaccaccgatttctgagttc

SEQ ID NO: 39044 - DNA, 22 bp, synthetic construct
  misc_feature 1..22: note = Synthetic Construct
  source 1..22: mol_type = other DNA
gtcagggtgcaaggtagctaag

SEQ ID NO: 39045 - DNA, 22 bp, synthetic construct
  misc_feature 1..22: note = Synthetic Construct
  source 1..22: mol_type = other DNA
ggttaggcaggaagccaagtct

SEQ ID NO: 39046 - DNA, 22 bp, synthetic construct
  misc_feature 1..22: note = Synthetic Construct
  source 1..22: mol_type = other DNA
gcagggagaagcattgtcaaga

SEQ ID NO: 39047 - DNA, 22 bp, synthetic construct
  misc_feature 1..22: note = Synthetic Construct
  source 1..22: mol_type = other DNA
ggtttgaccccacagccttagt

SEQ ID NO: 39048 - DNA, 22 bp, synthetic construct
  misc_feature 1..22: note = Synthetic Construct
  source 1..22: mol_type = other DNA
gccctggaatgtggagtctatc

SEQ ID NO: 39049 - DNA, 24 bp, synthetic construct
  misc_feature 1..24: note = Synthetic Construct
  source 1..24: mol_type = other DNA
gaagtagccactctttgcttccaa

SEQ ID NO: 39050 - DNA, 26 bp, synthetic construct
  misc_feature 1..26: note = Synthetic Construct
  source 1..26: mol_type = other DNA
ccaccttctcaggttgcatctctatc

SEQ ID NO: 39051 - DNA, 24 bp, synthetic construct
  misc_feature 1..24: note = Synthetic Construct
  source 1..24: mol_type = other DNA
ccccacagagcagtgagaataaca

SEQ ID NO: 39052 - DNA, 22 bp, synthetic construct
  misc_feature 1..22: note = Synthetic Construct
  source 1..22: mol_type = other DNA
gctgcacatttgtgctggattg

SEQ ID NO: 39053 - DNA, 21 bp, synthetic construct
  misc_feature 1..21: note = Synthetic Construct
  source 1..21: mol_type = other DNA
ccatcttggcctccgcctatg

SEQ ID NO: 39054 - DNA, 24 bp, synthetic construct
  misc_feature 1..24: note = Synthetic Construct
  source 1..24: mol_type = other DNA
gctggttctctgagctgacaccaa

SEQ ID NO: 39055 - DNA, 20 bp, synthetic construct
  misc_feature 1..20: note = Synthetic Construct
  source 1..20: mol_type = other DNA
aggcctccacagtggtaaga

SEQ ID NO: 39056 - DNA, 19 bp, synthetic construct
  misc_feature 1..19: note = Synthetic Construct
  source 1..19: mol_type = other DNA
cggcctggagatgccttgt

SEQ ID NO: 39057 - DNA, 19 bp, synthetic construct
  misc_feature 1..19: note = Synthetic Construct
  source 1..19: mol_type = other DNA
cctttgggctgccccttgt

SEQ ID NO: 39058 - DNA, 26 bp, synthetic construct
  misc_feature 1..26: note = Synthetic Construct
  source 1..26: mol_type = other DNA
gcatactagaaggctagggtgtgaga

SEQ ID NO: 39059 - DNA, 18 bp, synthetic construct
  misc_feature 1..18: note = Synthetic Construct
  source 1..18: mol_type = other DNA
atggccaggaggcacctt

SEQ ID NO: 39060 - DNA, 22 bp, synthetic construct
  misc_feature 1..22: note = Synthetic Construct
  source 1..22: mol_type = other DNA
tgaggggccttggggattatga

SEQ ID NO: 39061 - DNA, 22 bp, synthetic construct
  misc_feature 1..22: note = Synthetic Construct
  source 1..22: mol_type = other DNA
ttcagggagctgtccctcatct

SEQ ID NO: 39062 - DNA, 24 bp, synthetic construct
  misc_feature 1..24: note = Synthetic Construct
  source 1..24: mol_type = other DNA
gtgactcgcatagaggatgtttca

SEQ ID NO: 39063 - DNA, 20 bp, synthetic construct
  misc_feature 1..20: note = Synthetic Construct
  source 1..20: mol_type = other DNA
cccaggcaactgcaccaatg

SEQ ID NO: 39064 - DNA, 21 bp, synthetic construct
  misc_feature 1..21: note = Synthetic Construct
  source 1..21: mol_type = other DNA
aagaggggcctctgcttgtag

SEQ ID NO: 39065 - DNA, 19 bp, synthetic construct
  misc_feature 1..19: note = Synthetic Construct
  source 1..19: mol_type = other DNA
agacctcaggccgctcctt

SEQ ID NO: 39066 - DNA, 21 bp, synthetic construct
  misc_feature 1..21: note = Synthetic Construct
  source 1..21: mol_type = other DNA
tggtctcccatccccttcaca

SEQ ID NO: 39067 - DNA, 24 bp, synthetic construct
  misc_feature 1..24: note = Synthetic Construct
  source 1..24: mol_type = other DNA
gggagaaggaagaagaggttccta

SEQ ID NO: 39068 - DNA, 19 bp, synthetic construct
  misc_feature 1..19: note = Synthetic Construct
  source 1..19: mol_type = other DNA
cggcaggcacaggattgaa

SEQ ID NO: 39069 - DNA, 22 bp, synthetic construct
  misc_feature 1..22: note = Synthetic Construct
  source 1..22: mol_type = other DNA
agcagcaactccctccttcttc

SEQ ID NO: 39070 - DNA, 24 bp, synthetic construct
  misc_feature 1..24: note = Synthetic Construct
  source 1..24: mol_type = other DNA
cagcagctctgtgaatttctgtga

SEQ ID NO: 39071 - DNA, 22 bp, synthetic construct
  misc_feature 1..22: note = Synthetic Construct
  source 1..22: mol_type = other DNA
gggtcccaggcaagcagtgtaa

SEQ ID NO: 39072 - DNA, 23 bp, synthetic construct
  misc_feature 1..23: note = Synthetic Construct
  source 1..23: mol_type = other DNA
ccagacagaaaacacctggcatt

SEQ ID NO: 39073 - DNA, 24 bp, synthetic construct
  misc_feature 1..24: note = Synthetic Construct
  source 1..24: mol_type = other DNA
gggtagataacgagagcaggtttg

SEQ ID NO: 39074 - DNA, 23 bp, synthetic construct
  misc_feature 1..23: note = Synthetic Construct
  source 1..23: mol_type = other DNA
ggcacctgtgtgaacatggtagt

SEQ ID NO: 39075 - DNA, 26 bp, synthetic construct
  misc_feature 1..26: note = Synthetic Construct
  source 1..26: mol_type = other DNA
gcataggtctccttctccaagtcgta

SEQ ID NO: 39076 - DNA, 22 bp, synthetic construct
  misc_feature 1..22: note = Synthetic Construct
  source 1..22: mol_type = other DNA
tgctaatgcagggtgggaccta

SEQ ID NO: 39077 - DNA, 22 bp, synthetic construct
  misc_feature 1..22: note = Synthetic Construct
  source 1..22: mol_type = other DNA
aggccctgtttaccccatctga

SEQ ID NO: 39078 - DNA, 22 bp, synthetic construct
  misc_feature 1..22: note = Synthetic Construct
  source 1..22: mol_type = other DNA
caccacatttctgggcctctac

SEQ ID NO: 39079 - DNA, 24 bp, synthetic construct
  misc_feature 1..24: note = Synthetic Construct
  source 1..24: mol_type = other DNA
gggttgaagtggagatcgggaaag

SEQ ID NO: 39080 - DNA, 22 bp, synthetic construct
  misc_feature 1..22: note = Synthetic Construct
  source 1..22: mol_type = other DNA
gcaggaaagcagagtgtcaatg

SEQ ID NO: 39081 - DNA, 22 bp, synthetic construct
  misc_feature 1..22: note = Synthetic Construct
  source 1..22: mol_type = other DNA
ttgatccagctcctgccacttg

SEQ ID NO: 39082 - DNA, 20 bp, synthetic construct
  misc_feature 1..20: note = Synthetic Construct
  source 1..20: mol_type = other DNA
agtagggccacagtgggaat

SEQ ID NO: 39083 - DNA, 22 bp, synthetic construct
  misc_feature 1..22: note = Synthetic Construct
  source 1..22: mol_type = other DNA
tgacactggggagtcctgtagt

SEQ ID NO: 39084 - DNA, 22 bp, synthetic construct
  misc_feature 1..22: note = Synthetic Construct
  source 1..22: mol_type = other DNA
gggagaggagttcaacctgaga

SEQ ID NO: 39085 - DNA, 25 bp, synthetic construct
  misc_feature 1..25: note = Synthetic Construct
  source 1..25: mol_type = other DNA
ccacacttacttttagggctgatct

SEQ ID NO: 39086 - DNA, 22 bp, synthetic construct
  misc_feature 1..22: note = Synthetic Construct
  source 1..22: mol_type = other DNA
ggagtgcgagtccaggaatgtt

SEQ ID NO: 39087 - DNA, 21 bp, synthetic construct
  misc_feature 1..21: note = Synthetic Construct
  source 1..21: mol_type = other DNA
acccctccttggaccatctgt

SEQ ID NO: 39088 - DNA, 20 bp, synthetic construct
  misc_feature 1..20: note = Synthetic Construct
  source 1..20: mol_type = other DNA
atgctaaggcaggcctctgt

SEQ ID NO: 39089 - DNA, 20 bp, synthetic construct
  misc_feature 1..20: note = Synthetic Construct
  source 1..20: mol_type = other DNA
ggatgggagtctgcccttga

SEQ ID NO: 39090 - DNA, 22 bp, synthetic construct
  misc_feature 1..22: note = Synthetic Construct
  source 1..22: mol_type = other DNA
gcacagctcaagggaaggagaa

SEQ ID NO: 39091 - DNA, 20 bp, synthetic construct
  misc_feature 1..20: note = Synthetic Construct
  source 1..20: mol_type = other DNA
ggtccctgcagctttcatca

SEQ ID NO: 39092 - DNA, 22 bp, synthetic construct
  misc_feature 1..22: note = Synthetic Construct
  source 1..22: mol_type = other DNA
ggagctcttccagcctttgagt

SEQ ID NO: 39093 - DNA, 20 bp, synthetic construct
  misc_feature 1..20: note = Synthetic Construct
  source 1..20: mol_type = other DNA
tgtgcagccaactgcgtttc

SEQ ID NO: 39094 - DNA, 25 bp, synthetic construct
  misc_feature 1..25: note = Synthetic Construct
  source 1..25: mol_type = other DNA
aagaacctaccactttcacatccaa

SEQ ID NO: 39095 - DNA, 22 bp, synthetic construct
  misc_feature 1..22: note = Synthetic Construct
  source 1..22: mol_type = other DNA
ttgttttaccctccccttgctt

SEQ ID NO: 39096 - DNA, 22 bp, synthetic construct
  misc_feature 1..22: note = Synthetic Construct
  source 1..22: mol_type = other DNA
cccaggcactggaattctccat

SEQ ID NO: 39097 - DNA, 27 bp, synthetic construct
  misc_feature 1..27: note = Synthetic Construct
  source 1..27: mol_type = other DNA
ggagggattggcatatgtcagtgtaag

SEQ ID NO: 39098 - DNA, 20 bp, synthetic construct
  misc_feature 1..20: note = Synthetic Construct
  source 1..20: mol_type = other DNA
ggctggaagtttgggtgtga

SEQ ID NO: 39099 - DNA, 21 bp, synthetic construct
  misc_feature 1..21: note = Synthetic Construct
  source 1..21: mol_type = other DNA
gctccagagtttcaccacaca

SEQ ID NO: 39100 - DNA, 20 bp, synthetic construct
  misc_feature 1..20: note = Synthetic Construct
  source 1..20: mol_type = other DNA
agcgacagtgcgaggacata

SEQ ID NO: 39101 - DNA, 26 bp, synthetic construct
  misc_feature 1..26: note = Synthetic Construct
  source 1..26: mol_type = other DNA
gtttcccatcgttgatacttgcattc

SEQ ID NO: 39102 - DNA, 24 bp, synthetic construct
  misc_feature 1..24: note = Synthetic Construct
  source 1..24: mol_type = other DNA
ccctcagctcacaagaacctgact

SEQ ID NO: 39103 - DNA, 22 bp, synthetic construct
  misc_feature 1..22: note = Synthetic Construct
  source 1..22: mol_type = other DNA
aggacccctttccctagagttc

SEQ ID NO: 39104 - DNA, 21 bp, synthetic construct
  misc_feature 1..21: note = Synthetic Construct
  source 1..21: mol_type = other DNA
aggacaccaggagcagaccat

SEQ ID NO: 39105 - DNA, 20 bp, synthetic construct
  misc_feature 1..20: note = Synthetic Construct
  source 1..20: mol_type = other DNA
tgtggaacctcccaccacat

SEQ ID NO: 39106 - DNA, 23 bp, synthetic construct
  misc_feature 1..23: note = Synthetic Construct
  source 1..23: mol_type = other DNA
cacaggctggcagttaaaacaga

SEQ ID NO: 39107 - DNA, 25 bp, synthetic construct
  misc_feature 1..25: note = Synthetic Construct
  source 1..25: mol_type = other DNA
aggtttgagaacctccctatgtagt

SEQ ID NO: 39108 - DNA, 23 bp, synthetic construct
  misc_feature 1..23: note = Synthetic Construct
  source 1..23: mol_type = other DNA
cccaggctctagcaaaggtcttc

SEQ ID NO: 39109 - DNA, 26 bp, synthetic construct
  misc_feature 1..26: note = Synthetic Construct
  source 1..26: mol_type = other DNA
ggttacaacagcttgtaggtccttga

SEQ ID NO: 39110 - DNA, 22 bp, synthetic construct
  misc_feature 1..22: note = Synthetic Construct
  source 1..22: mol_type = other DNA
aaaaagagggcctggaatgtga

SEQ ID NO: 39111 - DNA, 22 bp, synthetic construct
  misc_feature 1..22: note = Synthetic Construct
  source 1..22: mol_type = other DNA
agagcctggggaagagaggtta

SEQ ID NO: 39112 - DNA, 26 bp, synthetic construct
  misc_feature 1..26: note = Synthetic Construct
  source 1..26: mol_type = other DNA
cctctgtggaggatagaatggctact

SEQ ID NO: 39113 - DNA, 21 bp, synthetic construct
  misc_feature 1..21: note = Synthetic Construct
  source 1..21: mol_type = other DNA
gccttccaccctgttggattt

SEQ ID NO: 39114 - DNA, 23 bp, synthetic construct
  misc_feature 1..23: note = Synthetic Construct
  source 1..23: mol_type = other DNA
cctgcaaactgcaacagggaatc

SEQ ID NO: 39115 - DNA, 24 bp, synthetic construct
  misc_feature 1..24: note = Synthetic Construct
  source 1..24: mol_type = other DNA
ctggatgctaatgtgcaggagtga

SEQ ID NO: 39116 - DNA, 24 bp, synthetic construct
  misc_feature 1..24: note = Synthetic Construct
  source 1..24: mol_type = other DNA
gggaagagacctagaggagagaca

SEQ ID NO: 39117 - DNA, 22 bp, synthetic construct
  misc_feature 1..22: note = Synthetic Construct
  source 1..22: mol_type = other DNA
gggattcactggctgctgtgat

SEQ ID NO: 39118 - DNA, 20 bp, synthetic construct
  misc_feature 1..20: note = Synthetic Construct
  source 1..20: mol_type = other DNA
ggccttactcccctggtact

SEQ ID NO: 39119 - DNA, 23 bp, synthetic construct
  misc_feature 1..23: note = Synthetic Construct
  source 1..23: mol_type = other DNA
gccaaattctgtgcaggtagaag

SEQ ID NO: 39120 - DNA, 20 bp, synthetic construct
  misc_feature 1..20: note = Synthetic Construct
  source 1..20: mol_type = other DNA
tcacttccaccgctgtgttg

SEQ ID NO: 39121 - DNA, 30 bp, synthetic construct
  misc_feature 1..30: note = Synthetic Construct
  source 1..30: mol_type = other DNA
ccatcagtgtagttcctctaactgtcaaac

SEQ ID NO: 39122 - DNA, 22 bp, synthetic construct
  misc_feature 1..22: note = Synthetic Construct
  source 1..22: mol_type = other DNA
ggccagaagactgcaaaagtca

SEQ ID NO: 39123 - DNA, 20 bp, synthetic construct
  misc_feature 1..20: note = Synthetic Construct
  source 1..20: mol_type = other DNA
ggcaggaaccacctggacaa

SEQ ID NO: 39124 - DNA, 21 bp, synthetic construct
  misc_feature 1..21: note = Synthetic Construct
  source 1..21: mol_type = other DNA
acagcaccagactccgaccaa

SEQ ID NO: 39125 - DNA, 22 bp, synthetic construct
  misc_feature 1..22: note = Synthetic Construct
  source 1..22: mol_type = other DNA
atctgacctcactgctccaatg

SEQ ID NO: 39126 - DNA, 25 bp, synthetic construct
  misc_feature 1..25: note = Synthetic Construct
  source 1..25: mol_type = other DNA
ctggatttcaggctatgtgcctctt

SEQ ID NO: 39127 - DNA, 26 bp, synthetic construct
  misc_feature 1..26: note = Synthetic Construct
  source 1..26: mol_type = other DNA
cagacttaagccagagcaattacaca

SEQ ID NO: 39128 - DNA, 19 bp, synthetic construct
  misc_feature 1..19: note = Synthetic Construct
  source 1..19: mol_type = other DNA
ctgctgtgtgcctgcaatg

SEQ ID NO: 39129 - DNA, 27 bp, synthetic construct
  misc_feature 1..27: note = Synthetic Construct
  source 1..27: mol_type = other DNA
gctccaccatccttaccttaactcgaa

SEQ ID NO: 39130 - DNA, 21 bp, synthetic construct
  misc_feature 1..21: note = Synthetic Construct
  source 1..21: mol_type = other DNA
gaccctcacaccagcaactac

SEQ ID NO: 39131 - DNA, 22 bp, synthetic construct
  misc_feature 1..22: note = Synthetic Construct
  source 1..22: mol_type = other DNA
ggtttccatgccctgactcaac

SEQ ID NO: 39132 - DNA, 21 bp, synthetic construct
  misc_feature 1..21: note = Synthetic Construct
  source 1..21: mol_type = other DNA
ccagaatgccatgggctgtga

SEQ ID NO: 39133 - DNA, 22 bp, synthetic construct
  misc_feature 1..22: note = Synthetic Construct
  source 1..22: mol_type = other DNA
cagcaagtcaaaggcacacagt

SEQ ID NO: 39134 - DNA, 22 bp, synthetic construct
  misc_feature 1..22: note = Synthetic Construct
  source 1..22: mol_type = other DNA
ggccctggggacatacttaatc

SEQ ID NO: 39135 - DNA, 20 bp, synthetic construct
  misc_feature 1..20: note = Synthetic Construct
  source 1..20: mol_type = other DNA
tggctgccgccttcctatca

SEQ ID NO: 39136 - DNA, 21 bp, synthetic construct
  misc_feature 1..21: note = Synthetic Construct
  source 1..21: mol_type = other DNA
gctggaagactgggttggaat

SEQ ID NO: 39137 - DNA, 23 bp, synthetic construct
  misc_feature 1..23: note = Synthetic Construct
  source 1..23: mol_type = other DNA
cgtaggcctggataactccaaga

SEQ ID NO: 39138 - DNA, 22 bp, synthetic construct
  misc_feature 1..22: note = Synthetic Construct
  source 1..22: mol_type = other DNA
cctcccagcaggagattgaaca

SEQ ID NO: 39139 - DNA, 22 bp, synthetic construct
  misc_feature 1..22: note = Synthetic Construct
  source 1..22: mol_type = other DNA
gcaaagcctcttccatctgcat

SEQ ID NO: 39140 - DNA, 24 bp, synthetic construct
  misc_feature 1..24: note = Synthetic Construct
  source 1..24: mol_type = other DNA
gaggcaaaggaagtccagtggata

SEQ ID NO: 39141 - DNA, 20 bp, synthetic construct
  misc_feature 1..20: note = Synthetic Construct
  source 1..20: mol_type = other DNA
gtgggacacagggaacaaca

SEQ ID NO: 39142 - DNA, 22 bp, synthetic construct
  misc_feature 1..22: note = Synthetic Construct
  source 1..22: mol_type = other DNA
cccaccgctggtgtttggaaaa

SEQ ID NO: 39143 - DNA, 20 bp, synthetic construct
  misc_feature 1..20: note = Synthetic Construct
  source 1..20: mol_type = other DNA
ctgcacaggcccagtgattt

SEQ ID NO: 39144 - DNA, 21 bp, synthetic construct
  misc_feature 1..21: note = Synthetic Construct
  source 1..21: mol_type = other DNA
acaccaaccaggaaggtccaa

SEQ ID NO: 39145 - DNA, 20 bp, synthetic construct
  misc_feature 1..20: note = Synthetic Construct
  source 1..20: mol_type = other DNA
tggaaacaggtcccctggaa

SEQ ID NO: 39146 - DNA, 19 bp, synthetic construct
  misc_feature 1..19: note = Synthetic Construct
  source 1..19: mol_type = other DNA
gcacggctgctgggttatg

SEQ ID NO: 39147 - DNA, 22 bp, synthetic construct
  misc_feature 1..22: note = Synthetic Construct
  source 1..22: mol_type = other DNA
ggcatcagcaggggtgatttga

SEQ ID NO: 39148 - DNA, 26 bp, synthetic construct
  misc_feature 1..26: note = Synthetic Construct
  source 1..26: mol_type = other DNA
cctttttctcccaattgctactgtgt

SEQ ID NO: 39149 - DNA, 23 bp, synthetic construct
  misc_feature 1..23: note = Synthetic Construct
  source 1..23: mol_type = other DNA
gtgcaccttctgtgtgtgaatag

SEQ ID NO: 39150 - DNA, 22 bp, synthetic construct
  misc_feature 1..22: note = Synthetic Construct
  source 1..22: mol_type = other DNA
acagagtttggtagcacagcaa

SEQ ID NO: 39151 - DNA, 22 bp, synthetic construct
  misc_feature 1..22: note = Synthetic Construct
  source 1..22: mol_type = other DNA
catgccaatgccttcacctttg

SEQ ID NO: 39152 - DNA, 21 bp, synthetic construct
  misc_feature 1..21: note = Synthetic Construct
  source 1..21: mol_type = other DNA
agggacctcctggtcctgatg

SEQ ID NO: 39153 - DNA, 23 bp, synthetic construct
  misc_feature 1..23: note = Synthetic Construct
  source 1..23: mol_type = other DNA
cagaggtccttcttccccataac

SEQ ID NO: 39154 - DNA, 23 bp, synthetic construct
  misc_feature 1..23: note = Synthetic Construct
  source 1..23: mol_type = other DNA
ggggagagaccaagtctgtctta

SEQ ID NO: 39155 - DNA, 24 bp, synthetic construct
  misc_feature 1..24: note = Synthetic Construct
  source 1..24: mol_type = other DNA
gggtgtgtccatttctgcccaatg

SEQ ID NO: 39156 - DNA, 23 bp, synthetic construct
  misc_feature 1..23: note = Synthetic Construct
  source 1..23: mol_type = other DNA
ggtgggacaggctaaaggcttac

SEQ ID NO: 39157 - DNA, 23 bp, synthetic construct
  misc_feature 1..23: note = Synthetic Construct
  source 1..23: mol_type = other DNA
ggctaagaccctgagctcctaga

SEQ ID NO: 39158 - DNA, 22 bp, synthetic construct
  misc_feature 1..22: note = Synthetic Construct
  source 1..22: mol_type = other DNA
ggacccagaggtgctttcatgt

SEQ ID NO: 39159 - DNA, 18 bp, synthetic construct
  misc_feature 1..18: note = Synthetic Construct
  source 1..18: mol_type = other DNA
tgcagaggagcggcttga

SEQ ID NO: 39160 - DNA, 20 bp, synthetic construct
  misc_feature 1..20: note = Synthetic Construct
  source 1..20: mol_type = other DNA
agttgctggcccaactgtga

SEQ ID NO: 39161 - DNA, 21 bp, synthetic construct
  misc_feature 1..21: note = Synthetic Construct
  source 1..21: mol_type = other DNA
atcgccgccatcgtcttctct

SEQ ID NO: 39162 - DNA, 22 bp, synthetic construct
  misc_feature 1..22: note = Synthetic Construct
  source 1..22: mol_type = other DNA
ccaaaactgaccagctgcctat

SEQ ID NO: 39163 - DNA, 22 bp, synthetic construct
  misc_feature 1..22: note = Synthetic Construct
  source 1..22: mol_type = other DNA
cccagggagtgcgttttctttc

SEQ ID NO: 39164 - DNA, 27 bp, synthetic construct
  misc_feature 1..27: note = Synthetic Construct
  source 1..27: mol_type = other DNA
cgagagcaagagagaaaggaagtctga

SEQ ID NO: 39165 - DNA, 21 bp, synthetic construct
  misc_feature 1..21: note = Synthetic Construct
  source 1..21: mol_type = other DNA
ggaggatcgtgtcccttcact

SEQ ID NO: 39166 - DNA, 25 bp, synthetic construct
  misc_feature 1..25: note = Synthetic Construct
  source 1..25: mol_type = other DNA
ggcattcctcaatagttgcttgaac

SEQ ID NO: 39167 - DNA, 20 bp, synthetic construct
  misc_feature 1..20: note = Synthetic Construct
  source 1..20: mol_type = other DNA
tggcgagcacacctcattgt

SEQ ID NO: 39168 - DNA, 22 bp, synthetic construct
  misc_feature 1..22: note = Synthetic Construct
  source 1..22: mol_type = other DNA
ggttggcttgagctgaggagtt

SEQ ID NO: 39169 - DNA, 25 bp, synthetic construct
  misc_feature 1..25: note = Synthetic Construct
  source 1..25: mol_type = other DNA
ccctgatctaaaccagtgggaggtt

SEQ ID NO: 39170 - DNA, 20 bp, synthetic construct
  misc_feature 1..20: note = Synthetic Construct
  source 1..20: mol_type = other DNA
agttccgggctttgcaccta

SEQ ID NO: 39171 - DNA, 24 bp, synthetic construct
  misc_feature 1..24: note = Synthetic Construct
  source 1..24: mol_type = other DNA
gagagatggtgtgtgtctccatgt

SEQ ID NO: 39172 - DNA, 20 bp, synthetic construct
  misc_feature 1..20: note = Synthetic Construct
  source 1..20: mol_type = other DNA
cctctgccctcaggggtttg

SEQ ID NO: 39173 - DNA, 22 bp, synthetic construct
  misc_feature 1..22: note = Synthetic Construct
  source 1..22: mol_type = other DNA
gccttgctttgggagaacaaac

SEQ ID NO: 39174 - DNA, 22 bp, synthetic construct
  misc_feature 1..22: note = Synthetic Construct
  source 1..22: mol_type = other DNA
ccctctcagcaaggagtgctat

SEQ ID NO: 39175 - DNA, 21 bp, synthetic construct
  misc_feature 1..21: note = Synthetic Construct
  source 1..21: mol_type = other DNA
gtcaacgtcactgcacctgaa

SEQ ID NO: 39176 - DNA, 23 bp, synthetic construct
  misc_feature 1..23: note = Synthetic Construct
  source 1..23: mol_type = other DNA
ggtcgtggacttaacctggaact

SEQ ID NO: 39177 - DNA, 24 bp, synthetic construct
  misc_feature 1..24: note = Synthetic Construct
  source 1..24: mol_type = other DNA
cccaaaactccctgagcacctaac

SEQ ID NO: 39178 - DNA, 27 bp, synthetic construct
  misc_feature 1..27: note = Synthetic Construct
  source 1..27: mol_type = other DNA
cgagttcatgaaaagctaggactcaga

SEQ ID NO: 39179 - DNA, 21 bp, synthetic construct
  misc_feature 1..21: note = Synthetic Construct
  source 1..21: mol_type = other DNA
cagaacaggcagcttggaaac

SEQ ID NO: 39180 - DNA, 22 bp, synthetic construct
  misc_feature 1..22: note = Synthetic Construct
  source 1..22: mol_type = other DNA
cccgtgatgggtaaggcattgt

SEQ ID NO: 39181 - DNA, 23 bp, synthetic construct
  misc_feature 1..23: note = Synthetic Construct
  source 1..23: mol_type = other DNA
gctgagtcagggatgatccgatt

SEQ ID NO: 39182 - DNA, 25 bp, synthetic construct
  misc_feature 1..25: note = Synthetic Construct
  source 1..25: mol_type = other DNA
ttcttgtctccttcaacctaacaca

SEQ ID NO: 39183 - DNA, 22 bp, synthetic construct
  misc_feature 1..22: note = Synthetic Construct
  source 1..22: mol_type = other DNA
gcctttgtcggcagaattggta

SEQ ID NO: 39184 - DNA, 21 bp, synthetic construct
  misc_feature 1..21: note = Synthetic Construct
  source 1..21: mol_type = other DNA
agagggtgggtggggatgata

SEQ ID NO: 39185 - DNA, 20 bp, synthetic construct
  misc_feature 1..20: note = Synthetic Construct
  source 1..20: mol_type = other DNA
tggacacacctgagcagtga

SEQ ID NO: 39186 - DNA, 20 bp, synthetic construct
  misc_feature 1..20: note = Synthetic Construct
  source 1..20: mol_type = other DNA
tgtgcctctgcctctcttct

SEQ ID NO: 39187 - DNA, 22 bp, synthetic construct
  misc_feature 1..22: note = Synthetic Construct
  source 1..22: mol_type = other DNA
gcaaattgcaaaagggcaggat

SEQ ID NO: 39188 - DNA, 25 bp, synthetic construct
  misc_feature 1..25: note = Synthetic Construct
  source 1..25: mol_type = other DNA
gggactctggaggtagtgagtgatg

SEQ ID NO: 39189 - DNA, 19 bp, synthetic construct
  misc_feature 1..19: note = Synthetic Construct
  source 1..19: mol_type = other DNA
acgcctgagctcctggtaa

SEQ ID NO: 39190 - DNA, 26 bp, synthetic construct
  misc_feature 1..26: note = Synthetic Construct
  source 1..26: mol_type = other DNA
cataattagagggcacaatgggtttc

SEQ ID NO: 39191 - DNA, 27 bp, synthetic construct
  misc_feature 1..27: note = Synthetic Construct
  source 1..27: mol_type = other DNA
ggaggttcacttaattgccacatcctt

SEQ ID NO: 39192 - DNA, 27 bp, synthetic construct
  misc_feature 1..27: note = Synthetic Construct
  source 1..27: mol_type = other DNA
ctgtaggtcttatttccagctctgtag

SEQ ID NO: 39193 - DNA, 26 bp, synthetic construct
  misc_feature 1..26: note = Synthetic Construct
  source 1..26: mol_type = other DNA
ccacttttctcccacagccctatact

SEQ ID NO: 39194 - DNA, 26 bp, synthetic construct
  misc_feature 1..26: note = Synthetic Construct
  source 1..26: mol_type = other DNA
gagaggcatacagaagaggtaagtgt

SEQ ID NO: 39195 - DNA, 20 bp, synthetic construct
  misc_feature 1..20: note = Synthetic Construct
  source 1..20: mol_type = other DNA
tctctcccaggcaggtcttt

SEQ ID NO: 39196 - DNA, 22 bp, synthetic construct
  misc_feature 1..22: note = Synthetic Construct
  source 1..22: mol_type = other DNA
gtgctcctgaaccagatgcttt

SEQ ID NO: 39197 - DNA, 22 bp, synthetic construct
  misc_feature 1..22: note = Synthetic Construct
  source 1..22: mol_type = other DNA
tgtccaccacccaagggttttc

SEQ ID NO: 39198 - DNA, 22 bp, synthetic construct
  misc_feature 1..22: note = Synthetic Construct
  source 1..22: mol_type = other DNA
ccagtctctgaggcatgaggat

SEQ ID NO: 39199 - DNA, 26 bp, synthetic construct
  misc_feature 1..26: note = Synthetic Construct
  source 1..26: mol_type = other DNA
ctccaactgcctatttctcctgatac

SEQ ID NO: 39200 - DNA, 22 bp, synthetic construct
  misc_feature 1..22: note = Synthetic Construct
  source 1..22: mol_type = other DNA
ggacagccatctctctgcttca

SEQ ID NO: 39201 - DNA, 23 bp, synthetic construct
  misc_feature 1..23: note = Synthetic Construct
  source 1..23: mol_type = other DNA
tgaatacctagcagcctccttct

SEQ ID NO: 39202 - DNA, 23 bp, synthetic construct
  misc_feature 1..23: note = Synthetic Construct
  source 1..23: mol_type = other DNA
ccagaagaaacccgtctgcttga

SEQ ID NO: 39203 - DNA, 23 bp, synthetic construct
  misc_feature 1..23: note = Synthetic Construct
  source 1..23: mol_type = other DNA
acaaacacatctgagggccaaat

SEQ ID NO: 39204 - DNA, 20 bp, synthetic construct
  misc_feature 1..20: note = Synthetic Construct
  source 1..20: mol_type = other DNA
gggatgaaaggcgactcgat

SEQ ID NO: 39205 - DNA, 23 bp, synthetic construct
  misc_feature 1..23: note = Synthetic Construct
  source 1..23: mol_type = other DNA
gctatctttacgggagcagctaa

SEQ ID NO: 39206 - DNA, 27 bp, synthetic construct
  misc_feature 1..27: note = Synthetic Construct
  source 1..27: mol_type = other DNA
gcctgtagtagattaggcactgtgtag

SEQ ID NO: 39207 - DNA, 19 bp, synthetic construct
  misc_feature 1..19: note = Synthetic Construct
  source 1..19: mol_type = other DNA
cccacctggcccattcctt

SEQ ID NO: 39208 - DNA, 20 bp, synthetic construct
  misc_feature 1..20: note = Synthetic Construct
  source 1..20: mol_type = other DNA
cagtggtggcattggtgaga

SEQ ID NO: 39209 - DNA, 21 bp, synthetic construct
  misc_feature 1..21: note = Synthetic Construct
  source 1..21: mol_type = other DNA
agccacaccccgtatgcatct

SEQ ID NO: 39210 - DNA, 26 bp, synthetic construct
  misc_feature 1..26: note = Synthetic Construct
  source 1..26: mol_type = other DNA
cagcagagagcatagacacaatcctt

SEQ ID NO: 39211 - DNA, 23 bp, synthetic construct
  misc_feature 1..23: note = Synthetic Construct
  source 1..23: mol_type = other DNA
gaggacacactgcagctactaac

SEQ ID NO: 39212 - DNA, 22 bp, synthetic construct
  misc_feature 1..22: note = Synthetic Construct
  source 1..22: mol_type = other DNA
gacaccatcggcagggctataa

SEQ ID NO: 39213 - DNA, 22 bp, synthetic construct
  misc_feature 1..22: note = Synthetic Construct
  source 1..22: mol_type = other DNA
tgggtccaggacagttcctaag

SEQ ID NO: 39214 - DNA, 24 bp, synthetic construct
  misc_feature 1..24: note = Synthetic Construct
  source 1..24: mol_type = other DNA
gagagactttccaagcaggagaca

SEQ ID NO: 39215 - DNA, 20 bp, synthetic construct
  misc_feature 1..20: note = Synthetic Construct
  source 1..20: mol_type = other DNA
atagaggcacagggcgaaga

SEQ ID NO: 39216 - DNA, 20 bp, synthetic construct
  misc_feature 1..20: note = Synthetic Construct
  source 1..20: mol_type = other DNA
actcagggtgcttggagcat

SEQ ID NO: 39217 - DNA, 18 bp, synthetic construct
  misc_feature 1..18: note = Synthetic Construct
  source 1..18: mol_type = other DNA
ttcgggcagcaccagaag

SEQ ID NO: 39218 - DNA, 25 bp, synthetic construct
  misc_feature 1..25: note = Synthetic Construct
  source 1..25: mol_type = other DNA
gattaatcctccctgcctggaattt

SEQ ID NO: 39219 - DNA, 24 bp, synthetic construct
  misc_feature 1..24: note = Synthetic Construct
  source 1..24: mol_type = other DNA
ccatgtgaggacacagcattcatc

SEQ ID NO: 39220 - DNA, 26 bp, synthetic construct
  misc_feature 1..26: note = Synthetic Construct
  source 1..26: mol_type = other DNA
cctctttcttcttcctccaaatccaa

SEQ ID NO: 39221 - DNA, 24 bp, synthetic construct
  misc_feature 1..24: note = Synthetic Construct
  source 1..24: mol_type = other DNA
gacctgattgctcagacagcatga

SEQ ID NO: 39222 - DNA, 26 bp, synthetic construct
  misc_feature 1..26: note = Synthetic Construct
  source 1..26: mol_type = other DNA
gggagtaatgaagccctttcctcttt

SEQ ID NO: 39223 - DNA, 21 bp, synthetic construct
  misc_feature 1..21: note = Synthetic Construct
  source 1..21: mol_type = other DNA
cccaacccctcacacatggaa

SEQ ID NO: 39224 - DNA, 21 bp, synthetic construct
  misc_feature 1..21: note = Synthetic Construct
  source 1..21: mol_type = other DNA
ggcagagaacagcaaatgcaa

SEQ ID NO: 39225 - DNA, 19 bp, synthetic construct
  misc_feature 1..19: note = Synthetic Construct
  source 1..19: mol_type = other DNA
gcaagcaacaggtgcacaa

SEQ ID NO: 39226 - DNA, 21 bp, synthetic construct
  misc_feature 1..21: note = Synthetic Construct
  source 1..21: mol_type = other DNA
caagtccaggctccctgaaac

SEQ ID NO: 39227 - DNA, 21 bp, synthetic construct
  misc_feature 1..21: note = Synthetic Construct
  source 1..21: mol_type = other DNA
gggcgaatcactgggagacaa

SEQ ID NO: 39228 - DNA, 23 bp, synthetic construct
  misc_feature 1..23: note = Synthetic Construct
  source 1..23: mol_type = other DNA
cacacaacctccatgtgggaaca

SEQ ID NO: 39229 - DNA, 23 bp, synthetic construct
  misc_feature 1..23: note = Synthetic Construct
  source 1..23: mol_type = other DNA
tgacgttcagcctaaaagcaaag

SEQ ID NO: 39230 - DNA, 20 bp, synthetic construct
  misc_feature 1..20: note = Synthetic Construct
  source 1..20: mol_type = other DNA
aggcagtgagaagccaccta

SEQ ID NO: 39231 - DNA, 25 bp, synthetic construct
  misc_feature 1..25: note = Synthetic Construct
  source 1..25: mol_type = other DNA
ggaacaaactgtggcaatgcgaatg

SEQ ID NO: 39232 - DNA, 26 bp, synthetic construct
  misc_feature 1..26: note = Synthetic Construct
  source 1..26: mol_type = other DNA
gctatggaacaaaaagacaccaccaa

SEQ ID NO: 39233 - DNA, 22 bp, synthetic construct
  misc_feature 1..22: note = Synthetic Construct
  source 1..22: mol_type = other DNA
tccatcctgaggctccatgctt

SEQ ID NO: 39234 - DNA, 25 bp, synthetic construct
  misc_feature 1..25: note = Synthetic Construct
  source 1..25: mol_type = other DNA
ggctgggtcactttgatctccttat

SEQ ID NO: 39235 - DNA, 27 bp, synthetic construct
  misc_feature 1..27: note = Synthetic Construct
  source 1..27: mol_type = other DNA
ccaggggaagaatgacattgacctttg

SEQ ID NO: 39236 - DNA, 23 bp, synthetic construct
  misc_feature 1..23: note = Synthetic Construct
  source 1..23: mol_type = other DNA
gatcactcttcccactctggttt

SEQ ID NO: 39237 - DNA, 22 bp, synthetic construct
  misc_feature 1..22: note = Synthetic Construct
  source 1..22: mol_type = other DNA
tcacttaggcactcctgggtaa

SEQ ID NO: 39238 - DNA, 22 bp, synthetic construct
  misc_feature 1..22: note = Synthetic Construct
  source 1..22: mol_type = other DNA
tctcagaaaggccttcccttca

SEQ ID NO: 39239 - DNA, 22 bp, synthetic construct
  misc_feature 1..22: note = Synthetic Construct
  source 1..22: mol_type = other DNA
ctggcgcatagggaggttattc

SEQ ID NO: 39240 - DNA, 24 bp, synthetic construct
  misc_feature 1..24: note = Synthetic Construct
  source 1..24: mol_type = other DNA
tctgaagtcagtcagtgtgtgttc

SEQ ID NO: 39241 - DNA, 22 bp, synthetic construct
  misc_feature 1..22: note = Synthetic Construct
  source 1..22: mol_type = other DNA
ccagtgtcaaggctcacctgta

SEQ ID NO: 39242 - DNA, 24 bp, synthetic construct
  misc_feature 1..24: note = Synthetic Construct
  source 1..24: mol_type = other DNA
gagaactgctgctcaagtctaagt

SEQ ID NO: 39243 - DNA, 24 bp, synthetic construct
  misc_feature 1..24: note = Synthetic Construct
  source 1..24: mol_type = other DNA
tccaagccataaatgcactaggat

SEQ ID NO: 39244 - DNA, 20 bp, synthetic construct
  misc_feature 1..20: note = Synthetic Construct
  source 1..20: mol_type = other DNA
agggctgccacagttaggat

SEQ ID NO: 39245 - DNA, 20 bp, synthetic construct
  misc_feature 1..20: note = Synthetic Construct
  source 1..20: mol_type = other DNA
aagggccctgtctcactgaa

SEQ ID NO: 39246 - DNA, 20 bp, synthetic construct
  misc_feature 1..20: note = Synthetic Construct
  source 1..20: mol_type = other DNA
gcagcatctacccggctcat

SEQ ID NO: 39247 - DNA, 20 bp, synthetic construct
  misc_feature 1..20: note = Synthetic Construct
  source 1..20: mol_type = other DNA
tgaccacttcagggccactt

SEQ ID NO: 39248 - DNA, 22 bp, synthetic construct
  misc_feature 1..22: note = Synthetic Construct
  source 1..22: mol_type = other DNA
gccaaaggagccctgttcacat

SEQ ID NO: 39249 - DNA, 27 bp, synthetic construct
  misc_feature 1..27: note = Synthetic Construct
  source 1..27: mol_type = other DNA
gtgagagacaggaagtcaaagggtaaa

SEQ ID NO: 39250 - DNA, 20 bp, synthetic construct
  misc_feature 1..20: note = Synthetic Construct
  source 1..20: mol_type = other DNA
ggctgaggaagcagccctta

SEQ ID NO: 39251 - DNA, 26 bp, synthetic construct
  misc_feature 1..26: note = Synthetic Construct
  source 1..26: mol_type = other DNA
ggtcgttagtcagtctgttgcactac

SEQ ID NO: 39252 - DNA, 22 bp, synthetic construct
  misc_feature 1..22: note = Synthetic Construct
  source 1..22: mol_type = other DNA
ttgcccctctgcctctcctaaa

SEQ ID NO: 39253 - DNA, 22 bp, synthetic construct
  misc_feature 1..22: note = Synthetic Construct
  source 1..22: mol_type = other DNA
cagtgaggagcagatggctaac

SEQ ID NO: 39254 - DNA, 20 bp, synthetic construct
  misc_feature 1..20: note = Synthetic Construct
  source 1..20: mol_type = other DNA
ggtgggctgctgtagcctta

SEQ ID NO: 39255 - DNA, 22 bp, synthetic construct
  misc_feature 1..22: note = Synthetic Construct
  source 1..22: mol_type = other DNA
ccgctggaactgcctgctattt

SEQ ID NO: 39256 - DNA, 20 bp, synthetic construct
  misc_feature 1..20: note = Synthetic Construct
  source 1..20: mol_type = other DNA
acctggatccctggccacat

SEQ ID NO: 39257 - DNA, 22 bp, synthetic construct
  misc_feature 1..22: note = Synthetic Construct
  source 1..22: mol_type = other DNA
gctttcaagcaatcccgtccta

SEQ ID NO: 39258 - DNA, 21 bp, synthetic construct
  misc_feature 1..21: note = Synthetic Construct
  source 1..21: mol_type = other DNA
gtcctgcttgtccttctgctt

SEQ ID NO: 39259 - DNA, 22 bp, synthetic construct
  misc_feature 1..22: note = Synthetic Construct
  source 1..22: mol_type = other DNA
caccttctgtgccactctgtag

SEQ ID NO: 39260 - DNA, 18 bp, synthetic construct
  misc_feature 1..18: note = Synthetic Construct
  source 1..18: mol_type = other DNA
tgcacacgccccgtgata

SEQ ID NO: 39261 - DNA, 21 bp, synthetic construct
  misc_feature 1..21: note = Synthetic Construct
  source 1..21: mol_type = other DNA
gcctgacttgccgatgcttct

SEQ ID NO: 39262 - DNA, 21 bp, synthetic construct
  misc_feature 1..21: note = Synthetic Construct
  source 1..21: mol_type = other DNA
tgcttctgtgggctgggttga

SEQ ID NO: 39263 - DNA, 22 bp, synthetic construct
  misc_feature 1..22: note = Synthetic Construct
  source 1..22: mol_type = other DNA
tgaaacggatcatggctgaaga

SEQ ID NO: 39264 - DNA, 22 bp, synthetic construct
  misc_feature 1..22: note = Synthetic Construct
  source 1..22: mol_type = other DNA
ccttgtagaggggcacaacact

SEQ ID NO: 39265 - DNA, 24 bp, synthetic construct
  misc_feature 1..24: note = Synthetic Construct
  source 1..24: mol_type = other DNA
gctcccctgtagggtagattcaga

SEQ ID NO: 39266 - DNA, 23 bp, synthetic construct
  misc_feature 1..23: note = Synthetic Construct
  source 1..23: mol_type = other DNA
agctgtttttgcaggtgagtgta

SEQ ID NO: 39267 - DNA, 19 bp, synthetic construct
  misc_feature 1..19: note = Synthetic Construct
  source 1..19: mol_type = other DNA
cgggccacaggcaagatgt

SEQ ID NO: 39268 - DNA, 24 bp, synthetic construct
  misc_feature 1..24: note = Synthetic Construct
  source 1..24: mol_type = other DNA
ccagagaagcaacaggaaccatga

SEQ ID NO: 39269 - DNA, 25 bp, synthetic construct
  misc_feature 1..25: note = Synthetic Construct
  source 1..25: mol_type = other DNA
gttttgttagccaagaaagggacat

SEQ ID NO: 39270 - DNA, 22 bp, synthetic construct
  misc_feature 1..22: note = Synthetic Construct
  source 1..22: mol_type = other DNA
ctcattggattgggccctgtaa

SEQ ID NO: 39271 - DNA, 23 bp, synthetic construct
  misc_feature 1..23: note = Synthetic Construct
  source 1..23: mol_type = other DNA
gtggtaaagaaggtggccgaatc

SEQ ID NO: 39272 - DNA, 20 bp, synthetic construct
  misc_feature 1..20: note = Synthetic Construct
  source 1..20: mol_type = other DNA
catcgtctgccggatacaca

SEQ ID NO: 39273 - DNA, 22 bp, synthetic construct
  misc_feature 1..22: note = Synthetic Construct
  source 1..22: mol_type = other DNA
cggcctctgaattttgccatac

SEQ ID NO: 39274 - DNA, 23 bp, synthetic construct
  misc_feature 1..23: note = Synthetic Construct
  source 1..23: mol_type = other DNA
cccagaaagaaggcgaggtgtag

SEQ ID NO: 39275 - DNA, 20 bp, synthetic construct
  misc_feature 1..20: note = Synthetic Construct
  source 1..20: mol_type = other DNA
aacagagcctgcctcccaaa

SEQ ID NO: 39276 - DNA, 24 bp, synthetic construct
  misc_feature 1..24: note = Synthetic Construct
  source 1..24: mol_type = other DNA
ctgctgacttcttaaggcctggat

SEQ ID NO: 39277 - DNA, 23 bp, synthetic construct
  misc_feature 1..23: note = Synthetic Construct
  source 1..23: mol_type = other DNA
gaatcttccccatctcccattgt

SEQ ID NO: 39278 - DNA, 25 bp, synthetic construct
  misc_feature 1..25: note = Synthetic Construct
  source 1..25: mol_type = other DNA
ccctcaccaattcaaggcttccttt

SEQ ID NO: 39279 - DNA, 20 bp, synthetic construct
  misc_feature 1..20: note = Synthetic Construct
  source 1..20: mol_type = other DNA
ggccaagatgccgtctcact

SEQ ID NO: 39280 - DNA, 23 bp, synthetic construct
  misc_feature 1..23: note = Synthetic Construct
  source 1..23: mol_type = other DNA
catcttctcaaagccgaacgaaa

SEQ ID NO: 39281 - DNA, 19 bp, synthetic construct
  misc_feature 1..19: note = Synthetic Construct
  source 1..19: mol_type = other DNA
aagcgaagggcagcagcaa

SEQ ID NO: 39282 - DNA, 23 bp, synthetic construct
  misc_feature 1..23: note = Synthetic Construct
  source 1..23: mol_type = other DNA
ccccttcatcctcatgcctaatg

SEQ ID NO: 39283 - DNA, 24 bp, synthetic construct
  misc_feature 1..24: note = Synthetic Construct
  source 1..24: mol_type = other DNA
ccaagccatggaagtttggggata

SEQ ID NO: 39284 - DNA, 30 bp, synthetic construct
  misc_feature 1..30: note = Synthetic Construct
  source 1..30: mol_type = other DNA
ggatttggactctcttaaaagtgggataac

SEQ ID NO: 39285 - DNA, 19 bp, synthetic construct
  misc_feature 1..19: note = Synthetic Construct
  source 1..19: mol_type = other DNA
aggacagtggcccatggat

SEQ ID NO: 39286 - DNA, 20 bp, synthetic construct
  misc_feature 1..20: note = Synthetic Construct
  source 1..20: mol_type = other DNA
ccacagcctggcaagattca

SEQ ID NO: 39287 - DNA, 21 bp, synthetic construct
  misc_feature 1..21: note = Synthetic Construct
  source 1..21: mol_type = other DNA
ggtcccttgtctggtgtcgtt

SEQ ID NO: 39288 - DNA, 23 bp, synthetic construct
  misc_feature 1..23: note = Synthetic Construct
  source 1..23: mol_type = other DNA
cacagggagcagtgattctcaca

SEQ ID NO: 39289 - DNA, 20 bp, synthetic construct
  misc_feature 1..20: note = Synthetic Construct
  source 1..20: mol_type = other DNA
ttggtgagagctgggaggaa

SEQ ID NO: 39290 - DNA, 20 bp, synthetic construct
  misc_feature 1..20: note = Synthetic Construct
  source 1..20: mol_type = other DNA
ggaaagcagtgcccatcact

SEQ ID NO: 39291 - DNA, 22 bp, synthetic construct
  misc_feature 1..22: note = Synthetic Construct
  source 1..22: mol_type = other DNA
ctgagtcttgttgggagccatt

SEQ ID NO: 39292 - DNA, 24 bp, synthetic construct
  misc_feature 1..24: note = Synthetic Construct
  source 1..24: mol_type = other DNA
cttctctgaaaaggagctggcata

SEQ ID NO: 39293 - DNA, 24 bp, synthetic construct
  misc_feature 1..24: note = Synthetic Construct
  source 1..24: mol_type = other DNA
ggtgttgatagcgagggaggatga

SEQ ID NO: 39294 - DNA, 19 bp, synthetic construct
  misc_feature 1..19: note = Synthetic Construct
  source 1..19: mol_type = other DNA
aaggtgggtcagcctgtgt

SEQ ID NO: 39295 - DNA, 19 bp, synthetic construct
  misc_feature 1..19: note = Synthetic Construct
  source 1..19: mol_type = other DNA
ccctgtgggtgccagacat

SEQ ID NO: 39296 - DNA, 21 bp, synthetic construct
  misc_feature 1..21: note = Synthetic Construct
  source 1..21: mol_type = other DNA
caggcaccaagagcaaacttc

SEQ ID NO: 39297 - DNA, 26 bp, synthetic construct
  misc_feature 1..26: note = Synthetic Construct
  source 1..26: mol_type = other DNA
gggtacaggtgacaattagcctggta
